United States Patent 12,371,699 (NUCLEIC ACIDS ENCODING CRISPR-ASSOCIATED PROTEINS AND USES THEREOF) - sequence listing, part 11

SEQ ID NO: 8399 - RNA, 3075 nt, synthetic construct
  misc_feature 1..3075: note = Cas9 variant
  source 1..3075: mol_type = other RNA
atgataagaacactaggtatcgacataggaatagcctcaataggttgggcagtaatagaaggagaatacactgacaaaggtctagaaaataaagaaatagtggcatcgggagtaagagtttttactaaagcggaaaacccaaagaacaaagaaagcctagccttaccaagaacgctagcgcgatctgctagacgacgaaacgcaagaaaaaaaggaagaatccaacaagtaaaacattatctaagtaaagcactgggactagacttagagtgtttcgtacaaggagagaaactcgctaccctcttccaaacttctaaagattttttgagtccttgggagttaagagaaagagcattgtacagagtactagataaagaggagttagctagagttatactccacatagccaaacgaagaggatatgacgacataacatacggtgttgaagacaatgatagcggtaaaatcaaaaaagcaatagcagaaaattctaaaagaatcaaagaggaacaatgtaaaactattggagaaatgatgtataaactatacttccaaaagtcactcaacgtgcggaacaaaaaagaaagttataacagatgcgtaggtagatccgaattacgagaagaactaaaaacaattttccaaatccaacaagaactcaaatctccatgggtaaatgaggaactaatatataaactcctcggcaacccagatgcacagagcaaacaggaaagagaaggattaatattttatcaacgaccactcaaaggtttcggcgacaaaataggaaaatgtagccacatcaaaaaaggggaaaattcaccatatcgagcatgcaaacacgcaccctccgcagaagaatttgtagcattaacaaaaagtataaattttctgaaaaacttaacaaacagacatggactgtgcttcagccaagaagacatgtgcgtatatttaggtaaaatactgcaagaagcacaaaaaaacgaaaaaggactcacatactcaaaactaaaactattattagacttacctagcgattttgaatttctaggcttagactatagtggtaaaaaccccgaaaaagcagtattccttagtttaccatcaacattcaaacttaataagatcacgcaagatcgtaaaactcaagataaaatcgcaaatattctaggcgctaacaaagattgggaagcaatactaaaggaattagaatcactacaattgagtaaagaacaaatacagacaataaaagatgccaaactaaacttcagtaagcacatcaacttaagcctagaagcattataccacttactacctctaatgagagaaggaaaaagatatgatgaaggagtagaaattttacaggaaagaggcatatttagcaaaccacagccaaaaaacaggcaattattaccaccactaagcgaattagccaaagaagaaagctattttgatattccaaatccagtacttagaagagcacttagtgaatttagaaaagtagttaacgcactacttgaaaaatatggaggatttcattatttccatattgaattaacacgagacgtatgcaaggcaaaatctgctagaatgcaacttgaaaaaataaacaaaaaaaacaaatcagagaatgacgcagcgtcacaacttttagaagtattaggcttaccgaacacatataacaacagactaaaatgtaagttatggaaacaacaagaagaatactgtctatattcaggcgaaaaaataacaattgaccaccttaaagaccaaagagctcttcaaatcgatcatgcatttccattaagcagatcattagatgacagccagtcaaacaaagtactatgcttaacatcatcaaaccaagaaaaaagcaataaaacgccatatgaatggctaggaagcgacgaaaaaaaatgggatatgtacgtgggacgagtatacagcagtaattttagtccatcgaaaaagcgcaaattaacccagaaaaactttaaagaacgtaacgaagaagatttcttagcaagaaatctagttgacaccggatatataggccgagttactaaagaatatataaaacattcactgagttttttgcctctcccagacggtaaaaaagaacatatccggataatatcaggtagcatgaccagtacaatgagatccttctggggtgtacaagaaaagaatagagatcatcacctacaccacgcacaagatgcaataataatagcatgtatagaaccttcaatgatccaaaaatatacaacgtacctaaaagataaagaaacacacagactgaaatcgcatcaaaaagcccaaatactaagagaaggggaccataaactatcacttagatggcctatgtcaaatttcaaagataaaatacaggaatctatacaaaacataataccttctcaccacgtatcacataaagtaaccggagaattgcatcaagaaacggtacgaacaaaagaattctactaccaagctttcggcggagaagaaggagtaaaaaaagctttaaaatttggcaagatacgagaaataaaccaaggcatagtagacaacggagccatggtaagagtcgacatatttaaatcaaaggacaaaggaaagttttatgctgttcctatatatacatacgattttgcaattggaaaactaccaaacaaagcaattgtacaaggcaaaaaaaacggaataattaaagactggctagaaatggacgaaaactacgaattttgctttagcctatttaaaaacgactgcattaaaattcaaacaaaagaaatgcaagaagcagtactagcgatatataaatcaacaaactcagcaaaagcaacaatagaattagaacatttaagcaaatatgcactaaaaaacgaagacgaagaaaaaatgttcacagatacagacaaagagaaaaacaaaacaatgacacgcgaaagctgcggaatacaaggattaaaagtattccaaaaagtaaaactaagcgtccttggtgaagtgttagaacataaaccaagaaatagacagaacatcgccttaaagacgacacctaaacacgtttga

SEQ ID NO: 8400 - RNA, 3078 nt, synthetic construct
  misc_feature 1..3078: note = Cas9 variant
  source 1..3078: mol_type = other RNA
atgggaggttatatgcctcaactaatgcggtatcgattagcgcttgatatcggttcaacaagtataggatgggcaatgattcggttaagcatgcaaaatgaaccaatagcaattataagaatgggcgtaagaatattttccgatgggaggaatccaaaagatggatcgtccttagcagtcacaagacgcgtagcaagacaaatgagacgaagaagagacaggctgttaaaaagaaaaacaagactcttaaatgcattagtacagaaaaagttcttcccagaagatgcagatgcaagaaaagcgctcgtcgtcctaaatccctatgaacttagaaaagaaggactctacagacaactatctgggccagagttcggcagagcattattccacataagtcaaagaaggggatttctaagtaataggaaaacagataagaaagataacgatagttctgttttaaagaaagctattgtcgatctaaggcaacaattagaagtcgaaaattgccaaacaatcggtgaatggctatttaaacaacaacaatctggaaaatcagttagagccagactgcgcggaaaaacacaaaaggataaagcgtatgatttttatatagacagagctatgatagcacatgaatttgacacactatgggtatcacaagcgaaatatgatcctttattgtttaatgaagatgcaagagcaatcttaagagacattttattataccaacgaccacttaaacctgtaaaacccggaagatgcacattaataccagatgaatcaagagcacccttagcattaccactaacccaacaagctagaatataccaagaactaaatcacctacgcataacaactcctgccctcggagcacaagcacttacagtggcacaaagaaatacaatagcagcattactagaaaaatctgatgtcaccttcgtaaaaatagcaaaggcactaggattaacaagtacaacagaatttaacttacaagatatcaagagagacagactaaaaggaaatgccacagccatcatactagcaaggaatcaatatttcggcagaagatggcatgacttcaatgcagacctacaaaaccttatagttgataagctagtaaatgaagggtcagagaccgccctgatagaatggctaaaagccaacactgacgtagatgaatcagcagcagaaagagtttcaggtgtaacattgccggaaggttatggtagtttatcagttgcagctcttaggagactacttccagccctaaaagaagacgttgtagtatattctgaagcggtaaaaagagctggattcgattctcattctgcactttccctaatcgaacaaacaggagaactttatcaagaattaccctactatggagaggtattacaaagacatgtaggatttggaagtggagatccaaacgatagtccagaaagaaggtttgggaaaatagctaatccaactgttcacatcggattaaatgaactacgaaaaataataaatgcattaataaagaggtacggaaacccagctgaagtagtagttgaattagcaagagatttgaaattgagtagagaaaaacgcaaagaaatacaggaagaacaaaagcaacgacaagatcgtaacgagaaaagaatcaaagatgcatgtgaaatacttggaattgatccacttgtaatagaccgtgggaaaagaagagaaataagccagaaaatgcaattatgggatgaactaaaccccaaagatgcagctaatagacgatgcccctatacaggagaccaaatctcaatagaaaaacttctaagcgcagaagtagaaatagaacacatactccctttttcaaaaaccttggatgattcactaaataataaaacagttgcaatgagacgagcaaacagagataaaggaaatcgaaccccatatgaagcatttggagaatctttaaacccagattacgattacgatgctattctacaaagagccagtctaatgcctagagagaaaaggaagcgatttgcatccgacggataccaacaatggttaagagatgacaaagactttttaagcagagcactcaatgatacggcatacttatcccgaatcgctaaagaataccttacattaatatgccctccaaattcagtcagagcaataccaggcagaatgactgcacagctaagagctatgttcggactcaatcgcctattgtcagaagggggcattaaaaatagagaagatcatagacatcacgctattgacgccgcagttatcggagtaactgaccagggattgttgcaaaaatttagtagagcatcagcccgaacaagagaactgcaattaagtagattagtagacgatatgcctctaccgtgggatacatatagagaacacgtaactcgcgcattagaacatttagtagttagtcataaaccagaccatggatatcaaggtaaaatgcacgaagatacagcctggggactaagggataatgggcaagtaactagaagggtaagaagcgaagacggaggaccaagacaaagattactagaaaacaaaaacgtagttaaaatcaatagtacacgagattttagccgacacggaatagatgaacaaggacaggtaaacgcatacaaaggatacgtcggaggatcaaactactgtattgaaatatggatcgacgaaaagggaaaatggaactccgatgtagtttccacatttcaagcataccaaatagtcagggaattaggggaaaaagcagcttggcaaaaattgagaaacccattattgagtcttagcgcaaagccgttagttatgagattaataatagacgatgtggtaaaaatgcagatagccggtcaaaacaaaataatgagagtagttaaaattgcacaaaatggacaaatcttctttgcagaacacaatgaagcaaatgtagacgcaagagacaaagataaaaataatccatttaaatatataagcaaaacagcagggagtttacagaaggcgggaggtatacatatggcaatatctccaattggagatgcgagaccagttagatatggaagatga

SEQ ID NO: 8401 - RNA, 3084 nt, synthetic construct
  misc_feature 1..3084: note = Cas9 variant
  source 1..3084: mol_type = other RNA
atgaaatacaccctaggattagatgtaggcacaaacagcatcggttgggcagtgcttgagttaaacacaaatggagaaccacaaaggattgaaaaactaggatcccgaatttttacagacggaagacacccaaaagacggaacaaccttagcatccaaaagacgccaaaaacgacatgaaagacgtagaagagatagactacaccagagaaagaaattagtcttaaatcaattagtctcaatgggactatttccacaatcagaacaagagcaacaagatttaaaatcattggatgtattaacattaagggcaaatggagtatctaaacaactatcagcgtacgaactaggaagagtcttctactacctaaacctcaaacgaggattcaaaagtaacaggaaaggaggcagtgaagaagacaaagcaaacaaaataagcgaacgtatcaagaaactacaagaacaattaaaagaaaatgatttcaaaaccgtgggacagtatctacatgatagatatataaaaggactaagcaccaaagccacgatagaaaacgactttcacttactcagacaattaattgaagacgagttcgacttcatagtagaaacccaatccaaattcttcccagaaataagcgatgaacaatggaacacactcagaaatcgtatgtttcaccaaagaccactcaaaccagttgaaacaggaacctgcagtctttttgaagataagaaacgaacatataaatatatgccatcatttgaagaatatcggttccttacagaattatttaatctcagttaccaagatgaaaactttcactcacattccttaagctcagaacagatattcaaagtattccatgaattaaagaacaccagagaagcaacatatacaaaaataaagaaattactaaaacttccctctgatctatcattctcaattgaaagaagtaaatcaaaagacaaaattaaaatttctacaacaaaccacttcttcagcaaatccttactattcgccgaagaatgggcttcattggatctcaaactcaaagacgaagtcgccgaaatatacttctcagacatgagcgtagaagaaatcaagaaaggcctactacaattgaaaatcgactctgagattatagaaaacctactagaagaaaaagtacccaatgtacaagaagctacatgcagctactcaaaagaagctctacagaaaatagttagtctcatactcgaagaagagagacatccaacactcatagtagatgacctcttcaaaaatgaaaaagaggaaacaagtttaatagataggctagattactacggagcaagcatcccagacagcatgcaaccgataccacaacatatcaaagataataatttaacacttaatgaagatgaaaaacgatatgggaaaatagctaatccgacagtacatgctgctctaaatcaaataagacaagttgtaaatgatttaatagaacaatacggaaaaccgacgaatatccacatagagttcgcgagagatctaaagaaaagcaaagaagaacgagatttcgacaacagaaagaagaagaaaaacgaagaactcaacgaacaagtaagagatttcatagaaaaacacaaccaaaaaccgtcagcattcaacttcgaaagggttaaattatggttcgaattagacgccatgaataatcaggtttgtgcatacagtggaaaaactatcagcgcaagaatggtattatcagatgaagtacaggtagaccacatactacccttcagtagaaccttagacgatagtctagcaaataaagtcttagtactagcatcagagaacgtcaagaaaagaaatcgtacaccttatgaggctttcggacaagatacagaaaaatgggcatcaatacaagaactggcaaaaagactaccctatcacaaacaatggagattcgcggaagacgctataaagaaattcgaagaaaaagaccaatttctacaaagacatttaaacgacacacgatatatatcaaaaatagcaaagaaatatcttggcagtataaccgacccttacaaaatagtagcatcccggggacaaatgacatcaatcatacgcggaaaactaggattaaaccaattcattcaaaaaccggatggcactaaaaatcgagaagaccatcgacatcacgcaatcgacgccctcacagttgcactaaccagcagatcctacttaaaaaggatcagtgacgcatcagcaaggaaccaagacccaaacaggattcctatcccagaaccatggaaaggatttataaaagatgcggacgtaaaattcaatgaaataatagtatcacacaaagtagatcacgggaaaaacggaccattcatggaagaaacatgtttcggtctgatcaaaaatccaaacaaatatgaagaagaaaatgactttaaattgataacaacaaaaagcctcgatagtgtaaaagatccctctacaataagatcacagagcttacaaaatctagcagaaaagagcggagtaatatcactagccaaatcaggtgtaaagaaactacgagtctacgacgtaacaaaagaaaaccccgcagacataggactaatagaaagcggtctcgcaaaaataacccacggcaaagataaacaacatgtaaagcattatcaaaaaggcgacataaattatttagcaatctggtgtctaccgcaaaacataacactaaaatcagataaccataagaaaagaaaaactgattatatcttcacagcgataaaaacattcgatctaaacagtaaaaacccaaacgatctgagaccccaccccgccgcaaaactggttacaaaagtatacaaaggagacacagtagcactagaagtgaataaccaactaaactactatatagtaaaatcaataagagctgctaacaagaaactatatttcttaaaaataaatcaatcatctgaattagcaaacgaaacccaattcatccctgcctacacaaaattagtagactataaatttagaaaagtatctgtcagtccaaccggagttataacagacaacggccccctattaaaatga

SEQ ID NO: 8402 - RNA, 3090 nt, synthetic construct
  misc_feature 1..3090: note = Cas9 variant
  source 1..3090: mol_type = other RNA
atgcgaagcctaaggtatagactagctctagatttaggaagtacgtcactaggatgggcattgtttcgattagatgcttgtaatagaccaacagcagtcataaaagctggagtaagaattttcagtgatgggaggaatccaaaagacggttcctcattagcagtaactagacgcgctgctcgtgccatgcgaagaagacgggatagacttctaaaaagaaaaacgcgaatgcaagcgaaattagtagaacatgggttctttccagccgatgcaggaaaaagaaaggcgttagaacaactaaatccctatgcgctaagagcaaaagggttacaagaagccctcctacccggagaatttgcaagagcactattccatatcaatcagaggagaggtttcaaatctaatagaaaaactgataagaaagacaacgatagcggagtattaaagaaagcaataggacaattaagacaacaaatggcagaacaaggaagcagaacggttggcgaatacctatggacaagactacaacaaggacaaggagtgagggccagatatcgagagaaaccatacacgacagaagaaggtaagaaacgtatcgataaatcttatgacctatatatagatcgagctatgatagaacaagagtttgatgcactttgggcggctcaagcagcattcaacccaactctttttcacgaagcagcgagagctgaccttaaagacacgttattacatcaaagaccccttcgaccggtgaaacccggtagatgcactttgctaccagaagaagaaagagctcccctagcactaccatcaacgcaaaggtttcgaatacaccaagaagtaaaccacttaagactactagatgaaaatttaagagaagtagcattaacattggcacagagagacgcagttgtaaccgctctcgaaacaaaagcaaaattatcgtttgaacagattaggaaattattgaaattaagtggaagcgtacaattcaacctcgaagatgcaaaaagaacagaattaaaaggaaatgcgacatcagccgcacttgcgagaaaagaattatttggagcagcctggtcaggatttgacgaagcgttgcaagacgaaatagtgtggcagttagtaacggaagaaggggaaggagcacttatagcatggctacaaacccacacaggtgtagacgaagccagagcccaagccatagtcgacgttagtttgccagaaggttacggtaatcttagcagaaaagcactagcaaggatagtacctgcattaagagcagcagtaatcacttacgacaaagcggtacaagcagcaggtttcgaccatcatagtcaattaggatttgaatatgacgcaagtgaagtcgaagacctcgtacatcctgaaaccggtgaaataaggtcggtatttaaacaactgccttattatggaaaggctttgcaaaggcacgtagcattcggaagtggcaagccagaagatccagacgagaaaagatatggaaaaatcgccaaccccacagtacatattgggctaaaccaagtaagaatggttgtaaacgcacttattagaagatacggaagaccaacagaagtggtaatcgaattagcgagggatttaaagcaatcccgcgaacaaaaggttgaagctcaaagaagacaggccgacaaccagagaagaaacgcacgaatcagaagaagtatagccgaagtacttggaattggagaagaaagagtaagaggatcagacatacaaaaatggatttgttgggaagaactatcgttcgatgctgcagataggaggtgtccatattctggagtacaaatctcagcagcaatgttactctctgacgaagtcgaagtagaacatatccttccttttagcaaaacgttagacgattctctcaataatcggacagtcgcaatgcgccaagctaatagaataaaacgcaacagaacgccttgggatgcaagggcagaatttgaagcacaagggtggtcatatgaagatattcttcaaagagcagaaagaatgccactaaggaaaagatatagatttgcccctgatggttatgaaagatggttgggagatgataaagattttcttgctagagctctaaacgatacaagatatttatctagagtagcagcggaatatctcaggttggtatgtccgggaactagggtaattccaggacaactaactgcactactaagaggcaagttcggccttaatgatgtattaggactagacggggagaagaatagaaatgaccatagacatcatgcagttgatgcctgtgtaataggagtaaccgatcagggtctaatgcaaagatttgcgacagctagtgctcaagctagaggcgacggcttaaccagactggttgacggaatgcctatgccatggcccacctatcgtgaccatgtagaacgagcagtaaggcatatatgggttagtcacaggcccgatcatggatttgaaggagctatgatggaagaaacatcatatgggattaggaaagatggaagtataaaacaaagaagaaaagctgatggaagtgctggcagggaaataagcaatttaataagaatacacgaagcaacacagcctttaagacacggtgtctcagcagacgggcaaccattagcatacaaaggatatgttggaggaagcaactattgcatagaaataacagtgaatgacaaaggaaaatgggaaggcgaagtaatatccacatttagagcttacggagtagtgcgtgccggagggatgggtagattacgaaacccacacgagggccaaaatgggaggaaattaattatgagattagtgataggagactcagtaagattagaggtggatggcgctgaaagaacaatgaggattgttaaaatatcgggatcaaatgggcaaatatttatggcacccattcacgaagccaatgtagatgcccgtaatacagataaacaagacgccttcacatatacctcaaagtatgcaggatcattgcagaaagcaaaaactagaagggtaactataagccccattggcgaagttagagacccgggatttaaagggtga

SEQ ID NO: 8403 - RNA, 3090 nt, synthetic construct
  misc_feature 1..3090: note = Cas9 variant
  source 1..3090: mol_type = other RNA
atgaaatatcgactggcactagatttaggtagtacttcattaggatgggctatagtacaattaaacgcaaaagatgaaccatgtgcaatagtacgtgcgggggtgcgaattttcccggatggacgtaatccaaaagatggaagctccttagccgtaaccagacgtaatgcaagagccatgagaagaagacgagaccggcttctaaaacgtaaagcgagaatgcaacgacttttaatagaacatgatttatttccggcggatgaagcagcaagaaaggctttagaaaccttaaacccatatgaattaagagccaaagggttggatgcggcactcactccggcggagttcgctcgggcattattccatttaaaccaaagacgcggatttaaatcaaacagaagaacagatcgtaaagataacgacagtggagccttaaaagctgcaataggaggattaagagcacaattggatacagcgggagcagacggtagagcaagaaccgtaggagaattactatggagacgaatgagcgatccgaatgtattaacagtaagagcaagataccgagaacaaagaataactaaagatgatggaaaaacacgagttgacaaatcctatgatctatacgtggatagagcaatggtagaggcagagttcgatgctctgtgggcaaagcaagcagaattaagcccgacacagtttggtgaagctgcacgagcaactctaaaagattgcttactccaccagcgcaatctaagaccagtaagaccaggtcgttgtactctagaaccagacgaaccacgtgctcccctagcgctcccgtcacaacaaagatttagaattttgcaagaagtaaatcatttacgtctgcttggaggtagactgttagaagaatcactgtcagtagaacaaagagataaactcgtagccgcattagaagatggatccaaatcatttaaaacagccatacctaagctacttggattacctggaacggtccaatttaatttagctgatgctaaaaggacagaactaaaaggtaatgcaacatcaatgctattaggtaagaaagactttttcggtcctgcctggcatggattctccgaagcacgtcaggacgaaatagtaatgagaatccaagaagaggaatcagaagctagattagtagactggttggcaacatcgacaggagtcgatgaagcgcatgctttgaaaatagcaaatgctgcattacctgaaggatatggatctttgagtgccaaagccctagcaaaaattctaccagcaatgagagcggaagtaataacgtatgataaagcggtcttagctgcaggatatgatcaccactcacacataagtcatgctgcttctacaggagaaatcttaccagagctgccatattatggagaatatctacaaagacatgttggatttggcacaggagaactaaatgatactccggagaaaagattcggaagaattgccaatcctaccgtacacattggcttgaatcaagtccgagtagtagtaaatgcactaataaaaaggtatggccacccaacagaagttatagttgaagtagcaagagatttaaaacagagtcaagaccaaagaagagaaacacaggaacaacaagctaaaaatcagaaaagaaatgaaagactgagaaaagatgcagctgctattttaggaattgcagatgaacgagtaagactagccgacatccaaaaactaatactttgggaagaattgagtttcgatatagcagacagaagatgtccatatagtggcgtccaactatctgccgctatggtattatcggaacaagtagaaatcgaacatatattacccttcagtatgacattagatgattctctaaataataaaacagtagcaatgcgattggttaatagactaaaaggcaatagaacaccttgggacgcacgagaagcatttgccgggcaaggctgggattacgatggtattctaatgagagcggaacgaatgccgagagcaaaacggcaacgatttgcaccagacggactagagaaatggctcaaagaggataaagattttctcgcaagggctttgaatgatacgcgacatttaagtagagtagccagagaatatttgagtttggtatgtcccgcttctacaagagttataccgggacaaatgacagcaatgttaagagcgaaatttggattaaacgatatattaggacttaatggagagaaaaacagaaacgatcatcgtcaccatgctgtagatgcatgtgtagtagcggtaacagatcaaggattattacaaaggtttgcacaagccagtgccgatgctaggggaaaaggattagatagattagtagaaacaatgccagatccgtgggacagctaccgagaacacgtacaaagggcagtgaatagtatttgggtatcacacaaaccagatcacggttttgaaggagcgatgcatgaagacacaacatacagacccccgcacctagatcccaaaaatatgtggagaacacgaggtataggaggtgggaaaccaaacgaaaaagaagcagatagcaaagcaatggtgggctttaccggacctgaacatttacaacgccaccacagagacaaagccggacaacaacttccatacaaaggttatgtagcaagcccaaaattttgtatggacatcgtacgaaacgataaaggccgatgggagggtgaagtagtaagcacatttgaagcatacagattagtaagtgagttcggaagagacgcagcactagcacatatccaatccaaatcaagaagtatttcgggaaaacctttggtaatgaggttgcaaggtggagatatggtcagatttgatgatgatgaaggtaggcctgtagtactccgagttgtcaatatgactgggaatggacaaatcttctttgcgccacataatgaagctaatggggacgcaagaaatagggataaacaagatcaatttgtatacctttctaaatacgctggttcactacaaaaagcgagaggaagaagggtaaccgtaagtcctgccggggaattgcgtgatccaggatttaaagaatga

SEQ ID NO: 8404 - RNA, 3090 nt, synthetic construct
  misc_feature 1..3090: note = Cas9 variant
  source 1..3090: mol_type = other RNA
atgagatccctaagataccgattagcgttagacctaggatcaacatctttaggctgggcattgtttcggttagatgcatgtaaccgacccacagcagtcataaaagcgggtgtacggatattcagtgatggtagaaacccgaaagatggatctagtttggcagttactcgacgcgcagcacgagcaatgagaagaagaagagacaggttattaaaacggaaaacgagaatgcaagcaaaactcgtagaacatggatttttcccagctgacgctggtaaaagaaaagcactcgaacagctaaatccctacgccctaagagctaagggtttacaagaggcacttctaccaggtgagttcgcgagagcgttgtttcatataaatcaaaggcgaggttttaagtcaaatagaaaaacagacaagaaagacaatgatagtggggctctaaagaaagcaattgggcaattacgacaacaaatggcagaacaaggtagcagaacagttggagaatatctatggactagactacagcaaggacagggagtgagggccagatatagggaaaaaccgtatactacagaggaaggaaagaaaagaattgataaaagttacgacctatacattgatagagcgatgatagaacaagagtttgatgcactatgggcagcacaagcggctttcaatccaacgctgtttcacgaggcagcgagagcagacttgaaagatacattgttacatcaaagacccctaagaccagtgaaaccaggaaggtgtacattattgccagaggaggaaagagcaccattggcattaccgtcaacacaaaggttcaggatacatcaagaagtgaaccatctgcgactattagacgaaaacctcagagaagttgcactcacactagcacaaagagatgctgtagtaactgcactagaaacaaaagcaaaactaagttttgagcaaatcagaaaactacttaaattatcaggaagtgtgcaattcaatttagaagacgcaaaaagaacagaactaaaaggaaacgcaacgtcagcagccttagccagaaaagaactatttggagctgcttggagtggatttgatgaagcactccaagacgagatagtatggcagctagtaacagaagaaggagaaggtgcactaatcgcttggttacaaactcacacaggtgtcgacgaggcgcgagcacaagcaatagtagatgtaagtctaccagaaggatacggaaatctaagtagaaaagcattagcacgaatagtaccagcgctcagggcagcagtaataacatatgacaaagccgtacaagcggcaggatttgaccaccactcacaattgggattcgagtatgatgcctcagaagtagaagacttagtacacccagaaacaggagaaataagaagcgtattcaaacaactaccatattatggcaaagcgttacaaagacacgttgctttcggtagtggcaaaccagaagacccagatgaaaaacgatacggaaaaatagcaaaccccactgtacatatcggcttaaatcaagtaaggatggtcgtaaatgcattgattcgaagatacggtagaccaactgaggtagtaatagaactagctagagatcttaaacaatcaagagagcaaaaagtagaagcccagcgtagacaggcagataaccaaagaagaaatgctagaattagaagatcaatagcggaagtcctgggaataggagaggaacgagtaagaggaagtgatatacaaaaatggatatgctgggaggaattaagttttgacgcagcagatagacgatgtccatatagcggtgtacaaatcagcgctgcaatgttattaagcgacgaagtagaagtagaacatattttaccctttagtaaaactctagatgactccctgaataaccgtactgtagcaatgagacaagcaaatagaataaaacgaaacagaacaccatgggacgcaagggcagagttcgaagctcaagggtggtcatatgaagatatactacaaagggcagaaagaatgccacttagaaaaaggtatcgctttgcgccggacggatacgaaagatggttaggagacgataaagattttctagcacgagccctaaatgatacacgatatctaagcagagtagcagccgaatatctacgactcgtatgtcccggtacaagagtaataccaggacagttaacggctctattaagaggcaaatttggactaaacgacgtattaggactcgacggtgagaaaaatcgaaacgaccatagacaccacgcggtagatgcatgcgttataggagtaaccgatcaaggcttaatgcaaagattcgccacagcttcagcacaagcacgaggagacggattaacgagattagttgacggaatgccaatgccctggccaacttaccgagaccacgtcgaaagagccgtcagacacatttgggtctctcaccgcccagaccatggatttgaaggagcaatgatggaagaaacgagctatggcatacgaaaagacggatcaattaaacaaagaagaaaagcagatggaagcgcaggaagagaaatatctaatcttataagaatacatgaagctactcaacctttaagacatggagtgtcagcagatggtcaacctctagcatataaaggatatgtaggcggaagtaattattgtattgaaataacagttaacgataaaggaaaatgggagggtgaagtcattagtacgtttcgagcttatggaatagttagagccggtggaatggggagactccggaaccctcatgaagggcaaaatgggagaaaattaataatgaggcttgtaataggagactcggtcagactagaagtagacggtgcagaacgaacaatgagaatcgtaaaaataagcggaagtaacggtcaaatattcatggcaccaatacacgaagcaaacgtagatgctcgcaacactgacaaacaagatgcatttacgtacacatcaaaatatgcaggatctttgcaaaaagctaaaacaaggagagtaacaatctcacctattggagaagtacgagacccaggatttaaagggtga

SEQ ID NO: 8405 - RNA, 3096 nt, synthetic construct
  misc_feature 1..3096: note = Cas9 variant
  source 1..3096: mol_type = other RNA
atgccagcaatatatagactagcattagatcttggaagcacatcgctcggatgggcagtattacgactagaacctgcggctctagaaccgatcgcaattatcaaagcgggtgtacgaatcttttcagatggccgcaatcccaaagacggagccagcctagccgttacaagaagggcagcaagggcaatgagaagacgccgtgatagattactaaaaagaaaagctagaatgcaagataaattagtaaaacatggattctttccttcagacatggacgaacgcaaagcattggaaaggctagacccatatgcacttcgtgcaaaaggtctaagagaggctttaactccaggggagtttgccagagcactctttcatataaatcaaagacgagggttcaaatcaaataggaaaacagataagaaagataatgatagcggcgcgctaaagaaagcaatttcacacctaagacaacagatggaagctgggggtcacagaactgtaggagatcatctctggagtagactccagcaaggattgggagtaagagcgcgatacagagaaacaccctttacgaatgatgagggaaagaaaagaattgacaaaagctatgatttatacatagatagagcaatgatcgagcaggagttcgatgcattatgggcagcacaagcagcatttaatccggccctgtttcacgaagtagcaagagcagatttaaaagatactttattacaccaacggcgacttagaccagtaaaacctggcagatgtaccctattacctgaagaagaacgtgcacccttagccctaccatcaacacaaaggtttcgaatttatcaggaagtaaatcatttacgactattaggtgaagatttaagagaagtagctcttactctagcacaaagggatgcagtggcaaacgctctagaatcaaaagcccgtttaacatttgaacaaataagaaaattactaaaactgtcaggaagtgttcaattcaatctagaagatgcaaaaagaaccgaattaaaaggaaacgccacaagtgctgcgttagcacgaaaagaattatttggagcagcgtggggtgggttcggagaagccttacaagatgaaatagtatggcagctagtaacagaagaaggagaaggtgcattgatagcatggttacaagcccatactggtgtagatgaagcaagagcacaagcaatagcagatgcatcactaccagaagggtacggatcattaagtagaaaagctcttgctagaatagtacctgcgctccgagcaggagtggtaacatacgataaagcggtgcaagctgcaggttttgatcaccactcgcaactaggtttcgaatacgacgcgggagaagtagaagattgggttcatccagatacaggagaaataagaccagtgtttaaacaactcccatattatggaaaacctctacaaaggcatgtagcatttggatcaggtaaaccagaagatccagatgaaagacggtatggaaaaatagcaaacccaacagtacatataggtttaaatcaggtaaggacagtagtcaatgccctaataagaagatatggaagaccaacagaggtagtaatagaactcgcaagagatctaaaacaaagtagagagcagaaagtagaagcccaaagaaaacaggcagaaaaccaaagacgaaatgcaaggattagaaaatcaattgcagaggtattaggtataggagaagaacaagttagaggtgcagatatacaaaaatggatatgttgggaagaactttccttcgacgtagctgaaagaagatgtccatactcaggagttcaaataagcgcaaggatgttattaagcgatgaagtagaagtagaacacatattaccattttctaaaacattagacgacagcttaaataatcgaactgttgcaatgagacaagcaaatagaataaaaagaaatagaacaccttggacagcaagagatgatttcgaagcacaaggctggagttacgaaggcatactacaaagagcggaaagaatgcccctaagaaaacgatatcgatttgctcctgatggttacgaacgatggttaggcgatgacaaagatttcttagcaagagctttaaacgatactcgatatttatcaagagtagcagcagaatatcttcgtttagtatgcccgggaagtggcacaagggtgattcctggacaaatgactgcaaggttaagaggaaaatttggtttaaacggagtattaggaccagatggagagaaaaacaggaatgatcatagacatcatgcagtagatgcatgtgttataggagtcacagaccaaggtttaatgcaaagatttgcgaacgcaagtgcacaagcccgagaagatggcctaacgagattagtagacgatatgccgaggccatggcctacttatagagcacacgtagaaagagccgtaaggcatatatgggtaagtcatcgaccagatcatggatttgaaggtgcaatgatggaagaaacatcatatggaataggaaaggacgggtcgatcaaacaacgtagaaaagccgatggatcaccaggaagagaaattactaacttaattcgtattcacgaagcgactcaaccgcagagacatggtgctggaccagacggacaaccactaccatacaaaggttatgtaggaggtagcaattactgtattgaaataactaggaatgacaagggaaagtgggaaggagaagttataagtactttcagagcgtacggaatagtgcgaacaagtgggcttgggcaactaagacatccgagagtaggacaaaatggaagggaattagttatgaggctagtaattggtgatagtgtaagattagaaattgatggaatagaaagaacaatgaggatagtgaaaatatcaggaagtaacggacaaatcttcatggcaccaatacacgaagcgaatgtggatgcaagaaacagtgataaacaagacgcttttgcatatacatcaaaatacgcaggtagtttacagaaaacaaaagcaagattcgtaacaatttcacccataggagaagtaagagatcttggattcaaaggctga

SEQ ID NO: 8406 - RNA, 3099 nt, synthetic construct
  misc_feature 1..3099: note = Cas9 variant
  source 1..3099: mol_type = other RNA
atgaagaaaagaatattaggcctggacatcggaattgcaagcgtaggctgggccttagtagagttcgacgacgagttccaagataacaaaaagaaaggaacaatcattaaaagtggagtcagaatatttacgagagcagaaacaccgaaagaaagagaaagtctagcaaaaccacgacgcgaagccagaagccaacgaagacgaatacgtagaagggtggaaagattaaacagtataagagaactatttgtgaaaaacggagtagtagaagaatggagcgtatctaagaaaaacccaaacaacatatacataacactaaaccaaataaaaacaccttggcaattaagaatggaatcactagatagaaaattaacaaacgaacaatttgcagtagtcctaacacacttagcaaaacacagaggatataaatcattaagaaaagatgacaaagcaggaaaagtactagaagcaataagccaaaacaagaaacgattgaacgacagcgactatcgaacattaggagaaatgttctgcaaaaatgaaagttataaagaacataaacgaaataaaggaggagaatatattaacagtgtagcacgagaattaattgaagaagaagtcgagaaaattttcgtcaaacaaagagaaaaaggtaataactttgccgatgtcaatacagaaagagaatacctaaagatagccttctcacagaaacctgcgggatcaataagtaaaatggtaggcttttgcacttttgaaaacggagagaaaagagcacctagggattcatacagcgccgaattatttaaagtactttgcacaataaacaacacaacttttactgacatgaaaacgggagaaatcagatctttctccaaagaagaaataggaaaaaccttagaaacagtcaaaaacgtaaaagatgtaaaatacgcaaaaataagaaaagatctaggcttagaagactcagttaaattcagtggagtcgattacagggaaaacgcaaaatcaaaaggagaaggagaaatattcgttagtatgaaaacataccacgaaataaaaagtaaaatagaaaaactatccaaagaaaaatgggataacctgaaaggtaacactgaattgttagactccatagtgaacatcattgcaaatcttaaagacgacgagagcattaagaaagagttccagaaactaaaaattgacgaagatataatagacgtattattaaacttcgaatttaagaaattcataaacctatcgtttaaagcactacgaaaaatcataccctttcaattccaaggccaaaaatacattaccgcttcaacatcagcaggatacagccttaaacaagaaggaataaagaataagctagtacctccagccaaagaaaatattaatgtagcggtcgtagcaagagcatttgcgcaaacaagaaaagtaattaacgccgtcatacgaaaatacggacaattcgaccaaatcaacatagaactagctactgaactgaaaaactcaaaattcgatagaagcaagatcgaagaagggcagaagaaatttcaatcccaaaaagacaaaatctttaaagaagtacaagaactaagaggaggaatgacacccagctcaagtctactattaaaataccgcttatggagagaacaagatgaacgctgcgtatacagcgggagaaaaattagcttcgaggatttactagatacaggtttcctcgacatagaccatattatcccatatagtaaatccatggatgacagctttaataataaagtgctatgtttggctgaagagaatcgtaataagaaaaacgacattccatttaactactaccaaaggatagatagggattggaacttattaatatccataatcacaagtatgaaaaacatgaaaattgcgaagaaaagcagacttctcaaacaagaactatctgacatagaaggattcatagaaagaaacataaatgacactagatatgcaactcgatacattaaagacttcctagaaaacaatttagagttcaaagaaaatgaatttattaaagtaaaagtacaagcaaggagtggcggactgacatccgtcttatcatacaactggggaatgagcaaagatagagaagaatcgtatttccaccatgcaaaagacgctatcatcgtggcatgttcaacgcaaggtatggtacaatacatatcaaaaatatcacaacaatacgaaaacgacaaagacaaaatgaagaaaataaaagacaaaactgaaaactgcataccaaaaccttgggattccttcagggcagatgtggaagaaagtatagaaggaatattcgtctcattcgcaccaagacataaagtaacaggttcagcacataaagaaacaatatatagcaagaaacacttagaaaaagaaagatatgtaactgtcaagaaatcgctcgacaaaataaaactctcagatttagaaaacataccgtgcaatgaaaattgtggtataataagagtactaaaagaaagattagaaaaattcaaaaacgactccttaaaggcttttgcagatcctgtccatatgccgacaaaatgccccaacaagaaaggacccgtaataagatcagtaaaaataaaagaatctaataaaacaggcatagaagtacgcaaaggactggcagagcgtggtgaaatggtaagagtagacgtattcataaaagacaagaaatactacttagtcccaatatatgtaagcgatttcaaaaataaagaccttcctaacaaagccatcgctgcattaaaactagaaaacgaatggatcatgatcgacaaaacatattcgtttaaatttagtttgttcaaagatgatctaataaaaattaagaagaagaaagaagaaatattcggttacttcggcggcgtccaccgatcaacaggaacaataaaaatcaaaagcagacacaaaccaaaagaaatagatgaaggaataggaagccgttgtttattagacttcagaaaattccaagtagatgtcttgggcaactacacggaagttaaacacgaaaaacgtatgccagcatacataacgcgaaaagataagaaacactga

SEQ ID NO: 8407 - RNA, 3105 nt, synthetic construct
  misc_feature 1..3105: note = Cas9 variant
  source 1..3105: mol_type = other RNA
atgaaaatactaggattcgacataggaatagcgtcaataggatgggcattcgtagaaaacggcgagttacgagattgtggagtccgaatattcaccaaagcagaaaaccctaaaactggagactcattagcaatgcctaggagagaagcaagaagtgtacgaaggcgcctagcgcgacgaaaagggcgactagaaactctaaaaagactactcgcaaaagagtgggatttatgttatgaagactacatagcagctgatggagaacttcctaaagccttcatgggtaaaaacctaaccaacccatatgtattacgatatgaagcactacaaagactattaggcaaagaagaattagctagagtaatactacacatagccaaacatagaggttacggaaacaaaaatgctaaaataacaaaatcagaagaaagtaaaagagagcaaggaaaaatactatccgcactagctacgaatgcttctgtaatagccagatatcgtaccgtaggagaatatttttacaaagaattttgtgaagtaatcaaaaatccacaaggcctaaataccaatgaaaattgtacacaacctaaagtaagagtattaaaaccgatccgaaacaaaggaggtgaatacacaaattgtatattacaagaagatctacaaagagaattaagatgcatcttcgaacaccaaaaaggcttcggttttcccataactcaagagttccaagataaaatcctaaaaattgccttctatcaacgctcacttaaagacttttcacatttagtaggcaaatgcacgttttatccagatgaaccacgagcaccaaaattcagtctaagtgcaatagaatttataaccaaagcaaaaaccatcaatctattagtaggaatcgtaaaagaaagcggagaagtttgggataaagaacaatggagggaacggttagatagcgtattttcagcggtatgcgaacgaggaaatttaacattcgcacaaatgaggaaaatattaaaaatcgacgaaagaatacaattcaaagaagttgactacacagccaaaaaccctgaaaacaagaaatttgttgagttcaaaaatctaaagaaattttgtgaaatcttaggagcaattgttggggatagagcattagctgacagtatagcacgagatatgacactcataaaagacgaagaagaattagcgcaaaaattaagaggatatggtaaatttagccaagaacaaataactcaactcggagccctaaatttctcacaccatattaatcttagcttaaaagctctcagtgaaattctaccctttatgagggaaggaatgaggtatgatgaggcttgtcaggaagccaaactacaggctaaacataatgataagaaaagcaaattcctgccaccattttgtggaagcatatatgctgatgaattaaccaatcccgtagtacatagagcaatagcagaatacagaaaaatattaaacgcactaatagcaaaatacggaaatgtacacaaaatacacatagaattaacccgtgatgtaggtaaaaatttccaagaacgagaaaaatataaaaaggaaatagaaagcaattataaagcaagagtacaagcaatgcaagaatgcgaaaaactcggattaacattaagtgaaggaaacatacttaaacttaggttattcatggaacaaaatgaacgttgcgtatactctggaaggaaaataaccttagcaaatctgaaagaacagggtgccttagaaatagaccacattctcccatacagtaggagtagcgatgatagttacatgaataaagtattagtattcacaaacgaaaatcaaaataaaggtaataaaacaccatacgaggctttcggaggagattcccaaaaatggggtgaaatagaatccctcgcattaaggagtggatatccaaagaagaaagctaaaagaatattagacaaagggttcggagatagagaagcaggattcaaaagcagaaacatagtagattcagggtatatagctcgattaatcgcaaattatacaaaagagtacttaaaattcttacctttagactctcatgaaaacacagccctaatcgcaggggaaaaagactcaaaaattcacgtggaagcagtaaaaggaatgttaaccgcaactatgagacacttctggggcttagggtctaaaaatagatacgagcacacccatcacgcgatagacgccataattatcgcatacattaatgccgcgatgattcaaagatttagccagttccgacaaaatcaagagtcgcttaaagccagattttatgcaaaagagttagcaaaagaagaatttaaaacccaaagagctttctttgaacctttttcgggattccgagagcaagtgctagcaaaagtaggccaaatatttgtatcacgtccaccaagaaaaagagcacgaggggctttacatgaagaaacattttactcaattgacgataagaaactaagtgaaacatacggtggcaaagaaggggtacaaagagctctaagtttaggcaaaattaggcaaataggaactaaaattgtagctaacggacctatggtaagagtggatatattcaaacataagaaatcagggaggttttatgctgttccaatatacaccatggatttcgctctagggatactaccaaacaaagctgtcgtatcaggaaaagataacgacagaataatcaaagattggttagaaatggatagcaactacgaattttgtttctcactatttaaagatgatgttatagaggtacaaaagaaagacatggaaaaaccggaactcgcatatttcgtcagtttaaataccagcagcgcaagtatagcgctagtaaaacatgataacaaatttgaaaccctaacttcaaatcaagcaaaactattctctaatgcaaaagaaaacaacgtaatagcagaatcactgggaatacaaaatttaaaagtcttcaagaaatacaaagtatcacccttaggtgaaataaaagaagctaaatatgaaccaagacaacccatagccctcaaaacgtcaccaaagaaacatagaaaacaaaataatgcacaatga

SEQ ID NO: 8408 - RNA, 3108 nt, synthetic construct
  misc_feature 1..3108: note = Cas9 variant
  source 1..3108: mol_type = other RNA
atgcgacgcttaggcctagatttagggacaaactcaatcgggtggtgcctcctagacttaggagatgacggggaaccagtatcaatttttcgtacaggagccagaatattcagcgacggaagagaccctaaatcattagggtcactaaaagcaacgagaagggaagcaagactgacccgaagaagaagagatagattcatacaacgccagaaaaatttaatcaatgccttagtcaaatatggattaatgccagcagacgaaatacaaagacaagctctagcctacaaagacccttatcctataagaaagaaagcattggatgaagcaattgacccatatgaaatgggaagggcaatatttcatataaaccaacgaagaggatttaaaagtaacagaaaaagcgccgacaatgaagcgggcgtcgtgaagcaatcaatagcagatttagaaatgaaactaggcgaggccggagcaagaacaataggtgaatttttagctgacagacaagcaactaacgatacagtaagagctagaagactaagtggtacgaacgcattatacgagttctatcctgatcgatacatgcttgaacaggagttcgacacactatgggcgaaacaagcagcctttaacccaagcctatatattgaagcagcacgagaacggctaaaggaaatagtatttttccaaaggaaattaaaaccccaagaagtaggacgatgtatcttcttatcagatgaagatagaatttcaaaggccctaccaagttttcaaagattcagaatttaccaggaattatcaaacttagcatggatagatcatgacggcgtagcacatcgaataacagcttcattagccttacgcgaccacttatttgacgaattagaacataaaaagaaactaacctttaaagcaatgagagcaatattacgcaaacaaggtgtagtagactatccagtcggtttcaacctagaaagcgacaacagagatcacctaattgggaaccttacaagctgcataatgagagacgcaaagaaaatgataggaagcgcatgggaccgattggacgaggaagaacaagattctttcattttaatgttacaagatgatcaaaaaggtgacgatgaagtgagatcaatattaacccaacaatatggactatctgacgatgtagcagaagactgtctagatgttagacttccagatggccacggaagtttaagcaagaaagctatagacagaatattgccagtgcttagggaccaagggttaatatattatgatgcagtaaaagaagcagggctaggtgaggctaatctatatgatccatacgcagcattaagtgacaaattagactattacggcaaagcactcgccggccacgttatgggagcgagcggaaaatttgaagattccgacgagaaaagatacggtacgataagtaacccaaccgtacatatagcactcaatcaagtgagagcagtagtcaatgaactcataagattacatggaaaaccagatgaagtagtaattgaaattggcagagatttaccaatgggggcagatggaaaaagagaactagaaagattccaaaaagaaggacgcgcgaaaaatgaaagagcaagagatgaacttaagaaattagggcacatagacagtagagaaagccgacaaaaatttcaactctgggaacagcttgctaaagaaccagtcgacaggtgctgtccatttactggaaaaatgatgagtatatcagatctattttcagataaagtagaaatagaacatttgttaccgttctcgttaaccctagatgacagtatggcaaacaaaacagtatgttttagacaagccaatagggataaaggaaatagagcaccattcgacgcgtttggaaacagtccggcaggatatgattggcaagaaatattaggaagatctcaaaatttaccctacgctaaaaggtggagattccttccagacgcaatgaaaagattcgaagcagacggaggattcttagaacggcaattaaatgacacacgatatatttcaagatatacaactgaatatatatctacaattatacctaaaaataaaatttgggtagtaacaggaagattaactagcctattaaggggtttttggggattaaatagcattttacgaggacataatactgacgacggaactcctgccaagaaaagcagagatgaccacagacaccacgccatagatgctatagttgtaggtatgacatcaagaggacttctacaaaaagtaagtaaagctgcccgacgaagtgaagacttagatttaacaagacttttcgaaggtaggattgatccgtgggatggattcagagacgaagtaaagaaacatatagatgcaattatagtaagtcacagaccaagaaagaaatcacaaggagctttgcacaacgatacagcgtatggaatagtcgaacacgcagaaaatggagcaagcacggtagtccacagagtccctataaccagcctaggaaaacaaagtgatatagaaaaagtaagagatcctctaatcaaaagcgctttattaaacgaaacagctgggctatctggaaaaagttttgaaaatgcagtacaaaaatggtgtgcagataactcaataaaatccttacgcatagtagaaacagttagcataataccaattaccgataaagaaggagtcgcatacaaaggatataaaggagatggaaatgcttatatggatatttatcaagatcccacaagtagcaaatggaaaggggaaatcgtaagtagatttgacgccaatcagaaaggttttatcccaagttggcagtcacaattccctacagctcgattaatcatgcgactaaggataaacgatctactaaaactacaagatggagaaatagaagaaatatatagagtacaaagactaagcggatctaaaatacttatggcgccacatactgaagcaaatgtcgacgcgagggacagagataaaaatgatacatttaaacttacatcaaaatctcctggtaaactccaatctgcatcagcaagaaaagttcacatcagccctacaggtctaattagagaaggttga

SEQ ID NO: 8409 - RNA, 3108 nt, synthetic construct
  misc_feature 1..3108: note = Cas9 variant
  source 1..3108: mol_type = other RNA
atggaacaactaaactatatattgggattagatataggaatagcatcagtcggatgggcagtcgtggaaatagaccataatgaagacccaataagactaatcgatgtaggcgtccgcacattcaacaaagcagaagtagcaaaaacaggagagagcttatcattaataagacgactcgcacgtggatcaagacgacttgttagaaggaagaaaatgcgcctattaacggcaaaacggcttctaaaaagtgaaggcattctatcagacttagatttcaacaaaggtgcaatattgaacctgcccaataattgctgggagttaagagttaaaggacttgataagaaactctctgataaagaatgggcagccgtactcctccatataatcaaacatagaggatacttatcacagcgaaaacatgacagaaaaacagacgacaaagaattgggagctctacttagtggagtcagtaaaaaccacagtctgctggaagaaggcgaatttagaaccgcagcagaattagccataaacgtcttttgcaattccaaaggccatatacgaaaccaatggggcgactactcacacactttctcaagattagatcttcaaaaagaaataaaacaattattcgtgtctcagcgagaactaggaaacccatacacatcatcatcatttgaagaaaatatcatctctttactaatgaaacaaaaagaagcaatttccggtaacgacatattaaaaatgttgggcaaatgcacatatgagaaaaatgaatataaagcagccaaaaatacgtactcagcagaaagattcgtatggctaacaaaacttaataacctgagaatagtagatgatggagtcgaaagagcattaaactcaagtgaaagaaaactacttatagacgagccatacaagaaagcaaaactaacatatgcacaggtaagaaaaatattagaactgcctgattcagcagtattcaaaggagtaagatatttcgcagataatgcagaaagctctacattaatggaaatgaaattctggcacagcataaggaaagcactagaatcaaacaaccttaaagatgaatggcttgtactcaaaaccaaaccagaattattagacgaaataggaaccggattctcaatatacaaaaccgatgacgatataacatcatatttaagcaacaaactcgataagaaagtactagacatcctattggtcgaagtatcattcgataaatttatagaattaagcctaaaatgtctaagaaaaataattcctctaatggaaaaaggatatcggtacgatgaagcatataaatatatttatggagaagttaacatagaatataacttaaatgatatcaaaaacccagttgtgctcagaagtttctcgcaaagtaggaaagtaataaacgctgtaataagattatacggatccccagcaagaatacacatagaaaccgctcgcgatataggaaagagctttaaagaaagaaaagcaatagaaaaacaacaagagaaaaatagattagaaaaagtaagagctgcagaacacttcaaacaattatttccaaactatgtcggagaaccaaaagcgaaagacatccttaaggtaagactgtatgaacagcaacaaggaaaatgtctatactctggaaaaattctagatataaaaagattaatggaacacggatacgttgaaattgatcacgcgctcccattctcaagaacatgggacgacagcttcaacaacaaagtattggtattagcaaacgaaaaccagaataaaggaaataaaacaccatatgaatggttcaatggaaaagataacagtgacagttggaaacgattccttgctctagttaacaattccggcttcagtgcagtaaagaaacaacacatactaatgaaagaaatagacgaagagggattcaaacaaaggaaccttaacgatacaagatacataactcgattcttatgtaactgggtagagaacaacatccccttattaggaaaaggagtaaagagagttttcgcaccacaaggaaaaattactgcactactccgaagtaattggggaataagaaaagtccgagaagataacgacaggcatcacgcaatagacgcaatagttgtagcatgcaccacagtaagcatccaacaaagaataacaaactacgttaaaaattcggaaataaatagaaaaatcaaaaggcaaaattatctaaaatttccagaaccatggaaattcttcagagaagatatatcaatacgagtattcagtaataaccctatagaggaactgaaacaacaactatcggacaggccagaagccaaccaccagttcgttacaccactcttcgtttcaagggcaccagtgagaaaaatgacaggacaaggacatgaagacacaataagatcagcaaaacgaatatctgagggaatatcagtcctcagagtaccattaactaaactgaatgataaatccttagaattaatggttaaccgagaacgcgaaaaagaattatatgatgcactcaaacaaagactattagagttcaaaaacgaccctgaaaaagcattcgctgaacctttctacaagaaaggtgggcaacaagtgaaaacagtcaggattgaaagagtacagaaaaatggagtactcgtaaataacaatacaggaattgcagataatggaaacattgtcagagtggatgtgtttctcaaaaagaagaaatatttccttgttcccatatacagttggcaagtggctaaaggaatacttccaaacaaagcaatagttgcacacaaaaacgaatgcgactgggcagacatggatggttccgcacaatttttattctcattatacaccaatgacctaattgaagttgtcctcaaagacagcacgatactaggatacttcagcagtatcgatagagctacagccgctataatcataaaagaacccgacatggaaaaatcaaaaggaaaagaagggatacacagggtcggagtaaaaacagcgagatccttcataaaatataacgtagacgtactagggaaaaacataagccgatgcagaaaagcaaaaagactccctgtaagatga

SEQ ID NO: 8410 - RNA, 3108 nt, synthetic construct
  misc_feature 1..3108: note = Cas9 variant
  source 1..3108: mol_type = other RNA
atgttaagaaaaatgcattataggctcgcattagacttaggttcaacatctttaggatgggccatgatacgacttaacgcaggtaacgaaccatgtgcagtaataaaagcaggcgtacgtatattttcaaatggcaggaacccaaaagatgggtcaagtttagccgttacgagaagagaagcgcgagcaatgaggagaagaagagatagattactaaaaagaaaagccagaatgattcagacattaattgaatatggatttttccctgcaaaagaggatcaacgaaaagcactggaaattatgaatccctttgcactaagagctaagggattaaatgaagccttaaccccagctgaatttgcaagagccttattccacataaaccaaagaaggggatttaaatcgaacagaaagacagacaagaaagataacgactcaggggcgctaaaaacagcaattaacaaactacgcgaaacactaaaaacagaaaactgtagaactgttggagaatggctaaataagagggatgtagctggattaacagtaagagccagatatcatcaagataaaacaataaaagaagatgggaaaagcaaaattaataaatattacgacttatatatcgaccgagctatgatagagcatgagttcgacgaactctggaaaaagcaggcggaactgaatccaactttatttacagaagcagcaagagcggatttaaaagacgttctattacaccaacgagctctcaaacccgtaaaacctggaagatgcactttcatgccggatgaagaaagggcaccactagctctaccatcgacccaaagattccgtatgtatcaggaagtgaataatctacgaatactaagggacggacttaaagaagaatctttaacgttaaaccaacgggatgacctaatagccgcactagaagaaaataataaacgtacatttacacaaataaagaaattacttggtctaggaggagtagtaaaatttaattttgaagacccaaaaagagaagaactaaaaggtaatactacatcagcaatattaggcaaagatgaacatttcgggtcagtttggttcaaatttgacgaggccaaacaagatgccatagtcatgcaactatttaaagaggaaaatgaagctaaattactaagatggctacagaatgaaaccggaattgacgagaaaagagccgaaacaatagcaaatgttggactaccagaaggctatggaagtctatgtgcattagctttagcaagaattttgccggaattacgacgagatgtagtgccctactcagatgcagcgaaagcggccggttttcatcattctgacacaagcaataatcaggaagttccaggattaacgttcccaattgaattagtagtaaccgaaacaggggaaataaagacaaaacatatatttcatgaactaccatattatggagaataccttcaacgccatgtcggatttggatcaggtaaaccagaagattcagcagaaaaacgttatggcaaaatcgcgaacccaacagtacatataggcttaaaccaagtgaggctagtagtaaacacactcattaaaagatatggacatccttccgaagtcatagtagaagtagcccgagatctaaaacaaagtaaagacttaagagacgaagaaggtaaaaggcaagcagaaaatcagaaaagaaacaagcgaatccgaaccgcaattgcgggagtcttgcaaacatccgaagaaagggtaagaagagatgacattgagaaaatgatcctatgggaagaattaagtttcgatccagcagacagaagatgtccatacagtggagtacaaataagcgcggcaatgctcttatcagatgaagtagaaattgaacatatactaccattctcacaaacattagacgattcactgaacaataaaacagtagcactaagacaagcgaacagagttaaaggaaatagaacaccatgggaagcattcggagcacaaagtacagcggggtttgattacgcgacaatattagcaagagccgaacatatgccaaaaggaaagagatatagatttgcggaagacggataccaacgctggctaaaagatgacgctggattcttaccacgtgccctaaacgacacaagacatatgagtaaagtagcccgagaatatatgtcactaatatgccccaatacacgagtgataccaggaagaatgacagcaatgctgagaggtaaattcggacttaacgatgtattggggctaaatggagagaaaaatcgaaacgaccatagacatcatgcagtagacgcatgtgtaattgcagttacagatcaagggctattacaacggtttgccaaagcaagtgcttcagctagggaacaacaactaaatcggctagtcgaaaatatgccccttccatgggaaagttacagagaacacgtagaaagagcaatagatgcaatatgggtctcccacaaacccgaccactctcatgaaggagcaatgcacaacgacaccgcctatggattattgggagacggtaaagtatcaatacataaaatggtagaaggaaaaagagaaagaatagaagaaagtctaaaagtaatagcgttcacaaatgctaaagcaaacgacagacacggtttattagataacggagaaccaaggccctacaaaggctataaaggagattcgaattattgtatcgaaataataagaaacgaaaaaggtaaatgggaaggggaagtcatatcaaccttcgacgcctaccaattagtgagagaacatggagtagcaaggttgagacacccaactttatctgtaagtggtaaaccactcgtaatgagactaatgaaagacgaaacaatacgcatggtaacaaatgaaaagcctataactgcaagagtatgttgggttagaagcgatacaagaatagcgtttgctagtacatcagaagcaaatgtagatgccagagacagagataaaaacgattcattcagttatatagttaaaacagcatcggttctccaaaaactccaagcccgaagaataagcatttcacctactggcgaactacgggatcctggatttaaagaatga

SEQ ID NO: 8411 - RNA, 3108 nt, synthetic construct
  misc_feature 1..3108: note = Cas9 variant
  source 1..3108: mol_type = other RNA
atggaacaactaaactatatattaggacttgatataggtattgcatctgtaggatgggccgtagtcgaaatagaccacaacgaagatcccatacgactaattgacgtgggagtaagaacgttcaacaaagcagaagtcgccaaaaccggcgaatccttatcactaatacgacgactcgcaaggggatcaagaagattggtaagaagaaagaaaatgagattactaactgctaaacgtttattgaagtcagaaggaatactaagcgatttagactttaataaaggcgcaattttaaacctaccaaataactgttgggaattaagagtaaaaggattagacaagaaattatcagacaaagaatgggcagcggtacttctacacataataaaacacagaggatacttatcacaaaggaaacacgatagaaaaactgacgacaaagaactaggagcactccttagcggcgtatctaaaaaccactcgttactagaggaaggagagttccgaactgccgccgaacttgcaatcaacgtattttgtaattccaaaggacacataaggaatcaatggggtgactattcacacacctttagtagattagatctacaaaaagaaataaaacaactcttcgtttctcaaagagaacttggcaatccatataccagtagttcgttcgaagaaaacataatatcactactgatgaaacaaaaagaagcaatctcgggaaacgatattctgaaaatgctcgggaaatgtacatacgagaaaaacgaatataaagccgctaaaaacacgtatagcgcagaaagattcgtgtggttaacaaaattaaataacctgaggatagtagacgatggagttgaaagagcacttaatagttcagaaagaaaattattaatagatgaaccatacaagaaagcaaaattaacatatgcacaagtaagaaaaatactagaattacctgactcagccgtattcaaaggcgtaagatactttgcagacaatgccgaaagttcaacactaatggaaatgaaattttggcactcaattaggaaagcattagaatcaaacaatctaaaagatgaatggctagttctaaaaacaaaaccagaactactcgacgaaattggtacaggcttcagcatctacaaaacagacgacgatattacatcttacctatcaaacaaattagacaagaaagtactagacattctgttggtcgaagtttcatttgacaaatttatcgaactcagcttaaaatgcctaagaaaaatcatacccctgatggaaaaagggtacagatatgacgaagcatacaaatatatatatggagaagtgaacatagaatataatctaaacgatatcaagaaccccgttgtattaagaagtttctctcagtcaagaaaggtcataaacgcagttatcagactctatggatcacccgcaaggattcatatagaaacagctagagacataggcaaatcgttcaaagaaagaaaagcaatagaaaaacaacaagagaaaaatcgactagaaaaagtaagagccgcagaacactttaaacaactattccctaactacgtaggcgaaccaaaagctaaagatatcctaaaagtaaggctatacgaacaacaacaaggaaaatgcttatattcgggaaaaatcttagacataaaaagattaatggaacacggctacgttgaaatagatcatgcactcccttttagcagaacatgggacgattcatttaacaataaggtcctagtcctggctaacgaaaatcaaaacaaaggaaacaaaacgccatatgaatggttcaacggaaaagataacagtgactcatggaagcgattcttagcattagtaaataactcaggattctccgccgttaagaaacaacacattctaatgaaagaaatagacgaagaaggatttaaacaaaggaacttaaatgatactcgatatataacccgttttctatgcaattgggtcgaaaataacatacctttattaggtaaaggggtaaaaagagtatttgcaccacaaggaaaaattaccgcgctccttagaagcaattggggtattagaaaagtcagggaagataatgatcgacaccacgccatcgacgctatagtagtagcatgcaccacagtatctatacaacaaagaatcactaactatgtgaaaaattcagaaataaacaggaaaataaaaagacaaaactacctaaaattcccagaaccatggaaattcttcagagaagatatatccataagagtattttcaaataaccccatagaagaattaaaacaacaactctcagacagacctgaagcaaaccaccaatttgtaacgcccttattcgtatcaagagcacccgtgagaaaaatgacaggccaaggccatgaagatacaataaggtcggcaaaacgaatttctgaaggcatatccgtacttagagtacctctaacaaaactaaatgataaaagcctcgaactaatggttaacagagaaagagaaaaagaactttacgacgcgctaaaacaaagactgctagagttcaaaaatgatccagaaaaagcattcgcagaacccttctataagaaaggaggacaacaagtaaaaacggtacgaatagaaagagtgcaaaagaacggggtattagttaacaataatacaggaatcgctgacaacggcaacatagtgcgagtagacgtttttctaaagaaaaagaaatatttcctagtacccatctacagctggcaagtggcaaaaggtatattaccaaacaaagccatagtcgcacacaaaaatgaatgcgactgggccgacatggacggatcggcccagttcttattttctttatacacaaacgacctaatagaagtagtactaaaagattccactatacttggatacttttcctcaatcgacagagcaacggccgctctgataataaaagaaccagacatggagaaaagcaaaggtaaagaaggaatacatagagtaggagttaaaaccgcaagatcattcataaaatacaacgtagacgtattaggcaaaaacatcagccgatgtagaaaagcaaaacggttaccagtcagatga

SEQ ID NO: 8412 - RNA, 3111 nt, synthetic construct
  misc_feature 1..3111: note = Cas9 variant
  source 1..3111: mol_type = other RNA
atgcgtatatttggattcgatataggcattacatctatagggtgggcatatgtagaatcaaacgaattgaaagactgcggagtaagaatatttacaaaagcagaaaaccccaaaaatggcaaatctctagctttgccaagacgagaagcaagaggcgctcgcagaagattagcgagacgaaaagccaggcttaatgcgataaagcgtcttttatgcaaagaatttggcctaaacgtatcagattacttcgcaaatgacggagaactaccaaaagcgtacgaaacgacaaaagacacaaaatccccatatgaactcaggagcctagcactagaacaaaaattagaaccaaaagaactggcacgagtaatcctacatatcgccaaacacagaggatacggaaacaaacacgctaaaaccggatcagacaaagattcaggtaaagtactaagtgcaataaaagtaaatgaaacagcaatgaaagacaaatatcaatcagtaggtgaatatctatacaaagagttctaccaaaaattaagattagaatcagagaaaaagggaaacaatataactaaagagttcaaaaacgtaagaaacaaaggggaaaattacgaacactgtgtcgcacaggaacaagtaagagcagaactcgaactaatatttgcaaaacaaaaagactttggagcaacattttccgaaaatttcgaaagccaaattatagaaacggccttttaccaaagagatctgaaaagttttgaagacaaagtaggcaaatgcgttttctatgaaaatgaaaaccgagccccaaaagactcattgtcagcaatggagttcgtagcgctaacacgaataattaacacacttaaaaatttagaagagaaaagcaaaaatctaggaattggcgaagtatatggaaaagataaaattcaagaaatactaaaaatagtactagataaaggcgaaatgtcatataaaaagttacgtgaaatattacacctcgacgaacacatattattcgcaaaagacagcaagttagattatacccaaggagtacaagaagcagaaaaagcaaaattcatagaactaaagaatctaaaagcattcaagaaagcaatgggaggtgatttttcaaactttgctcgagaagaattagataaaatagcgacagatataaccttagtcaaaagcaaagagaacctagcgaagaaactacaaaattatagtgctctctcaaaagaacaagtggaggcactatcgaacctttcatttgcaaaacatatcgacttatccttaaaagcattagaacagatactgccattcatgcgaggagataaaacaggaaaatgcttacgctatgacgaagcagtaaagaaagcagaattgcaagaacatagaaaacataaacaaaaaggagagttcttaatacctctaaaagattacgagccttaccttgcaaacccggtagtagcaagagcactctcagaatacagaaaagtattaaacgcactactacgaaaatacggcaaagtacataaaatacatctggagttcacaagagaagcaaaactaagcgccaaagaaagacaaaaatacgaaaaagaacaaaaagaacatttcgaagcaaatcaaagagcaatacaacaatgtgaaatattaggactgcctataaacggcacaaacatactgaaaatgaaactatggttagaacaaggagaatgctgtgcatatagcggtgaaaagataacacgtgaacacctactagactcaaacgcactccaagtagaccacatatacccatattcaagatcttttgatgacagctacatgaataaagtcctcgtatttgctaaggaaaatcaagacaaaggtaacaaaacacccttcgaagcattcggaggagataaagaaaaatgggatcgaatactctctctgtcagccaagttaccaaaacaaaaacaacgaagaatttcaaatacaaacttcaaagacaaagaaggcggtttcctagcaagaaatttaaacgacaccgggtatatagcaaaactagcaagtcaatggacaaaagattgcttagaatttgaagatctaagggaaaacgaagtaacaatagcaggagaaaaaggatctagcgtacacattgaggtagtaagtggacagctgacaagcatgcttcggcactattggggattagggaacaaagatagaaacaatcatcttcatcatgccgtagatgcagtcatcttagcatatacaaataatgccatgatcaaagccttcgcaaactttaggaaaaaccaagaagaaaacaaaaagaaattctatgcaaaacagatcgccgaaagcgaatataaagcgaagaaagcattctttgaaccatgcaaaaattttagacaaagggtcgaggagaaaataaaagaaatattcgtcagtaaaccaccaagaaaaagagtcagaggagcactacaccaggaaaccttttatccatttgaaaaattgtgcaacgataaagaatattcagaaaaactaaaaatggactatggcggtgaaaaaggaatgcagaaagcgatagctttaggaaaaatacgacaaatcggaacaaaaatagtaagtaacggagcaatggtaagagtagacatttttaaagataagaaaggaaaattctatgcagtcccaatatatacaatggactttgcattagggatcctgcctaataaagccgtagcaataggaaaagacaaagatggggtaatcaaagactggatagaaatggactcgaattacgatttctgtttctcactatttaaagacgatttaatcctagtgcagaagaaagaaatggaacgagcagaactatgctattttgtatcattcgggagtacaaacgcccaaataaacgtagaaaaacacaataacaaatttgaaggtctaagtgagaatgagaaaatactatattcaaatgcaacccaaaaagaagtagccggcaaatccataggtatacaaaacttaaaaacattcgaaaaataccaagtatcaccattaggggaagtacaaaaagcagagttcgaaccacaccaagaaatcaaactaaagagtagtccaaaaagaaaagactga

SEQ ID NO: 8413 - RNA, 3111 nt, synthetic construct
  misc_feature 1..3111: note = Cas9 variant
  source 1..3111: mol_type = other RNA
atgttacataaaatgcactatagactagccttagatttaggaagtacatccttgggttgggcaatgataagactcgacgctgataatcagccatgtgcggtcataaaggccggtgttagaatattttcaaacggacgaaatccaaaagatggatcatccttagcagtaacacgaagagaagcacgggcaatgagaagacgtagagacaggctattaaaacggaaggcaagaatgatgcgaacattaatagaatatggattctttcctgcagaagcagcacaaagaaaagcacttgaaacaataaaccctttcgctctacgagcaaaaggtctagatgaagcactaaccccagctgagttcggcagagcgttatttcacataaatcaaagacgaggattcaaaagtaacagaaaaacagacaaaaaggacaatgattcaggggccctcaaaacagcaataggcaaagttagagcaacaattgaagcagaaggatgtagaacagtaggggaatggttacacaagagggatgtagccggtttaacagttagagcacgataccaccaagacaaagttataaaagaagacggaaaaacaaaaattgataaatactatgatttatacattgatagagcaatgatagaacaagagttcgacgaactttggaaaaagcaagctgaattaaatccagcattattcactgaagctgccagagctgacctcaaagacgttctactacatcaacgaccacttaagcctgtaaaaagtggacgatgtacttttatgcctgacgaagaaagggcacccctagccctaccgagtacgcaaaggtttagaatgtaccaagaagttaataacttacgcatcctccgagatggattaaaagaggagcccttaacattaaaacaaagggatgacttaatagcggcattggagaaaaattcaaaacattcattcacacaaattaaaacactattaggtgtaggaggtgcagtacaatttaacttcgaagatttaaaacgacaagaactaaagggaaacacaacgtcagcaatactaagcaatgataaacattttggcaaagcatggtttacatttgatgaagcaaagcaagacgcaatagttttacaattagtaaaagaagaaaatgaagcaaaattagtaaggtggttacaagatgaaaccggaatagacgagaaaagagccgaagcaatagccaacgtaggtttacctgaaggatatggtagcctttgtgcaaaggcgctcgccagaatactaccagaattacgaagagacgtaatgacttacgataaggcggtacaagcagctggattcgaacaccatagcagattagggtcaaatactgaaattccggggctaacctttaaaatagaatcgatagatcaagactcaggagaagtaaaacaatttcacattcataaagtactaccctattatggagaatacctacaacgacatgtcgggttcggcagtggagaaccagaagacccggctgagaaaagatacggaaaaatagctaaccctaccgtgcacataggattaaatcaaataagattagtagtaaatgcactgttaaagagatacggacacccaagtgaagtaatagttgaattagcaagggatctaaaacaaagtaaagaccaaagggatgaagaatccaaaagacaagcggaaaaccagaaaagaaataagagattaagagatgcaatagcgggaacattgaaaatatcagaggaaagagtacgaagggatgacatacagaaaatgatactatgggaagaattatcatttgatccagccgatcggagatgtccatattctggtgcacaaatcagtgctacaatgcttctatcagacgaagtagaagtagaacatattttaccattttcacaaactctcgacgactcattaaataataagacagttgccttaagacaagcaaataggataaaaggaaatcgcacaccttgggacgcgtttggagcgcaagcggtagcaggatttgattatgaaagtatattagttcgagccgaagggatgccaaaagcaaaacgatatagattcgccgaaaatggatatcaaagatggctaaaggatgatgcgtcattcctagcacgagcattaaatgatacgagacatatgtcaaaagtcgcttttgaatacttaaaattgatttgtcccaatacgagagtaataccaggcagaatgacagcaatgttacgggcgaaattcgggttaaatgatgtactaggactaaacggagagaaaaatcgaaatgaccatagacatcatgcagtcgacgcatgcgtgatcgctgtaacagaccaaggattactacaaaggtttgcaaaagcatcggctagcgcaagagaacaacaattaaataggctagtggaaaatatgcccttaccatggggatcatatagagaacatgtgcaaagagcaataaatgcaatatggatatcgcacaaaccagaccacagtcatgaaggcgcaatgcacaacgacacagcgtatggcttgagaggagatggaaaagtgtcttttcataagatggtagaaggagtgagaacacacagcgaagataatttaaaggtaattgaaatcagtaatgcaaaagcaacggaccgacacggactcctcccaaatggagaaccaagaccctataaaggctacaaaggagacagcaattactgtatagaaattgtaaggaatgaaaaaggaaagtgggaaggtgaggttataagcactttcgaagcatatcaattagttagggaacatggaatcgcacgcctcagacattccacactttcagtaagcggaaaactattagtcatgaggctcatgatagatgatgtagtaagactaattatagatgaacaaacccgtacaatgagaatcgcaactttaagcggaaatggccaaatatttatggcggatacgtcagaggcaaacgttgatgcaagaaacagatcaaaggaagaaacatttgcgtatgtatctaaaatggccgggagcctacaaaaagctaatgctcgcagaattaacataagcccaattggagaactaagagacccgggtttcaaggaatga

SEQ ID NO: 8414 - RNA, 3114 nt, synthetic construct
  misc_feature 1..3114: note = Cas9 variant
  source 1..3114: mol_type = other RNA
atggaaaggatattcggttttgacataggaacaacatcaataggatttagtgttatagattattcaagtacacaaagcgcaggcaacatacaacgactgggagtaagaatattccctgaagctagagacccagatggtacaccgctaaaccaacaaagaagacaaaaacgtatgatgagacgacagctaagaagacgcaggataagaagaaaagcattaaatgaaacattacacgaagccggattcctacctgcgtatggaagtgctgattggcctgtcgttatggcagacgaaccatatgaattaagacggagaggtctggaagagggactaagtgcatacgaatttgggagagcaatttatcatttagcacaacatcgacattttaaaggacgagaattagaagaaagtgatacgcccgaccctgacgttgatgacgagaaagaagcagcaaatgaacgggcagctacattgaaagcattgaaaaacgaacaaactacactaggagcttggttagcccggagacctccatcagacagaaaaagaggaatacatgcacatagaaatgtagttgccgaagaatttgagagactatgggaagtccaaagtaaattccacccagcactaaaatcagaagaaatgagagcgagaatcagtgatacaattttcgcacaaagacctgtcttctggcgtaaaaacacactcggagaatgtagatttatgccaggagaacctctatgtcctaaaggttcttggctatctcaacaaaggagaatgctagaaaaactcaataatttagcaatagctggaggtaatgcaagaccacttgacgcagaagaaagagatgctatactaagcaaactccaacagcaagcatcaatgtcatggcctggtgtgagaagcgccctaaaagcactgtacaaacaacgaggagaacccggcgcagagaaaagtttaaaatttaatttagaattaggaggagaatctaaactattaggaaacgcactagaagcaaaacttgctgatatgtttggacccgattggccagcacaccccaggaaacaagagataaggcatgcagtccatgaaagactatgggcagctgattatggcgaaactccagataagaaacgagtaataatattatcagaaaaagataggaaagctcacagagaggcagctgcaaactcatttgtagcagattttggaataacaggtgaacaagcagcacaattgcaggctttaaaactaccaacaggatgggagccctattcaataccagcacttaatttatttctagctgaattggaaaaaggagaaagatttggagccctagtaaacggcccagactgggagggatggcgaagaacgaactttccacacagaaatcagcctactggagaaatactggacaaattacctagtcccgcaagtaaagaagaaagggaacgcatctcacaactaagaaaccccactgttgttaggacgcaaaatgaacttagaaaagttgttaataatttaataggactatatggaaaaccagacagaattagaattgaagtgggtcgagatgtcggaaaaagtaaaagagaaagagaagaaatccaatcgggcataagaagaaatgaaaaacaacggaagaaagcaacagaagatctaatcaaaaatggtatagctaatccaagtagagatgacgtagaaaaatggatactatggaaagaggggcaagaacgttgcccgtataccggtgatcaaataggatttaacgcactctttagagaaggacgctacgaggtagaacatatatggcctagaagcagatcttttgacaattcaccacgtaataaaacactttgtagaaaagatgttaatatagaaaaaggtaacagaatgccatttgaagcattcggtcatgacgaagatagatggtctgccatacagatacgcctgcaaggaatggtaagtgcaaaaggaggtacaggaatgagtccaggaaaagtaaaaaggtttttagccaaaacaatgccagaagattttgcagctagacaactgaacgacacgcgatatgctgcaaaacaaatattggcgcaactgaaacggttatggcctgatatgggacccgaagcgccagtaaaagtagaagcagtaacaggacaagtaaccgcacaactaaggaaattatggacactcaacaatatattagcagatgacggtgagaaaacaagagcagaccatcgacaccacgcaatagatgcgttaacagttgcatgtacgcatccaggaatgacgaacaaattaagtcgatattggcaattaagagatgatcctagagccgaaaaaccagcattaacacccccttgggatactataagagcagatgctgaaaaagcagtatcagaaatagtagtaagccacagagtcaggaaaaaggttagcggaccattgcataaagaaacaacatatggagatacagggacagatataaaaacaaaatctggtacatatagacaatttgttacgaggaagaaaatagaatccttgtcaaaaggagaactagatgaaattagagacccaagaattaaagaaatagtagccgcgcatgtggcaggtcgtggcggtgatccaaagaaagcattcccaccatatccgtgtgtgtcgccgggtggaccagaaatacgcaaagttcgattaaccagcaaacaacaactgaacttgatggcacaaacaggaaatggatacgcagaccttggtagtaatcaccatatagcaatttatagattacccgatggaaaagcagattttgaaatagtgagcttattcgatgcttcaagacgacttgcacaacgtaatccaatagtgcaaagaactagagcggatggcgctagctttgtaatgagtttggcagcgggtgaagcaatcatgattccagaaggctcaaagaaaggaatctggatagtacaaggagtctgggcaagtggacaggttgtattagaaagggacacagatgcagaccattctacaaccacaagaccaatgccaaatccaatattaaaagatgacgcaaagaaagtctctatagatccaattggcagagttagacctagcaatgattga

SEQ ID NO: 8415 - RNA, 3117 nt, synthetic construct
  misc_feature 1..3117: note = Cas9 variant
  source 1..3117: mol_type = other RNA
atggcaaaacaagtaagatatcgacttagtctagatcttggcagtactagcttaggatgggctatatttaggttagacgctgatgcccatccaacagcaattatcaaagcaggagttagaatttttagtgatggaagaaatgctaaggatggtagttcattagcggtaacaaggagagcagcaagatcaatgcgaaggagacgagatcgtttactcaggagaaaaacaagaatgctcgacgcgttattggaatacggctttttcccacaagacgcagcccaaagaaaagcattagaaagactaaatccgtatgcactcagagcagaaggactagcacgaccactaaccccaggagagttcgcaagagcaatttttcatctcaatcaaagaaggggatttaaatcaaatagaaagactgataagaacgataatgattctggtgcattaaaaacagcaacatcacaactcagacaagatattcaagcctcgggatgtcgaactgtaggagaatggttatggacgcagagattacaaaagaaacccgaaggtgtaccacatcaaggcgtaagggctagatatagagaaacccctcatattaactctgaaggaaagaaaagaatagaaaagaaatatgacttatatattgatcgatcgatgatagaagcagaatttgacgctttatggtcagcacaagcaacgttcaacccagtggtatttcatgcaacagctcacgaaaaattaaaagacatattgttatatcaaaggcctttacgaccagtaaaacctggaagatgcacgctattaccagaagaagaaagagctcccctagcgttaccaagtacacaacgctttagaatttaccaggaattaaataatttaagactattagtagatcaactgaacgaacagccattaacattagcacaacgagatactattgcaacactaatggaaggaagggctaaaatcagttttgaccaaatacgcaaagcactaaaattaggttcgatgacaaaattcaatctggaagacgataaaaggaacgaattgaaagggaatgcaacaggaagtcaattggcaaagaaagaatttttcggccccgcttggcatcaatttgatgaagcactgcaggacgatatcgtgtggcatcttctctcagaggagaacgaaagtgcacttataagttggctacaggatcgaacgggtattgacgcagctacagcccaggcagtaagcaatgcatctctacctgaaggatacggttctctaagtaggaaggctttagaggtaatattaccaagactccgttcagaagtaataacgtacgataaagcagtacaagctgcaggttttagccatcattctcaactgggtttcgaatacgatccagacgatgtagaagattggatagaccatgctacaggagaagtgaaacctatctttaaaagacttccatattatggaaaagcgctacaacgacatgtggcatttggtagtggaaaaccagaagactcacaagagaaaaggtatggtaaaattgcgaacccgacagtgcatataggtttgaaccaagtaagagttgtcgcaaatgcattaatcgcacggtacggacgaccaaccgaaattataatagaactagctagggatcttaaacaatcaagagaacagagacaacaagaccaaagaagacaagcagataaccaaaaacgaaacgcacgcataagaaattcaattgcacaagcactaggaatagcggaagcaagagtaagaagagaagatatacaaaaatggatattatgggaggaactagatccaggcgatgcaatgcatagatgttgcccatacagtggagttccaataagcgcaagcatgttactatctgaacaagtagagatagagcatatcttaccattcagcatgacgctagatgacagtctaaataaccgcacagttagcttaagacaagcgaatagaataaaaagaaaccgatcaccatgggacgcacgagaagattttgaggcacaaggatggcactatgatggaatcctacaaagggcaggtttaatgcccgtacaaaaacgttataggtttgcggccgacggatatcaacgatggttaagagatgatcaagactttctagcaagagcactaaacgacactcgatatttaagcagaatagcggcagaataccttagattagtatgtcctcagggaacaagggtaataccgggacaactaacagcattactaagaagaagatttggattaaatgacattctaggtttagaaggtgagaaaaatcgaaatgaccataggcaccatgcagtagatgcatgcgtaataggtataactgatcatggactaatgcaaagattcgccagggctagcgcacaagcacgtgaacaaggcctaacaaggttagcagaagaaatgccgctcccatggcctacatatcgagatcatgtggatagggccgttagtttaatatgggtatctcataaaccagatcacggacatgaaggcgccatgatggaggaaacagcatacggactgatgaaagacggaactatacgacagagacataaagcagatggaaccaagggacgtgaagtagctaatgtaatacgtatagcagaaccagcccaaccaacaagacacggagtcgatgatcaagggcgaccactgccatataaagggtatataggaggtagcaattactgtatagaaataacaagaggagcacaaggaaaatgggaaggtaccgtaatatcaacctctgacgcttatggcatagtaagagcaagaggtatagcaggacttagaaacacaagtcaaggccagaacggtcaccctctagttatgaggttagtaattggcgactccctaagactacgaataaacgatgcactacaaacgatgagagtaacaaaaataagcggcaatggacaagtatttatggcaggggtacacgaagcaaatgttgatgcaagaaatagagataaaagtcaagcctttgcattagtatcaaaaatggccgggtcactccaggcagcccaagcgcgacaagctactatatcaccaataggagaaattcgcgatccaggatttccaggatga

SEQ ID NO: 8416 - RNA, 3120 nt, synthetic construct
  misc_feature 1..3120: note = Cas9 variant
  source 1..3120: mol_type = other RNA
atgaaaaaaaggatattgggactcgacataggtatagcatccgtaggatgggcactgatagaatttgacgacgaatttcaggacaacaaaaaaaaaggaacaataataaaatcaggagttcgaatattcacaagagccgaaacacccaaagaaagagaacctttagcaaaaccaagaagagaagcacgatcgcaacgtaggagaatctcttgtcgagttgaaagactgaatttcgtgagagaactctttgtaaaaaacggactcgtagctaaagaatcagtaaacaagaataacccaaataacatatacataactctaaatcaaataaaaacaccatggcaactcaggatggaagcactggacagaaagctaacaaatgaagagttcgcggtagtcctaacacacctagccaaacatagaggctacaaaagcctaagaaaaacagactcaaaagataataaaacaggagaaatgttaaaggcaatcaaccaaaataaagaaaggttagacaactccgactaccgaacactaggagaaatgttttgcaaacatgagtcctacaaagaacacaaacgaaataaagatggggaatacattaattcagttacgagagaactaatagaagaggaagcagaaaaaatatttgcaaaacagagaaaagaaggaaacaactttgcagacgtagacatagaaagagaatatttaaaaatagcattttcacaaaagcctacaggaagcataaacaaaatggtaggtttttgcacattcgagaatggagaaaaaagagcacccagagatagttactcagcagagctattcaaagtactcaacactatcaacaacaccacaataactgatatgaaaacaggagaaacaagaaatttcacaggagcagaaataaaaaaaataatcgaaataataaaagacaccaaaggcatcacatacgtaaaaataaaaaaagaattaaaactaggaagttcacaattttctggcgtagattaccgagaaaatgcaaaatcaaaaggagaaggagaaatcttcgtctcaatgaaaacatatcatgagatcaaaagtaaaatagaaaaattatcaaaagagaagtggaataaactaaaagaaaacacagaactactagacagcatagtcaacataatagccaattttaaagacgatgaaagtatcaaaaaagagttccaaaaattaaaaattgatgaagacataatagatgtacttctaaattttgagtttaagaaattcataaacttatcttttaaagctttaagaaaaataatacctttccaattccaaggacaaaaatacataacagcatcaatgagtgttggatacagcttaaaacaagaagggatcaaaaataaattcttaagggtcccatcacaagaagaaaatgtgaatgtaccagtagtggcaagagcattcgcccaaacaagaaaggtgataaacgctgtgataagagaatacggtcaattcgatcagataaacatagaacttgcaacggatctaaaaaatagcaaattcgacagaagcaaaatagaaaaaggacaaaaagagttccaatctcaaaaagacaaagtcttccaagaagtccaagatctaacaggtgaaataataccatcctcaagcttattacttaaatatagactctggagagaacaagatgaaagatgcatatactcaggaagaaaaatctcccgaaaagacctcttagataccgggtttctagatatagaccacatcataccatattccaaatcaatggacgacggtttcaacaataaagtactctgtttagcggaagaaaatagaaacaaaaaaaacgatatcccctttaattactaccaaaggataggacgcgattggaacttcttaatatccataattgcctcgatgaaaaacatgaaatatgtaaagaaaaaaagattactaaagcaagaactcagtgatatagaaatagaatctttcatagaaagaaacataaacgatacaagatacgcaacaaggtacataaaaaatttcttagaaaacaatctagaattcaaagaaaacgaattcatcaaagcaaaagtacaagctagacatggaggattaactagcgtactacgatacaactggggaatatcgaagaatagggaagaatcatacctacaccacgcaaaagatgcaatcacagtagcatgttcaacgcaaggcatggtacaatatatatcaaatataagccaaaaatacgaaaacgggaaatataaaatgaaacaaataaaagaaagaactgagaacagaattcccaaaccatgggactcattcaaagacgacgtcgaacgctcaataaatgatatattcgtctcattcgccccacgacacaaagtcacaggatccgcccacaaagagactatatacagcaaaaaacacctagaaaaaggctacgttacaatcaagaaatctttagacaaaataaaattatcagacctaaaaaacataccttgcgatgaaaattgcgatataatacgggtcctaaaagaacggctagagaaatttaacgacgatagcttaaaagccttcgcagaccctgtacatatgccaaccaaatgttcaaataaaaaaggcccaataataagaagtgtcaagataaaagaaaacaataagacaggtatcgaagtaagaaaaggattagtagagcgaggagacatggtacgagtggatgtatttataaaggacaagaagtattatttagtaccaatatatgtatcggactttaaaaataaagatctgccaaataaagccatagtaagcagcaaaagcgagaacgaatggatcatgatagacaaaacctactcattcaaattttcattatttaaagatgacctaataaaaataaaaaataaaaaaggtgaaatatttggatatttaggcggtgtacacagactcacgggcggcataaacataaaatcatgctataaaccaaaagaaaaagacggcaacataggctcaaaatgtctactcgacttcagaaaattccaagtaggaatactaggagattacaatgaggtaaaacacgaaaaacgaatgcctgcctacataaacaccaaaaaagacaaagaacattga

SEQ ID NO: 8417 - RNA, 3123 nt, synthetic construct
  misc_feature 1..3123: note = Cas9 variant
  source 1..3123: mol_type = other RNA
atggataggagagatgcaagagcaatgagaaggagaagggatagatttcagcagcggcaaagagctttattaaaataccttgtggctgacggattattcccggaagatgaaggagaacgcaaggctttagcagctctagacccgtatgcactaagagccagagctctagacgaagcattgagtctgcacgagcttgggagagcattatttcatttgaaccaacgacgaggatttaaatcaaacaggaaggcagatagaaaagcagacgatgatgcaggaaaaatagcgataggtgtggatagagcaagagaagccatggcagagaatggggctcgaacttacggagaatggctacacagaagacgagcaagtgcaacggacgcaaatgcaattccaccagtcagaacaagattacgaccggaatcaggagaagatgccaagggagatggatatgacttttatcctggaagagaccttcttgaagaagaatttgcagcaatatgggaggcacaagcagctcatcatccagatgtgctaacagacgatgtctatgaaaggttattcgagatagttttctatcaaagaccactgaaggctcctcaaatagggatgtgtacgctaatcgctggtgataggcggttaccaaaggctcatccattatttcaaagaagaaggctactagaagaattaaatgcattaatgattgtacgtcctggagaggtagcacaaagattaacgagagaagagagggacacattatttcttaaactaaaagatagaaacaaagttagctttgaatcattaagaaagactttaaaactagatcctgatgccagatttaataaagaatctgaaaatagaacagagttaaaaggagatgaggtagcagcagcaatgggttctaaaacacgatttggtaatagatgggtacacttgagtattgaagaacaatgggcagtaatagaaagacttggagatgttgaatcggatgccgaggatgcagctttcagggcatggctcgcagaaaggtatgagttaactccagaacaaacaagagctgttacaaatgcgccactaccccaaggttatggccgatttggtgaaacagcaacaagaaaattaatagatgcactgagggatggagagaaagacggccgagtgctagtatatagtgaagcagtaaccgcagcagggttaggccatcattccgacagaagaacaggggaagtcttcgaagatgaagaaggaaggcctcagttaccttattacggtgtagccttagaaagacatataatgccaggaactggagatccatctgatagtgacgagatgagagtaggaaggctgactaacccaacagttcatataggcctaaaccaattgaggagaatcgtaaatagattaatcagagcatatggtccaccggcagaaatagctatagaattagctcgagaattaaaattgactgacgaagataagaaaagaataaacaaagaaaacaacagtaataggttagatgccgaacgtcgatcagaaaagttattggcgataggtaaaccagacacaggggctaatagggcactattgaaattgtgggaagaattaaatccagcaaatgtattagacagacgctgtatatactcaggagtacaaatcagtatagacatgttattttcagccgcggtagaagttgatcatatactcccatttactgctacgttagatgattcgaacggaaataaaatagtatgtactcgagaagctaaccgagaaaaacgtaaaagatcaccttatgaagcgtggggacatagcgcgcgatgggaagaaatagcagcaagggcggcccaattaccaagaaataagcgttggagattcgaaccggatgctatggaaaaatttaaagatgatggaggctttcaggctaggcatttaatagacacacaatacctggcaaggctctcgcgagagtatctggcaacattatatccagacaaaggagaagggtcaggccatatatgggtaagtccagggagattaacagaaatggtaagaaggaagctgggattgaacgatctattacccgaccataatttcggtggcggtgctgatcaagccaaaaatagattagatcacagacatcatgcaatagatgcagtagtagtagcaatagttgatagaggaatgctgaatagaatagcaagagcaagcggacaagagggcgcagaaggcagggaaagaattatcatcccagaaccttgggaagggtttagagatgatctgagaaccgcagtaaacgccataacagtttctcacagaacagaccatggaacagcatctaaggcaggtttgccaaaaggaaaagatgcaacagctggacgattacacaatgacactgcctacggatttacgggggaatcagacgcaaaaggaaactcaatagtagttaggcgagttcctttatccagttttaagaaacttgccgatatagacagagtacgcgatcccgaattgaaagcggctttataccaacatctcgacgggttagaaggaaaagcattcgaaaaggcaataggagaatttggaagtcgagaatggcacccatatggaggagtaagaagggtaagagtaactgaaccacttagcgtaataccaatccgcgatagaaatggacatatttataagggatacaagggcgattctaattaccgatatgatgtttgggagttacccggaggaaaatgggtaaacgaggtggtatcgatgttcgatgcacatcaaccgggatggcaaagtgcaataagggcagcaaatcctacagcccggaaagtcttaagtttacatagagatgatgtgctggcaatagaaagaaacggcgcggaaagagaattagtacgagtggtaaaattttcagaaaaacaattcgcggtagccccaccaaatgaaggtggcgcactaaaagcaagggatgcagataagggggacccctttaaatatagctatccatcgccgaatacattaaaagcgttaagggcaaggcaagtcagaatagatgaacttggaagagtgttagatccaggattcccagcacgaacaaaacagcgaaaaacaagaaagccaaattga

SEQ ID NO: 8418 - RNA, 3132 nt, synthetic construct
  misc_feature 1..3132: note = Cas9 variant
  source 1..3132: mol_type = other RNA
atgcaacgagataacccgttagtctatcgattagcattagaccttggaagcacaagtttaggatgggcggtatttaggttagatgcagaaggaagcccgctagcaattataaaagcaggagcaaggatttttagcgacggccgaaatcctaaagatggtagttcattagcagtaacaagacgagccgcaagagcgatgagacgacggcgtgatagattacttaaaagaaaagctagaatgctaggtgcattagaaagacatggtttctttccacaagatgaaagtgcaagaaaagtcctagaaacgctgaacccttttctattaagagcacaaggtttagaagttgcactgaaacctgaagaatttggacgagcactatttcatctaaatcaaagaaggggatttcaatctaacagaaaaacagatagaaaggactcagatagcggtgcattaaaacaagctataggtacattaagagctcaaatgcacgaatcaggatgcagaacagtaggcgagtggttttggaaagtacggatggaacacaaaccagagggtgtaaaaggacaaggtgtaagggcaaggtatagggaaactccatttactactgatgaaggtaagaaaagaatagataaaagatatgatttatacgttgatagagctatggtagctcaagaatttgacgcactgtgggctgctcaagcggcattcaatcccgcgttatttaatgaagccgcacgagcagaattaagagatatcttgttacatcaaagaaaactaagaccggttcaaccaggaagatgtacattggtaccagaggaacctagagctctacttgcgctaagcagtacacaaagatttagaatatatcaagaggttaatcacttaagggtcctacatgacgagctaagagaagagacacttactctagcgcaaagagaccagatcgtcgcactactagaaaaacaagctaaagtgacattcactgccatgagaaaggctttgggcttctcggcactatttaatctagaggacgccaagcgagatggactaaaaggaaatgctacagcggctgccttaagcaagaaagatttatttggaccgttatgggcaggatttggaacagcactgcaagacgaaatagtaacacaactaatgactgaggaatcggaaccccgtcttattgcatggcttcaagaacacaccggagtagatgaagcaagagcacaagcaattgccaacaccggacttccggaaggatatggatccttagggagaaccgcattagcaaggatagtaccagaactacaaagagacgtgattacctacgataaagccgtacaagctgcagggttcgctcaccatagcgatttagggttttcatttgaacacggagctgatgaagtagaaaggataggggaaaggaccatagcatcaaccggagagattaaaccggttttcgcctttaaacagttaccatattatggtcgagctttgcaacgacacgtagcatttgcaaaagataatcctagaaatgacgaagaaagatatggaaaaatcgcaaatccaacagtacatatagggttaaatcaagtcagagtagttgtgaatgcattaatgagaagatatgggcgtccggcagaagtagtgatagaattagctagggatttaaaacaaagtagggaacagaaacttgaagcacagcaacgtcaagcagacaaccagaaaagaaatgccagaataagaagaagcatagcggaagttttaggaataagtgaagaaagagtaaggacactagatatacaaaaatggatactatgggaagaactttcacatgatgcagcggatagaagatgtccgtactccggagtacaaatatccgccagtatgcttctaggtgaaagagtagaaatcgaacatatattaccttttagtatgactttagacgatagtttaaataatagaactgtagcgcttcgagaagccaatagaataaagaggaacagggcaccctgggaagctcgtgcagacttcgaagcccaggggtggagttatgacggaattttgcaaagggccgaaagaatgccgctaagaaaaagatacaggtttgcaccggatggatatgagaggtggctaggagaagacaaagattttctagcaagagcattaaacgacactcgttacttgagccgagtagccgcagaatatcttcggctagtctgcccaggctcagcaacacgggttattccaggccaaatgacagctttactaagaggaaaatttggtttgaatgacgtactcggactagatggagagaaaaacagaaacgaccataggcatcatgcagtagatgcatgtgttataggcgtgacagaccaacgaatgatgcaaagattcgcgcaagcaaatgctcaagcaagagaagacggtctaacaagactcgtagaagacatgccactcccatggcccacatacagagatcacgtagaaagagcagtacatcatatatgggtgagccataaaccagatcatggatttgaaggtgctatgatggaagaaactagctacggaatattaagagacggaagtataaaacagcgacgaaaagcagacgggtcagctggcagggaaataagcaatctaataagaatagctgaacctgggcaaccccaaaggcatggagtagacgcagaaggaaggccacttccatacaaaggatatgtaggaggaagtaattattgtatcgaaataacagtaaacgacaaagggaaatgggaaggacaagttataagtacatttgatgcatatagaatcgtaagagaaggaggtttaaggcagctaagacacccaacacaggggcaaaatggtagagctttagcaatgcgattagtaataggagactcagtacgtctagaagcaggagaggggtcactccaaactctaagagtagcaaagatgagtgcagcaggacaagtattcatgagcgaagtgaatcaagccaatgtagatgcacgaaatagaaacggtgatttgccatatgtaagtaagatggcaggttcttttcaaaaagctagagctagacaggtaacaatcagccctatcggagaattaagagacccaggatttaaaggatga

SEQ ID NO: 8419 - RNA, 3135 nt, synthetic construct
  misc_feature 1..3135: note = Cas9 variant
  source 1..3135: mol_type = other RNA
atgaaatataccctcggcctagacctaggctacaatagcatcggatgggccatcctggaaaacgacgaaaacggaagccccatcaaattattcaacgcaggtgtccacatattcgaaccatcaattgaagacatagaaatagatggtaaaggaaaaacaaaaaatgtcaaaagaagagaggcacgcctgagaaggagacagttattcagaaagacaaagcgacttgaaaaactcttaaacttttttatacaagaaggattcttccaaaaccaaaaggtattaataaatgatcctttcgaaagagcagaattcctatatcaattagacaaaaagtccagaaacccttatatattacgcagagaggccctagacaaccgattatccctcgaagagatagcacgaatcttctaccacatagctcaacacaggggcttcaaaagtacgaaaagagagttagcagaaatgaacaaagacgaaaaaaaaaaaaaggaagacggaatcatccaaagtgaaataaacacattaaaagaagaaatcaaaaaaaactcatgtcgaaccctaggcgaatactttgctaaactattcgagaatggcgaaaaaatcaggggaagacacacagaccgaaaaatgtacgaagaagaatttcaaaaaatatttaacaaacaaaaagaattttacccaaacatatttacagatgaattcaaaaaaaaactatacaagctaatatttcaccaaagagaactaaaaagtcaaaaagataaagtaggattctgcagcctcgaacgaggtaaaaaacgcgctccactagcactgcttgtatcacaaagatatagatacatgtgcaaagtgaacaaccttaacgtcatagacacggaaacaggagagaacagagaactaacggtcgatgaaaaaaagaaattatacgaaaaactggaaaattcagaaaaactctcatttaaagaaataaaaaaaatattaaacctgagcgaaaagcgatacatattcaacttggagaaatcggaaaaatacatcataggtaacaaaacaaatgtaaaaatgaaaaatataataaaagactgggacaacttcgatgaagataagaaaaatttcttcatcaatgaagcaagaacagtagttaaaattgaaactttagaacgacgaggaaaaaaattagggttgtcagatgaagaaagcaaagaattctcaaaagtagtttttgaagatggttatctcaactttagcaaaaaagcagttgaaaaactgttaccttatttaaaagaagggaaaaaagaatatgaggccataaaattagcatacccagaaaacagcgtacagaacgacaacctaaaagaactagattttttaccacccataaagagtaaagaactcaaaaaatatttcgaagtaagaaacccaatagtagaaaaagcattaacagaaacccgctatctagtaaacttcctaataaaaaaatatggcaaaccagaaacaatcaagatagaattagcaagagagctaaaactaagcaacaaacaaaaagaaagaaaacataaagagaaccaagaaaaccgaaaaaaaagagaagaagtgatagaaaagttaaaaaacgacctaaaaataagtgaacccacggaaacacagattcaaaaatatctgttagcagaagaatgtgactgtaaatgtccatataccggaagaagtatcagcatggacagcctgttcggagaacacccactgtttgatatagaacatataatcccattcgatagatcactcgacaacagcttcctcaacaaaacattatgttattcagaagagaaccgtaaagtaaagcacaataagacgccatacgaagcttactatgggaccgaaaaatgggaggccataatcgaaagagtaaaaaaattcaaatccaacgtaagaaacgaaaaactaagaagattccaaatgacaaaagaagacgtcgagaactacatacaaaactttagcactcaaaatttaaacgatacaaaatatgcatcaaaacttgcaaaaaaatacttaggccttttatatggttccataaacgaagacggaatagataaaaatagaaaaagaagaatattcgcaagttcaggtaaagtaactagcacactaagatatgcacttggactgaatacaatactcaatgacgaaaatataaaaactcgagaagaccaccgacatcatgcaatagacgccatcacaatagcgctcacagacagttcaatgataaaaaaaatttcagatgcctcaaaaagagagaagaatataaacagcctattcaaagatttccaagcaccctgggaaaatttccgaaaagaagtcgaagagataatcgcaaagatgaatatctcaataagaatcaacaaaaaagtttcaggtcaaatacacgacgaaacgttctataaaaaaccatttaaagaagaagaaaaaagctacactcatcaacgaataaacttagaagaactgacaataaaagacgaagacaaaaaaaaacaaagctcaaaactaatagacaacatagtggactcaaaaatacgtaatatcatcataaacagtttaaatggagaaaaaccaaaaataagatttaaagatcccaaagatcatccatatataatccaaaaaaacggtaaaaaaattcaaattcacaaagtcacgattaaaaccaaattggagacatacaacgaaataggaccagaaaaagcgaaaagatacgtaaaatcctccgactcgcatcatatagaaatatttgaagacttaaagacaaaaaaatgggacggttatgttgtaagcctactagaagcatacgaaagaaaaaaaaaaaaactaccaatcgtgaataaaaacttaggtgaaggaaaaaaattcctattcagcttagcgaagggagaaataatagaactagatacagaaaacggaaaaagagaattatttgtcgtgcgcataatttcagcgagcaacaatcagataaagtttacaagaataaatgactcaagaaaaataacggacatacctgctacaggtctaacggcctgcccaagcagcctaaaaaaaagaaactgcaagaaagtagtcattaatatattaggagaaaaacactacagcaacgactga

SEQ ID NO: 8420 - RNA, 3135 nt, synthetic construct
  misc_feature 1..3135: note = Cas9 variant
  source 1..3135: mol_type = other RNA
atggcggaaaaaaaatttaaataccgactaggacttgacttaggaacaaactcaatcggatggtgtatgttaagattaaacaaagacaacgaaccagcagcagttataaaatcgggagtcagaatattccacgacggcaggaatgaaaaaaccaaggaaccactagcagtagtaaggagaaatgcacgcagcataagacggaacctagacagaaaaatatccagacgaaatcacctcctaaatactcttgtcaaatactttctcttaccaagcaacgaaatcgaaagaaaagccctagccgtcttaaatccatacgaactacggagtagagcagtaaatgaaagactagaactttttgaactgggacgcttattaatgcacctttcaaagagaaggggattcaaatcaaatcgtaaagtagacaaagaagattctagcggaaaaataaaacctgcaatcgaacgactaaaaaataaaatgcaagaaacaaataaaaaaactgcaggagagtacctatactcccttatgcaaaatggaaaaccagttagagccagattaggaagaatagatggaagcaacggctacgaaatctacttagatagagccttaatagaagaagaatacaacttaataatgaacgagcagaaaaaacatcacaaggaattaacagacgacataattaacgaaatctttaacataattttttaccaacgccctctgaaaaaacaaataattggaaaatgttcattaacaggtgaagacaccaaactaaagaaagcacatgtcctagcacaagactttatactattgcaaaaagtacaagaccttcgagtatttgacgacaatcaacttgaatttagacctctctcgaatgacgaaaaagacataatcaaaagagaactacgaaaaaagaaagaggtatcttacgaaaacatacgaaaactattgaaaaaatactatgaaaatgtaaaatatggaatgttttcccatgaaaccctatataaaaaactacagggaaacaaaacaaatgcattaatgtcagacaaagaaatcattggtgactcatggtactctctatcgccagaagttcaatatgacatcatagaagaactctacagtgacaaagacaacgacgaattgagtaaactttacagtgaaaaatttaatctaaacgaaagtcaaatcaacggcttactaaataaagccatatatcgattagactccggatatataagatatggaaaaacagcagtaactaatctaaattccattatggacaaagataaccttaatctacacgatgccagagaagaagccggatacgaaaaagagaacaaacaagatgccagcgaatacctagagtactacggtaaagtattaccagacagtgttgtggatccacaaattgagaatcctaaaaatgacgaagaaagatacggcaaaattgcgaaccccacagtacatgccgcattaaatcaattaagaaaattagttaatgagctaataaaattatacggaaaacctgaacaaatagtaatagaactagccagagacctaaaaaactctcgaaaagcgaaggatgtaataaacaaaaaaatagcggaaaacagaaaattaaacgaagaagtagacaaaaccttacaggaatacagcgagaaatataacactcatattgtcaaaaacaaactcaaccgagataaagtaaaactatggcgtgaactagggaaagatcctctagaaagaaagtgcatatatacaggcgaacaaataaatatcgcaaaactatttagcgacgaagttcagatagaacatatagtgccatacagcaaaacattagacgattcatttaacaacaaaactctgagcatgaaacaagcaaattactacaaaggaaacaaaacgccttatgaagcctttaaagattccaaagatggatacaactatgatgacataatagccagagcaaaactgctgaataatgataacaaattcaaacgattcacaaaagatgcaatggatatatataatagggatggaaaagatttcatcgccagacaactatcagatactcaatatttaagcacacgtgcattaatctatcttcaaagtctatacgaaaaagcacaccattcttcgatatggacaataccaggccaacttacagcattaataagaaattatttaggtcttaacacactaataagtaatgacaaaaacaaaaatcgtaatgaccatagacaccatgctgtagatgcattcgttgtagcagtaacatcacgaagtttgttacaaaaaatctcatatgcggcatcactacaagaagaccttgacaaccgaaatgtttcgagttatagaaacaaactcctagaaaaaatgccggaaccctttccaaactacaggaaaagcctagaactagccatagacaatataaaaacaagtcacaaggcagacaggtctatcagcgggaagttacacgaagacacggcatatggtattgtcgaaaatgacgataaatacaacgtagtaaccagatggacagtagacaaattcaaagaacaaaagcattttgaaacaataagagataatgaactgaaagaaatagcgtgctcagacaaagaactattcgcgaaaatagtagaaacaaggaaaataaaaagtataagaaaactagccaaagaaaatccagtaatcaaaataaaagacaaaagtggacgagattacaaagcattcgcgggcggcaataacatatgcgtggaaatatacgaggtagatggcgtacgtaaaagcgaggtcatacaactattcgatgccgcacaaaaaggatttatgccagaatggatgaaaaaatatccaaatggcaaactattaatgagattatttaaaggagacgttatcggcttcatagaaaacagaaagtacaattactacactataaaaggcatcagcattgccgatcaaaacttaaagctactcgctatcaataaagcggaaggaatttttaagaaaggactaaacatactttttgactcaaacaacaaaaatagcttaaatgcaaaacaattcaatataagcgtaacaggcatagtaacaaaaaaaaaaaccgccgatgtaaacttctggaaaaacagaaaatga

SEQ ID NO: 8421 - RNA, 3135 nt, synthetic construct
  misc_feature 1..3135: note = Cas9 variant
  source 1..3135: mol_type = other RNA
atgttacacaaaatgagatataggttagcattggacctgggatcaacctccctcggatgggcaatggtaaggttaaatgcaaatcaacaaccctgtgcagtaataaaggcaggagtgcgaatttttagtaatggcagaaacccaaaagatggatcaagcctagctgtaactcgaagagaagctagatccatgagaaggagaagagatagacttctaaaaagaaaagcaagaatgatgagaaccttaatagaatacggattctttccagccaacgaaacacaacgaaaagcactagaaaatctaaatccatacgcattaagagccaagggattggatgaagctctaacgccaagcgaatttgccagagcattatttcacatcaatcagagaagaggatttaaaagtaacagaaagacagacaagaaagacagcgactctggagcattgaaaactgctataaaacagctccatagtgtattagacccacaaggtaatgacggaaaaccaagaactgtaggagaattattatataaaagatttacagacttgtcgaaactgccaaaagaccgaacggtccgggcaagatatagacaggataaaatagtaaaagacgacggaaagaccaagatagacaaatactatgatctgtatattgacagagcaatgatagaacaagagtttgatgccctatggaagaaacaaagtgaattaaatcccatacttttcacagaaaacgcacgtgccgatttaaaggatgtattattataccaacgcagcttaaaacccgtcaagcctggtagatgtacgtttatgtccgaagaagaacgagcaccactagctctaccaagcacacaaagattcagaatgtatcaagaagttaacaatctacggatactaagagaagggttaaaagaagagagcttaacactgcagcaaagagacgacttgataaatgcacttgagaaaaacaatagaaggacattcacacaaataaagaaattattaggtgtaggtggatcagtacaattcaatttcgaagatccaaaaagagaagaactaaaaggtaacacgaccagcgcaatcttaggaaaaagtgaacactttggggaggcttggtttgcctttaatgaagctaaacaggacgctatcgtactacaattgataaaagaagaaaacgaagctaaattagttcgatggctgcaagatgaaacaggaatcgatgaaaagagagcagaagtaatagcaaacgcggggttaccagaagggtacggtagcttgtgcatagaggctttagcgagaatactccctgaattaaggagagatgttgtaacgtatgataaagcagtccaagcagcaggattcgaacatcattctaagttaaatcgaaatgaagaaataccagatatcacgtttaaaatagaatctattgatagaaatagcggagaaatcaaacaatttcatttacataaagaacttccatactacggagaatacttacaaagacacgtaggatttggttcaggaaaacccgaagactcaatagaaaagaggtatggcaagatagccaatcctacagtacatataggactaaaccaagtacgtgtagttgtgaatgccctcataaaacgatacggacacccatcggaaataatagtagaagttgccagagatctaaaacaaagcaaagaccgcagagatgaagaaaataagagacaagctgaaaaccagaaaagaaatgaaagattaagaaaagatattgcagatatacttgggataagtgaagaaagagttagaagagatgacatagagaaaatgatactatgggaagaattaagtttcgatccagcagatagaagatgtccatacagtggcgttcaagtaagtacagtcatgcttttatcggacgaagttgaagtagaacatattttaccattctcacaaacattagatgatagtctcaataataaaacggtagccctaaggcaagcaaacagaataaaaggaaatagaactccatgggaagcattcggaactagcaacatcagcggctttgattatagtgggatattaacaagagcggaattaatgccaaaagcaaaaagatatcgattcgctgaagatggctaccaaagatggttaaaagatgacgcaggatttctagcaagagctctaaacgatactagacacttgagcaaaatagctagggaatatatgagtctaatatgccctaatacaagagtaataccaggacaaatgacagcaatgttacgacgtaacttcggtttaaatgatgtactaggattgaatggagagaagaatagaaatgaccatagacatcacgcagttgacgcatgcgtaatagctgtaaccgatcaaggtcttctacaaaggtttgcagccgcatctgcaagtgcacgagaaagacaattaaatcgtctcgtagagaatatgccactaccatgggaaagttatagagagcatgtacgtagagctattgatgggatatgggtaagccatagacctgatcattcacatgaaggtgcgatgcataatgatacggcttatggattacgaggaaacggtagagtatcatttcacaaaatggtggaaggaaaaagagaatacatagaggacaatctcaaagtaatagaaataactgacaccaaagcaatagatagacacggcttattaccgacaggaaaaccacgaccatataaaggatataaaggggatagtaattattgtatcgaaatagtgaggaatgagaaagggagatgggaaggtgaaataattagtacattcgatgcttatcaattagttagaaaatatggaattgtacaattaagatatcccgtattatcagtatcaggcaaaccattggtaatgaggctgatacgtaatgactttgtaagactagagcatgaaggaattacaagaacattaagagtctgtaaaatgagggaagacggacaagtcgcattagcagatgtaacagaagcaaatgtagatgcaagaacacgaacaaaagaaatatgttacgtattcaaaacgggagggagcttacaaaaggctaaagcccgcagaatcacaatatcaccaataggcgaattgagagatccaggattcaaggaatga

SEQ ID NO: 8422 - RNA, 3138 nt, synthetic construct
  misc_feature 1..3138: note = Cas9 variant
  source 1..3138: mol_type = other RNA
atgcaaaaggagaaaccattagcatatagactagcattagatttaggatcaacaagtttgggttgggcagtgttgagacttagcgcaccaggagaaccatcggctgtaataagagctggtagtagaatattttccgatgggagaaatcctaaagatggaagcagcttagcggtcacaagacgagcggcaagagccatgagacgaagaagagatagactcttaaaacgaaaagctaggatgttagcagctttagaaagacacggtttctttccacaagacgaagctgctagaaaagcattagaaaaactcaacccttatggactaagagcgaggggattggaatccgcgttaaagccggaggagtttggacgagcactattccatttgaatcaacgccgaggatttcaatccaacagaaaaacagacagaaaagattcagatagtggagcactgaaacaggcaataggcacactacgagcccaaatgcatgaatctggttgtagaaccgttggagaatggttttggaaggtacgtatggaaagaaagcccgaaggggtaaaagggcaaggggttagagcgcgttatcgagaaaccccttttacaactgatgaaggtaaaaagcgaatagacaaacgttatgatttatacgtagatagagctatggttgcacaagaatttgatgcattatgggcagcacaagcgacattcgcaccggcactttttaacgaagccgcacgtgctgaacttagagatattttgttacatcaacgcaaactaagacccgttcaaccaggaaggtgtacattagtcccagaagaacctagagctttattagcccttccatcaacacaacgattcagaatatatcaagaagtaaatcacctccgtgtactacacgatgaactaagggaagaggctttaacattagcacaaagagatcaaatagtggcactattagaaaggcaagcaaaggtaactttcactgcaatgcgaaaagcacttgggttttcggcattatttaacttagaagatgcaaaaagagatggtctaaaaggaaacgccacaactgcggcattgggaaagaaagatctttttgggccactctgggcaggattcgatacagcgttacaggacgaaatagtaacacaactgatgacagaagaatcagaacctaggttgatagcgtggttacaagaacataccggtgtcgatgaagcccgtgcacaagcaatagctaatgcaggcttaccggaaggatatggtagcttaggaagaactgcgttggcaagaatagtacccgaattacaaagagatgttattacatatgataaagccgtacaggcagcaggatttgctcatcattcagatttaggtttcagttttgagcatgatgcagacgaagtcgagagaataggagagaggactatcgcaagtactggagaaataaaaccagtatttgcttttaaacaactaccatactacggacgtgctctacaacgtcacgttgcttttgcaaaagaaaacccaaggaatgacgaagaaagatacggaaaaattgcaaaccctacagtgcacataggcctgaaccaagtaagagtagttgtaaacgcgctcatgtgtagatacgggcgtccgaccgaagtagtcatagaactagcccgagatctaaagcaaagtagggagcaaaaattagaagctcaacaacgacaagcagacaaccagaaaagaaatgcaagaatcagaagatccatagcagaggtactagggatttctgaggaacgagtaagaaccttagacatacaaaaatggatactttgggaagaattatctcacgatgctgcagacagaaggtgtccttactcaggagtacaaataagcgcatctatgcttcttggagaaagagtagaaattgagcatatactaccatttagtatgacattggatgactccctaaataacagaacggttgccctaagagaagcaaatagaatcaaaagaaatcgtactccctgggacgcaagaaccgattttgaagcacacggctggagttatgatggaattttacaaagggcagaaagaatgccacagagaaaacgtcatagattcgcaccagacggctatgaaagatggctaggagaagataaagattttctagcaagagcgttaaatgatacacgatatttaagtcgcgtagctgcagaatatcttaggcttgtatgcccaggctctgctactagagtaatccccggacagatgacagctctgttgaggggaaaatttggattaaatgatgtgctaggactagatggcgagaaaaatagaaatgatcatcgccatcatgccgttgacgcatgtgtaatcggggtaacagatcaacgaatgatgcaaagatttgcacaagcaaatgcgcaggctagagaagacggcttaacaagacttgtagaagatatgccattaccttggccaacatacagagcgcatgtcgaacgcgctgtaagacacatatgggtcagtcataaaccagatcatggattcgaaggagcaatgatggaggaaacttcttatggaatcttacgtgatggaacaatcaagcaaaggagaaaagcagatgggagtgcaggcagagagataagtagactcataagaataacagaaccaagtcaacctcaaagacatggtgtcgacgctgaaggacgaccattaccatacaaaggttatgttggaggttccaattattgtttagaaataacagtaaatgacaaaggaaaatgggaaggtcaagttataagtactttcgatgcctataggatagtaagagaaggaggactgagacaacttaggcatagcacccagggacagaatggacaggccttagcaatgagattagttataggtgatagcgttagattggaagtagatgaacaagaaagagtcatgagaatcgtaaaaataaacgggaacaatggacaagtctttatggcccctgttcacgaagcgaatgtggatgcacgtaatagtgacaagaatgaggcatttgcttatacaagcaagatagcaggttctttccagaaaactaaagcaagacaagtaactatctcgcctattggagaactgagagatcccggattcaaaggatga

SEQ ID NO: 8423 - RNA, 3138 nt, synthetic construct
  misc_feature 1..3138: note = Cas9 variant
  source 1..3138: mol_type = other RNA
atgaaaccccgaaacctaaactacatacttggcttagatctaggcattgcatcggtcggatggtctgtagtcgaaatcgacgaaaacgagtatccaatacgactaatagacgtaggagtaagaacattcgaaagggcagaagttccaaaaacaggcgaaagccttgcactagcgcgtagattagcaagatcaactagacgattaataaggaggagagcatttcgactactaaaagcaaaaaggctattaaaacatcaccaaatcgtaaatgccgaagaacttacacagttacccaatcaatgctgggaacttcgtgtaaaaggactagatagtctactgtcaaatactgaatgggctgcagttttactacatttactcaaacaccgcggatacttatcccagagaaaaaatgaagcccaaaacgccgataaagaactggggaaattgagggaaggaatggacaacaactcgaagctcttattagaaaataactacagaacacctgctgatatagcggttaagaaatttgcagtcgaagaaggacatatgagaaaccaaaggggagcttacacccataccttcaacagattagatattttggccgagatgcaattattattcaaaacacaaagagaattaggatctacatacgcaaatggtgaattggaacaagccttttgcgaacttcttctatggcaaaaacaagcactcaatagaagccaaatgctttcactagtaggcaagtgcacctttgaaaaagaggaaaaaagagcagcaaaggcaagctactcagcagaacgatttgtcgcaatccaaaaactgcagaaccttcgaatcctagaaaatggagaagaaagaggactatttgattcagaattctcactactcctggaaaacgcttataatctaaaatcaggactaacctacaaacaagtaagaaaaatcctaagcttatccgaaaacgccatatttaaaggcctaccttatctatcagacgatttagagaaacctgaaaaaacacaattcctagccttcaagttttaccatcaactagctgacatattaaagaataacggcttttccgatgagtggcaaaaactaagccaagaaccgacactactagacaagctaggcacagaactcagcctatgtaaagaagaaaatgaatttatcgctcaattcaacggcgaactacctgaagcaatgctatcaacgctatttaaccatacaaatttcgacaaattcatccacatatctttaaaagctttgaataatatattaccactaatggaacaaggaaatgactacacaaaagcatggcgaaaagtatatccagaaccaacaaaaaaggacgaaaaaaccctaccaccaattccagcagacgaaataagaaatccagtagtattaagaagtttatcccaagcaagaaaagttataaatgccgtcatccgcctctacggatccccagctcgaattcatatagaaacggcacgagaattaggtaaatcgtacgatgacagacaaaaaataaaaaaacaacaagacaaaaattcagatgaaagagatcaagcggtcaagaaattcctagaagaatgtccaaattttgccaataaagttaaaggaaaagatatattaaaaatacgactatatataaaccaagacggtaaatgcctctattcaggaaaaccactggacccccaccgattacttgaaataggatacgtagaaatcgaccatgcgcttccattctcacggacatgggacgattctcaaaacaacaaagttctagttttagcaaacgaaaatcaaaacaaaggaaatcaaacaccattcgaatggctaggaaaagatgaacaccaatgggcgctatttgttgcccgagtcaacggttgcagattcccatatgccaaaaaacaaagaatacttacaaagaagttagacgagcaagggtttttaaaaaggaacctaaacgacactcgatacgtctcagcctatctaatgaaacatattaaagaaaacctacacttagttggaaaagggagcgataaagtattcgctagtaatggacaagtcacaaatttcctcagaagatgttggggactcgaaaaaaaaagggaagaaggcgaccgacaccacgcactcgatgcaatagttgttgcctgctccacagcaagcatgagacagaaaataacattattcaagaaatatcaaagatggaatctaaaaaccggcaaacatattgatcaagagaccggagaaataatacccctccattttcccgctccatgggatttctttagacaagaagtcatgataagaattttctcagaaatgccacaagaagaccttataatgcaactccctgatagaccccaggctaatcacgaattcgtgcaacctctattcgtatcaagggcacccagccggaaaatgtccggacaaggacatgaagcaaaactaagaagtgcacgaatgttagaagcaacagggaaatcaattaaaaaagagttcctaaccgatttaaccatcaagaatctcgaacacatggtcaataaagaaagggaaccagaattataccaagcactagtagaacactttaaaaaatacggagacaagccaaaggaaaaattttttaagaaaggaggagtcgaagtaaaatcaattcgaatatccaaaacacaaaataagtcagtaaacttaggcaataaaacaatcgcggacaatggtgatatagtacgaacagacctattcttaaaaaacaaaaaatattatttcgtaaatatatacgcatggcaagtcagcaaaggaatactgccaaaagaaaccaccactggtaacatattagataattcatacgaattccaattttcactatttaaaaatgacctacttgaaattccccacccaaaaaacgaaaacgacagtatacttgcttactttatcagaccagacgatgaaaggagatggatccttaaatttcacgacaacgctaagataccggacatatatggaaaaaaagatgaaacatctataagactctcaatacaaggacaaaaatttattaaaaaatatcaagtagacgaattagggaaaaacatacgaccatgccggcctacaaaaagacaaggagtaagatga

SEQ ID NO: 8424 - RNA, 3141 nt, synthetic construct
  misc_feature 1..3141: note = Cas9 variant
  source 1..3141: mol_type = other RNA
atgaaaatatattcatttgatattggtgtagcatcaattggttgggcattcatcgaaaacgaagtattacaggattgcggcataagaatctttaccaaagcagaaaacccgaaaaacggcgccagtctagcactaccccggagggaagcacgaggagtacgtaaaaggctagcgcgaagaagaggccgactaaatacaataaaacagcttctatgcaaagagttcggattacaattggaagactacctgagtaatgacggagaactaccaaaagcatacacagcatcaaaagcaaaccccttaaaatcaccatacgaacttagaacattagccctctcgcaaaaattagactcaaaagatctcgttagagtaatattacatatagcaaaacatagaggttacggcaacaaacacgccaaagattcaaaagatactgaatcgggcaaagttaagaaagcaatagaatttaatagaaaaacattagcagaaaaaggctatagaagtgtaggtgaatatttatatagagagttcttccaacaatctagaataagtcaaaataacggcgcaactgaatttgttaacgttcggaacaagacaggtaactacgaacactgtgtggctcaggacatgctaaaagacgaattagaactaatattcagaaaacaaaaagaactaggattacatctaagcgacggattcgaaaaacagctcctcgacaaaatattcgaacaaagaccgctaaagagcttcgccgacaaagtaggaaaatgccaattcatagccggagcaaaaagagccccgaaagacagtatatcagcaatagagtttgtagcattgtctagaataataaatacattagcaaatctatcaaagaaatcaggagaaatgtatgataaagctatggtactaacaatcctagacagtgttttagaaaaaggagaaatgagttattacgccttaagagaagcaataaacttagatgagaaaatacgttttgctgactcaaggctagattattccaaagaaataaaagaaactgaaaaggtaaaatttgtagaatgcaaaaacctaaagtcatttaagaaagtcttaggtaattgttataaaacattagaaagaaaacatattgattctatagcggaacgaatagcagtaataaaagacgtagaaaaactccataaagaactagaaagctactgcgcaaccgaacaattatcattgacttcagaacaaatccaagcgctcagtcacctaaacttcagttcccatatttctcttagtctaaaagcgttagaacaaatactacccttcatgagaggagaaagagaagccagaagctccgatgcagactactgtataggaatagacgaaagcggagaaagccaatgtttacgatatgacgaatcagttgaaaaagcaggcctaaaagcattaagcaaagacactctaaaaggacaaatattaccacctttaaatgagtttgaaccctacctagcaaatccagtagttgcaagagcactagctgaatatagaaaagttttaaacgcactacttaaacaatatggaagccctcacaaaattcatatcgaatacgcaagagaagctaagttaaacaccacagaaagacaaaaatatgaaaaagagcaaaaagacaattatgcagcaaatcaagcagcgcataagaaatgccaagaactgggactagaacctagttcgacaaaccttcttaaattaaaattatggcaagagcaaggaggactatgtctatattctggagctaaaataacaatttcatatttacaagaccctaccgcactacaagtcgatcatatatacccctactcgcgaagttttgacgattcatatatgaataaatgtttagtactaactaaagccaatcaagaaaagggaaatcgaactccattcgaggcttttggtacagattcagccaaatggggcgtaatcacaaccttagcacaaaaacttccacataagaaaagaagacgaatactaaatacagcatttaatgataaagaagcaggattcaaactaagaaacctaaatgatacatcttacatagcccgcctagttgcagattataccgaaacctacctagagttcctaagcctcgtcgaatctgaaaacactacacttgggaaaggacaaaaaggtagtaagaaacacatagcaatcgtaaacggtgctttaacatctacaatgagatattatctaggattcgctagtaaagacagagataaccatctacatcacgctctcgatgcggtgataataggattcatgaacgacagtgtaataaaagcattcagtgactttaagaaaactcaagaaacatcaaaagccgcttattacgctcatacacttagcaaacaagaatataagaaacaaagagccttcatacaattaccatcaggtgaaaatttcagagccaacgtactagaaaaagcggaaagtgtattcgtctccaaaccacccagaaaaagagtaagaggagcattgcacgaagaatccttttattcccaaaatgacacaaaactattaaaaagctacggaggagcagaaggaattgaaaaagccttacaactcggaaaaatacggcaaataggaacaaaaattgtatccaacggagcaatggtacgagtagacatttttaaacacagaaaaagtggaaagttttacggagtaccggtatacacaatggatttcgctctaggtatactacctaataaagccgtagtacaaggaaaagacaaaaacgacgtaataaaagactggttagaaatggactcctcatatgagttcatattttcactttacaaagatgatttactattagtccagaagaaagaaatggcagaaccagaactatgctattttgtcagttttgacacgtcaggagcttctataaaagtagctaaacacgataacaatttctcaactttaactgaaaatcaaaaattattgttctcaaacgcaaccaaagaagaagtcgtaggtaaatccataggtattcaaaacctaaaagtattcgaaaaatggcaagtaagtgtattaggagaagtaaaaagaacacaaagctatccaagagaaaacattagcttggcttctaaagccaagaaatga

SEQ ID NO: 8425 - RNA, 3144 nt, synthetic construct
  misc_feature 1..3144: note = Cas9 variant
  source 1..3144: mol_type = other RNA
atgaaactgcttcgatatattttaggattggacctcggaatagcttctgtcgggtgggcaatagtagagatagatgaaaatgactttccgataagattaatagatataggcgtcagaacgtttgacaaagcagaagtaagcaagacaggggaatcactagcactcgcaagacgtctggcaagatctacaagaagattaataagacgacgagcttttcgtcttctcaaaggcaaaagattactaaagcaacacaatgtaataaacaaagaagccttgacaacactaccaacagactgctgggctctaagggtaaaaggattagacgaaaggctaagtccgacagaatggtccgcagtactactacacttgctaaagcatagaggatatctttcacaaaggaaaaatgaagcaaaatcggcggacaaggaaatgggagctttattaagcggagttgcatccaatcaccagttacttgtggaaaaccaatttagaacccctgctgaaatagcggtcaagaaatttgcactagaagaaggacatataagaaaccaattaggagcatatactcatacattcaatagacttgatcttctagcagaaatgaaactattattccagacacaaagagaacttggaaacccacataccagcggacaactagaacaagaattttgcgaattactgatgtggcaaaaaccagctttaagtggagatgctatactaaaaatgttaggaaaatgtacatttgaaacaaatgaatataaggctgctaaacacagctatacagcagaaagatttgtctggttaactaaactaaataacttaagaatactggaacatggaagcgaaagagttctcaacacagacgaacgatcactgttactcaatcaaccctacgaaaaggcaaaactaacatacacacaagttaggaaacttcttggattaagtgaagaagctcgttttaatggagtcagatatggcaaagaaaaagccgaagacgcgactttaatagaactaaaggcctaccatgcgatacgcaaggcagtagaaaaagctgacaaatctgcgtgggaaacacttaaaaatcaaaccgccttactcgatgaaatcggtacaactttctcaatatataaaacagatgacgacatcactgaacaattaaatggaaaattgtcagataccgtactaaatgcactattagaaaatctaaatttcgataaattcatccagttaagcctaaaatccctatacaatatagtgccactaatggagcaagggttaagatacgacgaagcatgtcaacagatatatggagaccatttcggtaaaaagagcggagagatcaacagacttctcccaccgataccagcagatgaaattagaaatcctgtagtgttaagaagtctcactcaagctcgcaaagtaataaacgccgtaattagactctatggatcaccagctcggatccacatagaaacagcaagagaattaggaaaatcatacaaagatagaaaagaaattgagaaaagacaagaacaaaacagagccgaaagagaaaaggcaactgcacaattcaaaacactattcccaacattcataggagaacccaagggaaaggacatcttaatgatgcgtttatacgaacagcaaaacggccaatgtctatattctggaaaaccactcaacttaaacagactacttgaaaaaggctatgtagaaatagatcatagtctcccttttagtagaacatgggacgattcacaaaacaacaaagtgttagtattagcaggagaaaaccaaaataaaggaaatcaaacaccctttgagtggctaggaaaagatgaacatcagtgggcgttattcgtagcaagagtaaacggatgtcgttttccttatgccaaaaagcagaggatcctaacccaaaaactagatgaacaaggtttcatagaaagaaaccttaatgatacacgttatatagcacgattcttagtaaatttcgtacgagaaaacttacacctaacaggaaaaggtaaaaatagggtatttgcaagcaacggacaaataactgcatttctcagaggaagatgggggttaagcaaagtcagagaagagtcggacagacatcatgcgttagacgcggtcgtcgttgcatgttctacagtagctatgcaacagaaaatcactcgattcgtaaaataccaagaaggaaacctacaaaccgctgaacggatagacagagaaacaggagaaataatacctttacactttccagacccatggcatttcttcagacaagaagtaatgatccgaatatttagtgagaatccacaagaagacctcatcattcaacttccggatcgacccgaagctaatcatgaatttgttcaacccctatttgtctctagaatgccaacacgaaaaatgtctggacaaggccatatggaaaccataaaaagcgcgaaacgtcttgatgaaggaatcagtgtgagcaaagtaccgttaacacaactgaaacttaaagatctcgacaacatggtcaacagagaaagagagaaggcattatacgaagctctcaaagctagattaaacgcttttaacgacgatccaactaaggcctttgctgaaccattctataagaaaggaggccaacaagttaaagcagtaagagtagaacaagttcaaaaatcaggtgtagttgttagaaatggaaacggagtagcagacaatgcctctatggtaagggtggacgttttcataaaaggaggaaaatacttcttagtacctatatatacatggcaggtagcaaaaggaatattaccagatcgagcggtagtagctgcgaaagatgaaagcgaatgggaattaatggacaaaacagcacaattcctatttagtatgttccccaatgacttaattcaagtaaaaacaaagaaagaaaccttctttggatactataatggattagatagagctacaggagcaataaatctgaaagaaccagacagtaatataaataaaggaaaaagtgggctacatagatcaataggagtaaaaacagccttatcagttgaaaaataccaagtagacgaattaggcaaaaatataaggccatgcagacctagcaaaagacaagcagtaagatga

SEQ ID NO: 8426 - RNA, 3147 nt, synthetic construct
  misc_feature 1..3147: note = Cas9 variant
  source 1..3147: mol_type = other RNA
atgaaaaggcttggcttagatataggaaccaacagcataggatggtgtttaatagaggacgatggggatggaaaaggaagaataatagacataggggcacgtatatttagtgatggacgcgacccaaaatcaggggcctcacttgcagtagacagacgagctgcaagagcaatgagaagaagaagagatagatatctagggagaagaaccgcattcttaaaagcacttaaaagattcggcttgatgccggcagatgaatccgcagctaaattattagcagaccgagacccatacgaacttcgagcaagagcacttgacgagagattagaaccgcatgaaattggcagagcattattccacttaaaccaacgaagaggatttaaatcaaatagaaaagctgaaaggaaaacaaaagatgctgaagatggaaaaatagcaaacggtgcgaaagcattagaccaagcaatggctgaatctggcgctgagacgttaggtcaatttctatcatcaagagacaccaagagagtaagaatgggtagtgatgcgcaagggtatgacttttatccacaacgaagacatgtagaatatgaatttgacacaatttggagtaggcaacaacaacatcatccggcacttttaacagaagaagcaagaaagaaacttcatgatatactatttttccaaagaccattgaaagagcaagaagtaggagtttgtacgtttgtacataatgaatgccgactaccaaaagcccacccactcttccaagagcgacgtttatatgaagaagtaaatcaacttgagataactactccaggcgcgccaaaccgaaaattgacaatggatgagagagacgcattaatcttagaattaaggtctagaaaagaaaggagctttgatagcctcgcaaaaagattgaaattagcaccaggccaatcttttaataaagcaagtgaatcacgaacgcgactaagaggagatgaagtatatgcagtaatggcccacaagaaacggtttggagacagatggccgcatttagatagagataggcaatgggcaataataaaaagaattatagaagaagaagatccagacaaattacacgcatttttaacaggcgaatggggtttaaccgacgaacaagcattagcgaccgcgagggctccactaccagaattatacggaagattaggccctaccgcaactgcacgaatcctggaagaattaaagaaggacgtaattacctatgatgaagcagtaagaagggctggatggcatcattcagacgatagaacaggagaaatcctaccgcaattaccctattatggagaactacttacaagggatataccacccggaactcaagacccaaatgatccacctgaacagagatggggtaaaattacaaaccctacagtacatataggtcttcgccaattagaaaaacttgtaaatgcgataattaaggttcatggtagaccagatcaaatagtagtagagctagcacgagaactcaaacttaatgaaaaggataaagaggaacataataggagaatacgaagagacactgcagccgcccaattaagatcagctaaactacaatcagagggaatacctgatactggagcaaatagaatgctgttacgaatatgggaagaattaaaccctggagaagtattagatagacgttgtccttattgtggagaaccagtaggaatgaggatgctatttgcgggtgaagcagacatcgatcacataataccatacagtcgatctctagacgatagcgctggaaataaagtagtagctcacaggtcgtgcaatagagctaaaggaaatagaactccatatgaaaaatgggtccatgatccagatagatgggacgtaataagcactcaagttgcgcgattacataagtccaaacaatggcgatttggtccggacgcaatggcaagagtagaaaaagatggtggttttatcgcaagacaattaacagatacccaatacttaagtagattagctggaagatacttaagctcattatatcctacaaaagatgatggaagtgtttatgttatacctggaagaatgacagcaatgctgagaagaagatggggactaaactctttactaccagaccataattttgtagacaatgaacattcaaatgcacctaaaaatcgactggaccatagacaccacgccatcgacgccgctgtagtggctgtaaccacaagggcattgatgcaggagatcgcacgaacagctggcagagcagaagacaaagatttagaccgtctattcgaagatctacctcaaccatgggaagggttccgagaagagttaggagaaaaattagtcagagtaacagtgtcacataaaccagaccacggaagaaaaggcttaccacccaaaaatcgagatgtcacagctggtcgtctacataacgatacggcatacggattaactggagatgtagcagcagatggtaaaacgccaattgtagtacaccgagtacctttaatgagtctaaaaccagctgatatttctgatcctgaccgtataccagatcccgccctaagatcagctctacatagggcaaccgatggtctatcaggaaaagcatatgatgcagcattggctggatttgcaaaaactcacccacaattcgcaggaataagacgagtaagagtaagagagccacttaccgtaatcccgatagcagatagagatggtagacctttcaaagcatacaaaggagatgccaattcaagagtagacatttggagaatgccagatggtaaatggttaagcgatgtagttacaatgtacgaagcacatcgtagagaccatagtgacaggagacctcatccagcagctaagaaattaatgtcactacgacaaaatgatatgatagcagtagaaagagatggggcaccaagacaaataatggtagtaaaacaaatatggccaacacaaataaacctagtagaacataaagaaacaggtaatctgaaagacagacactcgaacgaaactgatccgtttagattcttcgcaccaacagcaggagggcttaagaaaatgaaagcacgccaagtacgtatagatccattaggtcgcatattcgatcctggtccgcgatga

SEQ ID NO: 8427 - RNA, 3147 nt, synthetic construct
  misc_feature 1..3147: note = Cas9 variant
  source 1..3147: mol_type = other RNA
atggctaatatagctgaaaacttagtatttggaatcgacttgggaatagggtcatgtggttgggcagtgttaaaccaaaaggcaaaagatgaaaatatcgtcgcactaggtagttggtgttttgacgtaccagaaacagataaagaaagaatcccaaccaaccaaatcagacgagctaatagactgctaagaagagttatcagacgacgccgaaatagaatggcggaaatccgaaggttatttgccagtaagggtatgttagatacagcagacccagatgcactcgcaaaaataagtgctgacccttgggaaatgagagcaaaaggactcgattaccaattaacacctcaagagttcgcagtagcactgggacatatagcgaagcgaagaggttttaaaagcgcggcaaaacgtgtaagtacaaatgctccatcagaagactcaaaaatgttagcagccttagagaaaacaaaagaacaatcagcgcaatatagaacaataggagaaatgtttgctagagatccggcctacgccgatcgtcgaagaaatagagacggatgctttgacagaacaatgtcacgagaagacctgtttaaagaaacacaaatattattcgaaagtcagagaaggctcggaaatttcagcgctacttcagaaaccgaacaagcgtttatagacatagcgtttagacaaaaacctatgcaagattccgaaagattagttgaaacatgcttatttgagccagatgagaaaagagcatcaaggttcgctccatctttcgaacgttttagactgctatgcaggttagtaaacctccgtgtaaccgatggattagaagacaggccccttacaccagaagaattaaggctcgcttgcgaagatgctggaaaaactagaaaattgtcagtaaagaaagtaagatcattaataggattaagagatgatcaaaggtttaccactataccaccggatcaagaacaacatgatatagcagcacgtacgggagacgctttaaccggaactgctacctttagagcaatactcggtgaatccttttggagacaattactaccccatccagaacaattagacagagcggcttggataataagttttcatgaattaaccgacacaataattagtaaactagcaactataggtctaccaagcgaggttatggaacttattaggaaagctctagaagatggaaaattttctaaattcaaaggcgctgcatcactatcggacaaagcagcacgaaaactaataccctttttacaagaaggtcttacatatgataaggcttgtcagaaagccgggtataaccatgccgcatcaaaattcacacattatgactcgatcgacaccaaagctaaatttaacagcttaatggatgatgtcagagattctataacaaatcctgtagcgcgaaaagcaataagtgaaggcatgaaacaagtatgggcaatgcgaaaccaatggggcctacccggagctatctgtatcgaattagcaagagacgtaggtaacagcgccgaaaaacggagagaaatagaaagtggaattaagaaaaacactgctcaaagagagagagaacgtcaagaagctaaagagcacttaaatcaaagtgatattagttcagagacactactcagatatagactatggaaagaacaaggaggaaggtgctgttatacagatcaaccaataacaccctctcaattgatcgcctcagataattcagtacaagtggatcacatcttgccttggagcagatttggagatgacagctacctaaataaagcactatgcaccgcaaaagctaatcaagaaaagaaaaacagaactccatgggaatggatacacaatcaaaaaggtgttgaggcttggaaccattttaccgcggcagttgaatcaagaaaagaaactagaggcctaaagaaacgaaattttctattaaaatcttcaaaagaaacagaagaaagatttagatccagaaacctgaatgataccagatacgcagcacgagtaatggcagaagctgtaagacttttatacccatcgggtaatcgggcagaaaaaggaggagtaaaaagagtatttactagacccggagcacttacagcagccctccgacacgcttggggagtagaatctctgaagaaaataaatgggaaaagattaaatgatgatagacaccacgcactagatgctgcagtcgttgctgcggtaagcgaaaaagaaatacagaaattaactaaaagttttcaaatatgtgaacaaaaaggattagccagaccaatgagagacgtacccatgccatgggaaggttttaggcatcaactagaaaccgcatacgcagatatccgtgtcgcaaggcctgaaagacgacgagcgagaggaaaaggccacgatgcaacaataagacaattaagagaggaaaaagacggcccagttgtctacgaaagacgagcaataagcgatcttaaattgacagacctagaaagaataaaagacccagaaagaaattcagcgataataagcagtttaagaacatggattgagaaaggcaaaccagctgattaccctccacagagtccaaaaggtgatgaaataagaaaaataagggtgatgtcacgaaacaaaccagccgtatcagtaagaggaggaaccgcagaccgaggagaaatgactagagtagatgtattcaccaaaatgggaaagaaaggaaaacctgaatggtttcttgttccgatatatagacatcaagtaatagaccgtattcaatggccccaacctcccaatcaagccgcagctaatggaaaaagtgagaaaaattggccaacaatgggactagaacatgagttcagattttcactctatccacggagctatgtacaaatcgttaaacgtgacggcgaaatcatcgaaggatattttgccggattagacagaacagttgcagcttttagtctattaagctctagtgatccaacttcaattcaaagaggtataggcgcgaaaactctagaatcaataaggaaatataatgtcaataggtttggagatatatcaatggtagaacaagaaactcgaacatggcacggagacgtctgcatatcaccagatcaacccgacagtgcatga

SEQ ID NO: 8428 - RNA, 3147 nt, synthetic construct
  misc_feature 1..3147: note = Cas9 variant
  source 1..3147: mol_type = other RNA
atggtagaaaaaattctggggatagatctaggaatatcgtcactcggatgggcagtagttgaatacgataaagataacgatgaaaacaacaaaatcatagactgtggagtccgactattcacagcagcagaaacacccaaagaaaaggaaagcccaaataaagcgagaagagatgcacgcggactaagaagggtaataaaacggcgaagagtacgaatgaacacaataaaaaatctattaataacttacaaattgattgataaaaccttattagacgaagaaatgggcatgtttcactcacaatcaaatagggtcgacgtatggaaattaagacacgacgcactatatcacttactcagtggagatgaactagcaagagtactaatacatatcgcaaaacataggggttataaattcctaggagacgacgaaagtgacgaagaatcaggaaaggtcaaaaaggccggagctgaactcaaaaaaaaattccttgaagcgggttgtcaatctgtcggagaatggctttggaaagaaagaggtcttcaaggaaaaaaacgcaacaaatcaggagactacgaaatatcaattcctagagatttcctcgtagaagagatacaaagaatattcgaaacacaacaaaaattcggcagcacattcgccacctcagaactccaaaaagcatatacagacatagcgttttatgtaaaacctatgcaatcaatcgaagatatggttgggtactgtaccttttaccccaaaataaaaagcaaaaatcaagatggagaaaaaagagccccaaaagcaagcccatcagcggaacaatttgttattctatcaaaaatctttagcacaatcgtcattgatgaaaacaagcaagaaaaaaaacttatagagctcaaatcaatagagcagttgatccagatagcaagatcaaaagaaacactcaaatacaaacagttaagaaaagagttaaatttagccaaagatataagttttaaatccatctcagatgaagaaaaaacatggataaatctagtaggaaacgcaaaattcaaaaaaatcctaggactaaactacgaaacgtttttaaaaaacacagaaatctcagacgaaatagcaaaaatcttaacctatgacaaaacatttgaacaaaaagaaacgaaattaaaaaaccttctagtaaatatcgattggatagacaataaccacatagcagaacttgcaaaactatcatttagccaattcaaccaattaagccttaaagcaatcaaaatcatatctaaaattatgatagaaggatacgcaagatacgatgaggcagtgcaatatgcttttgaaaacaacttactacccaagccatcccatgaaaaaagcatattattaccccctctcaaagaaaccaatatcgcaatcttaaaccctacagtcatacgagcattcgcccaatttcgccaagtagcaaacgccctagtaagcaaatatggatcatttgacaaagtgcatttcgaactggcaagagaagttaatacaaaagaagatcgaaaacgttgggaaaaagatagagacaaaaacgaaaaaatgcaccgccaaattacagaaaagttagtagaagaaggcgttaaaccttcatacaaaaacatattaaaaagcaaactaaggagtgaacaaaaagatacatgtccatactgtcaaaaaaatttacattaccccatgatatttgaggacggttacgcagaaatcgaccacatcttaccactcagccaatcccaagacgattcctatgtaaataaagtcttagtacacagcgcttgtaatcaaaacaaaaaaaacagaactccgttcgaatggtttcaagacgaaaagaaagattgggacacctttaaaagttatatattaatggaatctactctaggagaaaaaaaaagaaactacctaataaaagagaatttcagcgaccctcagtctagaaaagaatttataagcagaaacttaaatgacacgcgatatatgagtaaagccataaaaacatactgtgaaaaccactggaaattgtcacacgacgatgataaattaagaatacaggtacgatctggtaaactaacatcaacattgcgacaccaatggggactagacaataaaaacagagaaacacacacacatcacgcaatggacgcaatcatgatagcattttcaactcaaggaatggtaaaaaaattatccgactactttgctaaaaaagaagcaaaagtagaaaaggacaaaccggtattaataacccccataaaacagtttaaagaagctgttgaacaagcaacaaccctagagagacaagaatcaatacagacaaaagcaggcgacacaataaccctgaacagactactaatttcaagaccaccaagagcttcagtaaccggtgcagcacatgaacaaaccgccaaaccatatcccagaatcaaacctataaaaaataaatataaaaggagaaggatacctatcgatgaggacaaattcgaactattcagaaatgataaagtagcaagtggaaacgacaaaaacttctacaacagttcaacaatcccacgagtcgacatatataaaaaagatgataaataccatgtagtaccaatttacttaagtgatatgacgaaagcagaggtacctaacaagtcactaggaacaaatccggaaggcatggacgaaaaatacttctgcttctctgtattcaaaaacgaccttatagaactcgaaacgaaagcaacaccaaaaaaaccatctaaaaaactacttggctactttaaacaactaaacggcgcgaacttcatactcaatagcattcataatggaataatcgacggctttgtctgctcaccgataacactcttcaaacaacaaaaagatatgtgcaaaaagtgccttcccgaagaccgtgcaataggtaattgttctcaagaaacgctagaattctgggaagcagaaaacataaaagttcccaaaaaagattttgaatgcgaccaaggaataaaatttgcaatagcagtaagaaaatacacgatcgatccactaggatactatcacgaggtaaaaggcgaaaaacttctaggaacaatacctcaaggtgcaaaaaaacatccaaaaagacaaaaatga

SEQ ID NO: 8429 - RNA, 3150 nt, synthetic construct
  misc_feature 1..3150: note = Cas9 variant
  source 1..3150: mol_type = other RNA
atgattaacgaaagattaacttttggaattgacctaggtataggaagctgtggatgggctgtattaagacacgctgatgcggcgggtgaaccaggagtaatcgaaggattagggagctggtgcttcgatgtccctgaaacttcaaaagaacgaataccaacaaatcaggtacgtaggagtaaccggttattaaggcgagttataagaaggagaagaaatagaatggcggaaatacgacgtttgtttcatgctcaaggtctattaccaagtgcagatgaagacgcattaaaaaggccaagactagatccatgggaattacgagctagaggactagaccaatgtttaagtgcagaagaatttgcagttgcattaggacatattgcacgccatcgaggatttagatcatccgcaaaaagaaaagcagcaaatacttcaggggaagactcaaaaatgttatctgcacttctagttacgagagaaagaactgctagatatcgaactgtcggggaaatgtttgcgagggatccagaatactcagcaagaagaagaaatagagatggaatctttgaccgaacagtagcgcgagacgatttaatacatgaagtaggaaaactatttgaagcacaacgagcaagaggatctgcatttgcttccccagacttggaagcagacttcaacgcgatagcatttagacaagcagaaatgcaagattctgagagattggttggaaattgcccatttgaacgagatgagaaaagagcagcaagatgggcacccagctttgaaagattcaggttactaactcgtttaattaatctgagaatagcaactgcagaaggagaacgtagattcacaccagaagatttagctagagtgtcagccgaattaggtgcaacagcgaaattgccagtgtctcgagtacgagctctaatcgggttgctgccagacgaacgattcactacaataagagtagaagatgaagatagagatattgtagcgcgaacgggagaggcagcaccaggaacttggcgcctacgaaaaacattaggcgaagcattatgggccgaaatgcaagcgagaccggaccagttagatgcaatagcccatgttttaagtttctttgaagcgacagctaaaataagaagcgaattagatagattaggtttacctgcagcagtaatagaagcactagatcgaggattagaagatggagcttttgcaaaattcaaaggagcaggacatatttccgcaaaggcttgtagaaatctattgcctcatttgcaacagggacatagatatgatcaagcctgtcgtttagcagggtacgatcatgctgcatccactctaagccatacggcccaagtagtaagtaaagcaggatttaacgctctagtaacggaattaggagaaagtatagcaaatcctatagctaggaaagcattaacggaaggattaaaacagatcagggctatgtgtgcaagatgggggttacccggtgccatacatattgaattagcgagggaagtaggaaacagtatcgaaaagagacgagagttagagagtcaaagagagaccactacaaaaaggagacaaacggaaagagatgagataagaggtctgttagccctagaggatgtagacgatgatactctattacgatacagactttggaaagaacaaggcggtaaatgtctatacacaggaaaagatatacacgtaagacaactaatcgcaactgataacagtgtacaagtcgaccacattcttccatggtctagattcggagatgacagttttaataataaaacattatgtttggcaagtgcaaaccaaaggaaacgaggccaaacaccatgggaatggttttcactaactggtactccagaggcttgggaagtatttgcatcaagagtagaaacaagtaaagatttaagaggattcaagaaaagaaatttacttttgaaaaacgccgatgaagttgcacaaagattcagatccagaaatttaaatgatactcgatatgcagcaagattactagctgaagcagcaaaattgttttatccagccggagatagacaagaaaaagacggacgaagaagagttctaaccagaccaggtccgttgactgcagctttgagacacgcatggggacttgaaagtttgaagaaagctgatggaaaaagagtttctgatgatagacatcacgcgctagatgcattagccgttgcggcaattagtgaacgagaagtacaaagattaaccagatcctttcaggaatgggaacaacagggactagcaagacctttaagacatgttgccccaccatggccaggatttcgaggtgacgtactcgcagcatacgcacaggcttttgtggcgagaccggaaaggcgacgagcacgaggcaaaggtcacgatgcaagcataagacaagttgtaggagaagggccagaagcccaagtcttcgaaagaagaggacttgcagatttaaaagaagccgatcttgacagagtaaaagaccccgagcgaaatcaggcaattattgaagctgtacgagcatggatattagccggacggccagcggacgcaccaccgcgatctccaagaggagacgtcattgtaaaattacgcacagcaccagcaaagaaaattaaaccagccgtaccagtccgtgggggcaccgcggataggggtgatatggttcgaatcgatgtatttactagaccaaataggaaaggtagagatgaatggtatctcgtaccaatatatcctcatcaagtaatgaatagaaaagcatggccacatccacccatgaggagtgtcgtagcatacaaagatgaagcaggatggaccgaaataggagctgaacatagtttcagattctctctatacccaagatcatacgtacaattagtaaaaagtaatggtgacgtaatagaaggatatttagtctcaatggatcgatcaactggagcatttcgcgtctttgtacataacaatccagctgaaatggcaaaaggaatcggagccaaaacattattaaacctacgtaaattcaatgttgatagatttggagtcaggacagaagtaaaatcagaggtgagaacttggcatggagaagtatgtacaagtccagtcccgccagattga

SEQ ID NO: 8430 - RNA, 3150 nt, synthetic construct
  misc_feature 1..3150: note = Cas9 variant
  source 1..3150: mol_type = other RNA
atgcaattatcaaaactaaattacatacttggacttgacctaggaatagcttccgtaggatggagcgtcatagaaatagacgaaacagaaatgccaatacgactgatagatgtaggagtaagaacgtttgaacgggcagaagtaccgaaaactggcgaatcactagcactcgctcggaggttagccaggtcaacgagaagactaataaggaggagagcctttagactccttaaagctaaaagacttttgaaaaaccatcaaatagtaagtgctgatgaactatcaacattaccaaaccattgctgggaattacgagtaaaaggtctagatgaaagattgacatgtcaagagtgggcggcagtactattacaccttctaaaacaccgaggatatttatcccaaagaaaaagcgaagcacaaaatgccgacaaagagatgggagccttattatctggagtagcaaataaccataaactcctaagcgagaatcattatcgaacaccagcagaaatagcagtaaagaaattcgcattagaagaaggacatatgagaaatcaaagaggagcatatacacacacttttaatagattggacttacttgctgagatgagattactattccaaacgcaacgagaactcggttcgccttatgctagtggagagttagagcaagagttctgcaaacttcttatgtggcaaaaacccgcactttcaggagacgcaatactaaaaatgttaggaaaatgcactttagaaccaacagaatataaagccgctaaaaacacatacacagcagaacgctttgtatggctcactaaattaaacaacttaaggatactcgaaaacggatcagaaagagcacttaacgctgatgaaagagcactcctgcttaaccaaccatatgaaaaagctaagtttacgtacgaacaggctcgtaaactactccagttaaacgaagcagcacgatttaattcggtaagatacggcaaggaaaatgccgagaaaagtacattaatggaaatgaaagcatatcatgccataagaaaggcagtagaaaccgctgattctagtgcatgggctacattaaaaacacaaccactattacttgatgaaattggtacagcattctccatttataaaactgacgaagacatcaaaacacaattacaaggaaagttagctgacaacgtaattgacgttctacttgaaaatttaaacttcgacaaatttatacaactcagtttaaaagcactctataaaatactacctctaatggaacaggggcttcgttatgatgaagcatgctctcaaatctatggtgatcattttggaaagaaagaacagaaaaacgatagattactacctcaaataccagcagacgaaataagaaatccagtggtattaagaacactaagccaagcgagaaaagttataaatgcagttatcaggctttatggaagtccagcacgaatccatatagaaactgcgcgagaactaggtaaatcatataaagatagaaaagaaatagagaaaaggcaagaacaaaatagagcagaacgagaaaaagcagttgataaatttaaagaattgttcccaaactttataggagaacctaaagcaaaagatatcttaactatgagattatacgaacaacaaaatggacaatgtctttactctggaaaaagtttagatctacatagattgttagaaaaaggttatgtggaaatagaccatgctctacccttcagtcgaacatgggatgacagtttcaacaataaagtattagtattagccggagaaaatcaaaataaatccaaccaaacacctttcgaatggcttggaaaagatgaacaaaaatgggcattatttacagcaagagtgaatagttgcagatttccctattcaaagaaacaaagaatattaaccaagaaactagatgatgaaggatttattcaaagaaatctaaatgacacaagatatatagccagatttctcgtgaacttcgtaaatgacaatcttcatttgacaggaaaaggaaaaagaagagtattcgcctcaaatggacaaataacggcattcctaagaggaagatggggactaacgaaagtacgagaagaaagtgataggcatcacgcactagacgctgtcgttgtagcctgctccacagtttcaatacaacagaaaataacgaggtttgttaaatatcaagaaggtaacctacaaacggcagaaagaatcgacagagaaactggggaaattattccactccacttccccgacccttgggcgtttttcagagaagaagtaatgataagaatattttctgaaatgccacaagaagacctggtaattaagttacctgacagacctcaagcaaaccacgagttcgtacaaccactatttgtatctaggatgccaactagaaaaatgtcaggtcaaggacacatggaaacaattaaaagtgcaaaaagactcgacgaaggcattagcgtaagtaaggttcctctcacacaattaaagttaaaagatctcgaaaacatggtaaacagagacagagaaatagccctatatgaagcattaaaagctagactcacagaatttaaggacgatccagccaaggcttttgcagaaccgttctacaagaaagggggcgtacaagtgaaaagtgttagagttgaacaagtacaaaaatccggagttgttgtgaggaatggaaacggagtagcagacaacgcgagcatggtaagagtagacgtttttattaaaggaggaaaatatttcctagtcccaatatatacttggcaagttgcaaaaggaatcttacccgatcgcgcggtaatcgcatacactcccgaaaatgaatgggaactcatggacgatagtgcccaatttcaattctcaatataccctaatgatctaattaaattaactacaaagaaagctattttctttggttattatagcggatttaaccgcttaacaggagccataaatattaaagaacacgatttacaaatttccaaaggagataaaggcgtacatttaggactaggagtgaaacttgctttaagtctagaaaagtaccaagtagacgaactaggtaaaaatataagaccgtgtagacccacacaaagacaaaatgtacgctga

SEQ ID NO: 8431 - RNA, 3153 nt, synthetic construct
  misc_feature 1..3153: note = Cas9 variant
  source 1..3153: mol_type = other RNA
atgagctcctatagattttcattcgatctaggaacaaactcaatcggctgggccgtattcgaattagacccaaaaactagaccagtagcacttgctgattgcggggtacgaatttttccggatggaagaaatcccaaagacaagcaatcactcgcagtagccaggagagaagctagagcagtaagaagaaggcgagaccgttatcttaaacgaagatccgaactaatggaacgtctagtagctaaaggtttaatgccagaaagtcgagatgatcaaaaagcattggaaggtctagatccatatgcattaagagcagccggactcgacgatgcactacctccccatcacttcggcagagcactgtttcatttgaaccaacgacgtggatttaaatctaataggaaaacagacagaggagaaaattcagaaacgggtataaccaaaatcgggatgaagaaattacatgaagctctattaagtgaaggatgccgaaccttaggtgaactacaacacagacatcatgaagcaaatcagactcctgcaatggatacaaatcctaaatcagtaaggagcaaattaagaggagaaggagcaaaagcagtctacgacttctatccctcaagagacgcagttgaagatgaatttaacaaattatgggacagtcaaaaacgattccacccggacttactaacagatagtgcacgtgatgcaatcagagatgcaatattctatcaaagaaaattaaagactccagacgcaggtcgatgctcttttaacccagcagaagaaagagtagcaagggcaatgccaatagcacaacatttcagaatactacaatttgtcggggacttacgacttattgataatgatctagtaaggcaccccctaaacaatgaccaaaagaaagcactatatagagacttattagcaaaaggtaaattaacattcaaagcaatgagaaaaactataggcataggaagcgaatacgcgttcagtcatgagagcgagaaacaatcagagtttcgaggagacgaaactgctgcacgtctagccggacccaaatactttggaccaaaatggagagaattatcatttaacgaccagagtgaaatagtagatagattactacatgaggaaaacgaagaaacacttatacaatacctacaagaccgatttggcttcgaccatgatagatgcgaagtaattgcagatgcaccattgcccgacggacatactagacttggaaaaacagctctcgaaacacttgtagaaataatgagagatgatcatctaccttacgatcaagcatgcaccaaagctggatatgaacacgcattacctccggatggtgtaattttggatgatctcccatactatggcatagcacttgagcgacacgtagcatttggagatggcaaatcagaaaacccggagaaaaggtacggaaaaatagcaaatcccacagtacacatagcacttaatcaattacgaaaagtaattaacgcattgatagcgaggtatggacacccagaccaagttgtgatggaaatagcaagagacctaaaacaatccaaagcaaaaagagacgacatatcaaaagaacaaaagaaaaatcaagatcgtaatgaccagagaagaaagaaattacaagaagctcacatcgcggtaaatgcagaaaacatgttacgaatgcgactatgggaagaactagatgaagataatgcagccgcaagagcatgtccattcacaggagaaacaattagtatggctaggttatttagtccagaagtagaaatagaacacatccttccattttcaagatcattagataactcaccagcaaacaaaacattatgtatggtttgggctaatagagccaaaggcaatcgaacaccatgggaagcatttggcagagacagggaaccaggattcgactggcccgaaatagccgccagagctgcacgactacccaaaaataaatcatggcgattcggtccagacgcaatggaaagacttgaaagagaaggtgactttttagatagacagttaacggatacacaatatttgtcaagaatcgctagagaatatgtgacgaaaatatgcgacccaaatcaagtttgggtaacaccaggtaggctcaccgcctggttaagaagaaattggggattaaacggtatactacccactgggaatgccaccaaaaacagggatgaccacagacaccacgctatcgacgcgatagtagtaggattaacagatcgcggtatactaaatcgagtatcaaggagtgcagcattagcagaagcagaagatcttgataggagtatagcagagatgcctgacccatttgatggtttcagagataacatccgacatatactagaacaaattattgtcagccacaaaccagatgcaggattcgtaccaggccatccaaaaggaaatacaaccccaggagcgttacacaacgatacagcatacggaataataaaaaccgacgcaaaaggcatgtcagaagtagttacaagaaaagatgtactctcttttaaaggaacaaaagaaatagaaagtataagggatgctgctacccgtcaatctctactggacgcagtagcgggcgttccaagcggattagcctttaaagaggctttaagagattggagtgtccgaacaggcacgaaacgcgtaagagttactttcaatatgagtgtaataccaatacaagatcgtgacggaaaagcatataaaggttataaaggtgacggaaacttatgtgctgaaatatacgaaaggccagatggaaaatggggagatgaaataatatcaaggtttgatgcagtccaaccagggtttaccccacaatggcaaagagaccatccagcagcacatagggttatgagattatttagagatgatatgataatggcagaaatagatggagtaatgaccgtatgcagaattgtcaaaatgagcccagggaaagtggtatttacaccccaccatgaagcaaacactgacagcaggaatagagataaagatgatccattcagtttccacacatgctcaggagaatctttgagaaaaaggaaagcacaaaaacttttcgttgatcctctagggaaaattagagggtatagagcaaaagaaggttga

SEQ ID NO: 8432 - RNA, 3153 nt, synthetic construct
  misc_feature 1..3153: note = Cas9 variant
  source 1..3153: mol_type = other RNA
atgggtgaaaatatgatcgacgaaagtttgactttcggcatagacctgggtatcggatcttgtggatgggcagtcttaagacgaccaagcgcttttggaagaaaaggagtaatagagggcatgggttcatggtgttttgatgtgccagaaacctcaaaagagcgaacacctactaatcaaattagaagaagtaatcgcttattaagacgagttattcggcgaagaagaaatcgtatggcagcaataaggagactactccatgcagcaggcctgttaccgtccactgactcagatgccctaaaaagaccaggacacgatccatgggaattacgagcgcgcggacttgataagccacttaaacccgttgaatttgcagtagtgctcggacatattgcaaaaagaagaggattcaaaagtgcagctaaaagaaaagctactaacatatcatcggatgataagaaaatgttaactgctttggaggctacgagagaaagattgggtcgctacagaacagttggtgaaatgtttgcaagagatccggatttcgcaagtagaagacgaaatagagaaggaaaatatgatcgaaccaccgcaagagatgatctagagcacgaagtgcatgcattatttgctgctcaacgacgattaggacaaggattcgcatctccggaattagaagaagcctttacagcatctgcatttcatcaaaggccaatgcaagattcagaaagattagtcggattttgtccatttgaaagaactgagaaaagagcagcaaaacttacaccatcatttgaaagatttagattattggccaggcttctcaatttacgaattacgacaccagacggggaaagaccactaacagtagatgaaatagcactggtaacacgggacttaggaaaaaccgcgaaactttcaataaaaagagtaagaaccttaataggactagaagataatcagcgatttacaactataagacccgaagatgaagatagagatatagtagccagaacaggaggagcaatgacaggtactgctacgttaagaaaagccttaggagaggcattatggacagatatgcaagaacgaccagaacaattagatgctatagtgcaagtattatcctttttcgaagcgaatgaaacaataacagaaaaattaagagaaataggacttacactagcagtactagatgtactcttaacagcacttgacgcgggagtattcgcaaagttcaaaggtgcggcacatataagtactaaagctgccagaaatttattgcctcatttagaacaagggagaaggtacgatgaggcgtgcactatggcaggatatgatcacgcagcttcccgcctgtcacatcatggtcaaatagtcgcaaaaacacaattcaatgccctagttacagagatcggtgaatcaatagctaaccccatcgcaaggaaagctctaatcgaaggtttaaaacaaatatgggcgatgagaaaccattggggacttccaggaagcatacatgtagaactagctagagatgttggaaattcaattgaaaagaggagggaaatagaaaagcatattgaaaagaatacggcattacgagcacgagaacgaagagaagtacatgacctattggatttagaagacgtaaatggggacacattattaaggtatagactgtggaaggaacaagggggtaaatgcttgtatacaggaaaagctatacatataagacaaatagctgccacggacaatagtgtacaagtagatcatatattaccatggagtagatttggggatgattcatttaacaataaaacactctgtttagcatcagcaaatcagcaaaagaaaagatcaacaccgtatgagtggttaagcggtcaaacaggtgatgcatggaatgcatttgttcaaagaatcgaaacgaataaagaacttcgaggatttaagaaaagaaattatttattaaagaacgctaaagaagcagaggagaaattcagatctcgcaacctaaacgatacacgatatgctgcgcgtctatttgctgaagctgtaaaactcttgtatgctttcggagaaagacaagaaaaagggggaaatagaagagtgtttacaaggcccggagctctaacagcagcactacggcaagcctggggtgttgaatcattaaagaaacaagatggaaaacgaataaatgacgacaggcaccatgcgttagatgctctcactgtagcagcagtagacgaagcagaaatccaaagactcaccaaatcgtttcatgagtgggaacaacaaggcctaggacgacctctgagacgagtagaaccaccatgggaatctttccgtgccgacgttgaagcaacttatccagaagtttttgtagcaagaccagaaaggcgcagagcaagaggagaaggccacgcagcaacaatacgacaagtaaaagaacgtgaatgcacaccaatagtatttgagagaaaagcggtaagttctcttaaagaagctgatctagaacgaataaaagatggcgaaagaaatgaggcaattgtagaagcaatacgaagctggattgcaacagggagaccagctgatgcaccaccgagaagtccaagaggagatataatcactaaaataagactagcaacaacaattaaagcagcagttccagtcaggggaggaacagcaggtagaggcgagatggttcgggcggacgtattttctaaaccaaatagaagaggaaaagacgaatggtatctggtcccagtgtacccacatcaaataatgaacagaaaagcctggcctaaaccgcccatgagaagtatagttgccaacaaagatgaagacgaatggactgaagtagggcctgaacatcaatttcgattcagtttatatccaagaagtaatattgaaataatacgaccgtcaggagaagtaatagaaggatactttgtcggacttcatagaaacactggagcactaacaataagcgcacataatgatccaaaatcgattcattcaggaataggcacaaaaacattactcgcgatatcaaaatatcaagtggatagatttggtagaaaatcaccagtaagaaaagaggtaagaacatggcatggcgaagcatgtattagtccaacaccaccaggatga

SEQ ID NO: 8433 - RNA, 3153 nt, synthetic construct
  misc_feature 1..3153: note = Cas9 variant
  source 1..3153: mol_type = other RNA
atgaaaatactaggatttgatattggtatagcaagtataggatgggctttcgtagaaaatggagaactaaaagattgtggtgttcggatttttactaaagccgaaaatccaaaaaccggtgatagcctcgcaatgccaagacgtgaagcaaggtcagtaagaaggcgattagcaagaagaaaaggacgcttggaaacactcaagcgactactagcaaaagaatgggacttatgctacgaggattacattgcagcggatggtgaactaccaaaagcattcatgggcaaaaacctaaacaatccatatgtcttgcgatatgaagcattacaaaggctactctcaaaagaagaattagtacgggtagtccttcatatagcaaaacatcgaggatacggaaataagaacgcgaaaatcacaaaatcagaagaatctaaacgagaacaagggaaaatattaagtgctttagcaacaaacgcttcggcaatcgctaggtacagaactgttggggaatatttttacaaagaattttgcgaagtgattaaaaacccacaaggcttatccactaatgaacattatacacaatcaaaagtccgtgtgttaaaaccaataaggaacaaaggaggcgagtatacaaactgcatattacaagaagatcttcaaagagaattaagatgcatctttgaatatcaaaaaggtttcggatttcctataactcaagagttccaagacaaaatcctaaagatagctttttaccaaagaccattaaaagactttagtcatttagtaggaaaatgcacgttctacccggacgagttcagagccctaaaatgttcgttatcggcagtagaatttataactttatcaaaaactataaatgtcttaacctatatatcaaaagaaagcggagaagtgtatagcaaaggtcaatacgaacaaatgttagatagtgtatttaaagccgtatgtgaaaaaggatcattatcatttgctcaattaagaaaaatactacatatagacgaaagaataagatttaaagaagtagactatatggctagaaaaagtaaaaacacatcaggagatagcacccataaacagaaaacatctaaccctgaaacaaagaaatttatagaacacaaaaatttaaagaaattttgtgagatactgtcagaaatcgccgaagatagagcactagctgatagcatagcacgagacatgactctcataaaagacgaagaaaaattagcgcaaaaactccatggatacggtaaatttagccaagaacaaataacgcaactttcagctctaaacttctcacatcatataaacttatctttaaaagcattatcagaaatcttaccattcatgagagaagggatgaggtacgatgaagcgtgcaaactagcaggactgaaagctagacacaatgacaagaaatccaaatttttaccaccattttgtgaatcaatctatgctgatgaactcacgaatcctgtagtacacagagctattgccgaatatagaaaaatattaaacgcgcttatcgcgaaatacggtagcgttcataaaatccatattgaactaacaagagatgtggggaaaaacttccaagaacgtgaaaaatacaagaaagaaatagaaagtaactacaaagccagggtccaagcaatgcaagaatgtgaaaaactaggattaacactaagtgaaggaaacatactaaaactacgcctattcagagaacaaaatgaaatctgtgtatatagcggacgaaaaatcactttggctaacctaaaagaacagggtgcattagaaattgatcacatactaccctacagtcgaagctccgacgattcatatatgaataaagtattagtatttacaaacgaaaatcaaaacaaaggaaataaaacaccatatgaagcatttggaggagactcacaaaaatggggagaaatagaatctttagcattacgatcaggatacccaaagaagaaagccaaaagaatactcgataaaggattcggagatagggaagctggctttaaatcaagaaatattgttgactccggttatatagcacgattaatagcaaattacacgaaagagtacttaaaattcctacctttagattcccatgaaaatactgcattaattgcaggagaaaaagattcaaaaatccatgtggaagcagtgaaaggtatgctcaccgccacaatgcgtcatttctggggtttaggatctaaaaatagatatgaacacacacatcacgctgtagatgctatcataatagcttacataaacgcagcaatgatacaacgattctctcaattcagacaaaatcaagaaagcctaaaggcaagattctacgcaaaagaattggcaaaagaagaatttaaaactcaacgagcattctttgaaccttttagggggtttagggaacaagtattagcaaaagtgggtcaaatatttgtgtcaagaccaccacgaaaacgcgcacgaggagctctacatgaagagaccttctatagtatagacgataagaaattaagcgagacatacggtggaaaagaaggtgtacaaagagctttaagcctaggaaaaataaggcagataggaactaaaatagtcgcgaacggacccatggtaagagtggatatatttaaacataaacaatcaaggagattctatgctgtccccatttacacgatggactttgcactagggattctacctaataaagcagtagtatccggcaaagacactaaatctaaggtaataaaagactggttagaaatggattcgtgttatgagttctgcttctctttatttaaagacgacctaattgaagtccagaaaagcgatatggaaaaaccagaattggcttatttcgtttcactagatgcttcagacggacgaataaaagttagacatcattgtaatgacattacaaaaataaacgaaaatcaaaagaaattattctctgaagcgatagaaaaagaagtagttggacgaggtagcatacaaaacctcaaagtctttaagaaatacaaagtatccccactcggagaaatcaaagaagcaaaatatgaaccgagacaacccatagccttaaaaaccagtccaaagaaacatagaaaacaaaacaatgctcaatga

SEQ ID NO: 8434 - RNA, 3156 nt, synthetic construct
  misc_feature 1..3156: note = Cas9 variant
  source 1..3156: mol_type = other RNA
atgaataactatatcttggggttagacatcggaattacgtcggtaggatacggtatagtcgacagcgacacaagagaaataaaagatgcaggagtcagattattcccagaagcaaatgtcgacaacaatgaaggtagaagatcgaaacggggagccagaagactcaaaagacgtagaattcacagactggacagagtaaagcacctactagcagaatacgacctattagacttaacaaacataccaaaatcaactaatccataccagacgcgcgtaaaaggtctcaacgaaaaattatccaaagacgagctagttatagcactactacacatagcgaaaagaaggggaatacataatgtcaacgtaatgatggacgacaacgatagcggaaatgagctaagcacaaaagaccagttaaaaaaaaacgccaaggcactttcggataaatacgtatgcgaattacaacttgaacgatttgaacaagactataaagttagaggagaaaaaaaccgattcaaaacagaggattttgttagagaagcacgcaaactactagaaacacaatccaaattcttcgaaatcgaccaaacatttattatgagatacattgagctaatcgaaactagaagagaatacttcgaaggacctggtaaaggatccccattcggatgggaaggaaatattaagaaatggttcgagcaaatgatgggacactgtacctacttcccagaagaacttagatctgtaaaatacagttactcagctgaactattcaacgcattgaacgacctgaacaatttagtaattactagagacgaggacgcaaaactaaactatggagaaaaattccaaataatagaaaatgtatttaagcaaaagaaaacacccaaccttaaacaaatagccatagagataggtgtacatgaaacggaaattaaaggctacagagtcaacaaaagcggtaaacctgaattcactcagttcaaactatatcacgacctaaaaaatatatttaaagatccaaaatatttaaatgacatacaattaatggataacattgcagaaatcatcacaatctaccaggacgctgaatcaataataaaggaactaaaccaattaccagaactattatccgaacgagaaaaagaaaaaatatccgcgttatccggatattcgggtacacatcgcctaagtttaaaatgcataaacttattacttgacgacctctgggaatcatctctaaaccaaatggaactattcacaaaactcaacctcaaaccaaagaaaatcgatctatcacaacaacataaaataccatcaaaactcgtagatgatttcattctttcgccagtggtaaaaagagcattcatccaatccatacaagttgtaaacgcaattatagacaaatacggactcccagaagacattataatagaactagcacgcgaaaataatagcgatgacagaagaaagtttttaaaccaattacaaaaacaaaacgaagaaacacgcaaacaagtagaaaaagtcttaagagaatatggaaatgacaatgcaaaaagaatagttcaaaaaataaaattacacaacatgcaagaaggcaaatgcctctattcactaaaagatataccactcgaggacctactaagaaacccacaccactatgaagttgaccacatcataccaaggtctgttgcatttgacaacagtatgcacaacaaagtattagtgagagctgacgaaaattcgaaaaagggaaatagaacaccataccaatatctaaacagttccgaaagttccttgagttataacgaatttaaacaacacatcttaaacctaagcaagacaaaagacagaataacaaaaaaaaaacgagaatatttactagaggaacgcgacataaataaatttgacgtgcaaaaagaattcatcaacagaaacctcgtagacacaaggtacgcaacaagagaactcacatccctattaaaagcctacttttcagcaaataacctagacgttaaagttaaaacaataaacggatcctttacaaattacttacgaaaagtatggaaatttgacaaagatcgaaacaaaggatataaacaccacgccgaagacgcactaataatagcaaacgcggactttctgttcaaacacaataaaaaactacgcaatatcaataaagtattagatgcaccaagcaaggaagtagacaaaaaaagagtcacggttcaatcagaagacgaatacaatcaaatattcgaagacacacaaaaagctcaagcaatcaaaaaattcgaaatacgcaaattctcccatcgcgtggacaaaaaaccaaatagacaactaataaatgacaccctatactccacacgaaacattgacggtatagaatacgtagtagaatcaataaaagacatatactctgtcaataatgacaaagttaagacaaaatttaaaaaagacccacacagattactcatgtatcgcaacgacccccaaacgtttgaaaaattcgaaaaagtctttaaacaatacgaaagcgaaaaaaacccttttgccaaatattacgaagaaactggcgaaaaaataagaaaattttcaaaaacaggacaaggaccatatataaataaaataaaatacctaagagaaagactaggaagacactgcgatgtcacaaacaaatacataaatagccgaaacaaaattgtacaattaaaaatatacagctatcgattcgacatctaccaatacggcaacaactacaaaatgataacaatatcctacatagacttagaacaaaagtcaaattactattatatttcacgagaaaaatatgagcaaaaaaaaaaggataagcaaatagatgactcatacaaattcataggaagtttttacaaaaatgatataatcaactataatggggaaatgtacagagtaattggagtcaatgattctgaaaaaaataaaattcaattagatatgatagacatcagcataaaagactatatggaattaaacaatataaaaaaaacaggcgtaatatataaaacaataggtaaatcaaccacccatatagagaaatatacaacggatatactaggaaacctatataaagcagcacctccaaaaaaaccgcaactaatttttaaatga

SEQ ID NO: 8435 - RNA, 3159 nt, synthetic construct
  misc_feature 1..3159: note = Cas9 variant
  source 1..3159: mol_type = other RNA
atggaaaataaaaacctacactacatactaggattagatctaggaatagcctctgtaggatgggcagtcgtggaaatcgacgaaaaggaaaacccattgaggctcatagatgtaggcgtacgaaccttcgaacgcgcagaaacacaaaaaggagaatcattggcactatcaagaagatcagcaagatctgcccgcagattaacacaacgtcgggtagcacgcttgaagaaagctaaacggctactgaaatctgaaaatatacttctttcaacagatgaacgactaccacaccaagtttggcaactaagagtagaaggattagatagaaaattagaaagacaagaatgggcagctgtacttttacatttaataaaacatcgaggatatttaagccagagaaagaacgaatcaaaatcagaaaataaagaactcggtgcgctactgtcaggtgtagcaagcaaccatgaattattacaacaagcaacatatagaacccctgcagaattggccgttaagaaatttgaagtagaagaaggacacattagaaaccaacagggcgcatatacacatacatttagtagactagatcttcttgccgaaatggagttattattcagtagacaacaacatttcggcaatccgttcgcttcagaaaaattactagaaaaccttacagcgctattaatgtggcaaaaacccgcattatcaggagaagacatacttaaaatgctaggcaaatgtacattcgaagacgagtataaagccgccaaaaatacgtacaccgcggagcgatttgtgtggattacaaaactaaacaatttacgcatacaagaaaacggtctggaaagagcactaagcgacaatgaaagattaatgttaatagaacaaccatacgaaaaagcgaaattgacttacgcccaggtaaggtcaatattaaatctaagcgacgacgctatattcaaaggagtaagatacagcggagaagacaagaaagcaattgaaaccaaaacaaccctgatggaaatgaaagcgtaccatcaaatcaggaaagtccttgagggaaacaacctaaaagcagaatgggtagcgttaaaagcaaatccaactttattagacgagattggtacagctttcagtctgtacaaaacagacgaagacatatcagcataccttgctggcaaacttagccaaccggtattaaacgctttactggagaatttatcattcgataaatttatacagttaagtctaaaagccctttacaaattattgccattgatgcaacaaggattaagatatgatgaagcatgtagagaaatatacggagaccactatgggaagaaaacagaggagactcatcattttcttccccagataccagcagatgaaattagaaatccagtagtactaaggacactaactcaggctcggaaagtcattaacggtgtagttcgactttatggcagtcccgctcgaatccatattgaaacagggagagaggtaggaaaatcctataaagatagacacgaattaaagaaaagacaagaagaaaatagaaaacaaagagagaaaacaataagtgaaattaaaactctattcccaaacttttcaggtgaaccaaaaggaaaagacatactaaaaatgagactatattaccaacaaaatgcaaaatgcctttattcaggaaaaccactagaactacatcgattatttgaacaaaaatacgtagaagtagaccatgctttaccactaagccgcacttgggatgactcattcaataacaaagttttagtcctagctaacgaaaatcaaaacaaaggtaacttaacaccatttgaatggttagatggtaaaaacaatagtgaacgatggagaacgtttaaggctttagtagaaacatctgccttcccatacgcaaagaaacaacgaatattatcacaaaaattagatgaaaaaggatttattgagagaaatctaaacgatactcgatatgtcgccagattcctatgtaactttatagcagataatatgcacctcacaggtgaaggcaagcgaaaagtatttgcatctaacggacaaataaccgcattattaagaagaagatggggattagcaaaaagtagagaagacaacgataggcaccatgcactagacgcagtattagtagcatgttccactgtagcaatgcaacaaaagataacacgatttgtccgctttaaggccggtgacgtcttcacaggtgaacgaatcgaccgcgaaacgggggaaataatacccctacacttccctactccatggcaattcttcaaacaagaagttgaaattcgaattttctcagacaacccaaaactagaactagaaaatagactaccagacagacctcaagcaaaccatgagttcgtacaaccactatttgtatcaagaatgccaacccgcaaaatgaccggacaaggacatatggaaacggtcaaaagcgcaaaacgtctcaacgaaggaataagtatgatcaaaatgccattaaccaaactgaagttaaaagaccttgaattgatggtaaacagagaaagagaaaaagacctatatgacgcactcaaaactagattagaagcctttaacgatgacccagcaaaggcttttgcagaaccatttatgaagaaaggcggagctattgtaaaatcagtcagggttgaacaagtacaaaaatcaggcgttctagtaagacagggtaatggggtcgcagataacgcaagtatggtacgagtcgatgtgttcacaaaagacggaaaatacttcctcgtacccatatacacttggcaggtagcaaaaggaatactacccaacaaagcagtaatacaaggtaaagacgaagaagattgggaagacatagatgacgcgacttttcaatttagcttacatcccaatgacctaatatcagtaaaaaccaaaaaggacgagttcttgggatactttaacggactaaatagacatacaggtggcatcaatataagaacacatgacctagaaaaatcaaaaggcaaacaaggtatcttcgaaggtatcggagtaaaaatagccctatcatttgaaaaatatcaaatagatgaactaggtaaaaacatcagattatgtaaaccaagcaaacgacaacccgttcgatga

SEQ ID NO: 8436 - RNA, 3159 nt, synthetic construct
  misc_feature 1..3159: note = Cas9 variant
  source 1..3159: mol_type = other RNA
atgaaaaacacatcgttaaactacgtacttggattagatcttggaatttcttcggttggatgggcagtcgtagaaatagatgagaaagaaaaccccctcagcttgatagatgtaggagtacggacattcgaaagagcggaaacacaaaaaggagaaagtctagcactagctagaagactagcaagatcagcaagacgactaacacaaagaagagtcgctagattgaagaaagccaaacgactattaaaaagcgaaaatatactattaagcaccgatgagtgtttaccacatcaagtatggcaactaagagttgaaggcttagaacgaaaattagaaagacaggaatgggcagcagtgctattacatttaataaaacatagaggatatttatcccaacggaaaaatgagtcaaaaagcgagaacaaagaattgggtgcactactaagtggggtagccaacaatcacaaactattacaacaaacaacataccgaactcccgcagaactagctgtaaagaaattcgaggtagaagaaggtcatataagaaaccaacaagggtcatatacacatacatttagccgattagatttactaagcgaaatggaattactatttagtcgacaacaacacttcggtaacccatttaccagcgaaaaattactagaaaacttgacagcactgctaatgtggcaaaagccagcgttatcaggagacgccatcctaaaaatgttaggaaagtgtacatttgaaaatgaatataaagccgcgaaacatacatatagtgctgagcgatttatctggattacaaaactaaataatttgagaatacaagaaaacggtctagaacgggcactaaatgataatgaaagattagcactaatgaaacaaccatatgagaaagccaaattaacatacgctcaagtcagaagtatattaaacctttcagatgaagcaatctttaaaggattgagatattccggtgaagacaagaaaacaagcgaaacaaaaaccgtactcatggaaatgaaggcttatcatcaaataagattagcattagagaaaaacgatctaaaaactgaatgggcagaattaaaagttaactcatcgttactggacgaaataggaacagccttctctttatataaaactgatgaggacataagtacatgtctagcaggaaaactaagtcaaccagtactcaacgcacttctagaaaacctaaatttcgataaatttatccaactaagtttaaaagcattacataaaatacttcccctcatgcaacaaggcctaagatacgatgaagcctgcgcagaaatctacggagaccattatggaaagaaaactgaagagaatcatctattactaccacaaataccagctgatgaaatcagaaatccagtcgtactgcgtacattaactcaagcaagaaaagttataaacggggtcgtcagactatacagtagtccagcaaggatacatatagaaactggaagggaagttggcaaatcgtaccaagacagacgagaactagagaaaagacaagaagaaaacagaaaacaacgcgaaaaagccatatctgaaattaaaaccctttttccgaatttcagtggagaaccaaaagcaaaagacatattaaaaatgaggttatattatcaacaaaatgcaaaatgcttatattctggcaaaccattagaattacacagattgctagaacaaggatacgttgaaatcgatcacgcattaccatttagtagaacgtgggatgattcctttaacaacaaagtattggtattagcgaacgaaaatcaaaacaaaggtaatctaaccccattcgaatggttagacgggaaaaataatagcgaaagatggaaagcattcaaagcgctagttgaaacatcagcatttccctatacaaagaaacaaagaatccttagtcagaaactagacgaaaaaggatttatagaacgaaacctgaacgataccagatatgtggcaaggtttctctgtaatttcatagctgacaatatgcatttaacaggagaaggcaaaagaaaagtatttgcaagcaacggacagataactgcccttctaagaggaagatggggattagcaaaatcaagagaagacaacgatagacatcacgcacttgatgcagttgttgtggcatgctcaaccgtaagtatgcaacagaaaattactagattcgtaagatttgaagaaggaaatgtattcacaggagaacgcatagacagagaaactggtgaaataattcccctacattttccagcaccgtggaaattctttcgagaagaagtagaaatacgaatatttagcgataatccgaaattggaactcgaaaatagattaatagcaaggccacaagcaaaccatgagtttgtacaacctctatttgtaagcagaatgccgacccgtaaaatgacaggtcaagggcatatggaaaccataaaaagtgcgaaaaggcttaacgaaggactatcagttataaaaatgttattaacaaaattaagattaaaagatttagaatctatggtaaatagggaacgtgaaaaagaactgtacgaagcgttaaaagctagactcgaagcatttaatgatgaaccagcaaaagcatttgcagaaccatttatgaagaaaggaggcgcgatcgtaaaaagcgtgcgagtagaacaagtacagaaaagtggagtactcgtaagggatggaaacggagttgccgataacgcgagtatggtaagagtagacgttttcactaaaggaggaaaatatttcctcgtccccatctatacgtggcaagtagctaaaggtatactgccaaataaagcagtaatacaagggaaaaatgaagaagactgggaagtgatggacgacgcgacttttaggttctccctgcatcaaaatgatttagtaaaattagtaactaaaaagaaaacaatcttcgggtacttcaacggcctaaatagagcaacagggaacattgacattaaagaacatgatttagaaaaatcaaaagtgaaagatggaatacaccaatcaatcggcataaaattggcactgagttttgaaaaatatcaagtagatgaacttggcaaaaatatacgattatgtaaatcctcaaaaagacaagcagttaggtga

SEQ ID NO: 8437 - RNA, 3159 nt, synthetic construct
  misc_feature 1..3159: note = Cas9 variant
  source 1..3159: mol_type = other RNA
atgataggagaacatgtcagaggcgggtgtttatttgacgaccattggactccaaactggggagcctttcgtcttccaaacacagttcgaacattcactaaagcagaaaatccaaaagacggttcatcacttgccgagcctagaaggcaagcacggggacttagacgccgtttaaggagaaaaacacaaagactagaggatttacggagactcctagccaaagaaggagtattaagtttgtccgatctggaaacactctttagagaaactccggcgaaagatccctatcaattaagagcagaagggctagatcgtccgctgagctttccagaatgggtccgagtattatatcatataactaaacatagaggtttccaatctaacagaagaaatccagtcgaagacggccaagaaaggtccagacaagaagaagaaggaaaactactgagcggcgttggagaaaacgaaagactcctacgcgaaggaggctacagaacagccggtgaaatgctagcaagagatccaaaattccaagaccaccgaagaaacagagcaggagattattcacatactctaagtaggagtttgttattagaggaggcacgaagattattccaaagtcaaagaacattaggaaatccccacgctagctcaaacttggaagaagcgtttctccatcttgtagcattccaaaatccatttgcatcaggagaagacattcgaaacaaagcgggacactgttcattagaacctgaccaaataagagcaccaagaagatcagcatcagctgaaacattcatgttactccagaaaactggaaatctgagattaattcatagaagaacaggagaagaaagaccattaaccgataaagaacgagaacaaatccatttacttgcctggaaacaagaaaaagtcacccacaaaacactaaggagacacctagaaatacctgaagaatggcttttcacagggctgccatatcatcgatcaggagataaagctgaggaaaaactatttgtccatctagccggaatacacgaaataagaaaagccttagataaaggaccggatccagcagtatgggatactctaagaagtagaagagatttactagacagtatagctgatacattaactttttataaaaatgaggatgaaatattaccccgacttgaatcgttaggtttaagcccagaaaatgcgagagctctggctccattaagttttagtggaacagctcacttgtccctatcagcattaggtaaactactccctcacctagaagaaggcaaatcatatactcaagcacgagctgacgctggttatgcagcacctcctccggatagacatccaaaacttcccccattagaggaagcagattggcgaaatcccgtggtattccgcgcattaacgcaaacaagaaaagtagtcaatgcacttgtcagacgatatggaccgccatggtgcatacacttagaaacggctagagaattaagtcaaccagcgaaagtcaggagacgaattgaaacggaacaacaggcaaatgagaaaaagaaacaacaagcagaacgagagttccttgacatagtaggtaccgcgcctggaccaggggaccttcttaaaatgagattatggagggaacaagggggattttgcccatactgtgaagaatatttaaaccccactagactggcagaaccaggatatgctgaaatggatcatatactaccatatagccgttcattagataatgggtggcacaatagagtactggtacacggaaaagataacagagataaaggaaataggactcctttcgaagcgttcggaggagataccgcccgatgggacagattagtagcatgggtacaagctagccatctaagtgcaccaaagaaaaggaacttactgagagaagattttggagaagaagccgaacgtgaattaaaagatagaaacttaaccgatacgagattcattacaaaaacagctgctaccctattaagagatagactaacattccatcctgaagcaccaaaagatccagtaatgaccttaaatggtagattaacagcgtttttacgaaaacaatggggactacacaaaaataggaaaaatggggacttacaccatgcactagacgcagcggtccttgcagtagcaagtagatcattcgtttatagactgtcatctcacaacgcagcttggggtgaattacctagaggcagagaagctgaaaacggattttcactaccatacccagcctttagaagcgaagtgttagctagactatgtccaacaagagaagaaattcttttaagattagaccaaggtggcgttgggtacgacgaagcctttagaaatgggttaagaccagtatttgtatcaagagcgccgtcacgaagattaagaggtaaagcccatatggaaacactacgaagccctaaatggaaagatcacccagaaggtccacgcacagcaagtagaataccattaaaagatctaaacttagaaaaactagaaaggatggtaggaaaagaccgagatcgaaaactatacgaggcgttaagagaaaggttagcagcttttggtggtaatggaaagaaagcatttgtagctcctttccgaaaaccatgtagatcaggagaaggacccctagttcgatccctaagaatattcgacagtggatattctggtgtagaattgagagatggaggagaagtttatgcagtagcagaccatgagtctatggtacgagtagatgtatatgctaagaaaaatcgattctatttagttccagtatatgtggcggatgtggcaagaggcatagtgaaaaatcgagctatcgtagcccataaaagcgaagaagaatgggatctcgtagatgggtccttcgatttccggttcagtttattcccaggcgatctcgtagaaattgagaagaaagatggcgcttacctaggctattataaatcatgccatagaggagatggtcgtctacttcttgatagacacgatagaatgccaagagaatccgactgcggaacattctatgtgtcaacaagaaaagacgtactgtccatgagtaaatatcaagtagatccacttggcgaaatccgtttagtaggtagtgaaaaaccaccatttgtgctttga

SEQ ID NO: 8438 - RNA, 3162 nt, synthetic construct
  misc_feature 1..3162: note = Cas9 variant
  source 1..3162: mol_type = other RNA
atgaaaagaaactatatccttggactagacatcggaataacaagcgtcgggtacgggataatcgactatgaaacacgagatgtcatagacgctggcgtacgcctattcaaagaagccaacgtagaaaacaacgaaggaagacgttcaaaaagaggagccagaagactaaaaagaagaagaagacatcgaatacaacgagtaaaaaaattactatttgattataacttattgactgaccactcagagttatcggggatcaacccttacgaagcaagagttaaaggtctatcccaaaaattatccgaagaagaattctcagcggcattattacacttagcaaaacgcagaggagtacacaacgtaaacgaagtagaggaagacactggaaacgaactctcaacaaaagaacaaatatcaagaaactcgaaagcactggaagaaaaatacgtcgcagaactacaattagaacgcttaaaaaaagacggagaggtaagaggctcaataaacagattcaaaacctcagactacgtaaaagaagcgaaacaattactaaaagttcaaaaagcataccaccaacttgaccaatcattcatagatacatacatcgatttactagagactagaagaacctattatgaaggcccaggagaaggctctcccttcggctggaaagacatcaaagaatggtatgaaatgcttatgggccattgcacatacttccccgaagaactacgatcagtaaaatacgcatacaacgcagacctctacaatgcactgaacgaccttaacaacctagtaattacccgagacgaaaacgaaaaactagaatattatgagaaattccaaataatcgaaaacgtatttaaacagaaaaaaaaaccgacattaaaacagatagcaaaagaaatattggttaatgaagaagatataaaaggatatcgagtaacgtcaaccggaaagccagaatttacaaacctgaaagtataccacgacattaaagacataacagcacggaaggaaataatagagaatgccgaactgttagatcaaatcgcgaaaattctaacaatataccaatcatccgaagacatacaagaagaacttactaacctaaactcagaattaacccaagaagaaatagaacaaatttcaaacttaaaaggctatacaggcacacataacttatcactaaaagcaataaacctaattcttgacgaactctggcacacaaacgacaatcaaatcgcaatatttaatagattgaaactagtaccaaaaaaagtagacctatcacaacaaaaagaaatcccaacgactctagtagacgactttatcctctccccagtcgtcaaaagatcctttatacagagtataaaagtaataaacgcaattataaaaaaatacggacttccaaacgatatcataatagaactcgcacgagaaaaaaacagtaaagatgcacaaaaaatgatcaatgaaatgcagaaacgaaacaggcaaaccaacgaacgaatagaggaaataattcgtacaacaggtaaagaaaatgcaaaatatctcatagaaaagataaaattgcatgacatgcaagaaggaaagtgcctgtactcattagaagcgataccattagaagatttactaaacaatccttttaactatgaagttgatcatataatacccagatcagtatcattcgataactccttcaacaataaagtgctagtaaaacaagaggaaaacagcaaaaaaggcaaccgaacacctttccaatacttatcatcttcagattctaaaattagttatgaaacattcaagaagcacatacttaacctagcaaagggcaaaggaagaattagcaaaacaaaaaaagaatacctactagaagaacgcgatatcaatcgattctcggtacaaaaggacttcataaacagaaacttagtggacaccaggtacgccacacgaggactaatgaacttactacgcagttatttcagagtaaacaacctagacgttaaagtaaaatcaattaacggaggctttacaagctttctaagaagaaaatggaaattcaaaaaagagagaaacaaaggctacaaacaccatgcggaagatgctctaataatcgctaacgcagacttcatcttcaaagaatggaaaaaattagacaaggcaaaaaaagtaatggaaaaccaaatgttcgaagaaaaacaagctgaaagtatgccagaaatagaaacagaacaagaatataaagaaatattcataaccccacatcaaataaaacacataaaagacttcaaggattacaaatattcccatcgagtagacaaaaaaccaaacagagaactaattaacgacaccctatacagtacaagaaaagacgataaaggaaacaccctaattgttaacaacttaaatggactatatgacaaagataatgataaacttaaaaaattaataaacaaatcaccagaaaagctattgatgtatcaccacgacccccaaacatatcaaaaattaaaactcatcatggaacagtatggcgacgaaaagaaccctttatataaatattatgaagaaaccggaaactacctcaccaaatactcaaaaaaggacaatggacctgtaatcaaaaaaataaaatattacggaaacaaactcaatgcacacttagatataactgatgactaccctaactcgagaaataaagtagttaaactcagtctaaaaccatacagattcgacgtatacctcgataacggagtatataaatttgtcacagtaaagaacttagatgtcataaaaaaagaaaattattacgaagtaaacagcaaatgttacgaagaagcaaaaaaactaaaaaaaatatcaaaccaagcggaatttattgcttcgttctataacaatgaccttataaaaataaatggcgaactatatcgcgtaatcggggtcaataatgatctcttaaaccgaatagaagtaaatatgatcgacataacataccgcgaatatctagaaaacatgaacgataaaagaccacccagaatcataaaaactattgcgagtaagacacaatcaataaaaaaatatagtaccgacattttaggaaacttatacgaggtaaaaagtaaaaaacatccacaaattatcaaaaaaggatga

SEQ ID NO: 8439 - RNA, 3162 nt, synthetic construct
  misc_feature 1..3162: note = Cas9 variant
  source 1..3162: mol_type = other RNA
atgaaaagaaactacatattaggactcgacataggaataacatcagtaggttacggtattatagactatgaaacacgtaacgtaatcgatgctggagtccgactcttcaaagaagccaatgtagagaacaatgagggacgaagaagcaagagaggcacaagaaggctgaaaagacgacgaagacaccgtttacaaagagtaaaaaaattactatttgaccataattttctcacagataattcagaattatctggaatatcaccgtatgaagcacgagttaaaggtttaaaccaaaaaataagtgaagaagaattctctgttgccctattacatttagcaaagcgaagaggagtacataacgtaaatgaagtcgaagaagatacaggaaacgagctaagcacaaaggaacaaatatcccgtaactcaaaagctctagaagaaaaatacgtagcagaactacaattagagaggctcaaagtagacggagaagtacgtggcgcagtcaatcgctttaagacctcagattacgtaaaggaagcgcaacaaatcctaaaagtacaaaaagcatatcaccaatttgaccaatcattcatagacacttatattgacttactagaaacccgaaggacttactacgagggaccaggagagggatcaccattcggttggaaagacattaaagaatggtatgaaatgcttatgggacaatgcacatactttccagaagaattgagaagcgttaaatacgcctataatgcagacctatacaacgcgttaaacgaccttaataacctcgtaattgcccgtgatgaaaatgaaaaactagaatactacgaaaaattccaaataatagaaaacgtattcaagcaaaaaaaaaagccaacactcaaacaaatagcaaaagaaatacttgttaacgaggaagacataaaaggataccgagtcacctcaacaggaaagccagaattcacaaatttcaaagtctaccacgatataaaatcaataactagtcgaaaagaaatattagaaaacgcagaactgctaaatcagatagcaaaaatattaacaatctaccaaagctccgaagacatacaaggagagttagcacggctctattcagagctcacgcaagaagaaatagagcaaatatcaaagctggcaggttacactggaacccatagactaagcctaaaagctataaatctaattatagacgaactatggcatacttcagacaaccaaatggagatcttcaacagattaaaactcgtacctaaaaaagtagacttatcccaacaaaaagaaataccaacaacacttgtagacgacttcatccttagtcccgtagtcaaacgctcatttatacagtcaattaaagtaataaacgcaataatcaaaaaatatggattcccaaatgacataataatagaacttgccagagaaaaaaattctaaagatgctcagaaattcataaacgagatgcaaaaacggaatcgacaaacaaacgaacgaatagaagaaatcataagaacaaccggtaaagaaaacgcaaaatacttaatagaaaaaataaaattacatgacatgcaggagggaaaatgcctatattctttagaagcaattccactcgaagatttattaaacaatccttttaattacgaagtcgaccatatcatcccgcgatcagttagcttcgacaattcattcaataataaggtcttagtcaaacaagaagaaaactcaaaaaaaggaaatagaactccattccaatatttttccagttcagactcgaaaatatcatacgaaatattcaaaaaacacattcttaacttagcgaagggcaaaggacgaataagtaaaaaaaaaaaagaatatctcctagaagaaagggatataaacagattttcagtacaaaaatacttcataaataggaatcttgtcgatacccgttacgcaaccagagaactaatgaacctactccggtcatacttcagagtaaatgatctagatattaaagtaaaatcaatcaacggaggattcacatcattcctcagaaaaaaatggaaattcaaaaaagaacgaaataaaggatataaacatcacgcagaagatgccctcataatagcaaatgcagacttcatttttaaagaatggaaaaagctcgacaaaacaaacaaagtaatggaggaccaaatcgtagaagaacaacaagcagaatctatgcccgaaatcgaaacagaacaggaatataaagaaatattcataacaccacatcaaatacaagacataaaagacttcaaagactataagtattcgcatagggttgataaaaagccaaatagagaactcgttaacgataccttgtactctacccgaaaagacgacaaaggcaacaccttaatagtaaacaatctaaaaggcttatacgataaagataatgacaaactaaaaaagctaattaataaatccccagaaaaacttctaatgtatcaccatgacccacaaacataccagaaactaaaggtaattatggaacaatacagcaacgaaaaaaatcctttatataaataccatgaagaaacgggaaactacttaacaaaatattcgaaaaaagacaacgggcccgttataaaaaaaataaaatattacggaaacaaactaaatgtatacttagacataacaagagactacctaaaaagtaggaacaaaatagtaaaactgtcactaaaaccatacaggtttgacgtctacctagacaacggcgtatacaaatttgtcactgtcaaaaacctagacattataaaaaaggaggattattacgaagtagactccgactcctacgaagaagctaaaatagtcaaaaaagtaagcgagcaagcacaattcgtcgcatcattctataataacgacctaataaaagtagatggagaactttttcgtgttataggagtgaataacgatctgctcaaccgaatagaagtaaacatggtcgacatcacttacaaagaatatctggaaaacataaatgacaaaaaatcctcacgaattattaaaacaatctcaagtaaaactcaaagcataaaaaaatacagtaccgacatattaggaaatctatatgaagcaaaatcaaaacagagaccacaaatgacaatgaaaggatga

SEQ ID NO: 8440 - RNA, 3162 nt, synthetic construct
  misc_feature 1..3162: note = Cas9 variant
  source 1..3162: mol_type = other RNA
atgaagagaaattatatattgggtcttgacataggaataacatctgtaggttatggaataatcgactacgagacaagagatgtaattgatgcaggagtaagactcttcaaagaagcaaacgtagaaaacaacgagggtcgaaggagtaaacgaggggcaggccgtctaaaaagaaggcgacgacacagactacaaagagtcaaaaaactattattcgattacaacctcctcacagaccactcagaacttagtggaatcaacccatatgaagccagagtaaaaggacttagtcaaaaactatcagaagaagaattttccgcagcattattacacctagcaaaaagaagaggagttcacaatgtcaatgaggtagaagaagatacaggaaacgaactttccaccaaagaacaaataagtagaaacagcaaagcattagaagaaaaatacgtcgcagaattacaattagaacggctcaaaacggacggcgaagtaagaggtagcatcaacagattcaaaacatcagactacgtgaaggaggcaaaacaactattaaaggtacaaaaagaataccaccaacttgaccaaagttttatagacacgtatatcgacctattagaaacgagaagaacctactacgagggacctggagagggatcacctttcgggtggaaagacataaaagaatggtatgagatgctaatgggacattgcacatacttcccagaagaattaagaagcgtaaaatacgcatataacgctgacctctacaacgcattaaacgatcttaacaacctggtcatagcaagagatgaaaatgaaaaattagagtattacgagaaattccaaataatagaaaacgtttttaaacaaaaaaaaaaaccaaccttaaaacagattgaaaaggaaattcttgtaaacgaagaagatatcaagggttaccgagtaacatcgaccggcaaacctgaattcagtaatcttaaagtctaccacgacatcaaagacataaccgcgagaaaagaaattatagaaaatgcagaattactagatcaaattgcagaaatattaacaatatatcaatcaagtgaagatatacaagaagaacttgtaaaactaaactcagaacttacccaagaagaaatagaacaaataagcaatttaaaaggatataccggcacacacaacctcagcttaaaagcaattaacctaatattagacgaactctggcacactaatgacaaccaaatggcaatattcaaccgactaaaactagtacccaaaaaagtggacttatctcaacaaaaagaaatacccacaacattggtagatgacttcatattatcccctgtagtaaaacgatcatttatccaatccataaaagtcattaatgcaatcataaaaaaatatggattgccaaatgacataattatagaactagcaagagaaaaaaacagcaaagacgcgcagaaaatgatcaatgaaatgcaaaagagaaatagacaaacaaacgaaagaatagaagaaattatacgaacaaccggaaaagaaaacgcaaaatacctgatagaaaaaataaaactacacgatatgcaagaaggaaagtgcctatattcactggaggccattccactcgaagacctcctaaataacccatttaattacgaagtagatcacataataccaagaagcgtaagcttcgacaactcgtttaacaataaagtacttgtaaaacaagaagaaaactcgaaaaaaggaaacagaacaccctttcaatacttatcatcatccgactcaaaaatatcatatgagacatttaaaaaacatatactaaacctagccaaaggaaaaggaagaatatcaaaaactaaaaaagaatatcttttagaagaaagggacattaacaggttctcggtacaaaaagacttcattaatcgtaatttagtagacacccgatacgcaacacgagaactcatgaacttactacgatcatatttcagggtaaacaacttagacgtaaaagttaaaagcataaacggtggctttaccagctttctaagaagaaaatggaaatttaaaaaagagcgtaataaaggctataagcaccatgcagaagacgcactcataatcgctaatgccgacttcatattcaaagaatggaaaaaactagataaagcaaaaaaagtgatggaaaaccaaacagtagaagaaaaacaagcagaaagtatgagtgaaattgaaacagaacaggaatacaaagagatattcataactccacaccaaattcaacacatcaaagacttcaaagattataaatactcacatcgagttgacaaaaaacccaacagagaactaataaacgacacattgtattcaacaagaaaagacgataaaggcaacacattaatagtaaataatcttaatggtctataccataaagataatgataaactaaaaaaattaatgaataaatcaccagagaaattattaatgtatcatcacgaccctcaaacataccaaaaattaaaactaataatggaacaatatggagatgaaaaaaatccactatacaaatattacgaagaaactgggaattatctaaccaaatactcaaaaaaggacaatggaccagttattaaaaaaataaaatattacggcaataaattgaatgcacacttagatataacagatgactacccaaacagtagaaacaaagtagtgaaactttcattaaaaccatacagattcgatgtatacttagataatggagtctacaaatttgtcactgtaaaaaacctaaacgttatcaagaaggagaactactatgaagtaaatagtaaatgctatgaaaaagcaaaaaaattaaaaaagataagtgaccaagcagaatttatagcttcattttacaataacgacttaataaaaatagatggagaactgtaccgagttataggggtcaatacagacctcattaaccgaatcgaagtaaatatggtagacataacgtatcgcgagtatttggaaaacatgaatgacaaaagaagccccagaatcttcaagacaatagcttcaaagacccaatcaataaaaaaatactcaactgacattctaggcacattatatgaagtaaattcaaaaaaacatccacaaatgataatgaagggatga

SEQ ID NO: 8441 - RNA, 3162 nt, synthetic construct
  misc_feature 1..3162: note = Cas9 variant
  source 1..3162: mol_type = other RNA
atgtcaggtatggtcttcggaatcgatttaggtatagcaagctgcgggtgggcagtattaagacaaccgcaaagagacggagatccaggtgaaattgtagatttagggtcatggatgtttgatgttccagaaacagataaagaaagaacacctacaaaccaagtaagaaggggaaaccggctattaagaagagtcataagacgacgcgcccaaaggatggtagaaataagacgtttatttcacgatcatggcttgctagcaggacatgcaccagaagcactaaaaagagcgggattagatccatgggatttgagagcacgctcattagataaagttctagaaccagcagcactagcagtagcactaggacatatagcaaaaagacgaggatttaaaagcgcagcacgcaggaaagaagcaaacacagcaggagatgatcaaaagatgctgaaagcattggaagcgactcatgaacgacttggcagatacagaacgattggagaaatgttcgcaagagatcctgactttgaaagcaggaaaagaaatagagatggaatgtttgacaggacacaagggagagatgatcttttgcatgaagtaggagaaatatttaaagcacaaaggaggttgggtagcgcattagctacggcagagctggaacaggcattcacagcaatagcattcagacaacttccaattcaagattcagaaagattagtgggactatgtcagttcgaaccgaaagagaaaagagcggcacggtttgcgcctagttttgaacgatttcgacttttacaacgattaacaaacctgagggtagtaacagttgaaggtgaaagacctttaacagcagatgaaatagccgcagctgcggcagatctaggtagaacagcgaaactaagtgtaaaagaagtaaggaaaagaataggattggctgccgaccatcgattcgcggcattcaaagctgatgaggaagatagagatataatagcaaggacaggcgaagcattacacggaacatatagattaaggaaagcattaggagaaggactatgggcagaaatgctacccggccagctagatgcgattgcgcacgcattaagtttcttcgaaacacaagatgtcatcctcaaagaactagataaacttgatctaccggcaggagtccgagacgcaatagcaacaggattggatgcaggagcatttgcaagatttaaaggaaccgggcatatatccgctcgagctgcaagagcactgttgccgcatttggaggccggactacgctatgatcaagcatgtacaaaagcaggatacgatcatgcagcatcgcgatgggccaaaagagaacaggtagctgataaggctgcattcaacaggctagtaactgacatgggtgctgaaatcgcaaacccaatagcgagaaaaagtttaacggaagctctgaaacaactctgggcaatgagaaataggtggggtcttcctgacgcaatacatattgagctagcaagagacgtcggaaacagtttagagaaaaggagggaaatagaaagagctatagagaaaaatactgcagcgagagaaagagaaagaggagaagcaagagatctcctagggatagatgatgtaagcggtgatactctattaagatacagattatggaaagaacaagcagggagatgtccatacacagatgcgcccataccccctggagctattatagcaacagataattcattccaagtagaccacattcttccttggagtaggttcggggatgatagctttgcaaacaaggtactttgtgccactgctgctaatcaaaggaagaaaggacaaacgccatgcgaatggattacggcagcccagggagaagaaggatgggcaacttttgtagcaagaattgaaggtaatgcagcgtttagaggaccaaagaaaagaaactatgtacttaaaaatgcgaaagaggctgaggaacggtttagagctaggaatttaaatgacactcgatatgctgcaagattactagctgaagccgtaaaattattctaccctgaaggcgaacgacaagataaaggaggtgtgagaagggtttttactcgaccagggggtctgacagccgcactaagacacgcatggggagtagaagccctaaagaaacgtgacggaaaaagggtagatgacgcacgacatcacgcacttgacgctttggtagttgcagcaattggagaaggggaggtacaaagattgacaaggtcatatcaggaatgggaacaacaaggacttgcaaggccattacgaagggtggatcctccctggggagactttcattcatttagaagggaagtaaaagatgcatatgacggcatattcgtagccaggcctgaaagaagaagggctcgcggggaaggacatgctgcaaccataaggcaagtgagggaaagggatggagcagccgtagtgtttgaaagaaaagctatagcagacttaagtgagaaaaggctagcggatatcaaagaccccgaaagaaatcaagcaatagtggaagcaattcgacaatggatcgtagacggaagaccagccgatagattaccacggtcaccagctggtgatgaaattagaaaagtgcgcttaaggacaaaagggaaaccagcagtacaagtgaggggtggagcagctgatagaggagaaatagtacgagttgatgtatttacaaaaccgaacaagaaagggaaaaacgagttctatttagtgccaatatatccacatcaagttatgaataaagcggaatggccaacaccaccgatgagggcagtagtagcttataaggatgaatcggaatggacccttttggacgaaaattttgggttcttatttagtttatttcccagatcatatgtagaagtaacaaaaccaggaggagaagtactttcaggatattttcaaggaatggacagatctacaggtgcaatcagtctattcaatcatagagattcaaggagtttaacggatgattcggggaactcaacccgtgggatcggggcaaaaacacttttaacgatgaagaaatatagcgttgatcgttttggaaaaagagcagaagtaaaaagtgaagttagaacttggcatggcgtagcatgtacatatccgacgcccccaggatga

SEQ ID NO: 8442 - RNA, 3165 nt, synthetic construct
  misc_feature 1..3165: note = Cas9 variant
  source 1..3165: mol_type = other RNA
atgaaattaactccactaaactatatactaggactcgacctaggaatagcatcagtaggatgggcagttgttgaaatagatgaacaagaaaatccactgggtctaatcgacgtgggagttcgaacattcgacagggcagaagtagcaaaaacaggagaaagcctagctctagcaagaaggttagcaagatcgtccagacgacttgttaaacgtagagcggacagaattaagaaagtaaaaagactccttaaaagcgaaaatatattactttctgccgatgaacaactacccaacgatgtctggcaattacgtgtaaaaggattggaccaaaaacttgaaaggcaagaatgggctgcagttcttctacatttattaaaacatagaggttatctctcacaacgaaagaatgaatcaaaatcagaaaataaagaactaggtgcattaagatctggcgtagcagcaaatcatcaaatattacagtcagctgaatatagaacaccagcagaaattgctgtcaagaaatttcatgtagaagaaggtcatatacgaaaccaaagaggcgcatacactcacacattttcaagacttgatctattggcagaaatagaattactatttactcgacaaacagaacttgggaaccctcatacaagtgcaaaattgttagaaaatttaaccgctctactaatgtggcaaaaacctgctctagcaggcgaagcaattctcaaaatgctaggtaaatgtacatttgaacccacagaatataaagcagccaaaaactcttactcagcagaaagattcgtttggctgaccaaactaaataatttacgaatactcgaacaaggagcggaaagagcattaaccgataatgaaagatttgccttattagatcaaccatatgaaaaagctaaattcacctatgcccaagcgcgtaccatgctcgcattacccgacgaagcaatatttaaaggagtgagatatcaaggggaagataagaaagccgttgaaaccaaaaccatactaatggaaatgaaagcctaccaccaaattagaaaagcattagaaaacgccgatctcaaagcagaatggaatgaactcaaaaataattcagaattattagatgacatcggaactgcttttagcttacataaaacagatgaagacatatgcagatatctcgatggaaaactatccgaatccatcctaaacgcacttctagaaaacttaaacttcgacaaatttattcaactatcattaaaagcattacaacagatactacccctaatgctacaaggacaaagatatgatgaagcagttagtgcaatttatggagatcactacggaaagaaaagtgctgaaataaacagattgctacctacaataccagccgacgaaatacgcaatccagttgttcttagaacgctcacgcaggcaagaaaagtaatcaatgcagtagtaagattatacgggtcaccggcccgtatacatattgaaactggtcgagaagtaggtaaatcatatcaagatcgaaagaaactagaaaaacaacaagaggacaacagaaaacatagagaatcagctgtacaaaaatttaaagaatactttccaaactttgtaggtgaaccgaaaggaaaagacatactaaaaatgagattatatgaactgcaacaagcaaaatgtttatactcaggtaaatcattagagttacacagactactagaaaaaggttacgtggaagtcgaccatgccctaccatttagccgaacatgggacgatagttttaataataaagtcctagtactcgcaaacgaaaatcaaaacaaaggaaacctaaccccatacgaatggcttgatggtaaaaataactcagaaccatggcaaaatttcgtggcaagagtacaaacctccggattttcacatacaaagaaacaaagaatcctctcacataaattagatgaaaaaggatttatcgagagaaacttaaatgacacaagatatgtagttagatttctttgtaatttcatcgcagataacatgttattaaccggaaaaggtaaaagaaaagtgttcgcatcaaatggtcaaatcacagcactcttgagaggccgatggggattacaaaaagttagggacgataatgaccgacatcatgcattagacgcagttgttgtagcctgtagtaccgtagcaatgcaacagaaaatcacaagattcgtgcgttacgaagaaggaaacgtattctcaggagaaagaatagatagggagacaggagaaataattccattgcatttcccctcgccctgggccttcttcagagagaacgttgaaatacgaatatttagtgaaaaccccaaactagaattggaaaacaggttacctgattatccacaatataaccacgaatttgtacaaccattattcgtaagtagaatgccaacacgaaaaatgactggacaaggtcacatggaaaccgtgaaaagtgccaaaagacttgatgagggtctatcagtattaaaagtaccattaacacaattaaaactaaatgatttagaaagaatggttaatagagaacgagaaatggccttatacgagagcttaaaagtaagactagaacaatttgataacgaccccgcaaaagcatttgcagaacccttctataagaaaggaggagctctagttaaagcagtaagggtcgagcaaacacaaaaatcaggcgtattagttagggacggtaatggcgtagccgataacgcttcaatggtaagagtagacgtatttacaaaagccgggaaatactttttggttccaatatatacgtggcaagtagcaaaaggtatacttccaaataaagcagtaactgcaaatgtagatgaaatagattggttagaaatggatgaaagttatcagttcatatttactatgtatcccaacgacctcgtaaaagtaaaacttaagaaagaagagttctttggctactatggtggtttagatcgtgcaacaggagccatagtaattaaagaacacgatttagagaaaagtaaaggccgacagggaatatacagaattggcgtaaaactggcactatcattcgaaaaatatcaagttgatgaacttggtaaaaatatacgaccatgtcgtcccaccaaacgacagcatgtaagatga

SEQ ID NO: 8443 - RNA, 3165 nt, synthetic construct
  misc_feature 1..3165: note = Cas9 variant
  source 1..3165: mol_type = other RNA
atgagaatattaggagtagatctaggcgtagcctccgtaggatgggcgttagtcaacgacaaaaataacaaaattatagattcaggcgtaagaatcttcacacagagcacgaaccgagaaggaaaaacattagccgcagtcagacgctcatttaggggcggacgaagagtactcagtcgacgaaaacaacgattaaaccaattaaagaaattgtttatagcccataaactactatcaaaaagtgagttcaaacatctgttcaacagcaaaaacagacttgatatatggcaactaagagctaaaggactcgaacaacaactcaataataaggaatgggccagagttctttaccatatagccaaaagacgagcctaccaatcaaatcgcaaatctgaagaatccggaaacaccgataaaaagaaagtcctatcaggtatctctaaaaacgaaaagaaaatgaatgaactcggatataaaacaataggggaaatgctatacacggaaaaccgataccccgataacaggatccgtagaaacaagaaagaccagtataaacacagtataagtcgtgacctacttagaaaagaaatagacgtactattcgaatcacaacgcgacttcggaaatcaatttgcaactgatggactaaaagaacattacaaagacatagcttttacacaaagaccaataaaatttaaagccgatttagtaggaaaatgcacttttgaaacacaagaatacagaggtgctaaaaattgcttctccgtcgagaaaagtacactactatctaaaataaacaacacggatcttatagacaaatccacaggagaaataaaaagattatttgaaataagtgagttcgataaactactcgatatattttactcaataaaagaagtaaaatacacaacacttaggaaacaacttaaaataacagacgcattcaagttcaaacagctagattaccatcaaaactttgaatataaaacgaacatcaaagcaaaaatcgaagatttttacaagttggaagattggttaacaccggaacaaaaagttttactagaaaaacaagtgctagacgataagaaagaaaaattcaaatgctacaaatacagcagtatacgctcaatcctaagccttagcgaaagccagaaatttaacggcgttaaatacgacacaaaagtagaaaacacagtcttcggaaaactaaatggctatcacagcataaagaaagaactaaataaagaagtctttgacttactgtttattgataaagataaattcaacaaaatagcagaaatactttcataccaaaaagacgacaaatcggctacacaagacctgaagaaacaagtattcaacgactttaacatggataaaactatcgtaaacgaagcaataaacagcctactgaatattagcttttcaggattcaactccttatccttaaaagccataaataaacttctgccatacctatgtcaaggtctcaaataccacgacgcagtagcacacagtgaatacaaacaccactcccaattcaaagcagcaaacccacaacaatacctacgaccccttaacaaagaagaaaattaccagataacatcaccaaccgttaaaagagtattctcacaatttcgtaaagtactaaatgcggttataagaaaacacggtagcttcgacgcaatgcacatagaaatggcacgtgaacttaaaaacagcaagaaaatcaaattcgaaatacaaaccggtcaaaaagaatacgcacaagaaaaagaagccattagggtaaaattcctagaaatatttaaatacgaaggttcaggtagggatctccttaaactacggctatatgaacaacaacatggaaaatgcatatatagtaagaaagaaatagaaataaacaaactcttagaagacggatacgtagaaatagaccatatactaccgtggtcaagaacattcgataattccctcaataacaaagcattatgcctcagcgctgaaaatcaaaacaaagcaaatcaaacaccatttgaatacctaacaaacagcgataaaaattccaaagattcaaaagaatggcaagaatacaaaaattatgtcagttcgttcgcaggaataaaacaagcaaagaaacataaactactaaacactacactaccaccccgaagagggaatgatttctccgatgatattaaaaaccctgaaagtggtttcctcgcaagaaacctaaatgacacagcatacgcatcgaggtttattaaaaactttgtacagaaccacttgcaatttagccaaaacgataccataaaacaaaaagttaaagttagaagcggagcattaacgaatcaactgaggtacaactggggaatagaagagaaaaatcgagacaacaacttacatcacgcagaagatgccattatactagcatttgccactcaaggagaagttcaacgaatgagcactatatccgcaaaaagagaagatttcaaataccaaacagcaaaagaaagaaaaataaaattcactccaccattcagcgattttaaatccgtgctagacgagtcagtaggcgacatattcgtaagtttcgcacctagacgaaaaatatctggcgcagcccacaaagcaacaataaaacctaaagatacaggcggaaaatacaaattcccagtaaacaatggaatggcagaaaacggagtaatacaaagagtagacgtatttaagaacgctaagaacaaatatcaattcatcgttttctacccagcagatttctataaagacgactttccggaacttgacctaaaaggaaacgaaatcgacaaaaacgtacaattcctattctcactctttaaagacgacctcatagagttcaagacgaagaaaacaaaaacaaaagacagtaaacacctcctagcgtacttcaaatacataagatcagacggcaaaatagcatttcaacaaaactacaaagctgaaatagaaagaaaagaaagcgacaataagaaaggatataaagatatattactagcaacgggaagtggtttagcatcacttaagaaatatcaagtttccgtactcggcgatatagcagaagtcaaaaacgaaaaacggctacccttaattaaacaaatgtacaaatcaaaacccaaaaagaaatga

SEQ ID NO: 8444 - RNA, 3165 nt, synthetic construct
  misc_feature 1..3165: note = Cas9 variant
  source 1..3165: mol_type = other RNA
atgaaccaaaaatttatcttaggactcgacataggaattacgagcgttggatacggcttaattgattatgaaacgaagaacatcatagacgccggtgtcagactgttcccagaggccaatgttgaaaacaatgaaggaagacgatccaaacgaggttcacgtcgactaaaaagacgaagaatccaccgactagaaagagttaagaaactactcgaagattacaacctactagatcagagtcaaattccacaaagcacaaacccatatgctataagagttaaaggcttaagtgaagcactaagtaaagacgaattagtaattgccctactccacatagctaaaagaaggggcatccataaaatcgacgtaatagactcaaacgatgacgttggcaatgaattatcaaccaaagaacaattaaataaaaacagcaaattgctgaaggataaatttgtctgtcaaatacaactggaaagaatgaatgaaggccaagtacgaggagaaaaaaatcgattcaaaacagcagacataataaaagaaataatacaactcctaaacgttcaaaaaaacttccaccagttagatgaaaactttataaataaatacattgaattagtcgaaatgagaagagaatactttgaaggacccggaaaaggaagcccctatggctgggagggagatcctaaagcttggtatgaaaccttaatgggacattgtacatactttccggacgaattaaggtctgtaaaatatgcctactccgccgacctattcaatgctttaaacgacttaaataacttagtcatccaaagagacggactatcaaaactagaatatcatgaaaaataccacatcatagaaaatgtattcaaacaaaagaaaaagcctaccttaaaacaaatagcaaatgagataaatgtgaatccagaagatataaaaggatatcgaataacgaaatcaggcaaaccacaattcacggaatttaaactttaccatgacttaaagagcgtcctctttgatcaaagcatactagaaaacgaagacgtactagatcaaatagcagaaatactcacaatctaccaggacaaagattccattaaatcaaaactaacggaactagacatactattaaacgaggaagataaggaaaatatagcccaactaacagggtacacaggaacacacagattatcactaaaatgtatacgattagttctagaagaacaatggtattcctcacgaaaccaaatggaaatattcacccacttaaacataaaaccaaaaaaaataaatttgaccgcagcaaacaaaataccaaaagcaatgatagatgaattcatactaagcccagtggtaaaaagaacttttggacaagcgataaatttaataaataaaataattgagaaatacggagtacccgaagatataataatagaactagctagagaaaacaactccaaagacaaacaaaaattcattaacgaaatgcagaaaaaaaacgaaaatacacgtaaaagaataaacgaaataatagggaagtatggaaatcaaaatgcaaaaagattagtggaaaaaatcagattacacgacgaacaagaaggaaaatgcctatacagcttagaatcaataccattagaagatctactaaacaacccgaaccactatgaagtcgaccacataatacccagatctgtttcattcgacaacagttaccacaataaagtgcttgtcaaacagtcagaaaatagtaaaaaatctaatctgaccccataccaatatttcaattccggaaaaagtaaactctcttacaaccaattcaaacaacacatcctcaacctaagcaaatcacaagatagaatctcgaagaaaaaaaaagaatacctcctcgaagagagagatattaacaaattcgaagtacaaaaagaattcatcaatcgaaatctagtggacacacgatacgcaacacgtgaattaacaaactacctaaaagcatacttctcagccaataacatgaacgtaaaagtaaaaaccatcaatggatcatttaccgattacctccgaaaagtatggaagttcaaaaaagaacgtaaccatggctataaacaccacgcggaagatgcactcattatagcaaatgcagattttctcttcaaagaaaataagaaactaaaagcagtaaacagcgtactagaaaaaccagaaatagaatccaaacaactagacatacaagtcgactccgaagacaattatagcgaaatgttcataataccaaaacaagtccaagacataaaagatttccgaaactttaaatacagccacagagtagacaaaaaaccaaacagacaattaataaacgatacactatacagcacaagaaagaaagacaactcaacatatatagtccaaacaataaaggatatttatgcgaaagacaacacgacgcttaaaaaacaattcgacaaatccccagaaaaattcttaatgtaccagcacgacccaagaacattcgagaaactagaagtgattatgaaacagtacgcaaacgagaaaaatccattagccaaatatcacgaagaaacgggagaatacctgacgaaatactcaaagaaaaataatggtcccatagtaaaaagcctaaaatacatagggaataaactcggatcacacctcgacgtaacacatcaatttaaatcatcgacaaaaaaactagttaaactgtccataaaaccgtaccgatttgacgtatacttaacagataaagggtacaaatttatcacaatttcttacctagatgtactaaaaaaagacaattattattacatacccgaacagaaatatgataaacttaaactaggaaaagcaatagacaaaaatgcaaaattcatcgcatcattttacaaaaacgatctcatcaaactagatggcgaaatctacaaaataattggagtcaactccgacacacgaaatatgatagaactagacctgccagatatccgatacaaagaatattgtgagctaaataacattaaaggagaaccaagaattaaaaaaactatcggcaaaaaagtcaattcaatagaaaaattaacaacagacgtactcggaaatgtgtttacaaacacacaatatacgaaaccacagcttctattcaaacgcgggaattga

SEQ ID NO: 8445 - RNA, 3165 nt, synthetic construct
  misc_feature 1..3165: note = Cas9 variant
  source 1..3165: mol_type = other RNA
atgaaattgacacccctaaattatattctagggctagacttgggtatagcttcagtaggatgggcagtcgtagaaatagacgaacaagaaaatcctttaggcctaatagacgtaggagtaagaacattcgatagagctgaagttcccaagacaggagaatcattagcgctagcacgaagactggcaagaagtgcaagacgactagtcaaaagaagggcagatcgcataaaaaaagctaagagattattaaaagcagaaaatatactgttgtccgcagatgaacacttacccaatgatgtatggcaattgagagtaaaaggactcgaccaaaaactagaaaggcaagagtgggcggcagtattattacatcttcttaaacatagaggttatctaagtcagagaaaaaacgaatcaaaatcggaaaataaagaactaggagcattattatcaggagtagaaacaaatcatcagatattacaatctgccgaatataggaccccagcagaaatagctgtcaaaaaatttcacgtagaagatgggcatataagaaatcagcgtggggcatacacacatacattctcgcgtctagaccttttagcagaaatggaactactattccaaagacaaacagatttaggaaatccacatacatccgcaaaactattagaaaacttaacagcactactaatgtggcaaaaaccagctctagccggtgaagcaatattgaaaatgttaggcaaatgtacgtttgagccaacagaatataaagctgcaaaaaattcgtatagcgctgagagattcgtatggttaactaaacttaataatttaagaatacttgaacagggagcagaaagagctctaacagacaatgaacgatttgcactccttgaccagccatatgagaaagccaaatttacctatgctcaagcacgaacaatgctcgctttaccagacgaagccatttttaaaggagtaagataccaaggtgaagacaaaaaggccgttgaaacaaaaaccatattaatggaaatgaaagcttatcatcaaataagaaaagcattagaaaacgctgatctaaaagctgaatggaatgaactaaaaaataacagtgaactattagatgatataggcacggctttcagccttcacaagactgacgaagatatatgtcgatacctagatggtaaattaagcgagagcatactcaatgccttactagaaaacctcaatttcgacaaatttattcaactgagcttaaaagcattacaacaaatcttaccgttgatgctacaaggacaaagatatgatgaagcagtaagtgcgatatatggagatcattatggtaaaaaatcagctgaaatcaacagactgttaccaacaattccagctgacgaaatccgaaatcccgtagtactacgtacattaacacaagcaagaaaagtaattaatgcagtagtaagactatatggttcacctgcaagaattcatatagaaacaggtcgagaagtcggtaaaagctatcaagaccgtaaaaaattggaaaaacaacaggaagataacagaaaacaaagagaatcagccgtaaaaaaattcaaagaatactttcctaactttgtaggagaacctaagggtaaagatattttaaaaatgagactttatgaactacaacaagctaaatgcttatatagcgggaaatcactggaattacatagattattagaaaaaggatacgtagaagtcgatcacgcgctacctttttcccgtacttgggatgacagtttcaataataaagtattagtactggcaaatgaaaaccaaaataaaggaaacttaacaccatatgaatggttagatggaaaaaataattccgaacattggcaaaactttgtagcgcgtgtacaaacctcaggatttagtcacacaaaaaaacaaagaatacttagtcataagcttgacgaaaagggatttatagaaagaaacttaaatgatacaagatatgtagcaagattcctatgtaacttcatagcagataacatgctgttaacaggaaaaggaaaaagaaaagtattcgccagtaacggccagataacagctcttctaagaggacgatggggactacaaaaagtaagagatgacaatgatcgacaccatgccttagatgcggtcgtggtagcatgcagtacagttgtaatgcaacaaaaaataacacgatttgtacgatatgaagaaggaaatgttttctcaggagaaagaatcgacagagaaactggtgaaatcataccactacacttcccaagtccatgggccttttttagagaaaatgttgaaataagaatattcagtgaaaatccaaaacttgagctcgaaaatagactaccagattacccacagtacaatcatgaattcgtacaacccttatttgtatcacggatgcccacgagaaaaatgactggccaaggacatatggaaacagtcaaaagtgcaaaaagactggacgaaggcctaagcgtcttgaaagttccactaacacaattaaaattaagtgacttagaaaggatggttaatagggaaagagaagtaacactatatgagtcattaaaagcgagactagaacaatttggaaatgacccagctaaagcatttgccgagccatttcataaaaaaggcggagcagtagtaaaagcagtcagggtagaacaaacacaaaaaagtggagttttagtaagagatggcaacggcgtcgcagataacgcatctatggtcagagttgatgtgtttaccaaaggaggaaagtactttttggtacccatctatacgtggcaagtagcaaaaggaatcttacccaacaaggcggtgaccgccaacgtcgatgaaatcgactggcttgaaatggacgaaagttatcaatttatcttcacaatgtaccccaatgatctggtgaaagtaaaactaaagaaagaagaattcttcggatactacggcggattggatcgggcgaccggagcaattgtgataaaggaacacgatctagaaaaaagcaaaggaaaacaaggaatctatcgtataggagtaaaactagctttaagttttgaaaaatatcaagtagatgaactgggaaaaaatatacgaccatgtagacccacaaaaagacaacacgtacgttga

SEQ ID NO: 8446 - RNA, 3165 nt, synthetic construct
  misc_feature 1..3165: note = Cas9 variant
  source 1..3165: mol_type = other RNA
atgaaagagaaatacatcctcggactagatttaggaatcacttcagtagggtacggtataattaattttgaaacaaaaaaaataatagatgcaggagtaagactcttcccagaagccaatgtggacaacaatgaaggtagaagaagcaaaagaggcagtcgacgactcaaaagaaggcgaatacaccgattagaacgtgtaaaactgctactaacagaatatgacttgataaataaggaacaaataccaacctctaataacccatatcaaatacgtgtaaagggattatcagaaatactttctaaagacgaactagctatagcactcctacacctagctaaaagacgaggaatacataacataaatgtatcatccgaagatgaagacgcttcaaacgaactatcaaccaaagaacaaataaaccgaaataacaaactccttaaagacaaatacgtttgcgaagtacaactccaaagactaaaagaaggccagattcgaggcgaaaaaaacaggtttaaaacaaccgacatcctaaaggaaatagatcaactattaaaagtacagaaagactaccacaacctagacattgactttataaaccaatacaaagaaatcgtagaaacgagacgagaatactttgaaggaccaggacagggatctccattcggatggaatggggacttaaaaaaatggtacgaaatgctaatgggacactgcacatatttcccccaagaactaagatcagtcaaatatgcatattctgcagacttatttaatgcattaaatgacctaaacaacctaataatccaacgagacaacagtgaaaaactagaataccatgaaaaataccacatcatagaaaacgtatttaaacaaaaaaaaaaaccaacactcaaacagattgccaaagaaataggtgtaaacccggaagacataaaaggctaccgaataacaaaatctggaacaccacaattcacggaatttaagctataccacgatttaaaaagtatagtattcgacaagtcaatactcgaaaatgaagctattctcgaccaaatagcagagatattaactatttatcaagacgaacagtcaataaaagaagaactaaacaagttaccagaaatactaaatgaacaggacaaagcagaaatagccaaactcataggttacaacggtacacacagattgtcactcaaatgcatacatctaataaacgaagaattatggcaaacaagccgaaaccaaatggaaatattcaactacttaaacataaaacccaataaggttgacctatcagaacagaataagattcctaaagacatggtcaatgatttcatattatccccagtggtcaagcgcacgttcatacaaagcatcaatgtaataaataaagtaatcgaaaaatacggaatccccgaagacataataattgaattagcgagagaaaacaactctgatgaccgtaagaaatttataaataatctccaaaaaaaaaacgaagcaacccgcaaacgaataaacgaaattataggacaaaccggaaaccaaaatgcaaaaagaatagtagaaaaaatacgattacatgatcaacaagaaggaaaatgcctatattctctcgaatctatagccctaatggatctactaaacaacccccaaaattacgaagttgaccatataatcccacgatcagtagcctttgataattccatacacaacaaagtcctagttaaacaaatagaaaactccaaaaaaggtaaccgaacgccataccaatatctcaatagttcagacgctaaactatcctataaccaatttaaacaacacatcctgaatctctctaagagcaaagacagaatttcaaaaaaaaaaaaagactacctgctagaagaacgtgacataaacaaattcgaagtacagaaagaattcatcaatagaaacctagtagacactagatatgcaacaagagaactaacatcataccttaaagcatacttttcagccaacaatatggacgtaaaagtaaaaactattaatggatcctttacaaaccacctaagaaaagtctggcgtttcgacaaataccgaaaccacggatataagcatcatgccgaagatgcactcatcatagccaacgcagactttctattcaaagaaaacaaaaaactacaaaacaccaacaaaattttagaaaaaccaacgatcgaaaataacacaaaaaaagtcacagtcgagaaagaagaagattataataatgtcttcgaaaccccaaaactcgtagaagacataaaacaatatagagactacaaattctcacatcgagtagacaaaaaaccaaaccgccaactcattaacgatacgctctactcaacaagaatgaaagacgaacacgactacatcgtacaaacaataacagatatatacggcaaagataatacaaatttaaaaaaacaatttaacaagaatccagaaaaattcctgatgtaccaaaatgatccaaaaacattcgaaaaactatccattataatgaaacaatattctgatgaaaagaaccctctagccaaatactacgaagaaacaggagaataccttacaaaatattccaaaaaaaacaacggaccaatagtaaaaaaaataaaactactaggcaataaagtcggaaaccacctcgatgttacaaacaaatacgaaaattccacaaaaaaattagtcaaactatcaatcaaaaactaccgatttgacgtatacctaactgagaaaggatacaaattcgtcaccatagcatacttaaacgttttcaaaaaagacaattactactatataccaaaagataaataccaagaactaaaagaaaaaaagaaaataaaagacactgatcaattcattgcgagcttctacaaaaacgacctaattaaattaaacggagatctatacaaaataattggggtaaactcagacgaccgcaacataatcgaattagattactacgatataaaatacaaagactattgcgaaataaataacatcaagggcgaaccacgaataaaaaaaaccatcggtaaaaaaaccgaatcaatagaaaaattcaccacagatgtactgggaaacttatatttacactctactgaaaaggctccacaactcatattcaagagaggcctctga

SEQ ID NO: 8447 - RNA, 3165 nt, synthetic construct
  misc_feature 1..3165: note = Cas9 variant
  source 1..3165: mol_type = other RNA
atggaaaacaaaaacctcaattacattctaggactagatctaggtatagcgtcagtgggatgggcagtagtagaaatagacgagaaagagaatccactaagacttatagatgtaggtgtcagaacttttgaaagagctgaggtaccaaaaacaggcgaatcactggccctaagtcggagattagcaagatctgcaagaaggttaacacaacgacgcgtagcaagattaaagaaagcaaaacgactgcttaaatcagagaacatcctcctatctacagacgaacgactaccacaccaagtctggcaactgcgagtagaaggactagatcataaattagaaagacaggaatgggcagctgtactactacatcttataaaacatagaggatatctaagccaaaggaaaaacgaatcaaaatcagaaaataaagaacttggagcactattatctggagtagacaataaccacaaactcctacaacaagctacatacagaagtccggcagaactagctgtaaagaaatttgaagtagaagaaggacacataagaaatcagcaaggcgcatatacacataccttcagtagactagatctactggcagaaatggaattactattttctagacaacaacattttggaaacccattcgctagtgaaaaactactagagaacctaacagccttacttatgtggcagaaaccagctttatcaggagaagcaattctgaaaatgctaggtaaatgtacatttgaagacgaatataaagccgctaaaaatacatattcagcagaaagattcgtatggataacaaaactcaacaatttaagaatacaagaaaatggactagaacgagcattgaatgacaatgagagattagcgttaatggaacagccatacgacaaaaataggttattttattctcaagtaagaagtatactcaaattatccgatgaggcaatttttaaaggactgagatattcaggagaggacaagaaagctatagagacaaaagcagtacttatggaaatgaaagcataccaccaaataagaaaagtcctagaaggaaacaatttgaaagcagaatgggccgaacttaaagcaaatcctacattactagatgaaataggaacggctttttcattatataaaacagatgaagatataagtgcatatctcgctggaaaattatcacaaccagtattaaacgcacttttagaaaacctatcatttgacaaatttattcagctatcgctaaaagccctgtacaaattgcttccccttatgcagcaaggacttagatacgatgaagcatgtagagaaatttatggagatcattacgggaagaaaaccgaagaaaaccatcatttcttacctcaaataccagcagatgagattcgaaatccggtcgtattgcgaacactcactcaagctcgaaaagtgattaatggtgtagtaagattatatggatcaccagcaagaatccacatagaaaccggaagagaagtaggaaaatcatataaagatagaagggaactagaaaaacgccaagaagaaaatagaaaacaaagagagaacgctataaaagagttcaaagaatactttcctcatttcgcgggtgaacccaaagcaaaagatatactaaaaatgaggctatataagcaacaaaacgctaaatgtttatacagcggaaaaccaatagaactacatagattattagaaaaaggttatgttgaagtagatcacgcactgcccttttctagaacatgggacgacagttttaataacaaagttctagttctagcaaacgaaaatcaaaataaaggaaatttaacacctttcgaatggctcgacggaaaacacaacagcgaaagatggcgggcattcaaagccctagtagaaacctcagccttcccatatgcaaagaaacagcgcatattaagccaaaaactagacgaaaaaggatttatcgaaagaaacctaaatgatacccgatatgtagccagatttttatgcaattttatagcagataatatgcacctaactggagagggtaaaagaaaagtctttgcaagcaatggccagataaccgcattattgcggtcacgatgggggctagcaaaatctagggaagataatgaccgacatcatgcattagacgcagtagtcgtagcatgctcaacagtagcaatgcaacagaaaataacaagatttgtaagatttgaagcgggagacgtttttacgggagaaagaatagatcgagaaacaggcgaaatcataccactacattttccaactccatggcaattctttaaacaagaagtagagattagaatatttagtgacaatcctaaattagaactagaaaatagacttcccgacaggcctcaggctaaccatgaatttgttcaaccactattcgtaagccgaatgcctacacgaaaaatgactggacaaggacacatggaaacagttaaatcagcaaaaagattaaacgaaggcatcagtgttatcaaaatgcctctgacaaagctaaaattaaaagacctcgaattaatggtcaacagagaaagagaaaaagatttatacgatacactcaaagcaagactagaagcattcaacgatgacccagcaaaagcattcgcagaacccttcataaagaaagggggagccatagttaaaagtgttagagtcgaacaaatacaaaaatccggagtactcgttagggaaggaaacggtgttgcagataatgccagtatggtaagagtcgatgtttttactaaaggcggcaaatactttttagtgcctatctacacatggcaagtcgctaaaggtatcttaccaaataaagcagcaacacaatataaagatgaagaagattgggaagtcatggacaatagcgctacatttaaattttcgttgcacccaaatgacttagttaaactggttactaaaaagaaaaccatattagggtactttaacggactaaaccgcgcaacaggcaacatcgatataaaagaacacgatctagacaaaagcaaaggcaaacaaggaatctttgaaggtgttggaataaagctagcactaagtttcgaaaaataccaagtagacgaattaggtaagaatataagactttgcaaaccatcaaagagacagcccgtgcgatga

SEQ ID NO: 8448 - RNA, 3168 nt, synthetic construct
  misc_feature 1..3168: note = Cas9 variant
  source 1..3168: mol_type = other RNA
atgaacaactatatactaggtctagatatagggattacgtcagtaggatacgggatagttgactcagatacacgagaaataaaagacgcaggggtcagacttttcccagaagccaacgttgacaacaacgaaggaagaagatcaaaaaggggagcaaggagattaaaaaggcgaagaatacacagactggatagagttaaacacctactagctgaatacaatcttctagatttgacaaacataccaaaatcaacaaacccttatcaaattagagtaaaaggattgaacgaaaaactatcaaaagacgaattagtaatagcgttactacacatagcaaaaagacgaggcatacacaacgtaaacgtcatgatggacgataacgacagtggtaacgaactatcaacaaaagaccaactcaagaaaaatgcaaaagcgctatcagacaaatacgtatgcgaactacaattagaacgcttcgaacaagactacaaagtccgtggcgagaaaaacagattcaaaacagaagacttcgtaagagaagcaaggaaattactagaaacacaatctaaattcttcgaaatagatcaaacattcataatgagatacatcgatttagtcgaaacacgaagagaatactttgaaggaccggggaaaggaagcccatttggatgggaaggaaacatcaagaaatggtttgaacaaatgatgggtcattgtacctacttcccagaagaactacgatcagtaaaatatgcttacagtgcagaactgttcaacgctttaaatgacttaaacaatctagtcataaccagagatgaagaagctaaactaaattatggagaaaaatttcaaatcatagaaaacgtctttaaacaaaagaaaacaccaaacctcaaacaaatagccaaagaaataggagtaagcgaaacagatataaaaggttaccgggtaaacaaatctgggaaaccagagttcacgcaatttaaactataccacgatttgaaaaatatcttcgaagactcaaaatatctaaacgatgttcaactaatggataacatagctgaaatcataacaatctatcaggatccagaatcaattataaaagaactaaatctactaccggaactattgagcgaaaaagaaaaagagaaaataagtgcgttaagcggatacgccggaactcaccgcctaagcctaaaatgcattaatcttctactagatgacctatgggaatcatctctaaaccaaatggaactattcaccaaactcaacctaaaacccaagaaaatagatctaagccagcaacataaaataccaatcaaactcgtcgacgacttcattctttctccagtagtaaaaagagcctttatacaatcaatacaagtagtgaacgcaatcattgacaaatacggtctcccggaagatataataattgaactagcccgcgaaaacaactcagatgacagaagaaaattcttgaaccagctacagaaacagaatgcagaaacaagaaaacaagtagaaaaagtcctcagggaatacggtaacgataacgcaaaaagaatcgtacagaaaataaaactgcataacatgcaagaaggcaaatgtttatattccctcaaagacataccattggaagacctacttaaaaaccctaaccactacgaagtcgaccacataataccaaggtcagtggcatttgataactccatgcacaacaaagtattagtcagggcagaagaaaacagcaagaaaggaaaccgaacaccttaccaatacttaaatagctcagaatctagcttatcctacaacgaatttaaacaacatatcttaaacctcagtaaaacgaaagatcgaataaccaaaaagaaaagagaatatcttctagaagagagagacataaataaatatgacgtacaaaaagaatttatcaatagaaacctcgtagacaccagatacgcaacacgagaattaacaagtctactcaaagcctacttcagtgcaaacaacctagatgtaaaagttaaaacaataaatggctcattcactaactatctaagaaaagtatggaaattcgacaaagatcgcaataaagggtataaacatcatgctgaagatgccctcataatagcaaacgcagattttctatttaaacacaacaagaaattaagaaacataaacaaagtactagacgcaccttcaaaagaaatcgacaagaaacgtgtaacagtacaatccgaagacgaatacaatcaaatgttcgaagacacgcaaaaagcacaagcaatcaagaaattcgaaatacggaaattctcacaccgcgtagacaagaaaccgaaccgacaactaataaaagacacactgtatagtactaggaatattgacgggatagaatacgtagtagaatctataaaagacatatactcggtcaacaacgataaagtaaaaacgaaatttaagaaagacccacacagactactgatgtatcgtaacgacccacaaactttcgaaaaattcgaaaaagtctttaaacaatatgaatcagagaaaaatccattcgctaaatactatgaagaaacaggtgagaaaattcgaaaattttcaaaaaccggacaaggaccatatatcaataaaataaaatatctaagagaacgactcggaagacactgtgacgttaccaacaaatacataaactccagaaacaaaatagtacaactaaaaatatatagctatagatttgatatataccaatatgggaacaattacaaaatgataaccatctcgtatatagacctagaacaaaaatcaaattattactacatctctcgagaaaaatacgaacagaaaaagaaagacaaacaaatagatgactcatataaattcataggtagtttctataaaaacgatatcataaactacaatggggaaatgtacagagtgataggtgtaaatgactcagagaaaaacaaaatacaattagacatgatagacatatccataaaagactacatggaactaaataatatcaagaaaaccggagtcatatataaaaccataggaaaaagtacaacccatatcgaaaaatacacaacagatatactcggcaacttatataaagcagcaccacccaagaaaccccaactaatattcaaaagaggaatggaatga

SEQ ID NO: 8449 - RNA, 3168 nt, synthetic construct
  misc_feature 1..3168: note = Cas9 variant
  source 1..3168: mol_type = other RNA
atgacaccaatcagcgaaagcctattgttcggattagacgtaggaataagttcatgcggttgggctgtacttaaacactcggacacaactggccacatagaagctctaggatcatggtgcttcaatgcaccagaaacaaaaaccgagagaactccaactaatcaaataagaagatcatcaagattgttacgaagagtagtaagaagacgcagaaatagaatgacggagataagacgactatttgctagacatggactcatagacaacgacaggcctgatgcactcagacagccagccatagatccatgggagatgagaggacaagggctcgacagacaactaacaccagaagaatttgccgtagctttagcacatatcgccaaacacaggggatttaaaagcagtgccaagagagtaaaaagtaatgcatcaccagacgactccaaaatgctagctgcattagagaagacaaaagaattatctgcacaatatcgaacaataggagaaatgttcgcgagagacagtgcttacgtgcaacgcagaagaaatcgagatggtctcttcgacagaacgatttcaagagatgatctaattgatgaagctaaaattttatttgaccgtcaacgaaagctaggaaatcctgtagcatcgaccgaaatagaagaagcatttacacgaatagcgttctggcaaaatccaatgcaagattcaggagtgttagtcgcgtcatgtcccttcgaaccaaaagaaaagagatcatcacggttctcaccatcgttcgaaagatttcgtttgttgtgtagattaataaatttacgggtcactgatggtccagaagaacgtcctcttactgaagaagaattacgattagcatatgaacatgcaggaaaaacgcgtaaactgacagcggcagcaataagaaaactcattggattgagagacgaccaacactttactacaatacctccagaacaagaaaaacaagacataacaagcagaactggagaaacatttgccggcacagctacgttccgatcagttttaggagaaagtctatggagacaacttttaccacacccagaatggctagataacgccgcatggataatttcctttcatgaacttacagaaacaattataaagaaattaggcgaaataggattgcctgtggaagcctacgaattaatatgtgatgcattaaaaagcgataaaagcccttttgcaaaattcaaaggcgcaagttcgctatcagacaaagcagtaagagcactgattccctatcttcaacaaggtttgacttacgataaagcgtgtcaaaaagccgggtatgaccacgcagcttcaagattttcagggagagcaacaatagatacaaaagcgaagtttaatgcgctaatggcagaagtaagagatagtattgctaatccgatagcaaggaaggcactgtcagaaggaatgaagcaattatgggcaatgaggaatcgatggggattaccaggagcaatttgcatagaactagcaagagatgtaggtaattccttagagaaaagaaaagaaattgaacgaaatttaaaaacaactgcaaaacagagagctagagaaagagaagaagcatgcgagttactcaacttaaaagaagtgtcatcagatatcttgctacgctatagattatggaaggagcaaggaggaaggtgttgttactccggaaaatcaatcacaccagatatgctcatggcacaggacaatagaatacaaattgatcatatattaccatggtctagatttggtgatgattcctatagcaacaagggactatgtttggcaaaggaaaatcaggctaagaaaaatcaaacaccttatgaatggatccacggacaaggaacaacagctcaaaaagaacaatgggataaattcgtagctgatgtagaaagcagaaagaacacgaaaggattaaagaaaagaaacttcctgctaaaaggatctaaagaaatcgaggaacgatttagaagtagaaacctaaacgatactagatacgcggcaaggttaatggtcgaagctgcgcggttactttacccagcaggacagagaggggagaaaggaggaacccgtcgtgtattcacaagaccaggagctctcaccgctgcattaagacacgcatggggagtcgaatcactaaagaaaatagatggtgaacgattacacgataatcgccaccatgcactagacgccgcaattgtagctgcggtctctgaagcagagatacagaaattaacaaagagctttcaggaatgcgaacaaaaaggtctgagcagacctatgagagatgtagctccaccctgggacggattcagagaccaactaaaagagaaatatgaaacgatatttgtagctcgtcccgaaagacagagagcgagaggtcaagggcacgaagctaccataagacaagtaagagaagaagaaacagggccagtaatatacgaaagaaaagcagtgtcagcactaaccctcgcagatttagctaaaataaaagaccctgacaggaatgcgggattaatagcatcattaagacaatggatcgaggcgggaaaaccagcagacaaacccccaagaacaccatgtcatcaatcagccgctggtcatgaaattaggaaagttagactagcaacgataatcaccccagctgtaccagtaaggggtgggatggcgaaaagaggagaaatgactagagtagacatatttaaagtaattggaaagaaaggaaaaccagaatggtacatgataccaatataccctcatcaaattatgaatagatcacaatggcccgcgcctccaaataaagcagtagtagcgggtaaatctgaagcagactggccgataatgggcgctgaagcacaattccaattcagcctatacccttgctcatatgtaagactatttaaagaggggaccgtaatagaaggttatttctgtggatgtcacagaagtagggcatatataaccttggcattaagcaccggtgcagctcctctacaaaaaggaattggtattaaaactcaagaacatatacaaaaattctctgtaaatagatttggtgagctatctccagttaaacaagaaacaagaacttggcacggagtagcatgcacaagcccagatcaacatgattga

SEQ ID NO: 8450 - RNA, 3171 nt, synthetic construct
  misc_feature 1..3171: note = Cas9 variant
  source 1..3171: mol_type = other RNA
atgaaagcattaaattacatactaggattagatttgggaattgccagcgtcggatgggccgtggtagaaatagatcaaaacgaactacctatcagactcatagacctaggtgtcagaaccttcgaaagagccgaagtccctaaaacaggagactcactagcactggctcggcgactagcaagaagttcaaggagattagtcagaagacgagcagtccgactactaaaagcaaaaagattactaaaacaagaaggaattttacaagcagatgactttcactctagccacctcaaaccattaccaaataatccatgggaattaagagtaaaaggactaaatcatctactcgatcgaaaagagtgggccgcagtactattacacttattgaaacatagaggatatcttagtcaaaggaaaaacgaatcaaaaaccgataataaagaacttggagcattattaaaaggggtgagtgaaaatcgacaacttttacaagctcaggctttcagcaccccagcagaaatagcaataaagaaatttcaacaagaagaaggccatataagaaatcaaaggggagcgtacagtcacacattcgacagaaatgacctactcgcggaattaagactattatttcaaaagcaacgagaatttaacaatccatatacgagtcaaagtttagaacaagctatcgcggaactacttatgtggcaaaaacccgcactttcgggagaagcaatattaaagatgttaggaaaatgcacattcgaaccctcagaatacaaagcaccaaagaatagttactcggcagaatattttgtctggctaacaaaactaaacaaccttagaatattggagaatggagctgatcgaggattaacagccgaagaaaggcaattattaatcaaccaaccatttgaaaaggctaaatttacatacgcgcaagcaagaaaactactagaattaagtgacttagcaatattcaaaggtgtaagatatggtaaggataatgcagaaagtgcaacgcttatggagatgaaagcgtggcatgcgatcagaaaggcattagagtcaaatggcctaaaaaccgagtggaacggcttaaagacaaaaccagaattacttgataaaataggaacagcttttagtatttataaaacagacgaagatatatcccaatacctgaatggtgaactaagcccagcagtactaaacgcgctattagaaaacttatccttcgataaatttataagattaagtttacaaagtctagcaaaaatcctgcccttaatggaacaaggcttacgttatgacgaagcatgtaaacaagtatacggagatcattatggaaagaaagaacaactggagttgaggttcttaccaaaaataccagtggaagacattagaaatccagtcgtccttcgtacgcttagtcaagcgagaaaagtaataaacggggtagttagactatatggctcaccagctagaatacatatcgaaacaggtagggaagtcggaaaatcattctcagagcgacgtgatatatcaaaaagacaagaagaaaatagaaatgaacgacagagagctgtcgaaaaatttaaagagttctttccgcactttgtaggtgaaccaaaagcaaaagatatactcaaaatgagactatacgaacaacaacatggaaaatgtctttactcaggaaaagaattagatcttaatagacttttggaaaaaggttacgttgaaatagaccacgcattaccatttagtagaacatgggatgatagttttaataacaaagtcttagtcctggcaagtgaaaatcaaaataaaggtaatcaaactccttatgaatggttaaatggaaaagaaaatgcggaacggtggaagttatttcaagcgctagtaaatggcagtagatttccctacagcaagaaacaacgaatattaactaaatatttagatgaggacggatttagagaaagaaacttaaatgacacaagatatgtagcaagatttttatgtaactttatagaagataatatgcaattagtaggacaaggaaagaaaagagtattcgcaagtaatggccaaataacagcactattaagacggtcatggggtatacaaaaagtaagagaagacaatgatcgtcatcacgcagtagacgcagtagtagtggcttgctcaacacgtgcattacaaaagaaaataacagattacgtgagatacaaagaaatgaatgtattcactggagagaaaattgaccaggaaaccggagaaataatcaaatttcattttccagaaccttggaaattctttagacaagaagtcgaaatcagggtttttagcgaaacaccagcagaagacgtagtaattgcattaccagatagaccgcaagcgaaccatgaatttatacagccgttattcgtatccagggcacctacaaggaaaatgactggccaaggacatatggaaacaattaaatccgctaaaagacttgcagaaggactaagtgtatcaagagtcccattaacccaattgaaactgaaagatttagaaaacatggttaatcgagaaagagaaaaagcattatatgaagccttaaaagttagattagaaaaattcaacaatgatccagcaaaagcattcgctgatcctttctacaagaaagggggacaacaagtaaaagcagtaagggttgaacaggtccagaaaagtggagtcctagtaaggcaagaaaacggagtagctgacaacgcgagtatggtgcgagttgacgtattcatcaaaggaggcaaatactttttagtaccaatatatacatggcaagtagcaaaaggaatattaccaaatagagcagcaacacaaggaaaagaagaagaatattgggatataatggacgaaacagcaatattccaattttcactttatcaaaatgacttaataaaattagtaacgaaaaagaaaaccatttttggatattttaacggattaaatagagcaacgagcaacattaacataaaagaacacgatctagacaaatccaaaggtaaagatggcatataccttgaggtgggagtcaaattagcactatcgctcgagaaataccaagtagatgaattggggaaaaatatacaaccgtgcaggagtatgaagaaaagaccaccagtaagatga

SEQ ID NO: 8451 - RNA, 3171 nt, synthetic construct
  misc_feature 1..3171: note = Cas9 variant
  source 1..3171: mol_type = other RNA
atgcctaaacagaaaagcacaagatacaggctagcactggatttgggaagtacaagtttaggatgggccgtcttacgactgaatgaacaacatgaaccaaatgctattataagagctggtgttagaattttctcaaatggaagaaatccgaaagacggttctagccttgcagttactaggagagcagcaagagcaatgagaagaagacgagacaggcttttaaaacgaaaagcaaggatgatgaataagctagtggaatacggtttctttccagcagatgttgcagaacgaaagaaattggaaagaataaacccgtatgaacttagagcaaaaggacttgacgctccattaacaccaggagagttcgcaagagctttatttcatataaatcaacgacgaggatttaaatcaaataggaaaacagacaagaaagaaaatgacagcggggctttaaaagcagcaattagtcatctcagacagcagttacatgaaaggaaagctagaaccgtaggagaatggctgtggcaaagattgcaagcaggcctaggtacacgagcacgatacagagagtcaagagtagcacaagcaaatggaaaaactaggatagagaaaagttatgatttatatgtggaccgtcaaatgatagccgaagagttcgatgccttatgggctgcccaagctgcattcaacccacaacagttttcggaacaagcacgaggtgaattaagagatgtattgctttttcaacgagatttacgccctgtgcgtcctggccgatgtaccctactacctgatgaggaacgagccccgctagcactaccaagcgtacaaagattcaggattttacaagaagcaaatcatcttcgactactacatccagacctaagagaagaaccactatcattagcacaaagggacgcagtagttgacgcactagaacataactcaaaaaggacatttgagcaactacgaaaacttttaaaattaaatgggacagttaaatttaatctcgaagatgaaaaacgtaaagaactaaaaggcaatgcaactagcgctacactttctaaagacggcctgtttggagagaattggtggaatctagatgaagcgctacaagacgcaatagtatggcagttagtatccgagcagtcagaagaaaaattacaaaattggttacaagcaaatacaggcgtgaatgcgactcaagcagaaactattgccaacgcaggactgcctgaaggatacggtagcttaagctataaagcattagcacgaattataccagcattacgtggaacagaggtagcaaatggaatcgacgtcccacgcacatatgatcaggcagttcaagctgccggattcgcccaccattcagatctagactcaggatttgacttcgaacatagccacgatgaagtggaaagaattggagaaagagtgattgctagcactggtgaggtaaaaccagtatttgcattcaaacaattaccatactatggcaaagccttaagaagacacgtagcatttgccaaagaacatccccgaaatgaagaagaaaggtatggtaaaatagcaaatccaacagtacatattggattaaaccaactaagagtagtagtaaatgcactaattagaagatatggcaggccaacagaagtagtggttgaattagctagagatttgaaacaaagcagagagcaaaggcaagaagaacagaaaaggcaagctgattatcagaaaagaaatgaacacatcagaagagaaatagcatcaatgcacggatgcgcagaagaaagagtatctcatgcagatgtacaaaaatggatactatgggaagaattgagcttcgatgttgccgatagacgttgcccgtattcaggagtacaaatatcggctcaaatgctactatcgaaccaagtagaaatcgagcatatccttcccttctcacaaactctggacaactcacttaacaatagaaccgtagccatgagacaagcaaacaggataaagggaaatagaacaccatggcaagccagagaagactttgaacgccaaggttggtcgtatgattcaatactacaaagggcggaaagaatgccgaaagccaagaggtatagattcagcagagacggatacgaaagatggttgaaagaagacaaagattttctcgcaagagcacttaacgatacaagatatctctcgcgtgtagctaaaacatacatggagctagtatgtccactgggtacaagagttatacccggccaaatgacagcacttttacgcgcaaaatttggtttaaacgacgttctaggtctaaacggtgaaaagaatagggatgaccatagacaccatgccgtagatgcatgcgttataggagtaactgaccaaggactcttacaaagatttgcgcaggcatctgcagatgctagagggaatggactcgaaaaattagtggaaaatatgcctgtaccatgggcaacatatcgagatcatgttaaaagagccatacaatgtatatgggtatcgcataaaccagaccacggatacgaaggtccaatgatggaagaaacagcgtatggtattcgaaaagatggaagtataagacagaaaactaaagcagatggatcaaccggacgcgaaattactcacctgatccgaataacagaacccacacaaaacctaagacacggagtcgacgctcaaggacaaccattagcttacaaaggatacgtgggaggctcaaatgactgtatagaaatcacacaaaatgaacaaggcaaatgggaaggtaatgtaattacaacatttcaagcatatgatatagtccgcaggttaggctcaaaacaaggaccgagaagattaaggcatcccacgcttgcacaaacacttgatgtatatggaaaaccgaaaaagctagtaatgaggttaatgatcgacgattgtgttcgattagaactagatggtaataagaaaacgctacgtgtggtaaaaataacgggaaatggtcaagtattcatggcaccagtacatgaagcaaacgtagataaaagaaatagcgataaaacagatccatttgcatacgtctctaaatacgcaggaagttttcaaaaagcaaaagctagacgaataacaatatcgccgatcggagaattgcatgatcccggcttctga

SEQ ID NO: 8452 - RNA, 3174 nt, synthetic construct
  misc_feature 1..3174: note = Cas9 variant
  source 1..3174: mol_type = other RNA
atgtctgataaatcaaaaatattaggattcgatataggcattacaagcataggatgggcatacgtagaaggagaagaattaatagattgtggggtacgaatctttactaaagcagaaaacccaaaaaccaaagaatccctagctttaccgagacgagaagcaagaggagttcgaagaagactagctcgcagaaaaggaagactaaatgcgattaaacagctaatttgcaaagaatttggattaaactaccaagactacatagcacaagatggagaattacccaaagcctacgctggaaaattaataaatccctacgaactacgatcgaaggctttacgagaaaaactagaaaaagaagaattggccagagtaattctacacatagcaaaacacagaggatatggaaacaaacatgcaaaagaaaccgatgacgctgaaagtggaaaaatcaagaaagctatttcaaataacgagaaaatactaaacgaaaaaggatatcaaagtgcaggagaatatttataccaagagttctttcagaaagaaagactgcaagaagaaaagaaaggaaataatacgacaaaagaatttaaaaatgtgagaaacaaagccggagattacgaacactgtattgcacaaacccaaatgcagaacgaactaagacttatattcgaaaaacaaagagagttcggtctaaatttcagcgaagaatttaaaaagaaagtattagaaacagcattcttccaacgacctttaaaagactttagtgacaaaataggagactgtacattcatcgaaggagcaaaaagagcacccaaagattcactctcagcaatagagttcgtagcgctaggacgaataataaacacactcaaaaatctacaaaatacctccggcgaagtctatagtcgagataaaatcaatgaaatactgcagatagtcttagataaaggcgaaatttcatacaagaaactaagagaaatcttagatatagaaagttccgtaagatttaaagacagcaaactagactatacaaaagaactaaaagaagcagagaaaacaaaactatttgaaagcaaaaatttacaaaaattcaagaaagccctcggcagcttcgaaggaatcagcagagaaatattagatagcatcgcaaaagaaataatgatcactaaagacaaagaaaaattagcaaaagaacttaagaaatttccactagacgaaacacaaatacaaaacttatcgaacctatctttctcacaaaccataaacctatcattagaagcattaagccaaatacttccattcatgcgtggcgaaagagaagataaatgcttacgctatgatgaagcagtagaaaaagcaggactaaaagaagtcgccaaaaacaaaagtaaagacgacttccttccacccctagaaaattatgagccctatttagcaaatccggtcgtagcaagagccttaagcgaatacagaaaagtactaaacgcactattaagaaaatatggaaaaatgcacaaaatacatattgagttcacacgtgaagtggggaaaagcaaagaagaaagaaataaaatagaaaaagaacagaaagaaaatttcgccaaaaatcaagaagcacaaaaacaatgcgaaatcctaggacttccaattaatggagcaaatattttaaaaatgaaactttggagagagcaacaagagtcttgcgtttacagcggaaaagaaatagccatagacgacctcaaaaaccccgcaattttacaggtagatcacatatatccatactcgagaagttttgacgactcatataataataaagtattagtattttccaaagaaaatcaaaacaaattgaacaaaaccccttttgaagcatttggagaaaataaagataaatgggaaaagatattaagtctagcgtctaaactacccaaaccgaaaagacaacggatatataacatgcaattcaaagataaagaacaaggatttctcacaagaaacatcaatgatactggatacatagccagattagtatcacagtggacaaagaattgtttatccttcgagaaactaagcgaagacgaagtaagcatcgctggagaaaagggatccaaagtacatgttgaagtgatatcaggatcattaacagcaatgctaagacactactggggactcggagacaaaaacagagacaaccatttacaccacgcagttgatgcgatcataatcgcatactcgaacgaaaaagttataaaggcttttagcgattataagaaacatagagaacaaaacaaagcaaaattttatgccaaagagatagctgaaagtgaatacaagaaacaaaaagtattctttgaacccaccaatcatttcagacaaaaagtattagagaaaattgacagtattttcgtaagcaaaccgccacgaaaacgagcaagaggagctctacacgaagaaacattctacagctttgaacgtctttgcaacgataaagaatacgcaaagaaagagaaaatggattacggaggaaaagcagggatacaaaaagcaattgcactaggaaaaatacgacaagttggaacaaaaatagtaagcaacggaacaatggtaagagtagatatcttccaacacaaaagcaatggaaaattctacggtgttcccatatacactatggacttcgcattaggtgttctacccaacaaagcagtcgtcagtggtaaagataagcaaggtgtaataaaggattggttagaaatggatagcaactatgaattttgcttcagtttgtttaaagacgacttaattctagtacagaagaaagaaatggaaaaagccgaattgtgttactatacagacttcaactcaaacactgcgggaattaaattcgaaaaacataacaacctatacgtaaatctaaacgaaaacgaaaggaaattgtttactagcaaagaagttgtaaaaggagggaagaaaaacgtatggaaggacaagacacccaaggaaatcgaacaattagagaaaaacagaaaaataataggaggattcgtcactatcgaagacctaaaaacattcgaaaaatatcaagtatcaccactaggtgaagtacaaaaagcggacttcgcacctaggcaagcaataaccctaaaatcatcacccaaacataggataaataaatga

SEQ ID NO: 8453 - RNA, 3174 nt, synthetic construct
  misc_feature 1..3174: note = Cas9 variant
  source 1..3174: mol_type = other RNA
atgtcaaacagagtaccatacagattagcattggatcttggaacgaactctatcggatggtgcttattagatttaaacggaaatggtgatccttgtggagtaagacgcatgggggtacgaatatttccagacggaagggatccaaagagtaaagagagcttagctgctgacagacgcctagcaagatctatgcgacgaagaagagatcgatatctaagaagaagatctgcattaatgaatgcgttagtagcagcaggtttaatgccggcagacagagcaacaagaaaggcgttagaaagcgaagacccgtgtgaattgagagctagagctctatttgaaccccttacagccggacaagtaggtagagctttatttcatttgaatcaaagaaggggatttaaaagtaacagaaaagcagcaggagaagagaacgaagcaggaaaaatcaaagcaggaatcagtgcgttgaaagctgaaatagaagcaagcggcgaaaccacgctaggagcatggttggcggcgagacatagaaaaagagaaactgtccgagcaaggttagatggagctggagctaaggcatcctatgaattttatccggaaaggggtttagtacatgatgaatttcaagccataaggaccgcccaggcacttcatcaccctgctgtaacagcagaacagtgggatagagttgaatcagtaatatttcgacaacgtcctttaagacctgtgagaccaggtaaatgtacactttttcctgatcaggaaagagctccctgggcattaccggtagcgcaagagttccgtatattaacagaaatcggaaatttaaaactatatagaccaggagaagaaccaagagaattatcagcagatcaacacgcacagttatttgctaaattatgtagatcagctgatctaacattcgagaaaatccggaaagaacttaagttagatcctggcttgaaggtaaatttagaaggggaaaagagagacagactaaaaggagatgctgttacttctgcattatcagcgaagaaaagattcggcccaaaatggaacgcactaacaccagacgatagaagagacatagtaggaagattaatagaagcagaagatgaagccgaactcgcaggatggttggaaagtgtacatggtttacccagcgaaaacgccgcacatacagcagcgagtcccggactaccggatggatactgtcgattatcagaaaaagcacttgtgaaattagttccactcatgagagaacaacgattgagatatgacgaagccgtgcttgctctcaatttgcaccattctgattttcgaccagaaggactattagatgaattgccatattacggcgaaccattagaaagattcatagctttcggaagtggagaacccagtgatcctcctgaacaacatttaggaagattcccaaacccgaccgtgcatataggattaaatgaactaagaaagctagttaatagaatagtagaacgatggggaaaacccgcagacatagtagtagagttggcacgcgatcttaaaagaagtagagatgaacgagatacaatacaaagagaacaagctcaaaaccagaggaaaaatgaagatagatttgcaaaaattaaagaactgggaatagatcctagaccagatagcatgttaagactacgactgtgggaagaattaccaaaagttggagttggacatgtttgcgtctatacaggggaacctataggtattcgaagattattggaaggagatgtagatatcgaccacatattaccatttagcagaacactatcagacggggcagataataaaatagtatgcgtaaggagagcaaatagattcaaaagagatagaagcccatgggaggcttttggagtgactgcagtagatggttatgattgggcagcgatagcacaaagagcagaagaactaccgaaaaataagcgatggaggttcttaccagatgcaatggatagatttgaaggagagagaggatttttggatcgacagctagttgaaactagacacttgagccgagtagcacgccaatatttggctagcatcgttgatctcaacaaagttagagtagcaccaggaaaacttactgcaatgctaagagctagatggggactaaacaaaatattaagcgacggaaacctgaaaaatagaagcgaccacagacatcacgcaattgatgcagcggtactagggatgatagaccaaagactcgtgcaattggtagcccaagcagcagcacgagcagaagcgaatgaattggaacgattatttgacggactgcccgacccttttgatggactagcagcaacgtcctttggagatcaagttcgcgagaaaataagaggaattactgttagtcatagggctgaacatggatggcaaggaagaatgcataatgacaccgcgtatgggccagtagaagcagtgaacggtgtacatacagtagtaacaagaaaacctttatctggtctcacagcaaaagattttcctaatatcagagacagagttctagcaaaagcactagaagatcatgttgctgcagaagcggccgctggacgtagctttggagatgcactaggaagtttcaaatggggtggacaaccggtaagaagagttcgaatgcttgacgtattaggaaatcccatacctatacaggatccgtcaggaacggtatttaaggtttataaaggggatagtaatgcatggtacgaaatactacgcgaccccagaggcagatggactggaaaaatagtaagtacatttgaggcataccgtctccaccgagaatggcttgctgaaacaggtggagattcaggaagagggtcaggtgtgtttctagactgggccgcaaagcgtgttgtaggtgaagcaggcacaccattatttaggcttttcaagggagacctactcgcactgggggaagccccggatagaagaatagtcagggtagtaaagtttagtgaaggccaagtagcgctagcacttcacttagaagctggaaatttaaaagcaagagatgcagataaaggtgatccatttaagtaccagtattgtagtccagactcattaaggaaacaagcagcaagaccagctggagttgacctcctaggctatgtacatgataaaggacctttagaatga

SEQ ID NO: 8454 - RNA, 3174 nt, synthetic construct
  misc_feature 1..3174: note = Cas9 variant
  source 1..3174: mol_type = other RNA
atgcgcagactaggactagatataggaactaacagtataggatggtgtctaatagaagatgataagaaaatagtagacattggagtaagaatatttagtgacggaagagatccaaaaagtggcgccagtcttgcggtcgaccgcagagacgcgagggccatgaggagaagacgcgatagatatttagggagacgatcagcattcttgcaagcattggtggtgcacgggttaatgcccgcagatgcagatgaggctaaattagtggcagacagagatccataccagttaagagctaaagccttacacgtagccttggaaccatttgaaataggcagagcactattccacttaaatcaaagaagaggattcaaatcaaataggaaagcagatagaaaagcgaacgccggagaagatggaaaaattgccgaaggcgcgaaagccttagatcaagcaatgtcggaagctggagtagatacactaggtcaatttctggcactgaaagagacgaaaagagtaagattaggaagcgatggtcaggcttatgatttttaccctcaaagaagacatattgaatatgaatttgatagaatatggaaagtccaaagtgaatatcatccagccttattaacagaagcagcaagagcagcattgcatcgaatattattcttccaaagacctttgaaagcacaagaagtaggattttgtacgttcgctggtgtgaatggaatagcagcaaatgaaagaagactaccaaaagcacacccattgtttcaacaaagaaggctatatgaagaagttaatcaattaagaattgtgtcagccggagctgcggaccgaccattaacactagacgaaagagatagactcatcctaagactacaggatagaaagaaagtgtcatttgatacacttgcaaagaaagaccttagacttgcggacggagaaagatttaataaagaatcagaaaaccggaaagaactaataggagatgaggtacgcgctgagatgtcagataagaaacgttttggaactagatgggtacatttcggactcgatgagcaattaagaatactagcaaaactgcaagatgaggaaaatccagaggcactattagactggttaagaagtgaatatggactagatgaagcagccgcagaatcagtggcaaatgcacgtttaccagaggggtatggaagattcggagaaacagcaacacgtcttctattagatgcattaaaagctgaggtaataacatacgataaagctgcactcagggcatttggccatcacagtgactttagaacaggtgaagtattagatagattaccatattacggagaacttctaacgcgagaaatagccccaggaaaaccagaatacggagatccattagaaagacaatatggaaaaataactaatcctactgttcatataggattacgtcaattagaaaagctagtaaatgcagtaatagcagtacatggtcgaccagatcaaatagtcgtagaactcgcgagagaactaaaattgaacgaaaaagaaaaagatgaacataaacgacgaataaaacgagacacggatgccgcaatcgctaggggaagaaaactagccagtgaaggttttatagacaacggtgccaaccggatgttaatgagaatttgggaagaattaaacccagctaatccactggatcgtagatgtccatattgtgcagaaccaataggaataagggccttattcagtggagaagctgatatagatcatattataccttatagcaggtcacttgatgataatgttggaaataaagtcgttgcacatcgatcatgcaatagagcaaaaggaaataaaactccatatgaaaagtggggacctcatattgatcctgaacgctgggaacgaataagtgatcaagtagcaagattgcacaaaagtaaacaatggagatttgggcccgatgcaatggaaagaatagacagagatggagggtttctagccagacaactgactgacacacaatatttatcaagggtggcagggaaatacctacgatcattatatccgactgctcaatcagggagagtagatgtaattccaggaagaatgacagcaatgctaagaagaaaatggggactgaacagtttgttacctgatcataactacgttgaaaatgaacactcaaacgctccgaaaaacagattagatcatagacatcacgccatagatgcagcagtagcagcggtaacaactttaagcctaatgcaacaaatagctgacgcagcagggagagcagaggataaaaatctggatcgactcttcgaagatatacctcaaccatggccaggatttagggaagaattaggagaagcattacgcagtacaacagtatcgcataaagcagaccatggaagaaaaagaaggccttcaagagacagagatgtaacagcagcaagactacataacgatacagcatacgggctaacgggagacgtagccgcagatggaaaaactccgattgtagtccacagggtaccactagcgtcgttgaaaccggcagacctaatagaccctttaaggattccagatccagtactcagggatgcattatatgcagcaacaagagatagaacaggaaaggaatttgaacaggctttgacacaattcgcgcgacaccatcccctgttcaagggaataagaagagtgagagtacgggaaccactgaatgtaataccaataagggatgcagcagggagagcgtataaggcttacaaaggagatgcgaacgctcgattcgatgtgtggagactccctaatggaaaatgggtaagcgacatagtaagcatgtttgatgcacactgtatggcagacaagtcagatagacgaccccatcctgcagctaagaaagtactatcattgagacaaaacgatatggtagcaatagagagatctggagtaacccaaattgcacgtgtagtgaaattttcgactaacggatcaatagcacttgctgctgataacgaagctggagctttaaaagcaagagatgcagcaccaaatgacgtagatccttttaaatacatcttttcatccggaggaggattaaagaacttaaaagcacgtcaagtaagggtagatcccctagggagagtctttgatccaggaccaagagaatga

SEQ ID NO: 8455 - RNA, 3177 nt, synthetic construct
  misc_feature 1..3177: note = Cas9 variant
  source 1..3177: mol_type = other RNA
atgaaaaacagctacatcctagggctcgatgtaggaatagcaagcgttggatatggtttaatacacagtgactcaaaaagtgtaatagacgcaggagtaaggctgttcccagaagccaatgtagaaaacaatgaaggtcggagagcgaaaagaggaagtagacgcttaaaaagacgaagaatacatcggctagacagagtaaaatacttactggctcaatatcacttaataattgacgacaaaatacctaaaagcacaaacccatacgccatccgagtaaaaggcctaagctcggcccttagcaaatcagaactcgttatagctttacttcatctagcaaaacgcagaggtatacacaacgtaaatgtagtaatggacgaaaacgaatcgactaacgaactttcaacaaaagaacaactaaaagaaaatgcaaaacaattggaaaacaggtacgtatgcgaactacaactagatcgattaaacgaacaatataaagtaagaggtgaaagaaacagatttaaaaccgaagattttgtacgagaagcgagacaaatattgacaacacaacaaaaataccatgatattgatgaacactttatagaacaatatactcacctactagagactcgacgagaatactatgaaggtccaggtaaaggaagtcaatacgggtgggaaggagatttaaaacaatggtacgaaatgctaatgggccgctgtacatatttcccagaggaactcagaagtgtaaaatatgcctacacagcagatctctttaatgcccttaacgatctaaacaatttagtcatagccagggacgaaaacgagaaattggaatattttgaaaaataccatatcattgaaaacgtatttaaacaaaagaaatccccaacactaaaacaaatagcaaaagaaatagacgtaaaagagagtgacattaaagggtacagaataaccaaaaatggaaaaccacaatttacatcatttaaactatatcatgacctgaacaaaatattcttagataagaaaaatcttgagaatatagaactactagacgaaattgccttcatattaacactttatcaagacccactatctataaaagaagcattagatcaactacaagatttactaaccgaatcggaaaaagaagcaatagcacacctaaacggatacacaggaacacataggttatcactgaaatgtctacacctgttaatagacgagatgtggcaaacaagtcgtaaccaaatggaagtcttcaccgcactcaacttaaaaccacaaaaatatcagttgtcaaaacaaaaacaaatcccaaagaaaatggtagaagagttcatactatcgccagttgtaaaaagatcatttatacaaagtatagaaatagtcaatacgataatcaagaaatacggattacctgaagagataataatagaactagcaagagagaaaaacagcgaagaccgaagaaaattcctaaatcgaatacaaaaagaaaatgaaaacaccagaaaacaagtcgaagaagtaataagagaatacggaaatagaaacgcaaaaggactcgtcgagaaaataaaactccatcaaatgcaagaaggtaaatgtttatacagcctacaaaacatacccctagacgacctattaagaaatccttcacactatgaaatagaccacataataccacgctccgtatcattcgacaattcttttaacaacaaagtattagtcaaacaagaagaaaactcgaagaaaggtaatcgcaccccataccagtacctaaatagcaacgaaagtgtacttagttatgttcaatttaaacaacacattttaaatctctctaaaagtaaagaacgaatatctaaaaagaaaagagaatatttactagaagaaagagacataaataaatttgaagtacaaaaagagttcataaaccggaatttagtagatacaagatatgcaacacgcgaattagtacaattgctaaaatcatacttctcagcaaacgatttagacgtcaaagtaaaaacaataaacggcagtttcacaaattatttgcgaaaagcatggaaatttgacaaatcacgaaataaaggatttaaacaccacgcagaagacgcactaataatagctaacgtaagttacctctttaaacaatcaaaagaactaaaagaagccaatgcaatactagaaaacaataacttaagcctaaataaaaacaaagatagtaaaaatcttttaacagaacaagattatagaaaaatgttcgaaattccaaaacaagtccaggacataaaagattataaggactttaaatacagtcacagggtcgacaagaaacctaatcgacaacttataaatgattcactatacagtacaagagaagttaacgaaaaccactatatcgtccaaacggtcaaagacatctatgcgaaagataacactaaaattaaagaccttttcctgaaaacaccagaaaaactactcatgtaccaacacgacccccaaaccttcgaaaaattaatgcttgttataaaacaatatggagaagagaaaaacccttttgcaaaatattacgaagaaaacggcgaatatcttactaaatatgctaaaaatgaaaaagggccaacgatcaagagactaaaatatataggcaagaaagtgggtacccacttagacatttcaactaacttctcaggagcaaaacgaaaagtagtacaattatcaataaaacccttcagatttgacgtctttcatagcaaagcaggttatcatatgcttactttaacatatatggatattaaaaagaaagaaaaacactaccaaatattgaaaaacgaataccaagcactaaaagaaagatataaagtaccatccgatgcacaattcataggctccttctattacaacgatctcatatctattaatgacgaactattcagagtaatcggcgtaaacaattcaacgagaaatgtagtagaacttaacatggtcgatataaactacaaagactattgcgacctaatgggaataaagaaaacaccacgaatatttaaaaccataacaaagaaaaccggcaaaatagaaaaatatagcacggacatcttaggcaaccaattcaaagtcaaaccctcgaaatcgcctcaacttatcttcaaacgaggagttctatga

SEQ ID NO: 8456 - RNA, 3180 nt, synthetic construct
  misc_feature 1..3180: note = Cas9 variant
  source 1..3180: mol_type = other RNA
atgcgacgtctaggattagatataggaaccaattcaataggttggtgcttaacacagggaccaggagatgaagcagacggaatagtagatataggcgtaagaatattttcagatggtcgagatccccaaagtggcacaagtctcgctgtagacagaagagatgctagggcagcaaggaggagaagagatagatatatcggaagaagatcagcattcctagacactttagtcgcacatggattaatgccagccgatgcggacgaagcaaagctagtagctgcgttagacccatacacactacgtgctagggcacttgaagcaccattaacaccacatgaaataggacgggcgctatttcacttaaatcagagacgaggatttaaatctaatagaaaagcagaacgtaaaacaaacgatgccgatgatggcaaaattgcaaccgcagcatatgcactagatagagcaatgttagatggaggcttcgatactttagggcaattcctaaatgcacaagaaacaaaaagagtaaggatggacggcgaagcacaaggttacgatttctacccacaacgacgtcacgtagaatatgaatttgacagaatttggacagaacaagcaaaacatcatccagctctactaactgaaacagctcgatatgcgctccatagaattttattttatcaaagaccacttaaagcacaagtagtcggaaaatgcacttttgtacactcagaagatcgcctggcgaaagctcatccattatttcaacaaagaaggctctatgaagaggtaaaccaattagaagttacaacaccgggagaagctaatagaaaactaacactagatgaaagagataggctagtgagagaactatctcataagaaagcaatagcatttacgtcattagccgccaaaataaaactagagccaggacaatcattcaataaagcatctgaaacgagaactcagctcgcaggagatgaagtaagggcagtattaggtgataagaaacgatttggacctgcatgggaacatttcgatcgagatcgacaatggacaatagtggaaagattgctagaggaagaagaccctgacgctttacatgcgtttttaacacaggattgtggcttagacgacgagcacgctgctgctacagctaaaacatccttaccagaaggatacggaagactcggagcaacagcaacagcaagaatattagcggaacttcaagcagaagttataacatatgacgaagctgtacgccgatgcggatggcatcacagcgaccaccgtacaggggaaatcttaccacaactaccctattatggtgaacttctaactcgagacattccaccaggtacccaagacccaaatgatccacctgaaaaacgatggggtaggattactaaccctactgttcatattggattaaaccaagtacgtcaacttgtgaatgccatagtggcagttcacggcaggccagaccaaatagttgtagaacttgctagagaactaaaattaaacgaaaaagataaagaagaacataatcggagaatacgtagagatacagcggcagcaattaaaagaagcgaaaaactaacacaagaaggatttccagataccggtgcaaatcgaatgctattacggttgtgggaagacctgaatccagctaatccattagatcgaagatgtccatactgcggagctcctataggcatgagagcgttattcgcaggagaagcagatgtcgatcacattatcccatatagtaggagccttgatgatagtgcaggaaataaagtagtagcacacagaagttgtaacagagcaaaaggaaaccgaacgccctacgaaaaatggagcgacgatcctgacagatgggatgcaattacagctcaagttgcccggctacataggagtaaacaatggcgatttggacccgatgcaatggcaagagtagaaaaagatggaggatttttatcgagacaattaacagatacccagtatttaagtagattagcaggtagatatctatcgtcactttacccaacaaaggaagaaggatccgtttatgttataccgggtcgaatgacagccatgctaagaagattatgggggttgaatgacattttatcagatcacaatatcgttgaaaataaacatagcaacgctcccaaaaatagactggatcaccgtcatcacgcaatagacgcagctgtagtagcagtatctactagaagcctcatgcaaaggatagcaagaacagctgggcaggcagaagacagaaatctagacagactatttgaaggactagatccaccatggccgggttttcgcgaccaattaagagatagattgttagctgtaaccgtctcccataaggctgaccatggacgaacaggtactccagtaccaggaaaagatgcgacagccggaagattacacaatgacacagcatacggactaacaggagaaacatcagcaaaaggacttccaatcgtagtacatagggtccccttaactagcttaaaacctgctgatataacagacccagatagaatcccagaccccgtcttaagagacgccatcgagcgagccacagcaggaaaaatgggcaaagatttcacagatgcacttgcaaaattcggaagaagcggagcccaagaaacagatcgtaaaggggaaagactatttagaggaacacgaagagtaagagtccgggaaccgctaggcgtaatacccatagcggatgcatctggacgagtatataaggcatataaaggtgactcaaatgctaggtttgatgtatggaggttaccagatggtaaatgggtatccgatatagtatcgatgtttgatgcccatagaccagaccaaggcgatcgtagaccccatccagccgcgaagaaagtattaagtctacgacagaatgatatgatagctatagagcgcgatggggcgccacgagaaatagttcgtgtagtcaaatttagcacaatcggctctgtacagctcgccgctacaacagaagcaggtccactgaaagctagagatgcatctccacctgatgtagacccttttaggtatattaacagttcggcagggggattaaagaaaataaaagctagacaagttagaattgacccactagggagaatatttgatccaggaccaagatga

SEQ ID NO: 8457 - RNA, 3180 nt, synthetic construct
  misc_feature 1..3180: note = Cas9 variant
  source 1..3180: mol_type = other RNA
atgatagaaagaatactcggcgtagatttaggaataagtagtttaggatgggcaatagtagaatacgataaagatgacgaagcagcaaatagaatcatagattgcggagtacgattattcactgctgccgaaacaccaaagaaaaaggaatcaccaaataaagctcgacgtgaagccaggggaatacgacgagttttaaatagaagacgagtacgtatgaacatgataaaaaaactatttttacgagctggtcttatacaagacgtagacctagacggtgagggaggaatgttttacagcaaagcaaaccgcgcagacgtatgggaactaaggcatgatggattatatagattactcaaaggtgatgaactagcaagagtactaatacatatagccaaacacagggggtataaatttataggagatgatgaagctgatgaagagagtggaaaagtaaaaaaagccggcgtagtgttaagacaaaatttcgaagcagcagggtgtagaacagtaggagaatggctatggcgtgagagaggagcaaatggaaaaaaaagaaataaacatggtgattatgaaatatcaatacatcgagacttattagtcgaagaagttgaggcaatttttgtagcccagcaagaaatgcgaagtacgattgcaacagacgcgctaaaagcagcgtatagagaaatagccttttttgttcgtccaatgcaacgtatagaaaagatggttggccattgtacttatttcccggaagaacgaagagcaccaaaaagtgcaccgacagcagaaaaatttatagctatatcaaaattcttctcaacagtaataatagataatgagggttgggaacaaaaaataatagaaagaaaaacactagaggaactattagatttcgctgtaagtcgagaaaaggtcgaattccgccatttacgcaaattcctagatctatccgataatgaaatattcaaaggcctacattataaaggcaaaccaaaaacagctaaaaaacgagaagccactttatttgatccaaatgaaccaacagagttagaattcgacaaagtggaagcagaaaaaaaagcatggatatcactaagaggcgctgcaaaacttcgcgaagcccttggaaacgaattttacggaagatttgtagcccttggaaaacatgccgatgaagcaacaaaaatcctaacatactacaaagatgaagggcagaaacgaagagaactaacgaaactgccattagaagcagaaatggtagaaagattagttaagattggatttagtgactttctaaagttatccttaaaggctataagggatattttgcctgcaatggaatcgggagctagatatgatgaagcagtactaatgttaggagttccccacaaagaaaaatcagcaatattgccgccgcttaataaaacagatattgacatactgaatccgacggttatccgcgcattcgcacaattcagaaaagttgctaatgcattagtgcgtaaatatggagcattcgatcgagtacattttgagcttgcaagagagataaacaccaaaggagaaatcgaagacataaaggaaagccaaagaaaaaatgaaaaagaaagaaaagaagcggcggactggatagcagaaacaagctttcaagtaccgttaactaggaaaaatatccttaaaaaacggttatatatccaacaagacggaaggtgcgcctatacaggtgatgtgatagagctcgaaagactgtttgatgagggctattgtgagattgatcatatattaccacgtagccgaagcgctgacgactctttcgctaataaagtgctgtgcttggcacgggcaaatcaacaaaaaactgatcggacaccatatgaatggtttggacacgatgccgctagatggaacgcatttgagacgcgaacgtctgcaccgagtaaccgtgttaggactggtaaaggaaaaattgataggctattaaaaaaaaattttgatgaaaacagtgaaatggcattcaaagatagaaatctaaatgatacaagatatatggccagggcaattaaaacatattgtgaacaatactgggtcttcaaaaattcacacacaaaggcaccagtacaggtacggagtggaaaattgaccagcgtgttacgataccaatggggtttagaaagcaaagatcgagaatcacacacacaccatgcagttgacgcaataatcatagcattctcaacacaaggaatggtacaaaaactcagtgaatattacagatttaaagaaacacacagagaaaaagaaaggcctaaattagcggttccgttggcaaattttagagatgcagtagaagaagccacaagaatagaaaatacagaaacagttaaagaaggtgtagaggtaaaaaggttactaatctcaagaccaccacgagcaagagtaacaggccaagcacatgaacaaacagcaaaaccatatccgcgaataaaacaagtcaagaacaaaaaaaaatggagattagcacccattgatgaagaaaaatttgaatctttcaaagctgatagagtagcaagtgccaatcaaaaaaacttctatgaaacttccacgatacctcgagtagacgtgtatcacaaaaagggaaaatttcaccttgtgccaatatatctacatgaaatggttttaaacgaattgccaaatttatcattgggaacaaatccggaagcaatggacgaaaactttttcaaattctctatttttaaagatgatttaatcagtatacaaacacaaggaacaccaaaaaaacccgcaaaaattataatgggatattttaaaaacatgcacggagcaaacatggtgttaagctcaatcaataatagtccatgtgaaggatttacatgtacaccagtttcaatggataaaaaacacaaagataaatgtaaactatgtcctgaggaaaacagaatagctggccgatgtctacaaggattcttggattactggagccaagaaggattaagaccgccaagaaaagaatttgaatgcgatcaaggagtaaaatttgcacttgatgtaaaaaaatatcaaatcgacccactgggatattattacgaggtaaaacaagagaagcgattaggaacaatcccacaaatgaggagtgcaaaaaaactagtaaaaaaatga

SEQ ID NO: 8458 - RNA, 3180 nt, synthetic construct
  misc_feature 1..3180: note = Cas9 variant
  source 1..3180: mol_type = other RNA
atgtcaaagcgtctccgatatcgattagctcttgatttaggtacgaactcaattggattttgtctattggatttgaatggtgatggtagaccttgtggagttagaaggatgggcgtaagaatatttccagactttagcaaattacaacagtccttagctgcagacaggagattagcacgatcaatgaggcgaagaagagatcgctacttacgaaggcgaaaagctctaatgaacgcgttagtagcagcggcactaatgccggcagatccaaaagcaagaaaggcgttagaagcactagacccgtacgagttacgagctgctgcagtagcagggccattaccagcacaccagttaggtcgagccttgttccacctaaaccaaagaaggggtttcaaaagtaacagaaaagcagctggagatgagaacgaagcggggaaagtaaagagtggaattagtgcattaaaagcggaattagctgcctcaggagcaggaacattaggacaatggttagctgctcgtcacgccaatcgtcaaccagtacgagcaagacttacgggtactggtgcgaaagcaacatatagcttttatccagaaagggcattagtgcacgaagaatttcaagctataagagccgctcaagctccacatcatcctggcgtaacagcagaacaatgggatcgaatagaaagtgttatatttcatcaaagaccgctaaaacctgtgaaaccaggtaaatgtacgttatatcctgaagaagaaagagctccatgggcgctaccgatagctcaaagatttagaattttacatgaactacataatctcagaatagtaaggcctggacaaggagaagaaggacttagccctgcggattttgataggttctttgacaggttatgtagaaaaggtgatttgacttttaagacattagccaaggaattaaaacttcccccagacgcaagaataaatttagaggatgataagagagatagattaaaaggagatgcaactgctgatgcgttatcagcggaaaaaggaaaaagaagaagaataggggcagcatggcattcatttccggcagacaggcaaagggaaattgtaggtcgattaatcgatgcagaagatgaaggagaattagctgcatggttagtagaagaactaggattaccgtgggaagtggcaatactgactgctgaacgtccaggcttaccagatggttattgtagattatctgaaaaagctctagaacaggtagtgccgttaatgcacgaggaacatttgccgtacgatgaagcggtacgagcacttggtctacaccatagtgaccatagaactggggaatttctagatgaactaccatattatggactacccttagaaagattcatcgcatttgggactggagaagcagacgatccaccggaactgagaatcggaagatttcctaaccctacagtacacgtagcattaaatgaattgagaagggtagtaaatagaataatcaggaggtgggggaaacccgaagagatagtggtagaattagctagggatttaaaacagagtcgtgcagatagagacaaaacacaaagagaacaagcggacaatcagaaaaagaattggacaagaacgcaacaactgagagaattaggaatggaaccaactggggaagcactgctacgtttaagattatgggaagaacttcctagaattggatcagcacatgtatgtgtttataccggtcaaccaataagtatgacgcaacttctacaaggggatgtagatgtagatcatatattacctttctcgaggacactagcaaatggggcagacaataaaatagtatgtcaccgtagagcaaaccgaatcaaaagaaacagaactccgtgggaagcatttggtgttgtttcagcggacggttatgactgggcagctattgcggaacgagccgaaagtcttcctaagaataaaagatggagattcctaccaaatgctatggaaagatttgaaactgaaagagggtttatcgacagacaattagtagaaacaagacatctaagcagagtagcaagagaatatttaggatgtatagttcctcttgagaaagtaagagcagctccaggaaggttgacagcgatgctaagggggagatggggtttaaattcaatattaagtgacgcaaacttgaaaaatagatcagatcaccggcaccatgcagtagacgcggcagtacttggtgtcatagatcaaagattagttcaaagagttgctgacgccgctaaaagagcagaagaaaaggaactagaaaaactatttgatgggctaccagatccattcgaaggactacccgggccatcatttcgagatcaagtacaagagagagcacaaggaattattgtctcacataaaccagaacacggatggcaggggcgaatgcataatgataccgcttacgggccggtagagcggctacccgatggaacacacagagtagtaacaagaaaacctttagggtccctagcagaaaaagatttcggaaatatacgagacagagcgctagcagctgcactagaaagacatgtagcagaacaagcagcacaaggtcgtagcctaggagaagcactaagttgtttcacatggaccggaggagaggtacgaagagtgagaatgttagacaaattaggttcgccagttgcagtacaggacgacgatggacatacttttaaattatataaaggtgattctaacgcatggtatgagatactcagagatggaagggggagatggacaggaagaatagtttcgacatacgaagcatataggctacatgcggagtggttagctgaaaggggtgatggaggaagatcggacgctgcattcccagactgggctgcccggagattatgtgcaggtattggtaaacccttattcagactattcaaaggagatatgttagctttcggaacagcacctaatcgcgaaataatgaaggtagtcaaatttagtgaaggacgaatcgtattcgcgggtcacagggaagcggggaatttaaaagagcgggatgccgataaagacgatccattcaaatatcgaacatgctcgccagaagcactgcgtaaagcgcaggcacgaccagtaggagtagaccctgcaggattcgtacacgataggggacctctagaatga

SEQ ID NO: 8459 - RNA, 3180 nt, synthetic construct
  misc_feature 1..3180: note = Cas9 variant
  source 1..3180: mol_type = other RNA
atgggtataagatttgcatttgacctagggacaaacagcataggttgggcggtttggcgaacaggaccaggtgtatttggagaagatacagcagccagtcttgacggatccggagttctaatatttaaagacgggagaaaccctaaagatggacaatcattagcaacaatgagaagagtaccaagacaatcaagaaaacgtagagacagattcgtacttagaaggagagatttactggcggccttaagaaaagccggtttatttccagttgatgtggaagagggaagacgattagccgcgacggacccctatcatttaagagcaaaagcactagatgagtcattaactccacatgaaatgggaagagtaatatttcacttaaatcaaagaagaggattcagatcaaatcgaaaagcagacagacaagatagagaaaaaggcaaaattgccgaaggttcaaaacgacttgcggaaactcttgcggcaacaaactgcaggactttaggagagttcttatggtccagacataggggtacgcctcggacaagatctccaacaaggataagaatggaaggtgaaggcgccaaagctctatacgccttctatccaacaagagaaatggtcagggcggaatttgaaagattatggacggcacagagtcgatttgcacccgatcttctaacaccagaacgtcacgaagaaatagcagggatattattcagacaacgagatttagcaccgccgaaaatagggtgctgtacatttgaaccgagtgaacgaaggcttccacgggcattaccatctgtggaagctagaggtatctatgaacgactagcgcacctacgaatcacaacaggcccagtatcagacagaggattaacgagaccagaaagagatgtactagcaagcgctctattagcaggtaagagcttaacgtttaaagcagtaagaaagacgttaaagatattaccacatgccttagtaaattttgaagaagcaggagaaaaaggtttggacggtgctctaacagctaaattattgtcaaaaccggatcattatggtgcagcatggcatggtctcagttttgcggaaaaagatacattcgtaggaaaactgttagatgaagccgatgaagaacggttaattaggagattagtaactgaaaaccgtttaagtgaggacgcggcaaggagatgtgcttcaattcctcttgcagatggatatggcagattgggaagaacggctaatacagaaattcttgcagcgctagtagaagaaacagatgaaacaggaacagtagttacctatgcggaagcagtaagacgagctggtgaaagaacgggaagaaattggcatcattctgacgaaagagatggtgtaatcctagatcgattaccctattatggagaaatcctacaacgtcatgtagtaccaggaagcggcgaacctgaagaaaagaatgaagcagcgcgttggggaagattagcaaacccaacagtacatatagggcttaaccaacttagaaaagtagtcaatcgattgattgctgcacacggtagacctgatcaaattgtggtcgagttagcaagggaactcaaattaaaccgggaacaaaaggagagattggacagagagaataggaagaatcgagaagaaaatgaaagaagaactgctatattagcagaacatggacaaagagacacggcagaaaataaaataagacttagactatttgaagaacaagctcgtgctaatgcgggcatagctctatgtccatatactggtcgagcaataggtatagcagagcttttcacaagtgaagtcgaaatagatcatatactaccagtatccttaactttagacgatagcttagcaaatagagtattatgtagaagagaagcaaatcgggagaaaagacgacaaacacctttccaagcatttggagcaacaccagcttggaatgatatagtagcacgagccgctaaattgcccccgaacaaacgttggagatttgatccagcggctttagaaagattcgaaagagaagggggattcttaggaaggcaattgaacgaaacaaaatatctaagccgattagctaaaatatacttggggaaaatatgtgatccggatagagtatatgtaactccggggacattaaccggattacttagagctagatggggcctaaatagcatcctaagtgactcaaactttaagaaccggagtgaccacagacaccatgcggtagatgcggtagttataggtgtactaaccagaggaatgatacaaagaatagcccatgatgcagcacgggctgaagatcaagacctagatagagtatttagagatgtaccagtcccgttcgaagactttcgagatcatgtaagagaacgggtaagcacaattactgtagcagtaaaacctgagcatggcaaagggggagcgttacatgaagatacatcctatgggctagtaccggatactgacccaaacgcagcacttgggaatttggtagtaagaaaaccaataagatccttaacagcaggagaggtggatagggtgcgagacagagcattacgggcaagattgggtgctttagcggctccattcagagatgaaagtgggagagtaagagatgcaaagggattagcacaagcattggaggcgtttggggcagaaaacggaattagaagagttagaatactcaaaccagatgcatcagttgtaaccatcgctgatagaaggacaggagtaccatacagagcagtagcgcccggagaaaaccatcatgttgatatagtacaaatgagagatgggagctggagagggtttgcggctagcgtattcgaagttaataggccaggatggagaccagaatgggaagtaaagaaactaggaggaaaacttgtcatgcgactacacaaaggagatatggtagagctatcagacaaggatggccaaaggagagttaaagtagtgcaacaaatagaaatatcggcaaatagagtaaggctgagccctcataatgacggcggcaaacttcaggatagacacgcagacgctgatgacccatttaggtgggatttagcaacaattcctcttttaaaagatagaggatgtgtggcagtaagagttgacccgataggtgtcgtaacgctaagaagatcaaacgtatga

SEQ ID NO: 8460 - RNA, 3183 nt, synthetic construct
  misc_feature 1..3183: note = Cas9 variant
  source 1..3183: mol_type = other RNA
atggcggtaaaaagtctgaattatatcttaggattagacttaggaattgcatcttgtggatgggctgttgttgaaatggatgaacaggaaaatccattgagacttatagatgtaggcgtacgaacatttgaagaagcagaaaacccaaaagacggaagcagtctagctgaaacaagaagactggcacgcgcacaaagacgattaatctccagacgagctaatagaatgaacaaactaagacgattgttaaaacaagaaaatgtactccaagcaaatgattacgacgaaaaaggtctaataataggattacccaaccaggcttgggaactacgagcacaagggctagatagaaaattagaaccaaaagagtgggcagctgttttaattcatttagtaaaacatcgaggctatttatcacaaagaaagaatgaatcacaaacagctgacaaagagctaggtgcactactcagcgggatgaatcataaccatcaactactacaaagccaaagtaaccaataccgaacccccgcagaactagcaataaaacaattcgcaactcaggacggacacataagaaaccaaagaggagcatacacacacacatttaacagattagacttacaaaatgaactaaaccagctatttgatgcccagacaaggctaggaaacccgcatgtatcaggaagtctaaaaacagctatcaatgacttattaatgaatcaaaaagcagctctcagtggagatgcaatactagaaatgctaggtagatgcacctttgaaccttcagaatacaaagccgccaaaaatacatacagtgcagaacgatttgtctggttaggtaaattaactaacctacgaatccaagacaacggactagaatctgcactatcacgagaacaaagagagctcctactcaatgaaccatataacaaaacaaaattaacttatcaacaagtaagaaaacttttaagattgccagaaacagcatttttcaaaggacttagatatggaaaagataatgcagaaagtgcaacactaatggaaatgaaatcatatcatgcaattcgaaaatctctagaaaacaaaagtttaaaatctgaatgggaaaagctaaagactcagccaaaactattagacctaataggcacggcgttctctatctacaaaactgacgatgaaattgcaggttgcctcaaaaatcagctgccagaaaacgtaataatagctctacaagaacaattaaatttttctaattttatggaactatcacttaaagcattagaaaaattactaccccttatggaacaaggactacgctacgacgaagcgtgtactcaaatttatggaaataggcatgagaaaatcgcagacaaaactgaaaaattcttacctaatataccagctgataaactaagaaatcccgtagttctacgtaccctaacacaagcaagaaaagtaataaatgcaataataagaagatacggcagtccagcaagagtgcacatcgaaactggaagagaagtaggcaagagcttctcagatagagataaactgaagaaacaacaggaagaaaaccaagaacaaagacgtagagcaatagatgaatggaaacaattctttccaaacgcagcacacgaaccaaaagcagtagacatcctgaaacttagattataccaattacaacaaggaaaatgtctttactcaggattaccaatagatgttagaaggctacctgaaaaaggttatgtagaaatagatcatgctttgccttttagcagaacatgggatgactcatttaacaataaaattctagtacttgcatcggaaaatcaaaataaaggaaatcaaacaccatatgaatacctgagaggagcagataactcagaatcttggagactatttgtagaaaatgttcagaactgtcaattcagtcctaataagaaacagaaaataatggcaaaacaactagacgaaaaaggcttcttagaaaggaatctcaacgacaccagatacgtatcaaggtttttatgtcaatttataagcgaatacctgcaccttacgggaaaaggtaagaaacgagtattcgcctctaatgggcaaataactgctttactacgcggaagatggggattaagtaaaaaccgtgaagaaaacgatagacaccatgcagtcgatgcagttgtagttgcatgctcaacagttgcaatgcaacagaaaataacacaattcgtacgctaccaaaaaggaaatgtgtttaccggagaaaggatagataaagagacaggagaggtaatttcaatacatttccctaccccatgggaacacttcagagaagaagtgatgataagagtatttgatgataatcctctgagaacgctaccagaaaaattaccaaacagaccagaagccttacatgaatatgttatgccattatttgtatcacggatgcctacaaggaaaatgactggacaaggacataaagaaacgattaaatcggcaaaaagactagatgagaaaataagtgtcttaagagtaccactcacacaactcaaactaaatgacttagaaaacatggttaatagagaaagagaacccgcattatacgaagcactaaaagcaaggctagaacaattcaagaatgatccagcaaaggcttttgccgaaccatttttcaaacaaggaggacaacaagtaaaagctgtacgtgtggaaatagtacaaaaatcaggcatgctgttaagaaaaataaatggagtagcagacaatggatccatggtgagagtagacgtcttcgagaaaagtggaaaattctacttggtacccatatatgcttggcaagtagcagaaggaatactaccaaaccatgcagtagtacactcaaaagatgaatccgattggatattgatggacgaatcctaccatttcaaatttgccttatacaaaaacgacctactagaagttcaaacaaagaaaggatgtataatgggatattttgcttcactagatcgagcaactggtgccataacaatcagagaacacgatagagataaaaagaaatgcaaagatggagaacatcgtagcataggagtcaaaatggcatcgagcttcaagaaacttcaagtggatgaactggggaaaaatatacacgaaacaagaagtagaaaaaggcccaatatcggatga

SEQ ID NO: 8461 - RNA, 3186 nt, synthetic construct
  misc_feature 1..3186: note = Cas9 variant
  source 1..3186: mol_type = other RNA
atgcataccctaccttacactttaggacttgatatagggatagcatcagtaggcgcagccctactatctgacgaaagtatattaggaatgcatgtaagaaccttttctgcagcagaaactgataaagaaggggacccgcttaataaaattagaagagaagcaagaagcgccaggcgtagaataaggagacgagcccatagattattaagattacgtcgtctgctaaaaagaacaggactaatatcggatacttcgttagaagtcttaaaaacatctaaaactccttggcaattaagatcagagggattagacaggttattaagcccttctgagttagccgcagcgttatatcacatagtcaaacatagaggctttcagagcaatagaaaagcagaattaaaaaccgacgcaaaagcgggacaaatgctttcaggtgtatccgcaaatcaacaattgatgagagataaatcatacagaacgatagcggaaatggtttgtaaagacgatgcattcaaagatcacaaaagaaacaaaggtggatcataccgaaatacgtttgctagatccgacttagctgacgaattaaaaacattactaaagaaacagagagaatacgataatccgctcgcaaccccagaactagaagaagcagtacatactctattaatggctagaaggccagtatttaaagacgatgatatagaaaagctagtaggattctgtacattcgagcacggcgagaaaagagcaccaaaagcggcattcagttcggaaagattcatatggctaggaaaattgaataaccttagacttatatacccaggcgaacaaagaagcctcacaccagaagaaaggtcacagataataaatctaccctttactcaagcatcagtaaaatttagccaaattagaaagaaacttgacctaccggaatatgttagatttaatttggtaaggtacaaacctggcgaagaaacatcaaaaagcgaaacagcaacattctttgaagccaaggcttttcatgaactaagaaaaacttatcgagaatctggaatatcagaattatgggaaagggaccaacatgatccacaaagactcgatcagatagctacagcaattgcagtctatagagatgatgaaagaataagaaatgagttatcacctcacactattgaaaacgaagtagtagaagcggtattaaattgcgactttacccaatttatcaacttatccttaaaagctctaaataaaattttaccatacatggaacaaggccagaggtatgatgaggcttgcacatcagcaggataccagcatcactctccccaacaaaatgaagaaaaatccggaaggattccccctccagataaaaacgtcataagaaacccagtagtttatagaagccttaatcaagccaggaaattaataaacgcaatcacaaaacgatacggggcgccagcagctattcatttagaaatggcaagagacctttccaaaccctttagtgaaaggaaatcaatagaaagagaacaggaaaaatacagaaaacaaaaagttcaactcagaaatgaatatatagaacattttggaactgaacctaacggcctgaatttactcaaatttagactttacaaagaacaagatgcccaatgcgcttatacacaaaaagcattagacctatccagactaaatgaagcaggatatgttgaggttgaccacatacttccatactcacggtcttatgatgattcattattgaacaaaacattggtactaacagaggcaaacagagacaaaggaaacagaacgccattcgaatttatgggtggagacgatcaatctcaacattggcaaaaatttgtaagatgggtgcaaatgaacccaaaaattagacaagctaaaagaaaccgctacttaagaaaagacttttcagaaaaagctgcacgagaatttcgggatagacacttaaacgatacacgatatataggtcgagaattaaaagcaatgattgaatcacatgttcagtggcatccggactcaaaatcaaaagattgctgcgtagttctatctggtcagttaacggcactactacgaggaagatgggggtttaacaaagatagagcagcaggagacttgcatcatgcagtagatgcagcagtagtcgcagcagcaaccagaggcatgatacaacgaatggctaggcacagtaaattccatgaactcaaaaatgttagaacaagttatgctgacccagacacaggagaagtagtcaatttagcagcagctcgggatctagaaaaacatttcccattgccatgggacaattttcggaatgatactctcgcctatcttaatccaagtgccataagcgctgatgaatctgcacaagaaggacaccgaggcgttagggtttccagagcacccacaagaagaaaattaggagctgcccaccaagaaaccattcgtagcaaaggaaaagataatatattacttgaacaaggactctcagcagtaaaaactcctctttctaaacttacgctgaaaaatatagaaaacatggtaggctatgaagacccaaggaacgcagcgctagtaaaagtattaagagaacgcctagaagcatttggaggagatggagcaaaagcattcgcaccgaatcaaccacccgtttacaaaccatccaaaccagggaaacaagcaccagaaataagaagtgtaaaaatggcaagcaaatctaaaggagcactacacgtccgagaaggtttagcagattccggccgtatgataaggatcgacatatacgaaactaaaaatggctacgttggggtaccaatttacgtatcagataaagcaagaagtaaactaccaaaagcatatccaaagaaaggagaagatagggccaactggccagaagtcgatacaaacgataactttctatttagtttatattcaacagattggatagaagccaaaacaaagaaagaaacaattgcaggctacgtaaaatcatacgatatattcgatggaagattgcttgtatacgcacacgataacaagaaagttgtaagaaaattaacactaagcgcacttgctgacctacagaaacttcacgtatcgatactaggagatctatataaaggagggacaccaaaatgcagccctttaagaaaaggccaagaactatga

SEQ ID NO: 8462 - RNA, 3186 nt, synthetic construct
  misc_feature 1..3186: note = Cas9 variant
  source 1..3186: mol_type = other RNA
atgctacgcctcggactagatataggtagcacatcaataggatggtttttatatcgcataactaacggcatgatcgccgagataatagattgtggtgtcaggttattttctgacggtagagatgcgaaaactggagtatcttcagcagtagaaagaaggaacgctagggcattgaggcgtagaagggatcggtatttaagacgacgagctgctttaatgcgaagactagcagcagcaggattaatgccggaagatccatcacaggcaaaaccattagaactcttagatccttatcgtttaagagcggacgcactagaccgaagactagagttaacagagttaggacgagcattatttcatttgaaccaacgaagaggattcaaaagtaatagacaaactgatagaggaaataatgaagggggtaagataatagatggtagtgcaagacttgatcaagcaatgatggctgtgggcgcgaggacctatggcgaatttctgcaccttcgaagatcccaagcagaagacttacgaagagtaccaagcgtgagaacaagattaacattaagatcagtagatggaggaaaagccgaaactggctatgacttttatcctgatagacgccatttagaagaagaatttaacaaagtatgggctgcacaagcggctcaccaccctgtattaacagatagtttaaggcatgaagtttttgaaactattttctttcagagaccattaaaggctcctgcagtaggacgctgcctcttcttcccagaaccacgattaccccgagcccacccattaacacaacgtcgtgttttatacgagacagtaaatgccctcagaatacgaacagaatcaggcgcagcagtaccattaggaaaggaacaaagagacaaagtaattatgttattagatggaaaagccccagtaaaagcaatagcatctgctaaattgtcactaaaagccatagcaaagcatctgaaattaagagacggacaaacctttactcttgaaaaaggacgagattatatcgcatgtgacccagtcagagcaagtttatcccatccggatagatttggaccccgctggagcgttttagaagcagaagtccaggcagaaatagtcgggcggatacgtgatgatgatgatacaatggctttagtagaatggttaaaacaagtgcatggcttagatgacgctcatgctcgagctacagcggatgcacctctcccggaaggttacggaagacttggcgaaacagctacaaggaaattattagattgtttaaaagcagaagtattaacctatagtgaagctgtcggaaaagcgctagaccaacatcactcagacagaagaaccggagaaattctagaaagtttaccatactacggcgaagtactgcaagctcacgtcattccgggaactggcgaaccgcatcacgatgacataactagatttggacgaataactaatccaaccgtccacataggactaaatcaattaagaagattagtaaatagaataatagctaggtatggcaaaccagcagaaatagtcgtagaactagctagagacctcaaacaatcaactggacagaagaaagctgcaatagcattaaaccttaaaaatcgaaaagctgcagaagctagaagtgctttactaacagaatggggcgttcctgatacaggagcaaataggatgtatgttaggctatggcaagaactacacgaagaccctatgatgagaagatgtccatacacgggtactataatcagtccatcgctattattcagcggagcgattgatatagatcacattttaccatacagtagaacactagatgattcaacagctaatagaacactatgtatgaaagaagcaaacagacagaaaaggaataaaagcccatccgaagcaagaagagatggtatgagaatatgggcattggaagatgacaatttaaggcatatacccgaatttaaaagatggaggtttgcagaagacgctatggcaagattcgaaggtgaaagagatttcgaagctagagcactcgtagacactcaatatttatcaaggatttcgaaagcctatttggaaacactctatgatggagcagacggaaaatcacacgtctgggtagtccccggaagattaactgaaatgctaaggagacattggggtctaaatgggatattaacagatccattacgagacgtaacaaaagaaaagaatagaatggaccatcgacatcatgctatcgacgcggctgtcgttgcagcaaccgatagaggtttaataaaagcaatggctgaacaagcacgaacagatgtggatcaaggtagagaagcactagctagctcaattatgccaccctggccaggttttagagaagctgtagcagctcaagtagatagaattatagtatctcacagacctgaccacggaagaatcgatctaacaacccgaatgaaaggaagagatcaaaccacaggacccttacatagagacactgcatacggcttaacaggacaatcagagaaaggagtccctctagtagtcacaagagaaccattcgataaccttacaccaacaatgattggaaaaataagagacgagccactaaaggcagcattggcagctgtaacagcgggaaagaaagacgacgcatttgccgaagcgttagcgcatttcagagatagaccaggaccataccatggaatacgacgagtaagattaatagagccaatatctgtggttgaaatccgtgacgcatcagggagggcctacaaaggttacaaaggaaattcaaatcattgctttgaagtatggagattaccaggaggcgcaataacagaacatatagtgagtaccttcgacgcccatcaaccaggtcccgaaccaagaccacatccggcagctaaaagactattaagactatttaaaagcgacatggttaaactcgatgattctaaatttggacccgtaatagcaacagtagtaatgtttgataggaatggaaaaataagtttagtccctcataccgcttcaaatgcccgaaaaagatgtgaaaagtataaagaagatctctatttacgttttacagccagaacattaatagaagcaggagcaagaagaataatagtagacgaaacaggacacttccgggatcccggacgaaaaggctga

SEQ ID NO: 8463 - RNA, 3189 nt, synthetic construct
  misc_feature 1..3189: note = Cas9 variant
  source 1..3189: mol_type = other RNA
atggctgaaaaacaacataggtgggggctggacataggaactaactcaattggatgggcagtaatagcattaatagaaggtaggcctgcaggattagtagcaacgggctcgagaatattcagcgatggaagaaatccaaaagatgggagtagcttagctgttgaaagaagaggcccaaggcaaatgaggaggagaagagataggtatctgcgtcgaagagatagatttatgcaagcattgatcaacgttggcttaatgccaggagacgccgctgccaggaaagcattggtaaccgagaatccttatgtactaagacaaaggggacttgaccaagctctaacactaccagaatttggaagggctttatttcatttaaatcaaagaagaggatttcagagtaacagaaaaacggaccgagccacagcaaaggaatcgggaaaagtaaagaacgcaatagcggcttttcgagcaggtatggggaatgcaagaacagtaggagaagcactagcaaggagattggaagacggaagaccagtaagggcaagaatggttggtcaagggaaagatgaacactatgaactatatatagcgagggaatggatagcgcaagaatttgatgctttatgggccagtcaacaaagatttcatgcagaggttttagccgatgcggcaagagatagactgcgagcaatattactcttccagaggaaactgctaccagttccggtagggaagtgttttctagaaccgaatcaaccaagagtagcagccgctttaccaagtgctcaaagattcagattgatgcaagaattaaaccatttaagggtgatgactctagcagacaaacgcgaaagacctttatcttttcaagagagaaatgatttattagcgcagctagtagctagaccaaaatgcggatttgatatgttaagaaaaatagtatttggggctaataaagaagcatatcgttttacgatcgagagcgaaagaagaaaagagttaaaaggatgcgatacggcagccaaattagcaaaagtcaatgctttaggtacaagatggcaagcattatcattagatgaacaagataggttagtttgtctattattggacggagaaaatgatgcagtactggcagatgcactacgagaacactatggtctcacggatgcacaaattgatacacttctaggattgtcatttgaggatggacatatgaggcttgggagatcagcacttctaagagttttagatgccttagaatcgggtagagatgaacagggattaccactaagctacgataaagctgtggttgcggcaggatatccagcccatactgcagatctagaaaatggcgaaagggatgcactaccatactacggagaattattatggagatatactcaagatgcaccaacagccaaaaatgacgcagaaagaaaattcggtaaaatagcaaacccaaccgtacatataggattgaatcaactgagaaaattggtaaacgcattaatacaaagatatggcaaacctgcacaaatcgttgttgaactagcacgaaatctgaaggctggcctggaagaaaaggagagaataaagaaacaacaaacagcgaatctggaaagaaatgaaagaataagacaaaaacttcaggacgctggagtaccggataatagagaaaatcgattaagaatgagattattcgaagaactcggacaaggcaatggtttaggaacaccatgtatatacagtggaagacaaataagcctacagagactgttttcaaacgatgtacaggtagatcatatattaccattcagtaaaacactagatgattctttcgccaataaggtattagcacaacacgatgccaatcgttataaaggaaatcgaggtccttttgaggcttttggagctaatagagacggatatgcttgggatgatattcgagcaagagccgcagtattaccacggaataaacgaaatagatttgctgaaacagcgatgcaagattggttgcataacgaaacagactttctagcaagacaattgacagacaccgcgtatctttcaagggtggcaagacagtatctcactgcaatttgctctaaagatgacgtttatgtatctccaggacgactaacagctatgctccgggccaaatgggggctcaacagagtgttagatggagtaatggaagaacaaggacgacctgctgtgaaaaatagagacgaccacagacaccatgctatagatgcagtagtaataggtgcaacagatagagcaatgctccagcaagtcgcaaccctggctgctagagcacgtgaacaggatgcagaaagattgataggagatatgccgacgccttggccaaattttctagaagatgttagagcagcagtagcaagatgtgtggtaagtcataaaccagatcatggaccagaaggtggattacataatgatacggcatacggcatagtagctggtccatttgaagatggacgatacagagtcagacatagagtctccctgtttgacctaaaaccgggagacctttccaacgtgaggtgcgatgccccactccaagcagaattagagcccatatttgagcaagacgacgcccgagcaagagaagtagcattaacggccttagcggaacgttatagacaaagaaaagtatggctcgaagaacttatgtcagttctaccaatacgaccaaggggagaagacgggaagacattgcctgattccgctccatataaggcttacaaaggagattccaattattgttacgaactttttataaacgaaagaggcagatgggacggagaacttatttcgacgtttcgagcaaatcaagctgcatatcgtagattccgaaatgatcctgccagatttagaaggtacacagcgggagggcgacccttattaatgcgattatgtattaatgattatatcgcagtagggacagcagctgagaggacaatatttagagttgttaaaatgagtgaaaataaaataactcttgcagaacatttcgaaggaggtaccttgaagcaaagagatgccgataaagatgatccatttaaatatctaaccaaatcacccggcgccttaagggatctaggagctcgaaggatctttgtagatttaataggtcgtgtactcgaccctggtattaaaggagattga

SEQ ID NO: 8464 - RNA, 3189 nt, synthetic construct
  misc_feature 1..3189: note = Cas9 variant
  source 1..3189: mol_type = other RNA
atgaatttaaattacattcttggattagatctaggcatagcaagtgtaggatgggcagtggtcgaaatagacgaacaagaaaatccacaaagacttatagatgtgggtgtccgtacttttgacagagcagaagtcttaaagaccggagagagcttggcgctcgcaagacgtcttgcacgaagctcaagaagacttgtaaaaagacgagcagaaagaatcaagaaagcaaaacgattactaaaagcagaaaaccttctattgagtgcagatgaaatcttaccaaacgaagcatggcagctaagagtaaaaggactagatcaaaaattagaaaggcaagaatgggcagcagttctattacatctattaaagcatagaggatatttaagtcaaagaaagaatgagagcaaatcagaaaataaagaattgggagcattacttagcggtgtagcaataaatcaccaaatattacaatccgcagagtacagaaccccagccgagatagccgtaaacaaatttcaagccgaggaagggcatataagaaatcaaaggggagcatacactcatacattttcaagactagacctattagccgaaatggaacttctatttcaaaggcaggccacactcggaaacccccacacatcaacaaaattattggaaaatctaacagcacttttaatgtggcaaaaaccagcacttgcaggagaagcaatattaaaaatgctaggaaaatgtacatttgaaccaacagaatataaagctgccaaaaatagttatagtgccgagagatttgtgtggctaacaaaattaaacaatctccggatacttgaacaaggagccgaaagagcattaactgataacgaaaggtttgccctactagaccaaccatatgagaaagcaaaactcacatacgcgcaagtacgaaccttactaggactctctgacgaagcaattttcaaaggactgaggtatcaaggtgaagataagaaagcagtagaaacaaaaacaacgctaatggaagtaaaggcttaccatcaaataagaaaagcgcttgaaggactcgatttaaaagccgaatggaatgaactcaaaaataaccccgcattattagatgaaataggtactgcattttcactctataaaacagatgacgatatacatcgatatttagacggaaaattatctgaatcagtacttaatgcgttacttgaaaaccttaattttgataaattcatacaactatcactgaaagccctacaacaaatcctaccattgatgctacagggacagaggtatgacgaagctgtcagtgcaatatacggagatcattacggaaagaaatcggatgaaattgatcgattactaccaaacataccaacggacgaaataagaaatcccgttgtattacgaaccttaacacaggctagaaaagtaattaacgccgttgtacgtctttacggatcaccagctagaatacacatagaaacaggaagggaagtgggaaaaagctatcaagacagaaagaaattagaaaaacaacaagaagaaaacagaaaacaaagagaaaatgcagtgaagaaatttaaagaatacttccccaatttcgtaggggaacctaaaggcaaagatatactaaaaatgcgactatatgaattacaacaagccaaatgtctctactctggaaaaagtctagaattatatagactattagaaaaaggatacgtagaggtcgatcatgctctacccttctccagaacatgggatgattccttcaataacaaagtactcgttttagccaacgaaaaccaaaataaaggaaacgcaacaccatatgaatggctagacgggaaaaataattctgaaggatggcaacattttgtcgcgagagtccaaaccagcggattttcatacgctaagaaacaacgagtattaatacaagaactagatgagaaatcgttcatagagagaaatttaaatgatactagatatgttgcacgatttctttgtaaccatatagcagataacatgctacttacaggtaaagggaaaagaaaagtgtttgcaagtaacggccaaataacagcactactacgaggatgctgggggctccaaaaagtaagggaaaacaacgatcgacatcatgctctcgatgccgtagtagtcgcctgctcgacaaaaagcatgcaagacaaaataactaaatttgtaaaatataaagaagggagactatttaaagacaagaaagacggcgtatataaaggagaaagaataaatagggaaacaggcgaaattatatccctacacttccccacaccatggaaattcttcaaagaaaacgtggaaatacgtatatttagtgaaaatccgaaactagaattagaaaatcgattaccagattatcctcaatataaccacgaatttgtacaaccattatttgtatccagaatgccgacaaggaaaatgactggacaaggccacatggaaacagtgaaatcggcaaaaagattagacaaaggactgagtgtactaaaagttccactaacacaattaaaactatcagatctcgaaaggatggtaaatagagaaagagaaatggctctatacgaagcactcaaagaatgtttagaacaattcggaaacgaccccgcaaaagcattcgccgaaccattctacaagaaaggaggtgccctagtaaaagctgtcagagtagagcaaacacagaaaagcggagtgctagtaagaaatggaaacggagtagcggacaacgcaacaggtagtatagttagagtagacgtgttcacaaaaggaggtaaatactttttagtccccatatatacatggcaagttgcaaaagggattctacctaacaaagcagtaatacaaggaaaagatgaatcagagtgggaagagatggatgaaaatgctgtgtttcaatttagcatgcataaaaatgatttaataaaagtcaaaacaaagaaaggagagatttttggatactttaatggtttagaccgcgccacagggagtattgaaatcgaggaacacgatctagagaaatctaaaggtaaaaatggaagccacaggggactaggagtaaaaactgcattctttctagagaaatatcaagtagatgaactaggcaaaaacataagaccatgcagaccaacgaaacgacaacatgtacgttga

SEQ ID NO: 8465 - RNA, 3192 nt, synthetic construct
  misc_feature 1..3192: note = Cas9 variant
  source 1..3192: mol_type = other RNA
atggaaaatcacataaattatcgactaggacttgatattggaatagcctcagtaggatggagtgtgataaacctagacaagaaaagaatcgaagacctaggtgtaagaatctttaacgcggcagaacacccaaaagacggatcaagtctagcattacccagaaggatagcacgagggagaagaagattactaagaagaaaagcataccgagtaaaacgcgtccgaaaactaatagttgactataacattttaaccaaagaccaactcaacgatttatttaaacaaaaatgccaaaacagcgtatgggaaataagagttaaagcactagacaacaaagtcacaaacgaagagtgggctcgactcttaattaacctatgtaaaagaagaggattcaaaagcaataggaaaaacgaggcagacgataaagaaacaaagaaagtcattaatagcattaaatcaaatatcaaaggcatgaaagaaagtggaagccgaacaataggagaatatatatatacgcaaacattaagttcaggagatatttctaaaagttttagaaataaagacggacaatacaataattgtgtaagtcgcaaaatgatagaagaagaaataaaaatactatttaagaaacaaagagaattaggatgcgagttcgcaagtgaagaaatagaagaaaaatatttagcaatattcaacagtcaacgccccttcagcaaattcgaagaccttgagaaaatggtaggtttttgcacgtttgaaaaagcaagcaaagaaagacgagctccaaaatgctcaattagcgcagaagagttcgttctgtatgataacatgaacaaattaagcatacttaataaaggagacactaggaaattaacaaatgaagaacgaaaaattattgttgaaaacgcttttaaaaataaagaaataaaatatagcaaactacgtaaaattctaaacctgagtaacgacgaaagatttagcaccttatcgtatagtaacaaaacagaattatcaaaaacagaaaattcaaaatttgttgccctaaaagggtaccacgaaataaaaagcgcaatagaaaaatcattcggaaaagatacgtggaatagagtcaaaaacaaccggacaatgctaaacgacatagcatacgtcctatcaatagcaaaaacagatgaagacataataaagcaattaagcctaagaaacataccgagagaaatcatagacgcagtactaggcctttcattttcaaaattctcaaatctatcgatcaaagcaattgagaaaatactaccatatttaaaagacggacaacaatataacgaagcgtgcaaaagtgcaggatacgattttaaggccacatataacggagaaaaatcgtacaaactccccctcatagacattgacgaaattgtaaacccagtagtaaacagagcactttcacaaacaagaaaagttataaatgctgtaatagatcggtacggaagcccaataggaataaacatagaactggcaagagatttggccaaaaacttcaaagatagatcaaaaatcaaaaaggaacaagaagaaaacagagccaacaaagaaaagatcaaaaatgaattaaaaatgttaatgaataaagaaccgacatcgtctgaaatattaaaatatagattatggaaggaacaacgagaagaatgtgcatatagccaggaaagaatatacatagaagacttattcaaagtaggccaatacgaaatagatcatataataccattttcaagatctttcgatgatagtttaaacaacaaagtattagtcaaagcagccgaaaaccaaaggaaagctaacagaataccctatgaatacttcggatccgacgaagaccgatggtacaggttcgaagtctgggtagaacagtccagcttatcattcaaaaagaaaaacaacctgcttaagaaaagatttagtagagaagactctatcgaatttaaagacagaaacttagtagacacccaatatatatcaagatacataagtaacttcataaaatcaaggctaatcttcaaagaatcagactccaaacaaaaagtaataacaataaatggaagggcgacaagctatttaagagcaaaatggggactccttaaagtaagagaaaacggggacaaacaccatgccctagacgcaaccgtaattgcagttgccacacaaggcatggttcaggaaatttctaaatattcaaaagcgcacgaactaaaatacatcaggcaaggagacgagtttatagatatagaaactggagaaatagtaaaagtcaaagaccataaacacctatctaaagacaggttaccagaaccatggctaggcttcagctcggagctgaggctgagattaagcgaaaatcctatcgaagaattgaagaaatctcccatttccacttacgatgaagaatttataagaaaaacagtaagaccaattttcgtatcccgagttccataccgtaaagttacaggtcgactatttgaagaaacagtatattctccaaaagcattcattgatgaaggttttatagccaaaaagaaactacaagacttaacactcaaagatttcgaaaatatatacaactacaattcagataagaaattatatgatgcattgagagaaagattagaagaatacggtgggaatgcaaagaaagcattcgccgaagaatttagaaaaccaacaaaaacaggcaaattagggccaattgtaaaaagtataaaagtcaaaacaaaaatcccattcaaagacggaattgacctaaacggaggtaaagtcaagaaagacggtttagttagaatcgacatatacgaaaaagaaggaaaatactacgtcgtacctgtgtacaggttagacatacaacaaggaaatatacccaagaaagccgcagtagcaaataaagaagaaaaagactggatcctaatggatgagagttataacttcaaattctctttatacaaaaacgatcttatatatataaaatatgactctaaaggggaatattttggttactacgacggctttgaccgacatacgggcgcgataaccctagaaagacatgataattccgagagatacaggggaatcgggatcaaaacaggggtaaaagaaatattcaagtacaacgttgatgttttaggaaggtattacaaagtagcaaaatga

SEQ ID NO: 8466 - RNA, 3192 nt, synthetic construct
  misc_feature 1..3192: note = Cas9 variant
  source 1..3192: mol_type = other RNA
atggaaaaatttcattatgtcttagggctggacctaggaatcgccagtgtgggctgggctgctatagaaatagacaaagaaaccgaaacatccataggtttactagactgtggtgtaagaacgtttgaacgcgcagaagttccgaaaacaggagattctctagccaaagcaagacgagaagcaagatctaccagaagattaataaggaggagatcacaccgactcttaagattaaaaagattattaaaacgagaaatctttcgccaaccagaaacatttaaggatctaccaattaatgcttggcaactaagagtaaaaggattagattctagactcaacgagtatgaatgggcagcagtcttactgcacctagtaaaacacagaggatacctaagccaacgcaaatcagaaatgtctgaaactgactccaaatcagaaatgggtcgacttttagccggagtagctgaaaaccatcaactattacagcaagaacaatacagaacgcctgccgaattagctctcaaaaagtttgtaaaacactttcgaaacaaagggggagattacgctcatacatttaatcgtctagacttgcaagcagaactacacttattattccaaaaacaaagagaactaggtaatccattcacaagccccgaactagaaagacaagtagatgaccttctaatgacacagagatcggccttgcaaggtgacgcgatactcaaaatgttaggtcactgcggttttgaaccagaacaattcaaagcagctaaaaatacattcagcgcagaaagattcatatggctaacaaaactaaacaatcttagaatacaagatcaagggaaagaaagagcgttaaccgcagacgaacgaacaaaactactagatgaaccttataagaaatccaaactcacatacgctcaagtaagaaaactcttaagtcttcctcaaacagcaatattcaagggattaagatatgatctagaacatgataagaaagcagaaaacagtacacttatggaaatgaaatcatatcacaatattcgacagacgttagaaaaatcaggcttaaaaaccgaatggcagtcaatcgctacacaaccagaaatattggacgcaataggaacggcattctcaatatataaaacagatgaagatatttctcatgaactgaaaacatgtagattacctgaaaatgtactaaacgaattacttaaaaacataaactttgacggatttattcagctatcgttaacagcactaaggaaaatcttaccattaatggaacaaggatatcgatatgatgaagcatgcacacaaatatatggaaaccatcattcgggatcactacagcaagaaagtaaacaattcttgcctcatataccaattgatgatgtccggaaccccgtagtctttaggacactaacacaagcaagaaaagttgtaaacgcaattatacgaaggtatggatcaccggcaagagtacacatcgaaatggctcgagaattaggcaaaagcaagtcggaccgagatcgcatagaaaaacaacaacagaaaaacaagaaagaacgagaaaatgcagtagcaaaatttaaagaagactttccagattttgtaggtgagccccgaggaaaagacatactgaaaatgagactctatgaacaacaacacggcaaatgtctatatagtggacatgatatagatataaaccgcttaaatgaaaaaggatacgtagaaatagatcatgccctaccattttctaggacctgggatgactcacaaaacaataaggtattagtactaggatcagaaaatcaaaacaaaagaaatcaaactccggatgaatacttggacggagcaaacaattcccaacgatggctagaatttcaagcaagagtacaaacatgtcactttagctatggcaagaaacaaagaatccagcttgctaaacttgacgatgaaacggaaaaaggcttcctagaaagaaacctaaacgatactcgctacatagctcgcttcatgtgccaattcgtccaagaaaatttatatctaacaggaaagggcaaacgtttagtatttgcatcaaacggtggaatgacagccacattacgcaacctatggggactacgaaaagttagagaagataatgacagacatcatgctctcgatgctatagttgtagcatgctccactgcatcgatgcaacagaaaattaccaaagccttccaacgacatgaatccatcgaatatgtagatacagaaacaggagaagtcaaattccgtataccacaaccatgggacttctttagacaagaagtaatgatacgcgtattttcagatcaaccatgtgaagatttagtcgaaaaacttagtgcacgacctgaagctctacatgacaacgtcacacccctctttgtatcaagagcacccaatcgaaaaatgagtggacaaggccatctcgaaacaataaaatcagcaaaaaggttatcagaagaaaattccatggtcaagaaaccccttacaactttaaaactaaaagatatacctgaaatagtagggtacccatctagagaaccccaactatatgcagcattaaaaacaagactcgaaacgcatgacgatgatcccataaaagcattcgctaaaccattttataaacccaacaaaaatggggaactaggcgctctagtccgatcggttagagttaaaggtgtacaaaacactggcgtgatggtacatgacggaaaaggcattgcagataatgcaacaatggtgagagtcgatgtttacacaaaagccggtaaaaactaccttgtaccagtatatgtatggcaagtagcacaaggaatcttacccaaccgagcagtaacaagtggaaaatcagaagcagattgggacttaatagatgaaagttttgaatttaaattttcactaagtagaggagacttggtcgaaatgatatcaaacaaaggacgaatatttggatattacaatggattagatagagcaaacggaagtattggcattcgcgaacatgacctagagaaaagcaaaggaaaagacggagtccatcgtgtcggagtaaaaaccgctacagcatttaataagtaccatgtcgatccacttggaaaggaaattcacagatgcagtagtgaaccaagaccaacattaaaaattaaaagtaagaaatga

SEQ ID NO: 8467 - RNA, 3192 nt, synthetic construct
  misc_feature 1..3192: note = Cas9 variant
  source 1..3192: mol_type = other RNA
atggaaaaggactatatcttaggattagatatcggaataggctcagtaggatacggactaattgactatgacacaaaatcaataatagatgcaggagtaagattattcccagaagcgaatgcagacaacaatttaggaagaagagccaagaggggtgcgaggagattaaaacgacgtagaatacaccgactagaacgtgttaagtcactcttatcagaatataaaatcattagcggcttagctccaacaaataaccaaccatacaacatacgagtcaaaggcttaacagaacaactaaccaaagacgaactggcagtggcactattacacatcgctaaaaggaggggaatacacaatgtcgacgttgcagcagacaaagaagaaactgcatcagactcactttctacaaaagaccaaatcaacaaaaacgccaaattcctagaatcccgatatgtatgcgaacttcagaaagagagactagaaaacgaaggacatgtacgtggtgtcgaaaaccgcttcctcaccaaggatatagttcgcgaggcaaaaaaaataatcgatacacaaatgcaatattatccagaaatagatgaaacattcaaagaaaaatacatatcattagttgaaacaagacgagaatactacgaaggaccaggtaaaggatcaccatacggatgggacgcagacgtcaaaaaatggtatcaattaatgatgggacactgcacttacttcccagtagaatttcgaagtgtgaaatacgcatatacagcagatctatacaatgctctaaacgatttaaacaaccttacaatagccagagacgacaatccaaaactagaatatcacgaaaaataccacataattgaaaacgtcttcaaacaaaaaagaaacccaaccctgaaacaaatagcaaaagaaatcggcgtaaatgacattaacatatcaggatacagagttactaagtcaggaaagccacaatttaccagttttaaactctttcacgatctcaaaaaagtagtcaaagatcatgcaatattagacgatatcgacctattaaatcaaatcgcagagatattaacaatataccaagacaaagacagtatcgtagcagaacttggtcaactagaatatctaatgagcgaagcagacaaacaatcaattagcgaactcactggttacacaggtacccatagcctgagcttaaagtgtatgaacatgataatagatgaattatggcacagcagtatgaatcaaatggaagtgttcacatacttaaacatgcgacctaaaaaatacgaactcaaaggctaccagagaatcccaacagacatgattgatgacgcaatcttgagtcccgtagtaaaaagaagttttaaacaagcaataggagtagtaaacgcaattataaaaaaatatggcttacccaaagacataatcatcgaactagcaagagaaagtaactctgcagaaaaatcaagatacttaagagcaattcaaaaaaaaaatgaaaaaacacgagaaagaatagaagcaatcataaaagaatacgggaatgagaacgccaaagggctagtacaaaaaataaaactacacgacgcgcaagaaggaaaatgcctatacagtttaaaagatatacccctcgaagacttgcttaggaacccaaataactacgacatagaccacattatcccacgaagcgtttcatttgatgacagcatgcacaataaagtccttgtacgcagagaacaaaacgccaaaaaaaacaaccaaacgccataccagtacttgacatcaggctatgcagacataaagtatagcgtcttcaaacaacatgtactaaatttggcagaaaacaaagacagaatgacaaaaaaaaagcgagaataccttttagaagaaagaaacatcaacaaatacgatgtccaaaaagaattcataaacagaaacttagttgatactagatacacaacccgagaactaaccacattactcaaaacatatttcactataaacaacttagacgtaaaagtcaaaacgataaacggatcattcacagatttcctaagaaaaagatggggattcaagaaaaacagagatgaagggtataaacatcatgccgaagacgcattaattatcgcaaatgcagactacttattcaaagaacacaaactactcaaagaaataaaggacgtaagcgacctagcaggagatgaaagaaactcaaacgtaaaagatgaagaccaatatgaagaagtatttggtggatacttcaaaatagaagacatcaaaaaatataaaatcaaaaaatttagccacagagtagacaaaaagccaaataggcaattaatcaacgacactatatactcaaccagagttaaagatgacaaacgctacttaataaataccctaaaaaacttgtatgataaatcaaacggagacttaaaagaaagaatgcaaaaagaccccgaatcattacttatgtatcaccacgatccacaaactttcgaaaaactaaagatagtaatgtcgcagtatgaaaacgagaaaaacccactcgccaaatactttgaggaaaccggacaatatctcacaaaatacgcaaaacacgataacggacccgcgattcataaaataaaatactacggaaacaaactagtcgaacatctagacataacaaaaaactatcacaatccacaaaacaaagtagtacaactaagtcagaaatcattcagattcgatgtatatcaaactgataaaggatacaaattcatcagcatagcatacttaactttaaaaaatgaaaaaaattactatgcaatctcacaggaaaaatatgatcaattaaaatcagaaaagaagatatccaacaacgcagtcttcataggatctttctataccagcgatataatagaaataaataacgaaaaatttcgagtcataggggttaactcagataaaaacaacctaatagaagtagatcgaatcgacatcagacaaaaagaattcatagaactagaagaagaaaaacaagtgaattacatgaactcagactcatatttaaaaaataatagaataaaagtgactatagggagaaaaacaacaaatattgaaaaatttcatacagacatattagggaacatgtacaaatcaaaaagacccaaagcaccacaattagtattcaaaaaaggctga

SEQ ID NO: 8468 - RNA, 3195 nt, synthetic construct
  misc_feature 1..3195: note = Cas9 variant
  source 1..3195: mol_type = other RNA
atgtctgaatgtgttacaaggaggattttaggaatagatctaggcatagcaagctgcggttggggcgttattgaagtaggagaagcaagtggcagtatcatagctagcggcgtaagatgtttcgatgcacctttaatcgataaaacgggagaaccaaaatcagcgactagaagaacagccagaggtcaaagaagaataattagaaggagacgacaaagaatgaacgcagtaagacgtttactagcagagttcggcgtattaacaggaagatcaccagatgcattacatcaagcattattgcgcctttcgcaaagtgtagcaggaagtcaagttacgccttggacattaagagcagcagctcatgaacgaaaactaacaaatgacgaattggcagtagtactaggacatatagcaagacataggggatttagaagcaatagcaaaaatgatggaggagcaaatgccgcagatgaaacaagtaaaatgaagaaagcaatggaaactacaagagagggattagccagatatcacagcttcggagcaatgatcgcatccgaccctaaattcgcggatagaaaacgtaatagagataaagactatagtcacacagctaaaaggtccgacttagaagatgaagtaagaacaatatttagatcacaaactaggttcggtagcctcgtagctagtgaaaaactatcacaagccttcgcagatgctgctttctttcaaagacctctacaggacagtgaagatatggtaggaagttgtccctttgaacctggtcagaaaagaacagctcggagagcaccatcttttgaattatttagatttctatcaagacttgcaaatctaaaattaaccgtaggtagagcaccagaaagaagattaacacccgatgaaatcgctcttgcagcgaaaggatttggagaaacaaagaaaagtatcacttttaaatcattaagggaggctttagatctcgatcccaacgctcgattctcaggagtagcaaaagaaaaagaaagtacactagatgtagcagcaagaacaggaggagctgcatatggaacaaaaacactgaaagatgcattaggtgacgcaccttggagatcattatcgaggatgcccgaaaaactcgatagaatcgctgaaatattgagctttagagaggatatgaaagcaataagaaatggattagaagaagtaggtcttgatgggctagtagtagacgctttaatgcaagctacagcaaacggagatttcaaagattttacaagggcagcgcatatttcggcattggccgcgagaaatattattcccggactaagagaaggtctggtatattcagatgcttgtactcgagtcggatatgatcatgccgcaagacccgcagttccactaagccaaataggaagtccagtaacgagaaaagcactatctgaagcactaaaacaagtgcgcgcagtagccagagaatatggaccaatagattattttcatatcgaactagccagatctattggaaaatccgcagaggaacggaagaaactcacagacgggatagaagcaagaaatgtggaaaaagagaaacggaggaaagaagcggcagaacacctaggtagagcacccagtgacgatgaattactacgctatgaactagcaaaagagcaaaactttaaatgcatatatagtggagacccgatagatccagcgggaattagtgccaatgatacacgatatcaggtagatcacatattaccttggtcaagatttggagatgattcttacgtcaataaaactttgtgtaccgcaagaagtaatcaaaacaaaagaggaagaacgccattcgaatggttcgatgcagacaaaacagaggcagaatggatggaatattcagctagagtagaagatctaaaagaagtaaaaggcagaaagaaaagaaactattcaatcaaagatgcagcgagcgtggaagacaaattcaaagcaagaaatttgaccgatacacaatgggcaactaggctattagcagatgaattgaaacggatgtttccaccccgagaatgtgaaagagttgtaacagtacgagctgatggaggaaatgacggcctaagcattgtagaggaaaggagagtatttactaggccaggagcaatcacgagtaaattaaggcgagcctggggactcgaaggacttaagaaacaagatggaaaacgtgtagaagacgataggcatcatgctgtagacgcattagttttagcggctacaacagagtcgctactgaataggctaactgtggaagtacaacaacgagaacgagagggcagacaagatgatatatttcattgcagtcaaccatggccaggttttagagtcgatgttcaaagaacagtttatggaagtgaaacgatgccaggcatattcgtatccagagccgaaagacgacgagcacgtggaaaagcccatgatgccactgttaaacaaatacgggatatagacggcgaaagaatagtctttgagagaaaacctatagaaaaattaacagataaagatttagaacgaatccccgtacctgaaccatacggaaaagccgctgatccgaagaaactaagagatgaattagtagaaaacttacgcgcatggattgcggcagggaaaccaaaagataaaccacctagatcacccaaaggggatattataagaaaagtaaggatagaaacgaaggataaagtcgctgtagagataaacggaggaactgttgatagaggtgatatggcgagagtagacgtattccgaaagaaaaataagaaaggagtttgggaattttacgtaataccaatatatccacatcaaatagtagcctccgctttaccgcctaaccgggcggttatagcatataaagcagaatcagaatggacggccatcgatggatgcttcgaatttgcatggagtttaaacccaatgtcatacttagaactcgtaaaaagtaatggcgaactaatagaagggtattttagaagtatggataggacaacaggagccattaatttatcacccatgtctacaaattcagaaacaatcaggagtataggagttaaaactttaagtagcttcagaaaatttactgttgataggctgggtcgtaaatttgagataccacgagaagtaagaacatggagaggtgaagcatgcacatga

SEQ ID NO: 8469 - RNA, 3195 nt, synthetic construct
  misc_feature 1..3195: note = Cas9 variant
  source 1..3195: mol_type = other RNA
atgaaacgcacaagccttagagcatatagattaggagtagatttaggcgccaatagtttgggttggtttgtcgtttggttggatgaccacgggcaacccgaaggattaggaccaggaggagtaagaatatttccagacggcagaaatccgcaaagtaaacaaagtaatgcagcgggacgcagattagcgagaagcgcaagaagaagaagagatagatacttacaaagaagagggaaattaatgggtctattggtaaaacacggactaatgccggcggacgaacctgcacgaaaacgattagaatgccttgatccatacggattacgagcaaaggcattagatgaagtgttaccgcttcaccatgtaggtagagctctgttccatctaaaccaaagacgcggactttttgcaaatagagcgattgaacaaggagataaggatgcgtcagcaattaaagctgcggcaggacgattacagaccagcatgcaagcgtgtggagcaagaactttaggagagtttttaaacaggagacatcaattgagagcgacagtaagagcaaggtcaccagtaggtggcgatgtccaagccagatatgaattttatccaacgcgcgctatggtggatgctgagttcgaagcaatatgggcagcacaagcaccacaccatccaacaatgacagcagaagcacatgacactatcagagaagccattttcagtcagagagcaatgaaaaggccaagtataggtaaatgctcattagaccctgcaacaagtcaagacgatgtagacggtttcagatgcgcttggagccacccgttagcacaaagattcagaatttggcaggatgtaagaaacctagccgtcgtggaaaccggaccaacctcaagtcgactaggaaaagaagatcaagataaagttgccagagcgttactccagacagatcagcttagctttgatgaaatcagaggattattagggctgccatcagatgctagatttaatttagaaagcgatagaagggaccacctcaaaggagatgcaacaggggcaatcttatcagcaagaagacactttggcccggcctggcatgatagatcattggatagacaaattgatattgtagcattattggaatccgcactagatgaagcagcaataattgcatctctaggaactactcacagtttagatgaagcagcagcacaaagggcattaagtgcactactacctgatggatactgccgattgggcttaagggcaattaaaagagtattaccacttatggaggcaggaagaacttatgcagaagcagcatcagctgctggttatgatcatgctctcctacctggaggcaagttgtccccgacaggatatttaccctattatggacaatggctacaaaatgacgtagtaggaagtgatgatgaaagagataccaatgaaagaagatggggaagactccctaatcctactgtacatatcggaattggacaattaaggagagttgtcaatgaattgataagatggcatgggccaccagcagaaatcacagtagaactaacaagggatcttaaactaagtccgagaagattagcggaactagaaagggaacaagctgagaaccaaagaaagaacgacaaacgaacgagtttattaagaaaattaggattgcccgcctcaactcataacttacttaaacttcgcctttgggatgaacagggcgacgtagctagtgaatgtccttatacaggtgaagcaataggactggaaagattggtctcagatgacgtagatatagatcacctaattccattttcaataagttgggatgattctgcagctaataaagtagtatgtatgcgatatgcgaacagagagaaaggaaacagaacaccttttgaagcctttggacatagacaagggcgaccctatgattgggcagatatcgctgaaagagcagcgagattaccaagaggtaaaagatggcgattcggacctggtgcgagagcacaattcgaagaattgggagatttccaagctcgactactcaatgaaacttcatggctagcaagagtagcaaaacaatatctagcagcagtaacacatcctcataggatccacgtactacctggaaggttaacagcactcctaagggcgacatgggaattaaacgaccttctacctggatctgatgatagagcagcaaaatcaagaaaagatcacagacaccatgcaattgatgctctagttgctgcattaactgaccaggcattattaagaagaatggcgaacgctcatgatgacacaaggcgtaaaatagaggttcttcttccatggccaacatttaggatagatctagaaactagattaaaagcaatgctcgtaagtcataaaccagatcacggtcttcaagcacgtcttcatgaagacactgcatacggaactgtagaacatccagagactgaagacggagcaaacctcgtttataggaagacttttgtagacatttcagaaaaagagatagatagaattagagaccgtaggttacgagatctagtgcgagctcacgtagccggtgaaagacaacaaggcaaaacgttgaaggctgcagtcttatcatttgctcagagacgagatattgctgggcatccaaacggaatccgccatgtccgcttaaccaaaagcattaaaccagattatctggtgccaataagggataaagcaggtcgaatatataaatcttataatgcaggagaaaatgcattcgtagacatactccaggcagaatcaggcagatggatagctagggcaacaacagtatttcaagcaaatcaagcaaatgagagtcatgatgcaccagcagcacagcctataatgcgagtatttaagggtgacatgttaaggatcgatcatgcaggcgcagaaaaatttgtcaaaattgtaaggctttcaccatcgaataatttactatatctagtagaacatcatcaagcaggagtattccaaactagacacgatgatccagaagattcattcaggtggctatttgcttcttttgataagttacgagaatggaacgcagagctagttcgtattgacacgctcggacagccatggagaagaaaaagaggactagaaacagggagtgaagacgctacacgaatagggtggacgagaccgaagaagtggccatga

SEQ ID NO: 8470 - RNA, 3198 nt, synthetic construct
  misc_feature 1..3198: note = Cas9 variant
  source 1..3198: mol_type = other RNA
atgaataaagatataaattacgcactcggtctagatattggaataaccagtgttggatgggcagtgataaatctagacctaaacagaattgaagatctaggagtacgcatatttaacgccgcggaaaacctaaaagacggatcaagtttagcgttgccaagaaggctggcaagaggaagacgaagattattaagaagaaaagcatatcgagtagaaagagtaagaaaactaatacttaaaaacaatatactaacaaaagaagaactagagggcctgttcaaaaacaaagaagtaatcgatgtctgggaagcaagagttaaaggcttagattacaaactatcaagagaagagtgggcaaaaatactgatcaacttttgcaaaagaaggggattcaaaagcaataggaagaacgaagcaaaggataaagaagcagggcaaatattaagcagcatatcatacaacatagagaaaatgaaggaaacaaattccagaacgataggtgaatatatatacaatgaagttaaaaacagtgaagactcatatgcgccactaagaaataaatttggcgaatataaaatgtgcgtatcaagggatgttatccgagaagaaatacatacactttttgaaaaacaacgggaattaggaaataattttgcatcggatgaaattgaagataaatattttgaaatatttaattcacaacgcccattttcgaattttgaagatctggaaaaattagtcggattctgtacattcgaacgtaaaaagcacaaaagagcaccaaaacattgtataagcagcgaagagttcacgttatatgaaggaattaacaagttaagtataatcaaggatggcgagaaaagaaaattaagcgaagaagaaagaacgctagtagtaaacgaagcatttaacaagaaagaaataaaatatacaacactaagaaaattactaggattatccgaagaagaattattttctacgctaacatatagtatcgacaaagatatatctaaaaccgaaaatacaaaattcgtatcccttaaaggataccatgaaataaaaagagcaatagaaaaaggagttagtaagaaagcatggcaggacatcgagaataatagaaatctattaaacgacatagcatacgtattaacactaggaaaaaccgacgatgaaattgagaaacaactaagactgaggaacgtcccagaagaactatttgagagcttactagatatgtcattcaacaaatttaataatctatcaatttatgccctggagaaaatactccctttcatgaaagaagggtaccaatataacgaagcctgcgaaaaagcagggtataacttcaaagctatatacgaaggagttagaactaagaaactacctgtaatagaaatagatgaaatagtaaacccagtggtaaacagagcattagcacaaacgagaaaagtaataaattctgttatagacaaatacggaagccccgtaaggattaatatagaactagccagggatctggctaaaaattttaaagataggaaactaatcgaaaaagaacaaaaagaaaacagggcaaatctagataaaatacgagaaaacctaagagaattaatggataaagaaccaaccgtagtagaagtgctcaaatatagactatgggaacaacaaagaggtgaatgtgcctatacacaaagccaaataccactagaaagacttttcagtccagggtactgtgaaatagatcatattattccattttcgcggagttttgacgattccctaagtaacaaaattctagtactcggcagtgaaaatcaaagaaaaggaaatagaacaccctacgaatattttggtgaagatagcgaaaggtggaactcatttgaaatatgggtcaaaggttcatacctaaattacaaaaagaaagccaacttattaaagaagaaattcagcgaagaagaacagagagactggaaagcacggaatttacaagacaccaaatatatatgcagatatataagtaatttcgtcaataacagactggagtttaaagaaagtgaaaataaacaaaaagtaataacagtcaatggcagagcgacagcctacctaagaagccgttggggattaaacaaagtaagagaggacggagataaacatcatgccttagatgcagcagtcgtcggagttacaacacaaggaatggtacagaaaataagtaaatattcaaaagcacacgagctatacacagtacgaaagaacgacgagttcgtagatgtagaaaccggagaatgcgtggatgtcgacgaatacaaagaaatacgaaaagacatcctccccagaccttggcgaggattcagcgaagaactaaagttgcgactaagcgataatccattagaagaactaaagaaaagtcctatagaaacatacaatgaagagttcataaaagaaaacgtaaaacccatattcgtatcacgcgtaccattcaggaaaataagtggtaaattatttaaggaaacaatatacagcgaaagggcattcaaagacggatattttgtcagtaaaaagagcttagtcgatcttaaacgaggagatttagataatttctataattatgaatgtgacaagaaattatatgatgcaatatcagaaagaatgaaagagttcaattacaatggaaagaaagcctttgaaagcccatttagaaaaccaactaaatcagggaaagaaggaccggtagtacgaagcgtaaaaatcaaaagcgcagtcccattcaaagacgggataccgatgaacgaaggtctagtagccaaagaaggaatggtaagaatagacatatacgaaaaagaaggaaaatacttcgtcgttccagtgtacagatatcaactagcaaaaggaatagtaccgaaacgtgccgctatagctaagaaagatgaactcaaatggcccataatggatcaaacatacaatttcaaatttagcatttacaaaaacgatctaatcgaagtaaaatatgataagaaaggcgtatatttcggatactacgacggttttgaccgcaattcggctagtcttacaatagaaaaacatgataactccgaacgatatcgttcaatagggctaaaagtaggagtattagaaatcaataaatatgaagtagatgttctaggcaattaccataaagtaaaattagggggtaattga

SEQ ID NO: 8471 - RNA, 3198 nt, synthetic construct
  misc_feature 1..3198: note = Cas9 variant
  source 1..3198: mol_type = other RNA
atgaataaagacataaactatgcgttaggattagacataggaatcacaagcgtaggatgggcagtaattaacctcgacctaaaccgaatcgaagatctaggcgttagaatcttcaacgctgccgagaacccaaaagatggtagctcattagcactaccaagaagactcgcacgaggcagacgccgtctattacgccgaaaagcatacagagtagaacgtgtaagaaaattaatagttaaaaataacattttaacaaaagaggaactcgaaggtctatttaaaaacaaagaagtaatagatgtatgggaagctagagttaaaggtctagactacaaattgtctcgcgaagaatgggctaaaatccttattaacttctgcaaaagacgaggctttaaaagtaacagaaagaatgaaacaaaagacaaagaagcaggacaaatattatcttcaattagttataatatagagaaaatgaaagaaactaactctagaaccataggagaatacatttataatgaagtcaaaaatagcgacgactcatatgcacccttacgaaataaattcggagaatataaaatgtgcgtttcaagagatgttttacgagaagaaatacacacactattcgaaaagcaacgtgaactaggtaacaactttgcatccgacgagatagaggataaatatttcgagatattcaactctcaacgcccattctcaaactttgaagatctagagaaactcgtcggattttgtaccttcgaaagaaagaaacacaaacgagctcctaaacattgtatatcttcagaggaatttacactctacgaaggaatcaataaactctcaatcataaaagatggagagaaaagaaaactaagtgaagaagaaagaacattagttgtaaatgaagccttcaacaagaaagaaatcaaatacacaacactgagaaaattattaggccttagcgaagatgaactattttcaacactgacctacagcatagacaaagacatcagcaaaactgaaaatacaaaattcgtcagcttaaaaggatatcacgaaataaaaagggcaatagaaaaaggtgtctcaaagaaagcatggcaagatatagaaaacaatagaaacttgctcaacgatatagcttatgtactaacacttgggaaaacagatgatgaaatcgaaaaacaattaagattgcgaaatgtaccggaagaattattcgaatcattactcgatatgtcattcagcaaattcaataacctaagcatttatgctttagagaaaatactaccatttatgaaagaaggatatcaatataacgaggcttgtgaaaaagcaggatataattttaaagccatatacgaaggtgtaagaacaaagaaattaccggtaattgaaatagacgaaatagtcaatccagtagtcaatcgagcattggcacaaactagaaaagtaataaatagcgtcattgacaaatatggatccccggttcgcataaacatagaattagcaagagatcttgccaaaaactttaaagatcgaaaactgatcgaaaaagaacaaaaagaaaaccgagcaaatttagataaaatcagggaaaacctaagagaactcatggacaaagaaccaacagcagttgaagtcctaaaataccgcttatgggaacaacaaagaggggaatgcgcatacacacagagccaaatagctttagaaaggttattctcacccggatactgtgaaatagaccatatcatacccttttcgagatctttcgatgacagcttaagcaataaaattttagtacttggcagcgaaaatcaacgaaaagggaacaaaataccatatgaatattttggagaagattcagaaagatggaactcattcgaaatctgggtaaaaggcagctacttaaattacaaaaagaaagcaaatctactcaaaaagaaattcaccgaagaagaacaaagagactggaaagcaagaaacttacaagacacaaaatatatttgcaggtacatatccaacttcgtgaataatagattagaatttaaagaaagtgaaaacaaacaaaaagtcatcaccgtaaacggacgagcaacagcatatttaaggtccagatggggattaaataaagttagagaggatggagataaacatcatgcactagatgcagcagttgtaggggtcacaacccaaggaatggtacagaaaatatcaaaatatagtaaagctcacgaactatacacagtaaggaaaaacgacgagttcgtagacgtagaaacaggagaatgtgtagacgtagacgaatataaagaaattagaaaagatatactaccaagaccatggagaggttttagcgaagaacttaaactacgactgtccgataatcctcttgaagaattaaagaaactaccaatagaaacgtacaacgaggaatttataaaagagaacgtaaaacccatatttgtttctagagtcccgtttagaaaaattagcggcaaattattcaaagaaacaatatatagtgaacgagcattcaaagatggatactttgtatcaaagaaaagcctcgtagatcttaaaagaggggacctagataacttctacaactatgaatgtgataagaaattatacgatgcaataagcgaaagaatgaaagaatttaattacaatggcaagaaagcattcgaatcaccattcagaaaacccacaaaaagtggcaaagaaggaccagtagtaagatcagtgaaaataaaaagtgccgccccattcaaagacgggataccgatgaacgaaggattagttgcaaaagaaggtatggtcagaatagacatatatgaaaaagaaggaaaatactttgtagtaccagtatacaggtaccaattagcaaaaggaatagtaccaaaaagggctgcaatagcaggtaaaagcgaactaaaatggccaattatggatcaaacatacaattttaaattttcaatattcaaaaatgatctaatagaaataaaatacgcaaagaaagatggctattttggatactatgatggtttcgatcggcacacagcaagtctcgtcattgaaaaccatgataacagtgatcgatatagaggaataggggtaaaaacaggtgttgtagagttcaacaaatacgaagtagatgtcctcggcaactatcataaagtcaaccttgggggcaactga

SEQ ID NO: 8472 - RNA, 3201 nt, synthetic construct
  misc_feature 1..3201: note = Cas9 variant
  source 1..3201: mol_type = other RNA
atgagtgaaagagtagtcagaagaatactaggcatagatctaggaattgccagctgcggatggggagttgttgatattagcggtgccggcggaggaattattgcaactggagtaagatgcttcgacgctccattaattgataaaacaggagaacccaaaagcgcaactcgacgaactgcaaggggacaacgaaggatagtaagaagacgaagacaaaggatgaatggagtgagacgactactatgtgagttcggacttttaccagatccaagacccgacgcacttaaccaggcaatgaggagaattagtacagcatccgcagcagctcaggttacgccttggactctaagagcagcagcgcatcaaaggttattatcaaacgaagaacttgcagttgtattaggacacattgcaagacatagaggctttcgatctaatgctaaaaacgaagcaggcgcaaatgcagcagacgaaacaagtaaaatgaaaaaggcaatggaagccacaagagaaggactagcaaaatatcacgcctttggagatatgatagctaacgatcctaaatttgcaaatagaaagcgaaatcgggataaagattatagtcacacagctaaaagatcagacctagaagatgaagtaagggcaatactaagagctcaattacgattcggatcagcagcggcaacagaaacattagcacaaacattcgcggacgtagcattcttccaacggccactccaagattctgaagacagagttggagactgcccatttgaacctgggcagaaaagagcagcacgccgagcccctagcttcgaactctttagattcttatcacgtcttgcaaatctaaagctagcagtgggaagaagtccagaaaggagactaaccgctgaagaaatcgcactcgctgcaaaaggatttggagagactaaaaagacgattacctttaaaagtctaagagaggcccttgacttagacccaaacgccagatttagtggtattggtaaagataaagaggcttccttagatgtagtggcgagaacgggaggagctgcatacggtacaaagacactaaaggatgctttaggagacgctccatggcgaagtttaagcagaactccagagacactagatagaatagctgaaatattgagcttcagagaagatatcacatcgattagaaatggattagaagacttaggactggattcgttagtcgttgaagcactcatgcaagcggcggcgaacggggattttaaagagttcacaagagctggtcatatatcagcacgagctgcaagaaacataatacccgggttaagagaaggattagtctacagtgaagcatgtgcacgagtaggatatgaccatgctgcacgattaagtgtaccacttgaccaagttggatcgccagtcacaagaaaagcactaagtgaagctctaaagcaagtaagagccgtggcaagagaatacggaccaattgactactttcacatagaactagcaaggtcagttggtaaaagcgcagaagaacgaaaacaattgactgacggaatagaagcgagaaatgtcgaaaaggcaaaaaggagaaaacaagcagaagaacatctgggacgagcgccaagcgacgacgagttattgagatatgaattagcgaaagaacaaaattttaaatgtatatacagcggagatgcaatagaccctgctggcgtagcagcaaatgatacacgataccaagtggatcatatattaccctggagcagatttggagatgacagttatttaaacaaaacattatgtacggcgagaagcaatcaaaacaagcgaggaagaaccccgtttgagtggtttgaggctgataaaacggatgttgagtggatggagtacgtcgcacgagttgaaaatctgcaggaagtaaaaggaagaaagaaaagaaattattcaataaaagacgccgcagctattgaagacaagttcaaagctagaaacttaacagatacccaatgggctactaggctattagcagatgaactaagcaggatgtttccgcctagagaatgtgaaagagctatatgtggtagagcagatggaggaaatgacggattaacaattgtagaggaaagaagagtatttacacgaccaggcgcaataacgagtaaactgagacgagcatgggggctggagggactaaagaaacaagatggaaagagagttgaagatgataggcatcatgcagtagatgcgctagtattagcagcaactacagaatcattgttacaaaggttgacagtagaagttcagagaagagagagagaaggcagaccagacgacatatttcactgtgctgaaccatggagaggatttcgagccgatgtcagacgcactgtatacggatccgaaacaatgccaggcatatttgtatcacgcgcagaaagacgtagggcacgaggaaaagctcatgatgccacaataaaacagatcagagaaatagaaggggaacgacttgttttcgaaagaaaaccagtagaaaagttaactgacaaagatctagagaaaataccaataccaaagccatatggacaagtctcagacccaaagaggctcagagacgaattagttgaatcattgcgagcctggattgcagcgggaaaaccaaaagataggcctcctctaagtccgaaaggagatgtgataaggaaagtaagaatacaaacaaatgacaaggtaagtgtcgaaattaatggaggaacagtagacagaggtgatatggcacgggttgatgtatttagaaagaaaaacaagaaagcagtatgggaatattatgtagtaccgatttacccgcatcagatagtagctttgaacgatccgcctgatagggcagtaatagcatatgcagaagacaaagattggaaagaaatagatagcagttatgaatttttatggagtctgtttggattaagttacgtggaaattagcaaagcaaacggtgaatgtattgatggatacttcagaggattacatagaggaaccggagcggcatcagtatgtaaacatatatctctcgggaaagacgcgaccgtaagcgggataggattgaaaaccttggccagtttcaagaaattcacaatagataggttagggagaaaatttgaaatacctcgggaagttagaacgtggagaggagaagcatgtacatga

SEQ ID NO: 8473 - RNA, 3201 nt, synthetic construct
  misc_feature 1..3201: note = Cas9 variant
  source 1..3201: mol_type = other RNA
atgtcacatctagtactaggactcgatctaggtccaaattcaataggttgggctttagtaaatgacgatcctgaacatccagtggaatcaaagctagtagatctaggtgtgcgagtgttcccggaaggggtggataatttcgacacatcgaaagaattatcaagaaatgaagatagaagagtggcaagaggaatgcgaagacaaataagaagacgtgctcgcagacgacaacaattaaaacaggcactaattgattcaaaattatggccatctgatccaaatgatgaagtagtattgtataacactaacccctacgaactaagagctcgcgcattaaaagaacgattagagccacacgaagttggaagagtcttattgcacttgaaccaaagaagagggttcttaagtaatagaaagaaagatagaggagacaaagaagttcaaggaatgttagcagaaataaacgaaaatgaacaacagtgtaaagacggtgggtttgacacgatcggcgcatggctggccgacaaacaagcaaatatagatcatgctaacagggaagaaaatgatcatgtacgaaatagacacttagcaagaagccaatatgtagatgaatttgaggcaatctggtcagtacaagcgaaacatcacccgaaactactaacagaagaactaaaagtaggaaaactaggaaaacagacatacccggtcaagccgataccgaggtggcacgaacatagacaaggattgagtccactagaatcgttcggaatatacggattgatatttttccaaagaccaatgtactggccaaaatcagttgtcggactttgtgaattagagccaaaggaaaggcgatgtcaaaggtcagacagaagacagcaaagatttcgactactacaagaagtaaacaacttaaaatacgtagatccagacactcatttagaacaaaaacttgatgacaagcaaagacgattattattagacaaattaagtcatacaaaagaaatgacttttgaccaaatacgaaaagcattagactttttagaaagcgtaaaatttaatttagagcgaggagaaaggtcaagattaaaaggagtgccaatagacgccctattcgcagcaaaagacgtactaggacaagaatggtatgatagaccagaacaacagaaaacagaaatagttgcagtattactagacaatgaaagagacgatgacagaataattgctagagcagtagcagaatggggaatgaccgcaaaagaagcagaggcaatgttgggtgtagatctcccagcaggctatgcaaatctaagttgtaaagcaatagagaaactattaccacatatggaaagaggactactatacatggatgacgatgagagcaacagtgcaatgcatgcagcaggttacttaagacgggatcaactaagaagaagaatatttgacgtactaccagacccagctagaacgccaaattgtccaattggtgacattccaaatccagtagtaaaaagaacgctcaccgaaataagaaaggttgtaaatgcaatcgtaagagaatatggcaagcccgacgcaatacatttggaactagcaagaagtgtccaaatgggcaaggagaaaagatcagaatactcgaagatgataagagatagagaagcagaacgagatggaattgtagaaaaacttagagaaagcggtgtaagagttacccgcgataatatactaaagtaccaactttgggaacaacaaaaccaagaatgcatatattcaggaaaacctatatcatttgaaaaattatttggagaaggaggaggtgtggaggtggaccacattttaccaagatcaagaagtcttgacgactcgcaagccaacaagatcgtttgtttaaggactgctaacgcgggtaaaggcgaccaaacaccctatgaatggttagcagatacacaacccaaacaatatgaacaagtatgccaaagagcaggtatgcttatgagatctggaaggatgccatatgcgaaataccggcgattcatacaaagagagctagaactagacaagtttattgcaagacaattggcagatacaggatatattaccaaagcaacgatggagtacctaagatatctattcgacaaagaccacgacgtattaggactaaaaggccaactaactgcagaactcaggtatcattggggattagaaaccatattagaagagttacccgattccccggcatggcatgaagcagacagtggaaaattaagacctggagagaaaaatagggccgatcatagacatcatgctatagacgccgtagttatagcacttacaaatcgaaggaggttggttcaactttcagacatagtaaaacgcggtggtgcaagagcccatggagaaatattagaagacccatggcctaatttcagggaaaacgttgtccaggcaataaagaaaacaaatgtgtcacatagggtagaaagaaaagtagcaggcaaactacatgaagaaactttgtatggtccaacaagaacaccaggagaatgggttctaagaaaacctgtaatagcactctcagccaatgaagtcgaacgaatacgggacgctacaataagacaaattgtagtaagtgcattggctgatgctggaatagacgtaggtagagggaagaaaccggatgccaagaaaatgaaagaagcgctatcaaaattaaaaatgccatccggagttccaatacgtaaagtcagactaacaaaaccagaacaaactatacaaccagtacgagcaggaaggccggatcaggcctttgttaaacccggaagcacacaccacttatgtatatttgagttcactgaaaatggtaaaacaaaacgcgacgccgtttttgtaacaatgttagaagccatgaatcgactaaaaagaagagaacccgtcatacagagaacccatccagaacgacctgatagcagatttgtaatgagtttaagtgcccgagaaatgttattagcaaactggaaagatggggaaaggctattaacgtttaaaaccgcaagcagtacacaaggacaaatatggttcgcggagcatacagatgcacgaaaatcggcagactataaacaatttgtcgcaaacgccaatacattagacgcaaagaaagtaacggtagatccactagggagaataagatgggctaacgattga

SEQ ID NO: 8474 - RNA, 3204 nt, synthetic construct
  misc_feature 1..3204: note = Cas9 variant
  source 1..3204: mol_type = other RNA
atggggacaagacttggactagatataggaacaaattcaattggatggtgtctttttaatttagacggaagtggacgaccgataggaatacgtgatattggtgttagaatattttccgatggacgagacccacgttcaggagctagcttagcagtggaaagaagggtagccagagctatgcgtagaagaagggatagatacattagaagaagaagtgcattattagaagcattgattaatacaggattgatgccggcagatgtacaagaaagcaaagcattgaccggatgtgatccttacgtcttacgggcacaagcactggacagagcattagatgctcacttacttggaagagtcttattccacttgaatcaaagacgaggttttaaaagcaacagaaaagcagaacgcaaagctggagatgataaagaaggaggtaaaatagccgatggagctaaagcactggatctagctatgcacgaagctggtgcacgaacctacggagaatttttggctggacgcgattctagaagggtacgattaagagcagaaggtgacggttatgacttctatccagagaggagacatttagaagctgagttcgatgccatatgggatgcgcaagcggcatataatcccgctttactaactgatgtagtaagggatagattaaggcgcataatcttctttcaaagaccattaaaagcacctaaagtcggtgggtgtacattctttaacgaagaaccacgactaccaaaagcacacccactctttcaagaacgtcgcttatatgaggaagtgaaccaattagaaatcacacgagcaggagcgccatctagaaaactaacactagatcaaagagacaagataataagaaaactaaaaagtgcaaaaaccgctagctttagcggactagcaagattactaaaattagcagatggtgaaagtttttctagagttacagagaatagaacaggactagcaggagatgatatctttacaagtttctcggacaagaggtgttttggtgacaggtgggcacattttgaccccggtgtacaatggagtattatagaaacagttacagaagaagaagaccccgtaagattacgagattggctaatggcaacccacggggtaactgtggaacaggctgaagcaatcggaagagtaagactccctgaagggcatggaagactgggtgaaacagcaagtcgattaattctagcacagctaaaaagtggaagtaaagatggacatccactaacttataatgaagcagtagaagcggcactaggtaaatcacactctgattttagaacaggtgaaatattagaacaactaccttattatggagagattttatcaagagaaattcctcctggcagtctagatccagatgacgatgatgagattagatggggaaaaataactaatccaacagtacatataggtctaaatcaattaagacgtttattaaacgcccttataaaagcacacggtagaccagatgaaatagttgtagaactagcaagagagctaaaattatcagagaaagataaagcagaacacaataggcgtataggagctaacacaagagcagccgaggcccgtagcaagaaactattagaatcgggtcaaccagacacaggagcaaatagaagtttattgaaactatgggaagatttaaacccaaacaacccattggatagatgttgtccattttgtggaagacacataggacaaatggcactattctcaggtgaaacggaaatcgagcatataatcccatattcaaggtccttagatgattccgcagcgaacaaagtaattgcgcatagatcttgcaatagggagaagggaaacagaaccccctgggaagcatggggacatactgaaagatgggcaataatagcagaacaagtttctcgtctacataaatctaaacaatggagatttgcaccagatgcaatagaacgtttcaatcaggaaggaggatttatagcaagacaactatcagatacacaatatttgtcaagaatggcgcgaacctacttatctagcctatatcctgatacagcaggagtatacgtaataccaggtcgcatgacagctatgttaagacggttatggggtctaaacgagttacttccagatcacaactatgtcgagaacccacacagtggcgcacccaaaaatagacttgaccacagacaccacgcaatagacgcagcagtcgtaggagtaacaacaagaggcttattaaatgaaatttccagagccgcgggaagggcagaacgacaagatttagacagattatttatagatctaccaaaaccatgggaaacattcagagaagatttacatgagagcttagctagagtagtaggcagtcataaagcagatcacggtcgaaaaggagtaccagcaaaaggaaaagatgccactgcagctagattacataatgaaacggcatatggcttgacaggacttacgtcagaatcaggcttgccaatagtcgttcatagagtaccattattgtcactaaaacccgatgatttatcaaatccgataaggattcccgacgcagcactccaaagagcactacgtgaagcgacagatggaaaatctggaaaggacttccaagaagcattagctcaattttcaaaatcagacccggtgttcaaaggtataagacatgtaagagtgagagaaaccctaaaggtaatccctatcagagatgcctcaggacacgctttcaaagcgtataagggagacgcaaacgcaagatatgacgtgtggcgaatgcctgacggaaaatgggttagcagctggagagatagagacggaaaggctcactccggtattattacaatgtttgctgcacaccaagcaggacagcctgtacagagacctcatccagcagcaaaaagagttttatcgctaagacaaaacgatctggtagcagtagaaccacaaggtcaaccacgcaaaataatgcgcgtagtcaaattttcctctggaggtcagataacatttgccgaacatcaagaagcaggtccgttaaaagcccgagacgctacgagtcctgatatagatccatttaagtacttttatagttccgcaggaggattacaaaaagcacgagcaagacaaataagaatcgacgaactaggtagaatatttgaccctggaccaaggtga

SEQ ID NO: 8475 - RNA, 3207 nt, synthetic construct
  misc_feature 1..3207: note = Cas9 variant
  source 1..3207: mol_type = other RNA
atgaaatatgtactaggactggatattggaattgcaagctgcggatgggccgtaataaaccaagaaaaacatagaatagaagacctcggagttcgaatattcgataaagcagaaaaccccaaagacggcaaaagtttagcaacgccacgccgcgacgctagaagcactagaaggaccttacgccgaaagaaacatagaatgcaacgcataaaaatccttctggtaaaacacggattactaagcaaaacagaaatagatcacctctacgaaagtgccaccgaaatagacgtatggtacctacggttaaatgcattggaacgcagattaaatcctaaagagttcgctagagtactaatccatctatcaaaaagaagaggtttcaaatctaacagaaaagaaactacactgtcagaaaatgggcaaatacttgaaaatatatcagaaaaccttcaaataatggaacagaaaaattatcgaactgtgggagaaatgatattaaaagacaaacgattcgaaaatcacaaaagaaacaaagatggtacatacatagggaccgtgacacgacaacaacttcaagaagaaatacaaatgatattcaacgcacaaagactctacaaaaacaaccatgcaactgaaaaattcgaaagttcttatcttgaaatatgggcaagtcaaagaccatacgcatctaaagaccaaatagagaaaatgataggatactgcacactagaaccaaaagagaaaagagtcccaaaagcatcatggtccttccaatactttgtcgccctacaaaccataaataatctacgactaatttcaaaagatcgaatcgaagaactatcttttgaagaaaagaaaaggataatgaacctagcacttgaaaaatcaatagttaaatacatcgacataagaaaattattaagtgtacccaaagaatttcaattcaattccctctcatatagcgctgacatagtcgatactacagtagaaaacaagaaatgcatagaacttaaagaataccatagtataaataaagtatataaacaaatatacggacaaaatgcactaaacttactaccaaaagattacgacacaatagcgtacggccttacgatcttcaaagatgacaaagacatacaagaatacttacaaaataaatatgtgaacgcgaaaggcaaaccaatcagcaacctagctaacaaaacatatgatgacacctttattcaagttctactcacactaaacttttcaaaaatgggccatctcagtttcaaagcactcaaaaatataatacccttccttgaagaaggattatcctatgataaagcatgtgaaaaagccggatataactttaaaggaaccagttatactaagaaaactaaatatctaccagttattcctcaaaatacaaaccccgtcgttcaccgagcattgtcccaaacaagaaaagtgatcaacgcaataatcaagaaatatggaagcccaaacgcaattcacatagaaactgcacgagaattatccaaaactttccaagaacgaaaagaaatagacagcatgtatcaagacaacagtaagaaaaatgaacatgcaatatgcaaactcaaagaactaggaaacattaacccatcaggaataaacatagtaaaatttaaactttggaacgaacaagatggaagatgcatgtacaccggaaaatacatagaaccccaccgtctattcgaagaaggttacactgaagtagatcatatactaccatactctagaagtctagatgactcatacaacaataaagtattaacactcggaacagaaaatcaaagaaaaggaaataaaacgccatacgaatacatgcgaaacaactcgatatgggacgaatttgaaacacgagttcaaagcaacaagaaaataaataaaaagaaacaacaaaaactcctacttcaaaacttctcccatgcaagagagcaagagttcatagaacgaaatcttaatgatacacgatacgcaacaatatatctatcaagcctgatccagcagcatttaatattttccgaatcatcacgagaaaagaaagtccacacagtaagcggaattattacaagtcatctcagatccagatggggatttaataaagatagaaaagaagggcacatacatcatgcacttgacgctgttatagtcgcagtcacatcagaccatatgatccaacgagtaacaaaatactacaaattaaaagaacttaaccgaaataggcaagcaaaacgaatgcaattccccgaaccatgggaaggattcagacttgaactcgaagcacgcatcagccctaacacccaacaatatctaaaaggaataagatttaaaaactacgcagatgtaaacttatctgaaataaaacccatattcgtttcacgaatgccaaaaagaagcattaccggcgaactccatcaggaaacaatccgtaaattcctaggttataacgaaaaaggcaaagtccttacagcaactaagacgaaactcgaagatataccgtttgacgcaaatggagatttcccaatgttcggaaaagaaaccgatctatacacctacaacgccattaaagaaagatacctatctcataagaaagacaaatccaaatctttccaagaaccattatacaaacccaccaaaagtggaggaataggaccattaataaaatccattaaaataatggacacaaggaccatagtgaaccctgtaaatcaaggaaaaggagttgtctacaatagcaaaattgcacgaacagacgtcttcaagaaaggggaaaaatattatttaatcccaatatatacaatagaccttatgaaaaataccctcccccaaaaagcaataaccgcaggaaaaggatacgaggactggaccacaatagacccgtccttcacattcttattctccctattcccaaacgatctaatacaaatagtaccaagcaaaaacaaaaccatcaaagcacgaacaacggtgagcaagaaagaagtactattgccaagtttaacaggatattttaaaggcgtacactccgggacagcaggcatcacagtcgaaacacatgacggctcaatcatagcaaatgtcggatcaaaacaactattatcctttgaaaaataccaagtcgacgtcctaggccattatacaaaaataaagaaagagaaacgtatcgggatggcaatatga

SEQ ID NO: 8476 - RNA, 3207 nt, synthetic construct
  misc_feature 1..3207: note = Cas9 variant
  source 1..3207: mol_type = other RNA
atgaataaagcagtagcatatcggctcgcattagatttgggttcaacaagtctaggctgggctatattccgattaaacgaagcgagagaaccaacagcaataattcgagcgggagtaagaatattctcagacggtcgcaatgctaatagcgagccattagctgtacatagaagagtcgcccgtgcaatgagaagacgaagggatcggttattaaaaaggaagaaacgaatgcatgatcagttagtacaacatggatttttccctgcagaagttgcggaacgaaaagaattagaaagattaaatccatatcaactaagggcaaaagggttacatgaagcattaactcctggagagtttgcaagagcgttatttcatattaatcaaagacgtgggttcaaaagtaatagaaagaccgatagaaaagacaatgactctggagcattgaaacaagcaatcagcgaattacgaaagagaatacaagattctgactgcgcaaccgcgggcgaatggttttggaaagaacgcatgcagcaaaaaccagagggcgtgaggggacagtgggttagagccagatatcgaaaaacaccatcaactacagacgaaggcaagaaaagaattggatatgatctatatgttgacagagcaatggtagagcaagaatttgacgcactatgggcagcacaagctgcattacaacccggtttgtttacagaagcagctagggcggaattaaaagatacattactataccagagagatctacgacctgtaaaaccaggtagatgtacattgttgcccgcggaagaaagagcccctctagcattaccatcaactcaaagattcagaatattacaagaagttaacaaccttagactattagatgaagcattacgagaggtacctttgaacctagcgcaaagagatgcggtcgtatcagcattagaaggcaagaaagaactgagtttcgcagctattagaaaactgctaacactaagtggaaaatttaacttggaagatgagaaaagagcggaattgaaaggcaatgcaacaagtgtcattttagcgaggaaagacttgtttggtgatgcatgggcgggatttgacgcggccgtacaagatgaaatagtatggagattagtttcacaagagagtgaaggggctctcatagcttggttacaacagcatactggagtagacggagtgtgtgcggaagcaattgtaaacacaagactaccagatgggtatggaaggttatctagaaaagcactagaaagaattgttccagctttgcaacgtgaagtatgtacttatgacaaagcagttcaagcggcgggatttgcgcaccacagtgacttagggtttgatttcgactacgcagaagatgaagtacaacaagtaggagaacacacaatagcaagcacaggagaagtacaagcacaatacgctttcaaacaattaccttactacggaaaggctttacagcgacatgtagctttcggatcgggtgatgctaaagatcatgaagaaaaatgctatggaaaaatcgcaaaccctacggtgcatatcggcttaaaccaagtaaggacagtcgttaatgcattaataagaagatatggtcacccaacagaagtagtagtagaactagcacgagatttgaaacagtccagggagcaaaaacaacaaactcaacgagaacaagcagataaccagaaaagaaatgaagatataagaaaaagaatagcaccgatactggaaacaagcccagaacgcgtaagagatagagacatcaaaaagtggatattatgggaagaactaaataagaaagatattgcagaccggcactgtccatatagtggagagagaatttctgcaactatgttattatcagaagcagttgaaatagaacacattctcccatttagtcgaacattagatgactctctaaataatcgtactgtcgcgatgagaagggcaaatagaattaaaggtgatagaaccccatgggaagccagggctgatttcgaggcacaaggatggcgatatgaagctatcttacaaagagcggaaggtatgccacctaggaaaagatataggttcgcagaggatggataccaaagatggttaggaaaagataggaactttttagcaagggctttaaatgatacctcatatctttcaaggttagcagcaaattatttaagattagtatgtccacaaggagtaagggtaataccaggtcagatgacagataagctaaggggaaaattcggattaaactcagtattaggattagatggtaagaaaaacagaaatgaccacagacaccatgcagtagatgcatgtgtcataggcgttactgatcaaggactaatgcaaagattcgcaaatgcgagtaaacaagcaagagagaacgggctaacgaggttagttcaagacatgctacttccctggtggccgagctattatgatcacgtagaacgagcagtaaggcatataagggtgtcacataggccggatcatggatttgaaggtgcaatgatgaaagggaccgctcacggtataagagaagacggaataagggaagacggaagaataaaacaacgaccaaaagcaaaaggatcagctgatcataaaactattacactaatacctattgatgaacctagacaactggcaagacacggagtggacgccgaaggaaaacctttaccatacaagggttatgcaagcggaagtaactattgcatagagataacgaaaaatggtaaaggaaaatgggagggacaagtaatatccacatttgatgcgtatcgcataaaagcggcggcagatgcagcagcaagagctggtcaagttatatctacggttgaggctgattcaatagtaagaaagtcaggatgggaaagattaagaggagcgcaaagtcaaaatggtcaaccattagtaatgagacttgttataggagattctgtacgtatggaagtagacggaagagatgaagttatgagggtcgtaaaaatgtctggaaaagaaatggtttttgccccagttagggaagcaaatgtagataagagaaataatatgccagacgagcaagacccatttacatacacatacaagagagctgaccaactccgtaaagcgaaagccagacaggtcaccataagtcccattggagagttaagggaccctggtttcaaaggatga

SEQ ID NO: 8477 - RNA, 3207 nt, synthetic construct
  misc_feature 1..3207: note = Cas9 variant
  source 1..3207: mol_type = other RNA
atgcaatacgtactcggactcgatattggcatcgcaagttgtggatgggcagtaataaatcaagaaaaagaacgaatagaagatttaggggtacgcatcttcgataaagcagaaaacccaaaagatggaaagtcccttgcagctcctcgaagagacgcaaggagtacaagaagaacactaagacgaaaaaaacatagaatgttgagaatcaaaatattactagtgaaacagggacttctatccaaaaatgaactcaaccatctatatgaatcaacaacagaagtcgatgtatggaatctaagattagacgccttagaaagaaaactcaaccccaaagaattcactagggtactgatacacttggcaaaacgaaggggatttaaatccaacagaaaagagactacactatccgaaaatggtcaaatactagaatcaataagtgagaatcagcaaataatggaacaacaaaactacagaactgtcggagaaatgatattaaaagacaaaaaattcgaaaaccataaacgaaacaaagacggaacctatataggaacagtaacacgccaacaactacaggaagaaatccaaatgatattcaccgcacagcgcttgtacaaaaacgattacgctacagaagaattcgaaatatcatacttagaaatatgggccagccaacgaccatatgcgtctaaagaccaaattgaaaaaatgatcggttactgtacactagaacctaaagaaaaaagagtaccaaaagcatcctggtccttccaatattttgtagctctacaaaccataaacaacctcagacttatatcaaaagacagaattgaagaattatcattcaaagaaaaaaaacaaataatgaatctagctttagaaaaatcgattgtcaaatacatagacataagaaaactacttagtatcccaaatgaattccaattcaactccctaagttattccgcggatacggtcgacacaacactagaaaacaaaagatgcattgaactaaaagagtattactcaataaataaagtctacaaacaaatatacgaaaaaaatgcactcaacctactaccaatagattacgacactatagcttacggactaaccattttcaaggacgataaagacatcctcgaatacctacaaaacaaatacgtaaacgcaaaaggaaagccaataaataacttagcaaaaaagacatacgactataccttcatacaagctttactcacactcaattttactaaaatgggacatcttagcttcaaagcactaaaaaacataattccatttttagaagaagggttatcatacgacaaagcttgcgagaaggctggatataacttcaaaggaacaagttatacagaaaaaactaaatacttaccagtcatcccacaaaacaccaacccggtagtccacagagcactatcacaaacaagaaaagtaatcaacgcaataataaaaaaatacggatcaccaaatgcaatacacattgaaactgcccgagaactatcaaaaacctttcaagaacgaaaagaaatagactctatgtatcaagacaactctaaaaaaaatgaacatgcaatacacaaattaaaagaattgggaaacattaatccatcaggaattaatatagtaaaattcaagttatggaacgaacaagacggtcggtgcatgtactccggcaaatacatagagccacatagattatttgaagaaggatatacagaggtagaccacatattaccatattccagatccctagatgatagctacaacaacaaaacactaacactcggaacagaaaatcaacgaaaaggaaacaaaacaccctacgaatacatgggaaacacatctatctggaatgacttcgaaaccagggtacatagtaacaaaaaaataaacaaaaaaaaacaacaaaaactactcctacagcatttctcttacgcaagagaacaagaatttattgagcgaaatcttaacgatacaaggtacgcaaccatatatctatcttcccttatacaacaacacctaatcttctctgaatcctcaagaaaaaaaaaagtacataccgtttccggaattataacctcacacctcagatctcgttggggattcaacaaagatcgcaaagaaggccatatacatcacgccttagacgctgttatcgtagccgtaacaagtgatcacatgattcaaagagtaacaaaatattataaactaaaagaattaaacagaaaccttcaagccaaaagaatgccattccccgaaccatgggaaggatttagattagaattggaagcacgaatatcaccgaacactcaacaatatttaaaaggatttagattcaaaaattatgccgacgtaaatctatcagaaataaaacccatatttgtatcccgcatgcccaaaaggtccataacaggcgaattacaccaagaaacaataagaaaatttataggttacaatgaaaaaggaaaagttttaactgctattaaaacaaaactagaagatatcccctttgacgcaaacggagactttccaatgtatggaaaggaaacagacctatatacttataacgcaataaaagaaagattccttagtcacaaaaaagacaaaagaaaatcgtttcaagaacctctatataaaccaacaaaaagtggaggaatcggacctttgattaaatccatcaaaataattgacaccagaacaatagtcaacccagtcaaccaaggaaaaggagttgtatacaacagtaaaatagcccgaaccgacgtctttaaaaaagatgaaaaatactatctaatccccatctacacaatagacctaatgaaaaacattctacctcagaaagctataacagccggaaaaggttacgaagactggaccaccatagacccgtccttcacatttctcttctcactcttcccaaacgacctcattcaaatagtaccatcaaaaaacaaaactattaaagcaagaaccacagtatccaaaaaagaagtcctacttccttctctaacaggatacttcaaaggcgtacactccggcacagccgggataactgttgaaacacacgacggatcagtcatcgctaacgtcggttcaaaacaattactcttaatagaaaaatatcaagtcgacatcctaggccactacacaaaaatcaaagaagaaaaaagaatcggtatggcaatttga

SEQ ID NO: 8478 - RNA, 3207 nt, synthetic construct
  misc_feature 1..3207: note = Cas9 variant
  source 1..3207: mol_type = other RNA
atgcctaaatcagcaaaaccacaacaagcatacaccctaggactagacatagggattgcaagtgtgggagcagccctgcttggacaacaacatataataggactgcacgtcaggaccttcgacagagctgaaactgccaaagaaggcgagccattaaacaaaatcagaagagacgctagactcactagacgtcgactacaaagacgagcacacagactattgcgactaaggagattattcaaaagacataatcttataccagatacagatacaagtacatttatctcaggacaatcaccctgggaattaagagctcaaggattagatcgtcaactaacaagtgctgaatggacaacagtcttgtatcacatagtaaaacatagaggattccactcaaacaggaaaagtgaagtaaaaactgatgaaaaagcgggacaaatgcttagcggggtaaaccaaaatcaagcactacttaaacaatcaggacttagaacaatgggtgaactagcagcacgacatgaagcattcagagaagcgaaacgaaacaagaaaggtgcatacaaccatacattctcgagacatgatttagaagatgagctgcacttattattcagtaggcaaagagaattaggaaatccatacgcaacaccagaattagaagacgcagtacatacactattaatgcaacgtagaccagctctttcaggaacgaatttattaaaaatggtaggacactgtacattggaaccagacgaatttagagcgccaaaagcctcatacacagcagaacgcttcatatggctaacaaaactcaataatctaagagttagtggatctggtgaaacacgacccttgaacgaatctgaaagacaagcacttctaagtaaaccattttcacaaagcaaacttacgtataaacaagtaagaaaaatattagaattaccggataatataagatttgtcggtctacattaccaccctgcacaagataatggcaaatcaccagaaaatagagtcttctttgaagccaaggcatttcacgctttaagaaacgtatacaagaaagcagggttaaacttagaatggcaaagagacagccaaaaccccgaaaaacttgacaacataacatacgcattgacagtatttaaagaagataaagaagctaaacaatggttaatagaaaaaggagttgaagccagtgtaattgaagcagtactaaatgaatcattttctgagtttgtgagactcagtatcaaagccctccggaaaattataccacatatggaaatcgggcacagatatgacgaagccgtgaaactagcaggatattcacatcactcccacttacctcagccaagcaaaacaccatatataccccgtttctcgaaacaatcaattgctaatcccgtagtatctagagcactaaaccaagccagaaagttagtaaacgctatagtacgagaatatggaccacccgatgccgtccacatagagctagcacgtgatcttaataaaccatttgatgaaagacgcaagatagaaaaagaccaagaaaaataccaaaaagacaaagccagagatatagaaacatttcaagaaaattttggatttacaccaaaaggattacagttaacaaaatggcgactgtacagagaacaatcgggaaaatgcgcatattcattaaagccactagacattaaccgattattcgaagatgggtatgttgaaattgatcacgcattaccatatagcaggtcatttaatgatggaatgaacaacaaagttttaaccttaacaactgaaaacagaaataaaggcaatcaaactccatatgaatacttagatggagcatcaaactccgcacagtggcgtaactttgtagcgtgggtaaattcaaataaatcttaccgagccagtaaacaaagaaacttactaagaaaagacttcgcagctcaagcagcaacagaatttcgcgaacgacatctcactgacacaagatacatagcacgcgaatttaaaagaatggttgaaacccacttaaaactaaataaaccaaatcaaagatgcgtagttgtaagtggacaactcacagcatacttaagagcccgatggggacttattaaagtacgagagaatggcgatctacatcacgcattagacgcagccgttgttgcagcgtgcagtcatgcaatggttaaacgtttagcagactattctagaagaggtgaacttcaatacgcaagaggacaccatttcgaccctgaaactggagaaattatagatattaatgcattgagaaaactagacgatcactttccgcaaccatggacagatttcagaagagaactacttgcttggctgtcacctgaccccgcacagcaactcaaaaatctagcatactacactgatgaaagactcaaacaggtcaaacctataagagtatcacgagcaccaacacgacggggtttaggggcagcacaccaagaaaccattcggagtgcaaaatacttaggtgaaaatagatcgactgtaaaaacgccactagaaaaactgaaactaaaagatattccaaacatcgtaggatacgaagatcctagaaatcaccaactaatacaagcaatcagtcaaaggttaaccgaacatggagatgatggtaaaaaggcattcaaagaaccactatataaaccaggcaataacaaaagcacagctccagtagtaagaagcgtaaaattatttacagtacaaaaatccggaatacctgtgcgaggtggcatcgcaaacaatggaaacatggtacgtgtagacatatttacaaagaaagaacgttattttgccgtcccagtatatgtaagcgacgcagctagaaatgaattacccaataaagcagtagctagaggcaaagacggatggatagacatagatgattcgttttctttcctattttccctatatccaaacgactgggtatcagtggtagtgaaaccacatgaagcaccctgtgagggttactatgcaggactagacatatcaacaggcgcaattcacatatgggcccatgaccgaaatagaagcgtaggtaaaaatggactaatgagatctataggaataaaaactgctcactcagttgaaaaatatcatgtagacctcttaggcaatctgtatagagttgtccatgaaacaagaaaacctcttcgagcaggaaaatga

SEQ ID NO: 8479 - RNA, 3207 nt, synthetic construct
  misc_feature 1..3207: note = Cas9 variant
  source 1..3207: mol_type = other RNA
atgcagtatgtcttaggattagatataggtatagcttcctgcggctgggcggttataaaccaagaaaaagaaaggattgaagacttgggagtcagaatatttgacaaggcagaaaacccaaaagatgggaaaagtatggctacaccaagaagagacgctagatcaacccgcagaactctcaggcgcaaaaaacacagaatgcaaaggataaagataattctagtaaaacaaggcctactcagcaaaacagaattagaccatctatatgaatcagcaaccgaagtagatgtctggaacctacgtctggatgcattggaacgcaagttaaacccaaaagaattcacaagagtcttgatacatttagccaaaagaagaggattcaaatcaaatcgtaaagaaacaactttatctgaaaatggacaaatcctagaatcaataagcgaaaaccaacaaataatgggacaaaaaaattacagaaccgtaggggaaatgattctacaagataaaaagttcgaaagccataaaaggaacaaagacggaacctatataggaaccgtgacaagacaacaactacaagacgaaatacaaatgatctttaacgcccaaagactatacaaaaataactatgccacagcagaattcgaaaactcatacctcgaaatatgggcctcgcaacgcccatatgcaagcaaagaccagatagaaaaaatgataggctactgtaccttagaacaaaaagaaaaacgagcgcccaaagcaagttggtcctttcaatacttcgtcgcactacaaacaattaacaatctccgtctcataagtaaagacagaatagaagaactcagctttgaagaaaaaaagcaaataatgaatttagctcttgagaaatctatcgttaaatacatagacataagaaaactgttatcagtccctaacgaattccagttcaactcgcttagctacagcgcagacacagtagacataacagtagaatcaaggaaatgtatagagttgaaagaatatcattcaataaacaaagtatacaaacaaatctatgaaaaaaatgctttgaacttactcccaaaagactacgatacaatcgcatacggcctaaccatattcaaagacgacaaagacatactagaatacctacaaaataaatacgtaaacgctaaaggaaaaccaataagcaatttcgccaataaaacatacgatgacactttcatacaagcattattaaacctaaacttcacaaaaatgggacacttatcctttaaagccttgaaaaatataataccattcttagaggagggactttcatatgacaaagcttgtgaaaaagcaggttacaactttaaaggtacatcgtatacggaaaaaacaaaatatcttccagtaataccacaaaataccaacccagtcgtacaccgtgctctcagccaaactcgaaaagtcataaacgcaattataaaaaaatacggaagcccaaacgcaatacatatagaaacagcaagagaactatcaaaaacttttcaagaaagaaaagaaatcgactcgatgtaccaagataattcaaaaaaaaacgaacacgctatttgtaagctaaaagaattgggaaacattaacccatcaggaataaatatcgtgaaattcaaactatggaacgaacaagacggacgatgcatgtattccggaaagtacatagaaccacacagactttttgaagaaggatacacggaggtagaccatatactaccatattcacgctcattagatgacagctacaacaataaaactctaactctaggaacagaaaatcaaagaaaaggaaacaaaacaccatacgagtatatgggcaacacatcaatatggaacgactttgaaacaagagtacagtcaaacaaaaaaataacaaaaaaaaagcaacaaaaattattactacaacatttcagttacgctagggaacaagaatttatcgaaagaaacctcaacgatactagatacgcaactatataccttagctcactcattcagcaacacctaatattctcagaaagttcacgtaaaaaaaaagtccacaccgtctcaggaataataacatcacatctaagatcaagatggggtttcaataaagatcgtaaagaaggacacatccatcacgcccttgacgccgtaatagtagccgttacctcagatcacatgattcagagagtaacaaaatactacaaactgaaagaacttaataggaacttacaagcaaagaggatgccatttcctgaaccatgggaaggattccgtctcgaactcgaagcaagaatatcaccaaacacccaacaatacctaaaaggctttagatttaaaaactacgcagacgtcaatttatccgaaatcaagccaatattcgtatccaggatgccaaaaagaagtataacaggagaactccaccaagaaacaatacgaaaattcatagggtacaacgaaaaaggtaaagtactaactgcaataaaaactaaattagaggatataccatttgatgcaaatggagactttccaatgtacggaaaagagacagatttatacacttacaatgctataaaagagagatttctatcccataagaaagataaacgcaaatctttccaagaaccattatacaagcctacgaaaagtggcggtataggcccattaattaaaagcatcaaaataatagacactcgtaccatagtaaacccagtgaatcaaggaaaaggtgtcgtatacaacagtaaaattgcaagaaccgatgtattcaaaaaagacgaaaaatactacctaatcccaatctacactatcgaccttatgaaaaatatactgccacaaaaagcaatcactgcaggaaaaggctacgaagactggactacaatagacccttcatttacatttttattttccctattcccaaacgacctaatacaaattgtccctagtaaaaataaaacaatcaaagcgaggacaacagtgagtaaaaaagaagtactgttaccttcactcaccggctacttcaaaggagtacattcagggactgccggaattacagtagaaacgcatgacggttctgtaatagccaacgtaggtagcaaacaattactattgttcgaaaaataccaagttgacgtccttggccactacactaaaatcaaagaagaaaaaagaataggaatggcaatctga

SEQ ID NO: 8480 - RNA, 3210 nt, synthetic construct
  misc_feature 1..3210: note = Cas9 variant
  source 1..3210: mol_type = other RNA
atgaagaaacaaccacaaagatatattcttgggttagatttgggaatcgcaagtgtaggatgggcgttaatattagtggatggagctgaaaatccagtaggtctgttggactgtggagtcagaacattcgaacgtgcagaagtcccaaaaacaggcgattcacttgccttagcacgtagacaagcaagatctgtgaggaggctaatcagaagaagggcacaccgactattacgattaagaagactattaaaaagagaaggaatcttatcggcagcagatttcaacagcgacggattacccaatttgccaattgatgcatggcaactaagagtagcaggtcttgaacgaaaacttaccaatcaggaatgggctgcagtactccttcatttagtcaaacatagaggatacttaagtcaaagaaaaagcgaaactcaaacagaaaacaaagaactaggtagattactagctggtgttgcagaaaattctaaactactaagtgaatcatcagaacaatacaggacgcctgctgaattagcagtaaaattatttgcggaacaaagtggaagactacgcaataaaggtggagactacacacacacattcaaccgcctagacctacaaaaagaactacacttactatttgaaagacaatgtgcattgggtaaccctttcgcaagcgccgaattacaatcaaaagtggatgaacttctaatgactcagagatcagcccttcaaggcgaagcagtactaaaaatgttaggtaaatgcacttttgaaccatccgaatataaagcagctaaaaatacatattcagccgagcgttttatttggttaacaaaattaaataacctaaggatattatacaacggtgaagatcgagcactagacgaaggcgaaagaaaacaactattagacgaaccatacaagaaagcaaaactcacctacaaacaagtaagatcaattcttaaccttccagaatcagcagtttttaaaggtctgaggtatggaaaagattcagatggcctaaaagccgaaaatggcgcactaatggaaatgaaggcataccacaaaatcagaacggtcttagaaaaagcaggactcaaaggagaatgggaaaatagaattagaaacccagaaatattggaccaaattggaaccgctttcagtgtgtataaaacagacgaagacataaaagcagaacttgcagcactacgacttccagaaaacgtactagacgctttattagcaggactaaatttcgataaattcatacaactatcactaaaagcattgtcgaacatactcccactaatggaaagaggaatccgctatgatgaagcatgtaaagaagtatatggagaccatcgagcacttgcagaaagtaaaaatcaaatgcttctgccgcaaataccagcaaatgaaataagaaatccggtagtactcagaacactaacacaggcaagaaaagtgataaacgctatcataagaagatatggatcaccacaacgagtacacatagaaactgcaagagagttgggaaaatcatttaaagacagaaaagaaatagagaaaaggcaagaagaaaaccgaaaggaacgagaaagagcagccgaacattttaaagagttgtttcctagatttacaggagaaccaaaaagtggcgatatactaaaactgaggttataccagcaacaacagggtaaatgtttatattcaggtattccaatagacctcggaagactaaatgaaaaggggtatgtagaaattgaccacgctttaccgttctcacgaacctgggatgattcttttaacaacaaagttttggtcctaggaagtgagaatcaaaagaaacgaaatcaaactccatacgaatatcttgacggagctagagatagccaaagatggagagaatttcaagctagagtacaaggatgcagatttccatacgctaagaaacaaagaatacaaaccgccaaattagattcaaaaaccgaacaaggcttcttagaaagaaatttaaatgacacaaggtacattgcaagattcctatgtggtttcatagaaaagagtttacatctacaaggtgccggaaagagaagggtattcgcgtcaaatggccaaataaccgcgttactcagaggactatggggactaaagaaggtacgagaagataacgaccgacatcatgctcttgatgcaatcgtagtagcatgctcaacagtaagcatgcaacagaaaataacgaaagcgatgcaaaggagagaaacattagaaactattaacacagaaacaggtgaagtaaaaacacgaatcccacaaccctgggactttttcagacaagaagtaatgataagagttttcagcgatgcaccacgagaagaattagcagaaaaacttaactcaagaccagaggcattacatgattttgtaagtccattatttgtatctcgagcacctaatagaaaaatgacaggtcaaggacaccttgaaactgtcaagtcagctaaacgtttaagtgaaaatattagtgtcgtaaagaaaccactaacagcgttaaaacttaaagatattgaaaatattgtaggataccccgacagagaacctgcactatacagggctttacaagaacgcctacaagcgtataaagatgatcctgcaaaagcattcgcagaacctttctataaaccagctaaagatggaggacaggggtcattagtaaaagcagtacgtattattgaaaatacaaaacatggcctcaaagtccgaaacggtatcacagatacaaatggagacatggttagggccgatgtatatcaaaaagcagataagaaaggaaaaagacaatatttcatagtcccagtttatgcctggcaagtagagaaaaatgaattgccaacagtggattgtaaaggatacgaaatagatgatacatacgagttctgtttcagcctctacaaatacgacataattgaaattcaaaatccagataatatgagtaaagaactcagagtgtactacataaactgcgattcatcagatggtagattttggctagcacatcacgataaaagtgccaaagaacaacaatttagaatatcgacacaaaaccaaccgattataaagaaataccaagtagatcctcttggtaaagaaataagactatgtaaagcagagaaaaggacagaattaaacggaaagaaaaagaaatga

SEQ ID NO: 8481 - RNA, 3210 nt, synthetic construct
  misc_feature 1..3210: note = Cas9 variant
  source 1..3210: mol_type = other RNA
atgaactacgatataggattaagaatcggaataacttcctgtggatggtccattataaacaaagatttagagagaatagaagatttaggagtaagagtatttgaaaaagcagaaaaccccgatggaacagctagcgcagcccctagaagagaagcaaggaaaagtcgaagaaaacacagaagaaaaaaacacagaattgaaagaataaagagactaattgttcaacatgacctactgtcaaaaaaagagctagatagtctatatctaagtccatttaatatagatgtttggaatttaagagtcgaagcactagaacgtaaacttgataatagagaattcgcaagagtactcattcacctagtgcagcgacgaggctttcaaacaatccgaaaatcggttgaaatacaagaggaaggcaaattgctcgaaaatgtaagcgaaaacgaaagaataatgaaagttaacggatacaaaactgtaggagaaatgttcagtaaacacgaaaaattcacacaccataaaagaaacaaagacggctcatatactagcgtagttaccagaagtctgctccttaaagaaattaaaacaatattcaactcacaacggatactaggcaacgtattttcaacacaaaaattagaatccgactacctatacatatggggaagccaacgtccaacactaacatatgaacaattaatgtcaatggtcggcaattgtatatacgaaaaaaaagagaaaagagcaccaaagacatcatgggctttccaatacttctcactactacaaaagataaataaattaaaagtaagcgacgataatacactaagaaaactgtcaaaagaagaacgagatatagtaatagaactcgctttcaaaaaaaaaaatgttagcttcgttgacattcgcaaagcactgaaattaaatgataacacaaaattcaatcatctcacttactcacacgtagtagaaacaaagaaagtagagaaggccacattcatagaactaaaaggctatcatctcataaaaaaacagctgaaagaccgcaacgtagaactaacgcaagaactacaaccaaaagattacgatgcaatagcagcagcgtccactttcttcaaaaacgacatcgaatttagagattacctgagaaatcaatacctggactcaaacggcaaaagaaaatcaaacatagcgaacaaagtctttgaagacaaagtaatagcagctgtttttgaattaaacttctcgaaagtatgtcacctaagttttaaatcactatataagcttataccccacctagaaaaaggactcgattataaagaagcaatcctctgtgcaggatataatttcagggacgaaaacaaacgagacaaaaaactattcctgccagtaatacaacaagaaacaaatccagtagtacacagagcattaacacaggcgcgtaaagtaattaatgctataatccgcgaatacggaagtccaaatacaataagatttgtagtagcaaatgacttagcaaaaacctataaacaacgaaaagaactagaatcaacactaaaaaaaaacagagcggaaaatgaaaagatcaaaacaaaactgctaagtatgggaataataaaccctaccggaatggacatcgtaaaatataagctttggtacgaacaaagcggtatctgcttatatacaggacgacaaatggaactttcatccttattcaaacctggatactcaatagttaaccacataataccatacaaccgatcatttgacgatacttaccacaatagagtcctaactttgactgaaaccaaatatgaaaaagggaacaaaatccccttcgaatattttggcgctgaagaaacatgttggaacgaatacgagaaaagagtttcaacaagcaagaaaatacacgataaaaaacgagaaaaactattaataagaaattttgacatagaatacgaaaacgaaatgataagtaacaacgtcttcgacacacattacataggatcctactttgaaaaatatattgacgaacatttacaatttaaaaaaagtacaaaaaaacaaaaagtattttcaatccacggaaacatggtagcccatctacatagtagatggggcttcaataaaaattctcgagaaatttaccttaatcatgccgtagacgcagctatcgtcgcagtattgacagatcaactaatacgaaatatagcagattactatcgaagagacaacatacttgaacagaaaggatcactcaaatttccggaaccatggaaaagcttttcaatagaactggaagccagaatatccccgcaagtacgggatctaataaaaaagctaaatctagatagctacctagatgttgacatccttcacatcaaaccagtatttatttcaaagaaaccaagacgaaaagtcaatggtgaagcccataaatccacaatcagaagtttaatcggcataaacgaaatcggaaaaaccgttacctgcatcaaaactagattagaagatatacctttcgatgaaaatggtgatttcccaatgtacggcaaagacacagacaaatatacttatacagctatcaaagaaagatacctagaatttaacaaagacaaagaaaaagccttttcaacccctttatacaaattaaaacgaaacggcgaaccgggtaaccaaataaaaagcgtaaaaataatagatacaagaaatatagtaaacaaagtaaaccaaggaaaaggaatagcatataattcaaacataataagagttgatgtattttcacgagatcaaaaatactacgtcgtaccaatatacttgagagattttataaaaggaagcctgccaaataaaataataaccgcagcaaaaggatttatgcaatggcccgaaacagataattcatatacattcttgttctcaattttccccaacgacttaatcaaagtcgtaccaaaagaaggaaaatttataaaagcaaagaatgaaaataaagagaatatcaatttaactgaaatacttggatacttcaaaggactagattcaagtacaggtgcattcacactcgaatctcacgatggtagcctattagcacgaggaataggaacaaaaaacttattacttatagaaaaataccaagtagatgtattaggacgatacaacaaagttggcaatgaagaaagacaggatatcaaaattcaacaaaattga

SEQ ID NO: 8482 - RNA, 3210 nt, synthetic construct
  misc_feature 1..3210: note = Cas9 variant
  source 1..3210: mol_type = other RNA
atgaattatgatataggtctccgaatcgggataaccagttgcggctggtccatcataaacaaagacttagagagaatagaagatttaggagtcagagtttttgagaaagccgaaaatcctgacggcacagctagtgcagcaccaagacgagaagcgcgtaaatcacgaaggaaacacagacgaaagaaacatagaatcgaacgaataaaacgtctaatagtacagcacgatctcctgagtaagaaagaattagacagcttatacttatcaccgttcaacatcgacgtatggaatcttcaagtagaagcattagaaaggaaactcgacaacagagaatttgcacgcgtactaatacacctagttcaaagacgaggttttcaaacaataagaaaatccgtagaaatacaagaagaaggcaaactcttggaaaacgttagtgaaaatgaacgtatcatgaaagtcaatggatataaaacagtaggagaaatgtttagtaaacacgagaaatttacacatcacaaacgaaataaagatggtagttacacttcagtcgtcacacgatcgctactcctaaaagaaataaaaactatatttaattcacaacggatattaggcaacgtattctcaacacaaaaactagaaagcgactacctatacatctggggttcacaacgccctaccttaacatacgaacagctaatgagcatggttgggaattgcatatacgaaaagaaagaaaaacgagctcccaaaacatcatgggcatttcaatattttagccttctacagaaaataaacaaactcaaagtatctgacgataatacccttcgaaaactcagcaaagaagaaagagacatagtaatagaactggcattcaaaaagaaaaacgtgagcttcgtagatatacgcaaagcactaaaattaaatgataacactaaatttaaccaccttacatattcacacgtcgttgaaaccaagaaagtagaaaaagccacattcattgaattaaaaggataccacttaatcaagaaacaattaaaagacagaaatgtagaattaacgcaagagctacaaccaaaagattatgatgccatagccgcagcctctacattctttaaaaacgacatcgaatttcgcgactacctccgtaaccaatatcttgatagcaacggaaaaagaaaaagcaacatagcaaataaagtatttgaggataaagtaattgctgcagtatttgaacttaacttttcaaaagtctgtcacttatcgttcaaatcactatacaaactcattccacatttagaaaaaggattagattacaaagaagctattctctgtgcaggctataatttccgagatgaaaataaaagagataagaaattattcttacctgtaattcaacaagagactaacccagttgtacacagagccttaacacaagctagaaaagtaataaatgctataatacgagaatatggatctccaaatacgatcagattcgtagtagcgaatgacctcgcaaaaacttacaaacaacgaaaagagctcgaaagtacattaaagaaaaacagagcagaaaatgagaaaataaaaaccaaactactaagcatgggaataataaaccccactggaatggatattgtaaaatataaattatggtacgaacaaagtggcatttgcttatacacaggtaggcaaatggaactatcttccctatttaaacccggatattctatagttaatcacataataccctataatagatccttcgacgacacttaccataatagagtcttaaccctcaccgaaactaagtacgaaaaaggaaataaaataccatttgaatacttcggagctgaagagacctgttggaatgaatacgagaaaagagtatcaacttcaaagaaaattcacgacaagaaaagagaaaaacttttaataagaaactttgatatagaatatgaaaacgaaatgatatccaacaatgttttcgacacacactatataggatcatatttcgaaaaatacatagacgaacatctacaattcaagaaaagtactaagaaacaaaaagttttctcaatacacggaaacatggtcgcacacttacatagtagatggggattcaataaaaattcgagggaaatatatctaaaccacgccgttgacgcagcaattgtcgcagtacttacagatcaattaataagaaacatcgcagactactacagacgagacaacatattagagcagaaaggatcactaaaattccccgaaccatggaaatcatttagcatagaactagaagcaagaatatcaccccaagtaagagacctcataaagaaattaaacctagactcctacctagacgtagacatactacatataaaaccagtctttataagtaagaaaccccgaagaaaagtaaacggcgaagcacacaaaagcacaatacgctcactaattggaatcaacgaaataggaaaaacagtaacatgcatcaaaacacgactcgaagatattccatttgatgaaaatggagacttccccatgtacggcaaagacaccgacaaatacacatacacagcaataaaagaaagatacctagaatttaacaaagataaagaaaaagcattctcgacacctctctataaactaaaaagaaatggcgaaccaggcaatcaaataaaaagtgtaaaaattatagacacacgaaatatcgtaaacaaagtaaaccaaggaaaaggaatagcatacaacagcaacataatacgagtcgacgtattctcaagagaccaaaaatactacgtcgtaccaatatacctacgagactttattaaaggatcattaccaaacaaaataattacagctgcaaaaggattcatgcaatggccagagacagataacagctacactttcttattcagtatattcccaaacgacttaataaaagtagtaccaaaagaaggtaaattcatcaaagccaaaaacgaaaacaaagaaaacatcaacttaaccgaaatactaggatactttaaaggactagacagttcaaccggagcattcaccttagaaagccacgacggctcacttttggcgagagggataggaacaaagaatttacttctaatagaaaaataccaagtcgacgtccttggccgatataacaaagttggaaacgaagaacgccaggacataaaaatccagcaaaattga

SEQ ID NO: 8483 - RNA, 3213 nt, synthetic construct
  misc_feature 1..3213: note = Cas9 variant
  source 1..3213: mol_type = other RNA
atggctacaagactaggactagacatcggaactaattccataggatggtgcttatacgacggagatagtatacgagatataggagtacgaatattcttagatggtagggaaccatccaaactaactgtaagtggatcaggaactcccctagcagttaaaagacgagatgccaggggagcaaggaggagaagagatagatacattggacggagaagtgcaatgcttcgagaattaaggaagcatggattattacctgcagaccctaaacaagcaaaagtactggaaactcaagatccatacgcattaagagtacgtgcattagacgaaaaattagaaccacaccaaatagggagggcactatttcatctaaatcaaagacgagggttcaaatctaatagaaaagcggaacgagcgagtaaagcgggagaagacggtaaaatagctactgctacgaagctattagacgaagaaatgcaaagactaggggcaaggacactaggagagttcttagttaaaagagattcagagttcgatggagaagccggtaaaagggtcaggatgagagcagatagtaaagcatatgatttttatccagacagacgacatgtactagacgaatttagggctatatggaatgcccaaaaagtctggcatccagaattattaacggaacaggcttggaacgacatttttcgagtgatagaatatcaaagagaacttaagccacaagtagtcggacattgtacatttgcaggaattaatggagtaccggcagacgaaaaacgacttccaaaagctcatccactatttcaacaaagaaggctttatgaagaagtaaatcaactcaaagttgtagcacctggagaagcgggtcgaccactcaccagggatgaaagagacgcattaattttaaaacttcaagataagaaatctgtttcttttgaaactttagggaaaactcttaaacttaaagatggggagagatttaataaagaatcagaaaacagaaaagccttggatggagacgaggtcagagcagccttatcaggtaaaaagctgttcggaactagatggtttcatttcagtgcagaagaacaatggatgatcattgaaagattattagaggaggaagatagtgaaacattgttaacctggttgaagatcggctaccgactagatgacgaagctgcactggccgtagccaatgcaaaattaccagaaggccacgggagattcgggttgagtgcaacaacagccttactaaaagaattaaaagcggatgtttgtacctatgcagaagcagccaagagagcaggatttcatcattctgatttcaggaccggagaagttttcgatcaattgccatattatggggaaatactagctagagagatcgcgccaggtaaaccagaatatggcgatgaaaatgaaagaagatttgggaaaataacgaaccctaccgtgcacataggcctgaaccaattaactaaattggtcaatgctataataaggttacatggaaaacctgattatatatttgttgaacttgcaagagaattaaaattaaatgagaaggagaaaatagcatataataggcaactgaaagaaaacacagatgcagccagagacagaggggcgaaattgggaactatgggtgtaagggatacaggacgaaaccggctaattttacggctctggacagaactaaaccctggagatgctttaaatcgaagatgcccattttgtggagaacaaattagtcaacgaatgattcagaatggtgaagtagaaatagaacacattatcccatatagccaatgctttgatgacggaattggtaataaagttctatcccatgtgcgttgtaatcgacaaaaaggagatcagacaccatgggaaagatggggacatgatccagatcgatggtcaataattcaggaacaagttgctcaccttcacagaagtaaacaatggagatttggtcccgatgcaagagacaggtacgcagcagaagaagatagctttctgccaagacaactaatagatacacaatatctaaccagaattgcagccaagtaccttgcatgcctatatcccgaaaggggtgaaaggcatgtatttgcagtacacggcggaatgacggcaatgcttagaaggttatgggatctaaattcaattttactagaccacaactgggtagaaaatctaaacagtaatgcacccaaaaatagattagatcatagacaccatgccatcgacgcggcagtagttggaataatgacgccaggacttatagcagaaatagctaaagccgctgcacgtgccgaaaaacaaaatcttgacagactatttgaagaacttccaatgccctgggctcaacatccaaatgacagacgatttagagacgaattaagagaaaagatcttagcagcgaccgtatcacacaaagctgaccacggaagacaaggaaaacctgaaagaggtagagatataactgctggaaaattacataatgacacagcttatggcttcactggactgacatcagacacagggcttccagtagttgtacatcgagtccctttaacatcactcacaccaaaagacatagcagatcccgatcgaataccagacacaacgctgagaggatctttatggcaagcaactagagacttaagcggaaaagaatttgaaaaagcgctcttagacttctcaaggacacatgcacaattcaaaggtattaggagagtaagggttagagaaggtttaactctgattccaattcgtaaccacgctggtaaaccttataaggggtatctgggtgattctaatgcacggtacaacgtatggcaaatgcccgatggaagatgggtacatcaagtaatatcaacattcgatctacatcaaccaggatttatagaacaacgcccacaccctgcagcaaagaaagttctaagtctcaggcagaacgacttaatagcgatagaaagagatggagccttaagacaaataatgcgagtacaaaaatacggacaaaacggacaaatatttctaatagaacataacgaggctggcaatatggcggaaagaaataagaatactgatgatccattcaaattctatgggccaggggcaagtgcacttagaaacatgaaggcaagacaagttagaatcgacgagctagggagaatatttgacccgggaccaaggtga

SEQ ID NO: 8484 - RNA, 3213 nt, synthetic construct
  misc_feature 1..3213: note = Cas9 variant
  source 1..3213: mol_type = other RNA
atggcaaaagactttgaatacatactaggactagacctaggtgaaacaagcatcggttggagtgttgtaagattaaacgagggagtccctgaacatctagaaagacttggagtaagaatctgctcagatggaagagacgcacaaagtcatgaaccactaagcgttgcaagaagaatagcaaggggattaagacgaagaagggataggtacatccacagacgcattagactaacagatgtcctagtcaaatacggattaatgccggaagatataaaagaaaggaagaaactacaagcactaaatccatacagactaagaagcgaagcactagatagaaaactagaaccatatgaactaggtagagttttatttcatataaatcagagacgcggatttaaaagcaatatgaaaactgatagaaaagacagcgaatctggtgccatgaaacaagccatacttaaaacccgcgccaaaatggaagcctcaggtgcaaggacactaggagagttcctatactttcttaacaaagacaaaacaagtacacaagaatacgttccagtcagaatgagaagtcatagcgagaaaaacaaaacagtatacgaaatgtatccagaccgggcaatgtatgaagatgaagtccacaaaatatttgaacaacaagaactatcaccagaagcgcaaacagaaatattcaatacaatattctttcaaagacctttaaaaccggtagaactcggtttttgtgagtttgaagatggagaaagacgagcctatacagcgagtgtagtctttcaaaaattcagagcactgcaacaaattaaccaaatatatgttcaggacgattatgaaagacggccacttactaaagaagaaaaagacatcttaaaacattttctattagaagacttctcggcattagataaaaacgggctactaacctgggcaaaagttagaacgttactaaaactacaaaagaagaaatttaatttagaatcagaaagaagaaaaggactaaatgctgatgtaacgagctggaaactttcaaatgcagcatgttttggtagagaatggttttcttttagcgatgcaaagaaagaagagatagtagccttaatcacaggagcagaaaaagaagaagaactaatagcagaactaaaaacaaaatatggattatcagatgaacgggctaaaaacacagcaaacgtttcactacctgatggcgtagcaagcctatcagcaaaagcaatgaagaaactaattccatttttagaagaggggatgttatatgacgacgcagtcaaacaagcagggtacgtcttttcttcaagttttaaaggagttttacccgaaaaatatgaaacatttatagaaccagaaagtggagaatgctttgatgaattaccctattatggccaagtattgagaaggtacgtacttggaggagttccatcagaagaaaataaactatttccagaaaaatattacggaaaaatcaataatccaacagtacacatagtattaaatcaattacgaaaactcataaattcacttgtcgcaaaatacggccacccaagaaaaatagtcgttgaaatggcaagggaccttaaactctcgaaaaagcaaaaagacgcaattgctaaggaacaagcactcaatgaaagagaaaataaaagaataggagccgaactagaacgattagatataaggaataattatgataacaggatgaaatataaattatgggaggatctgtcaacagacccaacaaaacggtcatgtccgttttgtggtaaacaaataagtcaacaagatatattttctccggagttcgaaattgaacacttaattccattctcaaggagctttatggatggaagatccaacaaagttttaagctgcagaagatgcaaccgagaaaaaggcaataaaactccgtttgaggcttttgggaatgattcaactcgatggaatgcaataatgggacgagtcgagagcttaccggaaaataaacgatggaaatttgcttcagatgctatgagtagatttgaaagagacggagacctattagcgagaatgatgacagacacacaatacatggcacgaatcgctagacgttatttatgttgcgctgcaaaccctaaccaagtatatgggatacccggacagttgacagccaaacttagagaacattggggactaaactcgatattatcggaccaaaaagaaaaagacagatcagaccatcgacatcatgcaatagatgcatttgtagtagcttgcactgacagaggaacactacaaaagtattcgactgaacgtagagattacgcaaaacctgaaatgccaagtgaaaaagcaccacatataccatttgccgatttcagactatctgatatcaaacgagtatttgacgaaatcatagtaagtcacaaacctgatcgcggaaatgcaagagcagcgatattaaaagggggaacagttgccaaactacatgaagaaacttattacgggatgggcggagaaggttctaagaaaggaacgtggaaactaatacaaagaatacctgtttcagaaataaagaaagcaagcgatttagattgtttaatagaccagaaaggaacagctaatccattgagagtactccttgtgggtgcttcagaatctgaacaggaacaaatcattgcgagctactttgcaagaagaggtacgcataaagtaaggacatatagagaaagaaataaagatgtaatcttaccatttaaagataaagatggcaaactctatcgttatgcagtctatggcagtaacgcatacgctgaaatatattgtccagatagaggtaaaaacgcaggaaaatggcaagtagaaattataccgaattactgcgcacaccaaaaaggctttattcctaaatggcggcacacagatgcccatgctaaattaataatgagactctataggaatgacatggtagcatacgaaaaagaaggcaaaactgtaatagcacgtgtaaagaaaatgggtgggaacggagtaatcgtgttcaggaaccacctaatcgctaaagaagaaggtgacagattaagctggcaagccgtagtaagtggcatgcaaagtgcaaacttaagaaaaatatatgtagacgtcttaggtcgcgtaatagatcccaaacgaccaatgacacaaaacgaaactgacggacaagataattga

SEQ ID NO: 8485 - RNA, 3213 nt, synthetic construct
  misc_feature 1..3213: note = Cas9 variant
  source 1..3213: mol_type = other RNA
atgtcgcacttcagattaaaacaattaaactacatactgggattagacttagggattgcttcagtaggatgggctgttgttgaaattgacactgaagaaaacccgacgcgtctaatagacgttggcgttagaactttcgaaagagctgaagtaccgaaaacaggggattctctagcagcggcaagaagacaagcaagaagtgctagaagactaatacgtagaagaacacaccgactactaagagctagacgtttattaaaacgcgagggtatccttcatgccgacgacctaaatgcagaaggccttgtcaaagaactacccaatactccatggcagctaagagttgatggtttggatagaaaattaatgccaaaagaatgggcagctgtacttttacacttagtaaaacatagaggttatctcagtcagcgaaagaacgaaagtgaaggagctgacaaagagttaggaagactcttggctggagttcatgaaaaccatcaagcactacaatcgagtgaatatagaaccccagcagaactagcagtgaaaaagttccaagcacagagtggacatataagaaaccaacgaggagactacactcacacctttgacagaaaagatttgcagcaagaactacatcaattatttgcagcgcaacagaaatacggcaacccattcgtatcagatggattgaaacaaggtatcgaaacattactaatgcaacaaagaccagctttatcaggagatgcagtacagaaaatgctgggaagatgtacatttgaaacagaagagttcaaagccgcaaaacacacctattcagcagaacgatttatatggctcacgaaattaaataacctcagaatacaagaaaacggcaatgaaagatgcctaaccgcacaagaaagaggacaaataatagacttaccatataagaaagcaaaacttacatatgcacaagtaaggaaagaactatcattaccagaaaacgcattctttaaaggattaagatatggaaaagaaaacgcagaaacggcagcactaatggaaatgaaagcataccatgctattaggaaagcattagagaaagcaggactgaaaacagaatggcaaggattagcatgtaaaccagaattactggatgcaataggcactgtattttccttatataaaaccgacgaagatatatccacacgcctacaagggcaactgagtgaagacgtaataaacgctttacttgcgggtttaaattttgataaattcatacaactctccctcaaagccctgtctaaaatattaccacttatggaacaagggcaaagatatgatgaagcccatgcagcgttatatgtaagatcaacaccacaaccacaacgcttattaccacaaataacagcagatgaaatatgtaacccagtagtcctaagaacactcagccaagctcgaaaagttattaacgcaatagtaagaagatatggttcaccagctaggatacacatagaaacagggagggaagtcggtaaatcctttaaagatcgacaagaaatacagaaaagacaagaagacaatcataaggaacgaaaacaagcagcagaaaaatttttagaatactttcccaatttcgtaggacaaccaaaagcaaaagacatactaaaacttagactatatcagcatcaacacggacaatgcttatacagtggaaagacactagacatatgtcgattaaatgaaaaaggatatgcagagatagaccatgcacttccgtttagtagaacatgggatgatagtttcaataacaaagttttagttctagccggagaaaatcaaaataaagggaaccaaacaccatatgaatggctaggcggcgctagcaatagtccaagatggcaggagttcgtcgcgcgagtaggttctagccgattccaccacagtaagaaacaaagaatattgttgcgccagttggatgaagaaggttttaaagaacgaaatttaaatgataccagatatgtagcacgattcttatgcaagtttatagaagaaaacatgttactcttagggagagggaaaaggagagtttttgcaagtaatggccaaataacatcattcttaagaagcagatggggtctaagaaaggtaagagaagaaaatgacagacatcatgcattagacgcagttgtcgtagcttgttctacggtagcgatacaacaacgaattacctattttgtaagacaaagagagatgaatatatttgatggagaattaatagataaagagacatcagaagtaagcagaccatattttccacaaccgtgggatttctttcgacaagaggtgatgatgcgtgtatttggaaagcccgacggagaccctagttttccagaagccgacacaaaagaaacactttgtacactccttgaaacaagattaagttctagacctcaagccgtacacgaatatgtaactccactattcgtaagcagagctcccactagaaaaatgagtggtcaaggacataaagaaacagtaaaatctgcaaaactactacatgagggcaaatcagtcctaagagtaccattaacacaattaaaaccaaatctactagagaaaatggtaaatagagatagagaacctcaattatatgaagcgctaaaagagaggttagcagcttacggaaatgatccggccaaagcgttcgctacagagtttaggaagaaaggcggacagttagttaaagctgttagagtagaagatacacagaaaagcggagtattactacacaaaggaacgggagtagctgataacgcaacaatggttagagtagacgtatttgagaaatcaggcaaatactatttagtaccaatatatagttggcaagtggcacagggcatcttaccaaataaagcagtaatacaaggtaaagacgagaaaaactgggatgaaatggacgaaacttatacttttaaattttcaatgtacccaaacgacctggtagaaattaacactggaaaacaacgactattcggttattatataggattagacagagcaacaggagctatatcaataagagaacatgatttagacaattttaaaggtaaaaatggaatatatcgagtaggcgtaaaaacagctataagttttaagaaataccaaaccgacgaattaggtaaagttgtggtaccttgtagacctaagaaacgccttccagtacgatga

SEQ ID NO: 8486 - RNA, 3216 nt, synthetic construct
  misc_feature 1..3216: note = Cas9 variant
  source 1..3216: mol_type = other RNA
atgaggttaggattagatattggaaccaatagtatagggtggtggctatatcaaacggatgatggaactatcacggacgtattagatggaggagtacgaatatttagcgatggtcgagacccacagtcaaaagaatcacttgccgtagatagaagagtagcaagggcgcagagaagaagaagagatcgatacctcagaagaaaagctgcattgatgaaaagaatggcgggtgcaggcctaatgccaacagaccaagcacacgcaaagaaattagaatcattagacccttatgcactcagagcagaagggctagactgtgaactgccacttacacatctaggtagagccctattccatctaaatcaaagaagaggttttaaaagtaaccgtaaaacagatagaggagataatgaatccggtaaaatcaaagatgcaactgcacgcttagattgggcaatgagagacgcaaaagcgagaacctatggagagtttctacatacaaggcaacaaaaagcagacgatcccaagcgaatgccaaccgtaagaacacgattaactgtggcaagaagagacaatgcagaaaaagaagaagccggctacgatttttacccagacagacgacacctctccgaagagttcgatgccttatgggccgcacaggcagattatcacgaagcactctcggacgatttaagagatcaaatcaagacaattatatttcatcaaagaccactaaagacacccgaagtaggactatgcctttttacagacgaaagaaggataccaagtgcacatccactaaaccaaagaagaattttattagaaacagtcaatgcgttaaggattgtagctagaggggaagctgctaggagattaacgttagaagagagagatcaaattgtacatgctttagataataaaaatcacacaaagactttaagtggaatggcaatgaaactaaaagctcttgggaaagtgataagactacgtagtgatcaaacatttacactcgaaacagcaaatagggacgcaatagcgtgcgatcttgtaagagcaagtctttcacatccagatagaatgggaggagtatggacaaccctagatgaaggcgcacaatgggaagtggtacaaagaattagagcagttcaaagtgattccgagttcgacgctttagtagtttggttagaacagaatcatggacttgataacgcgcatgcacaagcaacagctaatgctcctttgccagaaggttatgggagaatgggcctaatggcaacccgaagaatactagctgcacttcaaagcgacgttatgccttacagcgatgcagtagctgcatgtggatggtcacactcaggaggacccaccggagaagtcttagaaaaacttccgtattatgggaaaattctggatagacatgtcataccaggcacctatgatgaaaacaatgaggatgtaaaaaggtacggtcgtataacaaatcccacagtacatataggtttaaatcagataagacggctagttaatagaataatatgtatacacggcaaaccagatgaaatagttgtagaattagcgagggatctaaagaacagtgaagaccaaaaacgagaaatacagaaaataattaagaaaaatacagacgctgcaattaaaaggggcgagaaattaataaacgaattaggtcaaaaagacaccggtgcaaatagattagtgttaagattatgggaagatttaggacatgacgttatgactagaaattgcccatactcgggcaaaagaatatcagcggggatgttatttgatggctcatgcgacgtagatcacatattaccgtactcgaggacattagatgatgggatagccaacaaaacattatgcctaaaagaggcaaacagacagaaatcaaataatacaccatgggaagtatggggcgaaaccgaacaatgggatacgatagcagccaatcttaaaaatctaccggataataaagcgtggagatttgcatcagatgctatgcaacgattcgaaggagagaacgattttagtgcaagagcactaaaagatactcagtatctaagcagaatagcgagagcctatctagatgcactatatgatggaggtgacggtaattcacatgtatgggtagtaccaggccggctcacagaaatgctaaggagacattgggggttaaacggattagaagcgttaacagactcagacgaaaatacagtaaaagctaaaaataggatggaccaccgtcatcatgcaatcgatgctgcagtagttgcagcgacagatcgaggtctaattcaaaggatatccaaaatagcaaaaagagatgaacaagcaggagcagaagaagtcgcaagatctgtgtctcctccctgggacggattcagagatgatatagcagcacaattaagtagaattattgttagtcacagagctgatcatgggagaatagatagtcaagcaaaacagcaaggagaagatgcgactgctggtcaactacatatggatacggcatatggtgtagtggacgcaggaagagtagttagccgtaaaccccttttatcgctttcggaaagtgatatcaaaaagataagggacccggatttacaaagacatctaacccgtgttactaagggactagataaaaaggagttcgaacacgcactatcagatttcgcgaacgctagaaaactaccagaccagagcgaaaatccgtattttggcatgagaagggttaggttaatagatgcattacaggactcagcacgagtatcggtaagggatagggatggacatatctataaggcatataaagcgggatcaaatcattgttatgaagtgtggagactaccagacggaaaaatcaaaccatgggcaatatcaacattcgaggctcatcaaaccggaacagaaagtaaaccgcatccagcagccaaaagattattaagagtatttaaacgagatatggttgcaatagaaagagatggagaaaccttgatgtgttacgtacagaaaatggatatagcaaacgggttattcttagtaccgcatacagaaggtaatgcggatgcaagaaacagggataaggacgacagttttaaattcatacaaatgtcggctgtttccttgataagagcaaaaattaggagaatacatgtagatgaaatgggacgacttagggatcagggacctcccagatga

SEQ ID NO: 8487 - RNA, 3216 nt, synthetic construct
  misc_feature 1..3216: note = Cas9 variant
  source 1..3216: mol_type = other RNA
atgagatacaccattggacttgatattgggatagcaagtgtaggatgggcggttataaatgaagataaaagtagaatagaggatttaggagtgagagtatttaaaaaggcagaagaacctgatggaaagtcgttaaatttagccagaagagaagcacgtggatcacgaagaagaatacgccgacgagcaacacgaatgcaaaaagtaaaagaactgttagttaaatacaacctagtttccgaaaaagaactggaaacactatatataataactgaaactacaccagacgtatatgaactacgagcaaaaggccttgatcgtcttctaagtagacaagaatttgcaagggtccttacaaacatagcgaagcgaagaggatacaaaagcaatcgaaaaatagacgaagaagacaaagaagtagggaaattatcaaaaggtaccatagaaaacaaacgaatactccaagaaaaaggatatcgaacaattggagaaatgttttacaaagatgaaaaatttgaatataacaaaaggaacaaggcgggagaatacaacagtacggtactaagatctatgcttatagacgaagtacatactttattcgaaatgcaaagaaagttcaaatcagaattcgccaacgaagaattcgaaaaagaatacgtagaagtcatgacttaccagaaaccctacataacgcccgagctcttagagaaaatgctgggaaaatgtacatttgaaaaaggagagccaagagctcccaaaaattcatacacctttgaacgctttatgctattacaaaaagtaaataatcttaacatttatataaacggcgaaaaagtagaaataccacaggaaaaaaagaaagaaataatcgaattagcctacaaacaaagtgaaataaagtacacacaactcagaaaaaaactagaactaccaatagaagcaagatttgcagacctaaattatcaaatcaaaagaacagaggatgaaagcgaagaagcactagtaaagaaaatcgaagataaaaaatttgtaaaactcgaaggatggcacaaaattcggttagcgctaaaagaaaataaagataaatttgaaaaaatcgaaaaaaaccccgaattacagaacataatagcagatgcactagtacgaaacaaaacagacgaaaccattaaaaattacttagaaaaatcagacatcgacgaagagataataaacgctatactaaacatcaacttcacaaaatttggtcatttatcatataaagccatgaacaaaataataccagaattagaaaaaggtctaacttatgataaagcatgcgaaaacgttggatatgaattcaaaggaagaaaaaatgaactccaatacaaattaccaccagtgacggaactggaagatgaaatactgaactcagtcgtactacgagccgtcagtcaaacacgaaaagttataaatgcaataatagataaatacgggagccctacagcgatctatatagaaacagcaagagaactatcaaaaccatatgacgaaaggatgaaaatagaaaaaagacaaaaagaaaatgcagcaaacaacgaccaaatcaaagaatacataaaagaaacatttggattcgacccaaaaccctttgacatagtaaaaatgaaattatggcgagaacaaaatggcaagtgcgcttatagttcgaagccaataccagccgaaagactatacgaagaaaacttcgtacaagtagatcatataatacccttttcccggtgctttgacgatagttatcaaaataaagtacttgtactaacagatgaaaaccaaaaaaaaaaagaaagaacgccctttgaatatttcggagaagataaagaaagatggcaccagtttgaagaattcgtcaatctaacatataaattcaacacacgaaagaaagagaacctacttataaaaaattttaacgaagaaaaatcaaaagagtggatacaaagaaacatcaatgatacaaaatacatttcaaaatttatgtataactacatagccaacaatctaaaatttgcagattctgaaagtaaacgaaaagtatataacataaatggacaagcaacatccatcctacgtcattattgggggctaaaaaaagacagagaagaaagcgacaaacaccacgcccaagatgcagtaattatagcgtgtgccactaacaaaaacatcaaaaaggtttccgattacagcagaagaaaattattatataaaaacaatgaaattatcgatgaagaaacaggggaaataatagataaaaaatataacatagacattagcataaaagaaccatggccaaaattccgagaagaagtcgaagctcgtatggaagacgcagacaacaacggacaattatatgcactaattaacggaaattttactaactatgacgacgtagacattacacatataaaaccaattttcacaagtaggatgcccgaaagaaaaataacaggccgagctcacaaagatacaatgagatcacagaaattcatccaacaaggacaaaacttcaccgtcgtaaagaaaccactaaaggcaatatcaaaacaagaaatagaaggaatcataaacaatccagacttcaaaaatttatacctcagcgacaaaaaactatatgatgatatctatcaaaaaatgaaagaagcagactttaaagcagaaaaagctttcgcaaacgaatatagaaaatattcgaagaatggaaactcacccatagtcagaagcataaaagtcgcgagcgccggggcaacaggcgtacaactgaaaaacggagctatagcagaaaacgcaaacatggtcagggtggacgtattcgaaaaggacaataagaactatctggtcccaatatatgtaagtgactttgcaaagaacgaattaccaaacaaagccatatgcgctaataaagacgaaaaagaatggatagaaatgacggaaaaatataaattcaaattcagtctgtaccctaacgacttagtaaaaataaaaagaaaaaacgaaaaagaattctacgcatactattgttcaactcaccgcggaacaggaaacataaatctgctactagtgaacggagaagcaagaaaagacggagtaggaataaaaaatacagaaatcttcgaaaaataccaagtagacgttctcggcaacataagcaaagtgaacaaggaaaagagagaaggagttaaatga

SEQ ID NO: 8488 - RNA, 3216 nt, synthetic construct
  misc_feature 1..3216: note = Cas9 variant
  source 1..3216: mol_type = other RNA
atggattatagaatagggctagatattggaaccaattctataggatggtccataatagaactcacaaccgtgcagagtaaattagacggcaaataccgattaaaagccgtaggcttaattgatgctggcgtacgaatgtttgacagagcagaagtaccaaaaacgggagcaagcctagcattgcctaggagattggcaaggtcatcgcgtaggagattaaccagaaggtcagcaagaaagaaagccataagaaaccttctagtcaaagaagacatactaaatcagatagaattagatcatctatatcgtacgtcagaactggtcgatatatggcaaataagagtagaaggcttagaaaggagactaggcagacaagaatgggcacgacttttaatacatttaggacaaaaacgtgggtatcggtcaactaggaaagcagaagaaggtgcagatacagaaggtagagccgtactatcttccataaaagaaaaccaagagaccttaaaacaatatagaacagtaggagaaatgtgggccactgatgacaaattcaaaggcagagtaagaaactccaccaacgagttcatctttaacgtaagccgcgataatttagaagaagaaatacgatttctctttcagcaacaaagagaactaggttcaatgtacgcatccaaattattagaagaaagttacatggaagtctggggccatcagttaccatttgcctcaggcgaaagtatactcaaaaacgtaggaacttgctcactatacgaaaaagaaaaacgagcagcaaaagctacctatacattccaatattttatggctcttgacaaactaaataatgtaagaatcctaccctcaatgagaacattatcagaagaggaacgtggacttgcacttaaagcaatgttcgaaagagataaattacctaaaaatccaccaaaattcacttattctcatctcagaaaagcaattaaactagaagaagacgaaacatttcagacaatatcttacgatgtagagaaaacgttagcaaccaacgaatcagcagtatttgtaaatctagcggcttattatcaaataaagaaagtatgtgatgaacacaacgaaaattacgactacgtggactacaacacaatagggcatgcactaaccgtatataaaactgacgaggatattaataaatacttagcaagcaaaaataacatagcaaaaagggtttacgccaatgatttcatcgatagtgtattaaaacactcatatactacatttggccatttatcattaaaggctttaagtagaattataccattaatggaagaaggtgaagtatttgcaaaagcaaaagaaaaagcaggatttaaagaagaaagctatttagaaataaaaagtaagctattaacaaatataccagatgccatcaaaaatccagtcgtaatgagaagcctgacccaagcaagaaaagttataaatgcaataataaaacgtatgggagaacagcctgcatcaattcaaatagaactagcaagagaattatcgaaagatgtttctgaaagaaagaaaataacaaatggcttcgcggagaatagatcacgaaatcaatttgccataaaaaccttagaagaaaaccatataacgaatatacgcggacaagatatagttaaattcaaattatggcaggaacaagggggaagatgtgcctatagcctaaaaccaatcaaattagaagaactcatttcattcctgaaaaaggaacgaagatacgaacacaatctagatgtagaccacataatcccgtactcaaaaacattcgatgatagttatacaaacaaagtactggtattcagtgatgagaacaggaagaaaggagaccaaatcccagcagaatacttaggaataggtacgaaacgatgggaaaaatataaagaatttgtaataacaagcaagttcccggcaagcaagaagaaacgactattaaaagaacaattagttgaaagagaagaattatttatgaaagaacggcatttaaatgacacaagatatgctagcagatatttcatgaactttctgagagaaaaccttttacgtaaagaaacagtcttacacgaaacgcagtgggtcacggcagtagcaggaagagtaacatcacatataagaaaaagactaggctttggaaaagatagagaagaaacacatctgcaccacgccttggatgcaatcatagtcgcctgcactgataaatggatgatagattgtgtaaccaactattataaaagcagagaaggcggaagcataaaacgaaaagagatcagattcccgagcccatggaatggtttctggcatgatgttcaaaccaaattggcacaattaccacaaccagaggtcataaacgaatcaatatctaaaggaaatcctgacgcagtggattacatgcttgttagtcgaatgccaaggaaatccataaccggtgcagctcataaagaaacaatatcaaaatggggaggatatgatgataagggaaaggcactattagttaagaaagtagctctatcagaacttaaattcaaaaacgatgacttcccaatgtataataaagaaactgatccactactatacgaagcaatcaaaaatagatatgtagaatcaggacgagatgtaaaaagagcttttgccacaccactttacaaaccaagtaaaagtggaaaaagaaacgaagtcaaacgagtcaaagtcatagcagagaagaaagcaatggttagagaagtaaatggaggaatagcagaaaacggcggattagttaggagcgacatattcctaaaagaaaagaaatacgttatggtacctgtatacacatttgatacaataaaacaacaactcccaaataaatacgtagtaagtggacgagggtacgaacaatggccagaattaacagcagaacacgtattccagttttcagtttatccatatgaattagtacatgtcgggacaaacaaaggggacaactcattctattattttgcatcactaaatatatccagtaacgtactcaaattttcggaatgcaatcgaccaacaaaagattatattgaaataggattaaacagtataatactattagaaaaatacgaaattgacgttttaggtcgcatcactgggcagtcaaagaaaggaataagacaaagttttaaaaataacaaatctcaaatgaaagaatga

SEQ ID NO: 8489 - RNA, 3219 nt, synthetic construct
  misc_feature 1..3219: note = Cas9 variant
  source 1..3219: mol_type = other RNA
atgaggctaggactagatataggtactaatagcgtaggttggtggctatacaaaacggacggagaggcagccagtgcaagaatcgtagaagtaattgacggaggtgtaagaatattttcagatggacgtgacccaaaaagtaaaacatcattagcagtagataggagagttgcaagagctgccagaagacgaagagatagatatctaagaaggagagctagcttgatgaaacttttagctagaacaggactaatgccagcagatcctgtagaagctaaaaagctagaaagattagatccatacgaactaagatcaacgggattagacgatgcactaccattaacccattttggtagagcactatttcacctaaaccaaagaagaggttttaaatcaaacagaaaaacagaccgaggagacaacgaaaatggtaaaataagagaggcaactgcaagactagatttagaaatgatgacgagtggggcaagatcatacggggagttcctacatatgcgtaggcagagagcaagcgatcccagacacgtaccatcagtacggacacgtttatccgtggctgcaagaggcggtcctgacgcaaaagccgaagcaggttatgatttctacccagatagacaccacctagaagaagaatttcatgcactttgggcagctcaagcaacacaccaccaggcacttactgacgatttacgagatctagtcttcgagaaaatattttaccaacgaccactaaaagaaccaaagataggattatgtctatttacagcagaagaaagaatagctaaggcacacccactaacacaaagaagagtactgttcgaaacaataaatcaattaagagtcaccgcggacggaaggtcaactaggcctttaacactggaggaacgagatacattagtgcatgcactcgacaataagaaaccaaccaaatccatgacttcaatgaatatgacattaaaagcactagcaaaacttctcaaattaagagatggagagcggtttacattagaaacaggagtgagagaaaatatttcatgcgatccagtaagagcatgcatggcacatcctgccagattcggaccacaatggagttcattagactgggaagcacaatgggacgtgatatccagagtacgtcaagtacaatccgagggtgagtttatcgaattaacagattggttaatacaaggtcacggattagacgcagatcatgcaaaagccgttggcaatgctcctctgccagaagggtatgccagacttggtttttcagcaaccgaaagaatattagatcagctaaaagcagaagtttgtacatactctgacgctgtcgctaaatgtggttggcatcatagtgaccaaagaacaggagcctgccttgaagtattgccttattatggcgaggtacttgatagacatgttattccaggaacatacgatgcaaccgatgatgagataactaggtatgggcgaataacaaatccaactgtacacatcggattaaatcagttacggagattagtaaacaaaattatagaagtacacggaaaaccagaccaaatagtagtcgaacttgcaagagaacttaaacaaagcgagccgcaaaagaaagatgcaatgaaaagattaagaaacactactgccgatgcaattagaagaagcgaacagcttgaacaactaggacagcctaacaccggacataatagaatgctactaagactttgggaagatctaggccccgcaattggtccaagatgctgtccctatacaggaaaaacaatatcggtaacgatggtgtttgacggaagttgcgatgtagatcatattctccccttttcgagaactctggacgacagttttgcaaacagaacattatgcctaaaagaagccaatagagagaaaagtgacagaactccctgggaagcctggggtggaacggaccaatgggatgatatagcagcaaacctgaaaaatctacccgagaagaaacgcaaaagatttggaccagacgcaatggaatggttcgaaggagaaaacgacttcctggaccgtgctttagtagacacacaatacttggcgaaaatatcacgaatgtatctcgataccctatttacaaaaggcggccatgtatgggttgtacccggaagaatgacagaaatgcttagaagacattggggcttaaatgctttgttaaacgataaagacagaggagctgttaaagctaaaaacagaacagatcaccggcatcatgcaatagatgcagccgtagtagcggcaactgattatcgtttaatgcagaaaataagcagagcggccggacaaggtgaaaatgcaggtcaaagcgctgaacttatagcaagagatacagatgcgccatgggaacatttcagagccgatattgcatctcaattagagaaaatcattgtcagtcatagagcagatcatggaagaatcgatgtggaaggcaggaaaacaggccgagactcaacagcaggcaggctacataacgatacagcttatggagtgatagacgatttaacggttgcatcgagaaccccactaatgtcactaaaaccaagtgatatcgcaataacagaaagaggcaaaaacataagagatccacaattacaaaacgctttatatgtagccacaaaagggaaagaaggaaaaatgttcgaacaagctctggttgactttgcatctaaagaaggtccatatcaaggtatccgtagagtacgtctagtagaaacactacaaaaagccgcgagagtcgaaatcggtaaaactgaatctggccaaccattaaaagcctacaaaggagatagcaaccattgttatgaactctggaaattaccagatggtaaaatagtgcctcaagtagtaacaacatatgaggcgcacgcaggcagcgcgccaagaccacaccctgcggcaaaaagaatcttaagagtttttaagaaagatatggtcaaactcacaaaagatggcgaagaaatcgtaggatatgtacaatcaatgcatattaaaaatggtttatttgttgcacaacatttagaagcaaatgcagacgcaaggaatagagacaaaaccgatccatttaaatttctacaaatgggagcaggaaccttggtaaaaaccggattgaggagagtattagtagatgaaatagggcgattgcgagaccctggcccaccgaaattatga

SEQ ID NO: 8490 - RNA, 3225 nt, synthetic construct
  misc_feature 1..3225: note = Cas9 variant
  source 1..3225: mol_type = other RNA
atgcaaactaaaaacctcccatatacacttggactcgatataggtatggcaagtgtaggtgccgcactccttctaccagatcaagaacgaattttagcgttacacgtaagaacctttgataaagcagaaacagctaaggagggcgagtccctaaacaaaataagaagagattcaagattaactcgtagaagaatcagaagacgagcgcatagattagtaagactcgctaggctaatgaaaagagtcgggcttatagccgatgcaaatcctgaggcatttgctttgccaggtgtatcaccatggcaccttagagcagacgggttggatcgtctacttgaacccaaagaatgggccggagttttatatcatctagtgaaacatagagggtttcaaagcaatcgaaaaagcgaagcaaaagcagatgaaaaagccggacaaatgttaagtggagtcggacgaaaccaggctctactaaaagaggcaggataccgtactgttggagaactagcagccagacatgaagatttcaaagaagcaaaacgaaacaaagggggtagttattcacatacttttgccagagcagatctaaatgcagaactaaatctcttgttcgaaagacagagagcattaggatctagactagccagtgctgactttcaagaaaacgttagagatttgcttatggcaaggagaccaacattaagcggagctaacttactaaaaatggtcgggaaatgtacttttgagaaatctgaagatcgagctccaaaagctgggtatagagcagaaagatttgtttggttgggtaaattaaataatttaaagattgttggatccggagatgctcgaccactcaccgatgctgaacatagaattgtaatagatctaccattcacacaagcaaaattaacattcaaacaggtaagaaaagccttagaactcgaaacacaccaaagatttaacctactatcatatagaccagacccaaaaggaaaagataaagatccggaagaatcaacattctttgaggcaaaaagttttcacactctccgaaaagcatacgaaggtgcaggcctaaagaaagaatggcaaagggacgcattggacccagatcgactggacgcactggcatatgcattgacgtgttacaaagatgacactgagtcaagacaatggttagttgcccaaggaattggtacaccaataattgaagcagtactcgcagaaagttttgataaatttattcatttatcacaaaaagctctaaaagcgatactaccgcatatggaagcgggacaacgctacgatgacgccgcaaaatcagcgggatatgaccattcacaaccagacgcaggcacaggtaaaagagcaacattaccaccaccagataaagatacaataagaaacccagttgtatatcgcgcacttaaccaagcacgtaaattagtaaatgcaattgtagcagagtatggaccaccagcagctgtccacatagaattagcacgagacctgtcaaaaccgatagacgaaaggagagatatagaaaaaggacaaaaagaatttcaagcactaaaagaaaagctagctgcggcatttgaagaaacttttcatagaaagccatcaggtctagatttattaaaatacagattatttagagagcaacttgaccaatgcccatattgccaaaaggccctagttgtggatagactttttgaacctggatacgctcaaatcgatcatgcattaccatattcaagatcatttgatgatggaatgaataataaggtagttgttcatgttgcatgcaatcaagacaaaggaaataggacaccatacgagttcctagacggagctggagattcagaaaggtggcaacgcttcgttgcttgggtccaaggcaacaaagctataaggcaggccaagagaaatagattactaagggtcaacttcggtacagatgaagctaaagaattttcgaaacgaaatctatccgacactagatacatatgtagagaatttaaaaggacaattgaaacacagttcgcatggcattctgatgcggaagggaatgagaggtgcgtagtattgtcaggccaactgacaagtttattaagagcacggtgggggttaataaaagttcgagaagacggtgatctgcatcatgcattagatgtagcagtcattgctgcagcgtcaagaagtctagtaaaaaggatggctgactattcaagaagaaatgaactcgaaatggtgcgaaacagatacgtagatcccgctactggggaagtcgtagacgtcgcggcactaagacaaattgaagaccattttccaaaaccatggccactattcagagaagaactactggcaagactagcacccgaaccaaaactccaattaacatgcgtatcctcttatgatgaaggtttacgggaaagtataagaccgataagagtaagtcgtgctccaaccagaagaggtctgggcgctgcacaccaagagaccataagatccttacgagatggatctcagagtgccataaagacaccattacgagatttgaacctaaaagatctagaaaatatagtaggattcgaaagagatacagctcttatagatgctataagaactaggctagaagcattcggcggcgaagggaagaaagcctttgatgataaacaacctccattaaggaaaccatcaaaagatcctgataaagctccaatcatacgatcagttaaattattagtaacgcagaaaagtggaatacctattagaggaggtatagcaaacaatggtgctatgcttagaagcgatatcttcacaaaagcaggaaaattttacgctgttccaatttatgtagcagacgcagtaagaggagaactaccccatcgagcagttgcacaagcgaaaccagaattagaatggccgatgatggacgaatcataccaattcctattcagcttacatcctaacgactggatgacgataagactcaaaaatgaggtccgagaaggttactacgcaggactagatagagcgaccggaaatatatctctctggctacacgacagaaaccaaaacgtgggacaaaaaggcttattgacaggaaacggaatcaaaacggctctggcagtagaaaaatatcatgtagatttactaggaaaattacacagagtgcataaagaagaaagacaacctatacacattaaacccggtaagcgctga

SEQ ID NO: 8491 - RNA, 3234 nt, synthetic construct
  misc_feature 1..3234: note = Cas9 variant
  source 1..3234: mol_type = other RNA
atgaaatattcaataggactagacatcggaattgcaagtgtgggatgggcagtaataaatgaagacatagaacgaatagaagatttaggagtaaggatattcgatgttgcagaacaacccaaaactggcgcatctttaagtacaccaagacgactcgctagaagtacgcgaaaacgattgagacgtaggcgacatagagtggaaagagtgcgaaaattcatgatccaaaaaggattactaacacaagttcaaatggaacaattatacgattggaaagacggtgacttagatatctggttagtaagagtcaacgcgttagaacggaaactttccgacagggaatttgcgcgaatactcgtccactttgcgaaaaacagaggcttccaaagtaacagaaaatcagaactacaagaagaagacaatggagccgtcctatccgcagtacaggaaaacaaacgattgatggaagaaaaaggctatcaaacaataagcgaaatgctattatatgacgaaaaatttgagggaacaaaaaggaacaaaggaggagaatatacacacgtagtcgccagatcagatctaaaacgagaaatccaacttatatttgaaaagcagcgtgcatatggccacgcatttgcaactatggaaaacgaagataaattcttacagatatggtccagccaaagaccatttgccaccaaagacgacatagcaaagaaaataggaaattgtacattcgaacccaaagagaaaagagccccgaaatcaacatatacatttgaaagattcagagcattagacaaacttaacaggttaagaatactgtctggaacgtcaccagcaaggagtttaacacaagaagaacgagacctaatactgaacagtctttttagtaagaaagaagtaaaatacaaagaactcagaaaattgttaaaactgaatgatgaacaaaggtttaacgaaatattctacgatccaaacgaaaagatagagaaaaacgaaaacagaacattcttaagtctagaaagccagtataaaataagaaaaatcttacagaaaatagaaggaaaaagccttaatgatacctatagaccagtagacctagatacaatagcttatgccctaacagtattcaaagacgaccaagatatacgagattacctacaaaatcaatacgtagcatctaacgggaagaaagaattaaatctagctaatagaaaatataacgacgaactaattgaagaacttctacatttatcgttcaccaaatttggtcacctaagcctaaaagcacttaggaacatcctaccatttatggaacaaggaataccatatcaccaagcatgcgaaaaagcggggtatcagttcaataagaaagtaaatagagaaaaacaaaaactcctacctccagtaccagcaaaagacatagtaaatccagtcgtaatacgctcattatctcaagtccgaaaagtaataaacggaatcataaaaagatacggatccccaagtagcatctatatcgaactagcacgtgaaatgggaagaggctacaaagaaagaaaagacttagaaaaacaatacaataaaaacagacaaatgaatgaaggagccaagaaacacatattagaactaagaccagagttcggagaccccagaggacacgatatattaaaatacaaactatggcaagaacaggactgtcgatgtgcatactcttttaaaagcataccaattaaacaattattcgaaattgggtatgctgaagtcgaccatattataccatatagccgtagcttcgacgacagcaacaacaataaagtattagttctggccgccgaaaatcaaaataaacaaaatagaacaccttatgaatggttcggacacgacgaaacaaaatggcaagaatttacaagtctagtaacaacaatgaaagtcagtaaaaagaagaaatcattgcttttaaagaaaaacttcgatgaagaacaagcagaggagttcagatcacgacacttaaatgatacaagatacataactcgatacataaaaacatttatagaagataatctacaattcagaatagaagaaggcaagaaaacgtacgtacacaccgtcaacggagcatacacaagtttaatgagaaaacgatggggctttaacaaaaaccgacaagaaaacgcattacaccacgcactggacgctgttatagtagccgtttcgctaccctttaaacataaagttcgagcctatttcaaacgcagagaagaatacgcacacaaccaattaaaaagagaaggtgagttcttccccgaaccttggccaggcttcatacatgaattagaaatacgaatgatgcaagattcagaaaacatcaaattagcaatggagtccttaaatttaaaaacatatgatgagagctttataaaagaactcaaaccaatattcgttagcaggatgccaaaacgagctatgaaaggtcaaattcacgaagaaacactcaaaagagtacgtggcagaaccgacgatggctatataagaacagttaagaaagtcaaactcgaccagataccatttgacaaaaatggtgacttcccaatgtttggaaaagaaaccgacatgaaaacatacgaagccataaaaagcaggtacctagaaagcggaaaagataagaagaaagcatttaacacgcccctatacaaaccagctaaaaacccagaaaacgcacctataataagaagcataaaaatagaagaaaaagcaaatcgtgtagttatgctagacgaaaagacggcagccgacaatgcaagtattgtaagaacagaagtatttcgacacaaagaaaccggtaactacttcctaacccctgtatatgttgctgatgttttagcaaagaaagtgccagaccgtttaataacaactaagaaaccttacagcgaatggcgaaaaataacagatgaatacgagtttctattctcattatatccaaacgacctaatacgagtgaaaatgcctaaagagaaagaaactaaaacacacaccggagaaaaacatgtatggcaagaaaattttatgtatttcaaaggagttcactcaggcagtgcaggagtacggatgatagatcacatgaacagcttcgaggacgagataggagtcagaaaattagttgttttcgaaaaatatcaagttgatccattaggaagaatgaataaagttcacggagagaaaaggcacggaatttga

SEQ ID NO: 8492 - RNA, 3234 nt, synthetic construct
  misc_feature 1..3234: note = Cas9 variant
  source 1..3234: mol_type = other RNA
atgaaatacagtataggccttgatattggtattgcaagtgttggttgggcagttataaacgaagatatcgaacgcatagaagatcttggtgttcgaatatttgacgtagctgaacaaccaaaaacgggagcttcactatccacaccaagacgtctggcgagatcaactcgcaaacgccttcgtagacgacgacacagggttgaacgagtaagaaaattcatgatacaaaaaggcctattaacacaagtccaaatggaacaactatacgactggaaagatggagacttagatatttggctagtaagggtaaatgcattagaaagaaaactaagcgatagggagttcgcaagaatcctagtacactttgctaaaaacagagggttccaaagcaacagaaaatctgaattacaagaagaagataatggagcagtcctcagcgcagtccaagaaaacaaaaggctaatggaagaaaaaggataccaaacaataagtgaaatgcttctatacgacgaaaaatttgaaggaacaaaaagaaacaaaggtggagaatatacgcatgtcgtagcaaggtctgacttgaaaagagaaatacaattaatatttgaaaagcaaagagcatacggccatgcatttgcaacgatggaaaacgaagacaaattcttacaaatatggagtagtcaacgaccattcgctacaaaagatgatatagccaagaaaatagggaactgtactttcgaaccaaaagagaaaagagctcctaaaagcacctataccttcgaaaggttcagagctttagacaaactcaatcgtctacgaatattatcaggaacctcacccgcgagaagcctaactcaagaagaaagagacttaatattgaactctcttttcagcaaaaaggaagtaaaatataaagaactcaggaaattattaaaactcaatgacgaacaaagatttaacgaaatattctacgacccgaacgagaaaatagaaaagaacgaaaaccgaacgtttctcagcctagaaagccagtacaaaattagaaaaattttacagaaaattgaaggaaaatccctaaacgacacatacagaccagttgacctagacactatagcatatgcattaactgtctttaaagatgaccaagatataagagactatctacaaaaccaatatgtagcatccaatggtaagaaagaactaaacctcgcaaaccgaaaatataatgatgaattaatagaagaattactacatctgagctttacgaaatttggacacttaagtctaaaagcactaagaaatatcctaccattcatggaacaaggaataccataccatcaagcatgcgaaaaagccggatatcaattcaataagaaagtaaacagagaaaaacaaaaattattaccaccagtacctgccaaagacatcgtcaatcctgtagtaatacgatcactaagtcaagtcagaaaagtcataaatggaataataaaacgctatggaagcccaagtagcatatatattgaactggcccgagaaatgggaagaggatacaaagaaagaaaagatctagaaaagcaatataacaaaaaccgacaaatgaacgaaggagccaaaaagcacatattagaattaagacctgaatttggagatcctagaggtcacgacatactcaagtataaattatggcaagaacaggattgtcgatgcgcctactcgttcaaaagtataccgattaaacaactgttcgaaataggatatgcagaagttgaccatataataccatacagtaggagcttcgacgacagcaataacaacaaagtgctagtactagcagcagaaaaccaaaacaaacaaaacagaaccccttatgaatggttcggtcatgacgaaaccaaatggcaggaatttacatcattagtaacaaccatgaaagtatccaaaaagaagaaatcattactactcaagaaaaactttgacgaagaacaagctgaagaatttcgcagccgccatttgaacgacacacgatacatcacaagatatataaaaacattcatagaagataacctacaatttagaatggaagaaggaaagaaacaatacgttcatacagtaaacggagcatacacatccctaatgcggaaacgatggggattcaataaaaatagacaagaaaatgacttacaccacgcgctagacgcagtaattgttgcagtatcactcccatttaaacacaaagtctcggcatatttcaaaagacgggaagaatacgctcacaaccaactaaaacgagaaggagaatttttccctgaaccttggccaggctttatacatgaactagaaatcagaatgatgcaagactcagaaaatataaaactagcaatggaatctttgaacctaaaaacatatgacgaatcatttatcaaagaactcaaaccaatattcgtatcacgcatgccaaaacgagctatgagaggacaaatccatgaagaaacactaaaaagagttagaggaagaacagatgacggatacataagaactgtaaagaaagtaaaattagaccaaattccatttgataaaaacggagacttcccaatgttcggcaaagaaacagacatgaaaacgtatgaagcgataaaaagccgatacttggaaagcggcaaagacaagaaaaaggcttttaacacacccctatacaaaccagcgaaaaacccagaaaatgcgccaattattaggtcaataaaaatagaagaaaaagcaaaccgagtggtaatgctcgacgagaaaacggcagcagataatgcctcaatagtgcgcactgaagtattccgacataaagaaaccggcaactacttcttaacacctgtatacgtagctgacgtcttagcaaagaaagtacctgacagattaatcacaacaaagaaaccatacagcgaatggaggaaaataacagacgaatatgagttcttattctcactatatccaaatgaccttatacgagtaaaaatgcctaaagaaaaaggcaccaaaacacacacaggggaaaaacatgtatggcaagaaaacttcatgtactttaaaggagtacatagcggaagtgcaggcgtaagaatgatagatcatatgaatagctttgaagacgaaataggggttaggaaattggtagtatttgaaaaataccaggtagatccactaggaagaatgaataaagtacacggcgagaaaagacacggaatatga

SEQ ID NO: 8493 - RNA, 3234 nt, synthetic construct
  misc_feature 1..3234: note = Cas9 variant
  source 1..3234: mol_type = other RNA
atgcaacaaaaaccccaaaggtatatactaggattggacctaggcatagcaagtgtaggatgggcttgcgtatgggctgacgaaaatgaacatccaacaggattactagattgtggagtaagaacatttgagagagctgaggtacccaaaacgggtgatagtttagcactagcacggagacaagctaggtccgttagacgattaattaggcgacgagcgcatagattactaagactcaggagactgctcaagcgagaaggtgtcctgctatcagccgactttaacgagaacggacttgtaagagggttaccaatagatgcatgggctttgagagtagcaggattagacagaaaactatcgaataaagaatgggcagcagttctcttacacttagtaaaacacagaggatatctaagtcaaagaaaaaatgaaacacaatccaaagataaagaattaggaagattattagcaggagtaaatggcaatagagaagcactacaaaatagatcggatgaatatcgaactgcagcagagttagcggtaaagaaatttgcagctgaaaacaatggaagcttgcgaaataaaggaggagactactcacatacatttgacagaaaagacttacaacgggaacttcacctactttttgagaggcagcgagctttagataatccttttacttcctcagaaatggaggcagcagtagatgaactactaatgaaacaaagatcggctttacaaggtgaagctgtcctaaaaatgctaggaaggtgtacatttgagccaagtgaatataaagccgcaaaaaatacatactcagccgaaaggtttgtttggctaaccaaactaaataacttaagaatacaatacaacggagaagaaagagcattaagtgaagcagaaagaagactactactagatgagccttatcaaaaagccaagctaacctacaagcaggttcgtacaatactggaattaccagaaagtgctgtatttaaagggttaagatacggccatggagaagatggattaaaagcagaatcaggtactctaatggaaatgaaagcgtatcacgccgtaagaaaggccttgaaggacgccggactagaaggagaatgggaaaatagaataagaaatccggaattactagatgcgataggaacggcgttcagtctttataaaacagacgaagacatcagagcaaacttagcagcttttcgattatccgaaaacgtactagaagcattattagcaggtttgaatttcgataaattcgtgcacctaagtttaaaagcactagctaaaatccttccattaatggaacaaggaatgaggtatgatgaagcatgtaaagaggcctacggagatcattacggagcgaaggaacaagaagaccatagactattacctccgtttgtggcagatgatataagaaatccagtagtttttcgaactctaacacaggccagaaaaatcgtgaacgaaatagtacgaagatatggatctcctttacgcgtacacatagaaacaggaagagaagttggcaaatcgtttagtgatagaaaagaaatagaaaaacgacaagaagaaaatagaaaagaaagggaaagagcggcagcacactttaaagaattatttcccaactttgcaggagaacccaaagcacaagatatattaaaactaagattatatgaacaacaacacggcaaatgtctgtatagtggtaaagaaattgatctgcgaagactaccagagaaaggatacgtagaaatagatcatgcgttaccattctcacgtacgtgggatgatagttttaataacaaagttcttgtacttggaaaagaaaaccaagataaacgaaataggacaccatatgaatatttagatggtaagggaaattctggagcttggagggcatttgcagaacgagtttcgggatgtagatttccctacgcgaaaaaacaaagactcctaacacaaaaattggacgaaaagaccgaacaaggtttcttagagcgtaacttaaacgacacaaggtatgtagcaagatttctatgccaattcatagaagaaaaaatgcacctagagggagcagggaaaaaaagagtttttgcgtcaaacgggcaaattacggctctgttaagaggcttctgggggttgaaaaaagtaagagaagaaaacgacagacaccatgcgctagatgccgttgtcgtagcatgctcatcagtatcaatgcaacaaaaaataacgagacatttcagatatagggaagaacttgaacatatagatagagaaacaggagaagtaatacacggattcccacaaccatgggagttctttagacaagaagttatgacccgagtatttagtgatgatcctgtatcagaattggcagagaaattagacagcagaccagaagctgttcatgaatttgtaacccctttatttgtttccagagcacctcatagaaaggtaacaggccaagggcatcttgagaccataagatctgcaaaaagattagatgaaaaaatttcagtggtaaaacttcccctcacccaactaaaaacaaaagatatagaaagaatcgtaggatatccaaacagggaaccagctttatatgatgccttggcagcacgattagcagcttttaaagatgatcctgcaaaagcattctcggaaccattttataaaacgggcaaagacggaaaatgcggggtattagtcaaagcagtgagagtagaaaatgtccaaaaatctgggttattagtaagaaaagacgaaagtgggaaaatgcagggagtagcggataatgcaacaatggtaagggtagatgtatttggaaaaaacggaaaaaattatcttgttccagtatatgcatggcaagttgagaaaggagagctaccaaatagagcggtagtagcatatgccgacgaagaagattgggatgaaatggatgattcgtttgagtttaagttttcactctaccctaacgatttagtagaagttgtaacaaaaaaagataagttctttgggtattactcaggatttaatagagctaccggagcaataaacataaaagaacacgatttatcaaagagcaaagttaaaaatggggtttatgaaggcataggagtaaaaacagcacaaagcttccaaaaataccaagtagatacattaggaaaaactattagattatgtaagcccgaaaaaagaatgggattcaaaaaaaaatga

SEQ ID NO: 8494 - RNA, 3237 nt, synthetic construct
  misc_feature 1..3237: note = Cas9 variant
  source 1..3237: mol_type = other RNA
atgagatacgtattgggcctagacataggaatagcatcctgcggttgggccgtcatcaaccaagaaaaagaacggatagaagacttaggagtaagaatattcgacaaagccgagaaccccaaagacggtaaatcactagcagccccacgcagagacgcacgtagtacacgtagaactctacgaagaaaaaagcacagaatgcaaaggataaaagtactactagtcaaacacggacttctatccaaaacagaattagaccacttatatgaaagcgcaacagaagtagatgtctggaatctacgacttgatgcacttgaacgaaaattataccccaaagaattcgcaagaatactaatacacttagcaaaaaggagaggcttcaaatccaacagaaaggaaaccacactatctgagaacggccaaatcctagaaagcataagcgaaaaccagcaaatcatggaaaaacaaaactatagaacagtcggcgaaatgatattaaaagataaaaagttcgaaaatcacaaacgaaacaaaaatggcacatatgtaggtactgtaaccagacagcaattacaagatgaaatacaaatgatattccacgcacaaaggctctacaaaaatgattacgcaacagaagaatttgaaagctcatatctagaaatttgggcatcacaacggccatacgcatccaaagatcaaatagaaaagatgattggctactgtaccctcgaaccaaaagaaaaaagagcacccaaggcgtcatggtctttccagtatttcgtagctcttcaaacgataaacaatctacgtttaataagcaaagacagaattgaagaactgtcatttgaagaaaaaaaacaaatcatgaatctagcgctcgaaaagtccatcgttaagtacatcgatattcgtaaactattgtccgtacctaacgaattccaatttaatagcctatcctactccgcagatactgtagataccgccgttgaaagtcgaaagtgcatagaactaaaagaataccactccattaataaagtatataaacaaatctatggcgaaaacgccttaaacttattaccaaaatattacgacactattgcctacggactaacaatattcaaagacgacaaagacatcctagagtatttgcaaaacaaatacgtaaatgcaaaaggcaaacctatttcaaactttgctaacaaaacctacgacgatacatttatccaagctcttttaaatctgaatttcacaaaaatggggcatctttccttcaaagcattgaagaatataataccattcttagaagaaggactcagctacgataaagcatgtgagaaagcaggatataactttaaaggaacgagctatacagaacaaacaaagtatctacccgtaataccacaaaatacaaatcctgtggttcaccgagctctatcacaaacaagaaaagtcattaacgctatcataaaaaaatacgggagtccaaacgcgattcatatagaaactgcaagagaactctcaaaaacatttcaagaaagaaaagaaatagattccatgtaccaagataactcaaaaaaaaacgaacacgcaatccacaagctaaaagaattaggaaatataaacccatctggaataaatattgtaaaatttaaattatggaacgaacaagatggacgatgtatgtactcaggcaaatatatagagccacatcgcctatttgaagaaggctacacggaagtagatcacattttaccatactcacgttcattagacgactcatataacaacaaaacgctcacacttggaacagaaaatcaaagaaaaggaaacaaaataccatatgaatatatgggaaatacttcaatatggaacgacttcgaaacaagagtacaatccaacaaaaaaattaataaaaaaaaacaacaaaaattattattacaacattttagctatgcgcgagagcaagaattcattgaaagaaacctaaacgatacacgttatgcaacaatatacctatcctcactcatacaacaacatctaatattctccgaatcttcaagaaaaaaaaaagtccatacagtcagtggaatcatcacaagccacctaagatcacgatggggttttaataaagaccgcaaagaaggacatatccatcatgcgctagacgctgtaatagtagcagtaacctcagaccacatgatacaaagggtcacaaaatactacaaactaaaagaattaaatcgcaacctgcaagcaaaacgaatgcccttcccagaaccctgggaaggattcagactagaactagaagcaagaatatcacccaacacacaacaatatctaaaaggtctaagattcaaaaattacgcagatgtaaatcttagtgaaatcaagtccatatttgtctctagaatgcccaaacattccataaccggagaactacaccaggaaacaataagaaaattcataggctacaatgaaaaagggaaagtattaacagcaataaaaacaaaattagaagacatacctttcgatgctaatggagattttccgatgtatggtaaagaatcagatctatatacttacaatgcaataaaagaaaggtatttatcacacaaaaaggacaaaagaaaatcatttcaagaacccctatataaaccaactaagtctggcggaataggccccttaataaaatccataaaaatcatggatacaagaacaatagtcaacccagtaaaccaaggaaaaggagtagtatacaattcaaaaatagcccgaactgatgtcttcaaaaaagaagaaaaatactacctcataccaatctacactatcgacctaatgaaaaatatattacctcaaaaagccataaccgcaggaaaaggctacgaagattggacaacaatagacccatcttttacattcctattctcactatttccaaatgatctgatacaaattgttccttctaaaaacaaaacaatcaaagcacgaacaaccgtcagcaaaaaagaagtactcctcccttctctaaccggatactttaaaggagtacactccggaacagctggaataactgtagaaacacatgatggatcagtcatagcaaacgttgggagcaagcaacttttacttatagaaaaataccaagtggacgttctaggtaactatacaaaaataaaagaagaaaaaagaataggattaaccacatacaatgacaataaaaaaattgcagcttgctga

SEQ ID NO: 8495 - RNA, 3237 nt, synthetic construct
  misc_feature 1..3237: note = Cas9 variant
  source 1..3237: mol_type = other RNA
atgaaacaacaaccccaacgatacatactaggtctcgatttaggaatagcatctgtaggatgggcactaattttagtcgacgaagaaggaaacccaataggactattggattgcggtgttagaacattcgaaagagcagaagtaccaaaaacaggagactcgttagcattagcaagaagacaagcaagaagtgtgagaagactaatcagacgtcgcgcacacaggctcttaagactacgaagactcttaaaaagggagggagttttaagcgcggccgattttaatagcgacgggctcccaaatctacctatagacacttggcaattaagagtagcaggactggaaaggaaactaacaaatcaagaatgggctgcagttttactgcatctagtaaaacatagaggatatctaagtcagagaaaatcagaaacacaaactgaaaacaaagaactaggatgtctgctagcttcagtagctaaaaattcaaaattattgtcagaaaatgcaaatcaatacagaactcctgcagaattggcagttcgactatttgcagaacagtccggacatctaagaaataaagggggagattacacacacaccttcaatcgattagacttacaaaaagaattacatcttctatttgaacaacaaagaacctttggtaacccattcgcatctgcggaactacaaagtaaagtagatggattattaatgatgcaaagatccgcgttacagggagaagccgtactcaaaatgttaggaaaatgcacttttgaaccatcagaatataaagcagcaaaacatacatattcagctgaaagattcatatggttaacaaaacttaataacctaagaatcttagaaaatggaactgaacgtgctctaaatgaagcagaacgtaaattacttttagacgagccatacaagaaagcaaaactaacctatagtcaagcgcgaaaattactagatatgagtcatgatgccacatttaaaggactaagatacggcaaagacagtgaaggtttaaacgcagagaatggtgcactaatggaaatgaaagcatatcacaaaataagaacagttctggacaaagctggtctaaaaggagaatgggaaaatagaatcagaaacccagaaatattagataaaataggcactgcatttagtttatacaaaacagacgaagacatacaagcagctctcgcagacctacgactaccagaaaatgtactgaacgctctacttgcaggattaaactttgacaaatttatacaactttcactaaaggcattatcaaacattatgccactaatggagaggggtataagatacgatgaagcatgcaaggaagtgtatggagatcaccgagctctagctgaaagcaaaaatcaaatgttattgccaccaatacctgcaaatgagatcagaaatcctgtcgtactaagaacactaacacaaaccagaaaagtaataaatgcaataattcgaaggtacggttcacctcaaagagtccatattgaaaccgcacgagaattaggaaagtcatttaaagatagaaaagaaattgagaaaagacaagaagaaaatcgaaaagaacgagaacgggcagctgaacattttaaagaattatttccgcatttcgccggtgaacctaaaggaggagacatattaaaactaaggttatatgaacaacaacagggcaaatgtttatattcaagtatacctattgatctgggaagattgaacgaaaaaggctatgtagaaatagaccacgcattacctttttctagaacttgggatgactcatttaacaataaagtattggtgttaggttctgaaaatcaaaagaaaagaaatcagaccccatatgaatacttagatggagcaagcaacagtcaaagatggagagagttccaggcaagattacaaggttgcagattctcttatgcaaagaaacaaaggatacaaaccgcaaaactagattctaaaacagaacaaggatttctagaaagaaatttgaacgatacaagatacatagcaagatttttatgcggattcatcgaagaaaacctacatttacaaggcgagggaaaaagaagagtattcgcaagtaatggacaaattactgccctactacgaggcttgtggggactaaagaaagtacgagaagaaaatgacagacatcatgccttagatgcaatagtagtagcatgttctacagtgtctatgcaacagaaaataacgaaagctatgcaaagacgcgaaactctcgagacagtagatacagaaaccggagaagtaaagaccaggataccacaaccctgggactttttccgacaagaagttatgatgagagtattttctgatacaccccatgaagaattagccgaaaaactaagtggaagacctgaggcactgcatgattttgttagccccttatttgtcagtagagcacctaatagaaaaatgacgggccaaggtcacttggaaacagtcaaaagtgcaaagcgtctctcagaaaacatatcagtcgtgagaaaaccactaactgcactcaaactaaaagatatagaaaatattgtgggataccctgatcgggaaccagcattataccaagcattaagagaaagattacaagcatacaaagatgatccggtgaaggcttttgctgaaccattttacaaaccagctaaaaatggcggacaaggaagccttgttaaggcagtcagagtcaaggatgtacaaaagacaggagtaatggtaaggaaagatagaggaggtatcgctagaggaatagctgacaatgcgacgatggtaagggttgatgttttcggtaagaaagggaaaaactatcttgtaccagtctatgcctggcaagtagctaaaggcatcttaccaaatagagctgtcgtagcatacgcagatgaagcagattgggacgaaatggatgattcttatgaatttaaatttacattatacccaaatgatttggtagaaattatatcgaagaaaggaagaatattcggttattacagcgggttaaatagagcgacaggtgcgattgacataaaagaacatgatttgagtaaagaaaaagccaaaaacggcattcaccaatcggtcggagttaaaactgtgttatcattccaaaaatatcaagtagaccctctaggaaaagaaatatgcctatgcaaagttgaaaaacaccctgaacttaattccaaaaagaagaaatga

SEQ ID NO: 8496 - RNA, 3237 nt, synthetic construct
  misc_feature 1..3237: note = Cas9 variant
  source 1..3237: mol_type = other RNA
atgggctatctaataggtttagacattggcattacctcagtaggatatgctgtactacaaacagattttaaaggaaacccttataaaatcctactaatgaacaccgtaatattcccagtagccgaagctcccaaaacaggagaatccctagctgcccccgtccgacagaaaagatcatctcgaagaactaatcgcagaaccaaattccgtaaactaagagtccaaaaattattcgtacggttcggtctactcgaatcagccgatgtagcaacattcttgaatcaaaaagtaccacaccaagacatttggcaactacgcaaagatgcattaaacagaaaactctcaaatagagagctattcgaaatcttgtacttcttcgttggccaccgaggcttcaaatcaaatagaagatctgaagtaacaggaaaacaaccaaaagacaatcaagtagttcttacttcaatacacgacaggggaaataccctcaacgacttcgattcactaggtgaaatgatgcaagagcttccagaatttaaaaccataaaacataataaagcatacagacctgacaacacaatttacccgttacgtgcttggatagaacacgaacttagcgcaattttctcggttcaacagaaaaacaataggcaaataactgacaatttcattacacaatatcttgatattttccgttcccaaagagacttcgatcaaggcccagcagcaccttccagattcggcggcaacatgatcgagagaatggtaggaccagactccctagatgcccatgaaaaacgtgctgcaaaattaaccaataccttcttcagatttaatttcctgagcaccctaaacaatctaaaaattcaactgaccttaggagctgagttccatccactcacaacaccccaaagagaaatcgtcttacaagctgctactctcaaatcactcaactacaaacaaatccgacataaactacaattgccagattcagctcgattcaacctggtaccataccaatcaaacgaagatccaataaaaacagaatcaaaacattatctcttcaaaagaaaagcccttacacaaatagaagcagttactgataacccacaactaatagataaaattggcacaatccttgcatacttcaaaggggataaaacacgccaagaaaaactatcagcactaaatcttagcagagcggaaattaaacaactacttccgatcaaccaacctggatttggcaacctatcactcaaaacaatgcataaaatccttccctatttagaacaaggacacctttatcacgaggccgcacaacttgctggttacgatttccaaaataatctggtagatcgtcaatatttacgcgacaatctcaagaaccccgtagtaaaccgagcaattggaaaaacaatcaaagtagtaaatgcaatcataaagaaatacggcgacccagacgctatacatatcgaactcactcgcgagatcaaacatagccatgaagaacgacagaaaatagcacgacaaatgaacaccaatatggaccaaaatgacaaagtagcagaacacctaagagaaaacggtatccctgtaaatggacaaaacataataaaaagtaaactattttacgaacaaaaaggaatagacctttattccggacaacaaattaacgaacaagatctttatactgaagatcactaccaagtagatcacattataccctattcaatatcattcaacgactcattcaccaacaaaacagtaactcgaacctcaaacaaccaaaacaaagctaacagactgccattagaatacctatcagaagaaaaacaagatgccttccgagcaagagtaatgtctaatataagcaactacagaaaaagacaaaatctactaaaggaaggtataactgaagacaatcgtcaacaatggaaaacaagaaatattaatgacactggttacataaatcgattactttctcaatacctacgaaacaacgtacaatttacaaagaaatcacataacccagtatttaccgttaacggcgcaacaactgcttatataagaaaaagatatggaatcattaaaaatagacaggcaaccgacttgcaccatgcagtagacgcagtcataataggctgtatctccaacacattcgtttcaagattagcaaaatactcagaagctcaagaagcacgctatcataaacaattatggcaaatcacacaataccgccaagaacataaagacctctccactatagaatatcaggaactaatcaaacaattccccttaccctggcctgacttcagacacgaacttatggcgagattatctaccgaccccgccaaaatgatggcccaccatacctgggaacactatacagatgaagaaatatcccagctaaaacctgccttcgtaattagaagtgctaatcacaaagtaacaggcagtgcacacgacgataccatctacagtaagaaactttacgaccaacgtggagtcggcctactacgaacatccctccaaaacttaaaatacgattccaagaaagacggaatcaaaaattacgagagactaaaagacggtagtaacagtctagtatacgattcacttttacgcgcactaaaagaacatgacggtaacgcaaagaaagcctttccagacaaccaactacttatatcaaccggaaaccatcaacaaataataacacatgtaaaaactgtcaagaaaattacacatcccatagaggtaaacagagacactgctattgccataggaggtagaatgataagagtagacatattcaaacaagcaaaagcccaaaaactcataggcataccagtctatgttaacgatactgtaaaaccaacattaccaaacagagcctgcacatctggaaaacgatattctgattggtaccaactaacacgccaagatcaattcctctgttctctagtctccaacgacttagtactcgtagaaacggcttcgccactcaaagtaacaaacaacataaccaacgaagaagttcaaaccactcaactattatgttatttcagttccttcaacatcgcaaacgcacaaataaacttccactcaataaataatgatagctcaatcaacccaattgtcttaaataaagtcacctatctgactaaatatcaactcgactatttaggcaattatttcccagtaaaacacgaatcacgtaaaacattcaatcgaaaaaggtga

SEQ ID NO: 8497 - RNA, 3237 nt, synthetic construct
  misc_feature 1..3237: note = Cas9 variant
  source 1..3237: mol_type = other RNA
atgcataccagactagctttggatataggaacaacaagtatcggatggatcctatatgaattagttaacggtcaaccagcatctatattggacggcggtactcggatattctctgatggcagagaagcaaagactggacactctctagcagtaggaaggagaactgctcggggaatgcgaagacgaagagatagatacctaagaaggagagcagcactcatgaaaagattagcagcaatagggctaatgccagaatcacccgaagcagcagcacaacttgctactttagacccatacgaacttagagccagaggattagaccaccccttaccgccggaacacctggggagagcactatttcatttaaaccaaagaagaggattcaaatccaatagaagaacagataaaggaaataatgaaggagggatgatagccgacgccagcgcaagactcgaacaagcaatgatggcagcaggcgcacgatcttacggagaatttttacataaacggagagcagaagcaacagcaccaagagcgacaccagctgtacgaacacgtattaacccacatctaacaggggaagacggaaaagaacaacctggatacgatttctaccctgacagaaaacacttagaagacgaatttcaccgtttatgggaagcacaagccaggcataacccagatctcacaccagcaatgggagacctgttattccaaacaatttttcatcagcgaccattaaaagcaccagcagtaggaagatgtttgttcttagacgaacctagactaccaaaagctcatcctttaacacaacaaaggacattgtatgaaacagtaaacatgctgagaatcgcacctccgggacaaccaaaacgaagacttagtagagttcagagggatcaaattgtccatgcacttaacaacagaaaaatattagcaagtccagggaaaaacgtactaacattagcagctattggcaaattattaaaattaagacctggagaagccttcagtctagacacagcgaatagggacgctatagcgtgtgaccctgtgagaatgtcactcgcatatgaaggaagatttggtccccaatggagcgcattaagcgtagaaagccaatgggaactaatacaaagattacgagacgaccaagacggagcagcacttgtggattggattatggacagatacggatttgatagagatagagcaagagctatagcagacgctcccctaccagaaggattcggaagactaggagaaacagcaacaagagctgtgttagccgtgcttatcggaggaactacagaacaagaagttctaacatattcagaggcagtagccgcttgtggatgggaccacagccgactggggaccggagaagtattagacaggttaccctattacggtcaagtacttgacaggcatgttctgccaggcaccggtaggcctgaagacgatgaaataactagatttggcagaataacgaaccctacggtacatataggattaggtcaagtaaaaagacttgtcaacaaggtaatagacgcatggggacgaccgcatgagatggttgttgagctagcaagagatctaaaaatgagcgaagatcaaaaacgcaatcttgctaaggtaaacgcacaaaaccagagggcagccgaaatgagatccgctaaacttattggagatctaaaaatcgaagataacgggagaaatagaggaatactaagagtatgggaagagtcagcagcagatgtattacacagatgttgcccttatacaggagcacaaataagtgcttcaatgctctttgatggaagctgcgacatagatcacatattaccatactcaagaacactagatgatggtttcaataatagggttatttgcttgaaatccgcgaatagagagaaaagaaatttgactccatgggaagcatggggaaacacacccaaatgggcagctatcgaagccaatcttaaaaatttaccacccgcaaaggcctggcgtttcgcgcccgatgccatgttaagatatgaaggtgaaagagattttacagcaagagctttagtagacacgcaatacttaagccgattagcgcgagaatatttagaatgtttatacgcagaagatattgaccctggacctcattcaggaaagaaacccaggagaccaatctgggtagtaacaggaaaattaactgaactattgagaagacattggggcttaaattcattactacctgatgcacatcgaggtacagcgaaagccaaaaatcggctagatcacaggcaccatatgatagacgcagctgtcgtaggagcaacggatcatgcaactgtacaaaggatagcaaatatggcaaaaggcaatgtagaaaatggtctagaagatcttgcaggtaccatactaccaccctggccaggtttacgagacgatctaaaagcaaggcttgaaagaacgatagtctcccacagaggtaaccacggtgcaatagacccagctgcgcgaaaacaggggagagatacgactagcggacaactgcataatgacactgcttacggacttacaggagaaacattaaaaggggtaccattagtagtaaaccggaaaccaatagacatgttaacaccagctatgatagacaaaataagggatccgcatctatcgaggtggttgacagcagtgacaaaaggaaaagaaggaaaagatttcaaagcagctgtagaagcctttcgagcacatcccgggccttacaggggaatcagaagagttcgtctaatagaaccggttgaagtgataagaataaaagatagaaacggccgaccatataaaggatacaaaggagactcaaaccaatgctacgaagtatggtgcctgccagacagaaccctaacacaccacgtcgtaagtacatttgcagcccatcaaggtcaaaccggaaaaccccacccggctgcgaaacgcctagcaagattgtataagggtgatatggtgcgactggacagatctaaatttggcagcgttattgccacagtagaaaagtttgacagaaacggacaattagaattagtaccacataatgaaggaaatgcagaccaaaggtataggaaagataaatctgacagtgttttcatcaggcttcgagcagcaacattcatcgcaagcggcgcgaggagagtcatagtagatgaaatgggaagaataagagacccgggtccaggtaaacattga

SEQ ID NO: 8498 - RNA, 3240 nt, synthetic construct
  misc_feature 1..3240: note = Cas9 variant
  source 1..3240: mol_type = other RNA
atgaaatacggaataggactagactgcggcatcaactcagtgggatactgcatcatggaattaaacagcgatgacgaacctaaacgaatcgttcggctaaatagtagaattttcaccgaagctgaaaatcctaaagacggaagttcactggcagcccccagacgcgaagctaggggacttagaagacgtatccgaagacataaacacagattagaaagaataagagcattattagtaagggaaaacatagttacacaagccgaattagacaacatgttctcaggtacattatcagatatttatgaactcaggacagcggcactggacgctcccctaaataacattgaattcgcacgggttttgataaatcttgcacaaagacgaggatttaaatctaaccgcaagtcagaaaaaagttccagcgataaagaaactggcaaattgctatcggccataaaaaaaaacaaagaatcaatcgaagccggaggatacagaacagttggagaaatgctattcaaggatgaaagatatgctaaacacaaaagaaataagggcgaagcatatctaaacaccgtgtcgagagacatgatcgaagcagaaattcatgcagtctttgcgtcccaaagaaacttcggaatgccattcgcaaatgaaaaaatagaaaatgaatatacagatatagctttaagtcagagacccttcgatctaggaccaggagaaggaccagaaaactgtaaatctccttatgcaggcaaacaaataaaaaatatgataggacaatgtacattttttccagaagaaaaacgcgccgtaaaagcatcatattcattccaactatttagtttactccaaggcattaacaacattaccctcgtttcgtcagacggaaacacctttcctctaagccaagaacaaagaaaaacactaaaagattactgctttaaaacagcaaacgtaacgtatgcttcaatcagaaaagtcctccaaataccacaagaatacacgttcaaaaacataacttacactgacgatggaatagaaaaaagcgagaaaaaaacaaaattccaacacctgaaaccataccatgaaatgaaaaaagttctgggatcagctatacaaacattaacaccagaagaactcgacgaaatcggagaaatcttcactttttacaaagatgaaacaataataataaaacaactagaggaaaccgaaatcgataaaagcctatacgatttgttactacaactaccgacattcgaaaaagctggacacataagtacaaaagcatgcaaaatgataatccctttcctagaagagggaaaaacatacgacaaagcatgcgaatgtgcaggtttaaacttcaaagcacatacaaacatgcaaaaacaaatgttactacccgcaaaatcagatgaactaaacgatgtagttaatccagtggtcagacgcgctatatcgcaaacaataaaagtcgtcaatgccattattcgagaaatgggcacaagcccaacctacataaatatagaactggctcgagaactatcaaaatctaagaaggaacgcgacgaaataaacaaaaaatacaaactaaaccaagcagaaaacgagcggttaaaaaacgaaatcatagacaatttcaaaattaaaccaaacggccaggatataattaaactaaaactatggcatgaacaagacgacggaatatgtccttatacaggggtaagaattaaatatgagaatctattcgacgatggatatgcagaaatagaccacataattccatactcattgtcttttgatgattcatttaacaacaaaattcttactacagcgacacaaaatagacaaaaaggaaaccgaataccattagagtatctaccagaatcagaaaaagacggatttcgcgtatgggtaaacagcaacatacgaaaccacagaaaaagacaaaacctactcaaagaacactttacagaagctgacaagaaagagttcaaatcaagaaatctaaacgatacacgatacctcaataaactactcttaaactatatcaacgacaacttactattcactgacttttataatggaaagaaaaagcacgtaacatcagtcaacggagcagtaactgcatatatacgaaaaagatggggaattaataaaaacagagaagacggagatttacatcatgcagtagatgcagccgtcattgcatgcgtaacacaaggtattattaatcgaattactgcctattccgcaagaaacgaagctccttacgacttaaacacagaaactggagaaataaaagaacgcttcccactgccttaccccaacttcaaaaaagagctagatgcacgaacaaccatagaagatgaaaaaagactcaaaagagtacttatgtcatttagtaactactcatacgacgatgtagagaaagcaaaaccatgtttcgtatccaggactccccaccgaaaagtaacaggtgcagctcacgaagaaacaatacgatcaggaaaagtagaaggatttacagtatctaaaactgaactaacaaaattaaaacttacgaacggtgaaattgaaggctattatgaaccagaatcagatacactactatacaacgcattactacaaagactaaatgaatttggaggagacgccaaagctgcatttgcggacgaatttcacaaacctaaagctgatggaactccggggccagtcgtgaaaaaagtcaagacaataaaaagatcctcatcaaatgtgaaagcccgcaacaaaaatggacttggagtagcagataatggatccatgataagaatagatgtattctatgtagaaaatgaaggatattacttcgtcccaatctacgtagctgacactgtaaaagaaatgccaaatgaagcatgtccgtttggcaaagacaaaaaaaaaattatgacagacgatgatttcttattcagcttataccccaatgacctaataaaaataacagcaaaaaaagacatgaagtttagcttagccaacaaagaaagtggattaccaaaaaacaaatacgccaacgaagtgcttgtctactacagcgcagccgacatttctaacgcatcaatctctgttattatgcatgacaatgcatacaaattcagaggatgcggaattaaatcattagtaaagctagaaaaatacacagtagaccccctaggaaatgtaagcaaagtaaatcgagaaaaaagaatgtacttcaaatga

SEQ ID NO: 8499 - RNA, 3240 nt, synthetic construct
  misc_feature 1..3240: note = Cas9 variant
  source 1..3240: mol_type = other RNA
atgagacttggactagatattggtacaagttcaataggatggtggttatacgaaactgatggagcaggatctgatgctagaatcacaggtgtagtcgacggaggagtaagaatattttctgatggccgagatccaaaaagcggggcctcacttgccgttgaccgcagagcagcaagagcgatgagaagacgtagagatagatatctaagaagaagggcgactctaatgaaagtcttagcagaaaccggactgatgcctgctgaccccgcggaagcaaaagcacttgaagcattagatccgtttgcattaagagcagctggactagacgagccattacccttgccgcacctcggcagagcactgttccacttgaatcaaagacgaggatttaaatcgaacaggaaaacagacagaggagacaatgaatcgggaaaaattaaagatgcaactgcacgtttagacatggaaatgatggctaacggcgcaagaacatacggagagttcttacataaacgtagacaaaaagctaccgaccctaggcatgtaccttcggtaaggacaagattgtccattgcgaatagaggaggaccagatggcaaagaagaagcagggtatgacttctacccagatcgaagacatctagaagaggaatttcacaaactctgggcagcacaaggagctcatcatccagaattaacggaaacattgagagatttattatttgagaaaattttctttcaacgaccattaaaagaaccagaagtaggattatgcttattttcaggccaccatggcgttcctcccaaagaccctagactaccaaaagctcacccacttactcaaaggagagtgttatatgagaccgtcaatcaactaagagtgactgccgacgggagagaagctagacccctaacaagagaagaaagagatcaagttatacacgcgctcgataataagaaaccaacaaagagcttaagttcaatggtgttgaaactacctgctctcgcaaaagtcttaaaattaagagacggagaaaggtttacactagaaactggtgttagagacgcaatagcgtgtgatccattacgagcaagcccagctcatccagatagattcggcccaagatggagcattttagatgctgatgctcagtgggaggtcataagccgaattagaagagtccaatccgatgcggagcatgccgcattagtggattggctaactgaagcccacggcttagaccgcgcccatgctgaagcaacagcacatgcaccattaccagatggctacggaagacttggattaacagcaactactagaatattatatcaattaacagcagatgttgtaacatatgctgacgctgttaaagcgtgtggttggcaccacagtgacggtagaacaggagaatgttttgatagactaccgtattatggagaagtgttggagaggcatgttataccaggttcatatcacccagacgacgatgatataaccagatttggtagaatcacaaatcctacagtccacattgggctaaatcagcttagaaggttagtaaatagaattatcgaaacacatggaaaaccacaccaaatagttgttgaattagcaagagatttaaagaaatcagaagaacagaaaagagctgatataaaaagaattagagatacgaccgaagcagcaaagaaaagaagcgaaaaactggaagaactcgaaatagaggacaatggacgtaaccgaatgctactgagactatgggaagatctaaacccagacgatgcaatgagaaggttttgtccgtacacaggcacacgaatcagcgctgcaatgatttttgatggatcctgcgatgttgatcacatactaccatattcacggacattagatgatagctttccaaatcgaacactatgcttgagagaagcaaatagacagaaaaggaatcaaactccatggcaagcatggggcgacacaccacattggcatgcaatagcggctaatctgaaaaatctacctgagaataaaaggtggagattcgcaccagatgctatgacaagatttgaaggagaaaatggctttttagacagagcactcaaagatacccaatatttagcaagaataagtcgatcatacctagataccctattcacaaaaggaggacacgtatgggtagttccaggaagatttactgaaatgttgagaagacattggggactcaacagtttattatcagacgccggacgtggtgcagtaaaagcgaaaaatcgaacagaccatcgacatcatgctatagatgcggcagtaatagccgcaaccgatccgggcctgcttaaccgaatatcgagagctgctgggcaaggagaagctgcaggccaatcagcagaattaatagctagagacacaccccctccgtgggaaggattccgggatgacttaagagtccgactagataggataattgttagtcatagggccgatcacggaagaattgaccatgcagcaagaaaacaaggcagagactctacagcaggacaactacatcaagaaacagcatattcaatagtcgacgatatacatgtcgccagtagaacagacctactgagtcttaaaccagcgcaattactagacgaaccaggtcgatctggacaagtaagagacccacagttaaggaaagcattaagagtagccactggaggaaaaacgggtaaagactttgaaaacgccctacgctacttcgcgagtaaaccagggccatatcaggctattcgccgtgttagaataatcaaaccactacaggcacaggctcgagtaccagtacccgcccaagaccccattaaagcataccaaggcggaagtaatcatctcttcgaaatctggagattacctgacggagaaatagaggctcaagtaataacatcattcgaagcccacaccctagaaggagaaaagcggccacacccagcagcgaagcgcttattacgagttcacaaaggagatatggttgctttagaacgggatggtagaagagtagtgggacatgtacagaaaatggatattgctaatggattatttattgtaccacacaatgaagctaatgcagatactcgaaacaatgataaatcagatccttttaaatggatacaaataggagcccgcccagcaatagcttccggcataagacgagtatctgtagatgaaattgggagacttcgagacggaggaacaagaccaatatga

SEQ ID NO: 8500 - RNA, 3240 nt, synthetic construct
  misc_feature 1..3240: note = Cas9 variant
  source 1..3240: mol_type = other RNA
atggatgaagaagccaaaatccaattatcaaaagaatcatacgaagaagaattagaatcactactggaaaaaagcggagaagaattccgtgatgtcttcttacaagcaaaaaaagtttatgatgctatattattatcagatatactctctaccaagaagcaaaacagcaaagcaaaactatcactgggaatgatcgaaagatacgacagtcataaaaaggatttagaagaattaaaacaatttgttaaagcaaacctaccggagaaaacagccattttcttcaaagacagctcaaaaaacggttatgccggctacatagacggcaaaacgacacaagaggacttttataaatttctgaaaaaagaactaaacggtatagcaggaagcgaaagattcatggaaaaagtagatcaagaaaatttcctgcttaaacaaaggacaactgccaacggagttatccctcatcaagtccatctaaccgaactcaaagcaataattgaaagacaaaagccttactatccatttttagaagaagcacgcgacaaaatgatacgtctactgactttcagaataccatattatgttggacccctggcacaaggagaagaaacttcctcctttgcatggctagaacgcaaaactccagaaaaagttacaccttggaatgccacagaagtgatagattacagtgcatcagcaatgaaatttatccaacgaatgataaactatgacacctatttaccaaccgaaaaagtacttccaaaacactccatcttgtatcaaaaatatactatattcaatgaattaacgaaagtcgcctataaggacgaaagaggaattaaacatcaattttcatcaaaagaaaaaagagaaatcttcaaagaactattccaaaaacaaagaaaagtgacggtaaaaaaactacaacaattccttagcgcgaactacaacatcgaagacgcagaaatccttggagtagataaagcatttaattcaagctatgccacttaccatgattttctcgaccttgcgaaaccaaatacggaaagagtcgcagaattgctcgaacaaccggagatgaacgctatgtttgaagacatagtaaaaatattaacaatctttgaagacagggaaatgatcaggacacaactaaaaaaataccagtcggtgttaggagacggctttttcaaaaaacttgtaaaaaaacactacacaggttggggtcgattatccgaaagactaataaatggaatacgcgacaaaaaaactaataaaacaatattagactacttaatagacgatgacgatttcccatataacagaaaccgaaacttcatgcagcttattaatgatgactcattatcctttaaagaagaactggcgaatgaactagcattagcaggaaatcaaagtctactagaagtagtagaagcactacccggatcaccagctataaaaaaaggtatctggcaaactttaaaaatagtagaagagctaattgaaatcattggctataatccaaaaaacattgtagtagaaatggcaagagaaaaccaacgtaccaaccgatcaaaaccacgattgaaagcgcttgaggaagcactaaaaagtttcgactcacctttattgaaagaacaacctgtcgacaaccaagcattacaaaaggacagattatatctgtattatctacagaatggaaaagacatgtataccggagaagctcttgacatagatcgactgagtgagtacgatattgaccatataatacccagatcattcattgtagacaacagcattgacaacaaagtacttgtaagtagtaaagaaaacagattaaaaatggatgacgtacctgaccaaaaagtggtaatcagaatgagacgatactgggaaaaactactacgagctaacttaatatcagaacgtaaatttgcttacttaaccaaactagaattgacccccgaagacaaagcccgattcatacaaagacaattagtagaaacacgacaaataactaaacacgttgcggcaatactcgatcaatatttcaaccagcctgaagaaagtaaaaataaaggaataagaatcattaccctaaaatcttctctcgtttcccaatttagaaaaacatttggcattcataaagtaagagaaatcaacaaccaccaccacgcacatgacgcgtatctaaacggagtagttgccatagctttactaaaaaaatatccaaaattagaaccggaattcgtatacgggaactacactaaattcaacttagctacagagaataaagcaacagcgaaaaaagaattctacagcaatatcttacgattctttgaaaaagaagaatactcatatgatgaaaacggggaaatattctgggataaagcaagacacataccacaaattaaaaaggtaatatcatcacaccaagtaaatatagttaaaaaagtcgaagtacaaacggggggcttctataaggaaaccgtgaatccaaaagggaagccagacaaactcatacaacgaaaagcaggatgggatgtaagtaaatacggaggattcggcagtccagttgtcgcatacgcagtcgcattcatctacgagaaaggaaaagcacggaaaaaagcaaaagcaatagaaggcataaccataatgaaacaatcactttttgaacaagatccaattggattcctatctaataaaggatactccaacgtaaccaaatttataaaactaagtaagtatacactatacgaacttgaaaatggaagaagaagaatggtagcatcacacaaagaagcccaaaaagccaacagtttcattctacccgaaaaactagtcactttattattttacgcacaacactacgacgaaatagcacacaaagagtcattcgattatgtaaacgaccacttatctgaattcagagaaatactagatcaagtaatagatttctcaaatagatacacaattgcagcaaaaaacacagaaaaaatagccgaactattcgaacaaaatcaagagagtacagttcaatcactttctcaatccttcataaatttaatgcaactaaacgctatgggagcaccagcagattttaaattcttcgacgtcataattcctagaaaaagatacccatctttaacagaaatttgggaatcaacaatcatataccaaagcataacaggacttcgagaaacaagaacacgtatggccaccctatgggatggagaacagtga

SEQ ID NO: 8501 - RNA, 3240 nt, synthetic construct
  misc_feature 1..3240: note = Cas9 variant
  source 1..3240: mol_type = other RNA
atggacgaagaggcaaaaatccagcttagcaaagaatcatacgaagaagaactcgaaagtcttctagaaaaaagtggagaagaattcagagacgtctttctccaagcaaaaaaagtgtatgatgctatccttttatctgacatactctcaacaaaaaaacaaaactcaaaggcaaaactcagtctaggaatgatagaaagatatgactcccataaaaaagacctagaagaactaaaacaatttgttaaagcaaacttacccgaaaaaacagcaattttctttaaagattcatcaaaaaatggatacgcggggtacatagacggaaaaacaacacaagaggacttctataaattcttaaaaaaagaattaaacggaatcgccgggtcagaacgcttcatggaaaaagtcgatcaggaaaacttcttactaaaacagagaacaacagctaatggagtaataccacaccaagtccaccttaccgaattaaaagcaattatagaaagacaaaaaccatattacccaagcttagaagaagctcgagacaaaatgatccgattattaacattccgaataccctattatgtaggacccttggcacaaggagaagaaacttcatcattcgcctggctagagcgcaagaccccagaaaaagtaacaccatggaacgcaacagaagttatcgattactcagcctcagctatgaaattcatacaacgaatgatcaactacgacacttacttaccgacagaaaaagttctccccaaacacagtatactctaccaaaagtacacgatttttaatgagttgacaaaagttgcatacaaagacgaaaggggaataaaacatcaattttcatcaaaagaaaaaagagaaatctttaaagaactatttcaaaaacaaagaaaagtaacagtaaaaaaactacaacaatttctctctgctaattataacattgaagatgcagaaatattaggtgtcgataaagcattcaactctagctatgccacatatcacgattttttggatttagccaaaccaaacaccgaaagagtggccgaattactcgaacaaccagaaatgaacgcaatgttcgaagatattgtgaagattctcacaatatttgaagatagagaaatgatccgaacccaattaaaaaaataccaatcagtattgggagacggcttctttaaaaagttagtaaaaaaacattatacaggatggggaaggctcagtgaacgattaatcaacggcattagagacaaaaaaactaataaaacaatccttgactatctaatcgacgacgacgacttcccatataaccgcaatagaaatttcatgcaactgataaatgacgacagtctaagtttcaaagaagaattagcaaacgaactagcattagcaggaaaccaatcactactagaagtcgttgaagcattactcggaagtccagcaataaaaaaaggaatatggcaaacactcaaaatcgtagaagaactaatagaaataataggatacaaccccaaaaatatagtagttgagatggcgagagaaaaccaaagaacgaacagaagtaaaccccgcttaaaagcactagaagaagctctaaaatcatttgactctccactactcaaagaacaacccgtagataaccaagcactacaaaaagatagactatatttgtattatctccaaaatgggaaagatatgtataccggagaagcattagacattgatagactgagtgagtacgatatcgatcacattatccctagaagctttatagttgacaattcaatcgataataaagtactagtatcaagtaaagaaaatcgattaaaaatggacgacgtccccgaccaaaaggtcgttataagaatgagaagatattgggagaaattacttcgtgcgaatctaatatcagaaaggaaattcgcataccttacaaaattagagcttaccccagaagataaggcaagattcatacaaagacaattagtcgaaacccgacaaattacaaaacatgtcgctgcgatattagaccaatacttcaatcaacctgaagaaagcaagaataaaggaataagaatcatcacattaaagagctccttagtatcacaattccgaaaaacatttggtataaacaaagtccgagaaattaacaatcaccatcatgcacatgacgcatatttaaatggagtcgtagcgatagcgttattaaaaaaatatccgaaactagaacccgaattcgtatatggaaactacacaaaattcaaccttgcaacggaaaataaagctacagccaaaaaagaattctattcaaacatacttagattctttgaaaaagaagaatacagctatgatgaaaacggagaaatattctgggacaaagctagacacatcccccaaattaaaaaggtaatatcatcacatcaagtaaacatagtaaaaaaagtggaagtccaaacaggtggcttttataaagaaactgtcaatcctaaaggaaaaccagataaactaatacaaagaaaagcgggctgggacgtatccaaatacggaggatttggtagcccagtagtcgcatacgcagtggcctttatctatgaaaaaggcaaagccagaaaaaaagccaaagcaatagaaggcataactataatgaaacaatcactattcgaacaagacccaatcggattcctctcaaataaagggtactccaacgtaaccaaatttatcaaattatcaaaatacacattatatgaactagaaaatggaagacgcagaatggtagcctcacacaaagaagcacagaaagcaaacagctttatactaccagaaaagctagtaacgctactataccacgcccagcattatgatgaaatcgcgcacaaggaaagcttcgactatgtaaacgatcatctgtcagaattccgagaaatacttgaccaagttatagacttctccaatcggtacacaatagcagctaaaaatacagaaaaaatagcagagttatttgaacaaaaccaagaaagcacagtacaatcactctcgcaatctttcatcaacttaatgcaactcaacgccatgggcgcccccgcagactttaaattttttgatgtaataattcctcgaaaacgttatccaagcttaaccgaaatatgggaaagcactataatttatcaatcaataacaggacttagagaaacacgaacacgaatggctacactatgggacggagaacaatga

SEQ ID NO: 8502 - RNA, 3243 nt, synthetic construct
  misc_feature 1..3243: note = Cas9 variant
  source 1..3243: mol_type = other RNA
atgaaaacgagtttcgcatttgatattggcactaatagtatcggatggtgtgtcctagcccttgacaacgcaaatttaccatatcgaatccttgatgcaggagtaaggatcttttccgatggtagagaaccaaaatcaggaactagcttagccgaaggaaggcgactagcaaggggaatgtctaggagacgagataggtacaaaagaagacgtaaagccgttataagaactttaattgaatatgggctaatgccagatgaccctgcagcaagacgagcactcgtggctgagacaaacgataaagcgccaggtaaaatcgcaagtgatgtatatgcgctaagagcaagagcactagatgataaactgccactccaccacataggtagagcattatttcacataaatcaacgaagaggatttaaatcaaatagaaaaacagacaaaagggacaatgatcaaggaaaaatagcaagcggaatttcaaggttaagagacaaattagctagtgaaggaatgaggacattaggagaatatctcaatcatagacaccaagccggaaactgggtaagagtacgaccctcaagagttcccggtaaagatgataaagaggaggacggttatggcttttacccagaaagagcacttcttcaagacgaatttaatgctatatggacagcacaagcagcacattatccagatgttctaactgaagagagacgaacacatctggaaacaataatatttttccaaagaccgttaaaaccagttcaagtaggtaaatgcagtttcaaccctggtgaggagcgattgccaagagcgcacccgctttttcaagagttccgattatacaaagaagtaaatgaactagaattagttgatagaaatcaagaccatcataaattatcattagatcaaagagatgctttgatagcgcaactgaaaacacagagagaagccgcatactcagccttaagaaaaactgcaagagctcctttgggcacaagatttaataaagaaactgaatcccgaactaaaatgaaaggagatgaagtcgcagctgaattatccgcaaaaactcgatttggccaagcatggattagtatgcccttagaagaacgatggataattgtcgatacacttcggagagtagaagacccattagaattaaccgcatggttagaacaacattatggtctagatggtgaacatatcgatgcaatcctagcggcaagattaccagaaggatatgggcgtttaggagaaacagcacttacagaaattctggttgaacttaaagctgcagtgatatccgaagccgaggcagctcgcagagccggctatgatcatgcacttctacaaaggggagctggattggaggctttacctaaatatcaagaagtgatagcacgtagaatacctccaggaacgggcaacccagacgacccatatgacgtagaaaaaggtagaataacaaatccaacggtacatataggactaaaccaacttcaaaaggttttaaacgcgctaatacgccgttacggaaaaccagaacaaatagcaatagaactagcaagagaattaaaattgaatgatgaacagaaaagagagaaaaatattgaaatagcaagaaatacacgagcagccgaacaaagaagtgcaaaattagtggaacttggcgtaccagacacaggttataatagagtattattaaaattatgggaagaattaaatttaagggcaccagaaaacagagtctgtatatactgtggggaaccaataaatattgaaactttattcagctcagcagtagatatagaccacatactaccgtggtctaagacactcgacgattctcaagcgaatagattagtatgtcacgtagcatgtaacagacaaaaagctaactacgccccagcagaagtacctcaatggcaaggcaggtacgatgacattttagctagagcaaatacattgccattaaataaaaggtggagatttggccgagacgcaatgaagaaattcgcagacgaagaaacatttctagcaaggcaactgacagacactcagtatttatcaagactggcccatgcatacatggctgcattatatccggatgaagaaccagatgcccaaggagtactagcaagaaagaatcacgtgcgtgtaattacaggtaggatgactgaaatgctaaggagacaatggggtctaaattcattgctagcagaccataaccagaaaaacagaaatgatcatagacatcacgctatagatgcagcagtagtaggagtaactaccagagcgttactccaaagaatagcaacagtagcaggaggacgagaagctcaagcacttgaagaaacaattggcaaaatagaacctccgtggcccgggtttagagatgaattacaagcagtaattaaaagaatagtagttagccacaaaccagatcacggtacattacctaaaccaggtcaaggaggccaaacagccggacaattacataacgataccgcatacggcttaactggagaaactgattctagaggaactccaatagtcgtaagaagaaaaccgtttacatcacttactgaaaaagatctaccatcaatacgagatagacaactagctcaagcactaggatcagccatagcaggaagatcaggaaaagaactacaagctgccttggaacaatttagagatagggatgactataaatccatcagacatgtgagagtagtggaaccattaaatgtaattccaatacgtgacggaactgggagagcatataaagcatacaaaggagacgcaaattatagatatgatgtatgggaactaccaaatggtaagtggatgcatgaagtagtcagcatgtttgatgcacatgacaggagttggacaagtgcagtacatatacatcaccctgctgctaggagagttttatcactgaaacaaaatgacatggttgcttacgaccacccacaagacggtccaactataggcagagtggttaaattttcacaatctggacagatgacgtttgccccacacaaggaagcaggagcattaaaagccagagacgctgatccagaggacagattcagatacttctataaaagtggaagtgcaatgaaagatatcggattaagacaagtaagagtagatgaaattggaagagtgttcgacccaggacctagagataaagaagccagaaatgctagaaagaagaaaagcacagattga

SEQ ID NO: 8503 - RNA, 3243 nt, synthetic construct
  misc_feature 1..3243: note = Cas9 variant
  source 1..3243: mol_type = other RNA
atggcgaaatcatttgcttttgatatgggaacgaacagcataggttgggctgtattaggattagacagcgcaggagaccctgactcaattgagggtgcgggtgtaagaatattctcagatggtagggagccaaaatcgggagcatctttagcagagggtaggcgaatagcaagaggaatgtcaaggagaagggagcgatataaagcgaggaggaaagcactaataagaacactaggtgattatggtctaatgcctttagaaagagccgcaaggagagcccttgtagcggaaacaaatgaccgatcattcggattagtcgcgcaagacgtatacgcattacgagctcgagcactcgtggaaaaattaccaccatatcacttaggacgagctctattccaccttaatcagaggcgagggtttaaaagcaatagaaaaactgacggaagagataatgagttaggtatgattgcaactggcattgccgccctagatgctcaactgaatgggaggactcttgggcaatatctacacgaaatgcgaggcgcagatccgagacagcggggacaagttagagtaagaccgcatttagaaataaatgataaaggaagagaaattgcagcttatgggttctatccacaacgagcaatgctagaaagagaatttaatgcaatatgggcagcccaagccccacatcatccagaactgttatctgaagagagacgagctcatttgtttcaagtaatattttaccaaagaccattaaaacaaccagacccaggaagatgtagttttaatccggccgagccaaggctagcaaaagcccatccactattccagagatttagattagttaaagaaatcaacgaattgagaatagttacaggttccaacagccagggagtgccactaacattagagcaaagagatattctccttactttattaagagataagaaagcatctagtttcaaaactctattagcaaaaattattaaggggcaaccagaagcacgctttaacaaagctagcgactcgagagacaaaatgaagggagatgaattagcagcgacaatgtctgataagacaagatttgggcaagcatggttcgcaatgccagaagctgaacaatggcgtataatagcaaaattacgagatatagacgatccgttagaactaaatgcatggttagaatcggaatatggtttagcacccgaacgtagggacgcagtagcgaacgcacttttacctcaaggatacggtagattaggcgaaactgcgcttagaacgatgctagactatcttgaagcagcagtaatttcagaggcagaagcagcagcgcaagcaggctatgatcacgccttagctagaagaggagcagggttagatcaacttccgaaataccaagaagtactaggcaggagaatcccacccgggtcaggtgaaccaaatgacccttatgacattagaatgggacgaatatctaacccaactgtacatattgcattaaatcaattaagaagggttgtgaatgctttaataagaaaatacggaaagccagctgagatagctatcgagttagcaagagatctaaaactttcagaagaacagaagagagaagtaaacgctacgatagcaaagaatacaagggacgcagaaaggagagcagtaagacttgctgatgaaggaatagacaacacaggacataaccgcgctttgctaaggttttgggaagaacttgcagcagatccgctagaccgagtgtgtgtatattgcggaggtggaataggagcggcatccctattcaatggcagtgtagacatagatcatatattaccatggagtcgtacattagatgatagtcgtgcgaataggattcttgtgcacaattcatgtaatcgacttaaaagaaattttgccccttttgaagtaccagaatggagggaaatctaccaggatatattggtcagagcagcaaaattacccgctaacaagtcatggaggtttgctccggatgccatggataggtttgagggggagaaagactttcttgccagacaattaacagatacacaatacctagcgagaatggcacatgaatatttagcagcattatacccagatgaggagccagatgagtggggagtattcgcgagaggaaatcatgtaagagtagtacctggaagactgacagaaatgttaagaagggcctggggtttaaatgctattttatcagacgataatcgaaagaatagaaatgatcataggcatcatgcaatagacgcggtcgtagtaggagtaacaacaagagatatgcttaataaaataagccaagcagcaggacggggagcagatatgggggcagccgacgcgctacgaagattcgacccaccatggccttcattccatcaagcagtacgtgctgccgtagaaagaatcctagtatcacatcgagcagatcacgggactttaccagggaccgacggacaaggcagcacagctggtcaattacataacgacacggcatacggcctaacaggcgaaacaagaaaaggtttagcagtcgtggtacgaagaaaaccctatttaagcctagaacctagagatatagaaacaatacgagatccacaattaagagatcacctagctacagaaacatatggactcgccggcgcggagtttaccgcagcactaaaaagactacaacaaacagataaattctatgccggaataagaagagtaagggtaacagaagcgctttcagttattccaataagagacgcaacaggtcacgcatataaagcatacaaaggtgatgccaattttcgttacgacgtatgggagcttccaaatggtaaatgggtaccggaagtaatttcaatgtttgatgcccacgacagaggatgggtgtcacaagtacatgcagcaaatccagccgcaagaagagtgctatctcttagacaaaatgatatggttgcgtaccaacaccctgaacaaggattagtgtacggaagagtagtaaaattcggccaaagcggacaaatgacgtttgctgcacatcacgaaggaggttcattaaaatctagagatgctgatagggacgatccattcaaatatttttacaaatctgctggcacaatgaaagatattgggctaagacagattagagtagatgagataggtcgtgtacaagacccaggaccccaagatcgcgattcaaaaagagtaagaaaaagtgatcggtga

SEQ ID NO: 8504 - RNA, 3246 nt, synthetic construct
  misc_feature 1..3246: note = Cas9 variant
  source 1..3246: mol_type = other RNA
atggcagcattcaaaccaaacccaataaattatattttgggcctagacataggaatagcaagcgtaggttgggctatggtagaaatcgatgaagatgaaaacccaatatgtttaatagaccttggagtacgcgtatttgagagagccgaagtaccaaaaacaggagatagtcttgctatggcaagacgacttgctagaagtgtcagacgattaactcgaagacgagctcatagattactacgcgcacgaagattactaaaaagagaaggagtattacaagctgctgactttgacgaaaatggactaataaaatccctaccaaacacaccttggcaactacgggccgcagctttagatcgcaaattaacaccacttgaatggtctgcagtattattacacttaatcaaacatagaggatacttatcacaacgcaaaaacgaaggtgagacagccgacaaagaactaggtgcattactaaaaggcgtcgcagacaatgcacacgctttacagacaggggatttcagaacaccggctaaattagcattaaacaaatttgaaaaagaatcaggacacattagaaaccaacgtggtgactatagccatacattttctaggaaagatcttcaagctgaattaaacctactttttgaaaaacaaaaagaatttggaaacccccatatatcagacgggcttaaagaaggcatagagacactactaatgacacaaaggccagcactatctggagatgctgtacaaaagatgttaggacattgcaccttcgagcctacagaaccaaaagctgcgaaaaatacatatactgcagaaagattcgtatggttgacaaaattaaacaatctacgaatattagaacaaggaagtgaacaaccactaacagatacccaaagagcaaaattaatggatgaaccatacagaaaatccaaattaacctatgcccaagcgagaaaattattaggacttgaagacactgcattctttaagggtcttcgctacggtaaggataatgctgaggcatccacgttgatggaaatgaaggcttaccacgctatcagcagggcattagaaaaagagggattaaaagacaagaaaagcccattaaatctttcgccagaactgcaagatgaaataggaactgccttttcattatttaaaacagatgaagacataacgggtagacttaaagacagagtacaacccgaaatattagaagctctattgaaacacattagctttgataaattcgttcaaatatctttaaaagcgctcagaagaatagtccctttaatggaacaaggcaaaagatataatgaagcatgtgcagaaatttacggtgatcattatggaaagaaaaacactgaagagaaaatttatttgccgcctatacctgcagatgaaatccgtaatccagttgtattacgtgctctatcacaagctcgaaaagtcataaatggcgtagttagaagatacggaagtccggccagaatacacatagaaacagctagagaagtaggtaaatcatttaaagatagaaaagaaatagagaaaagacaggaagaaaatagaaaagacagagaaaaagctgctgcgaaatttcaagaatactttccaaactttgttggagaaccaaagagtaaagacatattaaaactaaggctttatgaacagcagcacggaaaatgcttatattcaggcaaagaaatcaacctcggtagattaaatgaaaaaggttacgtagaaatagatcatgcactaccatttagtagaacatgggatgactcttttaataataaagttttagtattggggagtgaaaaccaaaataaaggtaatcagacaccatatgaatattttaatggcaaggacaacagtagagaatggcaagaatttaaagctagagtagaaacatcgagatttccaagaagcaagaaacaaagaatacttctacaaaaatttgacgaagatggattcaaagaaagaaatctaaacgacacaagatatgtcaaccgatttttatgtcaattcgtggccgaccgaatgcgattaacaggtaaagggaagaaaagagttttcgcaagcaacggacaaataacaaacttactacgaggtttctggggacttagaaaagttagggcagaaaacgaccggcatcatgcactcgacgcagtcgtagtagcatgttcaacagtagccatgcagcagaaaataacaaggttcgtgcgttacaaagaaatgaacgctttcgatggaaaaaccatagataaagagacaggagaagttctccaccagaaaacacattttccacaaccatgggagttctttgcacaagaagtgatgataagagtttttggaaaaccagatggtaaaccagaatttgaagaagcagacacacctgaaaaattgcgcacattattggctgaaaaactatcttcaagacccgaagcagtacacgagtatgtaacaccactgtttgtatcaagagcgccaaatagaaaaatgtcgggtcaaggtcatatggaaactgttaaatccgctaaaagactagatgaaggtgtaagtgtattgagagtacccttaacccaattaaaattgaaagacttagagaaaatggtaaaccgagaaagggaaccaaaattgtatgaagcattaaaagcaagattagaagcccacaaagacgatccagcaaaagcatttgcagagccattttataaatatgataaagcaggcaaccggacacaacaagtgaaagcggtaagagtagaacaagtacaaaagacaggtgtctgggtaagaaatcacaatggaattgcagataacgcaacgatggtaagggtagacgtattcgaaaaaggagataaatattatcttgttcctatttattcatggcaagtagcaaaaggaatacttcctgacagagcagtagtcgcatacgcagacgaagaagactggacagtcatagatgagagcttcaggtttaaatttgttctatactcaaatgatttaattaaagttcagctcaagaaagattcctttctgggatattttagcggattagatcgagctacaggagccatcagtttaagagaacatgacttagaaaaatccaaaggtaaagatggaatgcacagaataggagtaaaaaccgcattatcattccaaaaatatcaaattgatgaaatgggaaaagaaatacgaccctgcagactaaagaaaagacctccggttcgatga

SEQ ID NO: 8505 - RNA, 3246 nt, synthetic construct
  misc_feature 1..3246: note = Cas9 variant
  source 1..3246: mol_type = other RNA
atggctgcattcaaacctaatcccataaattatatactaggacttgacataggaatcgcatccgtaggatgggccatggtcgagatagatgaagatgaaaacccaatatgcttaatagacctcggtgtaagagtattcgaaagagccgaagtgccaaaaacaggagatagcttagccgctgcaagacgacttgcaagatcagtaagaagattaacaagacgaagggctcatcgcctactccgggctaggagactactaaaaagagaaggagttttacaagcggccgatttcgatgaaaatggactcataaaaagtctacctaacacaccatggcaattaagatcagcagctctagacagaaaactcacaccactagagtggtccgcagtactattacatctcataaaacacagaggatacctaagccaaagaaagaatgagggggaaacggcagataaagagctgggagcactactaaaaggagtcgctgataatgctcatgccctgcaaacaggagattttcgaacaccagcagaattggcattgaacaaatttgaaaaagaaagtggccacataagaaaccgacggggagattacagccacacattttcacgaaaagacctccaagcagaactggacctactattcgaaaaacaaaaagagttcggaaacccacatataagcgatgatttaaaagaaggaattgaaactctactcatgacccaaagaccagcattatcaggagacgctgttcagaaaatgttgggacactgtacttttgaaccaacagaaccaaaagcagccaaaaatacttataccgcagaacggtttgtatggttaacaaaactgaacaatcttagaattttagaacaagggtcagaaagacctttaacagatacagaaagagcaactctaatggatgaaccctatcgcaaaagtaaactgacatatgcacaagctagaaaattactagaactagacgacacagcatttttcaaaggattacgatatgggaaagataatgccgaagcatccacattaatggaaatgaaagcctaccatgcaatcagccgagcattagaaaaagaagggttgaaagataagaaatcgcctctaaatcttagtccagaactgcaagacgaaataggcacagcatttagtttatttaaaacggacgaagacattacgggaagattaaaagacagggtacagccagaaattctagaggtattgctcaaacacatatcattcgataaatttgtacaaatatctttaaaagctctaagaagaatcgttccactaatggagcaaggaaaaagatatgatgaagcatgtgctgaaatttacggagatcatgatggcaagaaaaataccgaagagaaaatttatttacccccaatcccggcagacgaaatacgaaacccggtagtccttcgagcactatcgcaagcaagaaaagttataaatgcagtggttagaaggtatggatcccctgcaagaatacatatcgaaacagcaagagaagtaggtaaatcattcaaagatcgcaaagaaattgagaaaagacaagaagaaaatcggaaagacagggaaaaagcagcagcaaaattccgggaatattttcctaattttgtgggagaaccaaaaagcaaggatatactaaagctcagactctacgaacagcaacacggaaaatgcttatattcagggaaagaaattaatttaggacgactaaatgaaaaaggatatgtagaaatagaccacgctctacccttttctaggacatgggatgactcattcaataacaaagtattagtactaggaagcgaaaaccaaaacaaaggcaatcaaacaccctacgaatattttaacggaaaagacaatagtagagaatggcaagaatttaaagccagagtagaaacttcaagatttccaagatctaagaaacaaagaattttgctacaaaaattcgatgaagaaggattcaaagaaagaaacctcaatgatacacgttatgtcaatagatttttatgtcaattcgtagctgatcacatgctactaacaggaaaaggcaaacgaagagttttcgcaagtaatggacaaatcacaaacttactgcgcggtttttggggactaaggaaagtaagggcagaaaacaatagacatcacgcattagacgctgtagtagttgcatgttcaacagtagcaatgcaacagaaaataactaggttcgtacgatacaaagaaatgaatgcatttgatggtaaaacaattgataaagaaacaggagaagtgctgcatcagaaaacacattttccgcaaccatgggagttctttgcacaagaagtaatgattagagtatttggcaaacctgatggtaagccagaatttgaagaagctgatacaccagaaaaattaagaactttattagcagaaaaactaagttctagaccagaggctgttcatgaatacgtaacaccattatttgtttcaagagccccaaacagaaaaatgtcaggacaaggtcacatggaaaccgtaaaaagcgccaagagactcgatgaaggcgtgtcagttctacgtgtaccattaacacaattgaaactgaaagatctagagaaaatggtaaatagagaaagggaacccaaactatatgaagcgttgaaagccaggctagaagcccataaggacgaccctgcaaaagccttcgcagaaccattctacaaatacgataaagctggtaatcgtacacaacaagtgaaagcagtgagagtagaacaagtacaaaagacaggtgtatgggtgagaaaccataatgggatagctgataacgcaacgatggtaagagttgatgtatttgagaaagctggaaaatactacttagtaccaatatatagctggcaagttgctaaaggaatactaccagatagagcagtagtagcttacgcagacgaagaaggctggacagtaatagacgaatcattcagattcaaattcgtattatacagtaatgatttaataaaagtacaattaaagaaagatagtttcttaggttatttttcaggactagacagggcaactggagccatatcacttagggaacatgacctcgagaaaagcaaaggaaaggatggtatgcatagaataggagtaaaaaccgccttgagcttccaaaaataccaaattgatgaaatgggaaaagaaattagactatgtagactaaagaaaagacctccagtaagatga

SEQ ID NO: 8506 - RNA, 3246 nt, synthetic construct
  misc_feature 1..3246: note = Cas9 variant
  source 1..3246: mol_type = other RNA
atgacagcattcaaaccaaatcctataaattatatactagggttagatataggaatcgcatcagtaggatgggcaatggttgaaatagacgaagaagaaaacccaatacgattgatagacctaggtgtaagggtatttgaaagggcagaagtaccaaaaacaggagattcattagcagcagcacgaagattagcaagatcagtacgaagactaactagaagacgagcacatagattattaagagcaagaagattattaaaaagagaaggtgtattacaagcagcagactttgatgaaaatggactcataaaaagtttaccaaacacaccgtggcagctaagagccgcagcgttggatcgcaagctaacaccattagaatggagcgcagtactacttcatttaatcaaacataggggttatttgagccaacgaaagaatgaaggtgagactgcagacaaagaattgggagcattattaaagggtgtagcagataacgcacatgccttgcaaacaggcgacttcagaacaccggctgaactcgcagttaataaattcgaaaaagaaagcggccatatacgaaatcaacggggtgattatagccatacgttttcaagaaaagacttacaagccgaattagtattactatttgaaaaacaaaaggaatttggtaatccacatatatccgatggccttaaagaaggtattgaaacactattaatggcacaacgaccagctttatccggagatgcagtccagaaaatgttaggttattgtacttttgaacctactgaacccaaagcagctaaaaatacatataccgctgaaaggtttatttggctgacaaaacttaacaaccttaggattctagaacaaggatcagaaagacctttaaccgacactgaaagagcaacactcatagacatgccttacaaaaacaagctcacatatgcaaaagctagggagttactgggactagacgacacggcatttttcaaaggtttaagatatggaaaagacaatgctgagtcagcaacattaatggaaatgaaagcatatcatgcaatcagacgagcattagaaaaagaagggttaaaagacaagaagtcaccactatcactaagtccagaactacaagatgaaataggaactgcattctccctgttcaagacagacgaagacataacgggaagacttaaaggatgcctccaacctgaaatattagatgctttgctaaaacacataaacttcgataaatttgtacaaataagtctaaaagccctaagaagaatagtgccattaatggaacaaggcaaacgatatgacgaagcatgtgccgaaacatacggagaccattacggagagaaaaattctgaagaaatgttatacttaccaccaataccggcagacgaaatacgtaacccagtagtactaagagcattatcacaagcacgaaaagtaataaatggagtagtcagaagatatggatcaccagctcgaatacatattgaaacagctagagaagtaggcaaaagttttaaagacagaaaagaaatagaaaaacgtcaagaagaaaacagaaaagatagggaaaaggccgcagcaaaattccgagaatacttccctaactttgtaggagaacccaaaagtaaagacatacttaaactcagactatatgaacaacaacatggaaaatgtttatattccggaaaagcaatagatataagaagactaaacggaaaaggatatgttgaaattgaccatgcactaccctttagcagaacgtgggacgactccttcaacaacaaagtattagtattaggaagtgaaaaccaaaacaaaggcaatagaactccatatgaatatttgaatggaaaagataactcaagggaatggttagagtttaaagcaagggtagaaacttcaaggttcccgcatagtaaaaagcaaagggtattactacaaaaattcgatgaaaaaggatttaaagagcgaaaccttaacgatacgagatatgtcaacagatttttatgtcaatttgtagctgatcacatgcagttaacgggtaaggggaagagaagagtattcgcaagcaatggccaaattaccaatttactaagaggtttttggggattacataaagtacgagcagaaaatgacagacaccacgctctagacgcagtggttgtagcctgtagcacagttgcgatgcaacaaaagataacatgcttcgtgagatataaagaaatgaatgcatttgatggcaaaacagtagataaagaaacgggcgaagtcttacaccagaagacacacttcccacaaccatgggaatttttcgctcaagaagtaatgatcagagtatttggaaaaccggacgggaaacctgagttcgaagaagctgatacgccagaaaagttaagagcactattggcagaaaaattaagctcaaggccagaagcagtacatgaatacgtaacaccattatttgtaagcagggctcctaatagaaaaatgagtggggcccataaagacactttaagatcagcgaaaagattcgtaaaacataatgagaaaataagcgttaaaagagtctggctgaccgaaataaagctagcagacttagaaaatatggttaactacaaaaatggaagagaaatagaattatacgaagcacttaaagcaagacttggtgcatatggcggtaacgcaaaacaagcattcgatccaaaagataatccattttataagaaaggagggcagctagtcaaagctgtccgagtagagaaaacccaggaaagcggcgttctactaaacaaaaagaatgcctatacaatcgcagataacggtgatatggtaagggtagatgtattctgtaaagtagacaagaaaggcaaaaaccaatatttcatagtaccaatatatgcttggcaagtggctgaaaatatactgcctgacatagattgtaaaggatatagaattgatgatagctacacgttttgtttttcactacataaatatgacttaatagcctttcaaaaagatgagaaaagcaaagttgaatttgcttattacataaactgcgactcaagcaatggtagattttatttagcctggcatgataaaggttcaaaagaacaacaattcaggataagcacacaaaatctagtacttatgcagaaatatcagatagacgaattaggaaaagaaatcagaccttgtagattaaagaaaaggccaccagttaggtga

SEQ ID NO: 8507 - RNA, 3246 nt, synthetic construct
  misc_feature 1..3246: note = Cas9 variant
  source 1..3246: mol_type = other RNA
atggcagcgtttaaaccaaatcccataaactatatactaggattagatataggaatagcaagcgtgggatgggcgatggttgaaattgacgaagatgaaaacccaatttgtttaatcgatttaggagttagagtatttgaacgagcggaagttccaaaaactggggacagtttagccgccgcaagacgcttagcaagatcagtaagaagactcactagaaggagagcacacagacttctacgagcaagaagactactcaaacgcgaaggcgtactacaagcagcagactttgatgagaacggccttattaaaagtcttccaaatactccctggcaattaagatctgcagcattagacagaaaattaacgcccttagaatggagcgcagtacttttacatttaataaaacataggggttatttatcacaaagaaagaatgagggcgaaactgcagacaaagaattgggagcactattaaaaggagtagctaataatgctcacgcactacaaacaggagattttagaacaccagctgaattagcgctaaacaaattcgaaaaagaaagtggacatataagaaatcaaagaggagattattctcacacattttcacgcaaagatttacaggcagaactaattttattattcgaaaaacaaaaagaatttggaaatccccacgtatcgggaggtttaaaagaaggtatagaaactctattaatgacgcaacgaccagctctttctggtgacgctgtacagaaaatgcttggacattgcactttcgagccggcggaaccaaaagccgcgaaaaatacatacacagcagaaagattcatatggctaacaaaactcaacaatctccgaatactagaacaaggatcagaacgacccctaacggataccgaacgagccacactaatggatgaaccatatagaaaaagcaaattaacctatgctcaagcaagaaaattactcggtcttgaagatacagccttctttaaagggctcagatatggaaaagataacgcagaagcctcaactttaatggaaatgaaagcatatcatgctataagtagagctctagaaaaagaaggtctcaaagataagaagtcacctttaaatctctctccagaactacaagacgaaataggaactgcgttttcactttttaaaactgatgaagatataacaggaagattaaaagacagaatacaaccggaaatacttgaagcactactcaaacacataagttttgataaatttgtacaaataagtttaaaagccctaagaaggatagtaccattgatggaacaaggaaaacgttatgatgaggcttgtgcagaaatttatggcgatcattatggtaagaaaaatacagaagagaaaatatacttaccgccaatacctgcagatgaaatcaggaatcctgtagtactccgtgctttatctcaagcgcgaaaagttataaatggtgtagtaagacgatatggtagccctgcaaggattcacatagaaacagcacgagaagtaggaaaaagtttcaaagatcggaaagaaatagaaaaacgccaagaagaaaatagaaaagatagggaaaaagcagcagctaagttcagagagtatttcccaaatttcgtaggggaaccgaaatcaaaagatatacttaaacttcgactctatgaacaacaacacggtaagtgcctgtactccggtaaagaaataaacctaggccgattaaacgaaaaaggttacgttgagattgatcacgcactacctttttcaaggacatgggacgatagctttaacaacaaggtattagtccttggatcagaaaaccaaaacaaaggaaatcaaactccctacgaatatttcaacggaaaagacaattctagggagtggcaagagttcaaagccagagtagaaacctcacgatttccacgcagtaagaaacaaaggatactcctccaaaagtttgatgaagatggattcaaagaacgtaatctcaatgacactagatatgtcaacaggtttctatgtcaatttgtagctgacagaatgcgcctcacaggaaaaggtaaaaagagagttttcgcatcaaatggacaaataacaaacttacttagaggattctggggattaagaaaggtaagagctgaaaacgaccgacatcatgctctggacgcggtggtagttgcctgtagtacagtagcaatgcaacagaaaataacaagattcgtaaggtataaggaaatgaatgcgttcgatggaaaaacgattgacaaagaaacaggagaagtactgcatcagaaaacacatttcccccaaccatgggaatttttcgcacaagaagttatgataagagtatttggtaaaccagatggaaagccagaatttgaagaagcagatacaccagaaaaactaagaactttactggcagaaaaactatcttcaagaccagaagcagtccacgaatatgttacacccctatttgtatccagagctcctaacagaaaaatgtcgggccaaggacacatggaaacagtaaaatcagcaaaaagattagatgaaggtgttagtgtgctacgcgtgccattaacacaactaaaattaaaagacttagagaaaatggtaaatcgcgaacgcgaaccaaaattatacgaagcattaaaagcaagactagaagctcataaagatgatcctgccaaggcatttgcagagccattttataaatacgataaagcaggtaaccgaacacaacaagtaaaggcggtacgagtagagcaagtacagaaaacaggagtttgggtaagaaatcataatggtatagcagacaatgcaactatggttagagtagatgtattcgaaaaagcaggtaaatattatttagttccgatatattcatggcaagttgcaaaaggtatcttaccagatcgtgctgtagttgcctatgcagatgaagaaggatggaccgtaatagatgaatcgttcaggttcaaatttgtactatattcgaacgacttaataaaagtacaattaaagaaagattcttttctaggatatttcagtggtttagaccgagctacaggtgcaataagtttaagagaacacgatttagagaaaagtaaaggaaaagatggaatgcatcgaattggagtaaaaaccgcattaagtttccaaaaataccaaatagacgaaatgggaaaagaaataagactttgtagactaaagaaaagacctcctgtcagatga

SEQ ID NO: 8508 - RNA, 3246 nt, synthetic construct
  misc_feature 1..3246: note = Cas9 variant
  source 1..3246: mol_type = other RNA
atgctaaaacgagtcttaggaatagatgtcggaatatctagcattggatgggcattactagaatttcaaggtgatatagataacaaagatcttccatctggaaaaatactcgcatctggcgtaagagtatttactcaagctgaaaaccctaaaaacggcgaaagtctagcaaaaccacgaagagatgcaagacttgcaagacgaagaacaagaagacgagctcaaagactaacagacattaaagatttgttctttaaatataaattggttacaggtataagtagaaataaaattaattccatttataaaactgaagaaaacaagaaagacccatggacacttagaaaagaagcattatacaggaaattagacggcgaagaatttgcaagagtattaactcatatagcaaaacatagaggtttcaaatcaatgcgtaaaagtgaagaagaagggagtgatacaaaagcaaaagaaactcaacgtgtactcacagaaataggcaaaaataaagatacattaaaaacaggaatatggcaaaccgctggagaaatgatagcctcaaggccgaaaggtgacgcaagacgaaacaaaactgattcctataaaaattctataagccgggaactattacaggacgaaactaaaataatcttcgaaaaacaaaggggtatgaactctcaattcacatccgcagacttagaaaaagaatattcggacatagcattccatcaagcacctatacagagtatgctaaaaatggttggaggatgtaccttcgaaaaagacgaagaaggaaaaaggctaaaaagagcacccaaaaattcctattcagccgaagtatttaccgctttaactaaaataaataacctagttctcaaaaccaaaacagcaaatataaatgaccgattcctaacaacagaagaacgaaagaaagcattagaattatgccattcaaacgctaaagtaactttcaaacaattaaggggtgaactgggactaccagaagactggatattcaacaccgttgattacgccaagaaacccaagaaaactgcagtaaaagaaaccgaacctgaaagtgcttgcttctttcaaatgagaggatacaacgaaataagaaaaagtgtgggaaaagacttatggacagaaatcagtatgaagaaagaaattctaaattcaatagtcacaacactagcaacagagaaaagcgatgaagcaataaaagcccaactcaagaaatcagaagtaccagacgaaattgcagaaaaagtactgggtctaaactttcgcggattcctacatctatccataaaagcactcgacaaaataataccatttatgatggcaggagacaaatacactgatgcatgtgacaaagcaggttacaaagaacaaatatcaggcatcaagaaaatatttttaagaaaattaaacgatgaagaaaacgaacaaataacaaatcctgtcgcaaaaagagcaatcacacaattccgaaaagtaataaatgctattattcgagaatacggaaaattcgatcaaatgaatatagaactagcccgcgatttagcaaaatcatacgatgaccgaaagaaaataaaagaaggacaagaagactttagagccgaaaaagacagagctgcccaaagatgtaaagacaacggactagacccaaattcaaaagataatttatccaaataccgattatgggaacaacaagataacggattttgcatctattgcggaaaaccaatcgaactacaacgccttgcagaacaaggttactgtgaggtcgaccacatcctcccttactcacggagtttggatgactcacaacacaacaaagtattagcacatatacatgacaaccaacagaagaaaaatcaaataccatttgaacacttcggaggtgatggaccaaaatgggaagaatttgtaggaagactaaacagtcaattcaaaaacctaccaaaatctaaactaaacagacttgttaaacgtaaatttgatgaaaaagacatggaaggatttaaagaaagaaacataaacgacacaaggtacataagccggtttatcaaaaacttcgtggaaaatcatctagagttcgcagagagtgcacaaaaacaaaaagtatttgtaagaagcggctccctaacagccttcttaagacaccaatggggactcattaagaaacgagatgaatccgacagacaccacgcgttagatgctctagtcacagcgtgcgcaacccaagcaatggtgaaatcaacagcaatcacagcacaaaagatggaatcatacaactggatcaataaagaaaaaccaagaatgcctctaccgtggctaaactttagggacgacgttcaaaaatcattagacgcagtgtttgtgagcagagcaccaagacataaagtaggcggagctgcacacaaagaaactatcagatctattagaaaatgtggagaagaaaaccttataattgagaaaaccccactcgttgatatagcgacaaaatctggcataaaacttaaagatatagagaaactatataagaaagaacaaaacagaaaactatatgaaaccttaaaagaaaggctcgaacaaaatggtaacgatccagtcaaagcatttgggaatccagacgatccagtacgcatgccaactaacgatcttacaaaaacaggccccataataaaaagcatcaaactaataacaaacaagaaatctggactaaatgtgagggcgggaatagcagacaacggagaaattgcaagactagatgtatatgaaagaaaaggaaaattctatctaatccccaactatgtagcagactttgcaaacaaagagctacccaagaaagcaatcaaagctaatacacccgaaacagaatggcccatcatagacagaaattacaatttcaaattcagtctattcaaagacgacctaatctcaataaaacaaaaactcgattcaccagaagagttctattattataaagggccagatgtatctacagcgagtataacagtcgaaagtgtagacagaaaaagactatgggaggagaaaaagaaaggaaaaatagaaaacgtatttcacacccgaataggcacaaaaacattaaaaagttttcgtaaatttaacttggacatattaggaacaaaagccccagtagaaatcaagaaagaaacatgggttggtgtcataaggaaaaacggagtcgcaaacaatacaggaaacaaagcgatgtga

SEQ ID NO: 8509 - RNA, 3249 nt, synthetic construct
  misc_feature 1..3249: note = Cas9 variant
  source 1..3249: mol_type = other RNA
atggcagcctttaaaccaaatccaatgaattacatattaggactagacattggaatcgcaagtgtaggatgggcgatggtagaaattgataaagaagagaacccgataaggttaatagatctaggggtaagagtattcgaaagagcggaagtaccgaaaacaggagatagcttagcgatggccaggcggcttgccagaagtgtacgaagattaacaagaaggagagcacatagattactaagagcaagaagactactaaaacgagaaggtgtattacaagatgcagattttgatgagaatggtctagtaaagagcttgccaaacactccatggcaattaagagcagccgctttagatagaaaactaacatgtttagaatggtccgctgtattgttacacttaataaaacataggggatatctcagtcaacggaaaaacgagggagaaactgcagataaagaattaggagccctattaaaaggagttgctgacaacgctcatgcactacaaacaggagacttcagaacccctgcagaactagcactaaataaatttgaaaaagaaagtggacatattagaaatcaaagaggagactattcacacacattctcaaggaaagacctacaggcagaactcaatttattatttgaaaaacagaaagaattttcaaacccgcacgtttcggactcactaaaagaaggaatagaaacactcctaatggcacagagacctgccttaagcggtgatgctgtacagaaaatgctaggacattgcacatttgaacccgccgaacccaaagcagctaaaaatacatatacggcagaaagatttatttggttaacgaaactgaacaacctaagaatacttgagcaaggatcagaaagacctctaaccgatactgaaagagcaacattgatggacgaaccgtacagaaaaagcaaactaacttatgcccaagcacgaaaattgcttggacttgaagacacagctttcttcaaaggattaaggtacggcaaagataatgcagaggcaccaacattaatggaaatgaaagcgtatcacgcaataagcagagccttggaaaaagaaggcctaaaggacaagaaatcaccacttaatctaagcacagaattgcaagatgaaataggcaccgcattcagtctattcaaaacagacaaagacattacaggaagattaaaagacagagttcaaccggagatcttggaagcattactaaaacatatcagctttgataaatttgtccaaataagccttaaagcattaaggagaatagttccattaatggaacaaggaaaacgctatgatgaggcttgtgctgaaatatatggcgaccactactgtaagaaaaatgcagaagagaaaatatatttacctcctatacctgctgatgaaataagaaacccagtcgtactaagagcactaagccaagcaaggaaagttataaattgcgtagttcgacgatatggcagccctgctcgaatacacatagaaacagcacgagaagtaggaaaaagttttaaagatagaaaagaaatagaaaaacgacaagaagaaaatcgtaaagatcgagaaaaagcagcagcaaagtttagagaatatttcccaaattttgttggagaaccaaaatcaaaagacatcctaaagttacgattatatgaacaacaacacggaaaatgcttatactccggaaaagaaataaatcttgttagactaaacgaaaaaggatatgtagaaatagatcacgcactacccttctcgagaacgtgggatgactcatttaataacaaagttctagtacttggctctgaaaatcaaaataaaggaaaccaaacaccttacgaatacttcaacggtaaagataactcaagagaatggcaggaatttaaagcacgagtagaaacttctagattccctagaagtaagaaacagaggatattgctacaaaaatttgatgaggaaggattcaaagaaaggaatctaaacgatacaagatatgtaaatcgatttttgtgccaattcgtagcagatcacatacttctaacaggtaaaggtaaaagaagagtgttcgcctcaaacggtcaaataactaacttattacgcgggttctggggtttgcgaaaagtaagagcagaaaatgaccgtcatcatgcactagatgctgtagtagttgcgtgtagcactgttgccatgcaacaaaagattacacgattcgtgagatataaagaaatgaatgcctttgatggcaaaacaatcgacaaagaaacaggagaagtactgcatcaaaaagcacatttcccacaaccgtgggagttctttgcacaagaagtaatgattcgagtatttggaaaaccagacggtaaaccagagtttgaagaagcagatactcctgaaaaactacgaacattgttagcggaaaaactaagtagccgaccagaagcggttcacgaatatgtcacacctctatttgtatctcgagcacccaatcgcaaaatgtctggtcaaggtcacatggaaaccgttaaaagcgcgaaaaggcttgatgaaggaataagtgtacttagagtaccactaacacaattgaaacttaaaggactagaaaagatggtcaatagagaacgagaaccaaaactttatgacgcactaaaagcacaattggaaacacataaagacaatccagctaaagcatttgcagaaccattctacaagtacgataaagctggcaataggacacaacaagttaaagccgtcagaatagaacaagtacagaaaacgggagtgtgggtacgaaatcacaatggaatagcagataacgcaacaatggtcagagttgacgtctttgaaaaaggcggaaagtattacttagttcctatttatagttggcaagtagcaaaaggaatacttccggatagagctgtagttgctttcaaagatgaagaggattggacagttatggacgatagttttgaatttagattcgtattatatgcaaacgacctgattaaattgacagcaaagaaaaatgagtttttaggttattttgttagcttaaacagagcaacaggagcaatagacattagaactcatgatacagattcgaccaaaggtaaaaacggaatatttcaatcagttggggtaaaaactgcactcagctttcagaaaaatcaaatcgatgagttaggtaaagagataagaccatgccgattaaagaaaaggccaccagttcgatga

SEQ ID NO: 8510 - RNA, 3249 nt, synthetic construct
  misc_feature 1..3249: note = Cas9 variant
  source 1..3249: mol_type = other RNA
atggcggctttcaaaccgaacccaataaattacattctaggactcgacataggaatcgcgagtgtaggatgggcaatggtagaaatagacgaagaagaaaatcctataagattaattgatctcggtgtcagagtctttgaacgagcagaagtccccaaaactggagactcactagcgatggcacgaagactcgctcgcagcgtaagaaggctcacaagacgacgagctcatcgattattacgtgcaagacgtttactaaaacgagaaggtgtactccaagcagcagactttgacgaaaatggtttaataaaatccctcccaaacacaccatggcaactaagagcagcagcactggaccgaaaactcaccccattagagtggagtgctgtattattacatctaataaaacataggggatatttatcacaaaggaaaaatgaaggcgagacagcagacaaagaattaggcgcattactaaaaggtgttgctaacaatgcccacgcgctacaaacaggtgactttagaaccccggcagaactggcactaaataaattcgagaaagaatcagggcatatcagaaatcaacgaggagattattcacatactttctcacgtaaagatctacaagcagaattaattctactctttgaaaaacaaaaagagttcggaaatccacacgtaagcgggggtttaaaagaaggaatagaaacattactaatgacccaaagacctgccctgagcggggatgcagtacagaaaatgttaggtcactgtacttttgaaccagccgaaccaaaagctgctaaaaacacatataccgcagaaaggttcatctggctaactaaattgaataatctcagaatactcgaacaaggcagcgaaagaccactaaccgatactgaaagggcaacattaatggatgaaccatacagaaaatcaaaactgacttatgcacaagcacgaaagttacttggcttagaagacacagccttctttaaaggccttagatatggaaaagataatgcagaagcaagtacattaatggaaatgaaagcataccatgcaatttcacgagcactagaaaaagaaggactaaaagacaagaaatcaccattaaacttaagtagcgagctacaagatgaaatcggcaccgcattttcactatttaaaacagatgaagacataacagggagactaaaagacagagttcaaccagaaatactagaagcattattgaaacacatcagtttcgacaaattcgtacaaattagtttaaaagcactaagaagaatagtcccattaatggaacaaggaaaaagatatgatgaagcatgcgcagaaatatatggggaccactacggaaagaaaaacactgaggagaaaatatatttaccaccgataccagcagacgaaatacgaaatccagtagtactgagagccctaagccaagcacgtaaagtcattaatggagtcgtaagaagatatggaagcccagcaagaatacatattgagacagccagagaagtaggaaaatcatttaaagatcgtaaggagatagagaaaagacaagaagaaaatcggaaagacagagaaaaggcggcagcaaaattcagagaatacttcccaaattttgtaggagaaccaaaaagtaaagacattttaaaattaagactatacgaacaacaacacggaaaatgcttgtacagtggcaaagaaataaatctggtaaggttaaatgaaaaaggatatgttgaaatagatcatgctttaccattcagccgcacttgggatgacagctttaataacaaagtcttagtgctaggatcagaaaaccagaacaaaggaaaccaaactccatacgaatatttcaatggaaaagacaattcacgtgaatggcaggaatttaaagcacgtgtagaaacgagcagatttcctcgatccaagaaacagagaatattattgcaaaaatttgatgaagacggatttaaagagtgcaatctaaatgatacaagatatgtcaacagatttttatgtcaatttgtagccgatcatatcttactaacaggaaaaggaaagagaagagtcttcgcatctaatggacaaataacaaacttactcagaggattttgggggcttagaaaagtaagagcagagaacgacagacaccacgcacttgacgcagtcgttgtagcatgctcaaccgtagccatgcaacagaaaatcacaagatttgtacggtataaagaaatgaatgcgtttgacggaaagactatagataaagaaacaggaaaagtactacaccagaaaacacacttcccacaaccgtgggaatttttcgcacaagaagttatgataagagtatttgggaagcccgatggaaaacctgaatttgaagaagcagatacacctgaaaagctgaggacattacttgcggaaaaactatcctccagaccagaagcggtacacgaatacgtaacaccattgtttgttagtagagcaccgaatagaaaaatgtccgggcaaggtcacatggaaacggttaaatcagcaaaaagactagatgagggagtttctgtactacgtgttccactaacacaattaaaactaaaagatttagagaaaatggtaaatagagaaagagaaccaaaactatacgaagccttaaaagcaagactagaagcacataaagatgatccagcaaaagcatttgccgaaccattttacaaatatgacaaagcaggcaacagaacccaacaagtaaaggcagtaagagtggaacaagtacagaaaaccggggtttgggtaaggaaccacaacggcattgctgacaatgcaacgatggtaagagtagatgtatttgaaaaaggagacaaatattatctagttcctatatattcttggcaagtcgcgaaaggcatacttccagatagagcagtagtccaaggaaaggacgaagaagactggcaactaatagacgacagtttcaattttaaattctcattacatcctaacgatttagtagaagtcattacaaagaaagccagaatgttcggatacttcgcatcatgccacagaggaacaggcaacataaatataaggatacatgatttagaccacaaaatagggaaaaacggtatacttgaaggaattggagttaaaacagctctatcattccaaaaataccaaatagatgagttaggaaaagaaatacgaccttgccggctaaagaaaagacctcccgtaagatga

SEQ ID NO: 8511 - RNA, 3249 nt, synthetic construct
  misc_feature 1..3249: note = Cas9 variant
  source 1..3249: mol_type = other RNA
atggcagcatttaaaccaaacccaataaattacattctagggttggatataggaattgcaagcgtaggctgggcaatggtagaaatagatgaagacgaaaacccaatatgcctaattgatttaggagtaagagtgtttgagagggcagaagtaccaaaaaccggggacagcttagcaatggctagaagactggctcgatcagtcagaagattaacaaggagacgtgcccacagactactacgagcacgaagactactaaaacgagaaggagtacttcaagcagctgatttcgatgaaaatggattgattaaatccctgccaaatacaccatggcaattaagagctgcagcattagatagaaaattaactccactggaatggtcagcagtattactccatctcataaaacatagaggatatctttcccaaagaaagaatgaaggagaaactgccgacaaagaattaggtgcgttgttgaaaggagttgctgataatgcacacgcattacaaacaggtgattttagaactccagcagaattagctttgaataaatttgaaaaagaaagtggacatataagaaaccaaagaggtgactattcacacactttctcgcgaaaagatcttcaagcagaactaatactcttatttgaaaaacaaaaagagttcggaaacccgcacgtaagcggagggttaaaagaaggtatagaaaccctgttaatgactcaaagaccagcactatcaggggacgcagtccagaaaatgttggggcactgcaccttcgaaccagcagagccaaaagcggctaaaaacacctatacagctgaaagattcatctggctgacaaaactaaacaacttaagaatactcgaacaaggaagtgaacgtccactaaccgacactgaaagagcaacgctaatggatgagccttatagaaaatccaaactaacatacgcacaagcaagaaaactattaggtcttgaggatacagcctttttcaaaggcttacgatatggaaaggataatgcagaagctagcacattaatggaaatgaaagcataccatgctattagccgtgcattagaaaaagaaggtttgaaagataagaaaagccccttaaacttatcacccgaactacaagacgaaataggaactgctttttcattattcaaaacagatgaagacataacgggaagattaaaagatagaatacaaccagagatattagaagcacttttgaaacatatatccttcgacaaatttgtacaaatctcacttaaagcgctgcgtagaattgtacctttaatggaacaaggcaaaaggtatgatgaagcatgcgcagaaatatatggagatcactatggaaagaaaaacacggaagagaaaatctatctaccacctatacccgccgatgaaatacggaacccagtagtattacgagcccttagccaagcaagaaaagtaataaatggcgtagtacgaagatatggatcaccagcacgaatccacatagaaaccgctagggaagtaggcaaatctttcaaagacagaaaggaaatcgagaaaagacaagaagaaaacagaaaagatagggaaaaagcagcagcaaaattcagagaatattttcctaatttcgtaggtgaacctaaatcgaaagatatactcaaactgagactttatgaacagcaacatggaaagtgcttatatagcgggaaagaaataaatttaggaagactaaacgagaaagggtacgtggaaatagaccatgcactaccattttcgaggacatgggatgactcgtttaataataaagtattagtactaggaagcgaaaatcaaaacaagggtaaccaaacaccttacgaatactttaatggcaaagacaattcaagagaatggcaagagttcaaagcaagagtagaaacatcaagattccctcgatcaaagaaacaacgcatactactacaaaaattcgacgaagatggatttaaagaaagaaacctaaatgatacaagatacgtcaatagatttttatgccaatttgtcgcggatagaatgagattaactggaaaagggaagaaaagagtgtttgctagcaatggacaaataacaaacttattacgcggattttggggacttagaaaagtaagagcagaaaatgatagacatcacgcccttgatgcagtagtagttgcatgttcaacagtagccatgcagcaaaagataacgaggtttgtaagatacaaagaaatgaacgcctttgacggaaaaactatcgataaagaaactggagaagtattacatcagaaaacacactttccgcaaccgtgggagttcttcgcccaagaagtgatgatacgagtttttggaaaaccagatggaaaaccagagttcgaagaagctgatacaccggaaaaactcaggacactattagcagaaaaattaagttcaagaccggaagcggtacacgaatatgtaacacccctatttgtcagtagagctcctaatagaaaaatgagtggacagggacacatggaaacagtaaaatcagcaaaacgactggatgaaggcgtaagcgtactaagagtaccactaacccagctaaaacttaaagacttagagaaaatggttaatagagaacgagaaccaaaattatatgaagcgctaaaagcaaggttagaagcacataaagatgatcctgcgaaggcttttgcagaacccttttacaaatacgataaagcagggaaccgaactcaacaagtgaaagcagtgagggtcgaacaagtacaaaagactggagtatgggtaagaaaccacaatggaatagctgacaacgccactatggtaagggtagatgtatttgaaaaaggagataaatattacctagtcccaatatattcatggcaagtcgctaaaggcattttaccggaccgagccgtagttcaaggtaaagacgaagaagattggcaactaatagatgacagttttaacttcaaattctctttacatccaaacgatctggttgaagtcataacaaagaaagccagaatgtttgggtatttcgcatcctgtcatcgggggacaggaaatataaatatacggatacatgacttagatcataaaattggtaaaaatggtattctagaaggaattggagtaaaaacagcactcagctttcagaaatatcaaatagacgaactaggagaagaaataagaccatgtcgactaaagaaaagaccaccagtcaggtga

SEQ ID NO: 8512 - RNA, 3249 nt, synthetic construct
  misc_feature 1..3249: note = Cas9 variant
  source 1..3249: mol_type = other RNA
atggccgcatttaaaccaaacccgataaactacatattaggactagacatcggtatagcaagcgtgggatgggccatggtcgaaatcgacgaggacgaaaatccgatatgcttaatagatctgggagtaagggtatttgaaagagctgaagtaccaaaaacaggggatagtctagcgatggcaaggcgattagcgcgatcagtaagaagactaacaagaaggagagcacacagactcttaagagcccgaagactattaaaacgtgaaggggtgctacaagcagcagactttgatgaaaacggcctaattaaatcgctcccgaacactccttggcaattgagggcagcagcactagaccgaaaactaacccccttagaatggtctgcagtgctacttcatctaatcaaacatagaggatatttatctcaacggaaaaacgaaggagaaacagcagataaagagttaggagcacttttaaagggtgttgcagataatgcgcatgcactccaaactggtgattttagaacgcctgcagagcttgcacttaacaaattcgaaaaagaaagtggtcacataagaaatcaaagaggtgattactcccatacattttcaagaaaagaccttcaagccgaactaatattactattcgaaaaacaaaaagagttcggaaacccacatgtatcaggaggacttaaagaaggcattgaaacactattaatgacacaaagaccagcattatcgggagacgcagtacagaaaatgttaggacattgcactttcgaaccagccgagcctaaagcggctaaaaacacgtacaccgcagagagatttatttggctaactaagctaaataacctaaggatattagaacaaggcagcgagcgacccttgaccgatacagaacgtgcaacacttatggatgaaccatacagaaagtcaaaacttacgtacgcacaagctcgaaaactattaggattagaagacacagcattctttaagggtctcagatatggtaaagacaatgcagaggcctccacattaatggaaatgaaggcttatcacgcaatatcacgagccctagaaaaggaaggattaaaagataagaaaagcccactaaacttaagtccagaattacaagatgaaataggaacagcgttcagtctatttaaaactgacgaagatataacaggaagattaaaagatcgaatacaaccagaaattttagaagccctcttgaaacatatttcatttgataaatttgtccaaatatcattaaaggctttacggagaattgttcccttaatggagcaaggaaaaagatacgatgaagcatgtgcagaaatttacggtgatcactacggaaagaaaaatactgaggagaaaatatatctaccaccaataccagcagatgaaatacgtaaccccgtcgttctaagagccttatcacaagcaagaaaagtgatcaatggagtagtacgaagatatgggtccccagcgaggatacacatagaaactgcaagagaagtaggtaaaagttttaaagaccgaaaagaaatagagaaaaggcaagaagaaaataggaaagacagagaaaaagcagcagccaaattcagagaatactttccaaatttcgtaggagaaccaaaaagcaaagacatccttaaattaagactctatgaacaacaacacggcaagtgcctttactctggaaaggaaataaacctaggacgcttaaatgaaaaaggatacgtcgaaatagaccacgcattacctttctctagaacatgggatgactcatttaacaataaagtattagtacttggctcagaaaatcaaaacaaagggaaccaaacaccctacgaatattttaatggtaaagacaactcaagagaatggcaagaatttaaagccagagttgaaacgtcacgatttcccagatcaaagaaacaaagaatactgctacaaaaatttgacgaagatggttttaaagaaagaaatcttaacgatactagatatgtaaatagatttttgtgtcaatttgtggcggatcgaatgagacttacaggtaaaggtaagaaaagagtatttgcttctaacggtcaaataacaaatcttttgcgtggcttttggggtctcaggaaagtaagagcagaaaacgaccgacaccacgccctcgacgctgtcgtagtagcttgctcaacagtagccatgcaacagaaaataacacgatttgtccgttacaaagaaatgaacgcatttgacggaaaaacaatagataaagaaacaggcgaagtactacatcagaaaacccattttccccaaccttgggagttctttgcacaagaagtaatgataagagtctttggaaaaccagacggaaaaccagagtttgaagaagcagatacaccagaaaaattaagaactctcctagcagaaaaactatcaagcagaccagaagcagtacacgaatatgttacaccattatttgttagcagggcacctaatagaaaaatgtcgggccaaggacacatggaaacagtaaaatctgctaaaagattagacgaaggagttagcgtacttcgagttcctttgacacaactcaaacttaaagacctcgagaaaatggtaaacagagaacgagaaccaaaactatatgaggctttaaaagctagactcgaagcacataaagacgacccagctaaagcatttgcagaacccttttacaaatacgataaagcaggaaatagaactcaacaagtaaaagcagtacgagtcgaacaagttcaaaagactggagtttgggttaggaaccataatggaatagcagataatgcaactatggttagagtagacgtatttgaaaaaggagataaatattatctagtacccatatattcatggcaagtagcaaaaggtatactcccagatcgagctgttgtacaaggcaaagacgaagaagactggcaactaatcgatgatagttttaatttcaaattctcccttcatccaaacgatttagttgaagtaataacaaagaaagcacgaatgttcggctactttgcttcatgtcatagaggaacaggcaacattaatataaggattcatgacctggaccacaaaatagggaaaaacggaatattagaaggaataggagtaaaaaccgcactatcttttcaaaaataccaaatagacgaactaggaaaagaaataagaccatgtagattaaagaaaagaccaccagtaagatga

SEQ ID NO: 8513 - RNA, 3249 nt, synthetic construct
  misc_feature 1..3249: note = Cas9 variant
  source 1..3249: mol_type = other RNA
atggctgctttcaaaccaaacccaattaattacatattaggcttggacattggcatagcgagcgtcggatgggctatggtagaaatagatgaagatgaaaatccaatatgtcttatagatctaggggtacgagtattcgaaagggctgaggtgcctaaaacgggcgattcactggcagcagcaagacgattagctagatcagtacgacgtttaacgcgaaggcgtgcacatcgattacttagagcgagacgattgttaaaaagagaaggcgtactacaagcggcagattttgatgaaaatggtttaatcaaatcgctcccgaatacaccgtggcaattaagggcagctgcattggacagaaaattaacacctcttgaatggtcggcagtattgctacatctaataaaacatagaggatatctaagccaaaggaaaaacgagggagaaacagcagataaggaattaggcgcactcttaaaaggggtagcagacaatgcacatgcactacaaactggagatttcagaacgcccgcagaacttgcactaaataaattcgaaaaagaaagcggccacataagaaaccaaagaggagattattcacacactttctcaagaaaagacttacaagccgaacttatattacttttcgaaaagcaaaaagaatttggaaatcctcatgtatcaggtgggctaaaagaaggaatagaaacactattaatgactcaaagacctgccctatcaggagatgctgtacagaaaatgttaggtcactgtacgtttgagccagccgaaccaaaagctgccaaaaatacctatacagcagaaagatttatatggctaacaaaactaaataacctcagaatccttgaacaaggatcagaaagaccactaacagacactgaacgagctacgctaatggatgaaccttacaggaaatcaaaactaacttatgcacaagctagaaaacttttaggtctagaagacacagcgttctttaaaggattacgatatggaaaagataatgcagaagcatcgacactaatggaaatgaaagcctaccatgcaataagtcgcgctctagaaaaagaaggactcaaagataagaaatcacccctgaatctatcaccagaactacaagacgaaataggcactgctttcagcctgtttaaaacagatgaagacattacaggtagacttaaagatagggtacaaccagaaatactagaggcattactaaaacatatatcctttgataaatttgtacaaataagtcttaaggctttaagaagaatagtacctttaatggaacaaggtaaaaggtatgacgaagcatgtgccgaaatatatggcgatcactatggtaagaaaaatacagaagagaaaatatatttacctccgatacctgcagacgaaataagaaaccccgtagtgctaagagcactgtcacaagcaagaaaagttatcaatggagtagttaggagatacggaagcccagctagaatacatattgaaacagctagagaagtaggaaaatcatttaaagatagaaaagaaattgaaaagagacaagaagaaaatagaaaagatagagaaaaggctgcagccaagttccgagaatattttccaaatttcgttggagagccaaaaagtaaagatatcctcaaattaagactatacgaacagcaacatggcaaatgtttatacagtggcaaagaaattaatttaggaaggttaaatgaaaaaggttatgtcgaaatcgatcacgcactaccattttcacgaacatgggatgactcatttaacaataaagtattggtactcggatctgagaatcaaaacaagggtaaccaaaccccttatgaatacttcaacggtaaagataattcaagagaatggcaagaatttaaagcgagagtagagacatctcggtttccaagatctaaaaagcaaaggatactattacagaaattcgatgaagatggattcaaagaaagaaacctcaatgacacccgttatgtaaaccgatttctatgtcaatttgtcgcagacagaatgcgcctaactgggaaaggcaaaaagcgagtgtttgcaagtaatggacaaataacaaacctactccgaggattctggggacttagaaaagttagagcagaaaatgatagacaccacgctctagacgcagtagtagttgcctgtagtacagtagcaatgcaacaaaagataacaagatttgtaaggtataaagaaatgaacgcatttgacggaaagactattgacaaagaaacgggagaagtactacatcagaaaactcacttccctcaaccctgggaatttttcgcacaggaagtaatgatccgagtttttggcaagccagatggaaaaccagagttcgaagaagcagacactccagaaaaactaagaacacttttagccgaaaaattatcatctcgaccagaagcagtacatgaatacgtaactccactctttgttagtagagccccaaatcgaaaaatgtctggacaaggtcacatggaaacagtaaaaagcgctaaaagattagatgaaggagtatcagtattgagagtgccactcacgcaattaaaattaaaagaccttgagaaaatggtaaatcgcgaaagagaaccgaaattatacgaagcattaaaagctagattagaagcacataaagatgatccagccaaagcatttgcagaacctttttataaatacgataaagctggaaatcgaacacaacaggttaaggcggtgagggtagaacaagtacagaaaactggagtatgggtaagaaatcacaacggaatagccgataatgctacgatggtgcgagtagacgtattcgaaaaaggagataaatattatttagtaccaatatattcctggcaagtagcaaaaggaatcttacccgatcgtgcggtagtacaaggaaaagatgaagaagattggcaactcattgatgatagttttaatttcaagttttcattacacccgaatgatttagtagaagtaattacaaagaaagccagaatgtttggatattttgcatcctgccatagaggcacaggaaatataaacataagaatacatgatctagatcataaaataggcaaaaatgggattttagaaggaattggagtaaaaacagcattatcttttcaaaaatatcaaatagacgaactaggaaaagagatccgcccttgccggctcaaaaagagacccccagtaagatga

SEQ ID NO: 8514 - RNA, 3249 nt, synthetic construct
  misc_feature 1..3249: note = Cas9 variant
  source 1..3249: mol_type = other RNA
atggcagcttttaaaccaaatccaataaactacatattaggcctagatatagggatcgcctcagtaggctgggcaatggtagaaatagacgaggaagaaaatcctatccgtctcatagatctaggagtaagagtatttgaaagagctgaagtccctaaaacaggagattcattagcaatggctcgaagactagcacgatccgtaagaaggttgacacgtaggagagcacatcgtctcttaagaacaaggaggttactaaaaagagaaggagttttacaagccgcaaatttcgacgaaaatggactaataaaatctcttccaaacacactatggcaattacgagctgcagcactagatcgaaaattaactcccttagaatggtcagcagttttactacatttaatcaaacatagaggttacctctcacagaggaaaaacgagggagaaacagcggataaagaattaggagctttattaaaaggggtagcgggaaatgcccatgccctacaaacaggtgattttagaacccctgctgaactagcactaaataaatttgaaaaagaatctggtcacatcagaaaccaacgtggagattactcacatacattttcacgtaaagatttacaagcagaactaaatttattatttgaaaaacaaaaggagttcggtaatccgcacataagcgacggtctaaaagaaggaatagaaacattactcatgacgcaacgacccgcgttatccggagatgcagttcaaaagatgttaggacattgcaccttcgaaccgacggaacctaaagcagccaaaaatacttatacaaccgaaagatttatttggttaacaaaactaaacaatcttagaatacttgaacaaggatcagaacgtccattaacagacactgaaagggcaacattaatggatgagccatatagaaagtcaaaattaacctatgcacaagcaagaaaattgttagagctagacgatatagccttctttaaaggattaagatacggcaaagataatgcagaagcatcaactttaatggaaatgaaagcataccatgccatcagcagagctttagagaaagaaggattaaaagataaaaagtcaccattaaatttaagtcccgaacttcaagatgaaataggaactgcgttttctttatttaagacagacgaagacatcacaggccgcttgaaagacagaatacaaccagaaatattagaagcactattaaaacacataaactttgacaaatttgtacaaattagcttaaaagccctaagacgcatagtaccactaatggaacaagggaagcgatatgacgaagcatgcgctgaaatatatggtgaccactatggcaaaaagaacacagaagagaaaatagatttacctccaatcccagccgatgaaatccataacccagtagtactcagagccctatcacaggctagaaaagtaataaacggagttgtaagaagatatggaagccctgcaagaatacacatagaaactgcaagagaagtgggaaagtcatttaaagatcgaaaagaaatagaaaaacgccaagaagagaatagaaaagacagagaaaaagcagcagcgaaatttagggaatattttcccaattttgtaggtgaaccaaaaagtaaagacatattgaaactaagactctatgaacaacaacacggaaaatgcctatattcaggaaaagagattaacttagggagattaaacgagaaaggatatgtggaaatagatcatgcgctcccattttctagaacatgggacgattcattcaataataaggtattggttttaggatccgaaaatcagaacaaaggaaatcaaacaccttacgaatactttaatggaaaagacaactcacgcgaatggcaggagttcaaagcaagagtagaaacctcccgatttcctagatcaaagaaacagagaatcttactacaaaaattcgacgaagacggatttaaagaaaggaacctaaacgatactagatatgtcaatcgatttctttgccaatttgtagctgacagaatgaggcttaccggtaaaggaaagaaaagagtattcgcctcaaatggacaaatcacaaaccttctacgcggattttggggtttaaggaaagtacgagccgaaaacgataggcaccacgcattagacgcagtagtagtcgcttgcagtacagtagccatgcaacagaaaattaccagattcgtaagatacaaagagatgaacgcattcgatgggaaaacaatagataaagaaacaggagaagtattacaccagaaaactcattttccacaaccctgggaatttttcgcacaagaagtaatgattagggtattcggcaaaccagatggcaagcccgagttcgaagaagcagacacaccagagaaactgcgaacattattaacggaaaaactaagttctagacctgaagcagtccatgaatacgtcacgccattatttgtcagtcgagcacctaatcgaaaaatgtctggacaaggtcacatggaaacagtcaaatcagccaaaagattagatgaaggaatctcagttttaagagtacccttaactcaattaaaattaaaagacttagagaaaatggtaaatagagaaagagaaccaaaattatatgaagcattgaaagcaagattagaagcgcacaaagatgacccagcaaaagccttcgcagaaccattttataaatatgataaagccggcaatagaacacaacaagtaaaagctatgcgagtagaacaagttcagaagactggagtatgggtcagaaatcacaatggaatagcagataacgctaccatggtacgtgtagacgtatttgaaaaaggagataagtactacttagtacccatatattcctggcaagttgcaaagggaattttaccagacagagccgtagtccaaggaaaagacgaagaagattggcaattaatcgacgatagtttcaatttcaaattttccctacatccgaatgatcttgttgaggtaataaccaagaaagctagaatgttcggctatttcgcaagttgtcaccgaggcaccggcaatataaacatacgaatacacgatttagaccataaaataggtaaaaatggaatattagaaggaataggagtgaaaacagccctatcatttcaaaaatatcaaatagacgaacttggaaaagaaattcgtccctgccgactaaagaaaaggccaccggtgcgctga

SEQ ID NO: 8515 - RNA, 3249 nt, synthetic construct
  misc_feature 1..3249: note = Cas9 variant
  source 1..3249: mol_type = other RNA
atggcagcattcaaacccaatcccataaactatatcttaggattagacataggaatagcttcagtgggatgggcaatggtcgaaattgatgaagatgaaaacccaatatgcttaatcgacctaggagtacgagtctttgaacgagctgaagtaccaaaaacaggagattcattagcaatggcaagacgtctagcaagaagtgtaaggagattaaccagaaggagagctcacagattactacgagctagaagattacttaaacgcgaaggcgtacttcaagcggcagattttgatgaaaatggactaataaaatcattaccaaacacgccttggcaattgcgagcagctgccttagatagaaaattaacaccattagaatggagcgcagtactcttacatctaataaagcacagaggttacttgagtcaacggaaaaacgaaggagaaacagctgataaagaacttggtgcacttctaaaaggagtagcggataacgcccacgcattacaaacaggtgactttagaacgccagctgaacttgctttaaacaaattcgagaaagaatcaggccatattagaaaccaaagaggagattacagtcacacttttagtagaaaagacttacaagcggaactcaatctcctattcgagaaacaaaaagaatttggaaaccctcatattagcgatggattaaaagaaggaattgaaacactactcatgacacaaagaccggcattatcaggagatgctgtacaaaagatgctgggacactgtacctttgaaccggcagaacctaaagcagcgaaaaacacatatactgcagaaagattcatctggctaacgaaattaaataaccttcggattttagaacaaggatcagaaagaccacttacagacacagaaagaacaactcttatagacgaaccataccgaaaatcaaaacttacttacgcacaagccagaaaacttctcgaattagataatactgcattctttaaaggactgcgatatggaaaagacaacgcagaggcttctacattaatggagatgaaagcctaccatgccatctcacgtgcacttgagaaagaagggttaaaggataagaaaagtccactaaatttatctccagaactacaagatgaaataggaacagcattctcattgttcaaaacagacgaagatatcacgggaaggctaaaagatagagtacaaccagaaattctcgaagcactattaaaacacatatcatttgataaatttgttcaaattagcttaaaagctctaagacgaatagtaccattaatggaacaaggtaaacgatatgatgaggcttgcgcagaaatatacggcgaccattatggaaagaaaaatacagaagagaaaatagatcttcctccgattccagcagatgaaataagaaatcccgttgttttaagagctttaagccaagcacgaaaagtaataaatggagtcgtaagaaggtatggatcaccagctagaatacacatagaaacagcaagagaagttggaaaaagttttaaagacagaaaggaaattgaaaagagacaagaagaaaaccggaaagatagagaaaaggctgctacaaagtttagagaatactttccaaacttcgtaggtgaaccaaagtcaaaagatatattaaaattaagattatacgagcaacaacatggaaagtgtctatacagcggaaaagaaataaacctaggaagactcaacgaaaaaggatatgttgaaatagaccacgcactaccattttcaaggacttgggatgatagttttaataacaaagtcttagtattaggtagcgaaaaccaaaataaaggcaatcaaacaccctacgagtattttaacgggaaagataacagtcgagagtggcaagaatttaaagctagggtcgagacgtcacgattcccacgtagtaagaaacaacgtattctcttacaaaaatttgacgaagaagggttcaaagaaagaaatttaaatgacacaaggtatgtaaaccgattcttatgccaatttgtagccgaccatatgttactaaccggtaaagggaaaagaagagtttttgcatcaaacgggcaaataacaaatctactgagaggcttctggggattaagaaaagttagggcagaaaatgacaggcatcacgctttagacgccgtcgtcgttgcttgtagtacagtagctatgcaacagaaaataacacgatttgtgcgatacaaggaaatgaatgcatttgacggaaaaacgatagataaagaaacaggtgaagtactacatcagaaaacacatttccctcaaccgtgggagttctttgctcaagaagtaatgataagagtctttggaaaaccagacggaaaacctgaatttgaagaagccgatacgccggaaaaattaagaacattactagcagaaaaactctccagtagaccagaggctgtacacgaatacgtaacacctttatttgttagtagggcacctaaccgaaaaatgagtggccaaggccatatggaaacagtcaaaagtgcaaaaagattagacgaaggagtaagcgtactgcgggtaccactcacacaactaaaacttaaggaccttgagaaaatggtcaatagagaacgtgaaccaaaattatacgaagccctaaaagcaagactagaagcacataaagatgaccccgctaaagcattcgcagagccgttttacaaatatgataaagccggtaaccgaacgcaacaagtgaaagccgtcagagttgaacaagttcagaaaacaggcgtatgggtcagaaatcataatggaatagccgacaatgcaacaatggtaagagtcgatgtttttgaaaaaggcgataagtactacttagtaccaatatatagctggcaagtagcaaaaggcattttacctgatagagcagtggtccaaggcaaagatgaagaagattggcaattaatagacgatagttttaatttcaaatttagtctccatcctaatgacctggtagaagtaatcacgaaaaaggcacgtatgttcggatacttcgcatcttgtcacagaggaacaggaaatataaatataagaatacacgatttagaccataaaataggcaaaaacggaatattagaaggaataggagtcaagaccgcactatcattccaaaagtatcaaatagacgaactagggaaagaaataagaccgtgcagactaaagaaaagacctcccgtaaggtga

SEQ ID NO: 8516 - RNA, 3249 nt, synthetic construct
  misc_feature 1..3249: note = Cas9 variant
  source 1..3249: mol_type = other RNA
atggcagcctttaaaccaaacccaatgaactatatattaggattagatataggtatagctagtgtaggatgggccattgttgaaatagatgaagaagaaaatccaataagactgatagacctaggagttcgagtgtttgaaagagcagaagtcccaaaaactggagatagcctagcagcggcgaggagattagcaagatcagtgagaagactcactagacggcgagctcatagactcttaagagcgagaagactgctaaaaagggagggagtactccaagctgcagattttgacgaaaacggattaataaaaagtttgcccaatacaccatggcagttaagagccgccgctttagaccgcaaattaacaccactggaatggagtgcagtcttattacacctcattaaacaccgaggctacctaagtcaacgtaaaaatgaaggagaaactgcggacaaagaattaggagcactactaaaaggagtagcggataacactcatgctctacaaacaggagactttagaactcctgctgaactcgcactaaacaaattcgaaaaagaaagcggtcatattagaaatcaacgaggagactatagccatacatttaatcgtaaagatctccaagccgaattaaatttgttatttgaaaaacaaaaagaatttggaaacccacatgtatcagatggcttaaaagaaggaatagaaacattattaatgacacaaagacccgcactgagcggtgacgcagttcagaaaatgctaggacactgcacattcgaacctacagaaccaaaagcagctaaaaacacatacacagcagaaagattcgtatggctcacaaaactaaataatttaagaatattagaacaaggatcagaaagacctttaactgatacagaaagagctacattaatggatgaaccataccgaaagtcaaaattaacatacgctcaagcgagaaagttactagaccttgacgatacagccttcttcaaaggattaagatacggaaaggacaatgctgaagcaagcacacttatggaaatgaaagcatatcatgctataagccgagctctagaaaaagaaggactaaaggataagaaatcaccattaaacttaagccccgaattacaagacgaaataggcacggctttctcattattcaaaacggacgaagatattacaggaagacttaaagacagggtacaaccagaaattttagaagctcttttaaaacacatttccttcgataaatttgttcaaatatcactaaaagctctgagaagaattgtacctctaatggaacaaggcaacagatatgatgaagcatgcacagaaatatacggggatcactatggtaagaaaaacacagaagagaaaatatatctgccacccattcccgctgacgaaataagaaacccggttgttctaagagcactgtcacaagcgcgaaaagtaataaatggcgttgtaagaagatacggctccccagcaagaatccacatagaaactgcaagagaagtcgggaaatcttttaaagatagaaaagaaatagaaaagaggcaagaagaaaatcgtaaagatagagaaaaatcagcagccaaatttcgggaatattttcctaattttgtaggagaaccgaaatcaaaagacatacttaaactaagattatatgaacaacaacatgggaaatgtctatacagcggaaaggaaatcaacttagggagactaaatgaaaaaggatacgtagaaatagaccatgcccttccattcagtagaacatgggacgattctttcaacaacaaagtattagctttagggagcgaaaaccaaaataaaggaaatcaaacgccctatgaatacttcaatgggaaagacaattcaagagaatggcaggagttcaaggcacgagttgaaacaagtagatttccaagaagcaaaaagcaacgaattttattacaaaaattcgatgaagatggattcaaagaaagaaatctaaatgatacgcgttatataaacagatttctgtgccagtttgttgcagaccacatgctattaacaggcaaaggaaaaagaagagtcttcgcctctaacggacaaataacaaatttactaagaggtttctggggattacggaaagtacgggctgaaaatgatagacatcacgctttagacgctgtggtagtggcttgttcaacaatagcgatgcaacagaaaataacaagattcgtcagatacaaagaaatgaatgcatttgatggaaaaactatagataaagaaacaggcgaagtcttacatcaaaaagcacatttcccccaaccatgggaatttttcgctcaagaagtcatgatcagagtctttggtaagccagatggaaaaccagagttcgaagaagcagacactccagaaaaactaaggacattactagcagaaaaactctcatccagaccagaagcagtacacaagtatgttacacctctatttatatcacgcgcgccaaaccgaaaaatgagcggacaaggacatatggaaacagtaaaatcagccaaaagacttgatgaaggtatttcagtactccgagtacctctaacacaactgaaacttaaagaccttgagaaaatggtaaaccgagaacgagaaccgaaactctacgaagccctaaaagccagattagaagctcataaggatgatcccgccaaggctttcgcagaacctttttataaatacgataaagcaggaaaccgcacccaacaagtaaaagctgtccgggttgaacaagtccagaaaactggagtttgggtacataaccataatggaatagcagataatgcaacaatagtacgggtagatgtgttcgaaaaaggagggaaatattacctagtacctatttatagctggcaagtcgcaaaaggaatactaccagatagagcagtagttcaaggcaaagacgaagaagattggacagtaatggacgatagctttgagttcaaatttgtattatacgctaacgacttaattaaattaactgcaaagaaaaatgagttcttaggatacttcgtttcattaaacagagcaactggagcaattgacattagaacacatgacacagattcaacaaaaggtaaaaatggaatatttcaaagtgtgggagttaaaacagctctaagtttccaaaaataccaaatagatgaactgggaaaagaaattagaccatgtagactaaagaaaagaccacccgtaagatga

SEQ ID NO: 8517 - RNA, 3249 nt, synthetic construct
  misc_feature 1..3249: note = Cas9 variant
  source 1..3249: mol_type = other RNA
atggcagcctttaaacctaattcaatcaactacatattaggactagacatagggatagcttcagtaggatgggctatggtagaaattgataaagaagaaaacccaatcagactaattgatctaggagtaagggttttcgaaagagcagaagtaccaaagaccggagactcactcgctgcagcaagaagattagcaagaagcgtaagaagattaacaaggagacgcgcacataggttacttaggacaagacgattattaaagagagaaggcgtcttgcaagcagcaaactttgataaaaatggtctgattaaaagcctaccgaacaccttatggcaattaagagcggcagccttggacagaaagctaaccccattagaatggagcgcagtattactacatttaataaaacatagagggtacttaagtcaacgaaagaacgaaggagagacagcagacaaagaattaggagcgctacttaaaggagtcgcaggtaatgcccatgcactacaaacaggagattttagaacaccagctgaacttgcactaaataaattcgaaaaagaatcagggcatattcgtaatcaaagaggtgactactcacatacatttagcagaaaagatctccaagctgaattaaaccttttatttgaaaaacaaaaggaatttggtaatcctcatataagcgggggtctaaaagaaggaatcgagacattactaatgactcaacggccagcgttgtctggtgatgcagtacagaaaatgttgggccattgtactttcgaacccaccgaaccaaaagcagccaaaaatacttatactacagaaagattcatatggctcacaaaattaaacaatctaagaatcctagaacaaggaagtgaaagaccattaacagacaccgaaagagcaacactaatggatgaaccatatagaaaatctaaactgacatacgcacaagcacgaaagctactctctctagaagatacagcattctttaaaggtttaagatatggaaaagataatgcagaagcaagcacattaatggaaatgaaagcataccacacaatatcgagggcacttgagaaagaaggattaaaagataaaaagagccctttaaatctctcgcccgaactacaagatgaaatcggcaccgcattttctctatttaagacggatgaagacataactggtaggttaaaagacagaatccaaccagaaattcttgaggccttgttaaagcatatatccttcgataagtttgtacaaatatcgctaaaagcacttaggagaatagtccccctaatggaacaaggaaagagatacgatgaagcatgtgcagaaatatacggagaccattacggaaagaaaaatacagaggaaaagatctaccttccacccataccagcagacgaaatacgcaatccggtggtccttcgagcgctaagtcaagcaaggaaagtaatcaacggagtagtcagaagatatggttcacccgcaagaatacacatagaaacagcaagagaagtagggaaatcatttaaagacagaaaagaaattgagaaaagacaggaagaaaataggaaagatcgagaaaaagcagcagcaaaattcagagaatattttccgaatttcgtaggagaaccaaaaagcaaagacattctaaaattgcgactatatgaacaacaacacggaaaatgcctatattcaggaaaagaaataaatctagttcgactaaacgaaaaaggctacgtggaaatcgaccatgcgcttcccttttcaaggacatgggatgatagcttcaacaataaagttcttgtattaggttcagaaaaccaaaacaaaggaaatcaaacaccctacgaatattttaacggaaaagacaattcaagagaatggcaggaatttaaagcacgagtcgaaacaagccgatttccaagatcaaagaaacaaagaatattgttacaaaaattcgacgaagatggttttaaagaaagaaatttaaatgatacgagatatgtgaacagatttctatgtcaattcgttgctgaccacatattattgacagggaaaggaaaaagacgtgtattcgcatcaaacggacaaataacaaatctactacgaggattttggggactccgaaaagttagagcagaaaacgacagacaccatgcacttgacgccgttgtggttgcatgttccacagtggctatgcaacagaaaataacacgttttgtaaggtataaagaaatgaatgccttcgacggaaaaacaattgataaagaaacaggcgaagtactacaccagaaaactcattttccacaaccttgggagttctttgctcaagaagtaatgatacgagtctttggtaaacctgacggcaaacctgaatttgaggaagccgacactcttgaaaaattaagaacattattggcagaaaaactttcaagtcgacccgaagcggttcatgaatacgttacgcccctattcgttagtagggcaccaaaccgaaaaatgtctggacaaggccatatggaaaccgtaaaatccgcaaaaaggcttgatgaaggagtatctgtactaagagtaccattaactcaattaaaattaaaagatctcgaaaagatggttaatagagaaagagaaccaaaactatacgaagcactcaaggcacgactggaggcacacaaagatgacccagccaaagcattcgccgaacctttctataaatatgacaaagctggaaacaggacccaacaagtaaaagcagtccgagtagaacaagtacagaaaacaggagtatgggtaagaaatcacaacgggattgcagacaacgcgacaatggtacgcgtagacgtttttgagaaaggagacaaatactatctagtacctatatatagttggcaagtcgccaaaggaatccttcccgatagagccgtagtacaaggaaaagatgaagaagattggcaactaatcgacgatagctttaatttcaaattctcgctacacccaaacgacctagtcgaagttataactaagaaagccagaatgtttggttacttcgcctcgtgccacagaggcactggaaatataaatatacgcatacatgatctggatcataaaatagggaaaaacgggatattagaaggaataggggtcaaaacagctctatcatttcaaaaatatcaaatagatgaactaggaaaagaaattagaccatgcagactgaagaaaaggccaccggtaagatga

SEQ ID NO: 8518 - RNA, 3249 nt, synthetic construct
  misc_feature 1..3249: note = Cas9 variant
  source 1..3249: mol_type = other RNA
atggccgcctttaaaccaaatcccattaattacatattaggcttagatatagggatagcgagcgttgggtgggctatggttgagatagacgaagaagaaaatcctatacgattaatagatctcggagtgagggtatttgaacgagcagaagtacccaaaacaggtgattcattagctatggtaagaagattagcaagatccgtaaggagattaacaagaagacgagcacatagacttctaagagcaagaagacttctaaaaagagaaggtgttttacaagcggcagactttgatgagaacggactaataaaaagcctaccaaacacgccatggcaattgagggcggcagctttagatagaaaattaacacccctagaatggtctgcagtattgttacatctcattaaacacagaggatacttaagccagagaaagaatgagggagaaactgcggataaggaattaggagcactactcaaaggcgtggcagataatgcacatgcactacaaactggtgatttcagaactccagcagaattagccctaaataaatttgaaaaagagagcggccacatacgaaatcaaagaggtgattattcacacacattctcacgtaaagatctacaagccgaactgattctactgttcgagaaacaaaaagagttcggtaatccacacatatcaggtggcctaaaagaaggaattgaaacgttattaatgacacaacgaccagcgctaagtggagacgcagtacagaaaatgttaggacattgcacttttgaaccagcagaaccaaaagcagccaaaaacacatacacagcagaacgattcatatggttgaccaaattaaataacttaaggatattagaacaaggaagtgaaagaccattaacagacacagaacgagcaaccttaatggatgaaccatacagaaaatcgaaacttacctacgctcaagcacgaaagctgctaggcctagaagacacagctttctttaaaggattaagatatggaaaagacaacgcagaagcaagcacactaatggaaatgaaagcatatcatgcaatcagcagagcattagaaaaagaaggcttaaaagataagaaaagtccactcaatttaagtcccgaactgcaagacgaaattggcaccgcattttcactattcaaaaccgatgaagacataacaggtagacttaaagacagaatccaaccagagatactcgaggctttattaaaacatattagcttcgacaaatttgtacaaataagcctaaaagccttaagaagaatagtaccactgatggaacaaggaaaaagatatgatgaagcgtgcgcggaaatatatggagatcattacggcaagaaaaacacagaagaaaagatatatctaccaccaatacctgcggacgaaatacgaaatccagtggtactaagagcattatcacaggcacgtaaagtgataaacggtgtagtaagaaggtatggtagtccagctcgtattcatatagaaacggcaagagaagttggaaaatccttcaaagacagaaaggaaatagagaaaagacaagaagaaaacagaaaagaccgagaaaaagcagcagcaaaatttcgggaatattttccaaattttgtaggtgaaccaaaaagcaaagacatcttaaaactacgactatatgaacaacaacacggaaaatgcttatattcgggtaaggaaatcaacttgggtcgtctaaatgagaaagggtatgttgaaattgatcacgcgttaccattttcaaggacatgggatgattcatttaataacaaagttctcgtattaggttcggaaaatcaaaacaaaggaaaccaaacaccatacgagtactttaatggaaaagataatagccgagaatggcaggaatttaaagcaagagttgaaacaagtagattcccaagatcgaagaaacagagaatactactacaaaaattcgacgaagacggatttaaagagagaaacctaaatgataccagatatgtaaatagatttctttgtcaattcgtagcagacagaatgagattaaccggaaaaggtaaaaagagggtgttcgcgagcaatggacaaataacaaacctcctcagaggcttttggggcttaagaaaagttagggcagaaaatgatagacatcatgcactagacgcagtggtagtcgcttgctcaacagttgcaatgcaacagaaaataacgcgatttgtacgatataaagaaatgaatgcattcgatggaaaaacaatagataaagagacaggagaagtattacaccagaaaactcatttccctcaaccgtgggaatttttcgcgcaagaggtaatgattcgagtctttggaaaacctgacggaaaaccggaatttgaagaagccgacactccagaaaaactaagaactttattagcagaaaagctatcatctagacctgaagcagttcacgaatatgtaacacctctcttcgtaagtagagcaccgaaccggaaaatgagcggacaaggacatatggaaacagtaaaatctgccaaaagactagacgagggtgtatcagtactaagagtaccgctaacacaattgaaattgaaagatctggagaaaatggtcaacagagaacgggaaccgaagttgtacgaggcattaaaagcaagattagaagcgcacaaagatgacccagcaaaagcatttgccgaaccattttacaaatatgacaaagcaggaaacagaacgcaacaagtaaaagcagttagagtagaacaagtacaaaagacaggtgtatgggtacgaaatcataatggaatagctgataatgcgaccatggtccgagtcgacgtatttgagaaaggtgataaatattatctcgtacccatatatagctggcaggtagcaaaaggcattctaccagaccgtgcggtagttcaaggcaaagatgaagaagattggcaattaatagatgatagctttaattttaaattttcactacatccaaatgacttagtagaagtgatcactaagaaagctagaatgttcggttatttcgcaagctgtcacagaggaacagggaatatcaatataaggatacatgatctagatcacaaaattggtaaaaatggtatattagaaggtataggagtaaaaacagcattaagttttcaaaaatatcagatcgacgaacttggcaaagaaataagaccatgcagattaaagaaaagaccaccagtacgatga

SEQ ID NO: 8519 - RNA, 3249 nt, synthetic construct
  misc_feature 1..3249: note = Cas9 variant
  source 1..3249: mol_type = other RNA
atgcgagtactaggcttagatgcgggaatagccagcctaggatgggcattaatagaaatagaagaaagtaatagaggagaactttctcaaggaaccatcataggagcaggcacttggatgttcgacgctcctgaggagaaaacacaggccggagcaaaacttaaaagtgaacaacgtcgtacatttagaggacaacgaagagtagtacgacgcagacgtcaacgaatgaacgaagtaagaaggattttgcactcccatggactattaccatcatctgatcgagatgccttaaaacagcccggtctggatccatggcgcataagagcagaagctctagatcgattattaggtccagtagaattggcagtagcattgggtcatatagctcgacacagaggatttaaatctaattctaaaggagcaaaaacgaacgatcccgcggatgatacaagtaaaatgaaaagagctgttaatgaaacaagagagaaactcgcaagatttggctctgcagccaaaatgttagttgaagacgaatcattcgttttaagacaaacacccactaaaaatggagcatcagaaatagttagaagatttagaaacagagaaggagactacagcaggtcattactacgagatgaccttgcagcagaaatgagagcattatttacagcacaagcacgattccagtcagctattgcaacagcagacctacaaaccgccttcactaaagcggcattctttcaacggccgcttcaagatagtgaaaagctagtgggcccatgtccatttgaagtagatgagaaaagagcaccgaaaagaggatattcatttgaactattcagatttctttcgagactaaatcatgtaacattaagagatggaaaacaagaaagaaccttgactagagacgaattggcattggcagcagcagactttggagcagcggcaaaagtcagcttcaccgctttaagaaagaaacttaaactgccagaaacaactgtatttgttggagttaaagcggatgaagaatccaaattagatgtagtagccagatcaggaaaagcagcagaaggtacagcgagactaaggtcagttattgtagatgcattaggtgagttagcatggggagcattactctgttcccctgaaaaattagataaaatagccgaagtaatctctttcagatcagacatcggtagaataagcgagggtctcgcacaagctggctgtaatgctcctctagttgatgctctgactgccgcagcctctgatggaagatttgatccattcacaggtgcgggacatatttctagtaaagcagctagaaatatattaagtggactaagacaaggaatgacctatgacaaagcctgctgtgcagcagattatgaccacacagcaagtagagaacgaggagcatttgatgtagggggacacgggagagaagcgctaaaaagaattttacaggaagagaggatcagtagagagctagtaggatcaccaactgcaaggaaagcgttaatagagtccatcaaacaagtcaaagcaattgttgagagatatggtgtcccagaccgtatacacgtagaactggcacgagacgtaggaaagagtattgaggaaagagaagaaattactcgaggtatagagaaaagaaacagacaaaaagacaaactacgcggtctatttgaaaaagaagtaggcaggccaccacaagatggcgctagaggaaaagaagaactgctaagattcgaattatggtcagaacaaatgggaagatgcttatacacagatgactatataagtccctcacagttagttgcaactgatgacgccgtacaagtagaccacatattaccgtggtcaagattcgcagatgatagttatgcgaataaaaccttgtgtatggcaaaagcgaatcaagacaaaaagggaagaacaccttatgaatggttcaaagcagagaaaaccgatactgaatgggatgcattcatagtaagggtagaagctctcgcagatatgaaagggtttaagaaaagaaattacaaactaagaaatgctgaagaagcagcagcaaaatttagaaatcgaaatttaaatgatacccgatgggcgtgtagactcttagctgaagccttgaaacaattatatcctaaaggggaaaaagataaagatggtaaggaaagacgtcgcgtattcagtagaccaggagcactaaccgatagattgaggagagcatggggactacagtggatgaagaaaagtactaaaggtgatcgaatacctgatgacagacaccacgcactagatgcaatcgtgattgcagctaccacagaaagcctacttcaaagagcaacacgagaagtccaagaaatagaagacaaaggtctccattatgatctggtcaaaaatgtaactccaccgtggccaggattccgagaacaagcagtggaagcagtagaaaaagtttttgttgcaagagcagagcgcagacgagcaagaggaaaagcacatgatgcaactatcagacatatagccgttagagagggcgaacagagagtatacgaacgaagaaaagttgcagaactaaaactagccgatctcgatcgagtaaaagacgcagaaaggaatgctaggcttattgaaaaattacgaaattggattgaagcaggcagtcccaaagatgatcctccattatcacccaaaggagatccaatatttaaagtacgattggttactaaatctaaagttaacatagcgttagatactggaaacccgaaaagaccgggtacagtagatagaggagaaatggcacgagtcgatgtttttagaaaagcaagtaagaaaggtaaatatgaatactatttagtaccaatatatcctcatgatatagcgacaatgaaaacaccaccgataagagcggtacaagcatacaaaccagaagatgagtggccagaaatggatagtagctatgaattttgttggagtttagtacccatgacctacctacaagtaataagctcaaaaggcgaaatattcgaaggatactacagaggcatgaataggtcagtgggggcaatccaactatcggcacattcaaattcatcagatgttgtacagggtataggagccagaacacttactgaatttaagaaatttaatgtggatagatttggcagaaaacatgaagtagaacgggaacttagaacttggaggggagaaacatggaggggcaaagcatacatatga

SEQ ID NO: 8520 - RNA, 3255 nt, synthetic construct
  misc_feature 1..3255: note = Cas9 variant
  source 1..3255: mol_type = other RNA
atgaaaaatactctatacggaataggcttagacataggtgttgcgtcagtaggatgggcagtggtgggattaaatggaaccggcgagcctgtaggcttacatagacttggagttagaatattcgataaagcagaacaaccaaagacaggagaatcattagcagcacctagaagaatggctaggggaatgaggagaaggttgaggaggaaagctctaagaagggcagatgtatacgccttactagaaagatccggcttatcaactagagaagccctagcacatatgtttgaagcaggaggtttagaggatatttatgcattacgaaccagggctttggatgaacccgtaggaaaagccgagttcagtcgaattttactacatttagcacagagaagaggatttaagtccaatagaagaacagctagcgatggtgaagacggaagattattagcagcagtaaacgaaaacagaagacgcatggcacagggtggatggagaacagtcggagaaatgctatatagacatgaggctttcgcacttcacaaacgaaataaggctgatgaatacttgtcaactgtaggtcgagatatggttgcagaagaagcgagtctattatttcaacgacaacgagaactaggttgcgcatgggcaacacctgaattgcaggcagaatatctttcaatattactcaggcaaagatcttttgatgaaggtcctgggggtaattcaccgtatggaggtaaccaagtcgagaaaatggttggccgatgtacatttgaaccagatgaaccgagagcagccaaagcagcgtacagtttcgaatatttttcactcctgcagaaaataaaccacatacgtctagtagaaaacggcgaaacacgtccactaacacaacaacaacgacaacaactgttatcattagcacacaaaacaccggacgtatcattagctagaataaggaaagaattagctttacccgaaacagtccagtttaatggcgtaagatgtagagccaacgaaacattagaagaatcagaaaagaaagaaaaatttgcatgtctaccagcttatcataaaatgagaaaagccttggacggtgtagtaaaaggaagaatatcatcgttatcaatatcacaaagagatgcagcagctacagcattaagtctatataaaaacgaagatactctaagagcaaagttaaccgaagcaggatttcaagcacctgaaatagacgcactagcaggtttgaccggattcagcaaattcggacacctatctttaaaagcgtgcagaaaattaataccacatctcgaacaagggttgacatacgaccaggcttgtagcgcagcgggatatgattttaaagggcacggagcgggagaaagagcgtttacactacctgcagccgcccctgaaatggaacaaataacaagcccggtagtccggagagcggtagcgcaaaccataaaagtcgtgaatggaatcataagagaaatggatgctagcccagcttgggtgcgtatagaattagcaagggaattaagtaaaacatttggagaaaggcaagagatggacagatcaatgagggaaaacgcagcacaaaatgaaagacttatgcaagagctacgagatacttttcacttattatcacctacaggacaagatcttgtaaaatacagactttggaaagaacaagatggagtctgcgcttattcattaagaagactggatgtagaaagattgttcgaacctggatatgtagatgtcgaccatattgttccatactcattaagttttgacgaccgtagaagtaacaaagttttagtactatcaagcgaaaacagacaaaaaggtaataggttacctcttcaatacttacaaggaaagaggagagaggacttcatcgtctggacaaattcttcagtgagggattaccgaaaacgacaaaatttattgcgagaaaaattatccggtgatgaagcagagggattcagacaacgtaacttacaagatacacaacatatggcacgatttttatacaattacataagtgatcatcttgcatttgcgcaatcagaggctttaggtaagaaaagagtttttgcagtatcaggagctgtaacctctcatttaaggaaaagatggggattatcaaaagtaagagctgatggagatcttcatcatgcattggatgcagcagtaattgcatgtacaacagatggaatgatcagacgtattagcggatattacggacatatagaaggggaatatcttcaagatgcagatggagcaggatcgcaacacgctagaacaaaagaaagattcccggcgccgtggccaagatttagggatgaattgatagtgcgactatcagagcaacccggagaacatttattagatataaaccctgagttctactgtgaatatgggactgaacacatcaggccagtatttgttagtagaatgccaagaagaaaagtgacaggaccaggacataaagaaacaattaaaggagccgcagccgccgacgaaggcttattaacagtcaggaaagcactaacagaactaaaattagataaagacggggaaataaaagattactacatgcccagctcagatacactactatatgaggctttgaaagcacaattgaggcgctttggaggagacagtaaaaaggcttttgcagaaccattttacaaaccaaaagcagatggaacgccaggaccattagtacgaaaagtcaagacgacagaaaaagctacattgacagtaccagttcatggaggcgccgcctcaaatgatactatggtaagggttgacgtgtttctagtacccggggatggatattattgggtaccagtttacacagctgataccctaaaaccagaattaccaaaccgtgctgtagttcaagggaaaccatactcagaatggaaagaaatgagagaggaggattttatcttctctttatacccaaatgacttagtatatgtagaacataaatcaggactaaaatttacattacaaaatgcggatagtacactagagaaaacacgaacacaaacatccgcattcgtatactttgtaggaggaagtataagtacggcaagcatcacaatacgaacccatgataatgcttatggtatacctagccttggtgtaaaaactttaaaaacatttcacaaatatcaagtagacgtactaggaaatgtttttccagtacacaaagaaacaaggcaaaaatttaggtga

SEQ ID NO: 8521 - RNA, 3255 nt, synthetic construct
  misc_feature 1..3255: note = Cas9 variant
  source 1..3255: mol_type = other RNA
atgaaaaataccctatacggaataggtttggatataggcgttgctagtgttggatgggctgttgttggattaaacggtaccggggaacctgttggacttcatagattaggagtacgaatatttgataaagcagaacaacctaaaaccggagaaagtctagcagcaccccgaagaatggcaagaggtatgagaaggagattacggagaaaagcattaagacgagcggatgtatacgctttattagaaagaagtggattatcgacaagagaagccctggcacaaatgttcgaagctggtggattagaagatatttacgcattacgcacacgggcattagatgaaccagtaggaaaagccgaattttcaagaatattattacatcttgcccagcgaagaggtttcaagtcgaacagaagaacagcatcagacggtgaagatgggaggttattagcagcagttaacgaaaataggagacgaatggcacaaggaggttggagaactgtgggagagatgctatatcgacatgaagcattcgccttgcataaaagaaataaagcagatgactatttatcaacagtcggacgagatatggtagctgaagaggcttccctattatttcaaagacaaagagaacttggctgtgcctgggccactccagaattgcaggcagaatacctaagtattttattacgacagcgtagcttcgatgaaggacctggaggagactcaccatatggaggaaaccaagtcgagaaaatggtaggaagatgcacatttgaacccgatgaaccgagggctgcaaaagcagcgtactcattcgaatacttttctttgctacagaaaataaaccatataagactagcagaaaatggagaaacacgcccattgacacaaccacaaagacaacaattgctttcattagcacataaaacaccagatatgagtttagccaggattagaaaagaacttgcacttcctgaaaccgttcaatttaatggagtacgatgccgagctaatgaaaccctagaagaatccgagaagaaagaaaaatttgcatgtcttccagcatatcacaaaatgagaaaagcactaggcggagttgtaaaaggaaggataagtagtttaagtatatcacagagagacgcagctgctacagcgttatcattatataaaaatgaagacacactaagagcaaagctaacagaggcgggctttcaggcgcctgaaatagacgcattagcaggattaacaggatttagcaaatttggacacttatcactcaaagcgtgtaggaaattgataccccatttagaacagggactcacctatgatcaagcatgttcagcagcgggatacgatttcaaaggacatggagccggtgaaagggcttttacattaccagcagcggcacctgaaatggaacaaattacaagtcctgtagtaagaagggcagtggcccaaactataaaagtagtaaacgggatcatacgagaaatggatgcaagtcccgcatgggttcgtatagaattggcaagggaattaagtaaaactttcggagaaagacaagagatggaccgttcgatgagagaaaatgctgctaaaaatgaaagactaatgcaagaactaagagatacgtttcacctcctaagcccaacaggacaagatcttgtaaaatatcgtctctggaaagagcaagatggagtgtgtgcgtatagtttacaaaggctagatgtggagcaattattcgaaccagggtatgtagacgtcgaccatatcgtaccatactcattgtcattcgatgatcgaaggtcaaataaagtattggtactaagcagtgaaaacaggcaaaaaggaaatagactcccattacaatatctacaaggcaagagaagagaagattttatagtatggactaattcttcagtacacgattataggaaaaggcaaaatttattaagagaaaagctaagcgatgatgaagcggaaggattcagacaacgcaacctccaagatactcaacacatggcaagatttttatataactatataagtgatcatttagcatttgcacaaagtgaagccctaggtaagaaacgtgtattcgcagtaagtggcgcagtaacgagtcatttaagaaaaagatgggggcttagcaaagttcgagcagatggagatctacatcatgctctagacgcagccgtggtagcgtgtacaacagatggtatgataagaagaatatctggatactatggtcacatagaaggagaatattttcaagatgctgatggagcagggtcacaacacgcaagaacgaaagaacgttttccagcaccatggcctagatttcgtgatgaacttatagtacgattgagcgaacaacccggggaaccacttttagacattaaccccgctttttattgtgagtacggaactgaacatattagacctgtcttcgtcagccgaatgccaagacgaaaagtgacaggcccgagtcacaaagaaacagtaaaaggagcagctgctgcggatgaaggtctattaacggttagaaaagcactgacagaactaaaattagataaagatggggaaataaaggattattatatgccgagctcagacacactattatatgaggctttgaaagcacaactcaggcgattcggaggagatggaaagaaggcttttgcagaaccattctataaaccaaaagctgacggaaccccaggaccattagtaagaaaagttaaaacaacagaaaaagctacattaacagtacctgtacatggtggagctgcttcaaatgatacaatggtaagaatagacgttttctttatgcccggagacggatattactgggtgcctctatatgttgcagacacactgaaaccagagttacctaatagagctgttgtggcccataaaccatatagtgaatggcaagaaatgcgggaagaagactttgtgttttcgctatatccaaacgatttagtatacgtagaacacaaatctgaactaaaatttacggtccaaaatgctgattctacactagagaaaacaagaacacaggcttctgcatttgtctattttgttagcggcggtattagtggcggtacaataactgtaaggacacacgataactcttatggtatcccgtcacttggtttaaaaactttaaaaagtctatgtaagtatcaagtagatgttttgggcaatgtatttccagttcataaagaaacaaggcaaaaatttagatga

SEQ ID NO: 8522 - RNA, 3255 nt, synthetic construct
  misc_feature 1..3255: note = Cas9 variant
  source 1..3255: mol_type = other RNA
atgaaaaatacattatacggaataggtttagacattggcgtagcaagtgtaggatgggcagtagttggattaaatggtacaggcgaacctgtgggtctgcatagattaggagtacggattttcgataaagctgaacaaccaaaaacgggtgaatcattagccgcaccaagaagaatggctagaggtatgcgcagaagactaagaagaaaagcactgagacgagcagacgtttatgcattattagaaagaagtggattaagtacaagggaagaattagcacaaatgtttgaagcgggaggattagaagatatctatgctctacgaacaagagctctagatgaacccgtaggaaaagcagaatttagcagaatccttcttcatcttgcacagcgacgaggcttcaaatcaaataggagaacagcatcggatggagaagacggacgactactagcagccgtaaacgaaaataggcgacgaatggcacagggagggtggcgcacggttggagaaatgttatataggcacgaagcctttgcactacataaacgtaataaagctgacgattatttaagtacagttggtagggatatggtcgctgaagaggcttctattttgtttgaaagacaaagagccatgggctgcagttgggcagccccagaactgcaggcagaatatttatcgatactcttgcgtcaaagatcatttgatgaaggtccaggaggaaatagtccttatggaggtaatcaagtagagaaaatggtaggaaggtgcacatttgaacctgacgaacccagagcagcaaaggcagcttattcttttgaatatttctcattattgcaaaagttgaatcatattagactagcggaaaacggtgagacacgaccactaacgcaaccacaaagacaacaacttttatcactagctcacaaaacacctgacatatctttggcgaggattagaaaagaactagccctaccagaaacagtacaatttaatggagtcagatgcagagccaatgaaaccttggaagaaagtgaaaagaaagaaaaatttgcctgtctaccggcataccacaaaatgagaaaagcccttgacggagtagtgaaaggaaggatttcaagtttgagcatatcgcaaagagatgcagccgcaactgcgcttagtctctataaaaatgaagatacgcttagggccaaactaaccgaagcaggatttcaagcaccagaaattgacgcattagcaggactaactggattctcaaaattcggtcatttatcacttaaagcatgccgtaaacttataccacacttagaacagggtttaacgtatgatcaagcatgtacagcagcaggatatgatttcaaaggacatggtgcaggagaaagagcattcacattaccagcagcggccccggaaatggaacaaataacttcaccagtagtgagacgagcggtagcacaaacaataaaagtagtaaacggaattataagagaaatggatgccagtccagcgtgggtaagaattgaattagcgagagaactatcaaaaacattcggcgagagacaagaaatggatcgatccatgagagaaaacgcagcacaaaatgaacgacttatgcaagaattacgggacacattccatttacttagtccgacgggacaagacttggttaaatatagattatggaaagaacaagatggagtttgcgcatactcactcaggagattagacgtagaaaggttgttcgaaccaggatatgtagatgtagatcatatagtaccctactcactatcttttgatgatcgaagaagtaacaaagtgctagtattaagtagtgaaaatagacaaaaagggaaccgattaccattacaatacttacaaggaaagaggagagaagattttatagtatggacaaatagcagtgtacacgattacagaaaaagacaaaacttactaagagaaaaacttagtggagatgaagcagaagggtttagacaaaggaacttgcaagacacacaacacatggcacggtttttgtacaattatataagcgaccatctagcttttgctcaaagtgaagcactaggtaaaaagagagtatttgctgtatcaggagcagtgacaagtcacctaagaaaaagatggggtttatcaaaggtacgagcagacggtgatcttcatcacgcattagatgcagcggtagtagcatgtactaccgacggaatgatccgtagaatatctgggtactatgggcatattgaaggcgaatatttgcaagatgctgatggcgcaggaagtcaacacgcaaggacgaaggaaagatttccggcaccatggccacgttttagagatgaactcatagtgagactatcagaacaaccggcagaaccactactagatattaacccagaattttattgtgaatacggaacagaacacataagacctgttttcgtatccagaatgccgcgaagaaaggtaacaggacccggacataaagagaccatcaaaggagctgcagcagctgatgaaggtttattaacagtaaggaaagccctcacagaattaaaattagacaaagatggagaaataaaagactattatatgccttcctcagacacactactgtacgaagcactaaaggcccaattaagaagattcggtggtgatggtaaaaaggcttttgcagagcccttttacaaacctaaagctgatggtactccgggaccactggtaaggaaagttaaaacaactgagaaagcgactcttacagtacccgtacatggtggcgccgcatcaaacgatacaatggtacgagtagatgtgttcctagtgccaggtgatggatactattgggttccagtttacaccgcagatactctaaaacctgaattaccaaaccgagcagtagtgcaaggaaaaccatacagtgagtggaaagaaatgagagaagaagactttatatttagcctatatcctaacgatctagtatacgtcgaacacaaaagcgggttaaaatttacactacaaaacgccgattcgacattagaaaagactagaacacaaacgagcgcattcgcatactttgtaagcggaagtattagcacagcctccatcacaataagaactcacgataatgcttacggaataccaagtttaggagtaaaaactctaaaaacatttcacaaatatcaagtagatgtactaggaaacgtttttccagttcataaagaaacacggcagaaattccgatga

SEQ ID NO: 8523 - RNA, 3255 nt, synthetic construct
  misc_feature 1..3255: note = Cas9 variant
  source 1..3255: mol_type = other RNA
atgcgtttgggactagatatcggtactaattcaataggatggtggctatatggaacagaaggagggagaataacagaagtcgtagatgggggagtacgaattttctctgatggtcgagacccacaatcaaaggcttccctcgcagtcgacagacgagctgcaagaagtcaaagaagaagacgcgatagatatcttaggagaaaagcagcactaatgaaaagaatggcacaagtcggactaatgcctgcagacccagcagaagcgaaagtcttagaagtattaaacccttatgaactaagggccagtggcttagacggtccactaccgctaacccactttggtcgagcacttttccatttaaatcaaagaagaggatttaaatctaatagaaaaactgatagaggcgataacgaaagtggtaaaatcaaagatgcaactgccagattagatcaagcaatgatggcaaaaggagcaagaacttatggggaatttctacatatgcgcagagcagcagctttggatccgaaaagcgtaccaagtgtacgtaccagactaacagtcgcacgaagggacgacgcggaaaaagaagaagccggctacgatttctacccagatagaaaacatttaagtgaagaatttgataaactatgggcagcgcaagcaagacatgcaccagacgtattaactgaagatcttagggatgaaattgcaacgataatatttcatcaacgacccctaaaaacaccagaagttggtctttgtctcttcacaggacaacatggagttccggaaagagataaaagaataccaagcgcacatccacttaatcaaagacgaatcttgatggaaactgttaataatttaaaagtcgcagcccaaggggagcctagtcgaccgttaactagagaggagcgagatcaaatagtccatgcactagataataagaaacacacgaaaagtctatcgggaatgacaatgaaactaaaagcactaggaaaagtaatcaaattaagaccagagcaaggattcacattagaaacagcgaatagggatgcaatagcatgtgatccagtacgtgcaagtttaagccacccagatagattcggcgccagatggagcactctcgaatcagctggacaatgggatgttgtacaacggattagagctgtacaaagcgatgcagaacatgccgacttagtaggatggttaatggacgtacacggattagacagagaccacgctgaagaaacagcgaatgccccgttacctgaaggatatggcagattaggcctaacagcaactacgagaatcctagccgctctggaagccgacgtcttaaattatagcgcagcagtcgcagcatgtggatggcaccactcagacggaagaacaggtgaagtattagaatcactcccatattatggtgaaattctagaaaggcacgttatacccggaactggagaccccaatgatgatgacgtcaaaagatatggaagaataaccaatcctaccgtacacataggattaaatcaacttcgcagattagtgaataggataataacggtgtacggacgaccagacgaaatcgtagtcgaactagcacgagatttgaaattgagtgaagaccaaaagaaagatgttcagagagacataaagaaaaacaccgaagcagctattcgtagaggaaagaaattagaagaaatgggcgtaccgaataccggagcaaatagaatggtattgagactatgggaggaccttggagacgatgtgatgactcgaaactgtccatatacaggtaaacgaatatctgcaggcatgttattcgatggtagttgtgatgtagatcatatactcccatatagtcgaacgctcgacgatagctttgccaatagaacactttgccttaaagaggcaaatcgtcagaaaacagataaaacgccctgggaagcatggggcgaaactgagcaatgggaagctatagctgcgaatttgaaaaacctaccagccaataaagcatggcgatttgcacctgacgcaatggaacgattcgaaggagagaaagatttttctgcaagagcactagcagatacacaatatttaagcagaatcgcaagagcatatttggacgctctatatgatggcgatgatggaaaaagccatgtttgggtcgtccctggtagacttactgaaatgttaagaagacactggggcttgaacggggtcgctgccttaactgattcagataaacaaactgttaaagccaaaaatcgcacagatcacagacatcatgcaattgatgcagcagtagttgctgcaacggacagaggactaataaaaagaatagcagatatggctaaacgagatgagttcaatggagccgaagaagtagctagaagtataccaccaccatgggaagggtttagagatgacgttagtgctcaagtaacacgcatcatcgtctcacacagagctgatcatggaaggatagatccagctgcaagaaaaagtggcagagatagtacatcaggccaactacacaatgacaccgcatacggaataggtagagatggaactgtggtaagtcgaaaaccgttagctagcttatcgccaaacgatatcgtggtgactaaaagaggagcaaatataagagatgtagacctacaaaaacatctggcaagagtgacacacgggcttgacggaaaagcatttgaagctgctctattagcttttgctgccagtccaatattacccgacaacacggataatccatattttggattgaggagggtacgactagaagaaacactacaagaaagtgcaagggtggaagtagctgaccaagaaggaagaccatataaagcatataaaggtgatagcaatcactgctacgaaatatggtgtcttcctgacgggaaaattaaaccacaagtagttacaacttacgaagctcatcaatctggggctgaaaagaaaccacacccagcagcaaaaagacttatgcgaattttcaaaagagatatggttatgttagagagagacggggaaacaatcataggctatgtacagaaaatgaaacaaaatggcagcatatttgtcgcaccacacacggaagcaaacgcggatgcaagagatagagatccaaaagacgattttaaattaattcaattgggagctggttcattggtgaaagcaaaagcaagaagagtgattgttgatgaaatgggacgtttacgagatccaggaccaccactttga

SEQ ID NO: 8524 - RNA, 3258 nt, synthetic construct
  misc_feature 1..3258: note = Cas9 variant
  source 1..3258: mol_type = other RNA
atggacaaaggaacaaatagtataggatgggcggccttaagactagatgaacaaggagaaccagtaggtataattgaagccggtgttagaatatatgcagatggccgagaaccgaaaagcggaacatcactagcagaaggaagacgtatagcgagaggcatgtcaagacgacgcgatcgatacaaaagaagacggagaacagtgttgaatactctgacagaatttggattgatgccagctaccaaagctgcaagaaaggccctagtagctgaaacaaatgaccgaaggtttggagaagtagctagtaatgtatacgcactacgagcaagagcactagatgaaaaactcccgctttatcaattagggagagccttattccacttaaatcagagaagaggatttaaaagcaatagaaaaacagataagagagacaacgatcaaggaaaaatagcaagtgcaatttcccgactaggaagaaaattagacgaagcaggagctagaactttgggagagtttctacacaaacagcacgctgcaggaaaatgggtacgtgtaagaccaagtcgtgtaccaggagaagacgacaaagaagaagatggatacgggttctatcccgaacgaagttttctagagagagaatttgcagctatatgggaagcacaagcggcgttttatccggaactactgaccgaagaacgccgagaccatttgcactgggtaatgttctttcaacgaccactcaaaagaccaacggtaggaaaatgctcatttcatccggatgaagatagactacctaaagctcaccctctatttcaagaatttcgattaataaaagaattgaatgaattagaagttgtacacagaggggatagaagagaaaaactaacaccagatcaaagggacaggctattcaaccaattaagaactcagagatcgagtgcattcacagcattaagaaagacaataaaagctcctacaggaacgagatttaataaagagagtgacgcaagagataaattaaaaggagatgaggtcgctgcagaaatgagtcacaaagatagatttggacaagcctggattggaatgccactagctgaaagatgggcagttgtagcaatgttgctcgatacagaagaccccctagaggtcaaagcgtggctcgaagaaaggtacggattcgcagcagatagaattgatgcaattgcagcagcaaaacttccaacaggatatggaagactcggagaaacagctttaagagatatgctagatgagttaagaaacggaactgtcaaagatgatgcaggaagggatgtagtattaacagaaaggcaagcaatggataatatttggggcgataacccagccttacaaagagcagttaccgatgctcgagaattaccaccgtaccaagaagtccttggacgaagaatacccccaggtactggaaaacctgcagatccatatgatgtacaaaaaggccgattaacaaacccgactgtgcatatcggtctgaaccaacttaagcgtatcgtaaacgtactaatgaggagacatggtagaccggaacaaatagcactagaactcgctagggatctaaaactaaacgaagaacaaaaagcagagaaaaacagggaaattgcaaggaacacaaaagctgcagaagcaagaggcaaaaagttggaagagttaggccacgcgaacaatggttacaatcgagtcctattaaaattatgggaagacctaaacttaaaacaaccagaaaatagagaatgtatatattgtggaaaagcaataggcataggcaccctactttcaaatcaagtcgacatagaccatattctaccatggagtaaaacattagatgactcccaagccaatagaattgtttgtcacgtggaatgtaatagacaaaaaggaaatcatgcaccggctgaagtaccgcaatggcatgacagatatgacgatatactggcgcgagcagaacgactacctagaaacaaagcatggagatttggaagagaagcgatgaagaaatttaaagacgatgagagctttctagcgcgccaactaacggacactcaatacctatcaagattagcccatgaatatttaggagcattgtacccagatgaagaaccagatgagtggggagggccggctcgacgaaaccacgtgagagtgataccgggaaggatgactgaaatgttacgtagacaatggggtttaaatgcaataatttcagatcataatcaaaagaacagaaacgatcatagacatcacgcaatagatgctatagtagttggtgtaactacacgtaggttactgcaaagaatcgcaacagtggccggaggaagggaagctcttgccctagaggagactataggtaaaatcgaacctccatggccaggattctacgacgacgtaaaagctgcaattgacaggattgtagtttcccacaaaccagatcatggatctctaccaaaaccaggaaagcctggaagaacagcaggacaattacacaatgacacagcatacggatttacaggcgaagcaagaaatggagtacctataatggtacacagggttccttttgctagcttaacagaaaaagatattccaagcataagagaccggcaattagcagatgcgttatatgcagctatttcggggataagtggcaaagcagaattagcagctgcattagcgaggttctcagaatcaggaccttataagggtataagacatgtaagggtagtagaaccagtgagtgtcatagcaattaaggaccaagccggaaaagcctataagggatataaaggtgatgcgaattatagatacgatgtctgggaactacctaacggaaaatggacacacgaagtggtaagtatgtttaatgcacatagacctgattggcagagcgaaatcagaagtaaaaatcccgcagcccgcaaagtattaagtctacatcaaaacgatatggttgcttacgaacatcctcaagacggttacacaatcgggagagttgtaaaattttccgcgggaggccaaatggcattagccggcaatagagaaggaggagccttaaaaagtagagacgctgatcccgaagatagattcagatatttctacaaatctgggggagcaatgagagacgtgcagttaagacaggtaagagtcgacgaaactggaagggtattcgacccaggtccacaagatagagaaagcagaaacgccagaaaacaaaacgatgcaggatga

SEQ ID NO: 8525 - RNA, 3264 nt, synthetic construct
  misc_feature 1..3264: note = Cas9 variant
  source 1..3264: mol_type = other RNA
atgcggtataaaataggcttagatataggaataacatcagtcggatgggcagttatgaacctggatataccaagaatagaggatctaggcgtcagaatttttgacagagcagaaaacccccaaacaggtgagtccttagctctaccaagacgtttagcccgaagtgccagaagaagattacgaaggcgaaagcatagacttgaaagaatacgaagattagttatcagagagggaatactaaccaaagaagaattagacaaattatttgaagaaaagcatgaaatagatgtatggcaactaagggtggaagcattggatagaaaactaaacaacgacgaattagcgagagttttattacatctagccaaaagacgcggatttaaaagcaatagaaaaagcgaacgcagtaataaagaaaacagtacaatgctaaaacacatagaagaaaacagagcaatattgagttcatacagaacagtaggcgaaatgattgtaaaagaccctaaattcgcattacataagcgaaataagggcgaaaactatacaaacaccatcgccagagatgacctagaaagagaaattcgcctaatcttcagtaaacaaagggaatttgggaacatgagttgcaccgaagagttcgaaaatgaatatattacaatatgggcatcacaacgacctgtagctagtaaagatgacatagaaaagaaagtaggattctgcacatttgaaccgaaagagaaaagagctcctaaagcaacttacacatttcaatcctttatcgcgtgggaacatataaacaaactacgactcataagcccctctggggcaagaggacttacagacgaagaaagaagactactctatgaacaggctttccaaaagaacaaaattacttaccacgatattagaacactattacacctcccagatgacacatattttaaaggaatagtatatgatagaggagaatcaagaaaacaaaatgaaaatataagatttttagaactagatgcctaccatcaaatccgcaaagcagttgacaaagtttatggaaaaggcaaatcaagctcgtttctaccaatagactttgatacatttgggtacgcgcttacattatttaaagatgatgcagacatacatagttatcttagaaatgaatatgaacaaaacggaaaacgaatgcctaatcttgctaataaagtctacgataacgaacttattgaagaactattaaacttatcattcacaaaattcggtcatttaagcctcaaagcattgagaagcatactaccgtatatggaacaaggtgaagtatactcctccgcatgcgaacgtgcgggatatacttttacaggacctaaaaagaaacagaaaacgatgttgttaccaaacataccacccatagcaaatccggtagtgatgcgagccctaacccaagcccgtaaagtagtaaatgcaataatcaagaaatacggatctccagtcagcatacatatagaattagcaagggatttatcacaaacgttcgatgaacgacgtaaaacaaagaaagaacaagatgaaaaccggaagaaaaatgaaacagcaattcgccaattaatggaatacggactgacacttaacccaaccggacatgatatagttaaatttaaactgtggtcagaacaaaacgggagatgcgcctattcactacaaccgatagaaatagaaagattgttggaaccaggatacgtagaagtagatcatgtcataccctattctcgaagtttagatgactcatatacaaataaagtcctagtgctaacgagagaaaacagagaaaaaggtaacagaataccagcagaatacctcggagtaggcactgaacgatggcaacaatttgaaacttttgtccttacaaataaacaatttagcaaaaagaaaagagaccgtttattaagactccattacgatgaaaacgaagaaaccgagttcaaaaatcgaaacctaaacgatacaagatatatatcaagattctttgcgaactttatcagagaacatctgaaattcgctgaatctgacgacaaacaaaaagtctatacagtaaatggaagagttacagcacacttacgatcaagatgggagttcaataaaaatagagaagaatcagacctacatcatgcagtcgatgcagttatagttgcctgtaccacaccatcagacatagcgaaagtaactgcattctaccaacgaagagaacaaaataaggaactagcgaaaaagaaagaaccacattttcctcaaccgtggcctcattttgcagatgaactaagggcaagattaagcaaacatccaaaagaatcaattaaagctctgaacttaggcaactatgacgatcaaaaattagaaagtctacaaccagtatttgtcagccgaatgccaaaaagaagtgtcactggagcggcacatcaagaaactctacgtagatacgtaggtatcgatgaaagatcgggaaaaatacaaactgtagtaaaaactaaattatcagaaataaaattagatgcatcaggtcacttccccatgtacggaaaagaaagtgacccaagaacttatgaagccataagacaaagacttttagaacacaacaacgatccgaagaaagcatttcaagaacctttatacaaaccaaagaaaaatggggaaccaggtcccgtaataagaacagtaaaaattatagataccaaaaaccaagtaataccactcaacgatggtaaaacagtagcatacaattcaaatattgtaagagtagacgtctttgaaaaagacggaaaatattactgcgttccggtgtatacaatggacataatgaaaggaatattgccgaacaaagcgatagaacctaataaaccatatagcgaatggaaagaaatgaccgaagactacacattccgattcagtttatatcccaatgatctaatcagaatagaactgccaagagagaaaaccgttaaaacagccgctggtgaagaaattaatgtaaaagacgtttttgtatattacaaaaccatagactcggcaaatggcgggttagaattaatcagccatgaccacagattttcactaagaggagtaggatcaagaacattaaaacggtttgaaaaatatcaagtagacgtactaggaaacatatacaaagtgcggggagaaaaacgagtcggattagccagtagcgcgcattcaaaaccagggaaaactatccgaccgttacaaagtactagggactga

SEQ ID NO: 8526 - RNA, 3264 nt, synthetic construct
  misc_feature 1..3264: note = Cas9 variant
  source 1..3264: mol_type = other RNA
atgctaagaatgaaatatgcgataggactagacataggaatagcttcagtcggatacgctgtattagcactagaccatgaagaaaatccatggggaattataagattaggatcacgaatcttcgacgtagcagaaaatccaaaagatggggcatcacttgcactaccccgtcgagaagcaagatccgtccgcagacgattgagaagacatcaccaccgattagagcgaattaaaaacttactcataaacacagagttcataactaaagacgaattattacatctatatgatggaaacctaagtgatgtatatgaattaagagtcaaagcgttagactactcagtcaccaatgcagaactcacacgaatattactccatttagcacaaagaagaggctttaaatctaatcgaaaaagcgacgccaatgacaaagaagctggacaattattagaagcggtaagcgctaatgcaaaacgcatgcaagaaaaccattacagaacggttggcgagatgttctacaaggacgacttattcagtaaatacaaacgaaacaaaggaggaacgtacctcacaacagtgcatcgagatatgatagcggcagaagcacgaacaatactagaaaaacaattcgccttgggcaacaacatatgcacacaagactttatagataaatatctcagcatacttctttcacagaggcaatttgacgaaggaccaggagaaccatctccatatgcaggcaatcaaatagccaatatgattggaaaatgtacattcgaaccaaatgaatacagagcagcaaaggcttcgtactcattcgaaagatttaatctgctacaaaaagtaaatcatctgagattactactagaaggaaaaagtatagcattagacaacgaacaaaggaagaaaataatagcactagcacacgacaaagcagacttaagatactctcatattcgaaaagcacttggcttagatgaaaaagtattattcaatacaattacatacaatgatgatgtcagcgtaattgaaaagaaaacaaaatttaacttcctacaagcatatcaccaaataaagaaagtattggctgaagacatgcaaaaactaaccaccgaacaacttgacaacatcggtcaaatattatcaacctataaaagcgacaataaacggacagaagaattatcggcgctaggcctggaaaagaaaatcatagacgctctattaggtataaatggactctccaaatttgcacacctatccttaaaagcacttagaaaaattaatccctatttagaagagggcaaaatatacaacgaagcgtgtacagcagctggctacgactttaaagcccacgccaatacacagaaaactgaattactgcctgcatataaagaagaaatggacgacattacttcgcccgtagccaggagagcaatcgcacaaagtataaaagtaataaacgcaattataagagaacaaaaaggatcacctctatatataaacatagaactcgcaagagaaatggctaaaggatttgatgaacgtacacaaattgacaaagcaaataaagaaaatcaagctaaaaatgaacgaataatggaacggatcagaactgagttccacaaagcaaaccccaccggaatggacctaataaaactcaaattatgggaggaacaagatggccgaagcccatatagtcaaaaagcaatatcaatcaatagacttttcgaaccaggatacgttgatatagatcatatagtaccatattcaataagtttcgacgactcatttaaaaataaagtattagtctttagcgatgaaaaccgcgacaaaggcaatagactacctatagcatatctacaatctaaattcggagccaaagcagccgaaaactttatgatatgggtccaatctaacattaaagactataagaaaagacaaaaactcctcaaacgggaaattacagaagaggatataaataaattcaaagaacgtaacctccaagacacaaaaacaattagcagattcctatacaattatataaatgactatcttctttttgcaccatctgacaccggcaaaaagaaaagagtcacagcagtcaatggaactatcacagcgtatcttcgaaaacgttggggaataaataaaataagggccaacggagataagcatcatgccgttgatgcagtagtcatcgcttgcacaacggacaaaatgataaaggatttgtcatcatttagcagataccacgaactagagtacacgcatacagacaccgagagctttttagttaatagtctaacgggagaaatattaaaacgtttcccatatccgtgggaagatttccgaccagaactaatggctagattaagcgataatcctgcagatgcactacgaaagttaaacctcatcttctatcacggtatcgacctatccaccataaaaccaatatttgtaagtaggatgcctcgccataaagttacaggggcagcacacaaagctacaataaaaagcgcacgttgcctagacaacggaatagtaatctgtaaaacatctttacaaaacttaaaacttgacaaggaaggcgaaatagcaaactactacgcaccagaaagcgatacaatactatacaacgcactaaaagaacgcttaagatcatacgataataaaccagcaaaagcatttgcagaacccttctacaaaccaaaagccgacggtacacctggacccctagtcaagaaagtaaaagtatatgaaaaatcaacactaaatgtagcagttcaacaaaataccgcagtcgcagacaatgactcaatggtcagagttgatgtgttccacgtaaaaggaaatggttactacctcgtaccaatttatatagccgacacccttaagaaagaattaccaaacaaagcaatcgtcgcttacaaaccatacgcggactggccagtcatggacgatagtaacttcatattttctttataccctaacgacctaataaaatttgaacataaaaatagcgtaaaatttgctaaagtgaataaagaatctactttaaacgacttctattcaacaaaaagcgaaatcgtctatttcaaaggatgtaatatcaacacaggagccataactataataaatcacgaaaatacatatgtagtaagctctcttggggtaaaaaccttacccagcttagaaaaatatcaagcagatgtacttggaaactatacaaaagtgaagaaagaagttagaaaaccattcaggtga

SEQ ID NO: 8527 - RNA, 3264 nt, synthetic construct
  misc_feature 1..3264: note = Cas9 variant
  source 1..3264: mol_type = other RNA
atgcgctacaaaataggattagatatcggaattactagcgtaggctgggcagtaataaacctagacataccaagaatcgaagacttaggagtacgtatatttgacagggccgaaaaccctcagactggggaaagcctagcactcccacgccggctagctcgtagtgcaagacgtagattacgaagacgaaaacaccgcctagaaaggattagacgccttataatacgagaaggtattctaactaaagaagaactagataaactatttgaggaaaaacacgaaatagacgtgtggcagttacgagtggaagcactagatagaaaattaaacaacgacgaactcgccagagtattactacatctggcgaaacgtcgaggatttaaatctaacagaaaatcagaaagaagcaacaaggagaactcaacaatgttaaaacacatcgaagaaaatagagctatactctcatcctacagaacagtaggtgaaatgatagtaaaagacccgaaatttgcacttcataagcgtaacaaaggagaaaattacacaaacaccatcgcaagagatgacttagaaagagaaatccgtctaatattctcaaaacaacgagagttcggtaatatgagctgcacagaagagttcgaaaatgaatatattgcaatatgggcatcacagagacctgtagcatcaaaagacgacattgaaaagaaagtaggattctgtacgtttgaaccaaaagaaaaacgagcacctaaagcaacctatacattccaaagtttcatagcatgggaacatataaacaaactaagactaattagtccatcaggaactcgaggattaacagatgaagaaagacgattactatacgaacaagcattccagaaaaacaaaataacatatcatgacatcagaactttactacacttaccagatgacacctacttcaaaggaatagtgtatgatagaggagaatcaagaaaacaaaatgaaaatatcagatttttagaattagatgcttatcaccaaataagaaaagcggtcgataaagtatatggaaaagggaaatcttcatcatttcttcccatcgattttgatacctttggctacgctctaacattattcaaagacgacgcagacatacgatcatacttaagaaacgaatatgaacaaaatggaaaaaggatgccaaaccttgcaaataaagtgtatgacaatgaactaatagaagaactcttaaacctatcatttactaaattcggacacttgagtctaaaagcgttaagatcaatattaccctatatggaacaaggagaagtgtacagtagcgcgtgcgaacgtgctggatacacatttacagggcccaaaaagaaacagaaaacaatgttgctaccaaacattccacctatcgcaaacccagttgtaatgagagcattaacccaagcaagaaaggtagttaatgcaataataaagaaatatggctcccccgtatcaattcatatagaattagcccgcgatctaagtcaaacatttgatgaaagaagaaaaaccaagaaagaacaagacgaaaatagaaagaaaaacgaaaccgcaataaggcaactaatggaatacgggctaacactcaacccaaccggccacgacatagtaaaattcaaactatggagcgaacaaaatggcagatgtgcatattcactacaaccaattgagatagaacgattgctagaaccagggtacacagaagtagaccatgtcattccatacagtcggagtcttgacgattcttacacaaacaaagtattagtactaacaaaagagaacagagaaaaaggcaaccggataccagctgaatacctcggcgtaggcacagaaagatggcaacaatttgagacatttgttttaacaaacaaacaattctccaaaaagaaaagagatcgtctcttaagactacactacgatgaaaacgaagagaccgagttcaaaaatcgaaacctaaacgacacccgatacatatcgagatttttcgcgaattttattagagaacatttaaaatttgcagaatcagacgacaaacaaaaagtctatacagtaaacggtagagttacagcccacttaagatcacgctgggaatttaacaaaaacagagaagaaagcgacttacatcatgcagttgatgccgtaatagtagcttgcacaactccttcagatatagcaaaagttactgcattctatcaaagaagggaacaaaacaaagaacttgccaagaaaaccgaacctcattttccacaaccatggccacacttcgccgacgaattaagagctcgactttcaaaacatcccaaagagagtattaaagccttaaatcttggaaactatgacgatcaaaaactagaaagcctccaacctgtattcgtctcaagaatgccgaaaaggtcagtaacaggagctgcgcaccaagaaacactacgtcgctacgtgggtatagacgaaagaagtggcaaaatacaaacagttgtgaaaaccaaattatcagaaataaaattggatgcgtctggacacttcccaatgtacggaaaagaatctgatccacgtacgtatgaagctataagacaaagacttctcgaacataataacgaccctaaaaaggctttccaagaaccattatacaaaccaaagaaaaacggagaacccggcccagtcatacgcacagtaaaaataattgacactaaaaaccaagtaatacctttaaacgatggaaaaacagtagcgtataatagtaacatagttcgagtagacgtgttcgaaaaagatggcaaatattactgtgtacctgtatatacaatggatataatgaaaggcatattaccaaacaaagctatagaacccaataaaccatactcagaatggaaagagatgactgaggattatacatttagattctctctttacccaaatgatcttataagaatagaacttcctcgtgagaaaataataaaaacagcaggcggagaagaaatcaaaataaaagatcttttcgcttactacaaaacaatacactcaggaacagctggcctagagctagtatctcatgattgtagctttagcctatctggagtcggctcaagaactctaaaaagatttgaaaaataccaagtagatgtactaggaaatatatataaagtccgtggagagaaaagagttggtcttgcctcaagtgctcatagtaaaacaggagaaactataagaccattacaaagcacaagagattga

SEQ ID NO: 8528 - RNA, 3264 nt, synthetic construct
  misc_feature 1..3264: note = Cas9 variant
  source 1..3264: mol_type = other RNA
atgagatacaaaataggcctggatataggaataacatctgtaggctgggcggtcataaacctagatctacctagaatagaagacctaggagttagaatattcgaccgagcagaaaacccacagaccggcgagagcttagctttaccgagaagattagcaagatcagcaaggcgcagactaagacgacggcgacacaggttagaaagaataagacgattgctaaccagagaaaacgtactaacgcaagaagaacttgataaactatttgaaaagaaacacgaaatagacgtatggcaattaagagtagaagcactcgaccgcaaactaaacaacgatgaattagccagagtactccttcatcttgcaaaaagaaggggattcaaatctaacagaaaaagcgaacgatccaataaagaaaattcgaccatgctaaaacatattgaagaaaatcgcagcatcttaaccggctacaggacagtcggagaaatgatagtaagagatccaaaattcgtattacataaacgaaacaaaggtgaaaactacaccaacacaatcgctcgcgacgacttagaacgtgaaattcaactcatcttcgccagacaacgagaatttggaaatatgatatgtaccgaagcattcgaaaacgaatatatcgcaatatggtcatcgcaacgtcctgtagcatcaaaagacgatattgaaaagaaagtcggcttttgtacatttgaaccgaaagaaaaacgagcacccaaagccacatatacattccaatcttttatcgcctgggaacacataaacaaactgaggctagtaagtcctagtggaactagagaactaacagacgaagaacggagacttctatacgaacaggctttccagaaaaataaattaacatatcacgatatcaggacactattacatttaccagacgacacttacttcaaaggaatcgtatatgattggggagaacccctaaaacaaaacgaaaatataagatttcttgaactcgatgcataccaccaaatacgaaaaacagtcgataaagtgtacgggagaggaaaatctagcagcttcctaccaatagactttgacacttttggctacgcgttgacactcttcaaagacgacgcgcacatcagaagctatctaagaaatgaatacgaacaaaatggcaaaaggatagcaaacttagcaaacaaagtatacgataatgaactcattgaggaacttctaaatttgagcttcacaaaatttggacacttaagtctaaaagccctaagaaacatattaccctatatggaacaaggagaagtatacagtagcgcatgcgagcgtgcaggctacacatttactggaccaacaaagaaacagaaaacggtactattaccaacaataccaccgattgcaaatccagtagtaatgcgagccttaacgcaagctcgaaaagtcgtaaacgcgattattaagaaatacggatccccagtctcaatacatatcgaattagccagagacctcagtcaaacattcgacgaaaggaagaaaaccaagaaagaacaagatgaaaacagaaaaagaaatgaaacagcaataagacaattgatagaatacggattaacgcgaaaccctactggccacgacatagtaaaattcaaattatggtccgagcaaaacggaagatgtgcgtactcacttcaaccaatagaaatcaaacgactactagaaccaggctacgttgaagtagatcacgtcataccttactctagatccctagatgacagttacacaaacaaagttctagtattaaccaaagaaaacagggaaaaaggtaatcgaatcccagccgaatatttgggagtgggaaccgaaagatggcaacaatttgaaaccttcgtgctgactaacaaacaattcagcaaaaagaaacgcgatagattattaaggctacactatgatgagaacgaagaagcagaatggaaaaacagaagtctgaatgacacgagatatatatcaagattctttgcaaactttataagggaacatttaaaattcgccgacagtgatgataaacaaaaagtatatacagtcaacggtggcgtaactgcacatctgagatcacgatgggactttaacaaaaatagagaagagtctgatctacatcacgcagtagacgcagccatcgtagcctgcactacactcagtgacatagctagagttaccgcattttaccaacgcagagaacaagccaaagaattagcaaagaaaactgaaccacatttccctcaaccatggccgcacttcgcagatgaattaagagcaagattaagcaaaaatcccaaagaatcaatcaaagcactaaatctaggaaactatgataacgaaaaattagaatcacttcaaccggtttttgtatcaagaatgccaaaacgatctgttacaggtgccgcacaccaagaaactctaagaaggtatataggaatagacgaaagatcaggaaaaatacaaaccgtggtaaaaactaaactaagcgaaataaaattggatgcatccggccattttcccatgtatggaaaagaaagcgatccaagaacctatgaagcaatacgactcagactcctggaacacaacaacgacccgaggaaggctttccaagaaccactatacaaaccaaagaaaaatggggaattaggccccataatacgaacagtaaaaatcatagatacgaaaaatcaagtaatacctctaaatgacggaaaaacagtagcttacaactcaaacatagtccgtgtagacgtatttgaaaaagatggaaaatattactgcgtaccagtatatacgatggatataatgaagaaagtgcttccaaataaagcaatagaaccaaataaaccatactcagaatggaaagaaatgaccgaagactatactttcaggttttctttatacccgaatgacttaatcagaatagaactaccacgagagaaaacagtaaaaaccacagcgggccacgaaataaatattaaagacgtcttcgtatattataaaacaattgactcagccacaggaggactagaactgataagtcacgacaattcattcagcctcagaggtataggttctcgaacactaaaaagatttgaaaaataccaagtagacgttctaggaaatatctacaaagtgagaggagagaaaagagtcggactagcatcatcagcacatccagaaacccgggaaacgataagaccacttcagtcaacgcgagattga

SEQ ID NO: 8529 - RNA, 3264 nt, synthetic construct
  misc_feature 1..3264: note = Cas9 variant
  source 1..3264: mol_type = other RNA
atgaaaaaattagtcttaggcttagacattggagtagcgtcagttggatggggtataatagatgcagaaaatggagatgtagtcgatacaggagtgagactattctcatcacgagacgcttcagaaaatgaatcgcgccggacctcacgacaaagtcgtagactgagtagaagaaaaaaacacagaagagaaagaatcaaacaattactcctagcacatgacatggatatatgcgatatagtcaacgaaaatccctacgagctacgcgtaaagggacttaacgagaaactagaagtatcagaaatatacgtagcactaacacaccttgcaaaaagaagaggagttagctatctagatgatgtagtagaagaaggaggaaccataaagagcgaacaccttaacaaaaacatggaggaaattaaaagtggtaaaatgccttgtgaaatacaattagaaaggttcgaaaaatatggacaagtaaggggaatgatcgaaattaatcaagatacagaagaaagctcatttctagtaaacatttttaggacgagcgactacatcaaggaagcaaaaaccatcttagctacccaacaaaaatttcacaaacaaattactaatgaattcatcgacgaatacatacatataatggcctccaaaagagattactttataggacctggcaacgagaaaagtagaacagactatggggtctatagaacaaatggagatacttgggacaacttattcgaaatattaattggaaaatgttcagtattcccggaagaaacaagagctgcacgttcaagttacgtcgcacaggaatttaacttattaaacgatttaaataacctaaaaataagtaatcttgaatcaggaaaattatccgcatcacaaaaacacgacattgttgaaaaagtaaaaaactcaaaaaaattcggcactaaagatctcttaaaatatatagccagtgtatgcgaatgcaaaatagaagatatcggaggttgcagggtagataaaaataggaaaccgataatgcacacttttgagaattacagaaaagtgcacaacgcactgaatgaagcaggggtggacctacgactatcggaaactgattacgatgaactgatgaagattatgacattaaattcagaaacccttgagataaaaaaacaatgcaaagaaaaactcccccaactaactgaagattacctaaacgtatgtttagttttaaacaaaaaaggagcattctcaggttggcatgctttaagcctcaaagcaatgaaactcatgatgcctgaattatatggcacaagtaagaaccaaatgcaaataatacatacaatgcaactaggcaaagcatacttaaaaccactaaatcaacaaaagtaccttaactctgaagcaatactagaagagatttataaccccattgctgcccgaagcattagacaaacaataaaagtaacaaatgccatattaaaaaaatatggccacctagatagcgtaataatcgaaatgccacgagattatcaaacgagcgaagatgaacgaaaaatgattgaaaaaatgcaaaaagaaaacgaaaaagaaaaaaaagcggcattaaaaagagcacgtgaagaatacccatttcccgacgaagcattcagaaaccataaagaattagctacaaaacttaggttatggtaccaacaagatcagttctgcgtatattcaggtagaaaaatatctgtggtagatttagtacgcaatcccaaccaatttgaaatagatcacataataccccaatcagtaagcctagatgattcacttaacaataaagtactatgtttttcagaagaaaatcaaaaaaaaggacaacaaactccattttactatcacaagggcaaaagtggtaattggacctacgaacaatacaaactattcgtagaaaaattattcgacaaaaaaaaaatcagtaataagaagagggaactattactattcgaagaagacataaataaatgggatgttagaagaggatttatcgcccgaaatttagtagacacaaggtacgcatcacgagtaattcttaatagctaccaacaatactttggaaatcacgaaatgggaaccaaagtaaaagtcgttagggggaagtttactagtcagttacgaaaaaaatggcgtatattcaaggacagaaacgaaagccactctcatcacgcaatagatgccctaatagttgcagcaacagcaaatcttagattatggaaaaaaaatacattaggagtatctgatgaaggaaaagtttacgacaaggaaactggtgaaatcctacctttcgaaaagctaacagaaagcgaatacaacgaaatgatgaataaggaaccatacctcaactttaaaactaaactacaaaacatagagaccaaagttaaatactcttacagagtgtcaaaaaaagtaaacagaaaaataagcgatgccacgatatatagcacacgcgaaagagatggaatagactacatcgtgggaaaaattaaaaacatttacgacgtaaagacctataaagatcaatttttaaaaagatacaaaaaaaacaaagaacaattcttaatgtatcaacatgaccctcaaacattcgcaatattggaaaacatcatggcaacttaccaagacgcagaaaacccatttctcgcttataaaaaagaatacggagtcataaggaaatatagcaaaaaaggaggaggatcaccagtaacgagcctaaaatttatagacaaagtacttggacaaaaaatcgacctaacagcaaaaaaccaagctgcactcccaaaaaataaaaaggtagtcctccaatccatcacaccctatcgcgctgatgtatattatgacgaaatcgataaacgatatcacctcataggagtaaaatactcattgtttagtttctcaaaacaaggatatgtaataaaccccattgcgtaccaaaaactcctagaaaaagaacaaatccactcagaaatgaaattctgcttttcactatatagggaagatataatagaatttggtgaagacccagattcccttactagatacagattctggtctaaaaatgaatcaggaaaaaacaaaattgaagtaaaaccgatagaaaaaccaaatttcgagaaacaaacagtattaacaattacgaaaaagataaagatattaaataaataccaaacagatgtactaggtaatagctttaaagcccaagaagaaaaagatccaagaaatatagagtga

SEQ ID NO: 8530 - RNA, 3264 nt, synthetic construct
  misc_feature 1..3264: note = Cas9 variant
  source 1..3264: mol_type = other RNA
atgagatataaaataggacttgatataggtattacttcagttggatgggcagtaatgaacctagatatcccccgcattgaagatctcggagtccggatatttgacagagcagaaaacccacaaacaggagagagcttagcattacctaggagattagctagaagcgcaagacgaagactgcgcagaaggaaacacagactcgaaaggatacgcagattagtaataagagaaggaatacttacaaaagaagaactcgacaaactattcgaagaaaaacatgaaatagatgtatggcaactacgagtagaagcgctcgatagaaaattgaataatgatgaactagcaagagtattattacacttggcaaagcgccgagggttcaaatcaaatagaaaaagtgaaagatcaaacaaagaaaacagcacaatgttaaaacacatagaagaaaatagggctatcctgtcatcatataggactgtgggagaaatgatagtcaaagatccaaaattcgcattacacaaaagaaataaaggggaaaactacacaaatacaatcgcccgtgacgatctagaaagagaaatacgactaatattttcaaaacaaagggaatttggcaacatgagttgcacagaagaatttgaaaacgaatacataacaatttgggcctcacaaagaccagtcgcaagcaaggatgatatagaaaagaaagtaggattctgcacattcgaaccaaaagagaaaagggcaccgaaagcaacatatacattccaatcattcatagcatgggaacatataaacaaacttagacttatctcaccaagcggggcaaggggcttaacagacgaagaaagacgattgctttatgaacaagcatttcagaaaaataaaataacatatcacgacatcagaacactgttacatctgccagatgacacttactttaaaggcatagtatacgatcgtggggaatcaaggaaacaaaacgaaaacataaggtttctagaactagatgcttaccaccaaataagaaaagctgtagacaaagtatacggtaaaggaaaatccagttccttcttaccaattgattttgacactttcggatacgccttaacattatttaaagacgatgcagacatccacagttatctaagaaacgagtatgagcaaaatgggaagagaatgccaaatctagcaaacaaagtatacgacaatgaattaatagaagaactactgaatctatcatttacaaaatttggacatctaagcctcaaagcgctaagaagcatactaccatatatggaacaaggcgaggtatactcaagcgcatgtgaaagagcaggatacacgttcaccggccccaaaaagaaacagaaaaccatgttactcccaaatatcccaccaatagcaaatccagtagtaatgcgcgcattaactcaagcgagaaaagtagtgaacgcaatcatcaagaaatacggcagtccggtaagcatacacatagaactcgcacgtgacctaagccaaacatttgatgaaagaagaaaaactaagaaagaacaagatgaaaatcgaaagaaaaacgaaactgcaatcagacaattaatggaatatggcctaacacttaaccctaccggacacgacatagtaaaatttaaattatggtcagaacaaaatggcagatgcgcttatagcctacaacccatagagatcgaaagactattagaacctggctacgttgaggtagaccatgtaataccatacagtagaagtctagacgattcatatacaaataaagtattagtactaactagagaaaaccgagaaaaaggaaataggataccagcagaatatttaggagtgggaacagaacggtggcaacaatttgaaacattcgtattaacgaacaaacagttcagtaaaaagaaaagagataggttactaagactccactacgacgagaatgaggaaacagagttcaaaaatagaaatctaaatgacactagatatatcagtagattctttgcaaattttataagagaacatctgaaattcgctgaatccgatgataaacaaaaagtatacacagtcaatgggcgcgtcacagctcatttaagatcaagatgggaatttaacaaaaatagagaagaatcagacctacaccatgccgttgacgctgccatcgtggcttgtaccacaccttcagatattgcgaaagtaacagctttttatcaaagacgagaacaaaacaaagaactagccaagaaaacagaaccacacttccctcaaccttggccacattttgcagatgaattaagagccagactttcaaaacaccccaaagaatccatcaaagcactaaatttaggtaactatgatgatcaaaaattggaaagtctacaacccgtctttgtttcacgtatgcccaaaaggagtgtaactggagctgcacaccaagaaaccttacgacgatacgtaggcatagatgaacgtagtggaaaaatccaaacagtcgtgaaaacaaaattatctgaaataaaactagacgcatcaggccactttcccatgtatggaaaagaatcagacccacgaacatatgaagcaataagacaacgtctactagaacacaacaacgatccaaagaaagcatttcaagaaccattatacaaaccaaagaaaaacggagaaccaggtccggtaatacgcactgttaaaataattgacactaaaaatcaggttatcccattaaacgacggaaaaacagtagcatacaatagtaacatcgtaagagttgatgtttttgaaaaagacgggaaatactactgtgttcctgtatatacgatggacattatgaaaggaatcttaccaaacaaagcaatagaaccaaataaaccatattctgaatggaaagagatgaccgaagactacacatttagatttagtctttatccaaatgatttaataaggatagaactacctcgagagaaaacagtcaaaacagctgcaggagaagaaataaatgtaaaagacgtttttgtatattataaaaccatagactcagcaaatggcggactagaattaatatcacatgaccaccgattttctctgagaggagtcggtagccgcacactaaaacgatttgaaaaatatcaagtagatgtcctggggaacatttacaaagtaagaggagagaaaagagtaggattagcctcgagtgcacactccaaaacaggagaaactgttcgacccttgcaaagcactagagactga

SEQ ID NO: 8531 - RNA, 3264 nt, synthetic construct
  misc_feature 1..3264: note = Cas9 variant
  source 1..3264: mol_type = other RNA
atgaggtacaaaataggactagatataggaataacaagtgttggatgggcagttatgaatttagacataccaagaattgaagatctaggagtaagaatatttgaccgagcagaaaatcctcaaactggagaatctctcgcattgccaagaaggcttgctagaagcgcaaggagaaggctcagaagacgtaaacaccgactcgaacgaatacggcgactggtaataagagaaggcattctgacaaaagaggaactagataaactctttgaggaaaaacacgaaatcgacgtatggcaacttcgagttgaagcactcgacagaaaactcaacaacgatgagctggcaagagttttattacatctggccaagagacgaggatttaaatcaaacagaaaaagcgagagatcaaataaagaaaattcgaccatgctcaaacacattgaagaaaacagggcaatattatcatcatatagaacagtaggagagatgatagtcaaagatcccaaatttgcgctccataagcgcaataaaggtgaaaactataccaacacgatagcacgggacgatttagaacgggaaataagattaatttttagcaaacaacgagaatttggaaatatgtcttgcactgaggaatttgagaacgaatatataacaatctgggcaagtcaaagaccggtcgcgtcaaaagacgacatagagaagaaagtcggattctgcacattcgaaccaaaagagaaaagagcaccaaaagcaacttatacctttcaatcattcatagcctgggaacacataaataaacttaggctcatatcacccagtggcgcacgaggactaacagatgaagaaagaagactactatacgaacaagcatttcagaaaaataaaatcacatatcatgatataagaacactactacaccttccagatgatacatattttaaaggaatagtatacgaccgaggggaaagccgaaaacaaaatgaaaatatacgattcttagaactagatgcatatcaccaaataagaaaagctgtagataaagtatatggaaaaggcaaaagttcatcgtttctacctatagacttcgatacctttggttacgctttaactctattcaaagatgacgcagacatacactcatacttacgaaatgaatatgaacaaaatggtaaaagaatgcctaatttggcaaacaaagtatatgataacgaattaatagaagaattacttaatctatcttttactaaattcggacatctttccctgaaagcattgagatcaatactaccctatatggaacaaggcgaagtttatagcagcgcatgcgaaagagcaggctataccttcacaggaccgaaaaagaaacagaaaactatgctattaccaaacataccaccaatagcaaatccggtagtaatgagagcgctaactcaagcaaggaaagtagtaaacgcaattattaagaaatacggctcccctgtaagcatacacatagaattagccagagacctgagccaaacattcgatgaacgaagaaaaacaaagaaagaacaagacgaaaatagaaagaaaaatgaaacagcaattagacaactaatggaatatggtctgacactaaatccaactggccacgatatagttaaatttaaactctggtcggaacagaacggcagatgcgcatatagcttacaaccaatagaaatcgaacggttattagaaccaggatatgtagaagtagatcacgtaataccatatagtagatcactagatgatagttatacaaacaaagtactggttctcaccagagaaaaccgcgaaaaaggaaatagaatcccagctgaatatctaggagtcgggacagaaagatggcaacaattcgaaacttttgttttaacaaacaaacaattctctaaaaagaaacgagataggctactaaggttacattacgacgaaaatgaagaaaccgaatttaaaaatagaaatttaaacgacacacgttatatctcgagattcttcgcaaattttatcagagaacatttgaaatttgccgagtcagatgacaaacaaaaagtgtacacagtaaacggtagagtaacagctcatttacgaagtagatgggaatttaataaaaatagagaagaaagcgacctacaccatgcagtagatgcagtaatagtagcctgcaccactcctagcgatatcgctaaagtaacagctttctatcaaagaagggaacaaaataaagaattggcaaagaaaaccgaaccacatttcccccaaccgtggccacatttcgcagacgaattacgagctcgactaagtaaacatccaaaagaatcgatcaaagcactcaatttgggaaactacgacgatcaaaaactcgaatcactccagcctgtattcgtatcaaggatgccgaaaaggtctgtgactggagcagcacatcaagaaactctacgaagatacgtagggatagacgaacgatcaggaaaaatacagacagttgtaaaaacaaaactaagcgaaataaaactcgacgcatctggccattttccgatgtatggaaaagagagtgatcctagaacctatgaagcaattagacaaagattactagaacataataacgaccctaaaaaggcatttcaagaaccactatacaagccaaagaaaaatggagaaccaggaccagtaatacgcaccgttaaaattatagacaccaaaaaccaagtaattccactgaatgacggaaaaaccgtggcatataactcaaacatagtgcgagtagacgtctttgaaaaagatggtaaatattattgtgtaccagtatatacgatggatatcatgaaaggtatactcccaaacaaagctatagaaccaaataaaccatacagtgaatggaaagaaatgactgaagactatacctttcgtttttcactctatccaaatgatttaatccgaatagaattacccagagagaaaacggtcaaaacagccgcaggcgaagaaattaacgtgaaagacgtttttgtatactacaaaaccatagatagtgccaatggcggtctggaattaataagccatgatcacagattttcgttacggggagtgggatcacggacgttaaaacgatttgaaaaatatcaagtagacgtgctaggcaatatatataaagttcggggtgagaaaagggtggggctagcatcgtcggctcattcaaaacccggaaaaactattcgacctctacaaagtacacgagactga

SEQ ID NO: 8532 - RNA, 3264 nt, synthetic construct
  misc_feature 1..3264: note = Cas9 variant
  source 1..3264: mol_type = other RNA
atgcggtataaaataggattagacataggcataacttcagtgggatgggcggtcataaacctagatatccctcgcatcgaagatctgggtgtacgcatatttgatagagcggaaaatccacaaaccggggaatctctagccttaccaagaagactagcacgatcagctagaagacgactccgaagacggaaacaccgtctagaacgtataagacgcctaattatcagagaaggaatattgacaaaagaagaactggacaaattgtttgaagaaaaacatgaaatagacgtctggcagttacgagtcgaagcattagaccggaaactgaataacgatgaactagcacgggtattactacatttagccaaaagaaggggattcaaatcgaatagaaaatctgaacgttctaacaaagaaaactcaacaatgcttaaacacatagaagaaaatagggcaatattatcaggctaccgaactgtaggtgaaatgattgttaaagatccaaaatttgctctacacaaacgaaataaaggcgaaaactatacaaatacaatcgcaagagacgatttagaacacgaaataagactgattttcagtaagcaacgcgaatttggaaatatgagctgcacagaaaaatttgaaaacgaatacataacaatttgggcgtcacaaagacccgtagcaagcaaagacgatatagaaaagaaagtgggattttgcacatttgaacctaaagagaaaagagctccaaaagcaacatatacctttcagtcttttattgcatgggaacatataaacaaattaaggctaatctttccaagtggagcaaggggattaaccgacgaagaaagaagattattatatgaacaggcattccagaaaaacaaaataacctaccatgacatcagaaccctactccatttaccggacgatacatatttcaaaggaattgtatatgatcgcggagaatcccgaaaacaaaacgaaaacattagatttctagaattagacgcttaccaccaaatcagaaaagcggtggataaagtctatggaaaaggcaaatcgagctctttcttaccaatcgattttgacacattcgggtatgccttaacgcttttcaaagacgacgcagacatacatagttatctaagaaacgaatacgaacaaaatgggaaacgtatgccaaacctagcaaataaagtatatgacaacgaacttattgaagaattactaaatttatcatttaccaaatttggacacctatcattaaaagcgctacgatcaattctaccctatatggaacaaggcgaagtatactcaagtgcttgcgaaagggctggttacacattcacaggaccaaagaagaaacagaaaacaatgcttctaccgaatataccaccaatagcaaatccagttgttatgagggctcttactcaagctagaaaagtagtcaacgctataataaagaaatatggaagtcctgtaagcatacatatagaactagcaagagatttgagtcaaacctttgacgaaagacgcaaaacaaagaaagaacaagacgaaaatcgaaagaaaaacgaaactgcgataagacaacttatggagtatggactcacactaaaccctacagggcatgacatagtaaaatttaaattatggagtgaacaaaacggaagatgtgcctattctctgcaacctattgaaatagaaagattactggagccaggatacgtcgaagtagaccacgtaataccatacagtaggagtttagacgattcatacacaaataaagttctagtactaacaagagaaaacagggaaaaaggaaatcgcataccagcagaatacctcggagttggaacagaacggtggcaacaatttgaaactttcgtactcacgaacaaacaatttagtaaaaagaaacgagatcgtctactaagattacattacgatgaaaatgaagaaaccgaatttaaaaacagaaaccttaatgatacacgatacatttcgagatttttcgccaactttatcagggagcacctcaaattcgcagaaagtgatgacaaacaaaaagtatatactgtaaacgggagagtaacttcacacttaagatcaaggtgggacttcaacaaaaacagggaagaaagcgacctccatcatgccgtagacgctgccatagtagcatgtaccacgccatcagatatagcaaaagtaacagcattttatcaaagaagggaacaaaataaagaacttgctaagaaaacggaaccacatttccctcagccatggccacatttcgctgatgaactaagagcccgattatcaaaacatcccaaagaatctataaaagcattaaatctcggtaactacgatgatcaaaaattagagtcactacaaccagtcttcgtcagcagaatgccaaaaagatcagtaacaggagcagcacatcaagaaacgctacgtagatatatcggaatcgatgaaagaagtggcaaaatacaaaccgtagtaaaaaccaaactatcagaaataaaattagatgctagtggacatttccctatgtatggaaaagaaagcgacccaagaacatatgaagcaattagacaacgattactagaacacaacaatgacccaaagaaagcatttcaagaaccattatacaaacctaagaaaaatggggaaccaggacctatcataagaacggtcaaaataatagacaccaaaaatcaagtaatcccattaaatgatggaaaaactgtagcatacaacagtaatatcgtccgtgttgatgtatttgagaaagacggaaaatattactgcgtaccagtgtacacaatggacataatgaaaggaatccttcccaacaaagcaatcgaaccaaacaaaccgtattcggaatggaaagaaatgaccgaagactacacctttagattctcattataccctaatgacttaattagaatcgaattacccagagagaaaactgtaaaaaccaccacaggtgaggaaataaatgtaaaagatgtatttgtctattacaaaacaatagattcagcaacaggcggtctcgaactaatatctcatgacaaccgattctcacttagaggagtaggatctagaacattaaaaaggtttgaaaaataccaagtagacgtactcggtaatatttataaagtacgaggagagaaaagagtcggactagccagtagtgcacattcaaaaaccggagaaaccatcagaccacttcaatcaactagagattga

SEQ ID NO: 8533 - RNA, 3264 nt, synthetic construct
  misc_feature 1..3264: note = Cas9 variant
  source 1..3264: mol_type = other RNA
atgagatacaaaataggtctcgacatcggaataacaagtgtgggatgggccgtgataaatctagacatacctcgaatcgaagatctcggtgtaagaatttttgatagagctgaaaacccgcaaaccggtgaatcattagcattacccagaagattggcacgatcagctcgacgacgcctaagacgtcggaaacacagacttgaacgaataagacgactacttataagagagggagtgcttacaaaagaagaattagacaaactatttgaagagaagcatgaaatagacgtctggcaattaagagttgaagctcttgatagaaaattaaataacgatgaattagtacgcgtattgctacacctagcaaaaaggagaggctttaaatcaaatagacagtccgaacgaagtaacaaagaaaattcaaccatgttaaaacacatagaggagaaccgcgcgatacttagtggataccgaacagtgggagaaatgatcgtaaaggacccgaaattcgcattacacaagagaaataaaggtgaaaactacaccaacactattgcacgagacgacctagaaagagaaataagactaatattctctaaacagagagagttcgggaacatgagctgcacagaagagtttgaaaatgaatacatcgccatatgggcttcacaaagaccagtagcttcaaaagatgatatagaaaagaaagtagggttttgtacatttgaaccaaaagagaaaagggccccaaaagcaacttataccttccagtctttcattgcttgggaacatataaacaaactacggctaatcagtccaagtggaacccgaggattaacagatgaagaacgtagattactatatgaacaggccttccagaaaaacaaaataacataccacgacataagaacattactacaccttccagatgatacatacttcaaaggaatagtatatgactggggagaatcgttaaaacaaaacgaaaacatcagatttctagaattggatgcctatcatcaaatcagaaaagcaatagataaagtatacggtaaaggaaaatcatcatcattcttgccaattgacttcgatacttttggctatgcactcacattattcaaagatgacgcagatataagatcctacttaagaaatgaatacgaacagaatggtaaaagaatagcaaacctcgcaaacaaagtatacgataacgaactaatagaagaattactaaacctaagttttacaaaattcggccacctaagtctcaaggcactcagaaatattttaccatatatggaacaaggcgaagtgtactcgtcggcatgtgaaaaagccggttacacattcacaggacccaagaagaaacagaaaacagtactactcccaactatacctcctatagttaatccagtagtaatgagagccttaacacaagctcgcaaagtagtaaacgccataataaagaaatatggatcgccagtttcaatacacatagaactagcacgtgatctatcacaaacgtttgacgaaagacgaaaaaccaaacgagaacaagatgaaaatagaaaaagaaacgaaacagcgataagacaactaatggaatacggattaacgctaaacccaacaggcttagatatagttaaatttaaactatggagcgaacaaaacgggagatgcgcatattcactacaaccgatcgaaatagaaagattactcgaaccaggctatgtcgaagttgaccacgtaataccatattcaaggtcattggacgatagctacacaaataaagtattagtactaacaaaagaaaacagagaaaaagggaacaggattcccgcagaatacctaggagtaggcacagagagatggcaacaattcgaaacctttgtcttaacaaataaacaattctctaaaaagaaaagagatagactactaagactccattatgacgagaatgaagaaatggaatttaaaagcaggaacctaaacgatacaagatacatttctagatttttcgccaattttattagagagcatctcaagttcgctgaatcagacgacaaacaaaaagtatacacagtaaacggaagagttacatcgcacctaagaagtagatgggactttaacaaaaatcgcgaagaatctgacttgcaccatgctgttgatgcagcaatagtcgcctgtacaacgccatcagatatagcaaaggtaaccgcattttaccaaagaagagaacaaaataaagaacttgccaagaaaacagaaccccaattcccccagccatggccacacttcgcagacgaactaagagcaagacttagcaaacacccaaaagaatctattaaagcactaaatttaggaaattatgatgaccaaaaactcgaaagtttacaaccagtatttgtcagcagaatgccaaaaagatcagtaacaggtgcagcgcaccaggaaacattaagacgatatataggtattgacgaaagaagtggaaagatacaaacagtagtaaaaaccaaactatcagaaataaaactagatgcttcaggacattttccaatgtatggcaaagaatctgacccaaggacatatgaagcaattagacaaagactattagaacacaataacgatccaaagaaagcgtttcaagaaccgctttataaacccaagaaaaatggagaaccgggaccaataataagaacagttaaaataattgacactaaaaaccaagtaataccgttaaatgacggaaaaacagtagcatacaactcaaatatagtaagaatagatgtattcgaaaaagatggaaaatactactgtgtaccggtatatacaatggatattatgaaaggagttcttccgaacaaagcaatagaaccaaacaaaccatattcagaatggaaagagatgacagaagactataccttcaggtttagtctatatccaaatgacctaatacgaatagaactgccgagagagaaaacagtaaaaacagcggctggagaagaaattaacatcaaagacatgttcgtttactataaaaccattgattcggcaaacggaggcctagaattaatatcacatgacaatagttttagtttgagaggagtgggatcaagaacacttaaaagattcgaaaaatatcaagtcgacgtattaggtaatatttacaaggtcagaggagagaaaagggtaggactagcctcatcagcacattcaaaaacaggagaaacaataagaccactccaaagcacaagagattga

SEQ ID NO: 8534 - RNA, 3267 nt, synthetic construct
  misc_feature 1..3267: note = Cas9 variant
  source 1..3267: mol_type = other RNA
atgcctaaagaatttgatcctctcaaaccagccaaatataggttagctttagacataggatcaaaatcaataggattcgcaataatatttctaaaagaagacgtaaacaaattactaaaaccctatgcaatagtacgtagtggagtacgcatattcggagatggtaggacaccagcggcacctggtcaattgggatcatctttggcagccgaacgaagggtaaaaagatcgattagacgacaatacgcaagaaaacgcaagagactgcaaagattattgagaaatctgaaagaattgggtttctttccagatgattcgaaactatgcaaatcttttgaagatctaaacccatatgaactaagacataaaggtttaacaaaagaactaaaaccacacgagttcggcagattattaatgcacatggcgaaaaaccgaggattccaaagtaatagaaaagtagatctactagcagacaacatagattcacaagcgaaggctgaaacatcagcaatgaaatctgcaatagcaaccctacaaagcaggttaaacggtgaatttgaaacactcggtgcctacctatatgaaagatttaagaaaggtgaaacaataaaaagtagcaaaacacaaaaaggacaaaaggccgaatatgagttcagtattagtcgcagaatggtaaaacaagaatttgatagactatgggccgcacaagaacaatttaaccccgaactatttaatgaacaagccaaaaacacactcaaagacacaatattctttcaacgaaacttattaccacaaaaagtaggaaaatgcacttttctaccagaacatgaaagagcaagtaaagcactacctagctcacaatactttcgtattatatcggaactaaataaaatatcatttacagacgcagaaggtttaatactacccatatcattggaacaaaggaataaattattgaaatcattgcgaatcaaacaaaaactatcattcgatagaataagaacagaattaaacctcgattcaactgtcttaataaaccttgaacacgcctcaaaggactcaatcgaaggcgataaaacaggatacctcctaagtaaaaaggaatactttggccctgcatggagggatctaagtctagaaacccaagacgccatagttaccgcgttattaacccatgaaaatgaagcagaattagtacaaaaattagtagacgattttaatatagcacacgacgttgcaaaagcattagctaatgcaagactcgaaagccaatatatgagattaagtaaagaagcaatagaaagattaataccagaactagaaaaaggtgttgacagccaggatggttataaagttccagttaaatatcatgaagcaaccgaagcagccgggttcggacatcatagtgcactccaagaaaattgggctgattttccgaccctagatctaaaacagttacattccgacgataacgataaatatacagtcgcggaattaccactaccctattacggaaaagtaataacaagacaggtagcattcggaacaggcgacgtaaatgatccagtagagaaaagattcggaaaaatagcaaaccctaccgtacacatatgccttaaccaagtaagagtactattagacgaaataattgctaaatacggatacccatatgaagtcaacatagaactagcaagagaattaaaacaaaatcatgaacaacgtcaaagaagcattaaacaacaagccgcaaacaagaaagaaaatgaagaaataagaagagaaatcaaacaagcatacaaagtcgaaaaagcaaggataataaccgactcagaaattagcagggcagacatagaaaaatggagactatggaggagatcaaaatcaaaactctgcgtatactcagggaagaaaatatgcgaaacaatgatactaaataatgaagtggaagtagaccacatccttccaagatcaagaaccggagataacagctatcagaataaagttttagtattaaacaaagcaaatcgaattaaatcaaatcggacaccatgggaagcaaaagaattatttgaagcacaaggatggagctacgaggatatattaaatcgaatgagagccttagataaacaccaattattcagattcgccgaaaattcaatggatatctgggataaaaactaccgaagtttcgaagctagagccttgaacgacacaagatatataagcagggtagtaaaagactaccttaaagtggtatgtcataaagatagaatagtagtatcaaatggagcccacacagccttaattagaagggaatttggactcaatgacttattaggaaagaaaggcgagaaaaacagggatgaccacagacaccatgctatagacgcatgtgtaataggcgcactagatcgatctatgctaagaaaattacaaatagcgatggaagtagcagaaaaacaaaatagcgcaagaaacttcgtcgggctacaggaaccatggttcaactttagcactcaagtaaggcggagtataggacaaatatatgtgagtcataaaccaaaccacaactatgaaggcgaaatctttgaagcaagtatatacggactcagactaatttcagataaaagaactgagaaatacgtagggataaaacgtaacccagaaacaggtaaaacagataaaccaaagaaatctgtggtagtcatatcagacccgaaaactcaaaacaggtacgggttacgtcataaatttcattcagaaggacttccaaagaaatactacggcttaagttcaagctcagtattttgtttagaaatctaccgagatgaaaaaggaaactggcaagcatatactataccaagatatgaggcatataggatagtaaaacggaggggagtaaatgcactatatgacaacaaacgtagtaattttgaaggaagacctctagtaatgagattaatgagggacgattgcatagcatttgagaaaaacggtgtcaaagaagtgtacagaatccagaaaattaacggattaaagaaaaacataacactaacgagacattttgatgccaatgtggatgacaggtatcgacgcatgctaaaagctcaaaaagctgaaaaagcaggcgaagactttgactcagaagacttatgcgatgacttagttttcagctcatttggagcaagcagcttatactctaataaagcaaggaaagtgacaataagccctatgggagtactacgagaccctggattcaaagggtga

SEQ ID NO: 8535 - RNA, 3267 nt, synthetic construct
  misc_feature 1..3267: note = Cas9 variant
  source 1..3267: mol_type = other RNA
atgaaaaaattggtcctgggcctggatataggagtagcctccgtcggatggggaattatagatgcagaaaacggagatgtcctagacgcaggagttaggttattcagctcccgcgacgcatcagaaaacgagtccagaaggaccagccgaagacaaagtagaagattaagcagaaggaagaagcatagacgggaaagaataaaacaactattattggcacatgatatggacgtatgcgacattgtaaatgaaaacccctatcaactaagggttaaaggattaaacgaaaaactagaaatatccgagatatacgttgcattaacacacctcgcaaaacgaagaggtgtctcctatttggacgatgttgtagaagaagggggcgcaataaaatcagaacatttaaacaaaaacatggaagaaataaaatctggaaaaatgccatgcgaaatacaactcgaacgtttcgaaaaatacgggcaggtacgcggaatgatcgaaataaatcaagatacagaagaaagcagttttttagtaaacattttcagaacaagcgactacataaaagaagcaaaaacaatattagccacacagcagaaattccataaacaaatcactaacgaatttatagatgaatatataaacataatggcctcaaaacgagactacttcataggcccaggaaatgaaaaaagcaggacagattatggagtatacagaacgaacggggacacatgggataacttattcgaaatattaattggaaaatgcagcgtatttccagaagaaacccgcgccgcacgaagtagctatgtcgcccaagaattcaatctattaaacgacttgaacaatttaaaaatatcatcactagaatcaggaaaactcagcacaagtcaaaaacatgatattgtagaaaaagtaaaaaacagtaaaaaatttggtacaaaagacctccttaaatacatagcttctgtatgtgaatgcaaaatagaaaatatagacggatgtagaaaagacaagaacagaaaaccaattatgcacaccttcgagaattacagaaaggtacacaacgcattgaacgaagctggcgtagacttaagattaagtgaagcagactacgacgaattaatgaaaataatgacgcttaacagtgaaacactagaaataaagaaacagtgtaaagaaaaattaccacacttaacagaagattatctaaacgtgtgtttagtcctaaacaaaaaaggcgcttttagtggatggcatgcattaagcctaaaggcaatgaaactgatgatgccagaactatatggaacatcaaaaaatcaaatgcaaataatccatacaatgcaactaggaaaagcctacataaaaccactaaaccaacaaaaatacttaaatagcgaagccatcttagaagaaatctacaatccaatagcagcacgaagcataagacaaaccataaaagtaacaaatgcaatactcaaaaaatacggaccattggatagtgtaataatcgaaatgccaagagattaccagacatccgaagacgaaagaaaaatgatagaaaaaatgcaaaaagaaaacgaaaaagaaaaaaaagcagcattaaagagagctagagaagaatatccgtttcccgacgaggcatttagaaaccataaagaattagccacaaaacttagattgtggtatcaacaagatcaattctgcgtctactctggaagaaaaatatccgtagtagatttagttagaaacccaaaccaattcgaaatcgaccacataatcccacaatcagtaagcttagatgattcactcaataacaaagtattatgcttcagtgaagaaaaccagaaaaaaggtcaacaaacaccattttattatcataagggtaaatctggaaactggacctacgaacaatataaactatttgtagaaaaattgttcgacaaaaaaaaaataagcaataaaaaaagagaactattactatttgaagaagatataaacaagtgggacgtaagaagagggtttatagccagaaatttggtcgacacaagatacgctagccgagtaatattaaatagctaccaacaatatttcggaaaccacgagatgggtacaaaagtaaaagtagtaaggggtaaatttacatcccaacttaggaaaaaatggaaaatcttcaaagatagaaatgaatcacactcacaccacgcaattgacgctctaatagtagccgctacagcaaatttaagactatggaaaaaaaacaaactaggaatatcagatgaaggaaaagtatacgacaaggaaacaggagaaatactaccctttgaaaaattaaccgcgtctgagtataacgaaatgatgaataaagaaccctacttgaacttcaaaactaagctccagaacatagaaacaaaagtaaaatacagctacaaagtatcaaaaaaagtgaaccgcaaaatatcaaatgacaccatatattccacaagagaacgggacggtattgattacatcgtcggcaaaataaaaaatatatatgacgtaaaaacgtacaaggaccaattcctaaaacgctacaaaaaaaacaaagaacaattcctaatgtaccaacatgacccgcaaacatttgcgattctagaaagcataatggcaacatatcctgacgctgaaaacccattcctcgcgtataaaaaagaacacggagtaatccgaaaatatgcaaagaacaaagcaggtgccccggtaacctcactaaaattcatcgacggagccttaggacaaaaaatagatgtcacatacaaaaataaagcagccctccccaaaaacaaaaaagttgttctacagtccatcaaaccatacagagccgatgtctactatgacgaaggaaataaaagataccatctaattggtgtaaagtactcactattctccttctcaaaacaaggctatgtaataaacccaatagcatatcaaaaattgttagaaaaagagcaaatccatagcgaaatgaaattctgtttcagtctatatagggaagacataatagaatcaggagaagacccggattcattaacaagataccgcttctggagtaaaaacgagagtggaaaaaataaaatagaggtgaaacctatagagaaaccaaactttgaagatcgaaaagtcataactatcaccaaaaaaataaagatattaaataaataccagacagacgtacttggaaactcctttaaagcacaagaagaaaaagaccctcggtcaatcgaatga

SEQ ID NO: 8536 - RNA, 3267 nt, synthetic construct
  misc_feature 1..3267: note = Cas9 variant
  source 1..3267: mol_type = other RNA
atgaattacaaaatgggcttagatataggaatagcaagcgtaggatgggctgtaataaatctagatctaaaacgtattgaagatttaggagtacgaattttcgacaaagcagaacacccacaaaatggtgagtctctagccctcccacgtagaatagcccggtcagctcgtcgtagactaagaagaagaaaacacagattagaacgaattcgaagactacttgtatcagagaacgtcttgaccaaggaagaaatgaatctactatttaaacaaaaaaaacaaatagacgtatggcaactccgagttgatgcattagaaagaaaattaaacaatgatgaattagcaagagtcctattacacctcgcaaaaagaagaggattcaaatcaaacagaaaatccgaacgaaattccaaagaatcttccgaatttctcaaaaacatcgaagaaaaccaaagcatattagcacagtacagaagtgtaggtgaaatgatcgtcaaagattcgaaattcgcatatcacaaaagaaataaactcgattcatactcaaatatgatagcgagggatgacttggaaagagagatcaaactcatattcgagaaacaaagagaatttaacaaccccgtttgtacagaaaggttagaagaaaaatacctaaacatatggagcagccaaagaccgttcgccagtaaagaagatattgaaaaaaaagtaggtttctgtacatttgaaccaaaagaaaaacgagcacccaaggcgacatacacttttcaaagcttcatagtatgggaacatataaacaaactacgactggtcagccctgacgaaacgcgagcattaaccgaaattgaaagaaacctattatacaaacaagcattttcaaaaaacaaaatgacttattacgatatacgaaagttactaaacctaagtgacgatattcatttcaaaggactcctctatgaccctaaaagtagcctaaaacaaatagaaaacatacgctttctagaactagattcttatcataagatcagaaaatgtatcgaaaacgtgtatggcaaagacggcattcgtatgtttaatgaaacagacatagacacgtttggatatgctctaacaattttcaaagacgatgaagatatagtagcctacttacaaaatgaatacataacaaaaaacggaaaaagagttagtaacttagcaaataaagtctacgataaatcgctaatagatgaattattaaacctaagcttttcaaaattcgcacacctttctatgaaagccatcaggaacatcctaccatacatggaacaaggcgagatctattcaaaagcttgcgaactagcaggatacaacttcaccggacctaaaaaaaaagagaaagcactactgttaccggttattccaaatatagcaaatccagtcgttatgagagcattaacacaaagcagaaaagtagtaaatgctatcataaaaaaatatggctcaccagtttcaatacatatagaactcgccagagacctatctcacagtttcgatgaaagaaaaaaaatacaaaaagaccaaaccgaaaatcgaaaaaaaaatgaaaccgcaataaaacaattgattgaatacgagttaaccaaaaacccaacaggccttgacatagttaaattcaaattatggtcggaacaacaaggcagatgcatgtactcacttaaacccatagaactagaaaggctactagaacccggttacgtggaagtcgaccacatattaccatactcaagaagtcttgacgactcttatgcaaataaagttctcgtactgaccaaagaaaatagggaaaaaggtaatcatacacccgtagaatatcttggactgggcagtgaaagatggaaaaagtttgaaaagttcgtactagcaaataaacaattcagcaaaaaaaaaaaacagaatctcctgcgcttaagatatgaagaaacagaagaaaaagaatttaaagagcgcaatctcaatgacactagatacatatctaaatttttcgcgaattttataaaagaacatttaaaatttgctgacggagatggaggacagaaagtctacacaatcaacggaaagatcactgcccatctacggtcaagatgggattttaataaaaacagggaagaatccgacttacatcatgcagttgatgctgttatagttgcatgtgctacacaggggatgataaaaaaaataaccgagttttacaaggcccgagaacaaaacaaagagagtgcaaaaaaaaaggaaccaatattcccacaaccatggccacacttcgcagacgaactaaaagcgaggctatctaaattcccacaagaatcaatagaagcgtttgcacttggaaactatgatagaaaaaaactagagagtttaagacctgtgttcgtatctcgtatgccaaaacgatccgtaacaggggcagctcatcaagagacactacgaagatgcgtaggaatagacgaacagagcggaaaaatccaaacagcagtaaaaacaaaactatcagatataaaattagacaaagatggacattttcctatgtatcaaaaagaatcagacccaagaacatacgaagcaatcagacaacgactcttggaacacaacaacgatcctaaaaaggccttccaagaaccactctacaaaccaaaaaaaaacggtgaaccaggaccagttatacgaacagtaaaaataattgatacaaaaaacaaggttgttcatttggatggatcaaaaacagtagcttataactctaatatagtaagaacagatgtctttgaaaaagacggtaaatattattgcgtgcccgtctacacaatggatataatgaagggcaccttgccgaacaaagctatagaggcaaacaaaccttacagcgaatggaaagagatgactgaagaatatacttttcaattttcgttattcccaaacgacttagtaagaatcgtcttaccacgagaaaaaacaatcaaaaccagcacaaatgaagaaatcatcatcaaagacatattcgcatattacaaaaccattgattcagcaacaggaggactcgaattaataagtcacgaccgaaatttctcactaagaggtgtcggatcaaaaacactcaaaaggttcgaaaaataccaagtagacgtactaggtaatattcacaaagtcaaaggtgaaaaacgcgtaggcttagcagcacctaccaaccaaaagaaaggaaaaactgtagattcactgcaatcagtctctgattga

SEQ ID NO: 8537 - RNA, 3270 nt, synthetic construct
  misc_feature 1..3270: note = Cas9 variant
  source 1..3270: mol_type = other RNA
atgacggctttcaaaccaaatccattgaactacattctagggctcgacatcggaatagcatctgtaggatgggccatggttgaaatagatgataaagaaaaccccgttaggttaattgaccttggggtaagagtatttgaaagagcagaaatgcctaaaaccggagattcgctcgcagctgcaagaaggttagcacgtagcgttagaagactaacaagaaggagagcacacagattgttaagagcccgaagactacttaaacatgaaggcgtattaaaacctgaagactttgacgaaaacggattagtaaagccattaccatatatacctaaacaacctcgtaatacgccatggcaattaagggccgctgcactcgacagaaagctgacccctctggagtgggcggctgtattactgcacttagtaaaacacaggggatacctaagtcaacgtaagaacgaaggagaaacagatgacaaagaactaggcgcattactaaaaggcgtcgccgataacacacacgcactacaagcaggtaatttcagaactccggccgaactagcactaaacaaatttgagaaagaaagtggtcacatacgaaaccaacgcggagactacagtcacacattttcaagaaaagatcttcaagccgaacttgtactgctattcgaaaaacaaaaagagtttggaaatccttatgttagtgacgacctcaaaaatggaattgagaatctactaatgacacaaaggcccgcactatcaggagacgccatacagaaaatgttaggacactgtaccttcgaaccagcagaaccaaaagctgccaaaaatacctataccgcagagagatttatatggttaaccaaattaaacaatctaagaattttaaaccaaggtaatgaacgccccttaactgacgcagaacgcacaaccctaatggacgaaccgtacaagaaatcaaaactaacatacgcacaagctaggaaactattagatcttgacgacactgcattcttcaaaggcttaagatacggaaaagataatgccgaatcagcaaccttaatggaaatgaaagcataccacgcaattagccgagcccttgaaaaagagggcctaaaagataagaaatcaccactctcgttatcgccagaacttcaggacgagataggaacggcatttagtcttttcaaaacagatgaagaaataacaggaagattaaaaggttgcctacaaccagaaatattagacgcactacttaaacatataagtttcgacaaatttgttcaaatctcattaaaagccttaaggagaatcgttccactaatggaacagggaaaaagatacgatgaagcatgtgccgaaatttacggagaccaccacggtagacgaaatagcgaagaaacactttatttacctccaatacctgcagatgaaataaggaatccagttgtattgcgcgcactatcacaggcccgaaaagtaatcaacggtgtcggccgaagatatggaagtcctgcaaggatacatatcgagacagcccgtgaagttggaaaatcatttaaagaccgcaaagaaatcgagaaaaggcaagaagaaaacagaaaagacagagaaaaagcagcagccgaatttcaagaatacttccctaacttcgtaggagaaccaaaatcaaaagacatacttaaattaaggttatatagacaacaaaattgcaaatgtctatatagcggaaaagaaataaatctaggaagactaaatgaaaaagggtatgtagaaatagatcatgcacttccattctcaagaacctgggacgattcatttaataacaaagttttagtcttagggagtgaaaaccaaaacaaaggaaacagaacaccatacgaatacttaaatggcaaagacaattcaagagaatggcaagaatttaaagccagagtagaaacaagtagatttccacacagtaagaaacaaagaatactactacaaaaatttgacgaggaaggatttaaagaaagaaatttaaacgacactcgatacgtaaatagatttttgtgtaaattcgttgcggatcatatgcaattaaccggaaaaggaaaaaggagagtattcgcaagtaatggacaaataacaaacctattaaggggtttttggggattacgaaaagtaagagcagaaaacgaccgacatcatgcattagatgcggtagtagtagcttgtagtacagttgcaatgcaacaacgcatcaccaggtttgttagatataaagaaatgaatgcatttgacggaaaaaccgtagacaaagaaactggagaggtactccatcagaaaacccactttcctcaaccatgggagttctttgcacaagaagtaatgataagagtgtttggaaaaccagacggtaaacccgaattagaagaagcagatacaccggaaaaactacgagctctactagcagaaaaactatcaagcagaccagaagcagtacacgaatacgtagcacccttatttgtaagcagagcaccgaatcgtaaaatgagtgggcaaggtcatatggagacaataaaatcacccaaaaggttagacgaagggatttctgtagtaagggtaccattaactcaactaaaattaaaagatttagagaaaatggtaaacagggaaagggaacctaaattatacgaagctcttaaggcaaggttagaagcacacaaagatgacccagccaaggcatttgccgaaccattttataagcaagacaaagcaggcaataggacacaacaggttaaagcggttcgaatagaacaagtacaaaagacaggagtatgggtaaggaaccaaaatggaattgcagataatgctactatggtaagagtggatgttttcgaaaaaggtggcaaatattacctagttcctatctatagctggcaagtagctaagggaatattacccgacaaagcaataatagctttcaaagacgaagaagaatggcaactaatagacgactcatttaattttaaatttccattacacccaaatgatctagttgaagtcataactaagaaagcaagaatatttggatactttgcatcatgtcatagaggcacaggtaatataaatataaggatacacgatcttgacaacaaagtaggcaaaaacggcattctagaaggaattggagtaaagaccgccctaagttttcaaaaataccaaatagatgaattaggaaaggaaatacgaccatgtcgactaaagaaaagaccaccagtcaggtga

SEQ ID NO: 8538 - RNA, 3270 nt, synthetic construct
  misc_feature 1..3270: note = Cas9 variant
  source 1..3270: mol_type = other RNA
atgaacgtgagatacaaaattggacttgacataggaataaccagcgtcggatgggcagtggtaaacttagatataccacgaattgaagatttaggagttcgaatcttcgaccgagcggaaaatccacaaacaggagaaagtctagcactaccaagaagattagcaagaagcgccaggcgaagacttcgacgaagaaaacatagactcgagcgaatacgtagactattgataagagaaggtattcttatgaaagaagaattagacaagttattcgaagaaagacacgaaatagacgtatggcaattaagagtagaagcattggaccgtaaattgaacagtgatgaattagccagagtattactacacctagcaaagagaagaggattcaaatcgaaccgaaaatcggaacataattcacgagaaaatagcacaatgctaaaacacatagaagaaaacagagcgattctaagcagttacagaaccgtagctgaaatgatcgtaaaagatccaaagtttgccctccacaaaagaaacaaaggagaacactacacgaacactatcgctagagacgacctagagagagaaatccagttaatcttcaccaaacaaagagagttcggaaatatgaattgcacaaaggagttcgaaaacgaatatatagcaatatgggcatcacaaagaccattcgcaagtaaagatgatatcgagaaaaaggtaggattctgcacattcgaaccaaaagagaaaagagcacccaaagcaacgtacacattccaatctttcatcgcctgggaacatatcaacaaactaaggctcgtttccccagcaggaacacgaggactaacagatgaagaaagaagactcctatacgaacaagcattccaaaagaataaaataacatatcacgacataagaacattattacgattaccagacgatacatatttcaaaggcgtcgtctatgaccgaaacatgccactgaaacagaatgaaaccattagattcctagaattagacgcttatcaccaaataagaaaagttatagacaaggcttacggcaaaggcaaaagctcatcatttttacccatagattttgacacatttggatacgcccttacattattcaaagacgacgcagatgtaagaagttatctccaaaatgaatatgaacaaaacgggaaaccaatgcctaatttagccaataaaacatacgacaatgaacttatagaagaacttctcaacttatcttttacaaaatttggccacttatcccttaaagcactacataatatactaccatacatggaacaaggagaagtatacagttctgcctgcgaaagagccggttacaaatttacaggaccaagaaagaaacagaaaacaatgctacttccaaacataccatcaatagcaaaccctgtagtaatgagggcacttactcaagcaagaaaagtagttaatgcaataatcaagaaatatggcagccccgtaagtatacatatagaattagcgcgagatctaagtcaaactttcgatgaaagaagaaaaacaaaaagagaacaagatgaaaacagaaagaaaaacgaaacagcaataagacaattaatggaatacggtctcacattaaatccaacaggccacgacatagttaaattcaaactatggtcagaacagaatggcagatgtgcttattctctccaacctattgaaatagaaagactactcgaaccaggatacacagaagtagaccacgtcataccatacagtagatcactagacgactcttacactaataaagtactggtactcacaaaagaaaacagggaaaaaggcaaccgtacgccagcagaataccttggtgttggaactgagagatggcatcaattcgagacatttgtcctaactaacaaacaattctctaagaagaaacgcgatcgactactcagacttcactacgatgaaaatgaagaaacagaatttaaaaacagaaacctaaacgatactagatacatctcaagattctttgcgaattttatacgagaacacttaaaatttgccgagtcagatgacaaacaaaaagtctacaccgtaaacggaagaataacagcacacctgagaagccgatgggagttcaataaaaatcgagaagaatcagatctacaccatgctgtcgacgccgcaatcgtcgcatgcacaactccatctgacatcgccaaaataacagcattttatcaacgcagagaacaaaacaaagaattagcaaagaaaaccgaaccacattttccccaaccctggccccatttcgcagatgaattacgggctagactatcaaaacatccaaaagagtctataaaagcactaaatttgggtaattatgataacgaaaaattagaatcattacatccagtcttcgtatcaagaatgcctaaacgatcagtaaccggagccgcacaccaagaaacactcagacgatatgtagggatcgacgaaagatctggtaaaattcaaacagtagtcaaaacaaaactcagtgaaataaaacttgatgctagcggtcattttccaatgtacggaaaagaatcagatcctagaacctacgaagccatacgccaacgtttactagagcacaataatgacccaaagaaagcatttcaagaaccactttacaaacctaagaaaaatggagaacccgggcccataattagaactgttaaaataatagataccaaaaatcaggttgttcctttaaacgatggaaaaactgtagcctataacagcaatatcgtcagagtagacgtatttgaaaaagatgggaaatactactgcgtacctgtctacacgatggacattatgaaaggagtgctaccaaataaagcgatagaaccgaataaaccatacagtgaatggaaagaaatgacagaagactacacatttcaattctccctttacccaaacgacttaattagaatcgaattaccaagagaaaaagcaatacgaacatccactggagaggagatcaaaataaaagactttttcgcatactataaaacaatacattcgggcacaggcggaatggaacttatatctcatgatcgttcattctcgctatctggcgttgggtctcgaacgttaaaacgtttcgaaaaatatcaggtagatgtccttggaaacatctacaaagtacgaggagagaaaagagtaggattggcatcatcagcacacagcaaaaccggtaaaactgtaagaccactacaatctacccgagattga

SEQ ID NO: 8539 - RNA, 3273 nt, synthetic construct
  misc_feature 1..3273: note = Cas9 variant
  source 1..3273: mol_type = other RNA
atgcggtggaggctaggtttagatatgggcgctggtagtttaggatggtgtgcagttggattagacgatcagggatatccagacagtattttagccgcaggaagtcacatctttggcgatggtagagcaccttcaagaggcgaccagcagggaactccactcggcgttgaaagaagggcagcaaaagcaatgagacgaagacgcgatagatttctcggtagacaagctaagttacttgccagattaacactagcaggattatttccagcagatcccgtaagagcaaaagcattggaattgttagacccatatgtattgagagcaagagcattagatgaggcactgcccccacaccaactaggtagagcattctttcacttaaatcaaagaagaggatttaagtcaaaccgcaaaactgacagaggtgttgatgacgaggcgggcaagatagcgattggaattgacaggttacgagctgctatagcagctgcagaagctagaactatgggagagtttttgcacaagagaagacaatcagccccagacgtgaatcagataccatccgtgagaacacgattgaggcccgaaacaggagaagaagcaaagggcgacgggtatgacttttatccaggaagagagttggtggaagaagaatttgatgccatatgggatgcacaagcacctcatcatcctagccttttgacaccagacaatcgagcattgctccacgaagcaatattttaccaacgaccacttaaggcacctaaaataggaaaatgcactctcctgaataacgaaccaagattgccaaaagctcacccattattccagagaagaagactacttgaagaagtcaatgccctacgtatcgtaagaccaggagaagtagcaacaaaactaacttgcgaacaaagagatttacttatgttaaaattaaaagacaaggcgaaagtctcatttgaaacattgagatcgaaagtattgaaattagaacctgaagcaagattcaataaagaaggtgaaaaccgaacagagctcgtaggagatgaagtatgcgctcaaatgagcgcaaaaacacgtttcggtaaagcatgggcacatttcactgacgagaaacgttgggcaattttaagtagattgatagaagaagaagatgaagaaagactcgatacatggctaagaacagagcatggactcgatgcagagcaggcgagagcagtagcaggagcaagactgcctgcaggcttcggaagatttggtgaaacagccactagacgcttaatagcagctttgcaagcagaagtaatcgtgtattcagaagcagttgtagctgcgggactaggacatcactcagatatgagaacaggagaagtactagccgaacttccctactatggaatgacattggaacgacatttacttccaggaacgggggataaagctgaccctgaagagttaaggattggaagattaacaaacccaactgtacacatcgccttaaatcgacttagaagaatagtaaatagactcattaaaacatatggaagaccggaacaaattgctatagagttaggaagagaactaaaattaacggacgaagataaacaaagattatcacgccaaaacaatagaaatagagccgatgccgaagcacgcagtaagaaactcgctgaactcggtcaagcagacaatggagcaaatagagctagattgaaattgtgggaagaattaaaccgagaaaatgctttggatagaagatgcatatacagtggacaacaaatatcaatagcaatgttattctctgatgccgttgaagtagatcatatcttaccatttgacgcaacattagatgattcaaacaataacagaattttgtgtctgcgggaatggaatagacgaaaacgaaaacaaagtccttatgaagcctggggacatacagactactggccagacattgcagcgcgtgcagcacgtttgccaaaagagaaaagatggcgatttgaacccgatgcaatgcaaagattcagtgcagaagatagatttatagcacgtcatttggtagatacacaatatatgtcacgcttagcaagagaatatctagaagccttataccccgaaaaaggcgaaggatcaggacatgtctgggttagccccggacgtctaacagaattaataagaagaaaactaggactaaacgagcttcttccagaccacaatttcgcaggagttaaaaatagattggatcaccgacaccatacaatagatgcatttgtcgtagcagttacagatagatcattattacaaggaatatcacgcgcatcagcacttgaaggggaagaagggcgagaaagggtgatagtaccagaaccatgggatggcttccgagaagcactaagaactacactcaatacgataacagtttggcaccgacaggatcacggaactgcttcgaaagcaggactagcacaaggaagggaccaaaccgcaggtaaattacacaacgatactgcgtatggattaacagggaggcaagataccaaaggaaatgatttggtcgtaagcagaaaaccccttatgagcttgaaaccggctgacattgaaccagtaccagatgtagctccaataactaaaggtgttagggatagagacttacggaaagcattagcacactttacccaagccactgaaggaaaagggtttttacaggcccttgaaagatttactagactaggaccattacattttcgaggcattaggagggttagactaatacaacccttagctgttatacctataaaaggaccagggggtgtaccatataaaggatatttaggaggcgaaaattttcgctgtgacgtatgggaaatgccagacggagcctggaaaccagaggtaacaagcatgttccaagcacatcaaccagggtggactagcgccataagagcagcttgtccaacagctaggaaagtattaagtttacataaaagagatatgatagcaatagaacgtgaagagggagtacgaacgctaatggtagtagctcagatctggtcgaatggtcaagttacgctagtagaaccccacgaagctggagatcttaataaaagaaacaaaagtgaagacgacccttttggctatttcatgccaactgcagggggattaaaaagattaaaggcgagacaagttagagtcgatgaactaggaagagtgcaggatcctggcttcccagccagaaaagcaagaaggagaacaagaccgaaacaagtagactga

SEQ ID NO: 8540 - RNA, 3273 nt, synthetic construct
  misc_feature 1..3273: note = Cas9 variant
  source 1..3273: mol_type = other RNA
atggactggagactaggattagacttaggggcgaatagccttggttgggcagctttacgattagacagagcaggagaccctataggaatattagcaatgggctcacgaatatttagcgatggacgtgacccaaaaagtggcgcaagtttggccgtagataggagagcagcacgagcaatgcgacggaggagagatagattcaagcaaaggcaagcggctctacttaaatatttaataagagatgggttatttcctgcagaccaagccgatagacaacgattagcagatgaagatccatatgccttacgagctagagcgttggatgaggaactatcattatttgaaataggtagggcactcttccatctgaaccaacgtagaggctttcaaagcaatagaaaagctgatcgaggacaagatgatgaagcaggaaaaatagccgtgggagtagatagactgaatcaacaaatggaagaacaaggggccaggacattaggagaatttttacatcaaaggagacgcgccgcaactgacgcaaaccacataccatctgtgaggacaagattaagaccagaaaccggagagggagctaaaggtgacgggtacgacttttatccatctagagcacttatagcagaagagttcgaagaaatatgggcagcacaggcaccgcattacccggataccttaacacaacaagtacacgaccgtttatatgaaattatctttcaccaacgacccctaagagcaccacaagtagggcaatgtaccttagtagcaggagaaacaagattgccaaaggcacatcccttgtttcagaaaagacggttattagaagaaataaatgctctcatgatagttcgacctggtgaaattgcccaaaggttaacacctgaagaaagagatacattatatttaaaactgaaagacaaaagaacggtatcatttgccacactgagaaaaacattaaaattggacagtgccgcgagatttaacaaagagtccgaaaaccgtacagaactaaaaggagatgaagttgctgcagaacttggagctaagacacgtttaggtaccagatggcaacacttatcaggagatcaacaatgggaagttgtacatcgtttaatggctctcgaatcacaagcagatgaagcggcattcagagattggataagtcaaacttacgatttattacctgaacaagcagctgctgtgctcggagctagactacctcaaggccacggaagatttggacctacagcaactactactttaatcgattctctattacacgacagaactgaagacggaagggttgttgtttactcggaagccgttcaaagatcaggattaggtcatcatagtgatctacgacacgatcgtgacgatgaagatgtaaccgaacttccatactatggtgtagcattagaaaggcatattatgccaggtaccgccgaaccaacagatcctgaagaaatgaggataggtagattaacaaatcctacggttcatataggactaaaccaattaagacacgtagtaaatagactgataagggcatatggtccaccaaaagaaatagcaatcgaactagctagagaactaaagttaagtgaagatgagaaaaagaaaagaaatagtgaaaaccgagataatagattagcagcagaaggaagatcaaagaaattagaagaaataagacaaagggatacaggagctaatcgagcacttttaaaattgtgggaagaacttaacccaggaaacgtacttgatcggaggtgtatatatacgggtgaacaaataagcatagacatgttattctcggatagagtagaagtagatcatatcctaccgttcgctcaaacactcgacgattcaaatggaaataaattattatgtttaagagaagcaaaccgagaaaaacgaagaaggagtccttatgaagcatggggacacacagataggtggcctgatattgcagaaagagcttcaaggttaccaaaacccaaaagatggagatttgaaccagatgcaatgcaacgttttgcaactgaagatggatttcttgcaaggcatttagttgacactcaatatcttggacgattagcaagagaatatctatcttggttatatccaggaagaggtgaaggatctggacatgtatgggtatcaccaggtcgactaacggaaatggtcagaagaaaactaggcctaaacgaccttctgccagatcataatttcgggggaggagcagatcaaccaaagaaccgacttgaccatagacaccacgctatagacgcgctggttgtcgcaatagtagaccgtggaatgcttcaagcaatagcaagagcatcaggacaagatggtagcgaaggaagagaaaggattcatataccagcaccatgggatggatttagagatgatttaagagttgcagtcaatggcatcatagtatcacatcgtccggatcacggaacagtagctaaggcaggtttagcacgaggtagagatcaaaccgcaggaaggttacacaacgatacagcatatggattgacaggtgaaacggacgctaaagggaatagcattgtagtaagacgcattccactaagcgcaataaagaaaccagcagatatagcacgagttagagaccctctcttgagaaatgcgctagcagaatttacaaaaggtctagatggtaaagcgttcgaagcaagaataggtaggtttcatgaactgggcccattattatatagagggataagaagagtacgagttgtagaaactttaacagtaataccaatacgtgatgctgaaggcagagcatacaaaggatacaaaggtgattctaattatagatacgatgtatgggaaatgccagacggtaaatggagatgccaagtcgtaagtatgttcgatgcccatcaatcgacagaacaagctagaccacatccagcagctcgaaaaatactatctctacagagaaacgacattttagctatagaacgaacagagggtgatagagaacttgtacgagtggtaaaattttcggaaaaacagtttgccgtagcacccccacacgaagggggcagtctcaaaacacgagatggaaatgcagacgatccatttagatacttatatccatcgccgaatacgctcaagggatggagagcgagacaagtaagaatcgacgaactagggagagtactggatccagggttcccagcaagaaaaagtgtaagacgtacccgaccacgagcagcaccagtagattga

SEQ ID NO: 8541 - RNA, 3276 nt, synthetic construct
  misc_feature 1..3276: note = Cas9 variant
  source 1..3276: mol_type = other RNA
atgtactcaaatttactattttcatttgacattggaaccaatagtataggatggtgtgtatttgcattagacgaagccggtgaaccatatcgtatagtagatctaggagcaagaatatacgctgatggccgagatcctcagagtaaaacttctttagcagtagcgcgaagggaagcccgagcaatgtcaagaagaagagacagatacctcagaaggagaaaggctacattaagaacaatgatagaatatggattaatgccaggtgacaaagcaggacaagaagccgtgttaagagaaacaggtgacagagaaggaggagatgaatcatttaatccatacgccctacgagcacgagctcttagcgaaaaactacctccagcatatattggaagagttctatttcatctaggtcaaagaagaggttttaaaagcaacagaaaaaccgacagaaaagacaatgataaaggtaaaatcgcattaggcatagacgaacttacagccgccatgcatagaagcggatcaccaacactaggagcttggttggcaatgcgaagggccgaaggacacagtgtacgactaagagccggaagtgaggttttcgatgctgaaggttatgcattttacccagaacgatcgttattagaagatgagttccgacaaatttgggatgcacaagcggtacatcacccggacatattaacaccagaaaggagagcccatctattcagggtaatgttctatcagagacctttaaagaaacccctagtaggaagatgcagctttaatccagcggaatttcgactttccagagcgcatcctctatttcaagaatttaggctatacaaagaaataaacgacttagaagtagtactacctgatcaatctcatcgaaaattgaccctagatgaaagaaacgctctagtagctaaacttaaaactagccgaaaagcgtcattctcagccctaagaaaaacattaaaactaacaccggatctcgtctttaataaagaatcagaagcccgaaaggaattactaggggacgaaatttattcagttttagcagacgcaaagatgtttggagcccgctggggaggattcagcagagctaggcaatgggaaattataacccggttaaaagaagaagaagacccggcaagcctatcatcctggttaaaatcagagtttggactagacgacgaacgtgtaacagcaatcgcaaacgcgagtttgcctgatgggtatggaagattaggagaaactgccttagcatcaatgttagaagaactgaaaaccgcggtaatcccagaatcagaagcagcacgactctgtggttatgatcattcaaacctcgccaaagaacaagatgaaggactggatacattaccagaatatcaagaaatactagaaagacatattcctccaggaacaggagatccggatgacatatacgacctaagaaaaggtcgcataaccaaccctacagttcatataggactaaaccaactaagaagggtagtaaatgcgttaatacacagattcggtagaccccaacgcatcgtagtagaactagcaagagatctacaattatctgaaaaacagaaagatgatgttaatagaagaattgctaaaaacacaagggaagcagagggtagaagccaaaaattaatcgaaatgggacaactagatacaggatacaacagactacttttaaaactttgggaagaattaaacctagataaaccagaagatagagtttgtatatatagcggaaaacccatagggatcgccatgctattttcaggtgaagtagacgtagaccatattctaccatggtcaaaaactctagatgatagccaagctaacaaactactatgtcttaaaagtgctaaccgacagaaacgaaatagaacaccatcagatgtcccagaatggcgcgatagatacgacgaagtcttagcgagagcggctagattacctaggaataaaagatggagattcgcagcagacgcaatgcaacaattcgaggcagagggcggctttttagcaagacaattaactgatacacaatatttatcaagaatggctcttgaatatttaagtgctttatatccatctgaagaagctgataaaagtggagaattaagacaaagaaagagagttcatgtagttcctggcagactaacagaacttttaagacgcaactggggtttaaatacactgttgcccgatcataacttaggagaaatggcgcaagaaaagaacaggcgagaccaccgacaccacgcgatagatgcagcggtaattggtacaacttcaagaagtctattacaaaggatgtcgggggctgctgcaagactagacgatgttgcttttgatgacctagttagaacagtagtgaaagataaccctccctggccgggatttagagaagaattattagcagctataggcagagtaactgtaagccataaacccgatcatggaacggtcagtcgagctgcatatgcacaaggaaaaggacaaacagcagggaaattacataatgacacagcctacggattaactgggctagtggatgcgaaaggaagtccattagtagtaagaagaaaaccattcatggccctcgaagtaaaagatatagcctcaattagagacactgaattacaatcagctctgtacggagcaattggaagcctaacagagaagaaagcactacaagaagcactgataagattccgcgatactcatccacaattcaaaggtatacgacgagttagagtactggagacactcagcgtaataccaattgtagatagagatggaaaagcatacaagggttataagggagatgcaaactatcgatacgaagtttgggaaacattagatggaaaatggcacactgaggtagtgtcaatgtttgatgcacatcaaccaggatggcaaagtccattccacaaacaaaatccagcagcaagaagagtactaaaactacaacaaaacgacatggtcgcatacgagcaccctgcagatggctatacaatagcaagagtggttaaatttagtaatgataaacgaatatatttcgcttcacatagggaaagcggaagtcttaaagcacgagatgcagataaaggcgatccattcagttattttgctaaggcaaataatggcctccgagacataaaatgtagacaagttagaatagacgcagcaggtagaatattcgatccaggaccgcaggatcgtgaaactagacaagcgaacaaaggtgtatga

SEQ ID NO: 8542 - RNA, 3279 nt, synthetic construct
  misc_feature 1..3279: note = Cas9 variant
  source 1..3279: mol_type = other RNA
atggcatatacgatgggaatcgatgttggcattgcatcttgcggatgggcaatagtagacctagaaaggcaaagaataatagacataggagtaagaacatttgaaaaagcagaaaatccaaaaaatggagaagcattagcagtaccaagaagagaagcacgaagctctcgacgaaggttaagaagaaaaaagcatcgaatagaacggctcaagtacatgtttgtacgtaacggattagcagtagacatacaacacctagaacaaacgttacgcagccaaaatgaaatcgatgtttggcaattaagagtagatgggttagatagaatgttaacacaaaaagaatggctaagagttctaatacacctagcacaacgcagaggattccaaagcaatcgaaaaacagacggatcctccgaagacggacaagtattagtaaacgtaacagaaaacgacaggctaatggaagaaaaagattacagaacagtagcagaaatgatggtgaaagatgaaaaattctcagatcacaaaagaaataaaaacggaaactatcacggtgtagtatcaagagcttccttactggtcgaaatacacacactgttcgagtcccaacgtcagcaccacaacttcctagccagcaaagatttcgaactagaatatataaatatatggagctcacaaagaccagtagccaccaaagaccaaatagaaaaaatgataggaacatgcacattcctaccaaaggagaaaagagcgccaaaagcatcatggcacttccaatatttcatgttattacaaaccataaatcatataagaattactaacgcacaaggcactcgaccgttgaataaagaggaaatagaacaggttgtcaatatggcactcaccaaatcaaaagtatcatatcatgatattagaaaagtcttagaccttagcgaggaataccaatttgttggcttagactacggaaaagaagacgaaaaaaaaaaagtcgagtcgaaagagaccattataaaattagatgattaccacaaactaaacaagattttcaatgaagttgaattagcaaaaggtgaaacttgggaagcggtagattatgacactgtggcatacgcactaacattctttaaagacgacgaagatataagagattatctccaaaataaatacaaagacagtaagaatagacttgtaaaaaacgtcgcaaataaagaatacactaatgaattaatagaaaaagtaagtacactaagctttagaaaggtaggacatttaagtcttaaagctctacgaaaaattataccattcctagaacaagggatgacatatgacaaagcctgccaagcagcaggatttaacttccaaggtatcagtaaaaaaaaacgaagcgtagtactccccgtcatagatcaaataagtaatcccgtagtaaaccgcgcactaactcaaaccagaaaagtaattaacgccttaattaagaaatatggaagtcctgaaaccatccacattgaaacagctagagagttatcaaaaagattcgatgaacgaaaaaatataacaaaagattataaagagaacagagataaaaacgaaagagcaaagaaacacctatcggaactaggcataataaacccaacaggactagacatcgtaaaatataaattatggtgtgaacaacaaggaaggtgcatgtatagtaaccaaccaatatcatttgaaagattaagagaatcaggttatactgaggttgatcatataattccttactcgagatcaatgaacgatagctataacaatcgagtcttagtaatgacacgagaaaatagggaaaaatctaatcagacaccatacgaatatatgggaaacgacacccaaagatgggatgaatttgaacaacgagtaactaccaacccccaaataaaaaaagaaaaacgccaaaacctcttattaaaaggcttcacaaacaggcgagaacttgaaatgctagaaagaaatttgaacgacacaagacacataacaaaatacctatcgcactttataagtactaatttagaattctcaccatctgataaaaaaaaaaaagtcgtaaacactagcggacgaattacaagccatcttcgatcgagatggggcctcgaaaaaaatagagaacaaaacgaccttcaccacgcaatggacgctgtagtaattgccgtcacaagtgattcattcatccaacaagtaacaaactattataaaagaaaagaaaggagagaactaaatggagacgacaagtttccattaccctggaaattcttcagagaagaagttatagcaagattaagtcccaacccaaaagaacaaatagaggcactaccaaatcatttctactccgaagatgaacttgctgatctgcaaccgatttttgtttcaagaatgcccaaaagaagtataacaggtgaagcacatcaagcccaattccgaagagtagtaggtaagacaaaagaaggtaaaaatataacggccaaaaaaacagcacttgtcgacataagttacgataaaaatggagattttaatatgtacggacgagaaacagatcctgccacatacgaagcaataaaagaacgatacttagaatttggcggtaatgctaaaaaagcatttagtacagatttacacaaaccaaaaaaagatggaactaaaggaccattaataaaatcagtaagaataatggaaaacaagacactagtccaccctgtaaacaaaggtaagggagtagtctacaatagttctattgtcagaactgatgtattccaacgaaaagaaaaatactatctcctaccagtatatgttacagacgtcaccaaaggaaaactaccaaacaaagtaatcgctgctaaaaaaggatacgatgattggatagaagtcgatgattcatttacttttctatatagcctatatccaaatgacttgatattcattagacaaaacccaaagaagaaaatatcactaaagaaaaggatcgagagccattctatttcagacagtaaagaagtccaagagatcttaacatactacaaaggagtggactccagtacggcagccatcgaatttataacgcatgacggatcatattacgcaaaaggagtgggagtacagaacctcgactgttttgagaaataccaagtggatatacttggaaattacagtaaagtaaaaggagaaaaaagattagaactcgaaacatcggacaacaatcacaaaggcaaagacgtaaatagtattaaatccacaagtagatga

SEQ ID NO: 8543 - RNA, 3279 nt, synthetic construct
  misc_feature 1..3279: note = Cas9 variant
  source 1..3279: mol_type = other RNA
atgaaatatagcataggattagatataggtatagcaagcgtaggatggagtgttataaacaaagataaagaaagaatagaagacatgggagtaagaattttccaaaaagcagaaaaccctaaagacggcagtagcctcgctagctcaagacgagagaaacgaggttcccgacgacgtaacagaaggaagaaacatagattagatcgcatcaaaaatatactttgtgaatcagggttagtcaagaaaaacgaaatagagaaaatatataaaaatgcgtacctcaaatccccatgggaactaagagccaaatcattagaagcaaaaataagcaacaaagaaatagcccaaattctacttcacatagcaaaaagacgaggattcaaatctttcagaaaaacagacaggaatgccgatgatacaggcaaactactatcgggtatacaagaaaacaagaaaataatggaagaaaaaggatacttgacaataggggacatggtagccaaagaccctaaattcaatacccacgtcagaaacaaagcaggatcatacctattcagctttagccgcaaattattagaagacgaagttagaaaaatacaagccaaacaaaaagaactaggaaacacacactttacagatgacgtactagaaaaatacattgaagtattcaacagccaacgaaacttcgacgaagggccatcaaaacccagcccatattattcagaaatcggacaaatagcaaaaatgataggcaactgtacatttgaatcatcagaaaagagaacagcaaagaacacatggtcaggagaaagatttgtattcctacaaaaactaaataattttagaatagtcggattaagtggaaaaagaccactcactgaagaagaaagggatatagtagaaaaagaagtatacctcaagaaagaagtccgttacgaaaaactacgaaaaatactatatctcaaagaagaagaacgatttggagatttaaactatagcaaagacgaaaaacaagataagaaaacagagaaaactaaatttatatcattaataggaaattatacgatcaagaaattaaacctttctgaaaaacttaaatcagaaatagaagaagataaaagtaaattagacaaaatcatagaaatactgacatttaataaaagcgacaaaacaatagagtcaaacttaaagaaacttgaacttagcagggaggatatagaaatcttactgtcagaagagttcagtggaactctaaatctaagccttaaagcaatcaagaaaatcttaccatacttagaaaaaggcctatcatacaacgaggcttgcgaaaaagcagactatgattacaaaaacaacggaatcaaattcaaacgaggagaattgttacccgtagtcgataaagaccttatagccaacccggtagtattgagagcaatttcgcaaacaagaaaagttgtaaatgcaatcataagaaaatatggaacaccacatactatccacgtggaagtagcgagggatctagccaaatcctatgacgatagacaaaccattattaaagaaaataagaaaagagaattagaaaatgagaaaactaagaaatttatatcagaagagtttggaatcaaaaacgttaaaggaaaactgctactcaaatacagattataccaagaacaagaaggccgctgcgcatattctagaaaagaactcagtctaagtgaggtaatattagacgaatccatgacagacatagaccacataataccatactcaagatcaatggacgactcatactcaaacaaagtattagtattatccggagagaacagaaagaaatcaaacctattaccaaaagaatatttcgatcgacaaggcagagactgggatacctttgttttaaacgtcaaagccatgaaaattcatccaagaaagaaatcaaacctgttaaaagaaaaattcacaagggaagacaacaaagattggaaaagcagagcgctaaatgatacaaggtacataagccgatttgttgcaaactatttagaaaacgcattagaatatcgggacgatagtcccaagaaaagagtttttatgatcccaggacaactgacagcacaattaagagcaagatggcgactaaataaagtcagggaaaacggtgacctacatcatgcattagacgcagcagttgtagcagtcacagaccagaaagcaataaacaatatatcaaacatttcgagatacaaagaacttaaaaactgcaaagacgttataccaagcatcgagtaccacgccgacgaagaaacaggagaagtatacttcgaagaagtaaaagatacaagattcccaatgccatggtcagggtttgatctagaattgcagaaaagattagaatcagagaacccaagagaagaattttacaatttattaagcgacaaaagatatctaggatggtttaactatgaagaaggatttatcgaaaaacttagaccagtattcgtgtcacggatgccaaatcgaggcgtaaaaggacaagcgcatcaagaaacaataaggagcagcaagaaaatatcgaatcaaatagcagtaagcaagaaaccactaaactcaataaaactaaaagatctagagaaaatgcaaggcagagatacggacagaaaactatacgaagcactaaagaacaggttagaggaatatgacgacaaaccagaaaaagcattcgccgaaccattttacaaacccacaaattcaggaaaacgaggacctctagtacgaggtatcaaagtagaagaaaaacaaaacgtgggagtatacgtgaatggagggcaagcgagtaacggatctatggttcgcatagacgtgtttaggaaaaacggaaaattttacacagtacctatatacgtccaccaaacgttactcaaagagcttccgaacagagcaataaacggaaaaccatacaaagactgggacctgatagacggaagtttcgaatttttatattccttctacccaaacgatctaatagaaatcgagtttgggaaatctaaaagtattaaaaatgataataaattaactaaaacagaaataccagaagttaacttaagtgaagtactaggatattaccgaggtatggacacaagtacaggagcagcgacaatagatacccaagacggaaaaattcaaatgagaatcgggataaaaacagtcaaaaatattaaaaagtaccaagtagacgtactcgggaacgtctataaagtaaaacgagagaaaagacaaacgttctga

SEQ ID NO: 8544 - RNA, 3285 nt, synthetic construct
  misc_feature 1..3285: note = Cas9 variant
  source 1..3285: mol_type = other RNA
atgaaatcaaccttagctatagccagcatttcatccctaggttgggttatagaactaggagaaaacagaataatgagattgggattagacattggatcaacctcaatagggtggtggatatatgaaacaacagatggtcaaataacctcagttatcgatgggggagtacgtatatttagcgatggaagagatcctaaatctaaaggaagtttggctgtagatcgacgagtagctcgagctcaacgtaggagaagagaccgttatttaagaagaaaagcggcattgatgaaacgaatggcagaagtaggtttgatgccatccgatccaaaacaagctaaacaactggaggctttagacccatacgaattaagagctagaggattagatgaaactcttgaactcacagaactaggaagggcccttttccacttgaatcaacgacgaggtttcaaatccaatagaaaaacggacgctggagataatgaatcaggaaaaataatagacgcgactgctcgactggactgggcaatgagagaccatagagcacgaacctacggtgagttcctacacatgagaagacaaaaagccgatacaccccgaacaacgccggcagtaagaacaagattaaccatagcagcaagagacggagcggaaaaagaagaaagtggatatgacttctatcctgataggcaacatcttagggatgagttcgatgcgctttgggaagcacaagcagaatatcatggcgtattaacagaagacttaagggatgaaattggtacaataatatttcatcaacgtcccttaaaaacccctaaagttggaaaatgcctattcacaaacgaagaaagagtagcctcagcacaccccttaaatcagagacgaatacttgtagaaacagttaatgcgctaagagtagcacaattaggagaagtagctagagcattgactctcgaagaacgagatacaattttacacgcactagataataaagcccatacaaaaagtttaagtggcatgagcataaaactgaaagcactaggaaaagtaataaaactacgatcaggccaatactttacacttgaaacagcaaatagggatgcgatagcatgtgatccagttagagcatcactctcaaaacccgatagaattggaagctattggagtaccctcgatcataacgcacaatgggaagtagttaatcgaataagagctgttcagagtgatgcagatcatcgtgaattagtagcttggctagtatcacagcatagacttgctgcagaacatgcagaaggagctgcgtatgcaccattacccgatggatattccagattaggaatcacggcaacgaagagaatattagcagcgttagaagcgaatgtaattccttatagcaaggcagttgaaagttgcggctggcaccattcggatgaaagaacaggggaagtcctggatagattaccttattatggagaaatattagaccgtcatgttataccgggcacatatgatgatagtgatgatgacataactagatttgggagaataacaaatccaacagttcatattggtctaaatcagttaaggagattagtcaatagaataatcgaagtccatggaaaaccagacgaaatcgttgtagaattagcacgtgatctaaaattatcacaagatcaaaaagcagatgtagaacgaacaataaagaaaaacacccaggcagcaataagacgtggagaaaaattagaagaaatgggagtaccgaatactggagggaacagaatggtattacgattatgggaagatctaaatgatgatgatgtaatgaaaaggttctgtccttataccggacaaagaatcagtgcagggatgctttttgatgggagttgcgatgtagatcatattttacccttttccaggacactagatgatggattcacaaataaaacattgtgtctcaaagaagcgaatagaaagaaacgaaattacgcacctcatgaagcagctgaaaaagggctgctagacagggacgcgatggacagtgtcgctaaatacctccccgacaacaaagcatggagatttgctcctgatgctattgaaaggttcgaaggagaacgagactttactgcaagagcgctgaaagatacacaatatctttccagattagcgcgtacctatctcgacgcgctttatgatgggggagatgacaaaagtcatgtgtgggtagtaccgggtcgccttactgaaatgctaaggagacattggggtttaaatggactagaagccttagcagactcagatgagaaaacagttaaaaggaaaaatagaacagatcacagacatcatgcaatcgacgcggcagttgtagcagcaacagatcgaagtttaatacagaaaatatctaaaattgcagcttctgatgaacaagctggtgcagaagacacgttaaaatcaacacccccgccatgggatagtttccgagatgacatagctgcacaattacaaaacattacagtaagccacagagccgaccacggtcgcaccgacagtttagccaaaggaagaggagaagacactacaagcggagcattacatgaggccacagcactaggtataatagacgaaacacacgttacagtaaggattccaatagaatcactgaaatctggtcatttaatagaaggaagtagaaacggatatataagagacccatacctacgtgatcaactaactctagcaactaaaaacggaagcgataaagacttcacaacagtacttcaaaaattcttcgacagaagtaaaaggtacggtggaactagaagggtacgaataataaaaactctacaggatacggctcgaatttcagtaccacataacgcacccataaaagcatacaaaggtggctcaaatcacgcatttgaaatatggagacttccaaatggaaaaattgaatcacaagtgataacaacgtgggaacatcataatctaacagaaccaaaacgtcctcatccagcagctaaaagaataatacgattgcataaaacagatatggttgctatagaaagagatggaaaaactgttatatgcttcgtgcaaaagacagacccatcaaacggagcctttctagtaccccatttcgaagcaaatgcagatggaagaaaaaggaaaaatgaaccagtcgaatggtatcaaatgtcagcaaacagcttaattaaagcagacttgagaagagtgggagtagacgaaatgggtagagtaagagatccaggcccaccgccaattaggtga

SEQ ID NO: 8545 - RNA, 3285 nt, synthetic construct
  misc_feature 1..3285: note = Cas9 variant
  source 1..3285: mol_type = other RNA
atgaagtacagagtaggatttgatttaggtacaaacagtcttggatgggcagtagtaagattaaatgcatcaggagaaccagatagaatagaggtagcgggcagcagaatattttcagatggccgcgaacctaagagtggagcatcgctagccggtgcaagaagagatgcacgagcaatgagacgacgccgagacagatttaaacaaagacaagcagcactaattaagtacctaactcaagctggtttctttccggcagatgagagcgaacgaaaggcattaagtgcactcgatccctatgagctaagagcaagagcattagacgaggcgctaccattagcacacctgggacgagcgttatttcatctaaatcaaagaagaggatttaagtcaaatagaaaaacggacagggggaaaaacgatgatacaggaaagattagaataggagtagcgagactgtatgaacagatgagagatgcagacgcgcggacattaggagaatttctccataaacgtagagcggctgcaagtgacccaaatgcaataccccatgtaagaactagaatagttacattagcagcggaagacggaaaagcaagtgacgtatatgacttttacccagatcgccaaacattggaagaggaatttgaagcaatatgggaagctcaaacgtcacaccatccagaagcattaacagaagaaagacgagctcaattttatgaaattatatttcaccaaagaccattaaaacaacctaaaattggcttttgcacacttttaccgcccgaaaaacgattacccaaggcacatccactcttccaacgacgtagactattagaagaggtaaacgctttaaggatagtattaccggggaaagaaactcgagcattagaaaaagcggaaagagatgccttactatcaaaattaaaccaaagaaagaaagctgcatatgaatccctacggaaagcattaaaattggatccggacgcacgttttaataaagaaagtgacaatagggaagatatgataggagatgaaattgcggcggaaatggcacataaatcaagatttggaaaagtatggttaggtatgagtgcagaggctcaagcacaagtaattgaaagactaagaggactagaaagcgatgctgacgcagatgatttcgaagcatggttaagagacgaccatggattagcgcaggaacaagcaaaagccgttacagcggcaaacctaccggaagggtatggaaggttcggtgaaacagctactaggaaactaatcgcagcgttagaacaagaagtaattgtatattcagaagcagtccagcgggcaggtttaggacatcattccgatctgagggatggtcaagtatggacggacaagaaaggaaacccagcattaccatattatggcgcagttcttgaaaggcacatagtcccaggcacagccgatccaaatgaaacggatgatgccctaagaataggtcggctaacaaacccaactgtacatatagggctaaatcagctaaggagggtagttaacgcattaatgcgtagatacggacaacctcaagaaatagctatagaacttgctagagagttaaaattatcagatgatcgcaagaaagaaattaacacaaggaacagagaaaatagaaaagcagcagagaaaaggagccaaaaattaagaaatataggacaagcagataaaggaggtaatagggccttactaaaactgtgggaagaactcaatccagaaaacgtacttgatagaagatgcgtatacacgggacgagtaattagtatagacatgttattttcgggggcagcagaagttgatcatatactgcccttcagcgtgagtttggacgactctaacggaaatcgaatcctttgtttgcgagaagtaaatcggatcaaaagacaaaggaccccatgggaagcaagagatgacttacgtgcccattttggccctgatgcaggatgggaagctatagcggcgagagcagctcgattacctagggaaaaacgttggagattcgaacctgacgctgctaaccgtttcgacgctcaaggcggattcttagcaagacatctaaccgacacacaacatttaagtcgattagctaggagttatttaagtgctctatacccagaaacaggagaaggtagcggccatgtttgggtctcgccgggaagactaactgaaatgttaaggagagcatggagcctcaatcaccatctgccagaccataacattgctggagctgcaaaccaaccaaagaacagaaaagaccatagacatcatgccatagatgcaatagtagtagcattagccgacagagcgatgctaaatagaatagcacgagaatctggaaaagaaggccatgaagcagctggaagattagtcgccagcatacccgaaccatgggaaggattttctgacgaagtaggacgagctgtacgagcaataaccgtaagtcaccgacctgatcacggtacagcaagtaaagcaggacgagctaaggacaaagatgcaacagcaggaagattacataacgaaaccgcatatggattaacaggggagaaagacgctcggggactggatatagtagtaactagaaagccattatccgcttttaagaaaagcgctgatcttgatgcaattcgagacgatgatctaaaacaaaaactaaaagcatgggctgcaggaaaggaaggaggagcatttgaacaagcaatgcgatcatttggagacccagaaagaggaccaagatcacacccaggattgcgaagaattagagttacagaaccgttaagtgtgataccaataagagaccgggatggcagaccatataaagcgtataaaggagatagtaattacagatttgatatatgggaactaaaaacaggtaagtggaaagatgaagtggttagcatgttcgaggctcatagaccgaactggacttcacccatcagagctggaaatccaacagccagaaaagttttaagcgtcagacaaaacgacgtaatagcaatagaacgagaaaatggcccagaactaatgcgagtagttaagtttagcgcaggatcattagctttggcaccaccccaagaagctggatctttaaaagctagagacgcagataaaaacgacccatttaaatatgtatatggtagccctagcagtttgcaaagatggaaggctagacaagttagaattgatgaactaggtagagtattcgaccctggatttgcagtacgatcaaggagaagcagtgaatga

SEQ ID NO: 8546 - RNA, 3291 nt, synthetic construct
  misc_feature 1..3291: note = Cas9 variant
  source 1..3291: mol_type = other RNA
atgaaaaatatattcagttttgacatcggaacaaattctattggatgggcagtgttagctcttgatggaaatggtgatcctgtacgtatcgctgatgcaggcgtgcgaatattttcagacgggagagatccaaaatcaaaagcatctttagctgaagcaagacgtatggcaagagcaatgtcaagaagaagagatagaacactaagaaggaaacgagcgacactaagaacattggccgaaataggactcatgccagacacctctagtgcaagacaagcacagttaagagaaacatccgatcccaaatcaggcagcggtcaattaacgagaaatccatatgcactaagggcactagcattagaagaaaaactgccactattccacataggtagagcattatatcacttgggacaaagaagaggcttccagagtaatagaaaaaccgatagaaaagataatgacaaaggaaaaattgctttaggcattgaggaattacatgcagcaatgcgccaagatggagcacaaacttatggccaatggctagcaaggagacatgctctaggtcaagcagtaaggctgaggtcaggggcattagaccttgaaggagaaggttatgctttttatccagaacgaaaattattagaagacgagttccatcgaatttgggaagctcaggcaagacattacccagacatactgacaccggaacgccgagaccacttatttacagtaatgttctttcagagacccttaaagaaaccaaaagtaggtaaatgcagttttaataatcaggaggaaaggttatcaaaagcacatccattatttcaggagtttagactatataaagaagtgaacgaacttgaaatagtagaacccgatttaacacacaagaaactaacactggatcaaaggaatgcgctagtcaagaaactgcaagtatcacgagaagcaagttttgcggctctgcgcaaagtcctaaaactaaggcctgatcaacgattaaacaaagagtcagaatctcgcacaaaactaaaaggaaacgaagtatacgcagtattatctgataaaacaaggtttggacctaggtggggaacatttagccaggcagaacagtgggctataatcgaacgattaaaagaagaagaagatccaggacgtttgtttgcatggttaagaagtgctttcggaatagaaggggagcaagcagcagatatcgcaaatgtccatctaccagaagggcatggaagattaggaaaaacagctttagaagcgatgctagaagaattaaaagccgaagtcatcacagaagcagaagctgctaaaaggtgtggatacgatcatgcaaggttaggaggtggatctgatgaaggagaacctgaactcccgccataccaagaaatattacaacacagaatacccccaggtacaaataatccagatgatccatacgacatagaaaaaggacgatttacaaacccgacagtacacatagcgttgaaccaattacgccatgtgatgaatacattaataagaaggtatggtaaacccgctcaaatagcggtggaattagccagagatctaaaattaagtgaaagacaaaaagaagaggtaaacagaacaatagcaagaaatacaagagatgcagaaagaagaggaaaaacactggaagagaatcgcataccaaatacaggatataatcgtactttactaagattgtgggaagagttgaatccaggtaaagtagaggatagatgttgcatatatacgggaaaaccaataagcatatcaatgttattttcgggagaggtagatatagaccatatactaccctggagtagaactttagacgatagtcatggaaacaaactcctatgtcttagagaagcaaatagagtcaaaaggaacagggctcctgctgatgtaacggaatggagagataactacgatgaaatattatctagggctgctagactaccgcaaaataaacgcgacagattcgcacctgatgccatggaaagatttgaaaaggccggaggattcttggcacgacaattaacagacactcaatacctaagtagaatggcgttagaatacttggcttgtttatttcccgccgaagaaatggatggatttggagaactacgaaggcatcgatatataaacgtgtgtccgggacgactaacagaaatgttaagaagaaattggggactaaatagtatactgagcgactctcaattaggagaaaccgcccaagagaaaaaccggaaagaccatagacatcatgccatagacgcaatagttataggagtgacaggcagatcattactaaatagaatatcatacgctgctggacgtttggaagctcaacaactagaaacgctagttaaagaagctgctgcaacaaataaaccgtgggacggattccgagaagatgtggccaaagtagtaggaggtataatagtatcacataagcccgatcatggaacagcaggtagaaaagcaaaagatccagctagacagcaaactgcgggcagattacacaatgacacagcatatggactaacaggagaaacggatgcaagggggaacacgatagtagtaagaagaaagccatttctatcgctaacatcaaaagacataccaagtataagggacgaagccctaagagcagtactggaacaacatttacgaggtattccagatggaaaggctttccaagccgcattagacgcttttcgaaaacaaaaaggatttcaccattatcacggtattaggcacgtaaggttgacagaaccgctatcagttatcgggataaaagatagagacggaaaagtgtataaaggatacaagggagatgcaaaccaacgatatgatgtctgggaaacactcgacggaaaatggcatgcagaagtagtttcaatgttcgatgcacaccaaccaggatggcaaagccgtttccatgccgaaaatcctactgccagacgtgtactaagactccaacaagacgatatggttgcattaaatgcgccagatggagggagactcctagtcagagtcgtaaaatttagacaaaatgggcaaattaccttcgccggtcataacgaaagtggaaatttaaaagcgcgagacgcagccagtaatgaacaagacccattcaagtatatctcaaggatggcatcaagtttgaaagactgcggatgccgacaggtaagaatagatgcaacaggtcaagtgtttgatccagggccacaagatcgagcatcaaggttacaaaaacaatctaaaagatga

SEQ ID NO: 8547 - RNA, 3294 nt, synthetic construct
  misc_feature 1..3294: note = Cas9 variant
  source 1..3294: mol_type = other RNA
atgaagaaacaaccacaaaggtatatcctcggactggacttaggaatagcaagtgtcggatgggctcttatcctcgtagacggagcggaaaatcccgttggattactagattgcggagtccgaacattcgaaagagcagaagttccaaaaacaggagactcattggcactagccagacgccaagcgagatcagtcagacgactaatccgaaggagagcacacagactacttagactaagaagactattaaaaagagaaggcattctaagcgccgccgacttcaattcagacggattgcctaacctaccaatagatgcatggcaactaagagtagcaggattagaacgaaaattaacaaaccaagaatgggcagctgtcttattacatttggtaaaacatcgtggatatttatcacaaagaaaatcagaaacacaaacagaaaacaaagaattaggccgattactagccggtgtagccgaaaattcaaaactattgagcgaaagttccgaacaatacagaacgccagcagaacttgcggttaaattgttcgcagaacaatctggacatttaagaaataaagggggagagtacactcatacatttaatcgactagatctacaaaaagaattacatctgttatttgaaagacagtatgcactaggaaacccttttgcatcagctgaattacaaagtaaagtagacgagttattaatgacacaaagatcagccctccagggggaagctgtactaaaaatgctaggtaaatgtacatttgaaccatcagaatacaaagcagcgaaaaatacatactcagcagaaagatttatatggcttacaaaactaaacaacctaagaatcttatacaacggcgaagaaagagcccttgatgaaggagataggaagaaacttttagatgaaccctataaaaaggccaagctcacatacaaacaagttagatcaatcctaaatctgcctgaaagcgcagtatttaagggacttcgatacggaaaagatagtgacggcttgaaagcagaaaatggaacattaatggagatgaaagcatatcataaaattcgtacaatacttgataaagccggactaaaaggagaatgggaaaatagaataagaaatccagaaatcttagataaaataggaaccgcattcagcttatataaaacagacgaagatatacaagccgcactcgcagatctccgcctacccgaaaatgtccttgacgctcttttagcgggactgaattttgataaattcatacaactctccctaaaggccctacgaaatatattgccattaatggaaagaggtatacgttatgatgaagcatgtaaggaagtatacggagatcatagagcattagccgaaagtaaaaaccaagtattactaccaccaattcctgcagacgaaattcgaaaccctgttgtattaagaacattaactcaagcaagaaaggtaataaatgctataataaggagatatggaagtccacaacgtgtccacatagaaacggcccgagagcttggtaagagtaaacaagagagagacaaaatagataggaaaaataaagaaaatcaaaacgatagaaacagattagcaagcgacataagaaaacattttaatttcgaacctacaccgaaagacatattaaaattaagactatatgaacaacaacatggaaaatgtctctattccgacctaagggaagaaaagggagaatgtttatatacgggcaatgtaattgaattgcataggttattcgaagacggatacgtagaaatagaccatgcattaccactatcaagaacatgggacaattcactgaacaacaaggtccttgtgctgaaatctagcaatcaaaataaaggaaataaaacaccttatgaatggttggacggagcaaataattcaagaaggtggagagagttccaagcacgggttcaaggatgccatttcccctacgtaaagaaacaaagaatacaaacagccaaactagactccaaagcagaacaaggatttctagaaagaaatttaaatgatacacgatatatttctaaattcatgtgccaatttattaccgctaatctaaggctcgcagagacctcaaacgctttaatggaagaagtagcaggagaaaatccgtactggaaagagagaaaacgacaacgagtcttcgcgcctagtggaagcataatcgcactattgagaggtctctggggcttaaagaaagttcgagaagataacgatcggcaccatgccctagatgcaatcgtagtagcatgcagtactgtttcaatgcaacagaaaataacaaaagcaatgcaaagaagagaaaccctcgaaacagtagatagtgaaacgggagaagtaaaaacaagaatacctcaaccatgggacttctttagacaagaagtaatgataagagtattttcagattcacctagagaggaactagcagaaaaactgaactcgagaccagaagcactccacgattttgtatcgccattatttgtaagcagagcaccaaaccgtaaaatgacaggtcaaggtcatttggaaacagtaaaaagtgcaaaaagactaagcgaaaatatatccgtagttagaaaacccttgactgcccttaaattaaaagacattgaaaacatagttgggtacccagatcgagaaccagcattataccaagctcttagagaaagattactagcacacaaagatgatccggttaaagcattcgcggataaaccattctataaaccagcaaaagacggaggccaaggttctctcgtaaaagcagttaggataatagaaaatacaaaacatggactaaaaataagaaacgggataacagataccaacggtgatatggtcagaacagacgtctatcaaaagacagataagaaaggcaaacggcaatacttcatagtacctgtctacgcatggcaagtggagaaaaacgaattaccaactgtagattgcaaaggatatgaaattgacgacaactacgaattttgtttttcactatataaatatgacttaatagaaatacaaaacccaaatgatataaatcaagaactaagagcatactacattaactgcgacagttcggatggcagattctggttagcataccatgataaatcagctaaagaacaacaatttcgcatttcaacacaaaatcaaccaataataaagaaatatcaagttgacacattaggaaaagagatacggttatgtaaagctgagaaaagaacagcactcaatgggaaaaagaagaaatga

SEQ ID NO: 8548 - RNA, 3294 nt, synthetic construct
  misc_feature 1..3294: note = Cas9 variant
  source 1..3294: mol_type = other RNA
atgggaaaaggagatatattattttcatttgacataggaactaactcaatagggtggtgtgtttttgctttaagtgacaatggagacccatgtagaatattagatgctaacgctagaatctttgctgacggaagggaacctaagtcaggaaatagtctagcagaaggaagacgagccgcaagagcaatggcaagaagacgagataggtacaaaagaagacgaaaagccgttttaagaacattaacagaatatggactaatgccggcagaccccaaagcaagacaagcactggtagctaaaacgggagaccgagggcccaaaagcgaagaagcattagctgatgtctacagtttacgagcaagggcgttaatggaaaaattaccgttacaccacataggtagagcattatttcatctaaaccaaagacggggtttcaagtctaataggaaaacggacagaaaatcgaacgaaaaaggagcaatagaaacaggagttaatagactattagaagaaatgcgtgacacgggagcaccaacattaggcgcatatttagctaaaagacgttcagacggaagaccagtaagagtacgagcaggagcttcagaacaagaggcagaagatggaaaaccagcaaaaacagcatatgatttctacccagtaaggcggttattagaggaagaatttgacgcaatatgggaaaaacaatatagttatcatcctgaagtgttaacggaagaaagacgaggtcatttattcagagttatgtttcatcaacgaccgctaaaaccagcaatagtaggacgctgtagttttaatagcgctgaaacgagactagctaaggctcacccattatttcaggagttcagactctataaggaagtgaatgaattagaagtggttatgccagaccaaagccataggaaactaactttaccagaaagggatcgcttagtattgaagctaagaggacaacgaaaagccacatatgccgcattaagaaaagagttaagacttagagatttaaggttcaataaagaaacggaaaatagaacggatatgatgggagatgaagtaacagcggcattagcagacaaagctgtttttggaaatcgatggagcggatttagcactgatgagaagtggaggatagtcgaaagacttagagaagaagaagatccatttgcattacatgaatggttagtgagcgaacatgggttaagtgatgctgaagcggaacaagcagctaaagttcatctgccagacggttatggacgactaggaccaacagcagtatcaacgatgttggaagaattaaaggcagatgtaataacagaggcagatgcagcaaggctagcaggttacgatcacagtttagctagagcagacgaagacggattggacagactaccaaaatatcaagaagtacttgaaagaagaatacctcccggaactaacgacccagatgatccatacgacattgctaaaggaagaattacaaatccaacagttcacattgcattaaatcagtttagacatgtagtaaacgccttagcaagaagatttggtaagccggatcaaatagcgatagagttagcaagagaattaaaattaaatgacagacaaaaagacgaagtgaacagagtcatcggcagaaatactagagcagcagctttaagatcacagaaacttagagacattggacagaaagataacggttataaccgagcattattaaaattatgggaagaattgaacccagataagccagaagatcgagtttgtgtatacaccggacgacctatttgcataagtatgctattcagcggagaagtagatgtggaccatatactaccatggagtcgcacaatggacgacagccaagcaaatcgaattttatgtgttgtagaagcaaatagagttaaagcaaacagagcgccagcagaagttgcagaatggggaggaagatatgacgaaattctagaaagggcagcccggcttcctcgaaataaaagatggagatttgcaagagacgcaatggaaaaatataaagaaaatgagggcttcctcgcaaggcaactgaccgatacacaatatctatccagattagcgagggaatacgcagaggcattgtatccaacagaagaaccagacagactaggggaactacgaagaagaaaccatgttcgggttatacccggaagacttacagaaatgttgcgacgcggttggggtttaaatgcattattacctgatcataattttggtgcgggacaagcaaagaatagaaaagaccacagacatcatgcaatagatgcagcagtggtaggagtaactacccgtggtctcctccaacgaatatcaacagaggccggtctaagagagaaactagcacttgaggaaacaatagcagatataccaatgccatggccagggtttagagaagaacttaaagctgcgatagacagagcagtagtaagtcataaacccgatcatggaacactaccaaagcctggagaacacggtagaacagcgggacaactacacaatgacacggcgtacggaataacaggagaaacagatgcaagaggaaatccgatagtggtcaggagaaaaccattcttgtcccttacagataaagatataccaagtataagagatacagaattaagaggacgagtgtattcggcaacatcaggcctctctggaagggaactaagtgcagcattagattactttaggaaaacagataaacaatttcgcgggattcgacacgtaagagtaactgaaagcctctcagttataccgattcgggatagagatggaaatatttataaaggatataaaggagacgcaaattttaggtacgatgtatgggaattacctgatggtaaatggaaagcagacgtagtaacaatgttcgatgcgcatagaccagatcgtgcagcagaagaaagacggcctcatccggcagcaagaaaggtactatcattaaaacaaaatgatatggtggcatgtgaacacccaaaagatgggtatactataggaagagtagtcaaattcaatacagccgggcaaatatattttgcggctcataatgaaggagggtctctaaaagcacgcgacgccgatagagcagatccatttaagtatttttctaaaagtgctagtggattaaaagaaatagcagctagacaagtaagaatcgacgcaacgggacaagtattagatccaggtccccaagatagggaatcaaggctcgctaggaacaaacgtttggaaagagaaagggcatga

SEQ ID NO: 8549 - RNA, 3303 nt, synthetic construct
  misc_feature 1..3303: note = Cas9 variant
  source 1..3303: mol_type = other RNA
atgaaatacaccataggtctcgatataggaaccagtagtgtcggatggggcgtcatcgataccgaaagaaatcgaatacaagatttgggagtccgactctttgaaagcgctgaaaaccaaaaagatggtgaaagcctagcaaaaccacgaagagacgccagaagcatgcggagacgcctagctagaagaggtagtaggcttgaaagagtaaaatcgattttcgaaaaagcaaaatttctaacaagaggacaaatgggaataactcacgcacgaccaaacgacccatatagacttagagcagaaggccttgacagactactatccaatgaagaccttttcattgccgtctatcatttggctaaacgacgaggttataaatcaaataggaaaaatgtactagaaggagacggcgaagacgtaagagaaggaaaagccgtactagatggagtcgcccaaaacaagaaactcatggcttttaggggctatcgtacagtcggagaaatgtttttcaaagattcagttttcacagaagcaaaaagaaacaaagcaggaagctacaaacactgcgtcctaagggaaatgctagaagacgaacttggtaaaatattacatgcacaaagatcactcggaaacacattagtcacagactcattcatatcaaaactcttagaaaagaaaaccggtgtattcgtttatcagagaccttttgcaagtggtaatcaaatcttaaaattagtaggaccatgcacattcgaaccagaagaaatacgagctgcaaaagccacatactccttccaatactttaatgtactccagagactaaacaaccttacaattaaaaatacagatacaggaaccgagagaaaattaacctcagaagagagagcaaaaatgatcgcatttatttttagccacaaagatgtacaatatgctcaaatacgtctagaacttaaactatcagacgttgacagattcaatatggtaaattactttgttcaaagaaaagaattagaaactaaaactgcagaagaattaagaagagaaattgaaaagaaaacaaaattcccatcattatcagattactatactataaggaaaacagtatctgaaatcgattcagcattctggatccaaattgaaaaacaacacgacgtaatagatgcaatcggagaaatattcacattatataaaacagacgaagacataattgctcaactaaacactagaataccatcaataccaagaccagtagttagcgcattattaggactatcctttacaaaatttggacatctaagcctaaaagccctacgaaaaataatcccccatttagaaaacggagatacttatgacgtagcatgcgcaaaagcagatcccaaatacaccgatcgagccaaaacaagggcgcgaaaattgagacctctagataaagaggatcattcaataactaatccagttgcaagacgagcaatagcgcaaacaataaaagtagtaaacgcaattatagataaatatgactccccgagtgaagttcatatagaactcgggagagatctcgctaaaaacttcaaagagagaatgaaaattcaaaaagagcaaaaacaaaatcaagaaggaaatgaaagagccatagcaaaaattcacgaactctacaaattagaaaatccgagaggacaagatattattaaattccgattatggaacgaacaaaacggacagtgcatgtatagcggcgaacggattgacgaaataagactattcgataacggatatacagaaatagaccatataattccgttttccagatcttttaatgacagttacagcaataaagtattagtattaaaaatgaggaaccaggagaaaatgaacaaaacaccctacgaatacatgggaggagacgctgatacatggcagcgcttcgaaaatttggttaattccatgcacaatatcggaccaagaaagaaacaaaatttactactaaagaaatacgtcgcggacgacctaactttgagaactttaaatgacacaaggttcatagcccgatacatgaaaaactacattgaaaacactctactatttactgaaggccctcagaaacaacgggtatatacagtaaacggacaagcaactgcctacctgcgcaaacgatgggtactacacaaagacaggaccgaaaataacagacaccacgcacaagacgccgttgttgtagccgtagcaacaccctctctggtacaaggaattatgagacatgcaaaaatgggagaaatagtagattacttgcattcgcaaaaattcgcaccaaacgtgacagacatagaaacaggcaaaccatttgaatccgccgatatccaatctgcaaaagaaagaatcatagcgaaacatgaacaccgactaagaataccagaaccctgggaaggctttagcgatgaactagatgcaagaatgggtgatgatgtagttgaaaaactatctttaagaaaatcaaatattcacggctacaaaacaacatctgatttttcacaaatacatccaattttcgtatcaagaatgccaaaaagaaaaaccactggtagagctcaccaagaaactttaagatcaccacgaagattcaaagaatttcaagaatcagttgtacgcacaccattatctagcatcaacctaaagaaattagaagagatgtcagggaaaaacagcgacaaattgttatacgacatcctcagaaaaagactcttagcacacggagacgatcctaagaaagcatttacagaaccagtacataaaccacgaaaagatggaacgcaagggccattagtacgttcaataaaaatggttagcgaaggacaaagaagcggtattctagtcaacaacgaacaagcattagtagaccaagattcaatgatacgaattgacatatttagcaaaccaaacaagaaaggaaaagatgaatactatataataccagtatatgcataccatttcgcacaaaaagaactaccaaataaagtgataacagcaaaagcggaggcggattggagaacaatagatgatacattcgcttttgaatttagtctatatccaaatgacctagtaaaattaacaaaaggagacgacataaggtttggatactactcaggatgcaacagagcactggccgctatccacatactcccacacgatcaaaacatgcctctagtgaataacgggataaaaacattagacaaaatagacaaatatgtcgttgatattctaggagagtaccataaagttggaaaagaaacccgccaacaaatacagtga

SEQ ID NO: 8550 - RNA, 3303 nt, synthetic construct
  misc_feature 1..3303: note = Cas9 variant
  source 1..3303: mol_type = other RNA
atgggtgctactattgttacagatatatccagatcagccttcgcattcgacatcggaacaaaatcaattggaagcgcagtactcagactagatgacaggggtgaaccaattggaattataaatgcagctgttagaatatacgcggacggaagggagccaaagagtggaacaagtcttgcagaaggaagaagactggctagaggtatgagcagaagacgagatcgatataagcgaagaagacgtactctattaaatactctaaccgaatttggattaatgcctccaacagatgaagcaagaaaagccctactagcagaaacaaacgatagacgattcggcgcagttgccggaaatgtgtatgctctgagggctcgtgccttagacgaaaaattaccattacatcatttaggtcgtgcgctgtttcatctaaaccaaagaagaggctttaagtctaaccgaaaaacagataaacgcgacaatgatcaaggaaagatagcatcaggtatatcgaggctaggtcaaaaattggatgaagctggcgcaagaacgctaggcgaatttttacaccgacaacatagtgcaggtaaatgggtaagggtaagaccaagtagagtaccaagtaaggatgataaagaagaagatggttacggattctacccagaacgaagttttctagaacgggaatttgcagcaatttggaaagcacaagcagcattttacccagaactactgaccgaagaaagaggcgatcatttacacagagtaatgttctttcaaagacccttaaagcgacctaaagtaggaaaatgttcattttacccagatgaagatagacttccgaaagcacatccactatttcaagagtttagattagtaaaagaactcaatgaacttgaagtagttcatcgaggggatcgtagagaaaaattaacactcgaacaacgagatactttatttaatcaattaaggactcaacggagctctgcatttactgcattaagaaagacattgaaagcgccaacaggtacgagatttaataaagaatccgatgcaagggacaagttaaagggggatgaagtagccgcagaaatgtcgcataaagatagatttggacaagcatggattggaatgccactcgcggaacgttgggccgtaatagaaatgttactcgacacagaagacccactagaggtaaaagcatggcttgaagaacactatgggtttgcagcagacagaatagatgctattgcggcagcaaaattaccaccgggttacggaagactaggtgaaacagcattaagagatatgttggatgaactaaagaatggaactgttaaagatgattcaggaagagatgtagtattaacagaaagacaagcaatggataacatatggaaagacaacccagcgctacaaagagttgtagccgacgccagagaattacctccctaccaagaagttttaggaagaaggatcccaccaggaactgggaaaccagaagatccgtatgatgtacaaaaaggaaggctaactaatccaactgtacacattggattaaatcaattgaaaagagttgtaaatgcattagtgagaagacatggcagaccagatcaaatagctcttgaattagcaagagagctgaaattaaacgaagaacaaaaagcagagaaggacagagaaatagcgagaaatacgaaggcagcacaagcacgatcagaaaaactaagacaattagatattgatgataatggatacaatcgagtactattaaaactatgggaagacttaaacctaagacagccagaaaacagagaatgcatctattgcggaaaagcaataggtattggtacgttattttcaaatcaagtagatatagaccacatattaccttggtccaaaaccctagatgatagccaagccaacaggatcgtttgtcacgtagaatgtaacagacaaaaagggaatcatgccccagcagaagttcctcaatggcatgaccgttatgacgacattttagcaagagcagaaagattaccaaggaataaagcatggcgatttgggagggaggctatgaagaaatttaaagacgatgagtcattcctcgcacgacaactgacagatacacaatacctatcgagaatggcacatgaatatgtcgcagcactatacccagacgaagaaccagatgagtggggagttttcacacgcagaaaccatgtaagggttataccaggaagaatgacagaaatgttgcgacgtcaatggggactaaatgcgattataagtgaccatgaccagaaaaacagaaacgatcatagacatcatgcaatcgacgcaattgtcgttggtgtaacaacgagaagactactacaaagaattgcaacagctgccggagggagggaagccttagcactagaggaaacaattggtaaaatagaaccaccttggccaggattttatgatgacgtcaaagaagccatagacagaattgtagtctcacataaaccagatcatgggtctttaccaaaaccaggggagccagcacgtacagctggacaactacacaatgatactgcatacggatttactggagaagaaagaaaaggagtacccataatggtccatcgggtacctttcgcaaccttaaccgaaaaagatataccatcaattcgagatcgacaactagcggaagcattgtacggcgccattgcgggaatatcaggcaaggcagaactagccgcggccttagcaaggttcagcgcgagtggtccgtacaaagggataagacatgtgcgcgttgtagaacctgtaagcgttatagcaataaaggacagggacggaacaccctataagggatacaaaggagacgcaaattacagatatgatgtatgggaactgcctaatggaaaatggacacatgaggtagtaagcatgttcgatgcccatagaccagactggcaatccgaaataagaaacaaaaatccagccgcacgaaaagttttaagtttacaccaaaatgatatggtagcatatgaacatccacaagacggatacacaattggaagagtagttaagtttggttcaggcggacaaatggcattagcgggcaatcgcgaaggtggtgcattaaaaagtagagacgcggatccagaagatagattcagatacttctacaaatcaggaggagcaatgagggatgctagacttagacaagtaagagtagatgaaacagggcgagtatttgatcctggaccccaggatagagaaagcagaaatgcgcgaaaacaatcagccgcaggctga

SEQ ID NO: 8551 - RNA, 3306 nt, synthetic construct
  misc_feature 1..3306: note = Cas9 variant
  source 1..3306: mol_type = other RNA
atgaaaacgctaggcctagatctaggcacgaatagcctaggctgggcaatagtagaaacgagagacgaacctacaaaatactcagaaggtagtatagtagcaagcggggtaagaatattcagccagtcagaaatggccggtcgggacccacaaagtaaagcatctttagccgtagctagacgacaagcgcgaggaagtcgaagacgaagggatagatatttaaaaagaagacaaaggctagtggatttactcgtagatctaggactaatgccagctgacaaagcagcaagagccgaattagttaaaaatcatggagacggaaaaacaggagatctgtcatcatcggtatacgcactacgagcaagggcgctagatgaagcactctctccatatgaaatagggagagcgatatttcatctcaatcaaagaagaggatttaaatcaaatagaaaagcggactcaaacgatcccgaacaaggcgttatatcagaaggtatgagggctttggatgagaaaatggcagaagcgggagcgagaacaattggagaatggctacacatgagacgtcttcaaggactaccagttagagcaagaatagcacccgatggtgaaggatacgcattttatccttcaaggggagcactggaaagagagttcgaccggataatggctaggcaaactctatttcacactgatttgctaactgatactgcaataagagaattaagagaagttgtattccatcaaagacccctccgacctgttaaacctggcaaatgtagttataacccacttgaagaaaggctagcaaaagcacatccattattccaaaaatttagactcctaaaagaattgaatgaattggaaatagtaggggaagatcaaaaacacataaaactcactccggaacaaagaaacgccttagcgttacaattacggacaagtttaacgaaacaaggaaaagttccatttagcaaattaagatcaacattaaaattagggagagaagttagatttaacaaagaaacagataacagaagtgatttagaaggggatgtaatctactttagaatgtcaagaccagaatgtttcgggaatcgatgggctgatcttccagtcgaaatgcaggctgcaataacagaaagacttaggacggaaccagactataaaactctaatgaactggctcaaagctgaaacggggttagatgaagttcatgctagagccgtcgcggatacccctgtaccagacggttttggaaggttgggacaaagcgcgttgactgcattaatagatgcacttgagaatgaagttggcgaaggtgggttcgtcataactgaagctgaagctgctaaacgagtatatggacgaaccaattcagaagctgatccggacagaaaaggcgtagatgaacttccaaaatatcaagaagtactagcaagacacatacctccaggaacaggagaaccagacgacccatatgacgatttcatgggaagaataacaaatccaaccgtacatatagcattaaatcaactgagaagggtagtaaatgctcttattcgaacttatggaaaacctgatcggatagcaattgaagtagggcgagacctaaaaatgaatgatcgagaacgagacgaagtaaatagaagaataggaagaaatactaaagcagctatagaaaggggagtaaaactaacagaaacatttaggcagttagacaccggttataatcgtctcagattagaattgtgggaagacttaaatcaaaagccagagaatagagtatgtatctattgtggaaaagcgatagcaggacatatgctatttaatggggaaaccgacatagaccatatattaccatatagtaaaacactagatgatagtaaggcaaatcgaatactatgttgcacaagttgtaatagagaaaagaaaaataggcctccaagcagagtaccccaatggagatcaagatacggagagatattagctcgagcaaccactctcccaaagaataagcaatggagattcgcagaggatgcaatgactagattcggagaagaggaaggatttctagccagacaactaacggatatgcagtatataagcagattggctttaacttacctagcacacttatatgactacgaagaagttgacttagatggaatatacaaaagacacgcaagggtacgtgctctaccggggagaatgaccgaaatgttaagaagacaatggggactaaacgaattacttcatgatcataatttaataggaggagatgtggcaaaacctaaaaacagattagaccaccgacatcatgcaattgacgcaattgtaatcgcttgcacatcaagagctctaatacagcgactggcaacagcctcggcagcagctgaggaacgaggagccgaaagggtggtagaaagaatcgacccgccatggagtggatttcgagaagatgtcagggcagcagtaggagctattgtggtaagccataaaccggatcatggtaccgtgggccgtgaaggctacgctaaaggtcgaggacaaacggcgggtaaattgcacaatgataccgcttatgggcatacaggtgaaaaagacgcttcaggaaatgatatagtagttcgtagaatagccgtcactgatattcgatccccagcagatataaggaaaataaggacaaatgcacatggacactccgagttaagggaccgcttatatgaagcaaccagaggattagaaggaaaagcattcgaacaagccgtactagactttgttaaaggggatgccaaatttcgcggaatcagacacgtaagaataacggaagtagccaacccagtgtggataactcacggggatggaaggcacaagaaaggatatttaccaggaggaaacgacagatttgatgtatgggaattagccgatggaagatgggatgcagaagtagtgacaacctttgatgcccatagaccaggatttgtacctcgtatgcgattagaaaatcataatgcgcgtaaaataatgtcgttaaagaaaggcgatatgatagcttataacgatccggtatcaggtcaacgtataattgcaatagttagaaaatttgaccagcgtaacaaacaattatacttagatcctcacaacgaagcagggaatttagatagacgagaaaaagagaaaacttataaacctctaaggccaatgcctaatccgttaaagaaatatagaccaagacaagtcaggatagatgaaataggacaagtattcgatccaggcccgtggtgggaacgacaagatggttga

SEQ ID NO: 8552 - RNA, 3306 nt, synthetic construct
  misc_feature 1..3306: note = Cas9 variant
  source 1..3306: mol_type = other RNA
atggaacaaacaagtttagatttatcacaagcaatgaaaaaggtagcacaacctcaaaaaccatacagattaggagtcgacgtaggagtagcaagcatcggcgccgcagcagttacagacactgaaattttggggattcacgtaagaacctttgagaaaggagaaataaacggaaaaagtggaagaaaacctttaaatgcagactatcgaaggcaaaaaggacaacgcaaaagattgagacgtaaaaagaaccgactactttcgttaagaaggttatttaggagagttgggatgatagaaagtgccgcaatcgaagcattccctatatcgagtacatctccctggcaactcagaacagaaggcttagatagaagactcacaaacgaagagtgggcacaagtactctaccacatagctaaacatagaggttttcaatcaaatagaagagtagatatggatgaagctacaaaattatctgacgcagcaggggattcacccgaaacaacaaccaacacagaatccgacagtgacacgaagaaaatgcttgccggcgtagctgataacaaaagactactagcagaaaaaggataccgaaccattggagaagctgtcgccagagatccaaaattctcccacagaattagaaataaagaagaaagttatagtcacaccataggtcgtgatgagataaatgccgaactaaattgcctatttcaagcacaaaaccattacggaaatcctcatgctaccgaggaactgtccgaacaaataatcgatttaataaattggagacggaagacggtaactggggatgatataaaacgtatggtaggaagatgtacattagaaccaaaagaatacagagccgcaatacactcagtcagtgcagaagagttccgttggctaagtacactaagcagacttcgaatcgtcactcaaggcgaaagccgcccattaacaaaatgtgaatgggataaagttgtagatttaccctggagacaagaagcaatcacatacacgtcaataagaaatgctataggccttcgacacgacatcagatcaagattcaatataagatatgaaacgggaggcaaaaagacaaaaacagatactaaaaatgaaacaactaagggacaatcagcagacgcagtcacttcagaagtgaaaactgcagaaaaagaaacagctttcaaagcaaaaggataccatatactaagaaaagcatataaagcatttggttacgatgaacaatgggatcgagataggttcaataccgaactacttgatacactagcaactgcggtaaccttttacaaagatgatagtgaaatacaagcacatctggaaacaaatgacacaccagagtacgcaatacaaatagcactaaggttacctacattaaccaaattcagtaaactttcaaataaagcaatcttgaaaatcctgcctcacatgagagaacggcaatcatactccaacgcatgtctattagccggttacaaaaatcaccataagcagtatgacgatacaccacaaaatggaaaaataccaagaagtgcaatagaacatattaaaaacacagtagtctacagatcactaaatcaagcacgcagagtcataaacgctatggttaaagaatacggagctccacaagaagtccacatagaactggccagagatatggagaaaagcgccaaaaagaaggacgaaattgacctatggatgaaaaagagaaagaagaaaaacgacgagctgagagaaagattcggtaaaaacctatccagagacgaattattgaaatataaattatatgaagaacaaaacggacaatgcgcctatagcttacagcctatacaactgggtcgactattagaacccaactatgtagaagttgaccatgcgttacctagatcccgctctatggacaattcttataataataaagtcctagtattaacgaaacaaaatcgagataaaggagatcgaacaccctttgaatactttggagaagatcaagaatccgtagattggaaacgatttactaattgggtagaaagcaatccacaaatgccacaagctaaacgtaggaaattgctcacaaaatcattacaaaagggaatcttagataatttttcagccagaaacctcagtgacacaagatacatagcccgagaactaaaaacattaatagagcactatatactaaacactcctgaacgagagaaaacaaaatacgaaagatgcgtagtaatatccggaaaactaacagcacaaatgcgacaactctggggtattagtaaagcgagggatgtatccgataggcatcacggctctgatgcagcagtaatcgcatgtataacacccagtatggtacgaagaattacaagatatctgcaactgcaagaaagacgagcaatgccgtcagccccaggaaaaggggatgaacacccagcagtagtcgccagagcaatcccccacgctcccgtgccatggcccacatttgaacatgatctagaagcagcgttagagaaagtcctagtaagtagaccacaatcgagaaaatggtcgggcccaatacatgcagatacaatttacggggaacataaagatcaggagactaacaccgtagcaccgacccaaagaataaagctaacacaattaacaaaatcaaactacaaaaacatagtcggatacgacgaagagagaaataaagatttcatagatcagattgaagaaagattagaatgccataatttcaatggaaaacaagcattcggaacatcacagagtccaatatatagaataaagaaaaacggggagcttggaccggaagtaaagaaagtaaccatcaaactcccaattaaaaactcggtattcagaataagaagaggatatgttaaaaacgcgaaaaatagcacaatatatataaacatataccagaatacaaaaacaggtaaatttgaaatgcacccagtatatgcaaaagacttaacatccagcgctaatgcatcaaaatcattcgaatactccccagacttacagctagtcgatactataagaagaggagactacatagaaataactaggcgaaatggagaagtaatttcgggatattacgctactcataatatatcaacaagcgtacttgaattacaaccccatgacacaacagattcacgaaacaatagaactccagcaatcaaaacatctctcaatatagaacgtttccatatagacatcctaggacgcaaaagacgcgtcgtacggagggctaaaaacggactagcagacgacagagataaatga

SEQ ID NO: 8553 - RNA, 3309 nt, synthetic construct
  misc_feature 1..3309: note = Cas9 variant
  source 1..3309: mol_type = other RNA
atgggatatcgaataggactagatattggcataacttcagtagggtacgcaatactgaaaaccgacgaaaaaggatcaccatacaaaatagaacatctaacaagcgttatcttcccaatagccgaaaaccctaaagacggcaaatccttagcaatgccaagacgagaacaacggggagccagacgaagaaatagaagaaccaaatttcgaaaacacaggacaaaaatgcttttcgttagaagcgaactattaaccataaaacaaatagaagcaatctacagcgaaaaacaaaaattatcctcaatatacgaacttcgaactaaagcactaaatgaaagactcaccaatgaagaattatttagaatattatacttctttagcgggcacagaggatttaaatcaaacagaaaaagtgaattaacagaaaaagatatgggaccagtactaacagcgataaaagatatagaagaaaaattagcagacgggacatatcgaactctaggagaatatatggaattagacgaaaaatatcaagaacacaaaaggaataaagacggaatagaccgttacttaggcactgccaaaagaagcctaatagaagatgaaataaaacaaataataatcgcacaacaacaattcggaaacaccaaactaacttcaggattccaagtcgcctttataggagacgaagaacaaaccggaatcttcaatgatcaacgagaatttgaagacggaccaggcaaacaaagtccttacgctggcaatcaaatagagaaaatgataggagcgtgtacctttgaagaaaacgagaaaagggccccaaaagccagctatacatttcaatattttgatttcctatgcaaactaaacaacctcaaatatagagaaacaattggaggagaatatagattcctttctctagaacagaaaaatgtactcaaagagaaagttcttacaacacagaaaatcacgttttcaggagtgaagaaactactagatttaccagaacacgcacaattcaatctagttaattacggcacaaaaagcaccgtcaaagaaactgaaactaaatcagtattttatgcaatgatatcataccataaactaaagaaagcaataccggcacctatcttctcaaatttaagtacggccgaactcgatgaaataggaagaatactaacactatatagcagcgacaaaggaaggaaaaacgaattttactcgagacttgcaatcccagaggaagtagtagaagcattattacccataaacttcagtaaattcggaaacttatcattaaaagcaatgagaaaaatcataccctacctagaaatgggccttgtttatagcgaagcggcgactcaagctggctatgacttcaggcacaagaaaatagatcaagcatatatacatgaaaatgtaaccaatccagtcgtaaaacgcgctgcatcacaaacaataaaaatagttaataatataatacgaaaatatggagagccagatggcataaacatcgaactggcgagggaacttagcaaaaacttttcagaaagaaagaaaacagtaaaatatcaagaagaaaatagagcaagaaatgaaaggatcgctgataaattaagagaatgtgaactaccagtcaatggagccaatatcacaaggttaaaactcttcgaagaacaaggcgaatttgacccctacacagggcttaaaataccattcgaccgtgcgttcagtgaagaatacgaagtggaccacataataccatactcaaaaacactagacgattcatacggaaacaaaatactcgtgtccgctaaagcaaaccaagaaaaaggtaatagaataccaatggaatacctacaaggtaaaccagaacgaatcaagaaactggaatccataacagccacaatcaaaaaccccaagaaacgagagaaattacttaaacaacaattgactaaagaagatgtcgacggttggaaaacacgaaaccttaatgatacccgatacatatcttcattattacacgactacttcaatcaaaacattagctttgcaaaattggaatcagagaaaaagaaaagagtcatagcagtaaacggagcgataaccagtaaattaagagcaagatggggctttaataaaataagggaaaatggagatgaacatcacgcgctagatgctctaatagtagcgtgtgtaacagacaaatacataaaagagataaccagttttagtaaacgaaaagaagtaagattcaatgaaaacctgtggaaaagagagaaaacaccccaagaaatagaacaagaagttgttcattttaagaaagattatgaccgaatctttaaccaagcgttcccactgccctggacgaattttcgagaagaagtttcatgtagaatgtcagagaacccagctgaactaatgaaaaatcatacatgggaaacatacaccgacgatgaaatagcagcacttagacctatattcatagtcaggatgccaaacatgaaaacttcgggtcccgctcaccaagaaaccatacgttcaggaaaactcgaagaaaaaggcttaaatataagcagggtctccatcgaaaaattgaaactcgataaagaaggaaccatcaaatcaggtaatgcccaattttataaagactcaggcaatggttggcaactattacacgacaaattaaaagtagcattagaaaaacacgacggagacggatcaaaagcatttccggacggagtatttaaataccaatatcttgacaaagagcacacagtaagaaaagtccggttagttgcaaaaagtacattgcaaacctcattaaacgagaagaaatcagtagcagataacggatcaatgattcgcatcgacgtctttcgtaacgaacaaggaaaatatcaatttgttcctatctacgcaaaagatagagtagctaaaaagctccccaaccaagcagtggctgtaggaaaaatagcaaaagaatggcccttaatagaagaatccgacttcaagttcagtttgtattcaaatgatttaatacgggtaaagcataagaaaggggttaagcatgtatcaaaagatggaaataaagaggagaaaagcaaaactgacttctttggctactataccggagctgacatagcaacagcatcaataagcggaatatcacctaacaacttctttgaatttagatcaatgggcctagcaactctaatctcaatagaaaaatacaaggtcgactatttcggaaattaccaccaggtaaatgaaaaagtaagacagaaatttcccaaaaatagaatgtga

SEQ ID NO: 8554 - RNA, 3312 nt, synthetic construct
  misc_feature 1..3312: note = Cas9 variant
  source 1..3312: mol_type = other RNA
atgaaatacgacataggcatagatataggagtcgccagcgtaggagaagcagtaatagaccaggagggaaacatattggaagcatgctccaacctattcgacgaggctgatgcagcttctaacgtagatagaagaaatttccgtgaagggaggagaaacaagcgacgtgaaagaacccgagtgaatgacttcaaaaaattatggacaaaattcggtttcgaaatccccaaaaatgttatgaatgacacaattctactaaggaataaaggaataaaatgtgaattagatctaactgaattatattctgtcttattatatatgctaaagcatagaggaatcagttatctggaagatgcgattgatgaagcaaaaggatcaaactacgccaaaggaatagctctgaaccaaaaagaactaaaagaaaagctaccatgcgaaatccaactagaaaggctcaaaatatacggttcatatagaggggactgtatagtaaaaaaagaagatgaagacgaataccattcgaatgtattcacaataagcgcatacaaaaaagaacttgaaatactgtttcgtaatcagaaattaccagaagagttcatacaggggtacatgaaaatattcgaaagaaaaagggaatattacataggaccggggaacgaaaaaagccgcacagattacggtgtgtacacaacaaacaaggacgaagaaggccattatataacagataaaaatatattcgaaaagctaataggaaaatgcagcgtgtacaaagatgaatttcgagcagccggagcatcctatacagctcaagaattcaatgtgctaaacgatttaaataatttaacagtaaataaccgaaaactaaccgaaaacgaaaagaagaaaatcgtagaaaaaataaaaagtagtaatgcagtaaatatgagaagcataataaaaaaagttctaggagaggacattgaacaatttggcggagcacggaaagacaaagccgacaaagaaatttaccatacctttgaagtgtatagaaaaatgaaaaaagaatttgaaaaaaacggtatagacatagcagacttctcgagagaaaaacttgacgaaataggtaacatattaacactaaacacagaaacagaaggcatcaaaggagcactacacgaagcaaagaattcgttcacgtacagtgaaattgaaaccctaatcgacataaggaaaaaaaacagcagcctgttcagcaaatggcaaagcctaagcctaaaaattatgaatgaattaataccacaaatgtatgcccaaccaaaagaacaaatgcaattactcacagaaatgggagtattcaaattcaagagcgttaaattcaagaatagtaaatatatacccgtagaagaaatcataaaggacatatacaaccccgtggtggtacgatctgtacgaactacaataaaaatgataaacgaaaccattagaaaatacggatatccagacaatatcatcatcgaaatgccaagagacaaaaacagtaccgaagaaaaagaaagaataaaaaaagaacaaagcaaaaatgaaaaggaatatgaagggatactaaaacgaataaaagacgagtatgatatcgagatcaatcgagatgactatagaaagcaagaaaaactagcattaaaactgaaactatggaatgaacaagaggggagatgcccctactcgggaaaaatgataagcatatacggactactagaagacccacaattattcgaaatagaccacataattccaaaaagtatatcattcgacgacagtagaaacaataaagtgctggtatacagaagtgagaaccaaaaaaaaggaaataacacgccatacatgtatctttctaaaggagataaaaactggaactatgaccaatataaatcctacgtgctaggcctaaaaaacaaaggaaatataagcgataaaaaagtaaataatatgctattcatggaagatattaataaaatcgacgtattaaaaggatttataacaagaaacctaaacgacaccagatacgcaagtagagtagtactaaatatgctacagtcattcttcaatgaaaaagacggatgccccaccaaagtaaaagtaataagaggaagctttacccaccaaatgagagtaaacttaaggattaacaaggacagggatgagagttactcacaccacgcagtagacgcaatgttaatagtatactcacaaagaggatacgaagcatatcgaaaaatccaagaagcatgcgtagacttcgaaaccggtgagataatagatgaagaaaggtggcagcaatgtatatggggcaaagactatgaccaagtaatgtatgaagctaaatggtcaaaaatacgagaaaaaataatagaggcagaaaaaaatgtaaaataccatcacagagtagacaaaaaagtaaataggggactctgtaaccaaacaatatacggaactaggattaaagatggaaaaatatataaaatatcatcatacaatatatatgacaacaaagaatgcgcaagcctcttaaaaatgataaaagggggaaaggaaagcaaaatcttaatgtataactatgactcaaaaacatacagagatatgatcaaaatcatagacgaatactcagatgaaaaaaacccatttgtggcgtatatgaaggaaacaggtgactattttcggaaatatgccaaaaagcataatggtccaaaaatagaaaaggtgaaatactacaaagaggaagcaggttcgtgtatagacatcagtcataagtacggctatgaaaaaggaagtaaaaaagtgatactaggatcattaaacccatacagaacagatgttttctttaacgaaagactcaaaaaatactatctaataggtataaaatacaaccacataaaatgtgaaggcaataattatgtcatagacgaggacgcatataacgggctgctgcgagacgcaggagtaatatctcatgaaaacacaataaacgatctagagaaagtaggagtaaagtatttattctcgctatacaaaaacgacattataaaatacgagaaaaacggtgaaatgtttgtagaaagatttcttagcaggacaatggaatacgccaacaattacatagaaaccaaacctatccacaaaccattcttccaaaaaaaagataaaaaaggaaatataaaaaactctcaaaatctagtaggcttatcaaagacaaaatatatcggcaaactagtaacagacgcattagggaatacttacatggtagaaaaagaaaagttttccctgatagtagacatttga

SEQ ID NO: 8555 - RNA, 3315 nt, synthetic construct
  misc_feature 1..3315: note = Cas9 variant
  source 1..3315: mol_type = other RNA
atgaaacttatattagcattagatatcggaatagcatcagttggatgggcagtccttgacaaaaagtcggaaacagtactcgaagccggatcgaatattttccccgaagcaagtgcagccggaaatcaagtacgaagagagatgagacaagcaagaagaataaaacgacgacagagaacaagattagatgacttcaacaaattatggagaaagaacaatttatcaataccgcaatacaaaagtacagaaatagtaaacctaaaagtaaaagcgctacgagaagaaataagcctagacgaactttatttaatattgtattcctacttaaaacatagaggaatctcatacctagaggacgcccaagacgatagcctttcatccagcaatgcatacaccaacggtctacgagaaaatgcaaaagcattagaaaaacattacccttgcgaaatacaaagggatcgacttcaaacaataggcaaatacagaggccaaacacaaatcacagacgacaataacgaaaagatagacctaagcaacgtattcacaataggagcatatagaaaagaaataaagaaagtattagaaacacaaaaattataccacaacgaactcacagatgaattatgcgatgactatatattaatttttaatcgaaaaagaaaatactacgaaggacccggaaatgaaaaatcgagaacagattatggaagattcactaccagattagaccagaatggcaactacatagacgaagaaaatatatttgaaaaactaatcggaaaatgtagcgtatacccagacgaattaagaggagctgctgctagttacacagcacaagagttcaatttattaaatgatttgaacaatttaactataaacggccgaaaactggaagaatcagaaaaacatgcaatagtccaacgaattaaaacctcaaacacagtaaatatgagaaaaataatagcagactgtatgggcgaaacaatcgaaaacttttcaggagcacgaatagataaaagtggtaaagaacaattccacaaatttgaaacttataataaaatgagaaaaagcctctcagaaatcggtacagacatagatgagttcagtcgagacgaactcgacaaaatcggttacataatgacaataaatactgataaagaagcgctcatggaagcatttaacgaatcaggactcaatctagatgacagtgtcaaagaatgcctaataagtttcagaaaagcaaactccagcagcttcagtaaatggcaatcctttagtttaaaaatcatgaatgaactaattcctgaaatgtacatccaaccgaaagaacaaatgacactactgacggaaatgggagttgcaaaaggaagctccggtgatttcgcaggtttaaactacattccagtggatgttataagtgacgaaatatacaatccagtagtaagaaggtcagtaaggatctcatttaaaatcttgaacgctgtactaaagaaatataaagtacttgatacaatagtaatcgaaatgccaagagatagaaactcagatgaagaacgaaaaagaattactgattcacaaaaactaaacgaaaaagaaatggaatttatagaaggaaaattagcacaaatttacaatataaaattatcatctagcgatttttcatcacaaaaacaattaagtctaaaactaaaactatggaatgaacaagatggtatctgcctatatagcggaagaactatcgatcctgaagatataatcaaaaacccagacctattcgaaatagatcatataatacctagatcaataagttttgatgacagtaggtcgaacaaagtattagtgtatcgtagcgaaaaccaaaagaaaggtaaccaaacgccttatttctatatcacccattcagacggtgcctggacttacgaacaattcaaagctaacgtgatgaatctatcaaagaagaaagaatatgcaatcagcagaaagaaagtccaaaacctcctctactcggaagacattacaaaaagagacgtattaaaaggcttcataaaccgcaacataaatgacacaggatacgcaagtcgcgtagtattaaacacagtacaaaactttttcaaagccaaagaagcagacacaaaagttaaagttataaaaggatcctacactcatcaaatgcgatcaaatatgaaattagacaaaaatcgagacgaatcctatagccaccatgcggtcgacgcaatgttaatgggtttttcggaaatgggatatgaagcataccgacgtctacaaggggaatttatagattttgaaacaggagaaattttgaaaaatgacatgtggaacgagaaaatgagtgacgatgtttatgtcgattatctatatggaagaaaatggtccgcaatacgaaatgaaatcgtaaaagcagaaaaagacgtcaaattctggcacttcatagtaagaaaaagcaatcaagggctatgtaaccaaacaattagaggaacaagggaatacgacggcaagaaatacaaaataaacaaatttgacataaggacaaaagaaggagtcaaactttttaagaaactggcctttagtgaaaaagaaagcgatcgtgaaaaactattagtttacctaaatgaccgacagaccttcaataatctagtcaaaatattcgaagactacaaagatgcacccaacccgttcgttcaatacgaaaaagaaacaggagacgtagtcaggaaatattctaaaaggcacaacggaccaagaatcgacaaactaaaatataaagacggcgaagtcggagcatgtatagacatatcccataaatacggacttgaaaaagattcaagaaaagtaatcttagaaagcctagtaccctacagaatggacgtatattataaagaatcagacaaaatgtactatttagttggagtgaaacaaagcgatatcaaaagtcagaacggagcaaatgtaatagacgaagacctatacacgcggattctcataaatgagaaaatgattgagccggggcagagcagagatgatctagaacaactaggatacgagtttagatttagcttttacaaaaacgatataatagaatatgagaaagaaggcaaagtattcgtagagagattcgtaagtcgaacaatgcctaaagtcaggaattatattgaaactaaaccaataaacaaagctaactttgaaaaacagaacccagtaggtcttggcaaaacaaaaagtattaagaaatacagaacagatatactaggcaacagatacctatgtgaaaaagaaaaattcactaaattctgttga

SEQ ID NO: 8556 - RNA, 3315 nt, synthetic construct
  misc_feature 1..3315: note = Cas9 variant
  source 1..3315: mol_type = other RNA
atgaatcattacgtattgggactagacattggaatcacgagcgtaggatacggcgttatagacctagataattatcaatttgtagactacggagtccgattattcaaagagggaacagcggaagacaatgtcaaccgtagaacaaaacgaggaagtcgtagactaaaacggaggaggcaaacaagactagatgatatgaaagaactattacaaaaagaaaaaataatgagcgaaacatatcattcaagttacgacccatatgacatgcgtataaaaggcctatcccaaaaattatcaaatgacgaattaacatgcgcgatactccacataacaaaatgccgaggaacaacactagaagcacttgacagcgcagacgaggatagcgaaggtacaaaatctattttatctaaaaacgatcaagatttaaaaaaataccattacgtatgcttagtgcaaaaagagcggttaaaacaaagtggaaaaataagaggtactgaaaacaatttcaagaccgatgattacatcaaagagttggatgaaatattatcacaccaagatctatccgaagacctatgcgaaaaaataagaactatagtaagtcggagacgacaatactatgaaggaccaggatcagaaaaaagccctactccatacggacgatggatcgctcagggagttgctccaatagacttaatagaaaaaatgagaggaaaatgctcagtctttcccgaccaacttagggcagcaaaaaactcctacactgcagaactctttaacctacttaatgacctaaacaatctagaatgtgaaggagaaaaattaacaacatcccagaaacaagatgttatagacttcgtaaacgaaaaaggaggaataacaccaaaacagttagcgaaattgctaaatgtagatttaaaccaaataaaaggtttcagaatcgacaaaaacgacaagcccctactgacagaattcaaaggatataaagcctttaaaaaaattttcgacacaaacaattgcgacctctacaaaaaagatctctcaatcttagatgggctagcagaaatagtcacaggaaaaaaaggaatagaagaaagaaaacaagcaatacaacaagcataccccgaaatagatgaagcaatagtggaacaatgtgctgtgatgaaaggtatgacccaataccacagtctcagcctaaaagctatgcatctaattaaccaagaaatgctccaatcacccagaaatcaaatgcaagttctacatgaatcacatgtatttgacaagaatagagtctcacacaaaggacaaaaatacatagaagcagatgacgaagcaatattatcaccggtcgtaaaaagggcacaacgagagactttcaaagtagtaaacgcattacgtgagaaatatggtgaatttgaaagcatcgtcgtagaaactacaagagaccgaaactcacaagaacaaaaaaaacgtttaaatgactcacaaaaatattatgaacaggaaaatcgcaaagtagatgaactcttaagtcacgaaggttacgacccatcaaaaattaacggaaaaaccaagctaaaagtcagactttatctacagcaggaaggaaaaaccgcatatacgaatgctccaatagatctaaacttactaatcaaagacgcaacggcatatgaggttgaccatataattcctctcagcatatctctagatgactccataaataacaaagcattaataaacaggacagaaaaccagaacaaatccaacatgacgcccatatacgcaatactaagaggtaaattaaacatatcattagacacttacaaaacagttgtcaaaaacaaccgaaactatacaggcaaaaaacgatcatacctattatacgacaaagacataacgaaatttagcaacatgcaagaatttatcgcaagaaacttagtagatactagttacgcatgcagagttgtaatgagcacattaagcgactacttcaaagacaatgaaataagcacacatgtacacaccgtcagaggaagagttacaaacatgtttagaaacaggattaacatgcaaaaggaacgagaaaaagactatctacatcatgccgtagatgcattaattgtagccagcatcaagaaattaaacttattaaacacttatctcttaaaatacaacttcaacgatctctacaacgaagaaacaggagaagtattcgcagtaggagacgaccaacaagtgttagaccccaaatacatcagatttataacacaactaaaaacaatatatgatgaaagcaacatgtactataatggattaatcgaaaggaatgtgatgcaattcccccccataaaaatcagtcataaaatcgacacaaaacctaacagacagataagtgacgaaacaatctattcaacaaggacggtaggaaatgaagaatatgtagtaaaaaaatattctgacatttacgatccaaagttcacccaattgacagacgacataattaacgaccgaccattagaccgatggctcatgtaccgaaatgataaccaaacatttaaaataatacaatccataattctagaccacttccacatatttaaagacgacgaaaaacattattcctgcacaaaaaaaaagggccaaatacaatacgcactaaaaggcaaaaatcccctgtatctatataaacaagaacacggtaaggttaggaagtacgccaaaaaaggaaacggtccagaaatcacaatgatgaaatacttcgacggaaaactaggtaacaacatagacatatcaaaccactatcacgttcacaataaaaaagttgtattgttacagatatcaccatacagaaccgatttctacgtaagcccagaaggaaaatataaaatgttaacagtacgatacgcaaacgttttctacaaagaatcaaaaaaaaaatacgtaatagatgaaaagtggtatgcttcagaaaaaaaaagaaaaaatattacagacgacgacatttttgtatgctcgctacatcacgacgaactaattgggatacaaaaaaaagatggtgctaagtacgtatacgatctatcaaccgaagacggtggcaaacctagattataccatggagaaatggaaatacttaaattcaccgcaacaaacaatgatagcaagaacatcatagaagtgaaaccaatctatacttactgcaaaaaacaattaatgatttcaataggtccaataacaaaattagctaaatatgcaacagatgtcttaggaaacgtctacgaggttaaaaaaaatataatagatcatttatcgcacctatga

SEQ ID NO: 8557 - RNA, 3318 nt, synthetic construct
  misc_feature 1..3318: note = Cas9 variant
  source 1..3318: mol_type = other RNA
atgggtatacgaataggattagatataggcatagcaagtgtcggatgggccgtagtagacgacgattacaatataatagaatccggagcaaacatcttcaatgaagctaaagcagcgtcaaatgttgataggcgaactttcagacaaacaaaaaggctactccgacgacaaaaaacaaggctccgggattttgatatcctatggataaacgccggattagacataccgaaagaaaaagtcaacaagcaattacaattcagagttcaaggcatgacaatggaactatccgaaaatgagctttacgccgcactcaaaaacatgttaaaacacagaggtatcagttacttagaagacgcacttgatgaagaacaatcaggaaaaagcacatatgaaaaaggattacaagtaaaccaaaaggcattaaagtgtgataagatgccatgtgaaattcaatatgaaaggctaatgaaatacggaagctatagaggccatatagaagtaaaagatgaaagtggagaagaaatgatcctaagcaacatatttacactagacgcatactgtaaagaagccaagaaaatcctagaatgccagaaacaatatcatagttttataacagaagcttttgaagacgactacttagcattactaagacggaaaaggaaatactatgaaggaccgggaaacgaacaaagtcggacagactacggaaaatatacaacaaaattaaatccagaaacaggagaatacgtcaccgaagaaaatatctttgaaaaactaattggaaaatgctccgtgtatccaaaagaaatgcgtgcttcagcagcttcttacacggcacaaatatataatatgctaaacgacctaaacaacttaacaataaatggaagaaaactagaatatgaagaaaaaaaaagcatcgttgaagaggttcaaaaagcaagttcagttaatatgctaaaaataataaaaaaggtaataaacgaagacatcacaactatcgaaggagcacgaaaagataaaaacgacaaagagatattccacaaaatggaaacatacaataaaatgagacactactttgaaaaaaacggattagaattcaaaaaaatctcaacagatgaccttgacgaaataggaaacatactcacattaaatacagaaaaagaggcaatccttgaagcatttaataaatcacaactcgaacttagccaagaggagaaagaagcgttcatagagataagaaaaaaaaacggaagcttattcaacaagtggcattcattctcacttaaaatcatgaaagaactgataccagaactatatctacaatcaaaaaaccagatgcaattactaacagatatgggggttttcaagaaaaaaacagaaatattccagaattacgacaaaatcccaacagacgtaataatagaagacatatacaacccagtcgtcaaaaggtctatccgcataactgtaaaaatagtaaacgcactaataaaaaagtatggttacccacgagaagtagtaattgaaatgccacgagacaggaactcagatgaagaaaaaaaaagaatccaagatgaacaaaaaaaaaacgatactgaattaaaaaaaataatagagaaagtagaatcagaatacggaataaaaataactgacacgcactttagaaatcataaaaacttaagaatgaaattaagattatggcatgaacaagacggtcgatgcttatatagtggtaaagtgatagacatcagtgaattactaaacgattgctctaaattcgaaatagaccacgttataccaaaaagcataagctttgatgacagtagaagtaataaagtactagtttattccacagaaaatcaaaagaaaacaaaccaaaccccatatcagtaccttgaaggcaatggaaaagaatggagctttgacgaatatatgaaccaagtcatcgaattaaaggatagaaaattaataagcaaagcgaaaatgaacaaattacttttcagagaggacataacaaagatagaagtactaaaaggcttcatagctagaaacataaacgacacgcgttacgcaagtagagtagtacttaactcttttcaaaaatactttgagtcaaaacaatcagatacaaaagtaaaggtaataagaggaagctttacacaccaaatgagaaaaaaattgcaactctcgaagaatcgagatgaatcgtatgcgcaccacgcagtggacgcaatgcttatatgttatagtcaaatgggatacgaagcatatagacaattgcaagaggacttaattgatcccgattctgagaaaataagagatctgggtttgtggaaagagacaatcaccgaagcaaaatacgacgaagtactgtacaccgcaaaatggctcgaaaacaggggaaaaatacaagaagcggaaaaaaaagtaaagttctggcataaagtagacagtaaagcaaaccgagcactatgcaatcaaacaataagagggacgagagttatagacggaagtatacaaaaaatcaataaaatcaatatatacagtgttgacggctacaaaacatttaaaaacatgatacaaaaaggaaaagaaaaagatttccttatgtacaggaatgatcgcagatcatgggatgacttaatgaaagtttatagagaatactcagacgcaaaaaacgccttcgcggcatatcaagaagaaacaggagactacgtaagaaaatacgcaaaaaaacataacggttcaaaaataacaaatttaaaatactgcgcaaaggaactcggaagctgcatagacatttcccataaatatggcctcgaaaaagatagtagaaaagtgatactcgaaagtttgtcaccatacagatcagacgtctattacaatgccggtttaaaacaatattacatagttggtattaaaaatagtgatctatgcttccttaaaggcgaatacttcatcgattccaaaagatacttgcagatactgcgtgaagaaggtgttttaaccgaacaacataccctcaacgatttagctgcaataggaacggaatttcaattttcactatacgaaaacgattacctagaatatgaaaaaaatggagaaattaaaacagaaaggtttctatcacgtactaaaccaaagcaaaagaactacatagaaacaaagtcaattgacgccccaaaaattaaaaataaaaaacaaaacctagtaggtcttgcaaaatcaaaaagcataaaaaaaataagggtagatattctaggtaatagatactacgccagtaaagaaaagttttcactaatggttgataaattctga

SEQ ID NO: 8558 - RNA, 3318 nt, synthetic construct
  misc_feature 1..3318: note = Cas9 variant
  source 1..3318: mol_type = other RNA
atggacatggcatggcgactaggactggacctaggaaccaactcacttggatgggctgcactcagtcttgacgctgcaggagcaccagatgcaattttagcggcgggaagtaggatttttggagacggcagagatcctcaaagtggaacatcattagcagttgataggagagccgcaagagcggcaagaagaagacgagatcgattcaaacaacgccaacgagctttattaaaacatttggaagcagacgggcttttccctgcagacccggaggtacagcaagcattagcagctctagatccatatgcactaagagcaagagcattggatgaagctctaagtctacatgagatagggagagccctattccatctcaaccaacgaagaggatttcagtctaatagaaaagcagacagaggcaaagacgaagacgcagggaaaatagctattggcgttgaccgtttaaaggacgctatagcggccgcgggtgcacgaacgtttggggaatttctcaggcaacggagagctggtgcaacgggagaaaatcagattccatctgtgcgaactcgcttaagagccgaaacgggagaaggagctaaagggtcaggatacgatttctatccaagcagagctctcctaaaagatgaatttgacgccatctggcacgcacaagcagaacaccatccaaaagtattaacagatgaagcctatcatagactacatgaaatcgtatttcgccaaagaccattaagggcacctaaagtaggtgcatgtactttagtgccaggagaagccagattaccgaaagctcatccattgtttcaacgaaggaggctattagaagaactaaatgcattaatgatagtgagagctggtgctgtagctgaacgcctaactcccgaacaaagagacttattattattaaagttgaaagataagggtaaagtaacatttaaatcgttgagagaaaaagtattaaaattagatggagacgcgagatttaataaagaatcagaacatagaactgaattgaaaggagacgaagttgccgctgaaatgggaggcaagacaagatttggttcattatggcctcatttgtcgaccgaacaacaatggaccgtaatagaaagacaacaagcgttagaaagtgatgcggacgaggcagcatttaggacctggctagttgaaacacacaaattaacggcagagcaagccagagccgtagctggagcacgattacctgcaggacatggaaggttcggactgaccgcgactgctgctttactagcagcactaagagatggaagaaccccggagggtagaggtccaaacgcaccagcaacagaagctggtagagtcgttgtgtatagtgaagcagctgcgatagcaggttatcatcatagtgatcatagaagtggagaagtttttacagacgcgaaaggacgaccggcactaccgtactacggagtgccattagaccgacatatagtacccggaacagcagacccagatgaacccgatgaagctgcaagaataggaagattaacgaatcctactgtacacatagcattaaaccaattgagacgagtcgttaatagactcatacgagtctacggaccaccagcggaagttgcattagaactagcaagagaactcaaactttccgaagatgaaaagaaagaaagaaacagagagaacagtagaaacagactggacgctgagaaaagaagctctaaattggccgaattaggacaaagggataatggtggaaatcgcgcgctacttaaactatgggaagaactaaatcctgaaaatattttagaccgaagatgtatatatagtggtaggcagatttcgattggaatgatattctcaggggcagccgaagtggatcacatattaccattcgatgcaactttagatgattcaaacgctaataaaattttgtgtcttcgagaagcaaatagagataaaagaaaacgatcacccttcgaagcatggggcggaacaccacaatgggaagaaatagctgaaagggcttcgagattgccaagaaacaaaagatggaggtttgaaccagatgccatggaaaggtttgccgaagaaggtggatttttagcgagacatctagtagacacacagtatttaggcaggattgcacatgattatttaagatgtttatacccggataaaggcgacggtagtagtcatgtttgggtctcacccgggagactaactgaaatggtaagacgaaaattaggactaaacggactactaggcgaccacaatctaggagcagagcaacctaaaaatagaaaagaccaccgacaccatgctattgatgctgtagtcaccgctattcttgatagaagcatgctacaaagaatacaaagagcaagtggagaaggagcatcagatgcggagttactacgaattatagtaccagaaccatggactggatttcgcgatgatctccaacgagcagtagacaggatagttgtagcgcatagagcagatcacggaacagtagcaaaagcggcaacaagaggtagagaccaaacagcagccagacttcataatgacacagcatacggattcacaggtgaagctgacgccaaaggaacgccaattgttgtgcatcgagcaccactaggtgcgttaaagaaaccagaacatattgatcaagttagggatcctttattaagagcagcgctccacgacttcactgcaggcttaagtggaaaaccatttgaagatagaattgcagcttttccccggctaggtcctcttgattatagaggaatcagaagagtacgcgttgttgaacctttacaagtaattccaatacgagacgctgctgggagagcatacaaaggatacaaaggagactcaaattatcgttatgatgtatgggaactaccagatggaaagtgggaacaacgagtattgcaaatgtattatgcacaccaaagtggagaaccccctaggccacatccagcggcaagaaaggttttatcactacatagagatgacgtattagcaatagaaagaggggagggtggaagagagttagtcagagtagttaaatttagtacaaacgaatttaccctggcaccattaaatgaaggcggtgcattaaaaagtaggcatgcagataaaggagatccatttagatatctatatccttcgcccagcacattaaaagcgtggagggcaagagaggtaagggtagacgagttgggaagggtactcgacccaggttttccagcccggaaaagaagacgagtaacaagacccggtagagctgacgctgattga

SEQ ID NO: 8559 - RNA, 3321 nt, synthetic construct
  misc_feature 1..3321: note = Cas9 variant
  source 1..3321: mol_type = other RNA
atgcagtatattgtagctatagacataggagttgcatcagtaggctacgcagtaatcgacaaaacatcggaaaccgtaattgaagcaggatccaacatatttcctgaagcatcagcaactgacaaccaagaacgtagaggtatgagacaagcaagacgcttaaaaagaagagaaagaactcgattagacgattttacaaaactatgggaatatcacggtttagctataccacaagtcaagaaaaatgacatagtaggactaaaagttaaagcactctatgaatctattagtttggatgaagtctatctaatactatacagctacctcaaacaccgaggaatatcatatctcgaagatgtagaagattcaagtgtaagcggatcaacagcttatgccaacggactaaaactgaacgctaaagaactagagaaaaatttcccatgcgaaattcaaaaatatcgtttagaaaatataggaaaatacagaggacaaatacaaatagaagatgaccaaggcgaaaaactggacctatcaaacgtttttacaattggagcatatacaaaagaaattcaacaaatattagacactcagaagaaataccatgccgaaatagaagacgagttctgcgaaaaatatctaaaaatatttacaagaaaaagaaaatactatgaaggcccaggaaacgaaaaatcaagaacagactacggtaaatacaccacaagattaaaagaaaacggcgaatatatcacagagaaaaatatattcgaaaaacttatagggaaatgcagtgtatacaaagacgaactacgagcagcaagtgcctcatatacagcacaagagttcaacctactaaatgatctaaataatctaactgtaaacggaagaaaattagaagaaaacgaaaaacatctgatagtcgacaaagtaaaaacatctaatacaatcaacatgagaaaaattatagctgacgcgatgggagagaaaatagaagaattttatggagctcgaatagacaaatcagaaaaagaaatattccataaattcgaagtatacaataaaatgagaaaagcacttgcagccatacatgtaaatatagaggagtttagccgagacgatctagacgaaataggatacatcttgacaattaatacagataaagaagcaatgatggaagcatttgataatagcagactagaactaccaggggaaatcaaaaactgtctaatctccttaagaaaaactaatggaacactatatagtaaatggcacagcttcagcctcaaaatcatgaatgagctgattccagaaatgtacagacaaccaaaagaacaaatgactttactaacagaaatgggagttatgaaaggccaaacagatgagtttgagaaaaataaatacatacctgtagacgtagccagcgaagatatatttaaccctgtcgtcagaaggagtgtacggatatcattcaaaatcctgaatgcactaatgaagaaatatggaacactggatgaagtagtaatcgagatgcccagggatagaaatagcgatgaacagaagaaatgggaaaaagaaactcagaagaaaaatgaaaaagaacaagagtacatagaaaacaaactggcaaccgtctacgacatacgactatcatcagcagatttcagcagtcaaaaacaattgaacctaaaattaaaactatggaatgaacaagacggcaaatgcttatactcaggtaaaattatcgaacctgaagacctaataaaacacagcgaactcttcgaaatagaccacataataccaagaagtatatcatttgatgactcacgatcaaataaagtgctcgtataccgtacagagaaccagaacaaaggtaaccaaacgccatattattacctaacacacacaaatagcaaatggtcatttgaacaatataaagcacttgttatggatttaagcaaaaagaaagaatatggattaagcaagaagaaagtaagaaaccttttatattctgaagacataacaaaagcagatgtattaagaggattcataaaccgaaacataaacgacacatcatacgcagccagagttgtactcaacaccgtacaaggctatttcagagcgaaagaaatgggaacaaaagtaaaagtgatacgaggatcatatacccaccaaatgagagtaaacatgaaactcgataaagacagagagaaatcatacgcccaccacgcagtagatgcaatgttaatcgcattctcacagcttgggtacgaagcatatagaaaattacaaggtgagttcatagatttcgaaacaggggaaatattgaatagcgaaaaatggaaagaccaaatgagtgatgaagtatataaacaatatttataccgaaagaaatggtctaatataagaaacgagatcacaagagcagagaaaaacgtcaaatactggtactacgtagaccacaaatccaatagaggcctatgtaaccagaaaatacgaggtacaagagtatacgatggaaaaatatataaaataaacaaactagacataaggaagaaagaaggcgcagcattatttaagaaattagcatttagcgaaaaagaaagtgatagggaaaaactattagtatacaaaaatgacaagaaaacctacgaagacctagtaaggattatgcaagactacagcgacagcaaaaacccttttgtacaatatgaaaaagaaaccggagactacgtacgcaaatatgccaagaaacacaatgggcccaggatagacaaactaaaatatatagacggcgaggtcggatcatgcatagacataagtcacaaatacggatacgaaaaaggcagtagaaaagttgtactagaaagtctggttccatatagaatggatgtatattataagaaagaagaacaaacgtattacttagtagggataaaacaaagtgacgtaaaatgccaaaaaggagagtatgtgatagatgaggacgcatatgcaataaatctggtaaaagagaaaatgattcaacaaggacaaaaacgaagtgatttagaatcattagggttcgaatttcaactaagtttctacaaaaacgacataatagaatacgaaaaagacggaaagatcgtgagagagagatttctttccagaacaatgccaaaagtcaaaaactacatagaaacgaaacccatcgacagagcaaagtatgaatggcacgatcggaaattagtaggactaggaaaaacaaaaaggatacggaaatatcgcatggacatcctaggaaactactacttatgcaataaagaagagttctccaagtattgctga

SEQ ID NO: 8560 - RNA, 3324 nt, synthetic construct
  misc_feature 1..3324: note = Cas9 variant
  source 1..3324: mol_type = other RNA
atggggtacacagttggactagacataggagtagcaagtgtgggagtagcagtattagacgaaaacgacaatatcgtagaagcagtttcaaacatcttcgacgaagcagataccagtaacaataaagtaagaagaacattaagagaaggacgccgaacaaaacgaagacaaaaaaccagaatcgaagacttcaaacaactatgggaaacatctggttacatcatacctcataaactacatctcaacataatcgaattaagaaacaaaggactcaccgagctattatccctagatgagctatactgcgtattactctcaatgttaaagcacagaggaataagttacctagaggatgcggatgatggtgaaaaagggaatgcatataaaaaaggattagcatttaatgaaaagcaattaaaagagaaaatgccgtgcgaaatccagctagaaagaatgaagaaatacggaaaatatcacggagaattcataatagaaatcaacgacgaaaaagaataccaatctaacgttttcacaaccaaagcttacaaaaaagaactagaaaagatattcgaaactcagagatgtaatggtaacaaaataaacaccaaattcatcaaaaaatatatggaaatctacgaacgaaagcgggaatactatataggacctgggaacgagaaatcaagaacagactacggaatttacacaacaagaacagatgaagaaggcaacttcatagatgaaaaaaatatattcggaaaactaataggtaaatgctcagtatatccggaagaatatcgagcaagctcagcatcatacacagcacaggaattcaacctattaaacgacctaaataatctgaaaataaataacgaaaaactaacagaattccaaaaaaaagaaatagtcgaaatcatcaaggatgcctcatccgtaaacatgagaaaaataataaaaaaagtaatagacgaagacatagaacaatacagcggagctaggatagacaaaaaaggaaaagaaatataccacacattcgaaatctataggaaactaaaaaaagaactaaaaacaattaacgtagacatagacagtttcacacgcgaagagctagataaaacgatggacatcctaacactaaacacagaaagagaatcaatagtaaaggcatttgatgaacaaaaatttgtatacgaagaaaacctgattaaaaaattaattgaatttcgaaaaaacaaccaaaggttatttagcggctggcattccttcagttacaaagccatgctacaactaataccagtcatgtataaggaacctaaggaacaaatgcaattacttactgaaatgaacgtatttaaaagtaaaaaggagaaatacgtaaactacaaatacataccagaaaatgaagtagtcaaagaaatatacaatcccgtagtagttaaatcaattagaactacagtaaaaatactaaatgcattaataaaaaaatatggatatccagaatcagttgtaatcgaaatgcccagagacaaaaattcagatgacgaaaaagaaaaaattgacatgaaccaaaaaaaaaatcaagaagaatacgaaaaaatactaaacaaaatttatgacgaaaaaggaatagaaataacaaataaggactataaaaaacaaaaaaaacttgtactaaaattaaaattatggaacgaacaagaaggactctgcttatactctggaaaaaaaatagcaatagaagacctccttaaccacccggaattctttgaaattgaccacataataccaaaatcaattagcctagacgattcccgctccaataaggttttagtctacaaaacagaaaatagcataaaagaaaacgacacaccataccattatctaacccgaataaacggaaaatggggtttcgacgaatataaagcaaatgtgctagagttgagaaggagaggcaaaatagacgacaaaaaagtgaacaatctgttatgtatggaagatataacgaaaatagacgtagtcaaaggattcataaatagaaacttgaacgataccagatacgcgtctagagtagtcctaaacgaaatgcaaagcttcttcgaatcaagaaagtactgcaacacaaaagttaaagttatacgaggaagcctaacgtaccaaatgaggcaagaccttcatttaaagaaaaatagggaagaatcctattcacaccatgcagtagacgcaatgcttatcgcctttagccaaaaaggatacgaggcctacagaaaaatacaaaaagactgttatgacttcgaaactggggaaattctagacaaagaaaaatggaataaatatatagatgatgatgaatttgacgacatcttatacaaagaacgaatgaacgagatcagaaaaaaaataatagaagccgaagaaaaagtcaaatataattacaaaatagacaagaaatgcaatagagggctttgcaaccaaactatttacggaacacgtgaaaaagatgggaaaatacacaaaatatcaagctacaacatatacgacgataaagaatgcaacagtctaaaaaaaatgattaacagcggaaaaggaagcgatctattaatgtataacaacgacccaaaaacgtatcgagacatgctcaaaatcctggaaacctattcaagtgaaaaaaacccatttgtcgcatacaataaagaaaccggagactatttcagaaaatactctaaaaaccataatggaccaaaggtcgaaaaagttaaatactacagcgggcaaattaactcatgcattgatatatctcacaaatatggacacgccaaaaacagcaagaaagtagtactagtttcactaaatccatatcgcactgacgtatactacgacaacgatacaggaaaatactatctagtaggtgtaaaatacaaccatatcaagtgcgtagggaataaatatgtaatagacagtgaaacatacaatgaattactaagaaaagaaggagtattaaatagcgatgaaaatctagaagacttaaactctaaaaacataacatacaaattcagcctatacaaaaatgatataatacaatacgaaaaaggtggagagtattatacagaaagattcctcagtagaataaaagaacaaaaaaatctgatagaaacaaaacctataaataaaccaaacttccaaagaaagaacaagaaaggagaatgggaaaataccagaaaccagatagctttagcaaaaaccaaatatgttggcaaactggtaaccgatgtgcttggaaattgctacatagtcaatatggaaaaattcagcttggtagttgataaatga

SEQ ID NO: 8561 - RNA, 3324 nt, synthetic construct
  misc_feature 1..3324: note = Cas9 variant
  source 1..3324: mol_type = other RNA
atgggatacacacttggactagatataggtatcgcaagtgtcggattcggcctaattgacaacgtagacggcaaaatccttgaatcaggagtaagattatttagttcagctgaccctgataacaaccagacacgacgatcttcaagacaagcacgaagattaaatagacgaaaagtacatagactagaaagagtagcgcacctactcgaagaagctggattcgaaaaaggagaagtactagcacctacaccatatcatcttagggtaaaaggtttaacagaaaaactctcaaaaccagaagtatacgcagcactatataatttaatgaaacatagaggcataagctacttagaagacgtggaattagacgaagctgactcaagctcggtatcccaaaatgtagaactcttaaaagaatactacccatgtgaaatccaattagaaagatatgaagaatatggacaaatcagaggcataatcgaaacttacaacaaagacggtgaaaaagaaagtctagtaaacatctttccaacaggtgcatacaagaaagaagctgaagcaataattctcaaacaaggacagttttatcccgaactagataaagtttttctagaaaaatttacagaaattcttacagtaaaacgcccctactatgttggtcctggaaataagaaatcaagaacggattacggaatatatagagaaaacggcgagacactagaaaatcttttcgacatattaataggaaaatgtacaatctacccacaagaagcacgcgcagccaaattcagctataccgcacaactatttgattttcttaatgacatgaacaacatatcaatagccggcgaaaaattaactgaagtacagaaaagggagatctaccatcaaataatgtcatctaaaacagtaaacatgatgaaaatcatcacaaaagtcacaggatgccttaaagaagaagtgacaggttacagagtcgacagtaaatataaagccgaatttcactctttcgcgtcatatcgacaattcagaaacaaaatgctagactatggattcgacgtacaaacactgaacgttgaaatgttcgataaattagctgcaaaactgacgctaaacacagaatatcaccaaatcataacccaattagagtcactcaacctaggattatccaaagaactaatagagaaaattgcggatttccgaaagaaaaaccgcagcctattttcaaaatggcactcactgtcattgaaagctatgaacgaagtcgtagacgaactctggtctacaagcaaaaaccaaatgcaaatatttagtgaattaggcggatttaaatcgaatatagaagtattcaaaggactgaaatacataccactcgacgcaatggtcgatgaaatttacaaccctgtagtaagatgctccatacgagaatccattaaaataatcaatgcactactgaaaaagtatggagctttagacaaagtagtcattgaaatgccgcgagactcaaatgaaaaagaagaaaaagaccgaataacaaaacttaataaagagaatgacaacaaaaagaaacaagccattgaaaaagcacgcaacgaatacggctttggggaagaggcttacagacaacaaaacgacctgaacacaaaactaagattatggtacgaacaaaaacaacgttgcttatactctggagaaataataaaaatctttgacttaattaaaaacccccacctatttgacatagatcatataatacctaaaagtatatcatacgatgacagtctctcaaataaagtcctctgctacgcaactgaaaaccgcgaaaaaggcaacttaaccccataccgctactttaaaagaaaagcatcactaacatggaactacgaggcttataaaagttatgtaatcgaactttacaaagacggaaaaggagatctatcacgcacaaaactagaactcctactattcgaagaagacataaacaaatacgaagttagacaacgatttatcaatcgtaatctagttgatacacgctacgcctccaaagttgttctaaatacattacaagattttatgaaagaaaactaccccactacaacagtagaagtagtaagaggaaaatttacagcgcaacttcgtagacactgggggataagaaagaaccgagacgaaaatcatgcccatcacgccattgatgcattaatcattgcatgtgtcccacatttatcattatggaaagaacaaaagaaagtattctctaccgacgaatttagagtagatgaaaccactggagaaataatagaacaatcatacaaccaactaacatatcaagaaccattctcacaattcttctatcaactcgaaaaagtatctatcgactgtagatacagctataaagtagatagaaaattcaacagacaagtcgcggacgcaacaatatattcaacaagacaaggaatagtaaaacaaacaagtggagacaaaagttttacactagactccaattcaaaagaacactatgttatagcaaaaatcaaaaatatatacgaagacgtcgatgcgaaaagatttatggaccgctataagaaagacaaaacacaattcttaatgtaccaccatgacccacaaaccttctccatattagaagacgtaatgaaaacatatccagacaagaaaaatccattccaagcctatagacttgaatacggacctataagaaaatactccaagaaaggcaatgggccacaaatacaatctataaaatactacgattccaaactaggccaacacatagaactaaaacaagcaaatcaatccactaagaaagtcgtcttacaatcactaaacccatggagatgtgacatctactacaataagaaagacaaaagatatatcgccgcaggtttaaaatacgccgatctaagttatcaaaaaggaactggactttacggtatatcattgcaaagatatcaacaaatactaaactcagagaaaatagaattatccatagaacaaatagaactcctattagaaggaaggttaaacgaatctaattttgagttctgtttttcactatataaaaatgattttatacaatggaacgatgaaaataaccaaacatttcaatacagattcctagcacgaaatttaagcagtcccaacagaatagaagtcaaaccaataaataaatctaaatacgacaaacaagcagaaggactaaaaaccttaaagaaaggactaaacagattctataaaatctccgtagacgtattaggatatcaacactttataaagaaagaaaaattaaaactaacatttaaatga

SEQ ID NO: 8562 - RNA, 3330 nt, synthetic construct
  misc_feature 1..3330: note = Cas9 variant
  source 1..3330: mol_type = other RNA
atgtcacactacgtattaggtctagacattgggataaccagtgtaggctacggaataatcgacttagacacgaacgatttcatagactatggcgtaagactgttcaaagaaggaacagcagcaaataacgaagacagacgaaactcaagatctcgtagacgactactaagtcgaaaacatactcgattaatggatatgcaaaaagttttgaaggaagcaggcataatgactgaatcctatagtccacttagcaatgtctatgaaataagaaaaaaaggactaacaaaagaactgacgaatgatgaactcacagcagcaatattacatataacaaaacacagaggatcagtgatagaaacagttgaagacgacgaagcagcagcaaaagaaaccggagaactaaaaagcacactacacgaaaacgcactattactagcgaacaacaaatttgtatgtgagatacaattagaaagactcaatactgaaaacaaaataagaaatcataaaaataatttcaaaacaaaagactacgtagccgaattaaaagaaatcctgaaccaccaaaacctgtcagaagaagtcaaaaataagatcatacaaatagtcgaacgaagaagagcctactatgaagggccaggatcatttaatagcccaacaccatatggaagatttatagaagtcaacggacaggtgcaagaaatagacctaatcgaaaaaatgagaggtaaatgctctgtataccctgacgaattcagagcgcccaaaatgagtattagtgcggacctatttaacatcctgaacgacttcaacaacttactagtacaaggagaaaaactacaagaggaagataaaaaaaatttactaaaaataattaatgataaaggaagtatcacactcagacaaattagtaaaaaactagaagtgaacgaagatgaaatcaaaggatatagaatagataaaaaaggcaaagcactatttacagaatttaaaggatacaaaatcctaaagaaattattcttaaattgcgggcaatccatctcactagaagactatgaaatgctagacgaaataatagaaatagttacaaagaaaaaaggaatcgatgagaggaaagacgcgctaaaagaacttaaatgggacctaagcgatgatataataaatagcctaagcgaagtgacaggcatcgttggctatcattcactctctttaaaagcaatccgggaactagattccgagctttataaaacatcactaaatcaaatgcagttacttcacgaactaaagatgttcgataaaaatagaccctcctacaaaggaaaaaagaatatcgttgcagaccccgaagcaattctatcaccagttgcaaaaagagcgcaaaacgaaacgttcaaagtaattaacgcattacgtaaaaaatacggagaattcgacagcatagtagttgagatgacccgagataaaaacagccaagaacaaaaaaaaagaataaacgacagccaaaaagcactcgaaagcttaaacaaagaggtcgatcaattattacaacaaaaaggatacgacccacaaaaagtgaaaggaaaaaccaaacaaaaagtaagattatacatgatgcaagagggaaaatccgcatacacactacaggagcttgacctacaccgagtaataaaagacgacaaatatacagaaatcgaccacataataccaatatctatcagcctagacgactcacaaagcaataaagtactagcgctgcacagcgaaaatcaacaaaaaggaaacctaaccccatttatggcattccatacgggcagattcgcagacatgggatgcacctggaacaaattcaaggaaaacgtattatcaaataaaaactataaacataaaaagaaaaataacttacttgatgaacgagacatcaataaatttagcgtaatccaagaattcattaacagaaacctagttgacacaagttatgcaaatcgagttgtattaaacactcttacagactacttcaaagacaatgaaatcgatacaaaggtacacacagtcaacggtaaattaactgacctattcagaaagcgaataaatttaaaaaaagatcgaaatgaagattacttgcatcacgccatagatgctctaatagtggcatcaataaaaaagttacgattactagatggttatctggcaaaatacggatttgaaacattatacgatgaaatgacaggagaaataaaagaaattccagaagataaagcatttttcgacgacaaatatatacggtacatactcaacctaaagacaatatatgagagttcaaacatgtattaccgaggcatactggaacgcgaagaactcatataccagcccataaaaataagtcataagattgacaccaaaccaaacagaaaagtaagcgacgaaacaatatactccacacgaattatagataatgaagatcatctcatagaaaaatactcagatatatacgaccccaaatttaagaacttaacagaggacatactaaatggagaaaaaaacaagtacctaatggaaaaaaacgatccacaaacattcaatatattaaaacaaataatatttaatcactacaacacatataaagactccaaagaatactataaaatagaaaaaaaaaaagaaaaagaaattataaaactagtcggaataaacccactctcactctacaaagaagaaaacggtccaatcaaaaaatactcaaagaaaggaaacggccccgtcataatgtcaatgaaatacgacagcgaaaaattgggtaaccatatagatatcacaccagactccgcaaaaaataaaaaagtaatactaaaacaaataagcccgtaccgcaccgatttttacaagtgcagcgacgaaaaatttcgtttcgtaacggtaagatacaaagacgtacactaccaaaaaagtatcgataaatattgcatagacaaagaatggtatcaaaatgaaaaaaaaaacaaaaaaatagacgaaaaagcagagtttctattcagcatgcaccacgatgaactaataggcataacacgaaaggaaagcgaacagttcatctatgacgaaagcaaagagaaccacggtgaccctagatatcatgatggagtaaaaccagaaattctaaaatttactgcaactaacaacgatactaaagggatcatagaagtaaaaccactatacacatattcagcatacagactcaaacccacagtactaaatgtcaaaaacataaaaaaatatgcaaccgacgtactaggtaacctatatgaagtaaaacaaaacgagctaaaactagaattctga

SEQ ID NO: 8563 - RNA, 3333 nt, synthetic construct
  misc_feature 1..3333: note = Cas9 variant
  source 1..3333: mol_type = other RNA
atggcagaaggtaaaaagaggatatggaggctaggagctgatttaggagcaaactcattaggatgggcagcaatagaattatctgcacctgtgaatggaaaacccatagcaattctagctgccggaagtcgcatatttagtgacggacgcgatccaaaatcaggagcatcattagcagtagatagaagagatgcacgggccatgagaagaaggcgagatcgattcaaacagagacaaaaggcattaattaaatatctgatagcagatggtctatttccagcagacgaagctgcaagaaatgcgatggctgcaatagatccatatgcagtacgtgcaagagcattagatgaagcgctttcactcccagaacttggccgcgcactattccatctgaatcaaagacgaggcttcaaatcgaatagaaaggccgatagaaaagcagacgatgatgcgggtaaaatagcaataggcatagacagaacaagagatgctatagcagaagatgaagcagacgcaggagccgaacctggatcatggacatttggtaaatggttacatgaaagaagactgaaaggtcaaagcgtgagaacaagactaagaccagaatctggcgaagatgcaaaaggcgacggatatgatttttatcctgacagagcactaatggaagaggaatttgatgcaatatgggctgcacaggctccgcatcatccagatgtgctgacaaatgatgttcatgatagattacatgagataatattttatcaaagaccattaaaagctccacaagtaggaatgtgcagtctaatacctggtgatagacgattaccaaaagcacacccattattccaaaggcgtagactactagaagaattaaacgcattgatgatagttagaccgggtgaagttgctcaaagactaaccagagaggaaagagatatattactattaaaattaaaagataagaataaggtatcatttgctacccttagaaaagcattaaaactcgaccctgatgcaagatttaataaagaatcggaagatagaacagatttgaaaggagatgaagtagccgctgtcatgggttctaagacaagattcggtaatctatgggtacatctaagtattgaagctcaatgggatgtattagcgagattagatgcagtagaaagcgatgcagaggacgcggcattttgcgcatggttagtagaaacgtatgctcttacaccagagcaagcgagagccgttgctaacgcgccacttccaccgggctacggaagatttggggaaacagctacaagaaaattaatagaagccttaagagacggaaagaaagatgacagagtacttgtatactcagaggcagtaaccgaagcaggtctaggacaccactctgatcgcaggacgggcgaagtcttcgaagatgcaaaaggacgaccgcagttgccttattatggcgtagcactagaaagacacataatgcctggaacaggagacccttcagatccagaagaaatgagagtaggtcgattaacaaacccaactgtacacataggtttaaatcaattaagaaggattttaaatgtattaataagagcttatggtccgcctgcggaaatagcaatagaacttgctagagaattgaaactaacggatgaagacaaaaagagaataaaccgggaaaataacgataacaggatagcagctgaacgaaggagcgaaaaattattagctattggccaagctgactcaggggctaatcgggctctattgaaattatgggaggaattaaacccagcaaacgtactggatagaagatgtatatatagcggtcgacaaatatctatagatatgttattttctgcagctgtagaggttgaccatatattaccttttgctgcaacgctagacgattctaatggaaacaagatcgtatgcttaagagaagcaaatcgagagaaaaggaaacgctcaccacacgatgcatggggtcactccgcacgatgggatgaaatcgcagcaagagctgctcaattaccaagaaacaagagatggagattcgaacccgacgcaatggacaaattccgggacgaaggcggctttcaagcaaggcatcttgttgacacgcaatatttagcgagattatcgagagaatatttagcaacattgtatcctgaaaaaggagaaggcagtggtcacatttgggtatctccgggtcggctaacagaaatggtgcgacggaaattaggattaaacgatttgttacccgatcataatttcggaggtggagcggatcaagccaagaacagactagatcaccgacatcacgccatagatgcagtagtagtagcaatagttgatagaggaatgttaaacgcaatagcaagagcttcaggtcaagaaggagcagagggacgcgaaaggataattatacctgaaccatgggacgggtttagagatgccttacgtgaaacagtgaacagaattacggtatcacatagaaccgatcatgggaccgcatccaaagcgggacttccaaaaggaaaagatgcgacggctggtagattacataacgacacagcatatggatttactggagatacagatgcaaaaggtaatagtatagtagtaagaagggtccccttgtccagtttcaagaaattagcggaccttgacagaataagagatgctgatctaaaggctgcgttatatcaacacttaaatggcttggaaggaaaagcatttgagaaggctttagcggagttccataaattggaatggcataactttggaggggtaagaagagtgagagtaacagaacccttaacagttataccaataaaagatagaaatggaagaatatacaaaggctacaaaggcgattcaaattatcgatatgacgtttgggaacttccagatggaaaatgggtaacaaactggaaaaatgaagcaggggaagccatgtcaagcgtaataagtatgttcgacgcacatcaaagcagcgaaccccctcggccacacccagcagcacgaaaaatactaagtcttcatcaaaacgacctactcgcaattgaacgagaaggtgaagatagaaaacttatgagagtagttaaattcggacagtcaggacaaataacactagcagaacatcaacaggctggtgaccttaagaaaagagatgccgtaagtaatgacgatgacccatttaaatacttcgctccaacctcaggtggtttgaaaaaggtaaaagcaagacaagtaaggatagacgaaataggcagagttctagacccgggatttccagcaaggacagctagacgaaaaacaagaggatga

SEQ ID NO: 8564 - RNA, 3333 nt, synthetic construct
  misc_feature 1..3333: note = Cas9 variant
  source 1..3333: mol_type = other RNA
atgaccgctagaacacataagatatggcgcttaggggcagatttaggagcaaactcattaggatgggctgcgatagaactctcagcaccggtggatggcaaaccaattgcaatactgcatgctggtagtcgtatatttagcgatggaagggaccctaaatcaggtgcttctttagccgttgacagacgagacgcacgagcaatgagacgaagaagagaccgattacaacaaaggcagagagcactcataaaatatctaattgcagacggactttttcctgcagatgaaaatgaacgtaaagcaatggcaactattgacccatacgcagtaagggcaagagcactggatgaagcacttactctacctgaagtaggtagagcattatttcacttaaatcaaagaagaggatttaaaagtaacagaaaggctgacagaaaagctgacgaagacgcaggaaaaatagcaataggaatagacagaacaagagacgcaataagacaagccgaagaagaagcaggagctgaaccaggatcatggacatatggaaaatggctgtacgagagacgagcatcggcaactgacgcaaatgcaataccatcagtaagaaccagattaaggcctgaaacagacgaacatgcaaaaggtgacggatacgacttttatcccggtagagcgctaatggaagcagagttcgctgcaatatgggaagcccaagccgcacaccatccagatgctctcactaatgaagtacacgatagattacatgaaataatattttatcaacgtccattaaaagcgcctcagattggagtatgtacactaattagaggggatcaaagactacccaaagctcatccactatttcagaaaagaagattacttgaagaactaaatgcactgacaatcgtaagaccaggtgaaatggcacaaagactcacacgtgaggagcgagacaccctatttcttaaacttaaagacaaagctaaagtatctttcgtatcactaagaaaaacgctaaaactagatccggatgccagatttaacaaagaatcagaaaatagaagtgaccttaaaggggatgaagtcgcagctgccatgggagcaaaaacaagatttggcaatagatgggtacacttatctatagaagaacaatgggatgttattgcaagattggaggaagtagagtctgacgcagaggacgcagcttgccgagcgtggttagctgccacatttgatttaacccctgaacaaataagagcggtaacaaatgcaccactaccacctggatattctagatttggaaaagtagcaacccaaagactgatagacgcattaagggatggagaaaaagatggacgggtcctcgtatatagtgaagcagtggcagcagccgggttaggacaccattcagacctaagaacaggagaaatatttgaggatgcacaaggaagaccacaattgccatattatggtgtagctctagagcgacatataatgcccggaacaggaaaccctgatcactccgatgaaatgagaattggacgtttaacaaacccaacagttcatatcggattgaatcaactaagacgcatagttaacacattaattcgcgcatacggcccaccggcagagatagcaatcgaattagcaagggaattgaaattaacagacgatgataagaaaagaataaacaaagagaacaatgaaaacagactagcagcagagaaaagaagtgaaaaattattaacaatcggtagacccgatacaggtgcaaatagagcattattaaaactatgggaagaattaaatccggcaaatgttctggacagacgatgtatatacacaggaacacaaatctcagttgatatgttattctccgcagcagtcgaagtggatcatatattacccttcaccgctacattagatgactcaaatggaaataaaattgtatgcatgagggaagcaaacagaacaaaaagaaaacaatctccatatgaagcatggggtcatacagacagatgggaagaaattgcagctcgtgctgcacaattaccaaggaacaagcgttggagatttgaaccagacgctatggaaaaattcaaggacgaatccgggtttcaggctagacacttagtagacacccaatatttagcaagattatcaagagaatatctagaaacactctatccaggttcaggcgaaggatcttcgcatatatgggtgtctcctggacgattgacggaaatggtaagacgaaaattaggcctgaatgatcttttgccagatcacaactttggaggaggtgcagatcaggctaaaaaccgtttagatcatagacatcacgccatcgatgctgtagtagtagcaatagtagatagatccatgttaacagaaatttccagagttagtggcctagaaggagctgaaggaagggaaagaataataataccaccaccgtgggacgaatttagaaacgatctaaggacagcagtaaacgcaataacagtcagtcatcggaccgaccacggtacaattagcaaagccggattaccaaaaggaaaagacgcaaccgcaggtagactgcataacgacactgcgtacggattcactggagaaacagacgcaaagggaaattccattgtagtcagacgggttccactagctagttttaagaaattggccgaccttgatagaatacgagatacggacctaaaagccgcgctttatcaacacctcgaaggattagagggtaaagccttcgaaaaagcagtaatggattttccaaatctagaatggcatccattcggtaatgtcagaagagtaagggtaacagaagtattatcagttatacccatatccgatcaaaatggcagaatctataaaggttacaaaggagactccaattacagatatgatgtttgggagctacctggaggaaaatgggaagctgaagttgtcagtacctttgatgcacatcaaccagattgggtttcgaaaatcaggtcaagatcaccaactgcaagaaaagttttatctttacaacaaaatgacttaatagctgttgagagagctcacgagacgagagaattaatgcgagttgttaaattccgacaaaacggagaaattacatttgcacctcctcaagaggcaggatctttaaaaagaagagacgctacgccaaacgaagatgaccccttcaagtactttgcggttgcagcctcttctctacaaaaagctaaagcacgacaagttcgaatcgatgagctaggcagagtactcgacccaggatttccagcacgtacagcccgacgtaaaacacgtaaatcgacttga

SEQ ID NO: 8565 - RNA, 3333 nt, synthetic construct
  misc_feature 1..3333: note = Cas9 variant
  source 1..3333: mol_type = other RNA
atgagaatcctcggattcgacataggaataacctctataggttgggcatatgtggaaggagaagaactaaaagattgcggagtgcggatattcacgaaagctgaaaacccacaaaatggagactccttagcagcaccaagaagagaagctagaggcgtaaggagaagactagcaagacgaaaagtccgactaaatgtaatcaaaagactactatgcaaagagttcggactaaatctatcagactatttcgcaaatgatggcgaattaccaaaggcctatgaaacaacaaaagacacaaaaagtccatatgaactaaggagtttagcattagaacagaaactagaacctaaagaactagcacgagttatattacatatagcaaagcatagaggatatggaaacaaacacgcgaaacgggacttagaagcagaagaaaaagcaaagaaagcagccgaaaaagcaccacaagaaaaggaatcaacaacaaccaacggagactctaagaaagaacaagaaaaagtcttaaaagcgttatatcaaaatgaaacattactcaagaagtatcagacaaactaccaaaccaataataaaacgaacgacgaaacaaataataaaacaatattcctggtcggaaaatacttatataaagaatttcaagacaaaggccaaagaatcagaaacacaactaacaattatcaacatacaatgcgacaagaatggctaaaagatgaacttgaatttatattcaagaaacagaaagatttcggagccacattctcagaaaatttcgaaagtcaaatcctggaaacagctttctatcaacgcgatctaaagagcttcgaagataaagtcggcaaatgtgtattttacgagaatgaaaatcgcgcaccaaaagattccctatctgcaatggaatttgtagcactaaccagaatcatcaatacactaaagaatctagaaaagaaaagtaaaaatctgggaataggtgaaacatacggcaaagacaaaatacaagaaatattaaaaatagtgctagacaaaggggaaatgtcatacaaagaactgagaaaaattttaaaattgaatgagagcatacttttcgcaaaagactcaaaattagattacacaaaagggatgcaagaagcagaaaaagcgaaattcatcgagctaaagaatctaaaagcctttaagaaagccatgggaggagatttttcaaaatttccaagagaagaacttgataaaatagctaccgatatagtattaatcaaatcaaaagaaaacttagctaagaaattacaaaattactcagcactatccaaagaacaagtcgaagccctatcaaatctcaacttcgctaaacatatcgacctctccttaaaagcacttgacaaaatcttacctttcatgagagaaggattaagttatgacgaagttgttaagaaagtcggactacaagaacacagaaaatacaaacaaaaaggagagttcttgataccgttaaaagaatatgaaccatatttagcaaatccagtggtcgctagagcattaagtgaatacagaaaagtattaaatgcactattaagaaaatacgggaatgtacacaaaatacacttagaatttaccagggaagccggtaaaaattacgatgaaagaaagaaaatagaaaaagaacaacgagaacacttcgaagccaatcaaaaagcaataaaacaacgagaaatactcggattacctataaacggagcaaatatattaaaaatgaaattatggatcgagcaaggagaatgttgtgtctatagtggagagaaaataacttccaaacacttctttgattccaatgctctacaagtagatcatatatatccctatagcagatcatttgacgatagctacatgaataaagtgctagtattcgctaaagaaaatcaaaacaaactcaacaaaaccccatttgaagcattcggaagtgacaaagaaaaatgggatagaatcttgagcttatcggcaaaattaccaaaacaaaaacaaagaagaatcagcaacaaagatttcaaagacaaagaactaggctttatagcaagaaacattaacgacactggatatattgcaaggctcgcgtcacaatggaccaacaactgtctcaaattcgaagacttaagggaaaacgaagtaactatagcaggagaaaaaggtagtaaaaaccacctagaagtaatctccggccaactgacaagcatgctaagacactactggggactcggagacaaagacaggaacaatcatctgcaccatgccgtagatgctgtaataatagcctacacaaacgctaaaaccattaaagcatttgcagacttcaagaaaaatcaagaacaaaatcgcgctaaattttatgcaaaacaaatctcagaacaagaatacaaacgacaacggaatccattcgaaccctgcgcaaactttagacagcgagtagaagagaaaataaacaaaatatttgtatcaaaaccaccgagaaaaagggcgagaggcgcactacacaaagaaacatttggaagcatctgtttagatggaaacaacaattgggtagcaaggtttaaaataaaatctaagaaagaacaagaagatataaccaaagaaaaagcaacaaaagcaaaatataaagacgaatttaaaggagaagaaaatatcaggaaagcattgaaacttggtaaaataaggagaatcaataacacacaaaaagacatcgcaataggagataagatagttaaaaacgaaacaatggtaagagtcgatatattcaaagataagaaaggaaaattctatgccgttccgatctatacaatggacttcgcactcggaatcctcccgaacaaagcagtggcgacaggtgaagatgaagatggagtaataaaagattggatcgaaatggataaaacaaaatacgagttctgtttctcactatttaaagacgatttaataaaagtaagaaagaagaaaatgaaagaagcagaactatgttactttgtcggattcgacacagacggatcaagaataatcgtagcaaaacataataatgactatcaaacaatgacagaaaacgaatgtaaactatttacactcaaagaaaagaagaagaaacagaaaacactaaacgacgaagaagacaatcaagaacgaatagaaaccgaatataaaataatcggcggcagaactggtatacaaaacttagaaacatttgaaaaacaccaggtgagccccttaggggaggtacaaaaagctgagttcgaagatcggcaagaaatcaaactaaaatcttcaccaaaaggaaaagattga

SEQ ID NO: 8566 - RNA, 3333 nt, synthetic construct
  misc_feature 1..3333: note = Cas9 variant
  source 1..3333: mol_type = other RNA
atgtccgagaaatatcgtttggggttggacgtaggtaccaatagcttaggatgggctgtaatagggcttaaagaagacgtaccatcgtccgtattagcaacaggagttagaatatttagtgaaggacgagacgcaaaaactaaaagcacactaaaagcgtcgagaaccgagaaaaggtcagccagacgtagaagagacagatttttacaaagacaaactttcttaatttctgaaatggtcaaaagcggactcttcccaaaagatatagtagaacagaaaaacctggagttgttagacccatacgaaattagatttaaagcgctaacagaacaagtaccactacatcatctagggagagcattatttcatataaatcaacgaagaggattcaaaagttcaagaaaagataaatcagaagaaacaacttcgggagtagtgtcaaaaagcgttagagcattatatgaagaaatgcaattaattaatccagcaccagtgattgacgatccaaaagcgttaagtaaagaagaaagaagagaaataagagtacaagaggcaagcagccgagaagaagctctagtaactcttgcggaacaaaaaggggtcacattcggagctttcctatatagaagattgcaatcaggaaaaagcgtaagggcaagaaaagatgcggattcacaattatatgacgtatatccaaccagagaacttctaaaagacgagtattcaaaattaatgcaacatcaagcccaatattatccaaatgtaataaacgaagcattaatctcgcgactacatgacgttatatttttccaaagaaaactaaaagaacaagaaagagggttctgcacatattatccgtcagagaggcgcacatttagatgcatgcccagctttcaacaataccggatggtacaagagttaaacgctctagaatgggtagatgctgcaggaaaacattgcctaagagattatccagaatcacgcgatctaatattaagtgaattagaaaatataagtacgaaggcaggagaatttacatttggaaatatgaaaaagatccttaagaaaatgggggtaattgatggagaagtgtcttttaatttcgaaggacctaaaagaaaagggttccaaggaaatgtaacaagtagggaaatgagacatgaggattgtttcggaacaaggtgggacgaattaagtctagatgaaaaagatgatatcatagataaaataaatgacgatcatctagacgatgaagacatggaaagatacttaatagatacatacggactatcgagtttttccgtgggaaatgcaataaatgcgagattattagaagggacagccaacgttagcaggaaagcagcacgaacactttatgaaacaatgctatcagccaattgtctgcaaagtgacgctgtaatagctgttagtgagcaagacgatacttttgtaaatccttattctagaactggacgtggtgaacttttatctgaactaccatactatggggaagcgttccaagacgggcgccacataataccagggaaaagagagccaaaagtttcgcatgatcaactaaaattttatggcggagtcagcaatcctacagtacatatagctcttaaccaaattaggcttgtggtgaatgaaattataaaacgctacggtctacccagttcaatatccatagaattagctagaaatttaccagaaggacaagacggcagaaggaaaatagaaaagatgcaaagtgaaaaccagaaaaacaatgaacgatacgatcaaatattaacagaaaatggacaaagcccgaatcgagataacaggttgagattagcattatgggaggaactaggagaagggcccacagatagactatgtgtttttactgggaaattaatagaattagcagacttatttaacggatcggtagaaatagagcaccttataccatttagcgtatcactagacgatagcaaagccaacaaaacggtttgctggaaagaagctaatagattcaaaggaaacaaaacaccttatgaagccttcgccaacaactcaggtgattattcctgggaagaaattatggaaagagtcagagctttacctaattctaaacaatggagatttcaagaagatgccttaaagatttggaacagtgaccacagtgacttttcaggcaggcacctaaacgacacaagatacatatctagattagcgagagaataccttgaaaatatctgtccgtttaataaaattgatgtggtaaccggaagacttaccgcactcctaagaggacattggggtttaaataacatcttaagagggcacaatgaaccagaaacggcaacaccaaagaaaatgagggacgatcatagacaccacgcaattgatgctgtagtaatagcaatgacatcgctgacaatactacaaaaagtaagcagtgccgctggcaaagcagaagaacttgatgttggaaaactctttgcaaaggatgaaagcgggcgaagtgtaatagatccatgggacggttttcgagatgaagtagcagaaaaagtaaggaatataatagtttctcacaaaacaaaaaggaaaactataggaaacagcggcaaaagcactgacagagcattacataatgaaacagcttacggtttaatagatggaccagatgaaaaaggcttatactcagtagttacgacaaaacccataagttatttcgacaatagggataaaatagaaaagatacgcgatgaaaaactaagagatgatttcttaacagcatgggatggtgaaggtgataataaagccagtcaattagcagtccttgataaagctagcgggttaaatgtaaagaaatgccgttatgttgaaagaaagaaagtcatacctatcaacggcccagatgggcaaccatataaagcatacgatggtaactcaaattgggggatggaaatttatgagttcccaaatggacatccaaaagaaaagaaatggaacggagtggtaataagcacttacgacgccaataaaagtgaatttaaaccaggagaaacatttagaccacacccggctgcaaaattagtaatgagacttcatattaatgatattgtagaagtgcaaaatgatggagaacctattctctatagagtgcaactgatatcagcaggaacactaacggtctcaccattacatgaagctaatgtagattctagaaatagagataaacacgatgagttcaaatataaaagtttaagcgtaacacctatgcagaaaatgggagcgaagaaagtcaatataagtccaacaggcctgaaaaattactcgcgatga

SEQ ID NO: 8567 - RNA, 3345 nt, synthetic construct
  misc_feature 1..3345: note = Cas9 variant
  source 1..3345: mol_type = other RNA
atgggaataattattgggctagatataggtatagcttcagtaggaatagcagtagtagacaaagacacacttgacataaaatgtgtagttagcgatctattcgattcagcagatgcatctaaaaacatagaacgacgaaataaccgacaagcaagacgattaaacagaagaagaaaaacacgaataggcgactttaacactctttgggtatccatgttcggcgaactacccgaagaagtagattcgaatgtactactactacgaaatgcaggccttgatgaacaactaacactagacgaaatttactgtgtactaaaatacatgcttaaacatagaggaatttcatacctagaagacgcacttaatgaagaaaatgtaaccggaagctaccaaaaaggaatagccataaaccaaagagaatccgaatatatgttgccatgcgaaattcaactcgaaaggtttcgaaaatacggtcaataccgaggtgaatgtgaagcagaaaatgaaaatggagaaaagatcacactgagtaacgtctttatgacaaactcatatcgaaaagaaatagacaaattcctaaacacacaaggaaaatacggtatactaaatcaaaaattcatcgacgaataccttaaaatttttaaccgaaaacgaaaatattacgaaggccccggaaacgaaaaatcacgaaccgattatggaaaatacacaacaggaaaagacctagatggaaaatacataacagagaaaaacatatttgaaaaactaataggtaaatgctcagtctataaagaagaattgagagcggcaggagcttcttacacagcacaagaatttaacatactaaatgacctaaataacattacagtaaataacaagaaactgacaacacaacagaagaaagacgtaattgaaatcgtccaaaatagcgaccgaattaacatggagaaaattataagctcatgcataggagagaaaatagagaaaatagaaggagcgcgaatcgataaaaatgagaaaaacatttaccatacatttgaacaatacaataaaatgcgaaaaatatttgcagagaaaaattacgatataaaagaattaacaattgaacaactagatgaaatcggccgtatactaacaataaacactgaacgcgaaggaataaaagatgcaatcatggaatccgagctattgcacttaaataacgaacaaataaacctcttaatagaactaagatataaaaactcttccctatttaccaaatggcaaagcctatcaataaaagcaatgagagaaattatacccgatctatatgatagaaacgttaaccaaatgaatatattagcagaacgcggtgtattcaaagataaaataaacctattcgaaaattcagtttatctacctaaagaaccagtactcgaagagatatataacccagtggtcagacgaagtatatcaatgacaatcgacgcattaaacgctctaattaagaaatatggatacccagaagacatagtaatcgaaatgcctagagatagaaacgatgccgaacaaaaagacagaatcaagaaattccagaaaacaagagaaaacgaactcaaaaatatcaaaaagaaaataaaagaggaatatggcatagaaataacagacgaatattttcgaaaacataaaggattagaattagagttaaaattatgggtggagcaaaacgaaaaatgtccctactcaggtaaatatataaacgtgcaagacatcctatatcaccatgaactgttcgaaattgaccatataataccattaagtatatcatacgacgattcaagaaataacaaagtcctggtatacaaagaagaaaatcaagataaaggcaacagaacaccacttatgtacctcagcacggtcaaccgccaatacgaccagcacgagttcatgaactacgtactatcaacaaaaacattgccaagaaagaaaagggaactactactgaattatgaggatataacaaaaatagacgtactaaaagggttcattaacagaaacctaaatgacacacgatatgcatcaagatcagtcttaaatgcaatacagctgttcttcggaggaaaagaatgcgatactaaagtgagggtaataagaggagcggtcactaatcaactcaggattaaactaaatctaccaaaagatagagaaaaatcctactcacatcacgcaatcgatgcagcaataatgtgctactcccaaatgggcttaatgaattttagaaacatacaaaataaatttatagacttcgaaaatgaaacatacctgtcagacgaaagagatagttgctttgacaacaaatactacgacgaagcactattcggacaagtactaaaaatgcgtaaaaacctactcaaagcagaaggcaaaccacaaagatccgtacagagtaaaggcgtatttgacgaagaagagaaaaataatggtatagtaagataccaccacaaagtagataagaaaccaaatagaggcttatcaaatgcctccatctatggcacaagaaaaatagacgataaaatatacaaaatcgtcggatatgatattagaaacaacaaagacgcagaagcaatcataaacattataaagaaaggaaaatcagacaactttttaatggcaaaacacgatccagaaacatttaaaaacttaatggaaatatacgaacaatataaagaagagaaaaatccgtttctggcatacgaacaagaaactggagactacataagaaaatacgccaaaaaccataatggaccaataatcaagaaaataaaatacgtagactcagaagtaggatcatgtatcgatatatcagctaattatggatataaaaacggcgacaaaagagtaataatggacacactaacaccgtacagagcagatgtatattacaactacaaggatggaacatataggatcataggcgtaaaatatgcagacttcaaatacagtaacgccaaatatgtactagatgaagaagcctacgctctaattttaataaaagaaggtcttctcaaaataggagattcattagaaaacatatcatcatcaggatacgaatatcgactatccttttacaaaaatgacataatagaatataccaaaaatgacatagtatacaaagagagatttctcagccgaacgatgcccaaagtcaaaaattacattgaaactaaaccaatttctgcagctttatatgagaaaaggaatccgataggactcaccaacgctactaacatatgtaaaatatatacagacgtactcggcaacgaaaccaaaatatacaaagaaaaattcaaactaagcgtagactga

SEQ ID NO: 8568 - RNA, 3345 nt, synthetic construct
  misc_feature 1..3345: note = Cas9 variant
  source 1..3345: mol_type = other RNA
atgaactacacggaaaaagaaaaactattcatgaaatacatattagcactagacataggaatagcatcagttggttgggcaatacttgacaaagaatcagaaacagtcatagaagccggatcaaacatatttccagaggcttcagcagcagacaatcaacttaggcgagacatgagaggtgcaaaacgaaataatagacgcctaaaaacacgcattaatgacttcataaaactatgggaaaataataacttaagcataccacaatttaaatcaacagaaatcgtcggattgaaagtgcgagcgataacagaagaaattacactagatgaactttatctaatattatactcataccttaaacacagaggaataagttacttagaagacgcgttagacgacacagtaagtggatcctcagcctacgcaaatggcctaaaattaaacgcaaaagaattagaaacacactatccctgtgaaatacaacaagaaagactgaacacaatcggaaaatatcgaggtcaaagccagattatcaatgaaaacggagaagtcttagacctaagtaatgtattcacgatcggtgcataccgaaaagaaatacaacgagtcttcgaaatacaaaagaaatatcaccccgaacttacagatgaattttgcgatggatacatgcttatctttaatagaaaaagaaaatactacgaaggacccggtaatgaaaaatcaagaaccgattatggaagattcacaactaagctggacgcaaacggcaattacataacagaagataacatcttcgaaaaattaattggaaagtgctcagtctacccagatgaattacgcgcagccgcagcatcatacacagcacaagaatataacgtcctaaacgatctaaataacctaacaataaatggtagaaaactcgaagaaaacgaaaagcacgagatcgtagaaaggataaaaagcagcaatacaataaatatgagaaaaataatcagcgactgtatgggagaaaacatagacgatttcgcaggagctagaattgacaaatcaggcaaagaaatctttcataaatttgaagtatataacaaaatgagaaaagcactccttgaaatcggcattgacataagtaactattcacgtgaagaactagacgaaataggttacataatgactatcaacacagacaaagaagccatgatggaagcattccaaaaatcatggatcgacttatcagacgacgtcaaacaatgtctaataaacatgagaaaaacaaacggcgcactattcaataaatggcagagcttttcattaaaaataatgaatgaattaattccagaaatgtatgcgcaaccaaaagagcaaatgacactactcactgaaatgggagtaactaaaggcactcaagaggagttcgcaggattaaaatacatcccagtcgatgtagtatcagaagacatatttaacccagtagtaagaagatcagtaagaatttcattcaaaatattaaacgctgtattaaagaagtacaaagcattagatacaatagtaatagaaatgcccagagaccgaaactcagaagaacagaaaaagagaataaacgactcacaaaaattaaacgaaaaggaaatggaatacatagaaaagaaattagctgtaacatacggcataaaactaagccccagcgatttttcttcccaaaaacaactcagcttaaaattaaaactatggaacgaacaagacggaatctgcctatactcaggcaagaccatcgatcccaacgatataattaataaccctcaactcttcgaaatcgatcatataatacccaggtcaatcagctttgatgacgcaagaagtaacaaagtacttgtatatcgatctgaaaatcaaaagaaaggtaaccaaaccccatactactatctaactcactcacatagcgaatggtctttcgaacaatataaagcaacagtcatgaacctaagtaaaaagaaagaatacgcaatatcgcggaagaaaatacaaaatcttctttattctgaagacattactaaaatggatgtattaaaaggatttataaaccgaaatataaatgatacgtcctacgcatcacgactggtactaaacacaatacaaaacttcttcatggcaaatgaagccgatactaaagttaaagtaataaaaggatcttacactcaccaaatgagatgcaacttaaaactagataaaaacagagacgagagctacagccaccatgcagtagatgcaatgctaattggatactcagaactagggtacgaagcataccacaaactacaaggcgagtttatcgattttgaaacaggagaaatactgagaaaagatatgtgggacgaaaatatgtcggacgaagtctacgctgattatttatacggaaagaaatgggcaaacataagaaatgaagtagtaaaagcagagaaaaacgtgaaatattggcactacgtaatgagaaaatccaatagaggactatgcaaccaaactataagaggtacaagagaatatgatggaaaacaatataaaattaataaactagatatcagaaccaaagaaggaataaaagtcttcgcaaaattagctttttctaagaaagactccgacagagaaagactattagtatatctaaacgatcgaaggacgttcgacgacctatgtaaaatctatgaagattattccgatgcagcaaaccctttcgtacagtatgaaaaagaaacaggagacataataagaaaatatagtaagaaacacaatggaccccgaattgacaaattaaaatataaagacggagaagtgggagcatgcatagacatatcgcacaaatacggatttgaaaaaggttcaaagaaagtaatcctagaatccttagtaccatataggatggatgtatactacaaagaggagaatcactcatactatcttgtaggcgtaaaacagagcgacataaaattcgagaaaggacgaaacgtaatagacgaggaggcatacgcacgaatcctagtcaatgagaaaatgatacaacctggacaaagccgtgccgatttagaaaatctaggattcaaattcaaactgtcattttacaaaaacgacataatcgaatatgaaaaagatggaaaaatatacacagaaagacttgtaagccgaacaatgccaaaacaaagaaattacatcgaaactaaaccgatagacaaagcaaaattcgaaaaacaaaatttagtaggtctaggaaaaaccaaattcataaagaaatacagatacgatatacttggaaacaaatacagttgctcagaagaaaaattcaccagcttctgttga

SEQ ID NO: 8569 - RNA, 3348 nt, synthetic construct
  misc_feature 1..3348: note = Cas9 variant
  source 1..3348: mol_type = other RNA
atgagtgctacatatacaatcggactagacatcggaatagcctctgtcggatggtgtgcgtttggagaaacacacatattagatctaggagtgcgagcctttgacaaagcagaaacagctaaagaaggagaatcactaaacctagcacgtcgaaatgctagactaatgcgtagacgactattccgtagaacttggagactgaagaaattggcacgtcagctaaaaagtgaaggcttaatagccgacacaaaactatttaaaccagaactgccattttcaaaaagtttatggcaattaagggtagacggcctggatagaagactaaatgacgaagaatgggcaagggtaatttatcatctatgtaaacatcgtggtttccactggatctcaagagcagaagcaaaacaggcggaaggagatagcaaatcagaaggaggcaaagtaaaacagggactagcaggaacagctaaattaatggatgaaaaaggatataggtcagcagcggaaatggtcctagccgaatttccacaagctcaaaggaataaacaaggggagtatcaaaaagcactctcacgggaattactcgcaaaagaactagcactattatttgctcaacaaagagaatatggaaatttacatacgccaggagcattagaaacagccatattagggaacggggacaagaaaagtggtttattctggcaacaaaaaccagcattagctggcacggatcttctaaaaatgctgggcacttgcactttcgaaaaaggggaatatagagcaccaaaagcatccttcacggctgaaagacatgtatggctaactagattaaataatttacgaatcgtaacagatggagtaactagacaactaacagaacaagaaagacaactatgcctaccattaccgtatcgacaagctggtgatttaacctacaaacaattaggaagcgcacttgcaaaagctggacttttagaagcagggggatttaaatttaccgggttagcatatccaacagaagcacaaaaagcagaaggtaaagcgaaagatcccgaaagtgcgacgttagtaaaaataccggcatggcacgaactcagacagacactaacaaaaggaggattgaatgacgaatgggaaaaactagctggggacgccctatgtggacaaccagaaatattcgacaaaattgcctgggtactaagcgtatataaagatgatgatgaagtacgggcagaactagcaaaattggcattgccaaatccacaagcattaactgaagcactactaaatataaggttcgacaaatttcatagcctctctctaaaagccttacgcgcaatagtcccacacatggaacaaggattacgttatgatgaagcctgtgtccaagcgggataccaccattcccaactcttaaaagtaggagaaggagaacacaagtatctacctccattatatgatggcagggacggagatggaagaatgatatttgcagaagatgccgatatacctaggaacccagttgttctacgaagtttaaatcaagcaagaaaagttgttaacgcaatcataagacgatacgggagtccctcagcagtccatatagaaatggcacgggacttatcaaggcctttcgacgaaaggaacaaaataaagaaagatcaagacgaataccaagctagaaatcaaagagacagagaacaattttctgaattatttggacatcctccgaaaggcttagaatttgaaaaatggaggctatatagagaacaaaacggccaatgtgcatatagtcagcgaccactaacggcatctggaaacgtagcagaaatctttttagatggctcaactgaaattgatcatgcactaccatattcacgtagttttgacgacagtaaaaataataaagtattagtattgacaagagaaaacagagacaaaggcaatagaaccccttatgaatatctgggaggggctgaaaactcagaatcatggcaacgatttgtttcatttgtagaaagcaataaagcgtatagattagcaaagagaacaagattactcagaaaggacttcggggctaaagaatcagaagagttcagagagagaaacctaaatgatactagatatgtttgcagattctttaaaaattatgttgagcagcacctaaaacttgcagaaggatctgagacaaaaagatgcgtagttgtaagtggacagctaacaaattttctacgcgcaagatggggactactcaaagtaaggagtgatagcgacagacatcatgcattagatgcagctgttgtagcggcctgctcacatagcatggttcaaagactaagcaattactccagaactcgagaattggaacaagtcagagatggatttgttgatattgaaacgggtgaaatagtaaaccccgctatgcatcaacaactcagagaacactttcctgatccctggccatattttagacacgaacttgaagctagactcaagatagacagtccagaactacttagagaggaaatggcaagactaggctcatatagcgaagaagaattaaaagtactaaaaccgctatttgtctctcgagccccacagagaagaaatggtggagcagcacacaaagatacaatatacgggcagccagaaaaattaaagaaaaacggtagtgtaactcagaaagttgcacttacatctctaacattaaaagatatagacctccttgctgatccccatagaaatgctaaattatatggtgccataagagaaaggttagaggcacatggaggcaaaggagataaagcatttcctgcaaccaatcctctaagaaaacccgacaaagaaggaaatccaaccggacccatagtccgaacagtgaccaaagtcatagataaattatcaggaataccagttagaggtggaattgctaaaaatgacaccatgttacgagttgatgtatttactaagggaggaaaattccatcttgtacccgtatacgtccatcatagagtaacaggccttccaaacagagcaattatagcatttaaagacgaggatgaatggacattgatagacgactcattcgactggtgtttctcactctatccaaacgatcttttaagaataaaattaaagaaagaaagccattcgggctattattcatcatgtaatagaagtacaggagcagttaatctatgggcccacgacagaaatgtaaatgttggaaaagacggatttatcgaaagcatcggcgtcaaaatggcagtatccatagaaaaattacacgtagatacattaggtaatatatatcccgcaccaccagagaaaaggagaggactagcttga

SEQ ID NO: 8570 - RNA, 3351 nt, synthetic construct
  misc_feature 1..3351: note = Cas9 variant
  source 1..3351: mol_type = other RNA
atgtcacaaaaccaaaatcctaacacacagagtcaccttaacccaacgactcagtcaagcacgcaaagtaacccacaacccactacgcaggaaagcctaaaaatacttggatttgacataggagttgcgtcaataggatgggctttcgtagaaggaggagaattaaaagactgcggcgtaagaatatttacgaaagcagaaaaccctaaagatggaagctcactcgcgctccctcgacgcgaagctagaggcgtacgaagacgactagcaagacgaaaaggaaggctaaacgcacttaaggtactaatatgtaaagaatttggactgaatagaagcgactacctggctactgcaggagaactaccaaaagcatatgcaacatcaaaagaaacaaaatccccctatcaattaagagccgaaagcctagaaagaaaactaagcgctgatgagttcgcgagagtcatattacacattgcaaaacatagaggatacggcaataagcacgcaaaagaatcatcggatgacgactctggcaaggtcaagaaagccataagtgaaaaccaaaaagtaatgtccgaaaaaggttatacaacagctggacaatatttatatggtgaattttatcaaaaagcaagaaatttctcagaagctgaaccaaaatcacctaaaaatgcccgaggcacccaagaatttaaaaacgtcagaaataaaagtgaaaattatgccagatgtctagcccaaagtgaactacaaaaagaattagagataatctttgcaaaacaacgtgagttcggatttcaattcagcgacaagaaacataaaactataaacgcaaacggaaaactcaaagaactagactttgcagacgcagtcttagaaatagcctttttacaaagacccttaaaaagttttgctgacaaagtaggtaagtgtaccttctatgaagataaacctagggctcctaaagatagtttatcagccattgagttcgtagccctaactagaataatcaacacgcttgcaaacatcacaaaacgatcaggagaagtatactcagccgataaagttagagaaatattaagtatagtactagataaaggagaaataacatataaaaacctgcgaaaggttatagcattagatgaaagattacaatttccaaaggactcaaaattagattacgcaaaggaagacgccgaaaaggccaaagcaatagagttctcaaaactcaaggcttttagaaaagcgttgggcggatcttttgaaggattcataagagctgaactagacagtatcgcaaccgatatagcactaatcaaatctaaagacgaactcaaagccaaacttgcaaactatcagagcttaaatgatgaacaaagggaaaagttaagtgaattaagtttcgataaattcatagatcttagctttaaagcattagaagcaatactacccttaatgcgaggcgataaagatgataaaatatatagatacgacgaagcatggagagaagcaggtcttgtagaggtagccaagaaaacacaaaaaggagactcactcccacctcttatagaatatgaaaaagacttagcaaaccctgtagtagcacgtgcattagcagaatatcgaaaagttcttaacgcactattaaagaaacatggaaaagttcacaaaatacacttagagtttacacgtcaagcaggagtaagttcgaaagaacgaggcgaaataatcgccgagcaaaacaaacgacttaaagcgaacgaagaggcaagaaaaagatgcgaagaatacggactaataccatcagggaaaaacatcctgaaactaaaactatggcaagaacaaggagagttctgtgtatattccggaaagaaaataacacagtcagatcttagagacgaaagcaccttacaaatagaccatatatatccatactccagatcatatgacgatagtcaaaacaataaagtattagtctttacagacgcgaaccaaaacaaattaaatcaaacaccatatgaagccttcggcaaagacatttccaaatggaatcaaatactaggacgaatagaaaaattgccaaaagcaaagaagaaccggataaccaataaaaacttcgcaaacaaagaagcaggatttatagcaagaaatatagtcgacacaagctacatcgcaagattaagtgcttcatacactgacgccttcattgaattttgtccgctagctgaaaatgaagatactacattaggcaggggagaaaagggctcaaagaaacacatatcagttgtaaacggaagcctaacagcgaccatgagacattattggggcctgaacacgctattggatggcgaaaactccgaatcaaaagacagaagcaaccacttacatcatgccctagacgctataataattgcatatgtaaatgattccgttataaaggctttctcagactttaagaaaacacaagaacagaacaaagctagattaattgcaaaagaaatagaatctgcggaatacaaaataagcagacgcttcttcagtccgagcgggtttgaaaataacgaagcattccgccaagccataaaaagaaaaatacttggacagtcacttgaaagcagagaaaacgatatgactattaactcagaagcattaggagaaaaagtaggaggaatatttgtcagcaaacccccaagaaaacgtgccagaggagcgttacacaaagaaacattctcctctatagatgataaagacttactcaaaacatacggaggaaaagaaggtgtcaacagagcaataaagctgggaaaagtaagacaaattggaagtaagatagctgacaacggaactatggtgagagtagatatattcagacacaaagtctcgggcaagttctatggagtaccaatctatactatggatttcgctttaggtattttaccaaataaagcagtagtcggcggaaaagataagtctggagttattaaagactggttaccaatggattcaaattacgagttctgcttctcattattcaaagacgacctaattttggttcagaagaaagaaatgagtaaagcagaactctgttatttcgctggattcgacactagcggcggacaaataaaagtagaaaaacacgacaaccacttcgcgactctaacagataatcaacgtctattatttaacatcgccacccccaaagaagtagcaggaaaatccatcggaatccaaaatttaaaagtattcgaaaaatggcaagttagcccattaggagaagtatccaaagcagagttcaaagaaagagaacctattgcgttaaaaagtacaccaaagagattccttcaagggtga

SEQ ID NO: 8571 - RNA, 3354 nt, synthetic construct
  misc_feature 1..3354: note = Cas9 variant
  source 1..3354: mol_type = other RNA
atgaagcacatactaggactcgaccttggatcaaatagtataggctgggcgtttgtgcaacaagattttgaaaacaagcaaggtaaaataattgcaactggaagcagaatcattccaatggaccaaggaatactaggtgattttgagaggggaaatacagtatcacaaacagccgagagaacaacataccgaagcatgagaagactaagagaacgacatttattacggcgtgaacgactacatagagtactacaccttcttggctttctgccaccacactacgacgcccaaatagacttcacaaaaagatatggaaaatttatagacaacgcggaacctaaaatagcctacaataatggaaactttatttttatgaattccttcaatgaaatggttgaagatttcaaaaaacaccaaccacaattattttacaaaaaatcaaatggagaagaaagtcgaataccatatgattggacaatctactatctacgcaaaaaagcactaagtcaaaaaataacacaacaagaactcgcatggttaatcctccattttaaccaaaaaagaggttattaccaattaaggggagaagaagaaacagagaacccaaacaaggaagtcgctttccattcgctaaaggtcgtcgatgtagaagcagaggcacctaacaaaaaaggagaaatatggtacaccataagacttgaaaatggttggatatatagaagaactagcaaaaatccgctagatgactggaaaggaaaaacaagagatttcattgtcacaacagacctaaacgacgacggaacgataaaattagacaaggaaggtaaagaaaaaaggtcgttcagagcaccagacgaaaatgactggaaccttctaaaaaaaaaaacagaacacgacatagacttctccggtaaaccagtcggaacttacatatatgatcatctgttacagaacccaaatcaaaaaataaaaggaaaacttgtccgaacaatagaaaggaaatactacaaagacgaattgaaagccatattagcaaagcagatagcactccaaccagagttattcacggaaactctattagcggactgcataagagaactataccggaaaaatgaaacacaacaacaaaatctactatcaaaagatttcctacatctattcgttgaagatataatattctatcaaagacctctatgcagcaagaaatcaacaatagccaattgcacactagaaaaaagatcctacatagacaaagaaaccaatgaacgcaaagatgcaccaataaaagtatgtgccaagagcaatccttattatcaagaattcagggtcttgcaatggttacaaaacctaagaatctacgaaatagaaaccgatagagaagtaaccgcagaattcattgaaacacctcaagactacgaagctctttttaatttcttaatgagtcaaaaagaaatcgataatgaaggactattaaaatactttttattcgcaaaaaatccacaaataaaagacaaagcggcaaaatccgaattaaaaaaatggcttacgacctatagatggaattacgtatacgacgccgcagacaatagttcaaaaaaatacccaatgaatgaaacgggatacgaattacaacgttaccttcaaaaagtcgaaggccttcctgcaaactttctcacctttgatataacatatcaactctggcacctactctacagtgtgaaagacaaagttgaattcgaaaaagcactaaaaaaattcgctaaaaaaaaacaattagataaaactagcttcgtcgactccttcaagaactttaaaccctaccccaacgagtatggaagtttttcagaaaaagcaataaaaaaactacttccattaatgcgatttggaaaccactgggacttcaatagaatagacgtaagcacgcaaaaacgaatcgacgacctaataaacggtgtcgcaaatgaagatattcgcacgataataagggaaaaagcggaaaaataccagttaaattccgaaacatgttttcaagatcttccactatggctagcacaatacgtagtctataatcgacatgcagaagctacggatatcgaaaagtggacatcagtatcagatctcgaagcctacctagaagactttaaacaacacagccttcgaaacccaatagtagaacaggtagtaacagaaacattaagagtggtcagagatatatggcaacaatacagtggaggacaagcgaacttttttgatgaaatacatatagaactagggcgagaacttaaaaagaccgcagaagagagaaaacaactttctgataaaaaccaagaaaacgaaaacacaaacctcagaataaaaaaattactcgcagaattaaaagaagatgcctcaatacaaaatgtaaggccctactcactagtacaacaagaattacttaaaatatacgaagaaggagtctttagcagcactgacgaaatagaagaagatatacaaaaaataagaaaaaaagttgagccaaccccacccgaaatacaacgatacaaactatggcttgaacaaaaatacaaaagtccatacacaggcgaagtaataagcctaaccaaactctttactgaagaatacgagatagaacacataataccgcaaagcagatattatgatgattcattatctaacaaagttatatgtgagtctgcagtaaataaattaaaaacgaatcaactaggtctagaatttatacaaaaccatcacggtgaaaaggtccgaatcaccgcaaacaaagaagtaaccatcttcaccgaggaacagtacaaggaattcgttaaaaaacactacgctaacaatagtgccaaacaacagaaactcttgctaaacgaaataccagaaaaaatggtagctcggcaattaaacgacacaagatacataagcaaatgcatttcagaaatattaagcaaaatagtacgcagtgatgaaaaagacgaaggagtaaattctaaaaacataataccctgtactggaaagatcacaactgccttaaaacaagactggggtctaaacgacgtatggaatgaactaattttaccgagattcgaaagaatgaaccaattaacgcaaacacaactatttacatcatataatgatagattacaaaaaaatctacccactgtaccaattgaatactcacaaggattccaaaaaaaaagaatcgaccaccgacaccacgcaatggacgcactagtaatagcttgcgcaactagagaacacattaattacatgaataatcaacacgcactcgacaaaagtaaagacaaaaaagagaaacaacagtctagaatcgatctacatccactatga

SEQ ID NO: 8572 - RNA, 3354 nt, synthetic construct
  misc_feature 1..3354: note = Cas9 variant
  source 1..3354: mol_type = other RNA
atgcaaaccaaaaacttgttatatacactaggattggatattggaatagctagtgtaggctggtgtgtactaggagaaaatagaattatagatttaggagtaagatgttttgacaaagccgaaacacccgatagaggagagagcttaaacaaagttagacgagatgcaagattaatgagaagaagacttagaagacgtgcgtggcggttaaccaaattagcaagactactaaaacacgcaggattaatagattcaacacgcatcgtaagagatcgacacgacggcgcagtatctccatggcagctgagggtagaaggattggacagaaaattagcacccgaagaatgggcgagagtcatttatcatatagttaaacacagagggtttcactggataagtagggcagaagaacgaaaagcagaaagtgataaaggcgaaggaggaaaagtaaaacagggactgtcagcaacaaaacaactaatggtagagaaaaattatcgttcagctgccgaaatggtactaacggagttcccaggagcacaacgtaataaaagaggagaatatacaaaagcactcagccggatattactagctgcagaacttactaccttatttgaacgtcaacaagaattaggcaatcctcatgcaggcccagatttacaaacaaaaattttaggaaatggcgaccgcaaaagcggtctcttatggatgcaaaaaccaccattatctggatcagcactattaaaaatgctaggtaaatgtacatttgaacgcgaagaatacagggccccaaaagcgtcttttactgctgaacgccatgtatggctaacaaaattaaataacctgagagtacttgttgacggtgtcaccaggccactgtcagatccagaacgtcgattagcactttcactgccatatcaacaagcatccgacttcacttataaacaattaagggctgcattatgtaaaaatggactcttaccagacagttttcagtttagtgggcttgcttatccaacaggtgcacagcagccagacggaaaagctaaaaatcctgaaaacgaccgcctagtaaaacttccagcttggcaagaatttagaaaaactttaagggatgcgggattagaaaccgagtgggaaagcattgcaggaatggccgccggtggacaaccagacttactagaccaaattggatgggtactcagcgtattcaaagacggtgatgaagtactaagggaattaaggaaaattccattaccaggtggagagaagatggtacaggcgctgagcggcgtatcattcgacacttttcacaacctaagtctgaaagcattaaggaaaatagtaccacatatggaagcaggcctgagatatgacgaagcctgcctagccgctggctatcatcattcggatttaagaaaggatacagatgagaggagtttatatttgccaccactatattctggtagaacaacagacggaaggatggtatttagagatgatatagacgtaccaagaaatccagttgtattaagagctatcaatcaagcacgtactgttgtaaactcagtagtaagaagatacggaagcccaagctcaatgcatatagaaatggcaagggatctaagtagaccttgggacgagcgcaataaagtaaaacgagcacaggaagaatatcgagatcgaaatgaaaaattaaaaatagatttcgcagcagagtatggaatcgaaccaaaatctagagagttcgaaaaatttttactttacagagaacaagggggaaaatgtgcctactcattaaaacctctagatttagaccgcgtattaagggacttgggttatgcagaagtagaccatgctctcccttattcacgttcttttgatgactcaaagaacaataaagtattggtacttgctgaagaaaatagaaacaaaggtaaccgtacaccttacgagtacctagatggtacaagtgaaagcccacgatggagagagttcaaagcattcgtcgaaactaataaagcatacagacttgcaaaaagagcaaggctactacgaaaagatttctcaggaaaaggaagtgaagaatttagagaccgcaatcttaatgatacaagatatatatcaagattctttaaaaattacgtagaaagatttttaaaacttgcagaagaatcagaagaacgaacatgcgttgtattatcaggacaattgacagcgtttctccgtgcgcgatggggcttagcgaaagtacgaggagactcagatcgccatcatgcattagatgcggcagtaatagccgcatgttccagaagtatggtaaaaagactatcggattatgcacgaagacatgaactagaaaaagtaagaacaggatttgtggactttgaaacaggagaaatcgttgatgcaggtaaatataggcaaatcgaaagggattttccgtcaccatggccgtacttccgggatgaactactaaccagattaaatacagatgatcctgcagaattaagggaaagaatgcagtcattaggatcgtatccaccagaagcattagaaacattgagaccaatgttcgttagcagagcaccacagagacgaaacgggggagctgcacataaagatactatttacaggcaaacggaaaggctaaagaaagttgggtcagttactcaaaaagtaccactagcagcgctaaacctaagagatttagaaaacttagtggaccctcacagaaacgaaaaattatacgcagctattcgggctcgactagaagcacacggcgggaaaggtgaaaaagcctttccaccaaataacccattaagaaaaccagacagagatggtaaccccacaggcccgatagtacgtacagtaacacttgtaatagacaaaatgagtggaatccctgtacggggaggcgtagctaaaaacgacactatgcttcgcgtagatatcttcagaagtaagaaagacggcaaatttcatctagttcccctctatgttcatcacgcagtagcaaaacaactacctacacgcgcagttatagcatacaaagatgaaggggaatggactccaataaataaccatgattttgactttttattcgcattatacccaaatgatctagtaagaataacactaaagaaagaaaggcattttggttattatgccggatgtaatagagcaactggtgccgtaagtatttgggcccatgatagaaaccaacgtattgggaaagacggatttatagacggaataggggtcaaaacagccttaagtgtggaaaaatttcacgtggatactttagggaatgtataccccgcgccgccagaaacaagaagaggcttagcatga

SEQ ID NO: 8573 - RNA, 3357 nt, synthetic construct
  misc_feature 1..3357: note = Cas9 variant
  source 1..3357: mol_type = other RNA
atggggacaagatatagttttgatataggaacaaactcaataggatgggcagtttggaggacagggcgagatcccaaaggtatttttggcgaaaaagacgcaccattagagttactaggagcaggcgttaggttatttaaagatggaagaaatccaaaagacgggcaatcactcgcgacaatgcgtagaataccacgtcaagcaagaaaacgacgtgatagatttgttttaagaagagaagctctagtagcagcattaatagaagctgggctaatgcctgcaagcgaaaaagaacgaaaggctctagccgatttagatccatatcaactaagagcagctggattagataaagcactagcgccacatgaactaggcagagcaatatttcacctacaccaaagaaggggtttcaaaagcaatagaaaaacagatagaaaaagtgatgatcgagacaaaggtaaaatagccacagcatcggccgcattggcaaagaaattcgaagatgaaaatgcgagaaccttcggggaatttctttggcgacgacatcgagatccagacatgaaaaggcaagcagtattaaaagcacatgacccagccaaaggaaaacctgatttaagagcagcaaaactaagacaacccaccaggataaggctagaaggacaaggagctactgcactatatgaattttatcccacgagagaaatgttatgccacgagttcgatgcattgtgggaagcacaggcccgtcaccaccccatgctattaacaagagaggctggagataaaataagaagtatcctcttcaggcaaagagaactaaaaccacctttaatcggtttatgtactttcgaatatgctgcaggcgaaaaagaaagccgtttaccaaaagcattgccctcagtccaggcaagggaaatatatgaacgacttgggcacatacgattatctaccggttcagggacagatagaccattaaagtcgagcgagagggatgatctggcaactgccttactacactgtggtttaaccaaaattaaagtatctaaaacaaagggactagcattcaaaacggagttcaggaaagctctacgtctagggggcgaagtacgaataaactttgaagaaatgggagaggagggtctagttgatctaagaaccaacagacttctagtacaagatgatcactatggaccaagatggagggcattaagctggtctggcaaagacgcttttgtgaagaaactattggaagcaaccgacgacgataaactcgttgcaagacttatgacagaagacggtctaagcgctgttcaagcaagaaacgcagccagtataccattaccagacggatactcaagattaggacccacagcaaatgctgcgatattgcaggctctaattgacagtcgagacgaaaacggatttgtcgttacatacgataaagcagtacggagagccggtgaaagattgggcaaagactggcatcattcagatgagagagacggagaaatactagatgcactaccttactatggcaaagtattgcaaagacatatacttccagggatgatggatccggcagacaggaaagacgaagcaaaattttacggaaggatcatgaatccatcagttcatataggattaaaccaattaagaagacttgtaaatgcacttatagaaagattcgggccgccagatcaaatagtagtagaactggcacgagatctaaaaatgtcagcacgagaaaaagaacaagaacaaagaagaaatagagataatcgagaagcaaacgagaaaagaactaaaaagctagtggaattgggacaggataataatggagaaaatcgagcccgattaaaactatatgatgaacaacagagagccgggaatggagtagcgcattgtccatttacgttagatcctatagggataactcagttgttcagtccagaaatagaaattgaacatgtactacctagatcaaggacactagacgactcagccgctaacaaagtattatgtttcaggaccataaaccgaataaaacgtggtaaaacaccttgggaagcatttcatgccgatccgaaatggccagacatcgcagccaatgcagaaaaactgccaccgaataaaagatggcggtttcgagaagatgcaatggatgttttcgaagcaagaacatccggcaaaatggacaaaactacattagaacaaatgggtttaacaacaggatttcaagccagacacttaaacgaaacgaaacatatgtctaggttggcaaaagcgtatttaggaaaaatatgcgaccctgatgctgtctatgttaccccgggagcattaacctcattactaaggggaaaatggggtctaaatagtatactatcagatgataacttaaaagacagaacagaccatcgacatcatgcaatagatgcaataacaataggagcaatgacaagatccttgttactagaactaaatactttagccggaaaagctgagcaaagcgattacgacgacgtagtgggaaaagttccttggccattcgacaactttagagatgcagtacgaagcgtagtagatagagtagtagtgagcaacaaaccagaacacggaaaacaaggtgctttacacgaagacacggcctatggaatcgttggtgatgaagcagaagcagaagaaataggaaatctcgtgagaagaaaattgctggtagatctaacacccggtgaagttgacaggatacgagatgcaggattgcgtaaggccatgcaagcagccgtagcaccaagccgagacgcccgaggaaaagttagtgacgcaaaaggattcgctgcagcacttgacacatttgcgaaagcacaaggcatgaggagaatacgggttggcaaagaagacatgagcgcagtaactatccacgacaggcaaactgataaggcgtataaagcagttgcaccaggggaaaatcaccatgtggacgtagttcaaatgagagatggagcatggaaaggatttgcggtcactgtgtttgaagcaaaccaaaaagatttcaggccacaatgggagagggaaaaattaggagggaagctagtaatgagactacacaagggagacgccgtagaattagaaagctccggagtacgattagtgaagtttgtacaacaaatatggatgaaatcaaatctagtattgctaactgagcataatgagggaggagatttgcagaaaagacaccaagatgcagacgatccatttagatgggattttgcaaatataggcaaattgaaagaaagaggctgtgtagcagttaaagttgatgaactaggtcgagtaacaaaaagaataagtaatacgtga

SEQ ID NO: 8574 - RNA, 3360 nt, synthetic construct
  misc_feature 1..3360: note = Cas9 variant
  source 1..3360: mol_type = other RNA
atgggatatcggataggcttagacgtaggtataacaagtacaggatacgcagtactcaaaacagataaaaacgggctaccttacaaaatattaacacttgactcagtcatataccccagagcagaaaacccacaaaccggcgcttccctggcagaaccaagacgcataaaaagaggattaagaagaagaacacgacgtaccaaatttagaaaacagagaacacaacaattatttatacattcaggactactaagtaaaccagaaatagagcaaatcctcgcaacaccacaagcaaaatacagcgtatatgaattacgagtagcaggtttagatcgacgattaacaaatagcgaattattcagagtcctctatttttttatagggcacagggggttcaaatcaaatagaaaagctgaattaaacccagaaaacgaagcagataaaaaacagatgggtcaattattaaactccatagaagaaataagaaaagcaatagccgaaaaaggatataggactgttggggaactgtatcttaaagacccaaaatacaacgaccataaaagaaataaaggttacatagacggatacctaagtacacctaacagacaaatgttagtagacgaaattaaacaaatattagacaaacaacgagaactcggtaacgaaaaactaactgacgaattttatgccacttatttattaggagatgaaaatagagcaggtatatttcaggcgcaaagagatttcgatgaaggccccggcgcaggaccttacgcaggagaccaaatcaagaaaatggtcggaaaggacatatttgaaccaaccgaagaccgtgcagctaaggccacgtatacatttcaatactttaatttactacaaaaaatgacatcattaaactaccaaaacaccacaggagacacttggcatactcttaacggattagaccgtcaagccataatagatgccgtcttcgcaaaagcagaaaaacctacaaagacctataaaccaaccgattttggggaacttagaaaattactcaaattgccagatgacgcccgatttaatctggtgaactacggtagcctacaaacacaaaaagagattgagacagtagaaaaaaaaacaagattcgtcgacttcaaagcgtaccatgacttggtaaaagtcttgccagaagaaatgtggcaaagcagacaactactcgatcatatcggaaccgctctgaccctctatagcagtgacaaaagacggcgaaggtacttcgcagaggaactaaatttacccgcagaactaatagaaaaactacttccgctaaacttctcaaaatttggacatttaagcattaaaagtatgcaaaacataataccctatctcgaaatgggacaggtctattcagaagcaacaacgaacacgggctatgactttcgcaaaaaacaaatttccaaagatacaattagagaagaaattactaatcctgttgtaagaagagccgtcaccaaaaccatcaaaatcgtagaacaaataattcgcagatatggaaaaccagatggtataaatatagaactggcacgtgaactaggtagaaatttcaaagaaagaggagacatacaaaaaaggcaagataaaaacagacaaacgaatgacaaaatagcagcagaattaacagaattaggcataccagtcaatggacaaaacataatacgatataaactacataaggaacaaaacggagtcgacccgtataccggagatcaaataccattcgaaagagcatttagcgaaggatacgaagtagatcatataataccatattcaatttcatgggacgactcctacaccaacaaagtactcacatccgcaaaatgtaacagagaaaaaggaaacaggatccccatggtctatcttgccaataacgaacaaagactcaatgcattaacaaatatagcagataacataataagaaattcaagaaaacgccaaaaattactaaaacaaaaattatctgacgaagaactgaaagattggaaacaaagaaatataaacgacacacgattcataactcgagttctatacaattacttccgacaagctattgaattcaatccagaattagaaaaaaaacaaagggtacttcccttaaatggtgaagtaacttccaaaatcagatcacgatggggctttctgaaagtaagggaagatggcgatctccaccacgcaatagatgcaactgtgatagcagcaataacaccaaaatttattcaacaagttaccaaatattcacagcatcaagaagtaaaaaacaatcaagctttatggcacgacgcagagataaaagacgccgaatacgcggcagaagcacaacgcatggacgcagatctgtttaataaaatatttaatggatttccgttgccatggcctgaatttctagacgaactcttagccagaattagtgacaatcccgttgaaatgatgaaaagtagaagttggaatacctatacaccaatagagatagcaaaacttaaaccagtcttcgtagtacgattagcaaaccacaaaatatccggtccagcacatttagataccataagatcagcaaaattatttgatgaaaagggtatagttttaagtcgagtcagtattacaaaattaaaaataaataaaaagggacaagtagcaaccggtgacggtatttatgaccctgaaaactctaataacggagataaggtcgtatattccgctataagacaagctttagaagcacataacggtagtggagaactagcatttcccgacggttatctggaatacgtagatcacggtacaaagaaattggtaagaaaagtcagagtagccaaaaaagtctcattaccagtccgcttaaagaataaagccgcagcagataatggctctatggtaagaatagacgtatttaacactggaaagaaattcgtattcgtacctatttacattaaagacactgtcgagcaagtactacctaacaaagcaatagcaagaggcaaatcattgtggtatcaaatcacagaaagcgaccagttctgcttctccttatatccaggcgacatggttcacattgagtcaaaaactggtataaaaccaaaatattctaacaaggaaaacaatacgagcgtagtaccaattaaaaacttttacggttatttcgacggagcagacatagccacagcatcgatactagtaagagcacatgatagcagctacactgctcgttctataggtattgcaggactactgaaattcgagaaatatcaagttgattacttcggtcgctaccacaaagtacacgaaaaaaaaagacaactatttgtcaaacgggatgaatga

SEQ ID NO: 8575 - RNA, 3360 nt, synthetic construct
  misc_feature 1..3360: note = Cas9 variant
  source 1..3360: mol_type = other RNA
atgaacgataagaaaaatttgggcccactaacttttggatttgatataggcattgcgagcgtaggatgggccgtgttgagtccgactagaatagtagacttgggggtacgctgtttcgacaaagctgaaactgcgaaagaaggtgaaagcctaaacttagccagacgatcagcccgtttaatgcgtagacgactgcgtagacgagcatggagattaattaaattagcaagactacttaaacatgaaggcctaatagctgataccaagacttttatacagccatcagcatcgcatgcttcaccatggcaattacgaaaagatggattagatcgggctttaagtccagaagaatgggcaagagttttatatcatttatgtaaacatagaggattccactgggtttcaagggccgaagcgagaaaagccgacggtgatacaaaaggagaaggaggcaaggtgaaacaaggattagcatcaacaacaaaactgatgaatgacaaatcttatagaacagcggcagagatggtcttagcggagttccctagtgctcaaagaaataaaagaggtgaatatactaaagcactaagccgtgaactactagacaacgaattaaaacaactatttgaaagacaaagagaatatggtaacccccatgcagatacgaatcttgaggcaaagataagaggttcaggtgatcataaaagcgggttattttgggagcaaaaaccagcactatcagggaatgaccttttaaagatgcttgggaaatgtacatttgaaaaacaggagtatagagctccaaaggccagctttacagcagaacgacacgtatggttgacacgtttaaataacttaagaattattgtcgatgggagaacacgacctttagcagatgcagaaagaacaatggcattaagtttaccatatgaacaagtgggtgactttacttataaacaactaagagctgctcttgttaaagcaggactaatgccagatagtttcaaatttgccagtctagcatatccgagtgaatttcaaaaagccgaaggtaaagcaaaagatccagaatcagcagccctgacgaagttagctgcatggcaagaacttcgagcaacacttaaaaaggcagatctagaatcagaatggcaacaaatttcttgtgcagcattagaaggacaaccagaaacattagacgaaatagccggagttttatcagtttttaaggatgacgacgaagttttaaacgaactgcaaaaacttggtttaccgggaggtgcaaagacagaaaatgcattgttagatataagattcgataagtttcatgctctctccttgaaagcattaagaaaaattgttccgtacatggagcgaggattaaggtatgatgaagcatgtgagagagcagaatatcatcattcgcaactacataaagttggagaaggaaataggaagtacttgccccctttgtataaaagcagagataaagacggacgaatggtatttaatgacgaattaggagatataccacgaaatcctgtagtcttaagaagtcttaatcaagcacgaaaagtactaaatgcacttatagcgcgctacggtagcccctcctccgtacatatagaaatggctagagaattgtcaaaaccttttgatgaacgaatgaaagtggggaaagaacaagaagcataccgggaaagaaatgagaaagacaaacaaacattcgttgcagagtttggtatagtgggagccgctaagggaggtgagttcgaaaaatggaaattatacagagaacaacaaggaaaatgtgcatattctatacaaggaatagacttaaatagactattggaaccaggatatgtggaaatagatcacgcactaccgtacagtagatcctttgatgattccaaatcaaataaagtattagtattagcagccgaaaatcgtaataaagggaatagaacgccatacgaatacctagatggagaacacaattctgaaagatggcgtcaattcgtgggtttcgtagaatcaaataaactatataggcaagctaaaagatctagactattaaggaaagactttggcaaagaacaggcagatgagttccgcgaaagaaacctcaatgatacaaggtatgtatgtagatttttcaaaaaccaagtggaacaatttttaaaacttgcagaaggatcagaaagtaaaagatgcgtagtgctatcaggacaattaaccgcattcctaagagcaagatggggattaataaaggtaagagacgaaagtgatcgacatcatgcacttgatgcagtagtagttgcagcctgtacgcatggaatggttaaaagaatgtcagattatgccaggcgaaaagaattagatcaagtagctgaaggatttgtagatgtggagacgggagagataattaatgcagcaatgtttcaacaattacacgaacatttcccagacccatggccccactttagagacgaagtacagatgcgattaaaaatagatgatcctgcacaattacgtagtgatctcctgagattagggaattatgcagaggaagacgtccatgctgtaagaccattgttcgtatcccgagctccacagcgaagaaactcaggagcagcgcataaggaaacaatatatgggcaaccagagagacttaaagcacaagggggagttacagaaaaagtcgcactaacagcattgacaatgaaagaccttgatagactaatagacccacatagaaatgaaaaattatacgctgcgattaggaagagactagaggagttcggaggtaaagcagacaaagcattcgcagcatcaaatccattacacaaaccagacaaagaaggaaatcccacaggacctatcgtcaggaccgttacattagaaatagacaaactatcaggagtaccagtgaggggaggaatagccaaaaatgatacaatgctaagagtagacgtatttaccaaagccggaaaatttcatcttgtcccagtatatgtacatcataaagtgacaggtttacctaacagagcgatagtagccagcaaagacgaagatgaatggacagcaatagatgacagttttgaatttttattttcgttgtatccgaacgatctagtcaccataacccaaaaaggaaaagccccagttcgcggatactacgcaagttgtcatagagggactggggcattttcattatgggcacatgatagggcttcctcagtcggaaaaggtggacagatagaaggaattggaataaagacggcattagcagtccaaaaatataatgtggatgttttaggaaccacatacgcagctccactagaacaaagaagaggattagcatga

SEQ ID NO: 8576 - RNA, 3363 nt, synthetic construct
  misc_feature 1..3363: note = Cas9 variant
  source 1..3363: mol_type = other RNA
atgagaaaagtaactataggattcgacattggtgttagttcagtaggatggtcagtagttgacatgaataacggagcaatagttgaaactggagttagactcttttctgcatcatcagcagaaaacaacgtagaaagacgcaataacagacaaacgagacgacttaatagaagaaggaaaaacagattaaaagacgtaaaatacttactggaaactaaccattttacatttgaccaagaacaaggaacaaatccatacgaactaagagtcgctggactccacagaaaactcacaagatcagaacttgcacgagcactatatcatttagtaaaacgaagaggcataagctatgacttgacagatatcgaagaagaagaaatagtaaccacctctgcatataaaacggcactaggtaaaaaccaaagtcaactcgcagagaaaacaccaggtgaaatccaattcgcaagacttgaaaactatggaaaagtaagaggatcaattgaaataaacgaacaagatatcttattaaatatattcccgaccagcgcatacctaaacgaagcaaaaagaatcttagcaactcaaagaaaattctatccagaaatcacagaagcattcattgaaaaatactgtacaatacttacaagaaaaagggaatattatgtgggtcccggtactgagaaaaataggacagactatggtatctaccgaacaaatggagaaacactcgataacctatttgaaatcctaatcggaaaagacaaattttaccccaatgaagaaagggcagcaggaaatagttatacagcacaattatttaacttcgtcaacgatctaaataacctaaaaattcaaacaattgaagatcaaaaacttaccccaaaacaaaaagaagaaatcattgaacaggtaaaaacggcggagaagaaagtaagtttaattcaattaatatcgaaaatcaccaaaactccaaaagaccaaataacaggataccgaaccgacaaaaatggtaaaccggatcttcattcaatggcagtattccgtaaagtaagaaaacaattcctaacaatggaaattgacatcctacattggccggacgagcttcttaatgatctaggaagattacttaccctaaacacagaaaaaggagaaataaggaaacaactaacaaaagacttcatgaaaagatatcccatactgaacgaacagctagtagatcaaattatagaaaacagacacatattcgcagtaagcggtaatcataaatggcataggttcagccttagaacaatgaatgaactgttacccgaaatgctagccacatcaaaagaacaaatgacactcctaagcgaaagaggaatgatcaaacaacacaaaagagactatttaaaaatgaacgaattagatgcaagattaataagtgaagaaatatataatcctgtagtaggaaaatcggtaagggaagccataaaacttttcaatgaactaatgaagaaatatcaagaggtacgctacgtagttttagagatgccaagggatgacaacgaagaaaaagccaagaaagaattacaaaaataccaaaaagaaaacgaaaacgaaaaagagatagccctatctgagttccaaagaaaaggctttttcagcgacgcacaattggaacgagcactaattaaagacaggaaactaaaaaccaaaataagattctggcaccagcaagaagggaaatgtttatatagtggccaaataatcacaccagtcgaactactaacaaattcattcagtttcgatatagatcacataataccccaaagtgtaagtttcgatgattcactaaacaacaaagtactatgtacaaaagaaatgaatgaccaaaaaggaaaacaaacaccgtacgggttcctcctaaacggcaatggtcaagggttcgacaggttcaaagcaatggtaaacgcaaaccgactaatgagcaaaggcaagaagaaaaatttattattcatggaagacttaaacaacatagaaacacgaaaacgcttcatagcacgaaacctagtagatactcgatacgcaagcagagtagtgttaaacgaaattcaacaatacctcagagccaaaaataaagacactcaagtagccgtcgttagggggaaattcactgctacacttagaaaacattggaacataaataaatccagagaaacgcatcaccatcacgctctagatgcaagtatcatagctatcactccattactaagcgtgtggaagaagaaacaaaccctgataccaaaaacattatcagaagaaaaattagaatttgaatatgacgacatagtagaagacacaatattcgaaaaagcactataccaactccctaaagaaaactttaaagaacaactcaacaacagccaaccaaacatcaaattttcataccaagtagacaagaaaatgaacagaaaagtaagtgatgcaactatctacagtgtcaagcaggccaaattaagctcagacaaacaatccgaagaatatgtactagcgaaaataaaagacatatattctgtcgaaggatataaaacattcgctaaaatatacgaaaaggacaaatcaaaattcctaatggcacaaaacgatcctaaaacgtttgaaaaactagaagaaataatacaatcatacccatcaaccagagaaataatcgtgggagaaaaggttaaagttgtcgacgtatctccttttgagctataccgtaaggaatacggctatataacaaagtacgcaaagaaaaacaacgggccaataatcagacaactgaaatactatgatcacaaaataggaatgcaccttgacataaccaaccagaaaaacaatggaaaagggaagaaagtaatactacaacaactcaaatcatggagaaccgacgtttattacaatcacgagaaacaagaatacgaaataatgggattaaaatacagcgaccttaggtttaagaaagaccagtacggaatacccaaagaaagataccaagaagtaaaacagatggagaaaatagcgccacaaagcgaattttgtttcagcttatacagaaatgatagaataaaagttctcaataaagaaactgatgaggaagtagaactacttttcggagcacgaaactatacaagtgccggctacgtagacttaaaacctattgatagagtagaatttggcaagaaagaatggatcccggtataccaatacgcgacatccgatggaaaatgcaagaagaaattcgccaagaaaggatacgaaatctacaaagtcaatacaaccatcctcggcgaatcatactacatcaagaaagaaagaatgttacctaaaaatatcttagattga

SEQ ID NO: 8577 - RNA, 3363 nt, synthetic construct
  misc_feature 1..3363: note = Cas9 variant
  source 1..3363: mol_type = other RNA
atgtccgatttagtactaggcttagacataggcataggaagtgtaggagtaggtatattaaataaagtcaccggcgaaataattcacaagaactcaagaatatttccagcagcacaagcagaaaacaaccttgtacgaagaaccaatagacaaggacgtcgtttaacaagaagaaagaaacatagacgagtgagactcaaccgcctatttgaagaaatcggcctaattacagactttaccaaaatctcaattaatctcaatccttaccagttaagagtaaaaggccttacagacgagctaagcaacgaggaactctttattgcactgaaaaatatggtgaaacatcgtggaatatcatatctagacgatgcaagtgatgacggtaattcgtcagtgggggattatgcacaaatcgtaaaagagaactcgaaacaactcgaaacaaaaacaccaggacaaattcaactagaacgatatcaaacatatggtcaattacgaggggatttcacagtagaaaaagacggaaagaaacaccgacttataaacgtattcccaacgagcgcgtacagaagcgaagctctccgcatattacaaacccagcaagagttcaatccacaaataactgatgagttcatcaataggtacctagaaatactaaccggaaaacgaaaatattaccatggtccgggcaacgagaaaagtagaacagattacggtcgataccgaacatccggagaaacacttgataacattttcggtatactcataggaaaatgcaccttttaccctgacgaatttagagcagctaaagcaagctatacagcacaagagttcaatcttctgaatgacctaaacaacttaacagtcccaaccgaaacaaagaaactgagcaaagaacagaaaaatcaaataatcaactatgtcaaaaacgaaaaagctatgggaccagccaaattattcaaatacattgcaaaactcctttcctgcgacgtcgcagacataaaaggatatagaatagataaatcaggtaaagcagaaatacacacatttgaagcctacagaaaaatgaaaacattagaaacactggacatagaacaaatggatcgcgaaacattagataaattagcatacgtattaacattgaacacagaaagggaaggaatacaagaagcgctagaacatgaatttgcagacggatctttttcccaaaaacaagtagacgaacttgtccaattcagaaaagcaaattcgagtattttcggcaaaggatggcacaacttctccgtaaaattaatgatggaattaataccagagctgtacgaaacatcggaggaacaaatgactatattaacacgactaggaaaacagaaaacaacatcatctagcaacaaaacaaaatacatagacgaaaaactattaactgaagaaatttacaatccagtggtagcaaaaagcgtaagacaagcgataaaaattgtaaatgcagcaataaaagaatatggagatttcgacaatatagtaatagaaatggcaagggaaactaatgaagatgacgaaaagaaagcgattcagaaaatacaaaaagcaaacaaagacgaaaaagatgcagccatgttaaaagcagcaaaccaatataatggaaaagctgaactaccacactcagtattccatggacacaaacaattagctactaaaattcgactatggcatcaacagggggaaagatgcctatacactggaaaaacaataagtatacacgatctaataaataatccaaaccaattcgaagtggaccacatattaccactttcaataacattcgatgattccttagcaaataaagttctcgtttacgctacggctaaccaagaaaaaggtcagagaaccccatatcaagcattagattcaatggacgacgcatggtctttccgagaactaaaagcattcgtaagagaatcgaaaactctatcgaataaaaagaaagaatatctgctaactgaagaagatataagcaaattcgatgtccgcaagaaattcatagaacgcaatctagtagacacaagatatgcatcacgtgtagtactgaatgcacttcaagaacacttccgcgcccataaaatcgacactaaagtatcagtagtacgaggacaattcacatcacaattacgtcgccactggggaatcgagaaaactagagacacatatcaccaccacgcagtagatgcactaataatagccgcatcaagccaacttaacctgtggaagaaacagaaaaacacattagtatcatactcagaagaccaactactagacatagaaaccggagaactaatctcagatgatgaatataaagaaagcgtatttaaagccccctaccaacactttgttgataccttaaaatcaaaagaatttgaagactcaatattattcagctatcaagtagacagtaaatttaaccgcaaaatttcagatgccaccatatatgctacacgacaagctaaagtaggaaaagataaagccgatgaaacatacgtactaggaaagataaaagatatctacacccaagacgggtatgacgcatttatgaagatttataagaaagacaaatcaaaatttttaatgtacagacatgatccccaaacattcgaaaaagtaatagaacccatactagaaaactaccccaataaacaaatgaacgaaaaggggaaagaagtaccttgtaatccatttctaaaatacaaagaagaacacggatatataaggaaatactccaaaaagggaaacggtccagaaataaaatcactaaaatactacgacagcaaactaggaaaccacattgacataacacccaaggattctaataacaaagtcgtactacaatcactaaaaccatggagaactgacgtttatttcaacaaaaacacaggaaaatacgaaatacttggactaaaatactcagatatgcaatttgaaaaaggtacaggaaaatatagcataagtaaggaacaatacgaaaatataaaagtaagggaaggcgtagacgaaaactcagaatttaaatttaccttatataaaaacgatctactcctactaaaagacagcgagaatggagaacaaatattacttcgattcacctcgagaaacgacacatcaaaacattatgtggaactaaaaccatataaccgacaaaaatttgaaggctcagaatatctaatcaaatctctaggaacagtagtcaaaggaggaaggtgtatcaaaggccttggcaaaagtaatatatctatctacaaagtcagaacggacgtattaggcaaccaacatataattaaaaatgaaggagacaaaccaaaactcgacttctga

SEQ ID NO: 8578 - RNA, 3363 nt, synthetic construct
  misc_feature 1..3363: note = Cas9 variant
  source 1..3363: mol_type = other RNA
atgggactagacataggtgtagcatcagttggattctcagtactagacatagataaaggaaaagttatagaactcggagcgagactattctcggcaacggtagccgctggaaaccaagatagaagagatatgagaggagcaaggagacttcttaatcgaaacaaacaaagacgacaagacacaggtaaactgtttaagaaatttggactaattgatgactttgataaaggatcattctacgacaacttcaatcaaaatctaaacccatacgaattaagagtcaaaggcttaaccgaacaattaaccaaagaagaactagcagaatcactatatcaaatagttaaacaccgaggaatctcatatgcgttaaaagatgcagacgtagacgaaggaggaacagattacagcgtgagcttaaaaattaatagccaggaacttgctgaaaagactccagcgcaaattcaactccaaagattaaacgattacggaaaagtgcgtggacaagttgtaattggagatgacccagacaatcaaaaagtattattaaacgtctttcctacatcggcatatgaaaaagaagcaaaacaaatcattgccacacaacagcaattctacccagaaagtcttacagacaaatttacagaagaatactgccaaatattaacgagaaaacgagactactttgtaggcccaggcaacgaaaagagtaggacagactatggaatatataaaacagatggaagaacattagacaatctatttgaagaattaattggacacgataaaatatatccagaagaattaagggcaagtgcagcaagctacactgcacaactcttcaacgtcctcaacgatcttaacaacctacgcatattaaactacgaagatggaaaactaactaaagaagacaaagagaaaataatagccgaaatcaaaaataacacaacaacaataaacatgctaaatgtaataaagaaagtagccggatgctcaaaagacgacataaaaggatttagagtgaacgaaaaagataaacctgaaatatcaagtatgcctgtatacagaaaaattcataaagacctactcaaagccggagttgatatatccgactggccggtggagttcatagacgaactatcattcatattaacactcaacacagaaaacggagaaataagaaaacaattaaataaccgactcgcaccaaaattcgactttctaaatgcagacctaattcaactaattatcgacaataaagattcgtttgaaataaaaacaaataacaaatggcacagatttagcgtgaaaacaatgaacaaactcataccagaaatgatggaaagaccagtagaacaaatgacactcctcaatgaaatgggattggttaagaaagacaagaaaaggttcgaaaataacaaatacttgccatacaaagaaatagcaaaagacattttcaatccagtcgctagcaaatcagtaagagaagcactaaaaattgtgaatgctgtgctaaagaaatacggacatatagactacctagtagtagaaatgccacgagacaaaaatctgaaagaagaacaagacaacataaaagagttccaaaataaaaacaagaaagcaaaagacgcagcattcgaagcatttgttaaatcagtaggaagtgaacaacgcgtaaaagaggctttaagcaaaaatagaaaattacagatgaagatgagattatggtaccaacagcaagaaatagacccatacaacggtaaaacaatcgacgccacagacctaataaacaaccccgataaattcgaaatagatcacatcattccccaatcaatatcattttatgatagcataaacaataaaacactatgcttcgcaagtatgaatcaagtgaaaggacagaaaaccccatacgagttcatgctagaaggccacggacaaagctatgacaaattcaaagcaaccgtaatggcgaacaaaaattttgggaaagctaaacgagcgaactacctatttgaagaaaacgtaagcgatatagaaacaagaaagagatttttatcacgaaacttggtagacacaagatacagtagcagggttgtgcttaattccttacaggactttttcagagagaaaagcgcagatacgaaagtaacagtaataagaggaaaatttacctccaatatgagaaaacattggcacatagataaaaccagagaaacgtttcatcaccatgcaatagacgcaagtataatagcagcaacaccatttttaagaatgtggaagaaaggaggaaccatattccccgtaaaagttggtgaagaatcaatagatatagaaacaggagaaattctagatgacaaaaactttgataaagcaatgtatgaagaaccatactcaggttttgtatcagaaatcatgaacgcagacgacagaataaaattcagtcatcaggtagacaagaagatgaacagaaaggtctcagacgcaactatctattctactagaaccggcaaactagcaaaagacaaaaaggacgcagagtacatagtagcaaaagttaaagatatctactcagtagacggattcaagaaatttaagaaagtctacgataaagataaaacaaaatttttactctataaatatgacccaagaacattttcaaaactagaacgtataatatcagattgcccagacaaagtcgaaaaggtacagacaaatggaaaagttaaagctgtggacatctcaccgttcgaaatgtataggagagatcatggaatgataaagaaatattcaaagaaaggtaacggaccagctataaaacagttaaaatacctggacaagaaattaggatcacacatagatataacaccggcaaacgccaatggcaaacacgtgatattacagagtctaaaaccttggagaacagatgtatatctaaaccacgaaactggtgaatacgagataatgggaatcaaatattcagacctgaaattcaataaaaatgaaggctacggtatcaaaaaggacaaatatctcgaaataaagaaagtagaagaagtatcagagaaaagcgagttcatgttttcattataccgaaaagaccgtgtaaaagtgcaggacatgaaaaccggggaatcagtagaactactattctggtctcgaaatttcagcaacaagaaatatgcagaattaaaaccaatctcacaagcggaaaacgacaagaaactaccagtatatggtaaaggaagactaataaaaaggctaatacctaaaaattgtaaaatatggaaagtaaacacaacaatattaggcgatccatactatttagaaaaagaatcagattcacccaaagacatattagactga

SEQ ID NO: 8579 - RNA, 3366 nt, synthetic construct
  misc_feature 1..3366: note = Cas9 variant
  source 1..3366: mol_type = other RNA
atgtccgatctagttctaggtctcgacataggaataggtagcgttggtgtcggcatattaaataaggtaacaggagagattatccacaaaaattcccgaatattcccagctgctcaagcagaaaacaatctagtaaggagaacaaatcgacaaggaagaagactcacaagacgaaagaagcatagaagagttcgactaaatagacttttcgaagaatcaggattaataacagacttcacaaaaatatcaatcaatctaaatccataccaactgagagtaaaggggttaacggacgaactttcaaacgaggaactattcatagcattgaaaaacatggtaaagcaccgaggaatatcatatttagacgatgcttcggatgacggaaatagcagtatcggagactacgcacaaatagttaaagaaaattccaaacaactagaaaccaagacaccaggacaaatacaattagaaagataccaaacatacggacagctaagaggagactttacagtagaaaaagacggaaagaaacaccgacttataaacgtctttccaacaagtgcatacagatcagaagcgttaagaatattacaaacacaacaagagttcaacccacaaatcacagacgagttcgttaataggtatctagaaatattaactggaaaacgaaaatactaccatggaccaggaaacgaaaaatcaagaacagattacggacgataccgaacaaacggagaaacattagataatatattcggaatactcattggaaaatgtactttttacccagacgaatttagagcagcaaaagcctcatacacagcccaggaatttaatcttctaaacgatttaaacaatttaacagtcccaacagaaactaagaaactatcaaaagaacagaaaaaccaaataataaactatgtcaaaaatgaaaaagcaatggggccagctaaactcttcaaatatatagcaaaactactatcatgcgacgtagcagacataaaaggatatcgaatagacaaatcgggcaaagcagaaatacatacattcgaagcatatagaaaaatgaaaacactagaaactttagacatagaacaaatggatagagaaaccctagataaattagcgtatgtattaacactcaatacagaaagggaaggaatacaagaagccctagaacatgaatttgccgacggtagcttttcacaaaaacaagtagatgagctagtacaattcagaaaagccaacagcagcatattcggcaaaggttggcacaatttctccgtaaaattaatgatggaactcataccagaactatacgaaaccagtgaagaacagatgacaatattgacaagactaggtaaacaaaagactacatcatcttctaataaaacaaaatatattgacgaaaaactcctaacagaagaaatatataacccagtagtagcaaaatcagtcagacaagctatcaagattgttaatgcagcaataaaagaatacggagactttgataatatagtaattgaaatggcacgagaaacaaatgaagacgacgaaaagaaagcaatacagaaaatacaaaaagcaaataaagatgagaaagatgcggccatgctaaaagctgcaaaccagtataacggaaaagctgagctacctcactccgtctttcacggacataaacaactagcaactaaaatcaggttatggcaccaacaaggagaaagatgtttatacacgggaaaaacaatatcaatacatgacctaattaataatagcaaccaatttgaagtcgatcatatactaccgttatcaataaccttcgatgattccttagcaaacaaagtcttagtatacgcaacagcaaatcaggaaaaagggcaaagaacaccttatcaagccctagacagtatggatgacgcatggtccttcagggaactaaaagccttcgtaagagaatccaaaactttatctaataaaaagaaagaatacttactcactgaagaagacatatcaaaattcgacgtaagaaagaaatttatagaaagaaacttagtcgatacaagatacgcgtcaagggtagtactgaatgcattacaagagcacttcagagcccacaaaatagatacaaaagtatccgttgtaagaggacagttcacaagccaactcagaagacattggggaatagagaaaacaagagacacataccatcaccacgcagtcgacgcgctaataatcgcagcatcctcacaattaaacctatggaagaaacagaaaaacactctagtgtcatattccgaagatcaactattagacatagaaacgggagaattgatttcagacgatgaatacaaagaatttgtgtttaaagctccctaccaacacttcgtagatactcttaaaagcaaagaatttgaggactcgatactcttctcttatcaagtagatagtaaatttaaccggaaaattagtgatgcaaccatatacgcaaccaggcaagccaaagtaggaaaagacaaagcagatgaaacatacgtcttaggaaaaataaaagatatttacactcaagatggatacgacgcttttatgaaaatttataaaaaggacaaaagtaaattcctaatgtaccgacacgacccccaaactttcgaaaaagttatagaacctatattggaaaattatccaaacaaacaaatgaatgaaaaaggaaaagaagtaccatgcaacccatttctaaaatataaagaagaacacggatatatacgaaaatacagtaagaaaggcaacggaccagaaatcaagagcttaaaatactatgattcgaaactaggaaatcatatcgacattacaccaaaagatagcaacaacaaagtagtcctccaatcagtatccccatggagggctgacgtctattttaacaacacaacagggaaatacgaaatactaggacttaaatatgctgatctacagtttgaaaagggtacgggcacatacaaaatatcacaagaaaaatacaacgacataaagaagaaagaaggtgtcgattcggactcggagtttaaatttacactatacaaaaacgacttacttttggtaaaagaaacggagacaaaagaacaacaactattcagatttcttagccgtactatgcccaaacaaaaacattacgtagaattaaaaccatacgataaacaaaaatttgaaggaggcgaagcactaataaaggtacttggaaacgtagcaaacggaggacaatgcataaagggattagggaaaagtaatatatcaatatataaagtccgaacagacgtactaggtaatcaacacataatcaaaaacgaaggagataagcccaaattagacttctga

SEQ ID NO: 8580 - RNA, 3366 nt, synthetic construct
  misc_feature 1..3366: note = Cas9 variant
  source 1..3366: mol_type = other RNA
atgaacggtttagtgctaggattagacatcggcattgcgtcagtcggagtaggtattctagagaaaaattcaggtaaaatcatacacgcaaacagtaggctatttcccgcagccaccgcagacaataacgtagaaagacgaaagaatcgacaagcaagaagattaaatagaagaaagaagcatagaggcgtaagattccaagacctatttgaagactacgggttactaacggacttctcaaaagtaagtataaacttaaacccatatcgattaagggttgacggactcaacaaacagctaacaaacgaagaactatttattgcgttaaagaacatcgttaaaagaagaggaataagttacctagacgacgctagtgaagatggcggaacggtatctagtgactatggaaaagcagttgaagaaaatcgaaaattattagcagaacagacgcccggacaaatacaattagaacgatttgaaaaatatgggcaacttaggggagattttacagtagtagaaaacggagaaaagtgccgcttaattaatgtatttagtacaagtgcatacaagaaagaagccgaaagaatactgaggaaacaacaagagttcaattcaaaaattacagatgagttcatagaagattatctaaaaatattaactggtaaaagaaaatattatcacggacctggaaatgaaaagtcaagaacagactatggaagattccgaaaagacggtactaccttggacaacatttttggcatactaataggaaaatgcacattctatcccaacgaataccgtgccagtaaagcgagctataccgcacaagaatttaacctactaaatgatttaaataacctaagcgtaccaactgaaacaaagaaactatcagaagaacaaaagaaaacaatcatagaatacgcaaaatcagccaaaacactaggagcatccacattgctcaaatatatagctaaaatgatagatacgtccgtcgaccaaataagaggatacagagttgatgttaataacaaaccagaaatgcatacattcgaagtctatcgaaaaatgcaatcactagaaacaatcagtgtaggagaattaagcagaaatgtcttagacgaattagcccatatactaacactaaatacagaaagagaaggaattgaagaagccattaacacaaaactaaaagactcattttcccaggaccaagtccttgaattagtccaattcaggaaaaacaactcatcactattttccaaaggatggcataacttctcccttaaattaatgatggaactgattcctgaactttacgaaaccagcgaagaacaaatgacaatattaactcgcctaggaaaacaaaaatcaaaggaaacaagtaaaagaagtaaatatatagacgaaaaagaactaacagaagagatctataatcccgtagtagcaaaatctgttaggcaagcaataaagataataaatgaagcgacaaagaaatatggaatttttgacaacatagtaatagaaatggcacgagaaaatgacgaagaagatgccaagaaagattatatcaaaagacaaaaagcaaaccaagacgagaaaaacgctgcaatggaaaaagccgcatttcaatacaatggcaagaaagaactaccagacaacatattccatggacacaaagaattagcaacaaaaataagattatggcaccaacaaggagaaaaatgtctatacacaggaaaaactataccaatttcagatctaatacataatcaatataaatacgaaatcgaccacgtcttgccgctaagccttagttttgatgacagcttatcaaacaaagtacttgtactagcaacggccaaccaagaaaaaggtcaaagaacaccattccaagccttagattcaatggatgatggatggtcatatagggaatttaaaagctacgtaaaagaatcaaaactattaggcaataaaaagaaagaatatttactgacagaagaagatataagcaaaatagaagttaaacaaaaattcatagaacgaaacctagttgacaatagatactcatcaagagttgtattgaacgccctacaagacttctacaaagcccacaaatttgacacaactataagtgtcgtaagaggacaattcacaagtcaactcaggaggaaatggggtctagaaaaatcaagagaaacataccatcaccacgcagtagacgcactaatcatcgcagcaagtagccaacttcgtctatggaagaaacacaataacccattaatcagttacaaagaaggtcgattcatagacagcgaaacaggcgaaataatatcgctgtcagacgatgaatataaagaattagtatttaaagctccatatgatcacttcgtagataccttacgatcaaaaaccttcgaagacagcatactatttagttatcaagtcgacagcaaatataatcgaaaaatatctgacgcaacaatatacgcaacgcgaaaagccaaactcgacaaagacaaaagtgaagaaacatacgtactcggaaaaatcaaagatatctattcacaagctggttacgacgcatttattaaaatatacaacaaagacaaatcaaaatttttgatgtaccacaaagatcctcaaacatttgagaaagtaattgaagaaatactaaggacatatccttcaaaagaactaaatgataagaacaaagaaataccatgtaacccgtttgaaaaatacagacaagaaaatggaccgattagaaaatactccaagaaaggcaacggaccagaaataaaaagcatgaaatactatgataaaaacatacctgaatccttcataaatattactccatctaacagtaataacaaagtactcttaagacaactgtacccctggagaacagacgtatatttcaatccccagactgataaatatgaattgcttggactaaaatatgcagacctacaatttgaaaaagcaaccggaaaatacagtataacaatagataaatataacgaaatcaaagaaaaggaaggagtatcgaaagaatcagagttcaaattcacgctgtacaaaaatgacctcttactcataaaagacaccaaaaataatgaagaacaaatattcagatttttaagccgaacaatgccaaaccaaaaccattacgtggaactaaaaccatacgacaaaggaaacttcgaaggtaaagagaaaataaaagtgttcaaaatgacctcgaatggacggtgtataaaaggtctaggcaaaaagtatttgtcaatatacaaagtaaaaacagacatcttaggaaacaaacacttcattaagaaagaaggagacgaaccaaaacttaaattttga

SEQ ID NO: 8581 - RNA, 3366 nt, synthetic construct
  misc_feature 1..3366: note = Cas9 variant
  source 1..3366: mol_type = other RNA
atgaatgggctagttttgggtctcgatataggaatagctagtgtcggggtcggaatactagagaaaaattcaggaaaaataattcacgctaacagccgactgtttcctgccgcaacagcagacaacaatgtagaaagaaggaaaaacagacaagcaagaagactaaatagaagaaagaaacatagaggagtacgatttcaagacctattcgaagattacggattattaactgacttttccaaagtaagcataaatctcaacccatacaggctcagagtggacggattaaaccaacaattaacaaacgaagaactattcatagcactcaaaaatattgtaaaacgacgagggatatcatacctagacgatgcatccgaagacggaggcgctgtaagctctgattacgggaaagctgtagaagaaaatcgaaaattattagcagaacaaacaccagggcaaattcagttggaaagatttgaaaaatatggtcaagtccgcggagactttaccgtagtggaaaacggagaaaaacgacgcctaataaatgtcttcagtacttctgcgtatagaaaagaagccgagaaaatattacgcaaacaacaagagttcaacaatcaaatcacagacgaatttattgaagattatctaaagatattaacaggcaaacgaaaatactaccacggaccaggaaacgagaaaagccgaacagattacggacgattcagaacagacggaacaacacttgacaacatctttggagtactaatcggcaaatgtacattctatccaaacgaatacagggcctcaaaatcgagttatacagcacaagagttcaatttacttaacgatctaaacaacttaacagtcccgacagaaaccaagaaacttagtgaagaacaaaagaaagtaatagtagaatacgcaaaagaagctaaaacactcggcgcctcaacattactcaagtacatcgtaaaaatgatcgatgcttcagtagatcaaatatccggatatagagttgatgttaataacaaacccgaaatgcatacttttgaagtatatagaaaaatgcagtcactggaaacaatatcagtcggtgaattgtcaagaaacgtactcgacgaactcgctcacatattgacactgaacacagaacgggaaggtatcgaagaagcaataaactcaaaactaatgggcgtctttagtcaagatcaagttttagaattagtccaattcaggaaaaataacagttcactcttttcaaaaggttggcataatttttcacttaagttaatgatggaactgataccagaactatatgaaacaagtgaagaacaaatgacaatattaactagactcggcaaacaaaaatccaaagaaacaagcaaaagaacaaaatacatagacgaaaaagaactaaccgaagaaatatacaacccagtagttgcaaaatcagttagacaagccataaaaataataaacgaagccacgaaaaagcatggaattttcgacaacatagtaatagaaatggccagggaaaataacgaggaggacgcaaagaaagactacattaaaagacaaaaagctaatcaagacgagaaaaacgcagcaatggaaaaagccgcatttcaatacaacggcaagaaagaactacccggaaatatcttcaatggccacaaagaattagcaacaaaaataagattatggcatcaacagggagaaaaatgtttatacacaggaaaaacaatcccaatatctgacttaatccacaaccaatacaaatacgaaatagatcacatattaccattaagtttatcatttgacgattctttatcaaataaagttctagtacacgccacagctaatcaagaaaaagggcaaagaacgcctttccaagccctagacagcatggacgacgcttggagttatagggagttcaaatcttacgtaaaagaccttaaatcactatcaaacaaaaagaaagattatctactaactgaagaagacatcagtaaaatagaagtcaaacaaaaattcatagaacggaatctcgtagacacacgttatagctcacgtgtggtattaaacgcgctacaagacttttacaaatcacatcaatttgatacgacaattagcgtggtaagaggtcaattcacgagccaactccgaagaaagtggggcctagaaaaatcaagagaaacataccatcaccatgctgttgatgctctaataatagcagcaagttcgcaattaaggttatggaagaaacaaaacaaccccttaataacatacaaagaaggccaatttattgactcccaaacaggtgaaatcattagcttaacagatgacgaatataaagagctagtattcaaagcgccatacgatcatttcgtagacaccctgcactcaaaaacattcgaagacggaatactattttcatatcaagtagattctaaatacaatagaaaaatatcggacgccacaatatacgccacacgtaaagcaaaattagataaagataaaagtgaagaaacctacgtacttggtaaaattaaagacatctactcccaagccggatatgatgcattcatcaaaatatacaacaaagacaaacgaaaattccttatgtaccataaagatccacaaacatttgaaaaagtaatcgaagaaattctaagaacctatcctagtaaggaaaggaatgacaaaaacaaagaagtaccatgtaacccctttgaaaaatatagacaagaaaacggacctataagaaaatacagtaagaaaggaaacggaccagaaataaaatgtcttaaatattatgataataaactaggaaattacattgatatctcaccagacggatccgacaaccaagtagtacttcagtccctcaaaccatggagaaccgacgtatattttaaccaccaaacaaagaaatacgaattaatgggtctcaaatattcagacctgtcttttgaaaaaggaagtgggaaatactcgatcagcaacgaaaaatataactccataaaaaggattgaaggagtaaatgaacagagtgagtttaaattcactttatacaaaaacgatctaatccttatcaaagatagcgaaaataacgaacaaaaattattccgatttaactcaaggaacgacactgcaaaacactatgtagagcttaaaccctacgataaagcaagattcgacggacaacaagaactaataaccatcctgggaaatgtagcaaaaggagggcaatgcttgaaagggttaaacaaatcaaacataagtatattcaaagtaaaaacggatgtactaggaaagaaacacatcattaaaaaggaaggggatgaaccaaaattaaaattctga

SEQ ID NO: 8582 - RNA, 3366 nt, synthetic construct
  misc_feature 1..3366: note = Cas9 variant
  source 1..3366: mol_type = other RNA
atgtctgacctagtacttggactcgacataggaataggaagtgtcggcgtaggaatattaaacaaagtaactggagaaattatacacaaaaactcaagaatatttccagcagcccaagccgaaaataatctagtccgaagaacaaacagacaaggaagaagacttacccgcagaaaaaaacaccgcatagtcagactaaacagactattcgaagaatcaggattgatcacggactttaccaaaatcagcataaacttaaatccataccaattacgagtaaaaggtttaactgatgaacttagtaacgaagaactgtttatagctctgaaaaacatggttaaacatagaggaattagctacttagatgacgcctcagatgacggtaattcatcagtaggagattacgcgcaaatagtcaaagaaaacagcaaacagctagaaacaaaaacaccaggtcaaattcaactagaaagataccaaacatatggccagctaagaggcgactttacagtcgaaaaagatggcaaaaaacataggttaatcaacgtatttcccacatccgcctacaggagcgaagctctccgaatcttgaaaacacaacaagaattcaaccctcaaataacggacgaatttatcaataggtaccttgaaatattaacgggcaaaagaaaatactaccacggaccgggtaatgaaaaatcacgaaccgattacggaagatatcggaccaacggcgaaacactagacaacatattcggaatattaataggtaaatgtacattttatcctgaagaattcagagcagcaaaagcctcatacacggcacaagaatttaacttattaaacgacctgaacaacttaacggtcccaactgaaaccaaaaaactctccaaagaacaaaaaaaccaaattataaattacgtcaaaaacgaaaaagcaatgggcccagcaaaactatttaaatatatcgcaaaactcctaagttgcgatgtcgccgacataaaaggatacagaattgacaaatcaggaaaagcagaaattcacactttcgaagcatatagaaaaatgaaaactcttgaaacactagatattgaacagatggacagagagacattagataaactagcatatgtactaacacttaacacagagagagaaggaatacaagaagcattagaacacgaatttgcagatggctccttctcacaaaaacaagtagacgagttagtacagttccgaaaggcaaactcatcaattttcggtaaaggctggcacaacttctcagtaaagttaatgatggagttaataccagaattatacgaaaccagcgaagaacaaatgacaatccttacacgtctaggaaaacaaaaaacaactagctcttcaaacaaaacaaaatacatcgatgaaaaattactcacagaagaaatctacaatccggtagttgcaaaatccgttagacaagccataaaaatagtcaacgctgccataaaagaatatggagactttgacaatatagtaatcgaaatggctagagaaacaaatgaagatgacgaaaaaaaagccatacaaaaaattcaaaaagctaataaagacgaaaaagatgctgctatgttaaaagcagcaaaccaatacaatggaaaagcagagttaccccacagcgttttccacgggcacaaacagctagcaaccaaaatcagattgtggcaccagcaaggagagcgatgcttatacaccggaaaaactataagcatccacgatctcataaataaccctaaccaattcgaagttgaccatatcttacctctatctattacatttgacgactcactagcaaataaagtattagtatacgcgacagccaaccaggaaaaaggacaaagaacaccataccaagcattagacagcatggacgacgcatggtcctttagagaattaaaagcattcgtacgagaaagtaaaacgttatcaaataaaaaaaaagagtacctcctaacggaagaagatataagcaaattcgacgtacaaaaaaaatttatagaaaggaacctagttgacacaagatatgcctcacgtgttgtattaaatgcactacaagagcacttccgagcacataaaattgatactaaggtatccgtcgttagggggcaatttacatcacaattaagaagacattggggtatagaaaaaacaagagatacatatcaccaccacgcagttgatgcactcataatcgccgcgtcctcccaactaaatctgtggaaaaaacaaaaaaatacactagtatcatactcagaagaccaattactcgacatagaaaccggagaactgatatccgacgacgaatataaagaaagcgtctttaaagcaccttatcaacacttcgttgacacattaaaatcaaaagaattcgaagacagcattttattttcctaccaagtcgactcaaaattcaacaggaaaataagcgatgctacaatatacgcaacgagacaagctaaagttggaaaagataaaaaggacgaaacttacgttctcgggaaaataaaagatatatatacccaagacggatacgacgcattcatgaaaatatataaaaaagataaatcaaaatttctcatgtacagacatgaccctcaaacatttgaaaaagttatagaaccaatccttgaaaattatccgaataaggaaatgaacgaaaaaggaaaagaagtaccctgcaatccattcttaaaatataaagaagaacacggatacataagaaagtattcaaaaaaaggcaacggacctgaaataaaaagcctgaaatattacgactcaaaactcggaaatcacatcgacataacaccaaaaaatagtaacaataaagtcgttcttcaatcagtttccccatggcgagcagacgtatacttcaataaaactacaggaaaatacgaaatattagggctaaaatacgctgacctacaattcgaaaaaggcacaggtacatataagatatcacaggaaaaatacaatgacataaaaaaaaaggagggtgtagactcagattccgaattcaaatttactttatacaaaaatgatcttttactagtaaaagacacagaaacgaaagaacaacagttatttagatttctctcacgaaccatgccaaaaaaaaaacattacgtcgaattgaaaccatatgataaacaaaaattcgaaggcggagaagcactaattaaagtcctaggcaacgttgctaactcaggacagtgcataaaaggacttgcaaaaagcaacatatcaatatacaaagttcgaacagacgtacttgggaaccaacatattataaaaaacgaaggagataaaccaaaactggatttttga

SEQ ID NO: 8583 - RNA, 3366 nt, synthetic construct
  misc_feature 1..3366: note = Cas9 variant
  source 1..3366: mol_type = other RNA
atgagtgaccttgtattaggtctggatataggaatcggttcggttggtgtcggaatattaaacaaagttacaggagaaataattcacaaaaacagtcgtatcttcccggcagcacaagcagagaacaacctagtaagaaggacaaacagacaaggtagaagattgacaagaagaaagaaacacagacgagtacgattaaacagattattcgaagagagcggcctaattacggattttacaaaaatctcaataaatctaaacccgtatcaattaagagtcaaaggattaacagacgaactctccaacgaagaactattcatcgcactcaaaaacatggtaaaacatcgtggcatatcatacctagatgatgcatccgatgatggtaactcatcgataggtgattatgctcaaatagtcaaagaaaattcaaaacaacttgaaactaaaacaccaggacaaatacaacttgaacgatatcaaacatacggacaactccgtggagattttacagtagaaaaggacggcaagaaacacaggctcataaacgtatttccaacgtcagcttatcgaagcgaagcattacgaatactacaaacacaacaagaatttaatcctcaaataacagacgagttcataaaccggtatctagaaatactaacgggtaaaagaaaatactatcacggcccaggaaacgaaaaatcaaggacagattacggaagatatagaacttctggagaaacccttgataacattttcggcatcctcataggaaaatgtacattctacccagatgaatttagggccgccaaagcctcctataccgctcaggagttcaatctacttaacgacctaaataacttaacagtaccaactgaaaccaagaaactatctaaagaacagaaaaaccaaatcataaattatgttaaaaacgaaaaagctatgggacccgcaaaactattcaaatatatagcaaaactattaagctgtgatgtcgccgacataaaaggatatcggatagataaatcaggaaaagcagaaatacatacatttgaagcatatcgaaaaatgaaaacacttgaaacactggatatagaacaaatggaccgtgaaactctagacaaacttgcatacgtcctcacactcaatacagaacgagaaggaatacaagaagcattagaacacgaatttgcggatggttcgttctcacaaaaacaagtcgacgagctagtacaatttaggaaagcaaacagttcaatcttcggaaaaggctggcataattttagcgtaaaacttatgatggaacttataccagaattatatgaaacttcagaagaacaaatgacaatactcacaagattaggaaaacagaaaaccacaagttcaagtaacaaaacaaaatacatcgacgaaaaactgcttactgaagaaatctataatccagtagtagcaaagtctgtgagacaagcgataaagatagtcaacgcagcaataaaagagtatggagattttgacaacatagtaatcgagatggctagagaaactaacgaagacgacgagaaaaaggcaatacagaaaatacaaaaagcaaataaagatgagaaagacgcagccatgttaaaagcagcaaaccaatacaacggaaaagcagaactcccacattcagtattccatggtcacaaacaactagcaactaaaataagattatggcatcaacagggcgaaagatgtctatataccggaaaaacaatctcaatacacgatcttataaacaatagcaatcaatttgaagtagaccacatactgccattaagcataacattcgatgattcattagcaaataaagttctagtatatgcaactgctaaccaagaaaagggccaacgaacaccatatcaagctctagactcaatggacgatgcgtggtcattcagagaattaaaagcattcgtaagagaatcaaaaactctttctaacaaaaagaaagaatatctgttaacggaagaagacatctccaagtttgacgtaagaaagaaattcatagagagaaacctggtcgatactagatacgcgtcacgagtggtactaaatgcgttacaagaacactttagagcacataaaatagacacaaaagtatcggttgtaagaggacaatttacttcacaactaaggcgacattggggaattgagaaaacgcgtgacacatatcaccaccatgccgttgacgcactaatcatcgctgcctcatcccaactcaatttatggaagaaacagaaaaatacactcgtcagctacagtgaagaccaactactcgatatagaaacaggagaattaatatccgacgacgaatataaagaatcagtattcaaagctccttatcaacacttcgtcgacacactcaaaagtaaagagttcgaagactcaatattattctcttaccaagttgactcaaaattcaaccgtaaaataagcgacgccactatttacgcaacaagacaagcaaaagttggaaaagacaaagcggatgaaacttacgtactaggtaaaataaaagatatatacacacaagatggatatgatgcattcatgaaaatttataagaaagataaaagtaaattcctaatgtacaggcacgacccacaaacattcgaaaaagtaatagaaccaattctagaaaattaccccaacaaacaaataaacgaaaaaggaaaagaagtaccatgcaatccattcctaaaatacaaagaagaacatggatacatcagaaaatattccaagaaaggtaatggaccggaaattaaatcattaaaatattatgactctaaactaggaaaccacatagacataacaccaaaagatagcaacaacaaagtagttctacaatctgtgtccccatggagagcagatgtctactttaataaaactactggaaaatacgaaatactaggattaaaatacgcagatctccaattcgaaaaaggaacaggaacgtataaaataagccaagaaaaatacaatgatataaagaagaaagaaggcgtggactctgacagcgagttcaaatttacactatataaaaacgacttattattagtaaaagacacagaaaccaaagaacaacaactattccggtttttatcaagaacaatgccaaaacaaaaacattatgtagaactaaaaccttatgacaaacaaaaattcgaaggcggagaagcactaatcaaagtcctaggcaacgtagccaacagtggacagtgtaagaaaggactaggaaaaagcaacatatcaatctacaaagtcagaacagatgtgttagggaatcaacatatcattaaaaacgaaggagacaaaccaaaactagatttttga

SEQ ID NO: 8584 - RNA, 3366 nt, synthetic construct
  misc_feature 1..3366: note = Cas9 variant
  source 1..3366: mol_type = other RNA
atgtcagatctagtcctaggactagacattggaataggaagcgtaggcgtcggtattctaaacaaagtaacaggagaaattatacataaaaattcccgaatatttccagcagcccaagcagaaaataatttggtaagaagaacaaatcgacaaggaagaagattaaccagacgaaagaaacacaggagagttcgattaaatagactatttgaagaaagcggactaataacagatttcaccaaaataagtataaacctaaatccataccaactacgcgtcaagggactaacagacgaattatccaacgaggaactattcatagccttaaagaacatggtaaaacaccgaggaataagttatctagacgatgctagcgatgacggaaacagctcagtaggtgattatgcacaaatcgtaaaagaaaactcaaaacaattagaaacaaaaacacccggacaaattcagctagaaagatatcaaacatatggtcagttacgaggagacttcacagtagaaaaagatggaaagaaacacagactaataaatgtatttccaacctcagcctaccgaagtgaagcactaagaatcctacaaacacaacaagagttcaatccacagattacagacgagttcgttaacagatacctcgaaatcctaactggaaaaaggaaatactatcatggacctggcaatgaaaaatctcgaacagactacggaagatacaggacaaacggagaaacactagacaacatatttggaatattaataggaaaatgtacattttaccctgaagaatttagggcagcaaaagccagttacacagcgcaagaatttaatctattaaacgatttaaacaacttgaccgttccaactgagacaaagaaactaagtaaagaacaaaagaaccaaatcatcaactatgttaaaaacgaaaaagcaatggggccggcaaaactatttaaatatatagcaaaactactaagctgcgacgtagctgatataaaaggatatagaatagataaaagtggaaaagcagagatacacacgtttgaggcttaccgcaaaatgaaaacactcgaaacactagacatagaacaaatggaccgagaaacactcgataaactagcatatgtattgacactaaacacagaaagggaaggcatacaagaagcacttgaacacgagttcgctgacggaagtttcagtcaaaaacaagtggacgaattggttcaattccgtaaagcaaatagtagtatatttggaaaagggtggcataatttttcagtaaaattaatgatggaattaatacccgaactctatgaaacaagcgaagaacaaatgacaatattaaaacgactaggaaaacagaaaacaacatccagtagcaataaaacaaagtacatagatgaaaagctacttacagaagaaatttataacccggtagtagcaaaatcaataagacaagcaatcaaaatagttaacgcagcaataaaagaatacggagacttcgacaatatagtaatcgaaatggcaagagaaacaaacgaagacgacgagaaaaaggcaatacagaaaatacaaaaggctaataaagatgaaaaagacgcagcaatgttgaaagcagccaatcaatacaacggcaaagcagaattgccacactcagtatttcacggccacaaacaactagcgacaaaaatacgattatggcaccaacaaggggaacgttgcctatacacaggaaaaactataagcatccatgatctaattaacaaccctaaccaatttgaagtcgaccatatattacctctaagcataacttttgacgatagcttagcgaacaaagtattagtatatgctacagctaatcaagaaaaaggacaaagaacaccatatcaagcactagacagcatggacgacgcatggagcttccgagaactaaaagcgtttgtcagagaatcgaagaccctatctaacaaaaagaaagaatatttgttaacagaagaagacatttcaaaattcgatgtccgaaagaaatttatagaacgaaatctagtagacacaagatacgcatcccgagttgtattgaatgcattacaagaacactttcgagcgcacaaaatagatacaaaagtctcagtagttcggggacaattcacctcacaattgagaagacactggggtatagagaaaacacgagatacataccatcatcacgccgtagacgcgttaataatagcagcatcttcccaactcaacctatggaagaaacagaaaaatacacttgtaagttacagtgaagaccaattacttgacatagaaacaggcgaattaatatcagatgatgaatataaagaatcagtattcaaagccccataccaacattttgtagatacccttaaatcaaaagagttcgaagatagcatattattctcctatcaagtagattctaaattcaatcgaaaaatatcagatgccactatttacgcaacacggcaagcaaaagtaggaaaggacaagaaagacgaaacgtatgtattaggaaaaataaaagatatttatacacaagacggatacgacgcattcatgaaaatatacaagaaagacaaaagcaaatttttaatgtatcgccacgacccacaaacttttgaaaaagttatagaacccattttagaaaactaccctaacaaagaaatgaatgaaaaaggaaaagaagtaccatgtaacccattcctcaaatataaagaggaacatggatacatcagaaaatacagcaagaaaggaaacgatcctgaaataaaaagcctcaaatactatgacagcaaactaggcaatcatatagatataacgccgaaagactcaaataataaagtagttctacaatcagtgagtccatggagagcagacgtgtatttcaataaaaccactggtaaatatgaaatattaggcttaaaatacgccgacttacaatttgaaaaagggacaggaacctacaaaataagccaagaaaaatacaatgacatcaaaaagaaagaaggagtagatagcgattcagaatttaaatttacattatacaaaaatgacctactacttgtgaaagacacagaaacaaaagaacaacaactctttagattcttgtcacgaacaatgccaaaacaaaaacactacgtagaactcaaaccctacgacaaacaaaaatttgaaggaggcgaagcactcattaaagtcttgggcaacgtagctaactcagggcagtgcaagaaaggcttaggtaaatcaaatatatcaatatacaaagtacgaacagacgtattaggaaatcaacacattatcaaaaacgaaggagataaaccaaaactagacttctga

SEQ ID NO: 8585 - RNA, 3366 nt, synthetic construct
  misc_feature 1..3366: note = Cas9 variant
  source 1..3366: mol_type = other RNA
atgaacggattagtgctaggactcgacataggaatagcgtcagtaggagtaggcattttggaaaaaaactccgggaaaatcatacacgctaattctcgcttatttcctgcagcaactgctgataacaatgttgaaagacgaaagaacagacaagccagaagacttcacagacgaaaaaaacaccgaggcgtacgattccaagatctctttgaagactacggacttttaacagatttcagtaaagtaagtataaacttaaatccttacagattaagggtagacggattaaaccaacaattaacaaatgaagaactgtttatagcattaaaaaacatagttaaacgaagaggaataagctacctcgacgacgcctctgaggatggaggaacagtttcatctgactacggaaaagctgtagaagagaatagaaaacttttagcagaacaaaccccaggtcaaattcaattagaaagatttgaaaaatatggacaagtacgtggagacttcaccgtggtagaaaatggagaaaaaagacgtctaataaacgttttcagtacctcggcctatcgcaaagaagcagaaagaatactcagaaaacaacaagagtttaattcaaaaatcaccgacgaatttattgaagactgcctaaagatattaacaggaaaaagaaaatactatcatggaccaggaaacgaaaaaagcagaacagactacggacgatttcgaactgatggaacaacacttgacaacatatttggtattttaataggtaaatgcaccttctacccagacgaatatagagcgtcaaaagcaagttatacagctcaagaattcaatctattaaatgatctcaacaaccttacagtacctacagaaacgaagaaactaagtgaagaacaaaaaaaagtaatagtagaatacgcaaaagaagcaaaaactctaggagcttccacattactaaaatacatcgcgaagatgatcgacgccagcgtagaccaaattcgagggtacagagttgacgtcaacaataaaccagagattcacacattcgaggcttatcgaaaaatgcaatcattagaaacaataagcgtgggagaacttagtcgaaatgtactagatgaattagcacatatactcaccctgaatacggaacgtgaaggtatagaggaagctattaacacaaaactgaaagactcgttttcacaagaccaggtcctagaactagtacagttcaggaaaaacaactcatcattattttcaaaagggtggcataacttttctctaaaactaatgatggaattaattccagaattatatgaaacatcagaagaacagatgacaatactgaccagactaggcaaacaaaaaagcaaagaaataagcaaaaggacaaaatacatcgacgaaaaagaattaacagaggaaatatataacccagtagtagcaaaaagcgtacggcaggccatcaaaataataaacgaggcaacgaaaaaacacggaatatttgataatatagttatagaaatggcacgtgaaaataatgaagaagacgccaaaaaagactacataaaaagacagaaagccaaccaagacgaaaaaaatgcagcaatggaaaaagcagcattccagtacaatggtaaaaaggaactaccagacagcatatttcatggtcaaaaagaactagcaaccaaaataagattatggcaccaacaaggtgaaaaatgcctatatacaggcaaaaatatacccatctccgatttgattcacaatcaatacaaatacgaaatagaccatatcctaccactaagcctgtcatttgatgattccctaagcaataaagttttagtattagcgacagccaaccaggaaaaaggacaacgtactccctttcaagccttagactcaatggatgatgcatggtcataccgcgagttcaaatcatatgtaaaagaatcaaaattactaggaaacaaaaaaaaagaatacctactaactgaagaagacatttcaaaaatagaagtcaaacaaaaattcatcgaacgaaatcttatagacacaagatattcatcaagagtagtcctaaacgcactacaagatttctataaagcccacaaattcgacactaccatatccgtcgtaaggggccaattcacttcgcaacttaggcgaaaatggggcctagagaaatcacgagaaacatatcaccatcatgctgttgacgcactaataatagcagcaagttcacaattaagattatggaaaaaacaaaataatccattaatagcttacaaagaaggccagttcgtagatagcgaaaccggagaaataatcagcttaagtgatgacgaatataaagaactagtatttaaggcaccctacgaccacttcgtagacacactaagttccaaaacattcgaagatagtatactattctcctatcaagtggattcaaagtttaatcgaaaaatatcagatgcaacaatctatgccacaagaaaagccaaacttgataaagaaaagagtgaagaaacatacgttctagggaagatcaaagatatttactctcaggcaggctatgacgcctttataaagatatacaacaaagataaatctaaatttctaatgtaccataaagatccacaaacattcgagaaggttatcgaagaaatactaagaacatacccgtcaaaagaactaaacgataaaaataaagaaatcccgtgtaacccattcgaaaaatacagacaggaaaacggacccatcagaaaatacagtaaaaaatcaaatggaccagagataaaatcacttaaatattacgataataaacttggaaatcacatcgatatcacaccagaaagttcagacaatcaagttgtactccaaagtctaaaaccatggagaactgatgtatattttaaccaccagactaagaaatatgaactaatgggcttaaaatacagcgatctaagcttcgaaaaaggatcaggcaaatattctatttcaaatcaaaaatacaattccattaaaaggatcgaaggaatagatgaacaatcagaatttaaatttacgctttacaaaaacgacctgatacttataaaagacagtgaaaacaacgaacaaaaactatttagattcaactcaagaaacgataccgcaaaacattacatcgaactaaaaccatatgataaagcaaaattcgacggggaacaagaattaataacaatactcggaaatgttgccaaaggaggcagatgtttaaaaggtcttaacaaatcaaatatatcgatattcaaggtcaaaacagatgtattaggaaaaaaacatattataaaaaaagaaggtgatgaaccaaaattaaaattttga

SEQ ID NO: 8586 - RNA, 3366 nt, synthetic construct
  misc_feature 1..3366: note = Cas9 variant
  source 1..3366: mol_type = other RNA
atgaacggcttagtactaggactagacataggcatagcaagcgtaggcgtcggtatactaaacaaagatacaggagaaataatacatacaaacagtcgcatatttccagcagcaacagcggataataatgtcgaaagacgaaacagtcgccaagaccgacgtttaaacagaagaaagaaacaccgaggagtaagacttcacgatttgttcgaggattacgacctcctgaccgacttttcaaaagtatcaattaacttaaatccatatagactacgagtacaaggactagataacagcttgacaacagaagaactattcatagctcttaaaaatatagtcaaaagaagaggaataagctacctcgatgatgccagcgaagacggaggtgtcgtcagtagcgactacggcaaagccgtagaagaaaatagaaaactattagctgaacaaacacctggccaaatacaattagaaagattcaagaaatacggacaagtacgcggtgatttcacagtagtggaaaacggtgaaaaacgaagattaataaacgtattttcaacctcagcttacagaaaagaagccgaaagaatattgcgaaaacaacaagaatttaataatcaaataacagataaatttatcgaagactacctcaaaatattaacagagaaaagaaaatattaccatggaccagggaacgaaaaatcacgaactgactatggaaggttcaggacagatggcactaccttagacaatatatttggaatacttataggaaaatgcacattctacccaaatgaatatcgagcatcaaaagcgagctatacagctcaagagttcaacctattgaatgaccttaacaatctaacagtcccgacagaaacaaagaaactttcagaagaacaaaagaaaacaatagtcgaatatgcaaaatcagcaaaaacactcggagcttctacgctactaaaatacatagccaaaatgatagatgcaagcgtagatcaaatcagaggatacagagtcgatgtaaataataaacccgaaatgcacacttttgaagtctatcgtaaaatgcaatcattagaaacaataagcgtatgggaactctcaaggaatatacttgatgaactagcacacatattaacattaaacacagaaagagaaggaatagaagaagcaatcaacacaaaattaatggacgtattttcacaagatcaagttctagaacttgtacaatttaggaaaaataattccagtttattctccaaaggttggcacaatttctcaagaaaacttatgatggagttaattccggaactatatgaaaccagtgaagaacaaatgacaatattaacacgtttaggaaaacaaaaatcaaaagaaacatcaaaaagaaccaaatacatagacgaaaaagaagttactgaagaaatttacaaccccgtagtagccaaaagtgtaagacaagcaattaaaatcattaacgaagccaccaagaaatatggaatatttgacaatatagtcatcgagatggcaagagaaaacaatgaggaagatgcaaagaaagactatataaaacgacaaaaagctaatcaagatgagaaaaacgtagcgatagaaaaagccgccttccaatacaacggcaagaaagaactaccagacagcatattccacggacataaagagctggcaacaaaaatacgactatggcatcagcaaggagaaaaatgcctatataccggcaaaaatatccctataagtgatttaatacacaaccaatacaaatacgaaatagaccatatattgccactctctttatcgtttgatgatagcctaagtaataaagtattggtactagcaacagctaatcaagaaaaaggacagagaacgccgtttcaggcacttgattcaatggatgacgcatggtcatatcgtgaatttaaatcctatgtaaaagattcgaaattgttaggaaacaaaaagaaagactaccttttaacagaagaagacatctcaaaaatagaagtaaaacaaaaatttatagagaggaatttagttgatacaagatattcatcaagggtagttttaaacactctacaagatttttacaaagctcataaatttgatacaacaatatcagtcgtgagaggacaatttaccagccaactcagacgaaaatggggactagagaaaagcagagaaacataccaccatcacgcagtggacgcattaataatagcagctagttctcaactacgactatggaagaaacaagcgaacccactaataagttataaagaagatcaattcgtagattcagaaacaggagaaataatatcacttaccgatgacaaatataaagaactggtattcaaagcaccatatgctcacttcgtagatacactatcatccaaaaagttcgaagactcaatattattctcatatcaagttgactcaaaatacaatcggaaaatatcagacgctaccatctacgcaacccgcaaagtcaaactagacaaagataaaagtgaagaaacttatgtactcggaaaaataaaagacatatattcacaagctggttacgatgcattcataaaaatttacaataaagataaatcaaaattcctgatgtaccataaagaccctcaaacattcgaaaaggtaatagaagaaatactcagaatttatccaagtaaagagttcaacgagaaaaacaaagaagttccatgcaaccccttcgaaaaatatagacaagaaaacggccctatctgtaaatactcaaagaaaggaaacggacccgaaatcaaatctttaaaatattacgacaaaaacataccagaaagttttatcgatataactcccagtaacagcaaaaataaggttatactaagacaactaaacccatggaggacagacgtttattttaaccatcaaacagaaaagtacgaactgctcggattaaaatatgcagacctccagttcgaaaagaaaacagaaacttactcaatcacaatagacaaatataacgaaataaaagaaaaagaaggagtcggagaacactctgaatttaaattcacactttacaaaaatgatttgcttttaatcaaggacatggaaatcaaagaagaacaaatctttaggtttctatcccgaacgatgcccaataaaaagcactacgtcgagctaaaaccctactacaaaggaaacttcgaaggaaaagaaagaataaaagtctttaatacaacatcaaatggtagatgccttaaaggccttggaaagaaaggattatccatatataaaataaaaacagacgtactaggcaataaacactttataaagaaagaaggagaaaaaccaaaactaaaattttga

SEQ ID NO: 8587 - RNA, 3366 nt, synthetic construct
  misc_feature 1..3366: note = Cas9 variant
  source 1..3366: mol_type = other RNA
atggacagaacagaagtaaatattggattcgacatcggcatatcctcagtcggatggtcggtagtagcaactaaatccggacgaatattagaatcaggagtaagtctatttagtggagcaagcgcagccaaaaacgaagaacggcgtaactttaggcaatcaagacgcctactcagaagacgcaaaaacagaataagcgacctaaagaaatacctaaaagaacaatcattcacatataacggagaattactcaatgaaaacccttatgagatcagagtgaaagggcttactgaaaaactatcaaaagaggaaatagcattagcattactacatatagtaaaaagacggggagtatcatacgatctcggcgacatcgaggaagaaggcacaacaggcagctacaaagagggagttaagaaaaaccaaaaactactgaaagagaaaacaccagcagaaatacaatttcaaaggcttaagaaatttcataaagtgagaggacaaatagcaatagacgaaaatgatgttttgttaaatgtattcccaaaccacgcatacgtcgatgaagctcaacaaatattatatacacaacaagagttctaccccgaaataaatgaaacattcattaatcaagtcaccgatttcataagtcgaaaacgagactacttcatcggaccaggatcagaaaaatcacgaaccgattacggaatatatcgtactgacggaacaacactacaaaatctcttctcaatactaattggaaaagacaaaatattcccagacgagttccgcgctgcaggaaatagctacacagctcaagtctacaacttactcaatgacctaaacaatcttgcaatcgatgacacagaaacaggcaaattaacaaaacaacaaaaagagaaaattatcatggaactcaaaactaccgagaaaagtgtaaacatgatgaagttaatagctaagacagcaggggtcaccgtagaacaaattagtagataccgaataaacagggatggaaaatcagaaatccataacatggcagtctacagaaaaattagaaaagtatttctagaattaggctacgaaataaacgaatggccctctcaattattagacgaactgggagacgcactatcactaaataccgaaaacggcgaaataagaaggatattaactgacaatctagccaacaaatacaaaatactagatcagcagttaatcaatttaatcatagaaaacaaaaatgcttttacccttagtaccaatcaaaaatggcaccgatttagctacaaaacaatgaaaatccttataccggaattgctagaaacgaacaaagaacaaatgaccatactgacagaaatgggattaatgaagaaagaccagagaaactatgtcggcaaaaacaaaatagacagtgaagcactattagaaaatttatacaacccagtcgttcgaaaatcaacgaggcaaacaatgaaactcttcaacacccttctaaagaaataccctaacatagcttacgtagtaatagaaatgcccagggaagacgatgaagacaaagcaagaagggattatgtaaaattccaaaaagacaatgaaaaagaaaaagacgctgcactcaaaaacttcataatggaaagtggaaaatcggaagcggaagttatagcaaaatacagacaatcaaagaaatttagatcaaaagtaagattatggtaccaacaaatgggaagatgcctatactcaggaaaagcaatgccagcagaaagagtattccgagacgaccatttcacggacatagaccacgtgataccattatctgtcagttttgacgacggtatgaacaataaagttttgtgtctggcggagatgaatagacaaaaagataaacaaacaccatacgcattcttcaacgccggacacggacaaggcttccaagcaatgaacgcgatgcttaaaaacaataacagaatatcatcagcgaagaaacgaaatctcttgtttacggaaaacttaaacgacctcgaagttagaaaacgttttatagaacgaaatctagtagacacacgatacgcatcacgggtagtattaaatgaactccaacaattcgtaaaagcaaaacaattagacactaaagtaacggtcatacgaggcaaattcacgtcaaaactaagggaaaaatggaatataaataaaagcagagacacacaccaccaccacgcagttgatgcagcagtaattgcggtgtcacctatgttaaatttatgggaaaaaggtgccagcataattcccaacaaagtaggagaaaacgtaatagacatcaaaacaggcgaaatcataactgaccacgactatgaagccgacgtatatgaattaccatacgccaaattcttagaacaaatcccaaaagtaaagaaagatataaaatttaggcatcaagtagacaaaaagaaaaatagaaaagtaagcgacgctacaatctacacaacaagaaaagccaaagtaggaaaagacaaagaagaaacagattacgtattaggtaccataaaagatatatactccttagaaggctatgtatctttcaagaaaatttataacaaagacaaagcaaaatttttaatggcgagaatcgacccaaaaacctttgaaaaactagagaaaatagtagctgaatatccagaatcaatagaagtagttcaggataacgggaaagtagacgtacagaaaattagcccatttgaattatacagaaaagacaacgggttcgtaacgaaattcgctaagaaaaataatggaccggcagttaaaagtcttaaatactacgattcaaaattaggatcatcaattgatgtcacccctgataatgccaaaaacaagaaagtcatactacaaagtttaaaaccatggagaacagatgtatatttcaacgaagaaaaccaagaatacgaaataatgggactcaaatatagcgatttaaaatttgggaaaaacggaaagtacggagtaccaaaagtacgatatgaagaaattaagcaagaagaagaaatatccgaaggctcaaaattcctgttctcactataccgtggagacagaataaaagtcactaacgaacttggcgagaatctagacctattattctcaagccgtacactaccagcacaaaaaggatacgtagaacttaaaccaatagataaaaccaagttcgacggaaaagaaaaagtttccttctatggtaccgtaacaccaaatggacaattcgtcaagaaattcgctaagaaaggatacaaaatcttaaaactaaacacagatgaactaggaaacacttatatagaaaatggtgagaaagaaccctcagatatacttgacatgtga

SEQ ID NO: 8588 - RNA, 3366 nt, synthetic construct
  misc_feature 1..3366: note = Cas9 variant
  source 1..3366: mol_type = other RNA
atgaacggcctcgtactcggacttgatataggaataggatccgtaggagtggggatcttgaacaaggacacaggagaaataatacatgctaattcaagaatcttcccagcagcaactgcagacaataacgtggtgaggagatcatcacgccaaggcagaagactaaaccatcggaaaaaacacagatccgtaagattaaaagatttatttgaatactatgaccttctcacagatttctcaaaagtttccatcaacttaaacccatatagactcagagtaaacggacttaaccaacagctgacaaatgaagagttatttatcgccttaaaaaacatagtaaaaagacgcggaatatcctacctagacgatgcatcagaagatggtggagcagttagctccgattatggcaaagctgtagaagaaaacagaaaactactagcagaacaaacacccggacaaatccaactcgaaagatttgaaaaatatggacaagtgagaggagattttactgtagttgaaaacggcgaaaaacgacgactaataaacgtattcagtaccagtgcatacaagaaggaagcagaaagaatactaagaaaacaacaagaatataacaaccaaataatggatgaatttatagcagattatctaacaatactgacaggaaaacgtaaatattatcacggacccgggaacgaaaagagccggacagactacggccgatttagaaccgacggaaccacactagataacatcttcggtattcttataggaaaatgtacgttttatccagagaaatatcgtgcgtcaaaagcctcatatacagcacaagaattcaatctactaaatgatctaaacaatctaacagtccccacagaaacaaaaaaactaagtgaagaacaaaaaaagacaatcgtagaatacgcaaaaagtgcgaaaacattaggtgcatccactctacttaaatacatcgcaaaaatgatcgatgcaagcgtagaccaaataagaggttacagagtagatgtaaaaaacaagccagaaatgcatacattcgaagtatacagaaaaatgcaatcattggaaacaatatcagtaggcgaattttcccgagaagtgctagacgaactagcacatgttctaactttaaatacagaaagagaaggcatagaggaagccatcaacacaaaattaagagacagcttcagtcaagaccaaatattagaacttgtacaatttagaaagaacaactcatctctattctcgaaaggctggcacaatttttccttaaaattaatgatggaactaattccagaactctatgagacatcagaagaacagatggccattctaacacgtctcggcaaacaaaaattcaaggaaacttcaaaacgtacaaaatatatagacgaacaagaagttaccgaagaaatatataatcccgtggtagcgaaatcggtacggcaagctattaaaataattaacgaagcaacgaaaaaatacggtatatttgataatattgtgatagaaatggcaagagaaaacaatgaggaagaagcaaaaaaagactacatcaagagacaaaaagccaatcacgacgaaaaaaacgcagcaatggaaaaagcggcattccagtacaacggagaaaaagaactaccagactcaatattccatggacataaagaacttgcaacaaaagtaagactatggcatcaacaaggagaaaaatgtttatatacaggtaaaaacataccaatcagcgatctcatacataaccaatataaatacgaaatcgaccacatactaccactatccttatcattcgacgactcactgagtaacaaagtattagtcttagcaaccgcaaaccaagaaaaagggcaaagaaccccctttcaagcattagatagtatggacgatgcgtggtcgtacagagaattcaaatcttacgttaaagactcaaaatcattaggaaacaaaaaaaaagactaccttttaacagaagaagatatctcaaaaattgaggttaaacaaaaattcattgaacgaaatctagtagatacacgatactcatcacgagtagtactaaacaccctacaagacttctacaaagcacacaaatttgacaccactatatccgttgtacgaggccaattcacaagtcaactacgtagaaagtggggcctagaaaaatccagagaaacctatcatcaccacgcagtggacgctctcatcattgcagcctcttcccaactacgattgtggaaaaaacaaaataacccattaataagttacaaggaaggacaattcgttgatagtgaaactggagaaataatcagccttaccgatgacgaatacaaagaactagtattcaaagcaccatatgatcacttcgtagacacactcaggagcaaaaaattcgaagatagtatactattctcataccaagtggattcaaaattcaatagaaaaatatccgatgcaaccatatatgcaacgcgaaagacaaaactagacaaagataaatcagaagaaacttatgtcctcggaaaaataaaagacatttactcacaaagtggatatgatgcattcataaaaatatataacaaagacaaaagtaaatttctaatgtatcacaaagacccgcaaaccttcgaaaaagtaatcgaagaaatcctccgaacttatccttccaaagaattcaatgaaaaaaataaagaagtatcatgtaatccattcgaaaaatataaacaagaaaatgggccaattcgtaaatacagtaaaaaaggcaacgggcctgaaattaagtcattaaagtattacgataaaaatataccagaatcattcatcaacataacaccgagtaactcgaaaaataaggtaatactaagacaattgaacccttggagaacagatgtttactttaaccaccaaacagaaaaatacgagctcctaggcctaaaatacgccgacctacaatttgaaaaaaaaactggaacttattcaatcacaatagacaagtataatgaaataaaagaaaaagaaggagtaagtgaacactcagaatttaaatttactttgtataaaaacgacctattactcattaaagacacagaaatcaaagaagaacaaatatttagattcttgtcaagaacaatgccaaatcaaaaacactatgttgaattaaaaccatactataaaggaaattttgaaggaaaagaaagaataaaagtatttaacaccacgtcaaacggacgctgcttaaaaggattaagaaaaaaaggtttatctatctacaaaataaaaacagatgtcctagggaataaacacttcataaaaaaagaaggcgaaaaaccaaaactaaagttctga

SEQ ID NO: 8589 - RNA, 3366 nt, synthetic construct
  misc_feature 1..3366: note = Cas9 variant
  source 1..3366: mol_type = other RNA
atgtcagacctcgtactaggactggatatcggcataggtagtgtaggagttggcattttaaacaaagtaaccggcgaaattatacacaaaaactcaagaatatttcctgcagcacaagctgaaaacaatcttgtaaggagaacaaacagacaaggaagaagactaacacgacgcaaaaaacatagaatagtccgattaaatagactatttgaagaatccggcctgatcacagacttcacgaaaatatctataaacttaaacccataccaactcagagtaaaagggctaacggatgaactaagtaacgaagaactatttattgcattaaaaaacatggtaaaacaccgaggaatcagctacctagacgacgcatccgacgacggaaattctagcgtcggagactacgctcaaattgttaaagagaatagtaaacagctagaaacgaaaacaccaggccagatacaattagaacgctaccaaacatacggtcaactacgaggtgacttcactgtagaaaaagatggaaaaaaacacagattaataaacgtattcccgacctccgcgtatcgctcagaagcactccgaatcttacaaacccaacaagaattcaaccctcaaataacagatgaatttataaatcgatatctagaaattcttacaggaaaacgtaaatactatcatggacccggtaacgaaaaatccaggacagattatggaagatatcgcacaagtggagaaactcttgataacatttttggaatattaatcggtaaatgcacattctacccagacgaattccgagccgctaaagccagttataccgcacaagaattcaaccttctaaacgacctaaacaacctaaccgtaccaacagaaaccaaaaaattgtctaaagaacaaaaaaaccagataataaactacgtcaaaaacgaaaaagcgatgggaccagcaaaactttttaaatacatagccaaactattatcctgtgatgtagccgacatcaaagagtaccgaattgataaatcaggcaaagctgaaatacacacattcgaagcttatagaaaaatgaaaacacttgaaacccttgacatagaacaaatggacagagaaactcttgacaaactcgcctatgtgttaaccttaaacactgagcgtgaaggcatacaagaagcactcgaacacgaattcgcagatggaagtttttcacaaaaacaagtagatgaattagtccagttcagaaaagcaaattcgtcaatatttggcaaaggctggcataatttctcagtaaaacttatgatggaactaatacccgaattatacgaaacctccgaagagcaaatgacaatactaaccagactaggcaaacagaaaacaaccagtagtagcaacaaaaccaaatacatagacgaaaaactattaacagaagaaatttacaaccctgtggtagccaaaagcgtaagacaagccataaagatagtaaacgcagcaattaaagagtatggtgatttcgacaatatagtaatagaaatggctagagaaacaaacgaagacgacgaaaaaaaagccatacaaaaaatccaaaaagccaataaggatgaaaaagatgccgcaatgcttaaagctgcaaaccaatataacggaaaagccgaattaccacactcagtattccatggacataaacaattagccaccaagataagattatggcatcaacaaggagaaagatgcctatacacaggcaagaccataagcatacatgacctcataaacaacagcaatcaatttgaagtagaccatatcttaccactgagtataacattcgatgatagccttgcaaacaaagtacttgtgtatgcaacagcaaaccaagaaaaaggtcaaagaacaccctaccaagcactcgattcgatggatgatgcatggagtttccgcgaactaaaagccttcgtacgtgaatcaaaaaccttatcaaacaaaaaaaaagaatatctcctaaccgaagaagatataagtaagtttgacgtacgcaaaaaattcattgaaagaaatcttgtcgacacaagatatgcgtctagagttgtgctaaacgcacttcaagaacacttcagagcacataaaattgacaccaaagtatctgtagtcagaggacaattcacctcacaattgagacgacattggggtatcgaaaaaacacgtgatacttatcatcaccatgcagtagacgctttaataatcgcagcgtccatacaactaaacttatggaagaagcaaaagaacacactagtaagttatagcgaagatcaactactcgacattgaaaccggtgaactcattagtgacgatgaatataaggaaagcgttttcaaagcaccataccaacacttcgtagatacactaaaatcaaaggaattcgaagactctatcctattctcataccaagtagattcaaaattcaacagaaaaatatcagacgcaaccatatacgcaacaagacaagctaaagttggaaaagacaaagcagacgaaacttatgtattgggaaaaattaaagatatatacactcaagacggctacgacgcatttatgaaaatatacaagaaagataaatcaaaattcttaatgtaccgacacgatcctcaaactttcgagaaagttatagaacccatactagaaaactatccaaacaaacaaataaacgaaaaaggaaaagaagttccagtgaatccattcttaaaatacaaagaagaacatggatatatccgtaaatacagcaaaaaaggaaacggacccgaaattaaaagcctaaaatattatgacagtaaactaggaaatcacattgatataacaccaaaagactccaacaacaaagtagtactgcaatcagtatcaccttggagagcagacgtgtatttcaataaaaccacaggaaaatatgaaattctcggccttaaatacgcagaccttcaattcgaaaaaggaactggaacctacaaaatatcacaagaaaaatataacgatattaaaaagaaagaaggagtagactccgattcggaattcaaatttacactttataaaaacgacctacttttagttaaagacacagaaacaaaagaacaacaattattcagattccttagcagaacaatgccaaaacaaaagcactacgtggaactaaaaccatatgataaacaaaagtttgaagggggagaggcgcttataaaagtactaggaaacgtcgcaaactcagggcaatgcaaaaaaggactcggcaaatcaaacatctcaatatataaagtaagaaccgacgtactcggcaaccaacacataataaaaaacgaaggagacaaacccaagcttgacttttga

SEQ ID NO: 8590 - RNA, 3366 nt, synthetic construct
  misc_feature 1..3366: note = Cas9 variant
  source 1..3366: mol_type = other RNA
atgaacggattagtattaggtttagatataggaatagcaagcgtaggcgttgggatactagagaaaaactcgggaaaaataatacacgccaatagtaggctattcccagctgcaacagcagataataacgtcgaaagacgtaaaaacagacaggcaagacgattaaatcgccgcaagaaacatagaggcgtaagattccaagacttgttcgaagattacgggctattaacggactttagcaaagttagcataaatttaaacccctaccgattacgcgtagatggactaaatcaacaactgacaaacgaagaactctttatcgccctaaagaacatagtaaaaagaagaggcataagttacctagacgacgcctcagaagatggcggagccgtaagttcagactacggaaaagcagtagaagaaaataggaaactattagccgaacaaacaccaggacaaatacaactcgaaagattcgaaaaatatggtcaagtcagaggtgacttcacggtagtagaaaatggagaaaaatgcagattaatcaatgtattttcaacaagcgcatacagaaaagaagcagagaaaatactaagaaaacaacaagagttcaataaccaaataacagacgaatttatagaagattacctcaaaatactaacaggaaaaagaaaatactaccatgggcctggaaacgaaaaatccagaactgactatggccgttttagaaccgacggtacaacactagacaatatattcggggttctaatagggaaatgcacattctatccaaatgaatacagagcgagcaaatctagttacacagcacaagaatttaacttactcaacgatctaaacaatctaacagttccaactgaaaccaagaaactatcggaggaacaaaagaaagtgatagtagaatatgcaaaagaagcaaaaacactcggagcaagtacattattgaaatatatcgtaaaaatgatagacgcatcagtagaccaaataagcgggtaccgagtagacgtaaataataaaccagaaatgcacacatttgaagtctacagaaaaatgcaatcacttgaaactatatcagtaggagaactctcaagaaacgtgttagacgaattagcacacatactaacattaaacaccgaaagagaaggaatagaagaagcaataaatagcaaattaatgggcgtcttttcacaagaccaagttctagagctagtacaattccggaaaaacaactcctcactgttctcaaaaggttggcacaacttctccctaaaactaatgatggaactgattccagaactatacgaaacatcggaggaacaaatgacaatattgacacgactaggaaaacagaaaagtaaagaaactagcaaaagaacaaaatatattgacgaaaaagaattaacagaagaaatctacaaccccgtagttgccaagtcagttcgacaagcaataaaaataataaacgaagcaaccaagaaacatggaattttcgacaatatagtaatagaaatggcacgggaaaataacgaagaagacgcgaagaaagactacattaaaaggcaaaaagcaaatcaagatgagaaaaacgcagcaatggaaaaagcagcatttcaatacaacggaaagaaagaattaccaggaaacatatttaacggacataaagaactagcaactaaaatccgcctctggcatcaacaaggcgaaaaatgtctatacacaggcaaaactattcctatatcagatttaattcacaatcaatataaatacgaaatagatcatatcctgccactgtcactcagttttgacgattctttatcaaacaaagtgcttgtacacgccacagcaaatcaagaaaaaggacaacggaccccatttcaggcgctagactcgatggatgacgcgtggtcatatagggagttcaaatcatatgtgaaagatttaaaatcattaagcaataaaaagaaagactatcttctaacagaagaagacatctcaaaaatagaagtcaaacaaaagttcatcgaacgaaatctcgtcgacacaagatattcctcacgagtagtacttaacgcacttcaggacttctacaaatcacaccagttcgacacaacaataagtgttgtccgtggccagttcaccagtcaattaagaagaaaatggggattagaaaaatcacgagaaacttaccaccaccacgctgtagatgccctaataatagccgcctcttctcaattaagactatggaagaaacaaaacaatccccttataacatacaaagaaggccaatttgtagattctcaaaccggagaaataatatcacttacagatgatgaatacaaagagctagtgttcaaagcaccatacgaccactttgttgatactcttcattcaaaaacattcgaagacggtatactattttcttatcaagtagatagcaaatacaaccgaaaaatatccgacgccaccatttacgccacaaggaaagcgaaattggataaagataagtcagaagaaacttacgtattaggaaaaattaaagatatctactcacaagcaggatacgacgcatttatcaaaatatacaacaaagacaaacgaaaatttctaatgtatcacaaagatccacaaacatttgaaaaagtcatagaagaaatactacgcacatacccatctaaggaaagaaacgacaaaaataaagaagtaccttgcaatccattcgaaaaatacagacaagaaaacgggcccatccgaaaatactctaagaaaggaaatggaccagaaataaaatgcttaaaatactatgacaacaaactaggtaattatattgatatctctcctgacggatccgataatcaggtagttctacaatcattaaaaccatggcgtacagacgtatacttcaaccatcaaacgaaagaatacgaactcatggggttgaaatattcagacctctcattcgaaaaaggctccggaaaatattcaataagcaacgaaaaatataattctattaaaaggatagaaggagttaacgaacaatccgaatttaaatttacactatataaaaatgatctaatattaataaaagacagcgaaaataatgaacaaaaattatttcgattcaatagcagaaacgatactgcaaaacattacgtagaattaaaaccatatgataaagcccgattcgatggccaacaagaactaataacgattttaggaaatgtggccaaaggcggccaatgtttaaaaggattaaacaaatcaaatatttctatattcaaagtaaaaacagacgtactcggtaagaaacatatcatcaagaaagagggggacgaacccaaattaaaattctga

SEQ ID NO: 8591 - RNA, 3366 nt, synthetic construct
  misc_feature 1..3366: note = Cas9 variant
  source 1..3366: mol_type = other RNA
atggctgataaaacactaggtgcactaaccttcggattcgatataggaatcgcgagtgttggatggtgcgtattaggtgaaaacagaatagttgatttaggagtaagagcatttgataaagcagaaacagcaaaggagggagaatcactaaacctagccagaagaacagcaagactgatgcgaagaagattaagaagacgagcgtggagacttacaaagctagcaagattattaaaaagggaaggcctaatagctgacgcattccaaatgcatcaaccaagtgctacaagtccctggaaactgagggtcgaagcacttgataggcgattgacagatgacgagtgggccagggtaatttatcatttatgtaaacatagaggatttcattggataagcagagcagaagagaagaaagccgaaggagacgccaaaggagaatcaggacgagtaaagaaaggtttgagtgacacacaacgtagaatgggagaaaaaggttatagaagtgcagcagaaatggttctagcagagtttccagaagcacaaaggaacaaacaaggtgattatggaaaagcattgagtagggtattgctcagtgaagaactcgcgttactttttagaagacaacgggaattaggtcatacgcatgctagtaaagaattagaagcagcaatattaggaaatggtgacaggaaaggtggattattttgggctcaaaaacccccattagcgggtgcagatttattaaaaatgcttggaaaatgcaccttcgagaaagacgaatatagagcaccaaaagccagcttcacagcagaaaggcacgtatggttaactcgtctgaacaatttaagagttgtagtagatggtacgacaaggccgttaacagaagacgaaagaagggtggcattaccattaccctatggttatgcagatgcaaagttaacttataaacaattacgagcagcattaagtaaagcaggattatcaaacttctccttcgcaggaatagctgatgataaagaaaaagacaccttaacaaagttacctgcatgggaaaccttatctaaaacattgaaaggaaaaggtttagaaacagaatgggaaggaatggcaggagcagccaccggaggagatccaacattactagatgaaatatcaagagtattgtctgtatataaagatggagatgaggttgatgttgaactaagaaagctacctctcccaggtggagagaaaatggtagaaacactgtcagaaattagttttgataagtttcatgcactttcgctgaaagcccttagaaaaattgtaccacatatggaaacaggtttgagatatgatgaagcatgcgctgccgcgggttaccatcatagccaattgcatgaagcaggagccggaggtcaaaaatacctaccaccattttatactagaagagacaaagatggaagaatggtatttgacgaagaattagatgtacctagaaatccggtagttttacgagctttaaaccaagcaaggaaagttttaaacgcattagtcagagcatatggtagcccatcagcagtccatatagaaatggctcgagacttaagtaaacccttggttggccatccaacacctaatggaggatatatagagggaagacgagacatagaaaaattacaaaaagaatatagagaaagaaacgaaaaagataaagctgctttcgcagcagaacacggtattgcggccaagtcaagagagttcgaaaaatttcaattataccgagaacaacaagggaaatgtgcttattcactaaaaccactggatttgcatcgagtactccacgacataggctacgcagaagtagatcacgcacttccatactcgcgaagttatgatgatgggaaaaataataaagtcctagtacttacagaagagaataggaataagggaaacagaacagcttacgaatatttatgcgcgttcccaggtggagaaaatggagaaagatggcgcaatttcgtagcatacgtcgaatcaaacaaaagttacagacttgcaaaaagaaccagattattaagaaaagactttggtggaaaagcagcagaagaatttagagaacgcaatctaaacgatacaagatacatttgtaaatttttcaaaaatttcgtagagaggttcctccaattaaaagtaggagcagacggtacagcagcaaaaagatgtgttgttctgagcggacaaactacagcattcctacgtgcaagatggggactactcaaagtacgtggcgcttcagatagacatcatgcgttagacgcagctgtcgtagcagcatgcagtcatggcatggtcaagaggttagcggattacagtaggacaaaagaactagcaaaagtgcgagatgggtttccggatccagagacgggtgaaatagtcgatccagcaatgtttcaacaacttcacgcacacttcccagacccttggccacattttaggggtgaactagaagctaggctacaactagacgatagtgctgaattaagagcacaactggagatgtttgggacatacccagcagaagcattagaaacgctacgacctttattcgtttcaagagcaccccaacggagaaatggtggagccgctcataaagaaactatatatgcccaacctgaacgtttaaaagaacaaggaggggtaacacaaaaggtctctctcgcaagtttgaaaccaaccgatatagataaactcattgaccctcatagaaacgagaagctgtacgcagcaatcagggcaagattagaagcgcatggcggaaaaagtgataaagcattcccagctgacaacccgttaagaaaaccagacagggacggaaatccaacagggccgatagtaagagcagtaactatggttatagataaactgtccggaatacaaatccgcggaggaatcgcgaaaaatgatacgatgctacgagtagatgtattcaggcataagaaagacggtaaatttcacctagtcccactctatgtccatcatgcagtagcacaagaactaccgaatcgagccatagtcgcattcaaagatgaagacgaatggacgttgatagatgacaatttccactttctttttagttttcacccaaatgatttcataaggataactcagaaaaataaagcacctatcctagggtactatgctagctgtcatcgagggactggaaaccttaacctatgggcacatgataggaatcaaaaagtgggaaaagacgggcaaatagaaggaattggagtaaaaacagccgttgcattagaaaaattccacgtagatgtactaggtaatatatatcccgctccgccagaacaaagacatggactagcatga

SEQ ID NO: 8592 - RNA, 3366 nt, synthetic construct
  misc_feature 1..3366: note = Cas9 variant
  source 1..3366: mol_type = other RNA
atgagtgatctcgtcttaggtctggacatagggataggatccgtaggtgtaggaatcctaaataaagtaactggagaaattatccacaaaaacagccgaatattccctgccgcccaagccgaaaataacctagtaagacgaacaaatagacagggccgcagactgacaagaagaaagaaacatcgaagggtccgtctaaatagactttttgaagaaagcggcctgataacagatttcacgaaaatatctataaatctgaacccgtaccaattgagagtaaaaggcttaacagacgaattatcaaacgaagaactcttcatcgcactcaaaaatatggtcaaacaccgagggattagctacctagacgatgcatctgacgacggaaacagcagtgtaggagattatgctcaaatagttaaagaaaactcgaaacaattagaaacaaaaacacccggacagatccaactagaacgttaccaaacatatggccagctaagaggggacttcacagtggaaaaagacggcaagaaacacagactaataaacgtatttccaacctcagcataccgatcagaagcacttcgaatcttacaaacacaacaagagttcaacccccaaattacagatgagttcattaatagatacctagaaatattgacagggaaaagaaaatactatcatggcccaggtaatgaaaaatcacgaactgattatggaagatacagaaccagtggagaaacattagacaacatattcggtattctaataggaaaatgcacattctatcctgatgagttcagagcagcaaaggcttcttataccgcacaagaatttaacctactgaatgatcttaataatcttactgtaccaactgaaacaaagaaattatccaaagaacagaaaaatcaaatcattaactacgttaaaaacgaaaaagctatgggacccgccaaactcttcaaatacatagctaaactactttcctgtgacgtagcagatataaaaggataccgaatagataaatccggcaaagcagaaatacacacatttgaagcataccgtaaaatgaaaacattagaaacactagacatagaacaaatggacagagaaacactagataaactagcgtacgtattaacgctaaacacagaaagagaaggaatacaagaagctcttgaacatgagttcgcagatggatccttctcacaaaaacaggttgacgagctagtacaatttagaaaagctaacagtagtatatttggcaaaggatggcacaacttcagcgtaaaactaatgatggaattgatcccagaactatacgaaacaagtgaagaacaaatgacaattctcactagacttggaaaacagaaaacaacatcatctagtaacaaaacaaaatacatagatgaaaaactcctaacagaagaaatttataatccagttgtcgccaaatccgtcagacaagcaataaaaattgtaaacgccgctataaaagaatacggagacttcgacaacatagtaatagaaatggcaagagaaacaaacgaagatgacgaaaagaaagcaatccagaaaattcaaaaagcaaacaaagacgaaaaagacgcagcaatgctcaaagcagcaaaccaatataacggaaaagcagaactaccgcactccgtatttcatggtcataaacaactcgccaccaaaataagactatggcaccaacaaggagaaagatgcttatatacaggaaaaaccatatccattcacgatctaattaataactcaaaccaatttgaagtagatcacatattaccattatcaataacattcgacgacagcttagcgaataaagttcttgtatacgcaacagccaaccaagaaaaaggtcaaagaacaccctatcaagctctagacagcatggatgacgcgtggtcatttagagaattaaaagcatttgtaagagaatccaaaacactctccaacaaaaagaaagaataccttttaacagaagaagacatctcaaaatttgacgtacgcaagaaattcattgaaagaaacttagtagatactcgatacgcatcacgagtcgtcttaaacgcacttcaagaacatttcagagcacacaaaatagacacaaaagtaagcgtcgtaagaggacaattcacatctcaactaaggcgacattggggaatagagaaaactcgagatacatatcatcatcacgcagtagatgcgcttataatagcagcatcatcccaactaaacctatggaagaaacagaaaaacacactcgtatcatatagtgaagatcaactattagacatcgaaaccggagaattaatatcagacgatgaatataaagaaagcgtatttaaagcaccatatcaacattttgtcgacacccttaaatccaaagagttcgaagattcaatccttttctcataccaagtagactcgaaatttaatagaaaaatctcagacgctacaatttatgcgacacgccaagcaaaagtaggaaaggacaaagctgatgaaacttacgtcctcggcaaaataaaggatatctatacacaagatggttacgacgcatttatgaaaatctataagaaagataaaagcaaattcctcatgtacagacatgacccacaaaccttcgaaaaagttatcgaaccaatcttagaaaactaccctaataaacagataaatgaaaaaggaaaagaggtcccatgtaatccattcttaaaatacaaagaagaacatggttacataaggaaatatagtaagaaaggaaacggcccagaaattaaaagtctgaaatattacgattccaaactaggaaatcatatcgacattacacctaaagactccaataacaaagtagtactacaaagcgtctccccatggagagctgatgtctatttcaataaaactacaggcaaatatgaaattttaggtctaaaatacgccgatctacaatttgaaaaaggaacaggaacatacaaaatcagccaagaaaaatataatgacatcaaaaagaaagaaggagttgacagcgactctgagttcaaattcactctttacaaaaacgatctattactggttaaagacacagaaaccaaagaacaacaactttttcgcttcctcagtagaacaatgcccaaacaaaaacattatgttgaacttaaaccatatgacaaacaaaaatttgaaggcggagaagctctaattaaagttctcggaaatgtagcaaactcaggacaatgtaagaaaggtctagggaaatcaaacatatccatatataaagtaagaacagacgtattaggtaaccaacatatcattaaaaacgaaggcgataaaccgaaattagacttctga

SEQ ID NO: 8593 - RNA, 3366 nt, synthetic construct
  misc_feature 1..3366: note = Cas9 variant
  source 1..3366: mol_type = other RNA
atgaacggtttagtattaggcctagacatcggaataggatccgttggagtaggcatattaaataaagacacaggagaaataatccatgcgaactcccggatctttcctgcagcaaccgctgacaacaacgtagtaagacgatcatctagacaaggacgacgtctaaaccatagaaagaaacatagatccgttcggttaaaagatctattcgaatattatgatctactaaccgatttttcaaaagtatccataaatttaaacccataccgattacgggtcgatggactaaaccaacaattaacaaacgaagaattatttatagccctcaaaaatattgtaaaaagaagaggaatatcctacctagacgacgcttcagaagatggcggggcggtgtcatcggactacggaaaagccgtagaagagaaccgaaaattattagctgaacaaaccccaggccaaatccaactcgagcgattcgaaaaatatggacaagtaagaggagacttcacagttgtagaaaacggagagaaaagacgtctcatcaatgtattcagcacctcagcatacaagaaagaagcagaacgtatacttagaaaacaacaagaatacaataaccagataatggacgagttcatagcagactatttgactatcttaactggcaaaagaaaatattatcatgggccaggaaacgaaaaatctcgaacagattatggtcgattccgaacagatggcacaacactagacaatatcttcggaatcctcatcggaaaatgtacattttaccccgaagaatacagagcatctaaagcaagctatacagcccaggaatttaacttattaaatgatttaaacaacttaactgttcccaccgaaactaagaaattaagcgaagaacaaaagaaaacaatagtagaatacgcaaaatcagcgaaaaccctaggcgcatcaactctactaaaatacatagcaaaaatgatagacgcatccgtagatcaaatcagaggataccgcgttgatgtcaataataaacccgaaatgcacacatttgaagtgtacagaaaaatgcaactattagaaacgataccggttggagaatttagtagagaagtactagacgaactcgcacacatacttacccttaacactgagcgcgaaggcattgaagaagcaataaacacaaaactaatggatgtgttctctcaagaccaaatattagaattagtccaattcaggaaaaataatagttcactcttcagcaaaggatggcataatttttcattaaaattaatgatagaattaatacctgaattgtacgaaacaagcgaagaacaaatggctatcctaacaagactaggaaaacaaaaattcaaagaaacaagcaaaagaacaaaatacatagatgaacaagaagtaaccgaagaaatttacaatcctgtagtcgcaaaatcagtaagacaagccataaaaataattaacgaagccacaaagaaatacggcatattcgataacatagtcatagaaatggcccgcgaaaataatgaagaagaagccaagaaagattacatcaaacgacaaaaagcaaaccatgacgagaaaaatgcagcaatggaaaaagcagctttccaatacaacggcgaaaaagaattacctgactcaatatttcatggccataaagaactagcaactaaagtaagattatggcaccaacaaggtgaaaaatgtctatacacaggtaaaaacataccaatatcagacctaatacacaaccaatacaaatacgagatagaccacatattaccattaagtttgagcttcgatgactcattaagcaacaaagttttagtactggcaactgcaaaccaagaaaaaggacgcagaacccccttccaagcactagattccatggatgacgcatggtcataccgagagttcaaatcatacgtcaaagacagcaaatcattaggcaataaaaagaaagactatttgttaacggaagaagatatctcaaaaatcgaagtaaaacaaaaattcatagaaaggaatctagtagacacaagatattcctcccgagttgtgttaaacacactccaagatttctataaagcacacaaattcgataccaccattagtgtagtaagaggccaatttacatcccagctaaggagaaaatggggattagaaaaatccagagaaacgtatcatcaccacgccgttgatgcgcttattatagctgctagcagtcaattaagactatggaagaaacaaaataaccccttaatatcttacaaagaaggacaattcgtagactcagaaaccggagaaataatcagtctcacggacgacgaatacaaagaattagtattcaaagcgccctatgatcatttcgtagacaccttaagatcaaagaaattcgaagacagcatcctattttcttaccaagtagattcgaaattcaataggaaaatatcagatgcaactatttacgcaacaagaaaagcaaaactcgataaagataaaagcgaagaaacatacgtattaggaaaaataaaagatatctactcacaaagtggttacgacgcatttataaaaatatacaacaaagataaaagtaaatttctaatgtaccataaagacccacaaacgttcgaaaaagtcatagaagaaatattacgaacctatccatcgaaagagttcaacgagaaaaacaaagaagtatcatgcaatccatttgagaaatataaacaagaaaacggtccaatacgcaaatattcgaagaaaggcaacggcccagaaataaaatctctaaaatactatgataaaaacataccggaatcattcatcaacataacaccatcaaacagcaaaaataaagtcatactaagacaactaaacccatggagaacggacgtatacttcaatcatcaaacagaaaaatacgaattattaggcctaaaatacgcagacctacaattcgaaaagaaaaccggcacatacagtataacaattgataaatacaacgaaataaaagaaaaagaaggcgtatcagagcactcagagtttaaattcacactatataaaaacgatttattgctaataaaagatacggagataaaagaggaacaaatattccgttttctatcaaggaccatgcctaatcaaaaacactacgttgaactcaaaccttattacaaaggtaactttgaaggaaaagagagaatcaaagtatttaatacaacttcaaacggtagatgcctcaaaggattgcgaaagaaaggtttatcgatctacaaaataaaaacagatgtacttggaaataaacacttcataaagaaagaaggcgagaaaccaaagctaaaattttga

SEQ ID NO: 8594 - RNA, 3369 nt, synthetic construct
  misc_feature 1..3369: note = Cas9 variant
  source 1..3369: mol_type = other RNA
atgaatgggaaaatattaggcctagacataggtgtagcatccgtcggagtgggtattctagacaagaaaaccggagaaatcatacatgcgagtagcagaatatttccggcggcaacagcagattcaaatgttgaaaggagaggatttaggcaaggacgcagattagggcgaagaaagaaacacagaaaagtacgactagcagacttattcagcgacacaggattgataacagacttcagcaaagtatccataaaccttaatccatatgaattaagaataaaaggcttaaacgaaaaattgacaaacgaagaattattcatagctcttaaaaacatagtaaaacgaagaggaataagctacttagacgacgcaaatgaagacggcgaatccagctcaagtgaatacggaaaagcagtagaagaaaaccgtaaactattagctgataaaaccccgggacaaatccaattagaaagatttgaaaaatacggtcaagtaagaggagactttacaatcgaagaaaatggagaaaaacatagattattaaacgtcttttcaaccagtgcatacaagaaagaggctgaaagaatactaacaaaacaacaagactacaatcaagacattacagatgagttcattcaagcatacctcacaattctaacaggtaaaaggaaatactatcacggaccaggcaatgaaaaatcaagaacggactacggaagatttagaacggatggcacaactctagacaacattttcggaatactcataggcaaatgtacattttatcctgaagaataccgagccgcgaaagcaagctatacagcacaggagttcaacctattaaatgaccttaacaaccttacggttccaacagaaaccaagaaactatcagaagaacagaaaaggcaaattattgaatacgcaaaaggcgctaaaactcttggtgcagcgacactgttaaaatatatagctaagctagtagacggatcagtggaagatataaaaggatatcgcatcgacaaaagcgaaaaacctgaaatgcacacatttgacatatatcgcaaaatgcaaacactagaaactgtagacgtagaaaaattatctcgagaagtactagatgaattagcacatatactaacgctaaacacagagcgagaaggtatagaagaagccataaaagtgagcttcataaaaagagagttcgaacaagatcaaattgctgaattagtatcatttcgaaaatctaattcaagtttatttggcaaaggatggcataacttttcaataaaattaatgacagaactcatccccgaattatatgaaacctctgaagaacaaatgacaatactaacaagattaggcaaacagaaaaccaaagcacgatcaaagcgcaccaagtacatcgacgaaaaagaattaacagacgaaatatataatccagtagtagcgaaaagcgtaagacaagccataaaaataatcaacttagccacaaagaaatacggagtgttcgacaatatagtaatcgaaatggcaagagaaaacaatgaagaagatgccaagaaagattatgtaaaacgacaaaaagctaatgaagatgagaaaaacgcagctatggaaaaagcggcacaccaatataacggaaagaaagaactacctgataatgtgttccatgggcacaaagaattagcaactaaaataagattatggcaccaacaaggagaaaaatgcttatatacaggtaaaaacataccaatatcggatctaattcataaccaatacaaatacgaaatagatcatatactaccccttagcttatcattcgacgactcattagcaaacaaagttctagtgcttgcaacagcgaatcaagaaaaaggccaaaggactccattccaagccctagatagcatggacgatgcctggtcttatagagaatttaaggcttatgtcagaggtgctagagcactatccaacaaaaagaaagactatttattaaacgaagaagacataaataaaatcgaagttaaacaaaaattcatagaaaggaatctagttgacacaagatatagtagcagagtagttctaaacgccttacaagacttctacaaactaaacgactttgacacaaaaataagcgtcgttagaggccaatttacatcccaattgagaagaaaatggagaattgacaaatcaagagaaacataccatcaccatgcagtggatgccttaataatagccgcaagctcacaattacgattatggaagaaacaaggcaatccattaataagctacaaagaaaatcaatttgtcgatagcgaaacaggtgaaataataagtttaaccgacgatgaatacaaagagctagtatttcgagccccgtacgaccacttcgtggatacagtcagttcgaagaaattcgaagacaggatcctctttagctatcaagtagattcaaaatacaatcgaaaaatttcggatgctacaatctatagcacaagaaaagcaaaacttggcaaagacaaaagtgaagaaacatatgtgctaggaaaaatcaaagacatatatactcaaaccggatatgacgcgtttatcaaattatataagaaagacaaatcgaaattcttaatgtaccataaagatccaataactttcgaaaaagtaatcgaagaaatactaaaaacctatccagacaaagaaataaatgaaaaaggtaaagaagttgcatgtaatccttttgaaaaatataggcaagaaaacggaccactgcgaaaatacagcaagaaaggaaaaggaccggaaataaaatcactgaaatactacgataacaaactgggaaaccacatagacattactcctgataactccgaaaaccaagtgatactgcaatcattaaaaccttggagaaccgacgtctattttaatcacaaaacaaaaatctatgagctaatgggcttaaaatactctgaccttagcttcgagaaaggatcaggaaaatatagaataagtttagacaaatataatgtaattaaaaagaaagagggagttcataaagaatcagaatttaaattcacactatacaaaaacgacctgattctcattaaagacctcgagaaaagtgaacaacagttattccgatacaactcacgaaacgacacatcaaaacactacgttgaactaaaaccctatgacaaagcaaaattcgaaggtaaccaacctttaatggcattattcggaaatgtagctaaaggaggacaatgtctaaaaggcttaaataaagccaacatatcaatctacaaagtacaaacagacgtcttaggaaataaaagattcataaagaaagaaggagatgcacctaaattagaattttga

SEQ ID NO: 8595 - RNA, 3369 nt, synthetic construct
  misc_feature 1..3369: note = Cas9 variant
  source 1..3369: mol_type = other RNA
atgagtgacttagtattaggactggacataggaataggttctgtcggcgttggaatacttaataaagtaacaggtgaaataatacacaaaaattcaagaatattcccggcagcacaagcagaaaacaatctagtgcggagaacaaatcgacaaggaagaaggctaacacgtagaaagaaacacagaattgtaagattaaatcgactattcgaggaatcaggactcattacagactttaccaaaatatccataaatttaaatccataccaactaagagtaaaaggactaactgacgaactatccaatgaagaattatttatagcactcaaaaatatggtaaaacatagaggaataagctacttagacgacgcctcagatgacggtaattcaagcgtgggagactacgctcaaatcgtgaaagaaaactccaaacaattagaaactaaaacgcctggccaaatccaattagaacgatatcaaacttatggacaattacgtggagattttacagtagagaaagatggaaagaaacaccgactaataaacgtatttccaaccagtgcataccgttcagaagcattaagaatcttacaaacacaacaagaatttaactcacaaattacagacgaatttatcaatcgctacctagaaatactaacaggcaaacggaaatattatcacggaccaggcaatgagaaaagcagaacagattacggaagatacaggaccaatggagaaactctagacaatatattcggaatactcataggaaagtgtacgttctacccagacgagttcagagcagctaaagcaagctacacagcccaagagttcaacttattaaatgacttaaacaatcttacagtaccaaccgaaactaaaaagctatcaaaggaacagaaaaaccaaataataaattatgtcaaaaatgaaaaagtaatgggccccgccaagttgtttaaatacattgctaaattacttagttgcgatgtagcagacataaaaggccaccgaatagacaaatcaggaaaagcagaaatacatacatttgaagcatacagaaaaatgaaaacattagaaacattagacattgaacaaatggaccgcgaaactttagacaaacttgcgtacgtactaacactaaataccgaaagggaaggaatacaagaagcactagaacatgaatttgccgatggcagtttcagccaaaaacaagtagatgaattagtgcaattccgaaaagcaaattcatcgatattcggcaaaggatggcataatttttctgtaaaactaatgatggaattaataccagaactatatgaaacatcagaagaacaaatgactattctaacaagactaggcaagcagaaaaccacaagctcaagtaacaaaactaaatacatcgatgaaaaattactaacggaagaaatatataacccagtggtagctaaatcagtacggcaagcaataaaaatagttaatgcagccataaaagaatacggagactttgataatatcgtaatagaaatggccagagaaacaaacgaagacgacgaaaagaaagccatacagaaaattcaaaaagcaaataaagatgaaaaagacgctgctatgttaaaagctgcaaaccaatataacggaaaagcggaattgccacatagcgtattccacggacacaaacaactggcaactaagatcagactatggcatcaacaaggcgaaagatgcctctatacaggaaaaaccataagcattcacgacctaataaacaatccaaatcaattcgaagtcgatcacatcctaccactaagcataacatttgatgatagtctagcgaataaagtcttagtttatgctactgccaaccaagaaaaaggacaaagaaccccataccaagccttagattcgatggacgacgcatggtcatttagagaactcaaagcatttgtacgagaaagcaaaaccttatcaaataagaagaaagaatatctcttaactgaagaagatattagcaaattcgacgtacgaaagaaattcattgaaagaaacctagtagatacaagatatgcatccagggtagtgttgaatgcactacaagaacacttccgagcacacaaaatcgacacaaaagtatcagtcgttagaggtcaatttacatcacaactaagaagacattggggcatagaaaagacacgcgacacatatcatcatcatgcagtagatgccttaataatagcggctagcagccaattaaacctttggaagaaacagaaaaacactttagtaagttacagcgaggaacaactattagatatcgaaacaggagaacttatatcagacgacgaatataaagaatcagtattcaaagctccctaccaacactttgtggacaccttaaaatccaaagagttcgaagactccatattatttagttatcaagtcgattccaaattcaatagaaaaataagcgatgctacaatctacgcaacgagacaagcaaaagtaggtaaagataaaaaggacgaaacatacgtcctaggaaaaataaaagacatttacacacaagacggatatgatgccttcatgaaaatatataagaaagataaatccaaatttctaatgtacagacacgatccacaaacattcgaaaaagtgatagaaccaattttagaaaattatccaaacaaagagatgaatgagaaaggaaaagaggtaccatgtaatccgttcctaaaatataaagaagaacatggatatataagaaaatactctaagaaaggcaatggaccagaaattaaaagcctaaaatactacgattcaaaacttttaggaaatcctatagacataacacccgaaaattctaaaaataaagtagttttacagagcttaaaaccttggagaacagacgtctacttcaataaaaacacaggtaaatatgaaatcctaggtctaaaatacgcagacctacaatttgaaaagaaaacaggtacttacaaaatctcccaagaaaaatataatggaataatgaaagaagaaggtgtagatagcgatagtgagttcaaattcactttatataaaaacgacctactactcgtgaaagacacagaaactaaagaacaacaactatttagatttctatcgagaacaatgccaaacgtaaaatattatgtagaactaaaaccatactcgaaagacaaattcgagaaaaatgaaagcctaatagaaatattaggtagcgcagataaatcaggcagatgcatcaaaggactcggtaaatcaaacattagtatatataaagtcagaaccgacgtactgggaaaccaacacataatcaaaaacgaaggtgacaaaccaaaacttgatttctga

SEQ ID NO: 8596 - RNA, 3369 nt, synthetic construct
  misc_feature 1..3369: note = Cas9 variant
  source 1..3369: mol_type = other RNA
atgtccaacggaaaaattcttggacttgacattggaatagcaagcgtaggggtcggcgttatagatgcacaaaccggcgaaataatacacgcgtcttcgcgaatattcccaagtgccaatgcggccaacaacgctgaacgacgaacgtttagaggctcccgacggttaatacgcagaaagaaacacagaataaaaagactagatgacttatttaacgactttcatatcaacttggatggggaaatgtcaacggacaatccctatgtactgagagtcaaaggtctatctcaaaaattaacagtagaagaactatacatttcaattaaaaacataatgaaacgcagaggaatatcctacctagatgacgcagagtctgacaacgaagcaggaagaagcgattacgcaaaagcaatagagagaaataggcaacttttgacatcaaaaacccctggcgaaatacaactcgaacgattagaaaaatacggccaactgcgtggaaattttacaatcatagacgaagaaggtcaaagccaacaaataatcaatgtcttcagcacatcagattacgtaaaggaagtagagaaaatcttagattgccagaaaatgtaccacaaatttataagtgatgagttctgcgacaagttaatagaactactccgggaaaagagaaaatactacgtaggcccaggaaacgagaaaagccgaacagactatggtatctatagaacggacggcaccacactagaaaacctttttggtatcctcatcggaaaatgcacattctatcctgatcaatatagaagcagtagagcaagttacactgctcaagagttcaactttctaaacgacttaaataatctaacagttccgacagaaacaaagaaattatcccaagaacaaaaagagttcctagtaaattacgcaaaagaaacttcagttctaggagcaggaaagatcttacaacaaatcgccaaattagcagactgtaaagtggaagatataagaggatacagactagataataaggacaaacctgaactacacatattcgaaacatacagagcaatgaaagggttagtacctctagtcgacattggagttctatcacgcgaacaactagacattctggccgatatactcacactcaacacagactttgaaggtataagggaagcactgaagaaacaacttcctaacgtttttgacgaaaaacaagtaaaaggactcgcgtcatttagaaaaagcaaatcacaactatttgcaaaaggctggcataatctaagtcagaaaataatgctggaagtaatcccggagttatacgctacaagcgatgaacaaatgacaatattaacgcgtttaggaaaatttgaaaaatccagcgttgcagaatatcctagttccatcaatgtagacgaaataacggacgaaatctataaccccgtagtagcaaagtcaatacgacaaacaattaaaataataaatgctagcatcaagaaatggggagaatttgaccaaattgttatagaaatgccaagagatcgcaacgaggatgaagaaaagaaaagaatagcagacggtcaaaaagctaacgcaaaagaaaaagctgactcaatactcagggcagccgaactatactgtgctggtaaagtactacccgattacgtatacaacggccataatcaactggcaacaaaaataaggttatggtaccaacaaggcgagagatgtatatacacaggccaacctatatcgatacatgatctaatacacaaccaaaatcaatatgaaatagatcatatactaccgctttcgcttacatttgacgactcactttctaataaagtgctagtactagcaacagcaaaccaagaaaaagcacaaaggacaccatacaactacttaaaaagcgcaacctcagcatggagttacagagaatttaaagactacgttacgaaaagaaaaggaatcggtaaaaagaaatgcgaatacttaaccttcgaagaagatataaatggattcgaggtgcgatcaaaattcatccaaagaaacctagtagatacgagatacgcaagtaaagtgatactaaacgccttacaagattattttaaaatctcaggaatccaaacaaaagtcagcgtagtaagaggacaatttacgtcccaactccgacacaaatggggcatagagaaaacacgcgaaacgtatcaccaccacgccgtagatgcactaatcatcgcagctagtagccaattacgcttatggaagaaacaagaatctccattagtagttgattaccaagaaggaagacaagtagaccttgaaacgggagaaatactagaattaactgatgaacaatacaaagagctagtatatcaaccaccctaccaaggatttgttaacacaatttcaagtagtgcatttgataacgaaatactattttcataccaggtggattctaaagtaaataggaaaatatcagatgcaacaatatacgccacacgaaatgcgcaattgggaaaagataaaactgaaggaatctatgtattaggaaaaattaaagacatttacacccaagccgggtatgaagcatttttaaaacgatacacaaaagacaaaacatcattcctaatgtaccacaaagatttagatacatgggaaaaagtcatcgaaattatactaagagactacagagaatatgatgaaaaaggaaaagaaataggaaacccattcgaaaggtatcgaagagaaaatggatatgtaaagaaatactcacgcaaaggaaacggaacagctataaaaagtctaaaatactacgataacaaactgggaaatcatatagatataacaccagaaaacagcagaaatgcagtagtactccaaagccttaaaccatggagaacagacgtctacttcaacaaagaaacaggaaaatacgaatttttaggaataaaatattcagacttatccttcgaaaaagggacaggagaatacggcataagccaagaaaaatacgacagcataaaaatagctgaaggagtagccaagaaaagtatattcaaattcaccctatacaaacaagacctactatttataaaagatatagaaaataatttcggaaaactattaagatttactagcaaaaatgacacaagtaaacattacgtagaattaaaaccatacgacaaaaataaatttggaacagaagaacccttattacctgtattaggaaacgtagctaaaagtggccaatgtataaaaggcctaaacaaaagcaacatatccatatataaggtccgaactgacatactaggataccgacacttcataaaacaagaaggagaacacccacaattaaaattcaagaaatga

SEQ ID NO: 8597 - RNA, 3369 nt, synthetic construct
  misc_feature 1..3369: note = Cas9 variant
  source 1..3369: mol_type = other RNA
atgtctaacggaaaaatattaggtttagacatcgggatagccagtgtaggggtgggagtaatagacgcacaaactggcgaaatcatacatgcatcatcaagaatttttcctagtgcaaacgctgcaaacaatgccgaacgtagaacatttagaggctccagaagattaattagaagaaagaaacatcgaataaaaagattagatgaccttttcaatgactttcatataaatttagatggagaaatgtcaacagataatccatatgtgttaagagtcaaaggactatcacaaaaattaacagttgaagaattatatatctctatcaaaaacataatgaaacgaaggggaatcagttacctagacgacgccgaatcagataatgaagctggtagaagtgactacgctaaggcaattgaaagaaacagacagcttctcacatcaaaaaccccaggagaaattcaactagaaagattagaaaaatacggacaattaaggggaaacttcaccataatcgacgaagaaggacaaagccaacaaataataaatgtattctccacatcagactatgttaaagaagtggagaaaatactagattgtcagaaaatgtaccacaagtttatatcagatgagttctgtgacaaacttatagaattgttaagagaaaaacgaaaatattacgtaggaccaggtaatgaaaaatcaaggacggattatggaatatacaggacagatggaacaacattagaaaatttatttggaatactaataggtaaatgtacattttaccctgaccaataccgatctagccgtgcatcatatacagcacaagagttcaattttctaaacgatctcaataatctaacagtcccgacagaaactaagaaactcagtcaagaacaaaaagaatttctcgtaaattatgcaaaagaaacatccgtcctaggtgcaggaaaaatactccaacaaatagcaaaattagcagactgcaaagtcgaagacataagaggatacagactagataacaaagacaaacccgaactacacacatttgaaacctacagggcaatgaaaggtctagtacccctagttgatataggcgtcctatctagagaacaattagatatactagcagatatcctaacattaaacacagatttcgaaggtatacgagaagcacttaagaaacaactgccaaacgtgtttgacgaaaaacaagtcaaaggcttagcgagcttcagaaaaagtaaatctcaactattcgcaaaaggatggcacaacttatcacagaaaattatgctagaagtaataccagaactatacgccaccagcgatgaacaaatgaccattttaactagacttggcaaatttgaaaaatcaagtgtagcagaatacccatcatcaattaatgtagatgaaataacagacgaaatatataatcccgtcgtagccaaatcaatcaggcaaacaattaaaataataaatgcatctattaagaaatggggtgaatttgaccaaatagtcatagaaatgcctcgagaccgcaatgaagatgaagaaaagaaacgaatcgcagacggtcagaaagcaaatgcaaaagaaaaagccgatagcatactaagggcagccgaattatattgtgcaggaaaagtcttaccagactacgtatacaatggacacaatcaactcgcaaccaaaataagattatggtaccagcaaggagaaaggtgtatctacaccggacaaccaatatccattcatgatctaatacacaaccaaaatcaatacgaaatagatcacatattaccgttatccctcacattcgatgattcattatcaaataaagttctagtattagcaacagccaaccaagaaaaagcacagagaacaccgtacaactacctaaaaagcgccacttcggcatggagctacagagagttcaaagactatgtaacaaaaagaaaaggtataggaaagaagaaatgcgaatatttaacattcgaagaagatattaacggattcgaagtcagaagcaaattcatacaaagaaatctagtagacacaagatatgcatcaaaagtaatactcaacgcactacaagattatttcaaaatatcaggtatacaaacaaaagtaagcgtagtcagaggccaatttacctcccagttaagacacaaatggggtatagagaaaacaagagaaacctatcaccatcatgcagtggacgctttaatcatagcagctagtagtcaattaagactctggaagaaacaagaatcgcccttagtggtagattatcaagaaggaagacaagtggaccttgaaacgggagaaattctcgaattaacggacgaacaatataaagaacttgtctaccaacccccttaccaaggtttcgtaaatactatatcaagttcagcatttgataacgaaatattattcagctaccaagtcgactccaaagtaaatcgcaaaataagcgacgccactatatatgcaacaagaaatgcacaattaggaaaagacaaaacggaaggcatctacgttttaggtaaaataaaagacatttacactcaagcgggatacgaggctttcctgaaaaggtataccaaagacaaaacatcatttctaatgtatcacaaagacctagatacatgggaaaaagtaattgaaataatattaagagattacagagaatatgatgaaaaaggtaaagaaataggtaatccgttcgaaaggtatcgacgcgaaaacggctacgtaaagaaatactcacgaaaaggtaatggaacagctattaaatctttaaaatactacgataacaaactcggtaaccacatagatataacaccagaaaactcgagaaatgccgtagtccttcaatcacttaaaccatggcgaacagacgtatacttcaacaaagaaacaggaaaatacgagttcctaggtataaaatacagcgatctatcctttgaaaaaggcacaggcgaatacggaatatcacaagaaaaatacgactcaataaaaatagcagaaggagtagcaaagaaaagtatatttaaattcactttatacaaacaagatctcctctttattaaagacatagaaaataatttcggaaaattactaagatttacaagtaaaaacgatacctcaaaacactacgtcgaattaaaaccatatgataaaaacaaatttggtacagaagaaccattattacctgtgctgggaaacgtagcgaaatcaggacaatgcataaaagggttaaacaaatcaaatatatcaatatacaaagtaagaacagatatactaggatatagacatttcataaaacaagaaggagaacatccccagctaaaatttaagaaatga

SEQ ID NO: 8598 - RNA, 3372 nt, synthetic construct
  misc_feature 1..3372: note = Cas9 variant
  source 1..3372: mol_type = other RNA
atggctaaaatattagggcttgatttaggaaccaactcgataggatgggcattaatagacgatgttcaaaacaaaatccttggagtaggcagcagaatattcccaatgggcgtagaaaaccttggagatggggacggcgaaataagcaaaaatgcaagcaggacgggaacacgaggcgtaagaagacaatttttcaggagacgattaagaaagaaagtcttattaaaagcactttctgaaaacaacatgtgtccgatgataacctccgactttgacaactggaaaaagacgaagcaatttccctccgaaaaactagcaagctggtttgccctgaacccatacgagctacgtaataaggcgctttcagaaaaactaactctagaagaaatcggacgaatcttctatcaccttatacaaagacgtggtttcttatccaacagtagaaaagggggcacagacgatggggcaatattcaaaggtaatcctaaagaagggaaaataggaatcacagatacccaagaaagcatacaagacaagacactgggatcatatctatttgaaatataccctaaggaaaaccaacccttccaaaacggactagaaagaataagaaatcgatatactgttcgaaaaatgtatgtagacgagttcgaaatgatatgggaaaaacaagctcaatattattcaaacttaaacgaagatctaaaaacacttttcggcggaagaaaattagatggatataaagaagacggaattttattccaccaacgaccactaagatcgcaaaaacacttagtcggaaactgtgtattcgaacccaacaaaacaaaatgcccaatatcagcaatacctttcgaacaattcagggtttggcaatgggtaaacacagtagaatacaatggaaagaaaataagtcaagttgaaaaagagaaaatcgttgagttcctgtacgccaacgacaaaacagacttcaagaaaataagaaaagccataggtaaagaatcaacagagttcaaattcaactacaaagatgacgacaaaatagtaggaacctacacagtatcccacttaagcaataagaaatattttggaaagaaatggtttgagttcagcgaaaaagaacaagaagatatatggcacatattatatttctttgactccaaatctaacctaaaagaatatgcaattaaaaactggaactttacggaagaacaagcagaatcaatagcaaaatttaatgttaaagatgggtactcaagtctgtcaagaaaagcgatctcaaatatcttaccatttttgaaacttggctttacatatgatgtcgccgtagtccttggaggaatcaaaaacgtttttggacatgaatgggaaaaattaagtgacgaaaaacgcaacttcctaatagacaatgttgaaggaatagtacgctcaaaaactaaaggaggattcatagatgtgatcaaagacatactacgaaacgactacaacatatccgacaatcagcttagaaaactttatcaccacagtgctactatctacgttgcagaactattagaaaaactaccagtaggcaaagaagcagataaagaaatacagagtataaggaatccgatagtaataaccgcattattcgaactaagaaagctagtaaatgaactaatagatgatttcggctcaatcgatgaaataaaagtagaaatggcaagagacctaaaaatatccaaaagccaacgaaacaaaataagacgcgaacaaaaacgtttagaacgagaaaacgatcgcgtaaaagcacgattactagaagaaggacagagaataacacacgataatatactgttatacaaactatgggaagaatgtaagaaaacatgtccatataccggcaatccgataccattatataaattatttacaggggaaatccaaatcgaacacatacacccatggtccagatcactaaatgacagctttgccaacaaaacactctgctacgcagatgaaaacagaaagaaaggggacaaaacaccatatgaattttatggtaacgacgaaagtaactggtcagcaataaaagaacgagcgctcaaactattttctgatacaaaagaatacccaaatgcataccaaaaattcaaacgcttcgtacaacacaaattcgacgacgattttagctctagacaattgaatgacaccaggtatatcagcaaagaagccaaaaattacctctctaaaatttgtaagaaagtagcagtgagtccaggccaagcaacttcaaatttaagacaaaaatgggggatgaacaatatcctcaatgatgaaaacgagaaaactagagaagatcaccgccaccacgcgattgatgcgttagttatggcatgtacaaaaataagctatgtgcaagaactttctaaatggaatagatacaatcgaaatgcagaactcaagaaatttccactaccctgggaaacattttggtcggatgctaatagagcggttgataaaatcctaatatcccacaagaaagtttccaacgacataacaggtagaacacacataagtgagaaaaacggaaagaaatataaaaatgtaggagtcgctgcacgtggtcaattacataaagaaaccgtctatggaaaacgaaccttcaatggcgaagaagcattccatgtaagaaaaacgatcgattctttaacgacagaaaaacaattagaaaaagttgtagacgaatcaataaaactattaatcaagaaacgagtacaggaattaggagggtttgtcaaaggagccataccagctaatacctttttcgtcgttgatgaaaacggaattaaacaacctcagatatttttaccaaacaaaaatggggcaccagtccccgttttaaaagtcagaatgaaagaaaatataggaggcgctgaaaaactaaaagaaaatgttaatcaatgggtaaatcctaggaataaccatcacgtactaatatacaaagacgaaaaagggaatctaaaagaagaggtagtaacattctggacagtagtcgaacgaaaaagaacaggacaaagtgcatatcagttaccatttgatggcaaagagatagtgaccactttacatataaatgatatgtttctattaggacttaacgaagaagaaataaattgggagaaccccgattatgaagtcttaaaagaacatctatatagagtacaaaaattcacaagtggagactactactttcgtatagcaaaaacaagctcaatacaaaacgcaatagaaaaacaacagattaatagctttggattcggtaaaaatggatggagcacccacaacccaattaaagttaaaatatcagtaagcggaaaaatatcaaaagtttga

SEQ ID NO: 8599 - RNA, 3372 nt, synthetic construct
  misc_feature 1..3372: note = Cas9 variant
  source 1..3372: mol_type = other RNA
atgaatggactagtattaggactggacatcggaataggctcagtaggtgtaggcatactcaataaagacacaggagaaatcatccatacaaattccaggatattccctgctgccacagcagacaacaatgttgaacgccgaaacagccgacaagcaaggcgactgaacagacgaaaaaagcacagaggcgctcgactccacgacctctttgaggattacgacctactaatagattttagtaaagtcagtataaacttaaatccctacagactaagggtacaaggtcttgataatccactaactacagaagaactatttatagccctaaagaacatagttaaacgaagaggaatatcatacttagacgacgcttctgagaacggaggtgcagtatcaagtgactatggaaaagcagtagaagagaacagaaaattacttgctgaacaaacacccgggcaaatacaattagaacgtttcgaaaaatacggtcaagtacgtggagacttcactgtagaagaaaaaggtgataaacatcgactaataaacgtctttagcacctctgcatacaggaaagaagcagaaagaatattacgaaaacagcaagaatttaacaaccaaataacggataaatttatagaagactatttaaaaattttaacagaaaaacgaaaatactatcatggaccaggaaacgaaaaatcaagaactgattacggtagattccgtacagatggaacaacattagataacatattcggaatattaattggaaaatgtaccttctacccaaatgaatatcgagcatcaaaagcatcgtatacggcccaagaatttaaccttctaaatgatttaaataacctaactgtacctacagaaacaaaaaaactcagtgaagaacaaaaaaaaacaatagtagagtacgccaaatccgcaaaaacccttggcgcgtcaacactcttaaaatacatcgccaaaatgatagatgccagtgtagaccaaattagaggataccgagtagacgtaaacaataaaccagagatgcatacatttgaagtttacagaaaaatgcaatctttagagacaatacccgtaggcgaattttcccgagaagtgctcgacgaacttgctcatatattaacactcaatacagaacgagagggcatagaagaggctataaacacaaagttgatggatgtattctcacaagaccaaatactagagttagtccaattcaggaaaaacaattcctcactattctcaaaaggatggcataactttagtctcaaattaatgatggaactcatcccagaattatacgagacctctgaagaacaaatggcaattcttacgcgtctaggtaaacaaaaatttaaagaaacaagtaaaagaacaaaatacatagacgaaaaagaagtgacagaggaaatctataacccagtagtcgcaaaatcagtgagacaagcaataaaaatcataaacgaagcaacaaaaaagtatggcatattcgacaacatagtaatagaaatggcccgcgagaacaacgaggaagatgcaaagaaagattacatcaaaagacaaaaagctaaccacgacgaaaaaaacgccgcaatggagaaagcggccttccaatataacggtaaaaaggaactaccagatagcatatttcatggacataaagaattagcaacaaaaataaggctatggcaccagcaaggggaaaaatgcttgtacactggaaaaaacataccaatcagtgacttaatccacaaccaatacaaatatgaaatcgatcacatccttccattgagtctaagctttgacgattccctatccaataaagtactagtactagcaactgccaaccaagaaaaaggccaaagaacaccattccaagcactagattcaatggatgacgcctggagttatcgtgaattcaaatcatatgttaaagattcaaaactgttaggcaataaaaaaaaggactaccttctcaccgaagaagacatatctaaaattgaagtaaaacaaaaattcatagaacgcaacctagttgatacacgatattcatcacgtgtagttttaaacacactccaagatttttacaaagcacataaattcgacacaacaataagcgtagtccgaggacaattcacaagtcaacttagaaggaaatggggacttgaaaaatcaagagaaacatatcaccatcacgccgtagacgcactcataatagcagcatcatcccaattaagactatggaaaaaacaagcaaacccattaatttcttacaaggaagaccaattcgtggacagtgaaacaggagaaattatatctctaacggacgacaaatacaaagaacttgtcttcaaagcaccttatgctcattttgttgatacactttcatcaaaaaaattcgaagactctattctcttctcataccaagtcgattcaaaatacaaccgaaaaatctctgatgctacaatatacgctaccagaaaagtgaaacttgataaagacaaaagtgaagagacatatgtactcggcaaaataaaagacatatactcacaggcaggatacgacgccttcataaaaatctacaacaaagataaatctaaatttcttatgtaccataaagatccacaaactttcgaaaaagtcatcgaagaaatcctaagaacataccccagtaaagaattcaacgaaaaaaacaaagaagtaccatgtaacccattcgaaaaataccgacaagaaaacggccccatacgcaaatacagcaaaaaagggaatggaccagaaattaaaagtttaaaatattatgataaaaatataccagaaagtttcataaatatcacaccaagcaattctaaaaacaaagtaatcttaagacaacttaacccctggcggacagacgtatatttcaatcatcaaaccgaaaaatacgaactacttggtctcaaatatgcagatctacaatttgaaaaaaaaaccggaacatattcaatcacaattgataaatacaacgagataaaagaaaaagaaggagtaggcgaacaatccgaattcaaatttacactatataaaaacgaccttcttctaataaaagatacaaaaaacaatgaaaaacagatcttcagattccttagtcgaactatgccaaacgttaaacattatgtggaacttaaaccctatgacaaagctaaatttgacggcaaccaaccactaataacaatattcggaaatgtagctaaaggaggacaatgtttaaaaggtctaaacaaatcaaacattagcatattcaaagttaaaaccgacgttctaggaaataaacacttcataactaaggaaggagaaaaaccaaaattaaaattctga

SEQ ID NO: 8600 - RNA, 3378 nt, synthetic construct
  misc_feature 1..3378: note = Cas9 variant
  source 1..3378: mol_type = other RNA
atgaacggcttagtcctaggccttgatataggcatcgcaagcgtaggagtcggaatattaaataaagaaacaggagaaataatacatgtaaactcaagaatatttcccgccgcaacagccgactcaaacgtagaaagaagaggatttcgacaaggaagacgactcggcagaagaaaaaaacaccgttcagctcgattaaatgatttattcgaagaattcggattcataacagacttctccgcagtaccattaaaccttaatccatacgcacttagagttaaaggattatcagaagaactcacaaatgaagaactgtttatagcactaaaaaatataataaaaagaagagggatatcctatctagacgacgcatcagaagatggcgagaccgcatcaaacgaatacggtaaagcggtggaagaaaaccgaaaactactcgcagacaaaacaccaggacaaatacaactagaacgattcgaaaaatatggacaagtaagaggagattttacagtcgtagaaaacggagagaaccaccgattaataaatgtattcagtacaagcgcctataaaaaggaggcagaacgcatactaagacgacaacaagaattcaatgtaagaatatctgacgaattcatagaagcatacttgacaatactaaccggaaaaagaaaatactatcatggcccaggcaatgaaaaatcacgaactgattacggacgattcagaacagacggcaccacgctagataacatcttcggtattcttattggcaaatgtaccttctacccagacgagtatcgcgctgccaaagccagctatacagcgcaagaatttaacctactcaatgatctcaacaacctcactgtcccgaccgaaaccaaaaaactcagaccagaacaaaaacgacaaatagttgagtatgcaagaacagcaaaaaccttaggtacacccaccttactaaaatatattgccaaactcgtagacgggtcaatagacgatattaaaggctaccgaatagataaatcagataaaccagaaatgcatacattcgacgcttatagaaaaatgagaacattggaattagtagacgttgatatactatctagagaaactcttgacgatttagcatacattctcacactaaataccgaaagtgaaggaatattagaagcattaaattcaaaaatgcctggcacttttaccaaagagcaaatagacgaactcattcagtttagaaaaaaaaattcagctgtattcggcaaaggatggcacaacttcagtcttaaactaatgaacgagttaatcccagaactttatgaaacttcggaagagcaaatgacaattttaacgcgactaggcaaacaaagaagccgagaaatatcaaaaagaaccaaatacatagatgaaaaagaattaacagacgaaatctacaatccggtagtcgctaaaagcgttcgacaagctattaaaatcataaaccttgcgacaaaaaaatacgggatatttgacaatatagttatagaaatggcgcgagaatccaatgaagacgacgaaaaaaaagcaatccaaaatgttcaaaaggcaaatgaagacgagaaaaaagctgcaatggaaaaagcagcagacctctacaacggaaaaaaagaacttccagatagtattttccacggccacaaggaattagcaactaaaatacgactatggcatcaacaaggagaaagatgtctttatacaggaaaaaatatctcaatacacgacttgatccacaacccacatcaatacgaaatagaccatatcctaccattatcattatcttttgacgacggtctcgcaaacaaagtactggtcttagcaactgccaaccaagaaaaaggccaaagaactccctttcaagccttagattccatggatgacgcctggagttatatagagtttaaacaatacgtcagaaatagcaaaagccttagtaacaaaaagaaagactacttactcacagaagaagacatatcaaaaatagaagtaaaacaaaaatttatagaacgtaacctcgtcgatacacgatactctagcagagtcgtactaaacacgttacaagaattttacaaaacaaacgactttgacactaaaataagcgtagtaagagggcagttcactagtcaattaagacgaaaatggaaaatagaaaagagccgtgacacctaccaccatcatgccgtagatgcattaattatagccgccagttcccaactgcgactgtggaagaaacaaaacaaccctcttatatcgtacagagaaggccaattagtagatccagaaacaggagaaatactcagtctaacagatgatgaatacaaagaattagtacttagaccaccatatgattactttgtagatacgctaaaatcgaaatcgtttgaagacagtattttgttctcataccaggtcgatagcaaatacaacagaaagataagtgatgctacaatatatggaacacgtaaagcacagctaggcaaagacaaacaagaagaaacatatgtactaggcaaaatcaaagatatatattcacaaaaaggctacgaagatttcataaaaagatataaaaaagataccacccaatttttaatgtaccataaggacccacaaacttttgcaaaagtaatcgaagaaatacttaaaacataccccgacaaagaactgaatgaaaaaggaaaagaaataccctgcaatccatttgaaaagtacagacaagaaaatggccctatccgaaaatacagcaaaaaaggaaaaggaccagaaataaaatcacttaaatattatgacaataaactaggtaatcacattgacattacccctgtaaatagccaaaatcaagtagtactccaaagtctcaaaccctggagaacagacgtatatttcaacccccaaacctcaaaatacgaacttatgggattaaaatactcagatcttagattcgagaaaggaagtggttcatacggaatcagccccgaaaaatacaacaaagtaaaggccaaagaaggagtagacgaagatagcgagttcaaattcactctgtataagaacgacttaatacttataaaagacacagaaacaggagaacaacaactatttcgctacggttcaagaaatgacacctcgaaacattatgtagaattaaaaccttacgaaaaagccaaatttgaaggaaaccagcaactaatgaatttacttggaacggtggcaaaaggtggacaatgtttaaaaggtatcaataaacccaatctaagcatatataaagtgaaaactgacgtgctaggaaataaatatttcattaaaaaggaaggcgaccaaccacaactaaacttcaaaaaaaaaatttga

SEQ ID NO: 8601 - RNA, 3378 nt, synthetic construct
  misc_feature 1..3378: note = Cas9 variant
  source 1..3378: mol_type = other RNA
atgacaagcaaacaagaaaatctaggagcattaacatttggattagatataggaatagcgtcagtaggatgggctgtgcttggagaaaacagaataattgatctcggagtaagatgtttcgataaggccgaaacagctaaagaaggagagagcttaaatctggccagaagaatggccagactcctgcgaagaagattacgacgacgagcatggcgattaaccaaattggcacgacttcttaaaagagaaggtcttatagcagacgctaatttatttaaaaataaaatagaaaagaatacaccagtacccaagagtagctggcaattaagagtagatgcattagatagaaagttaaatgcggaagaatgggcccgagttatataccacctctgcaaacacagaggtttccattggatatcacgggcggaggaaaaggcagcagaatcagatagcaaaggcgaatcaggaaaggtaaaacaaggtctggcaggaaccaagaagctgatgcaagaaaagaactacagaactgccgcagaaatggtactcgcagaatttccggaagcccaaaggaataaacaaggagactactcaaaagcgctatccagaatattattaggcgacgaactaaaaacattatttgaacatcaaagaaaactcgactcaccgtttgctacagagaagctagaggcagcaatactaggaaatggagatcgaaaatcaggactattttgggcccaaaatccggctttagcaggtagcgacctactaaaaatgcttggatattgtacttttgaaaagactgaatacagagctccgaaagctagcttcacagcagaacgacatgtttggcttacaaggttaaataatttgagaattgttgttgatggaacaacccggccactaaatgaagcagaaaggcgaatagcacttctaatgccttatcagcaagccggtgattttacatataaacaattaagaacagcgttaacaaaagcaggtttcctacccgaaagtttcagatatacgggattatcatatgcaagtggacaaaaagcaggagagaaaacaaaagatcctgaaagtgccgctctcgtaaaattccctgcatggcaagaactacgcaaaacgctagaaaagaaagaattagcttcagaatggcagaaaatttcaactgatgcactagacgggaaaccacaattgctagaccaaatcgcctgggttctatctgtctataaagacgatgacgaagtaaaagcagagctatctaaactgaaccttccaaatgctgagaaaatgatcgacgcattactagacataagatttgataaattttcaaatcttagcctaaaagcattgtgcaaaattgtcccacttatggaacaaggacaaaggtacgacgaagcaatagcaaacattccagaatatggacaccatagccaactacataaagtcggtgctggagaacataaatatttaccaccattttataaagaaagagataaaaccggtaggatggtctttaatgatgatatggatataccacgaaatcctgtagtattaagagccttaaaccaagcacgaaaagttgtgaatgcactaatcaaaaagtacgatagtccacatgaagtacatattgagatggcacgagatctttcacgaccgttagatgaaagacgagaagtcgaaaagttacaaaaagaatttcgtgacaataacgaaaaaggaaaagctcaatttgcccaagactttaatatagtaggtgcagtaaagggaaaagaatttgaaaaatatcaattatacagagaacaacaaggaaagtgcgcatatagtatcgaaccaatggacatccacagactatttgaacaaggatacgtagaaatcgaccatgctttaccgtatagcagaagttttgacgatagcaaaaacaatagagtattagtcctagcaaaagaaaacagagataagggaaatagaaccccattcgaatacttaggtggaaaagataattcagaaccttggcgacaattcgtagcttttgtcgaaggaaataaagcatatagactagcaaaacgaagccgcctcttaaggaaagacttcggggataaagaagctaaagagttcagagaaagaaacttaaacgatacacgatacatctgtaaattctttaaaaattacgtagaacaatatctacaattacacgaagactcagaagcaaaaagatgtgtagtcctgagcggacaaatgacctcattcctcagggcgagatggggtctggtgaaagtacgaggtgatagtgacagacatcatgctctggacgcagcagtagtcgcagcatgttcacatgggatggttaaaagactatcagactatagccgaaggaaagaattggagcaagtaagggaagggttcgttgatgtagacacaggtgaaatagtaaatccagcaatgtttcaacaagtacaagaacattttcctaacccttggccccatttcagagacgaggttaaactaaggttatctatggatgacccagccttactaaggtccgaaatggaaaaatttgggacatataccccagaagcactacaagcattacatccactatttgttagtcgggctccccaaagacgaaatagtggagctgctcataaagacacaatttacgctcaacctaaaagattagtcgcccaaggcggtgtgacacaaaaagtagccttgacatcattaactttgaaagatctagacaaattaatagacccacacagaaatgataaactatacacagcaataagggcgagattagaacagcacggaggtaaaggcgataaagcgtttccatcgtccaatcctttaagaaaacccgattctgaaggaaacccgactggccctatagtcagaggagtaaccatggtaatcgataagctctcaggaataccaataaggggaggtatagctaaaaacgattcaatggtaagagtagatgtatttacaaaagcaaataaatttcacctagtacctgtgtacgtgcatcataccgtagctaaagcactacctaatcgagctgtagttgcttttaaagacgaagatgaatggactcttatcgacgatagttttgacttttgcttctcattacatccaaatgatctagtccaagtacagcaaaaaggaaaagccggaatgattggatactactcgagctgccatagaggaactggaaatataaatctatgggcccatgatagaaatctacaagtaggaaaggatggtatgatagaaggtataggggtaaagacagcactatcattagaaaaatttaatgtagatgtcctaggtaatagatacccagccccaccagaaaaacgcagagatctcgcatga

SEQ ID NO: 8602 - RNA, 3378 nt, synthetic construct
  misc_feature 1..3378: note = Cas9 variant
  source 1..3378: mol_type = other RNA
atgacagaccgcataagtctcgggctagatataggagtagctagtgttggattcagcgtcttagacatagataaagggaaagttatagaactaggagccagactattcaatgcaactgtagcagcaggaaatcaagacagaagagatatgagaggaagtcgaagactattaaaccgtaacaaacaacgaaggaaagacgtaagcaaattattccaggaatacggattgttagacaacttcgacagagataattttcacacagcttttaataacaattggaacccttacgagcttagagtcaaaggacttactaaacaattaaacaaagaagaattagcagattcactttaccagataatcaaaagaagaggaatatcatacgcattaaaagatgctgatgcaaatgaagatggaacagactactcatcatcactaaaaataaacagccaagagctaatagaaaaaacaccagcccaaatacaacttcaaagactaaacgactatggaaaagtcagaggtaaagttatagtcggagacgatatagatgaccaaaaagtactcttaaacgttttccccacaaatgcgtacgaaaaggaagcaagacaaattatagcaacccaacagcaattctatcctgaaatacttacaggcgaatttgttaaggaatactgccaaatattaacaagaaagcgagactatttcgtcggacctggcaacgaaaagagccgaacagactacggaatctataaaacagacggccgaacgctagacaatctctttgaagaactgataggacatgacaagatatatccagatgaactccgagcgtcagccgcgtcttacacagcccaactattcaacgtcctaaacgatctaaacaatctcagaattttatcctatgaagacggtaaactaactcagatagataaagaaaaaattatagcagaaatcaaaaataacacaacagtcgtaaatatgctcaatgtaataaaaaaagtcacaggttgccaaaaagacgacataaaaggatttcgtctaaacgaaaaagataaacccgaaataagttcaatgcctatatacagaaaagcacacaaagactttctaaaagtaggtattgatataacagactggcccatcgattttatcgacagactctccttcatactaacactaaataccgaaaacggcgaaataagaaaacaaatcaacaaaaggttagtacctgacttcgacttcctaaacgatgacttagtacaacttataatagacaataaagacagtttcgatattaaaacaaacaacaaatggcacagattttcactgaaaacgatgaataaactaatacccacaatgatagagagaccagtagaacaaatgacattactaacagaaatgggcctaataaaaaaagacacaaaaagattcgaaggaaataaatacttaccgtataaagaaattgcgaatgacatattcaatccagtagctagcaaaagtgttcgagaagcgttaaaaatagtgaacgcagtacttaaaaagtacggacatattgagtacattgtaatagagatgcccagagacaaaaatctggatgaagaaaggaaacaaatagcggacttccaaaaaaaaaacaaaaaaatcaaagatgcagcatttaacgcgtttgtcaaggccgtaggatctaaaaaaaacgtaaaaatcgcccttagcaaaaacagaaaattacaaatgggaataagattatggcaccaacagcaagggatagatccatataacggtgaagagataaacgcaaatgacttaatatcaaatccagacaaattcgaaatcgaccatataataccacaatccatatcatttgacgatggaataaataacaaaacactatgcttcgcctccatgaatcaagttaaagggcaaaaaaccccatatgaatttcttaatgaaggacacggacaaggatatgctaaattcaaagcaattgtaagcaagaacaaaaacttctctaaagcaaaaagggataattacctgttcgaagaaaatgtcagcaatatagaaacaagaaaaagattcttatccagaaatctagtagacacaagatactcaagcagagtagttctaaattcattacaagaattcttccatgaaaaaagcgacgataccaaagtaaccgtaatacgaggaaaatttacatccaacatgaggaaacattggcacatagataaaactagagacacctttcatcaccacgcaatagatgcatcaataatagccgcaacacccttcctacggatgtggaaaaaaggcagtacaatttttcccacgaaaataaatgaaacaagtatcgatatagaaacaggagaaatactagacgataaaaacttcgacaaagtgatgtatgaagaaccttactcaggatttatatctgaaatcatgaacgctgacgatagaattaaattctctcaccaagttgataaaaaaatgaatagaaaagttagcgacgcaacaatatatagtacacgaattggtaaattaagcaaagacaaaaaagacgcagaatacgtagtagcaaaagtgaaggatatatactccgttgatggctacgagaattttaaaaaagtatataaaaaagacaaaacaaaattcctactctacaaatatgatccgcgcacattttcagaattagaaaaaatcgtaattgattatccagataaaatagaaaaggtccaaaccaacggcaaaataaaggccgtagacatatcgccatttgaactctacagaagagacaatggtatggtaagaaaatattcgaaaaaaacaggtcctgcaataaaacaattaaaatatctcgacaaaaaactaggatcacacatagacataacgccaaaaaacgctaataacaaacatgttgttctccaaagcctgaaaccatggcgaacagacgtatatctgaaccacgaaacaggagaatatgaaataatgggtataaaatatagcgatttaaaattcaacaaaaatgaaggctatggaataaaaaaagacaagtatcttaaaataaaaaatatagagggagttagcgaaaatagcgaattcatgttcagcctatacagaaaagatcgtattaaggttcaagacatggaaacaaatgaatccgtagaactactcttctggtcacgcaacttctctaacaaaaaatacgctgaacttaaaccgatttctcaaattgacaatgacaaagtcttaccaatctacgggcgaggcagacttatcaaacgactcattcccaaaaattgcaaaatatggaaagtaaatacatccatacttggagatacctattacctcgaaaaagaatcaaattatccgcagaaaatactagactga

SEQ ID NO: 8603 - RNA, 3381 nt, synthetic construct
  misc_feature 1..3381: note = Cas9 variant
  source 1..3381: mol_type = other RNA
atgaatgggctagttttaggacttgatatcggaatagcaagcgtaggcgtgggaatactgaataaagaaactggagaaataattcacgcaaattccagaatatttccggcggccacagcggacagcaacgtagaacgaagaggattccgacaaggcagaaggctaggcaggagaaagaaacacaggagtgcaagactaaacaatctattcgaagagttcggattcatcacagactttagtgcaattccattaaacctcaacccatacgcactacgcgtaaaaggattatctgaagaattaacaaatgaagaattattcatagcattgaaaaatataataaaaagaagaggtataagctacttagacgatgcgtctgaagacggggaaaccgcaagtaacgaatatggaaaagctgtagaagaaaacagaaaattattagccgacaaaactccaggtcaaatacaattagaaagattcgaaaaatatggacaagtacgaggcgacttcaccgtagtagaaaatggagaaaaccatagacttataaatgtattcagtacttctgcatacaagaaagaagcagaacgaatactccgaagacaacaggaatttaatgttcgtatatccgacgaatttatcgaagcatatctgaccatactcacaggtaaaagaaaatattaccacggaccaggcaacgaaaagagtagaaccgattacggaagattccgcacagatggaacgacgctagacaacatctttggaatattaattggaaaatgtacattctacccagacgaataccgcgctgccaaagcctcatatacagcccaagagttcaacctactaaacgatttaaacaaccttacagtacccactgaaactaagaaactatcacccgaacaaaaacgccaaatcgtagaatacgcaagaactgcaaaaactttaggaacaccaacactactaaaatatatagcaaagctagttgatgggtccatcgatgatattaaaggatatcgaatagacaaatctgacaaacccgaaatgatgcacacgttcgacgcctacagaaaaatgcgaactctagacttagtaaatatagacgcactatccagagaaacattagacgatcttgcccacatactaacactcaacacggaaagcgaaggaatacttgaagcattaaactccaaaatgccatcaacctttacaaaagaacagatagatgaattaatacaatttagaaagaaaaacagtgccgtatttggcaaaggttggcacaatttctcacttaaattaatgaacgagctaataagtgagctatacgaaacaagtgaagaacagatgacgatactgacaagactaggcaaacaaagatccagagaaataagcaaacgaacaaaatatatagacgaaaaagaattaactgaagaaatatacaatcctgtagtagcaaaatcagttagacaagcaataaaaataataaacgaagcaaccaaaaggtatggaattttcgacaacatagtcatagaaatggcacgcgaaaacaacgaggaagatgcgaagaaagattacatcaaaaggcaaaaagcaaaccaagatgagaaaaacgcaagcatggaaaaagccgcctttcaatacaatggtaagaaagaattacctgactcaatattccacggacacaaagaattagccacaaaaataagactatggcatcaacaaggggaacgttgcctgtacacaggcaaaaatatttcaattagagacctgatacataatcctcaccaatacgaaatagatcacatcctcccactgtcgttatctttcgatgacggtctcgcaaacaaagttctcgtacttgccacagcaaatcaagaaaaaggccaacgaacccctttccaggctatagacagcatggacgatgcctggagctatagagaatttaaacagtatgttcgaaattccaaatccctatccaacaaaaagaaagactatctactaacggaagaggacattagtaaaatagaagttaaacaaaaattcattgaaagaaatcttgtagatactagatattccagtagagtagtattgaacacactacaagagttctataaaactaacgacttcgacacaaaaattagtgtagtcagaggccagtttacctcccagcttagaagaaaatggaaaatagagaaaagtagggacacataccaccaccatgcagtagacgccctaatcatagccgcctcttcacaactacgattatggaagaaacaaaacaatccattaataagctataaagaagggcaattcgtggacccagaaacaggtgaaatattatccctaacagacgatgaatacaaagagctagtattccgccctccttacgactatttcgtagacacattaaaaagtaaaagtttcgaagacagtatccttttctcctatcaagtagatagcaaatacaaccgcaaaatctcagatgccacgatatatggaacccgaaaagcgcaattaggcaaagataaacaagaagaaacttatgtactaggaaaaataaaagacatatactcacaaaaaggatatgaagacttcatcaaaagatacaataaagatgaaacacaattcttaatataccataaagacccacaaacatttgaaaaagtcatcgaagaaatcctaaaaacatatccagacaaagaattaaacgaaaaaggcaaagaaatcccatgcaacccattcgaaaaatacagacaagaaaatgggccaataagaaaatattcaaagaaaggcaaaggaccagaaataaaaattctaaaatattatgacaataaactaggtaatcacatagatataacgcccgtcaactcacaaaaccaagtagttttacaaagtctaaaaccatggagaactgatgtatatttcaaccctcgaacatcaaaatacgaactcatgggactgaaatatagtgacctcagattcgaaaaaggatctggatcatacggcatcagccccgaaaaatacaataaagtaaaagcaaaagaaggcgtaaatgaagactcagagttcaaattcacattatacaaaaacgatctaattctgataaaagacaccgaaactggagaacaacaactattcaggtacgggtcaagaaacgatacatcaaaacactatgtagaactaaaaccatatgaaaaagcgaaattcgaaggaaaccaacaactaatgaatctactaggaacagtagccaaaggtggccaatgtctcaaaggaataaacaaaccaaacttatcaatttacaaagtgaaaaccgatgtactaggcaacaagtattttataaagaaagaaggagaccaaccccaattaaacttcaaaaagaaattctga

SEQ ID NO: 8604 - RNA, 3381 nt, synthetic construct
  misc_feature 1..3381: note = Cas9 variant
  source 1..3381: mol_type = other RNA
atggcatcaaaacacgaaaatcttggtgccctaacattcggactcgatataggaatagcaagcgtaggatgggcagtcctaggagaaaacagaataattgatttaggtgtacgatgttttgataaagcagaaacagcaaaagagggagaatctttaaatctagcacgaagaacagctagattactaagaagaagattgcggagacgagcatggcgtttgactaaattagcacgactcctaaagagagaaggtctcattgcagacacaaacgtcttccaaaaaccctttaatctaaaagatgcaaatgaaaaaggactatcattttggcaactaagagtagatgcattagatagaaaattaagcgccgaagaatgggcacgagtaatatatcatctctgcaaacacaggggtttccattggattagtagagctgaagagaaagcagctgaaggagactcaaaaagcgaagggggaaaagtcaaacagggactcgcaggtacaaagaaattaatgcaagagaaaaactacagaaccgccgctgaaatggttctcacagagttcccagaagcccaaagaaacaaacaaggcgattatagtaaagcactttctcgcattttattaggagatgaaatgacacagttattcaaacaccaacgtgaactgggaaatccgcatgccactgaaaagctagaagcagctatcttaggaaatggagatcacaaaagtggactattttgggctcaaaatccagcgttagcaggaaacgatttactaaaaatgttaggccattgtacatttgaaaaggcagaatatagagtaccaaaagctagctttacagcagaaagacacgtgtggcttactcggctgaataacttgagaatagtcgtcgacggcacaacaagaccactcaatgaagccgagagacacttagcactattaatgccatatcaacaagcaggagatcttacatataaacaattacgtacagcacttacaaaagccggatatctaccagaatcatttagatataccggacttgcatatgcttccgggcaaaaagcagacgaaaaagcaaaagatcctgaatctgcacctctagtaaaattaccagcatggcacgaattaagaaaaacactagaaaagaaggaacttgcatcagaatggcagaaaataagtagcgacgcattggacggtaaacctcaactgctcgaccaaatagcatgggtcctttcggtttataaagacgatacagaagttgaggcggaactatgtaagttaaacctaccaaatgcagagaaaatgatcgatgcactattagatattagatttgacaaattttccaacctatcactaaaagcattacgtcaaattgttccgttaatggaacaaggacaaagatacgacgaagctgtcgctaatataccagaatatgggcaccattcccaattacacgaagtcggcgcgggtgaacataaatacctacctccgttttataaagaaagagacaaaacaggacgaatggtatttaacgatgacatggatatccccagaaacccagtcgtactacgcgcactaaatcaagcccgtaaagtagttaacgcactaataaaagaatatggatccccacatgaagttcacatagaaatggcaagagatttatcccggccactagatgaaagaagagatgttgaaaaactacaaaaagaatttcgtgatagaaatgaaaaagacaaggcgctattcgcacaagactttaatatagtcggagcagtaaaaggaaaagagttcgaaaaataccaattatacagagaacaacaaggaaaatgcgcatactcgatcgaaccaatggatattcacagattatttgaacaaggttatgtagaaatcgatcatgctttaccatactcaagaagtttcgacgatagcaaaaacaaccgtgtcctagtactagcaaaggaaaacagagataaaggcaaccgaacaccatttgaatacctcgggggaaaagataattccgaacgatggagacaatttgtcgcttttgtcgagggcaacaaatcataccgattagcaaaaagatcaagactattaaggaaagactttggtaaagatgaggccaagggtttccgtgaaagaaatctaaacgatacacgatatatatgcagattctttaaaaactatgtagaacaatatctacaattacatgaagactcagatgccaaaagatgcgtagtactttccgggcaaatgaccagctttctacgcgcgagatggggattggtaaaagtacgaggcgactcagacagacatcatgcactagacggagcaattgtcgcagcatgtagtcactcaatggtaaagagactaagtgattactcaagaagaaaagaactagaacaagtaagagcaggatttgtcgatgtagatacaggagaaattgtcaatccggcaatgtttcaacaggtacaagaacattttccaaatccatggccccattttcgtgatgaagtcaaactgaggctcaacgttgatgacccagccttactacatagtgaaatgaacagatttggaacatactcaccggaggcactaaaagcacttaggccactcttcatctctagagcaccacaaagaagaaacagcggagcagcacataaagacacaatttatgctcaaccagaaagacttgtagcacaaggaggagttacccaaaaagtaccactaacttcattaacactaaaagacttagataaacttatagacccccatagaaatgaaaaactttacagcgctatacgtataagattggaacaacatggagggaaaggtgataaggctttcccagcgagcaacccattgagaaaacccgactcagaaggcaatccaactggtcctatagtaagaggtgtaacaatggtaatagataaactgagcggaataccaatacgcggtgggatagccaaaaatgactcaatggtacgagtagacgtttttacaaaagcaggaaaattccatctcgttcctgtatacgtacatcatgcggtagcgaaagtattaccgaacagagctgttgttgcatataaagatgaaacagagtggacactaatagatgacggatttgatttttgctttagcatgtaccctaacgatctgctgagaataaaattaagaaatgcctcacacctaggatattatgcatcatgtaaccgaagtacaggcgcaattaatttatggagtcacgatagaaatcagcaagtaggcaaagatggtatgatagaatcgattggggtaaagactgctttaaatgttgaaaaattaaacatagacgtattaggaaatcgttatccagcacctccagaaaaacgaagagatcttgcatga

SEQ ID NO: 8605 - RNA, 3384 nt, synthetic construct
  misc_feature 1..3384: note = Cas9 variant
  source 1..3384: mol_type = other RNA
atgtctgatctggtattaggactagatatcggaataggttcagtaggagtcggtatactcaacaaagttacaggcgaaataatacacaaaaactccagaatattcccagcggctcaagctgaaaataacgttgaaagacgaataaatcgacaaggaagaaggttaacaagaagaaagaaacatcggagagtaagattaaatcatctgttcgaagaatcaggactaataactgactttacaaatgtaagtatcaacttaaatccataccaactacgtgtaaaaggtctaacagacgaactaagtaatgaagagttgttcatagccctgaaaaacatggtcaaacatagaggaattagctacttagatgacgcaagcgacgacggcaactcttcagttggagattacgcacaaatcgtaaaggaaaattcaaaacaacttgaaaccaaaacaccaggtcaaatacagctggaaagataccaaaaatacggacagctcagaggggattttaccgtagaagaagatggcaagaaacataggttaataaatgtattcccaaccagtgcataccgagcagaggcgctgcgaatcttacaaacgcaacaagagttcaatccgcaaataacagacgaatttattaacagttacctacaaatacttactggaaaaagaaaatattatcacgggcccggaaacgaaaaatccaggacagactacggccgatacacaactaagaaagatagcgaagacgaatatataacactagacaacatattcggaatcttaataggaaaatgcaccttctatccagaagaatacagagccgcaaaagcatcatatacagcacaagagttcaatctattaaacgatctcaataacctaacagttccaacagaaacgaagaaactaagcgaagaacagaaaaaccaaatcataaccaatgttaaaaatgaaaaagcaatgggccccgccaaattatttaaatacatagcaaaacttctaagttgtgatgtagcagacataaaaggttacaggatagacaaaagcgacaaagcagaaattcacacatttgaagcataccggaaaatgaaaacactagcaaccatagatatagaacaaatggaacgggaaaacctcgacaaattagcatatgtactcaccctcaatacggaaaaggaaggaatacaagaggctctagagcatgaatttgcagacggcacattttcacaagaacaaatagacgagctagtacaattcagaaaagcaaactcaagcatattcgggaaaggttggcactctttctccgtaaaattgatgatggaattaataccagaactatacgcaacatcagaagaacaaatgactatactcaccaggcttggcaaacagaaaacaacatcaagttcaaacaaaaccaaatatattgatgaaaaacaattaacggaagaaatatacaacccagtcgcagcgaaatcagtacgtcaagcaattaaaatagtcaacgcagcgataaaggaatacggagactttgacaacatagtaatagaaatggcgagagaaaccaacgaggacgatgaaaagaaagcaatacagaaaatccaaaaagcaaacaaagacgaaaaagacgctgcaatgctaaaagcagccaaccaatacaatggaaaagcagaattaccacacagtgttttccacggacacaaacaactagccactaaaataagactttggcaccaacaaggagaacgatgtctatacactggcaaaactatatcaattcacgatctaataaataactcgaaccaattcgaaatagaccatatccttccactctcaattacgttcgatgattcccttgccaataaagtcttagtttatgccacagcaaaccaagaaaaaggacaaagaacaccatatcaggcgctagacagtatggatgatgcatggagttttcgcgaactaaaggcattcgtaagagatagcaaagccctctcaaacaagaagaaagaatacctgttaacggaagaagatataagtaaattcgacgtcagaaagaaatttatagaacgcaacctcgttgacacacgatacgccagtcgagtagtactaaatgcactacaagaacattttagagtccacaaaacagatacaaaagtatcagtagtacgaggacaatttacttcacaattaagaagacattggggtatcgagaaaacaagagacacgtaccatcatcacgctgtagacgcgcttataatcgcagcctcctcacaactaaacctatggaagaaacagaaaaatactctagtaagttattcagaagatcaactcttagacatcgaaacaggggaattaataagcgacgatgaatataaagaaagcgtatttaaagctccctatcaacattttgtggacacattaaaaagtaaagagttcgaagattcaatattattttcataccaagtagactcaaaattcaatcgcaaaatatccgacgcaacaatatatgccacaagacaagcaaaagtaggtaaagataagaaagacgaaacatatgtgctgggaaaaataaaagacatttacagtcaaacaggatacgacgcattcataaaaatatacaagaaagacaaatcaaaatttcttatgtatagacatgaccctcaaaccttcgaaaaagtcatcgaaccaatactggaaaattacccaaataaagaattaaacgaaaaaggaaaagaagtaccatgcaatcctttcctgaaatacaaagaagaccacggatatatacgaaaatattcaaagaaaggaaatgggccagaaatcaaaagtctaaaatactacgatagcaaattaggaaaccatatcgacattaccccgaaaaattccaataacaaagtagtattacaatcagtttcaccatggagagccgacgtatatttcaacaaaacaacaggaaaatatgaaattttaggattaaaatacgcagatttaaaattcgaaaaaggaacaggaacatataaaatatcggaagaaaaatacaatgatatcaagataaaagaaggagtagacagcgatagcgaatttaagtttacactttataaaaacgatctactactaataaaagacacagaaactaaagaacaacagctatttaggtttctgtccagaacaatgccaaacgtaaaacactacgttgagctaaaaccatacgataaacagaaattcgacgataacgaagaactcataaagatactaggaattgttgcaaaaggaggacaatgcaaaaagggcgtaagcaaacccaacatctcaatttataaaatacgaaccgacgttctaggtaatcagcacatcatcaagaacgaaggagataaaccaaagctcgacttttga

SEQ ID NO: 8606 - RNA, 3384 nt, synthetic construct
  misc_feature 1..3384: note = Cas9 variant
  source 1..3384: mol_type = other RNA
atgaatggacttgtccttggattagatatcggaatcgcttcagtaggggtgggaatactcgaaaaagactctggtaaaattattcacgctaacagtagaatatttcctgcagcaaccgcagataacaacgtagaacgtagaacctctagacaagcgcgaaggttaaatcgacgaaagaaacaccgatccgtccgccttcatgatctcttcgaagaatacgggttattaacagactttagtaaagtaagcatcaacctaaatccctatcaaataagagtacaaggactcgacaaacgcttaacaaacgaagaactcttcatcgctcttaaaaatattgttaaacgccggggaatctcctatctagatgacgcgtcagaagatggaggtgcagtctcaagcgactatggaaaagcagtagaagaaaacaggaaactactcgctcaacaaacacctggccagatacagttagacagatttgaaaaatatggtcaagttagaggagatttcacagtagtagaaaacggagagaaacgacgattaataaatgtattcagcacatcagcctatagaaaagaagccgagagaatcctccggaaacaacaagaatttaacaataaaataacagagggcttcatagaagattatctcactatactcacaggtaaaagaaaatattaccacgggcccgggaacgagaaatcaagaacggactacggaagatatacaacaaagaaagacagccaaggtgaatacataacacttgacaatatattcggaatactaataggaaaatgtacattctacccagacgaatatagagcaagcaaagcaagttacactgctcaagagttcaatctactgaacgacctaaacaacctcacggtcccaacagaaactaagaaactatcagtcgaacaaaagaaaacaatagttgaatacgccaaaactgcaaaaacattaggagcgtcaacactcttaaaatatatagcaaaactaattggagtatcagtagatcaaatacacggatatcgaatcgacccaaacgaaaaaccagaaatgcataccttcgaagtgtatagaaaaatgcagagcttagaaacaataagagttgaggaactacctagaaaagtaatcgatgaacttgcacatatacttacactcaacacagaacgtgaaggcattgaagaagccatcaatgcgaaactcaaagatatattctctcaagatcaagtattagaattagtccaattccgtaaaaataattcgtcattattctcaaaaggatggcataacttttccctaaaactaatgatggaactaataccagaactctacgagacaagcgaagaacaaatgactatcctaacccgattaggaaaacagaaaagcaaagaaacatcgaaacgaacaaaatacatcgatgaaaaagaattaactgaagaaatatacaaccctgtagtagccaaatcagtccgacaagctattaaaataataaatgaagcgactaaaagatatggaatctttgataacattgttattgagatggctcgcgaaaacaacgaagaagacgcaaagaaagaatatattaaaaggcaaaaagcaaacctagacgagaaaaacgcagccatggaaaaagcagcatttcaatacaacgggaagaaagaattaccagacaatgtattccatggacataaagaactcgcaaccaaaataagactatggcaccaacaaggggaaaaatgtctttatacaggtaaaaacatcccaattagcgatctaatacaaaaccgttataaatacgaaatagatcatatactacccctatctttatcatttgatgacagcctatccaataaagtgctagtactagcaacagctaaccaagaaaaaggacaaagaacaccatttcaagcactagacagtatggattacgcctggtcgtacagagagttcaaatcatatgtcaaagatagcaaactactaagtaataaaaagaaagattacctattaactgaagaagatatatcaaaaatagaagtaaaacaaaaattcattgaaagaaatttagtagacacacggtacagctcacgggtcgtcctaaacgcactacaagatttttataaagaacaccaatttgatacaacaatatcagtagtgcgcggccaattcacttcacaacttagaagaaaatggggaatagagaaaagccgagaaacttatcaccaccatgcagtagacgcgctaataatagcggcttcatcccaactaagactatggaagaaacataacaatcccctcatatcctacaaagaagaacaattcgtagatagcgaaacaggagaaattatatcaatgagtgacgacgaatacaaagaactggtattcaaagcaccctacgatcactttgtcgatacactaaaatcaaagaaattcgaagatagcattttattctcataccaagtagattccaaatacaatcggaaaatatcagatgcaacaatatacgcaacacggaaagcaaaattagacaaagacaaaagtgaagaaacttacgtactaggtaaaattaaagatatctattctcaagccggatacgatacattcataaaaatatacaacaaagataaatcacgatttttaatgtatcacaaagatccccaaacattcgaaaaagttatcgaagaaatattaagaacatatccttcaaaagaactgaatgagaaaaataaagaagtgccatgtaatccctttgaaaaataccggcaagaaaatggtccaatacgaaaatattcacgcaaaggcaacggaccagaaattaagagcttgaaatattacgataacaaattaggaaaccacatagacataacccctaatgaaagcatgaaccaagtagtactacaatcactaaaaccctggcgaacagacgtattctttaaccatcaaacagaaaaatacgaactgatgggtctaaaatatagcgatttaaactttgaaaaaggctctggaaaatattccatatcactagaaaaatacaattctataaaaatgaatgaaggcgttagtgaagaatcggagttcaaatttacattatataaaaacgacctaatactaattaaagacgcattaacaaaagaagctcaaatattcagatacggaagcagaaatgacacaagcaaacattatgtcgaattaaaaccatacgacatgagcaaattcgaaggagatgaacgactaataaaagttctagggacagttgccaaaggtggccggtgcataaaaggattaaacaagaaagacattagcatattcaaagtaaaaacagacgtgttgggaaacaaacatttcataaagaaagaaggtgaagaaccaaaactaaaattctga

SEQ ID NO: 8607 - RNA, 3387 nt, synthetic construct
  misc_feature 1..3387: note = Cas9 variant
  source 1..3387: mol_type = other RNA
atgaccaaactcggaaaaccctacgggataggagtagacatcggttcaaattctataggatttgcagcagtagatgaaaactctcatttaattaggctcaaaggtaaaaccgtcataggtgcaagattgttcgaggaaggtaaagccgcagcaaaaagacgagcaggcagaacaacacgtcgacgattaagcaggaatcgttggagactcagctttttacgcgatttcttcgaaagccatataacaccgactgatccaaactttttcatgagacaaaaatatagcgaaatctcacccaaagataaagcacggtataaatatgagaaaagattatttaatgacagaacagatgcagagttctaccaacaatattcaacaatgtaccacctgagaaacagattgatgacagatccatctagagcagacgtccgagaaatatattttgcaatacatcatatactaaaaagtagaggccacttcctaactcccggagatgcaaaagacttcaacacaaatgatgtagctttagacgaaatcttccctgcactgcaagacgcttatgcccaagtataccctgatttagggatcacattcgatgaagataaagcaaacgagttcaaaactatcttactcaatgaaatcgcaacaagtattgacacacaaagagctcttgtaaaactattattagccgaagaagatgacaaagatattttaaaacaacaaaaacaagtattaacagaatttgctaaagcagtggtcggtctaaaaactaaattaaacctagcactaggaacagaagtcgattcaagcgaagccacagcgtggaacttttccttgggacaacttgacgataaatgggctggaatagaatccgcaatgacagatgaaggaacagaaatacttgatcagataagagatttataccgcgcacgtctactaaacgggatagtacctactggaaaaaccttatcacaagcaaaagtagacgactatacacaacaccatgaagacctacaattatttaaagcctacctaaaacaactagaagacgacggaacagctaaagcaattagacaattatacgacagatacatagacggtgatgatgcagctccattcttacgcgaaaacttcgtaaaagcactgaccaaagatgtcactgctcatccaaataccaaaagccctgaattattagaaagattagctcaacctgactttatgcttaagcaacgtaacaaagctaacggcgctataccggtacaaatgcaacaacgcgagctcgatcaaattataaagaaccaagctgtatattacgattggctagcagcccccaacccagtcgaaaaacaccgaaagagcatgccttaccaattagatgagctcctaaacttccgaataccatattatgttggacccctagttacagcaaaagaacaaaaggccgctcagggaggtgtattcgcctggatggtacgaaaggacccagaaggcaatataacaccatacaatttcgacgaaaaagtcgacagagaagcatcagcgaatacattcatacaacgcatgaaaacaacggatacatacttaatcggtgaagatgtactaccaaaacaatcacttctttatcagcggtatgaggttctaaatgaactaaacaatgttagagttaataatgaaaaactatccatagaacaaaaacaacaagtaataagggaactatttgaaagacataattctgtaactataaaacaatttgctgagaacctaagagcacacggagattatgcacacataccagaaatacgaggattagcagacgagaaaagatttctttcttcactatcaacatacagacagctaaaatccctattaccagaagccatagacgatccagcaaaacaagctgacatagaaaacataatcgcatggtcaacggtttttgaagatgcagcaatatttaaaacaaaattaaaagaaatctcttggctcggtagcgaggcaatcacaaaactgagtaacatcaggtataggggttggggacagttttctcgtaaatttttaaatggactgaccttgggaaacggacatacgataatacaagagttgttactatcaacaaataacttaatgcagatcctaacagatgagacacttcaaaagaaaatgacggaattaaacgccgacaaattaaaaacagcaaatattaatgacgcgatagataacgcatatacttcaccatcaaacaagaaagcgctaagacaagtcttacgtgtagtagatgacattaaacgagcagctgatggacaagacccatcatggttatacgtggaaacagcagatggtgggggcacgcccggaaagcgaaccagagctaggcaacatcaattacaagaaatttatgcaaatgcagcgcacgaattaatagatacagccgttagaggagagctagaagataaaataagcgacaaagcagactttaacgacagattagttttatactttatgcaaggtggaagagatatatacacaggagcaccattaaacatagatcaattaagttcctacgatatcgatcatatcttaccacaatcactaataaaagataatagtctagataatcgagtgttagtacacgctataattaaccgggagaaaaacgcaacctttgcctcaacaatatacgctcagaaaatgaatgcaacctggagacaatggcatgaagccggactcatttcaggccgcaaattaagaaatttacaaatgaggccagaccaaatcgataaatatgcaagtggtttcgtcgcaagacaattagttgagacaagacaaataataaaactaacggaacaaatagtagcagcccaatacccagacacaaaaattatagcagtaaaggcagggttatctcaccagctcagagaagaactagaatttccgaaaaatagagatgtaaaccactaccaccacgctttcgatgcttttctagccgcacgaatcggcacgtatttattaaaaagatttcccaacctacaagcattctttacatatggaaaattcacaaaagcagatgttaagaaattgagaggttttaattttataagagacatcactcacgcagaagataaaatcgttgcaaaagatacaggtgaagttgtgtgggacaaacaaagggatgtagacgaactagataggatatataacttcaaaagaatgctcataacccacgaagttcgatttgaaactgcggatctatttaaacaaactgtatacggagcaagagattcaaaagaagccggaggctctaaacaacttataccaaagaagaaagacatacaactgatattcatgggagctataagcgaaagaaccagacctattctacccctttga

SEQ ID NO: 8608 - RNA, 3387 nt, synthetic construct
  misc_feature 1..3387: note = Cas9 variant
  source 1..3387: mol_type = other RNA
atggacgagaaaatggattatagaataggtttagacatcggaatcgcaagtgtaggatgggcagtactacaaaacaactcggatgatgaaccagttcgtattgtagacttaggtgtaagaatattcgatacagcagaaataccaaaaacgggagaaagtctagctggaccgagacgagcagctagaacaacaagaagaagactaagacgaagaaaacacaggttagaccgaattaaatggctatttgaaaaccaaggactcataaacatcgacgatttcttaaaaagatacaatatggcaggattacctgacgtataccaattgaggtacgaagcactagatagaaaactcacagatgaagaactagctcaagtattattgcatattgcaaaacataggggtttcagaagtacaagaaaagctgaaaccgcagctaaagaaaatggagcagtgctaaaagccactgacgaaaatcaaaaacgaatgcaagaaaaagggtaccgaaccgttggggaaatgatttacttagatgaagcatttagaataggatgctcatggagcgaaaaaggttacatattaacaccacgaaataaagctgaaaactatcagcacaccatgttaagagcgatgcttgttgaagaagtaaaagaaatattctcatcacaaagaaggctagggaataagaaagcaaccgaagaacttgaagaaaaatatttagaaataatgacatcacaacgaagttttgacctaggacctggaatgcaaccagatggaaaacccagcccatacgctatggaaggctttagtgaccgggtaggaaaatgtacctttctaggggatcaaggcgaacttagaggagctaaaggaacatatacagcagaatatttcgtagcattacagaaaataaaccatacaaaactcgttaatcaagacggcgaaacaagaaactttacagaagaggagaggagagccctcacattactcttatttactcaaaaagaagtaaaatacgctgcagtacgaaagaaattaggccttccagaagacatactattttacaaccttaattataagaaagcagcgacaaaagaagaacaacaaaaagaaaaccaaaacacagaaaaagcaaaatttataggtatgccatactaccatgactacaagaaatgtctagaagaaagagtgaaatatttaactgagaatgaagttcgcgatctctttgatgaaataggcatgatactaacttgctacaaaaacgatgatagcagaacagaaagattagcaaaactcggactggtaccaatagaaatggagggattactagcgtatacccctacaaaatttcaacacttatcaatgaaagctatgcgaaatatcatcccattcctagagaaaggaatgacatacgacaaggcttgtgaggaggcaggatatgacttcaaagctgactcaaaaggaacaaaacaaaaattacttaccggagaaaacgttaaccaaacaataaatgaaataacaaatccagtagtcaaaagatcagtaagtcagacagtcaaagtcatcaacgcgatcataagaacatacggatccccacaagccataaacatcgaattggcacgtgaaatgtcgaaaacctttgaagaacggagaaaaataaaaggagatatggagaaaagacagaaaaataatgaagatgtaaagaaacaaatacaagagctcggaaaattatcaccaacaggacaagatattttaaaataccgattatggcaggaacaacaaggcatatgcatgtacagtggtaaaactatacctctagaagaactattcaaaccaggttacgatatagaccacatactgccatatagtataactttcgatgattcttttcgaaacaaagtattagtaacaagtcaagagaatagacaaaaaggaaatagaaccccatacgaatatatgggaaacgatgaacaaagatggaacgaatttgaaacacgggtaaaaaccacaataagagactacaagaaacaacaaaaattactaaagaaacatttcagtgaagaagagagaagcgagttcaaagaaagaaatttaactgatacgaaatatataactacggttatatacaatatgatacgacaaaacctagaaatggcgcctcttaatcgacccgagaaaaagaaacaagtcagagcagtaaacggagcaataaccgcatatttgagaaaacgctggggactaccacagaaaaatagagaaaccgacacgcaccatgcaatggacgctgtagttatcgcttgttgtacagacggaatgatccagaaaataagcaggtacacaaaggttagagaaagatgttatagcaaaggcacagaatttgtcgatgctgaaactggagaaatatttcgtcccgaagattacagtagggccgagtgggatgaaattttcggagtacatattccaaaaccatgggaaacttttcgagctgaactagatgtaagaatgggagatgatccaaagggatttttagacacccacagtgatgtagcacttgaactagactacccagaatatatttacgaaaacctaaggccaatatttgtaagcagaatgcccaatcacaaagtcactggagctgcccacgcggacacaataagaagccctcgacattttaaagatgaaggaatagtactgacgaaaaccgcattaacagatttgaagctcgataaagatggagaaatagatgggtattataacccacaaagcgatctactactatacgaggcattaaagaaacaactacttttatatgggaacgatgctaaaaaggcatttgcgcaagattttcataaaccgaaagctgacggtaccgaaggcccagtagttagaaaagtaaaaatacaaaagaaacaaactatgggtgtctttgtagatagcggaaatggaatagcagagaacggcggtatggtaaggatagacgtatttagagtcaatggaaaatattattttgtcccagtatatacagcagatgtcgtgaagaaagttctcccaaacagagcatcaacagccaacaaaccatacagcgaatggagaacaatggaagataaagattttctattcagtctatattcccgagaccttgtacatataaaatctaagaaaggaatcccaattaaaaacgtagacgggagcctgggagagagtaaagaagtatatgcatattatataggagcagatatatcaggtgccaaaatcgaaggaaaagcacatgattcgcgatacaccttcagaggaataggggttcaaaaactagaattaattgaaaaatgtcaagtagatatattaggccacataagtactgtcaaaaatgagaaaagaatgggctttagttga

SEQ ID NO: 8609 - RNA, 3387 nt, synthetic construct
  misc_feature 1..3387: note = Cas9 variant
  source 1..3387: mol_type = other RNA
atgaatgataaaaaccaaaaatataggctcggtttagatctaggaactaactccatcggatggtgcatttattcactagatgtgaataacaaaccagaaacactaatcgatatgggagttagaatatttagcgacggtcgtgaccccaaaactaaagaaccactagccgttgaaaggagaacagctagaggactacgacgaatcctacataggaggaaactgagaagacgacaaatgttcagacttctacaagaacaggggctaatgccaaatgacgcttccgaagcagccgcattaaaaagccttaacccctatgaacttagagtaaaagcgcttgacacaaaattagaaccctatgaattgggcagagctttatttaatttatcagtaagaagaggatttaaaagtaatcgaaaagaagccgtacaagaaaaagaaaaagactcacaaaacgacgcaaaatcacaaaatgaaaaatgcgaacacctagcaaaagctataaaagattcaggttgcaggacccttggcgagttcctgtggaaacataagaataccgaaacacaacaaaccgaaaacgatgcacgaaacatcggcatgaggttcgtaccaggaagatcgaattattaccccacgagaagaatgtatgtagaagagttcgatgcaataagaaaggctcaagaaccatattacagcggagttaactgggacgcactccatgaaaaattattctaccaaagacctttacgggcccaagaaagaggaaaatgcagatacatgccagataaagaaagaacgtttaaagcaatgccatgctcacagaaaataagaattttacaagaagtttataacatggattatatagatgaatatggtaaaactatacctttagaagaagcacaaacagatagtctaatatcattgcttgataaaagggaaaaattaagttttaaagcaatgaagaaagaattaggaattgatgaatcgtgcacctttaacctagaaagaggcggtagagaatacttacaaggaaacgcagccgcggttaaactaaggaacaaaaagagatttggagaattatgggactctttatcactcgccaaacaagacgcaattgtagaaaagttaataactgcagatgaagatgcagaaattatcagtatgctagctcaatacaatctaacggacgaacaaaagaaaaatatagctgtaaccgttttaccatctggcaccgcaatgctatgtaaagaagtcacagaaatgttagtacagaaaatggaacaaaacaaaatacctctaaccgtcgcagtgcaaatgctgggatacacatatgccgaccaatccgtaagggaagaagacacattaccatactacggcgcaatccttaccggctcaacaatgggagcacatccagaagccgatgaatcagaaccggaactcaaatatggaaaaataagtaatcccacagtacatgtcgccctcaaccaaactagaactgtcgttaacgctttaataaaagcatatggaaaaccacaacaaattgttgtggaattatcccgagatctgaaagcatcaagagaagcaaaagcacgcatacagaaaacaataacaatgaaccaaaaacgcaatgaaagagataataaaaacataacagacataaccaaaataccatatcccaaccgaaacgaccgactaaaatatcgtttatgggaagaattaggatcaggctcaaacagttttagtagaaaatgcctttattgtggaaaaccaatatccggttcagaaatattcactgaaaatatagaaattgaacacattctaccatttggaagaaccctattcgacggagaaacaaacaaaacagtcgcgcacacggattgtaacagagataaaggagacaggagcccatttgaggctttcggaagtagcccaaacggatataactggcatgaaatatgtgcaagagcaaattctttaaagaatcccgcaaaaaggacactttttgcagaaaatgcaatggaaaaatttgaaaaagataacagttttattcaaagacaactgacagataacgcatatctatcacgtagcgcactaagatacttacgttgtatatgcaaagatgtatggtcaataaatggtggcatgacaaaattattacgggataaatggaatatagactcaattctcaaacggaaaatagacgatcctgaaatagcgcattttgaactaaagaatgaccaaattggccaatacaagaaaaatcgatacgaccaccgacaccatgctctagacgcatccgtcatagcactaatagacagagcaatggtccaagaaatatcacaattaaacaaaataagacttaaaaatagaattgaagcgccacaaatgccagtactacgctctgaactaatagaaaaagtcaaacatataacagtttctttcaaaccggatcacgggagacaaggaaaattatcaaaagaaacactcttgggaaaaattaagaaaatagaaaaagtcgatatagattcaattcaaaccgacgacattgcctcaataaaagatgatgcaatccgcacaagattcgaaacgaaaagaagagaactaggtgatattaccaaagccaaagcagcactgaaaaccgaatttccaaaacttgacgtattcaaaacttattacgttagtcgaacacccatagtctcattaactgagaaaaacataaatagcatagttgacgagaaaataaaagaaaaattgaaaacattcattaaagaacacgcagacttaagtttcgcggaacaattacaaaaattcagtgaaacagaatggatcggaaaaccatcagcagcaggtaaaccaggcaagaaatacagaatagaaaaagtaagatgcataaattggggccaaactcctataaccataacatcctcagcagtaccccgatacttatgcccagaagactacctagctgcagtggtatggcaaataccatcgaagaagaaagatacagaacccgaatataaagcgaccttcttaaggagagacgaatttgatgttaacaataaacctaagaaactcgaaaaaccccatgatgcagcacaatacatttgcatgttatataaagatgactacttggaatttacagaaagtggggcaacccacctatgtagaatagcaggacttcccgcatcccaaaataataaaatcgatataagaccaatttatgcagtaagtgactgcaaagattggataatagcaactaacgaaaacatgctagaaccctgttggaaaccacaaaaagaagagaaaagaatatctgtaaacgtattatttggtaaacataaagccagatctgtaactgttaatcccataggaagagtcttcagaaaatga

SEQ ID NO: 8610 - RNA, 3387 nt, synthetic construct
  misc_feature 1..3387: note = Cas9 variant
  source 1..3387: mol_type = other RNA
atgtccgatctcgtacttggactagatataggtataggatccgtcggagtgggaatactcaacaaagtcacaggagaaataatccataaaaattcccgaattttccccgcggcacaagcagaaaataacgtagaaagaagaaccaacagacaaggaagaagacttacccgacgaaagaaacacagaagagtgagactcaatcatttatttgaagaatctggactgattacagactttactaaagtctcaataaacttaaacccatatcaattacgagtcaaagggctaatagacgaattaagtaatgaagaactattcatcgcgcttaaaaatatggtaaaacacagagggattagctacctagatgacgccagtgatgatggcaacagttcagtaggcgattatgcacaaatagtcaaggaaaatagcaaacaactagaaactaaaaccccaggacaaatacaactagaacggtaccaaaaatacggtcaattaagaggtgacttcacagtcgaagaagacggaaagaaacataggttaataaacgtcttccccacgtctgcatacagaagtgaagcactcagaatactacaaactcaaaaagaatttaatcctcaaatcaccgacgaatttataaacagatatctcgagatacttactggtaaaagaaaatattaccatggacccggaaacgagaaatctaggactgactacggaagatatacaacaaagaaagactctgagaacgaatacataacgttagataatatcttcggaatattaataggaaaatgcacattttaccccgaagaatacagagcagcaaaagcatcatacacagcacaagaatttaatttactaaatgacttaaacaacctgacggtaccaacagaaaccaagaaactatccgaagaacagaaaaatcaaataataaattacgtcaaaaatgaaaaagcaatgggcccggcaaaactattcaaatacatagctaaactcctatcatgcgatgtagcagacataaaaggatatagaattgataaatccgataaagctgaaatccatacattcgaagcatatagaaaaatgaaaacccttgaaacaatcgatttcgagaaaatgagtagagaccaattagacaagttagcatacgtactaacactaaatacagaacgagaaggtatacaagaagcactagaccacgaatttgccgacggaaactttagtcaagaacaaatcgacgaactggtacaattccgcaaggcaaactcttcaatcttcggaaaaggatggcataactttagtgttaaactcatgatggaactaataccagaactatatgcaacgagcgaagaacagatgacgattttaacaagactgggaaaacagaaaacaacgtcatcatcaaataaaaccaaatacatagacgaaaaattactaacagaagaaatctacaatcctgtagtagctaaatcagtccgccaagcaataaagattgtaaatgctgcgataaaagaatacggggacttcgacaacatagtcatagagatggcaagagaaaccaacgaagacgatgaaaagaaagccatacagaaaattcaaaaagccaacaaagacgaaaaggatgcagccatgttgaaagcagctaatcaatataatggtagagcagaattaccacattctgtattccacggacataaacaattggcaaccaaaataagattatggcaccaacaaggagagcgatgtctttacactggaaaaacaatatcaatacatgacctgattaacaacccaaaccaattcgaaatcgaccatatacttccactttccataacattcgatgattcacttgccaacaaagtcctcgtatatgcgacagccaatcaagaaaaaggacaaagaacaccatatcaagctctagatagtatggatgatgcttggtctttccgagaattaaaagcatttgttagagagtcgaaaagcctaagtaataaaaagaaagaataccttttaacagaggaagacataagtagatttgacgtaagaaagaaatttatcgaacgaaacctcgtagacactagatacgcgtcacgagtagtcttaaacgcactacaagagcacttccgtgcacacaaaaccgatacaaaagtatcggtagtccgaggacaattcacttcacaactgagacgacactggggaattgagaaaacgcgagacacatatcatcaccacgcagtagatgcacttataatagcagcttcttcacaattaaacctatggaagaaacagaaaaatactctagtaaattattcagaaaaccaactactagatatagaaaccggagaattaataagcgacgatgaatataaagaatcagtatttaaagctccataccaacatttcgtcgacacattaaaaagtaaagaatttgaagactcaatactcttttcttatcaagtagactcaaaatttaaccgaaaaattagtgatgcaaccatatatgcaacgagacaagctaaagtaggcaaagacaagaaagacgaaacatacgtacttggcaaaataaaagatatctattcgcaaaccggatacgacgccttcataaaaatttaccaaaaagacaaatcaaaattcctcatgtatcgacatgacccacaaacattcgaaaaagtaattgaacccattttagagaactatccaaacaaagaaatgaacgaaaaaggtaaagaagtaccatgtaatccctttttaaaatataaagaggaacacggtgactacatcagaaaatatagcaagaaaggaaacggccccgaaatcaaatcccttaaatactatgacagtaaacttggaaaccacatcgacattacaccaaaagactctaataacaaagtagtgctccaaagcgtaagcccatggcgagctgacgtatactttaacaaaacaacaggtaaatacgaaatcctcggattaaaatacgcagatctgcaattcgaaaaaggcacagggacatacaaaatttcccaagaaaaatacaacgtaatcaaaaagaaagaaggagtggactcagactcagagttcaaattcacgctatataaaaatgacctactcttaattaaagatacggaaacaaaagaacaacaattgtttagatttctatcacgcactaaaccaaatgtaaaacattatgtggaattaaaaccatacgacaaacaaaaatttgaaggtaacgaaagcctaataaacgtattaggagccgtggcaaaagggggccaatgtcaaaaaggaataaacaaaccaaacatcagcatctataaagttcgaaccgatgtcttaggaaaccaacatattatcaaaaatgaaggcgataaaccaaaactcgatttttga

SEQ ID NO: 8611 - RNA, 3387 nt, synthetic construct
  misc_feature 1..3387: note = Cas9 variant
  source 1..3387: mol_type = other RNA
atggacgagaaaatggactacagaataggactcgatatcggaatagcatcagtaggatgggcagttcttcaaaataatagtgacgacgaaccagtacgaatagtcgacttaggagtaagaattttcgatacagcagaaataccaaagacgggagaatcactagcaggaccgcgtagagcagcgagaacaactaggagaagacttagaaggcgaaaacacagattggacagaatcaaatggctatttgaaaatcaaggtcttatcaacatagacgactttttgaaaagatataatatggcaggattaccagatgtgtatcaactacgatacgaagcactagataggaaactcaccgatgaagaattggcccaagtactcctacatatagcgaagcatagaggatttagatcaacaagaaaagcagaaactgctgcaaaggagaacggtgccgtgttaaaggccactgacgaaaatcaaaaacgaatgcaggaaaaaggatacagaaccgtcggagaaatgatatatttggatgaggccttcagaacgggatgttcttggagtgaaaaaggatacatattaacaccacgaaacaaagccgaaaattatcaacatacgatgttacgagcaatgttggtagaagaagtcaaagaaatatttagctctcaacgtagattgggaaacgaaaaagcaacagaggaactagaagaaaaatatctagaaattatgacaagccaaaggtcatttgacctaggtccaggaatgcaaccagatggaaaaccaagtccatacgccatggaaggattcagcgacagggtaggaaaatgcacgttcttaggagatcaaggagaactaaggggcgctaaaggcacatacaccgccgaatacttcgttgcactacagaaaataaatcacacaaaattagtaaaccaggacggagaaacaagaaactttaccgaagaagaaaggagagccttgactttattattatttacacaaaaggaagtaaaatacgcagcagtaagaaagaaactcggtctaccagaagacatattattctacaatctcaattataagaaagcagcgacaaaagaggaacaacaaaaagaaaaccaaaacacagaaaaagcaaaatttataggtatgccatattatcatgactataagaaatgtttagaagaaagagtaaaatatctaactgaaaatgaagtaagagatttatttgatgaaataggtaccatattaacatgttataaaaatgatgatagtagaacagaaagactcgccaaacttggtctagtgcccatcgaaatggaaggacttctcgcatatactcctacaaaatttcaacacttatcaatgaaagcaatgcgaaacatcataccatttttagaaaaaggaatgacttacgataaagcatgcgaagaagcgggatatgacttcaaagcagactccaaagggatcaaacaaaaattgctcacaggtgaaaaagttaaccaaactattaacgaaataacgaatcccgtggttaaaaggtcggtttcacagacagtaaaagtaataaacgcaattatacgaacatatggaagtccgcaagcaatcaacattgaactagccagagaaatgtcaaaaacgtttgaagaaagacgtaaaataaaaggagacatggaaaaacgacagaaaaacaacgaagatgtcaagaaacaaattcaagaactgggtaaactatcaccaacaggacaagatatattaaaatataggttatggcaagaacaacaaggaatatgcatgtatagtggcaaaactataccactagaagaactatttaaaccgggttatgatatagatcatatactcccgtacagcataacatttgatgacagcttccgtaataaagtgttagttacgagtcaagaaaataggcaaaaaggaaatagaacaccatatgaatacatgggaaatgatgagcaacgatggaacgaatttgaaacccgagttaaaaccacaataagagactacaagaaacaacaaaaactactcaagaaacatttcagcgaagaagaaagatcagaatttaaagaaagaaacctcacagacactaaatacataacaactgtcatatataacatgataagacaaaaccttgaaatggcccccttgaatagacctgagaaaaagaaacaggtcagagccgttaatggagcaattacagcttacctgcgaaaaagatggggactaccccagaaaaatagggaaacagatacacatcatgcaatggacgcagtagtcatagcatgttgtacagatggaatgatccagaaaattagtagatacacaaaagtccgagaaagatgctactccaaagggacagagttcgtggacgccgaaacgggagaaatttttagacccgaagactactcccgagcggaatgggacgaaatatttggagtacatataccgaaaccatgggaaacattccgagcggaattagacgtgagaatgggagatgatccaaaaggattcctagacacacacagcgatgtagctctagaactggattacccggaatacatatatgaaaatctaagacctattttcgtttcgcgcatgcctaaccataaagttacaggagccgcacacgccgacacgataagaagcccaagacactttaaagacgaaggaatagtactcacaaaaactgcactaactgatctaaaactggacaaagacggagaaatagacggatattataatccccaatcggacttactactttatgaagccctgaagaaacaactacttttatatggaaatgacgcaaagaaagcattcgcacaagattttcacaaaccaaaagctgatggtacagaagggccagtagttagaaaagtaaaaatccaaaagaaacaaactatgggagtatttgtagacagtggtaacggaattgcggaaaacgggggaatggtgcgaatagatgtattccacgttaacggaaaatattatttcgtacctgtctatacagctgatgttgtaaagaaagtattacctaacagagcagctacagcgcacaaaccatatggtgaatggaaagtcatggaagataaagactttctgttcagcttatattcacgtgatcttattcatataaaaagtaaaaaggatatacccataaaaatggtgaacgggggaatggaaggaattaaagaaacatacgcatattatattggggcagacataagcgctgccaatattcaaggaatagcacacgatagtagatataaatttcgagggctaggcattcaaagtttagatgtactagagaaatgtcaaatagacgttctaggacacgtatcagtagtacgaagtgagaaaagaatgggattcagttga

SEQ ID NO: 8612 - RNA, 3387 nt, synthetic construct
  misc_feature 1..3387: note = Cas9 variant
  source 1..3387: mol_type = other RNA
atgagtgacctagttttgggactcgatataggcatcggaagtgtaggagtagggatactcaacaaagtcaccggcgaaatagtacacaaaaacgcacgaatattcccagcagcacaagcagaaaacaatgtagaaagaagaaccaacagacaaggacgaaggctaacccgaagaaagaaacacagaagagtaagactcaaccacatattcgaagaatccggccttataacagacttcaccaaagtatccatcaacctgaacccgtatcagttacgtgttaaaggcttaacagacgaactatccaacgaagaattattcatcgcactcaaaaacatggtaaaacacaggggtattagctatctagacgacgcaagtgacgacggaaacagcagcgttggcgactacgcccaaatcgttaaagaaaatagcaaacaattggaaaccaaaacaccaggacaaatacaactagaaagataccaaaaatatggacaattaaggggtgattttacgattgaagaagacggcaaaaagcacaggctgataaacgtattcccaacatcagcgtatagagcagaagcacttagaatcttacaaacacaacaagaatttaatccccaaattactgacgagttcattaattcctacctacaaatactaacaggaaaaaggaaatattatcatggtccagggaatgaaaaatcacgaactgactacggaaggtatacaacaaagaaagatagcgaagacgaatacataacactagataatatattcggtatattaatcggtaaatgtacattctacccagaagaatacagagctgctaaagcatcatacacagcccaagagttcaacttattaaacgatctaaacaatctaacggtccctactgaaacaaagaaactatcagaagaacagaaaaatcaaatcattacatatgtcaaaaacgaaaaagctatgggaccagctaaattatttaaatatatcgcaaaactactagcatgtgacgtcgcagacataaaaggatacagaatagataaatcagacaaaccagaaatccatacttttgaggcttacaggaaaatgaagactctagaaaccatagatgtagaacaaatggaacgggaaaaattagacaaattagcatacgtcttaacactaaacaccgaaagagaaggcatacaagaagccatagaacacgagttcagcgacggtacattttcacaagaacaagtagatgagctagtccaattccgtaaatctaatagtagcatattcggcaaaggttggcacaacttctcagttaaattaatgatggaactcataccggaactttatgctacatcagaagaacaaatgacaatattgactcgcttaggaaagcagaaaagaacctcaagctcaaacaagaccaaatatatagatgagaaaagattaacagaagaaatatataatccagtcgttgcaaaatcagtgaggcaagcaataaaaatagtcaacgctgctatcaaagaatacggggattttgataatatagtcatagaaatggcaagagaaatgaacgaagacgatgaaaagaaagcaataaagaaaatacaagaggcaaataaatcggaaaaagatgctgcaatgagaaaagctgcaaaccaatacaacggcaaagcagaactaccacacagcgtattccacggacataaacaattagccaccaaaatcagattatggcatcaacaaggcgaaagatgcctttacaccgggaaaacaatctcaatacatgacctaataaacaatcctaatcaatttgaaatagaccacattttacccttaagcatcacattcgacgactcactggcaaacaaagtcttggtctacgctacagctaatcaagaaaaaggtcaacgaactccataccaagcgttagattcaatggatgacgcttggagcttcagagaattaaaggctttcgtacgagaatccaaaacactaagtaacaaaaagaaagagtacctattgactgaagaagatatatctaaatttgatgtaagaaagaaatttatagaacgcaacttggtagataccagatatgcctcaagagtagtcctaaacgcactacaagagcatttcagagcacggaaaattgacaccaaagtttctgtagtacgaggccaatttacaagccaacttaggagacattggggaatagacaaaactagggacacttatcaccaccacgcagtagatgctctcataattgcagcctcatcccaactaaacctatggaagaaacagaaaaacacacttgtatcttactcggaggaccaattactagacatcgaaacaggagagctcatttcagacgatgaatataaagaatcagtatttaaagcaccatatcaacacttcgtagacaccctcaaatccaaagagttcgaagactcaatactattctcctatcaagtagactcaaaatttaatagaaaaataagtgacgcaaccatatacgcaactaggcaggcaaaagttggaaaagacaagaaagacgaaacatacgttcttggtaaaattaaagatatctactcacaagcaggatacgacgcattcataaaaatataccaaaaagacaaaagcaaatttttaatgtatagacacgacccccaaacttttgaaaaagtaatagaaccaatactcgaaaattaccccaacaaagaaatgaatgaaaaaggaaaagaagttccatgcaatccttttctaaaatacaaagaagaacatggagactacatcagaaaatactctaagaaaggcaatggacctgaaataaaaagcctcaaatactacgactcaaaattaggaaaccatatcgatataacacccaaaaattcaaacaataaagtagtattacaatccgtaagtccgtggcgagcagacgtctattttaataaaacgacaggcaaatacgaaatcctgggtctcaaatatgccgacttacaatttgaaaaaggaacaggaacatacaaaataagtcaagaaaaatataacgatatcaaaaagaaagagggagtagactcagactcagagttcaaattcacattatataaaaatgacctcctactaataaaagacacggaaacaaaagaacaacaactatttcggtttctatcgcgaagcatgccaaacaagaaacactacgtcgaattaaaaccatacagcaaagacaaatttgagaaaaatgaaacattaatagaaatactcgggcccacagacaaatcgggaagatgcatcaaaggattagcgaaatctaatctaagtatattcaaagtaagaacagacatactaggtaaccaacatataatcaaaaatgaaggagacaaacccaaattagacttttga

SEQ ID NO: 8613 - RNA, 3387 nt, synthetic construct
  misc_feature 1..3387: note = Cas9 variant
  source 1..3387: mol_type = other RNA
atgacgaaaattttagggttagatcttggcacaaacagcattgggtgggcagtcgtcgacgaaaagaaagagaaaatattaggaatgggctcaagaatctttcccgaaggagtggtaaatataggtgagggtgaaggtagagaaacaagtaaaaatgcatcacgaacagatgctagaggtacccgaagacaattcttcagaagacgactacgaaaacgatatttgctcagagaactagcaaagaaagggttatgccctataaactacacattagttaaagagtggaacgaagcccaaatatttaaaaacaaacaactacaagaatggttcaaattaaacccatacgaattaagatcaaaagcaatccaggaaaagatatctctggaagaattaggaaggatattctatcatttcatccaaagaagaggattccaaagtaactctagatctgccggagtagataatatcgagaaaagtgttatattcaaaggcgacacgaaaacaggtaaaataggcataagtgaaactttagaatcaatcaaaaacaccaaaacattgggatcatacttacacacaatatatccaaaacaaaataaaccatactcaggacataaagaaagaatcagaaaccgatatacgacccgtcaaatgtacatctacgaatttgaaactatttgggaataccaaaaacaattttactcagaattaagtaatgaattaaaaacagtactaggaggacgtaaaaaggatggttataaagaagacggtatcttattccatcagaggcctttaagaagccagaaacacttagtcggatactgcagttttgaacccaaaaagacgaaatgtcaaatcaacactatacccttcgaactatttagaatatatcaatgggtcaatacagtggattgcaatgaaaaagtaacatcagaagaccgaggcaaaatggtagaactcctactatcaaaagaaaaagtgtcttttaaagaaataagaaaagtaataaataaaagcgacggttactatcagttcaactataaaaatgatgataaaatagtaggaagttatactatttcaaatctttcaaacaagaaattcttcggaaagaagtggtttgacttctcagacaaagaacaagaggacatttggcacgtactctcgttctttgatgatcgcgataagctaaaacaatacgcaataaaatattggggtttcaacgaagaaaaggcagtaaaaatatcaaagttcaacttgaaagagggctacagcaatttatctaggaaagcaatacacaacatacttccatttctaaaactcggtttcatgtacgatgtagccgtaggattagggggagttaaaaatgcactagcggataaatggatagaaaatgaacaattcatattagataatgtaccaagtgtagtaagaagtaattttaaaggaggctatatagaaccactaaaacaaatgctaaaatacgagttcgatgtatcagacaaacaactcctcaaactatatcatcatagttccgcaatagaaacaacagaactcctcaaaaagttaccaataaactctgaagccgataaggaaatacaatcaatcaaaaaccccgttgtcataaccgcactctttgaaataagaaagctagttaacgaaatcatagatacatacggaaaattcgacgaaatcaaagttgaattagcaagagaccttaaggcttccaaatccaaaagatacgacacaagaagagaacagctcagactagaaaaagaaaatgacagaataaaaatagaattagaaaatttgggacaaagaataaaccatataactatattaaaatacaaactttgggaagaatgcgacaaaaggtgcccatttacggggaaaaacatagaagtaaatgaactgttctcaggagaagtccaaatcgaacatatttttccatggtcgcgaagtttaaatgactccttcatgaacaaaaccctatgttttgccgacgaaaatcgtgcaaaaggaaacaaaactccatacgaattttactccgaacaaggcgaacaaaaatgggaagaaataaaaatacaagcattaagttgcttcaaaaacaagccaaactacccaaacgcctatcagaaatttaaacaattcgttaaaaagaaacacgatgaagacttcatctcccgacaactaaatgatacgagatacatatccaaagaagccaaaaactacttatcaaaaatatgcaacaacgtacaagtagcgccaggccaaatgacagcaaccctaagacacaaatggggattaaatacgattttaaacaaagatgacgacacgaaaacaagggacgaccacagacaccacgcgatagatgctttagtaatggcctgttcaactcgctcccatttacaagaactctcaaaaagaaacagatatcaaaaagattacgagttcaaagatttcccaatgccttggcaattcttccggcaggacgctgagaaaagcgtagaacaaatcttagtaagtcacaaaaagttaaatacgattctcactgtacgaacccataaaacaaagaaaaatggtgtcgtgtataaaaatattggcgtagctgcaaggggacaactacacaaagaaactgtttttggaaaacgaaccgctccagacggtatagaagcataccacgtacgcaaaccaatagaaagtttatctacacataaacacataaacaaagtagtcgatgaaacaataagactcttaattctaaaacaagtaaacaaactaggaggtttcgtaaaaggaaaaatacccgaaggtaccttttacaacacagatgaaaacggaaataaacaaccacaaatattcttaccaaataaaaacggcaacccggtcccgattaagaaaattagattacgagaaaatattggaggtgccgaacaactcaaatcaacggtcaatcagcatgtaaatccaagaagcaaccatcatgtcctgatctacaaagacttcgatgacaacctgaaagaaaaagtagtcacattttggaccgccgtcgaacgtaagaaacaaaaacaagcagtgttccaactcccagaaaacggaaaagaaatcgtaacaacacttcaaataaacgatatgttcctattgggattaaaagacgatgaaataaactgggaacaccctaaatttacactactaaaagaacatctatacagagtacaaaaatttacatcaggagactactattttcgaaaacacatagaaagcaacttaaacggagaactaggaaaagcctaccaatacataaaaggtttcggcgaaggcaaaacaggctggaaaaccttcaaccccataaaaataaaagtatcagtaagcggcaaaatagaaaaagtatga

SEQ ID NO: 8614 - RNA, 3390 nt, synthetic construct
  misc_feature 1..3390: note = Cas9 variant
  source 1..3390: mol_type = other RNA
atgaacggacttgtactcggattagatatcggtatagccagcgtaggagccggaatattgaaaaaggatacaggcgaaattatccacgcaaattcaaggctgttcccagccgccacagcagataataatgttcttagaagatcttcacgacaagcccgaagaagcacaagacgaaagcgacatagagctgtaagattacacgatctgtttgaagactacgggctattaaccgatttcagtaaagtttctataaatctaaacccatacaaactacgcgtcgaaggaatggatatacaattaacaactgaggaactctttatagcactcaaaaacattataaaacgacgaggaatatcctacctagatgacgcatcagaagacggcgtcactgtttctagcgactacggcaaggcagtagaagaaaatagaaaactactctcagagcaaacccccggacaaatccaactggaaagatttgaaaaatacggccaagtccgaggagatttcaccgtggaagaaaatggtgaaaaacgacgactcataaacgtatttagcaccagcacatacagaaaagaagcagaaagaatactaagaaaacaacaggagtttaacaataaaataacagatgattttattgatgactacttaacaatcctcacaggaaaaagaaaatactaccatggaccaggtaacaagaaatcaagaactgattacggaagatatacaacgaagaaagacagtgaaggaaaatacataactctagacaacatctttggcgtcttaataggcaaatgcacgttttacccagatgaatacagagcaagcaaggcttcttatacagcccaagagttcaaccttcttaatgaccttaataacttaacagttcctaccgaaaccaagaaactatctgaaaaacagaagaaaacaatagtcgaatatgccaaaacagccaaaaccctaggggcaagcacactactcaaatacatagcaaaaatggtagatgcttcagtagaccaaatacatggataccgagtggatgttaacaagaaacccgaaatgcacactttcgacgtatatagaaaaatgcaatcacttgaaacattcaacgtgaatgaaatgccaagagaagtattagacgaattagcacacatactaactctaaacaccgaacgtgaaggcatcgaagaagcgataaacacaaaattaaaaggaacattcaaccaagatcaagtattagaattagtccaattcaggaaaaacaactcatctctcttctccaaaggctggcacaatttcagtttaaaattgatgatggaattaattcccgaactttacgccacaagtgaagaacaaatgacaattctcacaagattaggtaaacagaaaagcaaagaaatttcaaaacgaacaaaatacatagacgaaaaagaaatcacagaagaaatctataacccagtggtagcaaaaagcgttcgccaagcgatcaaaataatcaatgaagccacgaaacaatacggaatcttcgatcatattgtaattgaaatggctcgattaacaaacgaagaagacgccaagaaagattacatcaaacgccaaaaagctaacctagacgagaaaaatgcagcaatggaaaaagcagcttttcaatataacggaaagaaagaacttccagattcaatctttcacggacacaaagaacttgcgacaaaaataagactctggcaccaacaaggagaaaaatgtctatataccggcaaaaatatcccgatatcagatctcattcaaaaccaatataaatatgaaattgaccatatactaccactatcactatcctttgacgatagcttatcaaacaaagtattagtactagccaccgctaaccaagaaaaaggacaacggactccatttcaagcactcgaccgtatggacgacgcatggtcatatagagagttcaaaagttacgtcaaagactcaaaactactaggaaacaaaaagaaagattaccttttgacagaagaagacataagcaaaatagaagtaaaacaaaaatttatagaacgaaacctagtagatacgagatactccagtcgagtagtactaaatgccctacaagacttctataaaaatcatcactttgacacaactatatctgtagtgagaggacaatttacctcacaactaagacgaaaatggggactagaaaaatcaagagaaacctaccaccaccacgcagtagatgccttaatcatagcagcatcttcacaactacgactatggaagaaacaaaataatccactaatcttttacaaagaaggacaatttgttgatagcgaaaccggcgaaattttatcgttaaatgacgatgaatataaagaactcgtattcaaagcaccgtatgaccattttgtagacacccttagatcaaaaacatttgaggacagcatcctcttctcataccaagtagactccaaatacaatagaaaaatctccgatgcaacaatttacgcaaccagaaaagcaaaactagacaaagataaaagcaaagaaacctatgtcctttcaaaaataaaagacatatatagccaagcaggatacgatgccttcatcaaaatatataacaaagataaatctaaattcctaatgtaccataaagactcccaaacatttgaaaaagtaatagaagaaatcttaagaacatacccgtcaaaagagtttaatgacaaaaacaaggaagtcccctgtaaccctttcgaaaaatatagacaagaaaatggccccattcgaaaatactcaaagaaaggaaatggacccgagataaaatccctaaaatattacgataaaaacatacccgaatcatttataaatattacaccaagcaattccaaaaataaagtaatattacggcaattaaacccatggagaacagatgtatatttcaatcatcaaactgaaaaatatgaacttctaggactaaagtatgccgatctacaattcgaaaagaaaaccggcacttactcaataaccatcgacaaatacaatgaaatcaaagaaaaagaaggtgtcggcgaacaaagcgagttcaaattcacactctacaaaaatgatttactattaataaaagatacgaaaaataatgaaaaacaaatatttcgatttctttccagaacaatgccaaatgtgaaacattatgttgaacttaaaccatataacaaggcaaaatttgacggaaaccaacctcttataacaattttcggaaacgtagcgaaaggcggacaatgccttaaaggcctaaataagccaaacatatcaatatataaaataaaaacagacgttttaggaaataagtattttataaagaaagaaggagataaacctaaactaaaattttga

SEQ ID NO: 8615 - RNA, 3390 nt, synthetic construct
  misc_feature 1..3390: note = Cas9 variant
  source 1..3390: mol_type = other RNA
atggcagaccgtataagtctgggactagacattggagtcgcaagcgttggattttcagtactcgatatagataaaggaaaagtaatagagctaggcagcagactatttaacgcaaccgtagcagagggcaatcaagacagaagaagcatgcgcggtgcacgaaggttactaaaccgaaacaaacaaagaaggcaagatactggaaaactatttcaaaaattcggactgctcgacaattttaacaaagataatttttatgatacatttaatcaaaattggaacccttacgagctaagagtaaaaggacttacagaacatctaactaaaaaagaattggccgaaagtttatatcaaatagtgaaacatagaggcataagttacgctctcaaagacgctgatgcagatgaaggaggaacagactattctgcctcactaaaaatcaactctcaggagctagcagaaaaaacaccagcacaaatacaattgcagagactgaacgattacggaaaagtaaggggacaagtagtgataggagatgaccctgacaatcaaaaagtcctactcaacgtcttcccaacaagcgcatatgaaaaggaagcaaaacaaataatagcaacacaaaaacaattctatccagagatacttacagatgaattcaccaaagaatattgtaaaatactaacacgcaaaagagattacttcgtagggccaggcaatgaaaaatcacgaacagattacggaatctataaaacagatggtagaacactagataatttatttgaagaattaataggacatgacaaaatatatcctgacgaattgcgagcaagtgcagcctcatacacagcacaactcttcaacgtacttaacgacctgaacaatctacgtatactaagctatgaagatgggaaactaacaaaagaagacaaagaaaaaataatagcggaaataaaaagtaatacaacaacaatcaatatgttaaacgtaattaaaaaagtagccggctgcagtaaagaagatataaaaggattccgagtaaatgaaaaagacaaacccgaaatatcatcaatggcagtatatagaaaagttcataaagatttactaaaggtaggagtagatatctcagactggcccgtcgaattcatagacaaactcagttttatcttaacgctaaacacagaaaatggagaaataagaaaacaacttaacaatagattagtaccagaatttgacttcctaaacgatgacctcatacagttaataatagacaacaaagatagcttcgaaataaaaacaaataacaaatggcatcgattttctctcaaaaccatgaacaaactaatgccagaaatgttagaaagaccggtagagcaaatgactttactcaatgaaatgggtctggtcaaaaaggataagaaaagattcgagaacaacaagtatctaccttataaagaaattgcaaaagatatatttaacccagtagcatcgaagagcgtaagggaagctttaaaaatagttaacgccgtattaaaaaaatacggacatattgactacctagtaatagaaatgccacgcgacaaaaacctaaaagaagaacaagacaacataaaagaattccaaaacaaaaacaaaaaagcaaaggacgccgccttcgaagctttcgtgaaaagcgttgggagtgaacaacgcgtaaaagaagcattaagcaaaaaccgaaagttacagatgaaaatgagattatggtaccaacaacaagaaatagatccctacaacggagaaacaatagatgcaacagatctaataaataaccccgacaagttcgaaatagatcacatcatcccccaatcaatctcatttgatgactccataaacaacaaaacgttatgtttcgcctcaatgaatcaagtaaaaggacaaaaaacgccctatgagttcatgctcgaaggacatggacaaggatacgacaaattcaaagcaacagtactagataacaaaaacttcgatcgaaacaagaggaaaaactacctatttgaagaaaatgtatctgatatagaaacaagaaaaagatttctatcaagaaatcttgtcgacaccagatactcaagtcgagtagtgttaaattcacttcaagacttcttccacgaaaaatcagcagacaccaaggttactgtaatcagaggtaaatttactagtaacatgagaaaacattggcatatagataaaacaagagaaacgtttcatcaccacgcaatcgatgcatcaataattgcagcgacaccattcctgcgaatgtggaaaaaaggaggaacaatatttccagtcaaagtgggcgaagaaagcattgacatagaaacaggagagatattagatgacaaaaaatttgataaagtaatgtatgaagaaccatataacgggttcgtatcagaaattatgaatgcagatgacagaataaagttttcacatcaagtagacaaaaaaatgaacaggaaagtcagtgacgccacaatatatagcactagaacaggcaaattagcaaaagacaaaaaagatgccgaatacatagtagcaaaagtgaaagatatatactccgttgacggattcaaaaaattcaaaaaagtctacgataaagacaaatctaaatttctattatataaatacgaccctagaacattctctgaactagaaagaatcatatccgactgcccagataaagtagaaaaagtacaaacaaacggcaaagtaaaggcagtggacgtaagcccatttgaaatgtatagaagatatcacggtatgattaaaaaatattccaagaaaggcaacggacccgcaataaaacaattaaaatatctcgacaaaaaattaggatcacatatcgatataacgcctgcaaacgccaacggaaaacacgtaatcttacaaagtcttaagccatggagaactgacgtctatcttaaccatgaaacaggagaatatgaaataatgggaataaaatactcagacctcaaattcaacaaaaacgtaggatatgggataaagaaagataaatatcttgagataaaaaaaaacgaagaagtcagtgaaaaatcagaattcatgttcagtctataccgaaaagatagagtacgcatacaaaacatgaaaaccggtgaatcagtcgaattacttttctggagtcgcaacttttcaaataaaaaatatgccgaacttaaacccatatttaaattcgtcaccgaagacgatgactggccagtatacggccacgcaaagacacaaatcctaaaaagactagtcccaaaagactgtaaaatttggaaagtgaatactacaatcttaggtgacccatattatttagaaaaagaatccgataatccaaaagatatattagactga

SEQ ID NO: 8616 - RNA, 3390 nt, synthetic construct
  misc_feature 1..3390: note = Cas9 variant
  source 1..3390: mol_type = other RNA
atgactaacgggaaaatattaggccttgacataggcatagcatccgtaggagtaggcattattgaagcgaaaacagggaaagtggtacacgctaacagtagactattctcagctgcaaacgcagaaaacaatgcagaacgacgaggattcagaggtagcagaaggctaaatagaagaaagaaacatagagtaaaaagagtaagggatctattcgaaaaatatggcatagtcacagatttcagaaacttaaatttgaatccttacgagctcagggtaaaaggactgacagaacaattaaccaacgaagaattatttgcggctctaaggaccattagtaaacgaagaggaataagttacctagacgatgccgaagacgactcaacaggaagtacagattatgctaaaagcatcgatgaaaacagacgtctcctaaaaaccaagacgcccggacaaatacaactagaaagattagaaaagtatggacaactaagaggcaattttacagtatacgacgaaaacggagaagctcacagacttataaacgtcttcagtacaagtgattatgaaaaagaagccagaaaaatcctcgaaacgcaagcggattacaacaaaaagataacagccgagttcatagatgattacgtggaaatattaacacaaaagagaaaatattatcacgggcccggaaacgaaaagagtagaacagactacggtagatttagaactgacggaacgacactagaaaacattttcggaatactaataggtaaatgctcattctatcctgacgaatacagggcatcaaaagcatcctacaccgcacaagaatataactttttgaatgacttaaataacctcaaagtacctacagaaacaggtaaattatcaacagaacaaaaagaggctttagtagagttcgctaaatccaccgcaacactaggcccagcgaaattactcaaagaaattgcaaaaatcctcgattgcaaagtagacgaaatcaaaggatacagggaagacgataaaggaaagcctgacctacacacgttcgaaccttacagaaaacttaaatttaacctcgattcagtcaatatagatgacctcagcagagaagtactagacaaactagcagacatacttacactaaatacagaaagggaaggaatagaagacgccatcaaaagaaatcttccaaatcaattcacagaagaacaaatatcagaaataataaacgtgagaaaatcacagtcaacagcttttaataaaggttggcactcattttccgctaaactaatgaacgaactaattccagaactatatgcaacatcagatgaacagatgacaatattaacaagactagaaaaatttaaagttaaaaagaaaagttccaaaaatataaaaacgatcgatgaaaaagaaataactgacgaaatttacaatccagtagttgcaaaatcggttcgtcagacaataaaaataatcaacgccgcagtaaagaaatacggagactttgacaaaatagttattgaaatgccaagagataaaaatgccgatgatgaaaagaaattcatcgataaaagaaataaagaaaacaagaaagaaaaagacgatgcacttaaaagagccgcatatctgtacaacggtacagataaacttcccgacgaagtattccatgaaaacaaacaactagagactaaaatacgactatggtatcaacaaggagaaagatgtttatactcagggaaaccgataccaattcaagaacttgtacacaacagcaataatttcgaaatcgatcacatattaccattaagtctttcatttgacgattcactggctaacaaggtattagtgtattcatggacaaaccaagaaaaaggacaaaggaccccatatcaggtaatagactcaatggacgctgcttggagtttcagagaaatgaaagactacgttttaaaacaaaaagggctaggaaagaagaaaagagactacttattaacaacagaaaacatagacaaaatagaagtaaagaagaaatttattgaaaggaacctagtagacacacgctacgcaagccgggttgtactaaactcgctacagtctgccttaagagaattaggaaaagacacgaaagttagcgtagtacgaggacaatttacaagccaactaaggagaaaatggaaaatcgacaaatcacgtgagacataccaccaccatgctgtagacgcattaatcattgcagcaagcagtcaactaaaattatgggaaaaacaagataaccccatgttcgtagactatggaaataatcaggtagtcgacaaacaaacaggagaaatcttaagcgtatccgatgatgaatataaagaacttgtattccaaccaccgtaccaaggattcgtgaatacaatctcatcgaaaggattcgaggatgaaattcttttcagctatcaagtcgacagcaaatataacagaaaagtaagtgatgccaccatatattcaacccgaaaagcaaaaataggaaaagataagaaagaagaaacctatgtcctaggaaaaataaaagatatatactcacagaacggatttgatacattcgtaaagaaatacaataaagacaaaacacaattcctaatgtaccaaaaagatccattaacatgggaaaatgtgattgaagtaatattaagagattacccaacaactaagaaatccgaagacggcaaaaatgatgtaaaatgtaatccctttgaagaataccgaagggaaaacggattaatatgcaaatattcaaagaaaggaaaaggaacaccgataaaatcactaaaatactacgacaagaaactaggtaactgcatagacataaccccacaagaatcgaaaaatagggtagtactaagacagatatcgccatggcgagcagatatatattttaatcccgaaacactaaaatatgaacttatgggattaaaatattcagacctatctttcgaaaaaggaactggaaaataccatattagccaagaaaaatacgacgccataaaagaaaaagaaggcgtaggaaaagacagtgagttcaaatttaccctctacagaaacgatttaatcttgataaaagacacccttaacaattgtgaaagaatgctaagatttggaagtaaaaacgacacatcaaaacattatgtagaattaaaaccactagaaaaaggtacattcgactcagaagaagaaatactaccggtcttaggaaaagtcgcaaaatctggccaattcataaaaggactcaataaaccaaatataagcatttacaaagtaagaacagatgtattaggcaataaatattttgttaagaaagaaggagacaaacccaaattagattttaaaaataacaagaaatga

SEQ ID NO: 8617 - RNA, 3390 nt, synthetic construct
  misc_feature 1..3390: note = Cas9 variant
  source 1..3390: mol_type = other RNA
atgtctaatggtaaaatattaggactggacataggtgtagctagcgttggagttggtataatagatagtaaaacaggcaacgtgattcatgcgaacagtcgactcttttccgcagcgaacgcagaaaacaacgctgagagaagaggattccgaggagcaagaagactaacaagacgaaagaaacatagagtaaaacgagtacgagatctatttgagaagtatgatatttcaaccgactttcgaaatttaaatctcaatccttacgaattaagagtcaaaggattgacagaacaacttactaacgaagaactcttcgcagcactcagaacgattgcaaaaagaagaggcataagctatttggatgatgccgaggacgattcaacaggatcctcagactacgcaaaatcaatagacgaaaatcgacgacttttaaagactaaaacaccaggccaaatccagctagaaagactagaaaaatacggtcaattaagaggaaactttacagtgtacgatgagaatggcgaagcccatcgattaataaacgtattttccacaagcgactataaaaacgaagcaagaaaaatactagagacccaatccaactacaataaacaaataacagatgagtttatagaagactatatagaaatactaactcagaaaagaaaatattaccatgggccaggaaatgagaaaagcagaacagactacggaagatttcgaacagatggcacaacactagaaaatatattcggaatattaataggaaagtgtagtttctatcctgaagaatatcgagcatcaaaagcatcatataccgcccaagaatttaactttctaaatgacttaaataatttaaaagtaccaactgagacaggaaaattatccacggaacaaaaagagtacctagttgactttgcaaagaaatccaaagccctcggagcaagcaaattgctaaaagaaatagccaagatagttgactgctctgtagacgacataaaagggtaccgagtggacaacaaagataaaccagatttacacacatttgaaccgtacagaaaattaaaattcaacctgtcatcgatagatatagatgaattaagcagagaaacactcgataaattagcagatatactaacattaaacacggaaagagaaggaatcgaagacgccattaaaagaaatcttccatcacaatttaccgaggaacaaataagcgaaatagtacaaatccgtaaaaaccaatcaagcgccttcaacaaaggatggcattcattctcagctaaattaatgaatgaattaataccagaactgtacgtaacttcggaagaacaaatgacaatcttaacaagactggagaaattcaaagtcaacaagaaatcttcaaagaatacaaaaaccattgatgaaaaagaaataacagacgaaatatataatcctgtagtagcaaaatcagtgaggcaaacaataaagataattaacgccgcagtaaagaaatacggggatttcgataaaatagtcatcgaaatgccaagggataaaaacgcagaagacgagaaaaagtttatagacaaaaagcagaaagaaaataagaaagaaaaagatgactccctaaaaagagcagcctttttatacaacggaaccgacaacttgccagatggagtttttcacggaaataaagaacttaaaaccaaaataagactatggtatcaacaaggcgaacggtgcctatactcaggaaaattaattagcatacacgacttagtgcataattccaataaattcgaaattgaccacattctaccactatcactatcattcgatgattcactagcaaacaaagttctagtatacgcctggaccaaccaagagaaaggacagaaaactccataccaagtaatagatagcatggatacagcctggagcttcagagagatgaaagactacgtattgaaacaaaaaggactaggaaagaagaaatgcgaatacttactaacaacagaaaacatcgacaaaatagaagtaaagaagaaattcatagaaagaaatcttgtggatacaagatacgcatcacgagtggtacttaattcactacaaacagccttaaaagaactgggaaaagacacaaaagtctccgtagtaagaggccaattcacaagccaattaagaagaaaatggaacatagacaaaagtagagaaacttaccaccaccacgccgtagatgccttaataatagcagcgtcttcacaactaaaattatggcaaaaacaagaaaacccaatgttcgaaagctacggagaaaatcaagtagtgaataaagaaacaggcgaaattctttcaataagcgatgataaatacaaagaattagtattccaaccgccataccaaggttttgtaaatacaatctctagcaaaggattcgaggacgaaatcctgttctcctatcaagtagactctaaattcaatcgaaaagtgtcagacgcaactatctacagtacaaggaaagctaaattgggaaaagataaaaaggatgaaacctacgtcttgggaaaaatcaaagacatttattcacaagacggtttcgacacttttataaaacgttataagaaagataaaacccaatttttaatgtatcaaaaggatccattaacctgggaaaacgtaatagaagtaattctaagagattatcccagcgaaaaactaagtgaagacggaaagaaaacagtaaaatgtaacccattcgaagaatatcgcagagaaaacgggctaatatgtaaatactcaaagaaaggaaatggaaccccaataaagagcttaaaatattatgataagaaattaggaaattgcatagatataacaccggagaaaagcaaaaacagagttgtactacgacaaatatcaccctggcgagcagatatatattttaatttagaaacattaaaatacgaattaatgggcttaaaatactcagatttatcgtttgaaaaaggaacgggaaaatatcacataagtcaagaaaaatatgatgcaatccgtgagaaagaagggataggaaagaaaagtgaatttaaattcacgctctatcgtaatgacctaatactcattaaagatacattaaataactgtgagagaatgcttagatttggaagcaaaaatgatacatctaaacattacgtcgaactaaaaccactagaaaaaggaacattcgattcggaggaagaaatcctacctgtacttggaaaagttgcaaaatcaggtcaattcataaaaggactcaataaaccaaacatatctatctacaaagtaagaacagatgtattaggtaataaattctttattaagaaagaaggagacaaaccaaaacttgattttaaaaacaacaacaaatga

SEQ ID NO: 8618 - RNA, 3390 nt, synthetic construct
  misc_feature 1..3390: note = Cas9 variant
  source 1..3390: mol_type = other RNA
atgtcaaacggaaaaattctaggattagatattggcgttgccagtgtaggagtaggaatcatagatgctaaaacagggaatgttatccatgccaactcaagacttttctccgccgccaatgcagaaaacaacgcggaaagaagaggtttccgaggggcaagacgactaaccagacgaaagaaacaccgagtgaaaagagtacgtgatctattcgaaaaatacgatataagcacagacttccgaaatctaaacctaaatccgtatgagttacgagtaaaaggactaacagaacagctaacaaacgaagaattattcgctgcattacgaaccatagcaaaaagaagaggaatatcttacctagacgatgcagaagacgattcaactggcagctcagactatgccaaatctatagacgaaaataggaggttattaaaaaccaaaacgccaggccaaatacaactcgaacgcctagaaaaatatggacaactaagagggaatttcactgtctatgacgaaaacggtgaagcacatcgattgatcaacgtattctctacaagcgactacaaaaacgaggccagaaaaattttagagacacaaagcaattacaataagcaaataactgacgagttcatcgaagactatatagaaatactgacgcagaaaagaaaatactatcacggaccaggaaacgaaaaatctagaacagattatggaagatttagaacagatggcacaacacttgaaaatatattcggtatactaattggaaaatgctctttctatccagaagagtatcgagcatcaaaagcatcatacactgcacaagagttcaacttccttaatgatctcaacaatctaaaagtacccactgaaaccgggaaattaagcactgaacaaaaagaatacttggtcgatttcgcaaagaaatctaaagcactcggggcgtcaaaactactaaaagaaatagcaaaaatagtagactgttcagtagacgacataaaaggatacagagtagacaacaaagacaaaccagacttacacacatttgaaccatatagaaaattaaaattcaacttaagcagtatcgacatagatgaattaagtcgcgaaacacttgacaaacttgcagacattttaacactaaatacagaaagagaagggatagaagacacaataaagcgtaacctacccagccaatttacagaagaacaaattagcgaaatcgtacaaattcgtaaaaaccaaagttcagcatttaacaaaggctggcactcattcagtgcaaaattaatgaacgagctcataccagaactatatgtcacatcagaggaacaaatgactatcctcacaagattagaaaaatttaaagtcaataagaaatcgagtaaaaacacgaaaaccatagatgaaaaagagataacagacgaaatatacaatcccgtagtagcaaaaagtgtaagacaaacgatcaaaattataaacgcggcagtgaagaaatatggcgactttgataaaatagtcatagaaatgccaagagacaaaaacgcagaggacgaaaagaaattcatagataagaaagaaaaagaaaacaagaaagaaaaagacgattcattaaaacgggccgcatttttatataatggtacagataatctaccagatggagttttccacggaaataaagaactaaaaacaaaaatccgactatggtatcaacaaggagaaagatgcctatactcgggaaaactaatttctatacatgatctcgtccataactcaaacaagtttgagatcgatcatatattacccttaagcctctcatttgacgattcactcgcaaataaagttttagtttatgcctggacaaaccaagaaaagggacagaaaacaccctaccaagtaattgacagcatggatgcagcgtggagctttagagaaatgaaagactacgtactaaaacaaaaaggaatcggaaagaagaaaagagaatatctactaacaacagagaacatagacaaaatagaagtcaaaaagaaattcattgagagaaacctagtagacacgcgttacgcatctcgagtcgttctaaattcactacaaacagctcttaaagaactgggcaaagacaccaaagtatcagttgtacgaggacaattcacatcacaactaagacgtaaatggaaaatcgacaaatcccgtgaaacatatcatcaccacgcagtggacgcattgatcatcgcggcttccggtcaattgaaactatggcaaaaacacgaaaatctgatgttcgaaaattacggtgaaaatcaagtagtaaacaaagagacgggagaaatactaagtatatcagacgacgaatacaaagaattggtattccaaccaccttaccaaggatttgtaaatactattagttcaaaaacatttgaagacgaaatcctcttcagttatcaagtagactcaaaattcaatcgtaaagtaagtgacgcaacgatatactccacacgcaaagcaaaacttggtaaagacaagaaagaagaaacatacgtcctcggaaaaataaaagacatatatactcaagacggtttcgatacgttcataaaaagatataagaaagacaaaactcagttcctgatgtaccaaaaagatcctctaacctgggaaaatgttatagaagtaatactaagagactacccatccgagaaactatccgaagacggtaagaaaaccgtcaaatgtaaccccttcgaagaataccgcagagaaaacggtctaatatgcaaatatagcaagaaaggaaacggcacacctataaaatcactgaaatattatgataagaaactagggaactgcatagatataacccccgaaaaatcgaaaaatcgcgttgtattaagacaaatcagcccctggcgagcagacatatattttaacctagagacactaaaatacgaattaatgggcctcaaatactcagatttatctttcgaaaaaggaacaggaaaatatcacataagccaagaaaagtacgatgcaataagagaaaaagaaggtataggaaagaaaagcgaatttaaatttactctatacaggaacgacttgatactaataaaagacactttaaataactgcgaacgaatgctaaggttcggcagtaaaaacgacacatcgaaacactatgtcgaactaaaaccactagaaaaaggaactttcgactcagaagaagaaatactacccgtattaggaaaagtagcaaaatctgggcaatttatcaaaggactaaacaaaccaaatataagtatctataaagtacgaacagatgtactaggaaataaattctttataaagaaagaaggcgacaaaccaaaactagacttcaaaaacaataataaatga

SEQ ID NO: 8619 - RNA, 3393 nt, synthetic construct
  misc_feature 1..3393: note = Cas9 variant
  source 1..3393: mol_type = other RNA
atgaacaagattctaggactggatctaggaacaaatagcataggatgggccctcatcgaaaataatataatcttaggaatgggaagcagagttttcccagaaggcgtagtgaatcttggagaaggtgaaggcagagaaacctctaaaaatgcttcaagaacagaagctagaggagtaagacgccaaatatttagacgaagactaagaaaaaggtatttattaaaagagttagcaaaacataacttatgcccaatatcgcctaccttaatcaaagattggaatggaacagatatcttcaaaaatgaattaataatacaatggttccaactaaacccctatgaattacgagcgaaagccatacaagaagaaattacactaattgaactcggcagaattttctaccatatgatccaaagacgaggtttcctatcaaatagccgctcggctggagcggatgtaaaagaaacatcaacaatattcaaaggcgatgcaaaaattggaaaaataggcatatcggatacactgaaatcaattgaacaaaacaaaactctagggagtttcctacactcaatccaacccaaggaaaacgaaccatttagtggagaactggaaagaataagaaatagatacacaacaagacaaatgtacatcgatgagttcgagacgatatgggaatttcaaaaacagtaccacagcgagctaaattccaatctaaaaacaatccttggaggcagaaaaaaagataattacaaagaagacggagtcctttttcaccaaagaccactcaggtcacaaaaacacctagttggcttctgttccttcgaaccaaaaaaaaccaaatgtaaattgagcgccataccattcgaattattcagaatctatcaatgggtaaacacacttagctacgatgtaaatggagtaagacaaaaaataacacaagaagaaaggaaaaaaataatagatctactgcttagcaaagaaaaaccatccttcaaagaaataagaaaagccattggaaaattggacggatcctaccaatttaactacaaagacgacgacaaaatagttgggtcacatacaataagcaacttatcaaataagaaattctttggaaacaaatggttcgatttctcagaaaaagagcaagaaaatatatggcacatattatccttttttgacgacagggagaaactaaaagaatatgcaataaaaaactggagcttcgatgaagaacgcgcggtcaaaatctctaaattcaatctcaaagacgggtattcaaacctatcaagaaaagccatactaaatattttaccgttcctacaaaaagggtttatgtacgatgtagcagttggtctagcaggagtaaaaaataccctgtccgtaaactgggaagagcatgaacaatttgtcctggacaatgttcctgagattgtacgatcgaatctaaaaggaggatatatagaaccactaaaaaacatgctaaaaaacgaatttaactgtaacgacaaacaactagaaaaattataccaccattcatctgcaattgaaaccgaaaacatcctagacaggctacctgtaaatctccacgcagacagggaaatccaaaaaataaaaaatcccgtcgttataactgctttattcgaaattcgaaaattagtcaatgaagtaatagacacctacgggaaacccaacgaaataaaagtcgaacttgcaagagacttaaaagcatcgaaaagtaacaggttagaagcaagaaaaagacaaaaagatttagaaaaacaaaatgacagagtcaaacttgaattagagaacctaaaccagcgaagtaatcatatcaacatacttaaatataaactatgggaagaatgcaatcatacatgtccctttaccggacaaattataactatttcacaacttttcacaggcgaggtacaaattgaacacatattcccatggagcaggtcactaaacgatagtttcaataacaaaacactgtgctttgcagacgaaaaccgcgcaaaaggtaataaaacaccatacgaactctattctgaacaaggtgaccaaaaatgggaagcaattaaactacaagcactttcctgttttaaaacaaaagcaaactatcctaattgctacaacaaattcaaacacttcgtcaaaaagaaacatgatgaagacttcataagccgccaattaaatgatacacgttatatatcaaaggaagcaaaaaattaccttagcaaaatctgctcaaatgttcttgttgcaccgggtcaaatgactgccactttaagacatcattggggactcaactctatacttaacttagaagatgacacaaaaacccgcgacgaccaccgccaccacgctatagatgccctcgtaatggcatgttccacacgatctcacttacaagaattatcaaaaagaaatagatataacaaaaactacgacttaaaagacttcccagacccgtggcaaaacttccgacaagacgctgaaaacgccgtagcccaaatattagtcagccacaaaaaaagcaaatccttattaacagtaagaacacataaaactatcaaaaaaggcgtagaacataaaaacatcggagtagcagcaagaggacaactacacaaagaaagcgtttacggtctaaggaaagctccaaatagcaacaaagccttccatataagaaaaccactagagtcactaacaacagaaaaacaattggagaaaattgtagatgatagcataagactcttaatactaaaacgtataaatataataggaggatttatcaaaggcaaaataccaaaagaaacatttttcgtcgtagacgaaaatggaataaaacaaccacaaatctttttacctaatcgaaatggtaatccagtcccaattaaaaaagtaagaataagagaaaatatcggaggagccgaaaaattaaaagaaaataccaatcaatatgtaaacccacgatcaaatcatcacgtaatagtctacgaagactcaaacggaggactaaaagacgatgtagtgacattctggactgcagtagaacgcaaaagacagggacaagacgtttttaaactacctaatgatggagaaaaaatcgtatcgactcttcaaatcaacgatatgtttctacttggattaaatgacgacgatataattaccctaacatcaaaagaattaaagaaacatctatttaaagtccaaacgctatctagtagtttctatgaattcagattaagtaccgacagcacccaaaacaaaaacacaaactcaacagtattcagaagaattcaaagcttcggtatgggtaaaacagggtggaaagcattcaaccccataaaggtaaaattaaatagcattggcgaagtcaaaatcatatga

SEQ ID NO: 8620 - RNA, 3393 nt, synthetic construct
  misc_feature 1..3393: note = Cas9 variant
  source 1..3393: mol_type = other RNA
atgacaaatggaaaaatcttaggtctagacattggaatagcttctgttggagttggcataatagaagctaaaacaggtaaagtagttcatgccaacagcagactgttctctgcagcgaacgcagaaaataatgcagaaagacgaggttttagaggaagtcgaagattaaatagacggaagaaacatcgagtaaaacgcgtaagagacctattcgaaaaatacggtatagtaactgacttccgcaatctaaacctgaatccatatgaactaagggttaaaggactaacagaacagctcaccaatgaagaactgttcgcagcactaaggacaattagcaaacgacgaggaatttcatacttagatgatgcagaagatgactcaactggttcaacagactatgccaaaagcatagacgaaaatcgtagattacttaaaactaaaaccccaggacaaattcaacttgaaagactagagaaatacggacaactaagaggaaacttcacagtatacgacgagaacggagaagcgcatagactgataaatgtcttcagtacttcggattatgaaaaagaagcaagaaaaatcctagaaacacaagcagactacaataagaaaataaccgcagaatttatagacgactatgtggagatactaacacaaaaacgtaaatactaccatggaccaggaaatgaaaaatctagaactgactatggtagattcagaactgacggtacgacgttagagaatatattcgggattctaataggcaaatgctcattctaccccgatgaatacagagcaagtaaagcatcctataccgcccaagagtacaacttcttaaacgacttaaacaacttaaaagtcccaacagaaactggaaaattatcaacagaacaaaaagaagctctagtagagttcgccaaaagtacagctacactaggaccagcaaaactcctaaaagaaatagcaaaaatattagattgcaaagtagacgaaatcaaaggctaccgtgaagatgacaaaggaaaaccagacctacatacattcgaaccatacagaaaattgaaattcaacctagacagcgtaaatatcgatgatctgagtcgggaagtcctagacaaacttgcagacatactcacactaaatacggaaagagaaggtatagaagacgcaataaaaagaaatctacccaaccagtttactgaagaacaaatatcagaaataataaacgtgagaaaatcccaatcaacagcattcaacaaaggttggcactccttctctgccaagttaatgaacgaacttataccggaattatacgctacctccgacgaacaaatgacaatactaaccagactagaaaaatttaaagtaaagaagaaatccagcaaaaatatcaaaaccatagacgaaaaagaaattaccgacgaaatatacaatccagtagtagcaaaatcagtcagacaaacaataaaaataataaacgcagcagtaaagaaatatggtgacttcgataaaatcgtaatagaaatgcccagagataagaacgctgacgacgaaaagaaatttatcgacaaacgaaataaagaaaacaagaaagaaaaagatgatgcactcaaaagagcagcatacttgtataatggaacagataaactacctgacgaagtattccatggcaacaaacaactagaaacaaaaattagactttggtatcagcaaggagaaagatgcctgtacagtggtaaacccattcctatacaagagctagttcacaattcaaacaacttcgaaattgatcacatactacctttaagtttatcattcgacgatagtttagcaaacaaagtgttagtctactcctggacaaatcaagaaaaaggccaacgaaccccataccaggtgatcgacagcatggacgccgcatggtcatttagagaaatgaaagattatgtactcaaacaaaaagggctaggtaaaaagaaaagagattatttactaacaactgaaaacatcgataaaatagaagttaaaaagaaatttatagaaagaaaccttgtagacacacgatacgcgagtagagtagtattaaatagtttacaatcagctctaagagaactcggaaaagatacaaaagtaagcgtagtaagaggacaatttacaagtcaactaagaagaaaatggaaaatagacaaaagccgagagacgtatcaccaccatgcagtagacgcactgataatagcagcatcgagccaattaaaactgtgggaaaaacaagataatccaatgtttgttgattacgggaataatcaagtcgtagataaacaaaccggagaaattctcagtgtaagcgacaacgaatacaaagagctagtattccaaccaccctatcaaggatttgtaaacaccataagcagcaaaggattcgaagatgaaatacttttctcataccaggtagatagtaaatacaatagaaaagtgtcagatgcaacaatatatagtacaagaaaagccaaaataggcaaagacaagaaagaagaaacatatgtcctaggaaaaataaaagatatttattcacagaacggctttgacactttcgtaaagaaatataataaagataaaacacaatttttaatgtaccaaaaagaccccctcacatgggaaaatgtgatagaggtaatattaggggattaccccactacaaagaaatcagaagacggcaaaaacgacgttaaatgcaacccattcgaagagtacagaagagaaaacggtttaatatgcaaatatagcaagaaaggaaaaggaactccaataaaaagcctaaaatattacgataagaaactaggaaattgcatagacataacgcctgaggaaagcagaaacaaagtaatactacaatcaataaacccgtggagagcagatgtttacttcaacccggaaacactaaaatatgaattaatgggattaaaatacagtgatctcagttttgaaaaaggaacagggaactaccatatatcgcaagagaaatatgatgccatcaaagaaaaagaagggataggaaagaaaagcgagtttaaattcaccttatacagaaacgatctgatactaataaaagacatagcatcaggcgaacaagaaatatatagattcctcagcaggaccatgccaaatgtcaaccattatgtagaattaaaaccctacgacaaagaaaaattcgacaacgtacaagagctagtagaagcacttggcgaagctgacaaagtaggaagatgtataaaagggctaaataaacccaacatctcgatttataaagtaagaacagacgtactaggcaacaaatactttgtcaagaaagaaggagataaaccaaaattggactttaaaaataataagaaatga

SEQ ID NO: 8621 - RNA, 3393 nt, synthetic construct
  misc_feature 1..3393: note = Cas9 variant
  source 1..3393: mol_type = other RNA
atgaccaacggaaaaatactaggactagacatcggaatagcaagcgtaggagtaggcatcatagaagctaaaactggaaaggtggtacacgctaactctcgactattttcagcagctaatgctgaaaacaacgcagaaagaagaggatttaggggctcaagacgactaaacagaagaaagaaacacagagtgaagagagtacgagatttattcgaaaaatacgagatagtaacagacttccgaaacttaaacctaaatccatacgaattacgggtaaaaggactcacagaacaactaaccaacgaggaactatttgcagcactacgaaccataagcaagagaagaggaatttcctacctagatgacgccgaagatgactccactggctccactgattatgccaaatcgatcgacgaaaataggagattgttgaaaactaaaacgcccggacaaatacaactcgaaagactcgaaaaatatggacaactacgaggaaattttacagtatatgatgagaacggagaggcccaccggttgataaacgtattttcaacctcagattatgaaaaggaggctagaaaaatcctagaaactcaagctgactataataagaaaattacagcggagttcatagacgactatgtagaaatcctaacacagaaaagaaaatattaccacgggccaggaaacgagaaaagcagaactgactacggaagatttcgaacagatggcactacattagaaaacatattcggaatcttaataggtaaatgttccttctaccccgacgaataccgagcttcaaaggcttcatacacggcacaagaatacaattttctcaatgatcttaacaatttaaaagtaccaacagaaacgggaaaattatccaccgaacaaaaagaagccctagtagaatttgccaaaagtaccgctacacttggtccagcgaaattactaaaagaaatagcaaaaatactagactgtaaagtggacgaaataaagggctacagagaagacgacaaaggaaaaccagatttacatacattcgagccttatcgaaaactcaaatttaatctagattcagtgaatatcgatgaccttagcagagaagtgctagacaagctagccgatatactaaccctaaacacagaacgagaaggaatcgaagacgcaataaggcacaatctaccaaaccaattcacggaaggacaaatatcagaaataatcaaggtaagaaaatctcaatcaactgctttcaacaaaggatggcacagcttctctgctaaactaatgaatgaacttatacctgaattatacgccacgagcgacgaacaaatgaccatactcacacgacttgaaaaatttaaagtaaataagaaatcaagcaaaaacacaaaaactatagacgaaaaagaagttaccgatgaaatatacaacccagtagtagcaaaatcagtgagacaaaccatcaaaatcattaacgcagcagttaagaaatacggcgatttcgataaaatagtaatcgaaatgccaagagacaaaaatgcagacgatgaaaagaaattcatagataaacgaaacaaagagaataagaaagaaaaagacgatgcattaaaaagagcggcatacttatataatggcacagacaaattgccagacgaagtattccacggcaataaacaattggagacaaaaattagattatggtaccaacaaggcgaaagatgcttatactctggcaaaccgataccaatccaagagctagtccacaactctaacaactttgaaatagaccacatcttaccactaagtctatcatttgatgatagtttggctaacaaagtcctcgtttacgcgtggacaaatcaagaaaaaggccagaaaacaccataccaagtgatcgattccatggacgccgcttggagctttagagaaatgaaagactatgtactaaaacaaaaaggcctagggaaaaagaaaagagactatttactgacaacggaaaatatagacaaaatcgaagtaaagaagaaatttattgaacgaaatttagtcgataccagatacgcaagtagggtagtattgaatagtcttcaatcagcactccgagaattaggaaaagacacaaaaatttccgtaattagaggtcaatttacaagccaactaagacggaaatggaaaatcgacaaatcaagggaaacatatcatcaccacgcggtagatgcactcataatagctgcaagctcacaactaaaactatgggaaaaacaagataacccgatgttcgtcgattacggtaacaaccaagtcgtagacaaacagactggagaaatattaagtgtaagcgatgacgaatacaaagaattagtattccagccaccataccaaggattcgtaaacatgatatcaagcaaaggctttgaagatgaaattttattctcatatcaagtagattcaaaatataaccgaaaagtaagcgacgcaacaatatatagtacacgaaaagcaaaaataggaaaggacaagaaagaagaaacctatgtactaggtaaaatcaaagatatatactctcaaaacggattcgacacattcataaagaaatataataaagacaaaacacaatttttaatgtaccaaaaagacccattaacctgggaaaacgtaatagaagtaatacttagagattatcccactacgaagaaatcagaagacggtaaaaacgacgtaaaatgcaatccatttgaagaataccgacgagaaaacggattagtatgcaaatatagtaagaaaggcaaaggtacacctataaaatcacttaaatattacgacaagaaattaggtaactgcatagacatcactccagaaggcagtaaaaatgaagtagtactacagagtttaaacccatggagagcagatgtatacttcaatccagaaacactgaaatacgaattattaggcctaaaatacagcgacctgtcatttgaaaaagggacaggaaaatatcatatatcacaagaaaaatacgacgttataaaagaaaaagaaggaataggaaagaaatcagagttcaaattcacattgtatcgtaacgacctaatcctaataaaagacacagcatccggcgaacaagaaatttacagatttctttccagaacaatgccaaacgttaaacactacgcagaattaaaaccatacgacaaagaaaaattcgataatgtacaagaacttgtcgaagctctaggagaagcagataaagtagggcgatgtattaaagggctcaataaaagcaatcttagcatatacaaagtgaggacagacgtattaggaaacaaatatttcgtgaagaaagaaggagacaaaccaaaactagactttaaaaataacaagaaatga

SEQ ID NO: 8622 - RNA, 3393 nt, synthetic construct
  misc_feature 1..3393: note = Cas9 variant
  source 1..3393: mol_type = other RNA
atgacgaacggaaaaatactaggcttggacataggcatagcaagtgttggggttggtataattgaagccaaaaccggaaaagtggtccacgccaattcgcgactattttcagcagccaacgcagaaaacaacgcagaaaggcggggattcagagggtcacgtagactcaacaggcgaaaaaaacacagagtaaaaagggtaagggatcttttcgaaaaatatggcatagttacagacttccgcaacctaaatctaaatccatatgagttaagagtaaaaggattaacagaacaactaacaaacgaagaattatttgcggcactcagaacaataagcaaaagaagggggatatcctacttagatgacgccgaagatgactccacaggctcgacagattatgcaaaatccatagatgaaaacagaaggttactaaaaacaaaaacaccaggacaaatacaattagagagactagaaaagtatggacaacttagaggcaactttacagtatatgatgaaaacggagaagcacatagattaataaacgttttcagcacaagcgattatgaaaaagaagctcgtaaaatactcgaaacacaagcagactataacaaaaaaataaccgcagaatttatcgacgattacgtagaaatactaacacaaaaaagaaaatattaccatggacccggtaacgaaaaatctagaaccgactacggcagattcagaacagatgggacaacattagagaacatttttggcatcctaataggtaaatgcaatttttatcccgacgaatacagagcatcaaaagccagctacacagcgcaagaatacaactttctaaacgacttaaacaacttaaaagtcccaacagaaaccggcaaattatcaactgaacaaaaagaatcacttgtagaatttgccaaaaacacagctatattaggacctgccaaactcctgaaagagatagctaaaatcctagattgtaaagtggacgaaattaaagggtatagggaagacgacaaaggaaaaccagatctgcacacctttgaaccatatagaaaattaaagttcaacctggacagcgtaaatatagattacttatcaagagaagtattagataaacttgcagatatcctgacactgaacacggaacgagagggaatcgaggacgcaattaaacgaaatttacccaaccaattcaccgaggaacaaatatccgaaataataaatgtacgtaaatctcaatcaaccgcatttaataaaggctggcactcattttcagccaaattaatgaacgagctcattcccgaactatatgctacaagcgacgaacaaatgactatccttacgcgattagaaaaattcaaagttaaaaaaaagagctcgaaaaacataaaaaccatagacgaaaaagagattacagacgaaatatacaacccagtagtagctaaatcagtcagacagactataaaaattataaacgcagcagtcaaaaaatacggtgacttcgataaaatagtcatagaaatgccacgagacaagaacgcagatgatgagaaaaaattcatcaacaaaagaaataaagaaaacaagaaagaaaaagatgacgccttaaaaagagcagcatacctatataacgggacggataagttaccagatgaagtattccacggaaacaagcaacttgaaacaaaaataagactatggtaccagcaaggtgaaagatgtctatatagcggcaaaccaataccaattcaagaattagtacacaacagcaacaacttcgaaatagaccacatacttccgctaagcttaagttttgatgacagtctcgcaaataaagtactagtttactcgtggacgaatcaagaaaaaggacaaaaaacaccataccaagtgatcgatagcatggatgcagcatggtcatttcgagaaatgaaagaatacgtactaaaacagaaaggtctaggtaaaaaaaaaagagactacttactaactacggaaaatatagataagatcgaagtgaaaaaaaaattcatagaaagaaacttagtagacaccagatacgcgtcgagagtggtattaaactcactacagtccgcattaagagaattaggaaaagatacgaaagtaagcgtagtaagaggccaatttacttctcaacttagaagaaaatggaaaatagacaaatcaagagaaacctaccatcaccatgccgtagatgcattaattatagcagccagttcacaactgaaactatgggaaaaacaagataacccaatgtttgtcgactatggaaataaccaggtagtagacaaacaaactggcgaaatactaagcgtatccgataacgagtataaagaattagtttttcaacctccctaccagggttttgtgaacactatatcttctaaaggtttcgaagatgaaatcctatttagctatcaagttgacagtaagtataaccgaaaagtatcagatgcaacaatatacagtacacgaaaagcaaaaatagggaaagacaaaaaagaagaaacatatgtattaggcaaaataaaagacatatactctcaaaatggcttcgacacattcgtgaaaaaatacaacaaagataaaacccaatttctcatgtatcaaaaagatccactaacgtgggaaaatgttatcgaggtaattttgggagactatccaacaactaaaaaatcagaagacggaaaaaacgatgtgaaatgtaaccccttcgaagaatacagaagagagaatggattaatctgtaaatattcgaaaaaggggaaaggtacacctataaagtcactaaaatactatgataaaaagttaggaaattgcatagatatcacaccggaagaatcaaggaataaagttatactgcaatcaattaatccatggcgagctgatgtgtactttaatccggaaacactaaaatatgaattaatggggctaaaatatagcgacctgtcattcgagaaaggaacaggaaattatcacatttcacaagaaaaatatgacgcaataaaagaaaaagaaggcataggaaagaaaagcgaatttaagtttacattatatagaaatgacctgatcctaataaaagatatagcgagtggagaacaggaaatctaccgatttctttccagaacaatgccaaacgtaaaccattacgtagaattaaaaccttatgataaagaaaaatttgacaatgtccaagagctggtcgaagcactaggagaagctgacaaagtaggaagatgcataaaatcactaaacaaaccaaacatctcaatatataaagtaagaacagatgtcttaggaaataaatacttcgtaaaaaaagaaggcgataaaccaaaattagactttaaaaacaataaaaagtga

SEQ ID NO: 8623 - RNA, 3393 nt, synthetic construct
  misc_feature 1..3393: note = Cas9 variant
  source 1..3393: mol_type = other RNA
atgagcaatggaaaaatactaggcctagacataggcgtcgctagtgtaggagtaggaataatagatgcaaaaacaggaaaagtcatccatgcatccagtagactcttcagcgcagcaaacgctgaaaacaacgcagaaaggcgaggtttcagaggagcaagaagactcactagaagaaaaaaacaccgtattaaaagagttcgcgacttattcgaaaaatatgaaatagtaacagatttcagtaatttaaacctcaacccatatgaattaagagtaaaaggtcttaccgaacaattaaccaacgaagagttatttgccgctcttcgaacaatcgcaaagagaagaggtatatcatatcttgatgacgccgaagacgacagtacaggaagctcagattatgccaaaagcatagaagaaaatcgaagactactaaaaaatatgactcctggtcaaatacaactagaaagactagaaaaatacggccaactacgaggcaacttcacagtttatgacgaaaatggagaagcacacagattaataaatgtattttcaacttcggattacaagaatgaagcgcgaaagatactcgaaactcaatcaaactataataaacaaataacagacgaattcatagaagattacatcgagatactaacgcaaaaaagaaaatactaccatgggccaggaaacgaaaaatcacgaacagactatggcagataccgaacagatggcacgacacttgaaaatatattcggaatattaataggaaaatgcacattctaccccgacgaataccgtacaagtaaagcatcatacacagcacaagaatataacttcttaaacgacttgaacaatttaaaagtacctaccgaaactggcaaactatcaacagagcaaaaacactatctcgttgactttgctaaaagtagcaaagccctcggagtagccaaactactcaaagaaatagcaaaaatagttgaatgctcagtagacgatataaaaggatacagagaagataacaaaggaaaaccagacttacacacgttcgagccatatcgaaaactcaaatttaacttatcactaattgacatcgacgaattatcacgagaaacactagacaaactagcagacatactaacactaaacaccgaacgagaaggaatagaagatgccataaaaagaaatcttcccaatcaattcacagaagaacaaatagtagaactagtcaatgtacgtaaaaaccaatcatctgccttcaacaaaggatggcactcattcagcgtaaaattaatgaatgaacttataccagaactttatgcatcaagtgaagaacaaatgacaatattaaccagattagaaaaattcaaagtaaacaaaaaaagttccgaaaacacaaaaaccatcaatgaaaaagaaataacagacgaaatatacaatcctgtagtagcaaagtccgtttctcaaactgtaaaaataataaatgctgcagtgaaaaaatacggagacttcgacaaaatcgtgatcgaaatgccaagagacaaaaatgcagatgatgaaaaaaagttcatagataaaaaacaaaaggagaatgcgaaagaggtggaagacgcactaaagagagcagcatatctctacaatggcactgacaagctccctgacggagtcttccatggtaacaagcaactaaaaaccaaaatcaggctttggtaccaacaaggcgaaaggtgcttatattcgggtaaaccaatatcaatacaagacttagtacataacagcaataacttcgaaattgatcacatactccccttatcactatcttttgacgacagtttagcaaacaaagtcttagtatatgcttggactaatcaggaaaaagggcaaaaaacaccataccaggtaattgattcgatggatgcagcatggtcatttcgagagatgaaagactatgtactaaatcaaaaaggtattggaaaaaaaaaacgcgaataccttcttacaacagaaaacattgacaaaatcgaagtcaaaaaaaaattcatcgaaagaaatcttgtagacacaagatacgcctcaagagttgtactcaactcaattcaagccgcactaaaagaattagacaaagatacaaaagtatcagtaatacgtggacaattcacctcacagttacgaagaaaatggaaaatcgataaatcgagagaaacataccaccaccatgcagtagatgctttaataattgcagcctcaagtcaactcaaactctggcaaaaacaggaaaatcccatgttcgtagactacggagagaatcaagttgtgaacaaggaaacaggagaaatcctgtccgtgtcggacgacgattacaaagaattagtatttcaaccaccctaccaaggattcgtaaacacaatatcttcgaaagcattcgaagatgaaatacttttctcctaccaggtcgactcaaaatataacagaaaagttagtgacgcaaccatctattcaacaagaaaagcaaaactggggaaagataaaaaagaagaaacgtacgtactaggaaaaataaaagacatttattcacaagatggatttgacgcctttattaaaagatacaagaaagataaaacccaattcttaatgtaccaaaaagaccccgtaacctgggagaacgttattgaagtaatactccgagattatccaagtgaaaaattaagcgaagacggaaaaaaaaatgtcaagtgcaaccccttcgaagaatacagaagagaaaatggcctaatatgcaaatacagtaaaaaagggaaagggaccccaataaaatcattgaaatattacgataaaaagctaggaaattgtatagacattacgcccaaaggaagtaaaaatgaagttgtgttacaaagtttaaatccatggcgagccgacctatacttcaacccagatacactaaaatacgaattaatgggattaaaatactcagatttatcttttgaaaaaggcacaggcaagtatcacatatcacaggaaagatacgacgaaattaaagtcaaagaaggaataggcaagaacagcgaatttaaatttaccttataccgtaatgatctaatcctcataaaagatacagaaagtggagaagaagagttataccgatttttatctagaacaatgcctaatgtcaaacattacgtagaattaaaaccctacgacaaagagagatacgacggaggacaggaactcatgaaagtgtttggaaatgtagcgaatggtggacaatgtctaaaatcactcaataaaagtaaccttagcatctataaagtgcgaactgatgtattgggaaataaatttttcataaaaaaagagggagacaaacctaaattagactttaaaaataataaaaaatga

SEQ ID NO: 8624 - RNA, 3393 nt, synthetic construct
  misc_feature 1..3393: note = Cas9 variant
  source 1..3393: mol_type = other RNA
atgactaatggaaaaatcttaggtctggatataggaatagcatcagtaggagttggcataatagaagcaaaaaccggcaaagttgtacatgcaaactcacggctattttcagcggccaatgccgaaaataacgcagaaagaagaggattcagaggatcacggagattaaacagaagaaagaaacacagagtaaaacgagtgagagatctattcgagaaatacggcatagtgactgacttcagaaacctaaatctaaatccctatgaattaagagtaaaaggtctaaccgaacaactgaaaaacgaagaactatttgcagccctacgcacaattagtaaaagaagaggaatatcttacttggacgacgcagaagacgattcgacaggatcaactgattatgcaaaatcaatagacgaaaacagacggctactcaaaaataaaacacccgggcaaatacaattagaaagactcgaaaaatacggacaactaagagggaacttcactgtatacgacgaaaacggcgaagctcacagattaataaatgtattcagcaccagtgactatgaaaaagaagcaagaaaaatactcgaaacacaagcagactacaataagaaaatcactgcagaatttatcgatgattacgttgaaattttaacacaaaaacgaaaatattaccacggccctggaaatgagaaaagcagaacggactatggtcgatttagaactgacggaaccacactggaaaacatttttggaatactaataggaaaatgtaacttttacccggatgaataccgtgcttctaaggcttcttacaccgcccaagagtacaacttcctaaacgacctaaacaacttaaaagtaagtacagaaacaggaaagctatcaacagaacaaaaagagagcttagtagagttcgctaaaaatacagcaacactaggcccagccaaattattaaaagaaatagcaaagatattagactgcaaagtagacgaaataaaaggctacagagaagacgacaaagggaaacccgatctacatacatttgaaccatatagaaaactgaaatttaatcttgaatccataaacatagatgacttaagcagagaagtaatagacaaattggcagacatattaacattaaacactgaacgagaaggaatagaagacgcaatcaaaagaaacttaccaaatcaattcacagaagaacaaatatctgaaatcataaaagtaagaaaatctcaatcaacagcattcaataaaggatggcacagtttttcagcaaaattgatgaacgaattaattcctgaactgtacgcaacaagtgacgaacaaatgacgatcttaactcgtcttgaaaaatttaaagtaaacaagaaaagctctaaaaacacaaaaactatagacgaaaaagaagtcacagacgaaatatacaacccggtagtagccaaatcagtacgccaaaccattaaaataataaacgcagcagttaaaaagtatggggatttcgacaaaatagttatagaaatgcctagagacaaaaacgctgatgatgaaaagaaattcatcgataaaagaaacaaagaaaacaagaaagaaaaagacgacgctctcaaacgagccgcatatctatataacagttctgacaagctccctgatgaagtgtttcatggaaataaacaacttgaaaccaaaatccgattatggtaccaacaaggcgaaagatgcctctattccggcaaacccataagcatacaagagctagtccacaactctaataattttgaaattgatcacatattaccgttatctttgtcatttgacgactctctcgctaataaagtcctagtgtacgcatggacaaatcaagaaaaaggccagaaaacaccttatcaagtcatagattccatggatgccgcctggagtttccgagagatgaaagattatgtactaaaacaaaaaggattaggtaagaagaaaagagactacttactaacaactgaaaacatcgataaaatcgaagtgaaaaagaaatttatcgaaaggaaccttgtcgatacacgatatgcaagtcgtgtcgtattaaacagcttacaaagcgcacttcgagaattaggtaaagacactaaagtaagcgtagtcagaggacaatttacaagccaactacgacgcaaatggaaaatagataaaagccgcgaaacataccatcaccacgctgtagacgccttaataatagccgcatcaagtcagttaaaattatgggaaaaacaagacaatccaatgtttgtcgactatggcaaaaatcaagtagtcgacaaacaaacaggtgaaatcctatcggtaagcgatgatgaatacaaagaattagtattccaaccaccataccaaggttttgtaaacactatatccagcaaaggattcgaggatgaaatactattttcatatcaagtagatagtaaatataatagaaaagtatctgacgctactatatattcaacaagaaaagcgaaaataggtaaagacaaaaaggaggaaacatacgtattaggaaaaatcaaagatatttactcacaaaacggcttcgacacattcataaagaaatacaacaaggataaaacccaattcttaatgtatcagaaagacagtctaacgtgggaaaacgtgattgaagtaatcttaagagactatccgacaacaaagaaaagtgaagatggtaaaaacgatgtaaaatgtaacccctttgaagaatataggcgagaaaacggcctaatatgcaaatatagcaagaaaggaaaagggacgcccattaaatcattaaaatactatgacaagaaacttggtaattgcatagatataacaccagaagaatcacgtaataaagtaattctacaatccataaatccatggcgagctgatgtatactttaatccagaaacactaaaatacgaattaatggggcttaaatacagtgatctatcattcgaaaaagggaccggcaactaccacatatcccaagagaaatacgacgcaatcaaagaaaaagaaggcataggcaagaaaagtgagttcaaatttacattatatcgtaacgacctcatattaataaaagacatagcatcaggagaacaagaaatttatagatttttaagcagaacaatgccaaatgtcaaccactacgtagaattaaaaccttacgataaagaaaaatttgacaacgtacaagaacttgtagaagccctgggagaagccgacaaagtgggaaggtgtataaaaggactcaataaaccgaacataagcatatacaaagtccgaaccgatgtactcggcaataaatactttgttaaaaagaaaggagacaaaccaaaattagatttcaaaaacaataagaaatga

SEQ ID NO: 8625 - RNA, 3393 nt, synthetic construct
  misc_feature 1..3393: note = Cas9 variant
  source 1..3393: mol_type = other RNA
atgacaaatggcaaaatactcggtctggatattggaatagcatccgttggagtaggtatcatagaagcgaaaacaggaaaagtagtacacgcaaactcaagactattttcagcagcgaacgcagaaaacaacgctgaaaggagaggattcagaggatcacgcagattaaatcgcagaaagaaacacagggtaaaaagagtacgagacctatttgaaaaatacggcatagtgaccgatttcagaaacttaaatttaaacccttatgaacttcgagtaaaaggtctaacagagcaacttacaaacgaggaactgttcgcagcactaaggactatcagtaaaagaagagggataagctacctagatgatgcagaggacgactctacaggatcaacggattacgccaaatcaattgacgaaaataggagactactaaaaacaaaaaccccagggcaaattcaactagaaagattagaaaaatacggacaactacgcggaaactttactgtgtacgacgaaaatggagaagcacataggttaataaacgttttcagcacatctgactacgaaaaagaagcaagaaaaatactagaaacccaggcggattacaataagaaaatcacagcagagtttatagacgattacgtagaaatattaacacagaaaagaaaatattatcatgggccaggaaacgaaaaatccagaacagattacggacgatttagaactgatggcacaaccttagaaaatatcttcggaatattaatcggaaaatgttcattttacccagatgagtacagggcctcaaaagcgtcatataccgcacaagaatataatttcttaaatgatttaaataacctaaaagtcccaactgaaactggaaaattaagcacagaacaaaaagaggctctagtagagttcgcaaaatctacagcaaccttaggaccagctaaattactaaaggaaatcgcaaaaattttagactgcaaagtggatgagataaaaggatatagggaagatgataaaggcaaacctgacctccatacctttgaaccataccgcaaattaaagttcaacctggatagcgtaaacatagattatctaagtagagaagtactagacaagctagcaggaatcttaaccttgaatacagaacgggaaggcatagaagacgcaatcaaaagaaacctgccaaatcaattcacggaagaacaaataagcgaaataataaatgtacgaaaatcccaaagcacagcttttaacaaaggatggcatagcttttcagcaaagttaatgaatgagcttataccagaactatacgcaacctcagacgaacaaatgaccatattaactaggttagaaaaatttaaagtgaaaaagaaaagcagcaaaaacataaaaacaattgatgaaaaagaaattacagatgaaatatacaatccagtagtagcaaaaagtgttcgacagacaatcaaaataataaacgcagccgtcaagaaatacggcgatttcgataaaatagtgattgaaatgccacgagacaaaaatgccgacgacgagaagaaatttataaataaaaggaataaagaaaacaagaaagaaaaagacgatgccttaaaacgagcagcatatttatataatggcacagataaacttcccgatgaggtgttccatgggaataaacaattagaaactaaaattagactatggtaccagcaaggagaacgatgcttatactccggaaaaccaataccaatacaagaactggtacataatagcaataatttcgaaattgatcacattctaccgcttagccttagcttcgatgattcattagcaaataaagtgctagtatattcatggactaaccaagaaaaaggacagaaaactccgtatcaagtaattgactcaatggatgcggcatggtcctttagagaaatgaaagaatacgtactaaaacaaaaaggacttggaaagaagaaaagagattacttactaacaactgagaatatagataaaatcgaggtcaaaaagaaatttattgaacgcaacctagtagacacccgctacgccagtcgcgtagtactgaactccctccaatccgcattacgagaattaggaaaagacacgaaagtatcagtagtacgaggccaattcacctcccaattaagaagaaaatggaaaatagataaatcaagagagacctatcatcatcacgcggtagatgcattaataatagcagcaagctcgcaactaaaattatgggaaaaacaagacaatccaatgttcgtagattatggtaataaccaggtagtagacaaacaaacaggagaaatcttaagtgtatcagataatgaatacaaagagctagtcttccagccaccatatcagggatttgtaaataccatcagtagcaaaggcttcgaagacgaaattctctttagttaccaagtcgacagtaaatacaacaggaaagtgagtgacgcaacaatatacagtacaagaaaagcaaaaataggaaaagataaaaaggaagaaacatatgtgttagggaaaataaaagacatatacagccaaaatggattcgacacattcgttaagaaatataataaagataaaacacagttcttaatgtaccaaaaagacccgttaacgtgggaaaatgtaatagaagtcatcctgggggattatccaacaacgaagaaatcagaagatgggaaaaatgacgtaaaatgtaacccgtttgaagaataccgtagagaaaacggcttaatatgcaaatattcaaagaaaggaaaagggacaccaatcaaaagccttaaatactacgacaagaaactaggcaattgtatagacataacaccagaagaaagtcgaaataaagttatattgcaatcaataaatccgtggagagctgacgtatacttcaacccagaaaccctcaaatacgaattaatgggcttaaaatactcagacttatcctttgaaaaaggaaccggaaactaccacataagtcaagaaaaatacgacgctataaaagaaaaagaaggaataggtaagaaatctgagttcaaattcactttgtatagaaacgatctaatactaataaaagacatagcatcgggagaacaggaaatatacagattcctgagtagaacaatgcccaatgtaaatcattatgtagaacttaaaccgtacgataaagaaaaattcgacaatgtgcaagagctagtcgaagcgctcggagaagcagacaaagtaggtcggtgtataaaaggactaaataaacccaacataagtatatacaaggtaagaaccgatgtattaggtaataaatatttcgtaaagaaagaaggggataaaccaaaactagactttaaaaacaataagaaatga

SEQ ID NO: 8626 - RNA, 3396 nt, synthetic construct
  misc_feature 1..3396: note = Cas9 variant
  source 1..3396: mol_type = other RNA
atggctcaacacgtatttggactagatattggcatagcatcagtgggatgggcaatcttaggagaacagcgtataattgacttaggtgtaagatgctttgataaagcagaaacagcaaaagaaggagacccactaaacttaacaagaagacaagctagactattacgtcggcgactttacagacgagcatggcgactaacacaattatccagattactaaaaagaaaaggactaatagcagacgccaaactatttgctaaagcaccatcatatggtgatagcgcttgggaacttcgaagacaaggattagatagattattaactcccttagaatgggcgagagtaatctatcaccaatgcaaacatcgcggcttccactggaccagcaaagcagaggaagcgaaagccgatagcgatgcagaaggaggtagagtcaaacagggcctagctcacacaaaagcactaatgcaagctaaaaattataggtctgcagcagaaatggtgcttgcagagtttcctgatgcacagcgaaataaaaggggtcaatatgataaggccctcagtagagtacttttaggagaagaattagctctactctttgctacacaacgaagattaggaaatccacatgcctcagacttcttcgagaaactaatcttaggcgatggagatcgtaaatctggattattttggcaacagaaaccggcgctaagtggagccgacctcctaaaaatgttaggaaaatgtacattcgaaaaaggcgaatatcgtgcaccaaaggcaagtttttctgtagaaaggcatgtatggctaacacgcctcaacaatttaagaatcgtagtagatggacgtagtcgtccattaaacgaagcagaaaggcaagccgcacttctacttccataccaaacagaaacctcaaaatataaaacattgaaaaacgcattcataaaagcgggtctatggggtgatggagtaagattcggaggtttagcttatccaagccaagcacaaattgacgcagagaaaacaaaagatcctgaagaccaatttcttgttaaattaccagcatggcatgaactacgaaaggcattcaaagcagccggtcacgaagcgctatggcaacaaatcagtactccagcgctagacggagacccaacattattagatcaaatcgctaccgtgctaagtgtatacaaagacggagctgaagttgtccaacaattaagacaattagctttaccagaaccagcagcttcaattgcagttttggagaaaatcagtttcgacaaattttcatctctgtcattaaaagccttaagaagaatagtaccattaatgcaatcaggtttacgatacgacgaagcagtagctcaaataccagaatatggacatcatagtcaaaggatcgaaccaggcgccgctaaacatctatatctaccgccattttacgaagctcaaagaaagtatgcgggaaaaggagatcatataggatcaatgcaatttagagacgatgccgatataccacgaaaccccgttgttctgcgcgctttaaatcaggccagaaaagtggtaaatgccctaatcagagaatatggatctccaatagccgtcaatatagagatggcaagagacctttccagaccattagatgaaagaaataaagtaaaaagagcccaagaagaatttcgagatcgaaatgatagagcccgatctgaatttgaacgtgatttcggctacaaaccaaaagcagcagcatttgaaaaatggatgctttatagggagcaactaggacagtgtgcctattcacaacaaccactggatatacaaagagtattagatgaccataattatgcacaagttgatcatgcgctaccttatagcaggtcttatgacgacagtaaaaataataaagtgctagtacttacacacgaaaatcaaaacaaaggtaacaggacagcatttgagtacctaacatcttttccagatggcgaagatggagaacgttggagaacatttgttgcatgggtacaaggaaataaagcatacaggatggctaaaagaaaccgattactaagaaagaactacggtgtagatgaaagcaaaggtttcattgaccgaaatttaaatgatacacggtatatctgcaaattctttaaaaattatgtggaagaacaccttcaactggcagcaagagcagatggagatactgcgagacgctgtgttgtagtaaatggccaattaacagcatttctgagagcaagatgggggttaaccaaagtacgtggagacagtgatcgacaccatgcattagatgcagcagtggtcgctgcatgcactcatggaatggtcaaagcattagcagattattcaagacgaaaagagatatctttcttacaagaaggttttccagatccagaaacgggagaaatactaaacccggcggcatttgatagagcgaggcaacatttcccagaaccctggactcacttcgcccatgaactaaaagcaagattattcactgacgacttagcagccttaagagaagacatgcaacgactcggatcatatacaacagaagatttaggaagattgcgcactttatttgtatcaagagcaccgcaaagacgatccggaggcgcagttcacaaagaaacaatatacgcacaacccgaatcattaaagcaacaaggaggagtaatagagaaaatattactcactagcttaaaactacaagactttgataaattattaaaccccgaaagcaatgatcatttcgtagaaccacatagaaacgaacggctttatgcagcaatccgacagagactagaacaatttggaggtagagcagataaagcctttggtccagataacttatttcataaacctgacaaaaataaccaaccgacaggaccagtcgtcagatcaattaagttagtaagaggtaaacagacagggataccaataagaggaggcttggctaaaaacgattcaatgttaagagtagatatattcacaaaagcgggtaaattccatctcgttccagtttatgtacatcaccgagtaacaggactgccaaatcgagcgatcgttgcctttaaagacgaagatgagtggacattaatagatgaatcattcgcatttctattctccgtatatccaaatgattacgtcaaagtaacattaaagaaagaacaacagagtggatactatagtggagcagatcgaagcacaggagcaatgaacttatgggcacacgaccgagctgcatcggtaggtaaagatggtctaatacgcggcataggcgtaaaaacagccttaagtgtcgaaaaatttaatgtggacgtcctcggtaggatatatttggcgccaccagaaacacgctcaggactagcatga

SEQ ID NO: 8627 - RNA, 3399 nt, synthetic construct
  misc_feature 1..3399: note = Cas9 variant
  source 1..3399: mol_type = other RNA
atggcacaatatgtattcggcttagatatagggatcgcaagcgtaggatgggcagtattagacgcgcaaagaatagttgatctcggagtaagatgcttcgataaagcagaaacagctaaagagggagacccactaaatttaacaagaaggcaagcaagacttctcagacgaagattataccgtagagcatggagattaacacaattagcccgactattcaaacgtgaaggtctcatagacgacgcaaaattatttgcaaaagctccttcatggaccgaaaatgcctgggagctaaggctaagaggacttgatcacttgttaacacctcttgaatgggctagagtgatttaccacttatgtaaacatcgaggttttcactggaccagtaaagcagaagaagccaaagctgaatccgatgctgaaggaggcagagtaaaacaaggtctagcacatactaaggcactaatgcaagtcaaaaattaccgatcaacagcagagatggtattggcggaatttccgggagcacagagaaacaaaagaggccaatatgataaagcattaagtagagtactactcggcgaagaactagctctactatttgcaactcagcgtagattaggaaatccacatgcttcagaacatttcgaacaactcattttaggacacggggacagaaaaagtgggcttttctggcaacaaaaaccagctttatctggagcagatctactaaaaatgctaggcaaatgcacttttgagaaaacagaatatcgagcacccaaagctagtttctcagctgaacgccatgtatggttaactagacttaacaatctaagaattgtagtagacgggagagctagacccttaaacgatgctgaaaggcaagctgcactactcctcccctatcagacagaaacttttaaatataagacactaaaggctgctttcgttaaagtaggactgtggggagatggggttcgttttggaggattggcctaccctagccaagcacaagccgaagcagaaaaagctaaagaccctgaagatcaatttctagtgaaactacccgcctggcatgagcttagaaaagcgttcaaagcagcaggacatgaggcactatggcagcaaattagtatgccagcgctagaagaagatccaacactgttagatcaaatagcaacggtactatcagtatacaaagatggtactgaagtagttcaacaattaagacaactcgcattacctgaaccagacgcttcaatagctgttctggagaaaattagattcgacaagttttcttctctatctttaaaggctttacgacgaatagtgcccttaatgcaaggaggactacgttatgatgaagcagttgcacagatacctgaatatggacatcattcacaaagaatagatccaggagcaacgagacacttatatttacctccattttatgaagcacaacgaaaatacgctggtaaaggagacagaattggttctatgcaattcagagaagatgcagacgtgcctaggaatccagttgtactaagagcactaaatcaagctagaaaagtagtaaatgctttaatcagggaatatggatcaccagttgcagttaacatagaaatggcaagagacctatcgagacccttagacgaaagaaacaaggttaaacgagctcaggaggaatttcgtgataggaacgataaggcaagaagtgaatttgaacgcgattttggttacaaacctaaaggagcagtatttgagaaatggatgttatatagagaacaactaggtcaatgtgcatattcgcaacagcctttagatatccaaagagtattagacgacccaaattacgcccaagtggatcatgcactaccttattctagatcctacgatgatagcaagaataataaagtacttgtattaacgagagaaaatcaaaataaaggcaatagaacgccatttgaatacctaacaagttttcccggaggagaagacggagaaaggtggagagccttcgtagcatgggttcagggaaacaaagcatatcgaatggcaaaaagaaacagacttttacgaaagaactatggtacggatgaaagtcgaggcttcattgatagaaacttaaatgatacaaggtatatatgtaaattctttaaaaactatgtagaagaacacttgcagttagcagctagaacggacggagatacagcacgacgatgcgtagtagttaatggacaactgacagcatttttaagggcaaggtggggattagccaaagtccgaggcgattcagatagacatcatgcgctagatgcagcagtcgtagctgcttgtactcacggtatggtcaaagcacttgccgactacagtagaaggaaagaaattgcatttttacaagaagggtttcccgatccagaaaccggagaaatattaaacttagcagcatttgaccgagcacgagaacatttcccagaaccctggccccactttgctcatgaattaaaagcacgacttttcatagatgatctcgtggccctcagagaagatatgcaacatctaggaagctatgcccaagacgatttagacagacttagaacattattcgtatcccgagcaccccaaagaagaaatggaggtgcagtacacaaaggcacaatatatgctcaaccagagaaccttaaacaacagggttcaacaatagaaaagatattattaacaggactaaagttacaagattttgataaattactcaacccagaatcatcagaccattttgtagaaccacacagaaatgaaagactctatgcggcaatcaggagacgattagaagaatttggtggaaaagcagacaaggcttttggacccgataaaccattttataaacccgacaaaaatggccaacctacgggtcctattgtaaggtcaattaaattagtaagaggtaaacaaacaggtattccaatcagaggaggtttagccaaaaatgatagtatgctcagagtagatgtctttacgaaagcaggcaaatttcatcttgtaccagtatatgtacatcacagagtaactggcttaccagatagggcaatagtcgcattcaaggacgaagaagaatggacattgatcgatgaatcctacgcattcctctttagcgtatatcccaatgattttgtatgcgtacaacaacgtggaaagcccttaatcgaaggatattacgctggattagatcgagcaaatgggaatataaacgtatgggctcacgatagagcagctagtgtaggaaaagatggactaataagaggaatcggagtaaaaactgcactatcgcttgaaaaattaaatgtggatgtcttaggacgtatatatccagctccaccagagactcgcagaggactagcatga

SEQ ID NO: 8628 - RNA, 3399 nt, synthetic construct
  misc_feature 1..3399: note = Cas9 variant
  source 1..3399: mol_type = other RNA
atgaagaaaatcctaggagtagatctcgggataacatcatttggatatgccatcttacaagaaacaggaaaagatttatatcgatgcttagataattcagtagttatgaggaataatccttatgacgagaaaagcggagaaagttcccaatcaataagaagtacacaaaagtctatgagaagattaatcgaaaagcgaaagaaaagaataaggtgcgtagcccaaacgatggaaagatatggaatattagattacagtgaaactatgaaaatcaacgatccgaaaaataatccaattaaaaataggtggcaattaagagcagtcgacgcctggaagagaccactaagtccccaagaactattcgcaatattcgcacacatggcaaaacatagaggatacaaatccatcgcgacagaagatttaatatatgaattagaactggaattaggactaaatgacccggaaaaggaaagtgaaaagaaagcagacgaaaggcgtcaagtatataatgcacttagacatttagaagaattgagaaagaaatacggaggagagacaatagcacaaacaatacaccgagcagtagaagctggtgacctacgatcatacagaaaccatgacgactatgagaaaatgataaggagagaagacatagaagaagaaatagaaaaagtccttcttagacaagccgaactcggagccctgggattaccagaagaacaagtttcagaactaatcgatgaattaaaagcctgtattaccgatcaagagatgccaacaatagacgaatccctatttggaaaatgtacattttacaaagacgaattggcagcacccgcttactcttatctttatgatttgtacaggttatataaaaagctcgccgatttgaacatcgacggatacgaagttacccaggaagatagggagaaggtcatagaatgggtggaaaagaaaattgcgcaagggaaaaatttaaagaaaatcacacataaagatttgagaaaaatactgggattagcacctgaacagaaaatttttggagtagaggacgaaaggatagtaaaaggaaagaaagaaccaagaacattcgtaccatttttctttttggcagacatagcaaaattcaaagaactattcgcatcaatacaaaaacacccagacgcactgcaaattttccgtgaactagctgaaatattacaaagaagtaaaacaccacaggaagctctcgataggttacgagccctaatggcaggaaaaggaatagatacagatgacagagaattactagaattatttaaaaacaaacgatcagggactcgtgaactatcacatagatacatactagaggcgctaccactatttttagaaggatatgacgaaaaagaagtacaacgcatactagggttcgacgaccgggaagattactcaaggtatccaaaatcattacgtcacttacacttaagagaaggaaatctattcgaaaaagaagaaaatccaatcaataatcacgccgttaaatcattagcatcatgggcattaggtttaatagctgatctaagttggcggtatggtccttttgacgaaattatactagaaacaacacgggacgccctaccagagaaaattcgaaaagaaatagataaagctatgagagaaagagaaaaagcgttagataaaataattggcaaatacaagaaagaatttccgtcaatagacaaaagactagcgagaaaaatacaactgtgggagagacaaaaaggcctcgacctctactctggaaaagttataaatttatcccaactactcgacggcagtgctgacatagaacatatcgtaccacaatcattaggtggattatcaacagactacaacaccatagttacactaaaatctgtaaatgcagcaaaaggaaatcgattacctggagactggcttgcaggaaatccagactacagagagagaataggtatgctcagcgaaaaaggactaatagattggaagaaacgtaaaaatttactagcacaatccctagacgaaatttacacagaaaatacccattctaaaggtatcagagccacatcatacctagaggctttggttgcccaggtactaaaaaggtattacccattccccgaccccgaactaaggaaaaacggaatcggtgtaagaatgataccagggaaagtaacctcaaaaactagatcattactagggataaaaagcaaatctagagaaacaaactttcatcacgctgaagacgctttaatcctatcaacattaactagaggttggcaaaacaggcttcacagaatgctaagggataactatggcaaaagcgaagcagaattaaaagaattatggaagaaatacatgcctcacatagaaggactaaccctcgccgactacatagacgaagcatttcgacgattcatgagtaaaggtgaagaaagtttattctatagggacatgtttgacactataagaagtatcagttattgggtagacaagaaaccactctcagcgtcatcacacaaagaaaccgtttattctagtagacacgaagtacctacattgaggaaaaacatattagaagcattcgactcactaaacgtgattaaagatcgtcacaaattaactacagaagaatttatgaaaagatatgataaagaaatccgacaaaaactatggttacatagaataggtaataccaatgacgaatcttatagagcagtagaagaaagggcaacacaaatagcgcaaattttaacacgatatcaactaatggatgcacaaaacgacaaagaaatcgatgaaaaatttcaacaagcactaaaagaattaataacatcgcctatagaagtaacgggcaaattactaaggaaaatgcgctttgtttacgacaaactaaatgcaatgcaaatagaccgaggcctagtagaaacagataaaaatatgctaggaatacacattagtaaaggaccaaatgaaaaactaatttttagaaggatggatgttaacaatgcacacgagttacaaaaagaaagatcaggcattctctgttatctgaacgaaatgctttttatattcaacaagaaaggactaatacattatggctgtttacgctcatatctagaaaaaggacaaggaagtaaatatatagcactttttaacccaaggttcccagcaaatcctaaagcccaaccgagcaaattcacttcagattctaaaataaaacaagtcggtatcggttctgcaacgggtataataaaagcgcacctagatttagacgggcacgtaagatcatatgaagttttcggaacactacctgaaggttcaattgagtggtttaaagaagaaagcggatacgggagagtcgaagatgacccacaccattga

SEQ ID NO: 8629 - RNA, 3402 nt, synthetic construct
  misc_feature 1..3402: note = Cas9 variant
  source 1..3402: mol_type = other RNA
atggatctgaactatcgtatcggactagatattggcatcgcaagcgtaggatgggcagtgcttgaaaacaacagtaaagatgaaccagtacgtatcgtagatctcggagtgcgtttatttgaagctgcagaagtcccgaaaacaggagctgcattagcagaaccaagaagagaagcaagaacgactcgaagaagattaagaagacgaaaacataggttagaacgtatgaaatggttactacaagaatatggactaattcaaacagaagagttcatgaaaaggtatcactcggcaggactaccagatgtttatcgattaagatatgaaggattagaacgaaaactaaaggacgaagaattagcacaaatcctaatacatattgggaaacatagaggatttaggtcaactagaaaggctgagttaaaagacaaaaatgataaagaaacaggagctgtactctcagcaacaagggaaaacgaaaagttaatggaagaacacggttatagaactgccggtgaaatgatatacaaagacgataaatttcgtacaggttgtacttggaaagaagagggatatagattaacaccacgaaacaaagagggagattataaaaatactatgctgagagcactattagaagatgaagtaaaagtaatctttgactgtcaaagaaaattcggaaatcaaaaagcaagtgaagaactagaaaaagcatatttagcaataatgacatcacaacgatcatttgatatgggtcctggtaagcaaccagacggatcagcatcaccatatgcaatggaaggatttggagatagagttggactatgcgcattagaacccagagaaaaacaggaacctagagcgcccaaagcggcatatacaagtgagttattcgtcgccttacagaaaatcaatcatttaagaataacagagaagaacggaaaaggaaggggactaacaagtgaagaacgagaaaggttaagtgatctacttcataagaagaaagaattgacctatggagcagttagaaaagaactccaactcgaccttaggtatagattcaatacattgaactactcatcaaagaaaatgacagaagaagagaaaataaaagatgcagaaaaagctaaatttgtctcaatggttagtcattatgaatacagaaaacggatgagcggaatgttagaacaactgtcaccagaagaacaagccgacttaatggacgaagtaggaaaaatactaacactttataaaaacgacgacacaagatcacgcgaatttcaaaaactaggtttagattcggaaataacagaagaattactggaactgaacccacgcggatttcaacatgtatcactcaaagcgatgaagaaactcatgccgtatttaaaagaaggattaacatatgacaaggcttgtgcagaagcaggatacgatttccaaggaagtgtacaaaaagaaagatcaaggctactgaaagggaaagaaataacagatattataaacgatattaacaatccagtagtgaaaagaagcgtatcccaaacggtaaaagtaataaacgcaataattcagaaatatggaagtccacaggcagtgaatattgaactcgctcgtgaaatgagtagaaactacgacgaaaggagaaaaatggaaaaacaaatgaaagacagacaaagtgaaaatgaaagagccaaaaaggaaatacaagaattgggaaacgcatttccaacaggccaagatatattaaaatataggctgtggcatgatcaagatggcatatgcatgtatagcgcaaaaagaataccactagcagaattattcacgggagcatatgatatagatcacatattaccatactcaattacgtttgatgactcatacagaaataaagtgctagttacttcagaagaaaacagacagaaaggaaatcgaataccgtatgagtactttggttcagattcagaacgatggtctaagttcgaaaccttagtgaatagcagaatacgcgattacagaaaacaacaaaatttacttaaacaaagtttcactgaagaagaaagaaaggagttcaaacaaaggaatctaaatgatactaagtatattacacgtgtaatatacaacatgataagagaaaatctagcattagcaccttataatagcccaggaaagaagaaacaagtgtttgcggtgaacggtggagtaaccgcatatcttcgaaaacgatggggaatgtcagcaaaagatagatcaatagacacccatcacgcaagagacgccgtggtaatagcttgttgcacggacggaatgatacagaaaatctccaggaatatacaaggtcgtgaactgttatatgctagaggttttactgcagttgatgtagaaactggtgaaaaatttactagggatgatttcacaagagatcaatgggatgaaatattcggagtacaagtacccaaaccatgggagtatttcaatgaagaactcgatatacgattaggggaaaatccagtagagtttatagaaactcactctgacgtaagtaggaaattagattatccagcatggttctatgaaaacaacataatacgacctgtattcgtaagcaggatgccaaacagaaaggtcacaggagcagcacatgcagatacaatccgatcacctagacattatcaagaaactggatcagttcttacaaaaacagccctaattgatctaaaactgaacaagaaaacaggggaaatagaaaattattacaaaccagaatcagatactctattatacaacgcattgaaagaaagactggaactttatggcggtgatggcaagaaagcgtttgaagaaccattttacaaaccaaaagctgatggcagtagaggaaacttggtacgaaaagtaaaaacatacgataaattaacgttaggagtatacgtaaatagccaacatggcatagcagcgaatgcaaatgggtcaatggtaagagtcgacgttttcagagtatcaggtaagtattatttcgttcctgtatatatagcggatgtcgtacggaaaagactcccaatgaaggctgttgtccaaggaaagcaatatatagattggaaagaaatggaggataaagactttatattttcattatatacaagagatttaatcagtttcaagagtaaaaatgggaagaaagtgacctgtgttgacggaacatcgaaagcagtcaatgaagagattgtctattattatggcgcaaacatctcaacggctagtttctcgggaaaaagtcacaatggcagtttcgagtttacaagcctaggcattcaaggattggaatacttaaagaaatatcaagttgatgtcctcggtaatgtatctgaagtcaaaagagagaaaagaatgggattccgttga

SEQ ID NO: 8630 - RNA, 3402 nt, synthetic construct
  misc_feature 1..3402: note = Cas9 variant
  source 1..3402: mol_type = other RNA
atggggggattcgaagttgacagaaaaatatcacttggacttgatataggagtatcttcagtaggttattccgtcatagatgtggacacaggaaaagttctcgaactcggttcaagacttataaatggtaaaattggtacagaaaaccaagctagaagagaaatgagaggcactaggagactaattaaccgaaaaaaacaaagaagaaaagatactgtaaaattattcaatgaattcaaactaatcgacagtaagaaagatgaacattacttcgaccacttcgcaaacaacagcgacccatacgaactaagagtcaaaggactatctgaaaaacttagtttgtcagaaatagcagacggactataccacatcgtgaaacgaagaggaatatcatatgacctaaaagacgctgatgaagaatcagaaggttcagaatatgaaaatggtttaaaaataaataactccgaattaaaaaatcaaacaccagcgcaaattcaactcaaaagactaaacgagtacggcgctatcagaggaaaagtagtcatagatgaagaaaaaatcttacttaacgttttcccaaccaaagcttatctcgacgaagcaaaaagaataattgaaaagcaaagagaattctacccaggaatcctaaccgaagaattcgaagaaaaatattgtcaaatactaacacgaaaaagggattactttgttggccctggctccgaaaaatcgcgaacagactatggaatttataaagaagacggacgcactcttaataacttattcgaagaattaataggacacgacaagatttatccagaagaactcagagcatccggcgcatcatttacggcacaattatttaatgtattgaatgacctaaataaccttcatatatcatcttatgaagaccaaaaacttacaacggaaaacaaagaacaaataatatcagaattaaaatcaacaacatctaacgtaaacatgatgaaactcatccagaaaatagccggttgcgaagaatcagacatttcaggttacagaactgacaaaaactataaacccgaaatttcaagcatgcggatatatcgaaaagttcacaagaaactcttagaatcagagatagatattacaaattggccagacgattttattaataaattatcattcattttaaccttaaacactgaaaacggagaaatacgaaaccaactaaaaaatagattgcagcccgaatacgacttcttaaccgatgaactgatacagacgataatagataacaaagaaagtttcgatataaaaagcaataacaaatggcatcggttttcaataaaaacaatggaattattaatcccagaaatgattaaaagacctgtagaacaaatgaccctaatcaacgaaatgggactcataaaaaactcaggtaaaaaattctccaactacaaatacctaccatataaaaaaatcgcagaagacatatataatcctgtagcaagtaaaagtgtacgagaagcactcaaaatagtaaatgcaatcttaaaagaatacggccatattgaatacatagtcgtcgaaatgccacgtgacaaaaatgaagacgaagcaaaagaccaaatagaaaaattccaaaaggcaaatggtagactaaaagatgcagcccttgaagagttcacagaagctattggcgacaaatcaaccgtagataaaaaattaggtgttcatagatcaaaattactattcaagataaggctatggtaccaacaacgtggcatggatttatatgaaggcaaacctataagtgctgtagacctgcttaataaccccgacagcttccaaatcgatcatataatcccccaaagcgtatcattcgacgattcattcaacaataaaacactttgtaatagtggcctcaatcaaataaaagataagaaaacaccatttgaatacatgaacgaaggatatggacaaggtttcgatagcatgaaagcaatggtaatgaagaacccaagaatagatcacaataaaagaaaaaactacctattcagtgaaaacgttagcgacatagaaactcgaaaaagatttattagcagaaacctcgtagatacccgctacgcatcaagagtagttcttaataatttacaggaattttttaaagaaaaggaatcagacacaaaaataagcataatacgaggaaaattcacctcaaatcttagaaaacactggaaaatcaataaaaacagagatacctaccaccatcatgcgatcgacgcaacaataatagctgccacgccattcctaaatatttggaaaaaaggctcctcaatatttccatcaaacgtggaatcagaagactttttcgatataaaaacaggaaagataataggaaatgacgaattcaataagtatgcatacgatgaaccatacaatgggttttacaacgagttaagaaatgcaacagaccggataaaattttctcatcaaatcgacaagaaaatgaataggaaagtgtcagacagtacaatatactctactagagtagcaaaatcaccaaaaaataaaaaagaaagcgaatacatcgtcgccaaaataaaaaacatttatgacgcagacgaatacgcaaaattcaagagaatatacgacaaagataaaacaaaatttctactcaataaatacgatccacgatcatttaaccacttagaaaaaataatgaacacatacccagattccatagaaaggacaatgtcaaacaacaaggtaaaagtagtacgaataagcccttttgaattatatcgacaggaccatggcccagtaaaaaaatacagcaagaaaaacaatggtccagagataaagcaattaaaatacttagacaaaaaagtaggaagcagtatagatgtgactccagacaacgccaaaaataaacatgtcatactaaaatcactaaaaccatggagaacagacatatacctaaaccacgaaaccggcgaatatgaaataatgggaataaaatactcggacctcaaattcaataaaggagaagggtacggaattaaaaaagcaaaatatttagaaataaaacatagagaaaaagtaagcgatgattctgaatttatgttcacattatacaaaaaaaaccgaataaaagtagaaaacatggaaacagatgaaagcgtagaaatgttattctggtcaagaactatggattcacaaaaaggatatgccgaactaaaaccaatatacaaatacaaaacagaagacgacaactggccgatatatgggaatgcaaagaaacaaataataaagaaattaatccctaaaaactgcaaaatatggaaagttaatacagatgttctaggaaacccattttacgtagaaaaagaaggagaatacccaaaagatgtactagactga

SEQ ID NO: 8631 - RNA, 3405 nt, synthetic construct
  misc_feature 1..3405: note = Cas9 variant
  source 1..3405: mol_type = other RNA
atgaacggattggtccttggcttagatataggaatagcatctgtcggcgtaggaattttagagaaaaactccggaaaaatcgtacacgccagctccaggatattcccggcagcaacggctgacaataatgtagaacgaagaaagaacagacaagcacgacgactgcatcgacgaaagaaacatcgtggcgcacggttaaaagacttatttgaatactacggcctactaacagacttcagcaaggttagtataaatctaaatccttacagactaagggtagacggactagatcaacaattaactaatgaggaactatttattgcactcaaaaacatagtaaaaagacgtggcatatcgtatctagacgacgcaagtgaagacggagggacagtctctagcgattatggaaaagcggtagaagaaaatagaaaactcttagctgaacaaaccccaggccagatccaattagaacgattcgaaaaatatggacaactaagaggcgacttcacagtcgtagaaaactcagagaaatgtagactaatcaatgtattcagcacctcggcatacaaaaaggaagctgaacgcatactacgaaaacagcaagagttcaataatcaaataacagacgaatttatcgaagactacctcaagatactaacaggtaaaagaaaatactaccacgggccaggaaatgagaaaagtcgaactgactacggaagattccgaacagacggcgccacattagacaacatatttggcatcctaatcggaaagtgtacattttaccccaatgaatacagagctagtaaggcaagctacaccgcacaggagttcaacctactcaacgatttaaataatttaacagtaccaacggaaacaaagaaattatcagaagaacaaaagaaaactataattgaatatgcaaaatccgcgaaaaccctcggagcatctacactattaaaatatatagcgaaaatgatcgacgcaagtgtagatcaaatacgagggtacagagtagatgtaaacaacaaaccagaaatgcatacctttgaagtctataggaaaatgcaatccctagaaaccatatctgtaggcgaactaagtagaaacatacttgatgaactcgctcatatactaacacttaacactgaaagagaagggatagaagaagctatcaataccaaactaagagattcgttttcccaagatcaggtacttgagctagtacaatttcgtaaaaataactcaagcctattcagtaaaggctggcacaacttcagtttaaaactaatgatggaactcatcccagaactctatgaaacatccgaagaacaaatgaccatacttacaagactaggaaaacagaaaagtaaagaaacaagtaaaagaactaaatacatagatgaaaaagaagtaacagaagaaatatacaaccctgtagtagctaaatcagtcaggcaagcaataaaaatcataaatgaagccacaaagaaacacggaatatttgacaatatagttatcgaaatggctagagagaacaatgaagaagatgcaaagaaagattatataaaacgacaaaaagcaaatcaagatgaaaaatacgccgccatggaaaaagcagccttccaatataatggtaagaaagaattaccggacaacatatttcatggccacaaagaactagcaacaaaaatacgtctttggcaccaacaaggagagaaatgcctatacacaggaaaatcaataccaataagcgacctgatacataaccaatacaaatacgaaattgatcacatattacccttatctctatccttcgacgatagcctaagcaacaaagtactcgtcttagcaactgcaaaccaagaaaaaggacaaagaacaccttttcaagcactcgacagtatggatgatgcttggtcatatagagagttcaaaagctatgtaaaagaatcaaaacttctaggaaataaaaagaaagaatatttattaaccgaagaagatatttcaaaaatcgaagtaaaacaaaaattcattgaaagaaatctagttgacacaagatatagtagcagagtggttcttaacgcattacaagacttttacaaaaatcacaacttcgatacaacaatcagcgtcgtcagaggacaattcaccagtcaactaagaagaaaatggggactcgagaaaagccgagaaacataccaccaccacgcagtagacgcactaattatagcagcatcaagccaattaagactatggaagaaacaaaacaacccactgatagcttataaagaaggacaatttgtagatagccaaacgggcgaaattatctcactcacagacgatgaatataaagaattggtgtttaaagccccatacgatcacttcgtagacaccttaagcagcaaaaccttcgaagattcaatcctcttttcttatcaagtagactccaaatttaatagaaaaatatctgatgctactatatatgcaacacgcaaagcaaaacttgacaaagaaaagaaagaatacacgtacacactcggaaaaataaaagatatctatagcttaggtacgaaaacaccaagcaaaacaggattttataaattcctcgatctttacaataaagacaaatctcaattccttatgttccaaaaagacagaaaaacatgggatgaagtgatagagaaaatcatggaacaataccgaccattcaaagaatacgacaaagcaggtaaattagtagatttcaacccattcgaaaaatatcgccaagaaaacggtccgatacgtaaatactcaaagaaaggaaacggacccgaaatcaaaagtctaaaatattacgatatactactaggtaaacataaaaatataacaccagaaggatcacgaaatacagtagccctactatccttaaacccatggagaacagatgtttattataacatggaaaccaagaaatacgagttcctaggacttaaatacgcagatctaccattcgaagaaggaggagcatatgggatatcaacagaaacatataacgaattacgtgaaaaagagggaattggcaaaaactctgaatttaaattcacactatataaaaacgacttaatattaataaaagatacggaaacaaactgccaacaattctttaggttttggagtcgaacaggaaaagataaccccaaatcatttgagaaacacaaaatagaactcaaaccatatgaaaaagctaaatttgaaaagggcgaagaattagaggttctaggcaaagttcctccaagttcaaatcaatttcaaaagaatatgcaaatagaaaacttaagcatatacaaagtaaaaacagatgtactaggaaataaacacttcataaagaaagaaggcgacaaacccaaactcaaattctga

SEQ ID NO: 8632 - RNA, 3405 nt, synthetic construct
  misc_feature 1..3405: note = Cas9 variant
  source 1..3405: mol_type = other RNA
atgaacgggctagtgttgggactagacattggaatcgcttcagtaggagtcggaattttggagaaaaattctggcaaaataatacacgcaaactccagattatttccagcagcgacagcagataacaacgtcgaacggcgaaagaatcgacaagctagaagattaaacagaagaaagaaacatagaggcgtgagattccaagatctgtttgaagactacggattactaacagatttttcaaaagtaagtataaacttaaatccttacagactaagagtcgatggcctaaaccaacaattaacaaacgaagaattatttatagctttaaagaacatcgtaaaaagacgaggaataagttatttagatgatgcatccgaagatggaggcgccgtctcctccgattacggaaaagcggtcgaagaaaatcgaaaattactagccgaacaaacgccaggtcaaatacaattagaacgattcgaaaaatacggtcaggtaagaggagacttcacagttgtagaaaacggtgaaaaacttcgattaataaatgtcttctccacttcagcatacaagaaagaagcagaacgaatacttagaaaacaacaagagttcaataatcaaatcacagacgagttcatagaagactacctgaaaatactaacagggaaaagaaaatattaccacggaccaggcaacgagaaaagcagaacggactacggaaggttcagaaccgacggaactacattagataacatattcggcatcttaataggaaaatgtacgttctaccctgaagaataccgcgcatccaaagcatcatatacagcccaagaatttaatctcctaaatgacctaaataatttaacggtaccaacagaaacaaagaaattaagtgaagaacaaaagaaagtgatagtggaatatgcaaaagaagccaaaacattaggcgccagcactctattaaaatatatcgcgaaaatgatagacgcatcagtagaccaaattagaggatatagggttgacgtgaacaacaaaccagaaatgcatacattcgaagtttatcgaaaaatgcaatcattagaaacaatatctgtgggcgaattatcacgaaacgtcctagacgaacttgcacacatattaacactaaacacagaaagagaagggatggaagaagcaattaatactaaactaaaagacagcttcagccaagaccaagtcctagaattagtacaattccgaaagaataacagttctttattttctaaaggatggcataatttttcattgaaactaatgatggaattaataccagaactctacgaaacttcagaagaacaaatgaccatcctaacacgattaggaaaacagaaaagtaaagaaacaagtaaaagaacaaaatatatagatgaaaaagaattaacagaagaaatatataatccagtggttgcgaaatcagtaaggcaagcaataaaaataattaacgaagcgactaagaaacacggaattttcgacaacatagttatagaaatggctcgcgaaaacaatgaagaagacgcaaagaaagactacattaaacgtcaaaaagccaaccaagatgagaaaaacgctgccatggaaaaagccgcattccaatataatggcaagaaagaactcccagataacatatttcatggacacaaagaactagcaacgaaaatacgactatggcatcaacaaggcgaaaaatgcttatataccggaaaaactatcccaatatcagatcttatacacaatcaatacaaatatgaaatagatcacatcctaccgcttagcttaagttttgacgattcactaagcaacaaagtgctggtgctagcaacagccaaccaagagaaaggtcaaagaacaccgtttcaagcactggactcaatggatgacgcgtggagttacagggagttcaaatcttatgttaaagaatcaaaactattaggaaataaaaagaaagaatacttattaacagaagaagacatttcaaaaatagaagtaaaacaaaaatttattgaacgaaatttaatagatactcgatactcatcacgagtagtattaaatgctctacaagatttctacaaagcacacaaattcgacacaacaataagcgttgtaagaggccaattcacaagtcaattaagaagaaaatgggggttagaaaaatctcgagaaacttatcatcatcacgcagtcgacgctttaataatagcagcgtcaagtcaattaagactctggaagaaacaaaataactcattaataagctacaaagaaggacaattcgtagattcagaaactggtgaaataatctcactaacagacgatgaatataaagaactcgtgttcaaagccccatatgaccacttcgtagacactcttcgatcaaagaaattcgaagacagcattctatttagctaccaagtggattcgaaatttaaccgaaaaatatcagacgcaaccatatatgctaccaggaaagcgaaattagataaagaaaagaaagaatacacatataccctaggaaaaataaaagatatctattcgctaggaaccaaagcaccatcgaaaactggattttataaatttcttgacctctacaacaaagataaatcacaattcctgatgttccaaaaagaccgtaaaacgtgggatgaggtgattgagaaaatcatggaacaatacagaccatttaaagaatacgacaagacaggaaaactggtagacttcaatccgttcgaaaagtacagacaagaaaacggtccaatccgaaagtacagtaagaaaggtaatggacctgaaattaaatcactaaaatactacgacatactactaggaaaacataaaaacataacaccggagggatcaagaaacaccgttgcactcttaagcctaaacccatggagaacggatgtatattacaacatggaaacgaagaaatacgagttcctaggacttaaatatgcagacttaccattcgaagaaggcggggcttacggaatctcaacagaaacgtacaatgaactccgagagaaagaaggaatagggaaaaatagtgagttcaaatttacattgtataaaaacgatctaatcttaatcaaagacacagaaacaaactgccaacaaatttttaggttctggtcaagaacaggtaaagacaacccaaaatcatttgaaaaacataaaattgaattaaaaccctatgaaaaagcaagatttgaaaaaggagaagaactgaaagttttaggaaaagttccacctagctcgaaccaattgcagaaaaatatgcaaatagaaaatttaagtatatacaaagtaaaaacggacgtactaggaaataagcactttatcaagaaagaaggagacgagcccaaattaaaattctga

SEQ ID NO: 8633 - RNA, 3405 nt, synthetic construct
  misc_feature 1..3405: note = Cas9 variant
  source 1..3405: mol_type = other RNA
atgaatggactagtcctaggattggacatcggaatcgcatcagtaggagtcggaatcttagaaaaaaattcgggaaaaataatacatgaaaactccagactgttcccagcagccaccgcagacaacaacgtagaaagaaggaaaaacaggcaggcaagacgattaaatagaagaaaaaaacatagaggagtgagatttcaagacttattcgaagactatggtctgttaacagacttcagcaaagtatccatcaatctcaacccatacagactgagagtagacggcttaaaccaacagcttacgaatgaagaactgtttatagcattaaaaaacatagtcaaaagaagaggaataagttacctagatgacgcaagcgaagacggaggcactgtaccatccgactatggaaaagcggttaaagaaaacagaaaactattagcagaaaaaacaccaggacaaatccaactcgaacggtttgaaaaatatggacaattaagaggtgactttacggtcgaagaaaatggagaaaaatgcagactaattaatgtttttagtacgtcagcctacaaaaaagaagccgaaagaattctccgcaaacaacaagaatttaataaccaaataacaaacgaattcatagaagattacctcaaaattttgaccggcaaacgtaaatattatcatgggcccggtaacgaaaagagcagaacagactatggaaggtttagaacagacggcaccacactggataatatcttcggaattctcattggtaaatgcactttctatcctgaagaatatagagtatcaaaagcttcatatacagctcaagaattcaacatactcaacgaccttaacaatcttacagtccccaccgaaacaaaaaaattatcagaagaacagaaaaaagatatagtcgagtacgcaaaagaaacgaaaaccctaggagcatcaacactactaaaatatatcgcaaaaatgatagatgcatccgtagaccaaataagaggatatagagttgacgtaaataacaaacccgaaatgcacacattcgaagtatacagaaaaatgcaaagcttagagacaatatcagtaggtgagctatcacggaacgtcctagacgaactagcacacatattaacactgaatacagagcgagaaggaatagaagaagccataaacacaaaattgatgggcgttttctcacaagaccaagtactagaattggttcaattcagaaaaaacaactcaagcctattttcaaaagggtggcataacttttctctaaaattgatgatggaactgatcccagaattatatgaaacaagtgaagaacaaatgacaatattaactagattaggaaagcaaaaaagtaaggaaacttctaaaagaacaaaatacatcgatgaaaaagaagtaaccgaagaaatatataatcctgtagtagccaaatcagtaagacaagcaatcaagataatcaacgaagcaactaaaaaatacgggattttcgacaatatcgtaatagaaatggcaagagaaaacaatgaagaagacgcgaaaaaagattatataaaaagacagaaagcaaaccaagacgaaaaaaacgcagcaatggaaaaagcagcatttcaatataatggtaaaaaagaattacctgacagcatttttcacggacataaagaattagccacaaaaatccgactttggcaccagcaaggagaaaaatgtctctatacaggaaaaaatatacccataagtgacttaattcacaatcaatacaaatacgaaatagatcatatactacccttgtccttatcatttgacgacagcctatcaaacaaagtactcgtgctagccacagccaaccaagagaaaggacagcgaaccccttttcaagcgctagattccatggacgacgcctggtcctatcgagaatttaagtcttacgtaaaagactccaaactattaagtaataaaaaaaaagactacttgctcacggaagaagacatttcaaaaatagaagtaaaacagaaattcatagaaagaaatttggtcgacacccgatacagttccagagtagtactcaatgctcttcaagatttctataaggctcataaatttgatacaacaataagtgtagtaaggggacaatttacgtctcaacttcgccgaaaatggggattagaaaaatcacgagaaacataccatcaccatgcagtcgacgcattaataatagccgcgtcaagtcaactcagactttggaaaaaacaaaataatccattaataacatacaaggaaggacaatttgtagattctgaaacgggagaaataatatcactaacagatgatgaatacaaagaattagtattcaaagcaccctacgatcactttgtagatacattacgatcaaaaacttttgaagattcaattttattctcataccaagtagactctaaatttaatagaaaaatctcagacgccaccatatacgcaacccgaaaagcgaaactagacaaagagaaaaaggaatacacttatactctaggcaaaataaaagatatatactcactaggcacaaaaacaccaagtaaaactggattctacaaatttttagatctatacaataaagataagagccaattcctaatgtttcagaaagacagaaaaacatgggatgaagtcatcgaaaaaataatggaacaatatagaccgttcaaagaatatgacaaaactggaaagttagtagacttcaacccatttgaaaaatatagacaagaaaacggaccaatatgcaaatacagtaaaaaaggaaatggcccagaaatcaagtcgttaaaatactacgacatactactaggaaaacacaaaaatataacaccggaaggctcaagaaacacagtcgcacttctatcactgaacccatggcgaactgatgtatactacaacatggaaactaaaaaatatgaattcttaggtctaaaatatgcagacttaccattcgaaaaaggcggcgcctacgggataagcacagaaacatacaataaactaagagaaaaagaaggtataggtaaaaacagcgaattcaaatttacgttgtataaaaatgacctaattctaataaaagacacagaaacgaattgtcaacagatcttccgattttggtcaaggacaggaaaagataacccgaaaagttttgaaaaacacaaaattgaattaaaaccctatgaaaaagcccgctttgagaaaggtgaggaattagaagtattaggaaaagtacctccaagctcaaatcaattccaaaaaaacatgcaaatagaaaacctcagcatctataaagtgaaaacagatgtattaggtaaaaaacacatcatcaaaaaagaaggagatgaaccaaaactaaaattctga

SEQ ID NO: 8634 - RNA, 3405 nt, synthetic construct
  misc_feature 1..3405: note = Cas9 variant
  source 1..3405: mol_type = other RNA
atgaaatacatcgaatcggtatctataggttttgatataggcgttggatccgttggctacgctgtaatcaactccaaaacgaaacagatactagaatcaggtgtatcaatattccccgcggctgttgcacagaaaaatgtggagaggagagaatcaagacaaagtagaagattaagacggagaagagtaaatagattaaacgatctaaaaaaattactaaaaaaaaacggattcatcccatccccaaacaaaaatccatacgaaatccgagttagaggcttagaacatcagctctcacgagatgaaatagccatcgcagttttacatattgctaaacgaagaggaatatcatacagcttagatgatgtggttgacgaaaacgtaactgatttcaaaggaaaaatagcaaaaaaccaagaagcactaaagaacaaaacgcctggagaaattcaatatgaacgtttgttaaaatacggaaaagtccgaggaacagtcaccaattacgtagaatacgatgaacaaccagaatactttttaaacgtttttccaaactcagcctacgtcgatgaagccaaaaggatattgacatgccaaaaacaatactatccagaaataacagacgatctaatcgaaaacatagtaaaaataatatcaaggaaaagggcatactatatcggaccaggaaacgaaaaaagtagaaccgactacggaatataccgaacaaatggcgaaacactagaaaatatatttgagatcctaatcggcaaagactccgtaaatccagacgaactcagagctccagcaaattcactaaccgctcaagtatacaacctactcaacgatctaactaatataaggtacaacggttctgaacgcctaacacccgaacaaaagcaagacatactaagtgaacttttaaccacagaaaaaacagtacaaatgttaaatgtcatagcgaaaaaagttaatgtcaaaaaagaagagatctcaggatttagaacaaaaaaagacgacaagcccgacttccacacactcgaagtatatcgtaaagtacgaaaacacatgctaaacaaaggcatcgacattaacgaatggccaacagaatgcttcgacgaactagccttcatattcaatctaaacaccgaaataggagaaatacgcaacaggatatcggaaaaagtagtaccaaaatatgatttcatcactaatcaaatagtcgacgaccttttagaagaccccaaaatattcgcaatcagtactagtcaaaaatggcacagatttagtataaagacaatgaacgtattaataccagaacttttaaacggctataatgaacaaatgacaattctaaccaggatgggtttattagaagatagcaaaaacgactattccaatattgacaaaatagatataaaaaacgtaactgaaaacatatacaaccccgtagtcagaaagtcaataaaaaaatgtctaaaaatattcaacgaactatacaaaaaatatcctaatatctcggacgtagttatcgaactaccaagagaagataaccctgaagatgctagaaaactaataaaaaaaatgcaaaaagaaaacttagtcgaaaaagacacatcactcgaagcctttcgcaaagaagcgaacctatcagaaaacggtttaatcgatttcctaagaaaaggaaaaaatagggctctaaaaataagactatggtatcaacaagaaggaaaatgcctctacacaggcgaaccaatattagcagaagatttatgcaaaaacgaagctaactacgatatcgaccacataatccccatctcagttagttttgacgactcaattaataacaaagtcctatgctcttcacattttaaccgcttcgaaaaagaaaaaaaaacaccattcgagtacttctcaaacaaaagctctcatctaggacgatattccaattttgatgaatttagagcctctgtaaatgcaaacaaaagaattagcgacgtaaaacgcaaaaatttactatccaaggagctcctcagcgatctcgacacacgaaagaagttcatagcaagaaaccttgtcgacacacgctatgccagtagagtagtatttaacgaactgactcaatttttcgcatccaaaaaagccgacacgaaggtagctgtaataagaggaaaatttacgtcgcaactacgtcgggcttggcaactgaacaagagcagagacacttatcatcaccatgccgtcgacgcagccctaataggagttaccccattcttaaaaatctggagaagtggaaaaactatatacccaagaaaaatgacagaagcacaaacagacttcgaactaaacgaaataacaacaaacgatgaattcaaagaatcttattatcaactaccatgtccacaatttctagactacctcacccaaatgcaagaaaacctgaaaataaatttcgaagtcgacaaaaaaatgaatagaaaaatctcagatgcaatgatctattcttctagaaagaaaaaattaagtaaagacaaaaaagaaaaagaatactctttaggaacaatcaatgacatatactcagacgcaggctatagtaaattcaaaaatatatataaaaaggacaaggaaaaatttttaatgtatcaccttgatcataaaagttttgaaatcctagaagacataataagtcaatacccagacaaagaggagtatatcgattcagagggaaaagtaaagcagcgtgcagtgagcccatttgaaatatatagaagaaaatatggctatattcgaaagtactcaaaaaaaaataatggacccatcataaaaaatatgaagtattacaatgaaaatttaccaaaaatatacatagatattacccctaaacaatcaatagataaaaaagtatatctaaccaacataagtccctggcgtacggatgtatactataatagatcccaaaactcatatcatataatgggcatcaaatactcagaccttaggtatatagacggaaaatacggaatacccaaaaacgtctatgaaaaaataaaattacgcgaaaaaatacctagcgaatctgaattttgctttagtttatataaaaacgatcgagttaaaataatagatccaaataaaaatgaagaaatcgaactaagatttaattcaagaacattgccttctgtcctaaactacgtcgaattcaaacccctatttcaagaaagctataattcattgaccttactacctgtattctcaaagactactagcgaaggaagaataatcaaaaaatttacaagggaggacaacatcgtatacaaagtcaacaccgacgaactcggcaatccttactacatcttaaaagaatcccagaacccaaaaaacataatagacaactctaacaagactgaatga

SEQ ID NO: 8635 - RNA, 3405 nt, synthetic construct
  misc_feature 1..3405: note = Cas9 variant
  source 1..3405: mol_type = other RNA
atgaacggattggtcttaggactagacatcggaatagcatcagaaggtgtcggaatattggaaaagaactctggtaaaatcatacatgcaaacagcagactattcccggccgccaccgcggataataatgtagaaaggaggaaaaaccgacaagcaagaagattaaatagaagaaagaagcacagaggagtacgatttcaagatctatttgaagattacggtttactaacagatttcagtaaagtcagcataaatctaaacccatacagacttagggtagacggtttaaaccagcaattaaccaacgaagaactattcatagccttgaaaaacatagtaaaacgaagaggcattagttacctagacgacgcttcagaagatggaggtgcagtatcgtcagactacggcaaagccgtagaagaaaaccgaaaacttctcgcagagcaaaccccagggcagatacaactggaacgtttcgaaaagtatggacaagttagaggagatttcaccgtagtagaaaatggcgaaaaactcagattaataaatgtattcagcacttcagcatataagaaagaagcagaaagaatactccgcaaacaacaagagttcaacaaccaaatcacagacgagttcatagaagattacctcaaaatattaacaggaaaaagaaaatattaccatggaccaggcaacgaaaaatctcgaacagattatggacgattccgaacggatggtacaacattagataatatatttggaatactaataggcaaatgcacattttatccagaagaatatagagcttcaaaagcatcttataccgcccaggaatttaacctacttaatgatttaaacaatctcaccgtcccgacagaaacaaagaaactaagcgaagaacaaaagaaagtaatagtagaatatgccaaagaggccaaaacattaggtgcgtcaaccttacttaaatatatagccaaaatgatagacgcatcagtagaccagattagaggataccgagtcgatgtaaataacaaaccagaaatgcatacattcgaagtctatagaaaaatgcaatcactcgaaacaatatctgtaggggagctgtcaagaaacgtactagacgaactagcacatatactaaccttaaatacagaacgtgagggtatggaagaggcaataaatacaaaactgaaagacagcttttcacaagatcaggtattagagctagtacaattcagaaagaacaacagtagccttttctcgaaaggatggcataatttctcactaaaactaatgatggaattaataccagaactttacgaaaccagcgaggaacaaatgacaatattaacacgactcggaaaacagaaaagtaaagaaacaagcaaaagaacaaaatacattgatgaaaaagaattaacagaagaaatctacaatcccgtagtagcaaaatcagtaagacaagctattaaaataataaacgaagccactaaaaagcatgggattttcgacaacattgtaattgaaatggcgagagaaaataatgaagaagatgcaaagaaagactatattaaacgacaaaaagcaaatcaagacgagaaaaacgcggctatggaaaaagcagcatttcaatacaacgggaagaaagaacttcctgacaatattttccatggacataaagagttagctaccaaaatcagattatggcatcaacaaggagaaaaatgcttatacacaggaaaaacaatacccatatctgacttaatatacaaccaatacaaatacgaaatagaccacatattacccctaagtctatcctttgacgattctttaagtaataaagtccttgcactagcaacagccaaccaagaaaaaggccaaagaacaccattccaagcactcgattccatggacgatgcatggagctaccgtgaatttaaatcatacgtcaaagatttaaaatcactatccaacaaaaagaaggactacctactaacagaagaagatatctctaaaatagaggtaaaacaaaaattcatcgagcggaatttagtagacacgagatatagttcccgcgttgtcctaaacgcattacaagacttctataagtcgcaccaattcgacaccaccatatcagtggttagaggacaattcacaagccagcttagacgaaagtggggacttgaaaaatcaagagaaacatatcaccaccacgcggtcgacgccctcataatagcagcatcatcacaactcagattgtggaagaaacaaaataatccattgatcacatacaaagaaggtcaatttgtcgactcacaaacaggtgaaattataagtttaacagatgatgaatataaagaactggtattcaaagccccgtacgatcacttcgtagacacattatcatcaaaaacattcgaagactcaatactattttcgtatcaagtagattccaaattcaatcggaaaataagcgacgcaacaatatacgcaactcgaaaagcaaaacttgataaagaaaagaaagagtacacatatacactaggaaaaataaaagacatatattcattaggaactaaaacaccatctaaaaccggattttataaatttctcgacctatacaataaagataaaagtcaattcttaatgttccaaaaagatagaaaaacatgggacgaagtaattgagaaaattatggaacaatacaggcccttcaaagagtatgataaaacaggaaaactcgttgactttaacccctttgaaaaataccgtcaagaaaacgaaccaattcgcaaatacagcaagaaaggaaatggaccagaaattaaatccctaaaatactacgacatcttgctaggtaaacacaaaaatattacacctgaaggatcaagaaacacagttgccctactatcactaaatccatggagaacagacgtatactataatatggaaaccaagaaatacgagttcctaggcttaaaatatgcagatcttccttttgaagaagggggtgcatacggcatttccacagaaacatacaatgaactcagagaaaaagaaggaatcggtaaaaattccgagttcaaattcaccttatataaaaacgatttaatactaattaaagacacagaaacaaactgtcaacaaatattcaggttttggtcacgaactggaaaggataatccaaaatcattcgaaaaacacaaaatagaactgaagccttacgaaaaggccagattcgaaaaaggagaagaactagaagtgttaggaaaagtacctcccagtagtaatcaattacagaaaaacatgcaaattgaaaatctaagtatatataaagttaaaacagatgtattaggaaataaacatttcataaagaaagaaggagataaaccaaaattaaaattctga

SEQ ID NO: 8636 - RNA, 3408 nt, synthetic construct
  misc_feature 1..3408: note = Cas9 variant
  source 1..3408: mol_type = other RNA
atgagcgacttagtactcggactagacataggcataggcagtgtaggagtcggcattctaaataaagttactggagaaataatacataaaaactcacgcatattcccagcagcacaagcagaaaataacttagaacgaagaacaaacagacaaggaagaaggctaacgcgacggaagaagcaccgaagagtaaggctcaaccacttgttcgaagaaagcggattaatcacagatttcacaaaagtatcaatcaatctaaatccttaccaattacgagtaaaaggacttactgctgaattatcaaacgaagaattattcatagctcttaaaaatatggtaaaacacagaggtatatcatacttagacgacgcttcagacgacggtaattcatcagtgggagactacgcacaaatcgtgaaagaaaattccaagcaattagaaacaaaaactcctggacagatacagctagaaaggtaccaaaagtatggtcaactaagaggggactttactgtagaggaagacggacgaaagcataggctaataaacgtattccctacgtcagcataccacgcagaagcactacgaatactacaaacacaacaagagtttaaccctcaaataacagatgagttcatcaactcatacttagaaatactcacaggaaaaagaaaatactatcatggtcccggcaacgagaaaagtcgtaccgactacggcaaatacacaactaagaaagacgcacaaggacaatacattacactaaacaacatatttggtattctaataggaaaatgcacattctatccagaagaatacagagctgcaaaagcctcatatacagcacaggagttcaatttacttaacgacctcaacaacctaacagttccgacagaaacaaagaaactatcagaagaacaaaaataccaaataataacatatgttaaaaatgaaaaagcaatgggaccagcaaaactatttaaatacatcgctaaattactagcgtgcgacattgcagatataaaaggatatagaatagacaaaagcgataaagctgaaatacatacgtttgaggcttaccgaaaaatgaaaacactagaaacaatcgatattgaacaaatagaaagagaaaaacttgataaattggcatacgtactaacattgaatacagaacgcgaaggcatacaagaagccctagatcatgaatttgctgatggtacgttttcacaagaacaagtagatgaactcgtgcaatttagaaaagcaaactcctcaatatttggtaaagggtggcacagcttttccgtcaaattaatgatggaattaataccggaactatacgcgacatcagaagaacaaatgacaattcttacaagactcggtaaacagaaaacaacatcttccagcaacaaaacaaagtacatagacgaaaaacaactgactgaagaaatttacaatcctgtcgtcgcaaaatccgtaagacaagcaatcaaaatagtaaatgctgcgataaagaaatacggagatttcgataatatagtaattgaaatggcgagagaaactaacgaagatgacgaaaagaaagccatccagaaaatccaaaaagcaaacaaagcagaaaaagacgcagccatgcgaaaagcagcaaaccaatataacggcaaagcagagcttccacactccgtattccatggtcataaacaactcgcaacaaaaataaggctatggcatcaacaaggtgaaagatgtctatacacaggaaaaacaattagcatacatgacctgattaataatccaaatcaatttgaaatagaccacatattaccattaagtataacctttgatgactcactcgccaataaagttcttgtctacgcaaccgcaaatcaagaaaaaggacaacgaacaccctatcaagctctagatagtatggacgacgcatggtccttccgagaacttaaggcttttgttagagaatcaaaagccctatcaaataaaaagaaagagtacttactgaccgaagaagatataagtaaattcgacgtaagaaagaaattcatagaaagaaacctagtagacacacgctatgccagcagagtcgttctaaacgcactacaagaacatttcaaagcccacaaaatagacacaaaagtatcagttgtaagaggacaattcacgtctcaactgcgacgccactggggtatcgacaaaacaagagatacttatcaccatcatgcggtggatgcattaataattgcagcttcatctcaactgaacctctggaagaaacagaaaaacactttagtgagctactccgaagaccaactactagacatagaaacaggtgaacttataagcgacgatgaatataaagaatcagtttttaaagcaccttaccaacattttgtagatactttaaaaagcaaagaatttgaagacagcatactattcagctaccaagttgatagcaaatttaaccgcaaaatatccgacgcaactatctatgcaacacgacaagcaaaagtaggaaaagacaagaaagatgaaacctacgtattaggaaaaattaaagatatctatgcattagggacaaaaacgccctcaaaaacgggattctataaattcttagacctctacaacaaagacaaatcacaatttttagtctatcaaaaagatagaaaaacatgggatgaagttatcgagaaaattatggaacaatacagaccatttaaagaaagcgataaaaatggtaaagaagtggatttcaatccattcgaaaaatatagaatcgaaaatggaccaatacgaaaatattcaagaaaaggaaacggacccgaaattaaatcccttaaatactatgccagcaaattaggaaatcacatagacatcaccccgaaagattcaaataacaaagtagtccttcaatcagtaagtccttggagggcggacgtatacttcaataaaactacagggtcatacgaaatcctgggactaaaatacgcagacctacaattcgagaaaggaacaggaacatatagaatatcagaagaaaaatacaatgacataaagaagaaagaaggagtggacagcgactctgaatttaaatttacgctttacaaaaatgacttgctacttataaaagacactgaaaccaaagaacaaagactttttagattcttgtcaagatctatgccaaataagaaacactacgtcgaattgaaaccctattcaaaagacaaatttgagaaaaacgaaagtctaatcgaaatactaggatccgcggacaaatctggcagatgcataaaaggactagcgaaatcaaatctgtcaatattcaaagtacgaacagatgtcctaggaaaccagcacattatcaaaaatgaaggagataaaccgaaactagacttttga

SEQ ID NO: 8637 - RNA, 3408 nt, synthetic construct
  misc_feature 1..3408: note = Cas9 variant
  source 1..3408: mol_type = other RNA
atgggagtaatatttctgtatgaaaacattgtcaaaccctttccatctagatacgacaaggcgataatgaaacggctaaaaggaagacaaaccatgggatatatcctaagcctagacataggcattgcttcatgcggatactctgttcttgaaacagatgcattaggagtaccatataagatcaaaacgcttaactcaataatattcactagagcagaaaaccccaaaacaggagccagtctagcagaaccacgacgaaaatataggggcgccagacgtagaaaaagaagaaccagtttccgaaaacacagaacaagacaactattcatcacctccggtctactgtcaaaacaagacattgcacgatatctcaaccaacaagaaccacacgatgatatatgggaactgagagtcaaaggcctcgacgaaccattaacaaatttacagttatttcaagttttatattattttgttacacatagaggattcaaatccaatcgaaaagcagaattaaaagataaagacatagggccggtcctaaatagcataaacgcattcaaagaagaaatgcaaagtcacgactatagaaccataggtgaactatatgcaaacgacccgagattccgagacaggaaacacaacaaggattacacaaatggatttcttggaaccatacaaagaagttggctagtagacgaaataaagatgctcttaacaaatcaacaatcattcggtaatacgcaactaacgagtgaatttattgaattatatttaaacattttcacatcacagagaaactttgatgatggaccagcaagtggaccatactccggggatctgatcgataagatggtaggacccgatacattcaacaggtccaggaaaagggctccgcgagcaacatatacatttcaatacttttctttcctatcaaaacttaattccctaagaatagctccttcgatatcagccccatttgaaacactaaccgtcgatcaacgagcactcattactaaaagactatggggccctgacgttaaatcggcagacctaaaatttaaacagatacgcatggtattaagcctaccggaaacagcacgattcaatttggtaaattatggtaatacaccagaaaaagcactcgaaatagaagacaaaacaacatttataagtattaaacctctaagagaaatagaaaaagctctaacaggtacaacattaccagttagtcacgaccaactcgatgctatagccaggatattaactgtttacaaatcagattcaaacagaaaaactgcatttcataaccagacagtactttcagacgaagtaattgaacaacttttgccattaaatttttcaaaatttggacacttatcggttgaaaccatgcaagaaataataccatacctagaacaaggaatggtctatagtgatgccgccactgctgcaggatatgacttcagaaataatcaaatagatatggaatacatacgtgataatgtcacaaatcctgtagtaagacgagccgtatctgtagctaataaattagtgaaagcagttgtaagaagatatggaaagccagattcaatacacatagaactcgcacgagatctatcacaaaacttccaggaaagaagacaggacgaagtaagacaacagaaaaatgccagagacaatgaaaagatagcgaaaagactagaagaactaggtataccagtcaacggagtaaatataacgaaaatgaaactttatgatgaacaacatgggatagatctttacgatctatccacaaatgcaagcatggctgtaacagatatattttcagatgacaggtatgaaatagatcatattattccatactcggtatcatttgacgatagctatacaaataaagtcctcgtaagcgccaaagccaatcgagagaaaagagatagaataccaatggaagtctttggaaatgattcagaaagacgacgacaatttgaaaatagagtaaatacaaatataacgaatttacgaaagaaaagaaacctactaaaagaaactttctccgatgaagataaagccaaatggaaatcacgaaatataaacgacacaagatacttaaacagaatcctaatgaactatttgtcacaaaacgtagagttcaccgatgtcctaagcgatgcaaaacacgttatagccttgaatggggcagtaacagctaaaatacgttcaagatgggggataacgaaagtaagggcagctggtgatctccatcacgctgttgatgctgttgtaataggatgcgtgactgacgcattaatacaagcagtaactcgatacgctaaataccaagaacgtagagataacaaagcagccgccgaacaagacctagcagagaataacccagaagaactggatgcaaaacaatttcgaaaagtgttcaacgattatcctctcccatggcccgaatttagggaggaattaatgggtcgagtaagttcagatccgagccaaataatggccggacgacaatggtcacattataccgcagaagaaatatcagaactaaaacagccattcgttgtccgtgtacccaatcacagaatagtgggacctgcaaccctcgatacggtatacgggcaacctaatccggacgatggtctaataacgcaaagagtaagaatcacagaccttaaaccacagaaaaataaagatggagaagacataataaaagcaggagcaaatgtatatgaactagcagcagatggcggtaataaattagtttatgaatcaatactagacgcactacaagtagcaggcggagatggaaagaaggcattccctaccgggagactattagtaagatcaccaattcaagacatacccgtcgagagagtaagagtcacatccaaagcaacactggtggtaccagtcggtccaaaaagcgtagcggcaaatggctcaatggtacgcatcgatgtttacaaaacaccaaagaaatacgtatttgtacctatatatgtacgagacacagtaaaagcagaactaccagatcgtgctgttgctccagtaaaaccttacagccaatggtatcaattgcaaccaaaagatcagttcctattttccctattcgccaacgacttaataaggttcaaacatccaagaggtgtgtcaactaaagaaatattaacggatggatcacaagaaaaaggcaaaagaacggatgttgtcggctattttacgggcgccgatatagccacagcaagcatcgcaattgaaggtcccgacagatcattttcagcgagaggaataggattcgcttcacttaaaaatgtagagaagttaacagtgaactactttggagaattacacagcgtgcatgaaacccaacctatgcaatttcgagggcaacgcggatga

SEQ ID NO: 8638 - RNA, 3411 nt, synthetic construct
  misc_feature 1..3411: note = Cas9 variant
  source 1..3411: mol_type = other RNA
atgaacggacttgtactaggactagatataggaatcgcatcagttggcgtaggaatacttgaaaaagacacaggaaaaataatacacgcatcctcaagactctttcccgctgcaacagcagacaacaacgtagaacgacgttcaaacaggcaaggaagacgcttaaataggagaaagaaacacaggtctgtcagactccaagacttgttcgaaagctacggattattaacagacttctcaaaattatcaataaacctaaacccataccaactgcgggttcaaggaatggaaaatcaactaaccaacgaagaactatttatagcactcaaaaacatagtcaaacgaagaggcattagctacttagatgacgccagtgaagacggagggactgtatcaagcgactacgggaaagcagtggaagaaaataggcgactcttaacagagaaaacaccaggacaaatacaacttgaaagattcgaaaaatacggtcaactaagaggtgacttcaccgtagaagaaaatggagagaaaagaagattaataaacgtattttcaacatcagcataccgaaaagaagcagaacgcatattaaggaaacagcaagaatttaataacaaaataaccgatgagttcatagaagattatttgacaatcctaacaggaaaaagaaaatactaccatggccccggtaacgagaaaagccgcactgactacggaagatttaggacagatggcaccactttagacaacattttcggcattttgataggcaaatgtacattttaccccgaagaatacagagcatctaaagcaagttacactgcccaagagttcaacctcttaaacgacctaaataacttaacagtacctacagaaacaaagaaactcagcgaagaacaaaagaaaaccataatcgaatacgctaaaagtgccaaaacgttaggtgcgtcaacactattaaaatatatagctaaaatgatagacgcatcagtagaccaaatacgcggctaccgcgtagatgtaaataacaaaccagaaatgcacacattcgaagtgtatcgaaaaatgcagagcttagaaaccataaaagtagaagaattacctcgaaaagttctcgacgaactagcacatatactaacactaaatacagaacgagaaggaatagaagaagcaataaatagtaaactgaaagatacattcaaccgggaccaagttttagaactggttcaattccgtaaaaataactcttcactgttttcgaaaggatggcacaattttagcctgaaactaatgatggaacttataccagaactatacgaaacctcagaagaacaaatgactatactaacaagactaggcaaacagagatcaaaagaaacatcaaaacgcacaaaatacatagatgaaaaagaattaactgaagaaatatataatcccgttgtagctaaaagtgtaagacaagcaataaaaatcataaatgaagcaacaaagaaatacggtatcttcgataacatagtaattgaaatggcaagagaaaataacgaagaagacgcaaagaaaaattacataaaacaacaaaaagcaaatcaagacgagaaaaacgccgctatggaaaaagcagcatttcaatacaacggcaaaaaggaattaccagacaatatattccatggacacatggaattagccactaaaataagattatggcaccaacaaggtgaaaaatgcctttacaccgggaaaaacattcaaataagcgaccttatacacaatcaatacaaatacgaaatagaccacatattacccctgtcactatctttcgacgactcactatcaaataaagtattagtattagcaacagcaaatcaagaaaagggccaaaggactccattccaagcactagattcaatggatgacgcatggtcatatagagaatttaagtcatacgttaaagaatcaaaactgctgggaaataagaagaaagactatcttctaaccgaagaagacataagcaaaatagaagttaaacaaaaatttatcgagaaaaacctcgtagacactcgctattcctcacgcgtagttctaaacgcactacaggatttttataagaaacatcaattcgacacaacaatatctgttgtaagaggccaattcacaagtcaactaagaagaaaatggaaactggagaaaagcagggacacatatcaccaccacgcagtagacgccctcataattgcagcctcttcacaactccggttatggaagaaacataacaacccgcttatttcgtataaagacggacaattcgtcgactcggaaacaggggaaatagtctcgttgtccaacgaagaatataaagaattagtatttaaagcgccctacgatcatttcgtcgacacgctacgcagtaagaaatttgaagacagtatattattctcttatcaagtagatagtaaatacaaccgcaaaatcagcgacgcaactatatacgctacaagaaaagcaaaactagacaaagataagaaagaatacacatatacattaggcaaaataaaagacatatacgcactcggaaccaaaacacctagcaaaacaggattttataaatttcttgacctatataaaacagataaatcgcagttcctaatgtaccagaaagacagaaaaacttgggacgaagttatagagaaaataattgaacaataccgccctttcaaagaatacgacaaaaatggaaaagaagtagacttcaatccattcgaaaaatacaggatagaaaacggacccataagaaaatactcgcgaaaaggcaacggatcagtaatcaaatcaatgaaatactacgacaacttgttaggaaaatttgtagacatcacaccatccgaatcgaaaaacccagtggctttattatcactcaacccctggagaacagacgtatattataaccccgaaacaagaaaatatgagttcttaggattaaaatacgctgatttatgtttcggaaaaggcggatcatacggaatatcggaagttaaatacaataagataagggaaaaagaaggaatcggaaaagaatcagaatttaaattcacattatacaaaaacgacctaatattaatcaaagacacagaaacaaactgccaacaattctttagattttggtcaagaacagggaaagacaatcctaagtctttcgaaaaacacaaaatagaacttaaaccctacgaaaaagccaaatttgaaaaaggagaagaattagaagtcctcggaaaagttcctccttcgagcaaccaattccagaaaaacatgcaaatagaaaacctatccatatacaaagttaaaacagacgtacttggaaacaaacacttcataaagaaagaaggcgacgaaccaaaattaaaattcaagaaatga

SEQ ID NO: 8639 - RNA, 3411 nt, synthetic construct
  misc_feature 1..3411: note = Cas9 variant
  source 1..3411: mol_type = other RNA
atgaatggactagtcctaggattagacattggaatagcgtccgttggagtgggcatactaaaaaaagataccggcgaaataatacacacaaactcaaggctttttagtgcagctacagcagattccaatatcgaaagaagacgacacagaggtggtaaaaggctaactagacgaaaaaaacacaggtctataagactacacgaccttttcgaagattcgggactattaacagactttagtaaagtttcaatcaacctaaatccttatcaactcagagtacaaggattagacaaccaactcacaaacgaagaactatttatagctctaaaaaatatagttaaaagaagaggaatatcatacctagacgacgcaagcgaagacggcggaaccgtttcaagtgactatggcaaagcagtcgaagaaaaccgaaagctattagccgaacaaactccaggacaaatacaattggacagattcgaaaaatacggccaagtaagaggtgacttcacagtagttgaaaacggagagaagcggagattaataaacgtgttcacaaccagcgcttattccaaagaagccgaaagaatattaagaaaacaacaagagtttaacaaaaaaataacagacgagttcatagaaaactacctaacaatcttaacaggaaaaagaaagtattatcatggaccaggaaacgaaaagagcagaacagactacggaaggtacacaaccaaaaaagaccccgaaggaaaatatataacactcgacaacatatttggaattctcataggtaagtgtacattctaccccgatgaatatagagcctcaaaggcgtcatacacagctcaggaatttaatttactaaacgacttgaacaatctgacagtaccaacagaaacaaaaaaactaagtgaagaacagaaaaaaacaataatcaagtatgcgaaaacagctaaaacattaggagcaagtactttattaaaatacatagcaaaactaataggggccagtgtcgatcagatacatggttatagaatagacccaaacaaaaaacccgaaatgcatacctttgaaacttacagaaaaatgcaatcattagaaactataagtgtagaggaaatcccaagaaaagttttggatgagctagcacatatcttaacactaaataccgaaagagaaggaatagaagaagcgataaatgctactttaaaagatacattctcccaagatcaagtcctagagctcgtacaattcagaaagaacaacagttcgctcttttccaaaggatggcacaatttcagcttaaaactaatgatggaattaatacccgaactatacgaaacatctgaagaacaaatgacaatattaacaagactcggcaaacaaaaaagcaaagaaacatcaaagagaacaaaatatatagacgagaaagaattaacagaagaaatatataatccagtagtcgctaaatcagtccggcaggccataaaaataataaatgaagcaactaaaaaatatggtatattcgacaatatagtaatcgaaatggctcgcgaaaacaacgaagaagacgccaaaaaaggttataacgagcgacaaaaagccaacttagacgaaaaaaaatctgccatggaaaaagcggcatttcaatacaatggaaaaaaagagttaccagacaacgtgttccacggccacaaagaactagccacaaaaattcggctatggcaccaacagggcgaaaaatgcttatacacaggaaaaaacataccgataagtgatttaattcaaaaccaatataaatatgaaattgaccacattctgccattaagcttaagttttgatgactcactttccaacaaagtcttagtactcgcaacggctaaccaggagaaaggacaacgaactccattccaagctctcgactcgatggatgacgcttggtcctacagagaattcaaatcatacgttaaagacctaaagttactttcaaacaaaaaaaaagattatttactaaccgaagaagacataagtaaaatagaagttaaacaaaaatttatcgaacgaaacttagtagacaccagatactcttccagagtagtcctgaacgccttacaagacttttataaggaacatcaatttgacaccacaataagcgtagtacgaggacaattcacctcccaattaagaagaaaatggggtctagaaaaatcccgcgaaacctaccatcatcacgcagtagacgcactaataatagccgctagttctcaattaagattatggaaaaaacaaaataacccactaatatcatacaaagaaggtcaattcgtagatcaagaaacaggagaaataatatcgctaagtgacgacgaatataaagaattagtcttcaaagcaccatacgaccacttcgtcgacacacttaaatcaaaaaaattcgaagactcaatattattctcataccaagtagattcaaaatacaaccgaaaaatatccgatgccaccatatatgctacaaggaaagcaaaattagataaagaaaaaaaagaatatacctacacactcggcaagataaaagatatctacgctctaggaagcgagaaactaaaaacgggtttttacaaatttcttcacctttataaaaaagataaatcacaatttctaatgtaccaaaaagacaggaaaacttgggatgaagtcatagaaaaaatcttagaacaataccgcccatttaaagaaaaagataagaatggaaaagaggtagatttcaacccatttgaaaaataccggatagaaaacggtccaatacataaatattcccgaaaaggtaacggtccagtaataaaatcactgaaatattatgataaaaacatacctgagtcattcatcaatattacaccgagcaacagcaaaaacaaagtaattctaagacaacttaacccatggagaacagacgtatactttaatcatcaaacagagaagtacgaattattaggacttaagtacgcacatctacaatttgaaaaaaaaaccgggaactattcgataacaatagataaatacaacgagataaaagaaaaggaaggagtttcagaacaatcagaattcaaattcaccctacataaaaatgacttattactgatcaaggataccgaaacaaaggaacaacaactgtttagatttctctcaagaactaagccaaatgtcaaacattatgtagaactcaaaccatactcacgggacgaattcgaaaaaaacgaaaggctaatcgaaattttgggaagcgtagataaatcgggccgattcgtgaaaggattaggcaaatctaatctatcaatttataaagtaaggacagacgttttagggaaccaacacataatcaaaaaagaaggcgaagaaccgaaattaaaattttga

SEQ ID NO: 8640 - RNA, 3411 nt, synthetic construct
  misc_feature 1..3411: note = Cas9 variant
  source 1..3411: mol_type = other RNA
atgaacggattagtattaggcttagacataggaattgcatctgttggagtaggaatacttgagaaagacacaggcaaaataatacacgcatcatcaagactcttcccggcagcaaccgcagacaacaatgtagaaaggcgcagtaacagacagggtagacgactaaatagacgaaagaaacacagaagtgttagactacaagatctatttgaaggatacggattgttaacagatttttcaaaagtctccatgaacttgaacccataccagctacgcgtccagggaatggaaaaccaattgacaaatgaagaattatttgtcgcacttaaaaatatagtaaaaagacgaggcataagctacctagatgatgcatcagaggacggaggaacagtaagctcggattatggcaaagctgttgaagagaatagaaaactattagccgagaaaacgccaggacaaatccaactagaaagatttgagaaatacggtcagctacgtggagactttacagtcgaagaaaatggtgaaaaacatagactgataaatgttttcagtacaagtgcatatcgaaaagaagccgaaagaatattaagaaaacaacaagaatttaacagcaaaataacggacgagttcatagaagactaccttattatacttacaggaaaaagaaaatactaccatggacctggaaatgaaaaatcaagaactgattatggaagatttcgaacagatggtacaacactggataacatcttcggaatacttataggtaaatgcaccttctataccgaagaatatagagcatccaaagcaagttacacggcccaagagttcaacttactcaatgacctaaacaatctcacagtaccaactgaaacaaagaaacttagcgaagaacaaaagaaactcattattgaatacgcaaaatcagcaaaaacacttggagcatctacgcttctaaaatacatagccaaaatgatcgacgcctcagtagatcaaattagaggatatagagtagatgttaacaataaacccgaaatgcataccttcgaagtatacaggaaaatgcaatctctagaaactataaaagtagaagaattaccaagaaaagtattggatgaactagcacacatactcacactaaatacagaaagagaaggcatagaagaagcgataaacagcaaactaaaagacatatttaatagagatcaagtactcgaattagtccaattcaggaaaaataacagctcattattctcaaaaggttggcataatttttcaataaaattaatgatggaactaatacccgagctatacgaaacatcagaggaacaaatgactattctaactcgactaggaaaacaaagaagcaaagaaacaagcaaaagaacaaaatatatagacgaaaaagagttaaccgaagaaatatataacccagtcgtagcaaagagcgtgagacaagctattaagataataaacgaagctaccaaaaagtacggaatcttcgacaacatcgtaatagaaatggcaagagaaaacaatgaagaagatgcgaaaaaggactacataaaaagacaaaaagcaaaccaggacgagaaaaatgcagcgatggaaaaagcagctttccagtataatggcaaaaaggaattaccagacaatatttttcatggacacaaagaactcacaacaaagatcagactatggcatcaacaaggtgaaaaatgcctatacacaggtaagaatatacccataagtgatctcatacacaatcaatataaatacgaaatagaccatatattaccactcagcttatcttttgacgactctctaagtaacaaagttctagtattagcgacagcgaaccaagaaaaaggacaaagaacgcctttccaagcactagactcaatggacgatgcttggtcatatcgagaatttaaaagctacgtaaaagactcaaaattattatcaaataagaagaaagactacttactgacagaagaagatattagcaaaatagaagtaaaacaaaaatttatagaacgcaacctggtagacacaagatactcatcaagagtggtactaaacgcactacaagatttctacaaaagtcaccaattagataccacaatttctgtagtaaggggacaattcactagccaattgagacgcaaatggggcatagaaaaatctcgtgaaacataccaccaccacgcagtagacgcactaatcattgcagcatcatcgcaactaagattatggaagaaacacagtaatccactaatcgcatataaagaagggcaattcgtagacagtgaaacgggagagatagtaagtctatcagatgaagaatataaagaattagtatttaaagcaccatatgatcattttgtagacacattaagaagtaagaaatttgaagattccatattattcagctatcaagtggactcaaaatataacagaaaaatcagcgatgcaaccatatacgcaaccagaaaagcaaaattagataaagagaagaaagaatatacgtatacactaggaaaaataaaagacatatatgctctaggtacaaaaactccttcaaaaacaggattctataaattcctggatttgtacaaaacagacaaatcacaattcttaatgtatcaaaaagaccgaaaaacctgggatgaagttatagagaaaattatcgaacaatacaggccatttaaagaatacgacaaaaatggtaaagaagttgactttaatccattcgaaaaatacagaataggaaacggccctattcgtaaatacagtaagaaaggcaatggacctgaaataaaatcattaaaatactatgacatcctactaggaaaacacaaaaatatcacacccgacggctcaagaaacacagtagcgttgctcagcttaaacccatggcgaacagatgtgtattacaattcagaaacaaagaaatacgaatttctaggattaaaatatgctgatctatgtttcgaagaagggggagcatacggaataagcgaagtaaaatataagaaaattcgagaaaaagaaggcattggcaaaaacagtgagttcaaattcaccttatataagaacgatttaatcttaataaaagacacagaaaccaactgtcaacaattctttagattctggtcacgaacaggaaaggataatccaaagagctttgaaaaacataaaattgaactaaaaccatacgaaaaagcaaaattcgaaaaaggagaggaactcaaagtactaggaaaagtacccccttcatcaaatcaattccagaaaaacatgcaaatagaaaatctgagcatatataaagtcaaaacggacattctaggaaataaacacttcataaagaaagaaggagacgagccaaaattaaaattcaagaaatga

SEQ ID NO: 8641 - RNA, 3420 nt, synthetic construct
  misc_feature 1..3420: note = Cas9 variant
  source 1..3420: mol_type = other RNA
atgtccgacctagtcctaggacttgacataggaataggatccgttggcgtagggatactaaacaaagttacgggggaaatcatacataagaacagtcgtatatttccagctgcacaagcagaaaacaacttagaaagacgaactaaccgccaaggacgaagactcactagaagaaagaaacacagacgggttcgactcaatcacctgttcgaagaatcaggcctaataacagacttcacaaaagtcagcatcaatctgaatccctaccaattgagagtgaaaggacttaccgccgaactatcaaatgaggaactctttatagcacttaaaaacatggtcaaacacagaggaatttcgtatttagacgatgcatcagacgatggtaacagctcagtaggtgattatgcgcaaatagtaaaagaaaactctaaacaattagagacaaaaaccccaggacaaatccaattagagcgatatcaaaaatacggacaactacgaggcgacttcacagtagaagaggacggtagaaaacatcgattaataaatgtcttcccaacaagcgcctatcatgcggaagcacttaggatcctacaaacacaacaagagttcaacccacaaataacagacgagttcatcaactcatatctggaaatattaacaggcaaaagaaaatactatcatggaccaggaaatgaaaagagtcgaacagattatggaaaatacaccacaaagaaagacgctcagggacaatacataaccttaaataacatatttggaatattaataggcaaatgtaccttttaccctgaagaatatagagcagcaaaagccagctacacagcgcaagagttcaacttattaaatgatctaaacaacctaacagtacctactgaaacaaagaaattaagtgaagaacaaaaatatcaaattataacatatgttaaaaacgaaaaagccatgggtccagcgaaactattcaaatatatagcaaaactactctcatgcgatgtagcggacataaaaggatatagaatagataaatccgacaaagcagaaatccacacttttgaagcatacagaaaaatgaaaacactagaaacactagacgtaaagaaaatggcacgcgaagaattagacaaattagcctacgtattaaccctaaataccgaacgagaaggaatacaagaggctttagatcatgaatttgctgacggcacattctcacaagaacaagtagacgaacttgtacagtttagaaaagcaaattcatccatatttggaaaaggatggcactcattctcagttaaattaatgatggaattaatcccagaattatacgcgacgtcagaagaacaaatgactatactaaccagattaggaaaacaaaagacaaccagctccagtaacaaaacaaaatacatagacgaaaaacaactcacagaagaaatatacaaccccgtcgtggcgaaaagcgttagacaagcgataaaaatcgtaaacgcagcaatcaaaaagtacggtgattttgacaatatagtcatagaaatggctagagaaaccaacgaagacgatgaaaagaaagcaattcagaaaatccaaaaagcgaacaaagcagaaaaagatgcagcgatgagaaaggccgcaaaccaatataacggaaaagcagaactccctcactcagtcttccatggacacaaacaattagccacgaaaataagattatggcatcaacaaggcgaaagatgcttatacacaggaaaaacaataagcatccatgacttaataaacaatcccaaccaatttgaaatcgatcatatattaccactgtcaattactttcgacgacagcctagcaaacaaagttttagtgtacgctaccgcaaatcaagaaaaaggtcaaagaacaccatatcaagcactagactccatggatgacgcttggtccttcagagaactaaaagcatttgtaagagaatctaaagccttatcaaacaaaaagaaagaatatttattaacagaagaagacatatcaaaatttgacgtcagaaagaaattcattgaaagaaatctggtagacacacgatatgcctccagagtagtcttaaacgcgctacaagaacatttccgtactcacaaaatcgatacaaaagttagtgttgttagaggacaattcacaagccagttacgaagacactggggaatagagaaaacaagagacacataccaccaccacgccgtcgatgcattaataatagccgcaagctcacaactaaacttatggaagaaacagaaaaataccttagtctcctacagcgaagaccaacttctagatatcgaaacaggcgaactcatcagtgatgatgaatataaagaaagcgtcttcaaagccccataccaacacttcgtcgatacgttgaaaagtaaagaatttgaagatagcatattattcagctatcaagtagattcaaaattcaatagaaaaatcagtgacgcaaccatctatgcaacacgtaaagcaaaattagataaagaaaagaaagaatacacctacaccctcggcaaaataaaagatatttatgcattaggaacaaaaacaccatcaaaaaccggattctacaaatttcttgatctctacaagaaagataaatcacaatttttaatgtatcaaaaagacagaagaacatgggacgaagttatagagaaaatacttgaacaataccgaccattcaaagaaaaagataaaaacggaaaagaagtagacttcaatccttttgaaaaatatcgaatagaaaatggccccattagaaaatacagcagaaagggaaacggaccagaaataaaaagtttaaaatactacgataacttactgggaagatttgtggatataaccccatccgaatctaagaacccagtagccttactctcactaaatccatggcgaacagacgtttactataacacagagacacgaaaatacgaatttcttggcctaaaatatgcagatttatgtttcgagaaaggcggaagttacggcataagcaaggtaaaatataacaaaatcagagaaaaagaaggcattggcaaaaacagtgaatttaaatttacactatacaaaaatgacttaatcttaatcaaagacactgaaactaacagacaacaaatatttcgattttggagtcgtactggaaaagataaccctaagagctttgaaaaacacaagctagaactgaaaccatatgagaaaacacgttttgaaaagggagaagaactaaaagtactaggaaaagtacctccatcaagcaatcgattacagaaaaatatgcaaatagaaaacctatcaatatacaaagtacgaacagatgtactaggaaaccaacatataataaagaacgaaggcgataaaccaaaattagatttttga

SEQ ID NO: 8642 - RNA, 3420 nt, synthetic construct
  misc_feature 1..3420: note = Cas9 variant
  source 1..3420: mol_type = other RNA
atgaattattataacgggtttataataacagaaaacgcaatggcatcaaaacatgaaaacctaggagcattaacatttggtctcgatattgggatagcgagtgtaggatgggcagtcctcggtgaaaacagaataattgacttaggtgtccgatgttttgataaagcagaaactgcaaaagaaggcgagagcttaaatttagcgcgacgcacagccagactattaagaagaaggcttagacgcagagcatggagattaaccaaacttgctcgattacttaagcgggaaggactaatagcagatacaaacgtatttcaaaaaccattcaacctaaaagatgcaaacgaaaaaggactatcattttggcagcttagagtagacgcgttggatcgaaaattatcagctgaagaatgggcaagagtaatttaccatttatgtaaacatagaggtttccactggatcagccgtgcagaagaaaaggcagctgaaggagacagtaaaagtgaaggtggaaaagttaaacaggggttagcaggaacaaagaaactgatgcaagagaaaaactatagaacagcagccgaaatggtacttacagagtttccagaagcacaacgtaataaacaaggagattactcaaaagcattgtcaagaatattactaggggatgaaatgacacaactatttaaacaccaaagagaattaggtaacccccacgcgacagaaaaactggaagcagctatattaggaaacggggaccacaaaagcggcttattttgggcccagaatccagcgctagcaggtaacgacttattaaaaatgttaggtcattgcacctttgaaaaagctgaatatagggtaccaaaagcatcatttacagcagaaagacatgtttggttaactagattaaacaaccttaggatcgtggtcgatggaactactcgaccgctaaatgaagctgaaagacatcttgccctcctaatgccatatcagcaggcaggagatctgacatacaaacaactgagaacagcgctaacaaaagccgggtatctacctgaatcgttccgatacacaggcttagcttatgcttccggacaaaaagcagatgaaaaagctaaagatccggaaagcgcacctttagtgaaattacctgcatggcatgaattgagaaaaactttagaaaagaaggaattggcgagtgaatggcagaaaatatcgagcgacgctttagacggaaaacctcaactattagatcaaattgcttgggtactttctgtgtataaagatgacactgaagttgaagcagaactatgtaaactaaaccttccaaatgcagagaaaatgatagatgcattactagacattcgctttgataaattttccaacctctcactcaaagcacttcggcaaatagtacccctaatggaacaaggccaaagatacgacgaagctgtcgcaaatatacctgaatacggacaccattcacaattacatgaagtaggagcaggagaacacaaatatcttccacccttttacaaagaaagagataaaacgggaagaatggtgttcaacgatgacatggacattccccgcaacccagttgttcttagggcactaaaccaagcaaggaaagtagtaaacgcactaatcaaggagtatggaagcccccatgaagttcatattgaaatggcacgcgatttgtcacgtccgctagacgaacgacgcgacgtagagaaattacaaaaagaatttcgagatagaaacgaaaaagataaagcattattcgctcaagactttaatatagttggtgcagtaaaaggaaaagagttcgaaaaatatcaattatatcgagaacaacaaggaaaatgtgcatattctatagaacccatggacattcatagactatttgaacagggatatgtagaaattgatcacgcgttaccatatagccgatcatttgatgactctaaaaacaatagagtcctagtattagcaaaggaaaatagggataaaggaaatagaacaccatttgaatatcttggtgggaaagataacagcgaaaggtggagacaattcgtagcttttgttgaaggtaataaatcttatagattagcgaaacgaagccgattacttcgaaaagatttcggcaaagatgaagcaaaaggatttagagagagaaatctgaatgatacaagatacatatgcagattctttaagaattatgtagaacaatatttacaactgcatgaagactccgatgctaagcgatgtgtggtattaagtgggcaaatgacatctttcttaagagctagatggggattagtcaaagtgagaggagattcagacagacatcacgcattagatggcgcaattgtggcagcttgctcacactctatggtaaaaagacttagcgactattcaagaagaaaagaattagaacaagtaagagctggtttcgtagatgtagatacgggagaaatagtgaatccagcaatgttccagcaagtacaagagcatttcccaaacccatggcctcatttcagagacgaagttaaattaagactaaatgtggacgacccagcattattacactcagaaatgaacagatttggaacatattcaccagaagccttgaaagctctacgacccttattcataagtcgagcaccacaaagacgaaattcaggagccgcacataaagatacaatatacgcacaaccagaacgcctagttgcacaaggaggagttacacagaaagtacctctaaccagtttaactctaaaagacttagataaattaatagatccgcacagaaacgaaaaattatattctgctataaggattcgattagaacaacacggaggaaaaggagataaagcatttccagcgtccaatccattaagaaaaccagatagtgaagggaatcctaccggcccaatagtaagaggtgttacaatggtcatagacaaactatcaggtatacccataagaggaggtatagcgaagaacgactccatggttcgtgtcgatgtatttacaaaagccggcaaatttcatttagtaccagtatacgttcaccatgccgtagccaaagtactaccaaatagagcagtagtcgcttacaaggacgaaacagaatggactcttatagacgatggatttgatttctgttttagtatgtacccaaacgatctattacgtatcaaactaagaaatgctagtcaccttggttactacgctagttgtaacagatccacaggtgctataaacttatggagtcatgacaggaaccaacaagtaggcaaagacgggatgatagaatcaattggggtaaaaacagcacttaatgttgaaaaattaaatattgatgtacttggaaatcggtaccctgccccaccagaaaagagaagagacttagcatga

SEQ ID NO: 8643 - RNA, 3423 nt, synthetic construct
  misc_feature 1..3423: note = Cas9 variant
  source 1..3423: mol_type = other RNA
atgaaaaacatgacaaaggtcaacgttggtctggacgtgggaattagtagcgcaggttggagcgtaataaacgcagagaccaaccagattctcgaatcaggagtaagactatttagtgggtcagatgcagacgagaatgtaaatcgacgaaaccaaagacaaggacggagactctttcgcagaaggaaacttcgaatacaagaagcaaaaaagtatctagaaaatgtattccaattaaaagatatagaacctaaagatgagtggaacccatatgaaattcgcgtacgcgcactcaatgaaaaagtctcaaaagaagaactaagtatcgctttactaaacatagtgaaacacagaggcatatcgtatgaattagaagatgtcacagacgaagaaggaacaaatacacaatccttccagagtggactcgattataacagacgattactaaaaacaaaaacagtaggcgaaattcaatatgatagactacaaaaatatggacaagtaagaggacaaatacaaacagaagacggtctactaataaacatctttccaacaaaaaactacgtggaagaagtagaaagaatattagaaacacagaagaaataccatcccgagatagatgatgtctttatagaaaaaattatcagttttgtgacaaggaaacgagaatatttcgtaggaccaggcaacgaaaagtcaagaacagattacggcatctatcgagaaaacggagagacattggacaacctctttgaaatattaatcggaaaagacaaattttatccagaagaatacagggccgcaggaagcagctatacagcacaaattttcaatctactgaatgatctaaacaacttacgaatcccaacaactgaagatcatcatttaaccaaggcgcaaaaagaagaaataatcacggaactaaaaaatactagcagattaagtggcggaatgttaaaattaatatcgaaagtgacaaaagcaccaaaagaagagataagcggttacaggaaagacgaaaaagataaaccagacctccactctctggcctactatcgaaaacaaaaaaacatgctcgaaaaagaaggcatacaaattgcagacttcagtgaagagctgttagatgaacttgcaacaatgatgacactaaacacagaacccggagaaataagaaaacaacttaacaaaatcaccaaccaatacgacatcttaacaccagaagtaattgaggtactagttaagaatcacaccgcttttgtagctacatctaatcacaaatggcaccgttttagcctcaaactaatgaaagaatttattcctgaactactagaaacatcaaaagagcaaagtacaattttatgtgaaagagggttcatacaaaacagagcatcatacttagacgaaaaccatcattttaactatgcagaactacgagaaaatttgtacaatccagtagtacggaaatcaacttgtgaaatgctcaaagttttcacagccatccaagaaaaataccccaatatacaaaatgtaatagtagaacttccaagagaaacgaacgaagacgaacaaaagagaaaaataaagaaaatcaacgacaacaacgcaaaacgcaaaaaagagatactaaaagaagcacaagcacaatcaggactatcagaagaggcgttggaagaaaaactattaaaaaccaaaggactatatttaaaacttatgttatggtacgaacaagaaggcaaatgcgtatattctggtcaggaaataccattatccgacttactacagaataaaggaggatacgaggtagatcatataatccctatctcaatcagcttcgatgatagactctgcaacaaggtactagtaagacaacaactaaatagtcagaaatcaaatcaaactccatttgagtacatgacaacacataccgatggtcacctttcatttcatgaactgaaagaattagtaggcaaaaacaagcgatttagcaaagaaaaaagagaactcttactcgccgaaatatacagtaatgacatcgaaactagaaagagattcataaatcgaaatctagttgacacctcatacacagcaagaatagtattaaatgctttacaacaatataaaaaagaaaatcaattaagtatgaatgtcagtgtagtacgaggagcaatgacaaatatactccggaaaaaagtaaaactagataagacaagagaaacattccaccaccatgcgatagacgcaagccttatggcagtgatacccaatatcgaattctttaaagaaagaaaagaatggttgccaaaaagtgccaacgaagaagttgttgaagtggaagtgtcagaagaagaaaccatgcccgaaaaagaatttaaagtgaaaatgagactaccagagagctttatacaagatgtacagatactccaaagaaattcatttgcaaaagaagaggtatccggaccgcagacaagagaacgcaacttaaaaattaaatttagccaccaagtagaccaaaaaatgaacagaaaagtggcagacgatacgatttatggcacaagacaagctcaattaggcaaggacaaaaaggaagaaacatacgttattggaaaaataaaagatatttataattacgatgaatacgtaagattcaaaaaaagatacgacaaaaacaaagagagtttcctaatgtatcaccacgatccccagacattcgaaaaacttgaagaaattctagcacaatatcccgaatacattgaagatgaaaaaggaaaaaaaaaaaaagtttcaccattcgcattatacagagaagagaacggaccggtaacaaaatatgcaaaaaagaacaatggtccagtgataaaacaacttaaatattacgactcaaaacttaacagaaaaatagatatatctcacaaatactcaactaaaaacagacaggtagtactacaatccctaaagccgtaccgaaccgacgtatacagaaatcaagacacaggagaatatacactagttggtatagaccaaaatgacggaaaatttgtaaatggacactatggaatacctaaaagcagatacgaagagatcaaagcaaacaataaactatcggagcatgatgaattcgttttctcactatataaaaattcaatggtcaaggtaatcgatgaaaacggagagtctatcgtagtgaggtatctatcgagatcaatgcccaatcgaaaaaacaacgcagaaataaaaccagttgaaaaataccaattcgaagatggagaagtagttcccgtatatggcaagtgcagaaaacaaatgcagactgtattcgtcaaaaaaggatggaccctattaaaaggaaatactgatattcttggaaatacatacttcgtagaaaaagaatcagaaaacccaaaaaaaatgatagatgacaaatga

SEQ ID NO: 8644 - RNA, 3423 nt, synthetic construct
  misc_feature 1..3423: note = Cas9 variant
  source 1..3423: mol_type = other RNA
atgagggaaaatgggtcagatgaaaggagaagaaacatggatgagaaaatggattatagaataggattagatataggtattgcatcagttggctgggctgtacttcaaaacaattctgatgacgaacctgtaagaatagtagacttaggagtgagaatattcgacacggcagaaatcccaaaaacaggagaatcactggcaggaccacgtagagctgctagaacaacaaggagacgattaagacgtaggaaacatagactagacagaatcaaatggttattcgaaaatcaaggcctaataaacatagacgacttcttaaaacgatataacatggctgggctccctgatgtgtaccaacttaggtatgaagcattagaccgaaaactaactgacgaagaactagcacaagtattgttacatattgctaaacacagaggatttcgatcaacaagaaaagcagaaacagcagcaaaagagaatggagcagtattaaaagctacagacgaaaatcaaaaacgaatgcaagaaaaaggatacaggacagtaggagaaatgatatacttagatgaagcattcagaacaggatgtagttggtcagaaaaaggatacatactcactcctaggaataaagccgaaaattatcagcatactatgctaagagctatgctcgtagaagaagtgaaagaaatattctcatcccaaagaagactaggaaatgaaaaagcgacagaagaactagaagaaaaatacctggaaattatgacaagtcaaagaagttttgatttaggacctggtatgcaaccagacgggaaaccaagcccgtacgcgatggaaggcttttctgatagagtaggtaaatgcactttcctaggagaccaaggtgaactacgcggagcaaaaggaacctacactgctgaatactttgttgcattacagaaaattaatcatactaaattagtaaaccaagatggggaaacacgtaactttacagaagaagaaagacgagcgctaacgttactacttttcacacaaaaagaggtcaaatacgcagccgtaagaaagaaactaggactacccgaagacatattgttttataatttgaattacaagaaagcagccacaaaagaagaacaacaaaaagaaaaccaaaatacagaaaaagcaaaatttataggaatgccttactaccatgattataagaaatgcttagaagaaagagtcaaatatctaactgaaaatgaagtgagagatttatttgatgagatagggatgatactaacatgctataaaaatgatgactcgagaacagaaagattagcaaaactaggacttgtacctattgaaatggaaggactcttagcatacactccaaccaaattccaacacctatcaatgaaagcaatgaggaacattataccattcctagaaaaaggaatgacatatgacaaagcatgcgaagaagcaggctacgatttcaaagcagattccaaaggaactaaacaaaaactactgacaggagaaaacgtgaatcaaaccattaacgagataactaacccagtagtcaaaagatccgtgtcacaaactgtaaaagtaattaacgcaatcataaggacatatggaagcccccaagcaatcaatattgaactagcaagagagatgtccaaaacttttgaagaaagaagaaaaatcaaaggtgatatggaaaaacgacagaaaaataacgaagacgtaaagaaacaaatacaagaattaggcaaattgagcccaactggtcaagacatattaaaatatagactatggcaagaacaacaaggtatatgtatgtattcaggcaaaacaataccattagaagaactattcaaaccgggatacgacatagatcatattttaccctattcgataacatttgatgacagttttagaaacaaagtcctagtaacatcacaagaaaaccgacaaaaaggaaatagaacaccctatgaatatatgggcaacgatgagcagagatggaatgaatttgaaacgcgagtaaaaaccactataagagattataagaaacaacaaaaattattaaagaaacatttttctgaagaagaaagatctgagttcaaagaaagaaacctcaccgatacaaaatacataactaccgttatatacaatatgataagacaaaatttggaaatggcacccttaaatagaccagagaaaaagaaacaagtacgagcagttaacggagcaataactgcatatctaagaaaaagatggggactaccacagaaaaatcgggaaacagatactcatcatgctatggatgccgtagtcattgcttgttgcacagacggtatgatacagaaaataagtagatacaccaaagtacgcgaaagatgttacagtaaaggtacggaatttgttgatgcggaaacaggcgaaatatttagaccagaagattacagtagagccgaatgggatgaaatattcggagtacacattccaaaaccttgggaaacatttcgggcagaacttgatgtccgaatgggagatgatccaaaaggtttcctagatactcatagtgacgtggcattagaactagactatcctgagtatatatacgaaaatttaaggcctatatttgtaagccgaatgcccaaccataaagtaaccggagcagcacatgcagatactatccggagtcctaggcatttcaaagatgaagggatagtactaacaaaaacagcactaacagatctcaaattagacaaagatggagaaatagatggttattacaatccccaaagtgatttattactgtacgaagcgttaaagaaacaattattattatacggcaatgatgctaagaaagcattcgctcaagattttcataaaccgaaagcagatgggacagaaggaccagttgtaagaaaagtaaaaattcaaaagaaacaaactatgggagtatttgtagattcaggtaacggaattgcggaaaatggtggcatggtaagaatagacgtattcagagtcaatgggaaatattacttcgttccagtctatacagcagatgtagtgaagaaagtactaccaaacagagcaagcaccgctcataaaccatacggtgaatggaaagtaatggaagataaagattttctgttctctctatattctagagacctaatacatataaaatccaagaaagatatcccaattaaaatggtcaacggaggtatggaaggaataaaagaaacgtacgcctattatataggagctgatatcagtgcagcaaacatccaaggaatagcgcatgattcaagatacaaatttaggggactcggaatacaatcgcttgacgtgctagaaaaatgtcaaatagatgtcctaggacatgtaagtgttgtaagatcggagaaacgaatgggatttagttga

SEQ ID NO: 8645 - RNA, 3423 nt, synthetic construct
  misc_feature 1..3423: note = Cas9 variant
  source 1..3423: mol_type = other RNA
atgaacggcctcgtattaggattagacatcggaattgcatcagtcggtgtcggtatactagagaaaaactcaggaaaaatagtacacgcttcatcacgaatattccccgcagctacagccgataataacgttgaacgaagaaagaaccgacaagcacgaagattaaatagaagaaagaaacacagaggtgttagattccaagacctcttcgaagactacggtttactcaccgatttctcgaaagtatctatcaacttaaatccgtatagactcagagtagatggattgaaccaacagctaacgaacgaagaactatttatcgcattaaagaacatagttaaacgccgaggcatctcatacctagatgacgcatcagaagacggagggacagtatcaagtgactacggtaaagcagtcgaagagaatagaaaactactagcagagaaaacaccagggcaaatccaactagaaagattcgaaaaatatggacagttacgaggtgatttcacagtagttgaaaacggtgagaaatgcagactgataaacgtattctcaacgtcagcatataagaaagaagcggaacgaatattaagaaaacagcaagatttcaacaaccaaataacagatgagttcatagaagactacttaaaaattctaacaggcaaaagaaaatattatcacggaccaggcaacgaaaaatctagaacagactatggaagatacacaacacataaagactcgaaaggtgaatatgtaacgttagacaatatatttggtgtattaataggaaaatgtacattttatccaaatgaatacagagcctccaaagcatcatacactgcacaagaatttaacttactaaacgaccttaataacctaaccgtacccacagagaccaagaaactaagcgaagaacaaaagaaaaccataatcgaatacgcaaaatcagcaaaaacactaggagcaagcacattactaaaatacatagcaaaaatgattgacacaagcgtagatcagattagagggtaccgagttgacgtaaacaacaaaccagaaatacataccttcgaagtatatcgaaaaatgcaatcactggagactatatcagtaggggaactatctcgcaatgttttagacgaattagcccacatattaacattaaatacagaaagagaaggaatagaggaagccataaatactaaactgaaagatagtttttctcaagatcaagtacttgaactcgtacaattccgaaagaacaacagttcattattcagtaaaggatggcacaactttagccttaaactcatgatggaactgataccagaactgtacgaaacatccgaggaacaaatgacaatcttaacacgactgggcaaacaaaaatcaaaagaaacatcgaaaagaacaaaatatatagacgaaaaagagttaactgaagaaatatataatccagtagtagcaaaaagcgtaagacaagctataaaaatcataaacgaggccacgaagaaacacggcatctttgacaatatcgtcatagaaatggcaagagaaaacaatgaagaagacgcaaagaaagactacatcaaaagacaaaaagcaaaccaagacgaaaaatacgcagcaatggagaaagctgctttccagtataacggtaagaaagaactcccagataatattttccacggacataaagaattagctacaaaaataagattgtggcaccaacagggagagaaatgtctatataccggaaaaagtataccaattagcgatttaatacacaatcaatataaatacgaaatcgatcacatacttccattaagcctctccttcgacgacagcctatcaaacaaagtcctagtactcgccactgctaaccaggagaaaggccagcggactccattccaagcactcgatagtatggacgatgcatggagctacagggagttcaaatcatatgtaaaagaatcaaaattactaggaaacaaaaagaaagaatacctacttaccgaagaagacataagtaaaatcgaagttaaacaaaaatttatagaacgaaatttagtagacacacgatacagctcccgtgtggtcctaaacgcactccaagacttttataaaaaccacaactttgataccacaatttcagtcgtaagaggacaattcacatcacaactccgacgaaaatgggggttagaaaaatctcgagaaacataccaccatcacgcagtagacgcactaataattgcagcgtcatcccaactcagattatggaagaaacaaaacaacccactaattgcctacaaagaaggacaatttgtcgactctcaaacgggagaaataatctctcttaccgacgatgaatataaagagctagtattcaaagcaccctatgaccactttgtagacaccctatcaagcaaaacctttgaagacagtatcctcttcagttaccaagtagatagtaaatttaatagaaaaataagcgacgccaccatatatgcaacacgaaaagcaaaactagacaaagaaaagaaagaatatacgtacacactaggaaaaattaaagacatctatagcttaggtactaaaacaccatctaaaacagggttctacaaattccttgatttgtataacaaagataaatcacaattcctcatgtttcaaaaagaccgcaaaacatgggatgaagttatagagaaaatcatggaacagtacagaccttttaaagaatacgacaaagcaggcaaactcgttgacttcaacccctttgaaaaatatagacaggaaaatggcccaataagaaaatatagtaagaaaggaaacggaccagaaatcaaaagcctgaaatactatgatattttactcggtaaacacaaaaatattacaccagaaggctcacgaaataccgtagcattattatcgttgaacccatggcgtaccgatgtttattacaacatggaaactaagaaatacgagttccttggcctaaaatacgccgacctaccattcgaagaaggaggtgcatatggaataagcaccgaaacttataatgaactaagagaaaaagaaggaatagggaaaaattcagaatttaaattcacactttacaaaaatgatctaatattgataaaagatacagaaacaaattgccaacaatttttccgattttggtcaagaacaggaaaagataaccctaaatctttcgagaaacacaaaatagagctaaaaccatacgagaaagccaaatttgaaaaaggagaggaacttgaagtactaggaaaagttccaccatcatcaaatcaatttcagaaaaacatgcaaatagaaaatctatcaatatacaaagtaaagacagacgtgctgggtaataaacattttataaagaaagaaggcgacaaacccaaactgaaattctga

SEQ ID NO: 8646 - RNA, 3423 nt, synthetic construct
  misc_feature 1..3423: note = Cas9 variant
  source 1..3423: mol_type = other RNA
atgaatggactggtgctaggactagacatcgggattgcatcagttggtgtaggaatattaaaaaaagatattggagaaataatccacaccaatagtcgactattcagtgcagcaacagcagattcaaatatagaaaggagaggacatcgtggaggaaaaaggttaaccagaagaaaaaaacataggtcaatcaggttacacgacctcttcgaagacttcgggctcctaaccgacttctctaaagtaagtatcaacttaaacccgtaccaattaagagtacaaggactcgacaatcaattaacaaacgaagaactattcattgcactaaaaaatatagtaaagagaaggggaataagctatctagacgatgcgagcgaagacggaggtacagtttcaagcgattacggaaaagccgtagaagaaaaccgaaaactcttagccgaacaaacccccggccaaatacagttagacagattcgaaaaatatggacaagtaaggggagattttaatgtagttgaaaatggagaaaaacggaggctaataaacgtttttaccacctcagcatactccaaagaagccgaaagaatcttacgaaaacaacaagaattcaacaaaaaaatcacagatgaatttatagaagactacctaacaatactaaccggcaaaagaaaatactatcacggaccaggaaacgaaaaatcacgaacagactatggccgctacacaacaaaaaaagatccagaaggtaagtatatcactttagacaatatatttggcatccttatcggaaaatgcacattctaccctgacgaatacagagcaagcaaagcaagttacacagcccaagaattcaatctcttaaatgacctaaacaacctaactgttccaacagaaactaaaaaattaagcgaagaacaaaaaaaaaccattatcaaatacgcaaagacagctaaaacactaggcgcatctactttactaaaatatattgcaaaacttataggtgcatcggtagatcaaattcatggatatagaattgatccaaataaaaagccagaaatgcacacattcgaaacttatcgaaaaatgcagtcactagaaacaattagcgtagaagaacttccaagaaaggtcttagatgaattagcacacatcttaactttaaacactgagcgagaagggatcgaagaagccatcaacgctacactaaaagacacattttctcaagatcaggtacttgaactagtacaatttagaaaaaacaattcgtccctattttcaaaaggatggcactcttttagtctcaaactaatgatggaattaataccagaattatatgagacttcagaagaacaaatgaccattctcacacgattaggaaaacaaaaatcgaaagaaacaagcaaacgaacaaaatacatagacgaaaaagagttaaccgaagaaatatacaatccagtagtagccaaaagtgtacgacaagcaatcaaaataataaatgaggcaacgaaaaagtacggcattttcgataacatagtgatcgagatggcaagggaaaacaatgaagaagacgcaaaaaaagaatatattaagagacagaaagccaacttagacgaaaaaaatgcagcaatggaaaaagccgcattccaatacaacggaaaaaaagaacttccagacaatgtattccacggacacaaagaactggcgacaaaaatacgattatggcaccaacagggagaaaaatgcttatacacaggaaaaaatataccaatctcagatcttatacaaaaccaatataagtacgaaatagaccatatcctaccgttatccttgtctttcgatgacagcctaagtaacaaagtactcgtcctagcaacagcaaaccaagaaaaaggccaaagaacaccattccaggcattagatagcatggacgacgcctggagttatagagaatttaaatcctatgtcaaagatagcaaactcctaggaaacaagaaaaaagaatatttactaacggaggaagacattagcaaaatagaagtcaaacaaaaatttatagaaagaaatcttgtagacaccagatactccagccgagtcgtattgaatgcactacaagatttctataaagagcaccaattcgatacaacaatatcagttgtaagaggacagtttacgtcacagctacgacgaaaatggggactagaaaaatctagagaaacttaccaccatcatgccgtagacgcacttataatagcagcctcaagtcaacttagattatggaaaaagcaaaacaatccactcataagctacactgaaggacaattcgtagaccaagtaacaggagagattatatcattaagcgatgacgagtataaagaactcgtatttaaagcaccgtatgaccacttcgtagacaccctaaaatcaaaaaaatttgaagattcaatattattctcatatcaagtagacagtaaatataatagaaaaatctcggatgcaacaatctacgcaacccgcaaagccaaactagacaaggaaaataaagaatacacctacaccttaggaaaaatcaaagatatctacgcactaggaacgaaatcgccatcaaaaacagggttttacaaatttcttgacctttacaataaagacaaatctcagttcctaatgttccaaaaagatcgaaaaacatgggatgaagttatagaaaaaattatagaacagtatagaccatttaaagaatacgacgaaaatggaaaagaagtagatttcaatccatttgaaaaataccgaatcgaaaatggcccaattagaaaatattcaaaaaaaggaaacggacctgaaataaaaagtctcaaatactacgacaatcttttaggaaaattcgtagatataacaccatcagaatcaaaaaaccccgtagctctcctatcattaaatccgtggcgaaccgatgtctactataacacagaaacatcaaaatatgaatttctaggactaaaatacgctgacctttgctttgaaaaaggtggcgcatacggaatatcagaagttaaatataataaaatccgtgaaaaagaaggaatcggaaaagaatcagaattcaaattcacactatacaaaaatgatcttattcttattaaagacacagaaacaaactgccaacaaatatttaggttttggagtagaaccggaaaagacaatccaaaaagctttgaaaaacataaaatagagctgaaaccatacgaaaaagccagattcgaaaaaggagaagaacttgaagttctcggcaaggtaccaccatcctcaaaccaactacaaaaaaacatgcaaatagaaaacctctcaatatacaaggtaaaaacagacgtattaggaaataagcattttataaaaaaagagggagaagaaccaaaactgaaattctga

SEQ ID NO: 8647 - RNA, 3423 nt, synthetic construct
  misc_feature 1..3423: note = Cas9 variant
  source 1..3423: mol_type = other RNA
atggaagaaaacttccaatatcgtataggtttagacataggaataacctcagttggttgggcagtgcttcaaaataattcacaagacgaacccgtgagaattactgacttaggcgtaagaatattcgatgtagcagaaaacccaaaaaacggagacgctcttgctgcaccaaggagagacgctagaacgacaagaagaagactacgacggagacgacacaggttggaacgcattaaatttttactacaagaaaatggactcatagaaatggatagtttcatggaaagatactataaagggaatctaccagacgtatatcagctaagatatgaaggcctagatagaaaattaaaagatgaggaattggcacaagttttgattcatatagcaaaacacagagggtttagatccacaagaaaagccgaaacaaaaggcaaagaaggtggggcagttttaaaagctaccacagaaaatcaaaaaataatgcaggaaaaaggttacagaacagtcggagaaatgctatacctagatgaagcttttcatacagagtgcttatggaatgaaaaaggctatgtactgacgccgcgaaataggccagacgactacaaacatacaatactgagatccatgttagtagaagaagtacatgccatattcgccgctcaaagagcactgggtaatgagaaagcaacagaagaattggaaaacgcttatgtcgaaattatgacttcccaaaggagcttcgatatgggtccaggcctacaacctgacggaaaaccatcaccatatgcaatggaaggatttggcgacagggtaggaaaatgcacgttcgaaaaagatgaatatagagcaccaaaagcaacatataccgcagaactattcgtagcattacaaaagataaatcatacaaagttaatagatgaattcggaacaggccggttcttcaccgaagaggaaagaaaaacaattattgacctcttactatcaggcaaagaactcaaatatggtacaattagaaaaaaactaaatatagacccttcactaaaattcaatagtttaaattattcggcgaaaaaagaaggcgaaacggaagaagaaagagtcagagacacagaaaaagctaagtttgcaagcatgttctggacgtatgaatactcaaaatgcttaaaagatcggaatgaagaaatgacagtaggacaaaaagcggatctattagatcgaataggtgaaatacttactgcatacaaaaatgatgactctagaagttcaaggctggaagatttaggcttaagccgagaagaaatagacggccttctagaattaagccctgcaaaataccaaagggtcagtttaaaagccatgagaaaaatgcaaccatatctagaagacggtttaatatatgataaagcatgtgaagcagcaggctatgactttagggccttaaacgacggaaataaaaaacaccttttaaaaggggaagaaataaatgctatagtcaatgacataacaaatccagttgtaaaaagaagtgtatctcaaacaataaaagtaataaatgcgataatacaaaaatacggctcaccacaagcagtaaacattgagttagcaagagaaatgagcaaaaattttcaagatagaactaacttagagaaagagatgaaaaaacggcagcaagaaaatgaacgtgcaaagcaacaaataattgaattaggaaagcaaaatccgacaggacaagatatcttaaagtacaggctatggaatgatcagggaggatactgcttatatagtggaaaaaaaatacccctagaagagctatttggagggggttacgacatagatcatatattaccttattcaataacattcgatgatagctatcgaaataaagtacttgtaacggcacaagaaaatcgacaaaaaggaaacaggacaccatatgagtactttggggcggatgaaaaacattgggaagattacgaggccagagtaaggttactagttcgagattataagaaacaacaaaaactactaaaaaaaaatttcacagaagaagaaagaaaagaatttaaagaaagaaatttaaacgataccaaatatataacaagagtggtatacaatatgattagacaaaatctcgaattagagccgttcaaccatccagaaaaaaaaaaacaagtttgggctgtaaatggagcagtcaccagttaccttaggaaaaggtggggattaatgcaaaaagatagaagtacggatagacatcacgctatggatgcagtagtcatagcatgttgcacagatggaatgatacataaaatatcccgttacatgcaaggaagagaattagcctacagtcgcaatttcaaattccctgacgaggaaacaggagaaatcctaaaccgagataattttacacgagaacaatgggatgagaaattcggagttaaggttccactaccgtggaatagtttccgtgacgaattggatataagactattgaacgaagatcccaaaaattttctcctaacgcacgcggatgtacagagggaactagattaccctggctggatgtacggggaagaagaaagcccgatagaagagggaagatacattaactatatacgccccttatttgtaagtcgtatgcccaaccacaaagtaacaggcagtgcacacgacgctacaataagatcagcgcgggattacgaaacgaggggggtcgtcataacgaaagtaccactaaccgatcttaaattaaacaaagataatgaaatagaaggttactatgataaagattcagatcgattactatatcaagcactagtaagacagttgctactgcacggcaatgatggcaaaaaagcgtttgcagaggacttccataagcctaaagcagacggaactgagggaccagtagttcgaaaagttaaaattgaaaaaaaacaaacaagcggtgtaatggtaagaggtggaacaggaattgcagctaatggagaaatggtaagaatagatgtgtttagagaaaatggaaaatattatttcgtacctgtatataccgcagacgtggtgcgtaaagtattacctaatagagcagctatgaacggtaaaatagcatcagactggaagacaatggaagataacaattttgtattcagcttatattcaagggatctaatacatgtaaaaaggaaaaaagcaataccaacaatactatcatcaggtgcgacatttgagcaggaagaattttacgcttatttcacaggagccgatatatccacagtttcaatagcaggcatatcaaatgacaactcattcaaattcagggggttaggaatacaaggactagaaatatttgagaaatgtcaagttgatattctaggaaatatttcagtggtcagacatgaaaatagacaaggatttcactga

SEQ ID NO: 8648 - RNA, 3426 nt, synthetic construct
  misc_feature 1..3426: note = Cas9 variant
  source 1..3426: mol_type = other RNA
atgtacagtataggcttagacatagggatagcaagtgtaggctattcagtaatcgaaactaatagcggaagaatagtagaactaggagccagaatatttgaagccagaaacagtgataataataaagatagaagagactttagaggaggcagaagattaattaggagaagaaagacgagacttgacgacgcaaaacgatacttagacgaccaaggatttaaaaacgacaaatcattaattaacgtctgcccatatagtttacgagttaaaggtttaacagaagaactgtcaaaatcagaaattcgcaaagtaatactccacatattaaaaaaacgaggagtcagttacctaagttcagaagacttagatacaagtagtgtggataataaagactcctttaaacaagctgtaacaaaaaatctacgacaacttgacgacaaaacccctgggcaaatccaatatgagcgactgcaggagtcagggagagttcgtacagggataaaccagaatggacaatatcaacttaacgtatttgatgtcgcatcgtacgcaaaagaattaaaattaatacttgaaacacaacaacagtaccaccaagaaatagatgatcacttcttagatttcttcactaaagacggttaccgcgaagacgcaggtttaatttacagaaaacgaccatactatgacggaccaggaaacgcagcacagaattcatcttacggaagatgggcgaattaccaggtagatggaaaacccgcggaaaatatcttcgaccaactaataggaaaagacttcactggtaaaattagagcctccaacttaggaccatcagcccaaaaattcaacttactaaacgacttaaacaacctaagaataacaacaagagaagaggaaaaattaacgttcgaagagaaacaagaaatattagaagtactagaaaacgatcgtcccaaaacttttggtccaagaaacatcgcaaaaatgctgaaagtcgacatggacgacattaaaggatggagattaaactctagtgacaaaccagaaattcatacaatgaaagagtataacgatatgagattagtcctagaagcaggaggcttcgatattaaagcaatagatctcgaccatattgaagaaatagcaagcttaattacactcaacacagagcgcgaagcgtttgaactaagtttaagtaatgaaatcgataataatttaaaacaattccttgtcgaaaattttaacgcactaagaaaatgcaaaccaaacaactcttggcatagcttctcaaaggagaacttacaaaggttaatcaccgaattagaacatacctcagatgaacaaaatacaatactcgaaagacttggtctaaaatttgacttaagatccaaatattcagacagagatactttaccaatacacgaagtactagaagaaatctacaaccccaccgtaagcaagagcgtgagacaaacatttagagtcctaaatgccctggtaaaaaaatacggaaaagaaaatattgactacgtaacaatagaaatgcctagagataagaatgaagacgaccaaaaaaaaaccatccgcgaaatacaaaaagtcaacaagaacagaaaagataaaagtaaagaatactttctaaaaaaatcaggatggagcgaggagaagttcgaagaaaaattaagaacaagtcgaagatttgcatcaaaactatactacttttacgagcaagacggattatgcgcatatacaggtcagcaaatacagcccgaagacttattaacagaacgggtagaagtagaccacattatcccgctctcagtttcattagatgacagcataaacaacaaggtactagtaacaagtgaagctaatcaaaaaaaaggacaacggagtccttatgatgctttcatgtcaggcgatttttcaaaatatagaacatatgacgaatacaaggcatgggtattatcaaataaatacaaaaaatacaaaaaggcattactactagaagaacgaaacatcttcgacccagagcttgcaaaaaaattcaggcagagaaacctcaacgatacaaggtatgccagcagaatcgtgctcaacgcagtacaaagctttttctataaaacagatacaaaaacaagagtagtaaatggagcatttacacataccttaaggaaaaagtggaatctcgcagataaagatcgagaaacacatcaccaccacgcaatagacgcaacgcttgtagcagttactcccttcgttaaagcagaaaggtatgagtactacaaggactcagaaggaaaagctagtatggttgacacagttacaggcactataatcccgtactctgaatacaaaaaaaaaaacctatatgatagatcaaactatttactgatgtttggtaatgaaagtactatcaaccaagaaaaagaggataaatcagcagagttcataagaaatctcatacctgcaaagatttatccagaaataaaattctcgcaccaagtcgatagaaaatcgaacagaagactatcagacgccacaatatattcaaccagaagttacacagttgaaaaaggaaggggcaaaaataaacgggaagtaatagaaagagatattatcggaaaaataaaagacatatatacagccgatggttacgcagaatatgtcaaatataaagactcattactagtcaaagaaatagatgaaaaaaccttcgaaaaattagaagctataatagaagaattttcagacacagtagaagtaacagaccaacaaggcaaagttaaaaaagtcagcaaaagcccatttctacaatactgtgaaaaatatgatgtaccaggagtgactaaatactcgaaaaagaataacggtccagtgataaggagcctaaaatacagatatacaaaactcagatcacacatagacatctcaccaaaaaatagtaaaaatacagtagctcttttaacattagcaccttggaggacagacgtatactactcgcaagaaaccgcaagttatcatttactaggattaaaatacattgacttatcgttcagagacggaggatacggagtatctcgtaaaagatacgaagaaattaaaaaaaacgaaagaataccagaagatggcgaattcaaattctctctttataaaaaagattacatagaaatagaatttgacaaaaaaatactaccaggtttataccaatctagggacgtcagtgctagaaataaattctccatgaaaccaatcgacaaagctcaatggacaagtaaagaagatgtgcttatgtttggcaatgtaaaagccagcggagtattcgaaaaaactttaaaaaagaactacgttttgagaaaatatcacgtggatgtactgggaaacaaattcgaagtaaaagatgagattctaaaagacatactggaatga

SEQ ID NO: 8649 - RNA, 3429 nt, synthetic construct
  misc_feature 1..3429: note = Cas9 variant
  source 1..3429: mol_type = other RNA
atgtactcagtagggttagacatcggaatagcatcctgcggatactcaatcattaacgacgtaaacggaaatatcgttgagttaggtacattactattcaaatcacgaaattctgacaacaacgaagaaagacgaactaataggggatcaagaagattaataaaccgtcgtagaacacgtctagatgacggaaaaaaactattagctgaaaaaggattcaaacaagattcaaagcttaaacatgtatgcccatatgaattaagagtgaagggtttacatgaaaaattaacgcaaggcgaaatttacaaagttgtacttcacatactaaaaaaaagagggataagctacttagacgaatccgacgaaaattcatccggtatcgacggtgcttcttacaaggaccaagtaaatctaaacctaaacctacaaaaagaacttactcctggtcaaattcaattgaaaagactcaaagaaaacggaagaataaaaagtggcgtcacatttgaaaatggataccaacttaacgtattcagcgtgtcagcatacgctaatgaattaaataagatattaacaaaacaatcagagtactactccgaaatcgaccaaatttggattgatagatttacaaaaaacggatatagaaaagaagcaggattagtataccgaaaaagaccctattacgatggaccaggaaacgaaaaaaacaactccatatacggaagatgggcaaacttcaaagaagatggacacccaaaagaaaatatattcgaccaactaataggcctggattcggtagattccacgcaagtacgagcctcagcaagcaccctaacagctcagaaatacaacttactcaatgacttaaacaacctaaccataatagaagacgacagaaaattcacaaccgacgaaaaagtgtctataattaattacctaatgacacaagacataacacgatttggaccaaaggaattagcaaaattctatcaactagaagtagaccaaatacgaggatggcgcatagataataaaggcaacccagaaatacactctctcaaagtatacagagactggaaaaaaattttcaacacctcaagcatagatttaacctcaattcagacctgggtagttgacgaattagcaaacgtaatcactcttaatacagaaataccctctactctcgcaacacttaaaataaagataccggacatagatcaacaaatcctaaattttgttgaaaataacttctatgaactcaagaaaaaaacatcaaaaaactcgtggcatagcttcagtctaaagacactgaacattctcattccggaactgttaaacacatctgaagaacagaacaccatcctagaaagactcaacttaaagtttgatctcaagaataaatacgcagagaaaaatcaaatcccggttaaagagctcttagaacaaatatacaacccaacagtaacaaaatcagttcaccagagtattaaactatttaatgaaataatagaaaaatatggcaaaaataacatatcgtacgttaccattgagatgcctcgagacaaaaatgatcaagaccagaaggacaccataaaaagaataaacaaattaaacagtgaaagaaaaaatgattcagaaaaatacttcttagaacgctcaggctgggacacaattagattcgagagcgcattaaaaaaaccaagattcgcagaaaaattattattctattacgaacaaaaaggtaaatgcgcctactcaggccaagatatactagcagaatcactcctaaatgaatcatgcgaagtagatcacataatacctttgtccataagctttgacgacagcattcataacaaagtacttgtaacggcgagctcaaaccaagaaaaaggacaacgaaccccctatatggcatttatagacggagctaaattgggccaatcatgggatgattttgttgcatgggtcaactcctgtggattccatcgaaagaaagtacaaaaccttctatacgaggaaaacattttcaacccagatgtccaaagaggctttgtatcacgaaatttaaacgacacaagatatgcatcgagaatagtactaaatgcaattcaatccttcttctataaacaaaaagatttgaccaaagtaaaagttgtcaacggaagcttcacgcacacgcttagaaaaaaatggggatcatcattagacaaaaatagagatacataccaccaccatgctgtggatgcaaccttatgcgctgtaacacctttcataaacattgtaaaatatgaatttttcgaagaagatggaatcaaatatatggtcgatctgaccacaggagaaaaagttgcatattcagattacaaaaaaatgaaattttacgacaaaagagcatacgtacccatctgggatggatttataaaacaattaacaccggcaaacctatatcccaaaataaaattctcacatcaagtcgactccaaatggaatcgaaaaatatcggatgcaacaatatattcaacaaggaaaattgttgaaaccaaaataaacaagaaaggagttgcgaaagaaaccgtgaaagatatagtaatcgacaaaatcaaggacatatatactccagaaggatggcgtaaattcaaagaaaaacaagataaattactaatgaaaaacttcgatgaaaaaacatacaataaacttatcaaaatagctaaagagtacccagaaaaaaaagaagtccaaacaagcaacggaaaagtgagcttagtcgaggtatctccttttaaaatgtattgtgaggagcaaaacgtaccagccataaggaaatacagtaaaaaaggaaatggcccatacattagaagcttaaagttttacgataaagaactaggaaaacacattaatataacaaaagactcatacggaaatgacatagaacgcacaataagaaacaaaaaaatcattttaaaaaatcaaaactcttggagaaccgacgtatactataactcagtcaataattgttacgaactactaggcataaagtactgccatttaaaattctacaggggcaaatacggaataccgaaatctatatatgacgaactaaaaaaagaagacgaaataagctcagaatccgtatttaaattctcattatacagacacgacagagttagattcgaaaaagatggcgaatacatagaagcattattcggatcaaaaaacgaatcaaataaaaactacctcgaactctctcccatagacaaaaacaaatggttatcgaaagaaaacgtaaaattcttcggagaggtcgctgcatccggacgttttatcaaaggattaaaaccaggtataaaagtaatcaagcaatcgaccgattatatgggacacgtatatgcaatacaccaagaaaaattaaaattcgtactatcagacgcgtga

SEQ ID NO: 8650 - RNA, 3435 nt, synthetic construct
  misc_feature 1..3435: note = Cas9 variant
  source 1..3435: mol_type = other RNA
atgacatctaaacaagaaaagcatggtgcattaactttcgggttagatataggaatcgcttcagtcggttgggcagtattaggggaatctcgaatcgtagacctcggagtacgttgtttcgataaggcggaaacagcaaaagaaggggagagtttaaacttaaccaggagaatggcaagactattaagaagaagattaagaagacgagcatggcggttaacgaaactagcccgcctactaaaaagagaagggttaattgcagacgctaacttatttaaacataaaatagagaaaaacaccccagtgcctaagagttcgtggcaacttagagttgatggcttagacagacaactaaacgccgaagaatgggctcgggtaatatatcatttatgtaaacacaggggatttcactggataagccgagctgaagaaaaagccgcggaaggtgacagtaagggagaaggaggtaaagtaaaacagggtttagccggaactaagaaactaatgcaagaaaaatcataccgaactgcagccgaaatggtattagcagagttccccgacgcacaaagaaacaaacaaggtgactactcaaaagcattatccagaattttactcggagacgaattgaaagccctgtttgaacatcaacgcaaactaggtaatcctgtagcaacagaaaaacttgaagcagcaatactaggaaatggagacaagaaatgtggtctattttgggcacaaaacccggcactagcaggaaacaaattattagaaatgctaggtcgatgcacatttgagaaaactggaggcgatgatggaaaaggcgaatatagggctccaaaagcaagtttctcagcagaacgacatgtttggctaacacacctaaataacctaagaatagtagtggatggtactaccaggcctctaaatgaagcggaaagaagagtagcattacccatgccgtatcagcaagcaggagatctctcatataaacaacttggaggtgctttaattaaagaagggttcttacagaaagatggctttaaatttgctggactaccatatccaacaaaacaagcaagtgaggagaaagcaaaagacccagagacatcagtcttatgtaaactaccagcctggcatacgcttagaaaaaccttagagaaacatggactggaatcagaatggcaaaaactatcaaccgatgctttggacggtaaaccacaactactcgacaatatagcttgggtattaagcgtttacaaagatgatgatgaggtaaaaaccgaattgggtaagctaaatcttcctaatacagagaaaatgatagatgccttactggatataaggttcgataaattctcaaatttaagtttaaaagcattatctaaaatagtaccatttatggaacaaggtcaaagatacgacgaagctgtagcaaacattcccgaatatgggcaccattcacagctacataaagtaggtgctggggaacacaaatatcttccacccttttataaagaacgagacaaaaccggaaggatggtgtttaatgatgacatggatatcccgcgaaacccagtcgtcctaagagcactaaatcaagcaagaaaagttgtaaatgctctaatcaaggaatatggttcaccacatgaagttcatatcgaaatggcaagggatctctcacgcccactcgacgagcgccgtgacatcgaaaaactccaaaaagagttcggagaaagaaacaagaaagataaagaattattcgctcaagattttaatatagtaggaacagtaaaaggaaaacaattcgaaaaataccaattataccgagaacaacaaggaaaatgtatctatccatccatggatgaaaaacaaggcatatgttgctattctctaaaaccattagatttacatagagtactgtatgaagaaggatatgcagaaatagatcatgcattgccttacagtaggtcattcgacgatagcaagaataaccgtgtattagttcttgcaaaagagaatagagataagggaaatcggaccccttttgaatatctgggggataaagataacagtgaaccttggagacagtttgtagcttttgttgaaggtaataaagcatataggttggccaaacgaagtagactattaagaaaagattttggagacaaagaagcaaaggaatttcgagagagaaatctcaatgatacacgctatatatgtaaatttttcaaaaattacgtggaacaatacctccaactgcatgaggattccgaagcaaaaagatgtgtagtcctttcgggacaaatgaccagtttcttacgcgctcgatggggattagttaaagtaagaggtgactcagacagacatcacgcattagatgccgctgtagtagcagcatgtagccatggcatggtaaaaagactctccgactacagcagaagaaaagaactagaacaagttagagaaggatttgttgatgttgatactggggaaatagtcaacccagcaatgtttcaacaagtgcaagaacatttcccaaatccatggccacactttagagatgaggtaaaattacgcctaagtatagatgacccaactttattaagatcagaaatggaaaaatttggtacttacacacccgaatcattagaagcgctcagaccattatttgtatcgagagcacctcagagaagaaatagtggcgctgcccacaaagataccatatacgcacaaccgaaaagattagtagcacaaggaggtgtgacacaaaaagtcgcactatcgagtcttacactaaaagatctagataaacttattgatcctcatcgaaacgaaagactatacgcagcaatacgagcacgacttgaacaacacggaggaaaaggcgacaaggcatttccagcatcaaacccattaagaaaaccagatagcgaaggcaaccccactgggccaatagttagaggagttactatggtaatagataaactaagtggtatacccataagaggcggaattgccaaaaatgattcgatggtaagagtagatgtattcacaaaagcaaacaaatttcacttagtaccagtatatgtacaccactcggtacttggcttaccaaaccaagcaatagttggaggcaaagaagaatcagaatggacacaaatagacgattcttttgattggcatttttcaatatatcctaacgacctcatacgagtgacactaaaacaagaaggaaggtttggatactacgcaggctgcgacagaagcactgcagcaattcatctctgggcacacgaccgaaaccaacaagtcggaaaagatggactcatccgttccatcggagtaaaaacagctctatccatagaaaaatttaatgtcgacgtactaggaaacagatacccagcaccaccagagaaaagaagagatttagcctga

SEQ ID NO: 8651 - RNA, 3435 nt, synthetic construct
  misc_feature 1..3435: note = Cas9 variant
  source 1..3435: mol_type = other RNA
atgacatcaaaacaagaaaacttaggggcgttaacattcggattggatataggaatagcatcagttggatgggctgttctcggtgaaaatagaatcattgatttgggagtgagatgctttgataaagcagaaacagcgaaagaaggcgaatccctcaatctcacaagaagaatggcaagacttttaagaagacgtttgcggagacgagcttggagattaacgaaactagctagacttctaaaaagagaaggactaatagcagatgcaaatttatttaaacataaaattgagaaaaacactcccgttccaaaatcatcttggcaattaagagttgatggactggacagacaattaaatgcagaagaatgggcaagagttatatatcatttgtgtaagcatagaggatttcactggatatcgcgcgctgaagaaaaggccgcagaaggcgactccaaaggtgaaggaggtaaagtaaaacaaggtttagcgggaaccaagaaactaatgcaagaaaaatcgtatagaacggctgcagaaatggtgttagctgagttcccggatgcgcaacgcaacaaacaaggtgattatagtaaggctttatcgcgcatactcttaggagacgaactaaaagcattattcgaacatcaacgtaaactcggaaatccagtagcaaccgaaaaactggaagccgcaatattaggtaatggtgacaagaaatgcggattattttgggctcaaaatcctgcattggccggtaataaactattagaaatgcttggaagatgcacgtttgagaaaacaggaggtgatgacggaaaaggtgaatatagggcgccaaaagcatcattctctgcagaaagacacgtttggctaacacatttaaataatctaagaatagtagtagacggaactacgagaccattaaacgaagcagaaaggagagtagcattaccaatgccataccaacaagcaggggacctatcatacaaacagttaggaggagcattaataaaagaaggattcttgcaaaaagatggattcaaattcgcaggactaccttacccaacaaaacaggcttcagaagaaaaagcaaaagatccggaaacttcagttctatgtaaacttccagcatggcatactttaagaaaaacactagaaaaacatggtctagaaagtgaatggcaaaaattgtcgacagacgcattggacggaaaaccccaattattggacaacatagcatgggtactgagcgtatataaagatgatgatgaagtcaagactgaattagggaaattaaacttaccgaatacggagaaaatgatagacgcgcttttggatattagatttgataaattttcaaatttaagcctaaaagcactatcaaaaatagtaccattcatggaacaaggccaaagatatgacgaagcagttgctaacatacccgaatatggacatcatagccaattacataaagttggtgcaggagaacataaatacttaccaccattttataaagaaagagacaaaacaggaagaatggtctttaatgatgatatggacataccaagaaacccagtggtcttaagagcccttaaccaagcgaggaaggtagttaacgcactcataaaagaatacggatctccacatgaagtacatatcgagatggcacgggatttatctagacctttagatgaacgaagggatatagaaaaactacaaaaagaatttggcgaacggaataagaaagacaaagaactctttgcccaagattttaatattgtcggtacagttaaaggaaaacaatttgaaaaatatcaactatacagagaacaacaagggaaatgtatataccccagtatggacgaaaaacaaggaatatgttgttacagtttaaagccattagacttacaccgagtcctatatgaggaaggttacgctgaaatagatcatgccctcccctattcacgttcattcgacgatagtaaaaataacagagtacttgtactagcaaaagaaaacagagataaaggcaatagaacgccctttgaatacctcggtgataaagacaatagcgaaccctggcgacaatttgttgcatttgtagaaggaaacaaagcatatagattggcaaaacgatcaaggctcctcaggaaagatttcggagataaagaagccaaagagttccgagaaagaaatttaaatgacactaggtatatttgtaaattcttcaaaaactatgttgaacagtacttacaactacatgaagacagcgaagcgaaacgatgtgtagtattaagtggacaaatgacttcatttctacgcgcgcgatggggtctcgtaaaagttagaggagattcagaccgacatcatgctcttgatgcagctgtagtagcggcatgcagtcacggaatggtaaaaagattatcagattattcaagaagaaaagaacttgaacaagtaagagaaggatttgtggacgtagatacaggagaaattgttaatccagcaatgtttcaacaagtacaagaacatttcccgaatccttggccgcattttagagatgaagtaaaactaagactcagcatagacgatccaacattactaagatcggaaatggaaaaatttggtacctacactccagaatcgctagaagcactaagacctctgtttgtgtcaagagcacctcagagaagaaattcaggtgctgcccataaagacacaatttatgcccaacctaaaagattagtagctcaaggcggagtaacacaaaaggtagcactctcatcattgacattgaaagatctcgataaattgattgatccacacagaaacgaacgtttatacgccgcaatacgagcaagattggaacaacacggaggcaaaggagacaaggcattcccagcatctaatccccttcgaaaacccgactccgaaggcaaccctacagggccaatagtaagaggagtcacaatggttatagataaactttccgggattccaatacgaggcggaatagccaaaaatgatagtatggtccgcgtcgacgttttcacaaaagcaaataaattccatttagtgccagtatacgtacaccattcagtactcggattaccaaatcaagcaatagtaggaggaaaggaagaaagtgaatggacacaaatagacgatagcttcgattggcactttagtatatatccaaacgacttaatcagagtgaccctcaaacaagaaggcagatttggatactacgcaggatgcgacaggtcaactgcagcaatacatctatgggctcatgatcgaaaccaacaagtaggcaaagatggactaatacgttcaattggggttaaaacagcattatcaatagaaaaatttaatgtggacgttttaggtaatagatatccggctcccccagaaaagcgtagagatctcgcgtga

SEQ ID NO: 8652 - RNA, 3438 nt, synthetic construct
  misc_feature 1..3438: note = Cas9 variant
  source 1..3438: mol_type = other RNA
atgaaaacaatattaggtttggatttaggaacaaatagtatcggctgggcactagtaaaagaaacagaaaactcaaacgaaaaatccgagataataaaattaggtgtacgggtaaacccactgacagtggacgaaaaaacaaacttcgaagcaggaaggccattatcaactaacgctgaccgaaccgcaaaaagaagcgctagacgtaacctccaacgatacaaactgcggagaaaaaatctaatagatctattgataaaacacagacttatcgataaagacactcccctaactgagatcggtaagaataccacacatcaaaccctagaattacgtgcaaaagctgccagagaacgtatagaactcgaagatctagccagagtattccttgcaatcaataaaaaacgaggatacaggagtagcagaaaagttaataacgaagaagaaggacaggtagtcgacggtatggcagttgcaaaaaagctatatgacgaaaacttaactccaggacaatacgcatatgaactgctgtcaaaaggaaaaaaatatgttcctgacttttaccgatcagatcttcaagccgagtttgattccatatgggaataccaaaaacaattttacgccgacatactagatgacgaactatacaacgcacttaaaggacaaggacaacagaactcaaggaagagattcctagcaataaaaggcgtttacacagcagaaaacaaaggaaaaagagacgaggtcaagttacaacattataaatggagaagcgaagctattacccaaaaactttcgatagaagaggtggcgtacgttcttgtagaaataaacaacgacttaaataaatcatcaggatatttgggagcaataagtgacagatcgaaagaactgtacttcaacaaagaaacagtaggagaaaatctttggaaacaaatacaaaaaaacccacacacatctctaaaaaatcaagttttctaccggcaagattatctcgacgaattcgaacaaatctgggaaacccaagcacaattccatccgcaactaaccctagcattaaaagagcaaatccgagacgtagtaattttttatcaaagaaagcttaaatcccaaaaaggacttctctcattctgccaatttgaatcatgggaaatagaaaggaaagatgaaaatggtaatgtaatactaaataaaacaactcaactgccaaagagacaaaccgtaggacgacgagtagcaccaaaaagttctccattatttcaagaattcaaaatatggcaaaacataaacaatttagaaatcgcaaaaatatcagacggtaacagtaaaaataaaaaagaaactgaagcactaagtgatgacgaaaggaaactcctatttgaagaacttaatctaagagggaatctgagccaaaaagaagtactacaaatactcggtctgaaagataaggaatacaaaacaaacttcccagaaggcttggaaggtaacaggaccaatgcagcattattcaatatttatcagcaaatagctgaaaatgaaggatacggcgattggacaaaaaaaagcgcacaagaaataaaagaggagttaaaagctgtttttccacaaattggaatacaggcagacatactggacttcaacgcagagcttgatggaaaggaatttgaaaaccaagcatcataccagctgtggcacttgttatatagtgcagaagaagacgacaaaatcaacgaagaagatcagataatatacggaaattcagccgtatctttaaaaaaaaaactatgcgaaaaattcggcttcacaccggaatacgccaaatggatagcaaacgtaagtttacaggatgactatggaaatttaagcacaaaagccatgagaaaaataataccatacctcatcgatggaaatgattactccgaagcctgcgcattagcaggttataaccattcaaacagcttaacgaaagaagaaaacgacaaccgagaaagactcaacaagctcgaattattaccaaaaaacagtttacgcaatcctgtcgtagaaaaaatacttaaccaaatggtaaatgttgtaaaccaagtaattgaaacttacggcaaacccgatgaagtacgcatagaacttgcacgtgaactaaaaaaatcagcagaagagcgtgcagaaatgactaaaggcataaacgaagcaacgagaagaaacgaagatataaagaaactaataacaaagaacttcggaatcccaaatccaacaaagaatgacgttgtcaggtataggctatgggaagaattagccccactagcctataaagatgtattcaccggaagacaaataaaaaaagaagacctattctcgagcaaaatagatatagaacacataataccgaaagcactgttattcgatgactcattttccaacaaaactctagcattcagagaaacgaatctcaaaaaagctgacagaacagcatatggctttattgaatccgactacaatgcaacactagatgactacatacaaagggtagagacactatataataacgcaaaaggtacaatatccaagggaaaaagaaataagctacttatggctcaaaaaaacctaccagacggttttatagaacgagatctcagaaattcgcaatatatagccaaaaaagcaaaatcaatgatagaaaaagttttcaacgatgtaaacgtaacaagcggttcaataacggacagattaagagaagattgggatctgattaacgtcatgaaagaattaaacttcccaaaatataaagctctaggtctaacagagatagaagaaagatacgacataggacaagaaaaaacgaaaaaagtagaagtaataactgactggacaaaacgaaacgaccatagacatcacgcaatggacgcattaacagttgcatttaccacaaaatcacacgtacaatacttaaataatttaaacacaatacatagtctaaaaggagatgaagtagacctagaattatcaaaactttatgggctcaaaaacacaataacagaagtagttaacaaaaaaagaaaatttataccaccaatgcctaattttcgggaagaagccaaaaagcacatagaaaccatactagtcagtataaaaaataaaaacaaagtgtatacaaaaaacatcaacaaaaccaaaaaagaatccggttaccacacaaaagaacaactaacaccgagaggacagcttcacaaagagactgtatacggaaaaagcaaaagaccaatgaataaacccaccaaaatcaataaaaacttttcattagaacaagcgcaactgataatcaatgtccaagaaaaagaactagtgttaagacacttagcgcaattcgacaataaccccgcagtggctttcgacacaaaaacattaaaaaaatgccattatctcaagatggttaacttgtga

SEQ ID NO: 8653 - RNA, 3441 nt, synthetic construct
  misc_feature 1..3441: note = Cas9 variant
  source 1..3441: mol_type = other RNA
atgtccggaaacacacacgggccattaacatttggatttgatataggtatcgcatcagtagggtggtgtgtactaggagaaaatagaatagtaaatttgggtgtcagatgttttgataaagctgaaactgcaaaagaaggagagagcttgaatctggcgcgaagaactgcaagattaatgagaagacgactacgaaggagagcttggagactaacaaaactagctagactcttaaaaagggaaggtttaattgccgaagcatccaggatacatattcctagcccagtcagtccatggcgattacgtgtagaaggcatagacagacgtctaactgatgacgaatgggcgcgagtaatctaccacttatgtaagcataggggattccactggataagccgtgcagaagaaagaaaagcagaatcggacgccaaagaaggtggaagagttaaaaaggggttatcagatacccaacgaaggatgaccgaaaaaggctacagatctgctgccgaaatggtactagcggaatttcctgatgcacaaagaaataaacagggggactacggaaaagcattaagtagaatattattgtcagatgagttggccttgctatttcgaagacaaagagaattaggaaatccaaacgcaggaaatgaactcgaagcaacaatactaggaaatggaaataggaaatccgggttattttgggagcaaaaacccccgttagcaggagcggatttattaaaaatgttaggcagatgtacatttgagaaaaacgaatacagagctccaaaagcgtcattcacggcagaacgacatgtatggttaacacgattgaataatctaagggtagtcgtagatggaacaactagatcattagatgacgcagaacataggctagtactaccactcccctataaacaagccggtgactttacatataagcaactgagaacagcattaaccaaggcaggacttctacctgaaggtttcaaattcgcaggattaagctacccgaccggccggcaactagacgaccctaaagcaaaagatccagaatcagaaaaattagtaagacttcctgcttggcaagaattaagaaaaacgttaaaagataagaaccttgaaacagagtgggaaggaatggctggtgcagcaaccggcggtaacccggaattactggatgaaattgcaagagtacttagtgtatttaaagatggcgacgaagtaaccgccgaactatggaagttaccattaccaggtggtaaagcaatgatagacgctttgagcgaaatcagcttcgataaatttcatgctctaagtttaaaagcattaagaaaaatagttccccatatggaaagcggacttcgatatgatgaagcatgtgcagttgcgggatatcaccattcccagttacacgccgcaggagcaggggaacacaagttcttaccaccattttactcaagaagagataaagatggaagaatggtatttaatgaagaactagacgttcccaggaatccagtagtactaagagccctaaatcaagctagaaaagttcttaatgcattagtcagaacatatggatcaccaacagcagtccatattgaaatggccagagacctaagtcgaccactagacgaaagaaataaagtgaagaaagcacaagacgaatacagagaaaggaatgaaaaagacaaagcagcatttgcggcagaatatggtatagcaccaaaaagcagagagttcgaaaagtttcaattatacagagaacaacaaggcaaatgtgcatactcactcaagtctctagatttgcatcgggtattacacgacattggatacgccgaagtggatcacgcattaccttactcaagatcttacgatgacagcaagaataacaaagtattagcactaaccgaggaaaataggaacaaggggaatcgtacagcgtatgaatacttaacttctttccctggaggtgagaacggcgaacgttggagaaactttagtgtggcagtagaaacaaataaggcttacagactagcgaaaagaacacggctattgcgtaaagacttttcaggtcgagccgcggaagagttcagggaaagaaatttgaatgatacacgatatatctgtagattctttaaaaatacagtcgaacgatttttaaagctagatgctaaagtaggtgccggagatacagctgaaatatcagcaaagagatgtgtcgtattgagcggtcaaacaacggctttcttaagggctagatggggtttactaaaagttagaggtaactccgatagacatcacgctttggatgcagccgtagttgcagcgtgcagtcatggaatggtaaaaaggttaggtgattatagcagaacaaaggaattagcaaaagtccacgatggatttccagatccagaaacgggagaaataatagatccagtcatgtttcagcaactccatgcccatttccccgatccctggccacatttcagagcagaactagaagcaaggctaaatgttgatgacaccgccgatctaagagcaagaatggaattgtttggaacatatgcaccagaagcattagaaacacttagaccactcttcgttagtagagcacctcaacgacgaaacagtggagcagctcataaggacaccatctacgcacaaccagaacgcctgaaagaacaaggaggagtcacccaaaaagttccgctcacgtcattaacactaaaagatttagataaattaatagatccacatagaaatgaaaaattatatgcggctatcagagcaagattagaagcacacggaggaaaagcagataaggcttttcctgccggaaatcctttacgaaaaccagatcgagagggaaatccaactggacctgtcgtcagaacagtcaccatggtaattgataaattatcaggaatcccagtacgagggggaatagctaaaaatgatactatgttaagagtcgacatatttagacacaagaaagatggaaaattccaccttgtaccggtatatgtgtatcatgcagtagcaaaagaatttccaaatagagcaatagtgcaggcaaaagacgaagacgaatggacattaatagatgacaaattcgatttttgtttttcagcccatcctaacgacctattaaaaataactcagaaaagcggagaaacaatctttggatactatagagggtgtcattccggaacagcagcaataaacattgctttacacgacagatatgcttatgcagagaaaaccaccagtctagctttcagcaaaaagaatccgggaaaacctattcccaatgataaattaggacttatagaaggtataggagtaaaaatggcagccaatatggaaaaattccacgttgatacattagggaatatttatccagcaccaccagaacaaagacgaggcttagcgtga

SEQ ID NO: 8654 - RNA, 3441 nt, synthetic construct
  misc_feature 1..3441: note = Cas9 variant
  source 1..3441: mol_type = other RNA
atggcataccgcttgggactagatattggaataacctcagttggctgggcggttgtcgctttagaaaaggatgaaagtggtttgaaaccagtacgaatacaagatttaggcgtgaggatatttgacaaagcagaagattctaaaactggagcaagtttggcacttccgcggagggaagcaagaagcgcccgtagaaggacacgtcgcagacgacataggttatggagagtaaaaagactcttagaacaacatggaatactatctatggaacaaatcgaggctttatatgcacagagaacctcaagtccagatgtttacgcgctacgagtagcaggcttggatagatgtttaatcgctgaagaaatagcacgtgtgttaatacatatagcacatagaagagggttccaatccaatagaaaatctgaaattaaggactcagatgcaggaaaactattaaaagcagtacaagaaaatgaaaacttgatgcaatcgaagggataccgtacagtagcggaaatgctcgtatctgaagcaactaaaacagatgctgaaggaaagctagtgcacggcaagaaacacggctatgttagtaatgttagaaataaagcgggtgaatatagacacacggtctctaggcaggcaatcgttgacgaagttcgaaaaatttttgcggctcaaagggcactaggcaacgacgtcatgtcagaggaactggaagatagttatctcaaaattctatgtagccaaaggaattttgacgatggaccagggggcgatagcccatatggacatggaagcgtaagcccagatggcgtacgacaaagtatttatgaaagaatggtaggttcatgtacgtttgaaactggagagaaaagagcaccaagatctagctatagttttgaaagatttcaactgttaacaaaagtagtcaacctaaggatatataggcaacaagaagacggcgggagatatccatgtgaattaacgcaaacagaaagagcccgagttatcgactgcgcatatgaacaaaccaaaattacctacggtaaactaagaaaattactagatatgaaagacacagaaagttttgcaggactaacctacggtctgaatagaagcagaaacaaaacagaagatactgtttttgttgaaatgaagttctatcatgaagttcgaaaggcacttcaaagagcaggagtatttatacaggatttatcaatagaaacactcgaccaaattggatggatactttcagtttggaaaagcgacgataacagacgaaagaaattatcaactctaggattgagcgataacgttatagaagaattacttccgttaaatggatcaaaatttggccatttatctttaaaagctataaggaaaatcctcccttttctcgaagatggctactcatatgatgtagcatgtgagttagctggatatcaatttcaaggaaaaacagaatacgtaaaacaaagactgttaccaccgttaggagagggagaagtaacgaatccagtagtaagacgagcactaagtcaagcaattaaagtagtaaatgcagttataagaaaacatggttcacctgaaagcattcacattgaactagcacgagaattaagtaaaaatctagatgagagacgtaaaattgaaaaagcacaaaaagaaaaccagaaaaacaatgaacaaataaaagacgaaataagggagatactgggtagcgcccatgtaacagggagggatatagttaaatataagctatttaaacaacaacaagagttctgcatgtatagcggggaaaaactagatgtcacaagattatttgaacctggatacgccgaagtggatcatataataccatacggaatatcctttgacgatagctatgataacaaagtcctagtaaaaacagaacaaaaccgacaaaaaggaaatagaacaccattagaatacttacgtgataaacctgaacaaaaggcaaagtttattgccctagtagaaagtatacctttaagtcaaaagaagaaaaaccacttacttatggacaaacgcgcaatagacttagaacaagaaggttttagagaaagaaatttatcagacacaagatacataacaagggcattgatgaaccatatacaggcatggctattatttgacgaaacagcatcaacacgatccaaaagggtggtctgtgtcaatggagcagtaacagcttacatgagagcaaggtggggactaacaaaagatagagatgccggagataaacatcatgctgcagatgcagttgttgtagcttgcataggggatagcttaatacaacgagtaacaaaatatgacaaatttaaaagaaacgcactagcagataggaacagatacgtgcagcaagtaagtaaaagcgaaggtattacacaatatgttgataaagaaacaggagaagtatttacttgggagagtttcgatgaaagaaaatttctaccaaatgaaccactagaaccgtggccattctttagagatgaattattggctagactatcagacgacccaagtaaaaatattagagccataggtctgttaacgtattcagaaacagaacaaatagatcccatatttgtatcacgtatgccaactagaaaggtgacaggagcggctcataaggaaacaattaggtctcccagaatagttaaagtagacgacaataaaggcacagagatacaggtagtagtcagtaaagtagcattaactgagctaaaattaacaaaggatggtgaaattaaagactatttcaggccggaagacgatccacgtctttataacacactcagggaaagattagtgcaatttgggggagatgcaaaagcagcatttaaagaacccgtttataaaatcagtaaagacggaagtgtaagaactccggtacgcaaagtaaaaatacaagaaaaactaacattgggtgtaccagtacatggaggaagaggtattgcagaaaacggaggaatggtaagaatagacgtattcgctaagggcggtaaatattattttgttccaatctacgtagccgatgtactaaagcgagaactacctaatcgattagctacggcacataaaccatacagtgaatggagagtagtagatgactcatatcaatttaaatttagcttatatccaaatgatgcagtaatgatcaaacccagccgagaagtagacatcacatataaagatcgtaaagaacctgtaggttgcagaataatgtattttgtttctgcaaacatagcatcagcaagcataagcctacgaacgcatgacaattcaggagagctagagggactaggaatacaaggattagaagtatttgaaaagtatgtagtaggaccactcggcgatactcacccagtgtacaaagaaagacgaatgccatttcgagttgagagaaaaatgaattga

SEQ ID NO: 8655 - RNA, 3441 nt, synthetic construct
  misc_feature 1..3441: note = Cas9 variant
  source 1..3441: mol_type = other RNA
atggcataccgactaggtttagacataggaataacaagtgtaggatgggctgtggtagctttagaaaaagatgaatcagggttaaaacccgtacgtattcaagatctaggtgttagaatattcgacaaagcagaagactctaaaacaggagcaagccttgcacttcctagacgggaagcaagatctgcacgaaggcgaacaagaagaagaagacatagactatggcgcgtaaaaagactcttagaacaacatgggatattatcaatggaacaaatagaagcactctatgcacaacgtacaagcagcccagacgtatacgcactaagagtagccggcctagatagatgtcttatagcggaagaaatagctcgagtactcatacacatcgcacacagaagaggatttcagtcaaatagaaagagcgaaatcaaagatagcgacgcaggaaaattattaaaagctgttcaagaaaatgaaaatttgatgcaatcaaaaggctatagaacagtagcagaaatgctggtatcagaggcaacaaaaacggatgcagaaggaaaattagttcacggaaagaaacatggttacgttagtaatgttaggaataaagcgggagaatacaggcacacagtaagtcgacaagcaatagttgatgaagtgaggaaaatttttgccgcccaacgagcactaggaaacgatgtaatgtcggaagaactagaagatagttaccttaaaattttatgctcacaaagaaattttgatgatggaccaggaggggattcaccatacggacatggatcagtaagcccggatggagtcagacaaagcatatacgaaagaatggtagggagctgcacgttcgaaacaggagaaaaacgagcaccaagatcaagctattcgtttgaaaggttccaattgttaacaaaagttgtaaatttaagaatatatagacaacaagaagatggtggaagatatccatgtgaattaacgcaaactgagagagcacgtgttatagactgcgcatacgaacaaacaaaaattacttatggaaaactaaggaagctattagatatgaaagatacagaatcatttgctggattaacatacggactaaatagatcacgcaacaaaacagaagacacggtcttcgttgaaatgaaattctaccacgaagtaagaaaagcgcttcaacgcgctggagtatttattcaagatttaagcatagaaacactagaccagataggatggattttaagtgtctggaagagtgatgataatcggcgtaaaaagctaagtacactaggattaagcgataatgtgatagaagaacttcttccattaaatggaagtaaatttggacatctaagtttaaaagcaatcaggaaaattttaccgttcttggaggatggatactcgtatgatgtagcttgtgaactagccggctatcagtttcaaggaaaaacagagtatgtcaaacaacgcttattaccaccactaggtgaaggagaagtaactaacccagtggtaagacgagcgttaagtcaggcaataaaagttgtgaatgccgttattagaaaacatggctctccagaaagcatacatatcgaattagcgagagaattatctaaaaatttagatgagagaagaaaaatagaaaaagcacaaaaagaaaatcagaaaaacaacgaacaaataaaagacgaaataagagagatattaggaagtgcacacgtaactggaagagatatagtaaaatataagttatttaaacaacaacaagagttctgcatgtattcaggagaaaaactagatgttacacgtttgttcgaaccgggatatgcagaagtcgaccacataataccatatgggatttcctttgatgatagttacgataacaaagtcttagtaaaaactgaacaaaataggcaaaaaggaaataggacgccactggaatacctacgagataaaccagaacaaaaagcaaaatttatagcactggtagaatctataccgctgtcacaaaagaagaaaaatcatctactgatggacaaacgagcgattgatctggaacaagagggattcagagagagaaatctttcagatactaggtatataacccgggcattaatgaaccatatacaggcttggttattattcgacgaaactgcatctacaagaagcaaaagagtagtgtgtgtaaatggcgctgttacagcatatatgagagcgagatggggactgaccaaggacagaaatgcgggagataaacatcatgccgcagatgcagtagttgtggcctgtataggagacagtttaattcaaagagtgacgaaatatgacaaattcaaaagaaatgcacttgccgataggaacaggtatgtacaacaagtatcaaaaagcgaaggaattactcaatatgtagataaagaaaccggggaagtatttacgtgggagagctttgatgaaagaaaatttttaccaaatgaaccattagaaccctggccattcttcagagacgaactactagccagattgagcgatgacccgtccaaaaacatacgagctatcggcctgcttacgtattcagaaacagaacaaattgatccaatttttgtatcaagaatgcctaccagaaaagtaacaggagctgcacataaagaaacaataagatcacctagaatagtaaaagtagatgacaataaggggaccgaaatacaagttgtagtgtcaaaggtggctctaacagaattaaaacttactaaggacggagaaatcaaagactacttcagaccagaagatgaccccagattatacaatacactcagagaaagacttgtacaattcggaggagatgctaaagcagcttttaaggaacctgtttataaaatatcaaaagatggatcagtaagaacaccggtaagaaaagttaaaatacaagaaaaactaaccctaggggtaccagtacatggaggcagaggaattgcagaaaatggtggaatggtaagaattgatgtcttcgcaaaagatggaaaatattattttgtaccgatatatgttgctgatgtcctaaaaagagaattaccaaataggttagcgacagctcataaaccctattctgaatggcgagtggtagacgatagttatcagttcaaatttagtctatatccgaacgatgcggttatgatcaaaccaagtagagaagtagatataacctacaaagacagaaaagaaccagtcggtctaaggctaatgtatttcgcaggggcagatatttcaggtgcgactctaacactaaggacccatgataactctggagaattgaaaggcctaggcattcaaggtctagaagtatttgaaaaatacgtagtcggtccattaggggatacgcacccagtttataaagaaagacgaatgccattcagagtcgagagaaaaatgaattga

SEQ ID NO: 8656 - RNA, 3447 nt, synthetic construct
  misc_feature 1..3447: note = Cas9 variant
  source 1..3447: mol_type = other RNA
atgactaaattaaatcaaccatatggtataggtttagacataggaagtaactcaataggattcgcggtcgtcgatgcaaattctcacctcttaagactaaaaggagaaactgcgatcggtgcgcggcttttcagagaaggccaatccgctgcagatcgaaggggcagtagaacaacacgaaggagattatcaagaactcgctggagattatcattcctgagagatttctttgctccacatattactaaaatcgatccggactttttcttacgacaaaaatacagcgaaatttcaccaaaagataaagacagattcaaatatgaaaagagattatttaacgatagaacagacgcagagttctacgaagcctatccatcaatgtatcacctaagattgagattaatgacagatgcgagtcaagcagacccaagagaaatattcctagcaatacaccacatactaaaatctagaggtcactttctgacacctggagcagctaaagacttcaatactgataaagtggatctagaagatatattccctgcattaactgaagcatacgcacaagtttacccagacttggaactaacattcgaccttgcaaaagcagacgatttcaaagcaaaattactagacgaacaagcaaccccctcagacacccagaaagccctggtaaatctattactttcatcagatggtgaaaaagaaatagtgaagaaaagaaaacaagtgctcaccgaatttgcaaaagcaatcacaggtttaaaaacaaagtttaatctcgccttagggaccgaagtagacgaagctgatgcttcaaactggcaattctcgatgggacaactagacgacaaatggtcaaacattgaaacttccatgactgaccaaggcacagaaatatttgaacaaattcaagaattatatagagcccgcttacttaatggaattgtaccagcaggaatgtcattatcacaagcaaaggttgcagactacggccagcacaatgaagatcttgaattatttaaaacatacctcaagaaactcaacgatcacgaactagcaaaaactataagagtaatatatgatcgatatataaacggagacgacgctaaaccgttcctaagagaagactttgtcaaagcactaacaaaagaagtcacagctcacccaaacgaagtttcagaacaactcttaaatagaatggggcaagccaacttcatgttaaaacaacgaactaaagccaacggggctataccagtgcaactacaacagagagaactagaccaaattatagcaaaccagtcaaaatattatgattggctagcgaaacctaacccagtcgaaaaacacagagcttccaaaccctatcagctagacgaactactaacatttcgtataccctactacgtaggcccattaattacaccaaaagaacaagcaaaatcaggagaaaacgtatttgcctggatggtaagaaaagacccaagcggtaacataaccccatataactttgatgaaaaagtagaccgagaagcaagtgctaacgtttttatacaaagaatgaaaactacagatacatacctaataggagaagatgtcctaccaaaacaaagcctattataccaaaaatatgaagtactaaatgaactaaacaatgtacgagtaaacaacgaagcattgggcacagatcaaaaacaacgactaattagagaagtatttgaaagacatagttcagtaaccataaaacaagttgctgacaatctagttgcacacggggactttgcacaaagacccgaaataagaggactcgcggatgagaaaagattcctatcgtcactttcaacataccaccaactaaaagaaattttacacggcgcgatagacgattcaacaaagttacatgatattgaaaatataataacatggtctaccgtatttgaagatgctgcgatctttaaaacaaaactcgctgaaatcgactggcttgatgcagcaacaatcaagaaattatcaaacataagatatagaggatggggccaatttagtcgtaaattattggacggattaaaactcggaaatggtcaaactgtaatacaagaactaatgctctcaaaccacaatctaatgcaaattctaacagacgaaaccttaaaaacgacaatggcagaattgaaccaagataaactcaaagctgatgatatagaagacgtaattaatgacgcttatacatcaccatctaacaagaaggccttgagacaagtcttaagagtagtagaagatattaaacatgcggccaacggccaagacccatcatggctatatattgaaacagctgacggtcccgggaccgctggtaaaagaacacaaagccgacaaaaacagatacaaacagtatatgcaaacgctgcacaagaactaattgacagcgcagtgagaggagaacttgaagataaaatcgcagataaagcatcattcacagaccgcctagttttatattttatgcaaggtggcagagatatatatacgggagcaccactaaacatagaccaattaagtcactacgacatagatcacatattaccccaatcgttaataaaggatgatagtctagacaacagagtcttagtaaacgctacaattaacagagagaaaaacaatgtatttacaagcactttgttcgcctctaaaatggctgccacctggagaaaatggcacgaagcgggtctaatcagtggaagaaaacttcgaaatcttatgttacggcccgacgaaatcgataaatttgcacacggttttgtcgcaagacaattagtagaaaccagacagatcataaaattgactgaacaaatagcggctgctcaatatccaaatacaaagatcatagcagtaaaagcaggcctatctcaccaactaagagaagaattagatttccctaaaaacagggatgtcaatcattaccatcatgcattcgacgcatttttagctgcccgaatcggaacgtatctcttgaaacgatatgctaaactcgcaccatttttcacatacggagagttcgcaaaagtagatgttaaaaagtttagagaatttaatttcataggagctctaaagcatgctaagaaaaatatagtagcaaaagacacaggtgaaattgtctgggacaaagaaagagacatacaagaattagatcgtatttataactttaaaagaatgttaataactcacgaagtttattttgaaacggcagatctatttaaacaaacaatatatgcagcaaaagattcaaaagaaagagggggatcaaaacaattaataccaaagaaacgcggctatccaacacaagtctacggtggaatacacggcaaaatcagattaacctggagatggttaaaattactaagaaggaagaaaatgagcatagaactctcagaattacaactacttaaatga

SEQ ID NO: 8657 - RNA, 3450 nt, synthetic construct
  misc_feature 1..3450: note = Cas9 variant
  source 1..3450: mol_type = other RNA
atggaaaggtatcacataggactagacatagggacctcatcaatcggctgggcagttataggagacgactttaaaatcaagagaaaaaaaggcaaaaacctaataggcgtacgattgttcaaagaaggagataccgcagcagaaagaagaggttttcgcacacaaagacgacgcctaaacagacggaaatggaggctcaagttactcgaagaaatcttcgacccttatatggcagaagttgacaaatacttcttcgcacgattaaaagaatcaaacctctccccgaaagacagtaacaaaaaatacttaggaagcctactcttcccagacatttccgactcgaatttttacgacaaatacccaactatatatcatctaagaagagatttaatggaaaaagacaaaaagttcgacctaagagaaatatatttggctatacaccatatagtcaaatatagaggcaacttcctggaaaaggtgccagcaaagaactataaaaactccggcgcgtccataggttttttactcgaagaagtaaacgatctctacggcaacataataggcaacgaagatgtagcaatacttgataatgacaaattcgaagatgtagaaaaaatcattttaaacgatgaaatcagaaacattgacaaacaaaaaaatgtaggtcgcctcttagtcaaagacaaaaaagaaaagaatatagtaactgcattctcaaaagcaattttcgggtacaaattcaatctagaagaccttctattaatcgaaagtgatgaaaaaaataaactgaccttcaatgatgaaaacattgacgatatattcaatgaattaagtcattcactaaacgacaatcaaatggatctgctaaccaaaactcgtgaaatatactttaaattcaaactaaatatgatagtccccacgggatatactattagcgaatctatgatcgaaaaatacgaaatgcacaaagcacacctaaaaatgtacaaagaattcataaacactctaaacgcaaaagatagaaaaatactaaaaaatgcttacagtgactacataaataatgagaaagcaaaagcagcaaatgctcaagaaaacttctataaaacagtaaaaaaaacgataaaggaaaacgactccgacaccgcaaaaaaaatcatcggcttaatagatgaaggaaactttatgccaaaacaaagaacaggcgaaaatggcgtaataccacaccaactacatcaaattgaactcgacagaatcatagaaaatcaagcaaaatactacccatggctggcagaagaaaaccctgtagagaaaaacagaaaattcgcaaaatacaaactagacgaactggtcactttccgtgttccttactacgtgggcccccttatagacaaaactgaaagcaacaaaaatgaaaaagaaactaaattcgcttggatggtcagaaaggcaaaaggaacgataacaccatggaattttgaaaacttagttgatagaacagaaagtgcaaacaggtttataaaacgcatgaccagcaaagatacctatatcataggggaagatgtactacccgccagcagtctactatatgaaaaatacaaagtattaaacgaactaaacaatattaaagtgaacaaaaaaaaactagacgtcgaacaaaagcaacacgtatatctagacctattcacaacaagaaaaaacgtgacaaaagacgatctagcaacctctttaaattgcgatgtagaaagtattacaggcttgacagacaataaaaaatttaattcatcattatctagttatatcgaccttaaggcaatactgggcaacatagtagatgactacagcaaaaatgaagatcttgaaaaaataatcgaatattcaacaatattcgaagatggtaatatatacaaggagaaacttagtgaaataagttggctaacagatgaacaaatagaaaaactctcaaacatacactttaaggggtggggaagattatcaaaaaaattgttaacacaaataacaaatgaaaatggagaacgcataatagacactttatggaacaccagcaataactttatccaagtcatatctgacgaatcaatacaagcaaaattagctgaaataaatggagaatacgcaaacaaatacaaccttgaagacatattagatgaagcctatactagcccacaaaacaagaaggcaataagacaagtaatgaaagtcgtcgaagatatagaaaaggcaatgaaatgtgaacccacatcaatagcaatagaattcacaagagaaaaaaggaaaagcaaactcaccaacaccagatacaaaaagatatccgaaacttacgaaaaaataacggatgaacttatctcagagtacgaattaggaaaactacaatcagaacttgattcaaaagtaaacaacatgagagacagatattacttatactttatgcaactgggacgagacatgtacacaggtgaaaaaatgaacatcgatgaactgcatcaaaagtacgacatagatcacatactaccacaatcattcataaaagacgacagcctgaacaatcgagttcttacgagcaagagtgtcaacatcaaagaaaaaagtgataaaacagcagcagacctatacgcagcaaaaatgggagacttttggcgaaaactacgcaaacaaggattaatgacagaacaaaaatacaaaaatttactcacacgaactgacagcatcaataaatatactaaacaatccttcataaaacgtcaactagtcgaaacatcacaagtagtcaaactagctgcaaacattttacaagacaaatacagaaatacaaaaataatagaaataagagcaagattaaactcagatctacgaaaaaaatatgaactcataaagaacagagaagtaaatgactaccaccacgcaatcgacggttatttaacaacatttgtcggccaatatctctataaagtatatcccaagctaagaagttatttcgtgtatgatgattttaaaaaactagattcaaactatcttaaacatatggataaattcaactttatttggaaactagaagacaaaaaagctgaagacgtatatgataaagtaaacgatgaattcgtattaaacgtcccagaaatgaaagaatacatccgcaaaatttacaactataaatatatgttagtatctaaagaagtcacaacaaaaaatggagcattctatgatcaaacaaaatataacgccaaaacgataaaccttatacccataaaaaaagataaaccaaccaacatatatggtggttataaagggaaagtcagcagctacatgatgcttgtaaaaatccaaaaaaaaaaagaagtaatatacaaatttgtaggagtaccaaggttatggacagacgaattagatagattaatagatactgacgagaagaaagctttactcaagaaatga

SEQ ID NO: 8658 - RNA, 3459 nt, synthetic construct
  misc_feature 1..3459: note = Cas9 variant
  source 1..3459: mol_type = other RNA
atgaacgcagaacatggaaaagaaggcctgttgatcatggaagaaaatttccaatatagaatcgggctagatattggaatcacaagcgtaggctgggctgtgctacagaataattcacaagatgaaccagtacgaattacagatttaggggtacgaatatttgacgtagcagaaaatccgaaaaacggtgatgcattggcagcaccaagaagagacgcacgaaccacaaggaggcgattaagacgtagaagacaccgattagaaagaattaaattcttacttcaagaaaatggattaatagaaatggactcattcatggaaagatactataaaggaaatctgccagacgtttatcaactccgttatgaaggtcttgacagaaaattaaaagacgaggaattagcacaagtcttaatacatattgcaaaacatagaggatttagaagcaccagaaaagcagaaacaaaagaaaaagagggaggagcagtgttaaaagcaactacagaaaaccagaagataatgcaagaaaagggataccgaactgtgggtgaaatgctatatctagatgaagcatttcacaccgaatgtctatggaatgaaaaaggttatgtattaactccgagaaacagacccgatgactataaacacacaatcctaagatcaatgctagtagaagaagttcatgcaatttttgcggctcaaagagcgcatggaaaccaaaaagcaaccgagggactagaggaggcatatgttgaaataatgacatcacaacgatcatttgatatgggcccaggtctacaaccggacggaaagccaagcccatacgcaatggaaggatttggcgacagagttggaaaatgtacatttgagaaagacgaatacagagcgcctaaagcaacttacacagcagaactatttgtcgcactacagaaaataaaccataccaaattaatagatgaatttggaacaggtagatttttcagcgaagaagaaagaaaaacgataatcgggctattattaagttcaaaggagttaaaatacggaacaataagaaagaaactgaatatagaccctagtctaaaatttaatagtttaaattatagtgccaagaaagaaggcgagactgaagaagaaagagtattagacacagaaaaagcaaaatttgcctcaatgttctggacgtatgaatattcaaaatgtctaaaagataggaccgaagaaatgccagtaggggaaaaagcagatttatttgatagaataggagaaatcctaacagcctataaaaacgacgatagtagatcatctagactgaaagaattaggtctaagcggtgaagaaattgatggactgttagatctaagtccagcaaaatatcaaagagtgtcattaaaagcaatgagaaaaatgcaaccttatctcgaagatggattaatatatgacaaggcctgcgaagcagcaggttatgacttccgggctcttaacgatggaaataagaaacacttgttaaaaggagaggaaataaacgccatcgtaaatgatataactaatccagtagtaaaaaggtcagttagtcaaacaataaaagttataaacgcaataatacaaaagtatggaagcccacaggcggtaaacatagaattagcccgagaaatgagcaagaacttccaagatagaactaatttagaaaaagaaatgaagaaaagacaacaggaaaatgaacgagcaaaacaacaaatcatagaactaggaaaacaaaatcctaccggacaagatatactaaagtatagattatggaatgatcagggtggctattgtctctatagcggaaagaaaattccacttgaggaactttttgatggagggtatgatatagaccatatactaccatattcaataactttcgacgattcatatagaaacaaagtattagtgacagcacaagaaaatcgacaaaaaggtaataggacaccttatgaatattttggagcggacgagaagcgatgggaagattatgaagcatcggtgagactactcgtgagagattataagaaacaacaaaaacttctaaagaaaaattttacagaagaagaaagaaaagagtttaaagaacgaaatctgaatgataccaaatatataactagagtcgtatataatatgataagacaaaatttggaattggaaccctttaatcatcctgaaaagaagaaacaggtatgggcagtcaacggagcagttaccagttatctaagaaaaagatgggggttaatgcaaaaagacaggagtacagatcgacaccatgcaatggacgcagttgtaatagcatgctgtacagatggcatgatacataaaataagtagatatatgcaaggaagggaactcgcatacagccgtaattttaaattccctgatgaagaaacaggcgaaatattaaatcgcgacaattttacaagagaacaatgggacgaaaaattcggagtcaaagtaccacttccatggaactcattccgggacgaactagacataagattactaaatgaagatcctaaaaattttctactaacacatgccgatgtacaaagagaattagactatccaggctggatgtatggggaagaagagtcgcctatagaagaaggaaggtacattaactatataaggccattattcgtgagtaggatgccaaatcacaaagttacaggaagcgcgcacgatgcaaccataaggagcgcacgagactatgaaacacggggagttgtaatcacaaaagtacctttaacagatctaaaactcaataaagataatgaaattgaaggatattacgacaaagattcagatagactattataccaggctctagttagacaactattattgcatggaaatgacggcaaaaaggcattcgcagaagacttccataagccaaaagcagacggaactgaaggaccagtggtaagaaaagtaaaaatagaaaagaaacaaactagcggtgtaatggttcggggagggactggaatagcagcaaacggagaaatggttcggatagacgtatttcgagagaatggaaaatactattttgttccggtttatacagcagatgtagtgcgcaaagtactgcctaatagagcggcaacgcatacaaaaccatattctgaatggagagtaatggacgatgcaaacttcgtcttttcactatatagtcgagatttaatacatgtaaaatcgaagaaagatataaaaactaatcttgtaaacggaggcctactacttcaaaaagaaatatttgcgtactacacaggagcagatattgcaacggcatcgattgcaggttttgctaatgatagcaacttcaaattcaggggactcggaatacaatcattagaaatatttgagaaatgccaagttgatatattgggtaatataagcgttgtaagacatgaaaatagacaagaatttcattga

SEQ ID NO: 8659 - RNA, 3462 nt, synthetic construct
  misc_feature 1..3462: note = Cas9 variant
  source 1..3462: mol_type = other RNA
atgaaaaatatcctagggttagatctcggactttcctctataggttggagtgtaataagagaaaattcggaggaacaagagctagtggcaatgggaagcagagttgtatcattgaccgcagccgaattatcatcattcacacaaggaaatggtgtctcaatcaatagtcaaagaacccaaaagagaacccaaagaaaaggatatgaccgatatcaattaagaaggacattgctaagaaataaattggatacattaggaatgctaccggacgacagtctatcatacctacctaaactacaattatgggggctaagagctaaagcagtaacccaacgtatagaactaaacgaattaggccgagtattacttcacctaaatcaaaaacgtgggtacaaaagcatcaaatcagacttcagtggcgataaaaagataactgattatgtaaaaaccgtaaaaacaaggtacgacgaactgaaagaaatgaggctaacaataggagaattattctttagacgactaacagaaaatgcatttttcagatgcaaagaacaagtttatccaaggcaggcttacgtagaagaatttgattgtataatgaattgccaaagaaaattctaccctgacatattaaccgatgaaaccatcaggtgcattagagatgaaataatatattaccaacggcctctaaaaagctgtaaatatctagtaagcagatgtgagttcgagaaaagattttatctgaatgccgcaggaaagaaaacagaagcaggacctaaagtatctcctagaacctcacccctatttcaagtatgtagattatgggaaagtataaataatatagtagtaaaagatagaagaaatgaaatagtatttatttcagcagaacaacgcgcagcattattcgactttttaaacacccatgaaaaacttaaaggaagtgatctactaaaactccttggattaagcaaaacctacggatataggttaggtgaacaattcaaaactggcatacagggcaacaaaacaagagtagaaatagaacgagcattggggaactacccagacaagaaacgactactccaattcaacctacaagaagagtcaagcagtatggttaatacagaaacaggtgagattattccaatgatatctctgtctttcgagcaagaaccactatacagactgtggcacgtattatatagcatcgatgatagagaacaattgcaatcagtactaagacaaaaattcgggattgatgacgatgaggtcctagaaagactctcggcgatcgatcttgtaaaagctggatttggtaacaaatcctcaaaagccataaggaggattctaccgtttttacagttggggatgaactatgcagaagcatgtgaagcggcaggatacaaccattctaacaattatacaaaagcagagaacgaagcaagagcactattagacagattacctgccataaagaaaaacgaactaagacaaccggtggtggagaaaatcctaaatcaaatggtaaatgtagtcaacgccctaatggaaaaatatggtagatttgatgaaatcagagtagaattagcacgagaactaaaacaaagtaaagaagaaagatcaaatacatacaaaagtataaataaaaatcaaagagaaaacgaacaaatcgcaaaaagaatcgttgaatatggtgtacctacaagaagccgaatacaaaaatataaaatgtgggaagaatcaaaacattgttgcatttactgcggacaaccagttgatgttggagactttttaagaggatttgatgtagaagtcgaacacataataccaaaaagcctgtattttgacgattcattcgcgaacaaagtatgctcatgcaggagttgcaataaagagaaaaacaacaggaccgcatacgattacatgaaatcaaaaggtgaaaaagctctttcagattacgtggaaagagtaaacacaatgtacactaacaatcaaataagcaaaacaaaatggcaaaacttgttaacaccagttgacaaaattagtatcgacttcatagatcgtcagttacgagaaagccaatacatagctcgaaaagcaaaggaaatattgacaagtatatgctataacgtaactgcgacaagtggatcggtaactagcttcttaagacacgtctggggatgggacacagttttacacgatctaaactttgaccgatataagaaagtagggctaacagaagtaattgaagtaaatcataggggatctgttataaggagagaacagatcaaagactggtcaaaaagatttgatcaccgccaccacgcaatagacgcattaacaatagcatgcacaaagcaggcttacatacaaagactaaacaacctaagagcagaagaaggtccagatttcaataagatgagccttgaaagatatatacaatcacagccacactttagcgtagcacaggtcagggaagcagtagatcgtattctggtcagcttcagagcaggtaaaagagcagtaacccctggaaaaagatatataaggaagaatagaaaaagaatctcagtacaatcggtattaatacctagaggagccttatcagaagaaagcgtatacggagttatccatgtatgggaaaaagatgaacagggacatgtaatacaaaaacaacgagcagtcatgaagtatccaattaccagcataaacagagaaatgttagataaagaaaaagtagtcgacaagcgaatacatcgaattttaagtggaagactagcccaatataacgacaacccgaaagaagcatttgcaaaaccagtatatattgataaagaatgcagaatacccattagaacggttcgttgtttcgcaaaaccagcaataaacacattagttcctttgaagaaagatgacaaaggaaacccggtcgcctgggtaaaccctggaaacaaccatcacgtagcaatttatcgcgatgaagacgggaaatataaagaaagaacagtaaccttctgggaagccgttgacagatgccgagtaggaataccagcaatagtaacacaaccggacactatatgggataatattctacaacgaaacgatatctccgaaaacgttttagaatcgttaccagacgtaaaatggcaatttgtactttccttgcaacaaaacgaaatgtttatacttggaatgaacgaagaagattataggtatgcaatggatcaacaagactacgctctactaaacaaatatctatatcgagtacaaaaattatctaaaagtgactactctttcagatatcacacggaaacctccgtcgaggataaatacgatggaaaaccaaatctcaaactttcaatgcaaatgggtaaattgaaaagagtatctataaagtccttactaggcctaaacccacataaagttcatatttctgtactgggcgaaataaaagaaatttcatga

SEQ ID NO: 8660 - RNA, 3474 nt, synthetic construct
  misc_feature 1..3474: note = Cas9 variant
  source 1..3474: mol_type = other RNA
atgaattactataacggtttcataattaccgagaatgcaatgacttccaagcaagaaaaacacggagctcttacattcggcctagacattggcattgcatccgtaggatgggctgtacttggtgaaagtcgaatagtcgaccttggagtacgatgctttgataaagcagaaactgcaaaagaaggagaatctctaaacctgacaagaagaatggcaagactattacgcagacggctgagaaggagagcatggagactcacaaaattagcaagactcctaaaaagagaaggactcattgccgacgcaaatctgtttaaacataaaatagagaaaaacacaccagtaccaaaatcatcatggcaattacgtgtagatggattagaccgtcaattaaatgctgaagaatgggcacgagtaatatatcacctatgtaaacatagaggttttcactggatatcaagagcggaggaaaaagcagcagaaggcgatagtaaaggagaagggggcaaagtcaaacaaggattagccggcacaaagaaattaatgcaagagaaaagttatcgaactgctgcggaaatggtattagctgagttcccagatgcccaacgcaacaaacaaggtgactattccaaagcattatcaaggattttacttggagacgaattaaaagctctttttgaacatcaaagaaaattaggaaatccagtagcaactgaaaaattagaagcagctatattaggaaacggagacaagaaatgtggactgttttgggcccaaaacccagccttagctggtaataaactccttgaaatgttaggaagatgtacatttgagaaaacaggaggggatgatggaaagggagaatatcgagcaccaaaggcttctttcagcgcagaaagacatgtctggttaacacacttaaataatctgcgtatagtagtagatggtacaacgaggccattaaacgaagcggaaagaagagtagcactacctatgccttaccaacaagctggagatttatcttataaacaattaggaggagcgctaatcaaagagggatttttacaaaaagatggctttaaatttgccggactaccataccccacaaaacaagcctccgaggaaaaagccaaagatccagaaacgagcgtactctgtaaacttccagcttggcatacacttagaaaaacacttgaaaaacatggactagaaagtgaatggcaaaaattatctacagatgcattagatggaaaaccccaattactagataacattgcatgggtactaagcgtatataaagatgacgatgaagtaaaaacagaattaggaaaactcaatttacccaataccgagaaaatgatagatgcgttattagatataaggttcgacaaattcagcaacctgagtttaaaggcattaagcaaaattgttccattcatggaacagggacaaagatatgatgaagccgtagctaatatacctgaatatggacaccatagccaactacataaagtaggagcgggtgaacataaatacttacccccattctataaagaaagagacaagacaggcaggatggtattcaacgatgacatggacataccaagaaaccctgtagtattaagagcactaaaccaagccagaaaagtagtcaacgcccttataaaagaatacggttctccacacgaagtccacatagaaatggcgagagatttatccagaccactagatgaacggcgagacatcgaaaaattacaaaaagaatttggagagcgtaataagaaagataaagaattatttgcacaggactttaatatcgtaggaacagtaaagggcaaacagttcgaaaaatatcaattatatagagaacaacaaggtaaatgcatatacccatctatggatgaaaaacaaggaatatgctgctatagcctaaaacctcttgatctacatagagtactatatgaagaaggctatgcagagatagatcatgcattgccttatagtaggagctttgatgacagcaaaaacaacagagttttagtattggcaaaagaaaatagagataaaggtaataggaccccatttgagtaccttggagataaagataatagtgagccttggagacaattcgtagccttcgtagaaggtaataaagcatatagactagcaaaaagatcgagattattaagaaaagattttggtgataaagaagcgaaagaatttagggaaagaaatttgaatgatacaagatatatatgtaaattctttaagaactacgtagaacaatacttacaattgcatgaagattcagaagcaaaaagatgtgtagtactttcaggacaaatgactagctttttaagggctaggtggggcctagtaaaagtgcgaggagacagtgatcgacatcacgctctagacgcggccgtagtagcagcatgtagtcacggaatggttaaaagacttagtgattattctagaagaaaagaacttgaacaagtaagagaaggatttgtagacgtagacacaggcgaaatcgttaaccctgcaatgtttcaacaagtacaagaacactttcctaatccatggccccattttagggacgaagtaaaattgaggttatcaatagacgatccaactttattgaggtcagaaatggaaaaattcggaacatacaccccagaatcactagaggcattgcgacccctatttgtcagtagagccccgcaaagaagaaattcgggggcagcacataaagacacaatatatgcacaaccaaaaaggttagtagcgcaaggcggagtaactcaaaaggtagctttatcatcattaacactaaaagatcttgataaattgattgacccccaccgtaacgagcgactatacgcagcaatcagagcaagattagaacaacacgggggcaagggtgacaaggcctttcctgcaagtaacccattgagaaaacctgatagcgaaggaaatccaacaggacctattgttcgaggagtaacaatggtaatcgataaattaagtgggattccaatacggggaggaattgctaaaaatgactcgatggtaagagtagatgtcttcacaaaagcaaataaattccaccttgtaccggtatatgtccaccactcagtactagggctaccaaatcaagcaatagtaggaggaaaagaagaaagtgagtggacacaaatcgacgattcatttgattggcatttttctatctatccaaacgatctgatcagagtaacacttaaacaggaaggaagatttggctactatgcggggtgtgacagatctacggcggccatacatttatgggctcacgaccgtaatcaacaagttggaaaagacggactaatcagatcaataggtgtaaaaaccgctttatcaatagagaaattcaatgtagacgttttaggtaacaggtacccagcaccgcctgaaaaacgaagagatctagcttga

SEQ ID NO: 8661 - RNA, 3486 nt, synthetic construct
  misc_feature 1..3486: note = Cas9 variant
  source 1..3486: mol_type = other RNA
atgaagaaaatattaggcttagacctaggatcagcaagtataggttgggcgctagtagaggaaactgaacaaatgcaatataacatagtctcattgggatcgcgaataataccatataacggaactgaaggacaagagtttgaaaaaggcaccggagaatcgaggaatagcctacgcacaaaagcacgaacggcacgaaaagggtatgacagataccaactaagaagaaagaatctagagaaaatattattacaaaacggaatgtacccgaacgaacaagtaagagcactacaaaaactagaattatggaaattaagagcagacgcacctaacgtacagatatcattgcctgaattagggcgacttttattttggctaaaccagaaaagaggctataaatcatcaagatcagatgcaaacctagataagaaagatacggaatatgttgccacagtaaaaagcagacaccagaaaataaaagatgccgggcaaacagttggacaatacttttatggccaaatactagaaaacgaataccacagaataaaagaacaagtcttcccgcgagaagcctatatagaagaatttgatgccatagttgctagacaaaaagaatactaccccacaatactaaaacaagaattaatagataaaataagaaacgaagtgatttatttccaaagagggctaaaaagtcaaaaaggtctagtttcggtgtgcgagttcgaaggcagagagttcaatggacatttcggaggaccaaaagtagcacccaaatcatcccctatttttcaattagggaaaatatgggaaaatataaacaatataaaaatagccgatatagaattaacagcagaacaaaagctagtattctttaactacttaaactgccacgaaagaataacagaagcaaaaattcgagaactattaaaactatcaaaagatagccggttaaacggacaactcaaaaatggcttaacgggaaataaaacatatagtcaaattgcatcatgctttggaaataaaataggagaatatgaacgattattcaaattcgaattagaagttatagaaagcgaaaaacttgaatatacataccaccccaaaagccacatacctgtcggtgaaaagagacgtaaatatatctcagaaaacgtcgaaaaagaaccatactaccgtctatggcatacaatctacagtattaaagataaagatgaatgtagagcagcactcatcaaaaattttggaatcgaggaggaaatagcagaaaaattggcaagtctcgacttcagtgcaggcggatttggaaacaaatgcgccaaagttatacgcaaaatcctaccgtatttaatggagggagacaaatataacgtcgctatggactatgcgggatataatcacagtttttctcaaacaaaagatgaaaacttacaaagagttctattagatagcatcaaccacttgcctaaaaatagcttaagacaaccaattgtagagaaaatattgaatcaaatgataaatttagtaaacgaagtaataaaacaatggggccgaccagacgaaatacgagtagaactagcaagaaaacttaaacaaagtaaaactgagagaaacgatgatgataattttatgagaaaaagagagagggagaacgaaattataaaagccgatctagccaaatatggactaaaagcaacaagaaataatgtaataaaatggagattatatcatgaaatcgatgataaagacaagaaactaaacgcaagatgcatttattgcggacaacctatcagcttaacagaggctatactcggaaataatgtagatgtagaacatataatacctaaagacaaactctttgacgacagccagagcaacaaaactctagctcacagaagttgtaacagtggaaaaggcaacaaaacagcatatgattttatgaaagacaaaccacaattcgaagaatacgttgctcgagtagaagaactatacaagaaacatcttataagccttacaaagaaaagaaaattcctcatgtcagaagataaaattccatcagactttatagacagacaattaagagagtcgcaatacattgcgaggaaatcaagagagatattacaaactgtctgtcgaaacgtttggtcaactgatggaggtgtaacagctcacctcagaaaattatggggatgggatgatgttacaatgaacctacagatgccgaaatataaaggaataggcatgacagaaatagtagaatgggaaagtaatcacggaaagaaccaacatacacaagaagtaataaaagactggtctaaaagagatgaccacagacatcatgcaattgacgctttggtggtagcgtgcaccagacaagggtatatacaacgaataaacacccttaattccagtgaaacaaaagacgagatgcataggaaggtagctggctctctagtagagtttaaccagaaacacaccttactaaacaaatacctcataacggaaaaaccattcacaacgtcagaagtagaagacgtggtaagtaaaattctcgtgagctttaaagcaggtaagaaagcagctacaccaggaaaaagaaaagtaggaaaacgaggaaacaaacaagtagtacaagacggaataataatacctagaggagcactccacgctgacagcgtaagtggaagcatcaaacaatacgacccaactgggaactttgaaaatcacaatgtaataaaatacaaagtcggagtaggaaaaggatacctctttgatggaaaggacgacaaaaagaaaatagataaaacaatagactgtattgtagacaagaaaataagggacctcataaaacaaagagcagaagaatcaaactacagcctaaagaaaatgtttgaaacgccgatactatttaatcaacgagcagtcttctcagtgaggtgcaaaacaggaaacaaagcggtagttccaattcggaacggctacgtagtacctgacaacaaccaccataccgcaatatataaatatgatggaggactaaaagaacagtgcgtatccctaatgcaagcaatcgaaagaaaacgatacaatctaccaataataatcaaaaacccaaaagaaatatatgataaaataaccgaaatagcgaacataaaccaattactattcgactccctcccgaaactagattgggaatttgtgactactcttcagaaaaacgacatgttcatactaggtatggactatagtgcaaccgaagaagcgctagcagacggaaactatagattactatcagaatatttatacaaagtccaaaacatatcagatggaatctacagactatgtcatcacacaataacgaagttcgatctatctaaggccaataagccagacaagcgcttctacaatatacaatcattaaaggcttggaatacacttaatcctcaaaaagttaaaataaatatcctaggacaaatagagagacaatga

SEQ ID NO: 8662 - RNA, 3501 nt, synthetic construct
  misc_feature 1..3501: note = Cas9 variant
  source 1..3501: mol_type = other RNA
atgcatgtcgaaatagattttccgcatttttccaggggagatagtcatttagctatgaacaaaaatgaaattctaagaggctcctcagtcctatacagattaggattagatctaggttcgaatagtcttggatggtttgtaacacatctagaaaaacgaggagatcgccacgaacctgtagcgttagggccaggaggggtacgaattttcccagatggacgagacccacaatcaggaacatcaaacgcagtagatagacgtatggcaagaggtgcaaggaaaagaagagatcgattcgtagaacgaaggaaagaattgatagccgccctcataaaatacaatctacttccggatgatgctagggaaaggagagcactagaagtacttgatccatatgcactacgaaaaactgcccttacagacaccttaccagcacatcatgtaggcagagccttgtttcatctaaaccaaagaagaggattccaaagtaatcgaaaaacagatagcaaacaaagtgaagatggcgcaatcaaacaagctgcatcgcgattagcaacagacaaaggaaacgaaacactaggagtatttttcgcagatatgcacttaagaaaatcatacgaggacaggcagacagcaatcagagcggaactcgtaagattaggtaaagatcatttgacagggaacgcacgaaagaaaatatgggcaaaagtacggaaacgactatttggcgatgaagtattaccacgagcagacgccccacatggcgtaagagctcgggccacaataacaggtactaaagcaagctatgattactatcccacccgtgatatgcttcgagacgaatttaatgcaatatgggcaggacaatcagcacatcacgctacgataactgatgaagcaagaacagaaatagaacatataatattttaccaaagacctttgaaaccagcaatcgtaggtaaatgtacattagatcccgcaacaaggccatttaaagaagaccctgaaggctatcgtgctccatggtcccatccactagcccaaaggtttagaatattatcagaggcaagaaatttagaaatcagagatacgggaaaaggaagtagacgacttacaaaagagcagtcagatctagtagtagcggctttgttagcaaaccgagaagttaaatttgacaaacttcgaactctgctaaaattaccagctgaagcaaggtttaacttggagtccgatcgacgggcggcattagacggagaccaaacagcagccagattatcggacaaaaagggatttaataaagcatggagaggatttccaccagaaaggcaaatcgcgatagtagcacgacttgaagaaacagaagatgagaacgaattaatagcctggttagaaaaagaatgtgctttagatggagccgcagcagctcgagtcgcaaacacaactttacccgatggccactgcaggcttggtttaagagcaattaaaaagatagtaccaatcatgcaagacggattagatgaagacggggttgccggcgcaggatatcatatagcagctaaacgagcaggctacgaccatgccaaactaccaaccggagaacagttgggaagacttccctattacggacaatggttacaagacgccgtagtaggaagtggtgacgccagagatcaaaaagaaaaacaatatggacagtttccgaatccaactgttcatatcggattaggacaactaagacgagtagtaaatgacttaattgataaatatggaccaccaacagaaataagtatagagttcacacgggcacttaaactaagtgaacaacaaaaggctgaaagacaaagagaacagagacgtaatcaagacaagaataaagccagagcagaagaactggcaaaatttggtcgaccagcaaatccacgaaatctactaaaaatgcgattatgggaagaactagcacacgatccactcgacagaaaatgcgtatatacaggggaacaaatatcaattgaaagactgctaagcgatgaagtggacatagatcatatattaccagtagcaatgacactagatgacagcccggcaaataaaattatatgtatgagatatgctaatagacataaacgaaaacaaactcctagtgaagcgtttgggagtagtccaacattacagggacataggtacaattgggatgacatcgcagcaagagcaactgggctaccaaggaacaaaaggtggaggtttgacgcaaatgctagagaagagttcgataaaagaggaggatttctagccagacaattaaacgaaaccggctggctagcaagattggcaaaacagtaccttggtgctgtaacggatcctaaccagatctgggtagtcccagggcggctcacatctatgctacgagggaaatggggcctaaacggacttcttccgtcagacaattatgctggtgttcaggataaagcagaagagttcttggcaagcaccgatgatatggaatttagtggcgtgaaaaatagagcagatcataggcatcatgccatcgatggactggtaacagctctaacagatcgaagtttactatggaagatggcgaatgcatacgatgaagaacatgaaaaattcgtaatagaaccaccttggccaacaatgcgagatgaccttaaagccgcattagagaaaatggtagtaagccataaaccggatcacggtatagaaggtaaactacacgaagatagtgcatatggttttgtaaaacctctagatgctacaggcttaaaagaagaagaagcaggaaatcttgtttaccgaaaagcaatagaaagtcttaacgaaaatgaagtggacagaataagagacatccagctcaggactatagtacgagaccacgttaacgtagagaaaacgaagggagttgcactagcagatgcactacgacaattacaagctccttccgatgattaccctcaatttaaacatggattaagacacgtgagaattttgaagaaagaaaaaggtgattacttagtacccattgccaatagagccagtggagtagcttataaggcttattcagcaggagaaaatttctgtgttgaagtatttgaaacagccggcggaaaatgggatggagaagcagtaagaagatttgatgcaaataagaaaaatgccggaccaaaaattgcacacgccccacagtggcgcgatgcaaacgaaggcgctaaattagtaatgcgtattcataaaggtgatttaataaggttagaccacgaaggcagggcgcgaataatggttgtacatagactggacgctgctgcagggaggtttaaacttgcagatcataatgaaacaggaaatcttgataaaagacatgcaacaaacaacgatatagatccatttagatggttgatggcaagttataatactttaaagaaactagcagctgtaccagtaagagttgatgaactgggaagagtgtggagagtaatgccaaactga

SEQ ID NO: 8663 - RNA, 3507 nt, synthetic construct
  misc_feature 1..3507: note = Cas9 variant
  source 1..3507: mol_type = other RNA
atggctagaccagcatttagggcacccagacgagaacatgtaaatggatggacgccagatccacatagaatatcgaagccattctttattttagtgtcatggcacttattatcccgagttgttatagattcatcaagtggttgttttcccggtacttcgcgggaccatacagacaaatttgcagaatgggaatgtgctgtacaaccgtataggttatcttttgacttaggtacaaattcaatcggctggggattattaaatttagaccgtcaaggtaaacctagagaaattagagcgcttggtagccgtatatttagcgacggacgcgaccctcaagacaaagcaagtttagccgtggcgagaaggttagcacgacaaatgagacgacgaagagacagatatctcaccaggaggacacgactaatgggggcgctagtaagatttggactaatgcccgcagaccctgcagcccgaaaacgccttgaagttgccgtagatccctatttggcaagagaaagagcaacacgagaaagactagaacctttcgaaattgggcgtgcattatttcatttaaatcaaagaaggggatacaaaccagtaagaacagccactaagcctgacgaggaagcaggaaaagttaaagaagctgtagagcgactagaagctgcaatagcagcagcgggtgccccaacccttggtgcgtggtttgcatggagaaagacaagaggagaaacattacgtgctcgacttgcaggcaaaggaaaagaagcagcatatcctttctacccagccaggagaatgctagaagcagaatttgatactctttgggcagaacaagcaaggcatcaccccgacctccttacagccgaggcaagagaaatcttacgacacaggatctttcatcaaagaccattgaaacctccaccagtaggaaggtgcacgttatatccagatgatggacgagcgccgagagcgttaccaagcgcgcaacgcctgcgactcttccaagaattagcttctctaagagtaatccatctagacctgagtgaacggccactaacccctgcagaaagagatagaatagttgcctttgttcaaggtagaccaccaaaggccggaagaaaacctggaaaagtccaaaaatcagtaccttttgaaaaacttcgtggattattagagttaccacctggtacaggattctccttagaaagcgacaaacgtcctgaacttttgggggacgaaacaggtgctcgtatagctcccgcatttggacccggttggactgccctaccattagaggaacaggatgccctagtagaattactattaacagaagcagagccagaacgggcaatagcagctctaaccgcaaggtgggccttggacgaagcaacagcagccaaattggcaggcgcaacgctaccagactttcacggaagatacggcagacgggcagttgcagaattattaccagtgttagaaagagagacaagaggagatccagatggaagagttaggccaataagactcgacgaagctgtgaaattactaagaggaggcaaagaccacagcgatttttcacgcgaaggagcattgttggatgctttaccctattatggagcagttctggaacgtcatgtcgctttcggcacgggaaatccagcggatccagaggagaaaagagtggggcgtgtagctaatccaacagtacatatagcacttaaccaattacgtcatctagtgaatgctatattagctagacatggcagaccggaagaaatcgtgatcgaattagcgcgtgatttaaaaaggtcagcagaagatcgacgtcgtgaagataaacgtcaagcagacaatcagaaaagaaacgaagaaagaaaacgattgattttaagtctaggagaaagaccaactcctagaaacttattaaaattacgattatgggaagaacaaggtcctgtagaaaacagaagatgtccttatagcggagaaacgatcagcatgcgaatgttgctttcggaacaagtagatatagatcatatattacctttttcagtcagcttagatgatagtgctgccaataaggtagtatgcctacgagaagctaatcgtataaaacgtaatcgaagtccatgggaagcgtttggccacgacagcgaaagatgggcaggaatattagctagagcagaagcgttgcccaaaaacaagagatggagatttgcaccagatgcattagaaaaattagaaggagaaggtggactgcgagcacgacatttaaatgatactaggcatttatcaagattagcagtcgaatatctgaggtgtgtctgtcctaaggtaagggttagtcccggcagactgacagcacttttacgacgaagatggggtatagacgcaattctagctgaagccgacggtccaccaccagaagttcctgcagaaactctagatccttcaccagcagagaaaaatagagcagaccacaggcaccatgcgctagacgcagtagtgattggatgtatagacaggtcaatggtgcagagggtgcaacttgcagctgcatctgcagaaagggaagccgcagctagggaagataatatacgaagagtgttagaagggttcaaagaagaaccatgggatggatttcgtgcagaactagagaggagagcaagaacaatagtagtgtcccacagaccagaacatggtataggaggagcactacacaaagaaacagcatatggacccgtagatcctccggaagagggatttaacttagtggtaagaaaacctatagatgggctaagtaaagatgaaataaattctgttagagatccacgacttagaagggcactaatagatcgactggcaattagaagaagggacgcaaacgacccggcgacggcacttgcaaaagccgctgaagatctagcagcacaaccagcgagtaggggtattagaagggtaagagtactaaagaaagaaagtaacccaattagagtagaacatggaggtaatccctctgggccaagatcaggtgggccatttcataaactgctattggctggggaagttcaccacgtagatgtagctcttagagcagacggacgaagatgggtaggacattgggtgaccttatttgaagcacacggagggagaggagcagatggtgccgctgcacccccgagattaggagacggagaacgtttccttatgagattacataaaggagattgcttaaaactagaacacaaaggaagagtaagagtaatgcaagtcgtcaaattagagccatccagtaattcagttgttgttgtcgaacctcaccaagttaaaacagatcggtcaaaacatgttaaaatcagttgtgatcaactacgagcacgtggagcgagacgagttacagtagatccattagggcgagtacgagtacacgctcctggagcaagagtaggaataggtggtgatgcaggccgtacagcaatggaaccagcagaagatatatcatga

SEQ ID NO: 8664 - RNA, 3513 nt, synthetic construct
  misc_feature 1..3513: note = Cas9 variant
  source 1..3513: mol_type = other RNA
atgagtaaatacaatgtcggactggatatcggaatagcaagtgtaggatggagcatagttgatgcagacaaaaaaaaaattatagacctaggttcaagaatattttcctccggcaatgcagcagcgaaccaggaaagaagaggctttcgaggaacacggagattaataaggcgaagaaaaaatagactaacagacgtaattaactttttcggtgaaaaaaaattcatagacaccaaagtagtagacaaaaacgggcacgtacattataaattttcagtaaacaatacagaatcaccatatgagctacgcgtgaagggactatcagagatattaaccaaacaagaactagtaatagcactataccatatagtcaaacataggggaataagctacgatttaggcgacttagaagatgatggcaccagtggggtaacagactacaaaacttcaataaatatcaatcgtcaactgctcaacgaaaaaacagtaggacaaatacaattagaaagactaaacgagtttggtaaagtcagaggacaggttgaagagaatgaaaacgttacattacttaatgtcttcccgagtgcagcttatgtaaaagaagcaacgcaaatcttaacaaaacaaagagaattctatccagagattacagacgactttatagccaaatttatgttattcataactaggaaaagagattactttgtcggaccaggaaacgaaaaatccagaacagactatgggatatataaaaaagacggaagaacattggacaacttatttgacgaactaatcgggattgacaaaataaatggagagaaacgagcaagcgccagcagtctaaccgcacagatatacaatatgctaaacgacctaaacaaccttacagtgcctaacacagaagatggaagattgacgatccaaactaaaaaagaaatattggaggcagcaaagacaacaaatggattattcggaatagcacaaatttgcaaaatcatagggtgcaaaaaagatgacataaaaggtttcagaatagacaagtcggaaaaaaaaatcatgcatacactatcaggttatagaaaattcagaaaagaactagccgatgtcaacatagaagcaaacgatttaaatataaatctggttaacaagatagccgatattctgacattaaacacagaaaaagcagaaattcgcaaacaattagacaaatccaacatggatatttctaacgaaatgaaggaaatagtaataaacaaaaataaagaatttctagtcgacggacgagcaacatggcatagtttctcttataaaacactgaacttattaataccagaactcctgaatacaccagaagaacagatgacaatcttaacacgtctagggcttgtaaaacctaataataaaaaatacgaaggtctaaaaaacataccagcaaggagaataacagaagaaatttataatccagtagtcgcaagagcaacaagagaagcagtaaacgtattcaatgccatcacaaaaaaagtcggacgagataatataaaagatgttataatcgaactaccaagagaagacaacgaagtagatataaaaaaaggaatagtaaaaagacaaaaacaaaacgaagtcgaaaaagaaaccgcagatgcgctagtaaaacaacatatgacaatatcagatagtgcgcttatagcccaatacagaaaaataagaggcctttctcaaaaagtacgatactggtaccaacaagacactatctgtccatattgtggcaaaaaaatagaagcagtacaattaataaacaataacgatagctttgaagtagatcacatagtaccaatatcagtatcttttgatgattcacaaaacaacaaagtactagtacacagccaatgcaaccaggcaaaagaaaaacaaacaccattaggatggttaaataatggaggaggcttcgggcaatcgaaagcagattacatcgcaagagtgaaatctaacaaaaactatgcaaaaaataagatcgataacttactaaatgaaacagaccttaatgacatagctactcaaagaggattcatacaaagaaatctgaatgacacgagatatgcgtcacgtatagtcttaaacgaattttactctttcttcagaagtaacaacttatcaacaaaagtcaaagtagtacgcggtaaatggacttctcaaatgcgaaaaaaatggaatggcgtcggaggtttatcaaaaacgagagatacttaccatcatcatgctatcgacgcttgcatcatagcctgctttccgttattaaaagcgttcgataaggcaataaaactaatagatgtcgatggtgaaacaggcgaaatattacaggataaaaaagcaataaaattggcacaggaagcagaaatagtcgaaaagatatcagtaataaaaaataaaaaatttgaaaatatggtaaacgaaatatacaacttcccgctattcaaacaagtagaattagctaatgatataacaaatctagaaaatccagtaaaattctcacaccacgttgacaagaaggcaaatagggccgtagcaaaccaaactatatacggcaccagaatcaaagaaaaagaagtgacaaaaaggggcaagaaagaaaaaattcaagaaagatacacattaggaacaattaaaaacatatatgatatagatggattcatgaacttcaagaaattatacgacaaaatctccaagaacgacgacgttaaatttcttatgcaaaaaaatgaccccaagacatgggaaaaactaatagacattttcaacagctatcctgatagtgaagaagtgacgcaagtagacggaaaagtaaaacgggtagcagtaagtccattcaaattatattacagggaaaatggttttataacaaaatattcaaaacataatgacggtccaaaagtagtaagtattaaatattacgacagtaaagtcggaagtcatatagacataactccaaaagacgcacgaaataaagtaattcttcaaagtttaaaaccatggcgtacggacgtatattttaattcaataacacaacaatatgagctattaggcttaaagtacagcgatctaaaatttacaaacggagtgtatggaattacaagagacgcctacgaaaaacttaaacacggagtttcggaagatggagtaacggcatggaagcctatatcaaaaaacagcgagttcagattcagtctttatagaaatgacagagtacgagtaatagacgaaaaaggagactcaatagagttattatttgcgtcaagaacgacatcaaacgaagggtatgtagaactgaaaccaatatataaagctaagttcgactcaaaagaagaagtaggattttacgggctcgtaagcaacggtaggttaatcaaaaaaatgagcaaaggcgggtataaactttataaagtaaatacagatatcctaggaaaaccatactatgtgacaagagaatctgatgaaccgaaattaagcctatga

SEQ ID NO: 8665 - RNA, 3516 nt, synthetic construct
  misc_feature 1..3516: note = Cas9 variant
  source 1..3516: mol_type = other RNA
atggcaaagtatagcgtcggactagacataggaatttctagcgttggatgggcaataatagatatagaaaccaaacaaatagtaaacctcggatctagaattttcccctcgggaaacgcagccggtaaccaagaacgaagaggattccgcggtatacgaagattaataagaagaagaaaaaatagactaactgacctcaaaaaactcctgggggaaacattcttttcagacttaaagaaaatcgacagtaacggatacgaatactacgacattgacttccaaataaacgccaatccctatgaactacgagttaaaggaataaccgaaaaactcagcaaaaaagaattagctgttgtcctacatcatataatcaaacacagaggaatatcctacgaccttggagacctcgaggacgatggaacatcaggcgtttcagattacaaaaacagtataaacattaataggcaactattgcgggaaaaaacagtcggacaaatacaattagaaagacttatagaatttaaccaagttcatggccaagtcaaaaaagcagaagacgtaagtttactaaacgtattcccatcatcagcctaccgggatgaagctaacaaaatcatgataaagcaacaggaattttatagcgaaataacaaattccttcatggaacaagttgatcagttagtgtctcgcaaaagagattatttcattggacctggaaatgaaaagtcaagaacagattatgggatatataagtctgacggcaggacacttgataacctattcgcagaactcataggtacagacaaaatcaatggtgaaaaacgcgcgtccgcatcttccctaacagcacaagtatacaatctattaaacgatttaaataatttacatgtatccaacaccgaagacggaaaactcacaacgtcaactaaaaaagagataatcaaagcagcgaaaaccactgatggagtcttcggaatatcacaaatttgcaaaatcataggatgtaaaaaagaagaaataactggtttcagacaagataaatctgaaaaaaaagtaatccacacactcgcaggatacagaaagattagaaaggcattagcaaccataaatatagaggctaatgagttgaaccctacagtcttcgatcaaatcgcagacatcctcacactcaataccgaaaaagcagaaatacgaaaacagttagacaaagtacaattagatatcacagacgaaatgaaagagcttgtaatagataaaaacaaagacttcctcgtggacggaagagcgacatggcactccttctcttatcaaactctgaatatgctaataccagaacttctaaataccagtgaagaacaaatgacaatattaacccgaatgggcttaatgaaatcagacaacgaaaaatacagaggtctcaaaaaaatcccagcagagaaaatagcatccgaaatattcaaccccgtcgtagccaaaagcacccgagaagcaataaaagtattcaacgcgatatcaaaagaaataggaaaaaacaatatagaacacgtagttatcgaattaccacgtgacgacaatgaagaagatgagaaacgaaaaatccaaaaactacaaaaagcaaacgaaacagaaaaagaagccgcagataatctagtgaaacataagctaggcataagcgattctgccctcatagcacactacagaaaattcaaaggcttatcacaaaaagtccgatactggtatcaacaagaaacctactgtccatattgcggaaaaataatagaagcaacacaactaataaacaacaacgataattttgaagtcgaccatatcatcccaataagtgtaagttacgacgacagccaaaacaataaagtactagtccattcacaatgcaatcaagcgaaagaaaaacaaacaccactcggatggatcaacaatggagggggtttcggccagtcaaaaaatgaatacaccaatcgagttaaaaataacaaaaaatacagcaaaaacaaagtcgacaacctactaaatgaaacagacttaacggacataatcacacaaagatcattcatacagcgaaaccttaacgacacaagatacgcagccagaacagtcctagacgaattctatagttttttcaaatccaacgatctcccaactaaagtaaaagttgtcagaggaaaatggacatcgcaaatgcgaagaaaatggaacaatgtaggaggtctaaggaaaacaagagatacacatcaccatcatgcaatcgacgcatctataatagcaagtttcccactactaagagcattcgatagagctataaaattaatcgacgttgataaagaaacaggcgaaatcgtacaatacggaaaagctagcttaaatggagacgtaatagaagaaaaatcagtgatacaagcacccataataaaaaatgaaaaattcgaaaagctagtagacgaaatatataattttcccctttttaaacaagttgaactagccaacaatatagaaaaccccgaaaatcctgttaaattctcacaccatgtcgacaaaaaagcaaatagaacagttgcaaatcaaacaatttactctacaagaataaaaaaaacagaaaaaatcgtacgaaaaaaagtaacagcaaaagaagaagaatacgtaataggaaccataaaagacatatacgacgtaaccaacttcgaaaaattcaaaaaattatacgatgaatcgtcaaaaaaagatgacataaaatttctaatgcaaaagaacgacccaaagacatgggaaaaactagtagagatcatgaacacgtatccagactacgaagaaatctcacaactagacggcaaagtaaaaagagtaaaagtaagcccatttaaactttattttcgagaaaacggatttataacgaaatacgcaaaacacaacaacggacctaaagtagtttccataaaatactatgatagtaaactaggaaatcacattgacatcacaccagtcaacgccaataacaaagtaatactgcaatccctcaaaccatggcgcactgatgtctactacaacaatgaaacacaacagtatgaactactgggattaaaatacagtgacctcaagttcactaaaggagtttacggcataaccagagaagcctatgaaaaattaaaatatggatacaccgacggagtaccagcctggaagcctatatctaaggaatcagagtttaaattcagcctatatcgaaacgacagagtgcgcatcattaacgaagcaggagaaaaaatagacctgctcttcggtagcagaaatgaaacatctgaaggatacgtagaaatgaagccaatattcaaaacaaacttcgatgacgcagaagaagcctcattctatggaaaaaccagcaacaaaaggctaataaaaaaaatggcccggaaaggttaccaaatctataaagtaaatacggatatccttggaaacctatactacacagcaaaagaatctaacgaaccgaaattagatctatga

SEQ ID NO: 8666 - RNA, 3519 nt, synthetic construct
  misc_feature 1..3519: note = Cas9 variant
  source 1..3519: mol_type = other RNA
atgaggaaaccgtactctattggattggacataggcactaactcagttggttgggcagtaataaccgatgactataaagtaccatcgaaaaaaatgcggatacaaggaacgacagacagaacgtccataaaaaaaaaccttataggagcactactctttgataacggagaaacggctgaagctacaagactcaaacgtacaacaagaagacgatacacacgccgaaaataccgaataaaagaattacaaaaaatatttagttccgaaatgaacgaattagacatagcattctttcctcgcctaagcgaaagcttcctggtaagcgatgataaagaattcgaaaatcaccccatcttcggaaatctaaaggacgaaataacataccacaacgattacccaacaatatatcacctaagacaaactctagccgactccgaccaaaaagccgacctacgactcatatacctggcattagcacacataataaaattccgaggacactttttaatagaaggcaatttagactctgaaaacacagatgtacatgtgctttttttaaacctcgtaaatatatataacaacctgtttgaagaagatatagtagaaactgcatcaatagacgcagagaaaatcttaacatccaaaacatccaaaagccgaaggctagaaaatttgatagcagaaatccccaaccaaaaaagaaacatgctattcggcaatttagtttcccttgcattaggtctaacacccaacttcaaaacaaacttcgaattattagaagacgccaaacttcaaatatcaaaagattcatacgaagaagacctagataatttattagcccaaataggtgaccaatatgcagatttattcatagcagcaaaaaaactttctgatgcaatactactatcggatataatcaccgtaaaaggagcttcaaccaaagcccctctttctgcaagtatggtacaacgctacgaagagcatcaacaagatctagcactcctcaaaaacttagtaaaaaaacaaatccctgaaaaatataaagaaatttttgacaataaagaaaaaaatggatatgcaggatacatcgatggaaaaacttctcaagaagaattctacaaatacataaaacccatcctcttaaaacttgacggcacagaaaaactaatctccaaactagaaagagaagacttcctcagaaaacaaagaacattcgacaacggtagcattccacaccagatacatctaaacgaattaaaagccataatacgaagacaagagaaattctatccattcttaaaagaaaaccaaaaaaaaatagaaaaattatttaccttcaaaatcccatactacgtcggtcccctagcaaacggtcaatcttcttttgcctggctaaaaagacaaagcaatgaaagcataacaccctggaattttgaagaagtcgtcgaccaggaagcaagcgcccgtgcatttatcgaacgaatgacaaattttgacacatatctcccagaagaaaaagtacttcccaaacattcacctttatatgagatgtttatggtttataacgaactaacaaaagtaaaatatcaaacagaaggaatgaaaagacctgttttcttaagttccgaagacaaagaggagatcgtaaacctcctattcaagaaagaacgaaaagtaacagttaaacaactaaaagaagaatacttctctaaaatgaaatgcttccacaccgtcaccatactaggggtcgaagatcgatttaacgctagtctaggaacataccatgacttactcaaaatatttaaagacaaggcatttctagacgatgaagcgaaccaggatatactcgaagaaattgtctggaccctaactttattcgaagatcaagcgatgatagaacgacggctcgtaaagtatgccgatgtatttgaaaaaagtgttctaaagaaactgaaaaaaagacattacaccggatggggaagattatcacaaaaactcataaatggaataaaagataaacaaacaggaaaaacaatactaggattcctcaaggatgacggagtcgcaaacagaaatttcatgcaattaataaacgactcctctttagacttcgccaaaataattaaaaatgaacaagaaaaaacaattaaaaacgaatctcttgaagagacaatagcaaatctcgctggctccccagcaataaaaaaaggaatcctgcaatctataaaaatagtcgatgaaattgtaaaaatcatgggacaaaacccagacaacatagttatagagatggccagagaaaatcaaagtacaatgcaaggtattaagaactcaagacaacgcctaaggaaactcgaggaagttcacaaaaatactggatcaaaaatactaaaagaatataatgttagtaatacacaactacaatcagataggctgtacctatacctactccaagacgggaaagacatgtatacgggcaaagagcttgattacgacaatttatcccagtacgacattgatcatataataccgcaatccttcataaaagacaattccatagacaatacagtattaacaacccaggcgtcgaatagaggaaaaagtgacaatgtcccaaacatagaaacagtcaataagatgaagtcattctggtacaaacaattaaaatcgggagctatatctcaaagaaaattcgaccatctaacaaaagcagaaagaggcgcattatcggactttgacaaagccggtttcattaaaaggcaattggttgaaacacggcaaataacaaagcacgtcgcacaaatattagactcaagatttaactcaaacctaacagaagactctaaatcaaataggaacgttaaaataatcacactaaagtctaaaatggtatctgattttagaaaagacttcggtttctacaaattaagggaagtcaatgactaccaccacgcacaagatgcatacttaaatgcagtggtaggaactgcattacttaagaaatatccaaagctggaagcggaattcgtatacggagattataagcactatgacttagcaaaattaatgatccagccagacagcagcctaggtaaagctacaactagaatgttcttttacagcaacctaatgaatttcttcaaaaaagaaataaagctcgcggacgacacaatattcacgcgaccacaaatagaagtcaacacagaaacaggagagatagtatgggataaagtaaaagacatgcaaactatcagaaaagtcatgtcttacccccaagttaacatcgttatgaaaaccgaggtacaaactggtggattttctaaagaatcaatatggccaaaaggtgatagtgacaagctaatcgcacgaaaaaaatcatgggacccaaaaaaatacggcggctttgacagcccaataatagcatactctgtactcgtagtagctaaaaactgcaaaagaaaaaatagtaaaacaaaaaactatcaacgaacctgcggtaacaaaaacaatggaacacgctga

SEQ ID NO: 8667 - RNA, 3522 nt, synthetic construct
  misc_feature 1..3522: note = Cas9 variant
  source 1..3522: mol_type = other RNA
atgcgcccaatagaaccatggatacttggtttagacattgggacagatagtttaggttgggcagtatttagttgtgaagaaaaaggacccccaaccgcaaaagaattactaggaggaggagtcagattatttgactctgggagagatgcaaaagaccacacgtctcgtcaagctgaaagaggtgcatttcgacgtgcgagacgacaaacaagaacatggccttggagacgggacagattaattgccttgttccaagcagccggattaacacctccagctgcagaaacaaggcaaatagcactcgccctacgacgtgaagctgtttcgcgaccactagcaccagatgcactatgggcagcacttctacatttagctcatcatagaggatttagatcaaatcgaatagacaaacgtgaaagagctgcagcaaaagcattagcgaaagcgaaacctgcaaaagctacagcaaaagcaacggctcctgctaaagaagcagacgatgaagccgggttctgggagggggctgaggcggcactaagacaacgaatggcagcaagtggtgctccaacagtcggagcactactagcagatgatttggatagaggtcaacctgtgagaatgagatataaccaaagtgaccgtgatggagtagtagctcccacacgggcattaatagcagaagaattagcagagattgtggcaagacaatcaagtgcatatccaggccttgattggcccgcagtaacaagattagtactagatcaacgacctctccgatcaaagggggcaggaccttgcgcctttttaccgggcgaagatcgagctttaagagcactaccaacggtacaagattttataataagacaaacactagcaaacctgagattaccatcgacaagcgctgacgaaccgagaccactaacagatgaagaacacgcgaaagcattagccctcctatcaacggcaagattcgtcgaatggccagctctgcgacgtgccctcggtttgaaacgcggagttaaattcacagcagaaactgagagaaatggagccaaacaagcggcacgaggaactgcgggaaacctcacggaggcaatacttgcaccattaataccaggatggagcggatgggacttagatagaaaagaccgagtatttagtgatttatgggccgctagacaagataggtcagcattacttgcattgataggggatccacgtggaccaacacgagtaacagaagatgaaacagcagaagctgtggctgatgcaattcagatagtgttacccactgggagagcttctttaagtgccaaagcagctagagcaatagcacaagcaatggcgccaggaattggttacgatgaagcagttacgttagcattaggcctacaccatagtcatagaccaagacaggaaaggctagcaagactaccatattatgctgctgctctaccagacgtaggcttagatggggatccggtgggacctccgcctgctgaagatgatggagctgcagctgaggcttactatggtagaattggaaacatcagtgtacatatagccttaaatgaaactagaaaaatagtcaacgcactcctacatcgacatgggcctatattacgattagtcatggttgaaaccacacgcgaactaaaagcgggtgcagatgaaagaaaaaggatgatagcagaacaagcagaaagagaacgagaaaacgcagaaattgacgtagaactacgaaaatcagatagatggatggctaatgctcgcgaaagaagacaacgtgtaagattagcacgaagacaaaataatctgtgtccctacacatcaactccaatcggtcacgctgatctattgggagacgcatatgatatcgatcacgttattccgctagcccggggaggacgagatagcttagataatatggtcttatgtcaatcggatgctaacaaaactaaaggagataaaacaccatgggaggcttttcacgataaacctggttggattgcgcaacgagatgactttttagcacgattagatccacaaaccgccaaagcactcgcatggagatttgcagatgacgcaggagaaagagtagcaagaaaaagtgctgaagacgaagatcaaggatttttacctagacaattaactgatacgggttatattgcaagagtagcattacgatatttatctctagtaacaaatgaaccaaatgcagtcgtagcaacgaatgggagattaactggactgctccggttagcttgggacattaccccggggccagcaccgagagatttacttccgactcctagagacgctttacgtgatgatactgcagccagaaggttcttagatggactgacccctcccccattagcaaaagcagtagaaggagcagtccaagcaaggctggcggctctcggaagatcaagagtagccgacgcaggtttagcagacgctctaggtcttacgctcgcatctttaggaggtggaggtaagaatagggctgatcatagacatcacttcatagatgcagcaatgatagccgttaccactagggggttaataaaccaaataaatcaagcaagtggagcaggaagaatattggatttaagaaagtggccccgcacgaattttgaacccccatatcctacatttagagcagaagtaatgaaacaatgggaccatatacatccatcaattagaccagctcatcgagacggaggtagcttgcacgcagccactgtattcggtgtcagaaaccgtccggacgcgagagttctagtacaaagaaaaccagtagaaaagttattcctagacgcaaatgctaagccattgcctgcggacaaaatagcggaaattattgatggctttgctagccctcgcatggcgaaaagatttaaagctctattagctcgctatcaagctgcacacccggaagtacctccagcattggcagctctcgcagtagccagagatccggcttttggaccaagaggaatgactgctaacactgttattgcaggtcgcagtgacggtgacggggaagatgccggcctgatcacaccatttcgtgcaaatcctaaagcagcagtaagaactatgggaaacgcagtctatgaagtttgggaaatccaggtaaagggtcgtccgagatggactcatcgtgtattaacacgattcgatcgaacacagccagcacctccaccaccaccagaaaatgcaaggctagttatgagattaagaagaggtgatctagtatattggccactagaatccggggatcgcctatttttagtaaagaaaatggctgtagacggacgactggcattatggccagcaagactagcaacaggaaaagcgactgcattgtatgcgcaattaagttgcccgaacataaatttgaatggggatcaaggatattgcgtacaatcagcagaagggataagaaaagagaaaattagaactacatcctgtacagctctcggaaggcttagacttagtaagaaagcaacatga

SEQ ID NO: 8668 - RNA, 3525 nt, synthetic construct
  misc_feature 1..3525: note = Cas9 variant
  source 1..3525: mol_type = other RNA
atgggaaaatattcaatcgggctagatattgggatctcgagtgtgggctggagcataatagatatcgaaaagaagaaaatagtagacctaggatcacgaatattcccatcaggcaacgcagctgcaaaccaagaccgaagaggctatagaggtacaagaagactaataagacgacgtaaaaatagattagctgatgtcataaattttctgggtgaagaaaatttcatagatactaaagtagtcgaccagaatggaaatatccactataaattattagtaaattcaacggaatcaccatacaaactaagagtaaaaggactatctaaaatgctaacaaaacaagaactcgtcatagcattataccacatagtaaaacacagaggaatatcatacgatttgggcgatctagaagacgacggcacatcaggtgtcactgactacaaaacttccataaacatcaacagacagctattaataaagaaaactgtaggacaaatccaacttgaacgtttaaaagagttcggaaaagtacgaggacatgtaaagaaagacgaaaacataacactattaaacgtatttccatcaagcgcatacgtcaaagaagccactcaaatacttacaaaacaacgtgaattttatcccgaaattacagacgatttcatcactaaattcataccttttatatcaagaaaacgggactattttgtaggcccaggaaatgaaaaatcacgaacagattatggaatatacaagaaagatggtcgaacgctcgacaatttattcgacgaacttataggtatagacaaaataagcggcgaaaaacgagcatccgcatcgtccgtcacagcacaaatatacaatatgcttaatgaccttaataaccttacagtcacaaataccgaagacggaaaactaacaacacagacaaaaagggagattatcgaagcggacaaaaccacaaacggcctattcggaatcacacaaatatgtaaaatcataggatgtaagaaagacgacataaaagggttcagaatagataaagtcgagaaaccaatcatgcacacattaagtggttatagacgattcagaaaagagttagcaaaaataaacatagaagccaatgatttagatataaatttagttaacaaaatagccgacattctaactttaaacaccgaaaaagccgaaatacgtaaacaactgaacaaatcaaacattgacgtatccaatgaaatcaaagaactaataataaacaaaaacaaagatttcctagtagatggcagagccacttggcattctttcagctacaaaacacttaatttacttatcccagagctaatgaatacatcagaggaacaaatcacaatactaacaagacttggcctagtaaaaagcaattcagagaaatataaaggactgaaaaatattccagcaagacggataaccgaaggaatttacaacccagtagtcgccaaagcaacaagagaagcagttaacgtatttaatgcaatagctaagaaaataggaagagataacattagcgatgtagtaattgagctaccacgtgaagataacgaagccgacataaagaaaggaatagtaaaaagacaaaaacaaaatgaactagaaaaagaggcagcagatgcattggtaaaacaacagatgacaatttcagatagtgcgctagtagcccactacagaaaagtcagagggctttcccaaaaagttagatactggtaccaacagggaacatgttgcccatattgtggtaaaaacatagaagcagtccaactaataaacaacaacgatagttttgaagtagaccacataatcccaataagtgtgagcttcgacgattcccaaaataacaaagtacttgtacattcacaatgtaatcaagcaaaaggaaaacagacacctttaggatggcttaacaacggaggaggatttggacagaacaaaactgaatacgtagcaaaagttaaaacaaacaaaaactacagcaaaaataaaatggataacttgttgaatgatatggatctatcagatatagttacacaaagaggatttatacaaagaaacttaaatgatacaagatacgcaagtagaatcgtattagacgagttctatagtttctttaaatcaaacaatctttcaactaaagtcaaaattgttcgaggtaaatggacaagccaaatgagaaagaaatggaacggagtcggtggcctgaagaaaacgcgagatacataccaccatcacgcaattgacgcatctataatcgcgagcttcccgctgctaaaagtgtttgacaaagcaatcaaactaatagacatcgacagagaaacaggggaaatacttcaagacaaagaagcaataaaaatgtcacaagaagcaaagctactagagaaaattccagtcatacaaaatgaaaaatttgaagaattaattaatgaattatatgacttcccattattcaaacaagtagaattagcaaacgacataacgaaccctgaaaacccagtaaagttcagccaccatgtcgataagaaagctaatcgctctgtagcaaatcaaaccatatacggtacaagaataaaggaaaaagaaataaataaaagaggaaaagtcgaaaaagtgcaagaaaggtacattctaggcacaatcaagaacatatacgatatagatagctttacatctttcaaaaagatttacgacaaaatgagcaaaacaggcgacgtaaaattcttaatgcaaaagaaagatccaaaaacttggggaaagctagtagaaatcttaaatagctatccggacagcgaagaaataacccaagtagacggaaaagtaaaacgagtaaaagtaagcccttttgagttgtaccgcagagaaaacgactttataacaaaatacgctaaacacaacgatggacctaaaatagtatccatcaaatactacgatagcaaaataggctcacatatagatataacaccgataaatgctaaaaacaaagtagtgctacaaagtctcaaaccatggagaactgacgtctacttcaactcagaaacaagacaatatgaattactcggacttaaatatagtgatctcaaatttacaaacggggtttacggcataacctccgaagcatacgaaaaattaaaacatggaatctcagaagacggaactaaaacctggaaaccaataggtaaaaacagcggattcagatttagtctttaccgaaataacagggtaaaaatagtagacgaaaaaggtgaatcattagaactactcttcgcaagtcgaacaacctcaaacgaaggttatgtcgaactaaaaccgatatataaaagcaaattcgactcaaaagaggacgtcggcttctatggacaaatgaccccgagtggacaattcgtaaagaaaatggctagagtagggtacaaactatacaaagtgaatacagacgtactggggaacccatattacattacaaaagaatctgacgatccagaactcagcctgtataagaaatga

SEQ ID NO: 8669 - RNA, 3528 nt, synthetic construct
  misc_feature 1..3528: note = Cas9 variant
  source 1..3528: mol_type = other RNA
atggaagaaatgaaacagacaggaaggaaaaatgaagctccaaaactaacggatttaaactatagaataggacttgatattggaatagctagtgtaggatgggctgtattagagaacaatagccatgacgaacctttccgaattatagatctcggggtaagaatatttgacacagcagaacaaccaaaaactggcgctagtctcgccttacctagaagagaggcacgatcagctagaagaagaataagacgaagaagggatagaatagagcgaataaagaaattgtttcaagcagaagggttaattaatatcgatgaatttgaagcgaggtataaaatagcaggcctaagtgatgtgtataaattaagatatgaaggactagatcgaaaactcacagatgatgaattagcacaagtactcctacatatagcaaaacatcgtggattcaaaagcacgtccaaggcagaagaagcagaaaatgagaatgatgcagcaaagaagaaagaagcaggagcgttaaagaaagggatttcaaataataagaaattaatggaagaaaaaggatacagaacagtaggagaaatgatgtacttagatgaaaactttcggaccgattgtccctggaatgaaaacggatatatactcactccaagaaacaaatcaggagactacaaacatactgtactaagagacatgctcgtagacgaagtaagagaaatcttcaaaagtcaacgatcactaggtaatatacatgcatcagaagaactagaaaatgcttatctagatataatgctatcacaaagatcgtttgacatgggaccaggagcacctagcaaatatgcaatggaagggtttgaagaccgagtaggcttatgtacattcgagggcaaaaatggagagaaaagagcagcaaaagcggcatatacaagtgagttatttgtggcgttagagaaaatcaatcatacaaaaatagtatcagacgatggagcaacgaggtttttaacaacttatgaaagaaaatcaataatcgaactaatgcataaacagcaaacagtaaaatatgcagcagtcaggaaagccatcggattggcagaagaggacaaattttataatctgaactactctcctaaagctggaagcaagaaaagcccagaagacacagactttgttaaactagaaaattatcacaaaattagaaaagccttaggagaagatatagtaagcgaacatttaccagcagagaaaataaaactatatgactctatagctaccatattaactctttttaaaaacgatgactctagaataaaaagatttatcgaactaggaataggcgaagaatgttttgacggacttctatcactttcgccaagtaaatttcacaacctgtcattagtcgcaatgggaaaaataattccgtttttgctagacggaaacacttatgacaaggcttgtgaactggcaggttatgactttaaagcggacaacaaaggggagaaaagcgtactgctcaaaggcaaaaatataaccgatatggtaaatgacataacaaacccagtcgtaaggagaagtgtgtcacagacaataaaagtaattaatgcaatcatattagaatatggaagcccccaagctgtcaatatagaacttgcacgggaaatgagtaaaaattttgatgaacgtcgtaaactaaaatcagatatggaaagcagagaaaaagaaaataacaatgttataaaaagagtcaaagaatacaaacttaatccgacaggtcaagatatcgtaaaattccgactttgggaggaacaagatagacgttgcctgtattcaggagaaaagatcgatattaacgaccttttctcaagagatggtggatatgatgtcgatcacatactaccgtacagcataacatttgacgacacatatagaaacaaagtattagtaaaagcaagcgaaaatagacagaaaggtaacagaacaccatatgaatacttcatggcggagaaagatgatgacgaatggaatgtatatgaaaccttagtgagaaacactgtcaaagactataaaaaggttttaaaattattaaagaaacatataactgaagatgaaaaatcagagttcagagaaagaaacttgaccgatacaaaatatataacccgtattatatacaatatgataagacaaaacctagtgttaaagccttatcttagtctagaaaaagaacgaaagaaacaagtaatggcagttaacggatcaatcacacattatctttcaaaaagatgggggctagaatcaaaagacagacgaacggacacacatcacgcacaggatgcggtagtaattgcttgcacaactgatggaatgatcaacaaaatctcaagatacagtaaaggacgtgaattattatactcacgaggatttaaatttgtggacgaggaaactggcgaaatattaagtagggacaactttactagagaggaatgggacgagaaatacggcgtaaaaatacccataccctgggaacattttcgagatgagcttgacatacgaatgagcagatataacggtaccggagacgacagtatcgataaaacaacaccaagagacttcatactctcacaccgagacgcacataaatggataaattatccagaatggatgttcgttgaaggaaggcccggtagaagaggagtattggatggaatatttgtgagtaggatgccaaagcataaagtgagtggacaagcacatgaggaaactgtaagatccgcaaaatattataatgatggaggaagtgtatttgaatcaggaggatatgtagtaacaaagaaaagcatacaagatataaaattaaaagatggagaaattaaagagttcttcaatcctgatagcgatcgtctgttatataatgcacttgtagatagactgaacaaatttgaaaatgatccaaagaaagcattcgccgaaccattttataaaccgaaagcagacggaacccaaggcccaatagtgaagaaaattaaagtttttgaaaaacaatcgagcggagtctttgtaagagatggaaaaggtatcgcagctaatggcgcaatggtaaggatagatgtattctgtgaagaagataaaggtaaaaagaaatactatttcgtaccaatatatacagcagatgtggttaaaaagaaattaccagacagggcagcgactgcaaacaaattaatttcagagtggagagtaatgaaagaagagaactttatattttctctttattcaagagatttaatttatatagaaagtgataaaggagtacaagtaaaagatattgatggtaaaataagtaaaccagtaaatttatttgcgtattatttaggagcagatacgtcaacagcatccataagtggtaaactacatgattcaagtgctaacttccgctctattggaatccaaggtttgcgtagatttgacaaatgtcaagtcgatgttttaggaaacattagctttgttaacaaagagaaaagaatgccattcaattga

SEQ ID NO: 8670 - RNA, 3531 nt, synthetic construct
  misc_feature 1..3531: note = Cas9 variant
  source 1..3531: mol_type = other RNA
atgaataaagtccaagaagattgttacaaaaaaattaaagagaaattagcagacagggaataccgcataggcctggatctcggcgttggctcaataggttacgctgtagtatcactaaaaggcgatatgccagaagatgtcatactggcaggatcccgcatatttaaatcgagtataggcgcggcagaaagaagacacttcagagcgcagagaaacacccatagacaccacagagaaagaatgcgttacctatggaaattattagcagaaaaaaatttagcactacaattgccagaaaatctgtctaaaaaggagaactttaccgactttgacacatcaagaaaacggttccctatagaagttctcagaaacgacccatacatcttaagatacaaagcactagatgaaaagctatcattgttccagctaggatatgctctataccacattgcaaaccatagaggaacagcaagtgtacgcagtttcttagaagacgacgaagccaaagtgaaagagaacaaagaaacagcaaaactagccaaaaatacaaaaaaaataatgtatgagaaaaaatacagaacattcggggagtacttatatagggaaagaattgaaaaatttcgacagaacgaaagaatgaaagtaacaaataaaaacgaaaataaagaattcgcagtcacccgcgatattatcgaaaaagaagtagaaatgatcctaggagcccaaaaacgctataatacagcagtcctagcagatgattacatagaaagaattaaaaaagccatcttctacgaaacggagaaattaataccagaaccagaatactgcccatactttaaagacgacaaaaggttacctagatctcataagcttaatgaataccgccgcatctacgaagcattgaacaacacccgatactatataccagaaatagaggaaaaaaccggcgaaatactaagtagaaaagaaaaagaacaactatcaaaagaagaaaaagaaaaattattcaattttctactaaaaaataaagaattaacagaagcaaaagtaaaaaaactcctaaatcttagcgaaatggcaaaagtacaattacaaggaagagacaaaaaaaatcaaaaaatcaaaggatatgcattaataactctagaatcgctaccattttggtcaaaactgccagaacaacaacaagacgaatttttgtacgactggaacaaactcccggatgaaaagctaaaagatcggctgagaaactactataaattaaccgacgacgaaatagatgaaacatttcagaacatagtgctaccaagtaattacgcaccactaggcaaaaaggcgatggaaatactactagagtacataaagaacggactaagttacatagaagccttagataaagcagcagacgaaaataaaataaaagtagaaaaacatgaaattaacgacttactcccatactatggaaaaatactccaagaaagtacgcaaatgccaatcggcaaggctttttctaaacaattcgctgcaaagaattataaaaaaccggacataaacaaaaacgaacaagaattcggacgaatagctaatccagtcgtccatcaaaccctcaatgaattaagaaaactaataaatgaaataataaccgtattcggaaaaaagccactagaaatttctttagaaacatcaagagaactaaagaaatcacagaaggaaagagaactaatagccaaacaacaggacatagatgaggaaaaaagaaaaaaaatatggaagacctacatagagccacatctacaacaaataaaatctagatcagataaattaaaaaaactgtttgtattcgaactatgggaagaccaaaaacacaactgcccattctgcttagaaaaaataaatgtagacgacatatactcaagaggagtagacaaagaacacctttttcctcttaaaaaaagtgaagacgattccgaaaacaatttagtaatagcacacaataagtgcaacgcgaggaaagcagaaagagctccattcgacgcattcggacatgaatcaatatggaatgacatattctctaacgcagaaaagaacttaccaagaaagctatggcgattcagacaaggatcattcgaaaaattcctagaaaaacctccaatgttgaaaagattcgaaacagacaattcctatataagtaaaataagtgcaagatatctagcatgcctattcgacaaaccatccaaaatattttgcgtaaaaccattcttaaccgcccaactgcgaatagcatggcaactagacgaaattatgatacgcctagcagaaaatatcatcttagatagcgaaaaggattcgtttaacaaaggaggtttacaaaagaaaaagagaattgacaatagacatcacgccttagacgcggttgtcatagcatatgcatcaagagggtaccataattttttaaatagggtccacgccaaaggttacaaaataaattacgatgaaaagacatggctatcagaaactctacgacccccaggaaataaaaatcttgaggactttaaatctggaataataaatgtaatgataaatgctaacatctcgatcaaacacgaccacaataacaagggacaattagtaaaatcgaaagcatataaactgtactattcagaaattggtaaatatataattactaccttaaaaagcgtcagcgaaatattattcaaacaaaaagagaaaccacaagacactttgagacgagcactatgcaaatttgaagacagactatcagatataaaagataaaaaactacgaaaaaaattagaagataatatcacaatctataaaagtatagaaaacgagtccgccctatccaaagcaaaacaggaactagaagagtttgacctaaaagccaaaaaagaaggcaaaaaaggatacgaaaagattactgacatactaatttacaaaaaagcatgctcaatgcatggaggtaaatacatccacgtcaaaaatagaatcgaaaataaattctttgcattaaaagagcctacggaaatagaaacaggctttggctatgataccgcagataacctgtctcttgacctatatcatgataacaatggaaaattatgcggagaagtaataaggaaaatagactttaacagaaacagagtacctaactataaaaaagaagggtatatcttactagaaagaatataccaaggagacaccctagaagtagacataagtgacgacaaaatctcgctaaaaaacaaggtcggaagcgcacctgataaaagaacattcgtaaaagtactaaccttcacagagagcgacagatacttaaaaaacaagcgcgaccaaatacaaatatttttctgcaatctacttaagagcacattaaaacatgacgacagctcaaaacatgatgattcattttatgttagctcaatgcagaaatataacgtccgaaaggtaatcctaacatcattaggaataataaagtacagatccaaaatcctcaaaaataaagaaatctga

SEQ ID NO: 8671 - RNA, 3531 nt, synthetic construct
  misc_feature 1..3531: note = Cas9 variant
  source 1..3531: mol_type = other RNA
atgttattccctaaaaaactcagtaaagaagaagtagcgtacgtcctcgtcgaaattaactctaaccttaataatagttccaattacctcggcaacatctcagacagaagcaaagaactatatttcaacaaacaaacaattggacaattcctatacaccaaattaaaagaagaccgacactattcactaaaaaacaaagttttttacagacaagactatctagacgaattcgaaagaatatgggaaacacaagctatctttcacaaagaactaactgaagacctaaaaaaacaaataagagatacaattatattttatcaacgccgattaaaaagccaaaaaggactgatctccctatgcgaatttgaaaataaagaaataaccatcgaaaaagaaggcaagactgtgacaaaacaaataggagtacgagttattcctaaatcatctcctctcttccaagaattcaaaatttggcaaatacttaataatgtcatctgcaaaaaaaaaggcactcgtaagaaaaaagcagtaacaccagctccacttctctttgaacttttcggtacaccgtctgagactttcttctcactggacatggaatgcaaacaactattattcgaagaactaaacctaaaaggcaacctgaaggcagacaaagtgataagactactaggatacataccccaggaatgggaaatcaactataaccaattagaaggaaaccgcacacaaaaaagtctctacgaagcctatttaaaaataatcgaaatcgaaggatatgacatcaaaacctttcttagaataaaaagcgacaaagaagactgggacctagaagaatcacccttatcggcaaaagaaatacgtgaaaatatacagcatatattcgaaaccttaggcatctcaacagcaattttatacttcgatgccacacttcccattaaagactttgaaaaacaagcatcttaccaactatggcatttactttattcttacgaatcagataactcccccagcggaaacgaaacactatacaaactactacaggacaaattcggattcaaaagagaacatgcagtatttcttagcaacattagtttccaggacgattatggaagcctgtcagcaaaagccataaggaaaatctatccttacataaaggaaaaccagtatagcacagcatgcgaattagctggatacagacattccaaactaagtctaacaaaagaagaactgaacaaccgccctttaaaagacctaatatcgcccctcaaaaaaaactcacttagaaacccagtagtagaaaaaggccttaatcaaatgataaacgttgtaaacgcactaatagaaaaaaattcagaaaaagacgctgaaggaaacataataaaatacttccacttcgatgaaataagaatagaactagctagagaattaaaaaaaaacgctcaagaaagagcagaaatgaccttaaacataaaaaatgcaactatagagcaagagaaaataaaatccatactaataagtgatttcggaattaaaaatcctacaaaaaatgacataactcgataccgtctataccaagagctagctcacaacgattataaagatctatatacaaacaccgacataccaaaagaactactattttcaaaaaacatcgatatcgaacacatagtaccgaaagctcgagttttcgatgactcattctcaaacaaaactttagcatatagagactttaacctaaaaaaaggagaaaatacagcgttcgacttcatagactcatctctaggtgaagaagaattaaaccagtacatagcaagagtagaaaacgctttcaagaccaaaaacattagcgcaacaaaatatagaaatcttctcaaaaaagcaacagaaattaacgacggttttataaatcgtgatttacgtgaaacccaatatatagcaaaaaaagccaaagatctactattccaaataacacgttctgttgtatccacaagcggaagtataacagatagattacgtgaagattggggtcttattgacataatgaaggaacttaacatgccaaaatatagggatctcggactaaccgaaatcatagagaggagagatggtcgcaaagttgaagtaatcaaagattggacaaaaagaaatgaccacagacaccatgcgatggacgcattaaccgtagcctttacaaaaccaagttacattcaatatctcaatcatctaaacgcaagaaaagacgaaaataataaattatatgccgacatactaggcatcgaaagaaaagaaaccacaaaaattcacgacgaaaacggaaatgaaaaaagggtattcattgaacctataccaggattcagacaaatagcaaagaaatacttggaagaaatattaatatcacacaaaacaaagaataaagtggtaacaaaatcaataaataaaatagccggaacaaacaagaaacaagaaaccctaaccccacgaggtcaactacacaaagaaaccatatatggaaaataccactactactcaaacaaagaagaaaaaatcggtaccaaatttgacaaagaaacaatatcaaaagtaagtaatcccatttatagatacgccttacagaaacgactcgaagccaatgaaaacaacccaaaaaaagcctttacaggaaaaaacgcactgtcaaaaaaccccatctacctagacgatgcaaaaacaaaaatcctacccgaaaaagtaaatttaatatacctcgaagaagacttttccataagaaaaaaaattgtctcagaaaacccaacatcaaaggaattcgttcctaactccatatccattgaaaaaattgtcgacgaaggaataaaaaggatacttaaagaaagactagaaacatataacaacgacccaaagaaagcatttgctgatttagacaaaaatccaatatggctaaataaagaaaaaggaataagcattaagagagttaccatcagcggagtaaaaaacactcaggcgctacactctaaaaaagatcacttgggaaaaccaatacttgataaagaaggacaagaaattcccgtagacttcgtatcaacagggaacaatcaccatgtggcgatctacagagaccaaaaagggaatctacaagaacaaattgtaagcttttttgaagctgtagtacgggctcaacaaggtttaccaatcatagacaagacctacaaacaagaagaaggctggcaattcttattcaccatgaaacagaacgaaatgttcgtatttcccaatgaaataaccggatttaatcccagcgagatagatttactcgacccaaaaaacaaaaagctcataagtcccaatttattcagggtacaaaaaataagcattaaagactacttttttaggcatcacttagaaacaaacgttgaaacaaacaacatactcaaagatattacatggaaaagaggaggattatcactactcaaaggaatcataaaggtccgaattaatcatttaggaaatatagtatctataggtgaatattga

SEQ ID NO: 8672 - RNA, 3534 nt, synthetic construct
  misc_feature 1..3534: note = Cas9 variant
  source 1..3534: mol_type = other RNA
atgaataaagtacaagaaattgaatataaaaaaatcaaggaaaaattagctgatagagaatacaggatcggattagatttaggtgtaggatcaataggctacgccgtcgtatcgctaaaaaagtatgatgatctgtcctatctcccagaagacatcatactagctggtagtagaattttcgcctcatcgataggagcagtagaaagaagagaattccgtctacaacgtaatagccacagacatcgacgagaaagaatgcgtttcttatggaaactattagctgaaaagcaactagcacttcaacctagcaaagacctcgaaaaaaaagaaaactcagcagactgtgaaacatctcaaaaacgatttccaataaacatactgaaaaacgatccctacattctcagatacaaggcattagatgaaaaactctcactctttcagttaggatacgtactctaccatgtagccaaccacagaggaacagactccataaggtcatttcttgaagatacagacgataaaatcaaagaaaacacaaaaactgcgaaacttgctacggaaacaaaaaagataattgacagcaaaaaatacagaacattcggggaatacctatacaaagaacgcatacaacagaatgaaagaaaaaaagtttcgaatcgaaaaacagcaggcaataaaaacaaagagtttgcagtcactcgagacatgatatttaaagaaacagaaaaaattctggcaagtcaaaaacaatactacacaaatgtactaacagacgaatatataaaggagatagaaggagcgatattttaccaaacagaaaaactaataccagaaagtggctactgtccctatttcaaagacgaaaaacgtctcccttgttcgcacaaattaaatgaatacagaagaatatatgaagcactcaataacgcccgatactctgcccccgtactagatgaaaaaacaggtgaaattctcagttaccaagaaggagaggaattctcaagtgaagaaaaaaaaatactattcgatgaagtactcctaaaaggtaaaaagttaacagaatcagaaattaaaaaactcctccatttacccgacggatgcgaaatacaactacaaggtagagacaagcgaacgcaaaaaataaaaggatacgcgttaacagccctagaagcacttccattttggtcaaaattaagccaacaacagcaagatgagttcctgtacgactggaacggtctcccagaagaaaaactcaaacccaaacttatagactgctacagtctcacagaaaacgaggtagatgaaacattccaaaaaataagactaccctctaattacgctcccgtaggtaaaaaagcaatggaaattctattaacatatataaaagatggatattcatacactgaagctctagacaaagcagtctccgaaggaaaattcaaagtggataaacaaaccactatctacgactctttaccatactacggcaaaatactccaagaaagtacacagaaactaatcggaaaagcattctcaaaacaattcgcaaaacgaaattacaagaaaccgaacaccaaccgaaatgagcgtgaattcggaaaaatcgcaaacccagtggtacatcaaagtttaaacgagctccgaaagttaataaatgaaataattacagtattcggaaaaaaacccttagagataggactcgaaactgccagagagttaaaaaaatcaagcaaggacagagagtctctagtgaaacaacaaaatgaaaacgaatataaccgaaataagatatacaaggattatgttgaaccacacctatcacaaataaaatctagacaagagaatcccagtcgatatatatttaagttcgaactttttgaagaacaaaaaagtatctgcccattctgtttaaaagagataaccccagacgacataataaactcaaaagtagacattgaacacatattcccaatagaagagtcagaagacgatgcaaaaaacaatctcgtaatagctcataacgaatgcaatgcggacaagggcaagaaaagcccattcgatgcctttggagacaaaacatcaggaaaatacgtatggaacgacatactacacaatgctaagaaaaatcttccacacaaaatatggagattttatcaaggatcattagaaaaatttcttgaaaacaaaccaatgttaaaaaggtttggaacagataattcatatattagcaaaatagctgcaaaatacttagcatgtctgttcaacaactcatctaaaattttctgcatcaaatcaagcctaaccgcacaactccgaatagcatgggaactgaactctataatgataccactagcaaaaaacatactgtctgaaaaggagttggaagagtttaaaacactaaaaaacaaaaaaatacgaatggacaaccgccaccatgcattagatgctataactattgcatacgcaaacagaggatatcataattttttaaacaaaatacatgccaaaggatacaaaatagattaccgcgaaaaaaattggctttctaaaatccttctaccaccgttaaatagagacttagaagattttaaaatctcagtcaaaaactcaatagaaaaagctaacgtatcaataaaacacgatcacaaaacaaatggatccctagtaaaaggaacagcatacaaggtatattactcaggaacgggcaaatacataatcacaacactaaaaaacgtagaagaaatatcattcaaagaaaaagaggatcctgaagacactttaagaagagctctctgcggcttcgaggacagtaacattaaagacgaaaaacttataaagaaattaaaatataattcagacttatacaagaaaattctaaacaccaaaccaaaagccaaacaagaattggaacaagcaaaccaagagaccaaagaagaaggtaaaaaaacccaaaaaatcacagatgtactcatttataaaaaagcctgcagcctagtaggagaacaatatatacaatgcgcaagcagattggaaaacaaattcttcgcagtaaaagaaccgactgaaataagaacaggaattggatacgatacaggagacaacctatttttagatttatattatgataagacaagaaaattatgcggcgaaatcataagaaaaattgacttcaatcaaaacaagattccaaactatcaaaaagagggatacatattattcgaaagaatatatcaaggcgacacattagaagcagatacatcagaagataaaataagccttaaaaataagacaggatcagccctagacaacagaactttcgtgaaagttctaacattcacagaatcagataaatacttcgatggaaagaaagacaagatacagatattctttggaaacttgctaaaatccaactacaaacaagacgattcattttatatatcctcaatgcaaaaatacaatgtgcgaaaagtaatactcacctctctcggaataatcaaatacagaagtcaaatactcaaaaacaaagaagtatga

SEQ ID NO: 8673 - RNA, 3540 nt, synthetic construct
  misc_feature 1..3540: note = Cas9 variant
  source 1..3540: mol_type = other RNA
atgtcaaagaaagtatcacgaagatatgaagaacaagcgcaggaaatttgccagagacttggttccagaccctattcaatcggactagatttaggggttggctcaatcggagtagcagtagcagcttatgatcccataaagaaacaaccaagcgacctagttttcgtatcatccaggatattcataccttccacgggtgcagctgagagaagacagaaaagaggacaaagaaattcattaagacatagagctaatagattaaaatttttatggaaactactagccgaaagaaacctcatgctgtcgtactcagaacaagatgtccctgatccagcgagattaagattcgaagacgcagtagtgagagcgaacccttatgaattacgtctaaaagggttaaatgaacaattgacactttccgaattaggatacgcgctataccatatagcaaatcatagaggatcatctagtgtaagaactttccttgacgaagaaaaatcaagcgatgataagaaacttgaagaacaacaagcaatgacagaacaactagccaaagaaaaagggataagcacgttcatagaagtgttaaccgcattcaacaccaacggtttaataggatacagaaatagcgagagtgtaaaatcaaaaggagtaccagtgccaacacgagatataattagtaatgagatcgatgttttactgcaaacacaaaaacagttctaccaagaaatactctcagatgaatattgcgatcgaatagtgtcagctatactattcgaaaatgagaaaatagtccccgaagccgggtgctgtccttactttccagatgaaaagaaactaccaagatgccactttctcaatgaagaaagaagactttgggaagcaataaataatgcaagaataaaaatgcccatgcaggagggagcagcaaaaaggtatcaatctgcatcattcagtgacgagcagcgccatatcttattccatattgcccgatcaggaacagatatcaccccaaagctagtacaaaaagaatttccagctttaaaaacctccatcatagtactacaaggaaaagaaaaagcaatacagaaaatagcaggcttcaggttcagacgtttagaagaaaaatctttctggaaaaggttatcagaagaacaaaaagacgatttcttttctgcatggacaaacacacccgatgacaaaagattatcaaaatatttaatgaaacaccttcttctaaccgaaaacgaagttgtagacgcgttaaaaacagtttcattaattggagattacggtccaattggaaaaactgcaacacaactactaatgaaacatctggaagacggactaacatatactgaggcacttgaaagaggaatggaaacaggcgagtttcaagaacttagcgtgtgggaacaacaatcgttactgccatattatggtcagatcctcactggatctacacaagccctcatgggaaaatactggcatagtgccttcaaagaaaagagagattcagaaggatttttcaaacccaatactaattcggatgaagaaaaatatgggaggatagcaaatccagttgtccatcaaacattaaacgaacttagaaaactgatgaatgaactaataacaatactgggagctaaaccacaggaaataacagtagaacttgctcgtgaactaaaagtcggtgcagagaaaagagaagatataattaaacaacaaactaaacaggaaaaagaagcagtactagcctattcaaaatattgtgaaccaaacaatctagacaaacgctatatagaaagattcagacttctagaagatcaggcatttgtatgtccatactgcttagaacatataagtgttgcagatatcgcagcaggtagagcagatgtcgatcacatttttcctagagacgacacagctgacaactcgtacggaaataaagtagtagcacacagacaatgtaatgacattaaaggaaaacgaactccatatgcagcatttagcaatacatcagcatggggaccgataatgcactacctagacgaaaccccaggaatgtggcgaaaacgacgaaaatttgaaaccaacgaagaagaatatgcaaaatacctacaatctaaaggatttgtcagcaggtttgaatcagataattcatatatagcaaaagcagcaaaagaatatctaagatgtctattcaatccaaacaatgtaactgccgtgggaagcctaaaaggaatggaaacgtccatcctaagaaaagcatggaacttacaaggaattgatgatcttttaggtagtagacactggtcaaaggacgccgacacaagcccaaccatgcgaaagaacagggacgacaaccgccatcacggattagatgcaatagttgccctctactgcagccgttcattagtacaaatgatcaacacaatgtccgaacaagggaagagagctgtagaaattgaagcaatgataccaatacctggttatgccagtgaaccaaatctaagtttcgaggcacaacgggaattattccgtaagaaaatcctagaatttatggatttgcacgcattcgtttcaatgaaaaccgataatgatgcaaatggggcattattaaaagatactgtatatagtatattaggagcagatacccaaggagaggacttagtatttgtagtaaagaagaaaataaaagacatcggagtcaaaataggcgattatgaagaagtagcctcggcaatacgaggaagaatcacagataaacaacctaaatggtatcctatggaaatgaaagacaagatagaacaattacaatctaaaaatgaagctgccctacaaaaatacaaggaaagtctagtacaagcagcagcagtcctcgaagaaagcaatcgtaaattgatagaaagcggcaaaaagccaatacaattatcagaaaagacaatcagcaagaaagcactggaacttgtaggaggttattactatttaatttcaaataacaaacgaacgaaaactttcgttgttaaagaaccaagtaatgaggtaaaaggtttcgcctttgatactggatcgaatctttgtttagatttctatcacgatgctcaaggaaaactatgtggtgaaataataagaaaaatacaagccatgaaccctagttataaacctgcatatatgaaacaaggatattctttatatgtacgtttatatcaaggtgatgtatgtgagttgagagcctcggatttgactgaagcagaatcaaacctagcaaaaaccacacatgtccgactaccaaatgcgaaaccaggaagaacattcgtgataattataacattcacagaaatgggttcgggttatcagatatatttttcaaatctagcaaaatctaagaaaggacaagatacatcgtttaccctaacaactatcaaaaattacgatgtgagaaaagtacaactaagttctgcaggtctagtaagatacgtatccccgttattagttgacaaaattgaaaaagacgaagttgctctttgcggagaatga

SEQ ID NO: 8674 - RNA, 3567 nt, synthetic construct
  misc_feature 1..3567: note = Cas9 variant
  source 1..3567: mol_type = other RNA
atgaaatatatcttagggttagatatcggagtatcatcagtaggaattgcagtaataagtgaagaaaatcagaagaaaacaatagaaaacttagcagtacgtatcgtacccgaggatcccgactttcatggcaaattctactcaggaaacaccgcaagcaaaaatttagaaaggacagcaaaaaggggaaatcggaaaaataatcaaagattcaaagcgagaagagataaactttatcaatcactaaaagaaaacaacatgttcccaacatccaacctcttcgatctatctgctgttgaattatatggcttaagagccaaagcagtcagcgaacaagtatcgttacaagagcttggaagaatcctaatattattaaatcaaagaaggggatttttgagcaaccggaaatccgtcagcgaagaaaattccactgagtacaaagaacgcatagcaggactcgaaaaagccttaggaaacaagacaataggacaaaaactatattcagaactccaagaaaacaacaatgtctttgaggtattgctacgagagagaacctatcaacgtagctcttatacagaagaatttgatcgaatatgggatgaacagaagaaatattacttaatattaacgggatcaagcaatgaagacgataataaaggaacattatacgatctaataagaaatagaatcatatattatcaaagaccactcaaatcacaaaaaggactaataagcgaatgtttatttgaaaagcaccacaaagccgtagctaaaagttcaccatattttgaacttttcagaatctggcagaaaataaacgatctatcatggaaaacaccaaatggtgaactatttaaacccacagatgaacaaaagcaaaaactcaaaaacgcactttggaacggagataacttaaatcctaaacataaactcacagtaagcaaaataaaagaaatccttggctatacttccagagagaaaatatacctaaactttacagaactggacggctctcgaacttactctatattaaggaacgccctaatcgaagcaggcattgaaaaaccagaacaatacttattctttaacatggaaacgaatgacgaaaaaggaggattatttgaactatggcacataacatactcattacccatagaaaaagaagtcattaacgctcttaaaaacaggttcggtttcgataagaaacaagcagaaataatagcacgaagagttggttacagtagcgattatggaagtttaagtacaagagcaatacgaaaattactcgtacatctggaaaaaggtttaggttacacagatgcctgcgacaacataggttacgaccactcaggctataaaactaaaatagacttacaaccaaagttaaaacaattaaaaagaaatgaattacgcaacccagtcgtcgaacaaatactaaaccaagtcgtaaatgctgtgaatttaattatagaaaaatacgggaagatcgacgagatcagagtagaactagccagagaattaagaaataatgcaaaaacaagaaagaatatcagcttactaaattctaaaaacaagaaaaataacgacatcatacgaaagaaattacaagaagaatacggatttaaattcgtaaatggaagagacgttacaagatacatcttatgggaagaaaattcaaaagaatgcctatattgcaataaaacaattaacggatcagacatgctcacaggtaacgcagacatagaacatatattaccgaaatcacgttcattcaacaacgctatgaataactacataataacacacagaaaatgcaactcagacaaaggacagaaaacagcatatgacttcatgagctcaaaaggtgaagttattctgcaacaatatatagaaaaagtaaatgatttatacaaagatggcaaaggaagcatatccaaaacaaaattcgaaaatttactttgtaaaggagaggacataccatcagatttcgtggaaagaatgaagaaagattcccaatacatagcaaaagaagccgtaaaaatgctcaaaacagtgtgtcctaatgtttatacaacaaccggtcaagtgactgactttctacgcgaagaatggaaacttaaaaacttattacaagaattaacatttgagaaatacaaagccataggccaagtgaaagagaaaattattaaaacaaacaacgggcaaacaaaaaccttcaaagtaatagcggactggagcaaacgagacgatcaccgacaccacgccattgacgccctaatatgcgccctgacagaccagaaaataattttcaaattaaataacctaaacaaaatctaccaatacgaacgaaacgcattgagccaaaaagaaattgaagaaattgaagagttccttgaaggaaaattttccataaaagagttctctgctcaacaagggaacattatcgaatgcagcataccaaacattcgtaaagacgcacaaaaacacctagaaaacatattaatatcattcaagaaagaaaactcaaaagtgcttactatgaaccggaatcaaccgaaaaattgcaaagaacaaattacgtgggtaccaagagcccgactacacgaagatacaataatggggcgtgttaaaagaataccagagaagaaaatgaaattaaatgacaaagtatcattcgaacagataaaaatgatagtaaatcccgaaataaaagaaatattattatacagactagctaaatttggtgataacccaaaagttgcttttgctacgaaagccttaaagaaagaacctattttctaccgcgaaaatgaactaaaagaagtgagtatatatgaatgggtaaacacaaaacgggtcgcactaaatgaaaatataacagatagtcaaatagagaaaataatagatcaagctagtaaacgagctgtgaaagaacgccttaacggaggaaaaatcaaagaagtattcaagaacctaacggaaaacccaatccaactcaaaaacggaatgatacttaaaaatgtaacagtgacagacgaatcaaaagtggaaaagattagaaatggctttgctataaccggtaaaaatcaccatgcattagtatacaaagacgaaaacggaaaatataacgataaagtcgtttcattttgggaagcagtagcgataggattacgaaacgtaaccgaatacggtaatccgtatccaataattaacagaaatcacaatgatgaattaggagagttctacttctcaatgcaaatcaatgacctttttgtctttgacctaaaacatagtgaaaatccacaggaagaaaatgaaataaacttcttcgacgtagaaaatcgcaaacaaataagcgacaaactttttagagtccagaaaatgtcaaagaaaagtaacggacagttcgtatcagacttcagacatcatctcgaaacaagcgtaataagaaacgacatgatactgaaaaacataacttggatctcaataagtaaaaactcagatttagaacgactaacaaaaatacgagtgaatcacttaggagaaataataaaagtaggagaatga

SEQ ID NO: 8675 - RNA, 3585 nt, synthetic construct
  misc_feature 1..3585: note = Cas9 variant
  source 1..3585: mol_type = other RNA
atggacttcacagcagatgtatctgaattgaacgagagctttatgcaaattcacacagaatctaaatttgaaatagatacagcaaaagttcaagaaataagtcaactgctactggacaacaaaataacaagaatggatcgacaaaaacaagtagcaaacgttttagcgaaaaacagtggcgataaagaagccgataaaataaacaagaaaatagcgactgaattttgcaaagcagtacttggaaacaaagcaaagttcaacgtaattctaggagaagacgccgtagacagcgattggagctttaaaatggacgatgaaaactcagacgaggaaattgaaattctaatgggtcaaacaaacggacaacaacaaaacgttctccgaataattcatcaatggtattcacaaataacattaaacgggatagtacctgacggacaaatgataagcgagtcaatgatagataaatacgaattacatcgaaaacatctactactactaaaacaacaaattaaagtaactaaagacaaaaagaaagcacaacagctacacgaggcttatgaacaatacgtgcacggcactggagccaaaaagaaacttacacaagacgacttctactctaaagtgacgaaaaatctagaaacaagtgacttttctgacgaaataaagaaacaaattaacgcagaaacattcatgcccaaacaacgtacctcggcaaacggtgtcatacctcatcaattacaccaacaagaactcgacaaaataattgaaaaacaagccaaatattaccccttcttagccgaactcaacccagacacaaaaaggcaaaacatcgcaaaatataaattagacgaacttatagcttttaaaatcccatactatgtcggaccattgataacaacagaagaccagaagaaaacatccggtaaatcgtttgcgtggatggtcagaaaagaacctggaaaaattacaccttggaattttgaccaaaaagtagacaaaatggctagcgctgatcaatttatacgacgaatgacaaccaaagattcttacctaatcaccgaagatgtactaccagcagagagcttaatataccaaaaatataaagtactcaatgaactcaatatgatacgtgtaaatggaaacaaattaacaaaacacgataaacaaaacatctaccaacaagtattcgaaaaatataaaaccgtaaacgttaagaaagtccaaaactacttcttaacggatggaagatatcaacacgcaccaaaaataacaggattatcagacgacaacaaattcaactccaacctgtctacatacatagactttaagaaaatctttcaagatgtagtagatgacccacaaaaacaaaaagactttgaacgaataattgaatggtcaactattttcgaagacagacacatatatgaagtcaaactaaaagaaatctcttggttaaacgacgaacaacgaaaagaacttaaaaagaaacgacatcaaggatggggtagactgtccgccaaactcctaacaggaatcttcgatgaaaacggatattcaataatggaccaactatggaacactcagaaaaattttatgcaaatacaagccgaagaaggattcaataagaaaatacaagcagaaaacagcaaacatctagagaaaaatgacttcgaagatatactagaagatgcttatacatctccgcaaaataagaaagcaataagacaagtaataaaagtggtggaagatatacagaaaacaatgggcacagcccctcagaaaattagcatcgagttcacaaggtccgccgacaaaaatcctagaaggtcgatagaaagacaacgacaattagaagaaatttactataacgacgcaaaagaaatagtttctgaaggaatgcaagataatttacaaaacttcaccgacaataaacaaaccctaacagacaaatacttcttatattttactcaattaggaatagacatgtacacagggaagaaaataaacatagatgaaatagggaactaccaaatagaccacattcttccacaagcgttcataaaagatgactccatcgataacaaagtcttggtctcaagcgccattaacaatggcaaatcagataacgtaccgctatcaatgtacgcttcagtcaggataaaaagtgaagtgcaaaacaaatggaaaaattttgcagaacatggactcataagccaacgaaaactaaacaatctgatgacagaccctgaaagcatcgataaatataaagccagaggattcatcaaacgacagctagttgaaacatcacaagtgattagacttgtagcagaaatattgaacgaaaaatatcaaggcgagacagaaatcatcgaggtacgcgcaaaaatgaactcacaactacgtaaagacttcgacttattgaaaaacagaaatgtaaatgattaccatcacgccttagatgcatacctaacaacatttataggcaattacttataccgaagatacccaaaacttagatcatacttcacatacggacacttcaagaaaattgacgatgcaaaacttaaacaattcaatttcctacatgatatagaaaacgacaaagacccaaaatatgtcaacgacaacggagagttattatgggacagagaaaaagacattgcatattttaagaaaatatacaacttcaaatacatgttagtatcacatgaagtatcaacacgacaaggcgccatgttcaaacaaacaatattcccagcagcagcggatgcaaaaagtaaacttattccaattaaaaacgataaaccaacagccatctatggcggttatacaaacaacaatgacgcatacctagcaattataaaactagcaaaaacaggacaatttaaagtagtgggagtaccacaacgagccatcgtcaaacttaaacaggcttatgataaagaaacaggagactattcaaatgtattatataaagttctagaacctaaattcgttaaaaagaaagtaaatcgaaaaacaggagaaattacataccaagttgaaaaatttaaaatagttgtaccaaaagtcccatacagacaacttgttattgacggagaccaaaaatttatgctaggaagttcaacatataaatacaatgcaaaacaactcgtactatcagaaaacgcaatcaaaattcttgataagaaatcattcgatcagagcggttataaatcaagtgatttagatacagtatacgatgaaatcttaagccaagtagatcgatatttttcaatgtatgataaaaacaaattcagagaaggcctacataatggaaagaaatatttccaaagattacccatgatcgacaatgtcgaaaaagggaaaataaaagaaaacggcaaattcaaactccttaacgaaatacttatcggattacatgctaatcctagcttcgggaatctcaaatcactaggaataagcaccccatttggtatgatgcaattcgcgagtggtatttcgctaagcgaaaacgcgatattatgttaccagtcccctaccggaatatttgaacgcagggtcgcactaaaagatctatga

SEQ ID NO: 8676 - RNA, 3588 nt, synthetic construct
  misc_feature 1..3588: note = Cas9 variant
  source 1..3588: mol_type = other RNA
atgcagaaaaatataaacacaaaacaaaatcatatatacataaaacaagcacaaaaaataaaagaaaaactaggtgacaaaccgtatcggataggactggacctaggggtcggatctattggattcgcgatagtctcgatggaagaaaatgacggaaacgtcctcttacccaaagaaataataatggtaggaagcagaatattcaaagcatccgctggtgccgccgacaggaaactttctaggggacagagaaacaaccacaggcacactagagaaagaatgagatatctttggaaagtcttagcagaacagaaactggcactccccgtaccagcagacctggaccgaaaagaaaactcgtccgaaggtgaaacatccgccaaaagattcctcggagacgtattacaaaaagatatttacgagctacgcgtaaaatcattagacgagagactgagccttcaagaactagggtacgtactataccacattgcaggccatcgaggtagttctgccatcagaacatttgaaaacgattctgaagaagcacaaaaggagaacacagaaaataagaaaatagccggaaacattaaaagattaatggctaaaaagaattaccgaacttatggagaatacctatataaagaatttttcgaaaataaagaaaaacataaaagggaaaaaattagcaatgcagccaacaatcataaattcagcccaacaagagatctagtaataaaagaagccgaagcaatactcaaaaaacaagcaggaaaagacggattccacaaagaactcacagaggaatacatagagaaacttacgaaagcaattggctacgagtcggaaaagttaatacctgaatcagggttttgcccctacttaaaagatgaaaagagactgcccgcttcccacaaattaaatgaagaaaggagactatgggaaaccctgaataacgcaagatacagcgatccaattgtagacattgtcacaggcgaaataacaggatattacgaaaaacaattcacaaaagaacaaaaacaaaaactcttcgactacctccttacaggctcagaacttactccagcacaaactaaaaaactgttaggactaaaaaacacaaacttcgaagacataatccttcaaggtcgagataaaaaagcccaaaaaataaaaggatataaactaatcaaattagaaagcatgcctttctgggccagattatctgaagctcaacaggatagctttttgtacgactggaacagctgtcctgatgagaaactattaacagaaaaattatcaaacgaatatcacttaaccgaagaagaaattgataacgcctttaacgaaatcgtcttatcatccagctacgctcctctagggaaaagcgcaatgctcataatattggaaaagataaagaatgacctttcatacactgaagcagtagaagaagctctaaaagaaggaaaactaacaaaggaaaaacaagcaataaaggacaggcttccatactatggagcagtactacaagaatcgacccaaaaaataatcgctaaagggttttccccacagttcaaagacaaaggttataaaacaccccatacgaataaatatgaattagaatacggaagaatagcaaatcctgtagtacaccaaacactaaacgaactacgaaagctagtaaacgaaataatcgacatattaggaaaaaaaccatgtgaaattggattagaaacggcacgagaactaaaaaaatcagccgaagatagatcaaaattatcgagagaacagaatgacaacgaatcaaaccgtaacagaatatacgaaatctacatacgcccacagcaacaggtaatcatcacaagacgcgagaacccaagaaactacatcctcaaatttgaactactagaagagcaaaaatcacaatgccctttctgcggaggacaaatcagtccaaatgatataataaacaatcaggctgacatagaacatttatttccaatagcagaatcagaagataacggaagaaacaacttagtaatatcccacagtgcatgtaatgcagacaaagctaaacgttcaccatgggctgctttcgcgtcagccgcaaaagactcaaaatacgattataatcgtatactgtcaaacgttaaagaaaacataccacacaaagcctggcgctttaatcaaggtgcattcgaaaaatttatagaaaacaaaccaatggcagcaagattcaaaactgataactcttatatatcgaaagtagcacacaaatatttagcctgcctgtttgaaaaaccaaatataatatgtgtaaaaggatcactcactgcacaacttcgcatggcatggggattgcaaggattaatgattccgttcgcaaaacaattaataacggagaaagaatccgaatcattcaataaagacgtcaattctaacaaaaaaattcgccttgataacagacaccacgctttggacgccatagtaatagcctacgcgagtagaggatacgggaatttattaaataaaatggcaggaaaagattataaaataaattattccgaaagaaattggctttcaaaaatacttttaccccccaacaatatagtatgggaaaacatagacgcagacttagaaagtttcgaatcctccgttaaaaccgcattaaaaaatgcattcataagcgtaaaacatgaccattctgataatggagaactagtaaagggaacaatgtacaaaatattctactcggaaagaggatatacactcacaacttataaaaaattaagcgctctaaaactaaccgaccctcaaaaaaaaaaaacaccaaaagacttcctagaaacagcgttattaaagtttaagggaagagagtcagaaatgaaaaacgaaaaaatcaaatcagctatcgaaaacaataaaagactcttcgatgttatacaagacaacttagaaaaagcgaaaaaactcctggaggaagaaaatgagaagtcaaaagcagaaggaaaaaaagaaaaaaacataaatgacgcctcgatttatcaaaaagcaatcagtttatccggcgacaaatatgtccaattatcaaaaaaagaacccggaaaattttttgcaatatcgaaacccacccctacaactaccggatatggatacgatacgggagattcactatgcgtagacttatattacgacaataaaggcaaattatgtggtgaaataattagaaaaattgacgcacaacaaaaaaatccattaaaatataaagaacaaggattcaccttattcgaaagaatttatggaggcgatattctagaagttgacttcgacatacattcagacaaaaactctttcaggaataacacgggaagtgcgcctgaaaacagagtatttataaaagtcggaacctttacagaaatcacaaataataacatacaaatctggttcggaaacataataaaatctacaggtggccaagacgatagctttactataaactcgatgcaacaatacaacccacgaaaactaatattatcgtcgtgtggattcatcaagtaccggtcaccaattttaaaaaacaaagagggatga

SEQ ID NO: 8677 - RNA, 3594 nt, synthetic construct
  misc_feature 1..3594: note = Cas9 variant
  source 1..3594: mol_type = other RNA
atgtcaaaacatgtactaggattagatctaggagtaggctcaataggatggtgtctaatcgccttagacgaacaggaccaacctgcagagatactaggaatgggctcaagaatagtccctctaacaacagacgacttaaacgaattttctcagggaaaggcaattagcaaaaatcagaaaaggactactcaaagaacaataagaaagggattggatcgttatcaactacgcagaaaggtacttagtgaaaaactagcaggacatggaatgctccccgataaagatttaatgcaattacccgtgcttgatttatgggaactacgagcgcgcgcagcatcaccgggagaaaaactatcattaccagaaatcgggagagttttataccacataaatcaaaagagaggatacaaacatgcgaaaagcgatgaagcagaagaagttactaaaagaggcaaggaacaagggtatgttgcaactgtcaaaggacgttacgcagagcttcaacgtgaaggagccaccgtcggacagcatttcgcgtgcaaactgaaagaacatagacaagaatcaccaagcggagggttcttctataactatcgaataaaagaccaggtctatccgcgtgaagcatacatagaagaatttgataggataatggaagtacaatctgtattctacccagaagtattaacaccagcgttcattcaagaattaagagataaggtaatattcttccaaaggccattgaaatcatgtaaaggtctagtatcattttgtgagttcgaaaaacaagaaagagtagttcaactcaaaagagtcaacagggaaggaaaagaggaactccaagaacgtaaaatcactatcggtccaaaagtagctccaaaatcctcgcccatagcccaactgtgtaaattatgggaaagtattcataacatcaggatatattatccagacggaaaagaacgccccataacattagaagagaaaagaaaattattagcatacttacaaacacatgataagttaacatttacggcactaaagaaagaattaaaaataagcgacaaagagagattgtggtgtgataaactgttaaaaggcggaataaaaggcgataccactagagtcttgctacgaaaagcattagcaggatacaaaagatacgaacccctcctaagaatggacctagaactacgagatttccaagaaatagtaagcggaaaaagactaataagaccaatcgtagatgagtcatacttgtcccaacccctttaccgtctctggcacattctatatagtatcgaggaaagagaagccatgcgacgcgcattaattgatcaacttggatttttagaagaagatctagacggaggtctactagacaaactataccagatcgatttcgctaaacaaggatattcaaataaatctgccaaattcatatgcaaattactacctcacctacaaggaggtcatgggtactcgcaagcatgtgaactagcaggtaaaagacactccgcaggaagccttacgaaggaagaattagaagaaagaccacttctagaacacattccactattacaatgtaatgaattaagacaaccaattgtcgagaaaatactgaatcaaatgattaatttggtaaatgcattaagacaaaaatatggaagtatagatgaagtgagagtagaattagcgcgagaactaaagatgagcagggaagaaagagaagaaacaagtaaaagaattagatcaagagaaaaagaaaacaaagaaattgcggagagaataaaagagtacgaactatacccaactaaatccagaatacaaaaatataggttatggcaagaagccggagaacaatgtctttattgcggaagaagtatagacgtagtccaattcctcagaggcgacggcgtcgaaatcgaacacataataccaaaatcgatactatatgatgacagtagcgcaaataaaacatgcgcatgttctcgatgcaacaaagataaaggtaatcgaacagcctatgaatacatattagccgaaggaagagaagcagaatacctagatagattagaaactttattccacgatggaaagttaagttattctaagagaagacgcctgcagtggaagaaagctgatattcccgttgatttcatagaacgacaactacgattgacacaatatatagcacgacaagcacaagaaatattaagacaaggaatcaggcgtgtcggagcaagcgaaggaagcgtaactgcaaaattaagacatctctgggggtacgacgatatactaagagaactaaactttgaaagatatcagagcatgggggaaacagaaattgtatcccaagaagaaaaagatggaagcattaccaaatcggaaagaataaaagactggtcaaaaagaaaagatcatagacaccacgccattgacgcacttgttgtggcatgcacaagacaaggatacatacaaaggttaaatagtcttaactcagaggaagacagtctgcaaatgcaagaagattcaaaacagatgcgtgagaaaatgggaggtcagaaaagacctacagcagataaacacagtatattagaaaattggcttattttacaaccccacttctcccaccaagaagtgaagtcaaaagtagcggaaatactcgtttcatttcgaccaggaaaaagaacagtttcgacaggaagaaacacttacctaagaagtggtaagaaagttacacaaagtggagtactaatcccaagaggaccattgtcagaagagagcctgtatgggcaaatactcagaaatggtgaacccacctatgtaaagaaagtggcacttgagagcctatcagaagcacagatcgaacaaatagtagacccaaaactaagacgagaaatggttgctagaacacaacctagcgaaggagctaaattaaatcctaaactactacttgccacaccattctattcagacgctgcaggtacacaacgcgtccgctcagtgagagtagcgatcgaaaatggtaaaaatagcatagtaccactgagatacaatgaatcaggaaaagcgataacattcgtaaacccaggaaacaaccatcatgtaggaatctataggacctctgaaggcaagctagttgaaagctgtgtgaccttttggcaagctgtggatagggtaagatacggtattccgactatcataagaaaaccaagagaagtattagatcagctactgctacgggacgacataccagaagcattattagcccatctcccagcatccgactgggagttcgtagaatatctacaagcaaacgaaatgtttctaattggactaacagacgaagaaatacaaacagccctggccgaaagcgatttacttacactgtcaaaccacttatacagagtacagaaaatgtcttctgaatattacgtattcagataccatttagaaacagaagttgctgataataaaaataatactggaataatccctaaattttataggctaagaggaccaaatgatacatatctgaaagctaacccacgcaaagtaaaagtaaatctgttaggagaaatcagtttaccatga

SEQ ID NO: 8678 - RNA, 3615 nt, synthetic construct
  misc_feature 1..3615: note = Cas9 variant
  source 1..3615: mol_type = other RNA
atggaaagaatactaggcattgacaccggtacaaactcattaggctgggcaatagtagataaagacgaaaatcaataccacttagtagcaaaaggaaccaatatattttcagaaggcgtaaaaatagaaaaaggaatagaaagcagtaaagcagcagaacgaacagaacatcgatcagtgcgtaaacactattggaggagaaaaataagaaaaatcagattgttaactatactttcagacaatgacctatgtccaagactaaaacatgaacagttacgtcaatggaggttaaagaaagtatacccaacagacgacacatttatggaatggcaaaggacagaggataaagcacaagtaaatccttacaaattccgatacatatgtctcacacaaaaattagacttatcagacattactcaacgattcatattaggtagggccctttatcacctaaaccagcgaaggggattcctatcaaacagaaaagaagccactaaagagagtgaaggaacagtgaaagaaggaatatcaagtttatcgaaagacatgaaagactcaggatgtgaataccttggagaatacttctatcaactttatcaacaaggaaagaaaatcagaaatcattacactgcaagaaaagaacactacttaaaagaatttaaagcaatctgttcgaaacaagaactagacgatgcactaatagaaaaactagaaaaagccatatttgaccaaagacccttaaaatcacaaaaaggtcaagtcgggacttgtacattcgaaaaaggaaaaagcagatgtccttcaagccatccgctatatgaagactttagaatgtactcatttataaataacataaaagtacaagtcgacactttatacgacaaaggagagagaagcctaacagatgaagagaaacaattaattattccccttttcaaaagaaaatcgaaaaggacattcccattcgaagacatagccaagaaaatagcaggcaaaaacaattattgctacataaaaagtaatgaagaaaaggcttataaatttaattatcaaatggacactcaagtttccggaagccctgttaatgcacaattggaggaaatcttcggagaagactggttatcaagcgtttgcgaagtatatactctagcaaataacaaaagtcgatttcaaataatgaatgatgtatggcacgtactattcttctatgacgatgaagacaaattgaaagaatttgctaaagatcgactacaactggacgacgaactagcagaaaaatttagtaaaataagtatccctaatgattatgcagcgctgagcctcaaagcaataaggaaaataatgccttatctacgagactacggtctaatatactccgaagcagtctttttagcaaacctggttgatgtactaccacaacatgtgtggggaatcaaagaaatgagagaggcagcaatagaaaatgtcatagacgtaatgcactcatacgacaaaaataacatagacggaattacactggagggatgcgtaaaaacattcttaaaagaacgataccaagtatcagatgacaacttaaagaaattatatcatccaagcatgctagatccatatccaagacaacgaccaaatgacgagggagtatttcaattaggatcaccaagaatttcatccgttaaaaacccaatggctatgcactctttatttagactccgaaaagtcgttaatctaatgttaaagaaaggatatataaccccagatactaaagtacacatagagttctcaagagatctcaacgatgctaataaaagatgggcaatccaaacatggcaaagagaaaatgaaaaagaacgagaaagatgtaggaaagaaatagaaaaatacatcgcgagccctagcgacactgatatactcaaatatcaactatgggaagaacaaaatcacaaatgtctttacacgggagacgaaataagaatcacagactttctcggagataatccaaaatatgacatagaacacacaatacctagatctgctggtggagattcaacgaaaatgaacctcacactatgttcaagtagattcaacagagacgagaaaaagacaaaattacccgcagagctagtaaaccacgatgaaatcctagaaagaatatcaaattggaaagaaaaatatgaagacatagacaaacaaatacgaaaaatatccaccaaaggagcaacaagtaaagaagacaaagactccaaaatccgaagacgccattatcttatactccaacgagactactggagaggtaaatatcaacgatttacaatgacagaagttccagaaggattttcacgacgccaaggtacggacataagcgtgatatcacgttacgccagaatgtacctaaaatcggtatttaaacaagtctatatagtaaaaggaattgccacttccgactttagaaaaatgtggggcatccaagacgaatatgcaaagaaagaaagagtcaatcatgtacatcactgtatcgatgccatcactattgcatgcataggaaaagcagaatacgataaacttgcagattataggcaccaatacgacgactacctcttccaaggtaaaacaaaaccaacatttgataaaccatggcctagctttgtaatagatatcaaacacattcaagacgaactactaatagctcactatgcaaaagacaatctagaaaaattcactaagaaaaacctaagaggtaaagacggacggataataagagacaaattcggcaataaactccaaatgaagggagatacttcaagaaactcattacataatgataaattttatggagctatcaatcatgagggagaaataaaatacgtatacagaacaaacattgaagctctcgatgctaaaagcattggcaacatagtagacccaacagtaagatcaataatagaaagcgcaatcgcaatacatggtagccttaaagctgcaataaataaaggaatatggatgaacgaagaaaaacatataccaatcaagaaagttcgagtatttagaaacgatgtcaagaaacctatagaattaaaagaccaacgagacttatcagataaagactataaacaacactattatgtaacgaatgatgggaattatatgatgctaatattcagtaaactaaacaacaaaggaagagaaatcagacaacatgtagttatcaattcacttgaagcaaccgaagtaatcaaatcccataaaaggtcccaagtaggaaaagtcgtctgggaatcctactactcaaaagaggggttcgatttaatatataaactaaaaagcggaacgatgatattactctacgagaataacagagatgaagtctgggatctagatatccgcaatttacaaaaacgattatatataattactaaaatgaaatatgacggccgaatttacatgatgcaccatcaggaagcaagagaaaagaaagatctagaagaaaaatctggatctttcaaaattaatgaagactacagacccttaatcgtaaactcttataatcaattcaatgcattagtgcaagacctagatttcgaaatcaatgacctcggagagatacgtcgactaatatga

SEQ ID NO: 8679 - RNA, 3630 nt, synthetic construct
  misc_feature 1..3630: note = Cas9 variant
  source 1..3630: mol_type = other RNA
atgaagaaagactatatattggggttggatataggaataagttcagtaggttgggggcttctagaactagatgataacaacaatccatacaaaataatagatgtcggcagccggatatttacaccgggcgaagttgaaaagacaggagatagtagggcgaaagaacgtagagaaaaacgcggtgcgagaagaatagcaagaagacgcgaatttcgactagacagagtcaaaaatttactatatgaaaatggatacttaaaaggtaatataaactctaacatagtatctgagaaaaacgaagaactatcaataatattcaataatatgataaacaattattacaacggtaaaaacacaaacccatatatactcaaagtagaagcactagacagaaaactaactgatgaggaactatctatcatattagtccactatgccaagaaaagaggctacaaaagcaacagagaagaagcaagcgacaaagaatcagggaaagtattaactgcaattaaagaaaacgagaaaataatgaaagacaataactacaggactataagcgaaatgtacataaaagatgataaatttaaaaataaaattaaaaactccccaaacgactataaaattagcgtaacaaacgaaatgtacttagaagaaataaataaagtcctagattcacaaataaaattcggactcattacagacgactttaaaaaccaatacctagaaatatataattcacggcgatcttacgccaaaggcccaggcggaaattccccatacggcggagatctaatagaacgaatgactggtaaatgtaacttcgatggcaatccaagagccccgaaacgagcgttcagcagcgaaatttatgtagcgctaacaaaacttgtcaatctaaaatacaaagtaaacgacggagaatatataaaattaagcgaaaaagaaatcaaaaacataatagaaaaagcaaaagaaaagaaatcaatatcttataaagacttaacaaaaatgataggtaataacattgatttcaaagaccttacactctccaagaaagaatatataaaattaatagaagaactcaaaaagaaactaaatatcaagaaagacacaaaaataaacatcaatgaactatccagtgaagataaagaactatataacaaattatgtaatgataaattgctatctaaaacactaatagaattaaaaggatatcacatcttaaaagattccgtaataaaagcgtatagtaaagacatctgggatgaagtcaaagataatatgtacttgctagatgacttggcactatactgtactaactacaaagtaaatgaagatatcttaaataaaatcaaagaaagcgaaaacatagacaacatatttaacgacatacacttcgttgaacttctgcctaatttcaaagaccatctaatgctttccacagaactaataagaaaactaatacctataatgtatggaggtaatacctacgacaaagcaatgaatatattaggttataaccactcagatattaacggagataaagagaagaaagacttattggtacctatatgcgtagacgacaacataacaaatcaacgagtaataagatcattaacacaaacacgcaaagtcataaactcaataattaagaaatacggtatgcccaaaatcataaatatagaaacagccagagaacttgccaaaagcaggcaagaaagaaacgaaatcgccaaaaataacgtagaaaagcaagcagaaaatgagaaaatcaaaaatcaattagtggaattaggcttatttgtcagcacagacaaaatatcatcaacagacctactaaaatataaactatggaaagaacaaaatgaattttgcggctactcaatgaagaaaatatcaatagaagacttatttggtaataacatagtccaaattgaccatatactaccatattcaagaacctacaatgacaactacttaaacaaaaccttagtatatacaaaggaaaaccaggaaaaaggaaacagaactccctacgaatggttcggtaaaacagacaaatgggatgaatatgaaacatatataaacaatctaacgattagtcagaagaagaaagataactaccttctaaagaaactagacttcgacacagaaagagaaatgagaagtcaaaatctaaacgataccaaatacataagcaaagaattgagttcactaatcaaagcatacttaaatgtggaaaaagttaacatgtatcctggagcaattacagccaaattaagagctagatggggatttaatagactaacacactcctatctttctaaaaactatatactacccaaaaacataaaagaagacataaacaaagacagagataatcatctacaccatgccatggacgcgctagtaatagcttccattacaccaagcctacaacagaaaattacgctgtacgaaaaattcagcagatacatagatgggctgacagaattacaaatcaaaaacatatcatatataaaaatagaggattcagaggggcaatactataacgacgacacagatgaagtagaaaccatagatatcagagagtacataaaacaacagcttgccgaaaataatatatactataacagacataacataagcaaactcgagttcccactaccatacgaaaactttgacaaagaagcaaaactgagagtctacgaacaagatctagatacgctcaaatggaatctaaaatcctacaatacatacacccaaaaagatatcgacaatgtacatacactcatcccatcaatagcaaaaaccaaagtctcaggcaagatgcacgaagagacctactatggaataaaagaaatagggaaagacgaagacaagaaaatatataaaaccctcagaacaccaatcgaaaaagtaaaacgaaaagatttagataacatacctgatagactaggaggctcaaaggatgtgtatgaaagtctagtagaatggtttggcgactatgaagtgggagaagaagtactaaaggccaatggaaacaaatacccagtcagcaaatcagacaaggaacacaaagaaattaagaaattaaaattatatagcgagtacaaaaacacaggacatatgataaacaaatctaacgtagaaaaaggaggaatataccgcatagatgtatttaaatccaaagacaaagaagatgacaaattatatttcgcagcatacgatatactcgaaattaaaaagataaacaccttaaaggagaaaaacagggtagacgataattttaatataaaactcgactacggccaaggcaaaaactccaaaatcatgagttacacagacataataaacaactatgacctatacatatctctaaataaaaacgacctaataaaaataaccacgaacgatggaaaagaatcagtcgcttacgtagttgggtgcagcagcggaatgctagaagtcaaaagtaaactaggagacggatatgacataatcaaaacagatctaaacgaaaataacatattctccaaacaaagagcacaatatcagattacagtaagtacaataaaagaaatcaagaaattatcaatttcagtactaggtgaaattagcggactatga

SEQ ID NO: 8680 - RNA, 3633 nt, synthetic construct
  misc_feature 1..3633: note = Cas9 variant
  source 1..3633: mol_type = other RNA
atgagaaccatccttggactagacctcggtactaatagcataggatgggcagtaataaattcggtgatcaaagaacaaacagaaagaatatggatagaaatggctggctcgagaataatacctatggatgcagcgatactgggagattttgacaaaggtaacagcatttcccaaacggcagaacgaacaagatttcgaggcgtcagacgactgagggaaagacaacttttaagaagagaacgtcttcataaagtactaaaaatcctcggattcctgccagagcactatctaaaaggaattgatttcgagaagcatacaggaaaatttctatccggtagtgaacctaaacttccatgggtaaaagacagatggggaaaatattcctttttattccaaacggcgtttaatgaaatgctagcagacttcgcaaaacaccaaccgtcattagtcttcgatggcaagaaaataccttatgattggaccgtgtactacctaaggaagaaagcattaaccgaaatgatatctaaagaagaactagcctggatactgctaaattttaatcagaaaaggggatactatcaacttaggggagaagaggaggaagataatgccggaaaatctgtagagttctatgccttaaaagttctatcagtagaagcaacagatgaaaagaaaggaagagacatatggtacaatgttcatcttgaaaatggatgggtatatagaaggagtagcaatgtacctctagactgggaaggaagagtaaaagaatttatagttacaactgacttaaaccccgatggcacaccaaaattagataaatatggagaagttaagcgaagtttcagggcaccgaaagaagatgattggatgctaataaagaaaagaacggaagcagacataactggaacccataaaaccataggtagctatatatatgacgctctcctacaagaaccccaacaaaagataattggaaaattagtaaaaacagtcgaaagaaagttctataaagaagaactgaattttatactacaaaaacaatgtgcatttcatgctgaactacaagatagagacttatatatgcgctgcatagaagcattatatcctggaaatgaagtacaacgaaggaatatcgcaaatagagatttcatatatttacttatagatgatgtcctcttctaccaaagacccctaaaaacaaagaaatcactcatcgcaaactgcccatatgaagaaaatgaatacgtaaacaggaaaacaggagaaataaaaacagcaccactaaaatgcatagcaaaaagtcaccctttatttcaagaatttagactatggtacttcttaagcaatataagagtataccaaaaagaaagagaagtgaacggaacattacatctcgacgtagatgtaacaacagagttcttaaaaactgaagatgactatgttgcactctttgactggttaaattcccgaaaagaaattgaccaaaaagcattcctacgctacccagcttttgggcttaaaaaggaaataaataactaccgatggaattacgtcgaagacaaattttacccctgtaatgaaaccagacatgcaatactctcacgactagaaaaagcaggaataggtatagactttctatcagacgaaaaggaaacagccctttggcacatactatactcggtaagcgataaacaagagatagaaaaagcattagctacttttgcagtgaaaaatggattaaatgagagctttgtcgaagtatttaagaaattcccaccattcaaaagcgaatatggcgcatatagtgctaaagcaatcaagaaactattaccacttatgagatgcggaaaatattgggacatgtccctaatagatggaacaacaaaagaaagaatcgaacgaataatagcaggggaatgcgacgagtctataggggcaaaagtaagggaaaaagcaatgaatttaagcgacatatcctgctttaaacgattacccctctggctagcctgttacgtagtatacaacaggcattcagaagacaaagaaatcaccaaatgggaaacaccagcagatattgatgcatatcttgcagctttcaaacaacacagtctaagaaatccaatagtcgaacaagtcattacggaaacgttgcgagtagttagagacatatggaaacaagtaggaaaaatagacgaaattagaatagagctaggtagagaaatgaaaaatccagccgacaaaaggaaacgaatgacaactcaaatattagaaaatgaaaatgcaaatttaagaataaaagccctgttagctgagttcgtcaatccagagtatggagtagaaaatgtgagaccatattcaccatcccaacaagaaattttaagaatttatgaagatgcagtactaaaaggtgaagaacaaataccggaagatatagatgtaatactcaagaaatttaacaccagtaaactgcctactaaaagtgagttcttgagatacaaactatggttagaacaaaaatacagatcaccatacacgggtgaattaataccgctagcaaaattatttacagcagcctatgaaattgaacatgttattcctcaaagcagatattttgatgatagcttttcaaacaaagtgatatgcgaaagcgcagtaaataaattaaaagataaccaactgggctatgagtttatcaagaatcatcatggacaaaaagtagaagtaggattcggaaaaacggtcgaaatattcagtgtcgatagttatgaaagattcgtcaaggaacaatatgcgaaaagcggcataaaaatgaagaaacttttaatggatgacatccccgaacaattcattgaacgacaattaaatgattcacgttacatatccaaagtagtaaaaggattactatcaaacatagtacgtgagaaaaacgactcgggcgaatatgaacctgaagcggttagtaaaaacattctagtttgcactggatcagtaacagatagactcaagaaagactggggcatgaatgacgtctggaactcgatagtaagcccacgattcgaaaggctcaatgcattaactgaaacgcaatgcttcggccactgggaaaataaagatggaaagaaagtatttcaaacagctgtaccattagaataccaaaaaggattttcaaagaaaagaatagatcatcgacaccatgcgatggatgcaatagtaatagcctgtgcaaccagaaatcatgtaaactacctaaataatgaaagtgcttctagaaatgctaaaatatccagatacgacttacaaaggctgttatgcgacaaatcgcgtggagatggtaacgggaactacaggtggataataaagaaaccatggacaacatttactcaagatgctcgtgaagcgctcagcggaataatcgtatccttaaaacaaaatctaagaataataaacaaaacaacaaatatataccaacattttgacgcaaatggtacaagagtctatgaaaaacagaaaataggagattcatgggctatcagaaaaccgatgcacaaagataccgtgttcggagcagtaaatctccgaaaagcacttattccccaacactacaatctcacactatttatatcgagctga

SEQ ID NO: 8681 - RNA, 3642 nt, synthetic construct
  misc_feature 1..3642: note = Cas9 variant
  source 1..3642: mol_type = other RNA
atggagaaaaggttagggatcgacgtaggcactaatagtttaggttgggcaattgttgaagtagatgacgaaggatgcacactgttagataggggagtagatatttttcaagaaggcgtagccagggagaaaaaccaagaaaaacctgccgtgcaagacagaacagacgcacgagcactacgaagacactactttagacggagacttagaaaaattgcgctgttaagagttttagtaagacacgatctatgcccggcattaagcgaagaacaattaaatgcatggcaaggaaaaggaatttatccgctagatgacgcattcatacgatggcaaagaacagatgataatgcagacaggaatccatatagagacaggttcaggtgccttactgaagagttagatttagcatgcagagaggaaagatacgttttgggacgagctttatatcatttatgtcaacgacgaggttttctgtcaaatagaaaagatgcaggaaacgaagccgaagaaggaaaagtgaagcaagaaatcaaaacgctaagcgcggatatggcagcagcgggttgcgaatatctaggggaatatttttacagattataccaaaggaaagaaaagataaggaaacactacaccgcaagaaatgaacattacttggcagaatttcgagcgatatgccgaaagcaacgactcgacgaggaattgcgacaagcgctcgaaaaagctatcttctaccaacgtccgctcaaaagccaaaaaggattagttggtaaatgtacgtttgaaaaggacaagtcaagatgtcccgtatcgcatccgagatttgaggaatttagaatgttacaattcataaataatgtaagggttacaggaccgggggatgccgaaccaagacccttgtcaccagaagaagttgaaatcgtaagacctttgtttctaaggaaaagcaaaccacattttgactttgaagatatagctaaaaagatcgcaggaaaaggtaactacgcttgtcgaggcgagcttttgcaagcaccatatagatttaactgtgcagggaaatcaacagtaactggatccccagtatcagctctgttcgcatctgtttttggagatgattggcaaagagaaatctgcagcctatacacactaggagcgggcaaaaatgaagaacaaatcctaaacgacgtttggcatgttctgtttgcttttgaagacgaggagaggttacaagcatggttacaagaaaaactacaattaagcgcagacgatgccaagactctagctgcttttcgactaccgcaaggatacgctagtttatccttaaatgtaataaacaaaatactaccctatttacgaagaggatacaggtatgacgaagcagtattctttgcaaacctcggcaaagtattgccagcagaagtgtatgctgatccagcgagaagaagagaggtagaacaaggaataagcgcacaaatggatgatctaggggacggagagaaaaccaggaaagaagaaagaatacgagattatctaagaagatattggggtgtagaagagaaaagattggaaagactataccatccatctatgatagaagcctatcctagtgcatcaccaaatggccaagggttattacaactaggaagtccaagaataccagctgtacgaaatccgatggcaatgcgagcactttttagattaagagtattattaaacgaattgttaagagaaggcaaaatagatcgaggtacaaagataaacatcgaactagcacgcgaattaaacgacgctaataaaaggaaagctatcgaaagatatcaacgtgaaagagaagcagaaaacagaaaatatgcagaagaaataagacagcagtacgtagaagcgacaggtcattcgatagaacctagtgaagaagatatattaaaatatagattatgggtagaacaaggacattgtagcctgtatacaggtaagaccattggtatatcagaatttttgggtgacggacgaagatacgatattgaacatacagtaccaagaagcagaggaggtgaagacgcgcaatacaataaaacactatgcgaggaagaatttaacagagacataaaaagagacaaactaccaagtgaactagcgaatcatacggctattctagcttgtgtcgaaagctgtggatggttcgaacgcatagaaggattggaacacagagtctggggagcggacagacgagcaaaatcagctacaacaaaatcagcaaaagactttgctatacaagacagacattactggagaatgcatctagactattggcgacgtaaatgtgaagcatttactatgacagaagtaccagaaggtttttcaaacagacaaggtgtagacgttggcataatcggaagatatgctagactatacctccaaacagtttttgatagagtatatacggtaaagggagcgacaacagcggcattcagaagaatgtgggggctacaagaagaatatgctgccaaggaacgcgtaaaccatgtgcatcattgtatcgatgctataacaattgcgtgcataggttctcgggagtatgcattatgggcgcagtacgtaagacaagatgagttataccgttggggagaagcggacaaaccacgatgcgggaaaccttggccaacatttacggaagatgtaagagccaccgcagatgaacttttaatatcacatcacacaccagacaatatgccaaaacaatcaaggaaaagattaagagtgagaggaaaagttcaaagaaatgacaggggagaagtgaaatatatgcaaggcgatacagcaagaggcgctttacaccaacaaactttctacggtgcgatagagagagatggagagattagatatgtagtgaggaaatcgctagatcaattgctcccagcggatgttgagaaaatagtagatgaagccgtaagacaaaaagtcagagaagcagttgaagcatacggattcaaagaagcgacggacccaactaagcacactgtatggatgaacgaagaaaagcagatcccaataagaaaagtaagaatattgactggcgtcaagaatccgatattactaaaaccccatagagatgttagtgtaaaggaatacaaaagatactaccatgtagtcaacgacggtaattactgtatggcaatttacgaaggaagagataggcaaggaagattaaaacgaacattcgaaatcgtaaacaaactcgaagctgctagatatttcaaacgaagtgccgatagagaaagcagaccagatttagtaccactatccgatgtaaacggatattctctaaaatatttgttaaaaactggaacaatggtacttttctatgaaaacagcccggatgaactgtacgaatgctctgtaggtgaactcgctaaaagattatataaagtagtaggaatggcacaagatggaagggttcaattcctctttcaccaagaagctcgagatcaaaaagcagtaacggcagaatgcgggatgggaataagtgtatttgacgcacgtcatccggcaccaaaactaagaatcagagtcagtaacttcaaaatgtttgtcgaaggatatgatttcgaattaacagtaactggggaggttaaatttaaacggtga

SEQ ID NO: 8682 - RNA, 3642 nt, synthetic construct
  misc_feature 1..3642: note = Cas9 variant
  source 1..3642: mol_type = other RNA
atggaaaaacgtctaggaatagatgtgggaacaaacagcttaggttgggctattgtagaagtcgacgacgaaggatgtaccttattagaccgtggagtagacatattccaagaaggagtagcaagagagaaaaaccaggaaaagccggcagtgcaagatagaacagacgcaagagcgctaagaagacattatttcagaaggaggttacgaaaaatagcactattaagagttctagtccggcatgatttatgcccagcactatcggaagaacaattgaacgcatggcaaggaaagggaatttacccgttggatgacgcatttatcagatggcagcggacagacgataatgcagatagaaacccatacagagaccgattcagatgtcttacagaagaactagatttggcatgtagagaagaacgttatgttttggggcgcgcattataccacttatgtcaacgaagaggatttctgagtaacagaaaggatgccggaaatgaggccgaagaaggtaaggtaaaacaagagattaaaaccttatcggcagatatggcggcagcaggttgcgagtacctgggagaatatttttatcggctgtatcaacgtaaagagaaaattcgaaaacactacacggctagaaacgaacactacctagcagaatttagggctatatgtcgaaaacaacgcttagatgaagaactaagacaagcacttgaaaaagcaatattctaccaaagaccacttaaatcacagaaagggttggtcggaaaatgtacatttgaaaaagacaaatcaagatgtccagtaagtcacccaagattcgaagagtttagaatgctgcaatttataaacaatgtcagagtaaccggaccaggtgacgcagaaccgaggcctttgagtcccgaagaagtagaaatagtaagacccctatttctccgaaaatctaaactacactttgacttcgaggatatagctaagaaaatagcgggtaaagggaactatgcgtgtcgcggtgaattattacaagcaccatacagatttaactgtgcaggaaaatcaaccgtaaccggatcacctgtttccgccttatttgcaagcgtctttggagacgactggcaaagagaaatatgcagtctttacacgcttggagccgggaaaaatgaggaacaaatcctaaatgatgtatggcacgtgttatttgcttttgaggatgaagaacgattacaaacttggctacaagaaaaattacaattatctgccgacgatgcgaaaacattagcagcttttagactaccccagggatatgcatctttaagtttaaatgtaataaataaaatactaccatatctcaggagaggatataggtatgatgaagcagtattctttgcaaacttgggcaaagtgcttccagcggaagtatatgctgaccctgcgagaagaagagaagttgaacaaggcataagcgcacaaatggacgatttgggagatggagaacagacacggaaagaagaaagaattagggactacttaagaagatactggggagtggaagaaaaacgtcttgaaagactataccacccaagcatgatagaagcatatccctccgcaagcccgaacggacaaggactattacaacttggttcaccgagaatacccgcagttaggaatccgatggcgatgagagcattatttcgattgagggttttattaaatgaattattaagggaaggaaaaatagatagaggcacaaaaattaacatagagctagccagagaactaaacgatgcaaacaaacgcaaagctattgaacgttatcaaagagagagagaagcagaaaataggaaatacgcagaagaaatacgacaacaatacgtagaagcaacaggacacagtatagagccatcagaggaagatatcctaaaatatcggctctgggtagagcaaggacactgttcgttatatactggaaaaacaataggaatttcagagttcctaggagatggtcgaagatacgatatagaacacaccgttcctcgaagtagaggcggcgaagatgcacaatataataaaactctatgtgaagaagagttcaatagagatatcaagcgagacaaactcccctcagaactagctaaccatacagcaatattagcatgcgtagaatcttgcggttggtttgaaagaattgaaggattagaacaccgtgtatggggagcggatcgtagagctaagtcagcaaccaccaaatccgcaaaagactttgcaatacaagatagacattattggagaatgcacttggattattggagaagaaaatgtgaagcatttacaatgacagaagtacccgaaggattttcaaatcgtcaaggagtagatgtgggaattatcggaagatatgcaagattgtatctacaaaccgtttttgaccgagtatatacagtaaaaggagcaacaactgcagcatttagacgtatgtggggattacaagaagaatatgcagcaaaggaaagagtgaaccacgtacatcattgtatcgacgcgataacaatagcgtgcataggaagcagggaatatgcactgtgggctcaatatgtaagacaagacgaactttatagaagaggagaagcagataaaccacgatgcggtaaaccatggccaacattcacagaagacgtaagagctaccgcagatgaactgttaataagccaccacactcccgataacatgccaaaacaatcgagaaaaagactccgcgtaagaggtaaagtccaaagaaatgacagaggggaagttaaatatatgcaaggagatacagctaggggagcattacatcaacagacattttacggcgccattgaaagagacggagaaatcagatatgtagtacgcaaatcactagaccaattattaccagcagacgtagaaaagatagtggacgaagcggttaggcaaaaagtcagagaggctgtagaggcgtatggctttaaagaagctacagaccccacgaaacatacagtatggatgaatgaagaaaaacaaataccaattcgcaaggtaagaatactaaccggagttaaaaacccgatattactaaagccgcatcgagacgttagcgtaaaagaatacaaaagatattaccatgtagtaaatgacggtaactattgcatggccatatatgaaggacgggacagacagggaaggcttaaacgaacattcgaaatagttaataaattagaggctgctcgatacttcaaaagatctgccgatagagagagcagacccgatttagtacccttgtctgacgtgaatggatatagcttaaaatatttattaaagactggaactatggtattattttacgaaaactcacccgatgaactgtacgaatgtagtgttggtgaattagcaaaacgactttataaagtagttggcatggcgcaagatgggagagtacaattcttatttcatcaagaagcgagagatcaaaaagcagtcacagctgaatgcggaatggggataagtgtttttgacgcaagacatccagcgcccaagttaagaataagagtttcgaactttaaaatgttcgtagaaggttatgatttcgaattaacagtaactggtgaagtaaaatttaagaggtga

SEQ ID NO: 8683 - RNA, 3651 nt, synthetic construct
  misc_feature 1..3651: note = Cas9 variant
  source 1..3651: mol_type = other RNA
atgaccaaaatcctaggaatagatacgggaacaaactcactaggatgggcaatagtagataaaaccgcagacaattataatctattagacaaaggagtaaatattttccaagaaggagttaaaatagaaaaaggtatagaatcatcaaaagcagcagaaagaacagaacatagagcaaccagggtcagatactatagaataaaactaagaaaaataagactacttagaatactatctgataaccatttatgtcccccactatcacaagaagaactatcaacctggcgcttaaagaaagtctatcctaaaaacgaactatttatgcaatggcaacgaactgacgatgacacggagaaaacaccatatgcataccgacataaatgcatacatgaaaaactagatttgtcagatgttacggacagatacatactcggcagagcattctaccatattattcaaagaaggggatttctctctaacagaaaagaacaaggaggtgaggacagtggtaaagtcaaagaaggaatctccacactaacacatgagatgaacgaggcaggatatgaatacctaggtgactatttttatgccctttataataaaggtgagaaaattagaaaacattataccgcacgaaatgaacatttcctcagcgagttcaaagcgatatgtgaaaaacaagacttagaaaaagaactcggatcagaagttgttagaaatatagaaaaagcaatttttgatcaaagaccactaaaatcacaaaaagggcaggttggcaaatgtgtattcgagaaaaacaagactaagtgcccatcttcacatccaatgtatgaagaatttagaatgctaacttttatcaataatatcaaaataaaaacaccaaacgacgacgtactgagaccacttaataccggagaaagagagaaaataatgccattgttctttagaaaaagcaagaaacaatttgactttgaagatataacaaagaaacttgccccaaagaaaatgtacggattctacaagaaagaagaagatgcggaaatgccattcttgttcaactatccgatggatacgtcagtatcaggttgtccagtaacagcagccttaaaagatgtttttggcgatgattggatcacagcaatatgtgaaacatacacgctaggtgaaggaaaaagcagatttgacatagtaaacgacatctggcatgcactgtatttttacagcgacaaagataaacttgcggagttcgcaataaacagattacaattaagtgaagatgaagccaaaatcttctcagaaatatcattaccggcagactatgcaagtttatctctaaaagccatatgcaaaatccttccatatctcagaaggggattaatctactcacatgctgtatttctcggcaacctatgtgaagtaatgcctaaatacgaatggtcaataaaagaaatgagggaaactattattgacaatataataatggaaatggataaatgcgatacaaaagataaacgaaccttcgaagtatgcataaaggactacttaaaagggcaatacaatgtatcagacaattcactcaagaaactatatcacccatcaatgatagaaacctatccaagagtacaatacactaacgaacacggtgtataccaactcggaagcccgagaatagacagcgtgagaaatccgatggccatgagatcaatgttcaggctacgcaaactggtaaatcgactattagtggaaggcaaaattgaccaaaatacagaagtacacattgaatttgccagagaattaaacgatgcgaataaaagaaatgctatagcactattcgtaaaagaaaaccagtcagccaatgacgaagcaagaaaacaaataataaccctatttaagaaagaaacagggacagacatcgaaccaacagataaagacatcttaaaatacgttttatgggaagaacaaaatcacatctgtctatacacaggaaaacaaataagaataagtgattttataggagcaaatccaaaattcgatattgaacacacaattcccagaagtgtagggggagactcaacgaaaatgaacttaacactttgtgactccagatttaatagagaagtcaagaaaacaaaactaccagtagaactaccgaaccacgatgagatcatggaaaggatcaaagaatggaagaaaaattacgaacttctcgacattcagattaggaaaaacaagaaattatcaaaaggagcaacgacgaaagaacaaaaagatacaataataagaaaacgacacctattagaacttcgtagagattactggagaggaaaatacgaaagatttaccatggaaagcgtaccagaaggatttagccggaggcagggaacggatatatcagtaatatctaaatacgcacgattatacttaaaaagtttatttaatagagtatacacagtaaaaggaatagcaacatcagattttagaaaaatatggggcattcaagatatatatagtaagaaagaacgaataaatcacgtgcaccactgcatcgatgcgatcgtgattgcatgtataggactagatgaatataataaattaggagcctattatcacgatgaagaaaacaataaatggtatggaatgtcaaaagcgagtttcaagaaaccatgggcgacatttgtagaagatataaagaaaattcaggatgaaattctagtataccactatacgcctgataatatgccaaaacaaggacggaggcgtattaaaatcgacggcaagaaaatactatgcaaaggtgatgcagcaaggggaagccttcacaatgacacgtactacggagcaatagaaaatgatggtgctgtaaaatacgtaaaaagaatagatctcgcttccttagaagaaaaagacgtcaaaaatatagtagatgatacagtgagatctataattgaagcagcaataaaagagaaaggctttaaagacgccatggcctcgacaatatggatgaacgaagagaaaagagtccctataaagaaagtcagatgtttcaccccatcgataacgaaacctttaaacatcaggaaacaacgagatgtgtcaatcaaagaatataaacaacaatatcacgtagccaacgatagcaactatctactcgcactctatattggaacagacaataaaggaaaagaaaaacgagagttcgaaatcgtaaatatactacaagctgcacagtattatagaaccagtaacgataaagaagtcgtagacagacatatagtaccaataaaaagcgaacacgattatccatttgcatacacattaaaaatcggaacaatggtactactctacgagaaaagtcccaacgaagtctgggatgcaacaataaaagaacgtaatagaagactatacaaagttactggcttgtctacaatgagaatgaaaggtagaaacggagaatacgcctatgcaacggtcaaattaatacataatgaagaagccagaccatcaaaagacataaaagccaaaaatggtgaatacgaacagggagaagagttccgacccgcaataataatgttacacacacaactaaacgcattagtacaagggtatgattttgaaataaatgaactgggagaaatacgacgacttagatga

SEQ ID NO: 8684 - RNA, 3654 nt, synthetic construct
  misc_feature 1..3654: note = Cas9 variant
  source 1..3654: mol_type = other RNA
atggaaaaacaacgaatattaggactcgatcccggaaccaattcactaggctgggcagtcctagattttgacaactcaaaacaagaatacaacctcgtaagaaaaggcgaagtcatattcgaagaaggagtagggaaaagtgaaagaggtgaattcagtaaagcagcatatagaacattctacaaatcaacaaggaaacattacttccgaaggagactacgcaaaatcgaagtactaaaagtactagttaaatacgatttctgcccatatcttagtgacgacctattaaagcaatggcacgagaaaaaaatataccccgcggtaaaagaattcatggactggcaaagaacatcagatgctgaaggcaaaaatccatactacgatagacactgttgtttaaacgaaaaactggacttatcattaaaaagcgacagatatatcttagggagagcactatatcacctaacacaaagaaggggattcaaatctaacagattaatacaaaacaacgatgaaaacgaagaaggcaaagtaaaaaaaggaatatctgaattgagcacagaaatgcaagaagcaaattgtaactacctaggagattatttctacaaactgtacacagaaaagggaaacacagttcaaatccgaaaacgatacacagacagagaaaagcactacaaaaacgaatttaacgcaatatgcgaaaagcaagagctcaacgaaactatagtaaaagaactagataaagcaatatttttccaaagaaagctcaaaccccagcgccatggtgtaggaaagtgtacattcgaacctaataatcgaagatgcgcaataagtcacccagactttgagagattcagaatgttatgctttataaacaatataaaaataaaaacccccttcgaggaaaatctaagaccactgaacaacgaggaaaaagcgctaatagaaccccttttttacaggaaaagcataaagaacttcgactttgaagaaattgcaaaaaaactcgctggaaaaaataactactgctacatcaaagacgattcatcaaaacaatacaaatttaactatagaatgtcccaaggtgcttcaacatgtcagacgatagcaaaactcaagagtatcttcggagaagaatggaaaaacggtatagctgagacatatacaaatcgacgaaaaaaagaaggactaaaaaaacaagcagaaatggttgatgacatatggaacgtattatactcagtcagtgaatgcgatgtattaaaagacttcgcaataaacaaacttcaattagacgaaaaaacggcggataatttttctaaaacaaaactcgcgcaaggcttcgcaacactgtccttgaaagcaataagaaaaatactaccttttctggaacaaggtttcggatacacagaagctgtcttcttagcgaacatcccaaccgtagtcggaaaagaatattggaacaacgaagatattagaaacgacattatggaagaaataaaaactatattttaccataatacactaaaaactaatgatagccacaatacaattcttttttgtattaaagatatactatctaataattttgatctagcccccggagcaattgacaaattataccacccttcaatgattaatgtatataaagatgttataccaaacgaggacgggatactacagctcggttcacccaaaatcgacgctgtaaaaaacccaatggcaatgagaagtctacatatcataagaaaagtagtcaatgaactcttaagggaaggcataataaatagtgatacagaagtaagaatcgaatacgctcgagaactcaatgacgcaaacaaacgacacgcaatagcggattggcaaaaaaaacaatacggtaagcatcaaaaatatagaaaagaaataaaagagcttttcaaggcagaaacaggatttgaaatagaacctaatgagacagacatactaaaattcgaactctgggaagaacaaaaccatatatgtctatatacgggccaagaaataggaatctccgaattcgttggtgaaaacccaaagtatgatatagaacatacatttccaagatcactagggggagatagtactaagatgaacatgacactctgtgaaaacaaattcaaccgagagaataaacaaaaaaaactaccctccgagctagcaaatcactcagaaatactagagagaatagacgattggaaaaaaaaaatttacatattacaaaagaaatacgactcgatacgtacacataacggaatggataaagaaaataaagataaaaaaatagtatcccgacacaaaattaaactagaactcgattactggaaaggaaagtacaatagatttacaatgacagagataccagaaggtttctcacgaagacaaggaatgggcataggtttaatatcccgctatgctggactatatttgaaaacaatatttcacaaaaaggacaatcctcaaaaatcaaatgtttatatagtaaaaggtagtataacagctgaattcagaaggatatggaacattcaggatgattacgaaaaaaaatgcagagataaccatatacaccactgtatagacgcaattgtagtgggatgtattggaaagagagaatacgatctaatggctcaattctatcgagacgaagaaaaatataggtgggaaaaaaaaaaaaaaccttttttcaagaaaccgtgggaaacgttcacgcaagacatgctaagcttaaaagatgaagtcctcacagtacatttcaacccgagcaacttcacaaaaaaagcacacaaaaaggtctttacaccaaaagggatatttgtcgcacaaggtgactgtgctagagtaaaactacacaaaggtagttattttggagcaatcgaacaaaaaggcgaaataaagtacgttatgcgcaaggaactatcagcacttaaaattgaagatataaaaaacattgtagacgcagtagtaaaagaaaaggtactcgccgttgtaaaaaaaaaaggcttcaaacaagctatggcagaaccaatctatatgaacgaagacaaaagaatattaataaagaaagtaagactattcgtgagccaagcaaacccactcatagtcaaaaaacaccgagacctatcaagtaaagaatataaacaaaactattacgtagacaacgaaggaaacctaatgatagcaatgtacgaaggagtaaaaaaaaatggaaaaatagacagagaaataacagtagtaaacaacctggaagcagccaaattttttagacaaagtcaaaaaaataacgctgaaaaacagttaataagccacctatcacctaaaaacggttacccgttaaaaaccgtgctcactcaaaagcaactagtactaatgtatgaagatagccccaaagaaataaaactacgagacacaaaaaatatggtaaaaagactataccaagtattcggaatagaaaaagacggaagagtaaaactaaaattccaccaagaagccagaagcgaaggactaaatattaatagtgcagcatttaagatacaggacacaccagagtccctttacagacatacaaaaagcaatcttaaggtcctggttaatggtgtagacttcaaaataaatatactaggcgaaataagcctgatctga

SEQ ID NO: 8685 - RNA, 3654 nt, synthetic construct
  misc_feature 1..3654: note = Cas9 variant
  source 1..3654: mol_type = other RNA
atggaaaaacaaagaatactaggactagatccaggtacaaatagcctggggtgggcagttttagattttgacaatagtaaacaagaatacaatcttgtacgaaaaggagaagtaattttcgaagaaggagttggaaaatcagaacgaggtgaatttagtaaagcagcataccgaacattttataaatccacccgcaaacactactttaggagacgtctaagaaaaatagaagtactcaaagtacttgtaaaatatgacttctgcccttatttatcagatgatttactcaaacaatggcatgagaagaaaatatatccagcagtaaaagaatttatggactggcaacgaacgagtgacgcagaaggcaaaaatccatattacgacagacactgttgccttaacgaaaaactagacctgtcactaaaatccgaccgatacgtactaggtagagcactataccatctaacccaacgtagaggattcaaatcaaacagattgatacaaaacaatgatgaaaatgaagaaggaaaagttaagaaaggaatatcagaattatcaacagaaatgcaggaagctaattgcaactatctcggagattatttttacaaattatacactgaaaaaggaaacacagttcaaataaggaaaagatacacagacagagaaaaacattataaaaatgagttcaatgcaatctgcgaaaaacaagaactaaacgaaacaattgtcaaagaactagacaaagcaatcttcttccaaagaaaactaaaaccacaaagacacggtgtagggaaatgcacgtttgaacccaataatagacggtgcgcaataagccatcctgattttgaaaggttcagaatgttatgttttataaataacataaaaataaaaacgccttttgaagaaaatctccgacccttaaacaatgaagagaaagcattaatagaaccattattttatagaaaaagcatcaaaaatttcgactttgaagaaatagccaagaaattagcaggcaaaaataattactgctatataaaagatgactcaagcaaacaatacaaattcaactacaggatgagccaaggagcctctacctgccaaaccatagcaaagctaaaatcaatattcggagaagaatggaaaaatggaatcgcggaaacatatacaaataggaggaagaaagaaggacttaaaaatcaagccgaaatggtagatgacatttggaacgttctatattcagtatcagaatgcgacgtgctcaaggatttcgccatcaacaaacttcaactagacgagaaaacagccgacaacttttcaaaaacaaaactagcacaaggatttgcgaccctatccttaaaggccattagaaaaattttgccattcttagaacaaggctttggctacactgaagcagtatttttagcgaatataccaacggtcgtcggaaaggaatattggaataatgaagacataaggaacgacataatggaagaaataaaaacaatcttttatcacaacacactaaaaacaaacgactcacataataccattctgttttgcataaaagatatattgagcaacaactttgatcttgcaccaggagcaatcgataaattatatcatccatcgatgatcaacgtatataaagacgtaatacccaatgaagatggaatcctacaattaggatccccaaaaatagacgcagtcaaaaaccccatggctatgcgatccctacacataataagaaaagtagttaacgaacttctaagagaagggataataaacagtgacacagaagtaaggatagaatacgcaagagaattaaatgatgcaaacaaacggcatgcaatagcagattggcagaagaaacaatacggaaaacaccaaaaatacagaaaagaaataaaagaacttttcaaagcagaaaccggttttgaaatcgaaccaaacgaaacagatatactaaaatttgaattatgggaagaacaaaaccacatatgcctgtacacgggacaagaaattggcatttcggagttcgtaggagaaaatcctaaatacgacattgaacacacaatacctagaagtcttggaggagactctaccaaaatgaatatgacgctatgtgaaaataaattcaatagagaaaataaacagaagaaattgccaagtgaattagcgaaccactctgaaatactagaacgaatcgacgattggaaaaagaaaatatacatacttcagaagaaatacgattcaataagaacccataacggaatggataaagaaaataaggataagaaaatagtatcaagacacaaaataaaactagaattagattactggaaaggaaagtataacagattcactatgacagaaataccggaaggattttcaagaagacaaggaatgggaataggactaatatccagatacgctggcctatatcttaaaacgatcttccataaaaaggataacccacagaaaagcaacgtatatattgttaaagggagcataacagcagagtttagaagaatctggaacatacaagatgactacgagaagaaatgcagagacaatcacatccaccactgcatagatgcaatcgtcgttggatgcataggaaaacgagaatacgacctaatggcacaattttacagagacgaggaaaaatatcgatgggagaagaaaaagaaacctttcttcaagaaaccctgggaaacttttacacaagatatgctatccttaaaagatgaagtattaacagtacactttaacccaagcaacttcacaaagaaagcacacaaaaaggtattcacaccaaaaggaatattcgtagctcaaggagactgtgcaagagtaaagttacacaaaggctcctactttggggcaattgaacaaaaaggagaaattaaatacgtaatgagaaagaaactgtcagcgctaaaaatagaagacatagaacacattgtagacgcagtagtaaaagaaaaggtattggcggtcgtaaagaagaaaggattcaaacaagccatggctgagccaatctatatgaatgaagataaaaggatcttaatcaagaaagtaagactattcgtatcccaaactaatccattaatagtaaagaaacacagagacttatcctccaaagaatataaacaaaattactatgtggataatgagggaaacttaatgatcgcaatgtatgaaggagtcaagaaaaacggcaaaatagacagagaaattactgttgtaaataacttagaagcagcaaaattcttcaggcagtcacagaaaaacaatgcagaaaaacagctaatatctcacctatctcccaaaaacggataccccctcaaaacggtattaacacaaaaacagctagtactaatgtacgaagacagcccgaaagaaataaaacttcgagacaccaaaaatatggtaaaaagactatatcaagtattcggtattgaaaaagacggtagagtagaactcaaattccaccaagaagcaagatcagaaggactaaacaaaaattcagcagcctttaaaatacaagatactccagaaagcctatatagacatacaaaaagcaatttgaaagtcttagtaaacggagtagacttcaaaataaatatactaggtgaaatatccctcatctga

SEQ ID NO: 8686 - RNA, 3654 nt, synthetic construct
  misc_feature 1..3654: note = Cas9 variant
  source 1..3654: mol_type = other RNA
atgaaatacaactatgtactaggactagacataggaatcagtagcgtagggtggggtctactagccttggatgaaaacaacaacccctataaaataatagatgtgggatcaagaatattttctcctggagaagtagagaaaactggagacagtaaagccaaagaacgtcgcgaaaaacgtggaacaaggcgagtaatcagaagacgcgagttcaggctagatcgcgtgagaaatcttctatatgaaaaaggttaccttaaaggcaacattaccagcaatatagttagtgtcaaaaacgaagaacttaccataattttcaacgatatggtaaataactactacaaaagcaaagatactaatccttacaaactgaaagtagaagcactagacaggaaactaacaaacgacgaattaagtatcatcttagtacattatgcaaagaaaagagggtacaaatcaaaccgagaagaaagtagtgacaacgacaacgggaaagtaaaagaagcaataaaagaaaatacaaaccttatggaagaaaagaaataccgaacaatttcagaaatgtatattaaaaatgaaaaattcaaaaataaaattaaaaatggaccagacgactataaattaagcgtaaccaatgaaatgtacctcgaagaaattaacaaagtactagacagccaaattggttttgggttgatcgatgacaactttaaaaacgaatatctagaaatctacaatagtcgaagacactactctgaaggacctggatactattatgcaaaagatgcaaacggaaataaagtcaaggtcaggagcccatacggtggagatttaataaagaaaatgacaggcgtatgctctttcgacaagaaagctagagcaccaaaatacgcattcagtagtgaattattcgtctcaatttcaaaattagttaacttaaggtataaaattgacgacgactcgtacaaacaattaacaaaagaacaaattaacgagctcattgatgaagctaaaaataaaaacaaagtaacatacaaaagcctaataaaaattctaggtattaaaaacataaaagtaaaagacctaaacctcagtaaatctgaatacataaaagtaatcgacgaactaaagaagaaattgaatatctcaaaagaagagaaaattgacatatattccctagacgaagaaaataagaaaatatatgacgacatatacaatgaaaaactctttagtaaaacactcatagagttcaaaggctacaacctcttaaagaaagcaataacactctcctataattcaggaacatggaacgatgtaaaagacaacattgagttcttggacgaactagctttatactgtacagattacaaagtaaataatgaaatacaagaacacatccacaactctttaataatagactcacgattcgatgacagcaattttgtagaaaacttgccaaacttcaaagaccatctaatgctatccacagacataataaggaaactcatcccaataatgcttgaaggaataacctacgacaaagccatggacaaaataggatacaaccacagcaacttatacaaagacacaataaaagaagacttattagtcccagtatatgtttctaaaaacattacaaatcaacgagtcataagatcactaacacaagctagaaaagtaataaatgcgattatcaagaaatacgggtcaccaaaaatcatcaatatcgaaactgcaagagaactcgcaaaaacacagaaagaacgacgtataatagagaaaaatcaacaagacaaacaatatgaaaatgaaaggatcaagaaacacctcgttgaattggaattattttcagacgaatcaaaaattacaggcaatgatctcctaaaatataaactatggcaagaacaaaaagagttctgtggttatagcatgaagaaaattaaacttgaagacctcttctcaaacaacatagtacaaatcgatcacatcctgccctactcgagaacctacaacgacaactatctcaataaaaccctagtttatacaaaatacaaccaagacaaaggcaataaaacaccatacgaatggttcgggaaaacagacaaatggcaagaatacgaagcatttataaactcactaagcatcagtcaaaacaagaaagataactatctattgaaaaatctagaccaagacgcagaaagggaaatgagagaacaaaatctaaacgacacaaaatatatatcaagagaactactaagcctaataaaagcatatctcaacgtagatgaagttaacgctttcccgggcgccataacagccaaactccgcgcgcgttggggattcaacagattaacacactcgtatatatcaaaaacctatataatgcctgaagacatgaagaaaggaataaataaagacagagacaatcacctacaccacgccatggacgcactcgtaatagcaagtatcacaaaaagcctacaacagaaaataactttatacgaaaaatttagtagatacgtagacggaataaccaaaaatgaattaggaaaaataagcacagggaacattaatgacgacctatacaactattacgacgaagaaacaggagaaataaaagagctggaactacgacaatacatcaaaaatcaagtagcacaaaataacatatatttcagcaaacacaatgtatccaaattaatatttccaacaccatataacaactttgtagaagaggcaaaactaagagtttacgaaagggacctagaagtactcaaatggaatctgaaaaaccttgggacttacacatcgagtgaactcaacagaatccatgtcctgattccctcagtagccaaaaataaaataagcggaagactacacgaagagacatattacggattaaaagaggtcggcattggagaagataaagtaacgtataaaacattaaaaacaccaataagtaaagtcaaaaagaaagaccttgataacataccagactgcaaaggaggatctaaagacatatataacgctttagtaaaatggttcggcaattgcgagacaggcgaagaagccctaaaaatgcatgatggcaaatatcccgtaaacccaaatgacaaagagcaaaaagaaatacgcaaaattaaagtatacacaaaatataacgcaactggacacgttgtaaataacggcaacgtagaaaaagggggaatatatcgaattgacgtattcaaatccaaaaacaaagaagataacaaactatatttcacatcttatgacatatttgaaatagaacaaataaaagcatacgaaaaaggcaaaaacattaatttctcaataaaactagaatacggccaaggtaaaaataacaaaatactactatataaagatgtcaaaaacgaatatgacctcatcatgtcaatctacaaaaatgacttgatcagaataaaaacgaaaaccggaaacaaaagcacagcatacgtagttggattcagcggaggaaaactagaaattaaatccacaataggagacggatacgacataatcggtaacaataacattttcgataaatcaatggaaagatatcgagtcacatcaagtacaatagtaaaaatcgataaactaagcatttcaatactaggagaagtatcaggactatga

SEQ ID NO: 8687 - RNA, 3657 nt, synthetic construct
  misc_feature 1..3657: note = Cas9 variant
  source 1..3657: mol_type = other RNA
atgaacaaaagaatactagggcttgacacaggaacaaacagtttaggatgggctgtagttgactgggatgaacacgcgcaaagctacgaactaataaaatacggtgacgtaatttttcaagaaggagtcaagatagaaaaaggaattgaatcttcaaaagcagccgagcgaagcggatacaaagctatcagaaaacaatattttagaagaaggctacgtaaaatacaagtattaaaagtattagtaaaataccatctatgtccgtatttaagtgatgatgatttacgacaatggcacctacaaaaacaatatccaaagagtgatgaattaatgttgtggcagagaacttctgacgaagaaggcaaaaatccatattatgacagacatcgatgtctacatgaaaaattagatctaacggtagaagcagaccgatatactttagggagagcactataccacttaacacaacgaagaggattcttatccaataggttagacacaagcgcagacaataaagaagacggagtcgtcaaaagcggcatatcacaattaagcactgaaatggaagaagctggatgcgaatacctaggagactacttctataaactttatcatgaacaaggaaataaagtaagaatacgccaacgctacaccgatagaaagaaacattaccaacacgaatttgatgcaatatgcgaaaaacaggaattatcaagtgaattaatagaggacttacagagagctatattcttccaattacccctaaaaagccaaagacacggcgttggaagatgcacgtttgagcgaggaaagcctcgatgcgcagactctcatccagattacgaagagttcaggatgttatgctttgtaaataatatccaagtcaaaggaccacatgacctagaacttaggccactgacctacgaagaaagagagaaaatagaacacctgttctttaggaaatcgaagccaaactttgattttgaagacatagcaaaagaattagcgggtaagaaaaattacgcgtggatccatgacaaagaagaacgcgcatataagtttaattatagaatgacacaaggagtacctggatgcccaactactgcacaattaaagagcatcttcggggacgattggaaaacaggaatcgctgaaacatatacgttaatacagaaaaagaacggatccaaaagcctgcaagaaatggttgatgacgtctggaacgttttatacagctttagttcagtagaaaaattaaaagagttcgcacaccataagttacagttagatgaagaaaacgcagaaaaattcgctaaaataaaactttcgcattcattcgctgcactatcattaaaagcaataaggaaatttctcccattcttaagaaaaggtatgtactatacacatgcatcattctttgctaatataccaacaatagtaggcaaagaaatatggaacaacgaacaaagcaggaaatatataatggaaaatgtaggagaattagtttttaattatcaacctaagcacagagacgtccaaggcaccattgaaatgttgattaaagactttctagccaacaactttgaattacccgcgggagctacagacaaactataccatccgtccatgatcgagacatatccacacgccttgagaaatgagtttggtatattacaactcggaagcccgagaacaaacgcaatacgcaacccaatggccatgagatcactccatgtattacggagggttgtaaaccaacttttaaaagaaagcattatagacgaaaataccgaagtacatgtagaatacgccagagaattgaacgatgcaaacaaaagacgtgctattgcagatcgacaaaaagaacaggataaacaacacaagaaatatggtgatgaaataagaaaattatacaaagaagaaacaggaaaagatatagaacctactcaaaccgatgtattaaaattccaactctgggaggaacaaaatcactactgtctgtatacaggcgaacaaatagggattaccgattttataggatcaaacccaaaattcgacatagagcacactataccacaatcagtaggaggagactccacccaaatgaacttaactttatgtgataataggtttaatcgagaagtaaagaaagcaaaattacccacagagctcgcaaaccacgaagaaatcttaactagaatagaaccctggaaaaataaatacgagcagctcgttaaggaaagagacaaacaacgaacttttgcaggaatggataaagcagtaaaagacataagaatccaaaagcgacataaattacaaatggaaatagactactggagaggaaaatacgaaagattcacgatgacagaagtaccggagggattcagtcgtaggcaagggacaggtataggtctaataagcaggtacgccggactgtatctcaagtcactctttcatcaagccgattcaagaaacaaaagtaacgtttatgtagtcaagggagtagctacagctgagttccgtaaaatgtggggacttcaaagtgaatacgagaaaaagtgtagagataatcatagccatcactgcatggatgctatcactatagcctgtattggcaaacgagaatacgacctgatggcagaatactaccacatggaagagacatttaggcaaggaagaggctccaaaccaaaattctcaaaaccttgggctaccttcactgaagacgttttgaacatatataaaaacctattagtcgttcatgacacccccaataatatgccaaaacatacaaagaaatacgtacagactagcaaaggaaaagtactagcacaaggcgatactgctaggggtagcttacatttagatacatattatggagcaatagaacgagacggcgaaatacgatatgtagtacgaaggcccttatcaagttttaccaatccaaaagaattagaaaacatagtcgatgagacagttaaacgaaccatcaaagaagcaatagctgataaaaatttcaaacaagcaatcgccgaaccaatatatatgaatgaagataaaggaatattgataaagaaagtacgatgcttcgcaaactctgtaaaacagccaataaacatacgacaacacagggatctaagcaaaaaggaatacaaacaacaatatcatgtaatgaatgaaaataattacttattagcaatctacgaaggattagtcaaaaacaaagtagtaagagagttcgaaatagtctcatacatagaagccgctaaatactataaaagatcacaggacagaaatatattttcatccatagtaccaacccactcaacaaaatatgggctaccactcaaaacgaagttgttaatgggacaacaagttctaatgtttgaagaaaacccagacgaaatacaagtagataacacaaaggatctcgttaagcgtctatacaaagtagttggcatagagaaagatggacgtatcaaatttaaacatcaccaagaagccagaaaagaagggctcactatatactccaccccatacaaaaataacgacgattacgtcccaatatttagacaaagcatcaaaaacataaacatattggtagacggaatagatttcaacatagatatattaggcaaggtaacattaaaagaatga

SEQ ID NO: 8688 - RNA, 3657 nt, synthetic construct
  misc_feature 1..3657: note = Cas9 variant
  source 1..3657: mol_type = other RNA
atgaataaacgaatacttggactcgacacaggaacaaacagcctaggatgggcagtagtagactgggacgaacatgcgcaaagttatgaactaattaaatatggggatgtaatttttcaagaaggggtaaaaatagaaaaaggaatagaatcatcgaaagcagcagagagatccggatataaagcaatcagaaaacagtacttcagaagaagattaagaaaaatacaagtcctgaaagttttagtaaagtatcacctatgcccatacctttcagacgatgacctaagacaatggcacctacaaaaacaatacccaaaatctgacgaattaatgctatggcagcgaacttcagatgaagaagggaaaaacccctattacgacagacatcgatgtttgcacgaaaaactggatctaacagtagaagcggatcgatacacactaggacgcgcattataccacttaacgcaacggcgaggcttcttaagcaatcgcctagatacgagtgccgataacaaagaagacggggtagtcaaaagtggaatctctcaattaagtacagaaatggaagaagcaggatgcgaataccttggcgattatttctataaattatacgatgcacaaggaaacaaagtaaggatacgacaacgatatacagaccgcaataaacactatcaacacgagttcgacgcaatctgcgaaaaacaagaactatcgtcagaactaattgaagacctacagcgagccatattcttccaactgcccttaaaatcacaacgacacggagtaggaagatgcacatttgaaagaggaaaacccagatgtgcagactcacatcctgattatgaagagttcagaatgttatgctttgtaaacaatatacaagtaaaaggtccacatgacctagaactacgaccactaacctatgaagaaagagagaaaatcgaaccgctattctttcgaaaaagcaaacctaactttgacttcgaagatattgccaaagcactggcaggcaagaaaaactacgcatggatccacgataaagaagaaagggcctataaatttaactaccgcatgacacaaggagtcccaggatgtccgactatcgcacaacttaaatcaatatttggggatgactggaaaacaggaatcgcagaaacatacacattgatacaaaagaaaaatggatcaaaatcattacaggaaatggtcgatgacgtatggaacgtattatattcatttagcagcgtcgaaaaactcaaagaatttgctcatcacaaactacagctagacgaagaatcagcagaaaaattcgccaaaataaaactaagtcacagttttgctgcattgtcgctaaaagctatcagaaaatttttacccttcctaagaaaaggtatgtattacacacatgcatcattctttgctaacataccaacgatagttggaaaagaaatctggaacaaagaacaaaatcgaaagtatattatggaaaacgtgggtgaattagtattcaactaccaaccaaaacatagagaagtacaaggaacaatagaaatgttaattaaagatttcctagcgaacaatttcgaactaccagccggagcaacagacaaactataccacccatcaatgatcgaaacatatccaaatgcccaaagaaacgaatttggaatattacagctcggaagtcctcgaactaacgctataagaaatccaatggctatgcgatcgttacacatcttacgaagagtcgtaaaccaattattaaaggaatctataattgacgaaaataccgaggtacacgtcgagtatgcgcgggaactaaatgacgctaacaaaagacgagctatcgcagacagacagaaagaacaagataaacaacacaagaagtatggcgatgaaataagaaaactatacaaagaagaaacaggaaaagacatagaaccaacacaaacagatgtattaaaatttcagctctgggaggaacaaaatcaccattgtttgtatacgggagaacaaataggaattacggattttataggatcaaacccaaagtttgatatagaacacaccataccacaaagtgtaggaggtgattctactcaaatgaacttaacactatgtgacaatagattcaacagagaagttaagaaagcgaaactcccaacagaactagctaaccacgaggaaatactaactagaatcgaaccgtggaaaaacaaatatgaacagctagtaaaagaaagagataaacaaagaactttcgcagggatggataaagcagtgaaagacataagaatccaaaagcgacacaaattgcaaatggagatagattattggagaggtaaatatgagagattcacaatgacagaagttcccgaagggttctctagaagacaaggtacaggaataggactcataagtcggtatgctggcttatacctgaaatccctatttcaccaagctgacagcagaaataaaagcaacgtatacgtagtaaaaggagtagcaacagcggagttcagaaaaatgtggggtctacaatcggaatatgaaaagaaatgcagagacaaccatagccaccattgcatggatgcaataacaatagcctgtataggaaaaagggaatatgatttaatggccgaatattacagaatggaagaaacgttcaaacaaggtcgaggaagcaaaccgaaattctcgaaaccttgggcaacattcactgaagacgtacttaacatatataaaaatctattagtcgtacacgatacgccaaataatatgccaaaacatactaagaaatatgtacaaacaagtataggaaaagttttagcacaaggagatacggctagaggaagccttcatctagacacatactacggagcaatcgaaagagacggcgaaattagatacgtcgttagaagaccacttagttcatttacaaaaccagaagaactagagaatatagttgacgaaacagtcaaacgaactatcaaagaagccatcgcagacaaaaacttcaaacaagccatagccgaacctatatacatgaatgaagaaaaaggaatactaataaagaaagtcaggtgcttcgccaaatcagtaaaacaacccataaacataagacaacacagagatctttcaaagaaagaatataaacaacaatatcatgttatgaacgaaaacaattatctgctagctatatacgaagggctagtgaaaaacaaagttgtacgcgaatttgaaattgtttcatacatagaggcagcaaaatactataaacgatcccaagaccgaaacattttcagtagcatagtcccaacacattctaccaaatacggtttaccattaaaaacaaaactcttaatgggacagttagtcctaatgttcgaggaaaacccggatgaaatacaagtggataacacaaaagacctagtaaaaagactatataaagtagtcggaattgaaaaagacggaagaataaagtttaaataccatcaagaagccagaaaagaaggattacccatattttccacgccatataaaaataatgatgactacgcaccaatatttagacaaagtatcaataacataaatattttagttgacggaatagacttcacaatagacatactaggtaaagtaacattaaaagaatga

SEQ ID NO: 8689 - RNA, 3657 nt, synthetic construct
  misc_feature 1..3657: note = Cas9 variant
  source 1..3657: mol_type = other RNA
atgaacaaaagaatcttaggacttgatacaggaacaaatagcctagggtgggcagtagtagactgggatgaacacgctcaaagctacgagttcatcaaatatggtgatgtaatattccaagaaggagttaaaatcgaaaaaggtatagaatcatcaaaagccgccgaaagatcaggttataaagcaataagaaaacaatacttcagaagaagattaaggaaaatacaagtactgaaagttctcgtcaaataccacttgtgtccttacttgtcagatgatgatctaagacaatggcacctacaaaaacaatacccaaaaagcgacgaactcatgctatggcaaaggacaagtgataagaaaggcaaaaacccatattatgacagacatcgatgcctacacgaaaaattagacctgacagtggaagcagataggtataccttaggcagagctttgtaccacctgacacaacgacgaggctttctttcgaacagactagatacatctgccgataataaagaagatggcgtcgtaaaatccgggatatcacaattatcaacagaaatggaagaagcaggatgtgaatatttaggcgattatttttacaaattatatgacgaacaaggcaataaagtaagaatcagacaacgatacacagaccgaaacaaacattaccaacatgaatttgatgctatatgcgaaaaacaagagctatcgtctgaactaattgaagatctacaaagagcaattttctttcaattaccactcaaatctcaaagacatggcgtaggaaggtgcacgtttgaaagaggcaaaccaagatgcgcagatagccatcccgattatgaagaatttagaatgctatgttttgtaaataacattcaagtaaaaggaccacatgatctcgaattaagaccgctaacctacgaagagagggaaaagatagaaccactatttttcaggaaatcaaaaccgaacttcgattttgaagatatcgcaaaagcattagctggaaagaaaaactacgcatggatccacgacaaagaagaacgcgcatataaatttaactaccgtatgactcaaggagtaccaggatgtcccacaacggctcaactaaaatcaatattcggagacgactggaaaaccgggatagcagaaacatacaccttaatacaaaagaaaaatgggtccaaatcactacaagaaatggaagatgatgtatggaacgtactatacagtttcagtagcgtagaaaaattaaaagagttcgcgcatcataaactacaactagacgaagaatcagctgaaaaattcgcaaaaataaaactgagtcactcattcgctgctctatcgcttaaagcaataagaaaatttttaccatttttgagaaaaggaatgtattacacccatgcctcatttttcgccaacatacctacaatcgtgggaaaagaaatatggaacaacgaacaaaacagaaaatacataatggaaaacgtaggagagctagtcttcaactaccaaccaaaacatagggaagtgcaagggacaattgaaatgctaatcaaagattttctagccaataattttgagctaccggcgggagcgacagataaattataccatcctagcatgatagaaacatacccacacgcacaacgtaacgagttcggcatattacaactaggtagtccaagaacaaatgctatcagaaatccaatggcaatgagaagcctacatatacttagacgagtcgtaaatcaactattaaaagaaagcataatagacgaaaatacagaagtccatgtagaatatgccagagaactaaacgacgccaacaaacgcagagcaatagcaggttggcaaaaagaacaagataaacaacacaagaaatatgtagatgaaatcaggaaattatataaagaagaaaccggaaaagatatagaacccacccaaacagatgtattaaaattccaattatgggaggaacaagaccatcattgcttatacacgggggaacaaataggaataactgatttcatagggtctaacccaaaattcgacatcgaacataccataccacaatccgttggaggagacagcacacaaatgaacttaacactttgcgacaacagattcaacagagaaattaaaaaggctaaattgcctgcccaactctccaaccatgaagaaatactcgcaagaattgaaccatggaaaaacaaatacgaacaaaagataaaagagagagataaacaaagaacatttgccggaatggacaaagctgtaaaagacctacgaatccaaaaacgacataaactacaaatggatatcgactattggcgtggaaaatacgaaagattcaccatgaccgaagttcctgaaggatttagtcgcagacaaggaacaggaatcgggctaatatcacgatatgctggtttatatttaaaatcattatttcatcaagcagatagtaggaataaatcaaatgtatatgttgtaaaaggagtagcaactgcagagttcaggaagatgtggggtcttcaaagcgaatacgaaaagaaatgtagagacaaccattcacaccactgtatggatgccatcactatagcatgtataggaaaaagagaatacgatctaatggcagaatactatagaatggaagaaacatttagacaaggacgtggaagcaaaccaaaattctccaaaccatgggctacctttacggaagacgtactaaacatatataaaaatctccttgtagtccacgatacaccaaataacatgcctaaacacaccaagaaatacgtccaaacctctaaaggcaaagtactggcgcaaggggacacagcaaggggatcacttcaccttgacacatattatggtgcaattgagagagatggagaaattcgatacgttgtacgaaggccactttctagctttacaaaaccaaaagaactagaaaacatagtagatgaaactgttaaaagaacaatcaaagaagccatagcagataaaaattttaaacaagcgatcgcagagccaatctatatgaatgaagacaagggaatccttattaagaaagttcgttgctttgcaaaatcagtgaaacaaccaataaacatacgacaacaccgagacctttctaaaaaggaatacaaacaacaatatcatgtagtcaatgaaaataactacatgctagtaatatatgaaggactggtcaagaacaaagtggtacgagaatttgaaatagtcagttacatcgaagcagctaaatactataaaagaagtcaagacagaaacatcttttcaagcattgtaccaacacattcagccaaatatggtctacctctaaaaacgaaattattaatgggccaattagtactaatgtttgaagaaaatccagacgaaatacaagtggataacacaaaagatttagtaaaaaggctatataaagtcgtagggattaaaaaggacggaagagtcaaattcaaatttcatcaagaagcacgaaaagacggtttactaatattttctactccctacaaaaataataatggttacgtacctatctttagacatagcaagaaaaatataaacatcttagtcgacggcaaagactttactatagatatcttagggaaagttacgttaaaagagtga

SEQ ID NO: 8690 - RNA, 3660 nt, synthetic construct
  misc_feature 1..3660: note = Cas9 variant
  source 1..3660: mol_type = other RNA
atgaaagaagaagtacggggtaaaaatcgttcacaaacctgggcgatattagctaaattctttgtctggtctgaaaaagaaagcgtatggaatgaaaaagaagcacgtacagaagaacgagtaaaagaatataagctagttggactaaaaagggacacaaaaggaaacgaactcaaactcgaaaactacagatggagagttcaggccctaagcgaacaactaaaccctgaaatagttgcaatagtcttacaggaaataaatggtcaaatatcagctagcagcggatatttaggagcaatatcagacagatccaaacaactatattttaatagacaaacagtaggccaatatcttatgtcagaactcgaaaaagatccaaatgtatcgctaagaaatagagtattttaccgacaagattaccttgacgagttcgatagaatatgggaaaaacaagccgaatttcacgaagaactaacagttgaactaaagaaagagatacgggacataataatattctaccaaagacgactcaaatcccagaaaggtttaatctcattctgcgagttcgagaaaagggaagtagtagttgaagaagatggtcggaagaaaaacaaaacggtcggatgtcgagtaatcccaagatcccatccactcttccaggaatttaaaatatggcaaacactcaatgatattgaagtgtttgcatgggacaaacaatcaaaacgaaagaaagcagataaatcatctatactatttgacaatagcgaagacgcattacttgttgaagggaaacgatttctatatcaagaagaaaaagaactcctggcaaaagaattattcgttaaagaatcaatgaagaaagcagaagtactaaaattgctattcgaaaactaccaagaactagatttaaactttaaacaaatagatggaaatcatacaggctttgcattattctcagcatattccaaaatgatagaaaaatatggttacgaaccagtggattttaaacgaagtgcagacgaaattatcgaaaaactagaaactatattcacgaatttaggttggaacacagaacttttatctatcgacttatctaaggaagacaaagagttagaaagacagtcttatttccgattgtggcatttactatatagtttcgaaggagacaacacacccacaggtaacggaaaattactagagaaaattatgcagttatgcgacgtggaaaaagaatacgctgtagaacttgccaatgtgagttttcaagaagactacggatcactaagcgcaaaagcaatcaagaaaatattgccatatttaaaagaaggaaaccaatacgacgttgcatgcgactacgctggttaccgacattcacgaagctcattaaccaaagacgaaatagaaaacaaaatcttaaaagacaaattagaaatactacctaaaaactcactgagaaacccagtagtagagaaaatattaaatcaaatggtcaaccttataaacacacttatcgacacctatggaaaaccggatgaaatacgcgtcgaattagcaagagaattaaagaaaaacgccaaagaaagagaagaattaacaaaatccattgcaagaaacacaagagaacacgacgaaatacgtcaactacttagaactgaatttggtatgatgaatgtttccagaaatgatataataagatacaaattgtacgaagaactaaaagataacggctacaaaacactatattctaacgaatacatacctagagagaaaatattctcaaaagaaatagacatagaacacgtaataccccaagcacgactcttcgacgatagtttatcaaataaaacactagaataccgcgccataaatatagaaaaagggaacaaaactgcatatgacttcgtaaaagaaaaatatggaaacgacggattagaaaaatttttaaatagatgcgaaacgctatttaaagacaaacgaacaaaactcagaaaactgaaaatggaagaaaaagacataccagaaggttttattgatagagacctccgaaacacacaatacatatctaaaaaggcttttgccatgctaaatgaaatctccagaagagttgtagcaacaacaggaagcataactgataagttacgagaagactggcaactggtcgatttaatgaaagaactaaatttaccaaaatacgaaaaattaggaatggtcgaaatgtttgaagataaagacgggagaaaaataaagaaaataaccgattggacaaaaaggaacgaccaccgtcatcatgcagttgatgcactcacagtcgcattcactaaagacgtattcatccaattttataacaacaaaaatgcagcatggatgccagctagcaaagaacatgctaatataacaggtataaaagcacgatactttgagaacggaaaagcactagcgcctatgccactagcacaatttagagctgaagcgaaaaggcatctggaaaacctcctagtctcaatcaaagctaaaaataaagttataacaagcaatgtgaatcgaaccaaaaataaaaatggagaaaatagaaaattacaacaaacaccaagaggacaattacatctcgaaactgtatacggttcacatcgtcaatatgcaaccaaaatcgaaaaagtaaacgctgccttcgacgtaactaagatcgcaaccgtttccaaactagcctatcgaaacgcgttattaaagagattggaggctttcggcaatgatcccaagaaagcatttacaggcaaaaacacgttagagaaaaatcctctctacctggacgaaaaccaaactgaaatggtaccagaaaaagttcaaacagtagaatttgaaacagtatacacaattagaaaacccatagatccaaacctctctatagacaaagttgtagatgtcaaaataagaagcgtattagagaaaagactaaaagaatatggaggagacgccaagaaagcattcgtaaatctagacgaaaacccaatatggttgaatgaagcaaaaggaataagcataaaacgggtaagtatcagaggaatatcaaacgcacaatcccttcatgaaaagaaagataaagacggtaacctaatattaggaaaagaaggaagaaaaatacccgtagattttgtcaacacaggaaacaaccaccacgtagctatctataagaaaccagtattagataaagtaggccaagtggtattagacgaagaaggaaacccaaaatacgaactcgacgaagtagtcgtatcattcttcgatgcagtaacaagagcaaatttaggacagccaataatcgacaaagattatcgacgatctgaaggatggcaattcttattcagcatgaaacaaaacgagtatttcgtatttcccaacgacaagactggatttaatcctaaagaagtagacctactcaacccagaaaattacgccttgataagccccaacctctttcgagttcaaaaatttgcatacaaaaattacgttttccgacatcatctagagaccacgatcaaggacacaagtagtaccctaaaaggaataacatggacggatttccgaagctcgaaaggattagacaaaatagtaaaagttcgtgtagaccatatcggtcaaatagtcagcataggagaatactga

SEQ ID NO: 8691 - RNA, 3663 nt, synthetic construct
  misc_feature 1..3663: note = Cas9 variant
  source 1..3663: mol_type = other RNA
atgaaaagaatcctaggattagacctaggatcagcaagcataggatgggctctaatagaagaagatgaaaaagggataagaataatagcactaggctccagaataatcccgtataacggaactgaaggacaagattttgcaaaaggagctggtgaaagcagaaattcccttcggacgcaagcacgaacaactcgaaaaggatacgatagataccaattgcgaaggaaatatctaataaatgtacttgaaaagaatctgatgatgcccagtgaagatcttcgaaagatgccaaagatgaacctatggcaactaagaagtaaggcagtaacagaatatatttctagacaagaactcggaaggctattactatggctcaaccaaaagcgaggttataaaagtagccggagcgatgcaaacttagacaagaaagacactgattacgtaaaagaagtcaaatcaagatttgacaaaataaaagagaaaaaccaaaccattggccaatacttttatgaatcactgcaatgtgatgaatatttcagagtaaaagaaaatgtcttcccaagagaagcatacattgcagaatttgatgcgatttgctctcggcaaaaagatcacttaggtctaagcgaggaacttatagctgaaataagaaacgaaataatatattatcaacgaccacttaagagccaaaagggcttagtaagcgtttatgacttcgaagggaaatggatgaatcaaaatggtaaagaactatttattggcccaaaagtggcgcacaaatcaagccctctatttcagttagccaaaatttgggagtcagtaaacaacataaaactatcaacaaaatacggagatacaatcgaattaacattagaagaaaagaaacaattagtcgaatttctcgacaataacgaaaaattaaccacggctgcgttatttaaaatactgaggaaagacaagaaagaatacattctcccaaaacaactagaaaaaggactacaaggaaacataaccaaatgtaaaatagcagatatcctcggaagtaaatacaatcaattgctacagttaaatcttgaaaaacaagaagtaggaacaccctgttacttatatactaaatcgacaggtgaagtgcttggagaaaaaccactacaatacatagacaaatcagtcgaaaaagaactattttaccaattatggcatacaatctactcaatatcagacgaagatgaatgctgcaaagcactacagaaaagatttgatatagatgctgaaactgcagggagactagctaaaatagacttctctaaatatggattcggaaacaaaagtgcaaaagcaattaggaaaatactaccatacttaatggaaggtgacaaatacagtgacgcaatgtgttatgcaggatacaatcactctaactcactgactaaagaggaaaaccacgaacgtaaactcaacgacaaattaaaactactaactaaaaacagtttgagacagcctatagtagagaaaattatgaatcaaatgattcaacttgtaaataccataatcgacaaatacggaaaacctgatgaaatacgactcgaattagctagagaattaaaacaatcaaaagaagaaagaaacgacgcggataaagccatgtccaaaagacagcgagaaaacaaagaagcagaaaagaaacttgaggaacatggaatacgagccacacataataatatactcaaatacagacttttcgaggagatgggagaaaagaaacacgaagcaatttgtatatactgtggaaaccccatttcattctcggcagccatgaatggtgacgaagtagatgtagaacacataataccaagaagcaaattattcgatgactcacaatcaaacaaaacactagcacatcgtaaatgcaatgcaaacaaaaatgatatgacagcatacgatttcatgaaaacgaaaagcaaacaagactttgataaatatgtagaaagagtaaaccaattatacgcagaccgtataattagtagaagtaaatataataaactactcatgtctgaagatgatataccatcaaatttcatagatagacaactacgagaaagccaatacatagctacaaaagcacgagaaatattgcaaacaatttgttataatgtatggtctaccagtggaacagtaacagcagaacttagacacttatgggggtgggatgacataacaatgaatttacaaatgcccaaatacaaagaattagggttaaccgaaatggtagaatggacaagtgatcatggtaaaaacgtacacagcaaagaagttataaaaggatggacaaaacgcgatgatcacagacatcacgcaatagatgccctaacaatcgcatgtactaaacagggattcatccaaagatttaataccctgtcaagctctaaaaccagagacgacatgcaaaaagagctcgaaaaatgttcaattcaatttcgcgagaaaagatccctcctggaaaaatatattatatcacaaagaccaatatcggtgagtgacgtagccgaagcagtatcaaggatacttatctcatttaaagcaggaaagaaagtggcgacaataggaaaacgcaaagttaaaggaaaagtcgtacaacaaggaatcgtagtaccacggggagcactatcagaaggatcagtatacggaaaaatacgtacaatcgtaaggaaaatgcctgtaaaatatctgtttgagaatccagacttgatatttaaaccatatataaaagctctcgtaaaagaaagactagcagaatttgacaatgataacaaacaagcactcgcatcactgaagaaaaacccagtctatttagacaaagagaaaactaaattactggaatacggcacgtgttttaaagatgaatacgtaaagaaatatgacgtaaacccaaatttcacaaaaattgcagacgtaatagatggaaaagtaaaacaaatattggaagatagactatcaaaatttggaggaaaacccaaagaagcattcaaagacgttgtaaaagacggtaaaacccttaaatggtacgaagacgaaggactagaacgaccaataagatccgtaagatgtttaacaggattgagcgcagtagtaccagtcaagaaagacgaaaacggaatggacataggattcgtaaaaccaggaaataaccatcatgtagcaatatatgtaggagcagatggaaaaggacaagaacacgtctgtaccttttggaatgctgtagaaagaaagaaatacggactaccaataataataaaagacgcgaatgaagtatgggataaaataaccatggccggtgacgatgtctacccacagagctttttatcactcttaccaaaaccagattggacactaaaactatcaatgcaacaaaatgaaatgttcatattaggtatggaggaagatgaagtaaaattcgcaatagaaagcaaagactataaattattatcagaccacttgtaccgagtacaaaaactatcaagttcagattacaactttatccaccatttggaaactgatgtccaaaagaaaacaatgacctacagagtcagatcgttatcaggcttgtttgctctcaggccattcaaagtccgcattgactgtttaggaaacataatccccagctga

SEQ ID NO: 8692 - RNA, 3669 nt, synthetic construct
  misc_feature 1..3669: note = Cas9 variant
  source 1..3669: mol_type = other RNA
atgaagaaacgtatactaggactagactcgggaacaaatagtctaggttgggcagtcgtagacagagatgagaataatcaatactctctaattaaatacggggatcttatattcgaggaaggagttaaaatagagaaaggagtagaatcatcaaaagcagcagaacgaacatcacatcgagctttacgtaaactttactttagacgacgactcagaaaaatagaagtgttaaaagtcttagtaaaatataacttatgtcctcaagtcagcgaagaggaactacatctctggcatacaagaaaattatatcctcaaaacaaagacttacttcaatggcaacgcacagatgaaaaagctggaaagaatccttacatatatagatacagatgccttcacgaagaactcgacatgtccgtttcagctaacagaatgacagtaggtagagctatgtatcatcttgcacaacgtaggggattcctttcgaatcgcctcgacaatgaagaagatgaaaaccaaataggagctgttaaatgcggtatatctaatcttacagaagaaatacaatccagtggttgtaaatatctaggagaatacttctataaactctataacgaacatggaaacacagtaagactaagaaccagatatacatcaagagaatttcattacaagaaagagttctacgcaatatgcgaaaaacaaaaactcgacaagaaattaatagaggaactcgcttcagcactctatttccaacggccattaaaaagtcaaagacataccgtaggtcgatgtacatttgaaccaaacaaaccacgatgtgctgacagtcatccagcctatgaagaatttcgaatgttatctttcataaatacaatcaaagttcagggaccatatgacactgaactaagagtacttaatacggaagaaagggacagcatcactaaattgttctgtagaaaatcaaaacctaactttgactttgaagatatagcgaaagaactggcaggtcgaaacaattactgttacataggagatgttgtagacaaagcatataaatttaattatagaatgtcgcagggagtaagtggatgcccaactactacatacttaattaatgtatttggtcaggactggcaaacagggatagccgaatcctaccaagctatcgacacaaaactaggacaaaaatcagtagatgcaatgatagacgacgtatggaatgtactgtattcattttcatcaaaagataaattaagagattttggacgtaagaaattacaactaggtgataaagaagccgatacttttgcaaacataaaattaacacataaatttgcaagtctaagcctcaaagcaattagaaaaatcaatatatttttacgaatgggcctagtatacagccacgccgtaacattagcaaatatacccacaatagtaggaaccgacatctggcaaagaaaaagaaactttattttagctgagttactaccactgatcgaaaacttcaatccgaaagaaacaaaactccaagaaacactagatttctgcgtgaaagacttcttacaaaacaacttcgaactgaaaaatggagcagttgacaaattatatcatccctcaatgatagaagcatatccagacgccgggttaaacagtaatggtatactacaactaggatctccaagaacaaatgcaatacgcaacccaatggcaatgagatccttacacgaaataaggaaagtaataaaccaattactaaaagataaaatcatcaatcaagacacagaaatacacgtagaatacgctcgcgaactcaatgacgcaaataaaaggaaagcaataagcatatggcaaaaatcccaagaaaaattacacaagaaatacgtggaggaaataacaaatttatacaaagaggaaacaggtaaagctatagttccaacagacacagatatattaaaatttaaactgtgggaagaacaaaaccatatttgtctatacacaggtcaacaaattggaatagcagaatttttaggagctactccaaaatacgacatcgaacataccattccacaatctgtaggtggagatagcacagacatgaatctcaccctatgtgattcaagatttaatcgagaaatcaagaaagctcaattaccaacacaactgggtaatcacgcagacatcctagtacgaatagcagggtggaaaaattcatatgagaaactaagcaaagatatagatcgtatacgaacacacagtggcatggctaaagatataaaagatcgattaatacagaaacggcatttactaaaattagaaagagattattggaggggtaaatatgagaggtttacaatgaatgaaataccagaaggattttcaagacgacagggagttgggataggactaataagcaaatacgctggtctctaccttaaatcattattccacgataaaaacgaaagaaacaaaggccatgtattcgtagtaaaaggaacaacaacagccgaatttaggaaaatgtggggacttcaaaacgaatatgaaaagaaaagccgtaacaaccacgttcaccattgtatagatgcaataacaattgcatgcatcggaaaacatgaatatgcccaaatggcccaatactaccatgatgaagctgaatatctctaccatcacgggataaaaccaatattcccaaaaccatggaaaaccttcacagaagaccttctagatctagaacatagtctattcgtggtacatcactcacctaacaatatggctaaacaagcccgaaaacgcattataacatcaacaggacaacattgggcacaaggagattcagcacacggcagcttacacaatgacacatactacggagcaattgaaagggatggagaaataaaatacgtggtcaggagagcagtctccagtttcgaacaaatgtcagacgtagactcaatagtagatgatgtagtaaaagaaacagtacgtaaagccttagaaggtaaaaactttaaagaagccgtaaacgctcccatatacatgaataaagaaaaaggagtgttaattaagaaagtaagatgttatgccaaaagcattaagaaaccaattgacataagaacacatcgagacagctcatccaaagaatataaaagaaaattccatgtatcaaacgacatcaattacctaatagcaatatacgaaggtacagttaaaggcaaagtaaaaagagacttcgaagtagttaaaaacatagaagcggcaaactttttcaaaagatcccaagataggcgtgattacccaacgatagtaccagaaaaatcaataaaacatggttttccactaaaaacaaccttaacgaatggcaccatggtaatattatacgaggaaaataaagaagaaattgacttcaccaagaaagaagatatctgcagaagactttataaactggtaggaatgtcatcaatgatagttagtggatgtgaatatggagtactatcccttagacaccatcaagaagctcgaccatccaaagatatcaaaagcaaaaatggagcattcaaaaacggagaggccctaagacccgccataacaatgttacacacacaatttaatgccttagttgaaaatatagatttcaacatagatgtgacaggaaacatagaattaatatga

SEQ ID NO: 8693 - RNA, 3669 nt, synthetic construct
  misc_feature 1..3669: note = Cas9 variant
  source 1..3669: mol_type = other RNA
atgaagaaacgaatactaggtcttgatagcgggacaaactcattaggttgggcagtagtagacagagatgaaaacaaccaatacagcctaataaaatacggagatctaatattcgaagaaggagttaaaatagaaaaaggcgtagaatcctcaaaagccgctgaaagaacgtcacaccgagcactcaggaaactctactttcgaagacgattaagaaaaatagaagtcttaaaagtcctagtaaaatacaacttatgtccacaagttagcgaagaagaattgcatctttggcatacacgtaagctatatccacaaaacaaagatttattacagtggcaacgaaccgacgaaaaagaaggcaaaaatccgtatatctaccgttatagatgcctacatgaagaattagacatgagcgtatcagccaatagaatgacagtgggacgagccatgtatcatctagcacaacggcgaggatttctttcgaacaggcttgataatgaagaagacgaaaatcaaattggtgccgtaaaatgcggtatttcaaacttaaccgaggaaatacaatcatcgggatgtaaatacctcggggaatatttttataaactttacaacgagcatggaaacaccgtaaggcttagaacaagatatacatcaagagagttccactacaagaaagaattttacgccatatgcgaaaaacaaaaactcgataagaaattaattgaagaactagcatcagctttatactttcaaagaccccttaaaagtcaaaggcatactgtaggtagatgcacatttgaacccaacaaaccacgatgtgcagattcccaccccgcctatgaagagttcagaatgttatcttttattaacacaataaaagtacaaggaccatatgacacggaactcagagtactgaatacagaagaaagagacagtatcacaaaattattttgtcgaaaatcaaaaccaaacttcgattttgaggacatagcgaaagaactagcaggaagaaacaactactgttatattggcgacgtagtagataaagcatataaattcaactacagaatgagtcaaggagtatcgggctgcccaacaacgacctatctaataaatgtgtttggtcaagactggcaaactggtatagcagaatcatatcaagctatagatactaaattaggccagaaaagcgtagatgctatgattgatgatgtttggaacgtcctatactcatttagtagcaaagataaattaagagacttcggtagaaagaaactgcagctgggggacaaagaagccgacacattcgcaaacattaaactaacccacaaattcgcatcactatcattgaaagcaatccgaaaaattaacatattccttcgcatgggtttggtatactcacacgcggtcacactagctaatataccgacaatagtaggcacagacatatggcaacgaaaacgtaacttcatactagctgaattgctaccgctaatagaaaatttcaatcccaaggaaactaaattacaagaaactctcgatttttgtgtaaaagattttctacaaaataacttcgaactaaagaacggagcagtagataaattatatcacccatcaatgatagaagcctatccagacgcgggattaaactcaaacggcatattacaattaggatcccccagaacaaacgcaattcgaaatcctatggctatgaggtcactccatgagataagaaaagtaattaaccaattactaaaagataagataatcaatcaagatacagagatacacgtagagtacgcaagagaattaaacgacgcaaacaaaagaaaagcaatatctatatggcaaaaatctcaagaaaaattacataagaaatacgtagaagaaattacgaatttatacaaagaagaaacaggaaaagcaatagtccctacagacacggacattttaaaattcaaattatgggaagaacaaaaccatatatgtttgtataccggacaacaaataggaatagctgagttccttggagccacaccaaaatatgacatagaacatacgataccacaaagtgtaggaggtgattctacagatatgaacttaaccctttgtgacagccggttcaatagagaaattaagaaagcacaattaccaacacagttaggtaatcacgcagatattctagtgagaattgcaggctggaaaaactcatatgaaaaattatccaaagatatagaccgcataagaacacacagtggcatggcaaaagacataaaagatagattaatacagaaaagacacttactaaaactagaaagagattactggagaggaaaatacgaacgattcaccatgaatgaaattccagaaggattttcacgaagacaaggtgtcgggatcggtctaattagtaaatacgctggcttatatctaaaatctcttttccacgataaaaatgaacgtaataagggacacgtctttgttgtgaaaggaactacaacagcagaatttagaaaaatgtggggattacaaaatgaatatgagaaaaagtcaagaaataaccatgttcatcactgcattgacgccattactatagcttgcatagggaaacatgaatacgcacaaatggctcagtactatcacgacgaagcagaatatctatatcatcatggaataaaaccgatcttcccaaaaccatggaaaacattcacagaagacttactcgacctcgaacatagtctgttcgtcgtacatcatagcccaaacaatatggcgaaacaagctagaaaacgaatcatcacaagtactggtcaacattgggcacagggtgatagtgcacatggatcgttacacaatgacacctattacggcgccatagaaagggatggagaaataaaatacgttgtcagacgagcggtctctagcttcgaacaaatgagcgatgtagactcaatagtagacgacgtagtaaaagaaacagttagaaaagcactagaaggcaaaaattttaaagaagccgtaaatgcacccatatacatgaacaaagaaaaaggagtgttgataaagaaagtaagatgttacgctaaatcaattaagaagccaatagacattcgaacacatagagactcatcgagcaaagaatacaaaagaaagttccacgtttcaaacgacataaactacttaattgccatctatgaaggaacagtgaagggaaaagtaaaaagagattttgaagtagttaagaacatagaagcggccaactttttcaaaagatcacaagatagaagagactatccaacaatagtaccagaaaaatcgataaaacacggattcccattaaaaacgactctcacaaatggaaccatggtaatactttacgaagaaaacaaagaagaaatcgacttcacaaagaaagaagatatatgcaggagattatacaaactcgtaggaatgtcttcaatgatagtatcaggttgcgaatatggcgtactatctctaagacaccatcaagaggccaggccatccaaagatataaaatcgaaaaacggagcatttaaaaacggagaagccttaagaccagcaataacaatgctgcatacccaattcaatgcattagtagaaaatatagattttaacattgacgttacaggtaatatcgaattaatttga

SEQ ID NO: 8694 - RNA, 3678 nt, synthetic construct
  misc_feature 1..3678: note = Cas9 variant
  source 1..3678: mol_type = other RNA
atgtcaaaacgtatactagggatagacgtaggaaccaacagcttaggatgggctgttgtagacagaactgactgcgacaattacacactcgtaaaaagaggagacgtaatcttccaggaaggagtaaatattgaaaaagggaatattgaaaaatcacgtgcaagcgaaagaacaggccatcgatcaacaagaaaacactactttcgcaggagaatgttgaaaattaaagttctagaaatactcgtagaacaccaattatgcccttacctaagtcacgaagaactacaccaatggatgacgcggaaagtctaccctactaatgaagatttccgtctttggctaaggaccaatgacgcaaacgatcaaaatccgtatcatgatagacacgtgtgtctacacgaaagattagatttaagactacaagaaaaccgatacagattaggtcgagcactataccacttagcacagagaagaggctttcttagtaacagactggaacaaaattcaaaaactgacgaaacaggagccgtaaaatcagacataagccaattaaatgaagaaatgaagaaagccggatcacaatacttaggagattatttttattggctttaccaagaatatggaaatcaagtcacactacgaataagatatacagacagaaaacaacactatcaaaaagagttcgaagcaatatgtcaaagacaacaactttcagacgacctagttgacaagttacgaagggcaatatactttcaacgtagtctaaaatcacaacgagccggagtcggaaaatgcacatttgaaccagacaaacctcgatgcgctttgtcacatcccagatacgaagaatttagaatgttatcatttctaaacaacgtcaaagttaagggaccatctgacgatagtttaagaccattatcacccagcgaaaaagagaaaatcaaacccttattcctcagaaaatcaaaagcaaatttcgatttcgaagacatagccaaagcaattgccggaaaaggcaaatacgcatgcattagagataaagaaggtgctcaaaaaccatatcaatttaactacgcattatcccaaggagtcagcggttgtcctgtaacagccaaactaatagctgtctttggggaatcttgggaaagaaaccttgtgaatgcctacagatcacgcaatgatatgcgcaaatcagacgaagaaatagtaaatgaagtatggaatgtattgtattcctttagttcgaaagaaaaactaagagcgtggggtatggaaaaattagggttagatgaagcatgtgctggtgagttcgcagacatcacattgcccacagcatttgctgcattatcactaaaagccgtaaataaaattctgccatttttgagacaaggattcatctactcccacgcggtaatgctagcaaatattccttatataatagggatggatagatggaacgaaccccgccaacgacaattcattatggataacctacaagaactactagacaacttcacggcctcagacaaagcgctccaacaaacacttgatttttgtataaaagatttcttactgaacaattatgaactagcaccaggaaaggcagatagactataccaccccagtatgatagaaacatatccagacgcgaaagcagacggacaaggaatatatcaattaggaagcccagcaaccaacgcaataagaaatcctatggcgatgagaagccttcatatcttacgccgggtcgtaaaccaactcctaaaagagaaaacaatagattcagaaacagaagtccatatagaatatgcacgagaattaaacgacgcaaatcgccgatgggcaataaatcaatggcaaaggaaacaagaaacacaacgaaaagactatgcagagaaaatcagaaaagtctatgccgacgagttcgaaaaagtaattgaaccaacacaagaagaacttttaaaatatcagctctgggaggaacaacaacatctttgtttatacacaggagaacaaatcggacttacagattttataggaccgaacccaagatatgatatagaacatactataccacaatcaatgggtggggattcaacaaggatgaacttaacattatgcgaaagaacatataacaggacagttaaaggcaaccgaatgccgtctcaattagcagaacatgaatcaatattaactagaataaagccatggaaggataagtatgaagaactaaccgtaaaaataaataaactaagaactcatcctggaatggacaaagctagtaaagataacataataagaaaaaggcatttactagaactcgaaagagattactggtttcaaaagtaccaaagatttacaatgaccgaagttccagaaggattctcactaagacaaggaacaggaataggacttataggaaaatacgcaggtctttttctaaaatcactcttccatcatgtcaaggaaagaaacaggaagcaagtatacgtaataaaaggaccaataaccgctgagttccgtagattatggggattacaaaatttatatgaacaaaagtctcgagataaccatgcacatcactgtatagacgctattgtaatagcatgcatcaatccggccgaatacgccagaatggcatcttattatcgacaagaagaagactttcgcctgaacaagggaaataaaccggtattcccgaaaccttggacaacgtttacccaagatctacaggcattagaagcagaactgttagttgttcatgaaacaagaaacaatcttacaaagaaagcacgaaaacgagtaagaaccaaaggtggaaatgttctttcagaatcggattctgccagaggcagcttacataatgacacttattatggagctatacaaaaagatggagttattcggtacgtagtaagaaaagccctaagttcattatctgaaaaagacgtaaaagatatagttgacaaaaccgtcagagaaaaggtacaagctgctattcaagaaaaaggagctaaagaagcattagcaggaacaatctacatgaacgaagaaaagggcatcaccataaagaaagtgagatgttttacgaaaatagctagccctctagctatacgccgtcatcgggacgcgtcagccaaagaatataaaagaccatattatgttaccaacgaaagtaactacgtaatgggaatatacgaaggatgcataaaagagaaaacaaaaagagagttcatcctagtaaacaacttagaagctgtacgacagctcaaagcagcgagaaaacaaggagtagtctcttcgatattaccaccagtatcagcaaaatctcagttccctcttaaatataggttatatacaggaacgttggtcttattatatgaaaacagcccagaagaaatagactttaccaatcaagtggacatatgcaaacgtttatacaaagtaacaggtctcagctccatgacagtcacaggtaaccaatacggaacaatccaattaagataccaccaagaagcaagacaagcaaaagatctaaaagctcaaaatggcgcatataaagaaggcgaagaacaccgacccgcaataatgatgctccatacacaattcaaagcgttagtagaaggaacggattttagaatgaatatcttgggagaaatagaacccctacgcaaatga

SEQ ID NO: 8695 - RNA, 3690 nt, synthetic construct
  misc_feature 1..3690: note = Cas9 variant
  source 1..3690: mol_type = other RNA
atgggagacagaaaatataacttaggattagatataggaacatcaagcattggatttgcagccgtagatgaaaataaccaacccattcgtgtcaaaggaaaaactgctataggagtaaggcttttcgaagaaggaaaaaccgcagccgatagacgtggatttagaacaacgcgaagacgattatctagaagacgatggagaataaatctattaaacgaaatctttgatgcacatctagcagaggtagaccccacattcctagcaagattaaaagaaagcaatagaagcaaccttgacccaaaaaaatcatttcaaggcagtctattattcccagagcgaaaagactaccaattttatgaagaatatccaacaatataccaccttagaaaagccctcatggaaaaagatcgcaaatttgatataagagaaatatatctagcagtccaccatatcataaaatatcgaggaaacttccttaatggaacaccgatgagatcatttaaagtcgaaaacatagaactgaatacactctttgaccaactaaatcaactatatgccgaaatagttccagataacgagctcgcatttgaccttgctcaagtagccgacgtaaaagacgtactgagctctaccacaatatacaaaatggataaaaaaaaacagttagtaaaaatgatgttactccccgcaagcaataaagcactgcagagtgaaaacaaaaaaatagtaacacaatttgtgaacgcaattctcaattataagttcaaattagacgtactcctacaagttgagacagatgcagattggtcactaaaattgaatgatgaaggagctgatgataaattagaagaatttactggagacttagacgaaaacagactagaaataatcgatctcctgcaaagattacataattggttcagcctaaatgaaataaccaaagacggaaactcactatcagccgcgatggtagaaaaatacgaaaatcaccaccaccatctcggacttttgaaaaaagtgatagaaaatcacccagatgccaaaaaagcaaaagcactgaaagaaacttatacagcatacgtaggcaagaccgacgataaaacacaaaatcaagacgatttttataaagcagttgaaaaaaacctggacgattccccagatgcaaaaggaataaaaagattaatacaactcgatcaatttatgccaaaacagagaactggacaaaatggagcaatcccacatcaactgcaccaacaagagcttgatcaaataatagaaaaacaaagcaaatattaccccttcctcgcagaacccaatccaaatgttaaaagacgaaaagatgcaccatacaaattagacgaactcattgcatttaaaataccttattacgtaggtcccctcgtaaccccagaagaacaagctcaaaataaagaaaatgtttttgcctggatgaaacgcaaagcagccggtcctataaccccatggaactttgatgaaaaagtagatagaatggaatccgcaaatcgctttatcaggagaatgacaacaaaagacacatatttattcggagaagatgtacttcctgcagaaagcatgatatatcaaaaattcgtagtactaaatgaattaaataatttaaaaataaatgggaggcatttatctctaaaagacaaacaagacgtttataatgacctgtttaaacagcaaaaaacagtctccattaaggccctacaaaactattacgtaacaaaaaagaaggccgccacggcacctactgtaggaggtttagcagaccctaagaaattcctatcttctctctccacgtacatcgattttaaaaatatgtttggagaacgagtaaacgacccccaattccaagaagacctagaacaaattgtggaatggtccactatattcgaggatagaggtatatttaaggccaaactgcaagcactgggatggctcagcgaaaaacaaattcaacaacttgtagcaaaacgttataaaggctggggaagactaagcaaaaaactactaacaggcctcaaaaatgcggaaggatactccattttagacgaaatgtggagatcaactgaaaatttcatgcaaattcaatcacgacctgaattcgcagctttaatacaacaggccaatgaaaaacaattcgaggggaacgatcctgacaatgtatgggagaatatagaaaatatactaggtgatgcatatacatcacctcaaaataaaaaagcaatcagacaagtagtcaaagtggtacaagacattgaaaaagcagtcggaaacccacctgaaaaaattgccatagaattcaccagagaagccgctgcaaatccacaaagaacacaaagcaggctacgaacactagaaaaactatacgaaagtgcagaagaagtcgtagatgccggcttgaccgccgaattagcagaatttaaggaaaacaaacatgtactctcggataaatattacctgtactttacccagctaggtagagacgtttatacaggagatacaataagtcttgacaaattaaatgactatgatgtcgaccatatactcccacaatcttttataaaagatgattcattagataacagagtcctaactattagggctgtaaataacggaaaaagcgacaatgtaccagcaaaaatgtttggaaagaaaatgggatcattctggagacacttgttagataatggaatgatatccaaaagaaaatacaacaacttaataacagatccagacaatatatccaaatacgcacaaaaaggatttataaatagacaattagtagaaacatctcaagttatcaaactcacagcaaatatcttaaacgggatatatgacaaagatacggaaataatcgaagttccagcaaaaatgaacagccaaatgagaaaaatgttcgacctagtaaaagtacgcgaggtcaacgactaccatcatgcattcgatgcctatttaacaatcttcattggaaattacctttacaaatgttaccctaaactccgaccgtatttcgtgtatgacaactttaaaaaatttgggaacaaagaagacataggacacaagagatttaatttcctaggtaagatagaaagagaaaaaaaagtcgtagctccagaaaccggtgaaatcctctggagtaacgtagcaccaaatgaaacgattaaacaaattaaaaaagtctataactacaaatttatgatagtctcccgcgaaataacgacaagaagagcggaacttttcaaccaaacagtttatccaaaaaactatcgtggcaaattaataccaataaaagaagatagaccaacagatctttacggcggatacagcggaaatacagatgcgtatctagccatagttgcattagaagacaaaaagaaaggaaaatatttcaaagtagtgggtataccaacaagagccgcagccaaattagaaaaactaaaacaacaagacagccaacaatatcttcaagcactccacgaagtaatagctccacaattcacaaaaagtaccaaaaaaggtataaaaaaaaccgaattcgaaatagtactagacaaagtacactatcgccaattggtacaagacggtcctgtaaaaatgatgttaggatcatcaacatataaatataacgcaaaacaacttgtgctatccgaaaaagctctttga

SEQ ID NO: 8696 - RNA, 3696 nt, synthetic construct
  misc_feature 1..3696: note = Cas9 variant
  source 1..3696: mol_type = other RNA
atgataactagaattttaggacttgatactggtactaactctttagcgtgggcagtagtagacagagatgcaaatggaaattatacattagtaaaaaggggagatgtaatattcactgaaggggttaaaatagaaaaaggaatcgaatcaagcaaagcagcagaaaggacagcgcataaagcattacgcgtacactatagtaggagacgtttacacaaaatcgataccctcaaagtacttgtagaattagatttatgcccatacctatctaatgaacaactaaatttatggaaagctaagaaaacatatcccctaacagacgactttatgctgtggcaacgatctggcagtgctgaagaaaataacccttactactgtcgacacagatgtttgacccaaaaactggatttaacagaccaaagtcaaagattcttgctaggacgcgccttttatcatctagctcaaagaagggggtttctttcaaatagattagatacatctgccgattctgatgaatcaggcaaagttaaatctggaatagcagaactatccgtagaaatggaaaaagcaggatgcgaatttctaggagaatatttctatcagttatacaaacaacacggaaatactataaaactacgctctagatacactgacagggaagaacactacaagaaagaatttttagctatatgcgaaaaacaagaattggacccaaaatgggtagaagcactacaacgggccatctacttccaacgacctctaaaaagccaaagaaaaggagtaggaaaatgcacttttgaacctaagaaacccaggtgtgcagaatcacacccagattatgaagcattcaggatgctatgcttcttaaacaacgtgaaaattcaaacacccaatgacacgagcttacgacccttaaatgaagacgaaagagagaaaatttggccattatttttccgaaaatcgaaaccaaatttcgatttcgaagatatagcaaaagccctagcaggcaaaaataattacgcctggtacaaagatgccggtgaaaaaccattcaaatttaactatagaatgcaacaaggtgtatcaggatgtccagtaacagcacaactaatagatatttttggatcagactggcaaactgcgattgcagaaacgtacacagcagtagagaagaaaaatggtacaaaaaccatagatgaaatggcagatgacgtatggaacgtattatattcattcagctcaaaagacaaattaaaggctttcgcaactgaaaaactacaattagatgaagcaagcgctacaaaatttgctaatgctaaactcccacatggcttcgctagtctaagtctcaaagctatacggaatatcttaccctttttaagacaaggattcatatatgctcatgccgtacatctagctaaaatacctgatattgtaacaaaagctgtttggaacgacgcagataaaagagaaatgatcctatcaggtttgatggaaataatagaaaattataatcccaaagatagaggagttgaaggtacaatagatttctgtattaaaagtcatctacaagatgtaattgacctgcgccctggagcagcagacgcactatatcatccttcaatgatagaaacatacccggatgcaaaattgaacaaaatgggtgtttttcaactaggtagccctagaacaaatgcaatacgaaacccaatggcaatgagatctctgcatattctacgatcagtagtaaaccagcttttgagagacggaataatcgacagaaacactgaagtgcatgtagaatatgcgagagaactaaatgatgcgaacaaaagaaaagcaatagcagattatcaacgcgaacaagagaagaaacgaaaacaatatagggatgatataatagcactttataaaagcgaatgtcacaaagaaatagaacccacggacaccgacatcttaaaatttcaattatgggaagaacaagaccacctgtgtttatacacaggtacacaaataggaatctgcgactttctgggggataatccaaaattcgatattgaacacacagtacctagaagtgtcggcggagatagtacgcaaatgaacttaacactatgcgatgcaacgttcaatagacaagtaaaaggggcacaattaccaagtcaactatcaaatcacgccgatatactcgtaagaattgatcactggaaaagtaaatgtgaagatctgcgaaaacaattagacaaaatacgcacatacggaggtatggaaaaagcaatgaaagaccgattgattcaaaaacgacatagattaaaaatggatttggactactggcaagggaaatatagtcgatttactatgaccgaagtaccagaaggttttagcagaaggcaaggtgctggaataggattagtatccaaatatgcaggcttatttttaaaatcacttttccataacgaacagaatcccaacaaatctaacgtttatgtagtgaaaggagtaacaacagcagaatttagacgtatgtggggcttgcaaggagaatacgagaagaaaagtcgacttaaccactgtcatcactgtatagacgcaataacaatagcatgcataggtaaagctgaatatgacaaaatggcacaatattaccatgacgaagagttattccaatggagaggcacaaccacaaaaccacattttaataaaccttggcctacgtttaccgaagatgtcttagcaatagaacagtcactattagtaaaacatctaacaaaggacaacatgccgaaacaagcaaagaaaagggtaagaacagcaaccggaaaatacctggctcaaggtgatacggcacgaggatcactacataaagacacctactacggtgcaatagaacaagatggagaaatacgatacgtactaaggaaaccactaaacaaattcgagaatgaagcagaattagagaaaattgtagaccaagcggtaaaagagaaaattaaagaagccatagcagggaaaaattttaaaacagcaataacagagccaatatttatgaataaagagaaaggaatccgtataaacaaagtccgatattatgtcaaagcccaagaaagactcaaaataagacaacaacgtgacctatcaagtaaagaatacaaacaattcttttgcgtagaaaatgaaagcaactatttgttagcaatatacgagggagaattaaaaggaaagaaagagagagatttttgtgtggtaaacaatctggagtcagcggcatgtttaaaaagaagtaataaaggtaaagcagctccacttgttccagaaagaagtgaagaaaggaatttaccactattagcggtattaaaaagaggcacacaagtactattttatgaaaactccccagaggaaatcttgtttgacaatccacaagacttagtaagaagactatacaaagtcacaggtataaacactaagaaagatgtcaaaaatggtaaaacatatttatacgggaatatagagttaagattccatcaaaatgctcaaaagaaagatgacgtcaaaatgcaaagtggcgtatacaaaaataatgaagtgttacgacaaggaatagtattaagtcataaacagtttaaagctctagtagaaggagttgacttcgagttcaacgtattaggagaaatcaaaaagaaagaaaggcatgcatga

SEQ ID NO: 8697 - RNA, 3699 nt, synthetic construct
  misc_feature 1..3699: note = Cas9 variant
  source 1..3699: mol_type = other RNA
atgacaaaaacacgaatacttggactggatacaggaacaaatagtctaggatgggcaatagtagaccgtgacgaagtttcaggccaatatgagctagtagacagaggagacttaatatttacagaaggtgtaaaaatagaaaaaggaatagaatcttccaaagcaagcgaaagaacacaacacagagcactacgaaagcaatatttcaggcgacgactacgaaaaatagaagtactcagagttttaacattctaccatttatgtcccccagtttcagaagaagaactacatttatggcacgtaaagaaaatatacccggttgaaaatcacgaatttatgatatggcaacgtactaacgacaatgaaggtaaaaacccgtattattacagacacatttgtctccacacaaaattaaacttgacgctaatgaaagatagatatatacttggcagagctctatatcacctttctcaaaggagaggcttcctatctaacagactagaccagtcacaagacgaggatgacaaaggcacagtaaaaactggaatcagctccttaagtaaagatatgaatgacgcgggatgtacatacctaggagactatttttataaactatactcagaaaatggtaatcgagtaagaataagaaaccactacaccgcacgaaatgagcattatctagccgaatttgaagcaatctgccaagttcaaaaattagaacccgaattagtagaagcccttcgcagagcaatatttttccagcgaccgcttaaatcacaaagaaaaggagtaggaaaatgcacatttgaaccacgaaaaccccgatgtgcagacagccatccggattacgaagaatttagaaaattatgttttattaacaacattaaaatccaaacatcagatgacgacacaatgagaccactgaacaaggaggaacggcaacgaatcaacagtctgttttacagggtatcaaaagcaaatttttattttgaagaaatcgcaaaattattaggcggccgaaacaactactgttatttcaaagacgaagtacaaaaagactttaaatttaattaccgaatgtcacaaagcgtaagcgggtgcccaacgacagctcaattaagaaatatcttcggagaagactggaaaaccggcatcgcagaaacatatcaacactcagcaaagaaagacggatccctcaaaacagtcgatgaaatggcggatgacatttggaacgtactgtattcattctcttcaaaagattgcttgtataatttcgcagtaaataaactacagctagaagaagacaaagcaaagaaattcagcaaaattaaattatcacatgggtttgcatcaataagcctaaacgcaatacacaaaatattaccgtttctaaggatgggtatgatatattctcatgctgtcctttttgccaacattcctaccatagtaggaatggatgtatggaatgatgaatcaaaacgacaacacattatgactgagttgagcgatttagtatttaattatgatcccaaaaatagagaagtcgaaggtacaatagaaatgtgcatcaaagactttttgctaaataactacgatttaccagccggcgctgtatgccgattatatcacccatccatgatagacacatacccagacgctaaagcaaataaatatggcgtattacaattaggatcacccgcaacaaatgccataagaaatccaatggcaatgagatcgttacacgaattaagacacgtagtaaacctcttactaagaaaaggaaaaatagatcaaaataccgaagtacacgtcgaatatgctagagagttaaatgatgctaataagcgaaaagcaatagctgacagacaacgcgagctagacaaactacacaagaaataccatgatgatattataacactctataaagaagaaaccggaaaagacataaatccgacacaagcagacatattaaaattccaactatgggaagaacaagaacatgtatgcttatacacaggacggcagattggcatcagtaaatttttaggtccagacccagagttcgatattgaacatacggtaccaagatcagttggcggggacagcacacagatgaatatgactctatgtgacaggcgttttaacagagacgtaaagaaagcaatgttaccaagccaactacctaactatcaagaaatcctcccacggatagaaaaatggaaaaagaaatacgaaaaactcactaaagatatagatcattgtataacacattcaggaatgacaaaagaagctaaagatagcattatacagaaaagacacaggcttaccttagaacacgactactggcgtaacaaatacagcagattcaccatgacagaagttccagaaggtttcagcagaagacaaggagcaggaattggattggtttccaaatatgcaggattgttcttaaaatcactattccacgatccaaccgacagaagacgatcacatgtctatgtagtaaaaggaacgactacagcagagttcagaaaaatgtggggattgcaaagcgaatacgaaaagaaaagtagagataaccacgtacatcattgcgtagacgctataacaatagcttgtatagggaaaaatgaatataataaaatggcaagtttttatcacgatgaagaagccttcgaaagaggagaatgtgagaaacctcactttgataaaccatggcccacgttcacacaagatgttcttggattagaaaaacgattaatcgtagtacacagtacacaagacaacatgccaaaacatgccaagaaatacgtaagaacaccacgaggaaaatttatagcaaaaggagactgcgccagaggcagcttacaccttgatacctattacggagcaataaaacataaagatgatacagaaccgagatacgttttgagacgcgaattatcatcttttgactccgtaaatgatctagacataatagtcgacgatgcggtacgcgagaaaataaaggaagcagtaaaaggaaaatcaggaaaagcattcaaagaagcactagcaaatgtatatatgaataaagaaaaagatataagaataaagaaagtaagatgttacgtcccaagtgtaaaacgaccaattgacatacgacaccaaagagacatgtcgcgatttgactataaacgacaattccacgtagccaatgacggaaactacatgatggcaatatatgaaggagtcgtcaaaggaaaactgaagcgagatttcgagcttgtcaaaaatattgaagcggcgtcatattttaaggtaagccaggacaacgaatcatttagttcaattgtaccagagaaatcatcaaacggattccccttaaaagcagtactaaaaataggaacacatgtactattgtatgaaaacactgcttcagaaatagacttctctgatccagtagatttaactcggagattatataaagtggtaggactaagctcagctatcataaataactgctcatatggatttatcactttaaggtttcaccaagaagccaggcaagcgaagaacttaaaattgacgaaaggagtatttaaaaatgtagacaattatagaggagcaattatactttaccatactcaattaaaagcactcgttgaaggatatgacttcgacataaacatactcggagaaataacatcaaaacaatga

SEQ ID NO: 8698 - RNA, 3705 nt, synthetic construct
  misc_feature 1..3705: note = Cas9 variant
  source 1..3705: mol_type = other RNA
atgccaaacttttggagcatctttactgaaaacctacaaacataccttatgaaaactcgtatacttggacttgacacaggtacaaattcactaggctgggcagtagtagatcgcgacgaaaacaaccaatatacacctatctgcagaggagatctcatatttactgaaggtgtaaaacaagaaaaaggtatagagttctcgcttgcagcagaaagaacctcttaccgagcaagtaggagacattattttagaagaagactgagaaaagtagaagtattgaaagtgctagtaaaacataaactatgcccaccattgtccgatgaagcactcaatagatggcacaccaagaaagaatacccactggatgaagatttcatattatggcaaagaacaaacgaggcagacaacaaaaacccatatcacgatagacatatttgtttacacaggaaacttaatcttaaagatagccaaaccgataggtatacattaggtagagctctgtatcacttaacacaaagacgtgggtttctaagcaacagattagaccagaacgaagaagccgaagaaacaggaaaagtaaaaagtgcaatatcagaattatcaaaagaaatgaaagaagccggttgcgaatttttgggagattatttctatctattatataggacagaaggcaatcgagtacgaattagatcacgatatacagaccgagaaaaacactacttacaagagttcaaggaaatctgtagagtacaagaactggacgaagacttagccaaagccctggagaaaactatattcttccaacgacccctaaaaagtcaaagacaaggcgttggaaaatgcaccatggaaaaaggacattctcgttgtgctgtatcacatcctctctatgaagaatacagattattatgctacctaaacaatataagaataaaaacaccaagcgacgacaggctacgtcctctaaatgcagaggaacgggagaaaataacccctttattctacaaagagaaaaattttgactttgagaaaattgctaaaaagctggccggaaaaacacccttcggttggatcagggacgctgaagactggccctatcagtttaattacagaatgacacaagaagctcctgcttgtccaactacagcacagttaataaaggtcttcggagaagattggaaagctgcactcgcagaaacgtacacaatgtccgcaaaacaagatggaaccctgaaaaccgaagatgaaatttgtacagacatatggaatgttttatactcctttagtagtaaagaaaaactcaaagagttcggactaaagaaattacaattggacgaagtacaagcaaaagcatttagtgaaatacgtttaacaagagatttcgctagcttatcactaaaagcgataagaaaaatactcttctttttaagaacaggagaagattatagcaaagcaatctttttagctaatataccaaccatcgtcggtgaagaaatatggaatgatatcgaaagacgtagcaggctcctatacaaagtagatcttgcattaagaccgcaggaagaaagagatgcggaagaacatcgaacaattgcagaacgaatcaaagcagcggtagcagcggaagtaccagacgcacccattgacctcttataccacccaagtatgatcgaggcttatccagatgcaaaaagaaatgaacgttttgactgctatcaactaggatcaccaaaaacaaatgcagttagaaatcccatggccatgagatcacttcatatggttagaaaagtaataaatcatttgttaagaaaacacattatcgatgagaaaacagaaatacacattgaatatgctagagaactaaacgacgcaaacaagagacaagctatcgccgactggcaaagggaactaagcaaacgacatacagcatatgcacaaaacatcagacaattatataaagcagaaacaggattagtaatagaaccaactaaagcagacatacttaaatatcaactatgggaagaacaacaacatgtatgtctatatacaggtaagaaaatcggcatcgccgactttctcggagccaatccaaaatttgatatagaacacaccatacctagatctagaggaggagactccacacaagaaaatttaacactctgtgaatccaaatttaacagggatataaaaagagataaacttccgacggaactggcaaattatgaagaaattctggcaagaatcgaacattggaaaaagcaatgttatgccttgaaacttaaacgagatggtataaggactcactcaggattagaaaaatcaataaaagacagtagaattagaagacgacacttagtaggtttagaatatggttatttaaagggtaaatacgaccgctttactatgaaggaagtacctgaaggatttagccgaagacaaggcgccggtataggcttaataagcaagtacgctggattatttctaaaatccctatttaaagaccccaaaaatccaaacagaagtaacgtctatgtagtaaaaggcgcaataactgctgaatttagaaaattatggggacttcagcaagcagatgaagctaaaagccgagaaaaccacacacaccactgcatagacgcatatacgatagcatgtataggaccgtgtgaatacgcagcactagcagcctactatcgaagtgacgaagagttcaagtacggaagaagacgggaaaaaccacaattcgaaaaaccatggccaacctttaccgaagatctattaaaattacaagaagaattattaatagtacatcaaacgacagacaaattagggaaaagagatcgaagaaaggttaaaactccaagaggaaaatttcttacaggcggagacagcgcaagaggcagactacaccaagaaacatactacggagcaataaactacgacggcaatataaaatatgtggttcgcaagccactagattctctaactgaaaaagatctcgacaagattgtagatgaaacagtaatgggtatagttaagggagcagtagaagcaaaaggatcactaaaggaagcactagcggatggtatatatatgaacaaagaaaaaggaatactaattaaaagagtacgtatatttagtgatgtaagtgaacctataaacctaaaacaattaagagacgtctctactaaagaatacaaaagacatatccatttacgaaaagacgaaaattatctcttcgcaatatatgaaggaatagataaaaagaaaaacaagaaacaaacagaaacggctacggtagactacttggacgcagcaaaattctataaagattcaaaacgacgcgataaagccaactccctagttggagactatagcaagaaaaacaaactaccgttaaaatgtatattaaagaagcgacaaatggtacttttctacgaacactcaccagaagaaataaggtttaaagataagaaagacttgagtagacgcttatacatagtgacctcaatagcaaaagacggccgggtaaaatttctacaccatcaagctgcaacagcgaccggcattcaaagcagtccatcgccattcactaatgatggagaacaccaaccatactacagactatcagcttctaacataaaagtacttgtagcaggaatagatttcgatattaacatactaggagaaataacacccaaactatga

SEQ ID NO: 8699 - RNA, 3711 nt, synthetic construct
  misc_feature 1..3711: note = Cas9 variant
  source 1..3711: mol_type = other RNA
atgtatttttacaagaacaaagaaaacaagttaaacaaaaaggtcgtactcggtttagacctaggtattgccagcgttggctggtgtctcacagatatatcacaaaaagaagacaacaaattcccaataatactgcacggcgtcaggctcttcgaaactgtagacgacagcgatgacaaactcctaaatgagactcgccgcaaaaaaagaggacaacgaagacgaaatcgccgactcttcacacgtaaaagagatttcataaagtatttaatagataataacatcatagaactagaattcgacaaaaatcccaaaatactagtacgaaacttcatcgagaaatatataaatccattcagtaagaacttagaacttaagtacaaatcagtcacaaacctaccaataggcttccataacttaagaaaggccgccataaatgaaaaatacaaactcgacaaatcagaattaatagtactcctctacttttacctcagcctaagaggggcattttttgacaacccagaagacacaaaatccaaggaaatgaacaaaaacgaaatagagatcttcgataaaaacgaatcaataaaaaacgccgaattccctattgacaaaataatagaattctacaaaatatcaggcaaaatacgcagtacaataaatcttaaattcggacaccaggattacctcaaagaaattaagcaagtatttgaaaaacaaaatatcgactttatgaactacgaaaaatttgcaatggaagaaaaatcctttttctcacgaataagaaactactcagaagggcccggaaatgaaaaaagcttcagcaaatacggactctacgcaaacgagaatggaaacccagaactcataataaacgaaaaaggacaaaaaatctatacgaaaatattcaagactttatgggaaagcaagataggaaagtgcagttatgataaaaaactgtaccgagcgcccaaaaactctttctcagcaaaagtattcgacataacaaataagctcaccgactggaaacacaaaaatgaatatatatcagaaagactaaaacgtaaaatactactttcccgcttcttaaataaagacagcaaaagcgctgtagaaaaaatactaaaagaagaaaatattaaatttgaaaatctttcagaaatcgcatacaacaaagatgataacaaaattaacctcccaataatcaacgcatatcactccctaacaacaatatttaaaaaacacctaatcaactttgaaaattacctaatctccaatgaaaacgatctttcaaaattaatgtctttttataaacagcaatccgaaaaactgtttgtaccaaacgaaaaaggatcatacgaaattaatcaaaataataatgtattacacatattcgatgccattagcaacatactaaacaaattcagcaccatacaagacagaattcgaatcctagaaggatacttcgaattttcaaatctaaaaaaagatgtaaaaagctcagaaatctactcagaaatagcaaaattaagggaattcagcggcacctcaagcttaagcttcggcgcttattataagttcatacctaacctaatttccgaaggctctaaaaattattctacgatttcatatgaagagaaagccttacaaaatcaaaaaaacaatttctcccacagcaatttatttgagaaaacgtgggtcgaagacttgatcgcctcccctaccgttaaacgctcattacgacagacaatgaatttgctaaaagaaatattcaaatactcagaaaagaataacctagaaattgaaaaaatagtagtcgaggtcaccagatcatcaaacaataaacacgaaagaaaaaaaatagaaggaataaataaatacagaaaagaaaaatacgaagaactaaaaaaagtgtatgacctcccaaatgaaaatacgacactactaaaaaaactctggctcctaagacagcaacaaggttacgacgcatattcactccgaaagatcgaagcaaatgatgtaataaacaaaccatggaactatgacatcgaccatatagttcctagaagcatttcattcgacgattcattcagtaacctagtcatagtaaataaactagacaatgcaaaaaaatctaacgacttaagcgctaaacagttcatagaaaagatctatggtatagaaaaattaaaagaagcaaaagaaaactggggtaactggtacttaagaaacgccaatggaaaagcattcaatgataaagggaagttcataaaactttacacaatcgacaacttagatgaattcgacaatagtgatttcataaacagaaatttatctgatacgagttatataaccaacgctttagtaaaccacctcacgtttagcaacagtaaatacaaatattcagtagtgtctgtaaacggcaaacagacctcgaacttaagaaaccagatcgcattcgtaggaataaaaaacaataaagaaacagaaagggaatggaagcgacccgaagggttcaaatctataaactccaacgacttcctaataagagaagaaggcaaaaacgatgtaaaagacgatgtactcatcaaagatagatccttcaacggacaccatgccgaggacgcctactttataaccataatatcacaatacttcagaagctttaaacgaattgaacggctgaacgtcaactatagaaaagaaactagggaactagatgacctagaaaagaacaacataaagttcaaagaaaaagcatcattcgacaacttcttgcttataaatgcattagacgaattaaacgagaaattaaaccaaatgcgcttctctcgaatggttataacaaaaaaaaatacccagctattcaacgagactctatacagtggaaaatacgataaaggcaaaaataccatcaaaaaagttgaaaaactaaatctactagacaacagaacagataaaatcaaaaaaatcgaagaatttttcgacgaagataaactaaaagaaaatgagcttacaaaacttcatatattcaaccatgacaaaaacctctacgaaacactaaaaataatatggaatgaggtgaaaatagaaataaaaaataaaaacttaaatgaaaaaaactactttaaatactttgtcaacaaaaaactgcaagaaggcaaaatatcattcaacgaatgggtaccaatattagataacgactttaaaataataagaaaaataagatacataaaattctcctcagaagaaaaagaaaccgatgaaataatcttctcccaatcaaactttttgaaaatagatcaacgccaaaattttagcttccataacactctatactgggtacaaatatgggtatacaaaaatcagaaagatcagtactgcttcatatcaatagatgcacgcaactcgaaattcgagaaagatgaaataaaaataaactatgaaaaactaaaaacacaaaaagaaaaattacaaataataaacgaagaaccaatattaaaaataaacaaaggtgacctatttgaaaacgaagaaaaagaacttttctatatagtcggacgagacgaaaaaccccaaaaacttgaaattaaatacatacttggtaaaaaaatcaaagaccagaaacaaatacaaaaacctgtaaagaaatactttccaaattggaaaaaagtaaatctcacttatatgggagaaatattcaaaaaatga

SEQ ID NO: 8700 - RNA, 3717 nt, synthetic construct
  misc_feature 1..3717: note = Cas9 variant
  source 1..3717: mol_type = other RNA
atgacaaaagtattaggtttagacctaggtgctgctagcgtaggctgggccatgatagaagaagaagaaaaatcccataaaatattaggactaggatcgcgtattatcccttatgaaggaacagagggaaatgacttcgcaaaaggtaccggggaaagtagaaatgccttacgaacaaaagcccgaacagcgaggaaaggatatgaccgataccaattaagaagaaaatatctcgttgatactctagtgaaaaatgaaatgatgccagacgaatatcttagaaaattacccaaaatgcaattatgggaacttcgatccaaagccgttacaacggaaattacaaaacaagaactaggccgattgttcttatggttaaaccagaaaagaggatacaaaagcagccgatctgacgccaacctagataagaaagataccgaatatgtagtagaagtcaaaagtagacacgagaaaataaaagaaagtgggttcacaattggccaatatttctattcagaactaaaatccaacgaatacttcagagtcaaagaaaatatcttccccagagaagcctacatagaagaatttgacgctatttgtaaacaacagaaaagacacttaacggataaactcatatccagaatacgaaacgaaattatatattatcaacgaccattaaaatcccaaaaaggattagtatcagtatgtagatttgaaggattcttcaagaaaggcataaacggcaaagaatattttgtaggaccaaaagtggcgcctaaatcaagcccactgtttcaaaccgtaaaaatatgggaaaatataaacagcatcaggctcagcgatagaaatggtaaagaaataatgttatcattagaacaaaagaaatgcatattcaatcaccttgataacaatgagaaactaacaccaaaagatctatttataataataggagtgaagaaagaaaactgtttcgtaaataaacaattagagaaaggaatacaaggaaatgtcacaaaatctacaatattaaaatgctttggagagaacaatgattatgataaatggctaaagttagacctaaatataattgttaaaaaggacacatttggctatctgtacgacaagaaaacaggggagatcataggcgaaaaacttattaaacatgtagattcagcggtagaacgcgaacccttataccaattatggcacaccatatatagtataaacaacactgatgaatgttctgcagcattacaaaacaaatttggcttcgattcagaaactgcagacaaactaagcaatatagacttcggcaaagcaggattcggcaacaaaagcgcaaaagtcattagaaagatccttccatatcttatggaaggcgatgattatagtcaaagtatgtcatatgcaggctttaatcatagtgacagtctgacaaaagatgaaaatctaaaaagaaaattacttgacaagctaagaccgattgagaaaaatagcctcagacaacccatagtagagaaaattctaaatcaaatggtaaatgtagtaaacgcaatcatagacaaatatggtaagccagacgaaataagaatcgaactagcccgagaactaaaacaaaacaaagaagaaaggaacaagaccgacaaagatatgtcaaaaaggcaaagagaaaatggtgaaatatcgaaaagattagcagaatatgggttacgcgcaactaggaacaatataataaaatggcgactttatgaggaaatagataaccaagataaaaagttaaacgcaatctgtgtctactgcggacaaccaatatcactaacagaagcaataaagggtaacgaagtcgacgtagaacacattattccaaaatcaaaactctttgatgactcccaaagtaacaaaaccctagcccataggcgatgcaactcaacaaaaggggatatgaccgcgtatgatttcatggaaaataaaccagcacaggtgtttaatgcatacatcgaacgagtaaatatgttatatgacaacaagattatccggaaagtaaaaagagacaaactactaatgccggaaagcaaaataccagacaacttcatagacagacaattaagagaaagtcaatacatagcatccaaggcccgcgaaatattacaaacgatctgctacaacgtgtggtcaacatctggtacagtaacagcaagactccgacatctatggggatgggatgatgccactatgtcgttacaactcccaaaatacagagagttaggtttgacagaaatggtagaatgggaaagtgaacatggcaaacaaaaacacagtaaagaagtaatatcagactggagcaaaagggacgaccatcggcaccatgctgttgatgccctgacaatagcatgtacgaaacaaggatttatccaaagattcaatacattaaactcaagcaaaacaaaggaagacatggagttcgaaatcgccaaatgctcaattgaatacagagaaaacttaagtaaactagaaaaatatattatagcattgcgacctataccagtaagtgaagtagaagacgccgttgcaaatatattaatttcatttaaatcaggaaagaaagtagcagtgaaaggaaaaagaaaaatcggaaaacggggcaacaagaaaataattcagacagatattataatacctcacggctccttatcagaagaatccgtctatggcaaaataaaaacaatagaaagagaaaaaccattaaaatacctattccaaaattcacaactaatatttaataacaaaataaaaatccttgtcgaagaacgcctagctacgtttgaaaatgacacaaagaaagctctagcctccttaaagaaagtccctgtatacctagacgaagagaaaacaatagtactagaatatgcaacatgcttcaaagaagaatatgtaaagaaatatgatgtagacacaaactttagcaaaacagacaaagtaatagatgacaaaataaaagaaatattacaacacagactaggaaaattcggcggaaaagccaaagaaaaagaagccttcaaagacgtccagcaaggagataaaactataaaatggtatgaagatgaaggcctagaaagaccgatacatagcgtgaggtgcttcactggccttagcgctattgtacccgtcaagaaagatgaaaacggaatcgacattggattcgtaaaacctggaaataatcaccatattgctatttacagcgacaaagatgggaatcgatatgaacatatatgtaccttctggcatgctgtagaaagaaagaaatacgacataccagtagtaataaaagattcaaatgaaatatggaacaaaatatggtcaaaaccagaaggttcctatccgcaatcatttcttgataaactgccccaagaaaatttaacactagatttatcaatgcaacaaaacgaaatgcttatactaggaatgagttatgaagacataaaaacagcaatagacaactccgactataaacaactaagctctaacctgtacagactacaaaaactagcaaatgctaactatatgttccgacaccacctagagacgcaaataatagacgacaacaactcaaaagcctcaagacgatttataaacattcatagcctaaaagcattattcgcatggaacccctataaagtaaacattaactgcttaggtgacatccaaactaacagccgttga

SEQ ID NO: 8701 - RNA, 3720 nt, synthetic construct
  misc_feature 1..3720: note = Cas9 variant
  source 1..3720: mol_type = other RNA
atgaccgaaaaacgaaaattcgatatccgcgaagtatatctagctatacatcacattgtaaaatacagaggaaactttctgaatagtgctaccgttgacagcttcaaaaccagcaacatcgactttacaagtcaattcgatcgcctaaacgaactctacagacaagtaattttagaagagccgtttcagatcaacatgaaccaagtagacaaaatgacaaacaagctgctagataacgacgctttgaaactagatacacaaaaacaagtagcaaaacttttaccagtaatatacaacgacaaacctgtagataaacaatatacccgactagcaacagaatttagcaaagctatactaggatataaaactaaactagatgttatattaaaccttgatacacaaaacgcaaaagattgggcaataagactagatgacgaagacatagacgataaattacccgccctagtagaaaatctagatgaaagtagacaagagatagtaacaataatacgagatttatacgctcaaatcaccctaaacgcaatagtcccaaaaggaaagtcgttatccgaaagtatggtcgataaatataacgatcataaagaccacttagacctcctcatgggactaattcatgaattaggagacgactccgcaaaaggtattaaactccgcgaagcatatacacaatacgtaggaaaatcaggagataaaacactcaaccaagacgacttctacgcagctataaaaaaaaacctagacgaagacagcaaaagatcgcctaaaatacaacgccttattgaacaagcttcttttatgcccaaacaaagaacatcagcaaatggagttattccacatcaactgcaccaactagaactcgatcgcatcatagaaaaccaaggaagatattacccattcctaaaagaaccaaactcaaatacacacaaaccaaacggagggaaatacaaactagacgaactagtagcatttagaattccatactatgtaggaccactaataaccaaacaagaccaagaaaaaacctcaggagcagacttcgcatggatgataagaaaacctggacaaggtggcgaaataacaccatggaatttcgaccaagaagtagaccgtatggcatcagctaatactttcataagacgaatgaccactaaagactcatacttagtcgcagaagatgtactccccgactcatccctcatatatgaaaaattcaaagtgctaaatgaactaaacatgcttaaagtcaatgataggaggctcagcatctcacaaaaacaagatctatttaataacctattcaaaaaacaaaaaaccataagaacaaagaaactccaaacatatattcgtacaaaatgggaactcccaagtgtcatgatatcaggactcagcgaccccgataaattcaattcttcactagcaacgtacatcgacttccgtgacgtcttcggtgaaaaagtcgatgaccccaacagacaggcagattatgaaaaaataatagaatggtcaacagtatttgaggataggaaaatatatcaagctaaacttaaccaacttgattggctcaccgagagtcaatcaaaagccctacttaccaaacactacacaggatggggacgacttagtaaaaagctattgacaggactaaaagaccaaaacggcgacagcattttagatcagttatggaaaacaaacgataactttatgcaaatacaatctagagatgaattcgcgaagcaaatccacgacgagaacgccaaacaattccatgaagcaaataacgtagacgacatactagacgacgcatttacaagcccacaaaacaaaaaggccatcagacaagtcgacaaagtcgtacaagatgtagtaaaagcagtaggctatgccccggataaaatagccatagaatttacacgctcccctcaagatcgtcctcaaagaacatttagtcgccaaaggcagctgcaatcaacatatctcaatgtggcgaaagcccttatgaagagtaacctcaatcaagaactcaaatcagtcatagatagtcaacaaacattaacagataaattatatttatacttcacacaacttggacaagatatgtatacaggcaaagaaataaacttcgacgaattagtaaactatcaaatcgaccatatactccctcaagcatttataaaggatgactcattagataacagggtcctcgtaagtgcgccaataaataacgcaaaatcggacaacgtacccgtaaaaaaatttggtgctaaaatgggatacttctggaaacaattagcagaaaaccatctaatatccaaacgaaaacttaacaacttaacaacagaccccgacaaaatcggtaagtttacagcccaaggattcatacaccgacaactcgtagaaacatcccaagtaatacgactagtagcgaatattctcggaaatgaatatggacatgacggaactactatcatcgaagtaaccgctaaaatgaaccatcaaatgcgtaaagatttcgacctaatcaagatcagggatgttaatgactaccaccatgcaatggacgcgtatctcacagcgtacgtgggagattatctatatctaagatacccgaaacttagatcttatttcgtttatggagactttaaaaaactcaaagaccaatcacttaaaatcagaaattttaattttttacacgatctaacaaacgacgaagctggcgataaaatagtcgaccaggaaacaggagagatcatatgggataaacacgaatctgttaaacaattaaaaaaagtatatcactacaaatttatgctagtctcacaagaggtatacactcgacaagacgccctattcaaccaaacaatttatccagcaagtgacgctgataaacgcaagttaataccaattaaaaataacaaaccagttgacgtttacggcggatatagcggaaatgtcgacgcttacatggcaattgtcagaattcatggaaaaaaagaagacaagtataaagttgttggcgtaccaatgcgcgcagtagcggatctaaaaaaagccgaatcaaaaggacgtgacaattacttaaacgcagtacacgaagttctaaaacctcaattcacaaaaaaaaaaaaagacaggaaaacaggcgaaatcacagaaatgatggatgattttgacgtcctattagggaaagtttactaccgacagttaatagtagacggaaataagaaattcatgctaggatcatcaacatatcaatacaatgcgaaacaactcgtattatcagataaggcaatgcaagtcctttctaaagacgataaacttaaaaaccaagatgaaaaccaaaacttgatagacgtttatgacgaaatattggaaaaagtagatcaatacttcgagctttacgacataaacaaatttcgtcaaaaattacacgacgggcggaaaaaatttatcgaactccccgttgacaacgactttaatggaaaaaaattaatctcatacggaaaacgggccactataatatcaatccttaatggtttacacgcaaacgccacaatgtcaaatctaaaataccttggcatctccagcccatttggaatgttacaagttcctaacggaataatattatcacccgcctctcgtatttgctaccaatcaccaacaggactttttgaacgaaaagtaaaactctccgacctatga

SEQ ID NO: 8702 - RNA, 3738 nt, synthetic construct
  misc_feature 1..3738: note = Cas9 variant
  source 1..3738: mol_type = other RNA
atgataatatactttatattcgagaaaattgttaacactatcctagttatgaagaaaatagtcggactagatctagggacaaatagcataggatgggcactaatcaacgcttatatagacgaatataataaagaacatctatatggcatagaggcctgcgggtccagaataataccaatggatgcagcaatattaggaaatttcgacaaaggaaactcaatatcgcaaacagccgacagaacctcttaccgaggcattcgcagactaagagaaagacatttactccgacgcgaacgactccacaggattctagatctactcggcttcttaccaaaacattattcagactcgctaaatcgatacggaaaatttcttaacgatattgaatgtaaactaccatgggtaaaagacgaaacaggatcatacaaattcatattccaagaatctttcaaagaaatgctagccgacttcacagaacaccacccaaaactaatagccaacaacaagaaagtaccatacgactggactatatactatttaaggaagaaagccctaacacagaaaatttcaaaagaagaactagcatggatattacttaatttcaatcaaaaacggggatactatcaattacggggagaagaagaagaaacaccaaacaaactcgtcgaatattattcactgaaagtagaaaaagtagaagactctggtgaacgcaaaggaaaagatacatggtataatgttcacttagaaaacggaatgatatacagaagaacaagtaatataccattagactgggaagggaaaacaaaagagttcatagtaacaacagatctagaagcagacggctcacccaagaaagacaaagaaggaaatattaaaagatcattcagggcaccaaaagatgacgattggactttaatcaaaaagaaaacagaagcagacatagacaaaataaaaatgacagtaggggcctatatatatgacacactactacaaaaaccggaccagaaaataagagggaaattagtaagaacaatagaacgtaaatattataaaaacgaactatatcaaatactaaaaacacaatcagaatttcacgaagaactacgagataaacaattatatatagcgtgtttgaatgaactttacccaaataacgaaccaagaagaaactcaattagtacaagggacttctgccaccttttcatagaagatattatattctaccaaagaccactcaaaagcaagaaatcactaatagacaattgcccttatgaagaaaacagatacatagataaagaatcgggagagatcaaacacgcatcaataaaatgtatagcaaaatcccaccccctatatcaagaatttcggctttggcaattcatcgtaaatttgcgtatttatagaaaagaaacagacgtagatgtaacgcaagaactactacccactgaagcggactacgtcacattatttgaatggctaaatgagaagaaagaaattgaccaaaaagcattctttaaatatccaccgtttggttttaagaaaacaacatcaaattatcgttggaactatgtcgaagacaaaccatatccttgcaatgaaacacacgcacaaataatcaccagattaggcaaagcacacataccgaaagcattcctcagcaaagaaaaggaagaaacattatggcacattttgtacagcatagaagataaacaagaaatcgaaaaagcactacactcattcgccaacaaaaacaacttaagtgaggaatttatcgaacaattcaaaaattttccccctttcaagaaagaatacggctcatattcagcaaaggcaatcaagaaattactcccactaatgcgtatgggtaagtattggtccatcgagaatatagacaacggaacaagaataagaataaataagataatagacggggaatatgacgaaaatatacgagaaagggtaaggcaaaaagcaatcaaccttacagacataacacatttccgtgcattacctctctggctagcatgttatctagtatacgatcgccactcagaagtaaaagatatagtaaaatggaaaaccccaaaagacatagacctgtacctaaaatcgtttaaacaacactcattaaggaatccaatagtcgaacaagtaatcactgagaccctacgtacagtccgggatatatggcaacaagtaggacatattgacgaaatacacatagaactaggaagagagatgaagaatccagcagacaaacgcgctcgcatgagccaacaaatgattaaaaacgagaacacaaacttaagaataaaagctctccttactgaatttctcaacccggagtttggaatagaaaacgtacgaccatactcaccttctcaacaagatttattgaggatttacgaagaaggagttctaaattcgattttagagcttccagaagatatcggtataatccttggaaaatttaaccaaaccgacaccttaaaaagaccaacaagatcagaaatactaagatacaaattatggctagaacaaaaatacagatcaccgtacaccggagaaatgataccactcagcaaacttttcacaccagcgtacgaaatagagcatataatcccccaatcaagatactttgacgactctctttctaataaggtcatatgcgaatcagaaattaataaactcaaagacagatctcttggttacgagttcattaagaaccaccacggagagaaagtcgaactcgctttcgacaaaccagtggaagtgttgtcagttgaagcatacgaaaagctagtgcacgaaagctattcacacaaccgatcaaagatgaagaaacttttaatggaggatatcccagatcaattcattgaacgtcaactgaacgattcgagatacattagcaaagtcgtaaaatcactactatcaaatattgtaagagaagaaaacgaacaagaagctattagcaaaaatgtaataccatgcactggaggaataaccgatagacttaagaaagattggggaataaacgatgtatggaataaaatagtacttcccagatttattagactcaacgaactaacagaatcaacacgcttcacaagtataaacactaacaacactatgataccaagcatgccactagaactacaaaaaggcttcaacaagaaaagaatagatcacagacatcatgctatggacgcaataataatagcgtgcgctaatcggaatatagtaaactatctcaataatgtaagtgcatctaaaaacacaaaaataacacgtagagacctacaaactcttttatgccacaaagataaaaccgacaacaacggaaactacaaatgggtaatcgataaaccatgggaaaccttcacccaagatacgttaactgctttacagaaaattacagttagtttcaaacaaaacttacgtgtaattaacaaaacaaccaatcactaccaacactatgagaacggcaagaaaatagtatccaatcaatccaaaggagactcgtgggccatacgaaaatcaatgcataaagaaacagtacacggagaagtaaatctgcgaatgataaaaacagtctcattaaacgaagccctaaagaaaccgcaagcaatcgtagaaatggatctcaaaaagaaaatactagcaatgctagaattagggtacgatacaaaacgcatcaaaaactattttgaggaaaacaaagatacatggcaatga

SEQ ID NO: 8703 - RNA, 3741 nt, synthetic construct
  misc_feature 1..3741: note = Cas9 variant
  source 1..3741: mol_type = other RNA
atgagacttgtttatttagcacttgctcacatgattaaattcagaggccattttctatatgaaggagatctaaaagcagaaaacacagacgtacaagccctttttaaagatttcgtagaagaatatgacaaaacaatcgaagaatcacacttaagtgaaataaccgtagatgccctctccatactaacagaaaaagtgtcaaaatcctcaagactggaaaacctaatcgcgcattatccaactgaaaagaaaaacaccctatttggcaatttgatcgctttaagtttgggattacaagcaaatttcaaaacaaacttccaactaagtgaagacgctaaattacaatttagtaaagatacgtatgaagaagatctagaaggtctcctcggagaagtgggcgatgaatacgcagaccttttcgtatcggcaaagaatttatatgacgctatcttactatccggaattttgaccgtcgacgataactcaacaaaagcaccattatcagcaagtatggtcaaaagatacaaagaacataaggaggaactggccgcttttaaaagattcatcaaggaaaaacttccaaagaaatatgaggaaatattcaaagatgatactaaaaatggatatgcaggttatgtcggagcagataagaaattaaggaaacgttcaggtaaattagcaacagaagaagaattttataaatatgtcaaaggtatattaaacaaagttgaaggcgctgattacttcctcgataaaattgatagagaagactttttaagaaaacaacgaactttcgacaatggaagtataccacatcaaatccacttgcaagaaatgcatgccatacttagaagacaaggtgaacactatccattcctaaaagaaaaccaagataaaatcgaaaagattctaacatttaggataccatattacgtaggcccactagcaagaaaaggttcaagattcgcttgggctgaatataaagcagatgagaaaatcacaccatggaactttgacgacatactagataaagaaaaatcagcagaaaaattcataaccagaatgacactcaacgatttatatcttccagaagaaaaagtattacccaaacactcaccactatatgaaacgtttacagtatacaatgaactaacaaaggtaaaatatgtaaatgaacaaggagaagcgaaattcttcgacacaaatatgaaacaagaaatattcgatcatgtatttaaagaaaaccgaaaagttacaaaagataagctactcaattacttaaacaaagaatttgaagagttcagaatagtcaatcttacagggctagacaaagaaaataaagcctttaatgcatccttaggaacgtaccatgacttaagaaaaatactcgacaaatcattcctggacgacaaagtcaacgagaaaataattgaagatataatccagactttaaccctattcgaagacagagaaatgatcagacaaagactgcaaaaatactcagacatcttcacaactcaacaactaaaagaactggaaagacgacactataccggatggggcagactcagttacaaattaatcaacggaattagaaacaaagaaaataagaaaacaattttagactacctaatagacgacggttatgccaacaggaatttcatgcaattaataaatgacgacgcactaagtttcaaggaagaaatagcaagagcccaaataataggcgacgtcgatgacatagcaaacgtagtacatgacctaccagggagccccgcaattaagaaaggaatactacaatcggtaaaaatagttgacgagctcgtaaaagtaatgggtcacaaccccactaatataataattgaaatggctagagaaaatcaaacaacagacaaaggaagaagaaactctcaacaaagattaaaattgcttcaagacagcctcaaaaatctagacaatcctgtaaacatcaaaaatgtagaaaatcaacaactacagaatgaccgtctatttttatactatatacaaaacggaaaagatatgtatactggcgaaactcttgacataaataatctctcccaatacgacatagaccacataatcccccaagccttcataaaagacaactcattagataaccgagtattaactcgctcagataaaaatagaggtaaaagcgatgatgttccaagcatagaagtcgtacacgaaatgaaaagtttctggtctaaattgctaagcgtcaaactaataactcaaagaaaattcgataatctaacaaaagccgaaagaggagggctaacagaaaacgataaagctggtttcataaagcgacaattagtcgaaactcgacaaataaccaaacacgtagctcaagtacttgatgcaagatttaatgcaaagcacgacgaaaacaagaaagtaatcagagatgtcaaaatcattacactaaaatccaacctggtatctcaatttagaaaagacttcaaattttataaagttagagaaataaacgattaccaccacgcgcacgatgcttacctaaatgctgtaatcggtacagccctactcaaaaagtatccgaaactcgcatctgagttcgtttacggagagttcaagaaatacgatgtgcgaaaattcatcgctaaatcagataaagaaataggaaaagccacggcaaaatacttcttttattccaatttaatgaacttctttaagaaagaagtaaaatttgctgatggaaccgtcgtagaacgacctgacatagaaacatcagaagatggcgaaatagcctggaataaacaaactgactttaaaatagtacggaaagtactttcttatccgcaagtaaatatagtgaagaaaactgaagtccaaacacatggattagatagaggtaaaccaagagggttatttaatgctaacccaagcccaaaaccgaaaccagactctagtgaaaacctagttggaataaaacgaaatctagacccaaagaaatatggcggatacgcagggatcagtaattcttatgcagttctagtaaaagcaatcatagaaaaaggagttaaaaagaaagaaacgatggtactggaatttcaagggatctcaatcctcgacagaattacattcgaaaaagacaaacgagcgttcctattaggtaaaggatacaaagatattaagaaaataatagaacttccaaaatattcactattcgaactaaaagacggaagccgaagaatgctagcatcaatactctccacaaataataaaagaggagaaatccataaaggaaatgaattgtttgtaccgcaaaaatttacaactcttttatatcatgcaaaacgtataaacaatccaatcaataaagatcacatagaatacgtgaagaaacatcgagacgattttaaagaattattaaactatgtcttagaatttaacgaaaaatatgtaggcgcaaccaaaaacggagaaaggctaaaagaagcagtagcagactttgacagcaaatccaacgaagaaatatgcacgtcattcctcggggcagtaaacagtaaaaacgctgggttatttgaattaacatctctaggttcagcatcagacttcgagttcctaggagtaaaaatacccagatatagagactatactccatcttcactattaaaagattcaatacttatacatcaatcaataactgggctatacgaaacgcgaatagacctaagcaaactgggcgaagactga

SEQ ID NO: 8704 - RNA, 3747 nt, synthetic construct
  misc_feature 1..3747: note = Cas9 variant
  source 1..3747: mol_type = other RNA
atgaagaaaatcttaggacttgacctaggatctgcctcaatcggatgggcagtaataactgaaaacgtagaaaatggaataacgaaatgcgacatactggggatgggatcaagaataataccatatgaaggtactgaaggaaaagattttacaaaaggaactggagaatctagaaactcattacggacaaaagcaaaaacagctagaaaaggttacgaccgataccaactgcgcagaaaatacctagtcgatactttaattaaaaatcaaatgtatccagacgaagcaacaagaaatctaccaaaaatgaaattatgggaactacgagataaagcagttcattcaccagtatccctcatggagcttggtagattattattatggttaaatcagaaaaggggatacaaaagcagcagatcagacgcaaacttaggaaagaaagacacagaatatgtagcaacagttaaatctaggcacgagaaaatgaaagaactagatgtcactataggtcaatatttctatcgagaattatcagcaaatgaatttttcaaagtcaaagaaaacattttccccagagaggcatatattgaagagttcgatgcaatatgcaaaacgcaacaaatagcgcaccccatgatactaagaagcgaattgatagacaaaataagaaatgaagtgatatactaccaaagaccactaaaatcacaaaaaggtctagtatccgtatgcgagttcgaaggattttggagaatcgggaaagatggcaaagagtattttgttggtccaaaagttgctccaaaaagctcacctctattccaacttgctaaaatgtgggagaatataaataatataaaaatcggttctcgtaccggtgaggatctgaaattgactacggaacaaaaatgggccatatttcaacatttggacaataacgagaaattaacacccaccgatctattgaaaatactaaatctaaagaaagaaaattgttacgtcaacaaacaaatgggaaaaggattaaatggtaacataacaaaacatgcaatcctacaatgcctaggaggaagcgataaatatgaaaacctcctaaaactagaacttaaaatggtagacggcgacaaagaaggttacctatacgatagaaaaacaggcgaagtactcaactctaaaatgatcaaattcatagacccgatggtagaacaagaaccattctaccaactatggcacattatttacagcatacacgatcaggaagagtgctcaagagtactacaagccaaattcgacatcgaacaacccatcgcagataaacttgcagccatcgatttttctaaacacgcctttggaagcaaatcggcaaaagtcatcaggaaaatactaccatatttaatggatggcgacggttattcagaagcaatgagctacgcaggatatgatcacagcaactctcagacaaaagaggaaaacctacagcgcaaactcctagatttactaaaaccaataccgaaaaattctttaagacagccaatagttgagaaaatattaaatcaaatggtaaacgttgtgaacgcaatcatagaaaaatatggaaatccagatgaaataagagtagaattagcaagagaactcaaacaatcaaaagaagaaagaaacgatgcagacaaagcaatgagtaaaagacaaagagaaaatgatgccataacaaaaagactagaagaatttggattaagagccacaagaaataacataatcaaatggagactatacgaggaaatagataatcaagaaaagaaacttaacgctatgtgtgtatattgcggtcagccgatatcactaacggaagcactaaggggcaacgacgtagacatagaacatataatacccaaaagcaaactctttgatgatagccaaagcaataaaacactggcacatagacactgcaacaaaaacaaaaacgatttaacggcttatgacttcatgaaaggaaaaccagaagctgtattcaatgaatacgtagaaagagtgaatttactatacgacaatcatataataagaaaagcaaaaagagataaactgctgatgactgaatccaaaataccggataactttatagatagacaattaagagaatcacaatacatcgccaagaaagccagagaaatactacaaaccatatgtcatgacgtatggtctacatctggtacagtgactgcagaattgagacacctatggggatgggatgatgtaacaatgaacttacaaatggccaaatacagagaattgggcttaacacaccaagtagaatgggaaagtgaacatggtaaaaataaacacgaaaaagaagtaataacagattggaccaaaagagacgatcataggcaccacgcagttgacgcattaacaatagcctgcacgaaacaaggattcatacaaaggttcaacaccttatcagccgcaaaaacaagagaagacatgatgttcgacatagaacaaaggtcacatgaatttaaagagaaacgcagcttgctcgaaaaatacataataagcgagcaaccattaaaggtcgatgaagtagaaaaagctgtaagtaatattttaatatcatttaagagcggaaagaaagtcgcagtatggggtactagaaaaatagggaaaagaggatccaagaaagtaatacaaaagaaaattatagtaccaagaggttcattatctgaagagagcgtatatggaaaaataaagaaacaagaagaaaaagattacaaatatctatttgagaatccccaactaatatttaatccaacgattaaagctaaagtcgaggaaagactcctaatgtttgatggagacgtaaagaaagcaatcacatcactaaagaaaataccaatttacctagataataataaaaccgtggtcttagaaaaagccatatgtctaaaagatgagttcgtaatcaaatatagtgtggacataaacttcaacaaagtagacaaagtagtagacccaaaaatcaaagaaatattacaaaatcgattaaagaaattcggcggtaaagaaaaagaagccttcaaagacgtacaactagaagacaaaatgataatcaaatggtatgaagatgaaggcctagaaagacccataaaatcagttcggtgcttcacgggtctatccgcagtagtgcccgttaagaaagatgaaaacggtaacgatatcggttttgtaaaacccggaaataatcaccacatagccatatatactgacaccgaagaaaataaacaacaacatgtatgtacattctggcatgcggtggaaagaaagaaatatgatataccagttattattaaaaatactaacgaggtctgggacaaaatacaatcacaaccagacggaacatatcctgactcattcttagaaatgttaccgccaccaaatttaaatctattagtaaacatgcagcaaaatgaaatgttcatactagggaccacaaccgaagacataaaactagcaatagataaacgagattacaaaattataggagacaaactataccgtttacagaaaatgtccataaaacctagttccggtcaaatagatatagtattccgacatcatctcgaaacgcaactaatagacgacgaaaatagcaagaaatccaaacggttttataacgtccaatcactcggagccctattcgcactaaatccattcaaagttagaattgataatctaggtaacctcgtaaaagaaaaatga

SEQ ID NO: 8705 - RNA, 3762 nt, synthetic construct
  misc_feature 1..3762: note = Cas9 variant
  source 1..3762: mol_type = other RNA
atgaaagcgcgaggcaattttctccaccaagatacgcccgggcttactgcagctaatgcaaacatgggagacgctgttgaaaaactctgcgtagcattagaagattggtgcacactcagaaatttagagtgtaacataaggaaaaaccaaaagaatatacaaaacttattagaaggaaaaaccgtggaagtttcagcagaaaatgcactgaaagaatctttcgactctagtagagcctcaagaaaagataaagctaccatattgtcaacttggatagcaatacaacctggagaatacttagatgctaaacaagccaaagacgcttcaaaagaaatagccaatgtcctatttgggttacaaggaaatatgaagaaaatatttattgagttcgaagaagatcagaaaatccgactagataacgatgaacaagtagaagcgttttacagtttatgtccagatgacggagtggcattatttgaaagtttccagagcatatatagcgcttacatactaatgggtattcttaaaaatgcgaatggtggaagcatcagtagctgtaaagtggccgcgtatgatcaatacaaagaagatttaaaattattaaaagacctagtccgagaatttgcatccgaaaaatatgatgagttcttcagaggagatatattcgacagtagtaaaggatttagggccagaaattataatcctgccacagctaaaggatatacaaaatataactccgtacgaggagcatcatatgacgattttaagaaagaagtagagaaaatattcaaaggaactgtagctgaagaagatattaggtacgttgatatgatgcaaagatttgcggaaggaacattcttaagacgattaaaaacgagcgataacggaagcattccataccaactacatcttgaagaaatggatgcaatagttgaaaaccagaagcaattttaccctttcttagaatcggaaaaagaaaaattagaaagtttggtaacattcagaatcagttattacgtaggccccctaacacagaaaaatgcacgactagacaatcataataatgcacgcttcgcgtggagtcaaagaaaagaaggtaaagaacacgctagagtatatccatggaattgggaagaagtaatagatcggaaacaaagcgccgcaaaatttatggaaagattgaccggaacctgcacttacatacttgacgagcccgtgttaccgcgatgctctttactatatgaagagtactgtttactaaatgaattaaatggcagtaaatggagagatatgggaggagattggcataggttcgattatgagaccaggatggaaataatagaaaacctattcaaaaagaagaaaggaagtgtaaaatatgcagcagtcgaagactggttaaaatgtgaaaaacataaatcgtgcgcagaggtaaaaggtggccagggtgagacgggatttgaaagtaaactctccagttacgtattctttaaagaagtattacatgtcgatgaaatagacgaagccgacatccctatgatagaagaactaatatggtggaacactttattcgaagacagatcgatattgaaagaaagtattgaagacaaatatggagacagattaacggacgatcaaataaaagcaatctgtaagaaacgttttactggatggggcagactatcgaaagaactcttatgtggcattaaaacacatactgataatggaccctatagcataatggacgtactacgcgaaggtaacccaaataataacgcaagaagcgaaacaatggtattcatggagattctacgagatgacaaatttggatttgacaaattaatagaagaagaaaacatgagaagagtaagcgaagtagataatttcgacgtaaatgacttaccagggagtccagccgtaaggcggacagtaaaccaagccaaaagaatagtcgatgagatagttggaatagcaggatgcgaaccgcaaaacattttcatcgaagtaacgagagatgaagatgggcgtaataaaggaaggaggacaaaaagaagatatgataatattaaaaacgctatagcagcactaaagaaagaacagaaagagtatttcaataaagatgtaagtgatagtttaaataaaacaaacccttcagatttggataacgaaagactcgcgttatattttatgcaaaacggaaaatgtatgtattgtggaaaagacttagatataaaacaactcgataaataccaagtcgatcatatactaccccaaagctatgtgaaagacgatagtttcgaaaataaagcattagttcatatggaagataaccaaagaaaaagcgctagcatgcttttagatgatagtataataaggaaaatgaaaccctattgggaagctctcagagcggcgggattaataggtgaaaagaaatttaaaaatctcacaagagttagagtgagcgataaagaattaggtggttttatagcaagacagatggtggaaacatctcaatctatgaaattaacgagtttagtactagagaaaacgtacccgaatacaaacgtaagacctgtaaaagccggattctcaagcgatcttagaaagcgtcttgatctgattaaatgtagagaaataaatgattaccaccatgctcatgacgcatacctagcttgtgaaataggacaatttataacaatgagacacaataaattatacgaaaatcccatatcatattcacatgcggtaaaagatttcatagcaaaacgcgcaaaatacgcaaatgaccatggaactcctatgagtacatatgggatgccggggtcaagctcattcgtaataagctcgtttttaacttcagggtttgacgaagaaacaggtgaaatattcaaagatgcttggagtgcggaagtagcggcggtaaggatcagggaaagtctaaatagaaaagattgctatatatctagaatgccagaagaaacatcaggcgcattttggaaggaaaccttaatatctcctagggatccaagtcttggaaagaatctcagtctcccaataaagaaagggcttgatccacgaaaatatggcggctataacgaacagaagttcgcttatttctttgtgtacgaagcagtaaaaatcaaaaagaaaggagaagtaaaagagtacgtatttgccgccgtaccggtacaagtcgcagcaatagtagcgagagatccaaatgctttaacaggatttgcaaagaaagacgccgaagcaagaaagataaagtttttacggataataagagaaaaagtgtataaataccaactaatagaagttaatggtgaaagactatatataaccggtctaaaaagtgtaaggaatgcaagacaaatagcattatctcaagacatgacaacggtatttttgaaagctattaatgataaagacgtcgcagaagatgaattgaaaagtctatttgaagaaatagtgcaaagatacagactttgcgctaacagattaggaaatcaactaaaaatattttcactgtcagacagtttcaatagtgcgaactcagaatctaagaaaagagcactggtttcattagtagcaataatagatgctaaaacaaacaaaatagacttgtcaggtataggcagtggaaaagctgtaggaaacatgagattaagtttcagcaaagaaatgtcaaatagtaaaaatcattttgcgttcatagatcaaagtgtcaccggaatgtttgaaaggaaaacttacttatga

SEQ ID NO: 8706 - RNA, 3777 nt, synthetic construct
  misc_feature 1..3777: note = Cas9 variant
  source 1..3777: mol_type = other RNA
atgaccgaagaaaaccccgacatcagaaaagtatttttagctatccaccacatccttaaaaatcgtggtcactttttattacaaggccaaagtttcaaagaaggtaatctaaacaacctaatcaaagaactactgaacctagacattcttcatatatcaatcgaaatcacagaagaaaatatcaacaaaataacagaaattgcactagaaaagaaaacgcttacagacaaagtcaacgacctaaagaaaatctaccccaaagaaaaacaactcctagaagccttcagactaatcttcggcggaaaaacatcgttagacaaactcttcgcaatagatgaatataaagaactcgacgcctcagtcaaatctgtttcctttaaagagaaaatctacgaagaagtaagacatgactacgaacaagtattatccaactacatagaactactagacctggcaaaactggtttatgactcaattatcttatcagacattaaaaaggaaggtaaaaccttaagcgaatccaaagtagaactataccacaaacatagagaagacctaacaaaattaaaaacactcgtcaaaaatgattccaaactgagcgaagacaagaaagtagaactctatagtgctatttttaaagaagataaagacaaaggaactaattacgtaaattacatacgaaaatccgaagaaggaaaagggtgtaactacgaagacttcaagaaatttcttgtgaaagaactagccaaactagaagaatccagtgctaaagaagaaatactacgtgaccttgagctggaattatttctcccactacaaagaacaaaagacaattcagtagtgccataccaaatacacaaagaagaattggtaaaaatattagataatgccgcaaaatatcacaaatttcttaacgaaaaagatgactcaggatactcaatcatagaaaaagtcatacaactcctagaatttagaataccttactatgtaggaccactaaacagcagtaagaaagcaaaagtagatggattcgcttggtctgtaagaaataaaggatatgaaaacaccccagtgactccatggaactacgaaaaagttatcgatgagtcagcatcagctgaaaaatttatcacaaacttaaccaataaatgcacatatctaaaaggcgaagacgtactacccaaatcatcgttactctatagcgagttcgccctattaaacgaactaaacgcactgaaatacgatggcaaccgaatctcactagaagcaaggaatgtaataatcgaaaaactatttaaagaacaaggaaagaaagtcaccaaaacatcgatcaaaaatctattgaaagccgaaggatatatagatggaaaaggagaaatcaccggaattgatatcacagtcaaaaacgatctaaagtcatatcgtgattttaagaaaatattaggagataaatttaacacagaacacgtagaaaacatcatcctttggataacactttatggagaatccagaaaactgataaaagccaaaatagaggcagtatatggtgacatttactcaaaagaagagatagcaaagatgtcccgcctcgtatataaagactggggcaggttctcaagaaaactactaaccgaattagtatctaaaaagttatataacgaagaaactggcgaatgcctaaacataataggtgcaatgagacaaaacaatatactattcatggaactgcttgctgacagatttgattattcacaacaaatcatagattacaacaaagaactccagaaagaagtcacagaaataactcctgaaatcttagatgacctctacgttagcccatcagtcaaacggagtatctggcaaacagtaagaatcgttgaagagttaaagaaaataatcggatgcgctccagcaaagatctttgtcgaaacaacaagatcaaaccaagataaaaagaaaccaacggatagccgaaagaaacaactggaactattttataaagcggtcaagaaagatgtcaaagacctagaaaaagagattggcagtctcaacttcgacaaattaaatgaaagattaagcagcgtagaaccgtctaaactaaaagcgaagaaactatatctttactatacacaactaggaagatgtatgtactccggcgaaacaatagacattacccaactcaacaccactgcatatgatatagaccacatatatccacaaagtaaagtaaaagacgactctttcacaaacacagtcctagttaaaagagaatacaacgcagcgaaaacggaccgatacccactaggttccgacatacaaacaccaagcaatagacggttttggaaatttttaaaagaaaaaggtctcatcacagatgaaaaatacaaccgattagtgagaacagaagaatttagcgatgaagaactaaccggctttatagcaagacaacttgtggaaacctcccaatcagtcaaagcagtcgctggaatacttggggaacttaatccaaaaacttcaatatgctacagtaaagctgaaaacgtatcatccttcagacaaaattttggaaaaataaaagagggaaatagaaaatcagacaatacggaacaactcataaaagtgagagaaataaacgactaccaccatgcaaaagacgcctatttaaatgttgtagtgggtaatgtatacgacaccaaattcacacgaaacgtattcaattttataaaagataagaaagacggcaggaaatactctctcaacaacgtattttatgaaaatgtaagtaattccaataacgtagcctgggaattaaacaaaactgtacatcaagtagaaaaggtaatgaacaacaataacattctagtaacacggagaacctccgaacagaagggaggattatttgacgcaactgtttacaaagcaaaggtagcagcaaaagcaaaggaaggagtatattaccccttgaaaacaagcgacccagtagtcaacgacgtaaccaaatatggaggatttacgaaagtaaaaatagcctactattcgatattcgaatataccctcgtcaacaagaaaggagaagagaaaataacccgaataataccaataccaatctacgttagccaaaacataaaagatgactcaaccttactagaatttggaaaaactcaaataaatatcaaaagcggggaagaagtaaaagattttaaattaaaataccgaaaattatgcataggagaccttgtgaaaatcaacaactttttcaattttataggaggaaaaacaaatgacagctttgtatatgatggcgctgtacaagtaaccctggacacagaatcggaaaggtacattaaaaccttaagtaaataccaaaactggaagaaagaaaataaagacggagaattatgggaaagcataacaaaggagaaaaatacagaactatacaacctactcgtcgagaaaatgaacagcggcatattcatcaaaaagaaaccaaacaaattcaacgaactaaactccgaagaaataagaaataatttttcgtccatatcattagaagaacaagcaaaagtactattagaagtgctcaatctattaacgaataagaaaagtatattcgatctaaaaagcataaacatcaccgcagcacggggaaaaataagtttcaatctaagtaacttaagtcaattctccattattgaacagtcagttgctggattctacgaaaaagaaataacgattataggtgacaaagaaaacgacatggaaaataataactgctga

SEQ ID NO: 8707 - RNA, 3780 nt, synthetic construct
  misc_feature 1..3780: note = Cas9 variant
  source 1..3780: mol_type = other RNA
atgaaatatatattaggactagatctcggcgtagccagcataggatgggctgtgactgaaatcaatgaaaaaggagaaccagtgggactaatcgacgcaaactccgtaatcttcaaaccattagataacgataaaggtaaactatacaacgtagagcgacgagacaaaagaggctcacgacgaatattacgacgaaagaaacacagagtagaaagaacaaaaatgctgctcgtcaacagtagttttctcacaaatgaagaaatagataatctgtatgtaggtaaactagataatatttacgaagtgagactaaaaggactaaaagaacaattgtcgaaaaacgaaatagctcgattaatgatatactactgtaaaaaccggggcttcaaatcaaatcgaaaaacagaagacttagaaattcttaaatccctaggtgagaaaatatcagaaaaggacagcgacgaaaagaaactaaaaccaataatagccaaaaacacagaactgatcgaatctaaaggactaacaccgatagaagtgatatatatgattagagagaatgacaacagcatattaggattcaaaaataaagaagggaactataaatttggctttaaaagaaatcaagtaatagatgaagtaagaaaaattttaggaacacaacaaatactatccaaagagatagtagatgaatacatagacatactgtcatcccaacgagacttcagcgacggaccaggaggagacagcaaatacaaaatagactacacaaaattagcaggtaaatgtaaatacacgggggaagtacgagcagtaaaaagtgcaccatcatatgagatattcacaatgttgcaaaaactgaacgacatcaggtacgtaaaattcacatctgaagataagattgaaaagaaaaagctatcaaaggaagtaatacacaaactatacgacttagtagtagagaaaaacaaaacgctaacctatgacttaatagaaaaatcaattgacgaagaaaacatcaaactactaaatataccaaaattaagtaagtcaaaatacgtcgaactcagaaagtcttattttaaggaaaggaacgacaatgaaaatctaacagaagaagaaatcaatgcattcaacgaaaaacttaacaatgaaagaatgaaacaagaactaatacgcaacaacctaaaagcatataaggaactaaaatcaaaattcaaaaagaacaacatagacgaaaaccgcattaaagaactcggcggaatatactttttggatttagtagcagaattattaacctattctaaaacagacgaaaaactagaatactttgtagagaacgtcgaaagatatagcttattcaaagaacaaagggacatagtagaaataatcaaaacattcccaaactataccaaaaatggaaacctctccctaagtttagtaagagaattaaacaagttgctaatggaaggacacgattacgaaagcagcttaagttcgctaaactattacatagacacagacgttgattgggaaaaattcccgacaatttctgaaatagaagactccttgtcaacaaagataactaatccaaatgtcaagcacatcctcgttattctaagaaaactatataacacactgctattcaaatatggaagaccagaaaaagttcatctagaactaagtagagacttctcaaacgacttctcaacgagaaacaaaattcaaaaagaacaattagagaacaaggtgagaagagaagttgctgcattcgaaatgtatggagctaacaaagacatagtcgctggaaaggatagactatcaaacgacgacttcgtacgaataaagttatgggaagaacaaaataaagtatgcatgtactcaggaaggacaatcgagaaataccaattgaccagtgcagaagtacaaatcgatcatatactgccgtatagtaaatcattcgacaatagttattcaaataaagtgctagtattctccaacgaaaaccaagacaagaaagaacgtacaccctatcaatggcttaaaggtacagaaaaatggaatgaatttaaacaacgagtaagactaaatctaaacatctcaaacaaaaagaaagaaaatctactatttgaagacgaagtcgtaaacaacgagttcttagaaagagaactacatgcaacatcatacagcagccggttagccctaaacatattccaaagactaatacctgtatcagatgaagacaaatacgatgaacatggaaatgaaaaagtaaaatacttatataaccgaaatgtaatagcatttcaaggaaaaatgacctcgatgctacgaaatctatacagcctaaacaaatatacccactcatttgaaagcgacactctagacatcgataacaaggcttttattcttaaagaatttgaaatcaacaaagataatttaaaaatgacagcttataacgttaacacggggttagaaataacaagcgaaaccaaagtagagaaaaacaaatcgggagaatttaaaactataaaagacgaactccttaagaaagaacttgataagaaagaaaatctaatagagatctcagactacttcaaagacaaagtcttattcgacctaaaaatagtagactttgaagaaatagataccgtcgaaccggaaattataagcattttgtacaaaatgattaccgcactaaaagaagaagtctacagcaaaaatagagaaaaccatctccaccattctctagacgccttccttctaaccataatgaacagatcaatgcaaatgaaactaataaaatataaccaattaataagtgtattaaagaacaaagaaatcgagatattcaatgaggaaaaaggagaatatatagatagcaaagagttcgctgaagaactacaaaaacagaaaatcattgacatagatggaaatgaaaggggaatcaagtttaacgtaaatggaaaaacccatagactaaacctagtaaaaccatatgaaaattttctcgatgacattaaaaacaaaatattcgacaaaagagaaaacaataaactaccataccacgtcgtaaagagtaaagtatcaggcgctttgcacgcagaaacaatattaggagaaagtaaaggcgaaataacaaaacggatatctgttttcgatattaattacaaaaaccttggaaaaatattcgataaagatggaagccaaaaagaaatttacgaaacgttagtcaaatggttagaagcaaaaagcaaagactatccaaaacttaaaaacgggaacatcataaagaaagtaaaaattgtcgatggaaacaaggataaactaataaagctcggaaacaaaagatacgtagaaatgggaagaacaacagtaaaaatattagtattaaagaaagaagcagaagagggactaaaatttgcctccatcgggagatataaatataatctactgaaatcagaaaaagacgtaaacataagcatctggaaagacgctatacacttctgtaaagtaaggtacaataaactaaaggaaaatggttatagactaatacacgaactaataccaggagagacgatagaattagaactcaacaaaggaaacataagcaaatgcctagtagtgggattttccggaggaaaaatagaaataagctcagtaataggtgacgcattggacttaataaacgacaaaatatcaacaagaattaaagagagatactacataacagtatcaaccattaagagcattaagaaaataaataaaaacatacttggagattga

SEQ ID NO: 8708 - RNA, 3792 nt, synthetic construct
  misc_feature 1..3792: note = Cas9 variant
  source 1..3792: mol_type = other RNA
atgcacaaaaacaacccagacataagagaattattcttagcaatacaccatattctcaaatacagaggtcactttctattcgcaggccagcaattcaaaggttcagaaatcaaagacaacattagggaattactccaatacaattcattaaacataaaaatagatataacggatgaattaataaacaatatagccgaaatattattaaaaaaaaaaaacagcaccgataaaataatagaattcaaaaaactatttgcagacgaaaaacaactcatcgaagctctaaggctagcgttaggaaataaaacacaactagcaaaattattcgatatcgaagcctacaaagaacttgatatctctatcaaaacaatcagcttcaaagaaaaaatctacgaggatgttcggagtaactatgaagaaattctaggcgaatacataatcgtactagataccgccaaacttatatatgacgcaattatactatccgaaataaaaataaaaaatatgacaatctcagaaagtaaagtaatatcctacgaaaaacacggcaaagatttaaaacaactaaaacaattaataaaggaagacagtaaactaagcaaaaaagaaaaacgacaactattcgaaaacatcttcgtaaaggaagatgaaaaagaagctaactacgtaaactatataggaaaaaataatgtcgggtcatcaaaatcaagttgctcatacgaagactttaaaaaaagcttaattaaagaattaaaatactgcgaagaatcgaaacttaagcaagatatcctagccgaactagaactagaaacgtttctacctaggcagagaacaaaagataactcagtaataccctaccaaatacacaaagaagaacttgaaaaaattttaaacaacgctgtccaataccacccattcttaaataatacggacgagtatggtataagtataaaggaaaaaataatacaactactggaattcagaataccatattatgtaggatccctaaatacttcgcataaagtagggaacggtggtttttcatggtccgttcgaaataaaggatacgaaagaacagccgtaactccatggaatttcaacaaagtaatcaataaagaagagagcgccaaaaattttatagaaaatctcactaaccaatgtacatacctactatatgaagacgtattgccaaaacacagcctgttatacagcgagtttaccctgttaaacgaattaaattccatcaactacggaggtaaaagactgactgtagaacatagaaatctcataattgaacggttctttaaacaatcagcccctaaagcaacaggaaaagaactcaaaaaattcctcatgtccgaaggcgttatagacggcaaagacgaactaagtggcttcgacatatcaattaaaaatgatttaaaatcttacagagatttcaagaaaatcttgggagaaaaattcgactcagaaaaagtagaaaaaatgatcagatggatcacactcttcggcgaaagcaaacaactactcgtagacaaaatcacaaaagaatacggcgatatatattcgtctgaagaaattaaaaaaatcagcggactaacctacaaagactgggggagactatcagagaaattactgacagagatagtatcctcccaattatacgatgaaagtacaggtgaatgttttaacatcattaacgctatgcgcaataacacactacttttcatagaattactaggaaccaactatgattactttgaaaaaataaacacatacaacggtaaactcagaaaagaaataaccgaaataacaccccatatacttgacgatctatacgtatcaccagctgtaaaacgttcgatatggcaagttgtaagaatagtagaagaactcaaaaaggtaatcggcagcgagccaaaaagaatcttcgtagaaacaaccagaagtaataaggaaaaaaaaggcgacgacggacgaaaagactcaagaaaaaaagccttactagaactctacaaaaaaataaaaacatcggatatcgccgaacttgaaaaagcattaggacacaccgtcgatttcgacaaaaaaaagcaagatcttacagacatagataataataaactgaaagccagaaaactgtacctctactatacacaattaggtagatgcctatacaccgggaaggctatcgatcttaataaccttttcggcagcaattcggaatatgacatcgatcacatatacccacaaagcaaaactaaagacggatcttggaacaacctagtgctagtcaacaaaaccgaaaactcaaaaaaaagcaacggattaattagcgaaagtatacaaagaaaaaataaacacttctggagattcctcaaagcaaagaacctaatatcagaagaaaaatataaaagactaactagaacagaagatttcaccgacggagagctatctggattcatagcacgacaacttatcgaaacgtcacaatccgtaaaagtagttagtaaaatactacaaaatctcaacccgacaacagaactatgcttttccaaagcagagaatgtcagcgacttcagacaagaattcggaaaaataaaagtaggtaaaagaaaaaatttaacagaagaagaacaaaaaaaagccaaagagggtcagttaatcaaagtgcgagatctaaatgacctccaccatgcaaaagacgcatatttaaacatagtagtcggaaacgtttaccacataaagttcacacgaaacccaaaaaacttcatacgaaaaaacttcaaaaacagagaatatacactgaacacattattctactcagacaaagtagaaagaaatggagaagtagcatgggaaaaaggaaagacagaagaaattgtttccagcgtcatgtgtaacaatttaatcaatgttacaagaagaacgtctgagcagaaaggagctttatacgaagcaactatatataaagcaaacgcagctaaggaaggttcctactaccccgtgaaaacaaacaacaagaatttaaaaaatgttacacgatacggcggtttcacatctataaaaatagcttactatagtattttcaaatacgacataagaaacaaagataaagtaaaagaaaacattaaaatcattccaataccaatatacatttcacaaaatataaaaacagatctagacctcattaatttcgctgaaaaacaaattaaattaaaaaaaggcgaaaacatagaaaatctccaattaatatacaaaaaactaaacataggagctctagtaaaaatagaccactacccatactatataggcggaaaaactgatgacaacttctatgttgatggcgcagtacaagtcctgttaagcagcgatatcgaaagatacctaaaagaagtcgttaaatttgtaaactttcaaagagagaacaaggaagcaaaggtaagcaaagaacacatatccctcgaagagaacatcaaactatacaacaccttagtatgcaaaatggcaactaaaatatttacccacaaaaaaaacaataagtataacgacctcacacaagacaaagccaaaaacacatttaacaaattaagcctagaagaacaatgcaaagtcttattagaaatattaaatttactaacaaacaaaaaaactactttcgacctatcacttataaatgagaaaacaagtagagtcaaatgcggattcaacttactgaatcagaaacaattttcaatcatagaacaatccgtgactgggctctacgaaaaggaaattaagattattgaagactga

SEQ ID NO: 8709 - RNA, 3795 nt, synthetic construct
  misc_feature 1..3795: note = Cas9 variant
  source 1..3795: mol_type = other RNA
atgaaaaatgttctaggactggatttaggaacaaatagtataggatgggcactaatagaagtagatgaaaacaacctgccaataagaataatcgcaatgggaagtcgcataatccctctttctacatcagacaaagaagagttccaacgcggattgagtataaccaaaaaccaatcaagaacagtatcaagaacacaacggaaaggctacgatcgaaagcaactcaaaaagagcgatttaaagaaaattttaaacaaatacaacatatttccatcagaagaactcttaagattgccgatgctagacctatggaagctacgcagtgattccgcaaacccagacgaaaatattagcgccgaacaattagggcgaatcctatacatgctcaaccaaaagagaggatataaaagcgcacgaagcgaagctaacgcagataagaaagattcagactacgtacaagctgtaaaaggaagatacgaccaattaaaagacagaaaacaaacaataggacaatatttttatgacgaactttacaatgccaacgccaataactcatactttcgaatcaaagaagaagtatatccacgggaagcatacattgaagagttcgatacgatcataagcgcacaaagagaaaaacatgatttcctaactgacgaagttgtacaccaactaaggaatgaaataatatatttccaaagaaaactgaaatcacaaaaaggtttggtaagcatatgtgaatttgaaggcttcgagaaaacagtgtttgataaagagaaaaacaaaaataaagtagttttcgtcggaccaaaagtagctcccaaaacttcaccactattccaattatgcagaatatgggaagtggttaacacaattacgctaaaaattaaaaacccagaaggaagcaaatataaatggggagagaaaataccagacataaaagaaaaagaaattttagcagattatctttttaaaaatgaatcactgagtttctcaaaactattagaaatactcgaactaaagaaagagaacgtatacgtaaataaacaaatactcaaaggtataaagggaaatgaaacttactcagcgttacattcaatcctcggagataacgaattattaaacttcgatgtttccatcatgacttctaatcaaacagcattgctcgtagatcgaaaaaccggtgaaattctagaagaaagagcaggactggaattggacgcatcactagaaaaagagccactgtatcaactctggcacacgatatattcattaaaagatctcgacgaatgtaagaatgctctcattaaacgctttgacttcgatgacgaaacagccgaaaaactcagtaggatagactttaacaaacaagcctttggaaataaatctaataaatccatgcgcaaaatactgccattccttatggaaggatatgactattcacaatcatcatcattagccggctataaccacagcaactctttaaccaaaaacgaacgcgagcaacaaattacattagatagactagaactactacccaaaaattcattacgacaaccaatagtggagaaaatcttaaaccaaatgataaacgtcgtgaatgctatactagacgaatacggaaaaccgtcagaaatcagagtagaactagcacgagaacttaaacaatcaaaagacgagagaaacgaaacagacttgcaaaacagtaaaaacaagaaattaaatgacgaaataggaaaaagactagaagaacttggactacccgtgaccaaaagatatattcagaaatacaagtttattttcccttcattaagtaaaaatctaaaagaagccaaagttaacaatcaatgtatttattgcggggagaccttcaacctaacagaagccctatccggcgacgcatatgatgtagatcatatagttcccaaagccctcctatttgacgatagtcaaactaacaaagtcctagtacacagaaaatgtaactcgacaaaaacaaatcaaacagcatacgattatattgcaacaaaaggggatgaacatttaaaactgtattcagaaagacttgacgattggttcgaaagaggcatcatatcctacagtaaaatgcaacgcctaaaagtatcacataaagaatatctcgaacgcaagaaactaggaaaagaaaccgaaacggataagaaactctgggaaaatttcatagatagacaattaagagacacgcaatacatatcgagaaaatcaagagaaatcctacagaaaatatgcaatgacgtcaaaacaaccgagggaggtgtaacagctaaactaagaaacctatgggggtgggacgacgtactaatgaatttacaaatgcccaaatacaaagaattagggcaaacgataaccaaagaatggacctctgagcacggaaaacgaaaacaccaaaaagaagaaatagacaactggacgaaaagagacgatcatagacatcacgcgatagacgccttagtcattgcatgtacaaaacaagggttcattcaaagaataaacacactgaatagctcagacacgaaagacttaatgattaaagaagtcgaagaggcaaaaatagagttcaacgaaaagacaactctactcgaaaaatacctgaaaacgcaaaaaccattcagcacccaagaagtaatgaaagaagcagataaaattcttgtatcattcaaagcaggaaagaaagtagcaactataacaaaattcaaagcaactggcaaaaataaagaaaccggagtaatagtaccaagaggagccctccacgaacaaagtgtttacggaaaaatcaaagtaattgaaaaagacaaaccactaaaatacttattagaaaatagcgataaaatcgtcaacccacgaattaaaaaccttatagaaatcaaactatcagaaaacaaaaatgatccaaagaaagccctattagcgttaaagaaaattccaatatttttagacgaagaacaatcaataacattagaaaaagcatcatgttacaatgacgcaacagtactcaaatataaactacaaaacctcaaagcagctcaagtcgatgacatcgttgatgaaaaagttaagaaaatagtgagagaacgcctatcacaatttggaaacaaagaaaaagaggcttttaaagatacgctatggttcaacgaagaaaagaaaataccgatcataacagtaagactattcgccaggccagatgctaacaacttacaaacaatcaaaaaggacgaaaatggaaacggcataggattcgtagtcacaggaaataaccatcatatagctatatacgaagataaagataacaaaccagttcaacactcttgcactttttggcatgcagtcgaacgaaagaaatataacataccagctgtgatacgagactcatcagaagtatggaacgacttactacgaaaagaactaccagaatcattcctgaataaactacctgctgacaacttaaatttaaaattcagtatgcagcaaaatgaaatgttcatacttggactaagccaagacgagttcgttaaagcaatcgcgaacaatgataaaagtttactgtcaaaacacctctacttggtttggagtatctcagaaaacaactattggtttcgacatcatctagaaaccaaaaattctgatctaaagaaaacagatggcgtaaaagaatcaaaaaggttatacaacatcagatctttgggaagcctgttttctctaaatccaataaaagtaagactcaactatcttggagaaataacaaaaatcggtgaatga

SEQ ID NO: 8710 - RNA, 3801 nt, synthetic construct
  misc_feature 1..3801: note = Cas9 variant
  source 1..3801: mol_type = other RNA
atggcaaaatatatattgggattagacctaggaaccaactcaataggatgggccttaatcgaagtagacgagaataatataccaattagaataatcgtaatgggatcgaggattataccactcagctcaaatgatcgagaagaatttcaacgtggcttgtccattactaaaaatcaaaaccgaacaatatcaagaacacaaagaaaaggatacgaccgaaaacaactcaaaaggaacgatctcaacaaagtgcttaataaatacaatatcttcccctcaaaaatgcttctgaaccttccaatgttagatctgtggaaattaagatccgactctgcaaattcaaacaaagatatttccgcagaacaacttggtcgtatactctatatgttaaaccagaaaagaggatataaaagcgtacgatccgaggcaaacagtgacaagaaagatacagactacgtacaagcagtaaaaggcagatacgcacaattaaaagacagaaaccaaactataggtcaatatttctacgaagaactatacaatgccaacgtaaacaattcatattttaaaattaaagaagaagtgtacccccgagaagcatatatcgaagaatttgatacgataattaattctcagaaaacgaaacacgagttcttaacagaccaattcgtacatcaactacgaaacgaaataatatatttccaaagaaaattaaaaagccaaaaaggtttaataagcatctgtgaatttgaaggatttgagaaaacagtcttcgataaagagaaaaataaacacaaaatcgtattcgtaggtccaaaagtcgcaccaagaagtgcacctttatttcaactatgcagagtatgggaagtcataaacacaattagcataaaagtcaaaaaccctgaaggtagtaaatataagtggggagaacgaataccctccatcaaagaaaaagaaatcttagcggactatctatttaaaaacgaagtactgtcattcacaaaactcctagaaatccttggactaaataagaatgacgtctatgtcaacaagcaaatattaaaaggcataaaaggaaatgaaacttacgcaacactatataacattcttggcgaaaacgaatttttaaatttcgacgtctcaattataccttccaatcatacatcaatgctagttgacaagaaaactggggaaatattagaagaaagagcaggattagaacttgacgtaagtttagaaaaacaacctttttaccaactatggcatacaatctactcattaaaagaccttgacgaatgcaaaaatgcactaataaaacgattcgactttgatgatgaaactgcagaaaatctaagccgaattgactttaacaaacaagcattcggaaataaatcaaataaaagcatgcgtaaaatattaccattcctaatggaaggctatgactactcacaaagttgctcactagcaggctacaatcattctaattctctaactaaagacgaacgagaacaacaagtgacactcgacagactcgaattactacccaaaaactccctacgacaaccaatagtagaaaagattctaaatcaaatgatcaacctcgtcaacgcaatcctagatcaatacggtgagctatcagaaataagggtagaactagctagggaacttaaacaatctaaagatgagcgaaacgatgcggacctccaaaatactaaaaataagaaactaaacgatgaaataggaaaacgactcgcagaactaggactcccaattacaaaaaggtacatacaaaaatacaaatttatatttccttcattatccaaaaatctgaaagacgcacatgtaaataaccaatgtatatattgtggagaaacatttaacctatcagaagcgttaagcggcgatgcatacgacgtcgaccatatagtaccaaaagccttattgtttgacgactctcaaacaaataaagttctagtacaccgaaagtgcaactcaacaaaaacgaatcaaactgcatatgactacatatccacaaaaggagatgaacaagtaaggatatactttgagagagtggatgactggttcaaaagcggaataatcagctactcaaaaatgcaaaggttaaaagtttctcataaagaatatctcgagagaaagaaaataggaaaagaaactgaaacagacaagaaactgtgggaaaattttatagatcgacaattaagggacactcaatatatatcacgaaaaagcagagaaatattacagaaagtgtgcaataatgtaaccacaacggaaggaggcgtaacagccaaattaagaaatctctggggttgggacgatgtactcatgaaccttcaaatgccaaaatacagggagcttggccaaaccgtgataaaagaatggacaagcgaacacggcaaacgtaaacaccaaaaagaagaagttgaaaactggacaaaaagggatgaccacagacaccacgcaatagatgccctcgtaatcgcctgtacaaaacaaggatttatacaacgaataaatacactaaacagcagcgatacaaaagatctcatgctaaaagaagtagaagaggcaaaagttaaatttagtgagaaaacaactttattagaaaaatacctacgaacacaagaaccattctcgacacaagaagtaatgagggaagccgacaaagtattagtttcatttaaagcaggcaagaaagtcgcaacaatcaccaaatttaaagctataggcaaaaacaaagatagcggagtaatagtcccccgcggagccctacatgaacaaagcgtctatggtaaaataaaagtaatagaaaaagataaacctttaaaatacctattcgaaaactctgatcgcatagtagacccaaaagttaagaaattagtagaagtaagattaagcgaaaacgaaaacaacagcaaaactgcaataagcaccctcaagaaagcacctatattcttgaacgaagagaaaaccgaagtcttggaaaaggcttcttgttacaatgacgcaacagtgctgaaatacaaactccaatcgattaaagcatcacaggccgacgatatcgtcgacgaacgtgttaaatttttagtcaaagaaagattagctcaattcggcaacaaagaaaaagaagcatttaaagacatactatggtttaacgaagaaaaacaaataccaataataagtgttcgcttattcgctagaccagacgcaaataacctccaagttatcaagaaagacgaaaatggcaaaagcataggtttcgtactcacaggcaataatcatcacatagcaatatacgaagacaaagataacaaattaatacagcactcatgcactttttggcacgcagtagaaagaaagaaatacaacataccagtggttatcaaaaattcaagtgacgtatggtcccaacttctggataaacaattaccagaatcactcttaaataaattaccaacagataaactaaatctcaaattttctatgcaacaaaatgaaatgttcatcttaggcttaagccaaaaagagttcgacgaagctatcaaaaacaaccataaatcattcttaagcaaatatctttacttggtatggtccatatcaaacaacgactattatttcagacatcatctcgaaactaaaaacacagaactcaaaaacataagcaccgcaaaagaaagtaaaagatatttcagatttaaaagtgtgggtgccctagttggaacaaacccaattaaaataagacttaatcacttaggggaaataaacaaagttggagagtactga

SEQ ID NO: 8711 - RNA, 3807 nt, synthetic construct
  misc_feature 1..3807: note = Cas9 variant
  source 1..3807: mol_type = other RNA
atgactaagaatatactgggacttgacttaggcaccaacagtattggctgggcactaatagaagtggatgaaaataacacaccgatcagaataatcgctatgggttcacgcataatacctttaagtacatccgataaagaagagttccaacgaggacttagcattaccaaaaatcagagcagaacggtaagccgaacacagcgcaagggctatgacagaaaacaactaaagaaaagcgatttaaagaaaatcctaaacaaatataatatatttccatcagaggaactattgaaattaccgatgttagacctatggaaactacgaagtgatagcgcaaatcctaacgaaaatatctccgccgaacaacttggcagaatactatatatgcttaaccaaaaacgtggttataaaagtgcaagatcagaagctaatgctgataagaaagatacagactatgtacaagccgtcaaaggtagatacgctcaactaaaagaaagaaatcagaccatcggacaatacttctacgaagaactatacaacgcaaatactaacaactcatatttccgaataaaagaagaagtatatccaagagaggcatatacagaagaatttgatacgataataaatgcccagaaaaacaaacacgatttcctaactgacgaagtagtccaccaactaagaaatgaaatcatctatttccaaagaaaactaaaaagtcaaaaaggattagttagcatatgtgaatttgaaggatttgagaaaactgtattcgataaagagaaaaataaagataaagtcgtctttgtgggaccaaaggtagcaccaaaaacatcgccactatttcaattatgcagaatatgggaagtcgtaaatacgatatcattaaagattaagaacccagaaggcagtaaatataagtggggcgagaaaattccaaacttaaaggaaaaacaaatcttagcagattacctattcaaaaatgacagcttatcatttacgaaactactagaaatcctagacctgaataaaaacgacgtttacgtcaacaaacaaattctaaaaggcattaaaggaaacgaaacatttagcaccttacacacagtacttggtgacaacgaactattaaatttcgatgtaagtataatcccgtcgaatcatacgagtatgttggtagataagaaaacaggagaaatattagaagaacgagctggtctagaactggatgcatcactagaaaaagaacctttgtatcaattatggcacacaatctattcactaaaagacctagatgaatgcaaaaacgcactaataaaaagattcgggtttgacgatgaaacagcggaaaaactcagccacatcgactttaacaaacaagcattcggtaacaaatcgaataaatcaatgagaaaaatcctcccatttttaatggaaggatatgattacagccaaagttgtagcctagccggctacaatcactcaaatagtcttacgaaagacgaaagagaacagcaaataaccttagatcgcttagaattattatctaaaaattcattaagacaacccatagtggagaaaatcctaaaccaaatgataaacgtagtaaacgcaatactagaacaatatggaaaattatcagaaataagagtagaattggcaagagaactaaaacaatcaaaagacgaaagaaacgatgcagatttacagaactccaaaaataagaaactaaacgaagaaatcgggaaacgactcgctgaattaggattacctgttacgaaacgctacatacaaaaatacaagtttatttttcctagtttgagcaaaaacttgaaagacgcacacgttaacaatcagtgcatatactgcggggaaacctttaatctaacagaagccctgtcaggagacgcatttgacgtagaccacatagtcccaaaagcactactatttgatgattcccaaacgaacaaagtcttagtacacagaaaatgtaactcaacaaaaaccaaccaaaccgcatatgattatataggaacaaaaggtgaagaacaagttcgcgtatacagcgaacgaatcgacgattggttcaaacgcggtataatatcctacagcaaaatgcaaagactcaaagtaagccataaagaataccttgaaagaaagaaactaggaaaagaaacagaaacagacaagaaactatgggaaaactttatagatcggcaactaagagacacccaatacatctcacgaaaagccagagagatattacaaaaagtatgtaataatgtcacaacaacagaaggaggcgtcacagccaaactaagaaacttgtggggttgggatgacgtcttaatgaacttacagatgccaaaatataaagaattaggacaaacagtcatcaaagaatggacttcagaacacgggaaaaggaaacatcaaaaagaagaaatagaaaactggactaaaagagacgaccatcgacaccacgccatagacgcattagtcgtcgcatgcacaaaacaaggctttatacaaaggataaacacgctgaactcctcggacactaaggatctaatgcagagagaaataaaggaagccaagaaactactgggagaaaattacaatgaaaaagaatttgaaaacgataatgaatttgttaaaaaccacaaagaaagactatcacaactagatgactatttacgattacagaaacccgtaaaattcgacacaaaatacgtcgaacaagaagctgacaaagtgctagtatcattcaaagcaggcaagaaagtagcgacgataacaaaattcaaagccacagggaaaaataaagatactggagtaatagtcccacgaggagcactccacgaagcaggactatacggaatcagaacaatatacagtaaaggaggcatagcagaaaaacatataataaagaaatacaaagttggggtatcagcacaagaccacatctttaccgggaaagagacatacagtgtaaagaaagacaaaaacggaaatgaaaaagtagatgataaaataaaaatagttcttgactcaattgtagacaacaaagtaaaagaagtcgtcctaaatcgattaaaccgaggtttcaataacgaagaggattacagaatagacgtcaaaaaggcactcaacaattttaaaaacctagacgaagacccattgtggtacaacgaatcaaaagggataaaaatattgagcataaaactgaaaaccggattaaaagatagtgtagtacctctacgcttaaacgaaaagaacgaagtcataacactggtaaaaacaggaaacaatcatcatattgccatttatgaagataacgatggaaaacttattcaatactcctgtaccttctggcatgcagtcgaaaggaagaaatacaacataccaacggtaattaaaaactcatctgaagtatggaatcaggtactagacaagaaattgccagaaagtttcctaaaccgattaccagccgacaaactcaacttaaaattctctatgcaacaaaacgaaatgttcatactaggtttgctagaagaagagttcgacaaagcaataaaagataacgacaaatccctattatcaaaatacttatacctagtttggagcatcgctgaaggagactactggttcagacaccacctcgaaacgaaaaacacagaactcaagaaaacaaacggagccaaagaatcaaaaagatacttccgactctcaacaaaaggattaatagatttaaatcccgtgaaagtaaggcttaatcatctaggagaaatcacaaaaataggagaatactga

SEQ ID NO: 8712 - RNA, 3810 nt, synthetic construct
  misc_feature 1..3810: note = Cas9 variant
  source 1..3810: mol_type = other RNA
atgaacaacagtataaaatcaaaaccagaagtaaccataggcctggacctaggcgtgggaagcgtaggctgggcaattgttgacaacgaaacaaacataatacatcatttagggtctagactattttcacaggcgaaaacagcagaagacagacgatcattccggggcgccagaagattaataagaagaaggaaatataaactaaaacgttttatcaatctcatatggaaatacaactcttattttggcttcaaaaacaaagaagacatacttaacaattaccaagaacaacaaaaattacacaatacagttttaaatttaaaactagaagcactcaatgccaaaatcgatccgaaagcactaagctggatactacatgactacctcaaaaacaggggacacttctacgaagacaatagggatttcaatgtgtatccaaccgaggaattagcaaattacttcggggaatacggatactacaaaggaatcatagactctaaagaagacaatgacgataaactagaagaaggtcttacaaaatacaaattcagcaatcaacactggctagaagaaattaagaaagtactctcgaatcaaacaggcctaccagaaaaattcaaagaagaatacgaatcattattctcatatgtccgaaattattcagaaggaccaggctcaataaactcagtaagtccatatggaatttaccatctagacgaaaaagaaggaaaagtagtgcaaaaatacaacaacatatgggacaaaaccattggtaaatgcagcatttttccagatgaatatcgagcacccaaaaactcaccaatcgcaatgatatttaacgaaatcaacgaacttagtacaatacgatcatattctatctatctcacaggatggttcataaatcaagagttcaagaaagcatatctaaataaactcttagacctcctaataaaaacaaacagtgaaaaacccatagatgcccgacaattcaagaaacttagagaagaaacaatagcggaaagcataggaaaagaaaccttaaaagatgttgaaagagaagaaaaattagaaaaagaagaccacaaatggaaattaaaaggactaaaattaaatacaaatggcaaaatccaatacaacgacctaagctcattagccaaattcgttcataaactaaaacaacatttaaaactcgactttctactagaagatcaatatacaacacttgacaaaataaacttcttacaatcactattcgtctacttgggaaaacatctccgatattcaaaccgagttgacagcgctaacctcaaagagttctccgattcaaacaaactattcgaaagagtactccaagaacaaaaagacgatttattcaaattatttgaacaaacagataaagacgatgaaaagatattagcacaaacgcattctctgtccaccaaagcaatgctattagccattacaagaatgacaaatctagacaacgacgaagacaatcagaaaaacaatgacaaagggtggaacttcgaagctatcaaaaatttcgaccaaaaatttatagatataactaagaaaaacaataacttaagtttgaaacaagataaaagatacctagacgacagattcataaatgacgccattctatccccaggcgtaaaaagaatacttagggaagcaaccaaagtgttcaacgcaatacttaaacaattttcagaagaatatgatgtaacaaaagtagtaatagaattagcaagagaattaagtgaagaaaaagaactagaaaacaccaaaaactatgaaaaactaatcaagaaaaatagtgacaaaatttccgaacgactcgaagcactagatatcgctgaagacaaaatcgaagatatactaaaaagtcccacaaaatcctacaaagtgttactgtggctccaacaagaccatatagacccttactcccaaaaagaaatcgccttcgaagacatactaacaaaaacagagaaaacagaaattgaccatataatcccttattccattagctttgatgactctagttctaacaaactcttagtattagctgaatccaaccaggcaaaatctaaccaaacaccatatgaatttataacatccggcaatgccggtatcaaatgggaagactacgaagcctattgcagaaaatttaaagatggagacacatcgcttttagattcaactcaaagaagcaagaaatttgcaaaaatgatgaaaactgatacttccagcaaatatgacatcggattcttagcgagaaacctaaacgatactcgatacgctaccatcgtatttcgagacgccctaaaagactacgcaaacaaccatcttgtagaagacaaacccatgttcaaagttgtctgcatcaacggcggagtcacatcctttctccgcaaaaactttgacaaatcgtggtacgcaaagaaagatagagacaaaaacatccaccacgccgtcgacgcatcaataatctcgatattttcaaacgaaacaaaaaccctatttaaccaattaactcaatttgcagactacaaattatttaaaaacaccgacggaagttggaagaaaatagacccaaaaacaggagtagtaacagaagtaacagacgaaaattggaaacaaataagagtcaggaaccaagtgtcagaaatagccaaagtaataaataaatgcatacaagatagcaacatcgaacgcaaagcaaggtattcgcgtaaaatagaaaataaaacaaacatcagcttattcaacgacacagtgtatagtgccaagaaagtaggatacgaagatcaaattaaacgtaaaaatttaaaaacattagacatacacgaatctgcagaagaaaataagaactcaaaagtcaagaaacaattcgtatatagaaaattagtaaatgtctcacttttaaacaacgataaactagccgacctattcgccgaaaaagaagacattctaatgtacagagccaacccatgggttattaatctagcagaacaaatatttaatgaatataccgaaaacaagaaaattaaatctcaaaatgtatttgaaaaatacatgcttgatctcacaaaagaatttccggaaaaatttagtgaagcctttgtcaaaagtatgctcagaaacaagacagccattatatacaacgtcgagaagaaagtagtgcacagaataaaacgcttaaaaatcttaagtagcgaactcaaagaaaataaactatcaaacgtaataataagaagcaaaaatgaatcaggaaccaaactaagttatcaagacacaataaactctatagctctaatgataatgagatcaatagatccaacagcaaagaaacaatatataagagtaccactaaatacattaaacctacatttaggagaccaagacttcgacctacacaacatagacgcatacttaaagaaaccgaaatttgtaaaatacttaaaagctaacgaaataggagacgaatacaaaccctggcgtgttctaacatcaggcacattactcatacataagaaagacaagaaattaatgtatatcagctcatttcaaaatctaaaagacgttatcgaaattaaaaatttaatagaaaccgaatacaaagaaaacgacgactctgatccaaagaagaagaagaaagcaaaccgattcctgatgacactctcaacaatattaaacgactatatacttctagatgcaaaagacaatttcgatatccttggactcagcaaaaacagaatagacgaaattttaaactcaaagttaggtctcgacaaaatcacaaagtga

SEQ ID NO: 8713 - RNA, 3810 nt, synthetic construct
  misc_feature 1..3810: note = Cas9 variant
  source 1..3810: mol_type = other RNA
atgaacaacagcataaagagtaaacccgaagtaaccatagggctagacctaggtgtagggagtgtaggttgggctatcgttgataacgaaactaatataatccaccatttaggatccagactattttcccaagccaagacggcagaagatagacgaagctttagaggagtaagacgattaataaggagaagaaaatacaaactaaagagatttgtaaatttaatctggaaatacaactcatattttggttttaaaaacaaagaagatattctaaataattaccaagaacaacaaaaattacacaacaccgtattaaacttaaaaagcgaagctcttaatgctaaaatagacccaaaagcacttagctggatactgcacgattaccttaagaacaggggacacttctacgaagataacagggatttcaacgtataccctaccaaagaactggcaaaatactttgacaaatacgggtactacaaaggcataattgattcgaaagaagataacgacaacaaactagaagaagaactcacgaaatacaaattcagtaataaacattggctagaagaagtaaagaaggttctatccaaccaaacaggcctcccagaaaaattcaaagaagagtacgaatccttatttagttatgtaagaaactactcagaaggccccggctcgatcaactcagtctcaccatatggaatataccatctagacgaaaaagaaggaaaagttgtacaaaaatacaataacatatgggataaaaccataggcaaatgcaatatctttcccgatgaataccgagcaccaaaaaactcacctatagctatgatttttaacgaaataaatgaattaagtactatcaggagctattcaatttacctaactggatggttcataaaccaggaatttaagaaggcatacttaaacaaattacttgacctgctgataaaaactaatggcgagaaaccaattgacgcaagacaatttaaaaagttaagagaagaaactatagcagagtcaataggaaaagaaacattaaaagatgtcgaaaatgaagaaaaactagaaaaagaagaccacaagtggaaattaaaggggctaaaattaaacactaacggcaaaatacaatataacgacttaagctctttagcaaagtttgtacataaactaaaacaacacctcaagttagacttccttctcgaagaccagtacgcaacactagacaaaataaattttttacagtcattatttgtatatttaggcaaacacctgagatacaacaacagagtagactcagccaatctaaaagaattctccgattctaatcgactattcgagcgagtcctacaagagcaaaaagatggcttgtttaaattattcgagcaaactgacaaagatgacgaaaaaatattagcacaaacacattcactatctacaaaagctatgcttctagcaataacaagaatgacaaatttagacaatgatgaagataatcaaaaaaataacgacaaaggatggaactttgaagcaatcaaaaatttcgaccaaaaatttatagatattacaaaaacaaataataatcttagtctgaaacaagacaaaagatatctagatgatagatttataaacgacgctattcttagtccaggagtaaaacgaattttacgagaagcaactaaagtattcaacgcaatattgaaacaattcagtcaagaatatgacgtcacaaaagtcgttatagaattagctagagaactctcagaagagaaagagctagaaaacaacaaaaactacaaaaaattaattaaaaaaaattcagacaagatttccgaaggattaaaggccttggacatagcagaggataaaatagaagacatactaaaatccccaacaaagtcatacaaagtacttttatggctacagcaagaccatatagacccatactctcaaaaagaaatcgccttcgaagatatattaacgaaaacggaaaagacagaaatagaccacatcatcccatactccataagttttgacgattcaagttcaaataaactccttgtcctcgcagaaagtaaccaagcaaaatcaaaccaaacaccctacgaattcataacatcaggcaacgctggaatcaaatgggaagattatgaggcttactgtagaaaatttaaagacggagatacgagccttttagactcaacacaaaggtctaaaaaattcgccaaaatgatgaaaacagatacatccagtaaatatgacatcggattcttagcaaggaatctaaacgatacccgctacgcaaccatagtgttcagggacgccctcaaagactacgcaaacaaccatctagtagaggacaaacctatgttcaaagtcgtctgcatcaacggcggagtaacatcctttttaagaaagaactttgataaatcatggtacgcaaagaaagaccgagacaaaaatatacaccacgccgtcgacgctagtattatctcaatattttctaacaaaacaaaaacattatttgaccaactaacacaattcgcagattacaaactattcaaaaatacagacggaagctggaaaaaaatagaccctaaaaccggtgtagtaacggaagtaacagacgaaaactggaaacaaataagagtgagaaaccaagtctctaaaatagcagaagaaattgacaaatgcatacaagactcaaacattgaaagaaaggcaagatacagcagaaaaatagaaaataagacgaatataagtctcttcaatgacacagtatattcagctaaaaaggttggctacgacgatcaaataaaacggaaaaatttaaaaactctggatatagacgagtcagtagaggaaaataagaatagcaaagtaaaaaaacaattcgtgtaccgtaaactcgtaaatgtatctctactaaacaacgacaaactagccgacctattcgccgaaaaagaagatatacttatgtaccgcgcaaatccttgggtaataaacctggcagagcaaatattcaacgaatacacagagaacagaaaaataaaaagccaaaacgttttcggcaaatacatgctagacttaacgaaagaattccccgaaaagtttagtgaagcctttgtaaaaagcatgttacgaaacaaaacagcaatcatatataacgtcgaaaaaaaagtagtacataggataaaaagactgaaaatattatcttccgaactgaaagaaaataaattgtcaaacgtaataataagatcaaaaaacgaaagtggaacaaaactttcatatcaagacactatcaattctgtagccttaatgataatgagatcgatagaccccacagcaaaaaaacaatacataagggtcccattaaacacactaaacctgcatttaggagaccacgatttcgatctacataacatagatgcatatctaaaaaaacctaaatttgtaaaataccttaaggcaaatgaaataggagatgaatacaaaccatggcgtgtattaataagcggaagcctattgatacacaaacgcgataaaaaattaatgtatatatcatccttccaaaatttaaatgatctaatcgaaataaaaaacctaatagaaacagaatacaaagaaaacgtcgacagcgaccccaaaaaaaaaaaaaaagcaagccaaatacttcgttccctaagcactatactaaacgactacattctattagacgctaaagacaatttcgatatattaggcttatcaaaaaacagaatagatgaaatattaaatagtaaactagatctagacaagatcgccaaatga

SEQ ID NO: 8714 - RNA, 3822 nt, synthetic construct
  misc_feature 1..3822: note = Cas9 variant
  source 1..3822: mol_type = other RNA
atgaagaaaatcctaggcttagatttaggaacaaattcaatcggatgggcattaattgaggtagatgaaaacaatttcccaatacgaataatagctatgggaagccggataatacccctaagcagcaacgacaaagacgagttccaacggggattaagcataactaaaaatcagtcacgtacagtatcaagaacacaacgaaaagggtatgaccgaaaacaattaaagaaatccgacgacttcaaatattcactcagaagaatactcaacaaatataatatcttcccgtcagaagaactgttgaaattaccgatgttggatctatggaaactacggtctgacgcggtaaatccaaatgaaaacatatcagcagaacaactaggcagaattttatatatgctaaaccagaaaagaggatataaatcggcaagatcagaagcaaatgcggacaagaaagacacagactatgtattagctgttaaaggaagatacgcacaactaaaagaccgcaaccaaacaattggccaatacttttacgaagaactccataacgcaaaaacaacaaattcctacttcagaacaaaagaagaagtatacccaagagaggcctacatcgaggaatttgataccatcatcaatgcccaaaaatccaaacacgacttcctaaccgatgaagtcgttcatcaactgagaaatgaaataatatacttccaacgcaaattaaaatcacaaaaaggcctagtttctatatgtgaatttgaaggatttgagaaaaccatatttgacaaagaaaaagataaaaacaaagttgttttcgtaggacccaaagtggccccaaaaacaagtccacttttccaattatgtagaatatgggaagtagtaaatacaataacattaaaaattaaaaacccagaaggctcaaaatacaaatggggtgaaaagataccaaacatcaaagaaaaggaggctttagcagactatttattcaaaaatgaaaccctatcattcaacaaactcttggatattctcgaactgaagaaagaaaatgtttatgtaaataaacaaataataaaaggcataaaaggaaacgaaacatattcagccttacacagaattttaggagacaatgaattacttaaatttgacgtatcaataattccctcaaaccacaccagcatgctagtagacaaaaagacaggggaaatattagaagaacgagcgggtctagaattagatgtatcgctagaaaaagaacctctataccaactatggcatacaatatacagtatcaaagacttagatgaatgtaaaaatgcgctaataaaaagattcggctttgacgatgaaatagcagaaaaattatctcacttagattttaataaacaagcgttcgggaataaatcaaataagtctatgagaaagatactaccctttctaatggagggctataattattcccaatcatgcacacttgctggatataaccattcaaacagcttaacaaaagatgaacgagagcagcaagtaacactcgataaattagaactcctaccaaagaacagtcttaggcaaccaatcgtagagaaaatactaaaccaaatgataaatgttgtaaacgcaatattagaagaatatggaaaaccaagtgaaataagaatagaactcgcaagagaattaaaacaatccaaagatgaacgacatgatgcagacttacaaaattccaaaaacaagaaactaaatgaagaaattggaaaacgattaacagaacttggactcccagtaacaaaaaggtacatacaaaaatacaaatttatattccctagcttatcaaaaagtctcaaagacgctcaagtcaataaccaatgcatatactgcggagaaacttttaatttaacagaagcattatctggggatgcctatgatgtagaccatatcgtaccaaaaagtctactatttgacgactcacaaaccaacaaagtactggtacacagaaaatgtaactccacaaagactaatcaaacggcctacgactacatagcaagtaaaggcgaagaggaagtgcaaatatatagtgcccgagtagacgattggtttaaacgaggaattataagttattctaaaatgcaacgactaaaagtatctcataaagagtacctagaaagaaaaagtcttaataaagagacagaaacagataagaaactatgggaaaatttcatagatcgacaactaagggacacacaatatatatcaagaaaatccaaagaaatattacagaaagtatgtaacaacgtgacaacaactgaaggaggagtcactgcaaaactcagggacctatggggttgggacgacatactaatgaatcttcagatgcccaaatataaagaacttcggcaaacagtcatcaaagaatggaccagcgaacacggaaaaagaaaacatcaaaaagaagaaatcgagaactggaccaaaagagacgatcaccgtcatcacgcaatagatgccttagtaattgcatgcacaaaacaaggatttatacaacgaattaacacactcaactcaagtgaaactaaagatttaatgcaacaagaaataaacgaagcaaagaaactgctcggggaaaactataaagacaaagaatttgaaaacagcaacgaattagtcaaaaatcacaaaggaaggttatccaaattagacgattacctccgcctccaaaaaccaataaaatttaatactaaatacgtcgaaaaagaagccgataaaattcttatatccttcaaagcaggaaagaaagtcgcaacaataaccaaatttaaagcaacaggcaaaaataaagatactggagtcatcgtaccaagaggtgctctacacgaagctggcctatatggagtcagaacaatctattctaaaggaggtatagccgaaaaacacataataaagaaatacaaagtaggagtaagcgcacaagaccatattttcactggcaaagaaagctacagtgtcaagaaagacaaaaacggtaacgaaaaagtcgacgacaaaattaaagtggtcctcgatagcatagtagattccaaagtaaaagaaattgtacttaatcgactaaactttggattctcagacggtgaagactataaaaataacgttaagaaagctctaaacaattttaaaaatctagatgagtatcctttatggtacaacgaaaacaaaggaatcaaaattttaagcataaaattgaaaacaggtctcaaagacagcgttgtaccacttagattaaatgaaagtaacgaagtaatcactcttgttaaaacaggcaacaatcaccacatcgctatctacgaagacaaaaatagtaaaccagtacaacatagctgtactttctggcatgcagttgaaagaaagaaatacaacatacccgctgttataaagaaaagctccgatgtttggaaccaattgttagataaagaactaccagagtcattcctcaacaacttaccagaggacaacctaaatttgaagttttctatgcaacaaaatgaaatgttcgtattaggattatcccaagaagagttcaaagaagctattgaaaataatgataaatctctactaagtaaatatctatacctagtatggtccgtatcagaaaacaactattggttcagacaccatttagaaacaaagaactcagacttgaagaaaactgaaggagccaaagaatcaaaaagactctacaatataagatcggtgtcatcactcttctccttaaacccagtcaaagtacgattaaatcatttaggcgaaataacgaaaataggagaatactga

SEQ ID NO: 8715 - RNA, 3825 nt, synthetic construct
  misc_feature 1..3825: note = Cas9 variant
  source 1..3825: mol_type = other RNA
atgaccaaacacatattaggtctcgacttaggtactaactctattgggtgggcaataatccaagtcgataataacaataatgtacccatacaaataatagccatgggttcacgaataatcccactagattccaatgatcgtgatcaattccaaaaaggccaagcaatatcaaagaataaagaccgcacaacagcacgaacccaaaggaaaggatacgacagaaaacaattaaaaaaaagtgacgacttcaaatattcactaaaaaaaatactagaaaaattagatatattcccaactgaagaactaatgaaacttcccacactagacctatggaagctgcggtcagatgccgtaagtaacattgaagacatcacaccaaaacaactcggcagaattctctacatgctaaaccaaaagcgcggttacaagagtgcgagatcagaagcaaatgctgacaaaaaggacacagactatgtagcagaagtaaaaggcaggtacacacaactaaaagacaaaggacaaactctaggacagtacttttacaaagaactaagcgacgccaaccaaaacaacacctactatagagtaaaagaaaaagtataccccagagaggcgtacatagaagaatttgacgcaataataaacgtccagaaatcaaaacactccttcctaactgatgaagttattcatagtcttcgaaacgaaataatatattatcagcgaaaattaaaaagccaaaaaggactagtatcaatatgcgaattcgaagggttcgaaacgacatactttgataaaaaaacacaacaagacaaaactatctttaccggtccaaaagtagcaccaagaacatcaccattatttcaattctgcaaaatctgggaagtagtcaacaacatttccttaaagacaaaaaaccctgaaggatcaaagtacaaatggagtgaccgcatacctactatagaagaaaaacaaacaatagctaactacctacaagaaaacgaaaatttaagtttcatagaactcctcaaaatcctacaactgaaaaaagagcaagtatacgcaaacaaacagatactaaaagggatacaaggaaacactacattttcagccatacacaagataatcgggaattcagaacatctaaaattcgacatagaaaccatcccgtcaaaacatttcgcagtactagttgataaaaaaacgggggaaatcttagacgaaagagactccctggaattaaacagcgcattagaacaagaaccattctatcaactttggcatacaatatactcaataaaagatttagacgaatgcaagaaggcactaataaaaaggttcaattttgaagaagaaatagcggaaaaactatcgaaaatagacttcaataagcaagcctttggaaataaatcaaataaagccatgcgaaaaatgctaccatatcttatgctaggatacaatcaaagtgaagccgaatcattcgcaggatataaccgacgactaaccaaagaggaaaaatcaaaaaatgtctcagatgaaccattacaactattagccaaaaatagcttacgccagccagtagtagaaaaaattctaaaccaaatgataaacgtcgtaaatgcaataatagaaaaatacggaaaaccagaagaaattagagtagagttagcgagagagctcaaacaatcaaaagatgaaagagaagacgcagataaacaaaacggctttaacaaaaaactaaatgaattagtagctactaaactaactgaactaggacttcccaccactaaacattatatccaaaaatataaattcatatttccagctaaagacaaaaactggaaagaagcacaggtcgcaaatcaatgtatctactgcggagataccttcaacctaaccgaagcactgagtggagacaattttgatgtagaccacatagtaccaaaggcactactctttgatgactctcaagcaaacaaagttctagttcatagaagctgtaatagcacaaagacaaacaacacagcatatgactacataactaagaaaggcagccaagcactaaatgattacgtagctagagtcgacgattggttcaaacggggaattataagctatggaaaaatgcaacgcctaaaagtctcattcgaggaataccaggagagaaagaaaataggaaaagaaaccgaagccgataaaaggatctgggaaaattttattgaccgacaactcagagaaacagcttatatagccaaaaaagcaaaagaaattttggaaaaagtatgccacaacgtcacgtcaactgagggaaatgtaacagcaaaattacgccaattatggggctgggacaacgtactaatgaacctacaattacctaaatataaagaactagaaaaaaaaacgaaacaaacctttacacaactgaaagaatggaccagcgatcacggaaaccgaaaacaccaaaaagaggaaatcataaactggacaaaaagggatgaccacagacaccacgcaatagacgcattagtaattgcgtgtacccaacaaggatttatacaaagaataaatactctttcatcgtcagacgtaaaagatgaaatgaaaaaagaactagaagaagacaaaaccgtatacaacgaacgacttacactacttgaaaattacctacttgaaaaaaaaccgttctcaacagaagaaatagaaaaagaagcagacaaaatactagtcagctttaaagctggaaaaaaagtagccacactaagcaaatataaagcaacaggtattaacgaaatcaaaggagtcctagtgccaagaggtcctctccatgaacaatctgtttacggtaagataaaagtgattgaaaaagataaacccttaaaatatctctttgaaaactcagacaaaattgtaaacccacttattaaacacctagtaaagacaagattactagaaaatgaaaacaacgcacaagccgcactcgtaaccttaaagaacaaaccaatactactaaataataaacaaacagaaatactagaaaaagcatcttgctacaacgaggcaacagttctcaaatataaattacaaagtttaaaagcgtcacaaatcgatgacatagtagatgaaaaaattaagtttctaataaaagagcgactcagtaaatttggcaacaaagaaaaagaggctttcaaggatatattatggttcaacgaaaaaaaacaaattcctataacaagcatacgattatttgccagaccggacgcaaacaatctacaagtaataaaaaaacatgaaaagggaaagaacatcggattcgtattatccggcaataaccatcacatagccatatacgaagacaagaacaacaaattgatccaacacatatgtgacttctggcatgcagtcgaacgtaaacgaaataacataccagtcctcatagaagacactagcaccatatggaatcacttaattaacgaagacttctctgaatcattcttaaataaactccccaatgattcactaaaattaaaatttagcttacaacaaaacgaaatgttcatcctaggacttccaaaagaacaaagcgaggaagcaataaaaagtaacaataaatccttattatcaaaacatctatacctagtctggagtattaccgatggggactacttctttagacaccacttagaaacgaaaaacactgagctaaaaaagatagacggcagtaaggaatctaaaagatatctaagactttcaacaaaatccttagttgacctaaaccccataaaagttcgtttaaaccacctaggggaaataactaaaataggagagtga

SEQ ID NO: 8716 - RNA, 3846 nt, synthetic construct
  misc_feature 1..3846: note = Cas9 variant
  source 1..3846: mol_type = other RNA
atggaagacgatagtcaacatgatataagggaaatatatcttgcgatccatcatatggttaaatatcgaggcaatttcctagtagaaggcacactagaatcaagcaacgcattcaaagaagacgaactattaaaattactaggaagaattacaagatatgaaatgtcagaaggcgaacaaaatagcgatatcgaacaagacgacgaaaacaaattagttgcaccggcaaacggccaacttgctgacgccttatgtgcaacaagaggcagcagaagcatgagagttgacaatgctctagaagcactatcagcagtgaacgatttatcccgtgaacaaagagcaatagtcaaagccatttttgcagggttggaaggaaataaactcgatttagctaaaatattcgtaagtaaagagttcagttcggaaaataagaaaatattgggaatctattttaacaaatctgattatgaagaaaaatgtgtacaaattgtagatagcggcttattggatgatgaagaaagagagttcctagatagaatgcaaggacaatacaatgcaattgcattgaaacaattattaggcagatcaacttcagtttcagacagcaaatgtgcaagttatgacgcgcacagagcaaactggaatctcataaaattgcaacttagaacaaaagaaaacgaaaaagatataaacgaaaattacggaatcctagtaggctggaaaatagactccggccaacgaaaaagcgtgagaggtgaaagtgcatatgaaaacatgagaaagaaagcaaacgtattctttaagaaaatgatagaaacgtctgatctttccgaaacagataaaaatagacttatacacgatatagaagaagataaactctttccaattcaaagagacagtgacaacggagtaatcccacaccagttacaccaaaacgaactaaaacaaattataaagaaacaagggaaatactatccttttctcctagacgcatttgaaaaagacggtaaacaaattaataaaatagaaggactacttgcctttagagtaccctactttgtcggacctttagtagtgccggaagacttacagaaaagcgacaactcggaaaaccactggatggtgaggaaaaagaaaggcgaaattactccctggaactttgatgaaatggtggataaagacgcctctggcagaaaatttatagaaagattagttggtactgactcatacttgttaggggaaccaaccctacctaaaaatagtctgttataccaagaatatgaagtcctaaacgaactaaacaatgtaagacttagtgtaagaaccggtaatcattggaacgacaaaaggaggatgagattaggaagagaagagaaaaccttgttgtgtcaacgtctatttatgaaaggacaaactgtaacaaaacgaacagcagaaaacttgttaaggaaagaatatggaagaacatacgaattaagtggattaagtgacgagtccaaatttacaagttctttatcaacttatggtaaaatgtgtagaatatttggagaaaaatatgtaaacgaacacagagacctgatggagaaaatagtagaacttcaaacggtatttgaagacaaagaaaccctactacaccaactacgccaattagaaggaatttccgaagcagattgtgcgctattagtaaatactcattacacgggatggggcaggttatcacgaaaactactgactacaaaagctggagagtgtaaaatttcagacgacttcgcaccacggaaacattctataatcgagataatgagggcagaagacagaaatttaatggaaataattacagataaacaattaggattcagcgattggatagaacaagagaatctaggtgcagaaaacggaagctcgttaatggaagtagtcgacgacttaagagtgagtcccaaagtaaaaagggggatcatacaaagtataaggttaatcgatgatatatcgaaagcagtaggaaaaagaccaagcaggatctttttagaattagcagatgatatacaaccgtcgggaagaacaatcagcagaaaatcaagattacaagatttatataggaatgcaaatcttggaaaagagtttaaaggcatagcagacgaactaaatgcttgcagcgataaggacctacaagatgacagattattcctatattacacacaattaggaaaagacatgtatactggagaagaactagacttagacagactgagtagtgcatacgacatcgatcacataataccgcaagcagtaacgcaaaatgactcaatagataaccgagttttagttgctcgagcagaaaatgcccgaaaaacagactcatttacatacatgccacaaatagcggacagaatgagaaatttctggcaaatactcttagataacggactcatatcaagagtcaaatttgaaagattaacaaggcaaaatgaattttcagagagagaaaaagaaagatttgttcaaagaagtctagtggaaactagacaaatcatgaaaaatgtggcaactctaatgcgacaacgatacggaaatagtgcagcagtaataggactaaacgcagaattaaccaaggaaatgcacaggtacctaggatttagccataaaaatagagatatcaacgactatcatcacgcacaggatgccttgtgtgtaggaatcgccggccaatttgcagctaatagaggctttttcgcagatggagaagtatcagacggagcacaaaactcttataaccaatacttacgagattaccttcgagggtaccgtgagaaattatccgcagaagatcgtaaacaaggacgggcatttggttttatagtaggaagcatgagaagtcaggacgaacagaaaagagtgaatccgagaacaggagaagttgtttggagtgaagaggacaaagattatttacgaaaggtcatgaactaccgcaaaatgctcgtaacgcaaaaagtaggagacgactttggagcgctatatgacgaaacaaggtatgctgctacagatccgaagggcataaagggtattccattcgatggagcgaaacaagatacttcgttgtacggaggttttagttcagcaaaaccggcgtatgcggtacttattgaatcaaaagggaaaacaagattagtaaatgtgactatgcaagaatatagcttattaggcgatagaccaagcgatgacgaattaagaaaggttttagcaaagaagaaatcagaatacgcaaaagcaaatatattattgagacatgtaccaaaaatgcaattaatcagatatggtgggggattaatggtaataaaatccgccggggaactaaataatgctcaacaactatggttaccatacgaggaatattgctatttcgacgatctaagtcagggaaaagggtccctggaaaaagatgatttgaagaaattacttgattcaattttgggcagtgtccaatgcctatatccctggcataggtttactgaagaggagctagctgatttacatgtggcctttgataaactaccagaagatgaaaagaaaaatgtcattactggaattgtttcagcgctacatgctgatgcaaaaactgcgaatctttccatagtcggaatgactggatcatggagacgaatgaataacaaatctggttatacatttagtgatgaggatgaatttatattccaatccccatctggactatttgagaaaagagtaacggtaggagaattgaaaagaaaagcaaagaaagaagtaaactcaaaatatcggacaaatgagaaaagactcccaactctatccggagcaagtcaaccgtga

SEQ ID NO: 8717 - RNA, 3861 nt, synthetic construct
  misc_feature 1..3861: note = Cas9 variant
  source 1..3861: mol_type = other RNA
atgaccaaaaacatacttggactcgacctaggcacaaattcaataggttgggcactcatagaagtggatgaaaacaatacacccataaggataattgctatgggctcgagaataatacctctttccacatctgataaagaggagttccaaagaggattatcaataactaaaaaccaatcacgaacagtaagccgcacacagcgcaaaggatacgacagaaaacagctaaagaaatcagacttaaagaaaatcctaaataaatataacatatttccatcggaggaactactaaaactacccatgttagacttatggaaactcagaagtgactccgctaacccaaatgaaaatatttccgcagaacaactaggacgcatcctttatatgctgaatcagaaaagaggatacaaaagcgctagatccgaagctaacgcagataagaaagacacagactacgtacaagcagttaaaggcagatacgctcaattaaaagaaaggaaccaaactataggtcaatatttctacgaagaactatacaacgccaatactaataattcctacttcagaataaaagaagaagtctatcccagggaagcatacacggaagagttcgacacaataataaatgcccagaaaaacaaacatgacttccttacagacgaagtggtacatcaacttcgaaatgaaattatctatttccaacgaaaattaaaatcccaaaaaggcctagtatcgatttgtgagttcgaaggattcgaaaagacagtatttgacaaagagaaaaacaaagacaaagtcgtattcgttggatcaaaagtagctccaaaaacgagccctctatttcaattgtgcagaatatgggaagtagtaaacactatatcactaaaaattaaaaatccagaaggatcaaaatacaaatggggagagaaaactcccaaccttaaagaaaaagaaattttggcagactacctattcaaaaatgactcactctcattcactaaactgctagaaatattagaccttaataaaaatgacgtatacgtcaacaaacaaatattaaaaggaataaaaggaaatgaaacattcagcgccctacatacagtactaggggataacgaactgctaaacttcgatgttagcataatcccatcaaaccacacttcaatgttagtcgacaagaaaacgggagaaatcttagaagaaagagcaggactcgaattagacgcttctcttgaaaaagaaccactgtatcaactgtggcatactatatacagcctcaaagtactcgacgaatgtaaaaacgcattaataaaaagatttggcttcgacgatgaaaccgccgaaaaattaagtcatatagactttaacaaacaagcattcggtaacaaaagcaacaaatccatgagaaaaatattaccattcctaatggaagggtatgactatagtcaatcatgcagtctcgccggatacaaccattcaaatagcttaacaaaagacgaacgagaacaacaaatcacactagacaggttagaattactcagtaaaaacagtttaagacaacccatagtcgagaaaatattaaaccaaatgataaacgtagttaacgccatacttgaacaatacggcaaattaagtgaaatacgagttgaactagctagggaactaaaacaaagtaaagacgaaagaaatgacgcagatctgcaaaacagtaaaaataaaaagctcaacgaagaaataggaaaaagactcgcagaattgggcctgcccgttacgaaaagatacatacaaaaatacaaattcatcttcccatcactaagtaaaaatcttaaagatgcccacgtaaacaaccaatgtatatactgcggcgaaacattcaacttaacagaagcactatccggggacgcttttgatgtagaccacattgtaccaaaagcattattatttgatgacagtcaaacaaataaagtactggttcataggaagtgtaacagcacaaaaacaaatcaaacagcgtatgactacatcggtacaaaaggagaggaacaagtacgaatatattcagaacgagttgatgactggttcaaacgcggaataatatcatacagtaaaatgcaaagactcaaagtaagtcacaaagaataccttgaaagaaagaaactaggaaaagaaacagaaacagataaaaagttatgggaaaactttatagacaggcaactacgagatacacaatacatcagtagaaaagccagagaaatattacaaaaagtttgcaataacgtaacaacaactgaaggaggaatcacggcaaaactccgcaatctatggggatgggacgatgtactaatgaacttacaaatgccaaaatacaaagaactaggccaaactgtaataaaagaatggacatcagaacatggaaaacgcaaacatcaaaaagaagaaatcgaaaactggacaaagagagacgatcacagacaccacgctatagacgctctagtagtcgcatgcactaagcaaggttttatacaaagaataaacacattaaattcatcggatacaaaagatctaatgcaacgcgaaataaaggaagcaaagaaacttttgggagaaaattacaatgaaaaagagttcgaaaatgacaatgaatttgttaaaaaccacaaagaaagattatcccaactagacgattatctaagactacaaaaaccagtgaaattcgatacaaaatacgttgaacaagaagcagacaaagttttagtatccttcaaagcaggcaagaaagttgcaacaataacaaaatttaaagcgaccggcaaaaacaaagacaccggagttatcgtcctaaggggagcactacacgaacaaagcgtctacggaaaaatcaaagtaatcgaaaaagataaacccctcaaatatctattcgaaaactcaaagaaaatagtaaatcccaaaataaaagtcctagtagaagaaaggttagccgaaaacgaaaataacagtaaacttagtctcagtacactaaagaaaaatccaattttcctaaacgaagagaaaacggaaatcttagaaaaagcaagttgttataacgacgcgacagtattaaaatataaattacagagtcttaaagccagccaggctgatgacatagtagatgacagagtaaaattcctggtaaaagaaagactcgctcaatttggaaacaaagaaaaagaagcatttaaagatactctttggttaaacgaagaaaaacaaataccaataataaccgtccgactctttgctcgaccagatgccaacaacttacaagccataaagaaagataaaaacggaagagatatcggattcgttttaacaggaaacaatcaccatatagcaatatatgaagataaagacaataaattagtgcaacatagttgtaccttctggcatgccgtcgaaagaaagaaaaacaatgtaccagctgtcattaaaaacagctcagacgtttggaaccaattactggataaagaattacctgaatcattcctcaataaactacctatagacaaacttaaattaaagttcagccttcaacaaaacgaaatgttcgtcttaggacttctacaagaagattttgaggcagctatagaaaacaacgacaagaccctgttatcaaaacacctttatctagtatggtcaataacagacggagactactttttccgacaccatttagaaaccaaaaacacagaactaaagaaaacagaaggtgcgaaagaaagcaaaagatactttagactatcaacaaaaggactaatagacttaaaccctgtaaaagtaagactgaaccatttaggagaaataacaaaaataggagagtactga

SEQ ID NO: 8718 - RNA, 3864 nt, synthetic construct
  misc_feature 1..3864: note = Cas9 variant
  source 1..3864: mol_type = other RNA
atgaaaacagttttagggctagatttaggaaccaactcaataggatgggcactaattgaactggatgaaaacaacataccaatacgaatagttgcaatgggttcaagaataataccactatcaacgtcagacaaagaagagttccagcgcgggctaagcataaccaaaaaccaatctaggacagtatccagaacacaacgtaaaggatacgatagaaaacagctaaagaaatcatatctcaagaaaatattaaacaaatataatatattcccaagtgacgaattactaaaactaccaatgttagacctttggaaattaagaagcgacagcgcaaatcctaacgaaaatataagcgccgaacaattaggtaggatactttatatgcttaaccaaaaacgaggatacaaatctgcaagatctgaagcaaacgcagataagaaagatacagattacattcaagcagtaaaaggccgatatgcacaacttaaagacagaaatcaaacaatagggcaatacttttacggagaattgaacgacgcaaatgaaaataacagttatttcagaataaaagaagaagtatacccaagagaagcatatacagaagagttcgacaccataataaacgcacaaaaagataaacacgattttctaacagatgaagtaatacaccaactaagaaatgaaattatatattttcaacgaaaactcaaaagtcaaaaaggattagtaagtatctgtgaatttgaaggattcgagaaaacagtcttcgataaagagaaaaataaagacaaagtagtcttcgtcggccccaaagtagccccgaaaacaagcccactgtttcaattatgtagaatatgggaagtagtgaacaccataacactaaaaatcaaaaatccagaaggaagcaaatataaatggggcgagaaaataccagatgtgaaagaaaaagaaattttagcagattacttattcaaaaacgaatcacttagtttcactaaactactagaaatacttaaactaaataaaaacaacgtatacttcaacaaacagatattaaaaggtataaaaggaaacgaaacctactcaatattacactcaatccttggagacagcgaactcctaaacttcgatgtgagcatcataccaagcaatcacacgtcaatgctaattgacaagaaaacaggtgaaatattagaagaacgagcaggattagaattagacacaagcctagaaaaagaacctttaaatcaactatggcacacgatatacagcataaaagatcttgatgaatgtaaatcagcactaataaaacgattcggctttgacgatgaaaccgcggacaaattatctcgtatagattttaataaacaagcattcggaaacaaaagcaacaaatcaatgagaaaaatacttccatttctaatggaaggatacgactatagccaatcatgctccttagccggttacaatcactccaactcattcaccaaagacgaaagggaacaacaaataactctagacaaactagaactactccccaaaaactcacttcgacaacccattgtagagaaaatattaaaccaaatgataaacgtagtgaacgcgatattagaaagatacggtaaaccttctgaaataagagtagaacttgctcgagaacttaaacaatcaaaagacgaaagaaacgacacagatctacaaaattctaaaaacaagaaactaaacgaagaaataggtaaaaggctagcagaattgggactacccctgacgaaaagatacatacaaaaatataagtttatctttccgtctctgagtaagaacttaaaagacgcccacgttaacaatcaatgcatttattgtggagaaacattcaatttaacagaagctctatcaggcgacgcattcgacgtagatcacattgtacctaaagcgttacttttcgatgactcccaaaccaacaaagtcttagtacaccgaaaatgcaactcgacgaaaactaatcaaacagcatatgattacatagctaccaaaggcgacgaacaagttcgtgtctactcagaacgcgtagatgattggtttaaaagaggtataatatcctactcaaaaatgcaacgtcttaaagtatcacataaagaatacttagaaaggaagaaactcggtaaagaaacagaaactgataagaaactatgggaaaactttatcgacagacaactacgagacacacaatacataagcagaaaaagtcgagagatcttacaaaaagtgtgtaacaatgttgcaactacagaaggaggagtaacagccaaattaagaaacctatgggggtgggacgatgttctaatgaacctacaaatgcctaaatacaaagaactcggtcaaactgtcgttaaagaatggacttctgaacatggaaaaagaaaacatcaaaaagaagaaatagaaaactggacaaaaagagacgaccatagacatcatgcaatcgacgccctagtagtagcatgtacaaaacaaggcttcatccaaagaattaacacattaaattcatcggaaacgaaagatctaatgcaacaagaaataaaagaagccaagaaactattaggagaaaattataatgaaaaagagttcgaaaacaacaacgaatcagttaaaaatcacaaagagagactaagccaactcgacgactacctaaggcttcaaaaacccgtaaaattcgacacgaaatatgttgaacaagaagcggacaaagtattggtatcattcaaatcaggaaagaaagttgcgacgataaccaaatttaaagcaacagggaaaaacaaagacaccggagtaattgtcccacgcggagcgttacatgaacaaaatgtatacggtaaaataaaagtaatagaaaaagataaatctttaaaatacctctttgaaaattccgagaaaatagttaatccaaaaatcaaaaatatcgtcgaaataatcctctcagaaaacgaaaacaacagcaaaatggctctaagcactctcaagaaaaaccctatatttctaaacgaagagaaaacagatcttctcgaaaaagcctcctgttatgagtacgttacagtcaggaaatacccactaaacacaattaaagcatcacaagcagatgacatagtagacgaacgagtaaaattcctagtaaaagaaaggttaacccaattcggaaacaaagaaaaagaagcattcaaagatacactatggttcaacgaggaaaaacaaatacccattattacagtacgtctttttgcacgacccgacgccaacaacttgcaagcaatcaagaaagacgaatcaggtaaagaaatcggtttcgtcgtgatgggaaataaccatcatatcgccatctacgaggataaagacggaaaattagtccaacacagctgcacattctggcatgcggtggaaagaaagaaatacaacatatcaacggtcatcaaaaacagcagcgacgcatggaaccaatttctagataacgaactaccagaaccctttctaaataaattaccagccgacaaccttaatctaaaattttctctacaacaaaacgagatgtttatactagggctctcacaggaagagttcgacaaagctctaaaatcaaatgacaagtcactgctgagcaaacacctatatctagtctggagtataagtgaaaacaactactggtttcgccaccatttagaaaccaaaaacagtgacctaaagaaaacaaatggggtaaaagaatccaagagactctacaacataagaagtttaggcagcctattttcattaaacccaatcaaaatcagacttaaccatctaggcgaaataacaaaaataggcgagtactcatga

SEQ ID NO: 8719 - RNA, 3867 nt, synthetic construct
  misc_feature 1..3867: note = Cas9 variant
  source 1..3867: mol_type = other RNA
atgagattatttgaagagggacataccgcagaagacagacgactaaagcgtacagcacgacgaagaatttctaggcgaagaaaccgacttcgctacctacaagcatttttcgaagaagctatgactgacctcgacgaaaactttttcgccagactacaagaaagtttcttggtaccagaagataagaaatggcacaggcatccaatattcgcaaaactagaagacgaagtagcgtaccatgaaacgtatccgacaatttatcacctcagaaagaaacttgcagattcctctgaacaagccgacttacgtctaatttacctagcactagctcacatagtaaaataccgagggcatttccttatagaaggtaaactaagtaccgagaatacatcagtcaaagatcaatttcaacagttcatggtcatatataatcaaactttcgtaaacggcgaaagtcgattagtatcagccccgctaccggaatcagtactaatagaagaagagttaacagagaaagctagcagaacaaagaaatccgaaaaagtactacagcaattccctcaagaaaaagctaatggcctattcggacaattcctcaaactaatggtaggaaataaagccgatttcaagaaagtatttgggctcgaagaagaagcaaaaataacgtacgcttccgaaagctacgaagaagacttagaaggaatactagctaaagtcggtgatgaatacagtgacgtatttcttgcagctaaaaatgtatatgacgcagtcgaattgagcactatattagcagatagcgacaagaaatcacacgctaaactttcaagtagtatgatagtaagattcacagaacatcaagaagacctaaagaaatttaaaagatttataagagaaaactgccctgatgaatatgacaatctatttaaaaatgagcaaaaagacgggtacgccggctatatagcacacgctggaaaagtatcccaactaaaattctatcaatacgtaaagaaaatcatccaagacatagccggtgcagaatacttcttagagaaaatcgcacaagaaaacttcttaagaaaacagaggacatttgacaacggtgtcattccacatcaaatccatctcgccgaattacaagcaataatccacagacaagcagcatattatccatttttaaaagaaaatcaagagaaaattgaacaactcgttactttccgcataccatactatgttggaccattaagtaaaggagacgcatccactttcgcatggcttaaacgtcaatcagaagaaccaatccgtccatggaatttacaagaaacggtagatctcgaccaaagcgctacagcgttcatagagcgaatgactaacttcgacacctaccttcctagcgaaaaagtgttaccgaaacacagcctgctatacgaaaaatttatggtctttaatgagcttacaaaaatatcttacactgacgatagaggaataaaagctaacttctcaggtaaagaaaaagagaaaatcttcgactatttatttaaaactcgccgaaaagtaaagaagaaagacataatacaattttacagaaacgaatataatacggaaatcgttactctatcaggattagaagaagatcaattcaatgcatcgttctcaacataccaagacctactaaaatgtggtttaacacgcgccgagctggatcatcctgacaacgcagaaaaacttgaagatatcataaaaatcttaacaattttcgaagaccgtcaaagaataaggacacaactatcaacttttaaaggccagttcagtgcagaagtcctaaagaaactagaaagaaaacactacaccggctgggggcgtttaagtaagaaactaattaatggtatatatgataaagaatccggaaaaacaatattggactatttagtaaaagatgacggtgtaagtaaacattacaaccgaaacttcatgcagttgatcaacgattcacaactgtcattcaaaaacgcaatccaaaaagcacagtcaagcgaacatgaggaaacgttaagcgaaacagtaaatgaactagcaggatctccagcaatcaagaaaggaatatatcaaagcctaaaaatagtagatgagcttgtcgcaatcatgggatacgcaccaaaacgtattgttgtcgagatggcgcgagaaaaccaaacaacatcaactggcaaaagaagatcaatacaaaggctaaaaattgtcgaaaaagcaatggctgaaatcggatccaatctattaaaagagcaaccaaccacgaacgaacaactaagagacacacgcttattcctatactatatgcaaaatggtaaagatatgtatacaggtgatgagctctcattacatcgattgagtcattacgatatagatcatatcataccacagagctttatgaaagacgattcactagacaacttagtcctagtaggatcaactgaaaatagaggaaaatctgacgacgtaccatctaaagaagtagtgaaagacatgaaagcatattgggaaaaactatacgctgcaggactgataagccaacgaaaattccaacggctaactaaaggcgaacaaggtggactaacactagaagacaaagcacattttatacaaagacagctagtagaaacccgacaaataacgaaaaatgtagcaggtattctagaccaaagatataacgcaaaatcaaaagagaagaaagttcaaattatcacattaaaagccagtctaacaagccaatttagaagtatattcggactctacaaagtcagagaagtaaacgactaccaccatggacaagacgcctacctaaattgtgtagtcgcaacaactctactcaaagtatacccaaaccttgcaccagaatttgtctacggagaataccccaaattccaaacatttaaagagaataaagcaacagccaaagctataatatataccaatctactacgcttcttcaccgaagatgagcctagattcacgaaagacggagaaatactatggtccaactcctacctaaaaaccatcaagaaagaactaaattaccatcaaatgaatattgtaaagaaagtagaggtacaaaaaggtggctttagtaaagagtcaataaaaccgaaaggaccgagtaataaactcattccagtgaaaaacggtctagacccacaaaaatatgggggcttcgattcccccgtagtagcttatacagtacttttcacacacgaaaaaggaaagaaaccactaataaaacaagaaattctaggaattaccataatggagaaaacaagatttgagcaaaacccaatactattcctggaagaaaaaggattcctacgaccacgagttttaatgaaacttcctaaatacaccctatacgaatttccagaaggacgaagaagactcctagcatcagcaaaagaagcacaaaaaggaaaccaaatggtattaccggagcacctattaacattattataccatgcaaaacaatgtctattacccaaccagagcgaaagcctagcatacgtagaacaacaccaaccagaatttcaagagatattggaaagagtcgtagacttcgcagaagtacacacactagctaaatctaaagtacaacaaattgtaaaactattcgaagccaatcaaactgcagacgtaaaggaaatagcagcatcattcatccaactaatgcagttcaatgctatgggagcaccatccaccttcaaattctttcaaaaggatatagaaagagccagatatacatcaattaaagaaatatttgatgcaaccatcatatatcaatcaccaacgggtctctacgaaacaaggagaaaagtagtagattga

SEQ ID NO: 8720 - RNA, 3903 nt, synthetic construct
  misc_feature 1..3903: note = Cas9 variant
  source 1..3903: mol_type = other RNA
atgtggggagtatcattattcgaagcaggcaaaacagccgctgaaagaagaggctatagatctactcgacgacgtctcaaccataggaaattccgtctaaggttacttgaagatatgttcgaaaaagaaatcctatcaaaagacccgtcgtttttcataagactaaaagaagcattcttatctcccaaagacgaacaaaaacagttcaaaggaaatatactattcaatgacaaagattacacagatgcagactattacgaacaatataaaacgatataccatttaagatacgatctcatcagtcaacacagacaattcgatataagagaagtgtacctagctatacatcacctaatcaaatacaggggtcactttatatatgaagatcaaacgtttacaacagacgggaatcaactgcaacatcacattaaagccattatcacaatgataaactcaactttaaacagaataataataccggaaacaatagacataaatgtttttgaaaagatattactagatagaatgatgaacagatcaagtaaagttaaattcttaatagaacttacaggagaagacaaacaagacaaaccactcctcaaagaattgtttaatctaattgttggactaaaagcaaaaccagcatctatattcgaacaagaaaacctcgcaacaattgtagaaactatgaatatgtcaacagagcaagttcaattagatctcctaactttagcagatgtcctagcagatgaagaatacgacttgctactaacagcacagaaaatatatagcgcaataatattagacgaaagcatggatggatacgagtactttgccgaagccaagaaagaatcctaccgaaaacaccaagaggaattagtcctagtaaagaaaatgctaaaatcaaacgcaataactaatgatgaacgagcgaaatttgaatatttctacacagattatataggagctaaaagtagcaattatgaagaatccaaaaatataaagaaaggattgagcgcagcatatggaaaatactccaaagaagaacgattattcaaacacatagaactactcctagcaaaagaaaatgttcttactacagtagaacatgcattacttgagaaaaatatcacattcgcatcacttcttccactgcaaagatcttcacgaaacgcagttattccataccaagtccacgaaaaagaactcgtggcaatccttgaaaaccaagctacatactatccgtttctcctagaacaaaaagacaatatacacaaactactgacattcagaataccatactatgtaggaccattagctgaccaaaaggactccgaatttgcttggatggtacgaaaacaggctggtaaaataacccccttcaacttcgaagaaatggttgatattgacgcgtccagcgaagcatttatcaaacgaatgacaaataaatgtacgtacctcatacatgaagacgtaataccaaaacacagcttttcttatgcaaaattcgaagtcttaaacgaattaaataaaataagacttgatggaaaacctatagacatccccttaaagaaaagaatctttgaaggtctattcctagagaaaacgaaggtcactcagacatcactcaaaaagtggctcgctgaacatgaacacatgactgtttctgtcgtacaaggcacccaaaaggaaacagaatttgcaacttccctacaagcattccaccgttttgtaaaaatattcgacagagaaacagtatccaaccccgctaacgaagaaatgtttgaaaagataatatattggtcaaccgtttttgaggataagaaaataatgcgaagaaaactctcagaatatccacagttaacagaacaacaacaagtacaattagcacaagtacgattcagaggatggggaaggttatcacaacgactaataaacagaatcaaaacaccggtatccggcgatgaagaccacaaactcagcattaatgaaattctatggcaaacaaatgaaaacttcatgcaaataatacgcaacaaagactatttattcaagaaaataattgaagaacaattcgaaaacgaaactgcattactaaacaaacaacgaatagacgaattagcagcctcccccgccaataagaaaggcatttggcaagcaattaaaattgtaaaagaacttgaaaaagtcctacaacaaccagccgaaaacatattcatagagttcgccagaagtgatgaagaaagcaaacgatcaacaccacgggataaatttatcgaaaaagcatatgcgcaactaaagaaagaaacagacacgtttaatctagaacacctaaaagaacttaaacaaaggagcaaacaattaagttctcaaagactattcttatacttcatccaaaacgggaaatgtatgtactccggagaacatctagacatagaacgattagacagctatgaggtcgatcatatactaccacaatcatatatcaaagacaactcaatcgaaaatttagccctagtcaagaaagtagaaaatcaaagaaagaaagactctctattattaaattcatctataatcaatcaaaattactcaagatgggagcaactgaaaaacgcaggactaatcggcgagaagaaatttcgaaatttaactagaacgaaaataacggatcgagacaaagaaggatttatagcgcgccaattagtagaaactcgtcaaatcacaaaacatgttacacaacttctacaacaagaatataaagacactacaaaagtatttgcaattaaagcaactctagtatcaggattgagacgtaaatttgagttcatcaaaaacagaaacgttaacgactatcatcacgcacaagacgcctttttagtcgcatttctgggtaccaatataacatcaaattatccaaaaatagaaatggaatatctcttcaaaggataccaacactacttaaacgaagtaggcaaatcagctgctaaaccaaaattcacatttatagtcgaaaacctatccaaacaacaatacaactctacaactggggaagtaaaatggaacccggaagtagacattgcaaaacttaaacgcatattgaattttaaacaatgtaacatagtcagaaaagtagaggaacaatcaggcgctttatttaaagaaacaatatacccagttgaagaatctagcagtaaaacaatccctcttaagaaacatctcgataccgctatctacggtggatatacagccgttaattacgcatcatacgcattaatacaattcaagaaaggacgcaaattaaaaagagaaataataggcattcctctagcagtccaaactagaatagataattctgaaacctctctccaagcctatatcgcagaacaaataaaatccgaggtagaaatactaaacggcagaatcctaaaatatcaactaataagcaataatggaaaccgattgtacattgcaggtcctagtgaacgtcataacgctagacagctaatagtctccgatgaggcagcaaaagtaatctggctcatatcgactaaacaggcagacgaggcaatgtttctaaaatactatagattagaacatttagaagcagtattcgaagaattaatacgaaaacaagcagcagattaccagatcttcgaaaaactcataaagaaaatagaggtcaataaagtatacttctatagctgcacatacaatgaaaaagtaaaagtcattgaagagttacttaaaattacacaagctaacgctacaaatggtgatctcaaattactcaaaatgtcaaaccgagaaggtcggctaggatcagtatcagttgcacttgacttcaaaatcataaatcaatcagtcacaggactatatcaaagcatcgaagactacaacaattga

SEQ ID NO: 8721 - RNA, 3930 nt, synthetic construct
  misc_feature 1..3930: note = Cas9 variant
  source 1..3930: mol_type = other RNA
atgggtagtgtaggtttcgcaggtattgacaatcaatacaaccttgtaagaacaaaaggcaaaaacgtaataggagtaagattatttgatgaggcagacagtgcagcagaaagaaggggacacagaaccaataggcggagattacaacgacgaaggtggcgtcttagactactagatgacatatttgccaaacctttacaggcggttgacccaaactttcttgcaagattgaaatactcgtacgtaaataagaaagaccagggacagcaagatcactactatggaggttatgtattcgggtcaaccgccgctgatcaagcctatcaccaagcatatcccacaatataccatttacgaaaaagactaatggaggatgatcaaaagcacgatctcagagaagtatatctagcaatccatcatatagtgaaatacagaggaaacttcctcaacccgcaatcatcactagacatagaccaacaatttgatgtaacagattttgcacaagctctcgcaagattcgctgaccaccaagcactaagttgggcactggaagccccaataagatttttagaagcagaactagcaacaggtttgtcaaacagcgcacgagtagacgcagcaatagaagctttctcttttgacacgaaagtcgaccgggcagcaataaaagagatgctaaaaggattatcaggaaatcaaatagacttcacaaaactattcgtaaacgtggactctgccgattgggatcaggaagaaagaaaacaatggaaaatgaagttaagtgaagaagatttcgatgaacaagccttaccaatcttggaaagactctcacaagacgaaaccgaattcttcctagcgatcaaacgagcatatgatggaatcgcgttaatgagatttttaggagatgaacagagtctaagttcagcaatgataaaagcgtacgaagaccacagaagggatctaacttttttaaaaacacaagttcgaacacctcaaaaccgtcaagcactgtcagaaggctatacaaattatctaagcgtagacgataaaaaacacaaaagaggagccaaagaactagcacaattaatagaagcctcagatgcatccgaacaagataaagcaacaatgttagatagaatagcaaatgatcaatttgcaccaaaacaaagaaccaaagctaacggtctaattccatatcaattacatctagccgagttaaagaaaatactcgctaaacaaggccaatactatccatttttattggatacctttgccaaacaaggacaatcggtaaataaaatagaggaattagtgcaatttcgggttccatattatgtaggtccgatggtcccaaaaagtgagacagcaggaaatgcagaaaaccattgggtagaaaaaaatgacggtcaaacgaaggtcagtgtaacaccttggaattttgaccaagtgtttaatagagaccgagctgcaaaatcatttattgatagattaactgggaccgacacatacctaataggagagcccactttaccacgacacagtttaacttatgaaacttttactgtacttaacgaacttaacaacataagaatagacggaaaaaggttaccagttgaaacaaaacaagcaatagtggaagacttatttaaaaaataccgcttagtaactaaaaagcgtcttcaggattacttcgcatcatttgggaagagagaggtagaactaaccggactcgcagatgaatcacgatttactagctccttaaccagctaccatgatttacaagggcttttaggaaccgacttcatcactaacccacaaaatcatagtctactggaaaaaattgtcgaaatacaaaccgtattcgaagacagcgacatagcagaaagggagctaggcaaactaggattagaacaaaaactaatcccgagattagcaaaaaagcactatacaggatggggtaatctaagccgaaaactacttgatacttcatttattcatgatcctgaaagacccgaagaaccagtctcgataatggacttgctgtacactactaataaaaacttcatggaaatactacacgatagtgaatatggtgtagaagaatggctaaaatcccaaaacatgatcgatgaccaaaaggatatacaaatgcgaatcgacgaactaacaacatcaccagcaaataaaagaggaataaaacaagcctttaatgtcctagacgatattactcaagctatgggtgaagaacccgcatatgtataccttgaattcgctagagaaaagcaagcaagtcgacgtacggtatccagaaagaaaaggctggaaacactttacaaaaacgctgccctaaaaactgaattcaaagcaattaaagaagcattagctgaagaatcggacgataggatgcaagacgacagattatacttatactatgcacaactaggaagagatatgtacacgggtcaatcaatatcaattgaccaattatcatcacattacgatatagaccatatagttccaagggcattcataaaagatgacagcttggagaataaagtattagttaacaggacagataacgctaggaaaaccgactcagctacctttacagcagatgtaaaagcaaaagcattccctctttggcagcaattgaaaaaactcggattaatcagtgcaaaaaaatttagactactaacacggacaggagatttcaccgaaatggaaagagaacgattcatagcaagacaactcgtagaaactcgccagatcataaagaacgtagctgcgttaatagaagggcatttctcacaaacgcaagcagtagcaatacgagcagaggtaacaggagaattacgccaactaactcaaataaaaaaagatcgagatataaacgactaccatcatgcacaggacgcactgttagttgcaaccgcaggaacttatctgcatagacactttccaaaaagggacgcaagatttatatacaatgaattcgattactacacacagcactggttaaagaaccagggtgaaaatagaagacgacatccatatagttttgttgtcggcaccatgtcaaaaggaaacgaagattggacaccagacaatctaaattaccttagaaaagtcatgcaatacaaaacaatgttaatgacaagaaaacctgttggaccggaaggtgcattatacaaggaaactcttatcgcagccgaccccaaaaaaagactagtaggagcttcaaaagaaagacaagacccaacaatttatggagggtatactaaagaatccagcgcatatatgtccctagtaagagcaggtggcaaaaatcaattagttaaaattccagtcagaatcgcaaatgaaatacacagcggacaaaggaaattagacgattacgttcaagctaaggttaaaaaattcgaaagaattttattacctaaaataagcctcggtcaattagttgaagacgaagggcaacgtttttacttagctacaaacgagatgaaacacaacgcaaaacaactatggttggaccaaaaagtcgtaacgacatataaaagattaactgcagaatctcctgttgaagattttttgactgtatttgacgcactgacaagcagtgccacaattcatcatttcaaattctaccaaagagatttagagttactaagggataacagagcaggcttccaagatcttgcgaaagcaacacaactcaaggtcctcaaagacgtattatacgaactgcatgataacgcaggatggagagaccctataaaacaatatttcaaagaaattggattaaaagtcaggatgtggactaaactacagaaggaaggaggaataaaattaacagaccaagcagagcttatttatcaaagtccaagtggactatttgaaaaacgaaggcgagttcaagatttactgtga

SEQ ID NO: 8722 - RNA, 3939 nt, synthetic construct
  misc_feature 1..3939: note = Cas9 variant
  source 1..3939: mol_type = other RNA
atgcaaaacggatttctcggaataactgtatcatcagaacaagtaggatgggccgtaacaaaccctaaatatgaactggaaagagcatcaagaaaagacctctggggagttcgactttttgataaagctgaaacagcagaagatcgaagaatgtttaggacaaacagaaggttaaatcaacgcaagaaaaatcgtattcactacctacgggatatattccatgaagaagttaaccaaaaagaccctaatttctttcaacaactagacgaatctaacttttgcgaagacgacagaaccgtcgaatttaactttgatacaaacttatataaaaatcaatttcccacagtataccacttaagaaaatatttaatggaaacaaaagataaaccagacatacgattagtctatctagccttttccaaatttatgaaaaatagaggccactttttatataaaggtaacctgggggaagtaatggacttcgaaaacagtatgaaaggattttgcgaatcgctagaaaaatttaacatcgattttcctacattaagtgacgaacaagtgaaagaagtcagagacattctctgtgatcataaaatcgcaaagacggtgaaaaagaaaaacataattacaataacaaaagtaaaaagcaaaacagctaaagcgtggataggattattttgtggttgctcagttccagtaaaggtattgttccaagatatcgatgaggaaatagtaacagatccggagaaaatcagtttcgaagatgcttcctacgatgactatatcgccaacattgaaaagggagtaggaatatattacgaagctatagtatccgccaaaatgctttttgattggagcataatgaatgaaatcctaggcgaccaccaactattatcagacgcaatgattgccgaatacaacaaacaccatgacgacctaaaacgtctacagaaaatcataaagggaacaggatcaagagaactatatcaagatatattcatcaacgatgtaagtggtaactacgtctgctacgtaggccacgctaagacaatgagctcagcagatcaaaaacaattctacacatttctaaagaatagattaaagaatgttaatggaatttcatcggaagacgcagagtggatcgacacggaaattaaaaatggtacattattacccaaacaaaccaaaagagataatagcgtaattccccaccaactacaactacgagagttcgaattaatattagacaatatgcaagaaatgtatccatttctcaaagaaaaccgagaaaaactattaaaaatttttaactttgtaataccatactatgttggcccactaaaaggagtagttagaaaaggagaatctacaaattggatggttccaaagaaagacggcgtcattcatccatggaatttcgacgaaatggtagataaagaagcatcagcggaatgcttcatatccagaatgaccggtaattgctcatacctatttaacgagaaagtcttacctaaaaactcattgttatatgaaacgttcgaagttttaaatgaactgaatccactgaaaattaatggtgaaccaatatccgtcgaattaaaacaaagaatttacgaacaattatttctgactggaaagaaagtcacgaagaaaagtctaacaaaatacctaatcaaaaatggatatgacgaagacatagaactatccggcatcgacaacgaatttcattccaaccttaaatcccacatagacttcgaagactatgataacttatctgacgaagaagtagaaagaataatattaaggataactgtatttgaagataaacaactactaaaagactatctaaatagagaatttgtgaaactaagcgaagatgaacgcaaacagatatgctccttatcatataaaggatggggaaacttatcagaaatgttactaaatggtataacagtgactgattccaatggagtagaagtatctgtcatggacatgttgtggaacacaaacctaaatctaatgcagatcctcagtaagaaatacggctataaagcagagatagaacgttataataaagaacatgagaaaaacatatataacagagaagatctaatggattaccttaacatcccaccagcccaaagaagaaaagtaaatcaactaataacaatcgtaaaaagtctgaagaaacgctgcggagtccctaacaaaatatttttcaaagtgtctagagaacaccaagacgacccaaaaagaacatcatccagaaaagaacaattaaaatacttgtacaaaagtcttaaatcagaagatgaaaaacatttaatgaaagaactagatgaactcaacggacacgaattaagtaatgacaaagtgtatctatacttcctccaaaaaggccgttgtatatactcaggaaagaaacttaatttaagtagattaagaaaaagtaattaccaaaatgatatagattatatttacccactgtctgccgtaaatgacagatcaatgaataacaaagttttaacaggcatacaagagaatagagcagataaatacacctactttcctgtagatcctgaaatacaaaagaaaatgaaaggcttttggatggagctagtattacaaggattcatgagtaaagaaaaatacttccgtttgagccgggaaaatgattttagcgaaaacgagctagtctcattcatagaacgtgaaatcagcgacaaccaacagtccggtagaatgatagctagcgtattacaatactacttcccagaatcaaaaatagtttttgtaaaagaaaagttgataagctcctttaaaagggactttcatctaatatcctcctacggacacaatcatttacaagccgctaaagacgcatacattactatagtagtggggaacgtatatcatacaaaattcaccatggaccccgcaatatatttcaaaaaccataaacgaaaagattacgatctcaatagattatttcttgaaaacattagcagagatggacaaatagcgtgggaatcaggcccatatggatccattcaaacggtgagaaaagaatacgctcaaaaccacatagccgtcacaaaaagagtagtagaagtaaaaggaggactcttcaaacaaatgcctttgaagaaaggacatggagaatatccacttaaaaccaatgaccctagatttggaaacatcgcccaatatggaggctacacaaatgtgactgggagctactttgtcttagtagaatcaatggaaaaaggcaagaaaagaatatcacttgaatatgttcctgtatacctacacgaacgtttagaagatgaccctggacacaaactactcaaagaatatctagtcgaccatagaaaattgaatcatccaaaaatattactagcaaaagttcgaaagaactcactcctaaaaattgacggattttattacagattaaacggaaggtcaggtaatgctctaatactcactaacgcagtggaattaataatggatgactggcaaacaaaaacagccaataaaatttctggttacatgaaaaggagagcaatagacaagaaagctagggtctatcaaaacgaatttcacatacaagaactggaacaactatacgacttttatctagacaaactcgaaaacggagtatacaaaaaccgaaagaacaaccaagcagaacttattcataatgaaaaagaacaattcatggaattaaaaacggaggaccagtgtgtattactaacagagatcaagaaactcttcgtttgttccccaatgcaagccgacctcacactaattggagggagcaaacataccggaatgatagcaatgtcatccaacgtaacaaaagccgacttttccataatcgcagaggacccactaggcctaagaaacaaagtcatatactctcatatgggtgaaaaatga

SEQ ID NO: 8723 - RNA, 3939 nt, synthetic construct
  misc_feature 1..3939: note = Cas9 variant
  source 1..3939: mol_type = other RNA
atgcaaaatgggttcctagggataacagtatcatcagagcaagtaggatgggcagttaccaatccaaagtatgagttagagcgcgcttcgaggaaagatttatggggagtgagacttttcgacaaagctgaaacagctgaagatagacgcatgtttcgtacaaataggcgattaaatcaaagaaaaaaaaatagaatacactacctaagagatatctttcatgaagaagttaaccaaaaagatccaaatttctttcagcaattggacgaatcgaatttctgtgaagacgatcgaacagtagaatttaacttcgatacaaacctctataaaaaccaatttccaactgtctatcatttaagaaaataccttatggaaacaaaagataagcctgacataaggctagtatatcttgctttcagcaagtttatgaaaaatcgtggccatttcctgtacaaaggaaatttaggcgaagtaatggatttcgaaaactccatgaaaggattttgtgaatctttagaaaagtttaatatagacttccctaccttaagtgacgagcaagtaaaagaagtaagagacatattatgtgaccataaaatagctaagaccgtgaagaagaaaaatataataaccatcaccaaagtaaaatccaaaacagcgaaagcgtggatcgggttattttgcggctgcagcgtcccagtgaaggtcttattccaagatatcgacgaagaaatcgtaactgatccagagaaaataagcttcgaagacgcaagttacgacgactatatagcaaacatagaaaaaggagtaggaatctattacgaagctatcgtcagcgcaaaaatgctattcgattggtcaattctgaatgaaatcctaggtgaccaccaactcctatccgacgcaatgatagcagaatacaacaaacaccacgacgatttaaaaagattacaaaagataataaaaggaaccggatctcgagaactataccaggacatattcataaacgacgtttcaggaaattacgtctgctatgttggacacgcaaaaacgatgagctccgcagatcaaaaacaattctatacatttttaaaaaatagactaaaaaatgtaaacggaattagttccgaagacgcagagtggatagacactgagattaaaaacggaactttactgccaaaacaaaccaaacgagataatagcgtaataccccaccaactacaacttagagaatttgaactaatactagacaatatgcaagaaatgtatccattcctaaaagaaaacagagaaaaattactcaaaatattcaactttgtaataccatactatgtcggacctctaaaaggagttgttagaaaaggcgaatccacaaactggatggtaccaaaaaaagatggagtaatacatccatggaactttgacgagatggtagacaaagaagcttcagccgaatgctttattagcagaatgaccggtaactgctcttacttatttaatgagaaagttttacccaaaaactcacttctatatgagacttttgaagtattaaatgaactcaatccgcttaaaataaatggtgaaagcatatctgtagaattaaaacaacggatttacgaacaattatttttaacaggaaaaaaagtaacaaagaaaagtctcacaaaatacctaataaaaaacggatatgacaaagatatcgaactaagtggcatcgacaatgaatttcactcaaacctaaaaagtcatatagattttgaagactacgacaacctatcagacgaagaagttgaacaaataatattaagaatcacggtattcgaagacaagcaactactgaaagattacctaaaccgagagttcgtgaaattatctgaagacgagcgcaaacaaatctgttctctatcttataaaggatggggaaacctatctgaaatgttgctcaatggcataacagtaaccgactcaaacggagtcgaagtaagcgtcatggatatgttatggaataccaatttaaatttaatgcaaatactatcaaaaaaatacggctacaaggccgaaatagaacattataataaagaacacgagaaaacaatatataatagggaagacctcatggattacttaaacatacctcccgcccaacgaaggaaagtcaaccaactcatcactattgtaaaatccctaaaaaaaacatacggagtaccaaacaaaatatttttcaaagtaagcagggagcaccaagacgatccaaagcgcacttcaagcagaaaagaacaattaaaatatttatataaaagccttaaatcagaagatgaaaaacatttaatgaaagaactagatgaattaaatggacacgaactaagcaatgacaaagtatatctatacttcctacaaaaaggacgttgcatctacagtggaaaaaaactgaacttaagtcgactaagaaaatcaaactatcaaaacgacatagattacatatacccattaagcgccgtgaatgatagatcaatgaacaataaagtgttaactggaatacaagagaaccgagcagataaatacacttattttcctgttgatccagaaatacaaaaaaagatgaaaggattctggatggaattagttctacaaggatttatgagcaaagaaaaatacttcagactatcacgagaaaatgactttagcgaaaacgaactggtaagcttcatcgaacgagaaatctccgacaaccaacagtctggtagaatgatagcatcagtcttacaatattacttcccagaatctaaaattgtatttgttaaagaaaaattaatctcttcatttaaaagagattttcatctaatttcatcatacggacataatcatctacaagccgccaaagacgcgtatataacaatagtagtaggcaacgtgtatcacgcaaaattcactatggatcccgcaatttacttcaaaaatcacaaaagaaaggactatgaccttaacagactattcctagagaacataagtcgagatggacaaatagcatgggaaagcggaccttacggatctatacaaaccgtaagaaaagaatatgcacaaaatcatatcgcagtaaccaaacgtgttgtagaagtaaaaggaggcctttttaaacaaatgccattaaaaaaaggacacggcgaatatccactcaaaacaaacgacccacgcttcggtaatatagcccaatacggaggctacacaaacgttacaggatcatacttcgtcctcgtggaatcaatggaaaaaggtaaaaaaaggataagtttagaatatgtacccgtatacttacatgagcgactagaagatgacccgggacacaaattactaaaagaatatctagttgatcaccgaaaattaaaccaccctaagatcctattggccaaagtaagaaaaaactcactattgaaaatagacggcttctactacagattaaacggaagatctggaaacgcacttatcttaacaaatgcagtggaactcatcatggatgattggcaaacaaaaacggcaaataaaataagcggatatatgaagagaagggcaattgacaaaaaagcacgggtctatcaaaatgaattccatatacaagaattagaacaactctacgacttttacctagacaaacttgaaaatggggtctataaaaacagaaaaaacaatcaagcggaattaatccacaatgagaaagaacaattcatggaattgaagacagaagatcaatgcgtactactgacagaaatcaaaaaactattcgtatgttcaccaatgcaagccgacctaacattaataggaggcagcaaacatacaggcatgatagcaatgagttcaaacgtaaccaaagcagatttcgcagtcatagctgaagacccacttggcttacgcaataaagtaatatacagccacatgggtgaaaaatga

SEQ ID NO: 8724 - RNA, 3942 nt, synthetic construct
  misc_feature 1..3942: note = Cas9 variant
  source 1..3942: mol_type = other RNA
atgcactacctagatgaaatattcgcaccccacttacaagaagtcgacgaaaacttcctaagaagattaaaacagtcaaacatacatcctgaagacccagctaaaaaccaggcatttattggcaaactactatttccagaccttctaaagaaaaatgaaaggggatatcctaccctaattaaaatgagagatgaattacccgtagaacaaagagcacactaccctgttacaaacatttacaaactccgagaagccatgataaacgaagatagacaattcgacttaagagaagtttatctagcagtacaccacattatgaaatatcgtggacatttcctgaacaacgcatcggttgataaatttaaagtaggaaggatagacttctataaaagtttcaacgtattaaacgaagcatacgaagaactacaaaacggagaaggatcatttactatagaaccatcgaaagttgagaaaataggacaactgttattagatacgaaaatgaggaaactaaatagacagaaagccgttgcaaaactattagaagtaaaagttgctgacaaagaagaaactaaacgtaacaaacagatagccacagcaatgtccaaattagtactaggatacaaagcagatttcgcaactgtagcaatggcaaatggaaacgaatggaaaatcgatctctcttcagaaacaagcgaagacgaaatagaaaaattcagagaggaattaagtgacgcgcaaaatgatatattaacagagataacatcactgtttagtcaaataatgctaaatgaaatagttcctaatggaatgagcataagcgaaagtatgatggatagatattggacacacgaacgccaactagcagaagtaaaagaatatctagcaacccaacccgcgtctgcacgtaaagaatttgatcaagtatataacaaatacattggccaagccccaaaagaacgtggctttgatctggaaaaaggactaaagaaaattttgtcaaagaaagaaaattggaaagaaatagatgaattgttaaaagcaggcgacttcctaccaaaacaaagaacgagtgctaacggagtaattccgcatcaaatgcaccaacaagaattagatagaataatagaaaaacaagcaaaatactacccatggctggcgaccgaaaatcccgcaaccggggaaagagatagacatcaggcaaaatatgaactcgatcagctagtttccttccgcataccttattacgttggcccgctagtcacgccagaagtacaaaaagcaacaagcggcgcaaaatttgcatgggcaaaaagaaaagaagatggagaaataaccccttggaatctatgggacaaaatagacagagcagaatcagcagaggctttcatcaaaagaatgaccgtaaaagatacttatctacttaacgaagatgtccttcctgccaactccctattataccagaaatacaatgtcctaaatgaattaaacaatgtacgagtcaatggaagaagactaagtgtcggaattaaacaagatatatataccgaactttttaaaaagaagaaaactgttaaagtcagcgatgtagcaagtctagtaatggcgaaaaccagaggcgttaacaaaccatcagtagaaggcctaagtgatccaaagaaatttaactcaaacctagcaacgtacttagatctaaaatcaatcgtaggagataaagtagatgacaatagatatcaaacagaccttgaaaatattatcgaatggagatctgtctttgaagatggagaaatatttgcagataaattaacagaggtagaatggttgaccgatcaacaaagaagtgcattggttaagaaacgctataaaggatggggaagactaagcaagaaattactaacgggaatagtagatgaaaatggccaaagaataatagatcttatgtggaatactgaccaaaacttcatgcagatagttaatcaaccggtattcaaagaacaaatagatcagttaaatcaaaaagcaataacgaacgatggaatgacactacgtgaatgggtagaatccgtactcgatggcgcatacacatctccccaaaataagaaagccatctggcaagtagtaagagtagtagaagatatcgtcaaagcggtcggaaacgcaccaaaaagcatttcaattgaatttgctcgaaatgaaggaaataaaggagaaatcacaagatcacggagaacacaattacaaaaactatttgaagaccaagcacacgaacttgtaaaagatacgtccttaaccgaagaattagaaaaagcacctgacctcagtgatcgatactacctatactttacacaaggtggaaaggatatgtataccggagacccaattaatttcgacgagatatctaccaagtatgatattgaccatattcttccacaatcatttgtgaaagacgacagccttgataatcgagttctggtgagtcgagcagaaaataataaaaagtctgatagagttccagcaaaactttacgcggcaaaaatgaaaccctattggaatcagctactaaaacagggcctgataacgcaacggaaattcgaaaacctaactatggatgtagatcaaaatataaaatatagatcactagggttcgtgaaaagacaattggtagaaactcggcaagttataaaactaaccgctaacattttaggatctatgtatcaagaggctggaacagatataatagaaaccagagcagggcttacaaaacaattaagagaagaatttgacttaccaaaagttcgggaagttaatgattaccatcatgctgtagacgcatatttaacaacttttgcaggacaatacttaaatagaaggtaccctaaactccgatcattctttgtttatggagaatatatgaaatttaagcatggatctgatctaaagctacgcaattttaatttctttcacgagttaatggaaggagacaaatcacaaggcaaggtggtagatcaacaaactggagagttgataacaacaagagatgaagtagctaagtccttcgacagactcctgaacatgaaatatatgttagtaagcaaagaagtacatgatcgaagcgaccaattatatggagccacaatagtaacagccaaagaatcagggaaattaacctctccgatagaaatcaaaaagaaaagacccgtggatctatacggggcatacacaaacggaacatctgcgttcatgacaataataaaatttacaggaaataaaccaaaatacaaagtaatcggagtaccaacaacgtctgcagtaggtttgaaacgagtgggaaaaccaggctcagaatcgtacaatcaagaactacacagaataatcaaatccaatccgaaagtaaagaaagattttgaaatcgttgtacctcacgtttcatacagccagttaatagtagatgatgactgtaaattcacattagcgtctgacacctaccagcatccagccacacagttggttttatcaaaagaatcaatggaaataatagccgacgattttaaatttgtgaaagaaaataccgctactgcagacgaacagctagtaagagtattcgacgaaattgtgaatcaaatgaatcactatttcacaatattcgatcaaagatcaaatcgacaaaaagtaacaaaagctcgcgataaatttgtctcactaccaaccgaaagtgagtatgaaggggcaaagaaaacacaagtcggaaaaacagaagtaattacaaatttactaatgggactacacgcaaactcagcacaaggagaccttaaagttttaggattaagcacatttggattcttccaaagttctggtggtcttaatcttagcgaggatgccatgatcgtttaccaatcaccaactggattatttgaaagacggatatgccttaaagatatatga

SEQ ID NO: 8725 - RNA, 3942 nt, synthetic construct
  misc_feature 1..3942: note = Cas9 variant
  source 1..3942: mol_type = other RNA
atgtcgtttaaagaaaacagtaaaatatattacggattagacataggtacagattcagtaggatggtctacaacaaacgaaaaatatgaactgctaagatacaaaaataacctaatgtggggagtatctttgtttgaagctgcctcacttgcagaagaaagacggggacacagaacccaacgtcgacgatacgatagaaggcaacaacgagttgccctccttggggaactatttgcaaaagagattctaaaaactgatccggatttctttttaagattgaaagaatcttcactatatcctgaagatagaacaagtaagaacgtaaacacatactttgatgacgcggactttaaggactctgattacttcaaaatgtatccaacagtacaccatttaatcaaagaactctctgaatcaaacaaaccacacgacgtgcgcctagtctatttagcttgtgcatttattgtcgcacatagaggacactttcttaacggtgctgacgaaaataacgtccaagcagtcctagacttcgattcttcatactgtgaatttacggactggttcaaatcaaacgacatagaagataacccattctctgaaagtgtaaaaaatgaattttcagttatattaagaaaaaaaataggaattactgcgaaagagagagagataaaaaatttacttttcggtacaacaaaaaccccagactgttataaagacgaagaatatccaattgatattgatgttttaataaaatttatatcaggtggaaaaaccaatctagctaagctatttaggaatcctagctacgacgaactagacatacaaacagtcgaagtaggaaaagctgactttgctgacacaattgatttactagcatcatcaatggaggacacagatgtaccactattgagcgccgtaaaagccatgtatgattggtcattattaatagatgttttaaaaggtcaaaaaaccatatcagacgcaaaagtatgcgaatacgaacaacataaatcagacctcaaggcacttaaatacatagtacgcaaatacctagatcgcgcgcaatatgacgaaatttttagaactgctggagaaaaaccgaactacgtatcatattcatataacgtaacggacgttaaactgaaacaattaccatcaaacttcaaaaaaaaaaactctgaagagttttgcaagtatattaaatctaaattagagaaaattaaaccagaatcagacgacgaagccgtctataacgagctcattgaaaaatgcaattcaaaaacgctatgtccaaaacaagtaacggatgaaaacagagtgatcccctatcaattatattatcacgaactttctatgatcctagacaaagcttcagcatacctagatttcttaaacaaaacagaagacggcatatctgttaaacaaaaaatacttacactaatgaaatttcgcatcccgtatttcgtgggacccttagtaaaaagaaatgaaacagataacgtgtggatagtaagaaaagctgaaggtagaatttacccctggaattttgaaaacatggtagacttcgacaaaagtgaagacggatttattagacgtatgacatgcaaatgtacttacctagcaggagaagacgtactaccaaaatactccctactctacagtaaatacactgtactgaacgaaatcaataacataaaagtaaacggagaaaaaataagccctgaactgaaacaagacatattcaatgaactattcatgaaaacgtcacgagtcacagtcaaaaaaataacagaacttctgaaaagaaagggcgccttcagcgaagaaaaaggcgactcactatccggagtagacatcaatatcaaaagcagtttaaaaagctacctagacttcagacgactcttagaaaatggatccttatcagaaaacgacgtcgaacgcataatagaacgaataaccgtaacaacagacaaaccacgtctcgtatcttggctaaaggcagagtactcagatctaccagcagaggacattagatatataagcagactcagttacaaagattatggaagactcagcgctaaattacttactggctgctatgaactcgatacgaatactggagaaatcggtggcaggagcataatagacttcatgtgggcggaaaacataaatctaatgcaaatattatcagatagttatggatacaaatcatttatcgaagaggagaataaaaaatactacatgataaaccctacaggatcaatagcccaaacactgcgagaaatgtacgtatcaccaagcgtatcaagagcaataataagaacaatggaaatagtcaaagaactcaggaaaatcaccaaaaaagacccagataagatatttgttgagatggcaaggggaggaaaaccagaagagaaaggtaaacgaacaagctcacgcagagaacaaatagaaaaattatacgattcagccaaagcgttcgtatctgatgaagatatctcgcatatgagatcacaacttggctccttaagtgatgaacaattaagacgagaaaaatactatctgtattttattcaattcggaaaatgtatgtatagtggagaagcaatagacttcagccgactaggagacaatcattgctatgacatcgatcatatttttccccaatcaaaaattaacgatgacagcctacacaacaaagtcctagtcaaatcccaattaaatggagaaaaatcagatgattacccaataaaagcagaaataagaaacaaaatgcaccctctatggaagaacctattttacagggacccaaaaaacccggcagataaagtgaaatatgaaagactaacaagaagcacacccttcaccgaagacgaactagctggattcatcgaaagacaattagtagaaacaagacaatccacaaaagccgtagcaactctattaaaagagatgttccccgacagtaaaatagtgtatgtaaaagcaggtcaagtttcagaattcagacatgatttcgatatgctaaaatgccgtgaaataaacgatctacatcacgctaaagacgcatatctaaatattgtaataggaaatgtacatgatgttaaatttaccagcaatccaatgaattttgtaaaaaacgcagacaaacactataccataaaagtaaaagaaactctaaaacataaagttagtcggaatggagaaacagcatggaaccctgaaacagactttgacaccgtaaaacgaatgatgagcaaaaactcagttagatatgtgagatattgctataaaagaaaaggcggattctttaaccagaaccctgatagagcaggtaaccctgatttggctagattaaaaaaagatttagaccctgttaaatatggagggtacaactctaaatcaatatcctgtttttcgctcatcaaatgtacaggcgtcggcgcagtaattataccagtagaactattatgcgaaaaaagatacttctctgatgacagctttgcatcagaatacgcttacagcgtattaaaaaacgcactacctgctaaaaacatcgcaaaaataagtatagacgacatatcgttcccactaaaaagaagaccaattaaaataaacactctcttcgaatttgacggctaccgagttaatatacgatcaaaagactcctatcattatttcaccataagtagtgcaatggcagctatatatagcaaagatacttcagactatataaaagccgtatcttcctatatagacaaatccgacaaaggaagcaaatttaaacccggggaagccttcgacgtactatccaatctaaaagtttacgacgagatagccaaaaaatgcataagcgaaccattttcaaagatcagcaaactagcagaagcgggtaaaagatggaaaaaagaagaaatatcgttacagaattgcctactttga

SEQ ID NO: 8726 - RNA, 3945 nt, synthetic construct
  misc_feature 1..3945: note = Cas9 variant
  source 1..3945: mol_type = other RNA
atgttaaaaaaagattattctataggtttagacatcggaaccaacagtgtcggacatgcagtagtcactgacgattataaagtgccaacaaaaaagatgaaggtctttggagacacctccaaaaaaactattaaaaagaatatgcttggtgtattgctcttcaatgaaggacaaacagctgcagatactagactcaagaggggagctagaagacgatacacacgtcgaaaaaatagattaagatatttacaggaaatctttgctcctgcactagcaaaagtagatcccaatttcttttatagactggaagaatcttcacttgtagccgaagacaaaaaatacgacgtataccctatctttggaaaacgagaagaagaactactataccatgatacacacaaaacaatatatcatctcagatcagaactagcaaataatgaccgaccagcagatctccgactagtataccttgcactagctcatataatcaaataccgaggaaattttctattagaaggagagatagaccttcgtacaactgacatcaataaagtcttcgcagaattctctgagacgctcaatgaaaatagtgatgaaaatcttggcaaattagacgtagccgatattttcaaggacaatacctttagtaagacaaaaaaaagtgaagaactcttaaaattaagcggcgctaaaaaaaaccaacttgctcatcaattatttaaaatgatggtgggaaacatgggcagttttaaaaaagtcctcggtacagatgaagaacacaaactatcttttggaaaagatacatatgaagatgacttaaatgatctgctagcagaagcaggcgatcaataccttgatatattcgtagccgctaaaaaagtctacgacgccgctattctagcgagcatcttagatgtgaaagatacacaaacaaaaactgtgttcagtcaagcaatgatagaaagatacgaagaacatcaaaaagatttgatagaactaaaaagagtctttaaaaaatacttacctgaaaaatgccatgacttcttctcagaacctaaaatttctggttacgcgggatacatagatggaaaggtaagtgaggaagacttctataaatacacaaagaaaaccttaaaaggcataccagaaacggaggaaatattacaaaaaattgacgcgaacaattatctacgcaaacaaaggactttcgacaatggtgcaatacctcatcaagtacacctgaaggaattagtggcaatagttgaaaaccagggaaaatactatccattcctccgtgaaaataaagacaaatttgaaaaaatactaaactttagaataccatactatgtcggaccgttagctcggggaaactcaaaatttgcctggttaactcgagcaggcgaaggaaaaataacgccatataattttgatgaaatgatcgacaaagaaacgagtgccgaggactttataaaaaggatgactataaatgacctatacttaccaacagaaccagtcctaccgaaacattcactactatacgaaagatatactatcttcaacgagttagccggagtcagatatgtgactgaaaacggggaggcaaagtatttcgacgcacaaacaaaaagatcgatattcgaactatttaaattagaccgaaaagtatctgagaaaatggtaataaagcaccttaaagttgttatgccagcaataagaatacaagcacttaaaggtctggacaacggtaaattcaatgcatcatacggtacatataaagacctagtcgacatgggggtcgcaccggaattgttaaatgatgaagttaattcagaaaaatgggaagatatcataaagactttaacaatcttcgagggaagaaaactaattaaaaggcgtttagagaactaccgagattttttgggcgaagatattcttcgaaaactaagcagaaaaaaatacacaggatggggacggctatccgcaaaacttttagatggaatttacgataaaaaaacccacaaaaccatattagattgtctaatgactgaagattactcacagaattttatgcaactcattaacgatgatacatatagcttcaaagagacaataaagaacgcacaagttattgaaaaagaagaaacactagcaaaaacggttcaggaactccccggaagcccagcaataaaaaaaggaatattacaatcattagaaatcgtagacgaaataataaaagttatgggatataaaccaaaaagcatcgtagtcgaaatggcacgagaaacacaaaaaacacacggaacaagaaaaagagaagacagagtccaacaaatagtaaaaaacttaaaagacgccaatgaattacccaaaaaactaccaagtaatgctgaattaagtgacgaaaggaaatacctttactgcttacaaaatggaagggacatgtatacaggagctccactagactacgaccacttacaattttatgacgtagaccatatcatcccccaaagctttctaaaggacgattccatagaaaacaaagttctaacaataaagaaagaaaacgtaagaaaaacaaacggccttccttccgaagcagtcatccaaaaaatgggatctttctggaaaaaattacttgatgcaggcgcgatgacaaacaaaaagtacgacaatttaagacgcaatctacatggtggtttaaatgaaaaattaaaagaaaggtttatagaaagacagctagtagaaaccagacagataacaaaatacgtagcacaactattagatcaaagactcaactatgacggaaacggcgtagaacttgatgaaaaaattgcaatcgtaacactgaaggcgcaattggcttcacaattcaggtcagaattcaaactaagaaaggtaagggctctgaacaacctacatcacgcacacgatgcatacttaaacgcagtagtagcaaatttaattatggcaaaatatcccgagctagaaccagagttcgtctatggaaaatacagaaaaactaagtttaaaggactaggcaaagcaacagctaaaaacacattgtatgcaaatgtcctatatttcctcaaagaaaatgaagtatatccgttttgggacaaagcacgagacttaccaacaataaaaagatatttatacagagcacaagtaaataaagttagaaaagcagaacgccaaacgggaggattcagtgacgaaatgcttgttccaaagtcagatagcggaaaacttcttccgagaaaagaaggacttgatccagtgaaatatggcggatacgctaaagcagtcgagtcatatgctgttctgatcaccgctgatgaagtaaaaaagggtaaaacaaaaaaagtaaaaactttagtaaatatccctattatagactcaaaaaaatacgaagcagatcccactgcatatcttgccagcagaggatacacaaatgtcacaaactcttttattttaccaaaatatagtctattagaagacccagaaggcagacgtagatatcttgcatcctttaaagaattccaaaaggcaaatgaattaatcttaccacaacacttagtagaactgttatactgggttaacgcaaaagatggtgaacagaaattagaagaccataaagcagagtttaaagaactctttgataagatcatggagttcgcagataaatatgtggtggcacctaaaaacagcgaaaaaatccgaagattatatgaagaaaaccaagatgcaacaccaatggaactaggcaaaaacttcgtagaactgttacgttataccgcagacggggccgcctccgatttcaaatttttcggcgaaaacataccgagaaaaagatacaactcagcaggatctttgttaaacggaactttaatataccaatctaaaaccggtttatatgaaacacggatagatcttggcaagttatga

SEQ ID NO: 8727 - RNA, 3948 nt, synthetic construct
  misc_feature 1..3948: note = Cas9 variant
  source 1..3948: mol_type = other RNA
atgggctattcagttggcctagatattggaacaggatctgtcggatgggttgtaactaacgaagatggaaaactcgcgagggcaaaaggtaaaaatctaataggagtccgactctttaaaactgctgaacccgcagcagatagacgaacaaacaggacaacacgaagacgattatcacgacgcaaatggcgactaaggctcctagacgaactttttgcaaacgaactaggaaaaatcgattcaaatttcttaactaggctaaagtactcttatgtacacccaaaagatgacgcaaacagagcaaactattatggaggatacctgtttccaacacaagaagaaactaaaaagttccacgctaaatacccaacaatatatcacttacgtctggcattaatgacggaaagcagacaatttgatttaagagaaatctatttagcaatgcatcaaatagtgaaatacagaggtcacttccttaattcccaaagtaaaatgacaataggaaacacctataacccgcaagatctccaaaccgccatggaaaattacgcggaagctaagggactatctatcgaactcaaacaaccagaagagatggttgctattttaacaggagaagccggcttcggactaagcaagaaagcaaaagcagaaaaactacttaataatttcttctttgacaccaaagaagaaaaagccaccgtacaagcaatattagcaggaattgtaggtaacactatagatttcactaaagtctttaatagacaactaaccggagacacactaaaagcatggaaattaaaactagactcagagacgttcgacgtagactcagaaccaatactttcagacctagacgacgacgaaacagaactcttctttgcaatacgccaagcatttgatggtttcacgttaatgaatctattaggtgatcaaacatcaatatccgccgcaatggtcgaacgctatacacaacaccacgacgatttactcacagtgaaacaagtagccaagaaacaaggattaagccataaagaattttccaacatctactctgctttcctaaaagatgataccgataaaggcatgaagaaactcctggaagaatctaacttgtctacagaagatgtaaatggaatccaacttagaatggactcacacgactttttgccacaacaaagaacaaaagcaaacagcgtaataccccaccaactacatttagcagaattggaagcaattatagaaaaccaaggtcaatactacccgttcttactcgaaacgttcgaaaaagaaggaacagccgcaaataaaatcgccgaattattaaaattcagaataccatattatgtaggaccaatggttacaaagaaagatgtcgaaaatgcagggggagatgcaaccaatcactgggtaacacgaaacgaaggatacgagaaaagcgcggttacagcctggaattttgatcaggtttttaatagagatcaagctgcactcgactttatacaaagactgacaggaacagacacctacttaatcggcgaaccaacactacctcagaactcgctaaaataccaaatgtttacagtactaaacgaactaaataatgtcaaagtaaacggaaggagaatagataaccaaacaaaacacgacctcatccaagacctatttaaatcaaagaaaactgtctctcttaaagcctttcaagactactatcaaagccaaggaaaatcagatattcaagttgtaggactagcagacaaaactaaattcaacagcaatctaagcacctacatagatctcagcaaaactttctcggctgaagaaatggaaaaccctcagaaccaagatctattagaacagatagtagaaatacaaacagtcttcgaggactcaaaaatagccgaacgagaactaagcaaactagaattaacacccgaacaagtaaccaaattagcgaaaacacattacacaggatggggcaatctaagcaacaaattactcaccacacccatcgttgatgtaagtggaaagaaagtttcaattctagaccaactagcaaaaaccagtaaaaacttcatgtcaataatatcaaacgaacagtacggagtgcaagactggataaaagaacaaaacacaacagagactaccggtactctagaagacaaacttgcagacttgacgacgtcaccagccaacaaacgtggcataaaacaagcattcaacgtcctgttcgacatacaaaaagcgatgaaatctgaaccggacagagtatacctcgaatttgctagagaaacccaaacttcagtaagaacaatgtcgagatacaattatctcaaaggactttaccaaagtaaaagtctcgatgcggaagccaaaaatcttaagaaagaactagcagaaaccgaccagaagaaatttgataacgaccgcctctatctatatttccagcaacaaggaaaagatatgtacacaggtcaaccaataaatatagacaaactaagcagcgactacgacattgaccacatcataccacaagcattcacaaaagatgactcaatagacaacagagtcctagtatctagacccgaaaacgcaaggaaatccgattcaggaacatacaccacggaagtccaagcagcagcatccggactttggaaaactctagtacaatccggctttatctcacgcaaaaagtacgacagattaacccacgctggagattatagtgagggacagaaaaccggattcatagcaagacaattagtagagacacgccaaataataaagaatgtagcagctctcattgaaagcgagttcgaccagacccaagcagtagcaatcagagccgaaataacaggcgacatgcgacgtctagtcgccattaagaaacatagagaaataaattcatttcaccacgccttcgacgcgttattaatcacagccgcaggacagtatatgcagaaaaggtatcccgatcgtgatagtaacaacgtatacaatgagttcgacagatacactaacgattacttaaagaaactaagagaatcaagcagcaaagacgaagtacgaaaactaaaacctttcggatttatagtaggtactatggcaaaaggaaacgaagattggactacagaacaaacagaatatctaagacatattatgaacttcaaaaacatactaacgacttataaaacagggccagatagaggtcctctttcaaaagaaactatctacgcagtagatcctaaagcaaagctgattggaaccaataaacacagacaagatgttagtctctatggaggatatacctacccgtatagcgcgtatatgacattagtacgagcaaacggtaaaaatcagctagtaaaagtctccagatcagctgcatccttaatgaagtcaggacaattaaaactcgaagattacgtacaacaacaacctgaagtaaagaaatttgagaaaatattactagaacatcttccactaggtcagctagtcgacaatgatggaaaacttatgtatctcaccagctatgagttctatcacaatgcaaaacaattatggttatctacagaaaacgcagacctaatcagttcattatcaatagacagcgacgatcaaaagttaattaaagccttcgacatattaacagctgactcagtgatagaaagatttccattctatgaaattgacctaaagaaattaatagaactacgtgataaattcgtattaatagataataaactcgatgtgttacgtgtagttttaaaagcactacaactcgatagtgcgcaacaaaaaccactaaaactaatagacaaagcagccactgattggaaaaactatcgacaagccggcgggatcaaactgtcagataatgcagaaataatataccaatcaactacagggatattcgagaaaagaataaaaatatctgacctgctgtga

SEQ ID NO: 8728 - RNA, 3951 nt, synthetic construct
  misc_feature 1..3951: note = Cas9 variant
  source 1..3951: mol_type = other RNA
atgctacaaaaaaattacacaatcgggttagacataggaaccaatagcgttggctatgcagttattaacgacaactataaagtgccagcaaaaaaaatgaaagtactgggaaatacagataaaaaaacaatcaagaaaaacttgatgggggtgttactattcgatgcaggtgagaccgctgcaactacaaggctaaagagaggcactcgacgaagatatacacgccgaagaaaccgattgagatacctacaagaaattttaggacccgagctagcaaaggtagatgcaaactttttacatagattagcggaaagcagcctagtaacagaagacaaagaattctcagcatacccaatatttggggatagagaagaagaattattatatcataaaacatacaagacaatatatcatctaagaagcgccctagcaaataaagacgaaaaagcagatttaagattaatatatctagccctagcacatataataaaatacagaggcaatttcctcatagaaggagagattgaattaagcgacaccgacatagataaagtttatgcagacttctgtcggtcctttaatgaactatttgacaccgaagtactacaagaaatagaggtagaagccatcttcaaagataaaacactcagtaaaacaaaaaaagccgaggaactagtaaaagtttcaggcgtcaaaaaaaaccaagtagcacaccagttcttaaagatgatggtcggaaacaccgtgaatttcaaaaaagtcttcaacttaacagaagatcaaaaactttcatttggaacggactcatatgaagatgaattaaacgacctacttgctaaatcagatgaccgatacttagacgtttttgtagcagccaaaaaagtctatgatacagcaattctagctaacatcttaaacacaaaaaatagtgtcgcaacaaaaacaatattttcacaatcaatgatagaaagattcaaagatcatcaaaaagacctaaaagaactaaaacaacttttcaaaacttatcttccagaaaaatatcctgatttcttcggcaatagcaaagaggacggatacgctggatacatcgaaggaaagacaaacgaagaaaaattttacacacatacaaaaaagatactgaaaaacatccctcaggcagcctcagttctagcacaaatagacgtaggaaattaccttagaaaacaaagaacattcgacaacggagtaataccccatcaaatccaactaaaggaacttttagcaataatagaaaatcagggtaaatactatcccttcctcttagaaaataaagaaaaaatagcaaaaatactaaccttccgaataccatactacgtaggacctttagcaagaggcaacagtagattcgcttggttgaaaagagttggcaaggaaaaaataactcctttcaacttcgagaatgtagtagaccttgaaagcagtgcagaaaggtttatcgaaagaatgacgctcaacgacctatatctgcctgaagagaaggttttacccaaacatagtatgctctacgaaaaattttccatatttaacgaattagccggcatacgatatatcacagacaatggcgaaatgaaattcttagacgcacagaccaaacaatccatcttcgaactattcaaacaagaaaggaccgtcaaggaaaaaaaagttctcgacctgctcaaaacccttatgccgtctgaaagagtagtcgcaattaaaggaattgacaatggaaaatttaacgcctctttcgggacttaccatgatttatccaaaatgggattcaaaacagaaaaaattgcttcagaaagtaaccaagcaagatgggaagagataataaaaacattgactatattcgaagaccgaaaacttataaaatcacgattgcggaaatacgacgacttcttaaacgaaaaagaaataggagccttatccaaaaggaaatatacagggtggggacgcctctcagctaaattaattgatggtatatatgataaaaaaacacatcaaacgattctagattttttaatgaacgaagattacaaccaaaactttatgcaactcataagcaacgacaattactcattcaaaaaaatcatcgaagattctcaggtaattaaagaagaaggctctttgaccgaagttattcaagaattaccaggaagcccagcgataaaaaaaggtattctacaaagtatagagatcgttgacgaattggtaaaagtaatgggcggaaacccaaaaaaaatagtagttgaaatggcacgagaaacacaaaaaacacacggaacaaccagacgcgaagcgagaataaaggaaataatcaaaaaccttaacaaactaaaattaaatgaacttccaaaagatttaccttcaaacgaagaactaagtgacgaaaaagtgtacttatattgtctacaaaatggtagagacatgtacaccggagcaccactagacctagataacctatcacagtatgaagtcgatcacataataccccaatcatttctcaaagacgactcgatagaaaacaaagttttaacggcaaaaatagaaaacagtcgaaaaactaacggactcccttcagtggaaatagcaaaaaaaatgggcgcgttctggagatctctactgaaagtaggtgcaatatctgaaaaaaaataccgaaacttgaggagaagcctacacggaggaatgacagaaaaattaaaagaaacatttgtaaaacgtcaacttgttgaaacacgacagataactaaatacgtagcacaaatactaaacagccgatttaacgaagaaaaaaatgaagacaaagttgcaattgtaaccctaaaagcacaattaacctcccaatttagaaaagacttcgagctatataaagtacgagaaataaacaatctccatcacgcacacgacgcatatttaaacgcagtactggctaccttacttatgacaagcttcccagaactagaaccagaatttgtatatggaaaataccggaaaacaaaatttaaaggattaggaaaagctacagcgaaaaataacttatacacaaacatattacagctcctcaaggaggagtcagcacaatactgggatactaaagaaagagatcttgccacaataaaaaaaaacgtatatcaagcacaagtcaataaagtacgcaaagtcgaacgacaaacaggttccttctacgacgaaacagtagctaaaaaatcggcaagccaaaaattgttccccagaaaaaatggcctagatcccgtcaaatacggcggatatcaacgagccaacgaaggctactctctacttttcagagccgatatgttaaataagagaggaaaaactaaaagcgtaaaaacccttgtgaaaattccaatcatagaatcagctcagtatctcgctgaccctaccgaatatctggcaaaaagagggtattacaacgtgtccgaacacagtctattactgccaaaattcagtctactggaaaacaacaacggtctacggcgatacttagcatcatcaaacgaatttcaaaaagcaaatgaactaatattaccaaagcacttagttcgtttattatattggtcgcaatcaaaacaacgaaaagaagaacttaacaaacacagggccgaatttgcagaactatttacttacatcatggatttcgcagataaatacgtcgtagcacctaaaaactcagaaaaaataaaaaacatttacgaaaataacaaggacagcagtgtagaagtgcttggcaaaaacttcatcgaactactaaaatacacggctgacggcgcagcctcagacttcaccttttttgatacaaaaatacccagaaaacgctacaacagcgcaggtgatttgttggatggcaccctaatatatcaaagcaaaacaggactatatgagacccgaatagatcttggagcgatttga

SEQ ID NO: 8729 - RNA, 3957 nt, synthetic construct
  misc_feature 1..3957: note = Cas9 variant
  source 1..3957: mol_type = other RNA
atgatgatcaaactgaacaacatgaaaaagattctaggattagacctcggaacaaattcaataggatgggcagtagtagaaacggaagacaataagaaattcgaattgctcgacaaaggagtacgcatcttccaagaaggagtcaaaattgaaaaaggaatagaaagttcaaaagcagccgaaagaaccggttaccgtagtgcaaggcgcatcaaatttagaagaagactcagaaaaattgaaacattgaaagttctaattgaaaacaacatgtgccctctatcaatggatgaactaatagtttggaaagaaaacaaaaacaattaccctaaaaataaaatattctacaactggttaaaaacaaaagacccaaaagaaggaaccaacggcacatatattaacccctactactttagaacagaagccatcaaacggaaacttgaaaataccaatgacgtcgggagagccctataccacctggcccaaagacgaggatttaaatctaaccgactcgaatctacggatgaaaaatcaagaggaatagtaaaaacggaaatcaataaactatcaagtgaactaaacggcagatatctaggagaatacttttacgaactgtatctcaaaggagagaaaataaggaaacgacatatctcgagggaagaacattacttgaacgaatttaagaaaatatgcgaagtacagaactttaacaaagaactcgccgaaaaactagaacgagcaatcttctaccaaagaccacttaaatcacaaaagggtctagtcggaaaatgcacactacaaaataataagcaccgatgtccaatatcgagaccagaatttgaagagtttcgtatgtggcaattcataaactcaattaaatacaaaaattcagatggaaaattcgattttctaaacaaggaacagagggagaatatcatacctgcgtttgtatcaaacaaaaacgcaacattcgagttttcaaaaatcgagaaaatcctaaataagggagttcacatttaccagttcaattacaaaagcaatcacacgataggatcaaaccaaacaatgataaatttcatggatgttttcgacattgatagaaaactgacaaatgcatggctcctatgtgtaaataaaatatatgaactttacacggctaaaacaaagaaagacggatcgctaaaaagcaaaagtgaagttataacagacgtatggcacgtcttattcacattcgataatgaggaaaatttaaaagagttcgcacgaaataaattattactagacgaatctagcgcccaaaaatttagtaaaattaatttaaaacaggactattcacaacttagtctaaaagcaataaacaaaatactgccttacctacaagaaggactgatatatagctacgctgtcttcatagcaaatatagaaaatgtgataggaaaatcgatatggaacattaaagaaaaccaacaaataattagaacatctatcaagaaaattattgataaccataaaacagaattagacataaatacgataacaaacagcctaataaatgacttcaaagtgaattacaacaatgcccataaagaatataaagtagatgatatagatttaaagaacatcagagagaaaattataaaatactacgggaataaaacctggaactgcttaccagaagacgaaaaactatatgtcaaagaaaaagttgaaaaattatacgaaaaacaactcaaatcaggcaaaagaggcatttttatagagaaaatacgattagatgataggattgaaaatttcctgaaagacaacttcgattcttcagaactaaacctaaagaaactctaccacccctccgatgtatctgtttacaaaagtgtaaaaataactgacttagggttaagactcctaggttccccaatgataccatctattaaaaatccaatggccatgagggcaatgcatcaactgcgaaagttaataaaccatctaataatagaaggagtcattgacgattcaaccataataaatgtggagatgtcaagagaacttaacgacgcaaacatgcgtaaagctattgaacgatatcagcgccaacgagctacagaaaatgaagagttcaaaacaaaaatcaaagaactatataagaaagaatgtggaactgacttcgaaccaaacaatgacgatataatgaaatatcgattatgggaagaacaaaatcacaaatgtctatacacaggcaaatcaattggaatttgtgactttataggaagtaatcctgcattcgaaatagaacacacaataccaagatcactatcttacgataattcactagaaaataaaacactctgcgaaaaggagttcaatcaacaagtaaagaaaaacagaatacccttcgaattatctaactacaaagaaataattagtaggatcaataactgggaaataaaagcagaagaactatttaaacaaatccaaaaagtaaaaatacaatccagaatggccgctacaaaagaaattaaagataatgcaattcaaagaaaacacctactacaaatggaatttaactactggaacggaaaattgtcgaggtttaccagggaagacgtacctgaggggttcaaaaattcacaattagtggatattggtatcataactaaatatgcgcgagcatacttgaaaacagtatttaataacgtgaatacagtaaaaggttcaactgtagcagagttcagaaatatatggggcttacaagaatatttcgagaagaaagacagatccaaccacatacatcactgcatagatgcaattacaatcgcctgtctaacaaaagataaatacgatttcctagcacacttataccatctcgatgaacaaaacaaccgagacgccgtacaccgcgcgatgataaaatcaaaaccatgggaaaacttcgtacaggatgtcaaagaaatagaaaaccaaatcttagtatcacactatacacctgacaacttaccaaaacaaagtaagaagatactaagaaagagaggaaaaatacagaaaaacgaaaacggagatttaatttatgaaaagggcgacgcggtcagaggctcattacacaaagagagcttttacggagcaatcaaaagggaaatcataaacaagaaaggtgaaacagaagaaaaagttttatacgtaaaaagaaaaccactagaattttcggatctcggattcaagactatctccgaactggaaaatatagttgatgatgcagtacgagacaaagtactaaacgccgtaaaggacaagggcttaaaacaagcattaaacgaacctatctggatgaatgaagaaaaacaaataccgataaagaaagtaaggtgttacacaccctcagtcacaaaccctataaacctaaagaaacacagggacaaatcaaaacatgaatataaacaaagctaccacgtaactaacgatggcaattacctaatggtaatatatgagggaaaagactcccaagaaaaagtgaaacgagattatgaaatagtgtctaacctacaagctggagaatacttcaaacaaagcgtacatggggttcttaaagctcagggtatcaacaacttagaaggactaatacccaaattcaaagaatctggtaaaaatatcttaccgttaaaatacattttaaagacaggaactatggtaattttctgggaaaactatccagaagaaatatgggatatagacaaaaatcaattgtataaacgcttatttaaagttacccaattcgaatctgacggaagaatacaagcacgatttcatcaaatcgcaaaacccgacaacgaactaactaaagtcagtgagttagacttcagtaacatagctgagaaaataagattatcgaaaggaaacttaaatatgctagtaaatggatacgatttcaaaatcaacgtactaggacacatagaaaaactctcatga

SEQ ID NO: 8730 - RNA, 3957 nt, synthetic construct
  misc_feature 1..3957: note = Cas9 variant
  source 1..3957: mol_type = other RNA
atgggcagcaatatgctcaagaaagattatagtataggactagatataggaacaaacagcgtagggcatgcagtagtaacagatgattataaagtacctaccaagaaaatgaaagtattcggcgacacaagcaagaaaacaattaagaaaaatatgctaggagtattactattcaacgaaggacaaacagccgcagataccagactgaaacgaggcactagacgaagatacactagacgtaaaaacagattaagatatttacaagaaatatttgcacctgaactagctaaagtcgatcccaattttctctatcgacttgaagaatcatctctggtagccgaagacaagaaatatgatgtatacccaatattcggaaaacgggaagaggaactactataccatgatacatataaaactatctatcatctgcgaagcgcactcgccaacaatgatcaacccgccgatttaaggctagtatatctcgccttagctcacataataaaatatcgaggcaatttcttactagaaggagaaattgatctacgaacaacagacataaacaaagtcttcgcggagttcagcgaaacattaaacgaaaatagcgatgaaaacttaggaaaactagatgtagccgacatctttaaaaacaacactttctccaaaaccaagaaatcagaagaactgcttaaattatcaggtgccaagaaaaatcaactagcacaccaacttttcaaaatgatggtaggaaacatgggatcctttaagaaagtattaggtacagatgaagaacataaactctccttcggaaaagacacttatgaagacgacctaaatgacttactagcagaagccggcgaccaatacctggatatttttgttgcagccaagaaagtgtatgatgcagcgatcttggcttcaattttagacgtaaaagatacacaaactaaaactgtcttctctcaagcaatgatagaacggtatgaagaacaccaaaaagatctaatagaactcaaaagagtatttaagaaatatctaccggaaaaatgccacgatttcttcagcgaaccaaaaatcagtggctatgctggatatatagacggcaaagtatctgaagaagatttctataaatataccaagaaaacgttgaaaggaatccccgaaacagaagaaattctacagaaaattgatgcaaacaactatctaagaaaacaaagaacattcgataatggagcaataccacaccaagtacatctgaaagaattagtagctatcgtcgaaaatcaaggtaaatactatccatttctcagagaaaacaaagacaaattcgagaaaatattaaactttagaataccatattatgtaggaccactagcaagaggaaattcaaaatttgcatggctaacgcgagcaggagaaggcaaaataaccccatacaattttgacgaaatgatcgacaaagaaacatctgcagaagattttatcaaacatatgacaataaacgatctttacctacctacagaaccagtactcccaaaacacagtctactatatgaacgttacacaatatttaatgaattagcaggagtgagatacgtcacagaaaatggggaagcaaaatatttcgatgcccaaacaaaaagatcaatttttgaacttttcaaactagatagaaaagtatctgagaaaatggtaataaaacacctgaaagtagtaatgccagcaattagaatacaagcactaaaaggactagacaatggaaaattcaacgcgtcatatggaacttataaggatctcgtcgacatgggagtagcaccagaactattaaacgatgaagtaaactccgaaaagtgggaagacattattaagactttaaccatatttgaaggcagaaaactaataaaaagaagattggaaaactatcgagacttcctcggtgaagatattctgcggaaactttctagaaagaaatatacgggctggggtagactttccgcaaaattgctagatggaatttacgacaaaaagacccataagactatcctagactgtcttatgaccgaagattattcccaaaactttatgcaattgataaacgacgataattattcattcaaagaaacaataaagaacgcacaagtgattgaaaaagaagaaactttagccaagacagtgcaagaattaccaggttctccagcgatcaagaaaggcatactccaaagtttagaaattgtcgatgaaattataaaagtaatgggctacaaaccaaaatcgatagttgtagaaatggcgcgagaaactcaaaagacacacggaacacggaaaagagaagaccgagtgcaacaaatcgttgaaaatttaaaagatgcaaacgaactacctgaaaaactaccaagtaatgcagaactatctgatgaacgaaaatacttatactgcttgcaaaacggccgagacatgtataccggagcaccactggactacgatcacctccaattctacgatgtggaccacattattccgcaatcattccttaaagatgacagtattgaaaataaagttctgacaataaagaaagaaaacgtcagaaaaacaaatggcctaccatcagaagcagtaatccagaaaatgggcagtttttggaagaaattactagacgcaggagccatgacaaataagaaatatgataatctaaggagaaacttacatggaggactaaatgaaaaattaaaagaacgttttatagagcgtcaacttgtagagacgagacaaataaccaaatacgtagcccaactactagaccaacggttaaattatgacggaaatggtgtagaattagacgagaaaatagcaatagtgacgctaaaagctcaattagcttcacaattccgaagtgagttcaaattaagaaaagtacgtgctctaaacaatttgcaccacgcccacgatgcatacctaaacgcaatagttgctaacttgataatggctaaatatccagaattagaaccagagttcgtatatggcaaatatagaaaagccaaatttaaaggcctgggtaaagccactgccaaaaatacactatatgcaaatgtattatattttctgaaagaaaacgaagtatacccattctgggacaaagcaagagacctcccaacaatcaaacgatacctatacagagcacaagtaaacaaagtaagaaaagcagagagacaaataggaggattctccgatgaaatgttagtaccaaaaagcgattccggcaaactgctaccgcgaaaagaaggattagatcccgtgaaatacggtggatatgcaaaagctgtagaatcatacgcagtactaataaccgcagatgaagtcaagaaaggtaaaacaaagaaagtcaaaacattagtaaacatccccattatagactcgaagaaatacgaggccgaccctactgcatacttagctagtcgaggatacacaaatgtcacaaacagcttcattttacctaaatattccctcctagaagaccctgaaggaagacgaagatatctggcaagtttcaaagaatttcaaaaagcaaacgaattaatcctaccccaacacctagtagaattattatactgggtaaatgcaaaagatggagaacaaaaactggaggatcataaagcagagttcaaagaactattcgataaaataatggagttcgcagacaaatatgttgttgcacccaaaaacagcgagaaaataagacgattatatgaagaaaatcaagacgccaccccgatggaactaggtaaaaattttgtcgaattacttagatacacagccgatggagcagcaagtgacttcaaattcttcggtgaaaacataccaaggaaaagatataatagtgcaggatccctcttgaacggaacactaatttatcaaagcaaaactggcctttatgaaacaagaattgacctaggtaaattatga

SEQ ID NO: 8731 - RNA, 3960 nt, synthetic construct
  misc_feature 1..3960: note = Cas9 variant
  source 1..3960: mol_type = other RNA
atgttctctcaaagaaataacccttactgcgaactactctttaaaattatagtcacaaacatagaagagaaaaacctagaagtaataatgggaatacgcaactcagacatattctttataagtaattttatgtggtaccaaaaacttattatgatgattaaaaatatacttgggttagaccttggaacaaattctataggctgggcacttatagaagtagacgaaaataatataccaataagaataatagcaatgggaagcagaattataccactaagtacgagtgacaaagaagaatttcaaagaggtctatccataacgaaaaaccaaaaccggactgtaagcagaacccaaagaaaagggtacgataggaaacaactgagaagatcagatctaaagaaaatcctaaagaaatacaatatctttccatcagaagaactcctcaaactacccatgcttgacctatggaaattaagatctgattcagcgaacccaaatgaagacatcagcgccgaacaactaggaagaatcttatacatgttaaaccagaaaagagggtataaatccgcacgaagcgaagctaactcagacaagaaagatacagactacgtacaagcagtcaaaggacgctatgctcaactaaaagacaggcgtcagactataggacaatacttttatgaagaactatcaacagcattttcagacaaaaacaatcaacagtacttccgagtaaaagaagaagtatacccgagggaagcatacatagaagagttcgacacaataatcaacgctcaaaaagataaacacggctttctaacagataaagtaattcaccaacttagaaacgaaataatatactttcaaagaaaactaaaaagccaaaaaggtctcgtcagcatctgcgaattggaaggattcgagaaaacagtatacgataaagagaaaaacaaaaacaaagtcgtttttgttggaccaaaagtagctcccaaaacttccccactattccagttatgcagaatatgggaagtcgtaaatactatatcactgaaaatcaaaaacccagaaggaagtaaatacaaatggggagaaaaagttccaaacctaaaacaaaaagaaatattagctgattacctatttaaaaatgaaaacttatctttcagtacactcctggaaatattggaactaaagaaagaagacgtctatgtaaacaaacaaatattaaaaggcataaaaggcaacgaagcatacgcagcactacacaacgtactcggtgatcatgaactactcaattttgacgtatcaataataacaagcgatcatacagctatcctagtcgacaagaaaacaggggaaatactagaagaaagagcgggtttagaactagatgccagcctggaaagagaaccgttatatcaattctggcacacaatatactcattaaaagatctagacgaatgcaaaaacgcactcataaaacgatttggcctagatgaggacattgcagaaaaactatcccatatagacttcaacaaacaagcattcggatccaaatcgaataaatcaatgagaaaaatattacccttcttaatggaaggctataattattccgagtcatgctcacttgcaggttacaatcactctaactctctgaccaaagatgaacgagaatcccagataacgctagaaagattagaattattacccaagaataatctaagacaaccaatagtagagaagatacttaaccaaatgataaacgtagtaaacactatactagaaaaatacggtaagccttcagaaataagagtcgaacttgcccgagaactaaaacaatccaaagacgaaaggaatgacacagatctacaaaactcccgaaacaagaaattaaacgaagaaataggaaaacgcctagcagaactaggacttccggtaaccaaaagatacattcaaaaatataaatttatttttccatcattaagtaagaatctaaaagacgcccatgtgaataaccaatgtatatattgcggcgaaactttcaacctaacagaagcactcaatggtgacgcatacgacgtcgaccacatagtacctaaagcgttactcttcgacgattcacaaaccaacaaagttctagtccatcgaaaatgcaatagcacaaaaacaaatcaaacagcctacgactatataacagccaaaggagaagaagaagtcagaatatacagcgaacgagttgacgattggtttaagaaaggaataatatcttactcaaaaatgcaacgactaaaagtaagccataaagaatatttggaaagaaagaaattaggaaaagagacagaaactgacaagaaactgtgggaaaattttatagacagacagctaagggatacacaatacatatcaaggaaaagcagagaaatcctacaaaaagtttgtaacaatgtaacaactacagaaggaggagtaactgctaaactaaggaatctgtggggatgggacgacattctaatgaacctacagatgccgaaatataaagaactaggtcaaacaattacgaaagaatggaccagcgaacatggaaagagaaagcaccaaaaagaagaaatagaaaactggacaaaaagagacgatcatagacaccatgcaatagatgccctagtagtggcatgtacaaaacaaggatttatacagagaattaacactttaaactcttcggaaacaaaagaccttatgataaaggaggtagaagaagcgaaaatagagtttaatgagaagaccacgttattagaaaaatatcttaaaacacaaaaaccatttacgacgagagaggtaatgaaagaagctgataaaatattaataagttttaaagcggggaagaaagtcgcaacaataacaaaatttaaagcaacagggaaaaacaaagaaacaggagtaatagtcccaagaggagccctccacgaacaatctgtgtacggaaaaataaaagtaattgaaaaagacaaaccgttaaaatacttattcgaaaatcctgacaaaatagttaatagtcgtattcgcgatttagtagaaactagactttcagaaaatgaaaataactctaagaaagcactaagtactgtaaagaaaaaccccattttctttaacgaagagaaaaacgaaattctggaaaaagcaagttgctataacgatgcgactgtcctgaaatataaattacaaaatctgaaagcgaaccaagtcgacgacatagtagacgaaagagtaaaatttctcgtcaaagagcgattgactcagtttggatcgaaagaaaaagaagcattcaaagatattctttggttcaaccaagaaaaacaaatcccaattataacagtaagactattcgctagaccagatgcaaataatttacaaatcattaagaaagacaaaaacggaaaagatataggattcgttttaactgggaacaatcaccatattgccatatacgaagacaaagattctaaattagtccaacattcttgcgcattctggcatgccgttgaaagaaagaaatataacatacctgcggtcatcaaaaactcggcagatgtatggtctctactcctagataaagaactccctgtgctattcctagataaattaccagctgacgaattaaacctgaaattctcaatgcaacaaaacgaaatgttcatactcggtttaagtcaagaaggtttcgatgaagccattaaaaataacgacaaatccctactatcaaaacatttatatctagtatggtctatatccaataatgactactatttcagacaccacctagaaaccaaaaacacagaactcaaaaatatccccacagcaaaagacagcaaacgatactttaggttcaaaagtgtcggagccctagttggaataaatccgatcaaagtaagattaaaccacttgggggaaataacgaaaattggagaatga

SEQ ID NO: 8732 - RNA, 3960 nt, synthetic construct
  misc_feature 1..3960: note = Cas9 variant
  source 1..3960: mol_type = other RNA
atgggatacaacattggcctagatattggaactggatctgtaggctgggcagcactgacagatgaaggaaaactagcgcgggcaaaaggaaagaacttaataggagtgagattatttgactccgcgcaatctgcagcacaacgtcgtagttatagaacaacaagacgacgactttcccgacgaaagtggagacttagattactagaaaatatattcagtgacgaaatgggaatgatagatgaaaacttctttgccagattaaaatacagctacgttcacccaaaagatgaagtgaacaatgcacattactacggcggatatctgtttccgacacaacaagaaacccacgactttcacgaaaaatttcaaactatctaccacctaagattaaaacttatgatcgaagattgcaaatttgacctacgcgaaatctatttagcaatgcatcatattgtaaagtacagaggacatttcttaaactcacaaagcaaaatgacaatcggtgacagttacaatccccgagacttccaacaagccatacaaaactatgctgaagctaagggccttatctggagcctcaatgatgcacaagaaatgacagacgtactcgtaggacaagcaggatttggcctaagtaaaaaggctaaagctgaaagactattaagtgccttttcatttgacactaaagaagataagaaagctatacaagcaattctagctggcatagtaggaaataccacagatttcaccaaaatctttaatcgagaaaggtcgggcgacgaattaaagaaatggaaacttaaactagatagtgaagcgtttgatgaacaatcacaagctattgtcgacgaattagacgatgatgaaatggaattatttaatgcaatccgtcaagcatttgatggattcacactcatggatctattaggcgatcaaacatcaatatctgcagcaatggtaaaaagataccagcaacatcacgatgacctaaaaatggttaaagaaatagcgaagaaacagggtctatcacaccaagatttttcaaaaatctacacagcatttctaaaggatgatacagacaaaggcatgaaagcactattagataaagcagatttagcagacgatgtgttagtagaaatacaacaaaggattgagtctcacgattttctaccaaaacagcgcacaaaagcaaactctgtcataccttatcaacttcatcttgcggaactagagaaaataatagaaaatcaaggaaaatactatccatttttgctcgacacctttacaaacaaagcaggagaaactataaataaacttgtagaattagtaaaatttagagtaccatactatgtaggtcccatggtaacagctgcagatgtagaaaaggcaggcggcgacgccactaaccactgggtgaaaagaaacgaaggatatgagaaaagtccggtcacaccctggaactttgaccaagtatttaatcgagatcaagcagcacaagacttcattgaccgacttaccggaacagatacatacttaatcggagaacctacactactaaagaactcattaaaatatcaactttttaccgtacttaatgaattaaacaatgtcaaaattaatggacataaaatagatgagaaaacaaagcatgtactcatacaagatctcttcaaatccaagaaaaccgtttccgaaaaagccataaaagactactacctgtcacaaggaatgggagaaattcaaatagttggattagccgataaaacaaaatttaactcaaatctatcctcgtacatagacctaagtaaaacgtttgacgccgaatttatggaaaatcccgccaatcaagaactactagaaaacataatacaaatacaaacagtattcgaagacgtaaaaatagcagaacgagaattacaaaagttagccttacccgacgaacaagtacaacagctcgctaagactcattatacaggatggggtaacttatcagacaaactcctaagtactcctataattcaagaaggttcacaaaaggtttccattctaaataagttacagacaacatccaagaattttatgtcaattataacggataacaagttcggagtacaacaatggatccaagaacaaaacacagctgaaactgctgactcaattcaagacagaattgacgaactaacaaccgctcctgccaataaacgcggaataaaacaggcctttaatgtgcttttcgacattcaaaaagctatgggagaagaaccaaacagagtatacttggaatttgcgaaagaaactcaaaatagcgttcgaacaaattctagatacaacagactcaaggacctttataagtctaaaacactatcagatgacgtcaaagcgctcaaggaagaacttgaatcacaaaagtcttctctacaatcagaacgtattggcgaccgattatatttatactttttacaacaaggtaaagacatgtatacgggacagccaataaatatcgataaattgtccacagattatgacatcgatcacataataccacaagcatacacaaaggacgactcaatagacaacagggtcctagtatcaagacccgaaaatgccagaaaaagtgactcagcaacttacactacggaagtacaacaaagcgcaggcggcctttggaaaagcctaaagaacgcaggatttataagccaaaagaaatatgatagattaactaaaggtggagactactctaaaggacagaaaacgggatttatagcacgacagctagtagaaacaagacaaattatcaaaaatgtagcatcattaatagaatccgaattttcacaaaccaaagctgtagccataagatctgaaatcacagcagatatgaggagactggtagcaatcaagaaacacagagaaataaattcttttcaccatgcctttgatgcactattaataactgcagcaggacaatacatgcaagctcgataccccgatagagatggagcaaacgtatacaatgaatttgattattacacaaatacctatctcaaagaattaagacaatcttcatcttcatcccaagtaagacgacttaaacctttcggtttcgtagtgggcacaatggcaaaaggtaatgaaaactggagcgaagatgatacccaataccttagacacgtaatgaatttcaaaaacatcctaacaacaagacggaatgacaaagacaatggggctctaaataaagaaaccatttacgccgtagacccaaaagcaaaactgataggaacgaataagaaaagacaagacgtctcactgtacggaggttatatatacccatatagtgcgtatatgaccctagtacgagcaaacggtaaaaacttactcgttaaagttactatctcagcagcagagaaaattaaatcaggccaaatcgaactatccgaatatgtccaacagagaccagaggttaagaaattcgagaaaatcctaataaacaaactggctataggacaacttgtaaacaatgacggcaacctcatatacttaactagctacgagttctatcacaacgccaaacaactatggcttccaaccgaagaagctgacctaatatctcagttaaataaagattcatccgacgaagatttaatcaaaggcttcgacatactgacatccccagcaatactaaaaagattcccattttacgaattagacttaaagaaattagttaatatcagagacaaatttatagccgtagaaaacaaatttgatatattaatggtaattctaaaagcgctacagctggacgcagcccaacaaaaacccgtaaaaatgattgacaagaaatcagcggactggaaagactacagacagaggggaggaataaaactatcagacacatcagaaataatataccaatctaccacaggaatattcgagaaaagagtcaagatctcaaacctattatga

SEQ ID NO: 8733 - RNA, 3963 nt, synthetic construct
  misc_feature 1..3963: note = Cas9 variant
  source 1..3963: mol_type = other RNA
atgaccgagcaacaaagaccatacaatataggactagatataggaacaagctcaataggatgggcggttacagaccaaaatgacaaactactccacattcgcggccacaatggtataggtgtgaggctatttaaagaaggagagagtgcagcagaaagacgaggattccgaacaacaaggcgaagactaagtcgaaggagatggagactacgattcctggacagaatattcgatgcagaactagcaaaggtagatccgaatttcctagcacgactcaaacaatcgaatatcagccctctcgacccaaacaaacagatgttcggaaatatcctctttgacgacgcccaattcgacgaccaaaaatttcatcaacaataccctacgatctatcatttaagatcagctctagcacaaccagacgcacctcaagccgacgtacgcctaatatatttagcgctacaccacatgataaaattcagaggacattttttaaacggcgccgccgttgaaaaatttcatggtggacaactccacttagaggctgaatttcaagaactaaaccaaatattctcaaatcaacaaagagaccatgtacaattacaaacaagctctttggacgaagtagctacaattttaaaagacaaccaaagaacaccatcagaccgccaaagagaactatctgcacgattatttgttcccgtcgataagaccattgataaagaaaacaaaaaacttgcaacggaactgctcaaagcagtgttaggtctaaaagctaaattcgatgtaatacttggagtggaagcaacggacccacaagcattcaaactccaattcagttcagacgactttgacgataaaatagccgaattggcaagcgaacttacagacgaagcaaatgaaatattaactgttctccaacggctatacttttcattaaatctagccgacatacttacgaatcgacaaacaaaacaagtcgccgactcaataagcacagctatgatcaatagatacgatgaccacaaacaccacctcaaaatgctaaaagaacttgaaacacaagtaactcaagaacaaagagacggactaaaaaaagcttacgatgagtacattgacggagataaaccaacaattgacacattctacaccaacgtcaaaaaaaacttagacgattccgaactggctaatcaaatcaaatcccttatagatttacaagcatttatgccgaaacaaagatcaaaagagaatggttcaataccacaccaactacaccaaagggaattagaccaactaatagaagtgcaaggaaaatactatccctggcttttagctgccaaagacaaactagacgcactaatagccttcagagtgccttactatgtaggcccaatgatcgacccaaatgaatcagacgacccacagaacacaaaatttgcttggatggtaagaaaagaggcaggcgaaatcacaccctggaattttgaagaaaaagtcgacaaaacaggatcagcaacaaacttcataaaacgaatgacgacaacagatacatatttactaggcgaaccagtgctaccaaaaaactcactactctaccagcagtttacagtgctaaacgaacttaataaattaaaggtcgacggaaaagcacttacagttgatcaaaaaaaatatctttacgaacacgtatgcaaaaagcaacgccgcgtaactctcaaaaaattatctgactgtctaatggcaagaggggacttccctatgggggccatatttacaggaacaacagaccaaaaaaatatgaataacaccctaaaaacttatcaagacttccaagaaatattcggagatgagattgacaatcccgatagacaagtggacttcgaaaaaatgatagaatggtccacgatctttgaagacagagaaatctttaaactcaaattggcagaacttaattggctaacatccgaacaactagaacgagtatctaagaaaagatatcaaggttgggggagattatcacaaaaactactaactcatatagtaaatgagaacggtgaaagaattatagatcaattatggaacacaaaccaaaactttatggagattatgggtcaagacggggtaaaacaggcaattcaagaacacaatggagcgaacgtagcacaaacaggcatcaacgaaacaattgatgaactctatacgtctccacaaaacaaaaaagcaatcaggcaaatacttctagtcgtagatgacataaaaaaagcagtaggatatgcaccagccaatataatgatggaatttgctcgagaagatcgagatgaccacagactgatagcatcgcgagcacgacagttggaaaagacctaccaggaaatatcgaaaaattggtttgacaacgaatcagtgacccaagaattaaaagatcaaattaaaaataaaactaaattcactgatagattatacctttactttattcaaggaggaattgacctttatacaggacaccctctaaacatcgaccaattaagctcatatgacatagaccacatattaccgcaatcattcctacttgacaacagccttaataatcgtgtattgactagccaaagtgaaaacagagtacataaagaagatagactaccgggtgaaaccgtagctaataaaatgagaccaacatggaaaatgatgagagaacaaggactaatgacacaaagaaaatacaataatctcacattaaagccagaccaaatatccaaatttaataatcgcggccaattcataaacagacaactagtagaaacaagacaagtaataaaactagctgcagacataatgaatcaaaaatatcaagcagaccaaacaaaagtagtcacagttaaagccaatcttacacaccatatgcgggaaaaatttaatttctataaatcacgtaatgttaacgattatcatcacgcgtttgacgcatacctaacagttttcgtaggaaattggctattaaaagaatacccaaagttacagccctatttcgtctacggcgattttgcaaaaaccggaaccaataacttaaaatctttcaactttctataccgtttcgaaagagaccataaactaaatgataaaggggcaatcgacacagacaaagaccaacaacttggatatatgaaacgcatttacagattcaaaaaaatgttagtcacaaaacaattagaaactaatgagggtgccttatataaacagactatatacaaggcaccagccaacgaaaaaaatacaaaaaaaaaccgttcgctaataaatacaaaaaaaaatagaccatcagacatatacggtggatactcacaatccgtaacggcatacatgtcgctcgtcttttttaaaaatacatttaaactaataaaaatgccactcgttgcggccaacgcaataaaaaactccctatcgagttatcatgacactatactaaaaatactaggatcaaatgagtttaaagttttaataccaaaagtaaaaatgaaccaattaattaaggagggtgatagcctatatacagtcgttggcgtgtacaaacacaacgcacaacaactaatcctatcagacaacagtatgggaataataactaagccaatccgagaaatatgtgacagtgaccttgacagcgtgtttaatgaactcgttgacaacatagataagtacttaaatttatacaaaatagaagataaactcaccatcaaagaaaaattttatgccctaaaaaacaaagagtcgaaattcaaatgtatcagtgacatactagtcgggacacattgtaatgcagggagatcgaacttaaaaataataggactatccagttattgggggatgtttagtggaaacaatgacggactcaaaataaacgaaaattcacaattaatctatcaatctccaacaggcctatttgaacatagagtaaaagtatcagacttatga

SEQ ID NO: 8734 - RNA, 3972 nt, synthetic construct
  misc_feature 1..3972: note = Cas9 variant
  source 1..3972: mol_type = other RNA
atgaaagatttctatataggactagatatgggaaccgactcagtgggatgggcagtagcagatgaagactacaacctatgcaaattcaaaggcaaagcaatgtggggagtaagactctttgacgaaagtgccacagcagccgaaaggagaggtttcagaactgcccgacgtcgagcacaaagaaaaagacaaagaatactatggttacaaatgttattcaacgaagaaataagcaagaaagatatagcattctttcaacgattaaatgaatcaaaactatatttagaagacaaaagtactaatgtaccatatgcagtattcgctgacgaatcattcaccgatgttgactaccataaattgtacccaactatctaccatctaaggaaagaactcgtacaatcggacgagcctcatgatgtaagactggtatatctagcactacatcacctcatcaaaaaccgaggacactttttatttgaaaacgtcggctcggactttgaaaaagaaagttctttcgaggtattattcaaaaatttacaaaattacatactaggagaatatgaactagctctagagtgcattagcccactccagatagcagacatactcaaagataaatcaaaacgaaaaactacgaaatcaagcgaaatctgcaaactactcggaataagcaagaaaggccaaccgagactaaacgcaatcgtattgctaatgtgtggacaatccgtcaaactagctgacctatacggtgacgaaaattacaacaaagaagaaaaatcatcaatatcatttgaaaaaggttatgaagataatgaggaaacatatagagaattattactagagcgatttgaattaatagagaaaataaaagcattatatgactgggcaatattagcagatattctcaaaggagaaacttatatttcattcgcgaaagtaaaaacgtatgacgaacacaggcatgatttacaacagttaaaagcattcgttaaagaaagatgcagaagcgactataatgaaatttttcgagaaacctcagataaactaaataattatacggcatattgtggtaaatttaaagaaaatggaagaaacggcgtaatactacatagcgctaaccaaaccgacttctgcaaatatctaaaaagtaaattcgacaaactagataaatctggatacgaagacatgtttgaaaagatcgaaaacggaagttttatgccaaaaatagtcgtaaaagacaacggtgtaatcccaatgcaagtgaatgaaagcgaagtacgagccatattaaagaacgcatccggttaccttgactttttaaacaaccaggacaaagacggaataacagtagccgacaaaatactgcaaatttttgaatttagaataccatactacgtaggaccactaaatgtacactcagacaactcatggttagttcgtaaagacgggaaaatttacccatggaacttcaataaaatcgtcgacgtcgacaaaagtgccgaagaatttataaacaaattaacagccaaatgtacgtatctacccgaccgagatgtaattcccaaaaattcaatattatacagccgatatatggtactaaatgaattgaacaatttaaaactcgacggcaagaaacctgatgtcagctttaaacaagcagtctttaatgacttattcatgcaccgacgaaaagttacacaaaaagcattaagagaatacataaaagcacaaacaggaacggaacctgaaataactggaatagatggagactttaaagctaacatgagacccgcaattgaactcgcagggtacaacctatccgaacccgacaaagaagaaataataaaagccataactatttttggagacgacaagaaactattaaaaagaagaataaaagataaatacagcgaaatgctatcagaagacgaaattaagaaaatatgcaaattaaaatacaaagattggggaagactttcccgcgaatttctcaccgaaatctttgacgtagatacagctacaggtgaatgtaaagacaacataataaatacattatggaacacaaatgacaatctcatggaattactaggtgccaaatacaacttcacacaaagcatagaacaagctataagcaaatctacacacaaagcatctatagagaaaatggtcgaagatatgtacgtatctcccaaagtaaaacgaacagtatttcaatccttaaaaataatgaaagaaatagttaaaatcaaaggccatgctccaaagaaagttttcgtagaaatgacaagacatgatggtacaaaaggagacaacggacgtaccaaatctcgaaagaaacaattagaagaactatataagaaatgtaaagaagattccacagaactatgggatgaacttgagaaaactgacgacgacgagttccgacaagacaaacttttcctatactatacacagatgggtcgatgtatgtattccggagaaagaatagaactaagagatctattcaacaaaaacctgtacgacatagatcacatatttccacgatcaaaagtaaaagatgatagcatagacaatagggtcttagtcaagaaacaaataaacagtcataaagataacgattatccactcgactccacagtacgagagaaaatgagaggtcactggcaatacttattgagacacggatttatctcgaaaaagaaatatgatagattaacacgcgtaacacctctaactgatgacgagcttgctgacttcattgccaggcagctagtagaaacatctcaatcaacaaaagccgtcgccacgctattaaaaaccttatatccaaccacagaaatagtatacgtaaaagcagaattagtctctcgattcagaactgaatacaaatttattaaatgtagagaagtaaacgaccttcaccatgccaaagacgcgtatttaaatatcgtagtaggaaacgtatacaacgtaagatacacccatagtaaagcaatattcataaaaggactccaaaccaagaaatactccctaaatagaatgttcgcattcgatacgcctggagcgtggaacatcgaaaatgaaaagtcactctcaatagtcaagaaaacagttatgaaaaacaatatcctatatacacgctactcatatatgaagaaaggtggcttgttcaagatccaaccactcaagaaaggaaacggacaggcaccactaaagaaagatctacccctaagcgacattggcaaatacggaggttatgacaaaccaacagctagctacttttcctacatcaaatatgaaggcaagaaaggcaaagaatgccgacaactcgtcgccatcgataattacctcaagaaatactacgaagaaaatccaatcgaatacctaacaaatcgattaggactcaaaaatccagctgttctaatcccagtaataaaatataactcatgcatagaaattgacggatttcgaatgaacatatcaagcaaaagcaatgaaggaaagactatcgtttataaacccgctgtgcaattagttctaggagctgaaaaagaagcctacgttaagaaaataagtaaagtcctctccaagccagaagaacagaaaataacaagctatgacggagtatcagcagaagaaaatattgaactattcgacgcacttaccgctaaaatgacgaatactatctttaaaataaaactagaggacattgggaataagataaaatctggtcgcgacaaattcgtaactctagacgtcaagaaacaatgctacgtaataaatgaaatactaaagataatgcattgtaacgtagttacaggagatttaagtctaattggagcagccaagaaagcaggaattgtatcaacaaatagtgctctatcagagatcaagaaagttagctcaattatgttaataaaccagtctgtcacaggcctattcgaaacaaagatagatttgctaaatatctga

SEQ ID NO: 8735 - RNA, 3975 nt, synthetic construct
  misc_feature 1..3975: note = Cas9 variant
  source 1..3975: mol_type = other RNA
atgagagcaaaaggaaaaactctaattggcacttcgttatttagagaaggaaacacggcagcagaaagacgaggatacagaacaactcaacgtaggttaaaaagaaggaaacgaagactaaaactactagaagcattctttgacccatatatctttgaagtcgacgaaaactttctagctcgtctacacgaagctgatatctcgcctaaagacgaaaataaaaggttttgggggagcttactatttcctaatgagaaggacgcaaacttctatagaaaataccccacaatttatcacctgagaaaagcattaatggaagaagatagaaaattcgatgttcgagccatctttctcgctattcaccatattatgaaataccgagggaacttcttaagtcctctaagcgttgacagctttaaacaagaaggactagaactaaaagaacaactagacagacaacttaaaagagttgcagaactatacaacgaactaaatacagatgtaaaaattaacgtctcagacgtggaaacaatacaagacataataatagacaaaaataaaagtagaagagacaaagccggagcattgaagaaattattagcagtatcatccgataggaaagaaattaataaactcaatgccagtttagcaaaagaactaagcaacgctatactaggcatgaaagcacaatttgctaatttgctcctagcagacgatctagaaatcgacaaaaacaagaaaaatttcagcttattggatacaaatgctgaagaaaatgtgagtggtctattagaattagtcaacgaaaaacaagctgaactattcgacgcaataaaaaccatccacgatcaaataatactaaatgagatagttccagacggtaaatcaatatcacaaagtatggtcgataaatatgaagctcatagggaacaactacaagttttaaaagcactctatgagaaaatggatgcaaaacaaataaaagctatcaagaaagcctacagtctctacattgacggaaaagaccccaaagcaaagaaagttgataaaagagcacaccaaaatagagcagacttttataaagaagtgaagaaagttctagtagaactcgatgattctagagccgaaaaactattaggactaatagaaatgggtcaatttctacccaaacaacgaacggcgatgaatggcgtaatcccaaatcaactacatcaagtagaattggataaaattatagaaatgcaatcaaaatattacccgtggctagcagagaaaaatccagttaaaagccatcagaaaagagccccctacaaactagatgaacttctaacattcagagtaccctactatgtcggaccaatggtaacatctaagaaacaacaacaaaccagcaatagtaacttcgcatggatggtacgaaaacaagaaggcgaaataacaccatggaattttgaagaaaaagtagatacaattgcttcagccaacgacttcataaaaaggatgactgctaaagatacatatctagttggcgaagacgttctccccgccaactccttactgtaccaacgatataaagtattaaacgaactcaacaacataaaagttaatggaagaagattaccagtagagctaaaaagagaagcatacgtagcattattcgaaaatggagattctaaaaccgtctcagcgaaatgtttcaaaaactggctcaatgtaaaacttaaaaacctaaattcactaaaactggaaggtttaagcacaggcacgaaatttgacaataacttaagcacttatcatgacctcaagaaaatattcggcaaagccgtagacgacgccgggagacaaaaagactttgaacaaataatcgaatggctcactatattcgaagacaagaaaatactaagaataaaattaaaagaaatagaatggttaacagaagaaaacattacacaactaacgaggttaaattataacggttggggaagacttagtaggagactgctcacgggcatctgtgattcaaacggtcaacgaataatggactggctttgggacacaacaaacaattttatgcaaatacaaagccaaccagacttccaaaaagcgatagtagaatacaatagtgataaattagaacaaggggacatagagcaaatccttggcgaggcttatacatcaccacaaaataagaaagcaattagaaaagtaataaaagttgtacaagacgtggaaaaagcaatgggcgcaaaacctacttctatttcaatcgaatttaccaggtcagatggaagaagcgaattaactaacagtagaatgacacaattgcagaaaactctcatgtccttatccgaagaaatgacagaccaagcattactagcagagttcaaagacttccaagcatctaaaaagaaacttacaaataaatactatctttatttcacacaactaggtcgagatatgtacaccggcgaaccactaaacatagatcaattatcactatactcagatggggatcatatattaccaagatcatttataaaagacgactcacttgataacagggtcttaacaaaaagagcagttaacaacgaaaaatctgacactgtcccagtttgtgaatatggcgcaaaaatgaaagatttctggaatgatttgtacgacaacggcctaataagtaaacaaaaactcgctaacttgctaaccgacccagacgaaataggaccatacaaagcaaacggttttatacgccgtcaattagtggaaacaagtcaagtaataaaactgagtgcagaaatattacaaacactctatcaagataccaaaatcattgaagtacgccaaaaatacactcacgaactaagggaacattttaactttgtaaagattcgacaactcaatgactatcaccacgcgtttgacgcatacctaacagccttctctggccgttatctctaccaaagatatccaaaattaagagggtacttcgtatatggagactacaacaaattcgacgcgaagaaagaccgcaactacctcaaatcttataatttcctatatgaccttgaagaaggcaaaactgatcaaattgtagacaacgttgaacacaaagtattcatgaacagacaagacgcaataaaccaacttaagaaagcctacgaatacaaatatatgttagttagccaagaaacttacaccaatagtggcgcaatgttcaaagaaaccatatacccagtcaatcccaaacaaaaactcatccaaaagaaaaatgacaaacccgtcgacatatacggtggctacagtaataattacgatgcgtacctttccattgtaagactagaggacaagaaaggaataaaattccgggtagttggtatacccatgagaaataaagcagaattagataatctagcgaaagaagaccataacggatacatgcaaagattaaatgaaatagtcgacgaacaaataaactctagcgggaaaaagaaaacattccggattatacttcccaaagtccactttaaacaattagtagaagacgactcaggaaaatttatgttaggaagtgcagcatatccatacaatgccaaacaactcgttctaagtgtgaaatctatagaaagtctagcgaacaaagatgcctctgacagagaattagtagcagtatacgaagaaatactaaacgtagtgaacgataaattcaccctttatgatgccagacaattcaggaataaattaacaagctctaaagataaattcgtagaactaaatacagcagataaagtaacagaattgctcgacatattagacggattacacgcaaatccggttgttaagaaactcaaaataatcagtggaagtcctttcggatttctgcaaagaccatcgggaatagtattaactgaaaatgcaaaattgatctatcaatctcctacagggatatttgaaagagtagtatatttacgtgatttgtga

SEQ ID NO: 8736 - RNA, 3984 nt, synthetic construct
  misc_feature 1..3984: note = Cas9 variant
  source 1..3984: mol_type = other RNA
atggaaggtcaaatgaaaaataacggcaacaatcttcaacaaggtaactactacctaggattagatgtaggtacttcatcagtgggctgggctgtaactgatactgactataacgtattaaaatttagaggaaaatccatgtggggtgcaagattattcgacgaagcaagtacagctgaagaaagaagaacacaccggggcaacagacgtagacttgcacgacgaaaataccgactattattacttgaacaattgtttgaaaaagaaataagaaaaatagatgacaactttttcgtccgtttacatgaatccaacttatgggcagatgataaatcaaaaccctccaaatttcttctatttaacgatacaaactttacggataaagactaccttaagaaatatccaacaatttaccatctacgatcagacttaatacacaattcaactgaacatgacatcaggttagtatttctagcgttacaccatttaatcaaatacagaggccatttcatctatgacaactccgcaaatggagatgtcaaaacattagacgaagcagtcagcgattttgaagaatacttaaacgaaaacgatatagaatttaatatagaaaacaagaaagaatttattaatgtactgtcagacaaacatctaaccaagaaagaaaagaaaataagtcttaagaaactatatggggacataactgacagcgaaaacataaacatatctgtactaatagaaatgctatccggatccagcatatccctatcaaatttgttcaaagacattgaatttgatggaaaacaaaacctttctctagatagcgatatcgaagaaacacttaacgacgttgtagatatcctcggagacaacatagatctcttgatacatgctaaagaagtctacgatattgctgtcttaacctcaagtttaggcaaacacaaatatttatgcgatgccaaagtagaactattcgagaaaaataagaaagatcttatgatattaaagaaatatatcaagaaaaatcaccccgaagactacaagaaaatattctcatccccaactgaaaagaaaaactacgcagcctacagccaaacaaacagcaaaaatgtttgctcccaagaagagttctgtctcttcataaaaccatacatccgcgacatggtcaaatcagagaacgaagacgaagttagaattgcaaaagaagtagaagataaatcatttctcacaaaacttaaagggactaataacagtgtagtaccctaccaaatacacgaaagagaattaaaccaaatactcaaaaatatagttgcttatctcccctttatgaatgatgaacaggaagacatcagcgtggtagacaaaataaaattaatatttaaatttaaaataccatattacgtgggccccctaaacactaaatccacacgttcatgggtctacagatcagatgagaaaatatatccctggaatttcagcaacgtgattgatctcgacaaaactgcacacgagttcatgaatagattaataggccgttgcacctataccaatgatcctgttttaccaatggacagcttactatactccaaatacaatgtcttaaatgaaattaacccaatcaaagtaaacggaaaagcaatacccgttgaagtaaaacaagcaatatatacagacctgttcgaaaacagcaaaaagaaagttacgagaaaatcaatctacatatacctacttaaaaatgggtacatagaaaaagaagacatcgtaagcggaatcgatattgaaatcaaatccaaactaaaaagtcaccacgattttacacaaatagttcaagaaaacaaatgcactccagaagaaatagaaagaattattaaaggaatcctagtttattcagatgacaaatccatgctcaggcgatggcttaaaaataatataaaagggctatcagaaaatgacgtaaaatacttagcaaaactaaattataaagaatggggacgtctaagtaaaactttacttaccgatatttacacaatcaatcctgaagatggcgaagcatgttccatccttgatatcatgtggaatacaaatgcaacactaatggaaattttaagcaacgaaaaatatcaattcaaacaaaacatagaaaactacaaagcagaaaactatgatgaaaaacaaaatttgcacgaagaactcgatgacatgtacataagcccagctgctagacgctccatttggcaagcattacgaatcgtagacgaaatcgtagacataaagaaaagtgcccctaagaaaatatttatagaaatggcacgcgaaaagaaatcagctatgaaaaagaaacgaacagaatcgcgaaaagatacattacttgaattatacaaatcatgtaaaagccaagcagatggtttctatgatgaagaactgtttgaaaaactatccaacgaatcaaactcaagactaagacgcgatcagctttacttatattacacccaaatgggaagatctatgtacacaggaaaaagaatagacttcgacaaactaattaacgacaaaaacacatatgatatagaccacatatatcccagatctaaaatcaaagacgactccataactaacagagtactcgtagaaaaagacataaacggcgagaaaactgacatttatccaataagcgaagatatcaggcagaaaatgcaaccattttggaaaattttaaaagaaaaaggactgatcaatgaagaaaaatacaaacgccttacaagaaactacgaattaacagacgaagaactcagtagtttcgtagctagacagctagtggaaacacaacaaagcacgaaagctcttgctacacttcttaagaaagaatacccatccgctaaaatagtatacagtaaagccggcaacgtaagtgaatttcggaatagaaaagacaaagaattacccaaattcagagaaataaatgacctccaccacgccaaagacgcatacctaaatatagtcgtaggcaatgtatatgataccaaatttaccgaaaaattctttaataacataaggaacgaaaattactcactaaaaagagtcttcgacttttcagtacccggggcctgggacgcaaaaggtagtacatttaacacaataaagaaatacatggcgaaaaataacccaatcattgcattcgcgccatatgaagttaaaggagaactcttcgatcaacaaatagtaccaaaaggaaaaggacaatttccaataaaacaaggaaaagacatcgaaaaatacggtggatataataaactctcaagcgcattcttgtttgctgtagaatacaaaggaaagaaagcacgtgaaagatcactggaaaccgtatacatcaaagatgtagaactctatctgcaagatcctataaaatactgtgaaagtgtattaggactcaaggaacctcaaataataaaacccaaaatcttaatggggtccttattctcaataaataacaagaaattagtagtaacaggtaggagtggtaaacaatacgtatgccatcacatatatcaattatccattaacgatgaagattctcaataccttaagaacatagccaaatacctgcaggaagaacctgatggtaacatagaacgtcaaaacattctaaacattacttcggtgaataatatcaaactgttcgacgtactatgtactaaattcaatagtaatacctatgaaattattttaaattcactcaaaaacgacgtcaatgaaggtagagaaaaattttctgaactcgacattttagaacaatgcaatatacttctccaactactaaaagccttcaaatgtaaccgagaaagttcaaacctagaaaaactcaataacaagaaacaagcaggcgtcatagtaataccacacttattcacaaaatgctctgtttttaaagtcatacaccaatcgattaccggactatttgaaaaggaaatggacctcttaaaatga

SEQ ID NO: 8737 - RNA, 3984 nt, synthetic construct
  misc_feature 1..3984: note = Cas9 variant
  source 1..3984: mol_type = other RNA
atgaaaaattactcaataggactcgacataggcacgggatcagtcggatgggtctgtatcgatgaaaattaccaaatactaagatacaacaatcgagctgcctttggagtacacgaatttgaaactgcacacgtggcagaagaaagaaggataaaaagaggagccaggcgcagatataacagacgaaaaaaaagaattcaactactacaatcactctttgtaccacacatgcaacagaaagccttcttcgcacccacaataacagaacactactggaaaaatgacaatcaatttgaaaacagaaccctttccgaagtgctaatgagcctaggaatgaaccccaatacctatccaactatatttcacctaagacacgagcttattgaatcctcagtaaaaaaagatgcaagattaatatacctcgccctgcacaaccttgtcaaatttagaggacacttcttacaagaaggttcaacatggaatgcaaacatgtccgacgccaatttatccgaacaattcgaacagctcctccatatatatacagagatggaagaattaccacaagtatcactaacagcccaacaatcaactgatgttgaacacatactactaaataaccatataagcaaggctgagagagcaagacaactcacagcactttttgaaagaacctatgaaccatttttcaaacttatagtcgggctggatatcgcagctgcacagctatttaaacagagtgagcaacaacttctatacaaagaatcaaaaaccaaagttaatttaacagcggaaacacttcctgaagtactacaaacaatgttagaaccagaagttgcattcattgaggcagtacaaccattctaccaacaaacagttctcttcgatctcttaaaaggacaaagttatgtagctgcagcaaaggtggaagcctttaaccaatacgaaagagatttagcgctccttaaaagcgttataaatgaggttggttcagaaaaacaatatcgagcattttttataacatcaaaacaaaaaaaacgccaatttgaacaaaaacccaacatggaactcctatgtcaccttgatagatttaacagagagaaaaaatatgaagaaaccttttacaaagaagtatcaaaactattaacagcactcataaaggaagcaacaggagaagtgaaagaacacatcgagcaaataattcaagccatggaaagtcaatctttcttagtaaaacagaagggcattcaaaacgcatcaatcccctaccaaaactcactttacgaagcagagatgatactcagaaatcaacaagcctactacccgtggataacagatgaattcattgaaaaagtgaaacaactcattgcttttaggattccatactacataggacctcttgtccagggcgacgaacaaccatttggctggctacaacgacaagcggatggcaacatcacaccctggaacttcgacgaaaaagtcaacaaagcagcaagcgcagaatcctttatcacacgaatgacgaaaaactgtacttatctaaaagaagaaaaagttctacctaagcaatcattaatgtacgagaaattcacacttttaaacgaactaaactcagtccaaattagaagctcattagaacaaccacataaaaaacaccgcctatgcgaggatatgaaacaatggattatagaacatgtattcaaaaaaaccaaaaccgtaacacacaaaacattaatacaagcattaaaaaaatccccatacaaagacgaattatacgatgagagtacaggtaactggaaagacgtatacggaacacaaaaagaggaccgtttcgcatctagtcttagcacctatatttctttaaaagaaattgtaggagacatagttgataacgcgtttatggaagaaattatatactggctaacagtatttactgacagagacattatcactcttaagatgaacgataaatatccatttataactgaacaacaaatacaacgattactaagtttaaatatatctggctggggtcaactaagtcaaagactcctacaatcaatcccagttgatgatatgaaccgctccgtgatcgaatatatggaaaagcacgcagttaactttatggaattattatcaccaagacaatcagacttagcatacaaaatcgaacaagtcaataaacaacactccaaaaaaatccacaaaatacgatatgaagatatagaacagctaacagggtctccagcactaaaacggggaatatggcggagcgtaaaaataatcgaagaactaacagcaatttttggcgaacctaaaaatataatgattgaagttgcgagagaagatcaggcctcgcatcgaaccaaatcaagaaaagaacaatgggagagtataggaaaatccctagccaaagaagagaaagaactcaaagcattcttcaaggaaatggcccagtacccaaaacaacaattcgacagaacccgtttctggctgtatgtaacacaacaaggaaaatgcttatacaccggaaaaacactacgactagaagacttaagttcatacgaaattgatcacatactaccaagaaactttgtgaaagacgattccatagacaatctagctcttgtttacccaatggctaatcaagaaaaaaacaaagctggaaacaacaaaatgccactagaaataatagacgccaaacaacaaccagccatgatggcacattggaaacgactcaaccaactaaaattaatatccgactcaaaattgcacaaactgatgaaacctagctttaacgatgtggacaaagaaaactttatcgccagacaactagtagagacaagacaaattattaaacatgttcgagatttgttacaagaaagattcgaacacacagatatacacgtagtaaaagcaaaaatggtgagtcaatttcgcaaattttcacgaattccaaaaatacgcgattataataataaacaccatgcgatggacgcacttttcacaactgtcctcatacaattcatattacaaaaatatggcaaaaattttttacagttcgatctacaacacaaagatatttcaaaaaaatggtcaaaaattgcacaatctactaaacattttttcctctttcaacaatttgccgaacagcaaataaagtccccagttacgaaggaattagtgagtggcgtacaatactttgaacacatcttctacgaacaatcatggcaaacaacaaaaatgacacaaacgatcgattcaaacttctacaaagagacaatattctcacctaaattaaaaacagcaaaatacacttctgcgaaagcagagaaattcgtccatgatgcaatcgtaaaatacgcggtttgcggaatacaatatacttccttaaaaaaaaataaagaacaacatcatgtactcctcacagacattaacgtaatcgaacattatcaactaaaagaggcaagcctaaacgaattagcattacacttagcaaaaagagaatctaaagacgatgtcatagacgcacaaatgttagtagttatccccaaatataaaaaaataatgttaaacggatcaccatactattgtatctcatcagacgaaagacatattgcaacccaatttgttcttcgaaaagacctactagaagcagtacttcacgtcaacgacgaaacatcagtagacgaactacgcacgctcttccggagcatagtcgaagaaatgatgacacaatacaaagtatataataaagacactataagaaacaaaatagatgcttttatcgaaacagaactaatcgatgtagagacttttcaagtcggttttacggaaattaaaaaaatggtagctgcaaatgctcaaagatccgataaatttggtgggagattacgacaagttatgaaggtagaagatatatatataattgacgaaagtatcacagggcttaggtaccgaaaacctcggaaactagtaaaatga

SEQ ID NO: 8738 - RNA, 3984 nt, synthetic construct
  misc_feature 1..3984: note = Cas9 variant
  source 1..3984: mol_type = other RNA
atgaagaaaaactacaccattggattagacataggtaccgcgagtgtaggttgggcagtattaacagaagattatgaattaataaaacgaaaaatgaaaatatcaggtaatacgcaaaagaaagcagtaaagaaaaatttctggggagtaagactattcgaacaaggagaaacagcagaaggaagaagattaaaaagaacaacccgacgcagaatagccagaagaagacaaaggattcaatatcttagaacaatatttgatgaaggtatgaatcaagttgacgcaaacttctttgcaagactagatgaaagtttttcaattatagacgaaaaagaaaacgaaagacaccctatttttggaaacgtagctgaagaagcagcataccatgagcaattcccgaccatttatcaccttagagaacatctagcaaatagttccgaacaagccgatctaagacttgtatatcttgcactagcacatataataaaattccgcggccatttcctaatagaaggggaactaaatactgaaaactcaagtgtgagtggaacattcgaacaattcattaaagtatataatgaaacctttaatgtcgaaaaagcactagatctaacagtagaccttgacggtattgcagaacagaaaatttcgagaatgaaaagagcagaactaatacttagcctcttccccgaagagaaaagcacaggtgactttgcccaattcattaaaatgatagtaggtaaccaagggaacgtcaagaaaacattttctctgaatgaagacgcaaaaattcaatttagcaaagaagaatacgaagaaaatcttgaaacactattagcagaaataggggaggacttcagatcagtattcgatgcggcaaagagtgtatatgatgctatttcattagctaatatacttaaagtcacagacgcaacaaccagggctaaactatccagttcaatggtagtaaggttcaccgaccacaaagaagatcttaaaacactaaaaagatttgtcagagaaaacctacctgacgaatacgacgacctattcaaaaataagaaagtagcgggctacgcaggttacatcgatggcaacgaaacacaagaggctttctacaaatatctcaagaaaacactagcgaaagcaacaggcgccgaaggatttttagcaaaaatggaacaagaagacttccttcgaaaacaaagaacttttgacaacggggtaataccatatcaattacatcttgaagaacttaaagctatcattaaaaatcagaaaagttactatagcttcctagacgaagagaaaatatcacaattaatgacctttcgaatcccatattacgttggacctttagcaaaagaaaaaggccaatttgcatggttaactcgaaaagaaatgggaaaaataaccccatggaatctgaatgaaaaagtcgatatagaaaaatcagcaacagacttcgtagaaagaatgacaaataatgatagctacttacccatggaaaaagtcttaccaaaacattcattactatacgaaacattcacagtctacaatgaactaacaaaagtaagatatatcgacgacaatggacgcgcccaaaacttcagcagcaaagagaaaagacaaataataaatgaattattcaaacaacaaagaaaagtcaagaaagaaatgctagaagcgttcctcaaaaacgaatacgggatagagaaccccaaagtagaaggaattgaaaaatccttcaatgcctgtcttggaacataccatgatcttataaaactaggtatcagaccagaattatttgagcaaccagagcatgaacaacaattcgagcaaatagtaaaaatactgacagtctttgaagacaggaaaatgcgaaggaaacaactagaaaaattttcaaacatattaacagaagaagaacaaaaacaattagaaagaaaacattataaaggatggggcagactgtcagcaaaattaattcacggaattgtagaccaaaagacccagaaaacaatcttagactacttaatcgatgacgacgatctgcccaaaaacagaaaccgaaactttatgcaactaataaatgatgagaacctatccttcaaagaagaaattgagaaaatagcattcgacaacgataagagtaccgaagaaattgtacaagaacttgctggctcaccagcaataaagaaaggtatactccaatcattaaaaatcgtagaagaaatcatagacataatgggagaactgccgaccaacatagtggtggaaatggcaagagaaaaccaaacgacagcacaaggaaatagggcttcaaaagcacgaatgaagtacttggaagaaagcattaagaaattaggaagttcaatcctagaagacgaaccaatcagcaaagatgctaaccttctcaggaatgacagactattcctatactacttacaaaatggacgcgacatgtacaccggaaacgaactcgatataaacaatctatcttcatacgacatagaccacatcgtaccacagagttttgtcaaagatgatagcatagataatagagtattaacgacatccagtatgaacagaggaaaatccaacacagtaccagccgaatcagtagttaagaaaatgagaccaacatgggaaagattattagcaagcggactcatcagcaagaagaaatttagctatttaacaaaagcaacgaatggcggcttaacagaagaagacaaagcacattttatacaaagacaacttgtcgaaactagacaaattaccaaaaatgtagctcaaatcctccatcagaaatacaataacgaacaactttcagaaaaacctgtaagggtgatcaccttgaaatcagcattagcatcacagtttagaaaagatttttcactctataaaatcagagaactaaatgattaccatcatgcgcaagacgcatacctaaatggagtcatagctcaagcattactaaaagtatacccaaaactagaacctgagttcgtgtatggagaatatcaaaaagtctccatcagagccctaaacaaggcaactgccaagaaagaattttattcaaacataatgaatttcttcacaagtgatgaaatggtagcgaacgaagagacaggagaagttctgtggaatagacaacgcgacattaaaactatcaagaaagtaatgaactatcaccaaatgaacatagtcaagaaagtagaaatccaaacaggagcattcacaaaggaatccatacttcctaaaggtcctagtaagaaactaatagccaggaaaaataactgggctcctgtgaattacggcggtgtggactcaccgacggtagcgtatagcgtaataataacacatgaaaaaggaaaagcagcaaaagttgttcagcagctagtaggaataaaaatactagaaagacaagcatttgaacaagacgaagtagcattcctagaagaaaaaggattcatacaccctaaagtacaactgaaactgccaaaatattctctatatcaatttgccgacggacgtagacgtctacttgcaagcgcagaagaatcccaaaaggggaatcaaatggttctaccagtacatcttatagaactactgtaccatgcaaaacacgttagcgattcctcaggaaaaagtctagaatacctaaacgaacatcgtcatgagttcgcagaactcctggaagctatcctacaatttacagaacaatatatagacgccggtaaaaatcaaaagaaagtaagagatttatatgagaaaaatcaagacgcagacatgcgtgaactcgcatcatcatttatccagttacttcaactaaataaacagggcgcccctgctgacttcaaattctttggagaaacaataccacgacgacgctataaaaatactgccgaaatcgttgatgcaacatttataaatcaatcaatcacaggattatacgaaacacagaaaagattagtgtga

SEQ ID NO: 8739 - RNA, 3984 nt, synthetic construct
  misc_feature 1..3984: note = Cas9 variant
  source 1..3984: mol_type = other RNA
atgacagaacaacagcaaccatataatataggactcgacatcggaacgagctcaataggatgggctgtaaccgatcagaacgacaaactactacacatacgaggccacaacggcataggtgttcgactattcaaagaaggagaaagcgctgcagaacgcaggggattccgtaccacaagaaggagattatcaagaagaagatggagattacgtttcttagacagaatcttcgacgcagaactagctaaagtcgatccaaatttcctagcacggctgaaacaatccaacatatcacccttagacccaaataaacaaatgttcggaaacatactattcgatgacccacaatttgatgatcaaaaatttcaccagcaatacccaacaatttatcacttacgatcagcattggctcaaccagacgcaccacaagcggacgtaagactaatctatttagcactacaccacatgatcaaattccgaggacacttcctcaacggagccgcggtcgaaaaatttcatggaggacaacttcatctagaatcagagttccaagaattaaaccaaatattcagtaaccagcaacgtgaccatgttcaacttcaaacatcttctctcgatgaagtagctacgattttaaaagataaccaaagaacaccaagcgaccgccaaagggaactctcagcacgactttttgtccctgttgataaaacgattgataaagaaaacaagaaacttgccaccgaattattgaaagcagtcctgggtctaaaagcaaaatttgacgtgatcttaggagtagaagctactgacccccaggcctttaaattgcagttcagtagcgatgactttgatgacaagatagctgaattagcatcggaattaacagatgaagctaatgaaatcctaacagtactccagcgattatacttcagtttaaacctagccgatatactaacaaaccgccaaaccaagcaagttgccgattcgatatctactgcaatgataaatagatatgatgatcacaagcaccatctaaagatgctgaaagaactagaagcacaagttacccaagaacaaagagacggacttaaaaaggcttacaatgaatatatagatggagacaaacctacgatagacaccttctataccaatgtaaagaaaaacctcgacgactctgaactcgcaaaccaaattaaatcattaatagacctacaagcattcatgcctaaacaaagaagtaaagaaaatggatcaataccacatcaactccatcaacgagaactagatcagttaatagaagtacaaggcaaatattatccgtggttactagcggcaaaagacaaactagatgcattaatcgcgttccgggtaccatattatgtcggccccatgattgatccaaatcaatcagatgatccccaaaacactaaattcgcatggatggtcagaaaagaagctggcgaaataacaccatggaacttcgaagaaaaagtagacaaaacatcttcagccaccaactttattaaacgaatgacaaccacagacacctacctactaggtgaacctgtcttaccgaaaaacagtctcctctaccaacaattcacagttttaaatgaactaaataaactcaaagtaaacggaaaagcattaacagttgatcagaagaaatacttgtacgaccacgtatgcaagaaacaaagaagggttactctaaagaaactatcagattgtctagtggcgcgaggtgacttccctatgggagctatattcacaggaacaacagatcagaaaaacatgaacaatactctaaaaacgtatcaagatttccaagaaatatttggagacgaaatagataatccagatcgtcaagttgattttgagaaaatgattgaatggtcaacaatctttgaagacagagaaatattcaaattaaaacttgccgaattaaattggttaacaagtgaacaattagaacgagtatcaaagaaaagataccaaggatggggaagactttcacaaaaactactaactcacattgtcaatgaaaacggagaaagaataatagaccaactgtggaacaccaaccaaaacttcatggaaataatgggccaagattcagtaaaacaagctatccaagaacataatggagccaatgtcgcacaaaccggtataaacgaaaccatagacgaactctacacaagcccacaaaacaagaaagctattaggcaaatactattagttgtagatgacattaagaaagcagtaggatacgcaccagcaaatataatgatggagttcgcacgtgaagaccgagacgaccaccgacttatagcaagtcgcgctagacaacttgagaaaacataccaagaaataagcaaaaattggttcgacaatgaatcagtaactcaagaactaaaagatcaaattaaaaataaaactaaattcactgatcgtctatacttatacttcattcaaggaggaatagatttatatactggacatccactcaacatagatcaattatcatcatacgatatagaccatatactaccacagtcattcttattagacaacagcttaaataatagagtccttacaagtcaagcagaaaaccgagttcacaaagaagacagattacccggagaaacagtagcaaataaaatgagacccacttggaaaatgatgcgtgaacaaggacttatgacccaaagaaaatacaataacttaacgctgaaacccgatcaaatatcaaaattcaacaaccgaggacaattcataaacagacaattggtggaaacaagacaagttattaaattagcagcagacatcatgtcacaaaaataccaagcagaccaaacaaaagtcgttacagtaaaagccaacttgacacatcatatgagagaaaaatttaatttttacaaatctagaaatgttaacgactaccatcatgcattcgacgcataccttaccctttttgttggcaactggctattaaaggagtacccaaaactacaaccgtactttgtttatggcgacttcgcaaaaacaggcacgaacaacttgaaatcatttaatttcttatatcgatttgagagagatcacaaactcaatgataaaggagctatagatactgacaaagaccaacaactaggatacatgaaacgcatatatcgatttaagaaaatgttagtaacaaaacaattagaaacaaacgaaggtgccctatatggacaaactctataccccgctcccaaaaatgacaagaaaacaagaaatcttatcaattctaagaaaaaccggccatcagacatatacggaggctactcaaacgaaaacggttcattcttaactctagtaaaactcaagaaaggaagtaaatacgactatagattagtagctgttcccgtaagtaaaatatcagaaattaaagaatcagaacttgccacaatcgaaaaagctatagcgccccaatttttgaaatcctcaggaaaatatagagacttccaagtagttctaagcaaaatactaataaatcaaaaagtcattgatgatggtatgatatttacaataggatcgaaatcttataaacacaatgcaaaacaagtagtcctatctgataacagtatacaaatcgtaagtacactctccagaatatcagacaaagaaaaactcataaccgttttcgacgaaatagtcgacataacatcaaaatatctaccttggtacaaagtaaacgacgtagagaaaacgaaaatgctattcaggcaaatgcaagacattgatgaaatgaagaaaataatcgacaattccttaataggattacattgcaatgccagcataactgatttaggaaaagttggactatcaaaatattggggtaggttcgtcctaacagcgggcatatccctaacagtagatgcgcaattaatataccaaagtccgaccggcctattcgaacatagagtaaaagtcagtgatttatga

SEQ ID NO: 8740 - RNA, 3990 nt, synthetic construct
  misc_feature 1..3990: note = Cas9 variant
  source 1..3990: mol_type = other RNA
atgaataaacaaccctataacataggactagacataggtaccagcagcgtaggatggtcagcaacagaactagataatcgccttctccatataaaaggccacaacggcattggcgtacgacttttcaaagaaggggaatcagccgcagatcgtcgaggattccgaacgacaaggaggagattagcaagaaggaaatggagacttagactcctaaatgaaatattcgcaaccgaaattgccaaagtagacccctccttcttcgcacgattaaaacaaagcaacgtaagcccgaaagaccccaacaaaaccatgttcggaaacatcctcttcgatgatgaaaacctcgacgatcaaaaattccaccacgattacaaaacaatttaccatctacgacaggcaataataaatcaccctgaacaaaaattcgacattagattaatatacttagcaatgcatcacataataaaatataggggccacttcctcaaccaagccaacgtacaagactttaaaggcggaaaaatagaccttgaaaaatcatttaaagcattaaacgacatattcgaaaaccagggaagagacctccgtctggtcactgacgaagcaaaccagtatgttaaagttctctcagacaacgcaaaaactcgaagtgacagaaaaaaggaactttcaaagttgctatacgtaccaatagacaaagatacggacaaaaattcaaaaaaagtcacaggagagatattaaaagcaatattgggaaataaagccaaatttgatgtcatctttggaatcgaagtagaaaatccgaaagaatgggtgcttaccttcaactcagacgatttcgatgacaaaatagaaggtttatcttctcaaatgacagatgaagacagcgaaatactactcatcttaaaagaattatattttgcactcaacttatcagacatattaaataattctgttaccgacaaaaatgcaaaaacactaagcgaagcaatgataaatagatacgacgaccacaagaaccaactagccatgttaaaaaaagtcatagattcatcagacaaaaaacacgctaaagaattaaaagaggcgtactcggcttacatagatggcgaaaacaacaaaaaaataagtttcgaagacttaaaaaagcgaatacaaaagaacctcgttgactctgaactaagtcaaaaaataaatgatcttctagatcacgattactttctccccaaacaaagatcaaaggaaaatggagccatacctcaccagctccaacaacaagaattagatcaaatcatcgagtctcaaaaacaatactaccccttcctcgctgagctaaacccaaacgaaaaaagatcccgtcaagcaaaatacaaattagacgaactcgttgctttccgcgtaagctattacgtaggaccaatggtcgaagttacagacagcaatcaggagaataatggtaaattcgcatggatgatcagaaaagaacaaggagaaatcacgccgtggaacttcgacgaaaaagtagacagaacagaaacagcaactaaattcataacgcgcatgacaacaaccgatacctacctaattggagaacctgtattacctaaaaattctttactatatcaaaaattcgtcgtattaaacgagttaaataatttaaagataaatcaagaaacaataactcccggacaaaaacaatacctctatgaacacgtaatgaaaaagaacaaaagagttacactaaaaaaaatcgcagacgccctagttataaaaggcgattatccatatgcccccgaagttaaaggtactacagatcaaaaaaaccttaataatgggttaacaacatacattgacttagccaaaattttcggaaatgagctagacgatgtagatagagaagcagatttcgaaaaaataatagagtggagtaccatattcgaagatcaacatatcttcgtcctcaaactccaagaactaaaatggttaaccgaaaagcaacgtaaccaagtcgtaaaactccgatatcagggatggggcaaactctcaaaggaattacttgccggtttagtagatgataatggtcaaagaataatcgacctactctggagcgacaaccaaaatttcatgcaaatcgtcaatcaaaaaagcttcaaggagagtatagccgaccacaacggtgcacatttagaagaaaaaaatttaaaagacgtcataaacgacctatatacctcaccacaaaataaaaaagcaatcagacaagtaatattagtcgtcgatgatataataaatgcagtaggctatgaaccagcaaacataatgatggaatttgcacgcgaagattcaaacgaccacagattaacaaacagcaggtcaagacaactcgaaaacgtatataaagatataacaaattcctggttcgacaacgattcagtaaaagatgaactagaagacaaaataaaaaataaagacaaatttacagacagattatacctctatttcacacaaggtggaaaggacctatacactggcgagccactaaatatagacgatctatcctcatatgatatagaccatatactaccgcaatcatttatactagacaactctctagacaatagagtactcacctcacaaagaaataatagagtttcaaaagaagaccaacttcctggcgaactattcggaacgaaaatgcatgccttctggaagagattaaaagctgctcaccttatctcgaacaaaaaatattacaatttaacactaacgccaaactcaatatcaaaatttaacaatcaaggaagattcattaacagacaactcgttgagacaagacaagtaatcaaactggctgcagaaatccttcacaacagatattcagaagagaaaggcactaacatagtcactataaaagcaaacctcacacatcacatgagagaaaaatttaatttttacaaaaatcgcaacgtgaacgactatcaccatgcttttgacgcatacttaacagcctttgtaggaaactggctattacaacaatatccgaaattaaaaccttattttgtatacggtgacttcgctaaaaccgaaatcaacaacctaaaatcctttaacatgttatataaattcgaacaggcgcaccaacttaacgaaaaagatgggaaaatcgcaaaagataccgacgcgctacttggttacatgaagaatgtataccattttaaaaagatgttagtaacaaaagaattagagactaaccatggagctctatttaaccaaaccctgtacccatcaccagcccacgatataaaaaaaagacagttaatcaaacctaaagacaatagaccaacagatatatacggaggatacactcacgaagagcgaaaatatatgtccttagtaaaagtaataggtaaaaaagacaatgaatatagaatggcaaatgtaccattactgaaaataaacaaaaacaatgacatcaaagaaatattaaagtctcaatttagtaataaaaaattcgaaatcgtccttcccaaagtattaaaaaatcaacttttctccgaaaatggcgcattattcgtaataggatcaaaaggctacaaatacaacgcgaaccaattagtactgtcagacttagatatgaagctactaaatgacctatcaaataacaaaagcattgacgaagtcaccataaaccaactctttaaaaatatagttgatagtacaaataaatatatgccactatatgaaatcaaaaacctaaatgaagtcgtagaaaaatttaataatcttgaatttaatgacaaaaaaaaaactataacagactttctattggccacacatgcaaatcctactatgtcaaacctaaaaaacataggactaccctatttcggcagattcataagaaacacgggtattaaactctcagaaaacgcaaacgtcatatatcaatcacccacaggcctattctcacgaaaaattaaaatatcggacttttga

SEQ ID NO: 8741 - RNA, 3993 nt, synthetic construct
  misc_feature 1..3993: note = Cas9 variant
  source 1..3993: mol_type = other RNA
atgaaaaatgactacacaataggattggatatcggaacaaactccgtaggctactcagttgtaacagacgattataaggtcatatcaaaaaaaatgaatgttttcggcaatacagaaaagaaatccataaagaaaaacttctggggcgtaagattattcgaatcaggacagacagcacaagaagctagaatgaaacgaacatcacgacgacgaatagctagaagaaaaaaccgtatatgctatctacaagaaatatttcaaccagaaatgaatcacctagacaacaacttcttctaccgactaaacgagtccttcctagtcgcagacgacgctaaatacgataaacatccaatttttggaacacttgatgaagagattcattttcatgaacaatttcccacaatctaccatttaagaaaatacctagccgacggcgatgaaaaagcggacctaaggcttgtatatcttgcaatagcgcacataattaaatttagaggaaacttcctaattgaaggtgaactaaatacagaaaacaatagtgtgattgaattatcgaaagtattcgttcaactatacaaccaaacactcagcgaattagaaggattccaattcatagacgaaagtattgacttcagcgaagtactaacacaacaattgagcaagtcagaaagagctgataacgtgttaaagttgtttccagacgaaaaaggaacaggaatattcgctcaatttattaaacttatagtaggaaatcaaggaaattttaaaaaggtgttccaactagaagaggatcagaaactacagctatccactgacgactacgaagaaaatattgaaaatttattagcgataattggagacgaatacggagacatcttcgtagctgctcaaaatctctaccaagcaatattgcttgcaggtatattaacttcaacagaaaaaacaagagcaaaactaagtgcatcaatgatacaaaggtatgaagaacatgcaaaagacctaaaacttttgaaacgatttgtaaaggaacatattcccgacaaatacgcggaaatttttaacgatgcaaccaaaaatgggtatgcaggatacatagacgggaaaacaaaagaagaagagttttataaatatctaaagacaactttagttcaaaaatccggataccaatattttatcgaaaaaatagaacaagaaaattttctcagaaagcagcgaatctacgacaatggagtcataccacaccaagtccatgctgaagaattaagagctatattaagaaagcaagaaaaatattatagctttttgaaagaaaatcatgaaaagatcgaacaaatttttaaagtacgtatcccatactacgtgggacccttagcgaaacacaacgaacaatcaagattcgcgtggaatatcaggaaatctgacgaacctataaggccctggaacatgaatgacgtagtggatgaaaatgcatccgccgtggcattcatagagcgcatgacaataaaagatatatacctaaatgaaaacgtactacctagacactcactaatttacgaaaaattcacagtattcaatgaactaactaaagtcctatacgcggacgatcgaggcgtattccaacgcttttcagctgaagaaaaagaagacattttcgagaaattattcaaaagcgaacgaaaagttacgaaaaaaaaattagagaattatctcagaatagaactttcaatatcttcaccatctgtaaaaggaatcgaagaacagttcaacgcaaactttggaacttatcttgacctaaaaaaatttgatgagctgcacccctacctggatgatgaaaaatatcaagataccttagaagaggtaataaaagttttaacagtcttcgaagatcgatcaatgatacaaaatcaactagaacaactaccgctaaatctctctacaaaaacaataaaagcattatcaagaagaaaatacaccgggtggggaaggttatcagcacgtttaatagacggaatacacgataaaaactcgggcaaaactatcttagactacctaatagaagatgaatccgatagttatatcgtaaatcgaaattttatgcagctaatcaacgacgatcacttatcttttaagaaaataatagaagattcgcaaccatataaagaacagcaatcggctgaagaaattgttagtgaactatccggctcacctgccataaaaaaaggtatccttcaatccctaaaaatagtagatgaacttgtagccatcatgggttataaacccaaaaatatagtagtcgaaatggcaagagaaaaccaaacaaccggacgaggcaaacaaaactcaaaaccgaggttaaaaggaattgaaaatggactaaaagaattcagtgactcagtattaaaaggtagctccattgacaataaacaactccaaaatgatagactgtatttatactatctacaaaatggaaaagatatgtacacgggacatgaattagacatcgatcatctaagcacctacgacatagatcatataattccacaatcatttctaacggacaacagcatagacaaccgagtccttacaacatccaaatcgaatagagggaaaagcgataacgtaccatcagaagaagtagtaagaaaaatggatagattctggagaaaacttctaaacgccaaactaataagcgaaagaaaatacacaaatctcactaaaaaagaactaacagaatccgataaagccggatttctaaaaagacaactggtagaaacaagacaaattacaaaacacgtagcaacaatattagatagcaaattcaacgaagattcaaacaatagagacgtacaaataataaccctaaaatctgcattagtttccgaatttcggaaaacatttaatttatacaaagtacgggaaataaacgatctacaccatgcccacgatgcatacctcaacgcagtagtggcactttctttattacgggtatatcctcagcttaaaccagaatttgtatatggggaatatggaaagaacagtatacatgatcaaaataaagcaacgataaaaaaacagttctattcaaacataacaaggtactttgcaagcaaagactacatcataaacgatgacggagaaatattgtggaacaaacaagaaaccatagcacaggttataaaaactttaggaatgcaccaagttaatgtggttaaaaaagtagaaatacaaaagggcggctttagtaaagaatcaatacaaccaaaaggagaatcacaaaaactaatacgaaggaaacaacaatggaatacaaaaaaatatggaggatttgactcgccagtagtagcgtacgcaattttattgtcgtttgacaaaggcaagcgaaaagctagatcattcaaaatagtgggcataactatacaagatagagagtcattcgaaggaaacccgatactatacctatcaaaaaaagactatcacaatccaaaagtagaggcaatactacctaaatactcactattcgaattcgaaaacggaaggagaagaatggtagcgagcgcctcagaaacacaaaaaggaaaccaattaattataccaggacatcttatggaattattatatcactcaaaaaaaatcataaatggaaaaaactcagactccgtatcctacatccaaaacaataaagaaaaatttcgagagatttttgaatacatcgtagacttcagttccaaatatatatcggcagacgccaatctcaacaaaatagaaaaaatattcgagaacaacttccacaaagcttctgaacaagaaatagcaaaatcattcataaatctactaacattcacagcaatgggagcaccagcagacttcgaattcttcggagaaaaaatccctcgtaaaagatacgtcagcatttctgaaataatagacgctgtatttatccaccaaagcataacaggattatatgaaacccgagtccgtttaacagaagtctga

SEQ ID NO: 8742 - RNA, 3993 nt, synthetic construct
  misc_feature 1..3993: note = Cas9 variant
  source 1..3993: mol_type = other RNA
atggaaaaggaatacacaataggtttagatatcggcaccaacagtgttgggtgggcagtactaaccgacgattatcgattagtagctcgaaaaatgtccatacaaggcgactctaatagaaaaaaaatcaaaaaaaatttttggggagccagactgtttgaagaaggaaagaccgcacaatttcgcagaatcaaaagaacaaatcgcaggagaatagcacgcaggagacaaagagtacttgccctacaagatatattcgcagaagaaattcacaaaaaagacccaaatttttttgctagattagaagaaggggatcgcgtagaagctgataaaagattcgcaaaatttcctgtattcgctacactgtccgaagaaaaaaattatcatcgacaatacccaaccatataccatctccggcatgacctagccaactcgaaagagcaagcagatataagattggtctaccttgccatagcacattgcctcaaatacagagggcactttttatttgagggagaacttgatacagaaaatacatctgttacagaaaattatcaacaattcctacaggcataccagcaattcttccctgagccaataggagacctagatgatgccgttccaattttgaccgaaagactcagtaaagcaaaacgagtcgaaaaagtccttgcttactatccctcagaaaaatcaacaggaaatttcgcacaatttctaaagttaatggtaggcaaccaagcaaacttcaaaaaaacatttgacctagaagaagaaatgaaactaaactttaccagagactgttatgaagaagatttgaatgaattactagaaaaaacaagcgatgattacgccgaactatttcttaaggctaagggggtatacgatgctattttactatctcagattctatcaaaaagtgatgacgaaacaaaagctaaattaagcgctaacatgaaattgcgctttgaagaacaccaaagagatcttaagcagctcaaagaattagtaagaagagacctaccgaaaaaatacgatgacttcttcaaaaaccggtcaaaaaatggctacgcaggctacgtcaaaggaaaagcaacacaagaagacttctataaattcctaagaactgagttagcaggactagaagaatcacaaagcatcatggaaaaaattgatttagagatctacctactaaaacaacgaacatttgctaatggagtcattcctcaccaaatacacttggtagaaatgcgcgaaataatggacagacaaaaacgtttttatccattcctaaaaggagcacaaggaaaaattgaaaaactactcacatttagaataccctactacgtcggacctctcgcacaagaaggccaaagtccatttgcatggataaagcgaaagagcccctcccaaattactccctggaatttcgcagaagtagtcgacaaagagaattcagccatcgaattcatagaacgaatgacaaaccaagatacctatcttccaaaagaaaaagtattacccaaacaatccttaatatatcaacgattcatgatttttaacgaattaactaaagtctcctacactgatgaacgaggaaaatcacactatttcagtagtgaacaaaaaaggaaaatatttaatgaactatttaaacaacatccacgagtgacagaaaaacaattaagaaaattcctagaattaaacgaacaaatagacagtacagaaataaaaggaatagaaacatcgttcaacgcatcatacagcacttaccacgacttattgaaactgagtgaccaaatggacactttattagatgacccagatatgaccacaatgttcgaagaaattataaaaatattaacaatattcgaagaccgcgaaatgatacgcgagcaactgaaaccatacgaaaccgtcctaggattacccgccattaaaaaattagcaaaaaaacattacacaggatggggaagactctcagaaaaaatgatacaaggaatgagagaaaaacaatcacgtaaaaccattctagattatttaatcgacgatgacgatttcccttgcaatcgcaatagaaatttcatgcaattaattaatgacgatcatctttctttcaaggaaacaatagcaaacgaactaataatgtcagactccaacgtattactagaccaagtaaaagcaataccaggttcgccggcagtaaaaaaaggaatatggcagtcaataaaaatagtagaggaaataataggcatcataggcaaagcacccaaaaatatagtaatcgagatggccagagagaaccagagaaccagccgatcacgacccagattaaaagcattagaagaagctttaaaaaatatagattcacccctattaaaagattacccaacagacaatcaagctttacaaaaagataggttatacctctactacctacaaaacggtaaagatatgtacacaggagaacctctagaaatacatagactttcagaatacgacatcgatcacatcataccacgatcctttatagtagacaacagcctagataataaggtactagtaagctccaaagtaaacaggggcaagctcgacaatgcacccgatccattggtagttaaacgaatgagaagccactgggaaaaattacatcaagcaaaactaataagcgacaaaaaattagcgaatctaacaaagcaaaacctaaccgaagcggacaaagctagattcatccaacgacaacttgtagagacccgacaaataaccaagcatgtcgcaaacttgctccatcaacacttcaacctgccagaagaggtttccgcaacagaaaaaacatcaattattacactaaagtcgactttaacgagtcaattccgacaaatgttcgatatatacaaagttcgggaaattaatcaccaccaccacgcacatgacgcttacttaaacggcgttgtcgccatgacgctactcaaaaaataccccaaactagcaccagaattcgtttacggctcatacataaaaggtgatataaatcagataaacaaagcgacagccaaaaaagaattttactcaaacataatgaaattcttcgaaagtgaagaaattatatgtgacgaacaaggagaggtaatatggaacaaaaaacgcgacttaagtaccatcaaaaagacaataggagcacaccaagtcaacatagtaaaaaaagtagaaaagcagaaaggtggattctataaggaaactataaacagtaaggcaaacccagaaaagctaataccccgcaaagccagcctagatcctctaaaatatggtggatacggaagcccactagtagcttataccgtaatatttatattcgagaaaggcaaacaaaaaaaagtaacaaaaggaatagagggaataacagtaatggaacaacttagatttgagcaggaccccagagaatttttaaaaacaaaagggtatgaaggagtcaaacaatggctcatcctacccaaatatattttatttgaagcacaaggcgggtacagaaggatgatagcatcacaccaagaaactcagaaagctaacagtctaatcctaccagaaaacctagtaacattattataccatgcccgacattacgatgaaattaaccataaagtaagctttgactatgtcaacgcacacaaagagggattcaatgacatattcgacttcataagtgactttggagtaagatatatcctagcaccgcaacacttggaaaaaataaaggttgcatatgaaaaaaataaagaagttgacctaaaagagatgatcgatgcaattttaagcctactaaaatttacactattcggagcttcggtagaatttaagttttttgatataaaaatactgaaaaggtataaatcattaacagatatatgggaagcaacaataatctaccaatcagtaacaggactatacgaaagaagagtagaagtaagaaagttgtgggatggagaaagactatga

SEQ ID NO: 8743 - RNA, 3996 nt, synthetic construct
  misc_feature 1..3996: note = Cas9 variant
  source 1..3996: mol_type = other RNA
atgaacaaacagccatacaacatcggcctagatataggaacctcaagcgtcggctggtcagcaacagaactagacaatcgactattacacataaaaggccataatggcattggtgtaaggctattcaaagaaggagagtccgccgcagaccgcaggggtttccgaacaacacgaagacgactagctaggagaaagtggcgattacgattattgaacgaaatattcgcaacagaaatagctaaagttgatccatcattttttgcaagactcaaacaatctaacgtgtcaccgaaagaccctaataaaactatgttcgaaaacattttgtttgatgatgaaaaccttgacgatcaaaaattccaccacgactataaaaccatataccacctaagacaagctataataaaccaccccgaacaaaaattcgatatacggttaatttacttagccatgcaccatataataaaatatcggggacactttctaaatcaagcaaatgtacaagacttcaaaggaggaaaaatagatttagaaaaaagttttaaagcgcttaacgacatatttgaaaaccaaggtcgagatttaaggctagtaacagacaaagccaaccaatatgtaaaagtcctatccgacaacgctaagacaagatcagacaggaaaaaagagctatctaaactgttatacgtcccaatagacaaagatacagacaaaaacagtaaaaaggttaccggtgaaatattaaaagcgatattaggaaacaaagcaaaatttgacgtgatattcggaatagaagtggaaaatccaaaggaatgggtcttaactttcaattcagatgatttcgatgacaaaattgaaggacttagcagtcaaatgactgatgaagacagtgaaatacttttaattctaaaagaattatattttgctctaaatttatcagacatcttaaacaacagcgttactgataaaaatgctaaaacactaagtgaagcaatgatcaatcgatatgatgaccacaaaaaccaattagcaatgctaaaaaaagtgatcgactcatcggacaaaaaacacgcaaaagaactaaaagaggcttactctgcctacatcgacggagaaaacaacaaaaaaatttcctttgaagaccttaaaaagcgaatacaaaaaaacttagtagattcagaactttcccaaaaaatcaatgacttactagatcacgactacttcctcccgaaacaacgatccaaagaaaacggagcgataccccaccaactacaacaacaagaattagaccagataatagaatcccaaaagcaatactacccatttttagcagaattaaaccctaacgaaaaaagatcaagacaagcaaaatacaaactggatgaactagtagcattccgagtaccttactatgtggggccaatggtagaagttacagacagtaatcaagaaaacaatggtaaatttgcatggatgataaggaaagaacaaggagagattaccccatggaactttgacgaaaaagttgaccgaaccgaaactgcaacaaaattcataacacgcatgactacaactgatacatatctcataggagagcctgtactaccaaaaaacagtctattataccaaaaattcgtagtattaaacgaactaaataatctaaaaataaaccaagaaataataacaccaggtcaaaaacaatacctttacgaacatgtaatgaaaaaaaacaaaagagtaactttgaaaaaaatagcagacgcattagtaattaagggagactacccatatgcaccagaggtaaaaggaactacagaccagaaaaacttaaacaacggcctgaccacctacattgatctagcaaaaatatttggaaacgaactcgacgacgtagatcgcgaggcagattttgaaaaaatcatagaatggtctactatattcgaagaccaacacatattcgctctaaagctacaggaactcaagtggctaaccgaaaaacaacgtaaccaagtagttaaattaagatatcagggatggggtaaactatcaaaagagctcctagcaggtctagttgatgacaacggccaacggatcatagatctcttatggtcagacaaccaaaactttatgcagatcgtcaatcaaaaatcattcaaggaaagcatagccgatcacaacggcgcacatttagaagaaaaaaacttaaaagatgtaataaacgacctatacacgagtcctcaaaacaaaaaggcaatacgacaggtcatactcgttgtagatgatataataaatgcagtaggatacgaacccgccaatataatgatggaatttgctagagaagattccaatgaccaccgattaaccaattcaagatcaagacaactagaaaatgtttataaagacatcacaaatagctggtttgataacgactcagtaaaagatgaattagaagacaaaattaaaaataaagacaaatttaccgaccgcctttacttatacttcacacaaggaggtaaagatctatatactggagaaccactcaacatcgacgatctttcgagttacgatatcgaccatatactaccacagtcattcatcttagataactcccttgacaaccgagtattaacaagccaaaggaacaatagagtttccaaagaagatcaactaccaggcgaactcttcggtacaaaaatgcatgcattttggaaacgcttaaaagcagcccatctcattagtaataagaaatattataatttaacattaacaccaaattccataagtaaatttaacaaccagggaagattcatcaacagacaactagtggaaacacgccaagtaataaaattagccgcagaaatattacacaaccgatactcggaagaaaaaggaactaacatagtcaccataaaagccaacctaactcaccacatgagagagaaattcaacttttataaaaacagaaatgtaaacgattaccaccacgcatttgacgcttacctaaccgccttcgtcgggaactggcttttgcagcaatacccaaaactcaaaccatacttcgtttacggtgacttcgccaaaacagaaattaataacttaaaatcattcaatatgctatataaattcgaacaagctcaccaactcaatgaaaaagatggaaaaatagcaaaagatgctgatgccctgttaggatacatgaaaaacgtctatcatttcaagaaaatgctcgtaactaaaaaactagaaacaaaccatggagcgctttttaaacaaacgctatatccatcacctgcacacgacataaaaaaaagacaattaataaagcccaaagataatagacccacagatatatacggaggttatacacatgaagaaaggaaatacatgtcattggtcaaagttataggaaaaaaagataacgagtaccgtatggcaaatgtaccgctgctaaaaataaacaaaaataatgatataaaagaaatcctgaaatcccaattcagcaataaaaaatttgaaatagtattaccaaaagtactaaaaaatcaattattctcagaaaacggagccttattcgtaatcggttcaaaaggttacaaatacaatgcaaatcagttagtactatcagacttagacatgaaactactaaatgatctatcaaataacaaaagtatcgatgaagttacaatcaatcaattatttaaaaatatagtagatagtactaataaatatatgccgctatatgaaatcaaaaacctcaatgaagtagtagaaaaattcaacaacctagaattcaacgacaaaaaaaaaacgataactgacttcctattagccacacacgctaatcctacaatgtcaaatctcaagaatattggccttccgtcttatttcgggaggttcacatctggcaacgccggaatcaaattaagtgaaaacgctaatgtaatctatcaatccccaacaggtttattctccagaaaggtaaaaatcagtgatttttga

SEQ ID NO: 8744 - RNA, 3999 nt, synthetic construct
  misc_feature 1..3999: note = Cas9 variant
  source 1..3999: mol_type = other RNA
atgaaaaacagagaaaatataaaatattacataggagtagatataggtaccaactcagtgggatgggcagtaatcgacgagaatggtaacctactaaaaaaaggaaaacatcacttgtggggaagccgattgtttgatcaagctcaaacagcccaaaacagaaggaattatagatcatcaagacgacgatacaataaacgacgtcaacgaattggcctactaagattaataatgtctgatatggttctggaagtagatccaagctttttcataagattagagaaaaccaccttcctagacaaggaggacaaaaaagcgatactgaaagataattacaaaatgaattacaacctcttttgcgatgaagattataacgacaagaaatattttaaagattacccaactatatatcaccttagaaaaaaattatgcgaatcagacgaaaaagcagatccaagattaatttacttagctctccatcacatagtaaaataccgtggaaacttcctatacgaaggacaagaactacacctagaaccgtcaaataaagaagaagatttaaagattttattcgacatacttggaaaaaataatgacactgtctacgatatttctgaagaacaaatacaattcatccttaagaccgtagtcgagaatatatcaaaaacggcaaaagtcgacgaatgtatgtcacaactaaaactcaattctgaagacaaaaaaattgtaaaagaattcatgcggggcttagtaggaaacaaattcaacgtatcaaaactatacatgcacgaggacttacaattcgacgacgaagatttaaaattacaattttcagacaaatcatatgaagaaaaaataactgagtacgagaacgtactcgaggaaaaaatggaattcatcgacttaatgcaaagattctacagttggatagaattaagcaaaatagtaggaagcgattcccaacacgcatccatatcaggcgcaatggtaaacatttacgaaagtcatcgtgaagacctaagaacgctgaaagaagtaatgctaaaaatcggcaaaaaagagtacgacgaaatgttcaaaccgacttccaaaaacgtagtaaactactataattacgtaaacccagtagcatgctcaggtgataaaaccgatggattttataagtatgttaagaaagcgatcgagaaatctgacgattccagaaaagacgaaatactacaaaaaatagcaaacgagacgtacatgctaaaacaaacaagtaaaaacaatgcgtacataccataccaaatgcaaaaggatgaactaattaaaatactagaccatcaagaaaaatactatccagtattaaaagaaaacagagataaaataattagtatactagaattccggatcccctactattacggaccgctagacggtaacaaacaattcggatggttaataaaaaaaaaaggtaaagaaaatgaacgaattttgccatggaatcatcaagaaatagttgatgtacaggaaacagcagcacaattcataaaaaaactaacaaattactgcacatatttaccaatagaaaaagtaatgccacaaaagagtctaacttgtagcatgtacgaagtactatcagaagttaacaaaatacgaatagatggtaaactattaccaattgacacaaaaaatcgactaattgaagatctattttttaagcgtaaaacagtcaaggagaaagacctaataaactggttaaaacagaaccagctaacggtcggagaaataactggatatcaaaaagaaaaagccttcagcagtagcctcgcaccatggatagatttcaaagagatattcgacgaaataaacgatagtaattatgacttaatagaaaaaataatagaagacatgacaatatttaatgaaggctctattttaaaagaacgtttaaaaaaagcatacaacctagaccaaaataaagttaaaaaaataatgaaactaaaatactcaggatggagtagactaagcaagaaactcattaatgggatcagagcagacaacaaattcgggtcttccgtatcaattcttgacgtaatgaaagaaagccacatggcgctaatggaaatcattaacgaccaagatctgggtttcaaacaaattatagaaaaagaaaatttcaaaaatgaaacaggatcgtttgaatatgaagatatagaaaacttagcaggaagccccgctctgaaaagaggtatctggcaaacactacaagtcatagaagaaataaaaaactatatgggacacgaaccaaaaaatatttatattgaatttgcaagggaagaacaagaaaaggtaagaacaacaacaagagtcaaaaaattgaagtccatctataacgatataaagaaccaattagacgtacacggtaaagaagtctattcaaacttaaataaacaagacgaaaaatccagcatagaaaaacggctatacctatattacactcaactcggaaaatgcatgtatagtggcgaaagtctcgacatagacaaactatcaaactatgaaattgaccacatattccccagaacactcacaagtgacgactcattagacaacctagtgctcgtaaaaaaaaaagaaaaccaacgtaaactagacgatcttgttctacctttagaaataagaaacaaaatggaagttttctggaaaaaattgtatgacaacggactaataacacagactaagtattacagattaatgagggatgaattcagaagagaccaaatagataagtttataaacagacaattggtagagacaagacaaataataaagcacgtagcgaacataattgaaaaccactatgaggatactaaagtatttactgtaagagccaatttatcacatgaatttcgagaaaaatatgggatttacaaaaatcgtaatgttaatgacttccatcatgcacacgacgcctacatagcttgtataataggacgatatatccaaatacgatttccaggactagaagcgaagtatgtatatggccaatatatgcaaaacgtaaagaaaacaaaaaacaatatagataaagaaaaccacggattcataatcaattccatgaaatacgaatgcattgatgaagatacaggcgaagtcatttggaacccagaaaggatacttgattatataaagtgcttcaactatcgagacgtttatataaccaagaaactcgacacaaataatagggaactattcaacgtaaccattctgccaaacgacaaaaatagtgaaaaaggcaaaacaaaggctacaataccagtgaataagttaaggtctaatgtacgaaaatatggaggattcagcggtttacaaagcgatatcgtagcaatagaaggaaaaaaaggtaaaaaaatagaccgaagactaatcaacttgcccatactactaagatacgtaagtattgaagaccaatgcaaatatataatggaaaataataaatacagtgatgtaaagataataaagaaaataaaaaaaaaccaactcattgaaatagatggaatatgctactacctcaaaagtgcagatgaactagatacagcttatcaattaatactatccagagacgataacgaaatgatttaccgaatagatagagcaatacaaaacaatgattttagttatttcgataataaaaaagaaaacatagacgaattatatcgcctaatatgccacaaaatgatcgaaaattatccaaagtacaaaaaaaaagtctacgaatttataaaagaacgggaagaagaattctttgaattagataacagccagaaatgcattgtaatattcgaaatgattagagtcatgaaaaggggcgaacaatacattaacataccattcgaaccatacaatctaaaaaatgatagaaaagggagattaaactgtcaaagcatattgctagacaacacatacttttacgatgtaagtataactggaatatactcaaaaaagtacaaattatga

SEQ ID NO: 8745 - RNA, 3999 nt, synthetic construct
  misc_feature 1..3999: note = Cas9 variant
  source 1..3999: mol_type = other RNA
atgcaaaagaactacacgatcggactagatattggaacaaactcagttggttgggccgttatgaaagacgattacacattaataagaaagcgcatgaaagtattaggaaacacagacattaaaaagataaagaaaaatttctggggtgtaaggctattcgacgaaggagaaacagctaaagaaaccaggcttaaaaggggaacaagacgaagataccaacgacgaagaaacagattaatatacttacaagatatatttcaacaacccatgctagcaatagacgaaaatttctttcatcgattagacgactcgttctttgtaccagatgataaatcctacgatagacatccaatattcggtagcctagaagaagaagtagcgtaccataacacgtatccaacgatctatcatctaagaaaacacttagcagacaatcctgaaaaagcggacctacgattagtatatacggccctagcacacatagtaaaataccgtggacacttcctaatagagggagaactaaataccgagaacacaagcatatccgaaacatttgaacaatttctagatacatatagcgacatatttaaagaacaacttgtaggggacatatcaaaagtagaagaaatactatcaagtaaacaaagtcgatcaagaaagcatgaacaaataatggctttattcccaaatgaaaataaactcggaaatttcggaagattcatgatgcttatagtaggaaatacctctaattttaaacctgtattcgatttagatgacgagtataagctaaaactaagtgacgagacatatgaagaagacctcgatactttattaggaatgacagatgatgtattcctggacgttttcatggctgctaaaaatgtatacgacgcagtagaaatgtcagcaattatatccaccgacacaggtaatagtaaagctgtattaagtaatcaaatgataaatttctacgacgaacataaagtagacttagctcagttaaaacaattctttaagacacatctgccagacaaatactacgaatgtttctctgatccaagtaaaaacggttacgccgggtacatcgacggaaaaacaaaccaagaagatttttacaaatacatcgaaaaagttatgaagactatcaaatcagacaagaaagattactttttagataaaatcgacagagaagtattcctccggaaacaacgtagcttctacaattcagtaataccccaccaaatccacttacaggagatgcaagctatcttagaccgtcagagccaatactatccattcctagctgaaaatagagacaaaatagaaagcctggtaacatttcgtataccatattacgtaggacctttaactgtctcagatcaatcagaatttgcgtggatggaacgccaatcagacgaacccataagaccgtggaacttcgatgaaatagtaaacaaagaaaggtcagctgaaaaattcatagaaagaatgacaaatatggatacttatctccttgaagagaaagtgttacctaaaagaagtttactctaccaaaccttcgaagtctacaacgaactaacaaaagtaagatacacaaatgaacaaggtaaaacagaaaaattaaaccgtcaacaaaaagcagaaattattgaaaccttgtttaaacagaaaaacagagtacgggaaaaagatatcgctaactacctggaacaatatggatatgtcgacggaaccgatattaaaggtgttgaagacaaatttaacgcatcactatctacctataatgatctagctaaaatagacggagcaaaagcatatctggatgacccagaatatgcagatgtctgggaagacataatcaaaatactaactatctttgaagacaaagctatgcgcaagaaacaactgcaaacatactcagacacactatcaccagagatacttaagaaacttgaaagaaaacattacacaggctggggaagattttcaaagaaactaataaacggactcagagatgaaggatccaacaaaactatacttgattatttaaaaagtgatgaaggatctagtggccctacaaacaggaacttcatgcaactcatacgtgataataccctctcctttaaaaagaaaatagaagacgcacaaactatagaggacacgacccacatatacgatactgtagcagaattaccaggatctcccgcaataaagaaaggcataagacaagcacttaaaatagtagaagagataatagatattattggatacgaaccagaaaatatagtagtagaaatggctagagaaagtcaaactacaaagaaaggaaaagatctttcgaaagagagattagaaaaattaactgaggccataaaagaatttgacggaccatcagacgtgaaagtcaaagatcttaaaaatgagaatctccgcaacgaccgattgtacctatattacctacagaatggaagagacatgtacacaaacgaacccctagacataaataatctaagcaaatacgacatagaccacatcataccacaatctttcactacagataacagtatagacaacaaagttttagtaagcagaacgaaaaatcaaggaaacaaatccgatgatgtgccgtcaataaacatagtacataaaatgaaaccattctggagacaactacacaaagcgggtcttatatcagatagaaaattcaaaaacttgaccaaagccgaacacggcggcttaaccgaagccgaccgggcgcatttcctaaataggcaattagtagaaaccagacaaataactaaacacgttgctaacttactagattcacaatacaacacggcagaagaacaaagaataaacatcgtattactaaaaagctccatgactagcagattcagaaaagaatttaaattatacaaagtcagagaaatcaacgattaccatcacggacacgacgcatacctaaacgccgttgtagcgactacaataatgaaagtatatccaaatttaaaaccgcaatttgtatatggacaatataagaaaacgtcaatgttcaaagaagaaaaagcaacagccagaaaacatttttattcaaacattacaaaattctttaagaaagaaaaagttgtaaacgaagaaaccggcgaaatcttatgggataccgaaaggcatttatcgacaataaaaagagtcctctcttggaaacaaatgaatatagtgaagaaagtagagaaacagaaaggtcaactttggaaagaaacaatctaccccaaaggagacagcagtaaactaatccctgttaaagaaggaatggacccacaaaaatatggtggcctctcccaagtaagcgaagccttcgctgttgtcataacccacgaaaaaggtaaaaagaaacaacttaaatctgatttaataagcataccaattgtggatcaaaaagcatatgagcaacacccaaccgcctacctcgaagaagcaggatacaataaccctactgtattacacgaactcttcaaatatcaactatttgaactagaagatggaagccgtcgaatgatcgcgtccgctaaagagttccaaaaaggaaatcaaatggtactcccactagaactggtagaattactttaccatgctaaccgatatgataaagtaaaattcccagattctatagaatacgttcatgataacttagccaaattcgatgacctcctagaatacgtaatagactttagcaacaaatatataaatgcagataaaaacgtccagaaaatccagaaaatatataaggaacacggaacagaagatgtcgaactaaccgtagaaagtttcgtaaacctaatgactttcacagctatgggagctccagcaacgtttaaattctatggcgagtcaataacaagatcaagatataccagcatcacagagttcagaggttcaaccttaatatttcaatccataaccggcctatacgaaacaagatataaactagaagacaactga

SEQ ID NO: 8746 - RNA, 3999 nt, synthetic construct
  misc_feature 1..3999: note = Cas9 variant
  source 1..3999: mol_type = other RNA
atgatgaaagaatattcaataggtctagacataggttcatcatcagtcggattcgttgcagtagatgaccaataccgagtagtacgagctaaaggtaaaaatgtaatcggaacaagactatttgatgaaggaaaaacagcagcagaccgtagaggattgagaaccacgcgaagacgacttagtcgaagaaaatggcgattgagattattacgaggaatcttcgaaccacacataaacgaaatagatgaaagtttctttatgcggcttaaagaatcgaacataagccccaaagattcaaacaagcactttcctggtgatatactattcaatgatagatcagaccgcgagttctatgaaaattacccaactatataccatctgcggcaagcattaaaaacagaaaaacgccaattcgacatacgagaaatctatttagccatgcaccacattgttaaataccgaggccactttctagaaggaggaacagtaacagactttgaagtaggagaattagatctagctgggaaattctcaagactaaacgaacttttcgaatcgataaatctagaagtaccgttcgtattacgcctagacaatctagaagatgtaaaagcagttctcattgattcacaaagatcagcacaggacagacaacgaacacttacccctgatatttacgttccaagtaccgacaaaatcacagagaaaagattcaaaggtattgcaacagaattattaaaggcaatagttggaaacaaggcaaaatttgatgtactagctggcttagaactggataaagaagaagcaaaactctgggcacttactttcgattccgaaacctttgacgaagatatcgaacaactggaaggagacatgacagaagcaacacaggatctgattgaaatacttaaaagtctgagaagtctaattcgattagcagtcaatatgcccgaaggagtatcacttagcgaaatgatgattcaaagatacgaagatcatgcggaccatttaaaattattaagagacataattcataacacagatgcagaaaaggccgccggcttacaagcagcatatgacggatatatagatggagtcaaaggtaaaaagacaccagtagatgatttttataaagcaatcaagaaaaatctagacgactcagaagcagcccaccaaatcttagctttaatagataaaaacgagttcatgcctaaacaaaggagtaagtcaaatggatggattccacaccaaatacaacagaaagaactagacagaataatagaaaatcaaaaacaatattatccttggttggccgacgttaacccaaatgaatctcgacgaaaggtagccccatataaaattgatgaattagttacgttcagagtgccatactacgtaggaccattggtcacatcagaagaacaaaagaaatacggaagtaaattcgcttggatggtccgcaaagaagaaaaaggagaaataacaccatggaactttgaccaaaaagtagatagggccgcctcagcgacagaatttattaacagaatgacaaccatggacacttatcttttaaacgaagacgtactaccagcacattcattaatatatcaaaaatacgaagtccttaatgaactaaacaaagtcaaaataaatggcgacgcgataacccccgaacttaaacagaaaatatatcatgatttattcgaaaaacaaacaacagtatccatcaaaaatttacaaacatatttagtaagtgaatcagaagcgtcagaagttcctgaaattaaaggacttgcagatgaaaagaaattcctttcaggattaactacatatcatgacctcatgaaaatattcgacaggaacgtagtaaacgatcctgaaagagccgaagacttcgagaaaattataagatggagcacggtctttgaagataaacacatatatagagaaaaactcgacagcttatcatggctaacaacagatcaaaaagaccggttagctgtaaaacgatatagaggatggggacgactatctgaaaaactattaataggactaagagacgaaggacacagatccataatggactatctatgggaaacaacaagcaatttcatgcaaatacaagcacaaaacgactttagcgagaaaatcgcagcagaaaacaaagaatttttggacaatacacaatctgttcagggaattattaacgaactatataccagtccacaaaacaagaaagcaataagacaaacactactggtggtagaagatatcaaaaaggcgttccacggagaagcccctaagagaatatttgttgagttcgcaagagaaaatgaaagtactccccaaaggagtatacaaagacaaagacaagtcgagaatgcctacgaaaaagtgactcaaaacttattagtagacgacaagattagagcagaactaaaggattcaattaacgaaaagagattatttcatgaccgtctgttcctgtacttcatgcaaggaggtattgacatgtacagcggcaaaaagatcaacattgataacctttcagcgtatgacatagaccacatactaccccaatctttcaccgtagacaattctcttgataacagagtcttaacaaaccaaaaagataatagagaaaaaggaaacagcttaccttcagaactctatcgtggcagtatgaaagaaacttgggaaatgatgcggaaccaaggattgcttagcaaaggaaaattccatagattaatgatgactccaaactcgatgactgcttatgatcaacaaggtttcataaatagacagttagtagaaacaagacaagttataaaactggcagtagaaatattagccagcgaatttgatcaagctgatgaaaaagttgaaattgttagcgtaaaagctggtttgacacatcagatgcggcaagatttctcattaatcaagaatagagatgtcaacgactatcatcatgcatttgacgcataccttacggcgtttgtaggaacttaccttttaaaaagatatccaaaactgcgaccatacttcgtctacggcgaatttaagaaattctcacaaaaacaagcaaatctaacaaattttaactttttatgggcacttaaacacaaagaccaagtagctgtggaagatacaggcgaaaagatatggaataaaccacaagatctagcatacattagacacctttttgcatttaagaaaatcttgatttccagagaagtaagcgaaagacatggtgcattatttgatcaaacgttatataaagcgtcagacgacaaagcaagtggtcaaggttcaaagaaactaattccagcaaaagataacagaccgactgaactatatggaggttacagtggacaaacaagtgctttcatggctatagtaaaagtaaccaaaggaaagaaaactaaataccttgtcgttggtgtaccaacagctgccatatctcaattacaaggaatggacgtaaaaagtagtcaatacacagagaaaatatacaacatattatctccaaaactgctctctaaaaatgacgattttgaagtcatcgtcccaaaagtaagatataggcaattaatacttgataataatcagctatttacactcggtagcgacacttataaatacaacgcccgccaattagtcctatcgaatgaggttctagctgtaattaacagagataaatcatttatcgacaagaaactgtcagaagaagcagaaaatcaagcgttaaacgatgcattcgatgaaattgtcgtggcaatggataaacacttcgacctgtacgacaaaaacggtttcagggagaaagttaaagcaggcaaacaaagattcgaagaactaccagtttccctattctcagaagataaagagaatgaaggaataacaaaacgcacagtattaaaaaggattctgcaaggtctccacgcaaacgcaacaacaagcgacttaaaagtactagatggaaaattctataactga

SEQ ID NO: 8747 - RNA, 4002 nt, synthetic construct
  misc_feature 1..4002: note = Cas9 variant
  source 1..4002: mol_type = other RNA
atgaaaaactacacaataggattagacatcggggtagcatcagttggatgggtatgtatagacgaaaactataaaatattaaattataataaccgacacgcatttggggtgcacgagttcgaaagcgcagaatccgcagctggtagaagactaaaaagagggatgcgaagaagatacaataggcgaaagaaacgtctgcaactactacagagcttattcgacagttacataacagattctggattcttttctaaaacggattcacaacacttttggaaaaataataacgaatttgaaaatagatcattaacagaagtgctatcttcattaagaatatcttccaggaaataccctaccatatatcacctccggagcgaccttatagagtcaaataagaaaatggatctcagattagtctatcttgcactacataacctagtaaaatacagaggtcatttcttacaagaaggtaattggtcagaagctgcaagtgctgaaggtatggacgaccaactacttgagctagtaactcgatacgccgaactagaaaacctttctcccctcgatttaagtgaaagccaatggaaagctgcggaaactttattattaaatagaaaccttacaaaaaccgaccaatccaaagaattaacggccatgttcggaaaagaatatgaaccattctgtaaattagtggcaggacttggggtcagcttacatcaactatttcctagctctgaacaagcactagcatacaaagaaactaaaacgaaagtacaactttctaatgaaaacgttgaagaagtaatggaattgctactagaagaagaatccgcacttctagaggcagtccaaccattctatcaacaagtggttttatacgaattactaaaaggtgaaacatacgtcgcaaaagccaaagtatccgcattcaaacaatatcaaaaagatatggcatcacttaaaaatctactagataaaacattcggagaaaaagtctataggtcatatttcattagcgataaaaatagccaacgagaatatcagaaatcccacaaagtcgaagtactctgtaaattagatcagttcaataaagaagctaaattcgccgaaacattttataaagacctaaagaaattattagaggataaatctaaaacctcaataggtaccacagagaaagatgagatgctacgaattataaaagctatagacagcaaccagttcctacaaaaacaaaaaggaatacaaaacgccgctatacctcatcaaaacagtctatacgaagccgagaaaatcctcagaaaccaacaagctcactatccatttataacaacagaatggatagaaaaagtaaaacaaatattggcatttagaataccctactacatcgggcctctagtcaaagacaccacacaatcgcctttcagctgggtagaaagaaagggagatgcacccataacgccatggaattttgacgaacaaatagacaaagcagcttcagcagaagcattcatctccagaatgaggaaaacttgtacatacctaaaaggccaagaagttcttcctaaaagctccctaacatatgaacgatttgaagtacttaatgaactaaacggtattcaactaagaacaaccggagctgagagcgatttccggcaccgattatcatatgaaatgaaatgctggattatcgataacgtgtttaaacaatacaaaacggtatcaaccaaacggctactccaagagctcaagaaatcaccttacgctgacgaattatacgatgaacacacaggagaaataaaagaagttttcggaacccaaaaagaaaacgcatttgccacgtcactgagcggatatatttcaatgaaatcaatcttaggtgcagtcgtagacgacaatcctgcaatgactgaagaattaatatattggatagccgttttcgaggatcgcgaaattttgcacttaaagatacaagaaaaataccctagcataactgacgttcaaagacaaaaacttgctctagtaaaattaccaggatggggccgtttcagccgactactaatcgatggactacccctagacgaacaaggccaaagtgttttagatcacatggagcaatacagctctgtttttatggaagttctcaaaaacaaaggattcggtttagaaaagaaaatacagaaaatgaaccaacatcaagtagatggtacaaagaaaatacgctacgaagacatagaagaattagcaggtagccccgcattaaaaaggggcatatggagatcagtcaaaatcgtagaagaattagtcagtatattcggggaaccagcaaacatagttctcgaagtagcaagagaagatggcgaaaagaaaagaacaaaaagtcgaaaagaccaatgggaggaattaacaaaaacaacattgaaaaatgatcccgacctaaaatccttcataggagaaataaaaagccaaggagaccaaagattcaatgagcaacgattttggctatacgtaacacaacaagggaaatgcctatacacaggtaaggcactagacatccaaaatctatcaatgtatgaagtagatcatatcttaccacaaaatttcgtaaaagacgactccctggataatttagcattagtaatgccagaagccaatcaaaggaaaaaccaagtaggtcaaaacaaaatgcccctagaaatcattgaagcaaaccaacaatatgctatgagaactctctgggaaagattacatgaattaaaattaataagctcgggtaaactaggtagattgaagaaaccatcttttgacgaagtcgataaagataaatttatagcaagacagctagtagagacaagacaaatcataaaacacgtcagagatcttcttgatgagagattttcaaaatcagatatacacctagtaaaagcaggtatagtgagcaagtttagaagattctcagaaatacctaaaataagagactacaacaacaaacatcatgctatggacgcgctatttgcagcagcattgattcaatctatacttggcaaatatggaaagaactttttagcattcgacttatcgaagaaagacaggcaaaaacaatggagatcagttaaaggaagcaataaagagttctttttatttaaaaattttggtaacctgagattacaatcaccagtcacaggcgaagaagtaagcggagtcgaatatatgaaacacgtatactttgaactaccatggcaaactaccaaaatgacgcaaacgggcgatggcatgttttacaaagaaagtatattttctccgaaagttaaacaagcaaaatacgtttctcccaaaactgaaaaattcgtccatgatgaagttaaaaaccattctatatgcctagtagagtttacctttatgaagaaagaaaaagaagtacaagaaacaaaatttatagatctaaaagtaatagagcatcaccaatttttaaaagaaccggaaagccagctagccaaatttctagcagagaaagaaacaaatagtccaattatacacgcacgaatcatcagaactatccctaagtaccaaaagatctggatagagcatttcccttactactttatatcaacacgagaactacacaacgctcggcaatttgaaatcagctacgaattaatggaaaaagtaaaacaactatcagaaagatcgtctgtcgaggaactaaaaatagtgtttggcttattaatcgatcaaatgaacgataactatcctatttacactaaatcatcaattcaagatagggtacaaaaatttgtcgatacacaattatatgacttcaagagcttcgaaataggatttgaagaacttaagaaagccgtcgccgctaatgcgcaacgtagcgacacattcggatctagaatatcaaagaaaccaaaaccagaagaagtagcaatagggtacgaaagtataacgggtttaaaatatagaaaacctcgaagtgttgtaggtaccaaacgttga

SEQ ID NO: 8748 - RNA, 4002 nt, synthetic construct
  misc_feature 1..4002: note = Cas9 variant
  source 1..4002: mol_type = other RNA
atgtcacaaaatatagtagactactgcatcggactagatctaggaacaggttcagttggatgggcagtagtagacatgaaccatagactaatgaaaagaaacggaaaacacttatggggaagcagactgttcagcaatgctgaaacagcagcaaacagacgtgcaagtcgttcaataagaagacgttataacaaaagaagagaaaggattagactactaagagcaatactgcaagatatggtactcgaaaatgatccaacattctttattcgactagaacacaccagctttcttgatgaagaagacaaagccaactatcttggagctgactacaaagataattacaacctattcatagacgaagattttaacgattacacatactatcacaaatatccaacaatctatcatttaagaaaagcactgtgcgaatcaacagaaaaagcagatcctagattaatatatctagccctacaccacatcgtaaaatatagaggaaatttcctatacgaaggtcaaaaattcaacatggatgcttcaaacatagaagaccgattatccgatgtctttacacaatttgcagacttcaataacataccttacgaagatgatgagaagaaaaatctagaaatattagaaattctgaagaaacccctctcaaagaaagccaaagtagacgaagtgatggccctaatcgcaccagaaaaagatttcaaatcagcatacaaagaactggttacaggaatagccggcaataaaatgaatgtcactaaaatgatactatgcgaaccaataaaacaaggagactctgaaataaaactaaaattcagtgactcaaattacgacgatcaattctcagaagtcgaaaacgatctaggagaatacgtagaatttatcgactcactccacaatatttacagttgggttgaattacaaactataatgggcgctacacatacatataatgcctcgataagtgaagcaatggtaagtcgatacaacaaacaccatgaagacctacaattactcaagaaatgtattaaagacaatgtacccaagaaatatttcgacatgttccggaacgattccgaaaaactaaaaggctactataactatataaatcatccctctaaagcacctgtagacgagttctataaatacgtcaagaaatgtatagaaaaagtagacacacctgaagcaaaacaaatactccatgacatcgaactagaaaattttctcctaaaacaaaactcaagaacaaacggatcagtgccataccaaatgcaactagacgaaatgataaaaataatagacaatcaagcaaaatactacccggtgttaaaagaaaaacgagaacaactactatcaattctaacctttaaaataccgtactactttgggccattaaatgaaacaagtgaacacgcgtggataaaaagactagaaggaaaagaaaaccaaaggatactgccatggaactaccaagacatcgttgatgttgatgcaactgcagaaggcttcattaaaagaatgaggtcgtattgtacatacttccctgatgaagaagtcctccccaaaaacagtctgatcgtctcaaaatacgaagtatataacgaacttaataaaatacgagttgatgataaacttctagaagtcgatatcaaaaacgatatatacaatgaactcttcatgaacaacaaaacagtcacagagaagaaactgaaaaactggctagtaaacaaccaatgctgcaacaaaaacgcggaaataaaaggcttccaaaaagaaaaccaattctccacctcactgaccccttggattgatttcacaaacatatttggcgaaattaatcaatcaaactttgatttaatagaagacataatctacgatctaacagttttcgaagataagaaaataatgaaacgacgattaaagaaaaagtacgcactaccagacgataaaataaaacaaatactaaaattgaaatacaaagactggagccgtttaagcaagaaactccttgacggaatagttgctgataataaattcggttcttcagtaaccgttctagatgtgctagaaatgagtagattaaacttaatggaaataataaatgatcgcgatctcggctacgcacaaatgattgaagcagcagcatcatgcccggaagatggaaaattcacatacaaagaagtccaacgattagcaggctcccctgctcttaaaagaggaatatggcaatcactccaaatcgtcgaagaaataaccaaagtaatgaaatgtagacctaaatacatctacatagagttcgaacgatcagaagaaacaaaagaacgtacagaaagcaaaatcaagaaattagaaaacgtttacaaagatctggatgaacaaacaaaagtagaatacaaaacagttttagaagaacttaaaggattcgacaacactaagaaaataagctcggattcattattcctatactttacacaacttggcaaatgcatgtactcaggaaagaaattagacatcgactcactagacaaatatcaaattgaccacatagtaccacaatcactggttaaagatgactcattcgataatagagtactcgtagttccatcagagaatcaaagaaaactagacgatctagtagtcccatctgatataagggtaaaaatgaatagcttttggaaattattattcgatcacgaactaataagccctaagaaattttattcactgataaaaactgaatacactgaaagagacgaagaaagattcataaaccgacaacttgtcgaaactagacaaataaccaaaaacgtcactcaaataatagaagatcattactccactacaaaagtagccgcgattcgcgcaaacctatctcacgagttcagggtcaaaaaccatatatacaaaaatcgagatatcaacgactatcaccacgcccacgacgcttacattgtagccttaattggtggctttatgagggaccgatacccgaacatgcatgacagcaaagccgtctacagtgaatatatgaaaatgtttcgaaagaataaaaacgacaagaaaagatggaaagacggattcgttatcaacagtatgaactacccgtacgaagtcgacggagagttaatatggaatccagatattataaatgaaataagaaaatgtttctattataaagactgctactgcacaacaaaactcgatcaaaaatcaggacaaatgttcaatttaacagtcctcccaaacgacgcacatagtcccaaaggaacaactgaagcagtaatcccagtaaataagaacagaaaagatgtaaacaaatacggtggtttttcaggattacaatatgtcattgttgcaatagaaggcaagaagaaacgaggcaagaaaacaaaactcgtcaagaaaattagtggagtaccattacatttaaaagcagcctcactcgatgagaaaataaaatatattgaagaaaaagaaaacttaactgacgtgaaaattattaaggactcaataccagtaaatcaaatgattgaaatggatggaggagagtatctactgacatccccaatagagttcgtaaatggaagacagctagtactaaacgagaaacaatgcgctctcattgcagatatatacaatgccatctacaaacaagattgcgataatctcgacgacgttttgatgatccaattatacatcgagctaataaataagatgaaagcactatatccagcttatcaatccatagcagaaaaatttgaatccatgacagaagactatgtcgcagtatccaaagaagaaaaagcagacatcattaaacaaatgttaatcataatgcaccgaggtcctagaaatggcaaaatacaatacgcagatttcaacgtaggagatagaataggcaggaaaaataaaatgtctctcgacctagaaagagtaacgttcgtaagtcaatccccgacaggaatatacaccaagaaatataaattatga

SEQ ID NO: 8749 - RNA, 4002 nt, synthetic construct
  misc_feature 1..4002: note = Cas9 variant
  source 1..4002: mol_type = other RNA
atgggaaaagaatattatttaggattagacataggtaccgacagtgtagggtgggctgtatgtgacacaaactataaaataccaaaattcaaagggaacgcaatgtggggaataagactatttgaaaaatcaaacagcgcagaagaacgaagaggctttaggtctagtagacgcagaactcaaaggaaacgcgaaagattaaaactcttagaaatgctatttgatgaagaaatatccaaaattgaccccgcattcttcataaaactacgagaatcaaacttgtacttagaagacaagtccacgaaaataccatactgtgttttcagcgatgaaaactatacagacaaggactttcacagagactatccaaccatctaccacctaagaaacgagttaataaaatctaacaaaccgcatgatgtacgacttgtatatttggccctacatcatataataaaaaacagaggacacttccttttcgattacagctacaaaaatgataaatccggggatttcatgcccatatacaacgacttaaaaaattacttttacgacaattatgaaatagaactagattgttcggatgtcgacgaattcgccaacaccctaaaagacaaatctaaaggcaagacaaaaaaaaacgcagaaatagcagaactatttggcgtatccaaaaagtatgacaaagtactatacagcgcattatcattgttaagtggatcgagtgtaaaactattcgacatattcgatgacgaagcattgaaagatgtagaaaaaaaatctgtcagtttctcttcaggttttgatgacaacgctaacgacttccaaagttatctgggagaaagatttgaactgttagaaaaactgaaagcagtgtatgactgggcagttctggccgacatactggatggcaaagagtatataagcgaagcaaaagttgctatatacgagaaacacaaaagagacctgaagactctaaaaaaatatataaaaatatacatgccagaaaaaaaggcagaaatattcaacatatcgtcaaaagacaataactatgttgcttatagcaaacatataaaaacatctaacggtaccggcgtgctcatatctacttgcacacaagaggaattctgtgcctacctaaagaaaacattaggaatatgcaaagacgcatcctatgaagaaatgttcaaagaaatagaaaactcaacattcatgccgaaacaagtaactaaagataacggggtagtaccaatgcaagttaatgaaaaagagctcgtcgctatactagacaatgccaaagaatatttgccattcttattaaataaagacaatgatggaaaaacagtatatgacaaaattaaagcactcttcgaatacagaataccgtactacatcggaccattaaatacacactctacaaaatcttggttagtacgaagtaacgagaaaatttacccctggaatatcgaagatgtagtagactttgacaaatcagccgaaaaatttatagaaaatttaacaagtaaatgtacttacttaccacaatatgacgtaattccaaaacattctctgctatacaacaaattctgcgtcctaaacgaattaaataatctaaaaattgacggagaaaaaatatcagtacaactcaaacaagatatttacaacgatctattcaaaaaatactacaaagtaacaaacaaaaaactttgtgactacctaaaaagcagaaatatagccttcgacgaaatatcgggaattgataatgattttaaatcctcactcaaatcatataaagaccttgttgcatataacttgactgatgaacaaaaagaagaaatcgtaaaggcaattacaatttttggagatgataaaaaattactaaaaaaaagacttaaaaacgaattcggagggtgcttgtcggacgacgaaataaaaaaaatatgtaagctaaaatatactggctggtctaaactatccagagagtttcttacagatgtcactgcagtctacaaagagaccggtgaattaattaacattatatgcgccctttgggagacaaactacaatctaacatcattactatacagtgacgagttctgctgcgacgacaaagaaaacaaaacatttaacgacaaaatcaatgaactaaactctttcggtaatgacaaaacactcaatcaaatagtcgaagaactatatgtatctccactcgttaaaagacctatatatcaaagtctacttatcaccaaagaacttgaaaaaataatgaaatgcccccctaaaaaaatatttgtagaagtcgcaagaggtgcagaagaaaaaaaacgaactgtaagtaggcgcaataaactactggacctatataaatcatgcaagaacgattatccactcttattcgacgaactacaaaataatactacagacgatgaactaaaatccgataaactatacttatattttactcaattcggaaaatgcatgtatacaggagagaatatagagttaggcgacttattcaacaagaatctatatgacatagaccacatctatcctcaatcaaaaattaaagatgattccttagacaatcgcgtactggtaaaaaaaaccacaaacgcgaagaaagacaatgaatatccactaagttcacaaattagagaaaaaatgacaccccattggaaagcactactagacaaaggactaataaacaaaaaaaaatacgaaagattagtacgtaactacccactcagtgatgaagaattatcacaatttataagccgacaattagtagaaacacggcaatcaacaaaggcagtggctaatatattagaacaattgtatccaaggccagatactgaaatagtttacgtgaaggcagcactagcatcagaattccgccaccaatacgatatgttaaaatgtagagaagtaaacgacctacaccatgcaaaagacgcttatctcaacatcgtcgtgggaaacgcttacaacggcaaattcacacataataaagcgaactttataaagggtcttcaaaacaacgacaaagcctataccgtaaaattagactcaatgctaaaacataatatcgacggcgcatggatagcagataacaatgaatccttaaatatagtaaaatcaacgatgaataaaaataatatccgatatacacgatatgcctttgagaaaaaaggaggattattcaaagtcacaatcttaaaaaaaggaaacggtcaagcatccataaaaaaaaacgataaaagaaatagcatcgaaaaatatggtggatataaccaagtatcatccacctacttctcctgtgtagaacacggaaaagacaacaatagaatgatatcaatgttctcagtaaacctctacgacaaaaataaatatgaagagaatcccatagcttacctaatagaaaattacggtttaataaatccaataatcaaagtaaaaaaagtaaaaattcagtcgtgcataagttttgacaacatgctatgtcatttaggcggaaaagactccggtggtagccaaatttcctacagaccaggagtccaactcgtactaggctacgataatgaacgatacattcgaaacgtaataaggtgtgcgggaggagatttacaccttcaaacatcaaaaaatgaaaaagatatagtgacagccgaaaaaaatatcgaactattcaacttacttatcgaaaaaatgaaaaacaacatttacggcgtcctttatagcaatttaggcgataaattatactgcagcaaagaaaaattcgagaaactagacatagtcgaacaatgtaacgtaatcaaaaacgtccttacaattttaaaaaataatgcatcaaaaggtgatctgaaatcaataggtataaaagctaatggtgccatccgtttaaataacaacatcagcgaaataaagaaagtcaaaagtatcaaactaataaatcaatcggtcactggtctatttgaacaagaaatagaactattaaacctatga

SEQ ID NO: 8750 - RNA, 4002 nt, synthetic construct
  misc_feature 1..4002: note = Cas9 variant
  source 1..4002: mol_type = other RNA
atgtcacagaatatagtagactattgtataggccttgatttaggtactggttcagtgggatgggcagtagtagatatgaaccatcgattaatgaaaagaaacggaaaacacttgtggggttcgcgactcttctcaaatgcggaaacagcagcaacaagacgatcgtcccgaagcatacggcgacgatacaacaaacgaagagaaagaataagactactcagggcaatattacaggacatggtcctcgaaaaagaccccacattcttcatacggctagaacatacatctttcctggacgaagaagataaagccaaatacctaggcacagactataaagacaactacaacctttttatagacgaagacttcaatgactatacatactaccacaaatacccaacgatctatcatttaagaaaagccctatgtgaatcaacagaaaaagcagacccaaggttaatatacctagctctccaccatatagttaaataccgaggaaatttcttatatgaaggccaaaaattcaatatggacgctagtaacatagaagacaaactaagtgacgtgttcacacagtttgcagacttcaacaacataccatatgaagacgacgaaaagaaaaaccttgagattttagaaatactaaagaaaccactaagtaagaaagctaaagttgacgaagtaatggcattaatttcaccagaaaaagaatttaaatcagcatacaaagaattagttacaggcatagcaggcaataaaatgaacgtcactaaaatgatactgtgcgaaagcatcaaacaaggcgacagtgagataaaactgaaattttcagattcgaactatgatgaccaatttagcgaagtagaaaacgatcttggagaatacgtagaatttatagacagcttacataacatatactcatgggtcgagttacaaacaataatgggagcaacacatacagacaatgcctcgatatccgaagcaatggttagcaggtataacaaacaccatgaagatctacaactacttaaaaagtgtattaaagacaacgtaccaaagaaatattttgacatgtttcgaaatgattcagaaaaagtaaaaggatactataattacataaatagaccaaataaagcacctgtagatgagttttataaattcgtcaagaaatgcatcgaaaaagttgacacccccgaagcaaaacaaatattacatgacatagaattagaaaatttcttactcaaacaaaactcaagaacaaatggatcagtaccataccaaatgcaactcgacgagatgattaaaataatcgacaaccaagcaaaatactatcccgtactaaaagaaaaacgagaacaattattaagcatactaacattccgaataccgtattacttcggaccgctgaacgaaaccagtgaacacgcatggataaaacgactagaaggtaaagaaaaccaaagaatcctaccatggaattaccaagatacagtagatgttgatgcgacagcggaaggttttataaaacggatgcgatcttactgcacgtactttccagatgaagaggttctaccgaaaaatagtttaatcgtaagtaaatatgaagtttacaacgaactaaataaaatacgagtagatgataaacttctggaagtagacgttaaaaacgatatttataacgaactatttatgaaaaataagacagtaacagagaagaaacttaaaaattggttagtgaacaaccaatgttgcagaaaagatgcagaaataaaaggattccaaaaagaaaaccaattctcaacaagccttacaccctggattgactttactaacatattcggcaaaattgatcaaagtaattttgacttaatcgagaaaataatctacgatttaacagtatttgaagacaagaaaataatgaaacgaagactcaaaaagaaatatgccttacctgacgataaaataaaacaaatactaaaattaaaatataaagattggtcaagattatctaagaaactacttgatggaatagtagcagataatagattcgggagcagcgtaactgtacttgatgtgcttgaaatgagcaggcttaacctaatggaaatcatcaacgacaaagaattaggttatgcacaaatgatagaagaagcctcatcatgtccaaaagatggaaaattcacttacgaagaagtcgccaaactagcaggaagtccagcactaaaacgaggcatatggcaatccttacagatcgtcgaagaaattactaaagtcatgaaatgtagaccaaaatacatatacatagagtttgaacgatcggaagaggcaaaagaacgaaccgaatctaaaatcaagaaacttgaaaacgtctacaaagatttggacgaacaaacaaagaaagagtacaaatctgtattagaagaactcaaaggttttgacaatacaaagaaaatatctagcgacagcctgttcctttatttcacccagttaggtaaatgtatgtacagtggtaagaaattagacatagacagtctagacaaataccaaatcgaccatatagtaccacagagtctagtaaaagatgactcatttgacaacagagttctagtactaccttcagaaaaccaacgaaaactagatgacctggtagtcccattcgacattagagacaaaatgtatcgattttggaaactcctcttcgaccacgagctaataagtcctaagaaattttactcactaataaaaacagaatacacagaacgcgacgaagaacgatttatcaaccggcaattagtcgaaactaggcaaatcaccaaaaacgtaacacaaatcatagaagatcactactccacaacgaaagtggccgcaataagagcaaacctaagccacgagttccgcgttaaaaaccatatatacaaaaacagggatataaacgactaccatcatgcacacgacgcatatatagtcgccctgataggaggttttatgagagatagatatccaaacatgcacgacagtaaagctgtatattcagaatatatgaaaatgttccgcaaaaataaaaacgatcaaaagaaatggaaagatggttttgtaataaatagcatgaattatccttacgaagtagatggaaaactaatatggaatccagacctaataaacgaaatcaagaaatgcttttactacaaagactgttactgtacaacaaaacttgaccagaaatctggacaaatgtttaacttaacagtgttaccaaatgatgcacacagtgcaaaaggtactaccgaagcagtaattccggtaaacaaaaatagaaaagatgtcaacaaatatggagggttttctggattacaatatgtaatagcagcaatcgaaggaactaaaaagaaagggaaaaagctagtaaaagtcagaaaactatcaggaatacccttatatttaaaacaagcagatataaaagaacaaattgaatatgtagaaaaagaagaaaaactcagcgatgtcaaaataattaaaaacaatattcctctaaaccaactaatagaaatcgacggaagacaatatttactaacatcaccaacagaatgcgtaaacgcaatgcaattggtccttaacgaagaacaatgtaaactaatagcagatatatataatgcaatatacaaacaagatttcgacggtctggataacatgctgatgatacaactatacttacaactcatagataaactgaaaacattatacccaatttacatgggaatagtggaaaaattcgaaaaactcaccgaagacttcgtatctatatcaaaagaagagaaagctaacgtaataaaacaaatgttaataataatgcataaaggaccacaaaacggaaatataatatatgatgatttcaatgttgggaaaagaatagggagacttaatgggagaaccttctacctggacaatattgagttcatctcacaaagccctacagggatatacacaaagaaatataaattatga

SEQ ID NO: 8751 - RNA, 4002 nt, synthetic construct
  misc_feature 1..4002: note = Cas9 variant
  source 1..4002: mol_type = other RNA
atgtatacatactattttaaagaatcagaaatggtgtacgacgtcggattggacatcggaacaggaagcgtaggttgggtagccttagacgaaaacggcaaattagcacgggctaaaggaaaaaatttagtaggagttagactgtttgatacagcacaaaccgccgcagacagaagaggattcaggacaacgagacgacgattgtcaaggagaaaatggagactacgccttctagacgaactattttcagcagaaataaacgaaatcgactcatcattctttcagagactcaagtattcctacgtacacccgaaagatgaagaaaacaaagcccattactatggcggatacctatttcctacagaggaagagacaaaaaagtttcaccgaagttatccaacaatatatcacttaagacaggaactaatggctcaaccaaacaaaagattcgacatccgtgaaatatacttagctattcatcacctcgtaaaatatcgaggacatttcctatcctcccaagaaaaaataacaattggcagtacatataatcccgaagatctagccaatgcaatagaagtgtatgccgacgaaaaaggattaagttgggagctaaataacccagagcaattaacagaaataatctcaggcgaagcaggttatggattgaataaatccatgaaagccgacgaagcgctcaaattatttgagtttgacaacaatcaagataaagtcgcgataaaaacgttattagcaggactcactggtaaccagatagactttgcgaaactatttggaaaagatatatcagataaagatgaagcaaaactttggaaattaaaattggatgacgaagcactagaagagaaatctcaaacaattctaagtcaactaacggatgaggaaatagaactatttcatgcagttgtacaagcctatgatggctttgtactaatcggactattaaatggagccgactcagtatccgctgccatggttcaactctacgaccaacacagagaagatagaaaactcctaaaatcactggctcaaaaagcaggcttaaaacacaaacgcttctcagagatatatgaacaacttgcgctagcaaccgacgaagcaacaattaaaaacggtatctcaacagctcgagaattagtagaagaatcaaatctctcaaaagaggttaaagaagatacattaagacgtcttgatgaaaatgaattcttaccaaaacaaagaacaaaagcgaactctgttattccgcaccaattacacctagcagaactacagaaaattctacaaaaccaaggccaatattatccgtttctcctagatacgtttgaaaaagaagacgggcaggacaacaaaatagaagaactgcttcgatttagaataccttactacgtcggaccattagtcactaaaaaagacgtagaacatgcaggcggagatgccgacaaccactgggtagaacgtaacgaaggtttcgaaaaatcacgggtaaccccatggaatttcgataaagtattcaatagagataaagccgcaagggactttatcgaacgattaacaggaaatgacacatatctcataggtgaaaaaacgttaccacaaaactcattacgctatcaactatttacagttttaaatgaactgaataatgtacgagtaaacggtaaaaaatttgattccaaaactaaagcagatctcatcaacgacctatttaaagcacgaaaaacggtcagtttatcagcactgaaagactatctaaaagcacagggtaagggtgatgttacaatcaccggactagcagacgaatcaaaattcaactcaagcttgagctcatacaatgacttaaaaaagacattcgatgcggaatatcttgaaaatgaagataatcaagaaaccttagaaaaaataattgaaatacaaaccgtatttgaagacagtaaaattgcctcccgtgaactaagcaaactacccctagacgatgaccaagtcaaaaagttatcacaaacccattatacaggatggggtcgactttctgaaaagttactagacagcaagataatagacgaaagaggacaaaaggtatctatactagacaaactcaagtccacaagtcaaaactttatgtctataatcaataacgacaaatatggcgtccaagcatggataacggaacaaaacacaggaagctcaaagttaacatttgacgagaaagtaaacgaactcacgacatcacctgccaacaaacgaggaatcaagcaaagcttcgcagtacttaacgacataaaaaaagcgatgaaagaagagcccagaagagtatacctagaattcgcaagagaagatcaaacatcagtaaggtcagtcccaagatacaaccaacttaaagaaaagtaccaaagtaagagcctctcagaagaagctaaagtactaaaaaaaacattggacggaaacaaaaataaaatgtcagacgatagatatttcctctacttccagcaacaaggaaaagatatgtatacaggccgaccgattaactttgagagactcagtcaagattatgatatagaccacataatccctcaagcttttacaaaagacgactcattagataacagagttcttgttagccgaccagaaaatgcaagaaaatccgattcgtttgcgtacacagacgaagtacaaaaacaagatggatcattgtggactagcctactgaaaagtggctttataaaccggaagaaatatgaaagactaaccaaagctggaaagtatctagatgggcaaaagacaggattcatagcgagacaattagtagagactcggcaaataattaaaaacgtagcctcactcatagaaggagaatacgaaaatagcaaagctgtcgcgataagatcagaaataacagccgacatgagattactagtaggaattaaaaaacaccgcgaaataaattcattccaccacgctttcgatgcattacttataactgcagctggacaatatatgcaaaaccggtacccagatcgtgacagcacaaacgtctataacgaatttgatagatacacaaatgattacttaaaaaatctaagacaattaagttccagagatgaagtaagacgactcaaaagtttcgggtttgtagtaggaaccatgcgtaaaggaaacgaagattggtctgaagaaaacacgtcatacttacgaaaagtaatgatgttcaaaaatatactaacaacaaaaaaaactgaaaaagacagaggaccacttaacaaagagactatattcagtccgaaatcagggaaaaagttaataccattaaatagcaaacgatctgacaccgctttatatggagggtactctaacgtctactcagcatacatgacattagtccgagcaaatggtaaaaacctactaataaaaataccaatatctatagccaatcaaatagaagtaggtaacttaaaaataaacgattatatcgttaataacccagccataaaaaaatttgaaaaaatacttatatcaaaactaccacttggacaattggtcaacgaagacggaaatctgatataccttgcgagtaatgaataccgccataatgcaaagcaattatggctaagcactacagatgcagacaagatagcatcaatttcagaaaattcatcagacgaggaattattagaagcatatgacatcctaactagtgaaaatgtaaaaaaccgattcccgttctttaaaaaagatattgacaaattatcacaagtccgagatgaattcttagatagcgacaaaagaattgcagttattcagaccatactcagaggactccaaatagatgcagcatatcaagctcccgttaaaataataagcaagaaggtatcagactggcacaaactacaacaatcaggtggaataaaattaagcgacaatagcgaaatgatctaccaaagcgctacaggcatattcgaaacacgagtaaaaatcagcgacctattatga

SEQ ID NO: 8752 - RNA, 4005 nt, synthetic construct
  misc_feature 1..4005: note = Cas9 variant
  source 1..4005: mol_type = other RNA
atgaaaaatccctacacaatcggcttagatataggaacaaactcagttgggtgggcagtcctcacaaaccaatatgatttagttaaaaggaagatgaaagttgcaggtaatagtgataaaaagcagataaaaaaaaacttctggggagtacgactgtttgacgacggccaaactgcagtagatagaaggatgaataggacagccaggcgacgaatagagcggcgacgaaacagaatcagctacctacaagagatatttgcagtggagatggctaacattgacgcgaacttcttttgtcgcttaaatgacagtttctatgttgactcagaaaaaaggaattctcgtcacccatttttcgctaccattgaagaagaggttgcttaccataagaactatcgcacaatttaccacctaagggaagaacttgtcaactcatctgaaaaagcggatttgcgactagtatatctagcattggcacatattatcaaataccgtggaaactttcttattgaaggcgcactcgataccaaaaatacatcagtagacggcgtatacgaacaattcatacaaacatataatcaagtattcatgagcaatatagaagaaggcacacttgcaaaagttgaggagaacattgaagtagcaaatatcttagcaggaaaattcacacgaagagaaaaatttgaaagaatactacaactatacccaggagaaaaatcaaccggaatgtttgcccaatttatatcattaatagtaggctcaaaaggaaatttccaaaaggtgtttgatctgatcgaaaaaacagacatagaatgcgcaaaagatagctatgaagaagacctcgaagcactcttggccataattggggatgagtatgctgaactatttgtagcagcaaaaaacacttataatgctgtagtcctgtcaagtataataactgtaactgccactgaaacaaacgcgaaactcagtgcctctatgatagaaaggttcgatgcccatgaaaaagacctcggcgagttaaaagcattcatcaaattgcatcttccgaaacaataccaagaaatatttaacaatgcagcaatagacggatatgcaggctacatagacggaaaaaccaaacaagtcgacttttataaatacctaaaaactatattggaaaacatagaaggagctgactactttatcgccaaaatagaagaagaaaacttcctccgtaagcaacgaacattcgacaacggcgcaatccctcaccagctacatttagaagaactagaagcaataatacatcaacaagcaaaatactatcccttccttagagaagactatgaaaagataaaatcattagtcacatttaggataccatacttcgtaggaccactagcaaaaggtcaatcggaattcgcttggctgactagaaaagcagatggagaaataaggccttggaacattgaggaaaaggttgatttcggaaaaagcgcggtagactttatagaaaaaatgacaaacaaagatacatatctccctaaagaaaatgtactccccaaacacagcctatgctaccagaaatatatggtttataacgaactaactaaggtaaggtatatcgatgatcaggggaaaactaattactttagtggccaagaaaaacaacaaatatttaatgatctcttcaaacaaaaacgcaaagtaaaaaagaaagatcttgaactattcctaagaaatataaaccatattgaatcacctaccatagaaggcttagaagactcatttaatgcaagctatgctacatatcacgatctactaaaagtaggtatgaaacaggaaatattagacaacccactaaacacagaaatgttggaagacatagtaaaaatacttacagtatttgaagataaacccatgataaaagagcaactacaacaattttctgacgtgctagatggtggggtactaaaaaaactggaaagaagacattacacagggtggggaagattatcagctaaattactagtaggtatacgagaaaaacaatcgcacttaactatactagactatttaatgaatgacgatggcctaaaccgaaacttgatgcaactaataaacgactccaacttatctttcaaatcaattatagaaaaagaacaagtaagcacaacggataaagatttacaatcaattgtcgccgatttagcaggatcaccggctataaaaaaaggtatactacaaagtttgaaaatagtcgatgaactagtatcaataatgggatatccaccacaaacaatagttgtagaaatggcaagagaaaaccaaacaacaggtaaaggaaaaaacaacagcaaaccccgatataaatcattagaaaaagctataaaagaattcggctctaaaatcttgaaggaacacccaaccgataatcaagaattaaaaaataacagattatacctttattatcttcaaaatggtaaggatatgtatacaggtcaagaacttgatatccataatctcagtaattacgacattgaccatatagtcccacagagctttataacagataattcaatcgacaacttagtcctaacatcctcagcaggaaacagagaaaaaggaggcgatgtaccgccactcgaaatcgtaagaaagcggaaagttttctgggaaaaactatatcaaggaaatttaatgagtaagcgaaaattcgactatctaaccaaagcagaaagaggaggtctaacggacgccgataaagccagatttatacacagacaactcgtagaaacgagacaaataacaaagaatgtcgcaaatatattgcatcagagatttaacaacgagacggacaaccatggaaacacaatggaacaagttagaatcgtaacactaaaatctgccctcgtctcccaatttcgaaaacaattccaattatataaagttagagaagtaaatgactatcatcacgcacacgacgcataccttaacggtgtagtggcaaacacactgttaaaagtatacccccaactggaaccagagttcgtatatggagaatatcatcaattcgattggttcaaagcaaacaaagcaactgctaaaaaacagttctacacaaacatcatgttgtttttcggacaaaaagaaagaatcatagatgaaaatggcgaaattttatgggataaaaaatatcttgaaacaataaaaaaagttttagactatagacaaatgaatattgtaaaaaaaacagaaatacaaaaaggagaattcagcaaagctactatcaaacccaaaggaaacagctcaaaactaataccaagaaaagaaaactgggaccccatgaaatacggaggcttagactcccccaacatggcatatgcagtaatcatagagcacgcaaaaggaaaaaaaaaactaatattcgaaaaaaaaattatcagaataacgataatggaaaggaaaatgttcgaaaaagatgaagaagcatttctggaagaaaagggataccgacatccaaaagtactaaccaaactaccaaaatatactctatatgagtgtgaaaaagggcgaagaagaatgctagcgagtgctaacgaagcacaaaaaggaaatcaactagtattatcaaatcacttagtaagcctcctataccatgcaaaaaattgcgaagcaagtgacggaaaatccttaaaatatatagaagcccatagagaaacattctcagaactcctagcacaagtttctgaatttgccactagatatacattagcagatgcgaacctaagtaaaatcaacaacttatttgaacaaaataaagaaggagatatacaagcaatagcccagagctttgtagacttaatggcattcaacgcaatgggagcaccggcgagctttaaatttttcgaagcaacaatcgataggaaacggtatacaaacctcaaagaactattatcttcgactataatataccaatcgatcacaggactgtatgaatccagaaaaagactagacgattga

SEQ ID NO: 8753 - RNA, 4005 nt, synthetic construct
  misc_feature 1..4005: note = Cas9 variant
  source 1..4005: mol_type = other RNA
atgaaaaaaccgtacacgataggactcgatataggaactaattcggtgggatgggcagccctaacagaccaatacgatctagtaaaaagaaaaatgaaagttgccggaaactcggaaaagaaacaaataaaaaaaaacctatggggcgttagactcgttgacgaaggaaaaacagccgcccacagacgagtcaatagaacaacaaggcgaagaatagaaagaagaagaaatcgaatatcatatttacaggaaatattcactgcagaaatgttcgaagtagacgcgaattttttttatcgattagaagactcattttacattgaaagcgagaaaaggcaatcccgtcacccgttttttgcaacgatagaagaagaagtagcttaccatgaaaattaccgtactatttaccacctgagggaaaaacttgtaaacagctctgataaagccgacctacgactagtatacttagccctggcacacataataaaatatcgaggaaatttcctaatcgaaggcaaactcgatactaaaaatacatcagttgacgaagtattcaaacaatttattaaaacatataaccaagtcttcgcttcagacattgaagaaggatccctaacaagaatagaagaaaataacgaagtggcaaagatattttcagaaaaattaacgaaaagagaaaaactagacaaaatattaaatctatacccaaacgaaaaatcaactgacttgttcgcgcaattcatttcattaatcatcggatcaaaaggaaacttcaaaaaatttttcaacttaacagaaaaaacagatatcgaatgtgccaaagacagctacgaagaagatctagaagttctattagcaagagtaggggatgaatacgcagaaatttttgtcgccgccaaaaacgcttacaacgcagtagtactaagtagcataataacagtaagtaatactgaaacaaaagcaaaattatcagcttctatgatcgaacgattcgataaacacgataaagacttaaagcgaatgaaagccttcttcaaagtcagattacccgaaaactttaatgaagtatttaacgacgtagagaaagacggttatgcaggatacatcgaaggaaaaaccaagcaagaggcattctacaaatacatgaaaaaaatgctagaacacgttgaaggcgccgactacttcataaatcaaatcgaagaagaaaacttcttacgaaagcagagaacttttgacaacggagcaataccacatcaattacatttagaagaacttgaagccattctacaccaacaagctaaatattacccatttttaaaagttgactacgaaaaaataaaaagcctagttacatttagaataccatattttgtaggaccgcttgcaaacggtcaaagtgaattttcttggctaacaagaaaagctgacggggaaatcagaccgtggaacatcgaagaaaaagtggatttcggaaaatccgccatagattttatcgaaaaaatgacaaataaggatacttatctacccaaagaaaacgtcctacccaaacattcaatgtgctaccaaaaatatatggtttacaatgaattaacaaaaatacgatacacagacgaccaaggaaaaacccactacttcagcggtcaagaaaaacaacaaattttcaatgatctattcaaacaaaaaagaaaagttaaaaaaaaggacctcgagctatttctatacaatatgaaccacgtcgaaagcccaacagtagagggcgtagaagacgcattcaattcaagcttcactacttaccacgacctgcagaaagtcggagtacctcaagaaatcttagacgatccactaaacactgaaatgctagaagagattatcaaaatcctcactgtattcgaggataagagaatgataaacgaaagactccaagaattcagcaatgttcttgacgaagcagttctaaaaaaactcgaacgacgacactacacaggatggggacgactaagtgcaaaactcctaataggaataagggataaagaatcacacctaactattcttgattacttaatgaacgacgataaacataacagaaatctaatgcaattaataaatgactcaaatttatcattcaagtcgattatagaaaaggaacaagtatctacagcagacaaagatatacaatcaatagttgcagacttggcaggatcccctgcgataaaaaaaggaatccttcaatccctaaaaatagtagatgaactcgtaggtattatggggtacccaccacaaacaattgttgtggaaatggcacgagaaaatcaaacaacaggaaaagggaaaaacaattcaaaacctagatttacaagcctagaaaaagcaatcaaggaactaggcagccaaattctaaaagaacacccaaccgataaccaaggcttgaaaaacgatcggctctacctatattaccttcaaaacggaaaagacatgtatactggtcaagaacttgatattcacaatctatcgaattacgacatagatcatgtggtaccccaatcatttattacagacaacagcatagacaatcgcgttctcgcaagctccgctgcaaatagagaaaagggagacaatgtaccttccttagaagttgtccgaaaaagaaaagtatattgggaaaaattgtaccaagccaagctaatgtcaaaaaggaaattcgactatctaacgaaagcagaacggggaggccttactgaagcagacaaagctaggtttatacaccgacaacttgtcgaaaccagacaaataacaaaaaacgttgctaacatcctacatcaaaggttcaactgtaaaaaggatgagtcaggaaatgtaatagaacaagtacggatagtaacattaaaagcagcgctagttagccaattcagaaaacaattccagctatacaaagtaagagaagtcaacgattaccaccatgcacatgacgcttatctgaactgtgtagttgcaaacacactgctcaaagtttacccacaacttgaaccagaattcgtatacggagattaccaccaattcgactggtttaaagctaacaaagcaacagctaaaaaacaattttacaccaacataatgctattcttcgcaaaaaaggataggataatcgatgagaatggtgaaatcctgtgggacaaaaaatatctggacacaataaaaaaagttttgaactataggcaaatgaacattgtaaagaaaacagaaattcaaaaaggtgagttctcaaatgccactgcaaacccaaaaggtaatagtagcaaactaataccacgtaaagcagactgggatccaataaaatacggcggctttgacggatctaatatggcatacgcaatagtaatagaacacgaaaaacgaaaaaaaaaaacagtcataaagaaagaactcattcaaataaacataatggaacgaacagcatttgaaaaagatcagaaagaatttttagaaggaaagggctatcgcaatcccaaagtcataacaaagataccaaaatacaccttatacgaatgcgaaaacggacgaagacggatgctaggtagcgctaatgaagcacaaaaaggaaatcagatggttctaccaaatcatctgatgaccctactgtatcacgcaaaaaattgtgaagcctcggacggaaaaagtttagcgtatatagagtcgcatcgtgaaatgttcgcagaactactcgacagcatcagtgaattcgcatcacgttatactctagcagatgctaacttagagaaaataaatactatatttgaacaaaacaaatccggggacgtaaaagtaatcgcccaatcatttgtgaaccttttagaatttaacgcaatgggtgccccagcatcatttaaatatttcgaaacaaatatagaaagaaaaagatacaataacttaaaagaattgttaaatgctaccatcatctaccaatccataaccgggctatacgaagcaaggaaacgtctcgatgactga

SEQ ID NO: 8754 - RNA, 4005 nt, synthetic construct
  misc_feature 1..4005: note = Cas9 variant
  source 1..4005: mol_type = other RNA
atgaaaaatccatacacaataggacttgatataggaacaaatagcgtaggttgggcagtactcacagatcagtacgacctagtaaaacgaaaaatgaaagtcgctgggaactccgacaaaaaacagatcaaaaaaaacttctggggggtacgattattcgatgatggccaaacagccgtcgatcgacgcatgaatcgcacagcacgacgaagaattgaaagacgaaggaacagaatatcatacttgcaagagatatttgccgtagaaatggcaaacatagacgcaaatttcttttgccgactaaatgattccttctatgtagatagtgaaaaaagaaatagtcgacatccattctttgccaccatagaagaagaagttgcctaccacaaaaactataggactatataccatttaagggaagaattagtgaatagtagcgagaaagcagatcttaggttagtatacctagcacttgcacacatcatcaaatacagaggaaatttcttaatagaaggcgcactggacaccaaaaatacctctgtcgacgaagtctataaacagtttattcaaacctacaatcaagtatttatgtctaacatagaagaaggagccttagcaaaagtagaagaaaatacagaagtagcatcaatattagcagggaaattcacaagacgagaaaaattcgaacgtatactaaggttgtacccgggagaaaaaagcacaggcatgttcgcacaatttatcagcctgatcgtaggtaacaaaggcaatttccagaaagtatttaacttagtagaaaaaacagacattgaatgcgccaaagattcctacgaggaggatctagaagcgctactagcaataatcggggacgaatacgcagaactattcgtagccgcgaaaaacacttacaacgctgtagtactatcgagtatcataacagtgacagcaactgaaacaaacgccaaattatcagccagtatgattgaacgatttgacgcgcacgaaaaagaattaggcgagttaaaagcattcataaaactacatcttcccaaacaataccaagaaattttcaataacgcggaaattgatggctacgctggatacatagacggaaaaacaaaacaggtagacttctacaagtatttaaaaaccactttagaaaacgtggaaggcgcagattactttattacaaaaatagaagaagaaaatttcctacgaaaacaaagaacgtttgataacggagtaataccgcaccaattacatttggaagaactagaagcaatcttgcatcaacaagccaagtactatcccttcttgcgcgaaggatacgacaaaatcaaatctctagttacttttagaataccttacttcgtcggacccctagctaatggccaatcagaatttgcatggttaacaagaaaagacgacggagagataagaccatggaatattgaagaaaaagtagactttggaaaatcagcagttgacttcatagaaaaaatgaccaacaaagacacatacctaccaaaagaaaacgtattaccgaaacattcattatgctaccaaaagtatatggtttataacgaacttacaaagattcggtacatagacgaccagggaaaaacaaattacttttctggtagagaaaaacaacaaatctttaacgacctattcaaacaaaaacgaaaagtgaaaaaaaaagatttagaactattcctaagaaatataaaccatattgaaagcccaaccatagaaggattagaggactcttttaacgcaagctatgctacctatcacgatttattaaaagtaggccttaagcaagaaatactggacaatccactgaacacagaaattttagaagatattgtcaaaatactaacagtattcgaagacaaacgtatgataaaagaacaacttgaacaatttagcgatgtactcgatggggtagtcttaaaaaaactagagagaagacactacacaggttggggtagactctcagctaagctgctagtgggaattcgagacaaacaatcccatttaacaattcttgattatttaatgaatgacgatgggcttaacagaaacctaatgcagctaataaacgatagtaatttatcatttaaatcaataatcgaaaaagaacaagtatctacaaccgataaggatttacaatcaatcgtggccgatttagccggatcaccagcaataaaaaaagggatccttcaaagcctaaaaatagtagacgaacttgtaagtataatgggatacccacctcaaacaatagttgttgagatggcacgagagaatcaaactacaggaaaaggaaagaacaattcaaaacctagatacaaatctctagaaaaagccataaaggactttggatcgcaaatactaaaagaacatccaacagataatcaagaattaaaaaacaatagattatacttatactatctccaaaacggcaaagatatttacacaggacaagaactagatatacataatttaagcaactacgatatagatcatatagttccccaaagtttcataacagataattcaatagacaacctagtacttactagtagtgcaggaaatagagaaaaaggcggagatgtacctccactggaaattgtaaggaaaagaaaagttttttgggagaaactatatcaaggaaaccttatgagcaaaaggaaatttgactatttaacaaaagcagagagaggagggctcacagaagcagacaaagcgagatttatacatcgtcaactagtggaaactagacaaataacaaaaaacgtagcgaacatcttgcaccaaagatttaataaagaaaccgataatcatggcaatacaatggaacaagtacggatagtcacattaaaatcagctcttgtatcgcaattccgcaaacaatttcaattatacaaagttagggaggtcaacgattaccaccacgcgcatgacgcttacctcaacggagtagtagctaacactttattaaaggtatacccgcaactagaacccgaattcgtctatggagaatatcatcaattcgattggttcaaagcaaataaagcaaccgccaaaaaacaattttacacaaatataatgctgttcttcgcacaaaaagaaagaatcattgacgaaaacggagaaatactatgggataaaaaatatctagaaactatcaaaaaagtgctggactacaggcaaatcaacattgttaagaaaaccgaaatacaaaaaggggaattttctaaagcaacaataaaaccaaaaggaaacagttcaaagcttatcccgagaaaagaaaattgggatccagttaagtatggaggactagatagtcccaatatggcatatgcggtaatcatcgaacacgcaaaaggcaaaaaaaagatagttatcgaaaaaaagttgatacaaatcaacataatggaacgaaaaatgttcgaaaaagacgaagaagccttccttgaagaaaaaggatatcatcaacccaaagtactcacaaaactcccaaagtatacattatatgaatgtgaaaaaggcagaagacgaatgctatccagtgctaacgaggcacaaaaaggaaatcaactcgtactatcaaatcatttagtatctttactgtaccatgcaaaaaactgtgaagcttcagatggtaaatccctaaaatacattgaagcacacagagaaacgttcagtgagttactagcacaagtatcagaatttgccactaagtacaccttagcagatgctaatttgtcaaaaataaataacttatttgaacaaaataaagaaggagatataaaagctatcgcacaatcattcgtagacttaatggccttcaatgcaatgggtgccccagcctcattcaagttctttgaggcaacaatcgacagaaagagatatacaaatttaaaagaattactatcctcaacaataatatatcaaagcataacgggcctatacgaatcacgaaaacgcctagatgattga

SEQ ID NO: 8755 - RNA, 4005 nt, synthetic construct
  misc_feature 1..4005: note = Cas9 variant
  source 1..4005: mol_type = other RNA
atgggacgaaaaccatatatactatccctggacataggaacaggatccgtgggatacgcatgcatggataaaggtttcaacgtcttaaaataccacgacaaagatgcattaggagtgtaccttttcgatggagcactaacggcacaagaacgcaggcaatttagaaccagccgaaggcgcaaaaaccgaagaataaaacgactcggactactacaagaactactagcgccgctagtccaaaacccaaacttttatcaatttcaaagacaattcgcatggaaaaatgataacatggacttcaaaaataaatcactatcagaagtactatcattcctcggatacgaaagcaagaaatatcctaccatttaccacctacaggaagcgctactactgaaagacgaaaaatttgacccagaactaatatatatggcactataccacctagtaaaatacagaggccattttcttttcgatcacctaaaaattgaaaacttaacaaacaatgacaacatgcacgattttgttgaattaatagaaacatacgaaaaccttaataacataaaactaaatcttgattatgagaaaacaaaagtcatctatgaaatacttaaagacaacgaaatgaccaaaaacgaccgagcaaaaagagtcaaaaacatgcagaagaaactcgaacaattctcaataatgctccttggactaaaattcaatgaaggaaaactgtttaaccatgcagacaacgcagaagaactgaaaggcgcaaatcaatcgcatactttcgcagacaattacgaagaaaacctaaccccattcctaacagtagaacaatcagagtttatcgaaagagccaataaaatatatttaagccttactttacaagacatcttaaaaggtaagaaaagtatggcaatgagtaaagtagctgcatatgataaattccgaaacgaattaaaacaagttaaagacatagtttataaggctgactccacacggacccaattcaaaaagatatttgtttcgtcaaagaaatcacttaaacaatatgatgcaacacccaacgaccaaacgttctcatccctctgcttattcgatcaatacctaattagaccgaagaaacaatactccttgctaataaaagaacttaagaaaataatacctcaggattcagaattatatttcgaagcagagaacgataccctactaaaagttcttaacacaacggacaacgcgtccattcccatgcaaataaacctatacgaagctgaaactatactcaggaatcaacaaaaatatcacgccgaaataacagatgaaatgatagaaaaagtactttccttaatacaatttcgcataccgtactacgtaggcccgctagtgaacgaccacaccgctagcaaatttggttggatggagagaaaatccaacgaatctattaaaccttggaacttcgatgaagtcgtggacagatcaaaaagcgccacacaattcatacgacgaatgaccaacaaatgcagctatttaattaatgaagacgttttacccaaaaactcattgctttatcaagagatggaggtgctgaatgaactaaatgcaacgcaaatacgtttacagacggatcccaaaaaccgaaaatacagaatgatgccacaaataaaactatttgccgtagaacatatatttaagaaatacaaaacagttagtcattcaaaattcttagagattatgctcaattcaaatcatcgagaaaactttatgaaccatggagagaaattatcaatctttggaacacaagacgacaaaaagttcgcatcgaaattaagcagttaccaagacatgacgaaaatattcggagacatcgaaggaaaaagagctcaaattgaggaaataatccaatggatcacaatatttgaagataagaaaatacttgtacaaaaactaaaagaatgttatccagaactaacatcaaaacaaataaaccaattaaagaaattgaattactccggctggggaagactcagtgaaaaactactcacacatgcataccaagggcactcaattatagaactactacgtcacagcgacgaaaatttcatggaaatcttaactaatgacgtctatggattccaaaacttcataaaagaagaaaatcaagtccaatccaacaaaatacaacatcaggatatagcaaatcttacaacaagtccagctttaaagaaaggcatatggtcaactataaaattagtacgagaactaacttcgatatttggcgagcccgagaaaatcatcatggagttcgcaacagaagatcaacaaaaaggaaaagaacaaaaatcacgaaaacaactatgggacgataatattaagaaaaataaactcaaatctgttgatgaatataaatacattatcgacgttgctaacaaacttaacaatgaacaacttcaacaagaaaaattatggttatatctaagtcaaaacggaaaatgtatgtactctggacagtccattgatctagacgccttgctatcccccaacgctaccaaacactacgaagtagatcatatattcccaagatcattcataaaagatgacagtatagataacaaagtcctcgtcattaagaaaatgaatcaaacgaaaggagatcaagtaccattacagtttatacaacaaccttacgaaagaattgcatactggaaatcgctaaataaagcaggactcatatcagatagcaaattacataaattaatgaaacctgagttcacagcaatggacaaagaaggcttcatacagagacaattagtagaaacaagacaaatatccgtacatgtaagagattttctaaaagaagaatacccaaataccaaagtaattcccatgaaagccaaaatggtatcagagttcaggaagaaattcgacatcccaaaaatcaggcaaatgaatgacgcacatcatgccatagatgcgtacctcaacggcgtcgtctaccacggagcccagctggcataccctaatgtagacctatttgatttcaacttcaaatgggaaaaagtaagagaaaaatggaaagcattaggcgagttcaatacaaaacaaaaatcaagagaattattcttcttcaagaaactggagaaaatggaagtatcgcaaggagaaaggttgattagcaaaataaaactcgatatgaatcatttcaaaattaattactcaaggaaactagcaaatataccccaacaattttacaatcagaccgcagtatcgcctaaaacagcagaacttaaatacgaaagcaacaaaagcaatgaagtcgtctacaaaggattaacaccctaccaaacatacgtcgtcgcaataaaatcggtcaacaagaaaggtaaagagaaaatggaataccaaatgatagaccattacgtattcgacttttacaaatttcaaaatggcaacgaaaaagaactcgccttatatctagcgcaaagagaaaacaaagacgaagtactagatgctcaaatagtgtactcactaaataaaggagacttattatacataaataatcacccatgttactttgtaagccgtaaagaagtgataaacgcaaaacaatttgaactaaccgtagaacaacagttatcactgtacaatgtgatgaacaataaagaaacaaatgtagaaaaattactaattgaatacgatttcatagcagaaaaagtaatcaatgaataccaccactatctcaacagcaaattaaaagaaaaacgagttagaacatttttctcagaatcaaatcaaacccacgaagattttattaaagcacttgacgaactgtttaaagtcgtaactgcatctgccacaagatcagacaaaattggatcaagaaagaacagtatgacacaccgagctttccttggaaaaggaaaagacgtcaaaatagcatacacaagcatttcaggacttaagacaacgaagccaaagagcttattcaaactagctgaatcaaggaacgaactatga

SEQ ID NO: 8756 - RNA, 4005 nt, synthetic construct
  misc_feature 1..4005: note = Cas9 variant
  source 1..4005: mol_type = other RNA
atgaagaatccttataccataggtctagatattggaactaacagtgtaggttgggctgtcttaacagaccaatatgatctggtcaagagaaaaatgaaggtagcgggcaactcagataagaaacaaattaagaaaaacttttggggcgtccgactctttgatgagggagaaaccgcagcagatcggagaatgaatcgtacagcaagaaggcgaatagaacgcagaagaaatagaatttcatatctacaagaaatattcgcactagaaatggcaaacattgatgcaaactttttctgcagactaaatgactcattctacgtagattccgaaaaacgaaattctagacatccgttctttgcaacaatagaagaggaagtcgcatatcacaaaaattatcgtacaatataccatctaagagaagaattagtcaactcctcagaaaaagctgatctacgacttgtatacctagctcttgcacacatcattaaatacagaggaaactttttaatagaaggtgccctagataccaaaaatacaagcgtagacggggtatataaacaatttatacaaacatataatcaagtatttatatcaaatatcgaggaaggtacactagccaaaatggaggaaaatacaacagtcgcagatatattagcgggaaaatttacaaggaaagaaaaattagaaaggatattacagttatacccaggagaaaaatcaacggggatgtttgcacaatttatttctcttatagtgggatcaaaaggaaattttcagaaagttttcgatttggttgagaaaacagacatagaatgtgcaaaagactcatatgaagaggatttggaagctctcttggcaattatcggcgacgaatatgctgagctatttgtcgctgccaaaaacacatataatgcagtagtgcttagttctatcattacagtcaccgacaccgaaacaaacgcaaaactatctgcaagcatgatagaacgattcgacgcacatgaaaaagacctcagggaattaaaagcattcataaaactccatctccctaaacaatacgaagaaatttttagcaatgtcgcaatagatggatacgcaggatatatagatggaaaaacaaaacaagttgatttctacaaatacctaaaaacattattagaaaatatagaaggcgcagactactttatagcaaaaatagaagaggaaaactttttacgaaaacaaagaacattcgataacggagcaatacctcaccagctacacttagaagaactcgaagcaatactacaccaacaagcaaaatactatccgttctttaaagaagcatatgacaaaattaaaagtttagtaacatttagaataccttactttgtaggtcctctggcaaatggacaaagcgatttcgcttggctaacacggaaagcagatggcgaaatacgtccgtggaatatagaagaaaaagttgatttcggcaaatcagcagtagactttatagagaaaatgacgaataaagatacctatctaccgaaagaaaatgtcctcccaaaacatagcttatattatcaaaaatacatggtgtataatgaattaacaaaagtaagatatatagacgaccaaggaaaaactaattattttagcggacaagaaaaacagcaaatattcaacgactattttaagaagaaaagaaaagtttcgaagaaagacctagaacaatttctacgtaatatgtcacacatcgaatcaccaactatcgaagggctagaagacagctttaactcttcttacgcaacatatcatgatttattaaaagttggaattaaacaagaagtactagaaaacccgttaaacacagaaatgctagaagacatagtaaaaatactcacagtattcgaagataaaagaatgataaaagaacaactacaacaattctcagatgtattagatggcgcagtcttaaagaaattggaaagaagacattatacaggttggggccgacttagtgcaaaattacttgttggaattagagacaaacaaagtcaccttactatactagactacctaatgaacgacgacggattaaataggaatctcatgcaattgataaacgattctaaccttagttttaaaagtatcattgaaaaagagcaggtttcaacaacagacaaagatttgcaatccatagtcgcagaccttgccggcagtccagccatcaagaaaggtattttacaaagcctaaaaattgtagacgagctagtttcaataatgggctaccctcctcaaacaattgtagtcgaaatggcccgagaaaatcaaacaacagtaaaaggtaaaaataatagcagaccaagatataaatcactagaaaaagcaataaaagagttcggatcacaaatactcaaagaacatccgacggacaaccaagaactaagaaacaatagattatacttatactatttacaaaatggaaaggacatgtatacaggacaagaattagacatccataatctctctaattatgacattgaccacatcgtcccccaatccttcataacagataactccatcgataaccttgtactaacatcatcagccggaaacagagaaaaaggcgacgacgtaccaccacttgaaattgtaagaaagcggaaagtattctgggagaaactatttcaaggaaacctaatgagtaaaagaaaatttgattacttgaccaaagcagaaagaggaggtctaacagaagcagacaaagcaactttcatccacagacaactcgtggaaaccagacagataactaaaaacgttgccaacatactacaccaaagattcaacaacgaaacagacaaccacggtaataatatggaacaggttcgaatcgttatgctgaagtccgccctagtaagccagttcagaaaacaatttcaactgtacaaggtaagagaagtaaacgactatcatcatgcacatgatgcctatctaaatggagtcgtggctaacacattactcaaagtatatcctcaacttgaaccagaatttgtctacggagaataccaccaatttgactggttcaaagctaacaaagccacggcgaagaaacaattttacaccaatataatgctattctttgcacaaaaagaaagaataattgatgaaaatggcgagatcctgtgggataagaaatacctcgaaaccataaagaaagtactcgattacagacaaatgaatatagtgaagaaaacagaaatacaaaaaggagagttcagcaaagcaactataaaacccaaaggtaattccagtaaattgattccacgcaaagaaaattgggaccccatgaaatatgggggtttggactcgccaaacatggcatatgcggtcatcatcgaacatgctaaaggcaaaaagaaagttgtatttgaaaagaaaataatccgaataacgataatggaaaggaaagcattcgaaaaagatgaaaaatccttcttagaaaaacaaggatacagacaaccaaaagttctgaccaaattacccaaatacacactatacgaatgtgaaaatggaagaagaagaatgttagcatctgcgaacgaagcacaaaaaggtaaccaacaggtactaaaaggtcagctcataacattattacatcacgccaaaaactgcgaagcaagtgatggaaaatcactagactatatagagtcaaacagagaaatgttcggtgaactactagcccacgtatctgagttcgcaaaaaggtatacattagctgatgccaacttatcaaaaatcaatcaattatttgaacaaaataaagataacgacatcaaggtaatagcacaatcattcgtaaatctaatggcattcaatgcgatgggagctccagcttcgttcaaatttttcgaggccacaatagaacgaaagagatacacaaatctaaaagaactactatctgctactattatttatcaatcaataactggtttatatgaagctagaaaaagactagacggatga

SEQ ID NO: 8757 - RNA, 4005 nt, synthetic construct
  misc_feature 1..4005: note = Cas9 variant
  source 1..4005: mol_type = other RNA
atgaaaaacccttacaccattggcctggatatcggaacaaatagtgttggctgggccgttcttacaaatcaatatgatctcgtgaaacgaaaaatgaaagtagcaggaaacagcgataagaaacaaattaagaaaaacttttggggagtccgtttattcgacgatggacaaacagctgtagatcgcagaatgaacagaaccgcacgtcgacgaatcgaacgtagacgcaatcgaattagttatctacaagaaatctttgcagtcgaaatggctaacatcgacgcaaactttttctgcagactaaatgactctttctatgtagacagcgagaaaagaaacagcagacaccctttctttgcaaccatcgaagaagaagtcgcctaccatgataattacaggacaatatatcatttacgtgaagaactggtcaactctagcgaaaaagcggaccttcgactcgtttacttagcattagcccacattatcaaatatagaggaaactttctaatagaaggcgcattagatactaaaaatacatcagtggatgaagtgtacaaacaattcatccaaacatataaccaagtgttcatgagcaacatagaagaaggagcattagccaaagttgaagaaaacctagaagtcgcttctatactagccggcaaattcaccagacgagaaaaattcgaacgcattcttagactttaccccggagaaaaatcaacaggaatgttcgcacaattcatcagcttaatagttggaaataaaggcaacttccaaaaagtctttaatctagtagagaaaacagatatcgaatgtgcaaaagattcatacgaagaagatctggaagcgctcctcgccataataggagacgaatatgcggaattatttgtggcagctaaaaacacatataatgctgtagtactctcatctataataaccgtgacagcaactgaaactaacgccaaactcagtgcatccatgatcgaaagatttgacgcacacgaaaaagatctaggcgagctgaaagcatttataaaattacatttgcctaaacaataccaagaaatcttcaacaatgctgctattgatggatacgccgggtacattgatggaaaaaccaaacaggtagatttctacaaatatctaaaaacaaccctagaaaatgtagagggagcagattacttcatcacaaaaatagaagaagaaaactttttaagaaaacaaagaacttttgacaatggcgttatcccccatcaacttcatctcgaagagttagaagctatactacatcaacaagcaaaatattaccctttcttaagagaagactatgaaaagataaaatccttagtaacattcagaatcccatatttcgttggcccactcgcaaaaggtcaatcagagttcgcatggctcacaagaaaagcagacggagaaataagaccgtggaatatagaagaaaaagtagacttcggaaaatcagcagttgactttatcgagaaaatgacaaataaagatacatatttaccaaaagaaaatgttctaccaaaacactcattatgttaccagaaatatatggtctacaacgaattaacaaaagttagatacatagacgaccaagggaaaacaaattacttcagcggacaagaaaagcaacaaatttttaatgatttgttcaaacagaagagaaaagttaaaaagaaagacctcgaactattcctgaggaacataaatcatatcgaatcaccaacgatagaaggcttagaagacagctttaacgcaagctatgcgacctatcacgatctccttaaagtaggtatgaaacaagaaagcctggacagtcctctaaacgcagaaatgctcgaggacatagtaaaaattttaacagtatttgaggataaaaggatgataaaagaacaattgcaacaatttagtgacgttttggacggagtagtcctcaagaaactagaaagacgacattacactggatggggaagactaagtgcaaaattacttgtaggaataagagataaacaatcgcatctcacaattttagattacctcatgaatgatgacggcctaaacagaaacttaatgcagcttataaacgatagtaatctctcgttcaaatccataattgaaaaagagcaagttagcactaccgacaaagacttacagtccattgtagcagacttggcaggaagtccggcaatcaagaaaggaatactacaatcattgaaaatagttgatgaattggtttcgataatgggatacccaccacaaaccatcgtagtcgaaatggcaagagaaaaccaaacaactgttaaagggaaaaacaacagccggccaagatataagagcttagaaaaagcaataaaagagttcggaagccaaattttaaaagaacatccaacagataaccaagaactgaaaaacaatcgcctatacctatactaccttcagaacggaaaagatatatataccggacaggaattagatatacacaatttatccaactacgacattgaccatattgtaccacaatcatttataacagataattcaatagacaatctagtactaacatcatcagcggggaacagagaaaaaggaggggatgtaccacccctcgaaattgttaggaaaagaaaagtattctgggaaaaactgtatcaaggaaacttaatgtcaaaacgtaaatttgattacctcacaaaagccgaacgtggaggattgacagatgccgataaagcaagattcatccatagacagttagtagaaacaagacaaattactaaaaatgttgctaacattctgcatcaacggtttaataatgaaacagataattatggtaatacaatggaacaggtcaggattgtaacactgaaaagcgccctagtcagtcaattcagaaaacaattccaattatacaaagttagagaagtaaatgattaccatcacgcacatgacgcatacttaaacggagtagtagcaaacacactactaaaagtatacccccaactagaaccggagttcgtatatggagaataccatcagttcgattggttcaaagccaacaaagcaacagccaagaaacaattttatacgaacataatgctatttttcgcacaaaaagaaagaattatcgacgaaaacggtgaaatactatgggacaaaaagtacttagaaacaattaagaaagtattggattataggcaaatgaacatagtaaagaaaaccgaaatccaaaaaggagagttcagcaaagcaacaataaaaccaaaaggtaactcatcgaaattaattccgcgcaaagaaaattgggacccgatgaaatacggcggactagatagcccaaatatggcttatgcagttatcatagaacacgcaaaagggaaaaagaaaatagtaattgaaaagaaattaatacaaataaacataatggaaagaaaaatgttcgaaaaagacgaagaagcattccttgaagaaaaaggatacagacacccaaaagtattaacaaaattgccaaaatatactttatatgaatgcgaaaaaggaagaagaagaatgttagccagtgcaaacgaagcgcaaaaaggcaatcaactcgtattatctaaccacttggtgtctttactataccacgccaaaaattgtgaagcaagtgacggcaaaagtctaaaatatatagaagctcacagagaagccttctcagaacttctagcgcaagtatcagaatttgccacaagatatactctagcagatgctaacttatcaaaaattaacaacctattcgaacaaaataaagaaggggacattaaagcaatagcacagtcattcgtagacctcatggtattcaatgcaatgggagctccggcttcctttaaatttttcgaagcaacaatcgataggaaaagatacacaaaccttaaagaacttttatcatccactattatatatcagtcaataacaggactatacgaatcacgaaaaagattagacgattga

SEQ ID NO: 8758 - RNA, 4005 nt, synthetic construct
  misc_feature 1..4005: note = Cas9 variant
  source 1..4005: mol_type = other RNA
atgaaaaacccatatacaataggacttgatattggaacaaattcagttggatgggcagtacttacagatcaatacgacctggttaaaagaaaaatgaaagtagcaggaaacagtgacaagaaacaaataaagaaaaacttctggggagtacgactattcgacgaaggagaaactgcagcagaccgaagaatgaaccgaacagcaagacgaagaatagaaagacgacgaaaccgaatatcatatctacaagaaatatttgcactcgaaatggcgaacatagacgctaacttcttttgcagattgaacgattcattttacgtggactcagagaaaaggaacagcagacatcctttctttgccacaattgaagaagaagtagcctaccataaaaattatcgtaccatataccacctacgcgaagagttagtaaattcaagcgaaaaagcagatctccggctcgtataccttgcattagcacacataataaaatacagaggaaattttctaatagaaggagctctcgacaccaaaaatacaagtgttgacggggtatataaacaatttatacagacctacaatcaagttttcataagcaatatagaagaaggtacattagctaaaatggaagaaaacactactgtcgctaacatcctagcaggtaaattcacaagaaaagaaaaactagaaagaattttacagctataccctggagaaaaatcgaccggaatgtttgcacaatttatatcactgatcgtgggatctaaaggtaacttccaaaaagtattcgatcttgtagagaaaactgatatcgaatgtgccaaagatagctatgaagaagacttggaagctctactagctatcataggagacgaatatgcggaactgttcgtagcagccaaaaatacttataacgcagtagtgctaagttcaataataaccgttacagacacggaaacaaatgcaaaactctctgcgagtatgatagaaaggtttgatgcccacgaaaaagatctatcagaactaaaagcgtttattaaactacacctacctaaacaatacgaggaaatattcagcaacgtcgcaatagatggatatgcaggatacatagacggaaaaactaaacaagtcgatttctacaaatatcttaaaacactcctagaaaatatagaaggagcagactattttatagccaaaattgaagaagaaaattttctaagaaaacaaagaacattcgacaacggcgcaataccccaccaactacacctagaagaactagaagccatactacatcaacaagcgaaatactatccctttctaaaagaagcgtatgataaaataaaatctctagttacattccgaataccatattttgtaggaccactagctaacggccaaagcgattttgcctggcttacaaggaaagcagatggcgaaatacgaccatggaacatagaagaaaaagtagatttcggcaaatcagcagtagattttatagagaaaatgaccaacaaagatacatacttgcctaaagaaaatgtacttcctaaacatagcctctactaccaaaaatacatggtatataatgaattaaccaaagtaagatacattgacgatcaaggaaaaacaaactatttcagcggacaagaaaaacaacaaattttcaatgactatttcaaacagaaacgcaaagtgagcaagaaagacttagaacaatttctaagaaacatgagtcatattgaatcaccgaccattgaaggtttagaagacagcttcaattcatcctacgcaacgtatcatgatttactaaaagttgggataaaacaggaagtactggaaaaccccctgaacatggaaatgttagaggacatagttaaaatattaacagtattcgaagataaacgaatgatcaaagaacaacttcaacaatttagtggagttctcgacggcgcagtcctgaagaaactagaaagaaggcactacacggggtggggccgtctctcagccaaactcctagttggaataagagacaaacaaagccatttaacaattctagactatttaatgaatgacgacggactcaacagaaacttaatgcaattaataaacgacagcaacctaagtttcaaaagcataatagaaaaagaacaggtgtcgactacagataaagacttacaaagcatagtagctgatctggccggctccccagccatcaagaaagggatacttcaaagcctaaaaatagttgatgaattagtatctatcatgggctatccaccccaaacaatagttgtagagatggcccgagagaaccaaactactgtaaaaggcaaaaataactctcgcccaagatacaaatcattagaaaaagcgataaaagaatttggatcccaaatacttaaagaacaccctaccgacaatcaagaactaaggaacaatagattatacctatattatctgcaaaatggaaaagatatgtacacaggacaagaactagatatacacaacttatcgaattatgatatagaccatatagtgcctcagagcttcataacagacaacagcatagataacttggtactgacatcgtcagcaggaaatagggaaaaaggggatgatgtgccgcctttagaaatagtaagaaaacgcaaagtcttctgggaaaaactattccaaggcaatctcatgagtaaaagaaaattcgactatctaacaaaagctgagagaggtggcttaacagaagctgataaagcaaccttcatccacaggcaactcgttgaaactagacaaattaccaaaaacgtggcaaacatattacatcaaagattcaacaatgaaaccgacaaccatggcaacaacatggaacaagttagaatagtaatgttgaaatcagccctagtaagccaattcagaaaacaattccaactttataaagtaagagaagtgaacgactaccaccacgcacacgatgcgtatcttaacggcgtagtcgcaaacactctattaaaagtatatccacaacttgagccagaatttgtctacggtgagtaccatcaatttgattggttcaaagcaaacaaagcaacagcgaaaaagcaattctatacaaacataatgctatttttcgctcaaaaagagaggataattgacgaaaatggggaaatcttgtgggataagaaatacctagaaactatcaagaaagttctagattatcgacaaatgaatatagtcaagaaaacagaaattcaaaaaggtgagttctcaaaagcaacaatcaaaccaaaaggaaactcatcaaaactaataccaaggaaagaaaattgggaccccatgaaatatggcggactagacagtcctaatatggcatatgcggtaatcattgaacatgcaaaaggcaagaagaaaatagtatttgagaagaaaataatacgaattacaataatggaacgcaaggctttcgagaaagacgaaaaatcattcctcgaaaagcaaggctatagacaaccaaaggtcttaacgaaactacctaaatacactttatatgaatgtgagaacggtcgtagaagaatgctagcaagtgcaaatgaagcacagaaaggaaaccaacaggtattaaaaggtcagctaattactctattacatcacgctaaaaactgcgaagcatcagatggaaaatcactggactatatagaaagtaacagagaaatgttcggtgagctacttgcccacgtaagcgagttcgcaaaacgatacactctcgctgacgcaaatttaagtaaaatcaatcaactattcgaacaaaacaaagataacgacataaaagtaatcgcccaaagttttgttaatctcatggcgttcaacgcaatgggagccccagctagttttaaattctttgaagcgacgatagaaagaaaaagatatacaaatctgaaggaactactaagagcaactataatttatcaatctataaccggattatatgaagcaagaaaaagactcgacggttga

SEQ ID NO: 8759 - RNA, 4005 nt, synthetic construct
  misc_feature 1..4005: note = Cas9 variant
  source 1..4005: mol_type = other RNA
atgaaaaatccatatacaataggcttagatatcggcacaaactcagtaggctgggcagtgctaacagatcaatacgatctagtaaaacgcaaaatgaaagttgcaggaaacagtgataaaaaacaaataaaaaaaaatttttggggggtcagattatttgacgaaggcgaaaccgccgcagatcgcaggatgaatagaaccgcacgaagaagaatagaaagaagaaggaacagaatcagttatctacaagaaatttttgcacttgaaatggcaaatattgatgcaaactttttctgcagattaaacgactcattttatgtagactccgaaaaaagaaacagtagacacccattctttgctaccatagaagaagaagtagcataccataaaaattatagaacgatatatcatttaagagaggaattagtcaacagttctgaaaaagcggacctacgactggtctatttagcgctagcgcatatcatcaagtaccgaggcaactttctaatcgaaggagcactagacaccaagaatacatctgtagatggagtatataaacaatttatacaaacgtataaccaagtattcattagcaatatagaagaaggcactttagctaaaatggaagaaaatacaacagtcgcagatatcttagctggtaaattcacacgtaaagaaaagctagaaagaatacttcagctttaccctggagagaagagtacaggaatgtttgcccaatttattagcctcatagtgggatcaaagggaaacttccagaaagtattcgacctagtggaaaagacagacatagaatgcgctaaagacagttatgaagaagatctagaagcattactagcaataataggggatgaatacgcagaactcttcgtagcagccaaaaatacctacaacgcagttgtactctcaagtattataacagtaaccgacacagaaacaaatgcaaaattatcggctagcatgatagaaagattcgacgcgcacgaaaaagatttaagtgagctaaaagcgtttataaaactccatttacctaagcaatacgaagaaatatttagtaacgtagcaatcgacggatatgccggatacatagatggaaaaacaaaacaagttgacttctataaatatctaaagacactactcgaaaacattgaaggggcagactattttatagccaaaattgaagaagaaaattttttaagaaaacaacgaacttttgataatggagcaattccacatcaactacatcttgaagaattagaagcgatacttcaccaacaggccaaatattaccctttccttaaagaagcatacgataaaatcaaatctctagtcacattcaggataccatacttcgtaggaccattagcaaacgggcaatcagatttcgcatggcttactagaaaggctgacggtgaaataagaccctggaacatcgaagaaaaagtagactttggaaaaagtgcagtagactttattgaaaaaatgacaaataaggacacctatttaccaaaagaaaatgtcttacccaaacattccttatactatcaaaaatatatggtttacaatgagctcaccaaagtaagatatattgacgaccaaggcaaaacaaattattttagcggacaagaaaaacaacaaatattcaacgactacttcaaacaaaaacgtaaagtatcaaaaaaagacctagaacaatttcttagaaacatgagccacatagaatcaccaacaatagaagggttggaagactcttttaattcatcctatgcaacataccacgacttactaaaagtaggaataaagcaggaagttttagagaatccattaaacactgaaatgttagaagatattgtcaagatattaaccgtatttgaagacaaaagaatgattaaggaacaactacaacaattctcagacgtcttggacggcgcagtcttaaaaaagttggaaaggcgacattacacaggatggggtcggctgtccgcaaaactgcttgtaggtatacgcgataagcaatcgcacttaacaattttagactatctcatgaatgacgacggtctcaatagaaatttaatgcaactaattaacgactctaatttatcctttaaatcaataatcgaaaaagaacaagttagcaccacagacaaagatcttcaatcaattgtagcggacttagcaggcagcccagccataaaaaagggtatactacaatcactaaaaatagtagacgaactagtaagtataatgggctacccaccacagacaatagtagtagagatggccagagaaaaccaaaccactgtaaaagggaaaaacaattcacgaccaagatataaatcattagaaaaagctattaaagaatttggcagccaaattttaaaagagcaccccacagataaccaggaactcagaaataacagattatacttatattacctccaaaacggcaaagatatgtataccggtcaagagctggacatacataatctctcgaattatgacattgatcatatcgttccccagtcattcatcacagataactcaattgacaacctagtactaacatcctcagcagggaacagggaaaaaggagatgatgtaccaccactcgaaatcgtgcgaaaacgtaaagttttctgggaaaaattattccaaggaaatctaatgtccaaacgaaaatttgactatctcaccaaagccgaaagaggggggttaacggaagctgataaagcaacttttatacacagacagctagtggaaacacgacagattaccaaaaacgtagcgaacatacttcaccaaagatttaacaatgaaacggacaaccatggtaacaatatggaacaagtaagaatagttatgttgaaatccgcattggtatcacaattccgcaagcaattccaactctacaaagttagagaagtaaacgattaccatcatgctcatgatgcatatttaaatggcgtagttgctaacacactattgaaagtatacccccaattagaacctgaattcgtatatggcgaataccaccaatttgattggtttaaagccaataaagcaaccgctaaaaaacaattttacacaaatataatgctattttttgcacaaaaagaaagaataatagatgagaacggagaaattttatgggacaagaaatacctggaaactattaaaaaggtactagattacagacagatgaacatcgtcaaaaaaacagaaatacaaaaaggagaattttctaaagcgactataaaaccaaaaggaaactcgagcaaactcatcccccgaaaagagaattgggatccgatgaagtatggcggcttggatagtccaaatatggcatatgccgtaattatcgaacacgccaaaggaaaaaagaaagtggtatttgagaaaaaaataatcagaattacaataatggaacgaaaagcctttgaaaaagacgaaaaaagctttttagaaaagcaaggctatcgccaaccaaaagtcctaacaaaactacccaaatacacactatacgaatgtgaaaacgggagaagacgtatgttggcctccgcaaacgaagcacaaaaaggaaaccagcaagtactaaaaggccagctaataacactactacatcacgcgaaaaactgtgaagcatccgacggtaaatcactagactatatcgaatcaaatcgcgaaatgttcggagaattactagcacacgtatctgaattcgctaaaagatatactctagcagacgctaacctaagtaagataaaccaattattcgaacaaaataaagataatgacataaaagtcatagctcaatcatttgtaaatctcatggctttcaacgccatgggtgcaccagcaagcttcaaattctttgaagcaacaatcgaaagaaaacgatacacaaatctcaaagaactgttatccgcaacaataatctatcaatccattacaggactttacgaagctcgtaaaagattagatggttga

SEQ ID NO: 8760 - RNA, 4005 nt, synthetic construct
  misc_feature 1..4005: note = Cas9 variant
  source 1..4005: mol_type = other RNA
atgaaaaatccttatacaataggattagatataggcacgaactcagtaggctgggctgtactaacgaatcaatacgatttagtaaaacgaaagatgaaagtggccggaaacagtgacaagaaacaaataaagaaaaatttttggggcgtacgactgtttgacgacggacaaacagcagtcgatagacgtatgaaccggactgcgagacgcagaatagaaaggagaagaaacagaattagttacctacaggaaatatttgcagtagaaatggcaaacatagacgcaaacttcttttgtagattaaatgatagtttttatgtggacagtgagaaaagaaatagccggcatccctttttcgcaacaattgaagaagaagtagcctatcacgacaactatagaacaatatatcatttaagggaagaattagttaactcctcagaaaaagcggatttgagactcgtttatttagctttagcccatataatcaaatacagaggtaactttctgattgagggagctttagataccaaaaatacatccgtagacgaagtatacaaacaattcatacaaacatataatcaagtatttatgagtaacatagaagaaggcgcgctagccaaagttgaagaaaatttagaagtagcaagtatcttagcgggaaaattcacgcgtagagaaaaatttgagagaattttaagactttacccaggtgaaaaatcaacaggtatgttcgcacaatttattagtttaatagtcgggaacaaaggaaattttcagaaagtttttaacctagtagagaaaacagacatcgaatgcgctaaagactcgtatgaagaagatttagaagcattactagcaataataggcgatgaatacgcagaactatttgtagctgcgaaaaatacttataacgcagttgtactctcatcaataatcactgtaacggcaactgaaacaaacgcaaaactcagcgcaagcatgatagaaaggtttgatgctcatgaaaaagacctcggagaattaaaagcatttattaagctacacctacctaaacaataccaagaaatatttaacaatgccgcaatcgacggatacgctggctacatagatggaaaaactaaacaggtcgatttttataaatatctaaaaaccacattagaaaacgtagagggcgcagattatttcatcacgaaaatagaagaagaaaactttttacgcaagcaaaggacttttgataatggagtcattccacatcagctacacctagaagaactggaagctatactacaccaacaggcgaaatattacccatttttgcgagaggactacgagaaaatcaaatctcttgtaacctttcgaataccttacttcgtaggaccactcgcaaaaggacaatcagaatttgcatggcttacaagaaaagcagacggggaaatcagaccatggaatatagaagaaaaagtggattttggcaaatcagcagtagactttatagagaaaatgacaaacaaagacacctatctccctaaggaaaatgtattacccaaacattcactatgttatcaaaaatacatggtctacaatgaactaacaaaggtaagatacattgatgatcaaggcaaaacaaattattttagcggacaagagaaacaacagatctttaatgatcttttcaaacagaaaagaaaagtaaagaagaaagatctcgagttattcttacgaaacatcaaccatatagaatcaccaacaatagagggactagaagactcatttaacgcttcatacgctacatatcatgacctactcaaagtgggcatgaaacaagaaagtttagacagtccacttaacgcagagatgttagaagatattgttaaaatcctgacagtatttgaagataaaagaatgataaaagaacaacttcaacagttctcagatgtattagacggtgtagtcctcaagaaactcgaaagaagacactatacgggttggggcagactatcagcaaaactgctcgtaggaatacgcgacaaacaatcacacttaactatactagactacctaatgaatgacgacggacttaatagaaacctaatgcaactgataaacgactcaaatctttcattcaaaagtatcatagaaaaagaacaagtaagtacaacagacaaagatttacaatcaatagttgcagatttagctggatctcccgcaataaagaaaggcatcctgcaaagcctcaaaatcgtagacgaattagtaagtataatgggttaccctccccaaaccatagtcgttgaaatggcacgcgaaaatcaaaccactgtaaaaggcaaaaataactcacgtccgagatacaaatcactagaaaaagctataaaagagttcggatcacaaatattaaaagaacatccaactgacaatcaagaactgaaaaacaacaggttatatttatattacctacagaacggaaaagatatatataccgggcaagaattagatatacacaacttatcaaattatgacatcgatcatatagtaccccagagctttattacagataatagcatagataaccttgtcctcacaagtagtgcaggtaaccgagaaaaaggaggagatgtcccacccttagaaattgtaagaaaacgaaaagtgttctgggaaaaattatatcaaggcaatttgatgagcaaaagaaaatttgattacctaactaaagccgaaagaggaggtctaaccgatgcagacaaagctcgtttcatccaccgtcaattagtagaaacacgtcaaataactaaaaatgttacaaatatcctacaccaaagatttaataatgaaacagataattatggaaacaccatggaacaggtaagaatcgtgaccttaaaatcagccctagtcagccaattcagaaaacaattccaactatacaaagttagagaagtaaacgactatcaccacgcacatgacgcatacctaaatggcgttgtagcaaacacgttattaaaagtatacccacaactcgaacccgagttcgtctacggtgaataccatcaattcgattggtttaaagcaaacaaagctacagcaaagaaacaattctacacaaacattatgctgttctttgcccaaaaagaaagaattatagacgaaaatggcgaaatattatgggataagaaatacttagaaactataaagaaagtattagattaccgacaaatgaacattgtaaagaaaacagaaatacaaaaaggagaattttcaaaagcaaccattaaacctaaaggcaatagtagcaaactaataccacgaaaagaaaattgggaccccatgaaatatggagggttagactcacccaatatggcctacgcagtgattattgaacatgcgaaaggcaaaaagaaaatagtcatagaaaagaaactaatacaaataaatataatggaacgaaaaatgtttgaaaaagatgaagaagccttcctagaagaaaaaggatacagacatccaaaagtacttaccaaactccctaaatacactctctatgaatgcgagaaagggagaagaagaatgctcgcttcagctaatgaagctcaaaaaggaaatcagctagttctatctaatcacctggtaagtctattatatcacgctaaaaattgtgaagcaagtgatggaaaatcgttaaaatacatagaagcacacagagaggcattcagtgaactactagcccaagttagcgagttcgcaactagatataccctcgcagatgcgaatctttcaaaaattaacaacttatttgaacaaaacaaagaaggagatataaaagctatagctcaatcctttgtagatctcatggtattcaatgcaatgggtgcaccagcaagtttcaaatttttcgaagcaacaatagatcgcaaacgttatactaatctaaaagaactactatccagtacaataatataccaatcaataacggggctatacgaatctagaaaacgcctagacgactga

SEQ ID NO: 8761 - RNA, 4005 nt, synthetic construct
  misc_feature 1..4005: note = Cas9 variant
  source 1..4005: mol_type = other RNA
atgaagaaagagtacaccattggtctagatataggaactaattcggtaggatgggctgttctaacagaaaattacgacctagtcaaaaagaaaatgaaagtatatggaaacacggaaaccaaatatctaaagaaaaatctatggggagtaagactctttgatgaaggagaaacagctgcagatagaagactaaaacgaacaaccagaagacgatactctcgcagaaggaatagaatatgtaggttacaagatctatttacagaggaaatgaaccaagtcgatgcaaatttcttccacaggttacaagagagcttcctggtccccgacgaaaaagaatttgaaagacacgctatattcggaaagatggaagaagaagtatcttattatagagagttcccgactatatatcacctacgaaaacatctagccgacaccagtgaacaagccgacttaagacttgtatacctagctctagcacacattgtaaaatacagaggacactttctaatagaaggagaactaaatactgaaaactcaagtgtatcggaaacttttcgaacatttatccaagtgtataatcaaatcttcagagaaaatgaagtgccactagctgtaccagataatatagaagaattattttcagaaaaagtatcacgagctagaaaagttgaagcaattctcagcgtatacagcgaagaaaaatcaacaggtactcttgcacaattcttaaagttaatggtaggaaatcaagggcgatttaagaaaacatttgacttagaagaagacggcataatacaaatacccaaagaagaatacgaagaggaactagaaaccttattagcaatcataggagatgaatacgcagagattttctcggcaacaaaatcagtctatgatgcagtagcactaagtggtattctcagtgtaaccgacggagacactaaagctaaactatccgcctcgatggttgaacgatatgaagcacatcaaaaagatttagtacaattcaaacaattcatacgcaaggaacttccagaaatgtacgcaccaatattcagagataatagcgtctctggatatgcaggttacgtcgaaaattcaaaagtagtaacacaagcagaattttataaatacatcaagaaagcaatagaaaaagtccccggagctgagtacttcttagagaaaatagaacaagaaacattcctcgacaaacaaaggacattcaataacggcgtaatcccacatcaaatacacttagaagaactagaagcaataattcaaaaacaagcaacatactacccctttttggcagataacaaagaagaaatgaaacagcttgtcactttcaggattccctattatgtcggcccactagcagatggcaacagtccatttgcatggttagaaagaataagctccgaacccatcagaccaggtaacttagcagaagttgtcgacataaagaaatcggccacaaaatttattgaaaggatgacaaactttgacacctacttaccaacagagaaagtactacctaaacacagcatgatctacgaaaaatacatggtatacaacgaacttacaaaggtaagttacgtcgacgaaagagggatgaatcaacgtttctcgggagaagagaagaaacaaattgtagaagaactcttcaaacaatccagaaaagtaacaaagaaattactagaaaaattcctctcaaacgaatttggactggtagacgtggcaataaaagggatagaaacatcttttaatgccggttacggcacatatcacgactttctaaaaatagggataacaagagaacaacttgataaagaagaaaattcagaaacattagaggaaatagtaaaaatcctcacggtcttcgaagaccgaaaaatgatacgagaacaattaaagaaatatacatacctattcgatgaagaagtcctgaagaaactagaaagacgtcattatacgggttggggacgactgagcgcaaaactactcataggaattaaagagaaaagaacgcacaaaaccatactagactatctaatagaagacgacggaggaaaacaacctataaacagaaacttaatgcaacttataaatgattcagatctttcgttcaaaagcgaaatagccgaagcacaaagcgatatgaacacagaagatttacacgaagtagtgcaaaatttagcaggaagcccagcaataaagaaaggcatactacaatcattgaaaatagtggatgagctagttgatataatgggatccctccccaaaaatatcgtagtagaaatggcccgagaaaatcaaacgacatcgcgaggccgcacaaactccaatccacgcatgaaagcgttagaagaagctatgagaaacttaaggtctaatctactaaaagaataccccactgataatcaggctttacaaaacgaccgattatatttatattatctacaaaatggcaaagacatgtacaccggcctcgatttatcactacataacctctcatcatatgatatagatcacatagtcccacaaagtttcactaccgacaactcactagacaatcgagtcttagtatcctccaaagaaaaccgaggtaaaaaggatgacgtacccagtaaagaagtggtacagaaaaacatcactctttgggaaactcttaaaaacagtaacctaatatctcaaaagaaatacgataatctcactaaaggactgcgaggcggccttactgaagacgaccgtgcacattttatcaaacgacaactcgtagaaactcgacagataactaaacacgtagcacggatactagaccaacgattcaactcacagaaagatgaagaaggtaaaaccataagagcagtaagagtggtcacactcaaatccagtctgactagccaatttagaaaacagttcgccatacataaagtaagagaaatcaacgattatcaccacggacacgacgcatatctcaacggtgtcgtcgccaatagtttacttcgggtataccctcaactacagccagaatttgtttatggtgactaccctaaattcaacgcatacaaagcaaataaggcaacagccaagaaacaactctatacaaacattatgaaattctttgctgaagacgcagtaatcatagatgagaacggagaaattttatgggacaagaaaaatatagccacagtaaagaaagtgatgtcctacccccaaatgaatatagtaaagaaaccagaaatacagacaggctcattcagtaaagaaacaataaaacccaaaggagatagtgacaaactaatctcacgcaaaacgaattggagccccaaactctacggaggcttcgactcaccacaggttgcatatagcgtaataataacctatgagaaagggaaaaagaaagtaagagcaaaagccatagtaggaataaccataatggagcaatcccttttcaagaaagatccggtttcattattagaagaaaaaggatatgctaatcccgaggttttaattcacttgccaaaatacaccctttatgaattggaaaatggacgtagacgactcctggctagcgcaaacgaagcacaaaaagggaatcagctagtactcccagcaagtttagtaactctattatatcatgccaaacaagttgacgaagattcaggaaaaagcgaagaatacgtgagagaacatagagcagaatttgcagaaatcctcaactacgtacaagccttttcagaaactaaaattctagcaaataaaaacctacaaacaattttaaaattatatgaagaaaataaagaagcagatataaaagaaatagctgaatctttcgtaaacctcatgaaattttcagcatacggagctcccatggatttcaaattctttggcaaaacaataccaagaagtagatacacaagcgtcggagagttattatctgccactataattaaccaatcgataacgggactctatgaaactagaagaaaattagtagattga

SEQ ID NO: 8762 - RNA, 4005 nt, synthetic construct
  misc_feature 1..4005: note = Cas9 variant
  source 1..4005: mol_type = other RNA
atgcgaaaaccttacacgataggattagacattggaacaaactccgtgggatgggctgttctaacagaccaatataatctagtaaaaagaaaaatgaaagtagcgggatcagcagagaagaaacaaatcaagaaaaatttttggggagtacgactattcgatgaaggagaagtggcagcaggccgtcgaatgaatcgaacaacaaggagaaggatagaaagaagaagaaacaggatagcttacttacaagaaatatttgcggcagaaatggccgaagtagacgccaatttcttctaccggctagaagattccttctacatagaatccgagaaaagacacagccgtcacccattcttcgctaccatagaagaggaagtagcttaccatgaagaatataaaaccatttatcacttgagagaaaaattagtaaattctagtgataaagctgacctaagactggtttacttggcactagcacatattataaaatacagaggaaatttccttatagaaggaatgcttgacaccaaaaacacatccgtggatgaagttttcaaacaattcatccaaacatataaccagatttttgcaagtgatatagaagaaggctcattaacgaggcttgaagaaaacaaagaagtagccgaaatactatcagaaaaacttacacggagggaaaaattagataaaatcttgaaattatatacgggtgaaaaatcaaccgggatgttcgctagattcataaacctcataataggaagtaaaggcgattttaagaaagtgtttgatctcgacgaaaaagcagaaatagaatgtgcaaaagatacatatgaagaagatctagaagcattattagctaaaatcggagacgaatacgccgaaatttttgtagctgcaaaaagtacatataatgcggtcgtactatcaaacattatcacagtaaccgacactgaaacaaaagcaaaactaagtgctagtatgatagaacgcttcgataaacatgcaaaagatctaaaaagattgaaagcatttttcaaaatgcaattacccgaaaaatttaatgaagtttttaatgacatagaaaaagatgggtacgccggatatatcgacgggaaaacaactcaagaaaaattctataaatatatgaagaaaatgcttgccaatatagatggagcagattattttatcgaccaaatcgaagaagaaaattttctacgaaaacagcgaacatttgacaatggcacaattccacaccaattacatttagaagaactagaagcaattttacatcaacaagcgaaatactacccctttttaagaaaagattacgagaaaattcgatcattagtaacgtttaggattccgtacttcatcggtccattagcaaacggccaatcagacttcgcatggttaacaagaaaagcagacggagaaataagaccatggaatattgaagaaaaagtagatttcggaaaatctgcaatagacttcatcgagaaaatgactaacaaagacacatacctgccaaaagaaaacgtactgccaaaacattcactatgctatcaaaaatacatggtttacaacgagctaacaaaaataagatacatcgatgatcagggtaaaacacatcacttcagtggtcaagaaaaacaacaaatatttaacggtctgtttaaacaacaaagaaaagtcaagaagaaagacttagaaagatttttgtacaccataaatcatattgaaagtcccacaatcgaaggagtagaggacgcattcaactcatcgtttgcaacatatcacgacctacaaaaaggaggcgttacacaggaaatactagacaacccactgaatgcagatatgttggaggaaatagttaaaatcctaacagtatttgaagataaaagaatgataaaagaacaactacaaagtttttctgacgtattagacggcacaatactcaagaaactagaaagaagacactatacagggtggggaaggttgagcgcaaaattattaaccggtattcgagacaaacactcacacctcacaatactagactatctaatgaacgacgacggattaaacagaaacctaatgcaattaattaacgacagcaacctcagctttaaatcaataattgaaaaagaacaagtatctaccgctgacaaaggtatacaatcaatagtagctgaattagcaggaagccccgccatcaagaaaggaatattacagagtttgaaaatagtcgacgagctagtagggatcatgggataccctccacaaacaattgtagtagaaatggcaagagagaaccaaaccacggggaaaggcaaaaataacagcaaaccaagatttattagcctagaaaaagccattaaagaatttggaagccaaatactaaaagaacatccaacagacaaccaatgtctcaaaaatgatagactatatctatactatttacaaaacggtaaagatatgtatacaggtaaagagttggatatacataatttatccaactacgatattgatcacatcataccacaaagttttataacagataactcgatagacaatagagtattagtatccagtacagcaaacagagaaaaaggagataacgttcccctactcgaggtagttaggaaaagaaaagcattttgggagaaactataccaagcgaaactcatgtctaaaagaaaattcgattaccttacaaaagctgaaaggggaggcttgacagaagcagacaaagcaaatttcattcaacgtcaattagtagaaacgagacagatcaccaaaaatgttgcaaatattctgtatcaaagatttaactgcaaacaagacgaaaatggaaacgaagttgaacaagttcgaattgtaaccctgaaatcaaccctagtatctcaatttcgcaaacaattccaactatataaagtaagagaagttaatgactatcaccacgcccatgatgcatacttgaacggcgttgtagctaacacactcctaaaagtttacccacagttagaaccagaatttgtgtacggagactatcaccaattcgattggttcaaagctaacaaagcaactgctaagaaacaattctacactaacataatgagatttttcgcaaaagaaaatcaaatcattgataaaaacggcgaaatactatgggacaaccgttatttagacacaatcaagaaagtactcagctacagacaaatgaacattgtcaagaaaaccgaaatccaaaaaggcgagttcagcaacgccacagtgaatccaaaaggaaactcgagcaaactcatatcaaggaaagccgactggaacccaattaaatatggaggatttgacggcagcaatatggcctactctatagtaatagaatacgagaaaaggaaaaagaaaacagtcattaagaaagaactaatacaaataaacataatggaaagagtagcatttgaaaaagatcaaaaagcatttctagaagaaaaaggttactactcacccaaagtactaacaaaaataccaaaatataccctttacgaatgtgaaaacggccgacgaagaatgcttggatccgccaacgaagcgcaaaaaggtaatcaaatggtactgcccaatcatctcatgaccttactctaccacgctaaaaactgtgaagcaaatgacggagaatccctagcatacatagaaatgcacagagagatgtttgcagaattactcgcctacatttccgaatttgctaaaagatacacgttggcaaacgacagattagagaaaattaatatgttctttgaacaaaacaagaaaggtgacataaaagtaattgccaaatcctttgacaaattgaaagtatttaacgcgttcggtgcgccaagagatttcgagttctttgagacgacaataaaaagaaaacgatattacaatataaaagagctacttaacgccacgataatatatcaatcaataactggtttatatgaggccagaaaaagattagaggattga

SEQ ID NO: 8763 - RNA, 4008 nt, synthetic construct
  misc_feature 1..4008: note = Cas9 variant
  source 1..4008: mol_type = other RNA
atgaaaaactacacgataggactggatataggaacaaattctgtcggatgggccgtcatcaaagatgatctaacgctagtaagaaagaaaataaaaatatcaggaaatacagacaagaaagaagtaaagaaaaatctttggggatcattcttgttcgaacaaggagatacggcacaagatactagagtcaaaagaatagccaggagacgatatgaacgacgaaggtttcgcataagagaactgcagaaaatttttgacaaaagtatgggagaagtagatagcaacttcttccacagactggatgaatcatttctagtcgaagaagacaaagaatactcaaaatatccaatattctccaacgaaaaagaagataaaaattactacgacaaatatccgactatctaccatctaagaaaagacctagcagactcaaaccaaaaagcagatctacgcctaatctatttagctttagcccatatgatcaaatacagaggacactttctaatagaaggagacttgaaaatggatggaatctcaatctccgaatcgttccaagaatttatagattcatacaatgaagtatgcgcactggaagacgaaaatctagaaataatatacaacgatgaattactaactcaaatagaaaatatatttaaacaagatataagtcgatccaagaaactagaccaagcgatcgcattatttcaaggagtgaaaaggcaaagtctatttggaatattcctcactcttattgtcggaaacaaagccaacttccagaaaatatttaatcttgaagacgacataaaactagatttaaaagaggaagactacgatgagaatcttgaagaattattaagtaatatcgacgaaggttacagagacgtatttctacaagctaaaaacgtttacaacgcaatagaactctcaaaaattctgaaaacagacgggaaagaaactaaagccccattaagcgcacaaatggtcgaactatataatcaacatcgagaagaccttaagaaatacaaagactacattaaagcatacctacctgagaaatatggagaaactttcaaagatgcaacgaaaaacggttatgccggctatattgatgggaaaacatcacaagaggatttttataaattcgtaaaagcccaactaaaaggtgaagaaaatggagaatactttttagaagcaatcgaaaatgaaaatttcttaagaaaacaaagaagtttctacaacggagtaatcccttatcaaatacacctccaagaacttacggcagtactcgatcaacaagaaaaacattattccttcctaaaggaaaaccgagacaagataatatcactcttaacgtttagaataccctattacgtgggtccactcgctaagggagaaagtagattcgcttggctagaacgatcaaacagtgaagaaaagatcaagccttggaattttgataaaatcgttgatatcgataaaagcgccgaactattcatcgaaaaccttactagccgtgatacctacttgccagatgaaccagttctaccaaaacgtagccttatataccaaaagtttacaatatttaatgaactaacaaaaatatcatacatagacgaaagaggcatacttcaaaacttcagttcaagagagaaaatagccattttcaatgatctcttcaaaaataaatcaaaagtaaccaaaaatcaactggttaaatacatagaaaacaaggaacaaataatagctccagaaattaaaggaattgaagacagctttaattcaaactacagcacatacatagacctatcaaaaatccccgatatgaagaaactgctcgaaaaagacgaagatgaaattttagaagagataattaaaatcttaacaatcttcgaagatagaaaaatgagaaaacgacaacttatgaaatttaaagataaacttagtgaaaaagcaataaatcaactatcgaagaagcactacacaggatggggacaattatctgaaaaattaataaatggtattagagacgaacaatcaaataaaaccatattggattacctaatcgaagataacggatgcccaaagaatatgaacaggaacttcatgcaactaattaatgacgacaccttatcatttaaggaaaagatccgaaaagctcaagacataaaccaggtaaacgacataaaagaaatcgtaaaggatctacccggatcacccgctataaagaaaggcatctaccaaagtattcgcatagtagacgaaataattagaaaaatgaaagatagacctaaaaatatcgtaatagaaatggcaagagaaaaccaaaccacacaagaaggcaaaaacaaatcaaaagcacgactaaagaaaatacaagaagggctagaaaatttagattctgtccatgtggaaaaacaagcactagacgaagagatgctaaaatcaccaaaatattatctatactgtttacagaatggcaaagatatatatacaggcaaagaccttgacataggccaattgcaaacctatgacattgatcatataattcccagatcattcataacagataacagcttcgacaacctagtactaacatccagtaccgtaaatagaggtaaactagataacgttccaagtcctgatatagtacgtcagcaaaaaggattctggaaacagctactaagagctgggttaatgagtcagagaaaatttaacaatcttaccaaaggcaaacttacagatagggacagacaacaatttattaatagacaacttgtagagacaagacaaataacaaaacatgtagcaaacttattatcgcaccatctaaacgaaaagaaagaagtcggggaaataaatattgtactactaaaaagcgctttaacttcacagtttagaaagaaatttgacttctacaaagtccgcgaagtcaacgactatcatcatgcacacgacgcctacctaaacggagtcatagcactcaaattactcgagttgtacccatatatggctaaagacttaatatatggtaaatacagctatcatagaaaaattgaaggagataaagccacgcaagctaaatacaagatgtctaacatcatagaacgtttcagtcaagaccttctcgcaaacccagacggtgaaattgcgtgggaaaaagataaagatctgaataccataagaaaagtgctttcatcaaaacaaataaatataataaagaaagcagaagagggcaaaggacgacttttcaaagagacaataaactcccgaccatcaaagaaaacagagaaaagaatacccattaaaaataatcttgatccgaatatatatggaggttatatagaagagaaaatggcctactacatagcgatcaactacttagaaaacggtaaaacaaagaaagccatcgtaggaataagcatcaaagataagaaagactttgaaggacaaacaactgaatatttaggaaaaatcggatttaataaagcatccataattaatagcttcaaaaactacaccctctttgaactagaaaacggatcaagaaggatgatcgttggagcctcaaaagaaaacgactctaaaggagaattacaaaaaggtaatcaaatgtacttaccacaaaacctccttgagttcgtctatcacctaaaacactataatgaagacgaaaccagtcataaattcatcgtagaacataaagcatattttgacgaattattaaactacatagtggagttcgctaataaatatctagaactagaaaattcaatcgaaaagataaaagacctgtaccacggaaaaggaccagatgtcgaagaaaaagagctagtagaatcattcattaatttattagcgatcactaaatgcgggccagcagccgacataacatttctaggcgagaaaattagcagaaaaagatacaggtctacgaattgtctatggggatcagaagttatatttcaatcaccgacaggactatatgaaacacgactcagactggaatga

SEQ ID NO: 8764 - RNA, 4011 nt, synthetic construct
  misc_feature 1..4011: note = Cas9 variant
  source 1..4011: mol_type = other RNA
atggatgacaactaccaattaatgcacgctaaaggaaaatatgggtacggaacaagaatatattcggaaggacaaactgcagctgatagacggggttttagaaccacaagacgaaggttaaataggagaaaatggcgtttacgtctattacaagactttttcgagccctatatactaccacaagatgaagcattctttattagacaaaaacaatcaaatttagtaccacaagatacaaagaaacaatacccggaaagtgtactatttgacgacacaagtgacaaagacttttatacagaatatccgacaatatatcacttacgacaagcacttatgaccgagaatagacaatttgatataagagaggtatacctagcaatacaccacatagtaaaatatcggggacactttcttaataacgctccggttaaaacgtttaaatctggtaacctagatttagctataaaattcaatgaactcaacgaagagttcaaatcagtttacccagatctggaattacaattcaacttagatcaaatagacgaaatcaaaaagatattacttgacagtaccaagagtagatttgatagacaaggtgaagcagtcaaactaatatacacggtaagcgaagtgaaaaccattgaaaaactccaaaacaaaatagtgaagcaattcctcagcggtatactaggattaaatacaagatttgatgtgctaacaaacacagaaagcgatgattcaatgtggaaattcagtctcgattctgaatcaagcgatgatgctctagacgaaattatagcccaactcgacgatccagcaattcacgtagttgaattagtaaatgaaatacattcatcaataacactagctgggatcgttccagaaggacaaggtttaagtgaaagtatggtggaaaaatacgaagcacacaaagcccacttacaactattaaaagcagttgaaaagctagtagacaagaaagccgcagataaattggaagtagcctacgaccaatatattaatgggaaagatagtaaacaatttattaaagaagacttttacaaagctgtacaatctgaaataaaaggtgtagccggagacgaagtcgctgaaataaatcaactaattgaactagatcaattcatgccaaaacaacgaacaaaagaaaatggggccataccacatcaattacaccaacacgaacttgacgttataatcgaaaaccaatcgaaatactacgactggctcggggaaaaagttggaaacgaatataagttagacaaattggtgagctttagagtaccatactacgtagggccattagtagacactgcatcgaaagaaaagaaagatgaaacaagatttgcatggatggtacggaaaaacccagaaagcacagaagcaataacgccatggaactttgaagacatagtagacaaaaacgcatctgcggaaaatttcattaaaagaatgacaacaaaagacaaatacttacttaatgaggatgttctacccaaatgtagtttgttaacccaagactttgaagtatataacgaactaaacaacatacgagttaacggagagaaattcacagctgaacagaaacaattaattcatgatgaactctttactaagcacgcttcagttagtatcaaacaacttaaagactttctggtctcagaactaatgtacgtaagagacaatcttaaagtagaaggactcgcagacgaaaagaaactaatgagctcattgtccacgcaattcgattaccagaaaatcataccagaccaaataaacgacgtaaaatatagagaagacatcgaacaaataatagaatggagcacgatattcgaagatgctgcaatatttaaaaccaaattgaaagaaatagattggctaaccgacgaacaacgcaacaaactagcaaataaaagatacagaggatggggctcattatcaaaaagactattagcgtgcctcgtcgacgagaacgggcaaagaattatagatattctaagagacagcagtgataatttcatgatgatagtgaacagaccagagttcaaacaagcaatcttcgacgaaaacgcgaacctaacggaaacaaactccaagaaagacatgttcgaaatgatagacaatttttacacgagtccacaaaataagaaagcaataagacaagtgttacttgttgttcaagacattcaaaacgcgatgggcggcgtagctccgcagaaaatctttattgagttcgctagagaagatgaagtaaatggaagaagaacaaatagtcgctattcacaaatacgtgaaatgtactccaaagtcacagatgatgttataaacaaaacagttagaggagaattagaagcaaacaaaggctcactaaataaagaaaaactattcttatacttcttacaaggaggaatagatttgtactcaggaaaaacaataaacatagacaacatatcgtcatatgatgtagatcacgtattacctcaatcctttataaaagacgatagcataaacaataaagttctagttaatgccaaaggtaatagagttaaaaatgacaatgtgcccatggaactttttggagcaaaaatgtacccaacatggaaaaggatggtagatacagggattatgtcaaaagccaaatttaaaaatctaacactaaacccggataacgtagataaatttaaagcagaaggatttataaaccgtcagctagtggaaaccagacaaataataaaattagtagctcaaatattgaacgataaacttggcgacgacactaaaatagtaagcgttaaagctaacttaacacacgacatgagagtctttttcgatttcccaaagaatcggaacgtaaacaattaccatcacgcatttgatgcttacctcagtgcatttgtaggtacatatctctacaaacgttacccaaaactacaaccatacttcgtatatggcgaatttaagaaaatggacaaactgaaaaatatgacatcattcgattttctaagagatctcaaacacaccgacaaagtagtcgataaagacacaggcgagattatagcagataaactagctgtaataacaaatatgaacaaaatatatgacttcaagaaagtactggtaacacatgaagtccatgagaactctggggcaatgtatgaccaaaccctatacccagcaaaattagacaaatctctaggaagaaaaggcgccaaacaactaataccaaagaaagatgatatgccaaccgcactatatggtggatacacaggaagcaaagacgcgttcatgtcaatcgtaaggctcaagaagaaagatgaagtatattacaaagtaattggaataccagtccgcatcgcagactcagtccaacatggaaaagaagtcgatgtagaagcacttacacaattcatcgagaccaaatttaccaaagaaaaccttaacaagaaaacaggtgaaattacacggaaagtggaatggttcgaactcgttttacctaaagttctatttggacaagcagttttcgacggaggacaaccattcatgctaggaagctcaacatacccacacaacctacgagaattggtccttacaaaagacagcgtgaagaaaatagcaggcaaagagtctaataaatcatacttagatgcttacgacgaaattatggaagcaatgaataaatacttcccattatacgacaccaataaattcagagagaaagtgatagaaggaaggtcgaaatttattgatctccctgacaaagacgagtatgagaataataagctagtccaagtaggtaaaagtacgataatagacagaatgtttataggactacacgcaaatgccgcacgaaccgacctaaagaacataggaataactaccccatttggttttatgcaacaggcttccggtataaaactaaccaaagacacggtagttttatttcaaagcagcacgggcctgttcgaacgcaaagtcgcattaaaagacttatga

SEQ ID NO: 8765 - RNA, 4011 nt, synthetic construct
  misc_feature 1..4011: note = Cas9 variant
  source 1..4011: mol_type = other RNA
atgactaaagattatacaattggactggatatcggaaccaattccgtgggatgggctgtactgactgatgactatcaattaatgaaacgaaaaatgtctgttcatggaaacaccgagaagaagaaaattaagaaaaatttttggggagcccgactttttgatgaaggccaaacagccgaatttcgtcgaactaaacgaacaaaccgtcgcagactagcaagaagaaaatatcgcctctcaaaactacaagacttatttgccgaagaactatgtaaacaagatgactgcttctttgtacgattagaagaatcattcctcgtgccagaagaaaagcaatacaagccagcatcaatcttcccaaccctagaagaggagaaagaatactaccaaaaatacccaactatatatcatttaagacaaaaactcgttgacagcacagaaaaagaagacctacgtttagtatatctcgccctcgcccacctccttaaataccggggtcacttcctattcgaaggatatctcgacactgaaaatacatcgatagaagaatccttccgcgtttttcttgaacaatacggtaaacaaagtgatcaacctctaatcgttcaccaaccagtactcactatattaactgacaaattaagcaaaaccaagaaagtggaagaaattctaaaatattatcctacagagaaaattaacagcttctttgcccaatgcctcaaactaatagtaggaaatcaagcaaattttaaaagaatattcgacttagaagcagaagtaaagctacagttttccaaagaaacatatgaagaagacctcgaatcactgttagagaaaataggagacgaatatctagacatatttctacaagctaagaaagtacatgatgccatacttctatctgaaataatcagctctaccgtgaaacacacacaagccaaattatcctctgggatggttgaaagatatgaacgccataaagccgatttagcaaaattcaaacaatttgtaaaagaaaatgtcccccaaaaagcgaccgtgttctttaaagacacaaccaaaaacggttacgcaggctatataaaaggtaaaactacacaagaagaattttataaattcgtcaagaaagaattgtcaggagtagtaggctcagaaccatttttagagaaaatagatcaagaaacattcctactcaaacaacgaacctacaccaatggtgttataccccaccaggtacatctaatcgaattaaaagcaataatagaccaacaaaaacaacattacccctttctagaagaagcaggccccaaaattatcgcactattcaaattcagaataccatactacgtaggccccctagccaaagaacaagaagcatcctcattcgcatggatcgaaagaaaaacagcagagaaaatacatccttggaactttagcgaagtcgtagacatcgaaaaatccgctatgcgcttcatacaaaggatgacaaaacaagatacttacctacccacagaaaaagtactaccgaaaaatagcctcctttatcaaaaatatatgatattcaatgaattaacaaaagtgtcatataaagatgaacgaggcgtaaaacaatacttttcgggcgacgaaaaacagcaaatatttaaacaattattccaaaaagaacgaggcaaaattacagtcaagaaactgcaaaattttctttacacacattatcacatagaaaatgcacatatattcggcattgaaaaagcgtttaatgcatcatactcaacctaccacgacttcatgaaactcgctaaaaccaaccaaaaatctatgcaagaatggcttgaacagccagaaatggaaccaattttcgaagacatcgttaaaatactgactatatttgaagatagacaaatgatcaaacaccaactgagtaaataccaagaagtcttcggagaaaaactacttaaagagttcgccaggaaacactacacaggctggggtagattttctgctaaattaatccatggaatcagagatcgcaaaactaataaaacaattctcgactatctgatcaatgatgatgacgtaccagcaaataggaataggaatttaatgcaactcataaatgacgaacacctctcattcaaagaagaaatagcaaaagctacggttttctcaaaacacaaatccctagtagacgtaatacaagacctaccaggttccccagccatcaagaaaggcatatggcaatcacttaaaatcgtagaagaattaatagcgataattggttacaaaccaaagaacatcgtaattgaaatggcccgagaaaatcagaaaacacatcgtacaaaacctaggttaaaagcactcgaaaatggactaaaacaaataggatcaacactattaaaagaacaacccacagataacaaagccctacaaaaagaaagactctacctctactacttacaaaatggaagagacatatacacaggagaacccctagacatagaaaatcttcatcaatatgaagtagatcacataataccgaggagttttatagttgacaacagcatcgataacaaagtcttagtagcatcaaaacaaaaccaaaagaaacgcgacgacgtacctaacaaacaaattgtaaatgaacaacgcattttctggaaccaattaaaagaagccaaactcatctctcctaagaaatacgcatacttaacaaaaatcgaactaacaccagaagataaagcacgattcatacaaagacaattagttgaaacacgtcaaataactaaacatgtagctaacatattacatcaatcttttcatcaagaagaagaaggaaccgattgcgacggcgtccaaataataacactgaaagccacactaacatctcaatttaggcaaacattcggactctacaaagtaagagaaattaatccccaccatcacgcgcatgatgcctacctcaacggcttcattgcaaatgtattactaaaaagatatcctaagttagcaccagaatttgtttacggtaagtatgtaaaatattcattagcccgtgagaataaagctaccgccaagaaagaattttattcaaacatactaaaattcctagaatctgatgagcccttctgcgacgaaaatggggaaatctattgggagaaaagctatcatctaccacgcatcaagaaagttttatcctcccaccaagtaaacgtagttaagaaagttgagcaacaaaaaggtggcttttacaaagaaacagtaaactcaaaagaaaagcccgataaattaatagaaaggaaaaataattgggacgtaacaaaatacggaggatttggctcgccagtcatagcctacgctatagccttcgtctatgccaaaggaaaaacccagaagaaaactcgagcgatagaaggtataaccattatggaacaagcagcattcgaaaaagacccaacgacattcttaaaagacaaaggattccctcaagtgaccgaatttataaagctcccaaaatacactctttttgaatttgacaatggacggagaagattcttagcttctcacaaagaatcacaaaaaggcaaccccttcatactatcagatcagctagtaactcttttatatcacgcacaacactatgataaaataacgtaccaagaatcgttcgattacgttaacacgcacctgtccgactttagtgctattctcacagaagtcctcgcatttgccgagaagtacacattagccgacaaaaatattgaaaggattcaagaactttacgaagaaaacaagtacggagaaatttcaatgattgcacaatcgttcttgcaactcctacagtttaatgccataggagctccagcagatttcaaattctttggagtaacaataccaagaaaaagatacacgagcttaactgaaatatgggacgctactataatatatcaaagcgtcacgggactatatgaaacaagaataagaatgggagatttatgggcaggagaacaatga

SEQ ID NO: 8766 - RNA, 4011 nt, synthetic construct
  misc_feature 1..4011: note = Cas9 variant
  source 1..4011: mol_type = other RNA
atgacaaaagactacacgatcggactagatatcggaacaaattcggtaggctgggcagtacttacggacgactaccaattgatgaaacgaaaaatgagtgtccacggcaacaccgaaaaaaaaaaaataaaaaaaaatttctggggagccagactgttcgatgaagggcaaaccgcggaattccgtcgaacaaaaaggacaaacagaagaaggctagcacgcaggaaatatagattgtccaaacttcaagatcttttcgcagaagaactatgcaaacaagatgattgttttttcgtcagactagaagaatcatttctcgtaccagaagagaaacagtataagccagcttcaatatttccaacattggaagaagaaaaagaatactaccaaaaatatcctactatttaccacttgcgccaaaaactagttgattctacagaaaaagaagatcttcgtctagtttacctcgcactagcccatctattaaaatatcgaggtcatttcttattcgaaggagatctagacacagaaaacactagtatagaggaatcatttcgagtattcctagagcaatactcaaaacaatcagaccagcccttaattgtccaccaaccagtattaactatattaacagacaaactcagcaaaacaaaaaaagtcgaagaaatactaaaatattatccaacagaaaaaataaactccttttttgcacaatgcctaaaacttatagtcggaaaccaggcaaactttaaacgaatatttgacctagaagctgaagttaagctacagttctcaaaagaaacatatgaagaagatctagaatcacttctagaaaaaataggagacgaatacttggacattttcctgcaggctaaaaaagtacatgacgcaatattactatcagaaataatatcgagtacagtaaaacacaccaaagcaaaactatcttccggaatggtagagcgatacgaaagacacaaagcagatttagcaaaattcaaacaatttgtaaaagaaaatgtaccacaaaaagcaacagtattttttaaagacacaaccaaaaacggttacgcaggatatataaaagggaaaacgacacaagaagaattttacaaattcgttaaaaaggaactatcaggcgtggtgggatcagaaccctttcttgaaaaaattgatcaagaaacatttctcctgaagcaacgcacatataccaacggcgttattccccatcaagtacacctaatagaactcaaagctataatagatcaacaaaaacaacattatccgtttctggaagaagccggccctaaaataatagccctcttcaaatttagaattccatactacgtgggtcctctagccaaagaacaagaagcctccagttttgcatggatagaacgaaaaacagcagaaaagattaatccctggaatttctcagaagtcgtggatattgaaaagtcagcgatgcgttttatacaacgcatgacaaaacaagacacatacctacccacagaaaaagtattaccaaaaaactccctgttatatcaaaaatatatgatatttaacgaattgacaaaggtatcttacaaagacgaacgaggagtcaaacaatacttttccggagacgaaaaacaacaaatattcaaacaattattccagaaagaaagaggaaaaattacggtcaaaaaattacaaaatttcctctatacccactaccacattgaaaatgcacaaatattcggcatagaaaaagcctttaacgctagctattccacctatcatgacttcatgaaactcgccaaaaccaaccagaaagcaatgcaagaatggttagaacaaccggaaatggaaccaattttcgaggacatcgtaaaaatattaacaatttttgaagaccgtcaaatgattaaacatcagctctctaaataccaagaagtcttcggagaaaagcttttaaaagaattcgcaagaaaacattacacaggatggggaagattctctgcgaaactgatacacggaatccgtgacagaaaaacgaataaaacaatactagactacctaataaacgacgacgacgtacctgcaaacagaaatagaaaccttatgcaactaataaacgatgaacacttaagctttaaagaagaaatagcaaaagcaacagtatttagtaaacataaatcactagtcgatgttatccaagacttaccaggctcccccgcaataaaaaaaggaatatggcaatcactcaagatagtagaagaacttatcgcgattataggatataaacctaaaaacatagtaatcgaaatggccagagaaaatcaaaaaacccaccgaacatctcctcgcctcaaagcattagaaaacggtctaaaacaaattggaagtacattactaaaagaacaaccaacggacaacaaagcactacagaaagagcgattgtatctatactacttacaaaatggcagggatatgtatacaggcgaaccactcgaaatagaaaacttacatcaatatgaagtagaccatataatcccacgatccttcatcgtagacaactccatagataacaaagtcctagtggcaagcaaacaaaaccaaaaaaaacgtgatgatgtaccaaaaaaacaaatagttaacgaacagcgcatcttctggaatcaactaaaagaagcaaaattaatttctccaaaaaaatacgcgtatctcactaaaattgagttaactccagaggacaaagctcgattcatacaacgacaactcgtggaaacccgacaaataacaaaacatgtcgccaacatattacatcaatcattcaatcaagaagaagaaggaacagattgcgatggggtacaaataatcacattaaaggctacactaacatcccagttcagacaaacattcggattatacaaagttagagagatcaatccgcaccaccatgcacatgacgcctacctcaatggatttattgctaacgttctattaaaaagataccctaaattagctccagaatttgtatacggaaaatacgtaaaatactcactcgccagagaaaataaagccactgccaaaaaagaattctactcaaatatccttaaattcttagaaagtgacgagcctttttgtgacgaaaacggagaaatatattgggaaaaaagccaccacctaccaagaatcaaaaaagttttaagcagccatcaggtaaacgtcgtaaaaaaagtagaacaacaaaagggaggtttttacaaagaaaccgtcaattcaaaagaaaaaccagacaaactaatagagcgcaaaaataactgggacgtaacaaaatatggaggtttcggcagtcccgttatagcatatgctatagcttttgtttatgcaaaaggaaaaacacaaaaaaaaacacgagcaatagagggaataactataatggaacaagccgcatttgaaaaagatccgacaaccttcctcaaagaaaaaggtttcccacaagtcactgaatttatcaaattacctaaatatacgctatttgagttcgataacgggcgcagacgattcttagcctcgcataaagaaagccaaaaaggaaatccatttatactatccgatcaactagtaacactactctaccatgcacaacattacgacaaaataacataccaagaatcgttcgactacgtcaacactcacttgagcgatttctctgcaatactcaccgaagtcctggcattcgctgaaaaatacacactggcagacaaaaatatcgaaagaatacaagaattatacgaagaaaacaaatacggtgaaacctccatgattgcccaatccttcttgcaattattacaattcaatgcaatcggcgccccagcagacttcaaattctttggagtcacaattcccagaaaacgctacacatcattaacagaaatatgggacgccacaattatttaccaaagtgtaacaggactttacgaaacacgaataaggatgggagacttgtgggcaggagaacaatga

SEQ ID NO: 8767 - RNA, 4014 nt, synthetic construct
  misc_feature 1..4014: note = Cas9 variant
  source 1..4014: mol_type = other RNA
atgaaaaatatgaaaaagccctacacaataggactcgacataggcacaaactctgtaggctgggcagtactaactgatcaatacgatttggtaaaaaggaaaatgaaaatcgccggtgatagtgaaaagaaacaaataaagaaaaacttttggggcgtaagactatttgatgaaggacaaacagcggcagatagaagaatggccagaacagcaaggcgaagaatagaaagacgaaggaacagaatttcttatctacaaggtatatttgccgaagaaatgagcaaaaccgatgcaaacttcttttgcagacttagcgactccttttacgtagataatgaaaaacgaaattcacgacacccattcttcgctactattgaagaagaagttgaataccataaaaactatccaacgatataccatctacgagaagaattagtaaacagttctgaaaaagcagacttgcgcttagtatatttagcattagcccatatcatcaaataccgaggaaatttcctcatagaaggagctttagacacacagaacaccagtgtagacggaatttataaacagtttatccaaacctacaaccaagtatttgctagtggaatcgaggatggatcactaaagaaattagaagacaacaaagacgtggccaaaattttagtagagaaagtaacaagaaaagaaaaacttgagagaatcttaaaattatatcctggagaaaagagtgcaggaatgttcgcacaattcattagtcttatagtcggcagcaaaggaaacttccagaaaccatttgacctcattgagaaaagcgacatcgaatgcgcaaaagactcatacgaagaggacttagagagtttacttgctctgataggagacgaatacgcagaactatttgttgcagccaaaaatgcctactcagccgtagtacttagtagtataatcacagtagctgagaccgaaaccaacgcaaaattaagcgcgtcaatgatagaaagatttgacacccatgaagaagatttaggagaattaaaagcctttataaaattacatttacctaaacactatgaagaaatcttctcaaataccgaaaaacacggttatgcaggctacatcgacggaaaaactaaacaagcagacttttataaatacatgaaaatgaccttagaaaacatagaaggggcagattattttatcgctaaaatagagaaagaaaatttccttcgcaagcaacgaacatttgacaacggagccataccccaccaactccatttagaagaactagaagcaatattacatcaacaagctaaatattacccgttcctgaaagaaaactatgataaaataaagagtctagtaacattccgtattccatacttcgtaggacctctagcaaacggtcaatcagagttcgcttggctaacaagaaaagcagatggtgaaatccggccatggaacatcgaagaaaaggttgacttcggaaaatcagcagtagatttcatagaaaagatgacaaataaagatacatatctgccaaaagaaaacgtactacctaaacattcactatgctaccaaaagtacttagtgtataacgaactaacaaaagtacgttacatcaacgaccaaggaaaaacctcatatttctcaggccaggaaaaagaacaaatatttaacgatttattcaaacaaaaacgtaaagtaaagaagaaagatctggaactatttctaagaaatatgagccatgtagaatcacccacaatagaagggcttgaagatagtttcaattcctcatacagtacatatcatgatcttctaaaagttggaataaaacaagaaatactagacaatccagtaaatacagagatgcttgaaaacatcgtcaaaatacttactgtatttgaagataaaagaatgatcaaagaacaattacaacaattcagcgatgtacttgacggagttgtattaaagaaacttgaaagaagacactatactggttggggccgtctcagtgcaaaactattaatgggaatcagggataaacaatcacatctaacaattctagattatctcatgaacgatgatggtctgaaccgaaacctaatgcaattaattaacgactctaacttatcattcaaatccataattgaaaaagaacaagttacaacagcagataaagatatacagtcaatagtagcagacctggcaggatcaccagcaatcaagaaaggaatactacaatccttgaaaatagtagacgagctagtaagtgtaatgggatacccgcctcaaacaatagtagtagaaatggcaagggaaaaccaaacgacaggaaaaggtaaaaacaacagccgaccgagatacaaatcattggaaaaagcaattaaagaatttggatcacaaatactaaaagaacatccaacagacaaccaagaattaagaaataatcgattatatctatattatctacaaaacggaaaagacatgtacacaggacaggatctagatatacacaacctatcaaattacgatattgatcacatagtaccacaaagttttataacagacaacagcatcgacaatttagtactgacaagtagtgccgggaatcgtgaaaaaggagatgatgtcccacctttagaaatagttcgaaaaagaaaagtcttctgggaaaaattatatcaaggaaacttaatgagtaaaagaaaattcgactacctaacaaaagccgagaggggaggactaaccgaagcagacaaggccagatttatacataggcaacttgtggaaacaaggcaaataaccaaaaacgtcgcaaacatccttcatcaaaggtttaactacgaaaaagacgaccatggaaatacaatgaaacaagtcagaattgtcacattaaaatcagcattagtatcacaattccgaaaacaatttcagttatataaagtcagagacgtaaatgattatcatcatgctcatgacgcctacttaaatggcgtggtagcaaacacactgttaaaagtatacccacaactagaaccagaatttgtctatggagactatcaccaatttgattggttcaaggcaaacaaagcaacagcgaaaaagcagttctatactaatatcatgctattctttgcacagaaggacagaatcatagatgaaaacggtgaaattctctgggacaagaaatacttagatacggtaaagaaagtaatgtcctaccgacagatgaatatagtcaagaaaactgaaatccaaaaaggcgagttttcaaaagcgacaatcaaacccaaaggcaactcaagcaaattaatatctcgtaaaaccaactgggaccctatgaaatacggaggattggattcaccgaacatggcatacgccgtagttatagagtatgcaaaaggtaaaaacaagctagtatttgaaaagaaaataattagggtgacaataatggaacgaaaagcatttgaaaaagatgaaaaagcatttttagaggaacaaggctatagacaacctaaagttcttgctaaactcccaaaatatacactatatgaatgcgaggaaggaagaaggcgaatgttagcatcagcaaacgaagcacaaaagggaaaccaacaagttttacccaaccacctagtaactctattacaccacgtagctaattgtgaagtgtcagacggaaaaagtctagattatattgaatccaaccgagaaatgtttgctgagttacttgctcatgtctcagagttcgctaaacgttatactctagcagaagccaatttaaacaaaatcaatcaactgttcgaacaaaataaagaaggcgacataaaggcaatagcccagtcctttgtggatctaatggcatttaatgcaatgggtgcacccgcatcgtttaaattctttgaaacaacgatagaaagaaaaagatacaacaatctaaaagaattattaaattcaacaataatttatcaaagtataacaggattatacgaaagcagaaaaagactagacgactga

SEQ ID NO: 8768 - RNA, 4014 nt, synthetic construct
  misc_feature 1..4014: note = Cas9 variant
  source 1..4014: mol_type = other RNA
atgaaaaaattcgaaaactactacctaggactagacatcggaacatcatccattggatgggcagtcacaaactcccagtatgacattttaaaattcaacggaaaatacatgtggggtaccaggctatttcccgaagcaaataccgcacaggaaagacgcatccacagatcaagtagaagaagacttaaaagaagaaaagaacgaatacagatactccaaatgttatttgacaaagaaatagcgaaaatagattcaggattcttccaaagactcaaagattccaaatattataaagaagacaaaacagaaaaacaaaccaactccatattccatgataaagattattcagacaaagaatatcaccaagacttcccaacaatttaccatttacgaaagttcctactcgaaggaaataaacccaaagacatcaggtttgtatatctagctttacatcatatactaacacatcgtggacacttcttattccccgatatggaagtaagtaacgttaccgagttcagcaacatattcagtgaattgaagcaatacctatatgacgagatggacctcgatttcgaatggaaaaacggcaaactaaacgaagtagagaacatactcaaagatcgaaacctcgcgaaaagcgaaaaagaaaaaaaattatgtggcataatagaattagaaggaaagattgataatcaaagaaaagctatgataggtatgatgtgcggatgtaagaaaaagttcagtgatttatttcaaaacgaaaactatagagaattagaaatctcaagtttctctttcgcagactcctcatacgaagaaaaaagagatgaactcgaaggaatactcgcagaaaatatcttgtgtttagattacctaaaaaccatatacgattggggaaaattatccgacattctacagggtgaagaatcaatatcagtcgcaaaagtaaaaagctacgaggaacaccaactcgacctaaaatacctaaaaaacatactcaaactatattcacacaaagaaaaagaaaacgtttttagaaaaaaagagggaaagtacccaaaatacattagtgggaaattatcccaagaggaattcaacaaaagtatcaaaaaaatattagaggaaataaaaagcgtaaaacaagaagaccgtaaagttttcgacacactactaaaaagagcatccaacaacctactttgccctaaacaagtcataaaagaaaatggtgtaataccataccaaatacacaaatttgaactagaaaaaatcctaagaaatatggcagacttcttcccaatgctaaaagaaaaaaaagacggaaaaacactctccgaaaaaattatctcagtctttacattcagaattccctactacgttggtccccttaatcaaaattctgacagagcatggctagtaaaaaacaaagacgagaaaatatatccctggaactttgaagaaatagttaatctagaagaaagcgccgaaaaattcatacaaaacttaacaaacaaatgcacttatttagtactcgaagacgtactcccaaaatcctcaatcttatattcaaagttcatggtgctaaatgaactaaataatctcaaaatagatggtgaagccatatctgttgacctaaaacagaaaatatacctaaatcttttccaaaaatacaaaaaagtaacattaaaaaaattaaagggatatttaaaatccgaaaacattctaatagatacatcaacacaaataacaggaatagatggagacttcaaaagctccctaggaagctacctagatttttacaacatactaggggacaaagttaaaacagacttcggaaaaaagttgatagaaaattgcattctatggataacgctatatactggagaaaaaaaactactgaaaaataagatcatagcaaactacaaaggagaacttagcgaagaagagataaagaagatagtaaacttaaagtacaaagactggggaagacttagttacgccttcctagaagaaattcaatccgcctccctagaaactggagaattaaggaacataatacaaatgatgtgggaaaccaacaacaacctgatggaactcttaagttcgaactaccaatttttatccgaaatcgaaaaaagaaactccgtcgtagcaataggaaaagaatttaattacgaaacaatactcggagatagctacgcctctcccagtgtaaaacgaatgatatggcaatctctatcggtagtagatgaaattaaaaaaataatgaaaaaagccccaaaaaaaattttcattgaaatggcaaggcaagaagacatgaaaaaagaaagaaaggaaagccgtaaaagcacatttctaacgctatacaaatccataaaagaagaaggtcgcgattggattaaagaaatagaaaattggtccgatagcgagttcagatcaaaaaaactctacctatattacacccaaatgggcaaatgtatgtataccggagaaaaaatttcactagaccaactcttcaacaaaaacatatacgatatcgaccatatatatccgagatcaaagactaaagacgactcgattgagaatattgtcctagtcaaaagaaatataaatgcaaaaaaaacagatgagtatccacttgaaagaaacatacaacaaaaacagcacgacttttggaaaatgcttcatagtaaaaaattgataggcgacaaaaaatacgaaagattaacgagaaccactgagtttacagatgaggaactctctgatttcatcgcacgacagttagttgaaacaagacaatcaactaaaatagtggcagatatcctaaaaaatctattccctgaaacaaagatagtatatgttaaagcgaacctaacaagtgattttagaaaaaacttcaaaatactaaaatcacgagacataaacgactaccaccatgcacacgatgcatacctcaatattgtcacaggaaatgtatataatataaaatttacagacaaccctagaaacttcatcaaagacaaaaaattggaaggcaaaaaatataatctgaaagtagaaaaaattttcgaataccggaaagagaacgaatccttttggaatcccaaaacgatggttacgaaaattgaaaactacatattcaagaaacgaccacaattcacacgatatagctttgaacagcacggaggtttctttgatcaaaatatagtcgacaaggaaagctgtaaaaaaggaaccggctacatacctattaaaagttctaatgcaatactatataacacttctaaatatggaggatacggttcggtaacgggtacgtatttctttctagtagaacatacaatgaaagggaaacgtatacggactatagaaatgatgccgctgtatctatcaaagaaaattcactccaaagaagaactcgaaaaatactgcaaagagaaacttgagctgcagaagcccagtgttaggctagcacgcattaaatacaactcactactaaaaataaacgggttcccatatcacataacaggaaaaactaacgactcatattggatcatgagtgcaatacagctcctactaagtaaaaattactacgaatatttaagaaaactatacatcttctgtaaggaagagagattggaagaagaaatagtaggagaaaaaaatatcaaattatatacatgtatcctagaaaaactcgaaaaaagcatatattctcacaaactgctcaacatcaactataacggaaaaagcaagaacctaaaagacatactagaaagtgaaaaagaaaatttcttgctactttctgagaaaaagcaagcccagatactaatcgaaatatttaccttattagaaagtaacaactttggcgctaacctagaaagctttggatgcggaaaaaaatgcggcataacaaaaataaacaaaaacattgataagttagaagaagtactcctaatcaaccaatcaccgactggactctttgaaaatagcatagacctcaaaaaggtatga

SEQ ID NO: 8769 - RNA, 4014 nt, synthetic construct
  misc_feature 1..4014: note = Cas9 variant
  source 1..4014: mol_type = other RNA
atgaagaaagactatgtgataggactagatataggaactaatagtgtaggatgggcggttatgacagaagactaccaacttgtcaaaaagaaaatgcccatatatggaaacacagagaaaaaaaaaataaaaaaaaacttctggggagtaagactcttcgaagaaggacacaccgcagaagacagaagactcaagcgaacagcaaggagaagaatatccagaagaagaaaccgattgcgatacttacaagcgttttttgaagaagcaatgacagacctagatgaaaatttcttcgcgagattgcaagaatcattcttagttccagaggacaaaaaatggcacagacaccctatattcgccaaattggaggacgaagtagcatatcacgagacataccccacaatataccatctgcgtaagaaattagccgacagctccgaacaggccgatttaaggctcatatatttggccttagcccatatagttaaatacagaggacactttttaatagaagggaaactttcaacagaaaacataagcgtaaaggaacaattccaacaattcatgataatatataaccaaacattcgttaatggcgaaagtcgcctagtatccgcaccacttccagaaagtgtactaatagaagaagaactgacagaaaaagcatctcgaacaaaaaaatccgaaaaagtcctacaacaatttccacaagagaaagctaacggccttttcggtcaatttctgaagcttatggtaggaaacaaagccgactttaaaaaggtatttggactagaagaagaagctaaaatcacatacgcgtccgagtcatacgaagaggatcttgaaggcattctggcaaaagtaggtgatgaatatagcgacgtatttcttgcagcaaaaaacgtatatgacgccgtggaactatcaacaatcctagcagactctgataaaaaatcacatgcaaagttatcatcaagcatgatagtccgttttacagaacatcaggaagatctcaaaaaatttaaacgatttataagagaaaattgtccagatgaatatgataatttatttaaaaatgaacaaaaagacggttacgcaggatacatagcgcacgctggaaaagtttcacaactaaaattctatcaatacgtaaaaaaaataatacaagatattgcaggagcagaatatttcttagaaaaaatagcgcaagaaaacttcctaagaaaacaacgcacgttcgacaacggagtcatacctcatcaaatccacttagcggaactacaagcaataatacataggcaagcagcatactaccccttcctaaaagaaaaccaagaaaaaattgaacaactagtaacatttagaataccatattatgttggtccattgtccaagggagacgcaagcacgtttgcatggttaaaaaggcaatctgaagaaccaattagaccttggaacctgcaagaaacagtggatcttgatcaatctgcaacagcttttatagaaagaatgacaaacttcgatacatacttaccctccgagaaagtactcccaaaacatagcctactatatgaaaaattcatggtatttaatgaattgacaaaaatatcttatactgacgacagagggataaaagctaacttttctggaaaggagaaggaaaaaatatttgattacttatttaaaactcgaagaaaagtaaaaaaaaaagacataatccaattttatagaaatgaatataatactgaaattgtcacactatcaggcctcgaagaagatcaattcaatgcatctttttccacctatcaggacttattaaaatgtggcttaacaagggcagagttagatcaccctgacaacgcagaaaaactagaggatatcataaaaatactaaccatatttgaagatcgtcagcgcataagaacacaactctcaacattcaaaggtcaattcagcgcagaggtcctaaaaaaattagagagaaaacattataccggatggggaagacttagcaaaaaattaataaacggaatatatgacaaagaatctggcaaaactatattaggatacctaataaaagatgatggagtatctaaacactataacagaaactttatgcaattaataaacgactcacagctttcctttaaaaacgcgatacaaaaagcccaatcgtctgaacatgaagagactctatcagaaacagttaacgaacttgcagggtccccggcaattaaaaaaggcatctaccaatctttgaaaattgtagacgaactcgttgcaataatgggatatgcacccaaacgaattgtcgttgaaatggctagggaaaatcaaaccacgtccacaggtaaaagaagaagcatacaacgattaaaaatagttgagaaagccatggccgaaattggatcaaatctacttaaggagcaaccaacaacaaacgagcaactccgtgatactcgattattcctgtattatatgcaaaacgggaaggacatgtataccggcgatgaattatcattacataggctatcgcactatgatatagatcacataataccccaaagctttatgaaagatgatagcttagataaccttgtcctcgtaggatcaacagaaaatcgaggcaaatcagatgatgtaccaagtaaagaagtcgtaaaagacatgaaagcatattgggaaaaactctatgccgctgggctcatctctcaaagaaagttccaaagactcacaaaaggcgaacaaggtggcctaactcttgaagataaagcacacttcatacaaaggcaattagtcgaaacaagacaaataaccaaaaacgtagccggtatactcgaccaaagatacaatgcgaactcaaaagaaaaaaaagtacaaattataacgctaaaagcgtcattaacatcccaattcagatccatattcggattatataaagtgcgtgaagttaacgactaccaccatggccaagatgcatacctcaattgcgtcgtcgctaccacattactaaaagtatatcccaacctcgcgcccgaattcgtatatggagaataccccaaattccagacgttcaaagaaaataaagcgactgcaaaagcaattatatacacaaatctactccgtttcttcactgaggatgaaccgagattcacaaaagatggcgaaatactatggtcaaacagctacctcaaaactataaaaaaagagctaaactaccatcaaatgaacatagtgaaaaaggttgaagtacaaaaaggaggattctctaaagaatcaatcaagcctaaaggaccatcaaacaaattaattccagttaaaaacggtctcgacccacagaaatatggaggctttgatagcccaatagtcgcatatacagtactatttacacatgagaagggaaagaagccattaataaaacaagaaatattagggataacaatcatggagaagacgcgctttgaacaaaatccaatactatttctagaagaaaagggttttctccgacctagggtactaatgaaactacctaaatacactttatacgaattccctgaaggtcgaagaagactcttggcaagcgcaaaagaagcccaaaaaggaaaccaaatggtcttacctgagcacctactaaccttactatatcatgcaaaacaatgcttattgcctaatcaaagcgaatcattaacttatgtcgaacaacatcagccagagtttcaagaaatattagaacgagtagtggacttcgcagaagtacataccttagccaaaagtaaagttcaacaaattgttaaacttttcgaagcaaatcaaacagcagacgtcaaagaaattgccgcatcatttatacaattgatgcaatttaatgccatgggagcaccatcaacgttcaagtttttccaaaaagacattgaacgagcacgatatacaagcattaaagaaatatttgacgcaacaattatatatcaaagcacaacaggactctacgaaacgcgtcgcaaagtagtagactga

SEQ ID NO: 8770 - RNA, 4014 nt, synthetic construct
  misc_feature 1..4014: note = Cas9 variant
  source 1..4014: mol_type = other RNA
atgaaaaaagattacgtaataggactcgacatcggaacaaatagcgtaggttgggccgtaatgactgaagactatcaactcgtaaaaaaaaaaatgcctatctacggaaacacagaaaaaaaaaaaataaaaaaaaatttttggggcgtacgactctttgaagaaggacatacagctgaagacagaagactaaaaaggacagcacgacgacgaatcagccgtaggcgtaacagactaaggtatctacaagcattcttcgaagaagcaatgactgatctagacgaaaatttttttgctagattgcaagaaagtttcctcgttcctgaagacaaaaaatggcacagacatccaatcttcgcaaaattagaagacgaagtcgcataccatgaaacctatccaactatataccatctacgaaaaaaattggcagactcatcagagcaagctgatctacgactaatatatttagccttagcccacattgtaaaatatagagggcactttctaatagaaggaaaactgtcaactgaaaacacaagtgtgaaagaccagttccaacaatttatggtaatttataaccaaacattcgtgaacggagaatcaagattagtctctgcaccactacctgaatctgtactcatagaagaagaactaaccgagaaagcaagcagaacaaaaaagagtgaaaaagtactccaacaatttccccaagaaaaagcaaacggtctttttggacaattcttaaaattaatggtaggaaacaaagccgatttcaaaaaggtatttggtctcgaagaagaggctaaaataacttacgcaagcgagtcatatgaagaagacctggaaggaatcttagcaaaagtaggagacgaatacagcgacgtcttcctagcggcaaaaaacgtatatgatgcagtagaattgtcaacaatacttgctgacagcgacaaaaaaagccatgccaaactaagctcctcaatgatcgtaaggttcacagaacatcaggaagacttaaaaaaatttaaacggttcatcagggaaaactgcccagacgaatatgacaatctattcaaaaatgaacaaaaggatggatacgcaggatatattgcgcacgcgggcaaagtaagtcaattgaaattctatcaatacgtaaaaaagataatacaagatatagcgggtgcagaatacttcctagaaaagattgcacaagagaacttcttaagaaaacagagaacttttgataacggtgttattccacatcagatacacctagcggagctccaagcaatcatacacaggcaggccgcttactacccctttctcaaagaaaaccaagagaaaatagaacaattagtcacattcagaataccgtattacgtaggaccattatccaaaggagacgccagtacttttgcttggctaaagagacagtctgaagaaccaattagaccatggaacttacaagagaccgtcgacctagaccaatcggcaacagcctttatagaaagaatgacaaacttcgatacatacctaccatcagaaaaagtgttacctaaacacagcctgctatacgaaaaattcatggtattcaacgaattaaccaagatatcctatactgacgatcgaggaatcaaggcaaacttctcgggaaaagaaaaagaaaaaatattcgactatttattcaaaactagaagaaaagttaaaaaaaaagatatcattcaattctatcgaaatgaatacaacaccgaaatcgtaacgctttctggcttggaagaagatcaatttaatgcgtcattttcgacataccaagatctattaaaatgtgggttaacaagagcggaacttgaccatcccgataacgcagaaaaactagaagacataatcaaaattttaacaatttttgaagaccgtcaaagaatacgcacgcagctctccactttcaagggacaattttcggcagaagtattaaagaaactcgaacgaaaacactacacgggttggggacgactaagcaaaaaattaataaacggaatttatgataaggaatctgggaaaacaatcctagactacctcataaaagatgacggcgttagcaaacattacaatcgaaacttcatgcaactaattaatgactctcagctctctttcaaaaatgctatacaaaaagcacaatcatgtgaacacgaagaaaccctatcagaaacggtaaatgaactcgcaggaagtcccgccataaaaaagggaatataccaatcactaaagatcgttgatgaactagtagccataatggggtacgcccccaaacggattgtagtagaaatggcaagagaaaatcaaacgacatcaaccggaaaacgaagatcaatccagagattaaaaatcgtagaaaaagcaatggctgaaattggctcaaacctactaaaagaacaaccaacaactaacgaacaactaagagatacacgcttattcttatattatatgcaaaacggcaaagacatgtatacaggagatgaactttcattacacagactttcgcactatgacattgaccatataataccacaatccttcatgaaagatgattcactagacaatttagtactcgtcgggtctactgaaaaccggggaaaaagtgacgacgtcccttcaaaaaaagtagtaaaggacatgaaagcatactgggaaaaattatatgcagcgggacttatttcccaacgtaaatttcaacgtctcacaaaaggagaacaaggcggactaacactcgaagacaaagcacactttatacaaagacagctagtagaaacccgacaaatcacaaaaaacgtagccggtatactagaccaaagatacaacgcaaaatcaaaagaaaaaaaagtccaaataattacactaaaagcatcattaacgagtcaattccgatcgatcttcggattgtataaagtcagagaagttaatgactatcaccatggacaagacgcttatctaaactgcgtagtcgcgaccactcttctcaaagtatatcccaacctggctccagaattcgtatacggcgagtatccgaaattccaagcatttaaagagaacaaagcaacagcaaaaacaattatttatacaaacctaatgagattcttcacagaggatgaaccaagatttactaaagattcagaaattttatggtctaattcgtatctcaaaaccatcaagaaagaacttaattaccaccaaatgaacatcgtcaaaaaagtagaagtacaaaaaggcggattctcaaaagaatctataaaacccaaaggtcccagcaataaacttatccccgttaaaaatggattggaccctcaaaagtatggaggatttgattcccctgtagtagcctacacagttctctttacacatgaaaaaggtaaaaaaccactaattaaacaagaaatcctaggaatcaccatcatggaaaaaacccgatttgaacagaatccaatcttattcttagaagagaaaggtttcctacggccacgcgtactaatgaagctccccaaatacacattatacgaattcccagaaggtcgacgaagattactggccagtgctaaagaggcacagaaaggaaaccaaatggttctaccagaacacttactaaccctcttatatcacgccaaacaatgcctattaccaaatcaatcggaaagtttggcatatgtagaacaacatcaaccagaatttcaagagatattagaaagggttgtagactttgcagaagtacacacattagcaaaatcgaaagttcaacaaatagtaaagctctttgaagcaaaccaaacagctgacgtaaaagaaatagcggcatctttcatacaattaatgcaattcaatgcgatgggagccccatccaccttcaaattttttcaaaaggatatagaaagagctcgatacacatcaataaaagaaatatttgacgcaacaattatataccaatcaacaacgggcctttacgaaactagaagaaaagtggtcgactga

SEQ ID NO: 8771 - RNA, 4014 nt, synthetic construct
  misc_feature 1..4014: note = Cas9 variant
  source 1..4014: mol_type = other RNA
atgaagaaagattatgtcataggattagacatcggcaccaattcagtgggctgggcagtaatgacagaagattatcaattagtcaagaaaaaaatgcctatttacggaaacacagaaaagaaaaaaattaaaaaaaacttctggggcgttagactgtttgaagaaggacatactgcagaggaccgaagattaaaacgaaccgctagaagaagaatcagtagacgtagaaacagattacgttacctacaggctttttttgaagaagcaatgacggcactcgacgaaaacttcttcgccaggttacaagaatcatttctagtaccagaagataaaaagtggcatcgacaccccatctttgcaaaactagaagatgaagtggcatatcatgagacatacccgacaatatatcatttaaggaaaaaactagcagattcatcagaacaagcagatctacgactaatctacctagcactggcccatatagtaaaatatagagggcatttcctcatagagggcaaattatcaacagaaaatatcagtgttaaagagcaattccaacaatttatgataatatacaaccaaacatttgtaaacggggaaagtagacttgtatctgcaccactacctgaatccgtactaatagaagaagaacttactgaaaaagcatcacgaacgaaaaaaagcgaaaaggttttacaacagttcccacaagaaaaagcaaacggactcttcgggcaatttctaaaactaatggtcggcaataaagcagacttcaaaaaagtattcggtctagaagaagaagcaaaaataacctacgcaagcgaatcctatgaagaagatttagaaggaatactagcaaaggtgggcgatgaatactcagatgtatttctcgcagcaaaaaacgtctacgacgcagtcgaactatcaaccatcctagctgactccgacaaaaaatctcacgctaaattaagctcttcaatgatagtcagatttacagaacatcaggaagatctaaaaaactttaaaaggtttattagggaaaattgtcccgatgaatacgataatttgttcaaaaacgagcaaaaagatggatacgctggatatattacacatgctggaaaagtatcacaacttaaattctaccagtacgtaaaaaaaatcatacaagacatagcaggagcagaatactttttagagaaaatcgctcaagaaaacttccttagaaaacaacgtacattcgataacggtgttataccccaccaaatacacctcgcagaactacaggcaataatccaccgacaagcagcgtactatccatttcttaaagaaaatcaagaaaagattgaacaattagtaacattcagaattccatactatgtcggacctttatccaaaggagatgccaacacttttgcctggcttaaaagacaatcagaagagcccatcaggccctggaacttacaagaaaccgtagatttagaccaaagtgctacagcatttattgaaagaatgacaaactttgacacttacctaccttcagaaaaagtactacctaaacactcactactgtacgaaaaattcatggtattcaacgaactcactaagatatcctatacagatgacagaggcatcaaagcaaacttctcgggaaaagaaaaagagaaaatattcgattacctattcaaaactcgtaggaaagtaaaaaagaaagacattatacaattttacagaaacgaatacaatacagaaatagtaacattatcaggtttggaagaagatcaattcaacgcatcattcagtacctaccaagacttactaaaatgcgggctaacaagagcagaactagaccatccagacaacgcagaaaaactagaagacataataaaaatattgaccatatttgaagaccgacaaaggatccgtacacaactatcaacatttaagggacaatttagcgcagaagttcttaaaaagttagaacgcaaacactatacagggtggggacgcctatcgaaaaaactgattaacggtatatacgacaaagaatcaggcaaaacaatcttagactacctaattaaagatgatggcgtgtctaaacactacaatagaaactttatgcaattaattaacgacagccagctgtcatttaaaaatgcaatacaaaaagcacaaagttcagagcacgaagaaacgttaagtgaaacagtcaacgaactagcaggaagccccgcaattaagaaaggcatatatcaatcattgaaaatcgtggacgaattggtcgcaataatgggttatgcacctaaaagaatagtagtagaaatggcaagagaaaatcaaacaacatcaacaggaaaacgaagaagtattcaaagattaaagatagtggaaaaggcaatggctgaaataggttcgaacttactcaaagaacaaccaaccacaaacgaacaattaagagacacaagactatttctatattacatgcagaatggaaaagacatgtacactggagacgaactatcgctacacaggctatctcattacgatatagatcacataataccccagtcatttatgaaagatgacagcttagataacctagtattagttggaagtaccgaaaatagaggaaaatcagacgacgttccgtcgaaagaagttgtaaaagacatgaaagcatattgggaaaaactttatgcagccggcctcatatcacagcggaaatttcaaagactaacaaaaggtgaacaaggaggattgaccctagaagacaaagcccacttcatccagagacaactcgtagaaacacgacaaataacaaaaaacgtagcaggaatcctagaccaacgatataacgcaaaaagtaaagagaaaaaagtccaaataataacgctcaaagcaagtctcacgagccaattcagatcaatattcggactatataaagttcgagaagtaaacgactatcatcacggacaagacgcctatcttaactgcgttgtagcaacaacactactcaaagtgtaccctaatttagctcccgaattcgtatatggggaatacccgaagttccaaacctttaaggaaaataaagcaacagccaaagcgataatttacaccaatttactgaggtttttcacagaagatgaaccaagattcacgaaagatggcgaaattttatggtcaaattcatacctcaaaacaattaaaaaagaattaaattatcatcaaatgaatatcgttaaaaaagtagaagttcaaaaaggaggattcagcaaagaatcaattaaaccaaaaggaccctcaaataaattaatacctgttaaaaatggattagaccctcaaaaatatggaggatttgactcacctatagtagcgtacactgtactgttcacacatgaaaagggtaaaaaacccttaataaaacaggaaatactaggcatcaccataatggaaaaaactaggtttgaacaaaatcccatcttatttttagaagaaaaaggattcttaaggccgagggtgttaatgaaactaccaaaatacactctctaccaattcccagaaggcagaagacgattactcgcaagcgcaaaggaagcacaaaaaggtaaccaaatggttcttcccgaacatctactaacacttctgtaccatgccaaacaatgcctactacccaatcagtcagaaagtttagcatacgtagaacaacatcaacctgaatttcaggagatactggaaagggttgtcgattttgcagaagtccacacactcgccaaatcaaaagtacaacaaatagtgaagttattcgaagcaaatcagaccgcagacgtaaaagaaatcgcagccagttttattcaattaatgcaattcaatgccatgggtgccccatcaacctttaaattctttcaaaaggatatcgaaagagcgcgatacacaagcataaaagaaatattcgatgcaacaatcatataccaaagcactaccggactatacgagacccgccgaaaggtagtagactga

SEQ ID NO: 8772 - RNA, 4014 nt, synthetic construct
  misc_feature 1..4014: note = Cas9 variant
  source 1..4014: mol_type = other RNA
atgaagaaagactacgtgataggtctagacattggaacaaatagtgttggatgggctgtaatgacagaagattaccagttagtcaaaaagaaaatgccaatatacggaaatacggaaaagaagaaaatcaagaaaaatttctggggagtacgattattcgaagaaggacatacggcagaagacagacgactaaaacgaacagctagaagaaggatctcacgacgaagaaaccgacttcgctatttgcaagcattctttgaagaagcgatgacggacctagacgaaaactttttcgcacgactccaagaatcttttctagtaccagaagataagaaatggcaccgacacccgatcttcgcaaaattagaagacgaagtagcatatcatgaaacatacccaactatatatcacttaaggaagaaactagcagatagctctgaacaagcggatttacgactaatatatctagcgttagctcacattgtaaaatatagaggacattttctcatagaaggcaaactatcgacggaaaacatatcagtaaaagaacaatttcaacaatttatgataatatacaatcaaacatttgtaaatggagagtcaagattagtatcagcaccgttacccgaatccgttcttatagaggaagaactaacagagaaagcaagtcgaaccaagaaatcagaaaaagtattacagcaatttccccaagaaaaagcaaacggacttttcggacaattcctgaaattaatggtaggcaacaaagctgatttcaagaaagtgtttggattagaagaagaagctaaaataacctatgcatccgaatcttacgaagaagatttagaaggtatacttgcaaaagtaggggatgaatatagcgatgtatttctagcagctaaaaatgtatatgacgcagtagaattatcgactatactagctgattctgacaagaaatcccatgcaaaattatcaagtagcatgatagtcagattcacagagcaccaagaagacctaaagaaattcaaacggttcataagagagaactgtcccgatgaatatgataatctatttaaaaatgaacaaaaagatggatacgcagggtacattgcacatgctggaaaagtaagtcaactaaaattttaccaatatgtcaagaaaataattcaagacatagctggagctgaatatttcctagagaaaatagctcaagaaaatttccttagaaagcaaagaaccttcgataatggtgtaatccctcaccaaatacatttagcagaactccaagcaatcattcacagacaagcagcatactacccgttcttaaaagaaaatcaagagaaaatagaacagttagtaacgttcagaatcccatattacgtaggtcccctatcaaaaggagatgcatcaacatttgcttggctaaaaagacagagcgaggaacctattagaccatggaatcttcaagaaacagtagatctagaccaatcggcaaccgctttcatagagcgcatgaccaacttcgatacatatctacccagtgaaaaagttttaccaaaacatagtctgttgtatgaaaaattcatggtatttaacgaattaaccaaaattagttacacggatgaccggggtatcaaagcaaacttctcaggtaaagaaaaagagaaaatatttgattatctatttaaaactcgcagaaaagttaaaaagaaagacatcatacaattctacaggaatgaatataatacagaaatcgtaaccctcagcggactcgaagaagaccaatttaacgccagctttagtacctatcaagatttattaaaatgcggcctaacaagagcagaactagaccacccagacaacgcagaaaaactagaagacataattaaaatactgaccatatttgaagacagacaacgtatacgaacacagttgagtacgttcaaaggacaattctcagccgaagttctcaagaaattagaaaggaaacactacaccggatggggtcgattatcaaagaaattaataaacggcatatatgacaaagaaagcggaaaaactatcttgggctatctgataaaagatgacggcgtgtctaaacactataatcgaaacttcatgcaacttattaatgactctcaactgtcattcaaaaatgctatacaaaaagcccaaagctcagaacacgaagaaactctaagcgaaacagtgaacgaactagcaggatcaccagcaatcaagaaaggcatatatcaatcacttaaaatagtcgatgaactggttgcaataatgggatatgcgcccaaaagaatcgtcgtagaaatggccagagaaaatcaaacaacgagcaccggtaaacgacgctccattcagagattaaaaatagtggaaaaagctatggcagagataggttccaacctattaaaagaacaaccaacaacaaatgaacaactacgagatacacgactattcctatactacatgcagaacggtaaagacatgtacacaggagatgagttatccctccacagacttagccattacgacattgatcatataataccacaatcgttcatgaaagatgactccctagataacctggtcctagttggatcaactgaaaataggggaaaatctgatgacgtaccatcaaaagaagtagtaaaagacatgaaagcatattgggaaaaactctatgcagccggtttaatatctcaaagaaaatttcaaagacttacaaaaggcgaacagggaggcttaactttagaagacaaagcacacttcatacaaagacaattagtagaaaccagacaaatcaccaaaaacgtagccggaatattagaccaaagatataacgcaaatagcaaagagaagaaagttcaaattataaccttaaaagcatccctaacatcacaattccgatcgattttcggtctctataaagtacgtgaggtaaatgactatcatcacggacaagacgcctatttaaattgtgtcgttgctacgacattactaaaagtataccccaatcttgctccagagttcgtatatggtgaatatccaaaatttcaaacttttaaagaaaacaaagcaacagcaaaagcaattatatacacaaacctgctaagattctttacggaagacgaaccaaggttcaccaaagacggagaaattctctggagcaattcatacttaaaaacaatcaagaaagaattaaactaccaccagatgaatatagtcaagaaagtagaagtccaaaaaggaggtttttcaaaagaatccataaaaccaaaagggccatcaaataaactaataccagttaaaaacggattagatccccagaaatatggcggatttgactcaccaatagtggcatacactgttttatttacacatgaaaaaggcaagaaaccactaataaaacaagaaatcttaggaataaccataatggagaaaaccagatttgaacaaaatccaatacttttcctcgaagaaaaaggttttcttagaccaagagtactgatgaaactacccaaatatacgctctacgaatttccagaaggaaggagaagactattagcgtcagccaaagaagcacaaaaaggaaatcaaatggtattgccagaacatctcttaacacttttataccacgcaaaacagtgcttactacccaaccaatcggaaagtcttgcgtacgttgaacaacatcagcctgaatttcaagaaatattagaacgagttgtcgattttgctgaagtacatacacttgctaaatcaaaagtacaacagatagtaaagctgttcgaagcaaaccaaacagccgacgttaaagaaatcgccgcatcgttcatacaattaatgcaattcaatgcaatgggagccccaagtacgtttaaattcttccaaaaagatattgaaagagcgcgatatacaagcataaaagaaattttcgatgcaacaataatttaccaatcaacaactggtctatacgaaacccgtagaaaggtagtggattga

SEQ ID NO: 8773 - RNA, 4017 nt, synthetic construct
  misc_feature 1..4017: note = Cas9 variant
  source 1..4017: mol_type = other RNA
atgcaagattactaccttggtttggatataggaacaaattcagttggttgggcagtgacggatgaaaactacaacttattaagaaaaaaaggcaaagacttatggggagtacgactatttaaagaagcccaaccggctacagagcggcgaggtcatagaagctccagacggagaaccatacggaaaagtttgcgaaagcaactgttaagagaattgttcgaagaggaaataaatgcaatagacaaagacttcttccttcgtttagatgaatctaaatactggttagaagacaaaaaaatagaaggaaaatatagcttattcaacgacgaaaattttacagacaaagactattacgaaaaattcccaacaatattccacctaagaaaggccctaatagagtctgacgataaggaggacatcagactatatttcttagcaatcaaccaaatgatgaagcgacgcggccatttcctgatagacggtaaattaagtaacgtagaagacataaccccattcaaagaatgcatccaaaatttaattaacgaagaactggataccgaaatcgaaaccgaattctacgacaaagccatcaagatcgtaagtgattactcattaaaaaaaacagaaaaaaaaaatttaatcaaagacctcgtaaaggaaaccgactcaattgaagactccaaaaaaatcattaacatattcaaccttctcataagcggaaaatccaaagtaaacggaattttcgatgatgaagaaatcctagaaaaaattaaagaagataacaaagaagatttttacctcacatcagagaaatatgaagaaaacctggagtattttagccagcttttagactatagatttgaattaatatcatccttaaaaagtatctacgactacataatcctgcaagaggtactgaaaggtaaaaaatacctaagttatgcacaagtagaacgatacaaaaaccataaagaggacttgcgaaagttaaaacaactcataaaaaaatacgacaaaaatggaaagatctactaccaaatattcagggacgaaaattttaaaaagggatacgtagcttatctagggtattataaaaaaaacaaaaaaaacgtaccggtaaaaaaatgcgattatgacacattttcaaaaaacataaaatcaacactagacaaaatttgcgataaggaagacccactgtatatagaactcattgataaaatagaaaaaggaggattcctactgaaacaaatagtaagtacaaattcagtaattccacaccaagtacacgaactagaactagataaaatccttgaaaacttagaaaaaaattatccatcgttcaaagaaatatctgacggagtatcaaaaattgataaaattaaaatgattttcaatttccggataccgtactatgtaggtcctttaaacgactatcataaagacaaagttaactcaaatacatggatagtaaagaatgaaggatttgaaaatgaaaacattagaccctggaacttcagtaaaatagtcgatgaacacgcatgtgaagaagaatttatcaaaagaatgataaacgagtgttcctacattccaggtgaaaaagtactccccaaaagctcgcttttatatagcgaatatatggtactaaatgagctaaacaacttaagagtaaacggtgacaaactcaacccgaaaatcaaaaaggaaatagtggaaaacatatataaaaaagaaagaaaagttacactaaaaaaaataagaaacttcctcataataaataactatgtagactcgaaggtcgaatttagcggcctaagcgacggaattaaagcgaatatgtcttcatacatcgactttgcagaaatcctagacgacaattttgacaataacatggtagaagatctaatagaacaaatcacaatacacgttggaaacgtaaaactactaacagaaaaaatctcgaacaaatatcccaacctagaaaaaaaacaaataaacaaaatagtaaaccttaagttcaaagattgggcacgatttagtaggaaactactagtaggaatagaaggcacggaaaaagagacgggtgaaataaacacaataataggattcttaagagagacaaacgaaaattttatggaactaatgagtaaccgatacacatttagcgaagaaataagtgaaataaaaaaaaaatatataccaaataagttatccaaacaaatcgtcgacgacctatatgtaagtccagctgtaaagaaaatgatttggcaagtactcaacataaacgacgaacttataaaagtacttggaaaacaaccaaaaaaaatatttatagagatggcacgtggcaaagaagaaaaaccagaagtgaaagacagtagaaaaaataaactaattgaactatacaaaaatctaggaaaagaaggcaaagaatggctcaacagaatagaagacaaaacagaagcagattttagaaatagagcactttacctatactacacccaaatgggaagatgcatgtacactggggaaattattgatatagaacgattatatgataaagaattatatgatctagatcacataataccacgaaaaatgaaaaaagacgacagcatacacaaaaatctcgtactggttaccagaaatagcaaccaatatgaaaaaaaggataattaccccgtaccagaggtcattaaatcacgtgaaaacgttcgacacctatggtatgcgctaaaaaaaaaaggattaatcaccgaagaaaaatataacagactaacacgaattaacccactcagtgataaagaattatcagaattcatagagagacaactagtagaaaccagacaaaccaccaaagtcgtcaaggacttattcgaaaactactacaccgactcaaaaatagtaacagtcaaagcaggacttgtaagtgaattgagaagagatttcgaagtattaaaatgtcgagagataaatgacttaaatcacgcacatgacgcattcctgaacataattgtaggcgatgtgtggtccaaaaaattcacatccaacccttacaacttcgtgaagaaaaacagagaaaaatatacattaaataacatattcactaagaaccagaaagatctaagaggaaatgaaatctggaactgcgccgaaggtaaaaaaagaataattaagacactaaacaaaccttcagtattattttcagttgaaaactttgagcaaacaggacagcttttcgatcaaaatatcataggaaaacaagactataaagagaaaacaagttacgtcccaataaaaggagacgaaagattgcaagacataagcaaatacggaggatatagaggaatatcaggggcttactttttcatagtagaacatacagaaaaaaacaaaagagtaaaaaccatagagagcttgccaatatacatgaaaagctacgtagaagaaaatggcctccttgatttctgtaccaatgaaatgaaattagtggatcctaaaatcatagtaaaaaaattaaactacaaatcggaaataatagtcgacggattcaaatatctcatatcaggcaaaaccgaaaaccggctaagcttagaaaccaacgaatatttgtattggaaccatactcaaacaacagacataaaaaaaatactaaatatcaatgagaaaatcgaactcgaaaaatacaacggcgatatagaatcagaaagagaaaatataattaaatacattcaaatcattctagaaaaattcaaactcaaaccatttatcaaaagaagaaatctacctaacatagaaataaatttcgccgactatgaaacagagaaattactacaactcctcgttaatctaataccactcaccaccaaatatgtgagcccagtagacctaacagttatttcaggctcgaaatacgcaggtaaagtactcataccaaagaaaatatcaaacctcaatgaggtgatctttatatcaaaaagtatcacaggcatctatgaatcaaggagaagaatcatttga

SEQ ID NO: 8774 - RNA, 4017 nt, synthetic construct
  misc_feature 1..4017: note = Cas9 variant
  source 1..4017: mol_type = other RNA
atgaaacaagaatattttcttggactagatatggggactggttcactaggatgggcagttacagatagcacgtaccaggttatgagaaaacacggaaaagcactatggggaacaagactttttgagtcagcttcaacggcggaagaacgacgaatgttcaggaccgcaagaaggagactagatagaagaaactggagaatacaagtcttacaagaaattttctcagaagaaatctccaaagttgatccaggatttttcctaagaatgaaagaaagcaagtattatccggaagataaaagagatgcagaaggcaactgtccagaattaccatacgcactattcgtcgatgataattatacagacaagaactatcataaggattatccaaccatataccacctccgaaagatgctgatggaaacaacagaaataccggatataagattagtatacctggtgctgcaccacatgatgaaacacagaggccactttctcctaagcggagatatctcgcaaatcaaagagttcaaaagcacatttgaacaattgatccaaaacatacaagatgaagaattggaatggcatatatctctagatgacgccgcgattcaatttgttgaacacgtcttaaaagatagaaacctaacaagaagtacaaagaaatccagactaataaaacaactaaacgcaaaaagcgcatgcgaaaaagctatactaaatctgttaagcggaggaaccgttaaactctcagacatattcaataataaagaattagatgaatcagaaaggccaaaagtatcctttgccgactcagggtatgatgactacataggaatagtagaagcagaactggcagaacaatactatataatagcaagtgcgaaagcagtatacgactggtcagtcttagtagaaatattaggcaacagcgtaagtatttcagaagcgaaaataaaggtataccagaaacatcaagccgatctcaaaacactaaagaaaatcgttcgacaatatatgacaaaagaagattataaacgagtcttcgtagacaccgaagaaaaattaaataattattcggcatatataggaatgaccaagaaaaatggtaagaaagtggatctcaaatctaaacaatgtacacaagcagatttctatgatttcctaaagaaaaatgtcatcaaagtaatcgatcataaagaaattactcaagaaatagagtcagagatcgaaaaagagaacttcctcccaaaacaagtcacaaaagacaacggagtcattccataccaagtacacgactatgaactaaagaaaatattggacaacttaggcacgagaatgccgttcattaaagagaatgcagagaaaatccagcaactatttgagttcagaataccttattatgtaggtccattgaaccgggtagatgacgggaaagacggcaaatttacatggtcagtacggaaaagcgatgcaagaatctatccatggaacttcacagaagtaatagatgtcgaggcttccgcagaaaaattcattagaagaatgacaaataaatgcacatatctagtaggcgaagacgtgctacctaaagattcattagtatatagcaaatttatggtattaaacgaattaaacaacctgagactcaatggagagaaaatatcagtagaattaaaacaaagaatatatgaagaattattttgcaaatatcgcaaagttactagaaagaaacttgaacgatacttagttatcgaaggaatagctaagaaaggagttgaaataactggaatagacggagacttcaaagcatcattaacggcatatcatgactttaaagaacgcctaacggatgtacaattatctcaaagagctaaagaggcaatagtactaaatgtagttttatttggagatgacaagaaactgttaaaacaaagattaagcaaaatgtatccaaaccttacaacaggacaactaaaaggaatatgctcactatcataccaaggatggggtagactatcaaaaacttttctagaagaaattacagtaccagctcccggaacaggtgaagtatggaacataatgacggcactatggcaaactaatgacaacttaatgcaattgctcagtcggaactacggatttactaacgaagtggaagaatttaacacactaaagaaagaaacagacttgtcatataaaaccgtagacgaactatatgtttctccagcagtaaaaagacaaatatggcaaacattaaaagtagttaaagaaatacaaaaagtaatgggaaacgcacctaaaagagtatttgtagaaatggcgagggaaaaacaagagggaaagaggtcggattcaaggaagaaacagctagtagaactctacagagcatgcaaaaacgaagaaagagattggataacagaattaaatgctcaatctgaccaacaactccgatcagataaactttttctttattacatacaaaaaggcagatgtatgtattcaggtgaaactatacaacttgatgaactgtgggataacacaaaatacgatattgaccacatatatccacagtcaaaaaccatggacgactcactaaacaatagagtattagttaagaaaaactataatgcaataaaatcagacacttacccactcagcttagatatacaaaagaaaatgatgagtttctggaaaatgcttcaacagcaaggattcataacgaaagagaaatatgtacgtctagtaagatcggacgaattatccgcagacgaactagcgggatttatcgaacgacagatcgtagaaaccagacaatcaacaaaagcagtcgcaactatactcaaagaagcattaccagatacagagatagtatacgtaaaggcagggaacgtttcaaactttagacaaacttatgaattactaaaagtacgtgaaatgaatgacttacatcacgccaaggacgcatacctaaatattgtcgtaggtaacgcatacttcgtaaagttcacgaaaaacgcagcatggttcataaggaacaaccccggaagaagttacaatcttaaaagaatgttcgaatttgacatcgaacgctcaggagaaatagcttggaaagctggcaacaaagggtcaatcgtaactgtgaaaaaggtaatgcagaaaaataatatcctagtaacacgcaaagcgtatgaagtgaaaggaggattatttgatcaacaaataatgaaaaaggggaaaggtcaggtacctataaaaggaaacgacgaaaggcttgcagacatagaaaaatacggaggctataataaagcagcaggaacttatttcatgttagtcaaaagtttagacaagaaaggaaaagaaattaggaccatagagtttgtccccctatacctgaaaaaccaaatagaaataaatcacgaatcggcgatacagtacctagcacaagaaagagggctaaatagcccagaaatactactatctaaaatcaagatagatactctattcaaagtagacggattcaaaatgtggctgtctggaaggacaggaaatcaactgatcttcaaaggagcaaaccaactaattttgagtcaccaagaagcagcaatacttaagggcgtggttaaatatgtgaacaggaaaaacgaaaacaaagatgcaaaactctctgaaagggatggcatgacagaagagaaattactacaattatacgatacgttcctggacaaactctcaaatacggtatacagcatacgtttaagcgcccaaatcaaaacattaaccgagaagcgtgcaaaattcatcggtctatcgaacgaagatcaatgcatagttctgaacgaaattttacatatgttccagtgccaatccggaagtgcaaatttaaaactaatcggaggaccaggatctgccggaatcctagtaatgaacaataacataacggcatgtaaacaaataagcgtaattaaccaaagcccaacaggaatatacgaaaaggaaatagatctaataaagttatga

SEQ ID NO: 8775 - RNA, 4017 nt, synthetic construct
  misc_feature 1..4017: note = Cas9 variant
  source 1..4017: mol_type = other RNA
atgactaaaccatactcaataggcctagatatcggcacaaactcagtcggctgggcagttgttactgacggatataaagtaccagccaaaaaaatgaaggtacttggcaacacggacaaatcacacataaagaagaatttactaggagctctactctttgactcaggcaacacggcaaaggatcgaagactaaaaaggacagcacgcagaaggtataccagaagaagaaacagaatcttgtacttacaagaaatatttgccgaggaaatggcaaaggccgacgaaagcttcttccagagactcaatgaatcattcctaaccaacgatgataaagaatttgactctcacccaatttttggcaacaaagccgaagaggaagctcatcatcacaaattccccacaatatttcatctaagaaaacacttagccgacagcacagaaaaaagtgatcttcgactaatatacctggctctggcccatatgattaaatttagaggccactttctcatagaaggacaactaaaagcagagaataccaatgtacaaacattattcgacgactttgtagaagtttacgacaaaacggtagaagaaagtcatctatcggaaatatcagtatcaagcatactaacggaaaaaatctcaaaatcgcgaaggctagaaaatctgataaagtactacccaacagaaaaaaaaaacacgttatttggaaacctaatagctctatcactaggactacaaccaaatttcaaaacaaacttcaaactatccgaagatgcgaaactacaattttcaaaggatacatatgaagaagatctaggagaactgttaggcaaaattggagacaattacgccgacctattcatatcagctaaaaatttatatgacgctatactactatccggtatactcacaattgacgacaacacaactaaagcaccactgagcgcctctatgataaaaagatacgaggaacaccaagaagatcttgcacagctcaaaaaattcatacgacaaaacctacccgatcaatactcagaagtattttcagataaaacgaaagacggttacgctggatacattgacggaaaaacgaaccaagaagcattttataaatatataaaaaacatgctctctaaaaccgaaggagcggattactttttagataaaatagatagagaagattttctcagaaaacaacgaacatttgacaatggtagtgtcccacaccaaatacatctacaagaaatgcacgccattctgcgtcgccaaggcgaatactacccatttttaaaagaaaatcaagacaaaatcgagaagatccttacattccgcattccatactatgttggaccgcttgcacgaaaaggttcaaggtttgcatgggctgaatacaaagctgataaaaaagtaactccatggaactttgacgacatactcgataaagagaaatcagcagaggaatttataactagaatgacactgaacgacctatacctaccagaagaaaaagtcttacccaaacacagtcttgtatatgaaacttttaacgtatataacgagctaacaaaagtaaaatacgtaaacgagcaaggcaaagcaatcttctttgatgctaatatgaaacaagagatatttgatcacgttttcaaagaaaaccgaaaagttaccaaggataaactgctcaactacctaaacaaagaatttgaagaattcagaatagtaaacctaactggtcttgacaaagaaaacaaagcattcaacagttccttgggaacataccacgatcttcgcaaaatattagataaaagttttttggatgataaagtaaatgaaaaaataatcgaagatataatacaaaccctcaccttattcgaagatagagagatgatccgacaacgtctccagaaatatagcgatatatttacaacacaacaattgaagaaactagaacgcagacactacacaggatggggacgcctctccgccaagctgataaacggcataagggataaacagtcaaataaaacgatacttgggtacctaatcgacgacggatacagtaataggaactttatgcaattgataaacgacgattctttacccttcaaagaagaaatcgcacgcgctcaagtcataggagaaacagacgatttaaaccaacttgtctcggatatagctggatctccagctataaagaaaggaatactacaaagccttaaaatagtagacgaactagtaaaagtaatgggtcacaaccccgccaacattgtaatcgaaatggcaagagaaaatcaaacaaccgcaaaaggaagacgttccagtcaacaacgatataaacgtctcgaagaagcaataaaaaacctcgatcatgacctgaaccataaaatattaaaagaacacccaacagataatcaagcactacaaaatgacagactatttctctactacttacaaaatggcagagacatgtacactgaagatccattagacataaaccgtctctcagattacgatatcgaccatattatcccacaatcattcattaaagacgattccatagacaacaaagtattagtatccagcgccaagaacagaggaaaatcagacaatgtccccagtgaagacgtcgtcaatagaatgagacctttctggaataaactactaagctgcggtctaatatcgcaaagaaaatattcaaatttgacaaaaaaggaacttaaaccagatgacaaagcaggttttataaaaaggcaactggtagaaacacgacaaataactaaacatgtcgcacaaatactagatgcaagatttaatacaaaacgagatgaaaataaaaaagtcatacgcgatgtcaagataataacgctaaaatcaaatctcgtctcgcaatttagaaaagacttcaaattctataaggtccgtgaaataaacgattaccatcacgcacacgatgcctatctaaatgccgtgataggtaaagcattactcgacgtatacccacagctagaacccgaatttgtatatggagaatacccccatttccacggatataaagaaaataaagcaaccgcaaaaaaatttttttatagcaacataatgaatttctttaaaaaggatgatattcggacagatgaaaacggcgaaatcgtctggaaaaaagacgaacatataagcaacataaaaagagtactatcatatccacaagtaaatatagtcaagaaagtcgaaatacaaaccgtaggccaaaatggtggactctttgatgataaccccaaaagtcccttagaagtcaccccatcaaaattggtcccgttaaaaaaagaattaaatcccaaaaaatatggaggatatcaaaaaccaactaccgcttacccagtcttactcataaccgataccaaacaactcattcccatctcagttatgaataagaaacaatttgaacaaaacccagtgaaatttttgagagatagaggataccaacaagtaggaaaaaacgactttatcaaactaccaaaatatacactagtggatatcggcgacggaataaaaagattatgggcaagctcaaaagaaatacataaaggcaatcaactagtcgtatcaaaaaaaagccaaatactcctatatcacgcacaccatttagactccgacctatccaacgattacctacaaaatcataaccaacaatttgatgtactattcaacgaaataatttccttctcaaaaaaatgcaaattaggtaaagaacatatacaaaaaatagaaaatgtatatagcaacaaaaaaaattcagcatcaattgaagaactcgcagaatccttcatcaaactgttaggcttcacacaattaggtgctacaagtcccttcaattttttaggggtaaaacttaatcaaaaacaatacaagggaaaaaaagactacatactaccttgcacagaagggaccctaatcagacagagcatcacaggcctttatgaaacgagggttgatctatcgaaaatcggagaagactga

SEQ ID NO: 8776 - RNA, 4017 nt, synthetic construct
  misc_feature 1..4017: note = Cas9 variant
  source 1..4017: mol_type = other RNA
atgcgcgattactacattggattagacttaggtacaggatcactagggtgggccgtaacagatagagaatatgaaattatgagagcacatggaaaagcactatggggagtcagacttttcgattcggctaacaccgcagaagaaaggcgaggtttcagaactgcccggagacgcctagatagacgaaactggagaatcgaactactacaagaattgtttggtgaagatataggtaaggtcgatagcggtttctttctgagaatgaaggaaagtaaatacatgccggaagacaaaagggacgtaaacggaaattgtccaaaattgccatatgccctttttgtagaggatggctatacagacaaagactaccacaggcaattcccaaccatatatcatttaagaaaatggttgatggaaaccgaagaaacaccagacataagactagtgtacctagcactacatcatatgatgaaacaccgagggcatttcttattttcaggaaacatagagaaaataaaagaattccaagaaacattccggcaatatatagggaaaattagagaagaagaactagattttcatttatgcatagagggagaagaactgagggaaacggaaaatatattaaaagacaaaaacttgactagaagtgcaaaaaaaactagactaataaaattattaggtgctcacactgcatgtgaaaaagctgcattaaatctcgtagctggcggaactgtgaaattgagtgatatatttggcaatagtgagctcgacgcctgcgaaaaaccaaaactaagtttcgccgatgcaggatatgatgactacgctggaatgatcgaagacgaactaggagagcaacatgttattatagaaacagcaaaagcagtatatgactggagcgttttggcggacattttaggagactaccgttgtataagtgaagcaaaagcagcagtatacgaaaaacatcaaaaagatttaagacatttgaaagaactagtaaaggaaaacttaggaagagatgtgtacaaagaggtattcgtaaaaacaaacgagaaacttcccaactactccgcatatataggtatgacgaagaaaaatggcgtcaaatccgagatggaaggtaaacgatgtgatagaaaagcattttatgactatttaaaaaaaacagtagttaatgcaataccagacgaaagcaaaaccgaatatctcagaaaagaaatggaaacagagacttttctaccgcgacaagtcactaaagataatggtgttataccacatcaagtacatctacaggaattagatgctattttggaaaatttaagtggcagaataccagcactcaaagaaaacgggtcaaaaataagagacatcttcacttttagaataccatattatgtaggaccactaaatggcattgtgaaaggaggagaaaggacaaattgggttagaagaaaaaaagcaggaagaatttgcccatggaatttcgacgaaatggtagacactggggcatcagcagaagaattcataaggagaatgacgagtaaatgtacgtatttaatacatgaagacgtcttaccaaaaaattccatgttatatagcaaatttatggtactcaatgaactaaataacgtacgactgaacggagaacctatatcggtagaactaaaacaaaaaacatacgaagatctctttcagagacacagaaaagtcacaagaaggcgactcaccgattatattagaagagaaggtatagcaggacgagatgcggatattacaggtattgacggtgattttaaaggatcacttacagcataccacgattttaaagaaaaactaactggatgcgaattgagtcaagcagataaggaaaatataatcctcaacataacactattcggggaagataaagcacttttaaaaaaaagattaggagcgttatacccggcattgacagaaccacaaaaaaaagctatatgcgcattatcatataaagggtgggggcgactttcacaacggctattagaagggataacagcaccagcaccagagaccggagagatatggactgtaataagagctatgtgggaaaccaatgacaatcttatgcaagtactcagtgaaaaatactgttttgctgcagcaatagacgaagaaaacgccggtgaagaactgaaagaaattacgtataaaactgtagaacaaatgaacgtgagcccagcagtaaggagacaaatatggcaatctctacaagtgataaaagaaatatgtaaggttatgggaggccccccaaagagagtctttgtagaaatggcccgagaaaaaatggaatctaaaagaacagaaagtcggaaaaaaaggttaatagatctttataaaaaatgtagagaagaagaacgggattggatagaagaactcggtaacacagaagaaacacgactaaggtccgacaaactctacttgtattatactcaaaaaggtagatgcatgtattcaggtgaagtgatagaacttgaggaattatgggataaccgaaaatatgatattgaccatatctacccacaaagcaaagtaatggatgacagcttagacaatagagttttggtaaaaaaggagtataatgctgataaaacagatgaatacccaataagagcagatatcagaggaaaaatgagagcattctggagaatattaagagaagaagggtttatatctaaagaaaaatataatagattgacaagaggcacaggttttgagccctcggaattagccggatttatagcaagacaactcgtcgagactagacaaggaacaaaagcagtagcttcagtactaaaacaggtattccctgaaacagacatagtatacgcaaaggctcgagtagcatcacaattcagacaagaatttgatttaattaaagtgcgggaaatgaatgatctgcaccacgccaaagatgcgtacgtaaatatcgtcgtgggaaatgtctactatactaaattcacatcaaatgcagcatggtatgtgaaggaacatcccggtaggtcgtacaatttaaaaaaaatgttcacttcagagagagacgtagcaagaaatggagagacagcatggcgagcaggtaacagtggcactatagcaaccgtcaaacgcgtcatgggtaaaaacaatatacttgtgacaagacgttcgtacgaagttaaaggagggctattcgatcaacaactaatgaagaaaggcaaaggacaagtacccataaaaggtagagatgaaagacttgcagacatagacaaatatggaggctataacaaagcggcaggcacatattttatgctagcagaaagtgaagacaaaaaaggagcaaaaatacgatcagtcgaatacgtaccattgtatctttgcaattgcattgaaaaagacgaagaagcggctaaaaaatacctgcaaaaagagagaggtctaaaaaatccccgagttctgatagccaaaataaaaattgacacattatttaaagtcgatggattctatatgtggttaagtgggaggacgggaaaccaattaatatttaagggggcaaatcaattaatactctcagaaccagatatgagaattttgaaaaaagtattaaaatatgtcaaccggaaaaaagaaaataaaaacgcagtattaggcgaacacgatcagttacccgagacagacctaatccgactttacgatgtgttcttagacaaaatagaaaacacagtttaccacgtaagattgagtgctcagcagggaaccttaacgaaaaacaaagacacattttgtgaattgtcaaatgaggataaatgtatagtactcagtgaaatcctacacatgttccaatgccaaagtggaagcgcaaatcttaaacttataaagggacctggaagtgcaggaattttagtattaaataatattatatcaaagtgtaaccaggtgtcaataatacaccaaagtccaactggaatatatgaacaagaaatagatctaaaaaagatatga

SEQ ID NO: 8777 - RNA, 4020 nt, synthetic construct
  misc_feature 1..4020: note = Cas9 variant
  source 1..4020: mol_type = other RNA
atgaacaaagcatatacattagggttagacatagggacaaacagcgtaggatgggccgtcgtcacagatgattaccgattaatggcaaaaaagatgcctgtacacagcaaaatggaaaaaaagaaaataaaaaaaaacttctggggagccagacttttcgatgaaggacaaacagcagaagaaagaagaaacaaacgcgctacacgacgcagactacgacgacgtaaataccgtatcctggaattacaaaaaattttctccgaagaaatattaaaaaaagactctcatttctttgcacgtttagacgaatccttcctaatcccagaagacaaacaatacgcaaggttcccgatattcccaactctccttgaagaaaaagcatactatcaaaattaccctactatatatcatttaagacaaaaattagctgactctactgaaaaggctgatattagactagtctatctagctctagcgcacatgatcaaatatagaggtcactttctatttgaaggtgagctagacactgagaacaccagtgtcgaagaaacatttaaagaatttatagacatatacaacgaacaattcgaggaaggtatcatattctacaaagatatacctctaatactaaccgacaaactatccaaatcaaagaaggtagaaaaaatcttacaatattaccccaaggaaaaaacaacagggtgtctcgctcaattcttaaaactaatcgtaggaaatcagggtaacttcaagcaagcatttcacttagatgaggaagtcaaaatacaaatatcaaaagagacttatgaggaagaccttgaaaaattactaagaaaatccaacgaagaaatgatagacgtatttctacaagtaaaaaaagtgtacgatgctatactactctctgacatactaagtactaaaatgaaagataccaaagctaagctgtctgcaggcatgatagaacgttaccaaaaccacaaaaaagatcttgaggaactgaaacaattcgttagagcacacctccacgagaaagtcacagtattcttcaaagacagctccaaagatggatatgcaggatacatagatgggaaaaccacacaggcagatttctataaattcctaaaaaaagaactaacaggagtaccaggttcagaacccatgctagcaaaaattgaccaagaaaattttctattaaaacaaagaacaccaactaacggagtaataccacatcaagttcatctcactgaattcaaagcaataatagaccaacaaaaacaatattatccattcttagaaaaatcgaaagaaaagatgattcagttgctaacctttagaattccgtactacgtaggaccgctagctcaggacaaagaaacttcatccttcgcatggcttgaaagaaaaacgacggaaaaaattaaaccctggaatgcaaaagatgtaatagactacggcgcatccgcaaccaaatttatacaaagaatgatcaattacgatacatacctaccgacagaaaaagtcctaccaaaatattcaatgctatatcaaaaatataccatattcaacgaactaacaaaagtggcatacaaggatgataggggtattaaacatcaattttcttcagaagaaaaattaagaattttccaagaattgttcaaaaaacagaggagggtaacaaaaaaaaagttacagcacttcctaagtgcaaactataatatagaagacgcggaaatactaggcgtcgataaagtgtttaattcaagctacgcgacatatcacgacttcttagaattagctaaaccatataccgaaaaaataatagaattgttagaacagcctgaaatggaagaaatgttcgaagacatcgtcaagatcataactatattcgaagacagagaaatggtccgtacccaactcaaaaaataccaaagaatcctaggtgaagaaatctttaaaaaactagtcaaaaaaaaatacacagggtggggaagactcagtaaacgcctgatcaatggaataagagaccaaaaaacaaataaaaccatactggactatttaatcaacgatgatgatttcccctataatagaaataggaattttatgcaactcattaatgatgatcacctatcctttaaagaagaaatagcaaaagagttgacactctcagataaacagtcattattagaagtagtcgaagcgatccctggatcacccgcaataaaaaaaggaatttggcaaactctaaagatagtagaagaactaatagcaatcataggctataaaccaaaaaatatagtcatcgaaatggcaagagagaatcaaacaactacagggggcaaaaacagaagtaagcctcgcctgaaatcacttgaagaagcattgaaaaattttgactcacaactattaaaagaacgcccagtagacaaccaatcactccagaaagatagattatacttatattacttacaaaacggcaaagacatgtacacaggagaatctctagatattgataggctgtctgaatatgatattgaccatataattccacggtcatttattgtagaccactcactggataacaaagtacttgtatcctctaaagaaaacagactaaaaaaagatgacgtaccagactctaaagtcgtaaaacgcatgaaggcatattgggaaaaattattacgggcaaacctaatttctgaacgaaagttctcatatttaaccaagttggaattaacagacgacgacaaagctagattcatacaacgacaactagtcgaaacacgccaaataacaaaacatgtagccgcaattcttcaccaatacttcaaccaaacacaagaacttgagaaagaaaaagacatacgaataatcacccttaaatcctctttagtttctcaattccgacaagtattcggcatccataaagtccgagaaataaatcaccatcaccatgctcatgacgcatatctaaatgcagtagtagcccttgccctattaaaaaaataccctaggctagcaccagaattcgtatacggatcattcgcaaaattccatttagttaaagagaataaagccacagcaaaaaaggaattctactccaacatactaaaatttttcgaaaaagaggaacaattttgtgacgaaaacggagaaatcttctgggataaaagaaaacacatacaacaaattaaaaaagtaatttcatctcatcaagtaaacatagtaaaaaaagttgaagtgcaaacaggctctttttacaaagaaacagtcaacaccaaagaaaagccagataaactcatcaaaagaaaaaataactgggatgtaacaaaatatggaggattcggaagtccagtagtcgcatatgccgttgtcttcacatacgaaaaaggaaagaaccacaaaaaagccaaggccattgaaggaataacaatcatggaacaagcactatttgaaaaagatccgatctcatttcttatcgaaaaaggttacagcaacgtgaaccaattcataaaactaccaaaatacacattatttgaattagcaaatggacaacgacgaatgctagcatcgcaccaggaactccaaaaagcaaactcattcatactccctgaaaaactagtgacattattatatcatgcaaatcactatgatgaaatagcctataaagactcctacgactacgttaatgaacactttagtaacttccaagatattctcgacaaagtaataatattcgcagaaaaatacacaagcgcacctcaaaaattgaaccaaataattgcaacttacgaaaaaaatcaagaagcagatagaaaaataatggcacacagcttcgtaaatctaatgcaattcaacgcactaggagcacccgcagacttcaaattctttgatacaaccattactagaaaaagatatacatccctcacagaaatatggcaatcaacaatcatataccaaagcgtaacgggtttatatgaaacacgaaggagaatggcagatctatgggatggagtccaatga

SEQ ID NO: 8778 - RNA, 4020 nt, synthetic construct
  misc_feature 1..4020: note = Cas9 variant
  source 1..4020: mol_type = other RNA
atggaacgctaccacataggactagacattggcacatcaagtatagggtgggctgtaataggagacgacttcaaaataaaaaaaaaaaaaggaaaaaacctaattggaactcggctcttcaacgaaggagcaacagccgcagaacgtcgagggtttcgaacacaaagacgacgcttaaaccgtagaaaatggagactcaaactactagaggaaatcttcgatccatatatggcggaagtagacgaatacttcttcgcccgccttaaaagctcaaacctttctccaaaagattctaacaaaaaatacttaggaagcttactcttcccagacaaatcagactccaatttttatgacaaatatccaacaatataccatttacgacgcgacctcatggagaaagatgaaaaattcgatctccgagaaatatacctcgcaatacatcacatcgtcaaatatagagggaatttcctagaaaaagtcccggcaaagaattacaaaaattcaggagcaagcattggatttttattagaagaagttaactccctctacaaagatattataggcgacgaatcaatagctatactaaattccgagaaatttgaagacgtagaaaaaattattctagacgaagaaacgagaaatctcgacaaacaaaaatcagtagggaaactactcgtcgaagacaaaaaaaaaaaaaacatagtcacagcattttcaaaagccatatttggatataagttcaacattgaagacttactattaatagagaatgacgaaaaaaataaacttacgttcaatgatgagaacatagatgacatatttaacgaactatcacacagtctagatgataaacagatggacctactaacaaaaacgagagagatttactttaaatttaaactcaacatgatagttcccacagggtacacattatcagaaagtatgatcgaaaaatatgaaatgcataaagcacacttaaaaatgtacaaagaatttataaacactctcaacacaaaagacagaaaaatattaaaaaatgcatacagcgattacattaacacagaaaaagcaaaggcagccaacgcccaagaaaacttctacaaaactgtaaaaaagatcataaaagacaacaatagcgacaccgccaaaaaaataatcgtactaattgatgagggcaacttcatgccaaaacaacggaccggagaaaatggcgttataccacatcaacttcaccagatcgaactcgaccggatcatagaaaaccaagccaaatactacccatggttagcagaagcaaacccggtcgaaaaaaacagaaaattcgcgaaatataaactcgacgagttagtaacatttagggtaccatactatgtaggtcccctaatcgacaaaactgaatccaataaaaacgaaaaagaaaccaaattcgcatggatggtacggaaagcaaaaggaacaattaccccatggaacttcgaaaatctagtggataggacggaatcagctaacagattcataaaaaggatgacatctaaagacacctacatcatcggcgaagacgtactaccagcgtcatcactactatacgaaaaattcaaagtactcaacgaactaaataatattaaagttaacgaaaaaaaattagacatcgaacaaaaacaagacatatatctaaacctatttacaacagcaaaaaacgtgactaaaaaatcactggcgacgtatttaaattgctcagcagacagcatatccggattatccgatggagaaaaattcaattcatctttaagtagctacatagacctgaaagctatactaggaaacatagtggacgattgtaataaaaacgaagacttagaaaaaataatcgagtatagtacggtattcgaagatggaaatatatacaaagaaaagctttctgaaatatcctggttaacagacgaacaaattgaaaaactttcaaatatccatttcaaaggctgggggaggttatctaagaaactattaacgcaaatcaccaatgaaaacggcgagcgaataattgatgccctatggaacacttcgaacaacttcatgcaaataattaacgacgagtcgatacaagctaaactcgccgaaatcaacggaaaatacgcgggaaaaagtgacctcgaagatatattaagtgaagcgtatacatccccccaaaataaaaaagcaataagacaagtaatgaaagtagtagaagatattgaaaaggcaatgcaatgtgaaccaacatcaatttcaattgaattcaccagaaaaaaacaaaaaagtagacttacgaacacacgatataaaaaaatttctgatgtctacgaaaaaatcgcagacgaagtcatatcagaatacgaactgcgcaaactccagagcgaactagacagtaacgctaacaacatgcgagacagatactacttatattttatgcaacttggcagagatatgtacaccggagagaaaatcaacatagacgagttacaccaaagatacgatatagatcatattctaccacaatcatttataaaagatgatagtataaacaatagagtactaacgagaaaagacgtcaataacaaagaaaaaagtgataaaacagccgctgatctttacgccgtagaaatgtccgacttttggagaaaattgcgaaaacaaggcctaataactgaacaaaaatataaaaacctcctaacaaaatccgacagtatagataaatacgcaaagaagggctttatcaaaaggcagttagtagagacctcacaagtggtaaaactagttgctaatatcttacaagacaaatattccgacaccaagataatcgaagttagagcaaaactcaactcgaacttacgcgaagaatacaaacttattaaaaaccgagcagtaaatgactaccaccacgccatagacggttacttaaccacgtttataggacaatacctatacaaaacttaccccaaattaagaagttacttcgtttataacgacttcaagaaattggacagtaactacttaaagcacatgaaaaaattcaacttcttatggcaactacaagacgataaaacgatcgatatatacgacaatgtaaataataaattcgtactgaatgtacctgaaatgaaaaaatatatacaaaaaatatataactacaagtatatgttagttagcaaagaggtgactactaaaaatggagcgttttatgaccaaaccaaatataacgctaaaacggttaatctcatacccatcaaaaagaataaaccaacaaacatatatggcggatacaaaggaaaagtatcatcatacatgatgctagtaaaaatacgtaaaaaaaaagaagtaatatacaaattcgtgggcgttccacgactctggacagatgaattagatagactaaaagatacgacagaacgcaagatattactcaatgaaatagccaaaaattcgttatcaaaaacagaacaagatttcgaggtcatactcgataaagtatattacggccaattaataatagacggaaatcaaaaatatacactaggttcaagtgagtataaatataacgcaatgcaactacacctctccaaacacgcactcgaagttctagccaaagaaaacgtaaaagacgcagaaataacagataaagacttagtctctgtatatgaggaaatactatcagtagtaaacaaatacttcgaactatacgacatcaacaaatttagacaaaaactaaacgaaggcttagaaatatttagaaaattaccagtatacaacgtatacgagtcaaacaaaatcaaacaggttgggaaattcgaagtactcaatagaatacttatgggactacacgcaaatgccatgatcacagacttaaaagtacttggaataaaaacgaaactaggacaaatgcaagtaaatggcgggataaaactttcacccgacgcaaaactgatctaccaaagccccacaggaattttttccagagccgtacgagtcaaagatctcggatga

SEQ ID NO: 8779 - RNA, 4020 nt, synthetic construct
  misc_feature 1..4020: note = Cas9 variant
  source 1..4020: mol_type = other RNA
atgtcactcaacacaaataagaaatacaatattggactagacattggtactacatctgtcggctgggctgtcacagatgcagacggccaaaaattactcaaagccaaaaataaaaacctatggggtgtatctctatttgaagcaggtaaaaccgcagcagaacgccgcggataccgatcaacacgaagaagactcaaccaccgcaaattccgtttacgcttattggaagatatgttcgagaaagagatactgagcaaagacccatcattcttcatccgactcaaagaagcattcctatcaccaaaagacgaacaaaaacaatttaaaggtaacatattattcaacgacaaagattatacagatgcagattattacgaacaatacaaaacaatataccaccttagatatgatctaatatctcaacatcgacaattcgatatacgagaggtatatcttgcaattcaccatctcatcaaataccgaggacatttcatatatgaagaccaaactttcaccacggacggcaatcaacttcagcaccatataaaagcaataattaccatgataaacagcatcttaaatcgaattataataccagaaacaattgatataaacgtctttgagaaaacactgttagaccgaacaatgaatagatcaagcaaagttaagttcttaatcgaactgacaggcgaagacaaacaagacaaaccactattaaaagaattatttaatctaatagtgggactaaaagcaaaaccggcaagtattttcgaacaggaaaacttggcaacaattgtcgaaacaatgaatatgtccacagaacaagtacaactagatttactaaccctagctgatgtactcgctgacgaagaatacgacttattgcttactgcacagaaaatatactcagcaataatattagatgaatcaatggatggatatgaatatttcgccgaagcaaagaaagagtcatatagaaaacatcaagaggaacttgttctagtaaagaaaatgttaaaaagtaacgcgatcacaaacgatgaacgtgcgaaatttgaatacttctatacagattatataggtgcaaaaagttctaactacgaagaaagcaaaatcattaagaaaggactttccgcggcatacggaaaatactctaaagaagaaagacttttcaaacacattgaattactattagctaaagaaaacgtactcactactgtagaacatgacctgcttgaaaagaacattacattcgcaagtcttcttccccttcaacgatctagtagaaatgcagtcatcccatatcaagtccatgagaaagaactcgtagcgattttagaaaatcaagcaacatactacccattcctactagaacaaaaagacaatatccataaactactcacattcagaatcccatactacgttggtccattggcagaccaaaaagactcagaatttgcatggatggtacgaaagcaagcaggaaaaattaccccgtttaacttcgaagaaatggtcgacattgatgcatcatcagaggcattcatcaaaagaatgacaaacaagtgcacttacttaatacacgaagatgtaatccccaaacactccttcagctacgcaaaatttgaagtactaaatgaattaaacaaaataagactggacggaaaacccattgacatacctctgaagaaaagaatattcgaaggcttatttctagagaaaacaaaagttactcatacctctcttaagaaatggctagcggaatatgaacacatgaccgtatccgtagtccaaggtacccaaaaagaaacagaatttgcaacatctctccaagcattccatcgtttcgtaaaaatttttgatcgagaaaccgtcagcaacccggcaaacgaagaaatgtttgagaaaataatttattggtctacagtattcgaagacaagaaaattatgcgtcgaaaactatccgaatacccccaactaacagaacaacaacaagttcaactggcacaagtcagattccgaggttggggacgactaagccaaagattaatcaataggattaaaacaccagtttcaggagatgaagaccacaaattatcaataaatgaaatcttatggcaaacaaatgaaaactttatgcaaataattcgaaataaagattacctcttcaagaaaattattgaggaacaattcgaaaacgaaacagcccttttaaacaaacaaaggattgatgaattagcaacatcaccagcaaataagaaaggaatttggcaagcaatcaaaatagtcaaagaactagaaaaagtcttacaacaacctgccgaaaatatattcatagagttcgccagaagcgacgaagaatctaaaagatcaaccccaagagacaaattcatagaaaaagcatatgcacaactaaagaaagaaacggatacattcaatctagaacatctaaaagaattaaaacaaagatccaaacaactttcctcgcaaagactcttcctatattttatccaaaatggtaaatgtatgtacagtggagaacacctagatatagaaagattggatagctatgaagtagaccatattttgccacaaagttatatcaaagataattccatagaaaacctcgctttagtaaagaaagttgaaaaccaaagaaagaaagactcgctgctactaaatagcagcatcataaaccaaaactatagtcgatgggaacagctgaaaaacgcaggtctaataggtgaaaagaaatttagaaatctaacaagaacaaaaataacagatagagacaaagagggattcattgctagacaactcgttgaaacaagacaaattactaaacatgtaacccaattactacaacaagaatacaaagatacaaccaaagtattcgcgataaaagcaactttagtaagcgacctacgaagaaaatttgagttcattaaaaatcgaaacgtaaatgactatcaccacgcgcaagacgcctttcttgtagcattcctaggaacaaatataacaagtaattatcccaaaatagaaatggaatacctttttaaaggttatcaacattacctgaatgaagtaggaaaatcagcagcaaaacctaaatttacattcatagtagaaaacctatcaaaacaacaatacaatagtacaaccggagaagttaaatggaatccagaagtagatatagcaaaattaaaacgaatactcaacttcaaacaatgtaatattgtcagaaaggtagaagaacagtcaggagcgctattcaaagaaacaatataccctgtagaagaatcgtcatcaaaaacaataccactaaagaaacatctagatacagctatatacggcggctacacagccgtaaattatgcatcatacgcacttatacaatttaaaaagggcagaaaacttaaacgcgaaattatcggaatacctctagctgtccaaacgcgtatagataatagcgaaacatccctccaaacctatatagcagaacaaataaaaagcgaagtggaaatcttaaacggaagaatacttaaataccaactaatatctaataacggaaacagactctatatagccggcccccgtgaacgacacaacgcccgtcaactaatagtttctgatgaagcagccaaagtaatatggctcatctcaaccaaacaagcagttgaagcaaccttccttaaacactacactctagaacacctcgaagccgttttcgaagaactaatacgtaaacaggcagctgattaccaaatttttgaaaacttgatcaagaaaatagaagtcaataaagcatatttctactcatgcacatataacgaaaaagtaaaagtaatcgaagaattattaaaaataacgcaagcaaatgccacgaacggcgaccttaaacttctcaaaatgactaacagagaaggacgattaggaagtgtaagcgtagcactagatttcaaaatcataaaccaaagcgtcacagggttataccaaagcatcgaagattacaataactga

SEQ ID NO: 8780 - RNA, 4020 nt, synthetic construct
  misc_feature 1..4020: note = Cas9 variant
  source 1..4020: mol_type = other RNA
atgtcactcaatacaaacaagaaatataacatcggactcgacataggaacaacatcagtaggatgggcagtaactgatgcagacggtcaaaaactcctaaaagccaaaaataaaaacctatggggcgttagtcttttcgaagcaggaaaaacagctgcagaacgacgtggatacagatcaaccagacgtagacttaaccacagaaaattccgattacgattactcgaagacatgttcgaaaaagaaatcctatccaaagatccatcatttttcataagattgaaagaagcattcctatcacccaaagatgagcaaaaacagttcaaaggaaatatactattcaatgacaaagactacaccgatgcggactattacgagcaatataaaacaatctaccatttacgatacgacctaatttcgcaacacagacaattcgatatccgagaagtatacttagcaatacaccacctaattaaatacagaggacacttcatatatgaagatcaaactttcaccacggacgggaaccaactacaacaccacatcaaagcaataatcacaatgataaattcaatactgaaccgaataattattccggaaacaatcgacattaatgtttttgagaaaacattattagaccgaactatgaaccgttcttcaaaagtgaagttcttgatcgaacttacaggagaagataagcaagacaaaccacttttaaaagaattattcaatctgatcgtaggacttaaagccaaaccagcaagcatttttgaacaagaaaatttagctactatcgtggaaacaatgaatatgagcacagaacaagtccaactcgaccttttgactctcgctgatgtactagctgacgaagaatacgacctcctactaacagcacagaaaatatacagcgcaataatattagacgaatcgatggacggatacgaatatttcgcggaagcaaagaaagaatcgtatagaaaacatcaagaagaattagtactcgtaaagaaaatgttgaaaagcaatgcaattacaaatgacgaaagggcaaaattcgaatatttctatacagactacataggtgcgaaatcttcaaactatgaagaatcaaaaataatcaagaaaggcctatccgccgcatatggaaaatattcaaaagaagaacgactatttaaacacattgaactactactagctaaagaaaatgttttaacaactgtagagcatgatcttcttgagaaaaatatcacctttgcttcactcttgcctttacaacgctcctccagaaacgctgttataccataccaagtacatgaaaaagaactcgtagctatactagaaaaccaagcgacttattatccatttctattggaacaaaaagacaacattcacaaactactaacattccgaatcccatattacgtaggcccactagcagaccaaaaagacagtgaatttgcttggatggttagaaaacaggcaggcaaaataaccccattcaactttgaagaaatggtagacatagatgccagctcagaggcattcatcaaaagaatgactaacaaatgtacatatctcatacacgaagacgtgatacctaaacactccttctcctatgctaaatttgaagtactcaatgaattaaacaaaatacgactagacggcaaaccaatagatataccacttaagaaacgcatttttgaaggattattcttagagaaaaccaaagtcacacatacatcacttaagaaatggttagcagaacatgaacacatgacagtcagtgtggtacaaggcacacaaaaagaaacagagttcgcgacttccttacaagcattccacagattcgttaaaatattcgatcgcgaaaccgtgagtaatccagcaaatgaagaaatgtttgagaaaatcatatactggtctacagtattcgaagataagaaaatcatgagacgaaaattatcagaatacccacaactaacagaacaacagcaagtgcaactagcacaagtacgatttcgcggctggggtagactttcacagcgtttaataaaccgtatcaaaactcccgtatctggagacgaagatcataaattaagtataaacgaaatactctggcaaacaaacgaaaatttcatgcaaataatccgtaacaaagactacctattcaagaaaattatagaagaacaatttgaaaatgaaacagcactcttaaacaaacaaagaattgacgaacttgcaacaagccccgcaaacaagaaagggatctggcaggcaataaaaatagtaaaagaattagagaaagtactacagcaaccagcagaaaatatcttcatcgaatttgccagatccgacgaagaatcaaaaagatcaacccctcgtgataaattcatagaaaaggcttacgctcaattaaagaaagaaacagatacctttaatctcgaacatttaaaagaattgaaacagcgaagcaaacaactttcatcacaacgtctctttctatattttatacaaaacggtaaatgtatgtactccggcgaacacctcgatatagaacgactcgactcatacgaagtagaccatattctaccacaatcttacataaaagacaattcaatagaaaacctagctctagtcaagaaagtcgaaaaccaaagaaagaaagacagcctactactaaacagcagcattataaatcaaaactacagcagatgggaacaattgaaaaatgcaggtctaatcggtgagaagaaattccgaaacctcacgcgaaccaaaataaccgaccgagacaaagagggtttcatagctcgacaactcgtggaaacacgtcaaatcactaaacatgtaacacagcttttacaacaagagtataaagacacgacaaaagttttcgccataaaagcaactctagtatcagacctacgtagaaaattcgaatttatcaaaaaccgcaacgtcaatgactaccaccacgcccaagacgcctttcttgtagcttttctaggcacgaatataacaagtaactatccaaaaatagagatggaatacttattcaaaggttaccaacattatttgaacgaagtaggtaaatccgcagcaaaaccaaaatttactttcatagtagagaacctatcaaaacaacaatacaattcaacaacaggtgaagtaaaatggaatcctgaagttgacatagctaaattaaaaaggatactcaacttcaaacaatgcaatatcgtaagaaaagtagaagaacaatctggagcactctttaaagaaaccatctattcagtagaggaatcatcttcaaaaacaatacccttaaagaaacatttggatacagcaatatacggtggatacacggcagtcaactacgcatcctacgcactcattcaatttaagaaagggcgaaaactcaaaagagaaataataggcatacctttagcagtacagacaagaattgataacagtgaaaccagtctccagacgtatatagcagaacaaataaaatctgaagttgaaattctaaatggaagaatcctaaaataccaattaataagcaacaatggaaatagattatacatagctggcccgagagaaagacataacgcacgacaactaatagtgtcagatgaagcagcaaaagtcatatggttaataagcacaaaacaagcagtagaagcaaccttcttaaaacactacactctagaacaccttgaagcagtatttgaagaattaatccgaaaacaagcagcagactaccagatatttgaaaacttaatcaagaaaatagaagttaataaggcttacttttactcatgtacttataatgaaaaagtcaaagtcatcgaagaacttcttaaaattacccaagcaaacgccacaaacggtgatctaaaattattaaaaatgacaaatcgtgaaggtcgcctcggatcagtatcggtagcattagacttcaaaattataaatcaatccgtaactggattataccaatcaatagaagactataataactga

SEQ ID NO: 8781 - RNA, 4020 nt, synthetic construct
  misc_feature 1..4020: note = Cas9 variant
  source 1..4020: mol_type = other RNA
atgaaaaaagaatataccatcggattagacataggaacaaatagcgtaggctggtcagtacttactgacgattacagactcgtatccaaaaaaatgaaagtagcaggaaacaccgaaaaaagctcgacgaaaaaaaacttctggggagtaagattattcgatgaaggccaaacagctgaagcacgaagatctaaaagaactgccagacgccgtttagccagaagacgtcaacgtatcctcgaactacaaaagatatttgctccagaaatcttaaaaattgacgagcatttcttcgcacgactgaacgagtcatttcttgttctagacgaaaaaaaacaatcgagacatccggtgtttgcaaccattaaacaagaaaaatcgtaccatcaaacataccccacaatatatcatcttaggcaagccctagcagacagctcagaaaaagcagatattcgactggtatacttagcaatggcccacctattaaaatataggggacactttttgatcgaaggagaattaaacacagaaaattcttccgtaactgaaacattccgacaattcttaagcacatataaccaacagttctccgaagccgacgacaaacaaacagagaaattagacgaagcagtagattgtagttttgtttttaccgaaaaaatgtcaaaaacgaaaaaagcagaaaccctactaaaatactttccgcacgagaaatccaatggatatctaagtcaatttataaagctaatggtaggaaatcaaggcaactttaaaaatgtgttcggtctcgaggaagcaaaactccaatttagtaaagagacctatgaagaagatcttgaggaattactagaaaaaataggagacgactatatagatctttttgttcaagccaaaaatgtgtatgacgctgtactattatcggaaatactatctgatagtactaaaaacacacgcgccaagctatcagccggaatgataagaagatatgacgcccataaagaagacctagtattactcaaaagatttgtaaaagaaaatctaccaaaaaaatacagagccttctttggtgacaactctgtcaacggatacgcgggctacatcgaagggcatgctacacaagaggatttctataaattcgtcaaaaaagaattaacagggatcagaggtagtgaagtattcctaactaaaatagaacaagaaaatttcttgaggaaacaacgaacatttgacaatggtgtaatccctcatcaaattcacctaacagaactacgagcaattatagccaatcaaaaaaaacactacccattcttgaaagaagaacaagaaaaactcgaatccctgctcacatttaaaatcccttactatgtgggccctcttgcaaaaaaacaagaaaatagtccatttgcatggttaattagaaaatcagaagagaaaatcaaaccatggaacctccctgaaatagtggatatggaaggcagcgccgttcgattcatagaaagaatgatcaataccgacatgtacatgcctcataataaagtcttgccaaaaaactctctcctgtaccaaaaattcagcatatataacgaattaaccaaagtaagataccaagatgaacgcggccaaatgaactacttctcttccattgaaaaaaaagaaatatttcatgaactatttgaaaaaaacagaaaagtaactaaaaaagacttgcaagaattcctatacctaaagtatgacataaaacacgccgaattatccggaatcgaaaaagcctttaacgcatcatacacgacatatcacgatttcctaacgatgagtgaaaataagagagaaatgaaacaatggttagaagacccagaactagcctccatgtttgaagaaatcatcaaaacacttacagtattcgaagatcgagaaatgattaaaaccagactaagtcatcacgaagcaacactaggaaaacacataataaaaaaattgacgaaaaaacattataccggatgggggcggttgtccaaagaattaattcaaggaataagagacaaacaaagtaacaaaaccattctcgactatttaattaatgacgatgatttcccacaccatagaaataggaatttcatgcaactaataaatgacgatagcttaagctttaaaaaagaaatcaaaaaagcacaaatgataacggatacagaaaatttggaagaaatagtgaaagaactcactggttcccccgcaattaaaaaaggtatattacaatccttaaaaatcgtcgatgaaatagtcggaataatgggatatgaaccagccaatatcgtagtcgaaatggcaagagaaaatcaaacgacaggaagagggcttaaaagctccaggccaagacttaaagccctagaagaatccctaaaagattttggaagtcaactattaaaagaatatcccacagataactcaagccttcaaaaagatcgactatacttatattacctccaaaacggacgagatatgtatacaggcgccccactcgacatacacagactaagtgattacgatatcgaccatattatacctcgctcattcactacagataactcaattgacaataaagtgttagtctcttcaaaagagaaccgactgaaaaaagacgatgtcccatcagaaaaagtagtaaaaaaaatgcgttcgttctggtacgatctttattcatccaaactaatatcgaaacgcaaattggacaatttaaccaaaataaaactaacggaagaagacaaagctggttttatcaaacgccaacttgtagaaactcggcaaataactaaacacgtagcaggcattttacaccaccgtttcaataaagcagaagacacaaacgaaccaataagaaaagtcagaataatcacactaaaatcagcactagtaagtcaattcagaaacagattcggaatctacaaggtgagagaaataaatgaatatcatcatgcacatgacgcatacctgaatggtgtagtagcactagcacttctcaaaaagtatcctcaattagcgccagagttcgtatatggcgaatatttaaaatttaatgcccacaaagcaaacaaagcaacggtaaagaaagaattttatagcaatattatgaaattcttcgaaagtgacactcccgtatgcgacgaaaacggggaaattttctgggataaatcaaaatccatagcccaagtaaaaaaggtaattaaccaccaccatatgaatattgttaaaaaaacagaaatacaaaagggaggtttctccaaagaaacagttgaaccaaaaaaagactcatctaaattactccctagaaaaaacaattgggatcccgcaaaatatggaggcctgggctcaccaaacgttgcatacacagtagcattcacgtatgaaaaaggcaaagctagaaaaaggacaaacgctctagaaggaataacaataatggaaagagaagcctttgaacagtcacctgtattattcttaaaaaacaaaggttatgaacaagcagaaatcgaaatgaagctaccaaaatacgcacttttcgagctagaaaacggcagaaaacgtatggtagccagcaacaaagaagcacaaaaagcaaatagcttccttctcccagaacacctagtaacgttgctttatcacgcaaaacaatatgatgaaatatcacataaagaaagtttcgactatgtaaacgaacatcataaggagttttctgaagttttcgcacgagttctcgaattcgccggaaagtacacattagcagaaaaaaacatcgagaaactagaaaagatatataaagaaaaccagaccgacgaccttgcaaaactagcctcctcatttgtaaatttaatgcaatttaacgcaatgggtgcacctgcagactttaaattctttgacgtgacaataccaagaaaaaggtacacatcattaaccgaaatatggcaaagcacaataatacaccaatcaatcactggcctttacgaaacacgtataagaatgggaaagtga

SEQ ID NO: 8782 - RNA, 4023 nt, synthetic construct
  misc_feature 1..4023: note = Cas9 variant
  source 1..4023: mol_type = other RNA
atgaaaaaagaatatacaattggactagatataggcactaactcagtaggatggagcgtcctaaccgacgactatcgattagtatcaaaaaaaatgaaagtagccggcaatacggaaaaatctagcacgaaaaagaatttctggggtgtaagactattcgacgaaggacagacagcggaagcaagaagaagtaaacgaacggcgagacgaagactcgcacgacgacgacaacgaatactcgaactacaaaaaatatttgcacctgaaatcttaaaaatagacgaacacttttttgctcgtctgaacgaatcctttctagttctcgacgaaaaaaaacaatcaagacatccggtatttgcaaccataaaacaagagaaatcatatcaccaaacttacccaaccatctaccacctacgtcaagcactcgcagactccagtgagaaagccgatatacgattagtatacctcgcaatggctcatctactcaaatacagaggacactttttaatagaaggcgagttaaatacggaaaactcatccgtaacggaaacctttagacaatttctaagcacatataaccaacagttctcagaagcagacgacaaacaaactgagaaactagacgaagccgtcgattgtagtttcgtcttcactgaaaaaatgtcaaagacgaaaaaagccgaaaccctactcaaatacttcccacacgaaaaatcaaacggatacctctcccaattcataaaactcatggtaggaaaccaaggaaactttaaaaatgtattcggtctggaagaagaggctaaacttcagttcagtaaagagacatatgaagaagatctcgaagaattactagaaaaaattggagacgactatatagatctattcgtacaggccaagaatgtttacgacgcagtcctactaagtgaaatcttaagcgactcaacaaaaaacacaagagcaaaactatctgcaggaatgattcgacgatacgatgcacataaagaagacctagtccttttaaaacgcttcgtaaaggaaaacctccctaagaaataccgggctttttttggagacaattccgtaaacggatacgctggctatattgaaggtcatgcaactcaagaagatttctacaaattcgtaaaaaaggaattaactggaattcgcggctcagaagtattccttacaaagatagaacaagaaaactttctcagaaaacagcgtacttttgataacggagtcatacctcatcaaatacacttaacagaacttagggccattattgcaaaccaaaaaaagcattatcccttcctaaaagaagaacaagagaaactagaatcgttactgacattcaaaatcccctattatgtaggaccattagctaaaaaacaagaaaatagtcctttcgcatggcttataagaaaaagtgaagaaaaaattaaaccctggaatcttccagaaatagtagacatggaaggcagcgcagtaagattcatagaaagaatgattaatacagacatgtatatgccacacaacaaagttttacctaaaaattccttattatatcaaaaattttccatatacaatgaactaacaaaagtccgataccaagatgaaagaggacaaatgaattatttttcgtcaatagaaaaaaaagaaattttccatgaactctttgaaaaaaaccgaaaagtcacaaaaaaagatttacaagaatttctctacttaaagtatgatataaaacacgcagagttgtcggggattgaaaaagccttcaacgcatcttacacaacatatcatgattttcttacaatgtctgaaaacaaaagagaaatgaaacaatggttagaagaccctgaactagcatcgatgttcgaagaaatcataaaaacactaaccgtatttgaagaccgagaaatgataaagacaagactaagtcaccatgaagccacattaggtaaacatataatcaagaagctaacaaaaaaacattacaccgggtggggtcgactatccaaagaactaatacaaggcatacgagataaacaaagcaataaaaccatattagactacttaataaacgacgatgatttcccgcatcatagaaaccgcaattttatgcaacttataaacgatgatagtttaagctttaagaaagagatcaaaaaagcacagatgataaccgatacagagaatttagaagaaatcgttaaagaattaacaggatcgccagcaataaaaaaaggaatcctgcaatcactcaaaatagtcgacgaaattgtaggcataatgggctacgaacccgcaaatatagtagttgaaatggctagggagaatcaaaccacaggacgcggacttaagtcaagcagaccacgtttaaaagcgctagaagaatctcttaaagactttggtagtcaactattaaaagaatatcccacggacaattcgtcactacaaaaggacagattatacctatactacttacagaacggacgagacatgtatacaggagcaccactagatatccacagattatcggactatgatattgaccatataatcccacgttcatttactacagataactcaatagacaacaaagtcttagtgagctcaaaggaaaatagactaaaaaaagacgacgtcccaagcgaaaaagtagttaaaaaaatgagatcattttggtacgacctctacagttcgaaattaatatcaaaaagaaaattagataacttaaccaaaataaaactaacagaagaagataaggcgggcttcattaaaagacaactcgtagaaactcgacagattaccaaacatgtagctggaatactacaccaccgatttaataaagcagaagacaccaatgaaccaataagaaaagtcaggataattacattaaaatctgccctagtctcccaattccgaaacagatttggaatttacaaagtaagagaaattaacgaataccaccatgcgcatgacgcatatctaaacggagtcgtagcacttgcactactaaaaaaatatcctcagttagccccagaatttgtttacggcgaatacctaaagtttaatgcacataaagccaataaagcaacagttaaaaaagagttttactctaacattatgaaattttttgaaagtgatacaccagtatgcgacgaaaatggagaaatcttctgggacaaaagtaaatccatagctcaagtaaaaaaagtgataaaccaccatcacatgaacatagtaaagaaaacagaaatacaaaaaggtggttttagcaaagagactgtggaaccaaaaaaagactcatccaaactccttccaaggaagaacaactgggatccggctaaatatggaggattaggctccccaaatgtcgcatataccgttgcgtttacttatgaaaaaggcaaagcacgcaaacggaccaacgccctagaaggaatcactataatggaaagagaagcattcgaacaatcaccagtgctattccttaaaaacaagggttatgagcaagctgaaatagaaatgaaattacccaagtacgctctatttgaattagaaaacggaagaaaacgtatggtcgccagtaacaaagaagctcaaaaagcaaatagttttctcttacccgagcacctagtaacactattataccatgcaaaacaatatgatgaaatttcacataaagaatcgttcgactatgtaaatgaacatcataaagaattctcagaagtattcgcaagagtattagagttcgcagggaaatatacgctcgccgaaaaaaatattgaaaaattagagaaaatctacaaagaaaaccaaacagatgatctggcaaagctcgcatcatccttcgtaaacttaatgcagttcaatgctatgggagcaccagccgattttaaattttttgatgttaccataccccgcaaacgatacacatcattaaccgaaatatggcaatcaacaataatacaccaatcgattaccggactatatgaaactagaatcaggatgggaaaatga

SEQ ID NO: 8783 - RNA, 4023 nt, synthetic construct
  misc_feature 1..4023: note = Cas9 variant
  source 1..4023: mol_type = other RNA
atgaaaacagattacttcatgggattagatatgggaacaggatcactgggatgggcagttacagatagctcatatcacctttgcagagctcatggtaaagacctgtggggagtaagattatttgaaactgcacaaacagcagaagaacgaagagtattccgctgtaataggagacgactcgacagaagaaaaaggcgaatacaactattacaagatatttttgcgccagagatatataaaatagatccaggattttttctaagacttaaagaaagtagatatctgccagaggataaaaaaaacctcgaagggaaaacacccgaactaccatatgcactgtttgtagacaaaaaatacaccgataaagacttccataaagaataccccactatataccatctacgccttaggttaatgcaagaccgaactccagcggacgtgcgcttagtctatttagcgctccatcatcttataaaacatagaggacattttttatttgcaggaatagaagctgataaggtgacagacttcagtgccgcattctcagaatttctcaggatagtacaggaacaagaattagatataagcttcactccagacgaagaatcctcacaaataatcaaagaaacactacagaatacaaatttcactagatcgaaaaagtctactgaacttatcaaaggactcaaagcgtctacgggttgtgaaaaggcactgctaaaattaatcagcggttgcaaagttaaactatcagctgtattcgacgatcctggctgtgacgcctatgaaaaaccacaggtatgtttcgcagaatccagctacgaggattatgccgccattttagaagacgaactggaagatagattcatagtaattgctgcggcaaaagcactttatgattggtcggttctagtcaacattctaggagaagcaagtacagtaagtgaagctaaagtgggaatttatgaaaaacatagaagagacctaaagtatttaaaacatcttgtcaaaacgaacctaacaagggaagactaccaagatttgttcgttaaagcaggcgctaaaaaaaacaattattgtgcttatataggaatgacaaaaaaaaacaacaaaaaagttgttctagaggaaaaaagatgcaccaaggaagatttttacgcatacctaaaaaaagaaatatactcaaaggttcaagaaaatcctgaggcagaatatctattagaagaattggaaaaagggacatttctacctcgtcaagttagcaaagacaatggggtaataccatatcaattacaatttctagaacttcagaaaatattaaaaaacgcagtagaatacttaccatttctaaaagaagaatctgaaaaaatacaacaaataatgacatttagaataccttattatgtcggaccactcaacggaaaaaaagaaggtcaaaatacattcgcatgggctgtaagaaaaaataatgagccagtatacccatggaacttcgaggaagttatagatacagaagctagcgcagaacaatttatcaggagaatgacaaataaatgtacgtacctcccaggtgaagacgtattaccgaaagagagcctattatattcaaagtttatggtcctaaacgaacttaacaatctacgaataaatggaacaaaaatcagtgtagaattaaaacaagaactatatgaaaaactatttcaaagatatagaaaagtaagtgccaaaaaactacgagattatctggtacgaaatggcataacagaaaaagacgcagaaatatcaggtatagatggagactttaaaggaacactaagagcataccacgactttaaagaaaagttaaccggggtcgaactcactgaagcggaaaaagaaacgattatattaaatataacactgttcggtgaagataaagtattactcaaaaaaagaatgcaaagactgttaccaaatttaacagaaggccaaaaaaaagccatagtaaccctaaattattccggatggggaaggttatcacgagaatttttagaagaagtccaagcaccaaatccggaaagtggcgaaattcttagcattataagagcattgtgggaaacaaacgcgaatctgatgcaactcttgagtaaccaatacggatatcaagaaatactggaacaaatgagagcagactggaccggccataaattagactaccaaacagtggaagaactatatgttagtccagcagtaaagaggcaaatatggcaaaccttacaagtggtaaaagagctaaaaaaagttatgggaggcgaacccaagagggtcttcctggaagtagcgagagaaaaaatggaatcaggacgtaccgtctcgcggaaaaaacatctaaaagatctctaccttagttgtaagagtgaggaaagaaactggcttgcggaactcgatagacatgaagaacattcctacagaagtgacagactctttttatactacacccaaaaaggaagatgtatgtattgtggtaaaccaatcgatctaggtcacctatgggacgtaaacatgtatgatatagatcatatatacccacaatcaaaagtaatggacgatagcattagaaatcgcgttttaacatgtcgtacctgcaatgcagaaaaaacagaccattatccacttaaagcagaaataagacagaaaatgcgacctttctgggattctctgaaagcagggaattttattgaagaggaaaaatggaaacgactcatacgatcagaagagtttacatcaactgaactagccggatttatagaaagacaattggtagaaacgaggcagagtacaaaagctgtagcagatatattaaagcaagcaatgccagaaacagaaatagtatatgtcaaagcgaaaaacgtatcggcttttcgtcaagattttaacttcgttaaaaatcgagatgtcaatgattttcatcatgcaaaagatgcgtatcttaatatagttgttggaaacacgtacttcgtaaaatttacaaaaaatgctagttggtttattgaaagaaatccaggacgatcatacaatttaaaaaggatgtttacttcggattatgatgtaatgagcaacggtgaaatagcatggaaagcaggaaactccggaaccattactacagtaagaaaaatgatgaaaaaaaatagtgtattatttaccagaagaagttttgaagtaagtggaggattattcgatcaacaactaatgaagaaaggcaaaggacaggtttacgtaaaaagtggagacgaaagactacgttcaatcgagaaatatggaggatataacaaagcgacaggtgcctattttatgctagtagaatcggaaggaaaaaagggtgtaaaaaaaaggactatcgaatttgtaccactttatagaaaagcagagttagaagcaagtgaagaaaaaatgctagagtatctaagaacagaaatagggctcaaagaaccacatgtattgttgcataaaataaaaacagatacattattccaagctgatggatttaaaatgcacctgtcaggacgaactggcaaacaactcgtatttaagggggctaatcagtttttagtagccgaggattatgagagattattaaaaaaagtaggaaaagttacagaacaattgaaaacaaataaaaactacaaaataaatgactacgatgggatcacagaagaaggcttaaaagctttatattcggaatttttgtcaaaacttcaaaaagcaccatatggtaatcgactgggaacacaagcagaaacattggaaaatggcaaagagaagttcgataaactaagtttagaaaataagtgtcaagtgttaagtgaaatcctacatctatttcaatgtaatagtagcgctgcagatttgagtaaactaggaggacccggtcatggaggtatattggtacttagtaatgaaataactaaatgtaacaaaatctctatcatacaccagagtccggccggaatatacgaacaggaaattgacctaaaaacactgtga

SEQ ID NO: 8784 - RNA, 4023 nt, synthetic construct
  misc_feature 1..4023: note = Cas9 variant
  source 1..4023: mol_type = other RNA
atggaacaagaatactaccttggattagacatgggaacagggtccgtcggatgggcagttacagacagcgagtaccacgtactccgcaagcacggaaaagcactctggggtgtaaggttgtttgaaagtgctagcaccgcagaggaaagaagaatgtttcgaacgagtagaagacgactagatcgtagaaattggaggatcgaaatacttcaagagatattcgctgaagaaatttcaaaaaaagatcctggattttttctaagaatgaaagaatcaaagtactatcccgaagacaaacgagacataaacggaaactgcccagaacttccatatgcattatttgtagatgatgactttacagataaagactaccataaaaaatttccaacaatttatcaccttagaaaaatgctaatgaatactgaggaaacacccgatatcagattagtatatttagcaatccatcatatgatgaaacacagaggacattttttactcagcggcgacattaatgagattaaagaattcggcacgacgtttagtaaactactagaaaatataaaaaacgaagaattagactggaatctagagctgggaaaagaagaatatgccgtagtcgaatcaatactaaaagataacatgttaaatcgtagtaccaaaaagaccagactcataaaagcgctaaaagcaaaaagtatttgtgagaaggccgtcctaaaccttctcgcaggtggcacagtaaaactcagtgacatatttggactagaagaattaaacgaaacagaacgaccaaaaatatcgtttgcagataacggatacgatgattacattggagaagttgaaaacgaactaggcgaacaattttatataatagaaacggctaaagcagtctacgactgggcagtattggtagaaatactgggaaaatatacaagcatatccgaggcaaaagttgcaacttatgaaaaacataaatcagacctccaattccttaaaaaaatcgtaagaaaatatttaacaaaagaagaatacaaagacatatttgtaagcacatctgataaactaaaaaactattcagcctacatcggcatgacaaaaataaacggaaaaaaagtagatctgcaaagtaaaaggtgtagtaaagaggaattttatgatttcataaaaaaaaacgtactaaaaaagctagaagggcagccagaatatgaataccttaaggaggaactcgaaagggaaacatttttgccaaaacaagtcaacagggacaatggcgtcataccatatcaaattcacctctatgaactcaaaaaaatactaggaaacctcagagacaaaatagatttaataaaagagaatgaagataaactagttcaattatttgaatttagaataccttactatgtaggtcctctaaacaaaattgacgatggaaaagagggaaaatttacttgggcagttagaaaatcaaacgagaaaatatacccttggaacttcgaaaatgtagtcgatatagaagctagtgcagaaaaatttataagacgaatgactaataaatgcacctatttaatgggtgaagatgttctacccaaagactcgttactatactcaaaatacatggtccttaacgaattaaataacgtaaaactagacggagaaaaactaagcgtcgagttaaaacaaagattgtatacggacgtattctgtaaatacagaaaagtaactgtcaaaaaaattaaaaactacctgaaatgcgaaggcataatatctggaaatgtcgaaattaccggtattgatggagattttaaggcctcgcttactgcatatcacgattttaaagaaatattaacaggtacagagcttgcaaaaaaagataaagaaaatattatcaccaacatcgttttattcggggatgataaaaaattactaaaaaaaagactcaaccgcctttatccacaaataacacctaatcaactaaaaaaaatttgtgcacttagttatacaggatggggaagattctcaaaaaaatttctggaagaaataacagcgccagatccagaaactggagaagtatggaacataatcacagcactatgggaatctaataacaatctaatgcaattattatcaaatgaatacaggttcatggaggaagttgaaacttacaatatgggaaaacaaaccaaaacactctcgtatgaaacagtagaaaacatgtatgtcagcccatcggttaagagacaaatctggcagaccttaaaaatagtaaaagaactagaaaaagttatgaaagaaagcccaaagagagttttcatagagatggcaagagagaaacaagaatccaagagaacagaaagtaggaaaaaacaattaatcgacctatacaaagcatgtaaaaatgaagaaaaagattgggtgaaagaacttggagaccaagaagaacaaaaacttcgatcagataagttatatttatactacacacaaaagggtagatgtatgtatagcggcgaagtcatagaacttaaagacttatgggataacacaaaatacgatattgaccatatatacccgcaaagtaaaacaatggatgactccttaaataaccgagtactggtaaaaaagaaatataatgcaacaaaatcagacaaatacccgttaaacgaaaacatacgacatgaacgtaagggcttctggaagagtctcctagatggtggtttcatatctaaagagaaatatgaaaggctaattcgaaatacagaattatcaccagaggaacttgcgggatttatagagaggcaaatagtggaaacacgtcagagtacaaaagccgtagccgaaattctgaaacaagtattcccagaaagcgaaatcgtatatgtaaaagctggaacagtaagcagattcagaaaagatttcgaactattaaaagttagagaagttaacgacttgcaccatgcaaaagatgcctacctaaatatcgtagtgggcaatagttattacgttaaatttacaaaaaatgcaagctggttcataaaagagaatccaggccgaacttataatctaaaaaagatgtttacctcaggatggaacatcgaaagaaatggtgaagtagcttgggaagtaggaaaaaaaggaacaatagtgacagtaaaacaaataatgaacaaaaacaacatactagttacaagacaagtacacgaagcaaagggcggcttatttgaccaacaaataatgaaaaaaggaaaagggcaaatagcaataaaagaaacagatgaaaggctagcttccatcgagaaatatggtggatacaacaaagcagctggagcttactttatgttagtcgaatccaaagataaaaaaggtaaaacaataaggacaatcgaatttatccctttatatctaaagaataaaatcgaaagcgacgaaagcatagcactaaacttcctggaaaaaggaaggggattaaaagaaccaaaaatattactcaaaaagataaaaatcgataccttgttcgatgtagatgggtttaaaatgtggttatcgggtagaacaggagacagacttttatttaaatgcgcaaaccaactaatcctagatgaaaaaatcatcgtaacaatgaaaaagatagtaaagttcatacaacgcagacaagaaaacagagaattaaaactcagtgacaaggacggaattgacaacgaagttctaatggaaatatataacacatttgtagacaaattagaaaacaccgtgtatcggatcagattatcagagcaggcaaaaactttaatagacaaacaaaaagaatttgaaagactcagtttagaagataaatcgtcaacactatttgagatactacacatcttccagtgtcagagctcagcagctaaccttaaaatgataggcggaccaggaaaagctggaatactagtaatgaataataacattagcaaatgtaataaaataagcataataaaccaaagcccaacaggtatttttgaaaacgaaatcgacttactaaaaatatga

SEQ ID NO: 8785 - RNA, 4023 nt, synthetic construct
  misc_feature 1..4023: note = Cas9 variant
  source 1..4023: mol_type = other RNA
atgggagaagaatattttcttggtttagatatgggaacaggtagtctcggatgggctgtaacagatgacaaatatcaaatattaagaagacacggaaatgcgttatggggtgtacgactctttgaaaccgctaacacggctgaagaaagaagaatgttcagaacaaacagaagacgattagataggcaaggatggagaattaaaattttacaagaactatttgctgaagaaatatgtcgcgtcgatcctggcttttatttaagaatgaaagagtcaaaatactatccagaagataaacgagatgcaaatggtgaatgccctgcactaccgtacgctctattcgcagatgcacaatacacagataaagattatcacagagaatttccgactatataccacttaagaaaaatgcttatggaaacagaaaccacgccagacataaggttagtatatctagcattccaccacatgatgaaacatagaggacactttctattatccggagatattagccaagtcacagagttcaggaacaccttcttacaaatgatcgcaaatataaaaagcgaagaattagatttttcgctagaaattgaagaaacgcaaatgggacaaattgaagccgtattaaaagatcacaaattaactcggtcagagaagaaaagaagactaacacaaatacttaaaccagctacggcatgtgagaaagcaatattcaccctcctttcgggtggaacagtcaaactcagcgacatttttggaaaagccgaactagatgaaggagaacgaccaaaaatatcattcgcagacaacggatatgatgattattctgcaagtgtcgaagcggatctaggagaacaatactacatcatcgaaagcgcaaaagcagtatacgactggagcgtgttatctgacatcctgggagattcggtctcaatatcagatgccaaagtcaaactctatgagaaacacaagaaagatcttgcttacctaaagaaagtggtaagagaaaatctcccgcgagaggtatataaccaagtatttgtaaacacagatgaaaaattatgtaactactgcgcttatataggtatggccaagaaaaacggaagaaaagtagcattagaaggaaaaagatgcactagagaagaatttgagtcatttctacgcaagaaaattgtaaacaaaatagaagacaaagaaatacaagaatacttatctgaggaaatagaaaaaggaacatttttacctaggcaagttaccaaagataatggcgtaataccatatcaaatacatctctacgaattgagaaaaataatcgacaatttgtcacccagaatgcctttcattagggacaacggagataaaataatacagctattcacctttaggatcccatactatgtcgggccacttggaaaaggtgaaggcagtgaaaaattctcatgggcagtaagacgaacagacgaggcaatatatccgtggaatttcaaagacgtaatagatgtcgaagcatcggcagaaaaatttatttgcaggatgaccaataaatgtacatatttatatggagaagatgtcctcccaaaagattcgccgctgtattccaaattcatggtattaaatgagttaaataatttaaaattagatggccaaagcgtaagcgtagagctcaaacaaagaatttaccaagaattattctgccatacaagaaaagttactcagaagaaattagtaagctacttagttcgggaaggaataacaggcaaaaatgtggaaatatcaggtatagacggagatttcaaagcatccctcactgcttatcatgactttaaagaaaaattgactggagtagaactaagccaacaagaacaagaagaaatagttcgaaatatagtactttttggcgaggacaagaaactactgaaacaacgattggaaggacgatttccgcagcttacacaaaaacaaatcagtgtaatcgcaacattatcatataaagggtggggaagactcagtagagagttcttagaaaatatcacagtaccagcacctggtaccggcgaggtatggaacatcataactgccctctgggaaacgaatgataacctaatgcaattattatatggcgaatatggctttcaaacagaaatcgaatgttttaacgccaaagagaaaaagaaaagtctaagttatgagacaatagaggaaagttatgtgtctccatcagttaaacgacaaatttggcaaacgttgcaagtagtaaaagaactaaagaaagtaatgagaggggatccaaaaagagtttttatagaaatggcaagagaaaaccaagaaagcaaacgaaccgaaagcaggaagaaaactttattagatctctacaaaaattgcaagaaagaagaaccagaatggatagccgaactaacagagcacctcgaaaaattagatgatagtcaacttcgaaaagacaaactattcctctattatacacaaaaaggaagatgcatgtactcaggtgagagaatagaattagaagatctatgggataatacacgctacgacattgatcacatatatccacaaagtaaaacaatggatgattcagtcgataatagagtgcttgttaagaaagaatataatgccaagaaaaccgacgtatacccaatagctgccgacataagaggcaaaatgtcacccttttggaagaaactgctcgataataaattaataagcaaaaagaaatacgatagattagtgagaaccgaagaactaacaccagaagaattagcaggttttattgataggcaattagttgaaaccagacaaagtacaaaagtagttgcagaaatactaaaagaagcattccccgacacagaaatagtatatgtaaaagcaggtaatgtaagtaatttccgacatatgtttgatattgtgaaagtaagagagttaaacgatttacatcatgcaaaggacgcatatctcaacatcgtcgtaggaaatgcgtactatgtcaaattcaacaaaaacgccgcatggttcataaaagagaatcctggaaggtcatataatctaaaacgcatgtttgattatgacatccggcgcaataatgaagtagcttggcttgctggaagcactggaactatatcacaggtcaaaaatatggttagtaaaaatcatatcctggtaactcgcaaatcatatgaagtaacaggtggtctatttgaccaacaactgatgaagaaaggtaaaggccaagtcccagtcaaaacatcagatgaaagactaggaaacatagaaaaatatggaggatataataaagcaagtggagcatatttcatgttagtaaaaagtaaaaataagaaaggcgaagaacaaagaacaatagaatatgtccctatatacttaaaacactatattgaagaatcaaaagaaaacgctctcgactatctcaaaaatgaaagaaaactaaatgaaccagaaatattactagacaaaatcaagaaagacacgttattcagagtaaatggtttttatatgtgcttatcaaaacgaacagggaaacaactcgcatttaaaggagctaacgagctactgttaccagaacctgaaactctattactaaagaaaataacaaaatatatacagcgacgaaaagagaacaaagacctaaaacttacgaaacaagataatattacagaaaaagaactcttggaattgtacgatgtttttactgaaaaattaaaccatagtgtatatgccgtgtgtctaggaacacagggaaaaactctagtacagaagaaaccagcatttgtagcattgccggtagaagaaaaatgtatagtcctatcagaaattttacatttgtttcaatgtcaatcgggatcagcaaacctaaaattaataggaggcccagctagtgcaggaattttataccttaatagtaacatatctgacgctggtgaaatcttaataataaatcaatccccaagtggtatatttgaaaaacgtatagatctactccgattatga

SEQ ID NO: 8786 - RNA, 4023 nt, synthetic construct
  misc_feature 1..4023: note = Cas9 variant
  source 1..4023: mol_type = other RNA
atgaaaaaagaatatacaataggattagatatcggaactaactcggtcggatggtccgttttaactgacgactatcgactggtaagcaaaaaaatgaaagtggcagggaacacagaaaaatcatctacaaaaaaaaacttttggggagtcagattatttgatgaaggacaaaccgctgaagcaaggagatcaaaacgcaccgcgagacgcagactcgctcgcagaagacaacggatactagaattacaaaaaatatttgctccagaaattctaaaaatagatgaacacttctttgcccgcctcaatgaaagctttttagtgccagatgaaaaaaaacaatcaagacatccagtcttcgcaacaataaaacaagaaaaatcatatcaccaaacatatcccacaatttaccacttacgacaagcactagcagacagctctgaaaaagcagacattagacttgtatatctcgcaatggcgcatcttctaaaatacagaggtcattttctcatcgaaggagaactaaacacagaaaattcatcagtaacagaaacattcagacagttcctgtcaacatataatcaacaatttagcgaagcaggcgacaaacaaaccgaaaaactagatgaggccgttgattgctcatttgtattcacagaaaaaatgtcaaaaacaaaaaaggcagaaaccctactaaaatatttccctcatgaaaaaagcaacgggtatctatcacaattcattaaactaatggttggaaatcaaggaaacttcaaaaatgtgttcggtcttgaagaagaggcaaaattacaattcagcaaagaaacctacgaagaagatctcgaagaactgttagagaaaataggtgatgactacatcgacctatttgtacaagcaaaaaacgtatacgatgccgtcttattgtccgaaatactgagcgattcaacaaaaaatacacgagcaaaactttcagctggaatgataagaagatatgacgcacataaagaagatctcgttctattaaaaagattcgtaaaagaaaaccttccaaaaaaatacagggcatttttcggcgacaatagcgtcaacggctatgcgggctacatagagggacacgccacacaagaagccttctataaatttgttaaaaaagaactaacaggaattagaggctctgaagtatttctcaccaaaattgaacaagaaaattttctgagaaaacaacgcacctttgataatggagttataccccaccaaatccacctatccgaactcagagcaataatagcaaatcaaaaaaaacactaccctttcttaaaagaagaacaggaaaagttagagtcattactaacatttaaaatcccctattacgtaggaccactcgcaaaaaaacaagaaaattcaccctttgcttggttaatacgtaaatcagaagaaaaaattaaaccctggaatctcccagagatagtagatatggaaggttcagcggtcagattcatagaaagaatgattaacacagatatgtatatgccacataacaaagtactgccaaaaaacagtctcctctaccagaaattctccatatataacgagttgacaaaagttagataccaagacgaacgggggcaaatgaactacttcagttcaatagagaaaaaagaaatattccatgaattattcgagaaaaatcgaaaagtcacaaaaaaagatctacaggaattcctgtatttaaaatatgacataaagcacgcagaattatcgggaatagaaaaagcattcaatgccagctacactacatatcacgacttcctcacaatgagcgaaaataaacgagaaatgaaacaatggttagaagacccagaactagcttctatgtttgaagaaattattaaaactttaaccgtttttgaagacagagaaatgataaaaacccgcttatcacaccatgaggcaacattaggtaaacacataataaaaaaattaacaaaaaaacattatacaggttggggacgactaagtaaagaattaatacaaggtatcagagataaacaaagtaacaaaacaatcctagattatctaatcaatgacgacgatttcccacaccaccgaaaccgtaactttatgcagttgataaatgacgacagtctatcattcaaaaaagaaataaaaaaagcccaaatgataaccgacacagaaaatctagaggaaattgtaaaagaactaacaggatcacccgctattaaaaaaggcattttgcaatcactaaaaattgtagatgaaatagtaggcataatggggtacgaacccgctaacattgtggttgaaatggctagagaaaatcaaacaactggaagaggcttaaaaagcagtcgtccaagattaaaagcactagaagaaagcttaaaagactttggttctcaacttcttaaagaatacccaacggataacagcagcttacaaaaagaccgcctatatctctattacctacaaaatggaagagatatgtacactggtgcaccattagacattcaccgattatcagattatgacatcgatcatataataccacgctcttttacgacagataattctatagacaataaggtcctagtatcctctaaagaaaacaggctaaaaaaagacgacgtcccgtccgaaaaagttgttaaaaaaatgcggagtttttggtatgacctatattcatcaaaactaatctcaaaaagaaagctagacaatctaacaaaaattaagctaaccgaagaagataaagcaggtttcataaaaagacaattagtagaaactagacaaataacaaaacacgtcgcaggaattcttcatcatagatttaataaagcggaagacactaatgaccctatacgcaaagtacgtattatcacgctaaagtcggcactcgtctctcaatttcgaaatagatttggaatatacaaagttcgcgaaataaacgagtaccaccacgcacatgatgcgtatctgaacggcgtggttgcattagcactactcaaaaaatatccccaattggctccagaatttgtttatggagagtatctaaagtttaatgcccataaagccaataaagctacagtaaaaaaagaattttattccaatataatgaaattctttgagtcagacacaccagtatgtgacgaaaatggagaaatcttttgggacaaatccaaaagtattgctcaagttaaaaaagtcataaaccatcatcacatgaacattgtaaaaaaaacggagatccaaaaaggggggttcagcaaagaaaccgtcgaaccaaaaaaagactccagtaaattactaccccgaaaaaataactgggacccagctaaatacggtggattaggatctccaaatgtagcatatactgttgcttttacatacgaaaagggtaaagccagaaagagaacaaatgcattagagggaataaccataatggaaagggaagcttttgaacaatcaccagtactcttcttgaaaaacaaaggctacgaacaagcggaaatagaaatgaaattaccaaaatatgcgctttttgaactagaaaatggcagaaaacgaatggtagcctcaaacaaagaagcccaaaaagcaaacagcttcctattaccggaacaccttgtaacgctcttatatcatgctaaacaatatgacgagatatcacacaaagaatcatttgattatgtcaatgaacaccataaagaattctcagaagtctttgctagagtcttggaattcgcaggaaaatacacattggctgaaaaaaatatagaaaaactcgaaaaaatctataaggaaaatcaaacagatgacctagcaaaactagcatcttcatttgtcaacctgatgcagtttaacgccatgggcgctcctgctgatttcaaattctttgatgttactatcccgaggaaacgctacacctcactcaccgagatatggcaatcaactataatccaccaatcaatcacaggactctacgaaacaagaatacgtatgggtaaatga

SEQ ID NO: 8787 - RNA, 4023 nt, synthetic construct
  misc_feature 1..4023: note = Cas9 variant
  source 1..4023: mol_type = other RNA
atggagcaagagtactacctcggcttagacatgggaacaggatcagtaggttgggcagtaaccgatagtgaataccacgtactacgtaaacacggaaaagcattatggggcgtaagacttttcgaaagtgccagtacagcggaagaaaggaggatgttccgcacaagtcgaaggcggctagatagacgcaactggagaatcgaaattcttcaagaaatattcgcagaagaaatttcaaaaaaagacccaggcttctttttgagaatgaaagaatctaagtattatcctgaagacaaaagagacatcaatggaaactgtccagagctaccttatgcactattcgttgatgacgattttacagataaagattatcataagaaatttcccaccatataccatttgcgtaaaatgctaatgaatacagaagagacaccagatataagattagtatacctagcgatacatcacatgatgaagcacagaggccattttttattgagtggagatattaacgaaataaaagaattcggaacgaccttctcaaagttacttgaaaacataaaaaacgaggaactagactggaacttagaacttgggaaagaagaatacgccgttgtagaaagcatcctaaaagacaacatgctgaacagatcaacaaaaaagacacgactaattaaggctttaaaagcaaaaagtatttgtgaaaaagcagtacttaacctactggccggaggtacagtaaagctatcagatatattcggactcgaagaattaaatgaaacagaacgaccgaaaataagctttgcagataacggatacgacgactatataggagaggttgaaaatgaactaggggaacaattctacataattgaaacagcaaaagcagtatacgactgggcagttctagtagaaatattaggaaaatatacatcaataagcgaagccaaagtagcaacatacgaaaagcataaatcagacttacaattcttgaaaaaaatagtgagaaaatatttaacgaaagaagaatacaaagatatattcgtctcaaccagcgataagttaaaaaattactcagcctatattggaatgactaagattaatggcaaaaaagtcgacctacaaagcaaaaggtgtagcaaggaagaattttatgatttcataaaaaaaaatgttctaaaaaaattagagggacaaccagaatatgaatatctaaaagaagaactggaacgtgaaacttttctaccaaaacaagtaaatagagacaacggggtaattccttatcaaatccatctgtacgaattgaaaaaaattctggggaacctacgtgataagatcgaccttataaaagagaacgaggacaaactggtacagctctttgaatttcgcataccatactacgttggaccattaaacaaaatcgatgacggcaaagaaggaaaattcacatgggcagtccgcaaatccaacgaaaaaatttacccctggaatttcgaaaatgtcgtagacatcgaagcaagcgccgaaaaattcataagacgaatgacaaataagtgcacctacctaatgggcgaagacgtactaccaaaagactcactattatactcaaaatatatggtgctgaacgaacttaataacgtaaaactagacggcgaaaaattatcagtagagttaaaacaaaggctatacacagatgtcttttgcaaatatcgtaaggtcactgtaaaaaaaatcaaaaattacctcaaatgcgaagggattatatcgggcaacgttgaaataacaggcatcgacggagactttaaagctagtcttactgcatatcacgattttaaagaaatactaaccggaacagaattggcgaaaaaagacaaggaaaatataataaccaacatagtcctctttggtgatgacaaaaagttattaaaaaaaagactcaacagactatacccacaaataacgcccaaccagctcaaaaagatatgcgccctaagctatacaggatggggaagattttcaaaaaaatttctcgaagaaataacggcacccgatccagaaacaggagaagtctggaatataataactgcgctatgggaatcaaacaataacttaatgcagctgctgagtaatgaatatcgattcatggaagaagtagaaacttataatatgggaaaacaaacaaaaacactatcgtatgaaacggtagaaaacatgtacgttagtccctcagtaaaaagacaaatatggcaaacattaaaaattgtgaaagagctcgagaaagtaatgaaagaatcaccaaaaagagttttcatagaaatggcacgtgaaaagcaagagtctaagagaactgaatcaagaaaaaaacaactaatagacctatataaagcctgcaaaaatgaagagaaagattgggtaaaagaactaggcgaccaagaagaacaaaaattaagatcagataaattatatctatattatacacaaaagggtaggtgtatgtacagcggagaagttatagaacttaaagacctttgggacaatacaaaatatgatatcgaccatatatacccgcaaagtaaaacaatggatgactcactaaacaatcgggtactcgttaaaaaaaaatataacgcaataaaatcagacaaatatccattaaacgaaaatataaggcatgaaaggaaaggattctggaaatcactactggatggcgggttcatttcaaaagaaaagtatgaaagactgataagaaacacagaactgagtcccgaagagctagccgggtttatcgaaagacaaattgtcgaaacccggcaaagtacgaaagctgtagctgaaattttaaaacaagtattccccgaaagtgaaatcgtatatgttaaagcaggaacggtatcaagatttcgaaaagactttgaactactaaaagtacgagaagtcaacgatttgcaccatgccaaggatgcatacttgaacattgtagtaggaaatagttattatgtaaaatttacaaaaaatgcaagctggttcatcaaagaaaaccctgggagaacatacaatctaaaaaaaatgttcacaagtggatggaatatagaaagaaacggtgaagtagcctgggaagtaggcaagaaaggtacaatagtaacagttaaacaaataatgaataaaaataacatcttagtgacacgtcaggtacacgaagctaaaggaggtctattcgaccaacaaatcatgaaaaaaggaaaaggacaaattgctatcaaagaaacagatgaaaggctagcatcaatagaaaaatatggcggatacaataaagcggcaggtgcatattttatgctagtagaaagcaaagataaaaaaggcaaaacaataagaacaatagagttcattcctctatacctaaagaataaaatcgaatcggatgaaagtatagccctcaactttcttgaaaagggaagaggattaaaggaacctaaaatattattaaaaaaaataaaaattgacacactctttgacgtagatggattcaaaatgtggctttcaggaagaacaggagacagattactctttaaatgcgccaaccaattaatattagatgaaaaaataattgttacaatgaaaaaaatagtcaagtttatacagaggagacaagaaaacagagagttgaagctaagcgacaaggatggtatcgacaacgaagtactgatggaaatctataacacattcgtcgacaaactagaaaacaccgtatatagaatacgattaagcgaacaagccaaaacacttattgatagacaaaaagaatttgaaaggctgtcattagaggacaagtcaagtacactatttgaaatactacatatattccaatgccaaagttcggctgcaaacctaaaaatgatcggcggacctggcaaagcaggaatcttagtcatgaacaacaacatttcaaagtgcaataaaatttcgataataaaccaatctccaaccggaatattcgaaaatgaaatagaccttctaaaaatatga

SEQ ID NO: 8788 - RNA, 4026 nt, synthetic construct
  misc_feature 1..4026: note = Cas9 variant
  source 1..4026: mol_type = other RNA
atgagattccaaaacaagaaaacaggtgactacttcgtaggccttgatattggtacaaattcagttggatgggccgttaccaatgaaaaatatgaaatactaagagctaaaaaccacagaatgtggggctcaagactttttgaagaagggaaaacagcagaagaacggcgcgttcatagggccggaagaagaagattaaatcgcagaaatgacagactaatgattctagaagacttatttgccgaagaaatatctaaagtagacaaagcattctaccaaagattacatgaatcacaatatagacaagaacacaaaacagtgtcaggtccatattttctattcaacgacaaagagttcacagacgaagactaccatatagattatccaacaatttaccatttaagagtggcgctaatgaaagcccctgcaaaagacgttagattgttattcctcgctatccatcacataataaaatacagaggaaatttcctacatgaaggtgaaacattcaaaactactggtggattaacagatatactacaaagggtactcgcttgtaacgaatttagtggtctaaaacaacatatagatgacactgcactggtcaaattactaacaaataaaggcattaccagaagtgatatcgcaaaacaaatatcagaactagcaacagataaactctatagaaaacaagcaaaagcgttcgcatctttagtcctaggattgaaagcaaatctagatgacttattcaacgaaccggaatataaagaactcgactctgaaatacgaactgtagaatttagtggaaaagaatactgggaagaaagagacaaatacgaaccatacttgggtgaatcactctttgcactagacggttgcaaaacactgtacgacacattattattaagtaacatcaaacccgatggaaaatacctaagcgaagcgaaagtcgaaactttcgaaaaacatcatgaacatctagaatcactgaaagacttactcaaaagcaataaggcattatataaccgggtacttagggacgatgaaaagaacctaaacaattatataacctatatcggaaaatccgaatttaataaacgatgttcaagagacgagttctacaaatttttgaaacaaaccattaaagatatatcagacaacgaaaataaagcggaaatcgtccaactaatggaactggattccttcctaccgttactacgtgttcgcgaaaacggagtaataccttaccaaatacacgaagaagaattagaacagatcctgaacgtttcgtcggaaaaatacccgttcctcaataaagctgatggtagtggttttacaattgcacagaaaatcctgaaactactcacatttagaataccgtacttcgtgggaccattaaatccagctcataaagatagagacaacggttttgcgtgggttgtacgcaaagctcctggtaaagtatacccatggaactttgaagacaaagtagatataagcgctagcgcaacagcgttcatagaaaatttaacaaacaaatgtacatatctcattggcgaagacgtactacccaaatactcactggcgtattctaaattcagtctacttaatgaattaaataacctacgatacgatgggaaaccattatcctatgaaactaaacaaagtttcatcaaagactgtttcgagaaagaacataggaaaatgaccgagaaaaggatcagagagttcctaaaacatctaggaggaacagatggtaagggagcgctgaccggactagacgttgatataaaatcagatctaaaatcatatcgagatatggttcgtatactaggtgatggattcgatgaaacaatggcagaaagaataatcagatacgtaacattattcggggaagctaagaaagtattactaagtactttagaaatagaatttggagacgatttatcagacacccaaaagaaacaaatactaaaactacaatacagggactgggggcggttaagtgcaactctattaaaaggaattaaaggcgtagcaggcgacaacccagaatgctcaattctcgaatgcatggagcaacaaccgctcaacctaatggaagtactatcaagtcacaacacttacttagcagcaattgaagaatttaataaagaaagaacagaacctaccgacatagtagactacaaacttgttgatgatttatatatatcaccagctgtaaaaagatccgtatggcaaactctgagaatattagatgaaatcacaaaacttcgaggaagtgtaccaaagaaagtctttgtagaagtcgcacgtacaaacagagcagaaaagaagaaaactgattcaagaaaagaaagattactccaattatataaaacaatcaaagatgaaggaagaaactggaccgaggagataaaacaaagagacgcaggagatttcaatagcaagaaacttttcctatactacactcaacaaggaaggtgtatgtacagcggcgagaaaataacaagcattggcgacttattcacaagtaaatatgatatagaccatatctatccaagatccgtcacaaaagacaattcgtgggataacctagtcttagtaaaagcagaattaaatagagaaaagaaagacatataccctattgaaaaagatacacaggataggtgcatttccctgtggaaacaactactagaacaaggattgatatccgaacgaaaatatgaaaggctcgtacgaactacccctctaacagctgacgaactagccgacttcgtaaacagacaactggtagaaacaaatcaatccgtaaaagccgtcactaatttattaaaacgactataccccgatactactatttgctatgtgaaagcggaaaatgtatcagacttccgacaagagagagagtttgtcaaattacgaagtttaaatgcacatcatcatgccaaagacgcctatctgaacattgtagtgggaaacgtgtatcacgagaaatttactaataatcctagaaattttattaaaaatgcaagaagcgacaagaaaagaccctactcactaaatcatatgttcgactacctcctacaagtaggtaacaaagaaatatggaacccgaaaacggacaataatctagtaaagaaaatgatgagaaacaatgacgtacaagtaactagaatgttagtagaacagacgggagctctatatgatgcaacgatatataaagcaagtgtgacaaaatctgaatcatacgtacccctgaaatcctcagatgccatattgagcgacgtcaagaaatatgggggattcacatcaataaaaatagcatactattcaatcttcagattctataagaaaaatagcgaagagttcgaaacacacataatatcaatcccggtgttaaaagccgggaccctcaattcaaaagaagactacgttgcttatggcgaagaaataatgaataaacaaaaattcgatagagtggaattagtatacaagaaactatgtatgaactcactcgtaagaataaatggagtaatgtactacttaggcggtaaaacaaataactcattatacatagacagcgcaatatccttagtactacccgacaacatagctaagaaaataaaagcagttgaaaaatatatagctagagtagcggaaaacggaaactacaaaccacaacctgaccaagtgtcaccagaatttaatatgatcatatataaagcattaactgagaaaatgaaacaaccagctttcgtaggcttgaaaacaaacagagaaaatgaactagaaaaagaaaccactatcacagccttcatagcaatgacgttaatagaacaatgtaaaatgctaatggaaatcttaaatttactaacacaacagaaaacaacatacgccttgaaaccaataggtgtgagtgcgtcacgaagtacactcggaatgaacattacagggctatccgaatttacaattataacacaatctgttacaggattacaggaaaaagaaattaggataatatga

SEQ ID NO: 8789 - RNA, 4026 nt, synthetic construct
  misc_feature 1..4026: note = Cas9 variant
  source 1..4026: mol_type = other RNA
atgtggggatccagactatttgaagaagcaagcacggctcaagaccgccgagaacacagaagtaatcgacgacgcttagaaagaagaaaatacaggttagatttactggaagaactatttgtagaagaaataaacaaaatagatccagaattttttataaggctaagagaatcaaaatttcatttcgaagaccgcagcctaaagaatacctttatattgtttaacgacaaaatggaaggtggctacaacgacaaagttttctttagcaagtacccaaccatttaccacctaagaagtgcattaataaacgggaacaaagaagatgtgagagcagtattcttagcaatccataatatcctgaaaaatcgcggacatttcctcttagctggaaatgacattaatatcagtctatccttaaacgacactcttacagacctcttcgaatatttaaaaattcacttaggaatagaggtagaattcgagaataaactaaaagacatcgagaaaatcgcattagacaaaaacttaagcaaatcggacaaacaaaaaaaaattgtacaactcttagaaacagattacaaaaaacaacttgccgatgtatttaaactttccctaggacttaccgcaaatatggaaaacatattcggcaaggaaaacgaacagggtcttgaattcatcaatgctgaaaataaaataaagaaaatacagttcgacagctcttacgaagaaaacatagcagaattcgatcaattctacggagaatattttgaaataatcgacatatgcaaaaaaatttacgatgctatatcattaagccaaatactagtagacggcaaagggttgagcgaatcaaaagttctttcatatgagaaacacaaagaagatttaaaactactaaaaaaagtactaaaaaacattgacaaagcctatgacaacaaaggagaagacagactagtgtacaaagtattaaaagaagataaagataaaggaactaactatgtcaattattctaagctttcaaacaatggcacagcgactacaaaagaagaattctataagttcctatcaaaaaatctcgacttaaaaaaattcggaaaactaaacaaagaagacatagaaacactcgattatataaactcagaaattctcctaggtaggtttttgcccctccaaaaagagaaaatcaacggtgtaataccataccaattacagatgaaagaattaactcaaatcttaaacaacgcaagtaaatacctcccatttctaaacaaaattgaggacggcatgaccgtgaaagacaaaataataagtttgataaaatttagaataccatattatgtcggaccgttaaacgaatacaatagaatagagaacggaaacggattcgcatggatcgaaaaaaagaaaaatgaaaaaatatttccgtggaactttaatgatgtagttgacatagaaaaatccgcagaaaagttcataaataacctcaccaataaatgtacatacataaaagaagaaacggtactacctaaaaatagcatcatttattcaaaatttatggtcctcaacgagttaaacaacttacaatacggcaataaaaaattagatatagaattaaaaatgaaaatgtacacagacctattcctcgaaaagaaagacaatcgaaaagtaactgaaaaaagaatactagagtacttccgcatcaatggaatcaatgacggaaaagaaaaactcactggtttaaataatgaaatccacgcagacatgaaatcatatcgagacatgtgtgaaataatgggcgaaaattttaacatcaatgtagcagaaaacataataaactggataacagtttttcatggtgaaaaaaaaatactaataaacaaaataaaaaacgtgtatggtaagatgttcaacgacgaacaaatatcaaaactatcaaagctaaactatagcgattgggggcgactcagtaaaaaacttcttacagatatcaaatgctatatagacgcagacggcataaattttcctgtctcaatactcgaagctatggaggtatcaaataaaaacctcatggaactactatcaaacaaatacgaatttataagttgcatagacgacataaacaacaaatacttcggagaccgtgatatcagtgcgtcagaactaatcgacgaactctacgtcagcccagcagttaaaagagggatatggcaatcagtgagaatcctagaagaaattgtatctatcataggacacaacccaaaaaagatcttcatagaaatgacaagacacaacgaagaaaaagttcaaaaaagcagccggagacataatttggaagaactatacaaagcaataagaaaagaccccgaatatgtagaactcatcaaagaatttgactcaactacagacacagacagcttcaaaataaaaaaactatacttatactttatgcaactaggaaaatgtgcatattcgaaagaaaaaattgacttcgacaaattattcacagacagctatgatatagaccatatatacccaagaagtaaaaccaaagacgatagcatacacaacaatcttgtattggtcaaagcaaaatacaatagggaaaaaacagacgtttacccaatagatataaacatacaaaaaaatatgaattcattctggaacttcttatataccaaaaaattcataacagaagaaaaatataaaaggctaatcagaacatccgatctcactgacgaagagttagccaaattcatatcacgacaactggtagaaacatctcaatcaaccaaagcaacagcagaagtgctaaaacaaatatatggcgattccgacatatgctatgtgaaagcagaaaatgtgtcagactttaggtacggatcatcaagacaaaaagacaaaaacgacatacaaaaattattcgtgaaatgtcgagaagtcaaccacttccatcatgcaaaagatgcatacttaaacatagttgtaggaaacgtatacgacgtaaaatttacaaaaaaccccgtaaatttcattaagaaaaataaaatgggaaataaatcaaattacagtttaaaccacatgttttgctttgatgtcgaacgaaacggctacaaagcatgggactcatctgaaacgatcaagacagtaggcaggatgatgaaaagtaacgatgtaagaattacaaaacacgtccacccaacgcgaggagaactatatgacgctacaatatacaaagcaaaaattgcaaaaaccggatcctatatgccactaaaatcaagtaaaaatactccactatctgacgtaaccaaatacgggggttatacaaaaataaaaatagcgtactactcggtttacaaatataaatttagcgacaaaaatttaataaaaacagaaataagattaattccaataccgatctacttaagcaagaatgatgacgatataaaagaatacgtcaaaaattatctaaacgacagagtaaactcaaaattaatcgatttcacaaaaatttacgacaaactatacgtcaactccctaataaaaataaacggatatctatattatctgggcggcaaaactaacgacagggtgtggatagacaacgccgtaagcatagttctagatgataaaatagaatatcttataaaaagaataagcaacgacataaagtatggctatgaaatcaacgtctcagacgatgaattaatggatatttacgaatcacttgcagaaaaggccaataaaaaaatattctataatagactttccgacttcgaaaaaatattctccaatatggacgtcaaaaaaaaatttgtaaaactcgaaaaaaacgataaatgtcgagtattattacaactactaaatgttctcacagacagtcaaacgacatacaaattagaaatggtaggattaaaacatagcagaagtaacatcggaatgaagatttcaaacctagaagaatttaaagtcatcaacagtagcataaccggtttatattcaaacgaaattgacatcttaaacatttga

SEQ ID NO: 8790 - RNA, 4026 nt, synthetic construct
  misc_feature 1..4026: note = Cas9 variant
  source 1..4026: mol_type = other RNA
atggaaaaagactactatctaggactagacatgggttccggttctgctggatgggcagtaactgacgatcaataccacgtcctaagagcacacggaaaagcaatgtggggaactagactttttgaatcagcaaacaccgccgaagaaagaagaataaatcgcaccgcaaggcgtagactgaaaaggaggaaccaaaggatagaatggttacaagaaatattcgccgaagaaatcaatacgaaagatagtggattctttcggagaatgaaagaaagtaggtattgggcggaagacaaaagagatgaaaatggatcatgtcctgaaatgccatactcactatttattgacgaagatttcacagacaaagaatatcatgaaaaatttcccacaatatatcatcttagaaaatatcttatgaccactgaagaaacacctggtattcgcttagtttacttagcatttcaccatatgatgaaacacaggggacactttctacttaacggaaacattgaagaaattcgcaaatttcgtaaaactttcgatcaatttttagaagtagtacgaaatgaagagatgggattcgccggcgaaatcgaagaagagacatataagaaaatagaaatgacattgaaagatgtgaatttgacaagatctgccaagaaaacaactttaataaaatcgttaaaagtaactagggttgaggaaaaagaattgttggcattaatatcaggttgtacagtcaaactgagtaacatattcaacgataaatcactagacgaaacagaaagacccaaaatctcgttcgcggatgcaggattcgatgattatgaagcggaaattcaaagcaacttaaacgagaaatattacattattgaaagcgcgaaagccgtatatgattgggcggcgttagcagatattcttggagaatacagctgcatatcagaagccaaagtcgccctatacgaaaaacaccataaagacttaaaaagactgaaagatctagtacgaaacaatatatcttcagaagtatataaagagatatttgtcgatgtttcaggtaaatataaaaactactgcgcatatatcggtacaacaaacataaacggtaagaagaaagattttgaaggcaagaaatgcacaaaagaagatttttatgcatacctaaagaaatcagtaatcgaatgtataaacgatagtgagaaaacagattggcttaaactggagctagaaaaaggaaacttcttacccaaacaattaacgggagaaaactcagtgataccgtatcaagtacacttatacgaacttaatgctataattaccaatctacaagaaaggatcccacttttaaaaagagatggtgagaaaattagacaaatattcacatttagagttccatactacgtaggccccctaaacggaatcagcatagacggcaagaaaacaaattgggtcaaaagaaaagaaggcgtgatatatccctggaatttcagtgatattgttgacgaagaaagcagtgcagaatcgttcatccggcggatgacaaacaaatgtacatatttaatacacgaagatgtactaccaaaatactccttgttatacagcagatttgaagtcctaaacgaattaaacaacgtaagactaaacggagaacttctatcagttgaattgaaacagaaaatatatgaagacgtattccaacgataccgaaaagttacacagaaaagactaaaaaggtatttgctaacagagggaataatagatgaaaatacagtaataacaggactagatggagatttcaaaggatcattaaccgcctatcatgacttcaaagagaaacttactggattaaatttaaccgaaagagaaaaagaagaaataatattaaacataacattgttcggagacgcgcgtagcctacttagaaaacgaattggaaaaatttgctcccaactatcggataaacaaaaagaaaatctgtcaaaactatcctatcaaggctggggcagattgagtaagaaattccttaatgggatagcaatctcagttcaaggagaagaagaatggacaataataaaagcactatgggaaacccaagataatttatcacaactaatgggcgcgaaatatacatttagaaacgcagtagagaaagagaatggagaactagaaaatagagaaatatcatacgaaacagtcaaagacctttcaatatccccatcagtcaaaaggcaagtatggcaatccctattaattgttaaagaaatttgtaaaatacagaagaaacccccaagaaaagtatttgtagaagtagccaaagagaaaacaaacagcggaagaactgaatcacgcaagaaacgactacaagatttctacaaatattgtagtaaatatgagaaagaactatatgacgaatcaattcaaaataaactagaaaaatgctcagaaagcgacctacgatcggacaaacttttcctgtactacatgcaaatgggacgatgcatgtacaccggccagccaattgacttcgacgaattgtggaacaaccagaaatatgatatagaccatatatacccccaaagcaaaacaatggatgactcaatcgataaccgggtgctagttaaaagaatatcaaaccaagagaaaacagatgtttaccccatcagagcagacattagagaaaaacgaagaggcttctggaaggaactaaagaatgtagggttaatatcggaagagaaatataaacgactgactcgagcaacagagttcgaaccggcagaattagcaggtttcataagtagacaattggtagaaaacagacaaaccacaaaagtagtagcaagcatacttaaacaggcgatgcccgataccgaaatagtctatgttaaagccagaaccgtcagcgaatttcgacataaatttaacttcatcaaagttagagaaatgaacgactttcaccacgctaaagacgcatatctaaacgtagtggtaggaaacacatatttagttaaattcacaaaaagcccagttaacttcattgaaaatcacagcaatagatcatataatttaaagaaaatgttcacagacggaagagtagagaggaatggcgaaatagcttggatttcaggggaaaatggtactatcggaacagtaaggaacatcatgaagaaaaacaatatcctagtaacaaggagagctcacgaagccacgggaggattctttgatcaacaactaatgaagaaaggtaaaggacaagtccctgtaaagggctctgacgagcggctattagacattgaaaaatatggtggttataataaagaaacaggagcatacttcgtccttgtagaaagtgatgaaaagaagggcaaaaagaaacgaaccattgagtatgtgccaatacgattgaagaaacaattagaaaacaatagaaaagcactagaaaactacctatgcgaacaaagaggattaactaaccccgtagtcctaatagataaaataaaaatggattcattattcagagtagacggattctttatgtggctaagtgggagaactggaaaccaattgctatttaaatgcgcaaaccagctagtacttagcacagaagatgaagcaacactcaagaaaattgtcaaatttgtcaatagaagaaaagaaaacaaagaaattaaaatatatgaatcagacaaattaaacgaagaaatgctcaaccgattatataatactttcctctataaactgcaaaacagtatatatggaaatagattaggagaacaagccaaaaccttgagtagcaagaaagaaaacttcgacaaacttcaaatagaagaaaagtgcctagttctctatgagatcttacatatgttccaatgccaaagtgctacatccgacttacaactaattgaaggccctggaaaagctgggacattaagattaaattcaaacataacaaaatacaaaaacataaatatcattaaccaatcacccactggtatatatgaacaagtaatagacttacagaaaatttga

SEQ ID NO: 8791 - RNA, 4026 nt, synthetic construct
  misc_feature 1..4026: note = Cas9 variant
  source 1..4026: mol_type = other RNA
atgggaaaagggtattacgtaggattagatatgggcacaggaagtgttggatgggccgtaacagatgaaagctaccaaatcctaagaagacatggaaaagcaatgtggggagtgagattatttgaaagcgccaaaactgcagaagaaagaagaatgtttcgaacaggaagacgccgattagatagaagaggttggcgaatagaaatactccaagaaatattcgctgaagaaatctcaagagtggatcccggattcttcctaagaatgaaagaatctaaatactaccccgaagataaaagagacattcagggcaattgtccagaactgccttacactttatttgtagacaaaacatttacagacaaagattttcataagaaatatccaacaatttatcatcttcgaaaaatgttaatggaaactgaggacacacccgatatgcgactggtatatctagctttgcatcatatgatgaaacatagaggacacttcttacttagcggagacatttcacaagtaacagaatttaaaaacacatttaatcaatttattgagaacattagaaatgaagaaatggactttgaaatagaactagacgaaagcgccgtacaaatgatagaagaaacactaaaagataaaaatctaacacgcagtgctaagaaaagtaaacttgtaaaaggcctcaacgcgaaaaacgtaagagacaaagcatttctcacactacttagtggaggaacagttaaactaagcgacttatttggtatggaagaactaaatgaaggtgaaagacccaaaatttcattcgcagataacggttacgaagaatatgcagcagtggtagaaatggaattgggggagctatactacattgtagaaagcgctaaagccgtctacgactgggcaatactaagcgatattttgggcggaagcacatcagtatcggacgcaaaagtaagagcatacgagaaacataaagcagacttgaaatacctaaaagcagtagtaaaagaatattttcccaaagaagtatacaatgcagtatttgttgaaagcagcgataaactaaataactacccggcatacatagggatgacaaagaaaaacggaaagaaagtctcgctagaagggaaaaggtgcagcagagaggaatttatggacttcctaaagaaaaacattgtcgttaaattaccagacgaagaagcaaaaatgtatctacaaagtgaattagaaaaagactcatttctcccgaaacaagtaaacaaagataatggagtcatcccctatcaggtgcacaaatatgaactaaagaaaatactagacaatctaggtgataaaataccattcttaaaagaaaatgcagagaaaatagaaaaactattctcatttcgtataccatactacgtaggacccctaagaacgggaaacggggaaaactcaaaatttgcatgggccgaacgcaaatctacagagaaaatatacccatggaactttgaaaatgtgatagatgtagaacaatctgcggagaatttcatcaggaggatgacgaataaatgtacctatctcatcggagaagatgtacttccgaaagattcattattgtattcgaaattcatggtattaaatgaactgaataacctcagactagatggccagaaaataagtgttgaacttaaacagaaaatctatagagacgtattctgcagaagcaggaaagttacccaaaagaaactaaaatcatatctgatacgcgaaggcatagccggcaaaaatgtagaactaacaggaatagacggagatttcaaaggatcactcacagcgtaccacgactttaaagaaaaactaattgacgtagaattaactcaaaaagaaaaagaagagataattctaaatattgtcctatttggtgacgataagaagctgttaaaacaaaggttgaagaagaaattcccacaactaaccgaaaaacaaatcaatacagtaactgcactcagttacaaaggatggggacgactaagcaagaaattattggaagaagtaacagtacccgccccagaaacaggagaagtatggaacataataacagcattatgggagacaaatgataactttatgcaactactaagtaaggagtatcaatttagcgaccgaattgaagagttcaacgaagagaaagcagaccccgaagtaagctaccaaactattgaagacctatatgtatcaccagcagtcaaaagacaaatatggcaaacactacaaatcatacaggaaattgaaaaggtaatgggtgaaaaaccaaaaagagtattcgtggaaatggcgagagaaaaacaggaaaataaaagaactgaatcaaggaagaaaacattgtcagacttatatacaaaatgtaagaaagaagaaccagaatggatagaagcactatgcacaagtcttgaaaaacacgaagaacaccaacttagatcagataagttatacctctattatacgcaaaaaggaagatgtatgtatagtggagagccaatcgaccttgaagacctgtgggataatacaaaatatgatatagatcatatctacccccaatccaaaacaatggacgactccctaaagaatagagtattagtcaagaaagaatacaacgctaagaaatcagatacatatccaatcgcagcagatatccaaaagaaaatgatgcccttctggaaatcactgctaacaggtggctttataccaaaagaaaaatacgacaggttagtgaggaataatccattagatgcaaatgaactagcggggtttattgaaagacaaatagtagaaacacggcagtcgaccaaagctgtagccgagatattaaagaaaatcctacccgataccgaaatcgtatacgtgaaagcaaaaactgtatccaaatttagacaagactttgatttcataaaagtaagagatatgaacgacctacatcacgctaaggatgcctatttgaatatagttgtgggaaacgtgtacttcgtaaagtttactaaaaatgcagcatggtttgttaaagagaatccaggtagaacctataatttagaaaagatgttcatatgggatgtagcgcgagatggtgaaatagcatggaaggcagggaaaagcggaagtatagttcaagtacgcgctatgatggagaaaaatcacatcttagtaactaggagaagttatgaagtaaaagggggactatttgatcaacaaatacttaagaaaggaaaaggacaagtaccagtaaaagaatcagacgaacgactaagagacattggaaaatacggcggttacaataaagcggctggtgtttacttcatgcttgttagttcaaaagataagaaagggaaagaacaaaggacaatagagttcgttcccatatacttaaaggatagagtggaaaaagatatggaaagtgcacgaaattacttaatggaagagaggggattaagggaacccaaaatactgataaagaaaataaaaattgacacactatttaaagtggacggattctatatgtggttaagtggtagaacgtcaaatcaactcatattcaaaggagcaaaccaactaatactgagtaaagaggacatgaaaactctcaagaaagttgttaaatacattcaacgacaaaaagaggacaaaaatgtaaaaataagtatgcgagatgggataacagaagaagaattactaaaactttacgaaacttttctggataaaatacgacactcaatctatggcgcacgactatcaagtcaagaaaagaccctagttaacggaaaggaaaaattcatcgacctatcagtagaagcgaaatgtcaagtcttgtatgaaatccttcatctttttcaatgtcaatcgggggctgcaaatttaaaaatgatcggcgggccagctagcgctgggatactggtcatgaataacaacatcagtaaatgtaaaaacatttctattgtaaaccaaagccccactggtatatatgaaaaggaaattgatcttctaagagtatga

SEQ ID NO: 8792 - RNA, 4026 nt, synthetic construct
  misc_feature 1..4026: note = Cas9 variant
  source 1..4026: mol_type = other RNA
atgactcaaaaagtaatcccttataacataggattagatattggcacaaactccgtcggatgggcagttacagataacgaaaacaaattactacatataaaaggacacaacggtatcggagtcagactttttaaagaaggacaatccgctgccgaacgctgcggatttagaacaactagacggcgattatcaagacgaaaatggaggttaagactactaaacgaaatatttgcagataaaatagcaaaagttgacccaagctttttcgccagattaaaacaatccaacgtgtcccccaaggatccaaacaaaaccatgttcggaaacattctatttgataacggaaaccttaacgataaaagctttcatgacgaatataagacaatctatcatttacgacaaagtataatcgatcatcctgaaaaaaagtttgacatacgcctaatatatctggcaatgcaccacataatcaaataccgaggacatttcctaaaccaagcaaacgtacaagattttaaaggtggcaaaattgatctcgaagaatcctttaaagacctaaattccatattcgaaaatcaagggagggacttaaggcttgtcacagaggacgcgaacaaatacgtaaaagaactatcagataattcaaaaacaagaaacgatagacaaaaagaattatctaaagttttatatattccgatagacaaaaacagtgacaaaaacaataaaaaagtaacaaccgaaataataaaagcgattctagggatgaaagcaaaattcgacgtaatcttcggaatagatgccgaaaacgcaaaagaatggtcactgacttttaattcagacgactttgacgataaaatagaaggtctatccgcccaaatgactgacgaagcaggcgaaattcttttaatactaaaagaattatattttgccctaaatttatctgacatcctaaataactctgtcactgataaaaacgcgaaaaccctatctgaagctatgataaaccgctacgacgaccacaaagaacaactaaccatgctaaaacaagtaattgataactcagacaaaaaacacgccaaagcattaaaagcagcctattcagcatatatcgacggagaaaacaacaaaaagatatcctttgaagacttacgaaaacgtatccagaaaaacttagacaactcagaaacatccaaaaaaataaatgatttgttagaacatgactatttcttacccaaacaacgctccaaggaaaacggcgctatcccacaccaactacaacaacaagaactggacaaaattatcgaatcccaaaaacattattacccatttctagcagaattaaacccaaatgaaaaaagatcccgacaagcaaaatacaaattagatgaattggtagcattcagagtaccatactacgtcggcccaatggttaaagcaacagaaaacaaccagtcgaacaatggaaaatttgcgtggatgattaaaaacgacaacatctccgacaaattgaaaaaagaggaaatcaccccatggaattttgacaaaaaagtcgatagaaccgaaaccgcaacgaaatttataacccgtatgaccacaacagatacatatctaatcggcgaacccgtattacccaagaacagcttattgtatcaaaagtttgttgtcctaaacgaattaaacaacttaaagatcaacaaacagcctataacccccgaacagaaacaatacgtatatgaacatgtcatgaaacaaaccaaaagagtctccctaaaaaaaatagcagacgcactagtcataaagggcgactacccttatgcaccagaaataaccggtaccactgatcaaaaaaatatgaataacggactatcgacttacatagacttagccaaaatatttggagacgagctcgacgatatagatcgtaaagaagactttgaaaaaataatcgagtggtcaacaatatttgaagaccaacacatcttcgcactaaaactaaaggaaattaaatggcttacagaagatcaacggaaacaagtagtgaaactaagatatcaaggatggggaaaattaagcaaaaaactactagctgacctcgttgatgacaatggccaaagaattatagatctactctgggattccaaacaagatttcatgcagattgtaaaccaaaatagcttcaaacaggcgatagctgaacataatggcgcccatctagaggaaaaagaccttaaagatataataaacaatttatacacaagcccacaaaacaaaaaagccattaggcaagtcatcttagttgtagatgacattatccgagcagtgggatacgaacccgtaaacataatgatggaattcgcacgagaagactctaaagaccatcgactaactaattcacgatctaggcaactcgaaaaagtatacaaagatattacaaattcctggtttgacgacgataacgtaaaagacgaattaaaagacaaaataaaagacaaagcgaaatttacagacagactttacttatactttacacaaggcggaaaagatttgtacaccggtgaacccctcgacatagataacctatcgaattaccaaatagaccatatcttaccacaatctttcattctagataattccttagataaccgcgtcctcacctccaaaataaacaaccaaattaaaaaagataacttacccggcgagttctttggatcgaaaatgcacaatttttggaaacatctaaaagagctacacctaatatcaaacaaaaaatattataaccttaccctaactcccaattcaatatcaaaattcaacaaccaaggtagatttataaacagacaactagttgaaacacggcaagttattaaactagcagctgagatcctacataatagatattcagaagaaaacggaaccaacatagtaaccgtaaaagcaaatctaacacaccacatgcgcgaaaaatttaacttctataaaaacagaaatgtaaatgattatcaccatgcattcgacgcatatctagcagcattcgtcggaaactggctcttacaacaataccctaaactaaaaccttacttcgtttatggagacttcgccaaaacagaaatagacaacttaaaatcattcaacttaatatataaatttgaacaagcccatcaactaaacgaagaagacggtaagatagccaaggacaccgatgcactattaggatacatgaaaaacgtatatcacttcaaaaaaatgctagtaacaaaagaacttgaaacgaatcacgggaacctctttaaacaaacactatacccatcacatggaaagatgaaaaacctaataaatcctaaagaaaacagatcttcagacatctatggcggatattcatcggagaccggagcctacgtgtcactaataaaagtattcaaaaaaaacaaaatagaaaataaaataataaaaatccccctactatatatcgataaactaaaccgtcaagcaaacgccaaacaattcataagaaattttattataaaagatgattcaaataagtttgatatcctcagcgaaaaaatatttttaaatcaactagtaatcgatggagatgaactcttcacaatctccggcagtggtgacagacaaaacgcacaacaattaatcctatcagacaaatcgcttaaaattctctcaaaaaacatcaacgttatctccaaaaacgatttaatcataatttttaacgaaataatagatgatatatgcaaatacatgaaaatgtacgaagtggaaaatagcgatgaaacaaaagcaaaattcgaagaaataaatgacaaagacagaatgttaaaaataataaacgacttattactaggtttacatgcaaatgcaagtcgttcgaacctatcatcaattggactatcaccatcatttggtagattcttttcaggaaacgcagggataaaactcagcgaaaacgcaaaatttatatatcaatctccaacaggactattttcacgtaaagtcaaaatttcagacctatga

SEQ ID NO: 8793 - RNA, 4032 nt, synthetic construct
  misc_feature 1..4032: note = Cas9 variant
  source 1..4032: mol_type = other RNA
atgacgtactacctcggactagatatgggaacatcatccgtgggttgggcggttactgatgaaaactataatttaatacatcgccaccgtaaagacctatggggtatcagagaatttgaagaagcgaaaacagcagtcgaaagaaggactcagagaatctcaagacgaagaagacaaagagaagtggcacgtatcggactgcttaaagattatttccacgatgaaattcaaaaagtagatccaaatttttaccaaagattagacaattctaaatactttcctgaagacaaagaggaagtagtaaaagggaaaaacggaatatttgcagacgaaaattatacagaccgggactatttcgctgaatatcccactatattccacttgagaagagaactcctcaatagcaaggaaccccatgatgtgagattactgtatctggctttattaaacatgtataaacaccgaggccactttctgaacacaacactgggaacagatggagaaaacagaaaattatcagatgtctatcgcgattttgtcgtaaaaacagaagaagttctaggcttaaccttcccacaagaaacagataacggaaagatgcaagaaattatgtgttcccgcgagtttagtagaaaaaggaaagcagagcttttatgtgctttactagagatcgataagaaacaaaaacaacaagttgcattaatagaatgtgtgctcggactagataaatccgtaaaacaaatgtacggaaccgctgtcccagatgatttcgacaaaagtgtaaaagtaaacttcagcgattcaagttttgaagaaaaagtaagcgaagtagaagaattattagatgaagaaaaatatgaacttatattatgcatgaaagaactatacgacacggcagtactcaatcaaattatgggcgactgcaactatttatcagaggctagagtacaagaatacgaaaaacataaagaagacttaaaactattgaaaaggacagtaaagaaatacggaacagctgaagaatatcaattcttatttagaagctcggagaaagcaagttataacgcatatgtacattctgtaaacagtggcgagaaaataagaaggaatatggacggacgaagccgagacgacctatatacagtgctaaagaaaatgcttaaaaactatccgcaagaagacgcagattgcaaatatatcctagaggaaatagaaaaagaacaatttttaccaaaacaattagttagcgacaatggtgtcataccaaaccaaatacattataaagaaatgaagaaaattctggagaacgcagaacaatatttgcattttctacgcgaaaaagatgaatccgggtatactgtagcagagagaatactaaaacttttcgccttccaaataccatactatataggacctacctcagaaaaatcaggcaaaaacggaggaaacggatgggtagtaagaaaagagcaaggtcaagtattaccctggaatatagaagagaaaatagacatgaaagcgacctcagaaacgttcataagtagaatggttagaaggtgcacatatttaagcgacgaaatggtgctaccaaaagctagcttagaatacgaaagtttttgcgtcctaaatgaactaaataacctcagaatacgaggagtaaaattgccaataacggtaaaacaagacatatataaagacctatttgaaagaggtaaaagagttactagaaaacagattgtaaattatcttaaaggagtaggaatattacaagaaggtgaagaagatgaactaacaggaatgatggatactttcaacagttcgctagcatcgtatggcaaatttaaatcgatcctaggtgagaaaattcaagaagactcatgtaaacggatggtagaacaaataatattttggtgcactatatacggagacgcaaagaaattcctgaaagaacaattagaagaaaaatatggagatgtgctaaccagggaacaaatcaaaagaatattaggattcaaattaaaagattggggcaatctatccaagaagttcttagaactaaacggctgcgatcgaaacactggtgaagtcatgtcactgatcagaatgctttgggaatcagacgacaaccttatggaacttttaaaagatagttcttacacctaccgggcagaattagaagaacaacaggagaaattaacgaaaacattaacagagatatgcccagaagatttagaaggatattatttctccgcccccgtcaaaagaatgatttggcagacgctactaattctaaaagaagtagaaaaagtaatgggagaaccaccaaaaagggtatttgtagagatgacaagagaacacgatgaacgcagagagatgaaagatagtaggggaaagaaatttcaagagctatacaaaaacattaaagatgaagaacataactggaaagctgaaatagaagatgcggaaaaagatgggcggataagaagtaagaaaatgtacttgtatttaacccaaagaggacgctgcatgtataccggaaatccaatcgatttagaagagttattcaccacaaaatacgacatcgatcacatatacccacgacatttcgttaaagatgacaatctcgataacaacttggtattagtagaaaaagagaaaaacgcacacaaatcagaccaatatcccttaggagatgatatctatactgggagactcagttggtggaaagaactacacagagaaaaactaataaatgatgaaaaatataagagactaacggggagagcacctttttcagatgagcaaaaagcaggatttatagcacgtcaattagtcgaaacatcacaaggaacaaaaggagtagcaagtatattaaaggaagttttaccagagacaacaacaatagtgtacgcaaaagcaagaaacgtctcagatttccggaatactaacgaactactaaaggcacggtcagtaaacgattttcaccacgcgcaggacgcatatttgaatatagtagtaggaaatgtatattacgttaaatttacgaataacccgcttaacttcgtcaggtcaggcgaaggttataatttagacggggtattccgaaagaacgtaatcagaggacaagaaaatgcatggattgtaaaaccagaaaaaggagagaaaatgacacttgaaaccgtaaaaagagtgatggcgaaaaacacaccattactcaccagactatctttcgaaggaagaggaggtttggctaatcagacattatacagtgcaaaagaggctgcaggcgaaggctacgtaccactaaagagttccgattcaagactacaggatgtgaccaaatatggaggcttcacgtcagtaacaacggcttatttcatattagtagaacatgatatgaaaaagaaacgagtcaggaccatagaatccgttccaatcctgtggaaagaaagaatcgaaaaagaaagtggacaattagaaatatactgtagagaagcattgggtctagttaatccggacatcagagttcgtaaaatattaatacaaagtctagtaaagaaagacggattctatatgcatctatcaggaaaaacaggaaaccgatttataatgagaaacgcagtggaactatgtttgaaacaagagtggataaattactctaagaaactggaaaaagaaggatgcgatgaaagcattacaaaagagaaaaatgaagaattatacgaaatattaaaagaaaaacacataaatggcatctataggaaacggccaaacccaatgggtgaaaaactccacatacgacaggaaacattcaggatgttaaccttagaggaacagaagaaagtgctactatcgctattaaatttaacaaaaataggtccggttgaagcaaatttagaattaataggagaatcagcacatacagggaaaatgttaatcagtaaaaatataaccgaagtcaaagagttctatctcatacatcaaagcgtaacggggatatacgaaaaacaagtaaacttgctaaccgtgtga

SEQ ID NO: 8794 - RNA, 4032 nt, synthetic construct
  misc_feature 1..4032: note = Cas9 variant
  source 1..4032: mol_type = other RNA
atggccactaagaaagagtacaatatcggtctcgatattgggacaacatcagtgggatggagtgtagtagaaacagataaccaaaaagtaatgcgaaaaggaaacaaagcattatggggcgtaagattattcgaagaagcaacaacagcagaaagtcgcagaatgcaaaggtcaacaagaagaagatatgataggcgtagagaacgaataaaattacttcaagaggaattttccgaagagataaataaagttgacaaaaactttttccaaaaacttaaagaatccaaatatgtagaaaacgacaaaataaacaagaaaatagtactgacaaaagaagaaaaacaagaactaaaagactatcaaaacaaatataaaaccatatatcacctacgtgatgaactaattaataacccagagaagaaagatatacgattagtatatcttgcgatacaccacataataaaataccgaggaaattttctataccaaaacgcaaattttaatattgataaccttgacataaaagacaaactgaatgaattattctccatattgagtaacaacatacaagaattagaaataccagaggactacataaacataatagactttgatgaattagaagcagacctactaaaagataccaaaaacgacgtgaaagcactactcattgacaaccttaccgaactaacaaataaatcatcagcaaccgagtttggcaaattaatggtaggcaacaaaggtaacatcaataaactattaatgttagaaactgacaacaaaattgaaataagtttttccggcacagactacgatgataaatatgaagaataccaagaggcactaggagaaaacatagaaatccttgacattttaaaacaaatttacgactgtatatttctcaagaaaatattcaaaggaaataaaaacacatcaatatcatcgttaatggttaaatcttttgaacaacataagaaagacctaaacttccttaaagaattattcaaagacaacagagaactatacaatgaaattttccgaaccaagaaagacctatgcttatatgagaaatacattacaaacaaaatcgactgcgacgaatttcgaaaagaaattaataaactactagaatccctattctctgatgaaaatataaaacaaaatttgctcgacgaatacaatcttgaggtaaaagagagaatagaaaatggaacttttctcccaaggataacaacaaccgacaatggaaaatacccctatcaactaaataaaagtgagcttataaaaataatagaaaatcagggaaaatactacccatttctccttaacaaactaaacgacaataaaacttataaaatagttaaacttctagaatttaggataccatactacgtaggccccctggtttcagagaaaagatctgaaaactcatggctagaaaggaaaatcaataatgtaaaaatcaccccttacaacttcgatgacgttgtagataaagagaaaaccgctgaaaaattcattaaacgtatgataagtcactgcacctacttgcttgacgaatatgcactcgcaaacaacagcatactctactcagaatttaaagtaatgaacgaattaaaacaaataagggtaaacgatagaaaattagaattaaaattccaacaacaaatactcgaggacttctttaagaaaacatcaggaacaataacagaaaggaaatttaaaaattatctgatatcaacaggggaatacagcatggaaggcggaaatttccgaatcaccggctatagtgcagacggaaaattcgcaaacaatatgcagtcatatgtagacttcttcggagagaacggaatctttgcagacacagactataatctcgaaaacgcagaagaaatcatagaatggatcacaatattcgaagataaagatatacttgaaaagaaagtaagagataactatagcaaactaaatgaaaaccagattaagaaagtactagcaaagaaatattcaggatggggaagcctaagtaagaaacttctcaaaacaaaatactacaaagacaaagcaacggagctgtataaatcaatcctcgacctcatgtacgagaccgacaaaaatttcatgcaaataataaatgatgataaatacaatttccaagagatgatcaagaaattcaacaacaaagaagagaacaagaaactaaactactcaatcgtagaagaactagcaacaagtcctgcaactaaaagaggcatataccaagcactcaaagtggttgaggaacttgtagattatataggatacgaacccaaaaatatctcaatcgaaatggcaagatcagaagaagaaaaagtaaggaaagatagtagaaaagattacattaataatttatataaaggatgcaaagattccatagaaaattacaagaaattaaaacatgaactagattcacacgaaataacatcccaaagactgttcctatattttatccaagaaggaaagtgtctatacactggcacgccactaaacatcgaagacatagaaaatcaatccttatatgaaatagaccacatcataccaagaagtctaataaaagacgactccatagacaataaagcattagtactaaaagaatgtaaccaagacaagaaggcttcgtacgtcttaccttcgaagttcagaaactcaaagcagaaaacctggtggaaacatttaaaagataatggtctaatgtccgccaagaaatttcacaacctaatacgagaaaaatacaacgaagaagacataaatggattcataaatagacagctagtagaaacaagacaaataacaaaacatgtggctaacatactaaacaatttgtacaaggatacaaatgtcatttatttaaaagcagacctttcccacaactatagggagaaatatgacttattcaaattcagagacataaatgactatcaccatgcacacgacgcatatctagcagcagttctaggggaatacaaagagagattcatgaaacgaaaaataaactttgacatggtcaaagaactgaactcaaaaatagtcgaaatggacgaaggcaaaagaagaaatctacgattcggatacgtcataaacagtctcgatgaaaacctaaatgacatagttttaaaaataagcgaaaatctagtcgataatgaaacaggtgaagtattatttgacgctcatgaatttaataaaagagtagaagacactttatatagaaacgacatactaatctccagaaaaacagagataagaactggccaattctacaaagaaactatatacaagaaaggtaaaggcactatcccaatcaaattcggtatgccgaccgacatttacggcggctactctaatacaaacgctaggaaactaatgcttatagaatacaatgaatctaaaatgaaaataatcgggttacccatggccttagcagtacgaaataacgacgccgaaataaatgattacattaaaacacaaataaatctcaagaaaaacagtacatttaaaatcaagaaatgctccatcccatttgaaaccgaaataatatacaacaatcaaaacgtattcataaagggatatagtataggtcataagaactgtgaaatcagcaacgcaatacaactcaaaatagccaaagacaaaatgaaacactggaaatacgcactacaatacttactaaatgataagaaacaatacatagattttgccgaaaaatatgtcaatgaaatatacgatttcctaataaacttagatctgtttcccttgttcaacaaagagctagacaaaatcaaaaacaaagtaaactttgaagaccttgccttagatcaacaaaagaaaatcactaaagaactcttcaaaatgctacattgcaacagtgtaaacgccaacctaagcgaatttggacttggtgaccgcatgggacgactctcgggatacaacataacagatggaataataatatcaaaatccgtaacaggaataagagaatccagatacgagttctga

SEQ ID NO: 8795 - RNA, 4035 nt, synthetic construct
  misc_feature 1..4035: note = Cas9 variant
  source 1..4035: mol_type = other RNA
atgagccaaaacaataacaaaatatacaatataggtttggacatcggagacgcatcagtaggatgggcagtagtcgacgaacattataacttactaaaacgacatggaaaacacatgtggggctcccgactcttcactcaagcaaacacagccgtagaaagacgctcaagcagatctacacgcagaagatacaacaagagaagagaacgaattagactactcagagaaatcatggaagacatggtcttagatgtcgacccaacatttttcatacgtttagcgaatgtatcgttcttagaccaagaagataaaaaagactacttaaaagaaaactaccacagcaactataatctattcatagataaagacttcaacgataagacctattacgataaatacccaaccatatatcacctccgaaaacatttatgcgaatccaaggaaaaggaagatccacgtcttatatatttagcgctgcatcatatcgtaaaatacagaggaaactttctatatgaaggtcaaaaattctcaatggacgtttcgaacatagaagataaaatgatagatgttctaagacaattcaacgaaattaacctatttgaatacgtagaagacagaaaaaaaatcgacgaagttctaaatgtattgaaagaaccactatctaagaaacacaaagctgaaaaagccttcgctttatttgatacaacgaaagataacaaggcagcctataaagaactatgcgcagcattagccggcaacaaatttaatgtaacaaaaatgctaaaagaagccgaactgcatgacgaagacgaaaaagacatatccttcaagttctccgacgcaacattcgacgatgctttcgtagaaaaacaaccactgttaggagattgcgttgagttcatcgacctacttcacgacatctactcttgggtagaattgcaaaacatactaggttcagcacatacaagtgaacctagtatatcagctgcaatgatacaaagatacgaagatcacaaaaacgacctaaaactactcaaggatgtaatacgaaaatatctacccaaaaaatacttcgaggtgtttagagatgaaaaatccaaaaaaaataattattgtaactacatcaaccacccttcaaaaactccagtcgacgaattttataaatatattaagaaactaatcgaaaaaatagacgaccctgatgtcaaaacaatattaaacaagatcgaactcgaatcttttatgctaaaacaaaacagcagaacgaatggagcagtaccataccaaatgcagttagacgaactaaataaaatactagagaatcaaagtgtttactatagcgatctaaaagataatgaggacaaaattaggtccatcctaaccttccgtataccatactatttcgggccattaaacataacaaaagatagacaattcgactggataataaagaaagaaggaaaagaaaacgaacgaatcctcccatggaacgccaacgagatagtagatgtagacaaaacagcagatgaattcataaaacgaatgagaaatttttgcacctatttccctgacgaaccagtaatggccaaaaactcacttacagtctcaaaatatgaagtattaaatgaaataaacaaattaagaatcaacgaccatcttataaaaagggacatgaaagacaaaatgttacataccttgtttatggaccataaatcaatctcagccaacgcgatgaaaaaatggttagtaaaaaatcaatattttagcaacacggacgacataaagatagaaggcttccagaaagaaaatgcatgttcaacttcattaacgccatggatagatttcacaaaaatattcgggaaaataaatgaaagcaattatgattttatagaaaaaatcatatacgatgtaacagtgttcgaagataaaaagatactcagaagaagactaaagaaggaatacgacttagacgaagaaaaaataaaaaaaatcttaaaactaaagtattcagggtggagtagactatctaaaaaattactatctggaatcaagactaaatacaaagacagcactagaacaccggaaactgtcctggaggtaatggaacgaacgaacatgaatttaatgcaagttataaatgacgagaaactaggattcaaaaaaaccatagatgacgcaaactccactagtgtctcaggtaaattttcttatgcagaagttcaagaattagcagggtccccagccatcaaaagaggaatatggcaagctttattaatagtagacgaaattaaaaagataatgaagcatgagcctgcacacgtgtacattgaattcgcaagaaacgaagacgaaaaagaaagaaaggattcattcgtcaaccaaatgctaaaattatacaaagattacgatttcgaagacgaaacagaaaaagaggccaacaagcacctaaaaggagaagatgccaaaagcaaaataagaagtgaacgactaaaactatactacacgcaaatgggaaaatgcatgtatacaggaaaatccttagacattgatagattagacacataccaggtagaccatatcgttccacaatcactattaaaagatgactcaatcgataacaaagtgctggtcctttcttccgagaaccaaagaaaattagatgatctagtaataccaagtagcataaggaacaaaatgtacggattttgggaaaaactatttaataacaaaataatatcccctaaaaaattttattcactaataaaaactgaattcaacgagaaggatcaagagcgcttcatcaacagacaaatagtcgaaacgagacaaatcacaaaacacgtagcacaaataatagacaaccactacgaaaacacaaaagtagttacagtccgagcagacctatcgcaccagttcagagaaagatatcacatctataaaaatagagacatcaacgactttcatcacgctcacgacgcatacatcgcaacaattctaggaacttatataggacacagattcgaatccttggatgcaaaatatatctacggtgaatataaaagaatattcagaaatcagaagaataaaggaaaagaaatgaaaaaaaataatgatggtttcatattaaactcgatgagaaacatctacgcagacaaagacactggtgaaattgtatgggatccaaactatatagaccgcataaaaaaatgcttctactacaaagattgttttgtcactaaaaagctagaagaaaacaatggaacgttctttaatgtcacagtactaccaaatgacactaacagcgacaaagacaataccctagctactgtccccgtaaacaagtaccgaagtaacgtaaacaaatatggaggatttagcggagtgaactcattcatagtagcaataaagggaaaaaaaaaaaaagggaaaaaagtaatagaagtaaataagttgaccggaataccattaatgtacaaaaacgccgacgaagaaatcaaaataaactatctgaaacaggcagaagacctagaagaagtgcaaataggaaaagaaatattgaaaaaccaactaatagaaaaagacggaggattatactacatagtggcgcctaccgaaataataaatgcaaaacaactcatactaaacgaatcacaaactaaactagtctgcgaaatctacaaagcaatgaaatacaaaaattatgataacctagacagtgaaaaaataatagatctatacagactgctaataaacaaaatggaactatactacccagaatacagaaaacaattagtcaaaaaattcgaagacagatatgagcagctaaaagtaatttcaatagaagaaaaatgtaacataattaaacaaatactagcgacgttgcattgcaattcctcaataggtaaaatcatgtactcagacttcaagatatccaccactataggtcgattaaacggtagaacaatcagcttagacgatatcagcttcatcgcagaatcacctactggtatgtacagtaaaaaatataaactgtga

SEQ ID NO: 8796 - RNA, 4035 nt, synthetic construct
  misc_feature 1..4035: note = Cas9 variant
  source 1..4035: mol_type = other RNA
atgaagaaaaccaacccatatatattatcacttgatatcggaactgcatcaatagggtatgcatgtatggacttagacttcaatatccttaaataccacgacaaagacgcaataggagtattaaccttcgaaggagcagataccgccgcagaaagacgaggttttcgtacaagccggagaagaaagaacagaagaataaaacgactcggacttctacaagaagtcttagcacccctagtcaaaaatccaaattactaccaactactaaacctacacaaatggaaaaacagcaacgaagatttcaaacacagatcactatcggaagtactaaaaattctaggtaaaaacccaaaaacataccctacaatataccatctacaacaagatatccaaaaccatcccgagaagaaatttgaaccagagcttatattcttagccttgtaccacctagtaaaatataggggacatttcctattcaacaatcttagctttgacaaagggaagacagtagacaatgaagcccaactctctgaattactcgaacagtatcaatctataaatccctacgaagatagtataagtaataaagatataaatgtgatagttgacaccttgaaggacgaccaactaacaagaaacgataaatctaaagaattgaaacgaaacgtctccaaaacacacgcagaactattcaaaatgctagtcggactaaaattcaaacaaagcattctcttcgaaaacatggaaaacgccgaagatattaaagaatcggcaacaggtagcgacgccatctcattatctgatgattattacgaaaacctatccgaatttcttacagacgaacaacttaacttcattgaatctgccaacacattctttatgggaataatgctagatcgaatcctaaaaggcgccacatccatctccgccgctaaagtccgagactataaaatattcaaaaatcaacttaaaataataaaagacatagtatatcaaaacaaatacgacaaatatcatgagttctttgtaacatcaaaagaagacatgcgagcataccaggaaaatccagatgcaaagacattcggaaaactaagcaaattcgaccaatatcttattcacccgaaagatcaatacgcaaaactaatgaaagatctgaaaggcatcgtacccaagaaatacaccgaagtattaaacctgatagatgaacaaaaattcctggtagtacaaaacactacagacaacgcatctataccataccaaaataacgtgtttgaagccgaaaacatcttacgcaatcaacaaaaatattatccggaaataacagaagaaatgattggaaaagtaataaacctaatctcattcagaatcccatactatgtgggacctttaactaacaaaaacggccaaagcgacttcgcgtggatgataagaaaatctgacgaacaaaccttaccatggaatttcgacaaagtcatcgataaatccaaatcggcagaaaaatttatacgccgaatgacgtcgaaatgcacatacctcttagaagaagacgtcttgcctaaacacagcctactgtaccaagaaatggaagtactcaacgaactcaataacgtccaactacgcggggaaaatgaacctaaacaccgaatccatcgactagaccccaaagttaaacaatttatctaccacaatctttttcaaaagaagaaaaacgttacacacaaagacctcatcactctattacaaaattcagaacacagaaacaccctaaataaaacatctggacaaaaacttaaagtctttggaacgcaaaacgactcaaaattcgcttcaaaactcagcacatataatgatatgaaagctatcttcggttcagtagaaaataaacgacaaatgatagaagaacttgtcctctggataacaatattcgaagacaaagcaatattaaaacagaaaataggagaaaaataccccaacatcacagaaaaacaactaaaccaaatagtaaaactaaattactcaggatggggccgactgagcgaaaaactactaactaaagaagtcaatggaagatcattaatagatttaatgtattcaacagaaaataattttatggaaataataacagataaaacactaggatttgattgttttatcaaaaactcaaacaaagttaaaaacgccaaaatatcctacaaagatgttgctgaattaagaacatcaccggcgttaaagaaaggtatatggaacgctataaaaatggtcagagaaatttcggatctcttcggggcgccagagaaaataataatagaatttgctacagaagaccaagtaaaaggcaaaagacaaaaatccagatcagaattatgggacgacttagttaagaaaaacaacttgaaaagaaataagaaatttaaaggtctgtttgaagaactaaaagcctacccagaccttgacttctcgaatccaaaattatggctatacatacatcaaaatggaaaatgcatgtacacgaagaaacccatagatctagaaagattaatgtcggacacaaataaccaactatacgagattgaccacatactaccaagaacatttgtaaaagacgacagcataaacaataaagtgctagtaatacaatcagcaaaccagaagaaaagcggagacaaaatgcctctagaaatatttgataatcatgtacttgtaccgttctggaaaatgttatatgaaaacgacctcatatcatcttctaaactatcaaaattaatgaagaaagaatttaacgacttagacaaagaaggtttcatacaaagacaattagtagaaacaagacaaataattagccacgtatcagattttctaacagaagagtaccccagcacaacagtagtaccaatgaaagccaatgtggtctctgagttacggcgaaaatttgacatcccaaaaataagacaacttaatgactggcaccatgcagtagacgcataccttaacggattcgtatatcaagcagcccgcgtattctacccgaaagtcaacttattcgaatttaacttcaaatgggaaaaagttcgtgaaaaatggagacaactaggtgaatttacggaaaacaataagaaaagggagttcttcctattcaaaagaatggaaaactacgtaaacgaacacggagaaggaatgatcagtaaactcattttcgatttagacaacttcaaatttaattattccagaaaagtagaaagtaccgaaagtgccttttacaaacaaagcgcattttctcctaaaaacaccacagcccaatatgattccgacaaaaataaaaccgcaatatataaagaaatgaaaaataaaagaggtattgtggtatcatatacatatgtaaagaaagatcaggaattgatcgggtatggggttttcaacgaaactgtattcgaatatgtaaacaacgctgacgtagacatgaacacaagggcacttaaaatagtacgaaaagccttccctaaattagacataaagaaagcacaatacctattctctataaataaaggcgatgcattgctagttaatggacacccattcctattcgtaagcgcgaaagaaagaattaatggaaaacaactcgaatttgatattaacatgcagagaagactgaagaaagcacttagaccttacaacaaaatgacagaacaagaaaaagttggtgtatacaaccaattcgcagaaaaagttgttcaagaatacgaaaacagcttaggggctaaaacacggaacgaaaaattagaattaataagaaatcaattcaacgaatctgataaaagcaacgaagcattaatacaatgcatcctagaagtactcaaaatgacaaaagtgtcggcggagcggtcagtaaaactaaaaattcgatggggatcacaaacaccgaatacactaatagacataaacaacaaagcgaaaataatgtataattccatcacaggtttgaaacaaacgagactaaaatcaatatacaaattagcagaaagtaaaaatgaactctga

SEQ ID NO: 8797 - RNA, 4035 nt, synthetic construct
  misc_feature 1..4035: note = Cas9 variant
  source 1..4035: mol_type = other RNA
atgaacaaaaactactacatcggtctagatatggggaccaactcagttggatgggcagtaaccgaccaagagtacaatttaattaaactaaaaggcactcacgcttggggagcaagaatattccaagaggcaaaagataaaaaaggtactcgcgcaattagatctagccgaagaagaatggacagacgaaaataccgaatacaccttctgaatcagttattcgcacaagaaatccaagccattgactccaccttctttatccgactagcatattcagcatactgggaagtagacaagaaagacaaaggaattgggagaaacatattatttaaaacaaaacaagaagaatcacagttctacaaaaaatacccaacaatatggcatctgcgaaaatccctcttagaaaaccaacccgatgctttctccgatttacgttatgtgtatctagcgtttcatcacattatgaaatatagagggaattttctccatgaaggagaaattaaaacaaacgaactacaagtccaacaaatcgaacaacttaatcaattcctcattaataaatacaaagaaatatacgataacgacgtcgaagaaagaactttcattgctaaccatcaaatcgacgcactaaaagagatattattgaataaaaacactaataaaaccaccaaagaaaaagaaatcaaaaagctttttgattacgcagactgcgaatcacttgaaccatatataagttgtttctctaaattagcagtaggcgggaaatttgatctctcaaaactcggatatgaaggtaacatccaattcagtgacccctcttttgaagaaaaagcatcaatcttacaagacgatttcagactcatagccatagcaaaagagatgtatgactttgtgattttgaatgatctattgaaggaccaaccaaatttaagtacagcaatggttcatgtatatgaaacacatagacaggacctaaaaaagctaaaagacattataatagatatagacgctaataaaggtttacaaaataatgatagatggtatttcaaactattcaaagataaaaacgcgccaaaaaactactccgcattcatccataaaaattccaatcaaaaacgaccaagcatagacgagttcaatgacgagataaaaaaaatacttatcgaacaccgcaacgacgtatccctggaaaaacaagacgacctcaaaatgctattcgaaaaagtggaaaataagacactattaaaaacgatagccatacaatccacgtctgtaattccacaccaacttcacctagacgaactagaaaaaatcatagataacgcatcaacaaaatacccctttctatcgaacatcagagataagctcgtattgctctttaccttccgagttccctattattacggacctttgaatgacaaatccccctactccaacgtagagagaaaacaattcgcaactgtaacaccttggaactttgacgaaatatttgatgagaacaaaacccgagaaaaattcatgaagaaactcacaaataactgtacttacttgagcggtgaaacagtaatgccaaaaaaggcactcgcatacgaagattatttaatatacgaccgattgaacgttttacttgtaaatggcgaatacttaagcctacaagaaaaagaaaaaatctaccactacctaatatcacggccaaaaacaactttagatcaattaaaaaaagaattagccaaatggcacaatcaaagtccgattgacataatcttttcaaatattcatgaagaaatcccatttgaggcctcaagccacgcacacctcatgaaaagtttcgacttagaaaaacaaaaagaagaattagaacgatacatcactttagccactatatacgccgacgacaaaaaatcactaaaagaattactaaaaaatgaatctctactagatgaaaatcagaaaaatgtcattctcacactaccaacgaaaaaatgggcacctttgtcctataaacttctacaaaatatagtttatactgacgactacggcgtagtacattctatactagacataatgaaagaaacgaaccaaaatttccaaatggtgctacataacgaacaataccatttcaaagaactaatcgaacaagagaaccaaaaatttacccaagaaaaaacaatcgaagatcttatagaagaaaaattggaatcaattccaagtctaacacagagatcaatacgtcaaacactactaattattgatgacatcattaaggcatcacaccaaaaagtgccagaaaaaattttcatagaagtaacacgcaataacgacgacaaacgaaaaggacaagatggcaaccaacttgcacgagacaaagaactcaaccgcttcctaactaatctactaaaggacgaaaaagctaaccaattctgcgacgtatcgcaacttctaaaagacttagaagaagtcgataaagtcaagctgaaagggaaacacatctacctatattttaagcaactcggaatagatctatacacaggaaaaaaaatagttttaaaccaattactaacttccacaaaatacgacaccgaccatataatcccgcaatccttgataaaagacgactcactagacaacctagtcctagttgaacgcgaagtcaatctaaaagttaaaggcaatcactatcccgtaccatcacgaatacaagacgaacaaaaaaaactatggcactttctcttacaaaaaaaggcaataagcgaaaaaaaatacggtaacctgaccagaacctccaaaataaaactcgaagaagtagaagatttcgtagcaagacaaatcaatgtaatcaattattccaatgtgataatacgggacattctcaaactcaaatacccacacacagacataattttttcaaaatcacaatacccttccttcattcgaaaacatctgaaaatagtcaagaacagagacgtaaacgacgcacaccacgcagtagatgcatacctaaatgtcgtctcaggcaatttactatcaaccacattctcaaaagcctatatcaggaaaaaatatatccaaatacaggacggcgaaaaagagacattcaacatggaaaccatactagaaaattactttaaaaataatgaaaatcaattaaaaataaaaacaaactgcctcaggagagatgcactaataacattcaaagtggactacttcagcggcgaattttacggccaaacgcgactaccaaaaggaaatgaaaaccttatacccataacactaaacgaagacaaccctatgtccgacaccagtaaatacggaggctatacgaaccttgcgcaagcatacctattcgccgtaagctatcaagaggacggtgagatgaaaaaagcaatcctgagagtaccatatctatacgacactttatataagaacgatagtgataagttactatcgaaagttctagacaacccaaaagcaacaaacatacaaatactgcgtaaaatccatctaaaccaaaaaataagatttaacgacggtatatatttgctatatacaaacgaaaaagatagaaacaaatataaaatggcatatcaaaactacatagacaatgattacctatactatttacattgggccaacaaacacttagaggaactattagacaatcaagaaaaacaaactttcatttacaactcaaaaaacgaccaattcgaggtatcgaaagccaaaaataaagaaatattccaatatttactacaaaaaaccaaagccaaagtctatgacacttgcaactacatagtgaaagcgagagagaccaatatcgaaatcttcgaacaactaactctaaaagaacaaataactatgattaaccaatggatcaagatgatgagtcgagactgcgaaaaagtaaaattcgatgctcgtttcacaaatttctcaaactgtcttctcagactctcaaacaatattaacccgaaagattcaattacaatcatatatgaaagccccaccggattattcaaacatgaagtgaaaatatga

SEQ ID NO: 8798 - RNA, 4035 nt, synthetic construct
  misc_feature 1..4035: note = Cas9 variant
  source 1..4035: mol_type = other RNA
atgaagaaaaccaatccatatatactgagtttagacatagggacagcaagtataggatacgcctgtatggaccttgactttaatatattaaaatatcatgataaagacgctataggagtactaacatttgaaggggccgacacagcagctgaaagaagaggtttccgcacaagtagaagacgcaaaaatcgacgcataaaaagacttggattactacaagaagtactagcaccactcgtgaaaaatccaaactattaccaattacttaacctacataaatggaaaaatagtaatgaagacttcaaacataggtccttatcagaagtactaaaaaccctaggcaaaaatccaaaaacatacccaacaatctaccatctacaacaagatatacaaaatcaccccgagaagaaattcgaacccgaactcatcttcctagcactctaccatctagtaaaatacagaggacacttcctattcaataacctctcattcgataaaggaaaaaccgtagacaacgaagcacagctctcagaactactagaacaataccaaagtattaacccatacgaaggatcaatattcaataaagatataaaagtaattgtcgacacactcaaagatgaccaacttacgagaaacgacaaatcaaaagaactgaaacgtaacgtatccaaaactcacgcagaactatttaaaatgctcgtcggactgaaattcaaacaatccatactctttgaaaacatggaaaacgtagaagacataaaagaatccgcaacaggaagtgacgccataagtctgagtgatgactactacgaaaacctaagcgaatttcttaccgacgaacaactaaatttcatagaatctgccaatacattctttatgggtataatgctagacagaatattaaaaggagcaacatccataagcgctgcaaaagtacgagattacaaaatatttaaaaatcaattaaaactaataaaagacatcgtataccaaaacaaatatgataaataccacgaatttttcgtcacttcaaaagaagacatgcgtgcttatcaagaaaatcctgatgcaaaaacattcggaaaattatctaaatttgaccaatacctaatccatccaaaagaccaatatgcaaaactgatgaaagatttgaaaggtatcgttcctaagaaatacactgaagtgctaaacctaatagatgaacaaaaattcctagtcgtacaaaacacaacagacaatgcatccatcccatatcaaaacaacgtatttgaagcggaaaatattttaagaaaccaacaaaaatactacccagaaattaccgaagaaatgataggcaaagtaataaatctgatcagcttcaggattccatactatgtgggaccactaacaaataaaaacggacaatcggactttgcctggatgataaggaaatccgacgaacaagcactcccatggaactttgacaaagtaatcgataaaagtaaaagcgcggaaaaattcatcagaagaatgacttccaaatgtacatatctactcgaagaagatgtcttaccgaaacattccttactatatcaagaaatggaagtactaaatgaacttaacaacgtacaactcagaggagaaaatgaacctaaacatcgtattcaccgtttagacccaaaagtaaaacagtttatctaccataacttattccagaaaaagaaaaatgtcactcataaagatctaataacacttctccaaaattctgaacataggaacaccctcaacaaaacatctggtcaaaaattgaaagttttcggcacgcaaaatgattctaaattcgcctcaaaattaagtacatacaacgacatgaaagcaatattcggaagtgtagaaaacaaacgacaaatgatcgaagaattagttttatgggtaactatatttgaagataaagcaatcctaaaacaaaagattggagaaaaatacccaaacatcacagaaaaacaactaaatcaaatagtaaaactaaattacagcggttggggcagattaagtgaaaaacttctaacaaaagaagtaaacggccgatcactaatagatttaatgtattcaaccgaaaacaatttcatggaaattatcacggacaaaactctaggattcgattgctttatcaaaaattctaataaagtcaaaaacgctaaaatcagctataaagacgtcgcagaattacgaacaagcccggccctcaagaaaggaatttggaatgcaatcaaaatggtaagagaaataagcaacttatttggagcacccgagaaaataataatcgagttcgcaacagaggaccaagtaaaaggaaaacgacaaaaatcacgatcagaactttgggatgatttagtcaagaaaaacaatttaaaaagaaataaagaatttaaaggactattcgaagaaatcaaggcttacccagacctagatttctcaaaccctaaactatggctctacatacatcagaatggtaaatgtatgtacactaagaaacctatagatcttgaaagactcctatcagatacaaacaaccaattatatgagattgaccatatacttccccgaacgtttgtaaaagatgactcgataaataacaaagttctagttatacaaagcgctaaccaaaagaagtctggcgataaaatgcctctcgaaattttcgacaatcacgtcctagtaccattctggaaaatgctatacgaaaacgatttaataagcagttccaaactatccaaactaatgaagaaagagttcaacgatcttgataaagaaggttttatccagagacaacttgtagaaacacgacaaataataagtcacgtaagtgactttctaactgaagaatatccttccacaactgtcgtgcccatgaaagctaacgtagtcagcgaactacgaaggaaattcgatatcccaaaaataagacaactaaacgattggcatcacgctgtagatgcatatttgaacggctttgtatatcaagctgccagagtattttatccaaaagttaacttatttgaatttaatttcaaatgggaaaaagtacgcgaaaaatggcgacaattaggtgaatttactgaaaataataagaaacgcgagttctttttattcaaaagaatggaaaactacgtgaatgaacacggtgaaggcatgataagcaaactgatattcgacctagataactttaagttcaactacagcagaaaagttgaatcaacagaatccgcattctacaagcaatcagcattctccccaaagaatacaacagcccagtacgacagcgacaagaataagaccgctatttacaaagaaatgaaaaacaagcgagggatcgtcgtcagctatacatacgtcaagaaagaccaagagctcataggatatggagtatttaacgagacagtatttgaatacgtaaacaatgccgatgtagacatgaacacgagggcgctaaaaatagtccgaaaagcattcccgaaattagacatcaaaaaggttcaatatctcttttccatcaacaaaggtgataccctcctcgtaaacggtcaccccttcctcttcgtatctgcatatgaaagaataaacggaaaacaacttgaatttgacatagcaatgcaacgaaaaataaaacaagcactaagtccatacaataatatgaccgagcaagaaaaagtagagttctacaaccaatttgccgaaaaagtcatagaagagtttagaaatagtataggacttcaaagcagagatagaaaagtaaatttaatcaaaaatctattcaataatacagagaaaagcaatgattcgatgacgcaaagcatattagaagtcctaaaaatgaccaaagtatcagcagaaagaagcaaagaactcaagattaggtggaacggccaaacaccaaacaccttcatcgacaccaaaaataacgcagaaatacaatacaaaagcatcactggactaaaaacaacaaaaccaaagtcaattttcaaactggcagaatctaagaatgaactttga

SEQ ID NO: 8799 - RNA, 4038 nt, synthetic construct
  misc_feature 1..4038: note = Cas9 variant
  source 1..4038: mol_type = other RNA
atgaaaaaaccatattccatagggctagacataggaacaaactcagtaggttgggcagtcgtaacagacgattataaagttcccgcaaaaaaaatgaaagtgttaggtaacacagataaatcacatatcaaaaagaacctcctaggagccctactatttgacagcggaaacaccgcagaagacagacgcttaaaacgaaccgcgagaagaagatatactagaagaagaaacagaatcctctacctccaagaaatattttccgaagagatgggcaaagtggacgactccttcttccaccgattagaggattccttcttagttaccgaggacaaaagaggagaaagacatcccatattcggaaatctagaagaagaagtcaaatatcatgaaaattttccaacaatttaccaccttagacaatatttagcagacaacccagaaaaaacagatctacgcctagtatacctagctctcgcccacataataaagttcggcggccactttcttattgagggaaagttcgatacaagaaataacgacgtgcagaggttattccaagaatttttagcagtctacgacaatactttcgaaaactcatccctacaagaacaaaacgtacaggtcgaggaaattttaacagataaaatctcaaaatcggcaaaaaaagacagagtgttaaaactattcccgaacgagaagtcaaatggaagattcgctgaatttttgaaactaatcgtaggcaaccaagcagactttaaaaaacattttgaacttgaggaaaaagcaccactgcaattttcaaaagatatttacgaagaagaactagaagtccttctagcacaaatcggtgataactacgcagaactcttcttatcagccaagaagttatacgactcaattttgctaagtggaatactcactgtaactgatgtatccacaaaggctccactatcagcttccatgatacaaagatacaacgaacaccaaatggacctagcacaactgaaacaattcattagacaaaaactaagcgataaatataacgaagtattttcggacgtatcaaaagacggctacgccggatatatagatgggaaaacaaatcaagaagcgttttataaatacttgaaaggcttattaaataaaattgaaggatcaggctacttcttagacaaaatcgagagggaggatttcctaagaaaacagagaactttcgacaacggatcaataccacatcaaatacatctacaagaaatgagagcaattatacgccgtcaggcagaattctaccctttcctagccgacaaccaagacagaatagaaaaaatacttacattcagaatcccgtactatgtagggccattagcaagaggtaaaagcgatttcgcgtggctatcgcgaaaaagcgcagacaaaataacaccatggaattttgatgaaatcgtcgataaagaatcatcagtggaggcatttataaaccggatgacaaactacgacctatatctcccaaaccaaaaagtactccccaaacattcattattatatgaaaaattcacagtttataacgaactcaccaaagtaaaatataaaaccgaacaaggaaagacagcattctttgatgccaatatgaagcaagagatttttgatggcgtctttaaagtataccgaaaagtaacgaaagataaactaatggacttcttagagaaagaatttgatgaattcagaatagtggacctcactggactagacaaggagaacaaggcgtttaacgcaagttacggtacgtaccatgatttaagaaaaatcttagataaggatttcctcgataacagcaaaaacgaaaaaatactagaagacatagtattaacacttacactgttcgaagatagagaaatgataagaaaaagattaaaaaattattccgacttattaacaaaagaacagttaaaaaaacttgaaagacgacactataccggatggggtagactcagtgccgagttaatacacggaattcgaaacaaagagagtcggaaaactattttagactatttaatcgacgatggtaacagcaatcgaaatttcatgcaacttataaacgatgacgcattgtcattcaaagaagaaatagcaaaggctcaagtaatcggcgaaacagataacctaaaccaagttgtctcggacatagcagggtcaccagcaataaagaaaggcatactacaatctctcaaaatagtagacgaacttgttaaaataatgggacatcaacccgaaaacatagtagtcgagatggcgagggaaaatcaattcacaaaccaaggacgcagaaactctcaacaaagactaaaaggtctcacagatagtataaaagaatttggctcacaaatactaaaagaacaccccgtagaaaacagccaactgcaaaatgatagactattcctctactatttacaaaatggtcgggatatgtacactggtgaagaattggatattgattatttatctcaatacgacatcgaccacatcataccacaagcctttataaaagacaattcaatagataatcgagtattaacctcatcaaaagaaaacagaggcaaatcagacgatgttccatcaaaaaatgtagtcagaaaaatgaaatcatattggtctaagctcctatcagctaaattgataacacaaaggaaattcgataacttaacaaaagcagaaagaggaggcctgaccgacgacgataaagcaggttttataaaaagacaactagttgaaacaaggcaaattacaaagcatgtagcacgaatattagacgaaagatttcatacagaaacagacgaaaataataaaaaaatcagacaagtaaaaatagtaactttaaagagcaacttggtgagtaacttcagaaaagaattcgaactgtataaagtgagagaaataaacgattaccatcacgcccatgacgcatacctaaatgctgtaatcggaaaggcattactaggagtatatccacagcttgaaccagagtttgtttacggcgactacccacactttcatggacacaaagagaacaaagcaacagcgaaaaaattcttctactcaaatattatgaactttttcaaaaaagatgatgtaagaacagataaaaacggagaaataatatggaaaaaagacgagcacatatcaaatataaaaaaagtactgagttatccacaagtaaatatagtaaaaaaagtagaagaacaaacaggaggattctcaaaagaatcaatactacccaaaggtaacagtgacaaacttataccacgaaaaacaaaaaaattctattgggacactaaaaaatatggcggcttcgattcaccaatagtagcatactccatcttggtgatagccgatatcgaaaaaggtaaatcaaaaaaattaaaaacagtaaaagcattagtaggagtcacaataatggaaaaaatgacctttgagcgagacccagtagcatttctcgaacgaaaaggttacagaaatgtacaagaagaaaacatcattaaactccccaaatactccctattcaaattagaaaatggaagaaaaagactactggcaagtgcacgcgagttacaaaaaggtaatgaaattgtcctgccaaaccacctaggaacactactttatcatgctaaaaatatacacaaagtagacgagcccaaacacttagattacgtagacaaacacaaagacgagttcaaagaactcctagatgtagtttcaaatttcagcaaaaagtacacacttgccgagggaaacctagaaaaaataaaagaactttatgcacaaaacaatggcgaagatttaaaagaactagcctcttcattcatcaaccttctgacctttaccgccattggtgcacctgccacctttaaatttttcgataaaaatatcgacagaaaaaggtatacctctacaacggaaatactaaacgcaacactcatacatcagtcaataactggcttgtatgaaactagaatagacttgagcaaactaggtggagactga

SEQ ID NO: 8800 - RNA, 4038 nt, synthetic construct
  misc_feature 1..4038: note = Cas9 variant
  source 1..4038: mol_type = other RNA
atggaaaactacaatattgggttagatattggaacaacctcagtaggctgggccgtcgtaaacgatgccacgaataaagtcatgagaaaaggaggcaaagcactatggggagtacgcctgttcgatccagccgtaacagcagaagacagacgagccaaacgtggcacgagaaggagatacgataggagaagggaaagaattaaacttctacaagatgagttcaaagacgaaataaacaaagttgattctaacttctttcttaaattagaagaatcaaaatatacttcaaaagacatcaaaaataaaaccgttttaatatccatggaagaagaaaaagccataaagaaatacaatcaagaatatccaaccatttatcatttaagacaaaaattaatgaacagcaacgaacaaatggacataagactggtgtacttagctattcatcatataataaaataccgaggcaactttatatacgaagggaactccttttcagtgaacaatctaaatatagataataaactcaaagaaattttcttatcattatctgaagatgtagatgaattggacataagcgaagaatgcataaataacataaattataaacagctagcaaacatctttaacgaacaatctaaaaatgatctcaaagttaaacttacttcagaactcaccagttatagtctaaacaaaaacttcatatccgaattttgcaaactaataatcggaaacaaattcagcgccaagaaattattcaacctagaaacagacaacgatgtaagcctcagcttcgacggcaccgacttcgaagataaagcaggagacttagagagcttactgaacgactatttagaagtgttggaacaactcaaagaactatatgacatggtcttccttaagaaaatattcggtggtagtaaagaaactacgatatcgggactaatggtcgaacgatataaccaacataagaaagacctcaaactactgaaagacacattttcctccgatagaaaaatatacaacaaaatatttagatccaagaaagacataaaagacgataaagatatgtgcttgtatgacctatacatccacaataaactagaaacaactgacttcctaaaagaaatcaagaaatacgtgaacacagataatttcattataactgacgaagactttctaaaaaggctagaaaataatgaagtactaccaagaataacaagtaaagagaacggcaaatacccataccaattaaataaagacgaacttgtgtcaataatagaacatcaaggaaaacactacccattcttgttaaataagacagacgacggaatctacaaattagtacgactattagaatttcgaatcccttatttcgttggacccctagtatcaaaagacatgagtgaaaacgcatggatgctccgtaatgaaggaatgcaaggagtccacataaccccgtataacttcaagaaagtaataaacctagataaaacagcagaaatctttataaagcgcatgatatcacattgcacgtatctcctggatgaagaagccctacctaataacagcatcttatacagcgaatttaaagtactaaacgaactaaaacaaataaaagtcaacggagaacatctaacaaaagatgaacaacacaaaattattgaggaactttttatgaaaacatcaggaactataaccgaaaataaatttagagagttcctacttaacacattggactataatttctatgaaaacgaactaaaaattaccggctactcggctgattgcaaattcgcaaacaacatgcaatcatacatagacttctttggcgaaaatggaatcttcgaaggcaccagctacaatactaacgatgctgaaaagataattgaatggatcactattttcgatgacaaagacatcctcaaaagaaaagtagaaaatgaatacccagaattaaaatctaatcaagttaaaaacatattaaacaagaaatactccggatggggacgactaagcagaaaactattactagatctacgtgtactcgacaaagaaactgatatacccaaaagtatcatggacttaatgtacgaaacagatgaaaactttatgcaaatcataaataacgacaaatataatttccaaaaactaatcgctaaagaaaataaaatcgaaaacaccagcaatgacctctcatacgatgtagtagagaatctcgcgacaagcccagcgaccaaaagaggaatataccaagctctaaaagtagtcaaagaaataaccacctatatggggtatgaacccaaaaatataatggttgaaatggccagaggagatgaaaagaaaatacgaaaagatgaccgcaagaaatacctacaaaaactgtatgacaatataaaagacgaagtcgactcaaactacaaaaacttaaagaaagaactcgcaaaagaagagaaaattgacaccgacaaactatatttatactatctacaagaagggaaatgcttatattgtggaaaaccaatcaatgtcgacgatctaaatactaaaaacagtctatatgaaatagaccacatattaccaaggacacttattaaagacaacagctgggacaaccgcgttctagtctgcagaggatgtaatcaaaagaaagcagcctcattagtgctcccaaaagagttccgcaacgactatactaaatcaatctggatcaggcttaaaaataacaaacttatgtctaacaagaaattctacaatttaacaagaaaatcatattctgaagaagatattaaaggattcataaatagacaactcgtcgaaactagacaaataactaaacacgtagcaaatatactaaattgtttttacccaaaaacaaaaatagtttatttaaaagctaatatctcacactcataccgagataaatacgacttattcaaatttcgcgacataaatgactaccatcacgcacatgatgcataccttgctgctacattaggaagctatcaagaaaaatacctccattacgatcttgactacaacaaaataaatgagttcaatgaaaaactaatcaaaaatgaagactataagagactgcattatggaattgtagtaaatagcctcgacgaagagttccaatccgcctttgcagaaatagcaccaagactgataaacgaagaaacaggcgaactcctatttaatgccaagaaattcaacgatttagttgaagacacactctataggaatgacatactaattagtagaaaaacagaaatcagaacaggcaaattgtacaaggaaaccatctataaaagaggtaagggaaatataaaaataaaagaaaatatgccaaccgaaacgtatggcgggtactcaaacatggaaacaagttatctgacacttgtaaaatacggcaacaagacaaaattaatcggaatccccatgagcatcgcaaacaataaggatgtaaaagtaaaacttgattttatcaaagaacatttagatctcaaaagtctagataacatagtaatcctaaaagacaacataccttatgacgtaagtataaattacaaaaaccaggacgtatatgtaaagggttatagtaccgcaaacaaaaattgcgaactatcgaacgcccaccaacttaaaatcaagaaagacatgatgaagaaatgcaaatacgtcctgaacaaagtatacaaaaacaaatatgatgacatcaccaacatggacatagaaaacgcaataacttttataaactacctattcgaaataaaaatcgagttcccattgttctccaaagaaataaccaaaatacaggataacataaatttaactgaatgttccttcgaacaattagcaaacataataaaacaacttctaataatctaccactgcaattctaaaaacggaaacctaaaagaatttggactttcagatcgaatcggacgactctccggtgcaaatgtcacaggaggagatttcatctttacaagtgtcacaggcctaaaagaaaagacagcatcctacgacggagaatga

SEQ ID NO: 8801 - RNA, 4038 nt, synthetic construct
  misc_feature 1..4038: note = Cas9 variant
  source 1..4038: mol_type = other RNA
atggttgaaaaatatggaataggtttagacatcggtacttccacattaggctggacctcagttgacgaaaacggcaaaatacaaagactgaaaggtcaaacagcactagggacaaggttattcaacgaaggtcaaacagctgaagaacgtcgaggttttagaacaacacgccgccgtattcaaagaaggagatggagactacgattattacgagaaatctttgatgaacccatcggatcagtagacgcgggatttttcgctagacagaaaatgtcatcactaagtccacaagatgatcgcttcgaagacacataccggctgtttaacaaccaaactgataaagcctttcacgatgaatatccaactacgtatcatctaagacaagcgttaatgaacagtgaccgacaattcgacataagagagatatacttagctatacatcacattgtaaaatatagaggaaattttcttcggtccggcaaaccagcggatttcaaaacaggtaaactagatctaaaagaaaaatttgaagaaattaacgcagattggcaaacattaatatcggaggatgccccgcaactaccagtcgatgacctaacaacaattaaagcagtgctagtggatggatctagatctcgtagtgatagacaaaggggtctggtaaaactatggatggccaatgaaactgtagagaaaaactggaaacctgttatgactgaattagctaaagcaatattaggactcaaaactaaattatacttgttgacagggctagatttacctaaagaagaccaaaaagcatggacattctcactagacactctagaagaccatcaaggagacatcgacagcttctttgatgatcatgcccaacaactaatcgatcgtttagcagaacttcgggctatgatacaactgacagaaataataccgagcggactgaatttctcgcaatcaatggttcaaagatacgaagcacatagaagccacttagaaatgtacaaacaatacgctttagaccaaactgatcctaaaaggacaaaagccttgcgggctgcatataacgcatatatcgatcagcatgaaattgcagacgatttctatactgccgttaaaagagtcaccaaagatgatcaatcagaaacagcagaagaaataaacagactaataggcctagaacaatttatgcccaaacagaggacaaaggaaaacggagtaatcccttatcaggtacaccaacaagaacttgaccaaataatagcacatcagaaaaagtactatccatttctaggaacggaaaatccagtaatagatcaccgagaatcgcaaccttatatgctagacgaattagtatccttccgggttccatattatgtaggaccaatggtagctgcaaatcccgaattaaaaacaacagaaaaccctttcgcctggatgataagaaaagctcaaggcgaaataacaccatggaactttgacgaaaaagtagatcgtaaaggcagtgcaactgctttcatagaaagaatgaaaactacagatacatatctattaggtgaagacgtactaccacaacaatcactattgtaccaaaggttcatggtcctcaatgaacttaataacatacgaatagatgacgagctactaacaacaaaccaaaaacaatgggtattcgacagagtctttaaaggaaaaggtacaattagtgcaaaacacctacaagacgcattaaaacatcacggcgaaacagatggcttaccaaaaatatccggattagcagatccaaccaaatttaacagcgcactaacctcctaccgtgatttccaaaaatggttaccaaacgacatagatcggaaagacagaactgcagatatagaaactataataaattggtccacagtgttcgaagatacacacattttcgttgaaaaacttaaagagatcgaatggctaacagctgaccaaaggagaagaatagcatcaaacagatatcggggttggggtagactatcaaaacacttattaactgaaataaaagatgaacaaggattatccataatggaccaattatggagaacacaacacaatttcatgcaaatcgtacatgagccggattatgctaaacaaatcgaggcagcaaacactgtcggaatggcaaaacaagatatcggaaccgtaataaacgatttatacacaagtccgcaaaataagaaagccattagacaagtactcgccgtagtgaaagacatacaaaatgcacaccacggagtcgcaccgtcatggatatttatggaagccgctcgaggtgcagatcaaaacccacaaagaagtaggcaaagacaacgtcagttacaagatttatatgctaaaacagcagcagatctagtagatacagaagtacaacaagagttaacagacaaaattaaggataaagcaaactttactgatcgtctaatgctatatttcttacaaaacggacaagacatgtactcaaaagagaaacttaacatcgacaggctaagtgagtacgacatagaccacatattaccacaagccttgataaaagatgactcattagacaaccgagttttggtccatcaatcaatcaaccgaaataaatcagacacatttgcctcagaaaaatacggagcaaaaatgcaaggtgcctggcaccaatggcgagcggcaggactcatcagtgccagaaaattacgaaatctagaaatgagaccagatgaaatcagcaaatacgcaaccggcttcatacgacgacagcttgtcgaaacaagacaagtaatcaaacttgtaactgaaatcctatctcatcaatataaccctgaggaaacaaagctagtttcagtcaaagcaggcctatcccatgaacttagaagagaggcaggactaccaaaactcagagacttaaacgattaccatcatgcaatcgatgcgtacctagcagcaagaataggaacctatctattgaaacgttatccgcggcttgagagatttttcgtctacggtcaattccaaacatcaagattagatctaaggagattcaactttattcatgacctagttaaatcaaaacaaggagtgatagtagattcagacactggtgaaatattatgggatagacaaaaagatatcgactacattaaacatttaatgggacttaaacatctattagtaacacatgaagtctacgactcagcagcagaaatgtatgcccaaacgatattcaaagccagtgacaatgatagcaaagtccttataccaactaaaaatgatagaccgactgcaatctacggtggttatactaagcggagaaatggatatttagcaatccttaaaattaccgaaaagaaagctgaaacgtacagagtcgtaggtgttccaacattatacatgagtcaattagcaaccgcacgatcccactcggtagaagcagaaaaggcactactaaagagcttaatggctccagagatcttaagtgaaagcaaagtcgtctcattcgaagtggtagtatcacacgtccatttaaaccaattagtaagagatacagtatttgggcctgcgcactactttggtttgggaccctttaggtatgtaagaaatttccatcagctagtcttgccatttaaagatcaagagatattagttaaaaggacacctacagatgaggaactcaatactgtttttgaagatatttgttggcaagtggaaaactattttgcagtatttgacataaatggatttcgaaacgctttaaagaaaagtatagataaatttgaacaattaccaattgaaaacgtgtttaaagataagaaattagtgacccaaggaaagaaagaagtcttagcatttgttatgcagggtctccatgcgaacgcttcatacaggaatttaaaagtctcattgggaataaaaacaccattaggtcaactacaactaacaaaattcatgttatcaagagatgcagaattaattgatgaaagcccaactggactgtttcgaagaataagaaggctaaaagatttatga

SEQ ID NO: 8802 - RNA, 4038 nt, synthetic construct
  misc_feature 1..4038: note = Cas9 variant
  source 1..4038: mol_type = other RNA
atgggtaacaaacttaggaacgtagatgactactacttaggactagacataggtacggaaagcgtaggttgggcagtaactgacaaatactacgtaatacctaaatttaaaggtaacgccatgtggggcgtacatttgtttgacgaaggagaaacctcagttaaaagacgtggatttcgatcggctagaaggagaacacaacgaaaaagagaaagactagcattgttagaagcgttattcgacgaagaaatatgtaagaaagactgtactttcttccgacgattacatgaatccgacctttggcctgaagataaatcaggagacgataaatatgcagtattcgcagacgaaaactacacagataaagattttcacaaagaataccctacaatctatcatttaagatatgaactaattaaaaacaaagaaccccatgacgtcaaattggtctttctggcactacatcacataattaaaaataggggacatttcctattcgacagcttatcaagcgcggaagattttaactctgcatacgagactatgtgtagctacctatcagataatgaaatacaacttaattgtagtgacatagaacaattcaaagccatactaaaagataggagacaaggtaagatcgagaaaactaaaaatttagcctcacttttcggaataacaaagaaaagcgaccccgtatcttacgcagtaatggctgtcctatcaggttcgacagtaaaaatgtgtgatctatttggagatgacgaattaaaaacagtcgagaaaaacaatatatcattcgctagcggttacgaagaaaatgaagaaatatatgcgtcagtactcggagatcgatttgaacttgtcaaaatacttaaagcagtatatgactgggcagtattagcagatatattagatggaaagaaatacatttctgaagctaaggtagcggtttatgaaaagcacaaaaatgaccttaaaaccttgaagaaatacgtaaaaacatatctaccagaaaaatacaatgaaatatttaaaatttctgacggaaagaaagacaactacgtcgcatacagtggacacataaaagaatccggaaaaaccggagaactcaagaaaacatgcaattcggaaaatttttgcgcatatctaaagaaaactttgggcaaaaatgccgatctctcatacaaagaaatgttcgatgaaatcgaaaacaaaacatttatgccaaaacaagtcacaaaaagcaacggagtagtaccgatgcaagttaacgaagaggaacttaaagctatacttgacaacgccaaagactacttatcattcctaaacagctgcgacgaaaatggagtatcagtttatgataaaattatcaaaatcttcgaatatcggataccatattatgtaggacccttaaatacacacacagagaacagttggctgaagagaaaagatggtgtaaaaatatacccatggaacttcgacgacgtcgtcgatattgactcctcagctgaaaaatttataaataacttaacgtccaaatgcacatatcttcccgaatgtgacgtaattcccaaatgtagcctcctttatagtaaatttacagtacttaacgaaataaacaatctaaaactaaatggcgaagacattccagtggaattgaaacagggaatatacaaagacctctttatgacaagaagaaaggtaacagtaaaacaaataaaagattaccttaaagccagaggatgttatgataacaacgacgtattatcaggaatcgatacaacagttaaaagctcactaaaatcttatttcgatttcaaaggatttgaaagccttaccttcgatgataaagaatcaataatagcaagttcagtcatattcggggacgataagaaattgttaaagaaacggctgaagaaactatttccagaaaaactaacagatgaagatatcaagaaaatatgcaaacttaaatatacaggctggtccaggttaagcaaagaatttctgtgcgatgtggaatttacgtacaagaaaacaggcgaagtaatgaatgtaataacagcactatgggaaaccaattataacttaatgcaaatactttatagcgaagatttctgctgtgatggtgacgaaaagaaaaaccttaacgataaactagacgagctcagctatacaggagaccagcacagcctaagaaaagccgtggatgccctctacgtaagcccgaaagtcaaacgaccaatactcagagcactactaatagcaaaagaaatcgaaaagatacaggaaagaccaccgaagaaaatattcgtagaagtcgcaagaggtatagacaacagagaagaaagacacagagacagcaggaaaaacagacttatggaattatataaaaattgcaaaaaggaagcagaaaaattctgcccttacttcgacgcactcagtaagaaactttcagacgaagatgaaagcaaattaagacgagataaactatatttctattatatccagttaggcaaatgcatgtacacaggagaggaaatatcgttaggagaactaatgaacggaaatggacgttttgacatagatcatatatacccaagatcgaaaataaaagatgattccctaacgaataaagtcctagtaaataaaacagtaaacaacaataaaacaaatgtctacccgattgatgcagccatacagtctaaaatgagtccatactggcagatgcttaggtcatcaggattaatcagtgaagaaacatataaaagactaactagaaaaacaccattaacagacgacgaattatcagcattcgtcagccgtcaactaactgagacacaacaatctacaaaagcagttgcccacatcttagagcaactctatcctaaacctaagacagaaatcgtttacgtaaaagcagctctagtacacgcatttagacaatctaacgacatgctaaaatgcagagaagtaaacgatctccaccacgcaaaagatgcttatttgaacatagtcgttggtaatgcctacaatgttaaagtcacacacaataaagtaaacttcataaaaggcttgcaaaacaacgacaaaggatacacagttaacccagaaaaatttttcagccatgacattccaggcgcctggagcgtaaaagattccatgaacacggtaaggaggtttatgaacaaaaacaatataaggtacactagatttcctagaaagaaacaaggtggattatttaaaataaacccgttaaagaaaggaaacggccaagtgcccttaaaagcatcgggcgccagatcctgtatcgaaaaatatggcggatatgacaaggcaacctcagcttatttctcatacgtcgaatatacagataagaaaggcaaagctgtaagacaaatgttcccagtcaatttatatgaagtaaaagaatacgaagcagacatgcaaggatttgtaacaagtcgaatcgccgaagcatctaacgttaaaatcctaataccatgtgttaaatatgacgcgtgtatatcattcgatggatgccgaatgtttataacgaagaaaacagggaatcgaataggatacaaacctggaatgcagctagttcttggatacaaatatgaaaaatacatccgcaatattgaaaactacttaactaaacacaaagatagagagataatcccaagagataatatatccgcggaagaaaacatagaattatacgacatcttaaccggaaaaatgctaaatacagtactttcagtaaaattcagtggaataggaaagaaactagagaaaagacgagaaaaattcgtattatgctcacctgaagaacaatgctgtgtcctaaatgaaatacttaaaatcttacacgctaatgtactaagtggcgatctctcattgattggagaaagtccaaacacaggcacgatgaagacaaacgcaaaattcagcgaaataaaggacgtacactcaataaaattaattaatcaatcagtcacagggctctttgaacaagaaatagatctccttaaatga

SEQ ID NO: 8803 - RNA, 4038 nt, synthetic construct
  misc_feature 1..4038: note = Cas9 variant
  source 1..4038: mol_type = other RNA
atgggaaaaccctatagtatcggactagatattggaaccaattcagtagggtgggcagttgttacagatgattacaaagtccctgctaaaaaaatgaaagtcttaggcaacacagacaagcaatccatcaagaaaaaccttcttggcgcattactattcgatagcggagaaaccgcagaagcaacccgactcaagcgaactgcaaggcgtagatatacgcgccggaaaaacagattaagatatctacaagaaatatttacaggagaaatgaataaggttgatgagaattttttccaaagactagatgactcattccttgtagatgaagacaaaagaggagaacaccaccctatatttggaaacatagcagccgaagtaaagtaccatgacgatttccccacaatatatcacttaagaaggcatctagccgacacatcaaaaaaagccgatcttagactagtatacctagcattagcgcacatgataaaatttagaggtcacttcctctacgaaggagacctaaaagccgaaaatacagacgtccaggctttatttaaagatttcgtagaagagtacgataaaacgatagaagaatctcatctatccgaaataacggtagacgcactaagcatcttaaccgaaaaagtgagtaagagcagcagactcgaaaacctgatcgcgcattaccccactgaaaaaaaaaatactctattcggaaacttaatagcactatccttagacctccatcccaatttcaaaacaaactttcaactatcagaagacgcaaaactacagttttcaaaagacacctacgaagaagatctcgaaggattcctaggagaagttggagatgaatatgcagatctatttgctagtgctaaaaacctatatgacgcaattctattaagtggaatattaacagtagacgataactcaacaaaagcgcctctaagcgcttcgatggtaaaacgctacgaagaacaccaaaaagatttaaaaaaattgaaagattttatcaaagtaaacgccccagatcaatataatgcgatattcaaagataagaacaaaaagggatatgcatcctacatagaaagtggagtcaaacaagatgaattctataagtatttaaagggaattctcctcaaaattaacgggtcgggcgacttcttagataaaatcgatagagaagacttccttagaaaacaacgcacctttgataatggcagcataccacaccaaattcatttacaggaaatgcatgcgatattgagaagacaaggagaacattatccctttctaaaggaaaatcaagataaaatagaaaaaatactcacattccgaattccctactacgtcggaccactcgcaagaaaaggaagcagattcgcatgggccgaatataaagcagatgaaaaaataacaccatggaacttcgatgacatactagataaagaaaaaagtgcagaaaagtttatcacccgcatgactttaaatgatttatacttacccgaagaaaaagtactacccaaacatagtccactctacgaagcatttacagtctacaacgaactcaccaaagtaaagtatgttaacgaacaaggtgaagccaaattcttcgacacgaacatgaaacaagaaatatttgatcatgtattcaaagaaaacaggaaagttacgaaagataaattactcaattatctcaacaaagaatttgaagaattcagaatcgttaatctcacaggcctcgacaaagaaaataaagcttttaattcctcattaggtacatatcacgatctccgaaaaatattggacaaatcattcctggatgacaaagccaatgaaaaaacaatcgaagacatcatacaaactctgacattatttgaagacagagaaatgatacggcaaagattacagaaatattctgatatattcacaaaagcccaattaaaaaaattagaaagacgacactatactggttggggaagactaagctacaaactaatcaacggtatcagaaacaaagaaaataaaaaaacaattctagactacctgatagacgatggttacgcaaaccgtaactttatgcagttaataaacgacgatgctctctcatttaaagaagagattgcacgtgcacaaattatcgatgatgtagacgacattgcaaatgtcgtacacgatcttcccggttccccagccataaaaaaaggaatacttcaaagcgtaaaaatagtcgatgagcttgtcaaagtgatgggacacaacccagcaaacatcataatagaaatggcccgtgaaaatcagacaaccgataaaggacgacgaaactcacaacaacgactaaaactactgcaggactcattaaagaacttagacaatccagtaaacataaagaacgtcgaaaatcaacaactccaaaatgatagactattcctttattatatacaaaacggaaaagatatgtacactggagagacactcgatattaataacctatctcaatacgacatagatcatataataccgcaagcattcataaaagacaattccctcgacaatagagtattaacaagatcagacaaaaatcgtggtaaaagtgacgacgtaccctctatagaagttgttcatgaaatgaaaagcttctggtctaaacttctctcagtaaaattaatcactcaacgaaaattcgataacttaaccaaagcagagagaggcggactaacagaggaagacaaagcaggtttcataaaacgacaactggtagaaacacgacagattacgaaacatgttgctcaaatactagatgaaagattcaacacagaattcgatggaaataagagaagaattagaaatgtcaaaataatcactctcaaatccaacctagtatcaaacttcagaaaagaatttgaattatataaagttagggaaataaatgactaccatcatgctcacgacgcctacttaaacgcagtagtcggaaatgcactcctattaaaatacccacaactagaacctgaattcgtctacggagagtaccccaaatataatagctacaggagccgcaaatccgccacagaaaaattcctcttttatagcaacatactgcgattctttaagaaagaggatatacaaacgaatgaagacggcgaaattgcctggaataaagagaagcacatcaaaatcttacgaaaagttttatcatacccacaagtaaatatagttaaaaaaactgaagaacaaacaggaggattcagtaaggaaagtatactaccaaaaggggaatccgacaaattaatacccagaaaaacgaaaaactcatactgggaccccaaaaaatatggaggcttcgactctccggtagttgcatactcaatactggttttcgccgatgtcgaaaaaggaaaaagcaaaaaattgagaaaagtccaagacatggtagggatcacaataatggaaaaaaaaagattcgagaaaaatcctgtagacttcctagaacagagaggctacaggaacgtacgactagaaaaaataataaaattaccaaaatacagccttttcgaactcgaaaacaaacgccgaaggttactagcaagtgccaaagaacttcaaaaaggtaacgaattagtaataccacagagatttacaaccttgctctaccactcatacagaattgaaaaagattatgaacccgaacatcgagaatacgtagaaaaacataaggatgaatttaaagaactccttgaatacatcagtgtgttttcaagaaaatacgtactagcagataacaatcttacaaaaatcgaaatgctatttagtaaaaataaagatgccgaagtgtcatcactcgcaaaatcttttataagtttattaacttttactgccttcggagcgccagcagctttcaatttcttcggtgaaaacattgatcgaaaaagatacaccagtgtcaccgagtgtctaaatgctactctgatccaccaaagcataacgggactttatgaaacacgaatcgatttatccaaactaggggaagattga

SEQ ID NO: 8804 - RNA, 4038 nt, synthetic construct
  misc_feature 1..4038: note = Cas9 variant
  source 1..4038: mol_type = other RNA
atggatcaaaaatattccatagggctagacattggcacaaattccgtcgggtgggctgtagtaactgacgattacaaagtacctgccaagaaaatgaaagtattaggaaacacagacaaacaatctattaagaaaaatctcttaggggcactattattcgatagcggggaaaccgctgaagctacaagattaaaaagaacagcacgccgaagatacacacgaaggagaaacaggcttagatatttacaagaaatattcgcagaagaaatgaataaagtagacgaaaacttcttccaacggctcgatgactcattcttagtagacgaagataaaaggggcgaacgacacccaatatttggcaatatagccgcagaggttaaatatcacgacgacttccccacaatctatcacctgagaaaacatttagcagacatttctcaaaaagccgatctaagattagtctatctagccctcgcacatatgattaaatttagaggacactttctaattgaagggcaactaaaagcagaaaacacaaatgtacaagcactatttaaagactttgtagaagtctacgacaaaacagtagaagaaagccatctatctgaaatgacagtggacgcactatccatcctaactgaaaaagtaagcaaatcacgaaggttagaaaacctcatagcccactacccagcggagaagaaaaacacactatttgggaacttaatagctttatcactgggtctacagccaaactttaaaacaaactttcagttatctgaagacgcgaaattacaattctctaaagacacttatgaagaagatttagaaggcctactcggagaaataggtgacgaatacgcggacctattcgcctcagccaaaaatctatacgacgcaattctattaagcggaatattaactgtagacgataattccacgaaagcacccttaagcgcatcaatggtcaaaaggtacgaagaacaccaaaaagacctaaagaaattaaaagattttataaaagttaatgctcctgaccaatacaatgcgatattcaaagacaaaaataagaaagggtatgccgggtatatagaaaacggagtaaaacaggatgaattttacaaatacttaaaaggaatacttttacagataaacgggtccggagacttccttgataaaattgacagagaagatttcttaagaaaacagagaactttcgacaatggatcaatacctcatcaaatacacttacaagaaatgcatgctatactccgaaggcaagaagaacactacccatttttaaaagaaaatcaagacaaaatagagaaaattttaacgttccgaataccatactatgttggaccattagcacgcaaaggatcgagatttgcatgggcagaatacaaagctgacgagaaaattaccccctggaactttgacgacatacttgataaagaaaaatccgcagaaaaattcatcacacgaatgactctaaatgacctatacttaccggaagaaaaagtattacccaaacacagcctactctatgaaacattcacagtatacaatgaactcacaaaagtaaaatatgtaaatgaacaaggagaggcaaaatttttcgacgccaacatgaaacaagaaatatttgaccacgtttttaaagaaaatagaaaagtaacaaaagacaaactactcaactatctaaataaagagttcgaagaatttagaatagttaaccttaccggtcttgataaagaaaacaaagcattcaattccagtttaggaacatatcatgacctgagaaaaatactggataagagcttcttagatgacaaagcaaatgagaaaactatagaagatataatacaaacactaacacttttcgaggacagagaaatgataagacaaagactacaaaaatattcagacatctttaccaaagcacaattgaagaaactagaacgaagacattatacaggatgggggaggttatcgtacaaactgatcaatggaatacgaaataaagaaaacaagaaaacaatactagattacttaatagacgacggatatgcaaaccgaaatttcatgcaattaataaacgacgatgcattatcatttaaagaagaaatcgccagagcgcaaataataggcgacgttgacgacatagcgaatgtagtacacgatcttcctggatccccagccattaagaaaggcatactacaatcagtcaaaatagttgatgaactggtcaaagtaatgggccacaacccagcgaatattataatcgaaatggcccgtgagaaccaaatgacagacaaaggaagaagaaactcacaacaacgactaaaattgttacaagactcactaaagaacttagacaacccagtaaacattaaaaacgtagaaaatcagcaactccagaatgacaggttatttttatattacattcaaaacggcaaagacatgtatactggtgaaacacttgacatcaataatctatcgcaatatgatatagaccacatcataccacaagcattcataaaagataattctcttgataacagagttttaacgaggtccgacaaaaaccgaggaaaatcagacgacgtaccatctatagaagtggtacacgaaatgaaatctttttggtcaaaactcctgagtgtaaaactcattacccagcgtaaatttgataacctgaccaaagcagaaagaggcggtctaacagaagaggacaaagcaggattcataaaaagacagttagtcgaaacacgtcagattacaaaacacgtcgcacaaatcctagatgaacgtttcaatactgagttcgatggaaataaacgcagaattagaaacgtaaaaataattaccctaaaaagcaatctcgtatcaaactttagaaaagaatttgagctatacaaagtccgggaaattaacgattatcatcacgcccacgacgcttacttaaacgcagtagtcggaaacgccttactattaaaataccctcaactagagccagaatttgtttacggtgaatacccaaagtacaactcatataggtcaagaaaatctgctacagagaaatttttattctattctaacatattacgctttttcaagaaagaagacatacaaacaaacgaagatggggaaattgcatggaataaagaaaaacacatcaaaattcttagaaaagtactaagttatccccaagtaaatattgttaagaaaactgaagaacaaacaggtggttttagcaaagaatcaatcttaccaaaaggagaaagcgataaactcataccccgcaaaaccaaaaactcctactggaacccgaagaaatacggcggctttgactcacccgtcgtagcatactccatactcgtgtttgccgatgtcgaaaaaggaaaaagtaagaaactacgaaaagttcaagatatggtaggtataaccataatggagaagaaaagattcgaaaaacacccagtagatttcttagaacaaagaggctatcgaaacgtaagactcgaaaagataattaaattaccaaagtattcccttttcgaactcgaaaataaaagacgtagactccttgcatccgcaagagaacttcaaaagggaaacgagttagtaataccccaacggttcacgactttattatatcattcatatcaaattgagaaaaactatgaaccagaacatagagaatacgtagaaaaacataaagatgagttcaaggaactactggaatatatttcagtattttctaggaaatacgtattggccgacaacaacctgactaagattgaaatgctattcagtaaaaacaaagacgccgaagtgagcagtctagcaaaaagtttcatttctctattaacattcacagcatttggcgctccagcagccttcaacttcttcggtgaaaacatagatagaaaacgttacacttctgtcacagaatgtttaaacgcaaccttgatccaccaaagcataacaggattatacgaaactaggatagatcttagtaaattaggagaagattga

SEQ ID NO: 8805 - RNA, 4038 nt, synthetic construct
  misc_feature 1..4038: note = Cas9 variant
  source 1..4038: mol_type = other RNA
atgaaaaaagaatactcaattgggctagacattggtacaaacagcgtaggttgggctgtaataacagacgactataaggtaccagcaaaaaaaatgaaagtattaggcaacactgataaacaaagtataaaaaagaatctactaggggctctactatttgatagcggcgaaacagcggaagcaacacgcttaaaacgaactgcacgtagaagatatacccgaagaaaaaacagactaagatatcttcaagaaatttttactgaagaaatgaacaaagtagacgaaaacttttttcaacgtttagacgacagtttcttagtagaagaggacaagcaaggaagcaaataccccattttcggcactcttaaggaagaaaaagaatatcacaagaaatttaaaacaatctaccatctcagggaagaactagctaattctaaagaaaaagcagatctaagactagtttacctagcacttgcacacatgataaagtttaggggacactttttatacgaaggagacctaaaagcagaaaatacagacgtacaagctctcttcaaagatttcgttgaagaatatgacaaaactatagaagaaagccacctctccgaaataaccgttgacgcactatcaatattaacagaaaaagtatcaaaatcatcaagactagaaaacctcatagcacattaccctaccgaaaaaaaaaacacattatttggcaatttaatcgcactatcactaggattacaaccaaatttcaaaaccaacttccaactgagcgaggatgcaaagttgcaattcagcaaagacacatacgaagaagatctagaagaactactaggagaaatcggagatgaatacgctgatctatttgcatcagccaaaaatctttacgatgcaatacttctatccggtatactagccgtagatgacaatacaactaaagcaccactgtcggcatctatggtaaaacgatatgaagagcatcagaaagacctcaagaaactaaaagattttatcaaagtaaacgcccctgaccagtacaatgcaatatttaaagataaaaacaaaaaagggtacgcagggtacatagaaagcggcgtagaacaagatgaattctacaaatacttaaaaggaatacttctcaaaataaacggcagtggtgattttttagacaaaattgattgtgaagacttcctacgaaaacaaagaacatttgacaacggatctataccgcaccaaatacaccttcaggaaatgcatgcaatattacgcagacaaggagaacactaccctttcctaaaagaaaatcaagacaaaatcgaaaaaattttgacattcaggataccttactatgtaggcccactagcccggaaaggtagtaggttcgcgtgggccgaatataaagctgacgaaaaaataaccccctggaatttcgacgacatacttgacaaagaaaaaagcgcggaaaaattcataacaagaatgacactaaacgacctatatttgccggaagaaaaagttctaccaaaacatagtcctctctatgaaacctttacagtctacaacgaactaacaaaagtcaagtacgtaaacgaacaaggcgaagcaaaattttttgatacaaacatgaaacaggaaatatttgatcatgtattcaaagaaaatcgaaaagtcacaaaggacaaactactgaattatttaaacaaagaattcgaagaatttcgtatagtcaatctaacaggtttagataaggaaaacaaagctttcaattcatcattaggcacttaccacgacctacgcaaaatactcgacaagtcattcctagacgacaaagctaacgaaaaaacaatagaagatataatccaaacactcaccttatttgaagatcgagaaatgattagacagagactgcaaaaatattccgacattttcaccaaagcacaattaaaaaaactggagagacggcattacacaggatggggtagattatcctataaattgataaatggaattaggaacaaagaaaataaaaaaacaattctcgattacctaattgacgatggatacgcaaatagaaatttcatgcagctaataaatgacgacgcactatccttcaaagaagaaatagcacgagctcaaattataggcgacgtagatgacattgccaatgtcgttcacgatctacctggctcacccgccatcaaaaaaggcatacttcagagcgtcaaaatagtagatgaactggtaaaagtgatgggacataatccagcaaacatcattatagagatggcaagagaaaaccaaacaacagataaagggagaagaaactcccaacaacggctcaaactattgcaagactcattaaaaaatctcgataaccccgtaaatataaaaaatgtcgaaaaccaacaactccaaaatgacagattattcctctattacatccaaaacggaaaagacatgtatactggtgagactttagacattaataacttatcacaatacgatatcgaccatataataccacaagcatttataaaagataatagcctagacaaccgggtcctaaccagatccgacaaaaacagaggaaaaagtgatgacgtaccatcgatagaagtcgttcatgagatgaagagtttttggtcaaaactacttagtgtaaaattaatcacacaaagaaaatttgataatttaacgaaggcggaaagaggaggattgacggaagaagacaaagcgggctttattaaacgacaactcgtggaaactcgacaaattacaaaacacgtcgcacaaatactagacgaaagattcaatacagaattcgacggggctcaacgacgaattagaaatgtgaaaattataacgttaaaatctaatttagtaagcaatttcagaaaagaattcgaactatacaaagtacgagaaataaatgactatcatcatgcccatgacgcatatctaaatgccgttgtgggtaatgcactattactaaaatatccacagctagaacccgaattcgtatacggagaataccctaaatataacagctatcgatccagaaaaagcgccaccgaaaaattcttattttattcaaatattttacgattctttaaaaaagaagacattcaaactaacgaagatggagaaatagcatggaataaagaaaaacacataaaaatactcaggaaagtattatcataccctcaagtcaatatagtaaaaaaaacagaagagcaaaccgggggattttctaaagaatcaattctaccgaaaggtgaatcagataagttaatcccaagaaaaacgaaaaattcatattggaaccctaaaaaatacggtggatttgacagtccagtagtcgcatactcaatccttgtcttcgccgacgtagaaaaaggtaaatccaagaaactacgaaaagtacaagatatggtaggaataactataatggaaaagaaaagatttgaaaaaaatccagttgactttctagaacaacgcggttacagaaacgtaagacttgagaaaattatcaaactacccaaatattctttatttgaacttgaaaataaaagaagaagacttctcgcaagcgcacgagaactccaaaaaggcaatgaactagttataccacaacgatttacaacattgctttatcattcatatcaaatcgaaaaaaactatgaaccagaacatcgagagtacgtcgaaaaacataaagacgaattcaaagaactattagaatatatcagtgtattttcgcgaaaatacgtactcgcagataataatctcacgaaaatcgaaatgctattttcaaagaataaagatgcagaggtgtccagcctagcaaaatcattcatttccctacttactttcacagcatttggtgccccagcagcattcaatttttttggggaaaacatagatagaaaacgctatacatcagtcacagaatgcttaaatgcaacgttaatacatcaaagcataacaggcctctacgagacaaggatcgatctatccaaactaggagaagactga

SEQ ID NO: 8806 - RNA, 4041 nt, synthetic construct
  misc_feature 1..4041: note = Cas9 variant
  source 1..4041: mol_type = other RNA
atgaatcaaaccaaaaactatgatataggcttagacattggagtaggctcagtagggtggacaattactgactctcaaagccaaaaagttctcaaagtaaaaggaaaacaaggaattggcgtacatttatttaacgaaggtcaaacagccgaagaaagacgccaattccgtactaacagacgccgattaaaacgtcgcaaatggagactccgtctcctcagagaattgttcgacgagccaatatcatccatagaccctgagttctttgcaagactcaaatacttcaatgaatcaagcaaagacccaaaaaacaaaggttaccaaccacaattgcacgatgacctaaaagacgttgacttctatcgtcaatacccaacgatatatcacctaagacacgcgttaatgactcaaaaagaaaaatttgacatacgagatatctatcttgcaatacatcatatcgtcaaatatcgtggacattttctgatgaatggacattcatcaagtttcagtgtcgctcagacagattggaaagcagatctgacaaaactctttgaactcatacaagaaacaagaaccaacctcgatttcagtttcgaccttacagaaatcgacacaatcaaatcacttctattcgacaaaaacctaagtcgaaacgacaggcaaaaggaaattgtaggtctaatcaacaataatagccaacttgataagaaagataaggcattgacgaagcaacttgtcgaaagtgtcgtcaaaggtatagttggtatgaaaacacggaccgatatattattaggatacgaagtggacaataaagaacaaagcaaagcctggaattttagcatagacgagttagacgaccaaatggcaacaattgatccagcactctcacaaaattctcaagctcacgacataattacactaatacaaaaactctatatgacagtacagctggcccaaatagtgcctgaaggacaatcagtatcagaaatgatgataaatagatataacctatatgccgaacaactccaacaattaaaagattacaaaaaaataaatctagaaacaggcctacttctcagggaagcctatgacgaactgatgaccaaagcgctaacggctgcacctggaaaaaccatacacgacactttctataataaggtaaaaaaaatactaaaagaccaagacaataaacaagcactgtcaattaaacaagcaattgaagactccaattatctcatacccttacggattaaatctaacggagtcataccctatcaacttcatcaaagagaactagacgctataatagaaaatcaaaaagaattctacccatttctagccacaccaaacccagtagatgggcatcaagaagcattaccatataaactagacgaattaataggctttaaagtaccatactatgtcggtccaatggtcgacccagaagtagattccgaccaaaatttcgcatggatggtccgaaaagaaaaaggtgaaataaccccatggaattttcataataaagtcgacattacacaaagcgcagataactttataaaaagaatgaaaacgacggacacttacctaataggcaaagacgtactaccacaaaattcgctactctatcaacgctatacagtgttaaacgaactaaatggtataaaagtagcaaacaaaaaactaacaatagaacaaaaacaacgcttatatgaccaactattcaaaaaaaaaaaaacagtaaaaaaacaagacattctaaacaacctagttgcagctggcgaaattcacgaagatgacaatttaaccggtctatcaaatggcacaacattcaacaataaccttggctcatatatagattattgtaaaataatcggccaagacaaattagaagacgcatcaaaacaagctgatatagaacgtataatcgagtggtccacaacatttgaagacgctaatatttttttaacaaaattagccgaaataaactggttaacagaagatcaacgacaaaaactctcccaaattcgctacagaggatggggtcaatttagtaaaacgctattaaccgatataaaggacaataaagacaattcaattattgataacttaatgtccacaaaaaaagttttcatgcagataataaacgatacaacaattaaacaaaaaatagatgattacaatcaataccacctaaatcatgcagatttaaaagacacaatcgctaatttattcacttcacctcaaaacaaaagggcaataaaccaaaccctactagtaattgaagacattataaacgcagttgggcacaaaccaaatagaatattcatagagtctgcaaaagacaatagaaatgccaaaaaccaattaacccaaagtagactcaaacgaatagttaaacagttcgaagataacaaacaacacgtagatcaatctgtctatgaggagttaaaacaactggacgacggttcccacgcctcaatagacgatagacttctcttatacttcctacaaaatggaaaagacatgtacactggacaacctatagacatatcccaactcagcaccagccaataccacatagaccatatactcccacaagccaaagtaatggataacgcattagataacagagtgctcgtatcatcaaaagcaaacacagaaaaatcagaccgcttcttatcagaaatacctcaatttcagcaacggagtctatgggcggaactcgaaagaatgggttttctaacaaaggctaaaaaagaacgtctcctaatgactagcgatgaatttaagcagaattccgtcagattcatagcacgccaactcgtcgaaacaagacaaatcataaaactagtcaaccaactaataatacaagaacatcccgaagtcaaactcgttaacattaaagcagacctaacaaatgcttttagaaaaaaattcaatttcgtaaaaaaccgcaacgctaacgactaccaccatgcattcgacgcatacctcacaagcctcattggtagccatttacttaaatcacacccaaaatgggagccactctttgtctactcagactacgataaaataaaattcgacaacgctccacaaggagtcaacatcatgaaagaattcgaacaaagcaaactcgcagacgaaaatggcgaaataatctggaataaagacgaaatgatggcctatttagaacgactatacaattcaagacaaatactgatcacgaagaaagtatacgcacgacacggtaacctatttaaacaaacaatcttcaaagcaggagaaagcgacaacctaattcccgtaaaaaataacagaagcgacatagcaatatatggaggttataaatcaaaacaagtctcatactatgctctaataagcttacacaacaaaaaaagacaaaaacgactagtagctgtttacctaatagatatccaaaaactccaaaatctaaacgaatcagactatttcaaaacattacacacaatcattaaagaaagacacaacataaagccagaatttgacatactagccgataaaatctaccaaaatcaattaataatagacaacaaaaacggctccaatcgacctttcagaatagaaggagactttaaaaacgatagacaactgtatcttcctttacagtaccagagatggttagctagcaaagaaccaacagatgaaaaacttaaccgaatattcgaccatatatgcgaacagctagccgattactttcctctgtttgcaggcaacgcttgcgacaaattacttgataacagagataaattctatcagttaagtatcaaatcagaattcaacgacaaaggtaaactaattgcagaaggaaaattatccgtaattgataaactattggtagctatgcacgcagatagcaggaactccaatctcgcagtaatagggctgtcaagcagctggggtaggtttaagctacatggcggcaacgaagctataggaacatctgtacaacttatccatcaatcacccactggattatttaaacgtatacaaagatttaattga

SEQ ID NO: 8807 - RNA, 4041 nt, synthetic construct
  misc_feature 1..4041: note = Cas9 variant
  source 1..4041: mol_type = other RNA
atgttatcagcaggagtgatgttaggcgatgtttcagcattaaaatccagtagaaattcactatttcagaaaagtaagaaattaattgaaaattcaagctcagacttaacaaaagtcgattatagtaaaatgagagaaattctgttaagcataagaaatatagctatccgatttttcaacaatgaagactttaaagaaagtgactactacaaagaatttcccacaatttggcatttacgtaaaaatcttatggaatccgacaaaaaggcagatataagattagtttacctggctctacacaatatagttaaatatcgcggtaacttcttacaagaaaataataaagacttaagggctgccaacgctaatgctggagcagcagcgatcgacttaagcaatgcacttgaagaatacttttcactgcacgaagacgaaagtgcattgacatgcgtcccaaatgtagccgatttacaaatgacgctggaacaacctggactacgcaatggtgaacgtctagatcggatagtagcagccttaaatatgcctgaccgagcacgtgcaaaactttttgcaaaggcttgtattggacaaaaagtggaatttagcaaacttgcattaggaatggaaaaacaagaaggtacaaatgcatacatctgggacgatgataaatacgacgaactcgttgctctatgccctgaagacttcttcccagtattggaaaccttgaaaaacgcttactcagcatatgtattatcagacttattagcaggcaaattatcaatatcagcttctctaatcgactcctatgagcaacatcagaacgacctaaaaatagtaaaagaattagtaagagaatatttagggcaaaaagaatatggccgactatttcgaggtcctaaattcgccaatggagattataacttcaataaagtagcaaaaccatcatacacgtcatacattttaggtgaatcattatgcaacaaacaaggaacaacacgagaggagctagtcaaggaactaaaacgagtctttgatgactgttcggcgatacaagcagataaaagatatcagaaaataaaacagagacttgaagacgatcccaaattcttaataaaacagaaaacccgagcaaacggcgctataccatatcaattgcatttagaagagatgcatcaaataatagaaaaacaaggaaaatattacccatttctagtcgaacaacaggacctaatagaaaaacttgtatcatcaagaataccatattacgtcggtccactaaacggtggacacgaccccaaccatccatatccaacgaatcccatagatccaaagcgaaagtttgcatggtcagtaagaaaaccaggaatggaacatgaaaaagcatacccttggaatgtagatgaagtaatagattcagaagaaacagcggaaaggtttatacgtaggatgacagggacctgtacatacctatatggagaaccagtagttcccagatgctccctactatatgaagaattttgcgttttaaatgaactaaatggtgcccgctggggagaaggtaatggggacacccatagatttgatagttccgacagaacagaaatactcgaacaactattcaagaaaagaaaaagagtaacacacaaagcaatagcaacatggctagaaataaatcacggagtaactaatgtgaaaatatcaggaactcaagcagaaaacgcatttgaaagtaagctctcaagctataatgatttttgcaacctattaggagttgatggattagaagatgtctgcccgctaacaaaagatgacattgaacaaattatattatgggtgacagtcttcgaagataagaaattactcctccaaaaacttcaacgagctttcggcgataaattgtctgaaaaacaaatcgcaagtattatgcgaaaaccatatgccggatggggcagattatccagtaaactacttactggaatcaaaagagaaacacctttcggaagaataagtatattagacgtaatgagagatggagacccgagaccgggacaccatttagacgcaatgaatttcatggaaattctcagagaaaaagattttggattccaagacagaatagatgagataaataaagaaagaacaaaagagtctggcttactattaagtgtagaagacctgccaggaagtcctgcactacgaagatcagtcaatcaggcaatgcatatattaaaagaaatagtatcaattgctggaaaagaacccagcagaatagtcattgaagtcacacgagatcccgacgaagagaaaagaggccatcgcacagatacaaggtacaaacaactcagtgaagcccttgctgcgattaaaacagatattgtacagtttgattcatcactactagcagaacttaaagaaagaaaagacagtttggattctgaacgcttaatgctatacttccaacaatgtgggaaaagcctgtactcagggaaacccctagacattaatcgtctcagcgaataccaagtagaccacataataccacaatgttacataaaggacgacagtttagataacaaagctcttgtctttgcatccgagaaccaaattaaactagactcattacttctagacaaatcaataataaggtctcaaaaaggcagatggcaagaactacacagagctggtctaatatccaacaagaaatttcgaaacttaacatgcacggaaataagcgatcgaatgatgaaaggcttcataaatcgccaattagtcgaaacatcacaaattgtaaaatttgtaagacaaatgtgcgaacaacgatatgaatcgtcagaagttattagcctaagagccagtctaagtcataacctaagagatagatgtggctttataaaatgcagagaattaaatgactaccatcacgcacatgatgcttatctagcatgtcaaatagctagattcatcggaatcagataccctcgatggcaagacggaatcagcagagagtttataaacaaatatataaaacaacttgttaaaaagggaaaatcatctggaaaattctttgcaggcaaatcaggatttattatagattcgtttatgcatgatggattcgacagagaaaccggagaaatatttagagacggatgggatgctacatttgaaatcacaagaatgagaagagtacttggatacaaagattgctttataacaagaatgccagaggaacagacaggcgcatattgggaagagactatatattcacccctagacgccaaaaatgggaaaaacctacaaattcctctaaagcagtcaggcaaagaaggctacctcgatccaaagaaatacggtggaacaaatacggcatttaatgcatatttcttcgcctttgttgcaaaagatgctcgtggaagggacaaatacttctttgaaggagtcccagtatatctcgcaaaacaactaaacgaacaacctcaaattttagtagattttgcaaattccattgcagcaaccaagaaatgctcgaccgcaaaaatacttagaagcaaagtaccgctaagacaaaaatttttacttgacggtacatccttttatcttggaggcagaaccggaaataaaaacgtaatactatcaggggtcgaatttgcatgtggaattgatatggccaaaatgattgacacagcgattaaacaccctgaagaattatctcaaaaggaacttatatctataatacaaatgctagccgacacgatagaaagaaacagtgaccgacaagcaagtttaatcaacttccgaagattcgatgacaaacttaggaatatagacgctattgcagcatctagaataattaaaaatttattaaactctatgaacggagtaaagcaatcttgtgatttaagcgatttaggcggatcaaaacaaagcggattcatgcaatcaaatatagctacactttttgaacgaataacatggtgttacagtagtataaccggaatgttcgaacagcgagtttcattcgaagatcttaaaaatggaatttga

SEQ ID NO: 8808 - RNA, 4041 nt, synthetic construct
  misc_feature 1..4041: note = Cas9 variant
  source 1..4041: mol_type = other RNA
atgaagaaaagaaatagagaagaatattatgttggcttagatattggaacctcaagtgtaggatgggcagttgctacacccgactatagaatacctaaattcagaggacacaaaatgtggggtagtaggctatttgcagagggaaaaagagcagcagaaaggagacagttcagaacaaatagaagaagattagcaagacggcgagatagactccagattctagaagaattgttcgcagaagaaatggccaaagttgataatacattctttatgcgcttaaaagaatcaaaattctttttagaagataaaaccgtcaaagaaaaacacatcttattttcaaccgataaatttgacgcagacagattttacaaagataacccaacaatatatcacgtaagaaaaagactgatggaagaagaaccgcaagacatccgagaattatttttagcagtacatcacatactcaaatacagaggtcacttcctatttgccggttcattggagcaaaatggcgattccatagaggaactcgtaagaacactatttggaaaacaaggattagcaatattagatgatacaattgattcaaacgaaatggtaaatattctaaagaataacgagaaaactaaatctgacagaaagaaagccgtgcaagaattatggaaccctctaaaagacaaagtaaagaaagcgcaagctgcagagatggctggtgtagtacttggactaaatagcgacatatcaaaattatttgacaattcggattacaaagacttgaaaataaattttagttccggcgactacgacgaaaaacgtgatgattatgcaaattcaataggcgatgatatagtcttactagacactatgaaagctctatatgatacactaatactcagccaaattctacaaggaaaacaaagtataagcgaagccaaagtagaagactacaacactcataaagaacaactgagggctttaaaagcgatattaaagccgcacaaaagattatataatgaaatgtttagagaaaacaataaaaaggatttaagcaactacgtagcttacataagttcttacagtgaaggaaagagagtaaatcgagaggggttttataaatacgtacaagcggttctaaagcaagtcgatgatagcgactcaaagcaagctattctagaagcaattagattagaaacattcttaccactcctaagagttaaagacaatgcagtaataccgcaccaaatacatcaagcagaactcgaggcaatcctagaaacagcccgtaaaaagtacaaattccttaacgatgtctcagaaggcgtttcagttaaagataaaataatacaactattcacctttagaataccttactatgtaggtccattaaacccacactccggagaaacagtcgccgacagaaaacaaggaacaggatgggttgttagaaaacaaagaggcaaagtctacccctggaattttgcggacatggtagatgtaaaagcaagcgcagaggcattcatcacaaatcttaccaacaagtgtacatatctaataggcgaagacgtattgccaaaaagaagtctcctctactcagaatttatgctactcaatgaactaaatatgattaaatatgatggacatgaattaccagtcgaaataaagagattatatatagagcaagtatttaaacaggaacacaagaaacaaacaaaagggagagtactagactttttaaaaagaaatggtttaattaccggatcagccacagcagtgataacgggaatggatgatagtattaaaggagatctgcaatcctacagagacatggtaagaatttttggcacagggttcgatcattcaatggctgaaagaattatacgatgggttacactattcggcgaagcaaaagatattctagaaaataagattagagaagtctatggaaattcaatatcagatagtcaaatgagagcaatcaagaaactgaaatacgccgattggggtagattgtcccaagcattctttatcaaaattatcggatgtgataaatcaggagtggaacgaaacatcatcacatgtttacgagaatctagccaaaatttaatggaaatactatctgatcaaggtacttatattaaacaaataaaggcttggaaccatcaacatacaaccaatatgatggatacgttggattatcagctagtagatgacttgtacgtggctccatccgttaaaagatcaatatggcaaagtttatgcatagtagaagaattagtcaagataatgggccaagccccgaagaaaatatttgttgaagtaactagaactaatcaagctgagaaaactaagaaagacagccgtaagaaaagattggttgaactatacacagcaatcggaaaagaaggtgcagcatggaagaaagaaattgaaaaacaccaagcgggtgatttcagaagaaagaaactatatttatattatacacaaatgggaagatgtatgtattctcacgaacctatagcaatggatgcactattcacgagtgaatatgacatagatcatatatatccacagagcttaacaaaagatgacagttgggataatctggtattagtcaaatcccaactaaataaagaaaaatcggatcaatatccactcagaccggcgatacgagagaaaaataaagcatactggcaatatctatgtagagctggttttattagtgaaaagaaatacgaaagactaatgagaactacagaactaacggctgaagaactatcgggtttcattgcgagacaattagtagaaacatcgcaagctactaaagcggtaataggattactagaacgaatatataaacatactgacatatgttttgtcaaagcagaaacagtatcacaatttcgacaccaacataatttcataaaaattagagaactcaacaattaccatcatgcaaaagatgcatacctaaacatagtcgtaggcaatgtatatcatgaaaaatttaccaaaaatcctagagagttcatagcacgatccacagaaagaagaccttacaacttaaatagaatgtatgattttgacctactaaaacaaggacgagtcatttggcaagtcccaaagagcttagaaacagtacaagccatgatgaaatcaaacgatgttaggattacgaagaaactcttagtccaaaaaggggaactctatgatgcaaccataacgaaagcacataaaacgaaagaaggcatgtactttccattaaaaggagctgatgcacgcttacgcgatgttcatagatatggtggatatgagaaaattaaaatcgcgtattactcagtcttttcgtgttgtgagaaggcttcagatacaatccatactctcataataccaattccagtttacgcagccggattgctacaaactgaggcagacctcactgcatatgcttggcagacaaaacagaaaaccaaacctataaaagatatatattcaatgatcacgcccatttacaagaaactctgcataaacacagtagtaaaaatagacggattcaaatactttctcggaggacgaacagaagactacatatgtctctatccagctattcctgttgtattagatgaacaagcagctgcttatttaaaagcagtatcaaaagtaggcagagcagatgatgtagagaataccgcccaagcaatagatcttataactgcagaagcgaatgaagcattttatgacgtattgcttaagaaaatggaagcaaaaatatttgtaaaagcataccaagaaagggttgaaaaattagctagcgaaacagcacgagaacgatttagaaaattaagtataggagcgcaatgttcctgtttattagaaatcctaaatctcctagcaaataataaaacaacgagcaatttgaagaaatggctaggagtaacgatgtctcgacgaaaacaacctatggatctaaccaaactagaggaatgtatagtatacgaaacgtccataaccggactgtatgagaaagcagtatcacttctatga

SEQ ID NO: 8809 - RNA, 4041 nt, synthetic construct
  misc_feature 1..4041: note = Cas9 variant
  source 1..4041: mol_type = other RNA
atggtagaacactatgcaataggatttgacataggaacgggtagtacaggtttcgccggagtagatcctaatggaaaattagtacgtatgaggggtaaaaacgtctacggagtgtacagatttaaaggaggagaagcggcagctgatagaagaggattccgtacgacacgcagacgaataaaacgacgaaaatggcgtctaagattcctaaaatctttctttgaaccctatatcgctccaatagatcccgagttctttctaagacaaaaatactcagcagactcaccacttgacccaaaaggaatacgagcagacaaaggcctattatcagacatgtcagaccaggagtttcacgcaaaatatccaacaatataccatttaagatatcaactgatgcacgagaaaagacagtttgacgtcagagaaatttacctagcaatgcatcacataataaaatacagaggccactttttaatagaagatggtgcagacaactttgatgccaaacaaatagatttctttgaccaatttcaacgaatggccgcagttacagccggattacctgaattggaaacgttagtcgttccagacgaaacacaatccgacgcatttaaaagagttttattcgatgaatcccaaaccaaatctgatagacaaaaagtattagcctcacaattattagatatccaagacaatcaatccaaagcaattaaagattttatagcagcgttaactaaagccgtagtaggtatgaaagcaaatctggcaacattaacgtccaccgctatagaaagcacagataaaaatgattggactaaacccctagggcaactcgatgactttttactaaaacatgaagaagatctagacgaagatggatacgcattgatagatgccgctaatcaaatgtactccgctgcagttctcgcggctttagttcctgaaggaatgggattctccgaagctatgatggctagatacgcacaacataagaaacagttagctttatacaaacaggttatagctagtctaccagataaaactcaacgacatgaattaaaagacgcttacgcagattacattgaacatgcagcacaaaatcccagagatgccttctacaaaagagttacaaaagtcctcgaaggagtagattccgcagacgcgcgtactgtaatgactgcaatcagtcatgacgagtttctcctaaaacaaagaactttatctaacggaaaaataccttatcaaatgcaacaacacgagttcgacgcaataattgaaaatcaaaaagcgtactatccatggcttgcaaccccaaacccggtagaagctgatgccaaaagattaccctattatttagacgaactgattggcttcagagtcccatattatgttggtccaatggttacagaaaaacaatcccagttcgcctggatgattcgaaaagcggacggagaattaactccatggaatttctttgacgtcgttgatagagagaaaactgctaaccgatttattcagcgcatgcaaactaccgataaatacatactaggtgaagacgtacttccgaaacacagcattttatatcaacaatttgaagtgctaaacgaattgaataatattcgggttgagaaacatcccctaacaactgaacaaaaacaatttatatatcaacgactttttgtagaccagcagagaaaaacaataaccaagaaaaatttacaagataccctcgtggctatgggagaatttgacaaagctccagatataggaggcttagcaaaagaagatgtaatgatgtcaagtctagctacattcgcagactactcaaagatattacccgaagccatttcagatccaactagacaaaacgacatagaagatatcatagcatggagtacaattttcgaggacacacaaattttcttcgataaacttaaaacagtcgactggttaacaactcaacaaagaaaacgcttagccagtattagatacacgggctgggggaaattatctaaacgccttctacaacaaatacctacatcgaaacacactaacgtaatggcagctctctgggcaactagcgacaattttatgcaaatactccaagatgaacaattccaagaaggactctatgatgcaaatagattacccgaagaaacactaaccccggatgaacaggtagagaaaatcttagacgaggcttatctaagcccagcagataagaaaggcgctagaaaagtaataaaagttatgaatgacatagtacgagctaatcatggagtactaccagaacaagtctttctcgaatctgcagatgaccctcagaaaaacaaacgcagatctgttagtcgatcaaaacaattagaagaaaaatatagacaagctgcacagagctttattgacgaagcagtaaaagaagaactaaacgcacaaatagtaaattcagctgaatttaacgatagattagtattatactttacccaaaatggtagggatatgtacaccggtaaaaggttagatatagaaaacttaggaagctatcaaatcgatcatattttaccacaaagtctcgtcaaagatgacagcttagacaatagagcacttactgccagagacataaacgcagaaatgagtaaccaatttgttagcgaaagatttggattaggaccaagagctttttggcaacaactcaaaaataacggtctcataagcggcagaaaatttcgaaacttagtgatgcaaagagatgaaatagacaaatatgcacccggcttcataaacagacagctagtcgaaactaggcaaattataaaaacagtagaacaaataatacaccgactatggccagacatacaaatagttacaataaaagcaaacttaacgcatcaagttcgaagcgaattaggtttccccaaagtcagagaattaaatgactatcaccatgcttttgacgccttgttagcggcacgaatagggcaatacctcttagaacactacgcaggattgaaaccgttctttacatatggagaatttaaaagaggcgatacaaagaaatacggtacaaccaacttcctaagacgtttaacaaaagataataaagacaagaaaggcgaattattaccagaagtctccgattggattgactcaattgactctatatataattataagaaaatccccgttgtctgggaaaatacaacaaacatgtcagcactatttgatcaaactatatacccaagaccagaccgagacaccacaaaaaggaaattgattcccacaaaactggacaaacctaccgatatatatggcggttacagctctgcaaaaactgcctacatggctgttatgcgtgtacaaacaaagaaaggtacagaatacccagtattcaatatccctgtaagtatagcatcacaattaaacagaatcaccgaccaaacaatgctcaaacaacaagtaaaacaattcatcataaatgcagaacaatctgcttcgaaaaagaaactctacgaatcaggagacgttatcctctcccgcgtagccctaggccaacggtttacagacaaaaattacggtgaagtatttctaatatctaacatggaagttcaaaatccacaatccttatggttaggtagagcaagccaacaaagattgacaagagaaccagagggaaatgaaaaaccagagacctcattagctgatatttaccaacaaatattaaaacaagtagatcgatacttccttgcgttcaacattcgacaacaaaggcaaaaactgcttggcaccttagaccaattcactagcttacctgtcggacgcgttaatgaacaaactcgcaccgaccaaaatcaaagatcaattatagctcgtgtgatgattgtgctaggaaaaggaagtagagaagaaaaatttccagagtttgggctatcagcactggggcgcctagtgagaactgggggaataacactaagtgaagatgcacaaataatataccagtctccaacaggtttatttgaacgaagagtagcgctcaaagacttatga

SEQ ID NO: 8810 - RNA, 4041 nt, synthetic construct
  misc_feature 1..4041: note = Cas9 variant
  source 1..4041: mol_type = other RNA
atggctaaaatactaggtctagacttaggcacaaatagcataggttgggcggtagtagatattgaaaacaataatgaatttacattaatcgaaaagggggtaagaatatttcaagaaggtgtgaagatagaaaaaggaatagaaggtagcaaagcagcagaacgaacgacttacagatcagctcgcagaatcaaatacaggcgaaaactcagaaaaatacaactcttaggcgtactaagcgaaaacggttattgtccttttctcagcaaagacgaactggacagctggagatacaaaaaggtatatcccacaaataaatcatttttgaactggcagaaaacgaacgaaatacaacttgaaaacccctacttttacagagcactgttggttgaaaagaaactcaatttaaatatagaagaagacagattcaaaataggcagagcattctaccatctagctcaaagacggggattcctatcaaatcgtatggaaggaaccaaagaaaatgacggtacagtgattaaatcaatcacagagatatcaaccgccaaaggggacaaaaccttaggccaatacttttatgaaagatacaagaaaggagagaaaataagggacacatacactcatcgcgaagaacattacttggaagaatttgtaagaatatgcgaatttcaacaattagacaacaaatttgcagaaaaagtaagaaaagcaattttctatcaaaggcccctcaaatcacaaaaaggactcataggaaaatgtgtatttgaaccaaagaaatcacgctgttccgtttcaagacctgagttcgaagaatataggatgctatgtttcttaaacaacattaaaataaaaaccccatcagatgaaaatttgcgcttcctgacagacaatgaaaaagaaaaactaaaaccgcaatttttccgaaaaagcaaagaccacttcgactttgaagacctcgttaaacaactagcgcccaaaaaccaattcaagttttataaatccagagacatattacctggtaattggctctttaattattcaatgaacacaacagtatcaggatgcccaatttctgcaaggttaaaagatctatttggcgaaaactttatggacataaaatttgactatatacgagaaaaagatggaaagaaatcagtaatagacatacacgacatctggcacgtgttgttcacgtacgactcagaagaaaaattaaaagagttcgccagaaaccggttaaatttagacgatattaagataaaagaatttcaacgtatacaattaaagaaagaatacgctgcactatcactaaaagccataaggaaaatactacctttcctaagagaagggctaatatactcacacgccgtatttatagcaaacatggaaacggccataccgagcgaaatatggaacaattatactaatcggaatataatcaaaaatgaaatatacaatatcattagcaaccaaactgaagataaacaagtagtagatatagtgaacggtattataaagagcagtcgtatcgaaaactcagtgtggagtaatgaagcagtagagttctttaagaaagacctaaacagcaaaattaaaaattattacggaatcaaaacgtataacgattttcccgaagaaaagaaaatacgcatagaaacatacgcattcaacctctttaaacaacaaatgatgaaaaatttcggacgcggagaatttgctgcagtacaacgtatagacgaacgactaaaactatttttaacagacaactttaatatcgatccaatattactaaagaaaatataccatccttcagcaatagaagtatatcaaccaccagtacgcaaaaacgacggaaaactatacctaggttcgccaatggtcagtagtatacgcaacccgatggccatgcgcgcactccatcaacttcgaaaattaattaatgaacttataaggaaagaactaatagactctaacacaaaagtaaacatagaaatggcaagagaactcatgaatgccaatgaacgaaaagcctaccaaaactggcaaaatgatagagagaaaatccgaaaagaatacgcactcaaaataaaacaacatctcgatgtagacaaagaacctagtgacgtcgatatcctgaaataccaattatgggaagaacaaaaccacaaatgcatatatacaggaaaagaaataaatataagtgactttcttggctccaatccaaaattcgacatagaacacacgataccacggagcatatctttcgataactcacaatccaacaaaacactatgtgaaaattattttaatagatccgttaagaaaaacagaataccagcagccctaccaaatcacggagaaataatagaacgtctcgaaaactggaaattaaaatatgaggaactcgaaaaacaaatacaatatgcagtacgacaagctaaaggtgcaggagataaagattcaaaagatcgagcaatacaaaaacgacacaaactaaaatttgaatacgactattggaaaaacaaatatgacagatttgttatggaagatgtcccagaaggattcaaaaattcacaattagtagacacagggataataacaaaatatagtagaatgtacctaaacacattattcgataaagtatatactgtaaaaggaaacactgttgccgattttagaaaactgtggggcatacaagatgaatacgaaaagaaagcaagagtaaatcacagccaccattgcgtagacgcaataacaatagcctgcataacaaaatccaactacgagaatctagctaaattttaccacgactgggaagaactccatgttaaaggcatagaccaattaccaccaatgaacaaaccgtggaaaacctttacagaagacataaaagccatccaatatgaaattctggtgagccattacacgccagataacttaccaaaacaaagcaagaaaattctacgcaagaaaggaagaatacagaaaaacgaaaatggaaatcccatttatttaaaaggtgacacagttagaggtagcctacatcaacaaaccttctacggagcaattgagaaaactgaggttaataagaaaggtgaacccgaaaaagtcataaaatatgtagtaagaaaaagcctagacgtattagatgacagcagtgtgaaaaacatcgtagacgacatcgtaaaagaaatagtacaaaacgcacggataaaagaaaaagattttattaaagaattagaaattcaaaagcggaagttagccaaagctgaagaaaacaaagtcgtacaaattcaagctgaaatagacaaactaaataaacaagtagcagacttatacactatgccgaacaaaaatggcaaccctatacccataaagaaagtgagaatatttcaaacatcagttacaaacccaatacacctaaaacaacaaagagataaatctcagaaaacctcaaaaccacataaagagttctactatgcagccaatgatagtaattatatgatggcaatatacgaaggaaaagacgaaaaaggcaaagtaaagcgagacttcaaattactaaataacttagaggcaggagaatttttcaaatactctgtccacaaagacctgaaagagaaaaacctagaaaatattagaaacgtgataccagataaagtatcagcaggtaaaattgaaataccactaaaagctatcattaaaaccggaacgatggtaatattatgggaaaattctccagacgaagtatgggacttaactatatctgaagtggataagcgattatacaaagtagtgggaatgagtgtgaatcgaatcaaatcagatgttaaaactttcgagttcgggaacattgtcctaagacacaataaagaagcctctccagcaactttacttaaaatacaagatggtgaatttaaatccgacgaaaattacatagcccaaagaaagctaagccataaccaattcaacgctctagtagaaggtgtagatttttcacttagtgtgttaggcgaaataaaacgtctgaagtga

SEQ ID NO: 8811 - RNA, 4044 nt, synthetic construct
  misc_feature 1..4044: note = Cas9 variant
  source 1..4044: mol_type = other RNA
atgggagaagatggaaaaccagtacgagtcaaaggcaaaacagcaataggagcaagattatttcaagaaggtcatgtagccgcagaccgacgcatgtttagaaccacaagacgtaggctcaatcggcgtaaatggagactaaaattattagacgaaatattcgatccttatataaccccagttgactccacattctttgcacgattaaaacaaagcaacctcagccctaaagacagccgaaaagaatttaagggaagtatgttattccctgatcttacagacaagcaatatcatgaggattaccctacaatttaccacctacgacgtgcactcatgaccgaagataaaaagttcgatatcaggatggtctacttagctatccatcacatagttaaatatagaggaaactttttaaactcagcaactgtagacacgtttaaagcgtctaaagtagatttcaagaaatcatttaaccaactcaatgaactatatagcgccataaatcccgaagacgctttccaagtcgacatgaataaatcagatgaaaccggaagactatttttagactcctctataagaaaattcgataaacaaaaacaaatctcaaaactcataccagtcgttgtagaagacaaagaagccaagaaactaaatggcaaaatcgcactcgaaataactaaagcaattctgggttataaatcgaaactaaatgtagttactcaaacagaacctgaagatccaaagaaatgggcagttaaattcgatgatgaagacatagatagtaaactcaacgatatcctaccagaaatggacgagaatcaacaatccatagtcgaaataattcaagacttatattcccaggtaacactaaaccaaatagttccaaacggaatgtcgctttcagatagcatgatcaagaaatataacgatcaccacgaacatttaaaactatataagaaacttatcgataatataagtgacactaagaaaagatcggcactcaaaacggcatatgacaaatacgtaggtgacgacggaaaaacaatcgaacaagatgaattttatagcaatgttaagaaaaacttagacgacagcgacctttcaaaacaaatcgccgacttaattgaagcagaaaaattcatgccaaaacaaagaaccagtcaaaatggcgtaatcccacaccaactacatcaacgtgaactcgatgaaataattgaacaccaatctaaatactacccctggtttgctgaagctaatccaaataaacacgacctccatttggcaaaatacaaaatagaagaattggtagcatttagaatcccatattatgtaggtccaatgataacccccgaagatcaagagaaaagttcacaaactatatttgcgtggatgaaaagaaaagaacccggacaaatcacaccctggaattttgacgaaaaagttgatagaatggaaagcgcaaacaggttcataaaaagaatgacaacaaaagatacctacctcatcggcgaagatgtgctaccagaccaatccctgctatacgaaaaatttaaagtacttaatgaactcaacatggtcagagtgaacgaccatccactaaaagtatcagaaaaacaagcaatataccgtgacctattcgaaaaccaaaaacgaatcagcgtgaaaaacttacaaaactacgtaaaatctaagtctggattaccaaccggcccaaaaatatctggactttcagatcctgaccacttcaactcatcgcttggaacgtacaatgacttcaagaaaatgttcggagataaagtagacgacccagatttgcaagatgatttcgagaaaatgatagaatggtcaactatatttgaagacaagaaaatattgagagcaaaactcgacgaagtagcatggctatcagacacccagaaaaacgaatttaaagaaataagatatcaaggatggggccgactcagtaagaaattgttaacaggtatcgttgacggcaatggccaaaggataatcgatgaattatggaatacaaataaaaactttatgcaaatacaatccgatgactcctttgccaaacgtatacatgaagccaacgctaatcaaatgaaagctacagatgtcgaagatgtattggcagatgcatatacaagtccccaaaacaagaaagccattagacaagtagtgaaagtagtcgatgacatacaaaaagccatgggtggagtagctccaaaatttataagcatcgagttcacacgcagcgaagacagaaatccgagacgaacaatatccagacaaagacagttagaaaatacactaaaagataccgctcaggctctcgtcaaatcaataaacccagatattttatcagaacttgataacgcctcaaaaagcaagaaagggctaacagacagactctacctatacttcacccagttaggaaaagacatgtatactggaaaaccaataaatatagatgaaatatcaaattacgatatagaccacatattccctcaagcatttataaaagacgactccttaaacaatagagtactggtatccaaagcgggaaataatggtaaatccgcaaacgtccctttaaaactatttggagcaaaaatgggcggatactggaaacaattagcagacgcaggcctaatcggtcaacgcaaacttaaaaatttacagacaaatcctgacaccatttctaaattcgccatgcatgggtttataagacgtcaattagtagaaacttctcaggtaatcaagctagtggctaacatcctaggagataaataccgaaacgacgacacaaaaattatagaaatcaccgcacgaatgaaccatcaaatgagagatgaatttggattcatcaaaaaccgtgaaataaacgactatcaccatgcattcgatgcatacttaactgcattcctaggccactacctctatcatcgatacataaaattgcggccatacttcgtatatggagatttcaagaaattcagggaagacaaagttactatgagaaactttaactttctacacgatttaactgatgacaaacaagaacgtatagctgacacagaaactggtgaagtaatatgggacaggaaacgtagcatacaacaattacgagatgtgtaccattataaattcatgctaataagccaagaagtattctctttaaacaaagaaatgttcaaacaaaaacttttcccagcgactcttgcaaagaaaagcaaactaattcaaataaagaaagataaaccagtagatatatacggaggctatagcaacaacacagacgcctatctaacagtcgtaaaacttaaaggatcaaaagaggataaatacaaaatagtaggagtaccaatgcgagccttagacaatcttaaacacgcagaaaaagaaagcccgcaaagctacacggcagagttaagaaaagcccttgaaccgcaatttacaaaaataaagaaaaacagaaaaacaggcgaagtatccaaagtcgtaaccaactttgatatcgttttaggacgcctattctaccgacaaatggttatagacggctctgaaaaatctcttatagcttcatctgtataccaatacaacgcaaaacaacttgttttaagcgaccaagccatcagaaccatctccgatcaagaaggcattgatgaatttgaattatcttcacaatacgataaagtatacgacgaaatagtccagaaagtcgaaaaattactcccaatatttcaacacagacactttcaagaaaggttaaacaatggaaaaagcctattcgtaaaccttccagtacacgacgtttacgaaggcaacaaacttgaacaagtaggaaagaaacatatcataaactcaatactcggtggtatccatgccaacgcagacagaccagacatagatctattcggtatcaaaaatctaggacaattttccagtacaagcggcattaatttatcatcagacgctataatatgttatcaatccccaacaggtctatttgaacgccgtgtagttctcaaagatctttga

SEQ ID NO: 8812 - RNA, 4044 nt, synthetic construct
  misc_feature 1..4044: note = Cas9 variant
  source 1..4044: mol_type = other RNA
atgactaagagggaagaaccttacaacgttggtttagacataggaagcagttcggtaggctgggcagtagttgataataactatcacttattaaatatcaaaaaaaataacctgtggggcgctcgcctttttaaagaggcagaaacagctcaagtcactagaggccacaggagcatgagacgccgataccgtagaagaagaaatagactaaactggctagacgaactcttcgcagatgaattagccaaaatcgatccatcatttctattacgcatgaaaaattcttgggtaagcaagaaagaaagtacaagaaaaagggatccatataatcttttcatcgatgaaaaatacaacgacgtcgattattttaaccagtacccaacaattttccacttacgaaaagaactaatcaccgaagataaaaaagtagatattagattaatatacctagcaatccacaacataatcaaatacagaggcaatttcacactagaaaaccaaaattttgatatatcgcaactcagttcgaacttcagccaacagatatcagactttttcgccttgttttccgacttcggtgtgataatgccagaagatttcgaccccgacaaaatctcagacatacttctaaatccaaatctcagtccaagtggtaaagtctctgaagcgatagcaacaatttcaccaaaaacaaatgtaaaagcaaaaattaaaataattctgctactactagtaggcaacaatggagatctgaaaaaattatttgatttggaaacaaccgaaaaaatagcagtaaaactcagctcccgacacattgactcagaacttccaataatactatcagaactaaacgaacaacaagaaaacatcataaccatcgcaaactccatatttggctcaattatcctaaaagatttcctaggagacgaaacatctattagcgccgcaaaagttataagtttcgaggaccacaaacaagacttacagaaactcaaaacaatgtggcgcgaaacctcgaacaaggaagcggttaaagcaggcaaaaaagcctacgaagactatattggacatgaagattcagaaactttctacaaaaaaataaaaaaatttttagaaaaagcccaacccgtagacttagcaaataaagctctcgctgagatagaactagaaaattatcttccaaaacaaagaaatagaaacaacactgttattccataccaactaaatgaaaatgaactaatcgccatactagaccaccaagaaaaatattacccattcctaaaagaaaaccgagacaaaatactctctctactaaccttcagaatcccgtattacgtcggaccccttcaagactccaacaataaccggttctcatggatgacacgaaaggcttccggagcaataagaccgtggaacttttccgaaaaagtaaacgttgaacaatcatccaatgacttcatcaaacgaatgagatcaaccgacacatacttaataggagaacccgtactaccaaaaaaatcactaatataccaatgttacgaagtattatccgaattaaataatacaagagttaaagatggaagcagcaatccaaaacgtcttgatgtcacaataaaacaaagaatttataacgagattttcaaaaaccaaaaaagcgtctcagtaaaagtcctacaaaactggctcatcaaagaatcttactttaaatcaccagagataagcggtctcgcagacaaaaaaaaatacctttcaagtttgagtacatacattgactttaaaaaaatattcgggcaaagattcgtagatgatccagtgaattcccctcaactcgaggaattggcggaatggttaacattatttgaagataaaaaaattctcctcataaaactccaaaactccaaatattcgtatgatcaagcaacaataaataaattatcgacaatgcgataccaaggtacaggaaaattatcaaaaaaactgctagtagacctcaaaaccacaaaaaaatcaatcggtaaatccggagcagaatcattatccatcctagatctaatgtggagtacaaaagacaacttcatgcaaatcattcatgacgcagactacacatttgaacaacaaatcaaagaatttaactatgacactgaagacgaattaaccccactagaaaaagtagcgaatctacatggaagtcccgcactaaaacgaggactcaatcaatccatcaaagtcgtggccgatatagtaaaatttatgggacacgaccccgaaaaaatattcatcgaatttacccgatccgacgacttcagcaaactcacaatatcccgatacagaagaattaaaaaacaatatctggaaatcgccaaagcaataaaaaaaattcccgcagagtttaaagatattaaggaatatcaaacacaattggaggaaaacaaaggcaaactggcatctgaaagattaatgttatatttcttacaatgcggacactcattatacagcaacaaaccaatcgacttaaatatgatcaattccagcaaatatcatgtagaccatatattaccccaatcatacataaaggatgacagtttagaaaataaagctcttgtattggcatctgaaaacgaaaataaaatagataacatgctaatctctcatgacataatcgcaaccaacctaccaagatggcaggccctaaaagatcaaaatctaatgggttccaaaaaattcgccgatttaaccagaaccactgtcaccgaaaaccaaaaaaaaggatttatacaaagacaattagttcaaacatcccaaatagtcaaaaatataacactaatattaaatgacctttacaaaaacacttcctgcatagagacacgggcaacactatcatctgaattcagaaaagcgttctcgaactttgacgaaacaacatatcattaccaattcccagagtttgttaaaaatcgagacgtaaacgatttccatcatgcacaagacgctttcctcgcttgtgtaataggcgaataccaactgaaaaaataccccaaagacaatctacggctcgtatatgatcaatactctaaattcctagattctttaaagaaagacactagaaaaaaaaacggcagaatgcctagatacacacaaaacggtttcatcataggctcaatgtttaacggaaaaacatatgtagacgacaatggcgaaataatctgggaccaaaagataaaagaaagtatccgaaaaacattcaactaccaccaatttaatgtcgtaaggcaaaccatagaacaacacggaaaactttttaatgacaccatccaaccacattcagaccgttataaactaattcctctgaaaaccaaccgcgacccagcaatatacggtggatacaataatgataacaacgcatactcagtagtacttgatgttgacggaaaaaaaaaaatcaacgggatacccataaggattgcaaaccaattaaaatccgacgaactcgacctctcttcatggttagaaaataatataaagcataaaaaacccatgacaattctcatagataaagtaccaaaataccaaagaattataaatgaggaaacaggagatttacttataacatccgcaaatgaagtaatcaataatgtacagctctttctaccatccatgtacaccgctctaattagcctactcgattctaccaaaacagaaatgtatagcaaattattatcaaactacgaagccaacatcctaatagacatatatgactatttattaactaaattaaaaaataattatcccctatataggaaagaatgggcaaaattagctgaacacagagacgatttcattgaaagcgatctggttactcaagcatccacgctccagcaattgataaaatttatgcacgccgacccctccaacgtcaacctcaaattcggaaattttaaaggcaacagattcggtagaaaaaacggcaacatcaaactaagtaaaaccgacttcatatatgaatcacctacaggcctgttcaaatcgattaaacacatcgactga

SEQ ID NO: 8813 - RNA, 4044 nt, synthetic construct
  misc_feature 1..4044: note = Cas9 variant
  source 1..4044: mol_type = other RNA
atgaaatcagaaaaaaaatattatataggactagacgttgggactaattcagtaggatgggctgtaaccgatgaattctataatattttaagagcaaaaggtaaagatttatggggcgtaagattgtttgagaaagccaaaactgcagcagacactcgaacatttcgatcaggacgtagacgaaatgacagaaaagggatgagattacaaatcctacgagaaatatttgaagacgaaataaagaaagttgataaagatttctatgacagattagacgaatctaaattctgggctgaagacaaaaaggtatctggtaaatattcattattcaacgataaaaacttctccgacaaacaatactttgaaaaattccccacaatatttcaccttagaaaatatctaatggaggaacacggcaaagtagatatcagatattatttcctagccataaatcagatgatgaaaagacgaggacacttccttatagatggacaaattagtcatgtaacagacgataaacccttaaaagaacaactaatcttactgatcaatgacctactcaaaattgaattagaggaagaattaatggactcaatatttgagatactagcagatgttaacgaaaagaggacagataaaaagaataatttgaaagaactgatcaaaggtcaagattttaataaacaagagggcaatatactcaattccatcttcgaatccatagtaactggcaaagcgaaaattaaaaacatcatatcagatgaagacatcctagaaaaaataaaagaagacaacaaagaagacttcgttctaacaggagactcatacgaagaaaacttacaatatttcgaagaagttttacaagaaaacataactctttttaacacactaaaaagtacatacgacttcgtaattttgcaaagtatactaaagggtaaatctacactatcagatgctcaagtcgaaagatacgacgaacataagaaagaccttgaaatactaaaaaaagtaatcaaaaaatacgatgaggatggaaagttatttaaacaagtattcaaagaagacaatggaaacggttatgtctcttatataggatattacttaaacaaaaacaaaaagataacagctaaaaaaaagatatcaaacattgaattcactaagtacgtaaaaggaatactcgaaaaacaatgcgactgtgaagacgaagcagtaaaatacctactcggcaaaatagaacaagaaaactttttactaaagcaaataagctcaatcaattccgttataccccatcaaatacacttattcgaactcgataaaatcttagaaaatttggcaaaaaactatccatcgttcaataataaaaaagaagaattcacaaaaatagaaaagatcagaaaaacatttactttccgaatcccttactacgtcggtcccctgaatgattatcataaaaacaacggaggaaatgcatggatattcagaaataaaggtgaaaaaatccgaccatggaattttgaaaaaattgttgacctacataagtcagaggaagaatttattaaaagaatgctcaaccaatgtacatatttacctgaagaaacggtattaccgaaatccagcattctatattcagagtacatggtactgaatgaactaaacaacttgcgcataaagggaaagccactcgacacagacgtaaagcttaaactcatagaagaactatttaagaaaaaaacaaaagtaactctgaaatcaataagagattatatgatacgaaataacttcgccgacaaagaagacttcgacaattccgaaaaaaacctagaaatagttagcaatatgaaatcatatatcgatttcaataacatactcggagacaaatttgaactggaaatggttgaagatctgatagaaaaaataacaatacacaccggaaataaaaccctgctcaaaaagtatatagaggaaacctaccccgatctttcttcaagccagatacaaaaaatcatcaatctcaaatacaaagattggggaaggttatctcgaaaattattagatgggataaagggcagaaataaaactgatgatgtcaacaccgtaattaacttcatgcgtaactccagcgataatctcatgcagataatagaaggaaaaaattacagtttcaacgaatacatagacaacttgagaaagaaatatataccacaagaaatatcatatgaagttgtcgagaacctctatgtgtcgccatccgtaaaaaaaatgatttggcaagtaataagagttacagaggaaataaccaaagtaatgggttacgacccagacaaaatattcatcgaaatggcaaaatcagaagaagaaaaaaagacgacgatatcacgcaaaaataaattattagacctctataaagcaataaaaaaagacgaacgagatagccaatatgaaaaactgctaaccggactcaataaattagatgagagcgaactcagatcaaagaaactatatctttactatacgcaaatgggaagagacatgtatacaggcgaaaagattgaccttgacaagctattcgacagtacacattacgacaaagaccacataatccctcaatcaatgaagaaagacgattcaatcataaacaacctagtactcgtcaacaaaaatgccaaccaaacaacaaaaggcaatatctacccagtacctagctccatacgaaacaacccagatatatacaactattggaaatatctaatggaaaaagaattcatcagcaaggaaaaatataatcgattaattaggaacacaccattgacgaacgaagaactcggcgtctttataaatagacaacttgtggaaacacgccagagcacaaaagcaataaaagagttattcgaaaaattctaccagaaaagcaaaataatcccagtaaaagcatcattagctagcgacttaagaaaagatatgaatacactaaaatcacgcgaagtcaatgacttacaccacgcacacgacgcatttctaaacatagtggcaggtgatgtatggaaccgagaatttactagcaatcctataaattacgttaacgaaaaccgtgaaggagacaaggtaaaatatagcctatctaaatatttcacgcgcccaagaaagagcaaaggtaaagtaatatggacaccagaaaagggaagaaaacttattgttgacaccctcaataaaccctcagtcctaatatcaaacgaatcccatgtaaaaaaaggagaattattcaacgctacaatatccggcaaaaaagactacaaaaaggggaaaatatacttacctcttaaaaaagatgatcggctaaaagacgtctccaaatacggtggatacaaagccataaatggggcattctttttcctagtagaacacaccaaaagcaaaaaaaggattaggagtattgagctattcccactacatcttttaagcaagttctatgaagacaaaaacactgttttagattatgccataaacgtcttacagctacaagatccaaaaataataatagacaaaataaactataggacagaaataataatagataacttttcctatcttatctctaccaaaagtaacgacggaagtataactgtcaagccaaatgaacagatgtactggcgagttgacgaaataagcaacttaaaaaaaatcgaaaacaaatacaaaaaagatgcaatactcacagaggaagacaggaaaataatggaatcatacatagataaaatctaccaacaatttaaagctggaaaatataaaaatcgtcgaactactgacacaataatagagaaatacgaaataatagacctagacacactagacaataagcaattgtatcagctacttgtagcttttatatcactatcctacaaaacatctaacaacgccgtagatttcacagtaataggtctagggacagaatgtggaaaaccaaggatcacaaatctccctgataatacatacttagtatataaatcaataacaggaatatacgagaaaagaataagaatcaaatga

SEQ ID NO: 8814 - RNA, 4047 nt, synthetic construct
  misc_feature 1..4047: note = Cas9 variant
  source 1..4047: mol_type = other RNA
atgaagaaaccctacacaattgcactagacataggaacaaattcagttggatgggtagtagtaacagatgattaccgagttccaacaaagaaaatgaaagttcttggtaatacagaaagaaaaaccatcaaaaagaatttaataggcgcgctactctttgattccggagacacagccgaaggaactcgacttaaacgcacagcacgacgtagatatacaagacgaaagaaccgattaagatatctcaaagaaattttcacagaagaaatggctaaagtagatgatggatttttccaaaggctagaggatagcttctacgtattagaagataaagaaggtaacaaacatccaattttcgcaaacctggctgatgaggttgcatatcacaagaaatacccaacaatttatcatctacgtaaagagttagtcgacaaccctcaaaaagctgacttaagattaatatatcttgcagtcgcacatataataaaattccgaggtcattttctcatagaaggcacactatcatcgaaaaataataacctacaaaagagctttgaccatttagtagacacctacaacctattattcgaagaacaacgacttctaacagaaggtataaacgctaaagaactccttagcgcagcactaagtaaatcaaaaaggctagaaaatctcatctctttaatccccggacaaaagaaaaccggaatctttggaaatatcatagcactctcccttggcttaacacccaatttcaaagccaacttcggattatcaaaagacgtgaaactccaacttgcaaaagacacatacgcagatgatttagactcactactagcacagataggggaccaatacgctgatttatttctcgcagctaaaaacttatccgatgcaatattactgtcagatatacttacagaatcggatgaaattacaagagcgccattatccgcaagcatggtaaaacgatacagggagcatcacaaagatctagtcacattaaaaactttaattaaagatcaattacccgaaaaatatcaggaaatatttctagataaaactaaaaatggatatgcaggttacattgaaggccaagtatcacaagaagagttctataaatatttaaaacctatattagctagattagatggatctgaacctttattattgaaaatagacagagaagatttcctacgaaaacaacgaacattcgacaacggatcaattcctcatcaaatacatctagaggaactacatgctatattacgcagacaagaagtattctaccctttcctaaaagataatcgaaagaaaatagaaagtttgctaactttccgcattccctactacgtaggaccattagcacgaggccacagcagattcgcatgggttaaaagaaaatttgacggcgccataagaccatggaatttcgaggaaatagtagacgaagaagccagcgcccaaatcttcatagagaaaatgactaaaaacgatctatatctacccaatgaaaaagtccttcctaaacacagtcttctgtatgaaacttttactgtctacaatgaactcacaaaagtaaaatatgcaaccgaaggaatgacacgaccacaatttttatcagcagaccaaaagcaagccattgtcgatcttctgtttaaaacaaatagaaaagtaacagtaaaacaattaaaagaaaactacttcaagaaaattgaatgttgggatagcgttgaaattacaggcgtagaagatagctttaacgcatccttaggcacctaccacgatctactaaaaataattcaagataaagactttctagataaccccgataaccagaaaatcattgaagacataatacttacgttgactttattcgaagacaagaaaatgataagtaaaagactagaccaatacgcacacttatttgacaaagtggttcttaataagttggaacgacatcattatacaggttggggcagattatcaggtaaacttatcaatggtatacgagacaaacaatcaggcaaaacgatattagactttttaaaagcagatggctttgcaaacaggaacttcatgcaattaatccacgattcagagttaagtttcatcgacgaaatagcaaaagcacaagtaatcggtaaaactgaatacagcaaagaccttgtgggaaatttagcgggttcaccagcaataaagaaagggatatcgcaaactattaaaatagtagatgagctagtgaaaataatgggatacttaccacaacaaatagtgatagaaatggcacgagaaaaccaaacaacagcacaaggaattaaaaatgcgaggcaacgaatgagaaaattagaagaaacagccaagaaactaggctctaacatattaaaagaacatccagtagacaactctcaattacaaaatgacaaaagatatctttactatttacaaaacggaaaagacatgtacaccggcgacgatctggatatagactacctaagctcctacgacatagatcacatcataccccaatcattcattaaaaacaacagcatagataacaaggtgttaacgtctcaaggagctaacagaggaaaattggataacgtaccctctgaagccattgttagaaaaatgaaaggatactggcaaagcctactacgagccggagcaatatcaaaacaaaaatttgacaatcttacaaaagccgaaagaggcggattaactcaggtagacaaagccggatttatacaaagacagctagtagaaactagacaaattacaaaacatgttgctcaaatcttagactcacgttttaacacagaatttgacgaccacaacaagagaatcagaaaagtgcacataatcacattaaaatcaaaattagtatccgactttagaaaagaatttggactttataaaataagagatattaaccactatcaccatgcccacgacgcctatctcaatgcagtcgtagctaaagccatattaggaaaatacccccaactcgctcctgaatttgtatatggcgattatcccaaatacaactcattcaaagaaagacaaaaagcaacccagaaaatgctattttactccaacattctaaagttctttaaagaccaagaaagccttcatgttaacagcgatggtgaggaaatatggaacgcaaacaaacatctaccaattattaaaaatgtacttagcatcccccaagttaacatcgtaaagaaaacagaagttcaaactggagggttttataaagaatcaatattatctaaaggaaatagtgataaattaataccacgcaaaaacaactgggacacaagaaaatatggaggctttgactcaccaacagtagcatatagcgtccttgtaatagcaaaaatggagaaagggaaggccaaggtactaaaacctgtaaaagaaatggttggaatcacaatcatggaaagaacagcctttgaggaaaacccagttgttttcctcgaagcaagaggttatagagaaatacaagaacatctaataataaaattacccaaatatagtttatttgaattggaaaatggaagaaggagattactagcctccgcaagcgaattacaaaaaggtaacgaactattcctaccagtagactatatgactttcttatacttagcggctcattaccatgagctaacaggctcatctgaagacgtattacgcaagaaatactttgtagaccgtcacttacactattttgatgacataatccaaatgataaacgacttcgctgaacggcatatcttagcaagttcaaatctcgagaaaatcaaccacacttaccataataactcggacctaccagtaaacgaacgagccgaaaacataataaatgtattcacattcgtagcactcggcgcacccgcagcattcaaattctttgatgcaaccattgacagaaaaagatacacaagcaccaaagaagtattaaacgctaccctaatccaccagtccgttacaggactatacgaaacacgaatcgatctctctcaattaggtgaaaactga

SEQ ID NO: 8815 - RNA, 4047 nt, synthetic construct
  misc_feature 1..4047: note = Cas9 variant
  source 1..4047: mol_type = other RNA
atgaaatcagaaaaaaagtactatataggtctcgacgtaggaacgaactcagtaggctgggctgtaaccgacgagttctacaatatattaagagcaaaaggcaaagatctttggggggtacgcctctttgagaaagcaaaaacagcagctgacacacgcacatttagaagcggaagacgaagaaacgatcgcaaaggagtgagactacaaatactacgtgaaatattcgaagacgagattaaaaaagtcgacaaagacttttacgaccgactagacgaaagtaaattctgggccgaggacaaaaaagtgtcaggtaagtacagcctcttcaacgacaaaaacttttccgacaaacaatatttcgaaaaattcccaactatatttcatctccgaaaatacctaatggaggaacatggaaaagtagatataagatactatttcctagcaataaaccaaatgatgaaacgaagaggacactttctaatagacggacaaatttcccacgtgacagacgacaaacccctcaaacaacaacttatactccttattaatgacctactaaaaatagaacttgaagaagagtttatggactctatattcgaaatactagcggatgttaatgaaaagaaaactgaaaaaaaaaacatcctaaaagaattaataaacgcacaagacttcaacaagcaagaaggaaagatactatattccatattcgaatccatagttacaggtaaagcaaaaatcaagaacataatatcagacgaagatattctcgaaaaaataaaagaggacaacaaagaagacttcgttctcaccggcgactcatatgaagaaaacctacaatatttcgaagaagtcttacaagaaaatataacattatttaacacgctaaaaagcgcctacgactttgtgatactacaaagtatactaaaaggcaaatcaactctttccgatgcacaagtcgaaagatacgatgaacacaaaaaagacctcgaaattttaaaaaaagttattaaaaaatatgatgaagacggaaagttattcaaacaagtcttcaaagaagacaatggcaacgggtatgtatcgtatataggatattacctaaataaaaacaaaaaaattacagctaaaaaaaaaatttcgaatatcgaatttactaaatatgtaaaaggaatcttagaaaaacaatgcgactgcgaagacgaagacgtcaaatacctgctaggaaaaatcgagcaagaaaacttcctattaaaacaaatatcgtcaattaattcggtcataccacatcaaattcacctcttcgaattagataagattttagaaaatttagccaaatattatccatcattcaataataaaaaagaggaatttacaaaaatagagaagattcgaaaaacctttacattcagaataccatattacgtcggacccctaaacgactatcataaaaacaatggcggcaatgcttggatattcagaaacaaaggtgaaaaaattcggccctggaacttcgaaaaaatcgtagacttacataaatcagaagaagaatttattaaacgtatgttaaaccaatgcacctacctcccggaagagaccgtactaccaaaaagttccatactctactccgaatacatggtattaaatgaactaaacaatttacgaataaacggaaaaccaatagacacagacgttaaattaaagttaattgaagaactatttaagaaaaaaacaaaagtcacactaaaatccatacgagactacatgatcagaaataactttgccgataaggaagatttcgataattcggaaaaaaaccttgaaattgtatctaacatgaaaagttatattgacttcaacaacatactcggagataaatttgaattagaaatggtagaggacctgatagaaaagataacaatacacacagggaataagaagctattaaaaaaatacatagaggaaacctacccagacctcagttcctcccagatacaaaaaataattaacctaaaatataaagattggggacgactatcacgaaagctactcgatggaataacaggaactaacattgagactggagaaatagacaccgttataaattttttaagaaatagctccgacaacctaatgcagatcataggtagtcagaactactcattcaataacgacatagataaattaagaaaaaaatacatcccacaggaaataagttacgaagtagtagaaaacctatatgtaagtcccagcgtaaaaaaaatgatatggcaagtaataagaataaccgaggaaataaccaaagtcatgggctacgatccagacaaaatttttatagaaatggcaaaaagcgaggagggaaaaaaaaccacaatctcaagaaaaaacaagctcctggcattatataaggctatcaaaaaagatgaacgcgacagccaatacgaaaaattattgacaggcctaaacaaattagacgacagtgatttaagatcaaggaaattgtacttatactacacacaaatgggtagagacatgtacacaggagaaaaaattgatctagataaactattcgacagcacccattacgataaagaccatatcatccctcaaagcatgaaaaaagacgacagcataataaacaatctagtactagttaacaaaaacgcgaatcaaaccacgaaaggaaacatttatccagttccatcatccatacgtaataacccgaaaatatataactactggaaatacctgatggaaaaagaattcatctcaaaagaaaaatacaacagattaatacgaaataccccactaaccaacgaagaactcggaggattcataaaccgtcaactagtagaaaccagacaatcaactaaggcaataaaagaattattcgaaaaattctataaaaaaagcaaaataataccagtaaaagctatattagcgagtgacctaagaaaggacatgaacactctcaaatcgagagaagtcaacgatttacaccacgcacatgacgctttcctaaatatcgttgcaggcgatgtctggaatcgcgaattcactagtaacccgataaactacgtaaaggaaaacagggaaggcgacaaagtaaaatacagtctatcaaaatatttcacacgtccacgcaaatcaaaaggcaaagttatatggacaccagaaaaaggccgtaaattaatagttgacacattaaacaaacctagtgtactcataagtaatgaatcacatgtgaaaaaaggagaattattcaacgctaccatagccggcaaaaaagattacaagaagggaaaaatatacctaccactaaaaaaagacgacagactacaagacgtcagcaaatacggcggctataaagcaataaatggagcattcttcttcctagtagaacacactaaatcaaagaaacgaataagaagtatagaactctttccactccatctccttagtaaattctatgaagacaaaaacacagtattagattatgcaatcaacgtccttcaattacaagaccctaaaataatcatagataaaataaattatagaacagaaataataatagataatttctcgtatttaataagcactaaatcaaacgacggatcaataactgtaaaacccaatgaacaaatgtactggagagtagacgagatatccaatcttaaaaaaatagaaaataaatacaagaaagatgctatactaacggaagaagatcggaaaataatggagtcttacatagataaaatttatcaacaattcaaggcaggcaaatataaaaacagacgaacaacagataccataatagaaaaatacgaaataatcgacttagacacgctcgacaacaaacaattatatcaattactcgttgctttcatctcactctcatataaaacaagtaacaacgcagtggattttactgtaatcggcctcggaacagagtgtggtaaaccaagaataacaaacctaccagacaatacgtaccttgtctacaaatcgatcacaggaatatatgaaaaacggatcagaataaaatga

SEQ ID NO: 8816 - RNA, 4047 nt, synthetic construct
  misc_feature 1..4047: note = Cas9 variant
  source 1..4047: mol_type = other RNA
atgaaatctgaaaaaaaatattacataggcttagatgtgggaactaactctgtgggatgggcagtcaccgacgaattctataatatattgagagcaaaaggaaaagacttatggggagtcagattattcgaaaaagcggacactgcagcaaatacacgaatattcagatcagggagaagacgaaatgatcgaaaaggaatgagactccaaattttaagagaaatattcgaagacgaaatcaaaaaagtagacaaagatttctatgatcgacttgacgaaagtaaattctgggcagaagacaaaaaggttagtggcaaatattcactgtttaacgacaaaaacttttcagataaacaatactttgagaagttcccaaccatattccacctacgcaaatatttaatggaagaacacggtaaagtagatatacgatattactttttagctatcaatcaaatgatgaaaagaaggggccacttcctaatcgacggacaaatatcacacgtcacagatgataaaccactaaaagaacaactaatattacttattaacgacctactaaaaatagaattagaagaggaattaatggactcaatctttgaaattctagcagacgtaaacgaaaaaagaactgataaaaaaaacaacctaaaagagctcatcaaaggccaagactttaacaaacaagaaggaaacatattaaattccatattcgaaagcatagtaaccggaaaagccaaaatcaaaaatataatctcagatgaagatatacttgaaaaaataaaagaagataataaagaggacttcgtacttacaggagacagctacgaggaaaatttacaatacttcgaggaggttctccaagaaaatataacgttatttaacactttaaaatctacatatgattttctaatactgcaatcaatactaaaaggaaaatccacattaagtgacgcacaagttgagcgatatgacgaacacaagaaagacctcgagatcctgaagaaggttattaagaaatatgatgaagacggcaaactatttaaacaggtattcaaagaagataatggcaacggatacgtatcttacatcggatattaccttaacaaaaacaaaaagataacagcaaaaaaaaaaatatctaatatagaattcaccaaatacgttaaaggaatactagaaaaacaatgcgactgcgaagatgaagacgtaaaatatctactaggcaaaattgaacaagaaaattttctgctcaaacaaatctcatcaataaactctgtaattccacaccaaatacacttattcgaactcgacaaaattctagaaaacttagctaagaactacccaagttttaataacaaaaaagaagaattcaccaaaatagaaaaaatacgaaaaacatttaccttcagaattccttactacgtaggccccctaaacgactatcataaaaacaacgggggcaacgcctggatattcagaaacaagggcgaaaaaatcaggccatggaacttcgaaaaaatagtcgatctgcacaagtcagaagaagaattcatcaaaagaatgctcaaccaatgtacatatttaccagaagaaacagtattacccaaatcatcaatattatactcggaatatatggtcttaaacgaattaaacaatctaaggataaacggaaaaccattagacactgacgtaaaactcaaactcattgaggaactatttaaaaagaaaactaaagtaacactaaaatctataagagactatatggtaagaaacaactttgctgacaaagaagacttcgacaattcagaaaaaaatttagagatagcatccaacatgaaatcatacatcgacttcaataacatactagaagacaaattcgatgtagaaatggttgaagacctcattgagaaaatcaccatacacacaggaaataagaaacttctaaaaaaatacatcgaagagacatacccggatttatcaagttcccaaattcaaaaaataataaacctaaaatacaaagattggggcagactgagccgcaaactattggacggtataaagggtactaaaaaagaaactgaaaagacagatacagtaatcaatttcttaagaaattcatctgataatttaatgcaaataattggttcacaaaactatagcttcaatgagtatatagataaactgcgcaaaaaatatataccacaagagataagttatgaagtagtcgagaacctatatgtcagcccgagcgtaaaaaagatgatttggcaagttatacgagtgacagaagaaataacaaaagtaatgggatacgatccagacaaaattttcatagagatggccaaatcggaagaggaaaaaaaaaccacaatatcgaggaagaacaaactgctagacctatataaagcaataaagaaggacgaaagggacagccaatacgaaaaactgctaacagggctcaacaaactagatgactcagatctccgatccaggaagctatacctatactacacacaaatgggcagagacatgtacacaggcgagaaaatagacctcgataagttattcgatagcacacactacgacaaggatcacatcattccccaatcaatgaagaaagacgactcaataataaataacttagtactagtcaacaaaaatgcaaaccaaacaaccaaaggaaatatatatccagtgccatcctcgatcagaaacaacccaaaaatctataattactggaagtacctcatggaaaaggaatttatctcaaaggagaaatacaacagactcataagaaacacacccctaactaacgaggaactaggaggattcataaaccgccaacttgtagaaacacgacaaagcacaaaagccataaaagaactatttgaaaaattctatcaaaaaagtaagattataccagtaaaggcctccctcgcttcagacctcagaaaagacatgaacacactcaaaagcagggaagtaaatgacttgcaccatgcacacgacgcatttttgaacatagtagctggagatgtatggaatagagaatttacgtcaaatccaataaattacgtaaaagaaaaccgagaaggtgataaagtaaaatactcgctttctaaagacttcacacgaccacgtaaaagcaaaggaaaggtaatctggacacccgaaaaagggagaaaactaatcgtagataccttaaacaagccatcagtactcatatcaaatgaaagtcatgtaaagaaaggggaattgttcaacgcaacaatagcaggtaaaaaagactataaaaaaggcaaaatatatctacccttaaaaaaagacgacagattacaagatgtttctaaatacggaggttataaagctataaatggggcctttttcttcctagttgaacatacaaaatcaaaaaaaagaattagatcaatagagttattccctctacacctcttatcaaaattctatgaagataaaaatacagtactcgactatgcaataaatgtacttcaacttcaagatcccaaaatcataattgacaaaatcaactatagaacagaaattataatcgacaactttagctacctaatctcaactaaaagcaatgacggcagtataactgttaaaccaaacgaacaaatgtactggcgagtagacgagattagcaacttgaagaaaatagaaaacaaatataagaaagacgccatactgacagaagaagacaggaaaattatggagtcttacatagacaaaatataccaacaatttaaagcaggaaaatacaaaaaccgaagaacaaccgacacaattatagagaaatacgaaataattgacttagataccctagacaacaaacaattatatcaactcctcgttgcattcatctcattatcatacaaaaccagcaataacgcagtagattttaccgtcataggattagggaccgagtgtggcaagccaagaatcacaaatctaccagacaacacttatttagtatataaatccatcaccggaatctacgaaaaaagaataagaataaaatga

SEQ ID NO: 8817 - RNA, 4047 nt, synthetic construct
  misc_feature 1..4047: note = Cas9 variant
  source 1..4047: mol_type = other RNA
atggaaaagaattattatctcggactagaccttggatcgaatagcgtagggtgggccgcgacagacgaagattataacttcctccgattaaaaggtaagacagcatggggtgccagaattttcagcgaagctaaagactgcaaagaacgaagaacttacagatctaacaaacgacgcctagccaggcgcaagtacagactagtattactaaaacagttatttgcagaagaaatgactaaagtagataagactttctttttgagattagccaattcaacatattgggaagaagataaaacgaaagactccgatgggaatgaaataggaaaaaatctaatcttcaaaacacatgaagaagaaaaacaatactatactaaatatccaacaatatggcatcttcgaaaagctctaatagaaaacgacgaagaagcactgtcaaatctcagatacgtatatctagcgatacatcacattgtcaaatatagaggaaatttcttaacagagggcgaaatgggcaacgatatacccccaataacgaccatagaagaaataaaccaaacactatctctcctggaagtagatagcagcgaagatgcaactgacaaaactacttacataaaacccgaatcctacaacgaattatttacaatcctcgaaaacaacaacctaaacaaagtaaaaaaacagcaagaaatagataaattatttataagctccaaagaaagatcagaaaacataaaaaattacatcaatttattcaaaacaataatagtcggaggctcattctccttgaaaaaaatcaacgaagacacagaagacatttcagtggattttacaaaagactttgaaaactcagaagccgacatatccaaagcactaggagattcgttcaacctagtgttaatagccaaaaaatattatgattatattatactaaaagaactattaggaaaaaataaagaaatatccgaagcaatggtacaaatatacgaggaacacaaagacgacttaaaatccttaaaaaccatacttaaagaccttgacaataaactcggaaatgatggcaaagatcgaatttactactccgtgttcaagcaagaaccgacagaaaaatttaaagaaacaaactatttaagctttgtacaaggcgggaaactagaggaactaaacaagtacataaaaaaaatacttgaaaacaatgagaaagacattgatgacaaggagacatacaacgcattatatgaaaaagcctgtaaaggcgacttattcaaaaaacaagccaacgcatgtacaagtctgatcccacatcaatttcatctccgcgaactaaaaaagatcctcgaaaatgccggaaggaaatactcctttctaaatgatatcagcgataaaataataaaaatattcaaatttagagttccttactactatggcccactaaacaacgagtctaatgcacactcatgggtggtcaaaaaagagggtcaagaaaaagcaaaaataacaccatggaacataaacgaaatcatcgacacccccaaaactcgcgataacttctttaaaaaactaacaaattcatgtacatacctagtaggggaaactgtattaccaaaaacatccctatactacgaaaaatatctagtattagatcgactcaacaaaatgcaggtaaatggagactacctaagcgcaagcgaaaaaaacgacgtcttaaaatttatcctttctcgaaagactacaaccatagaacaaatcagaacctatttatcaaaaaataaatctactaaagctaacgacatttctatctccaatataaaggccaccgacccctttaacgctgtaagccacgcattctacggaaaacacccagacctcaacataaacttatgcgaggaactaatcaaattcgctaccatctacgctgatgataaaaaagaacttaaaaaatttgtctcctcgaatttcaaccttacagacgaattcatcaaagaatacctaaacactcccactaataaatggggacgattaagcagaaaatttctctgtggcggcgatcaactcgaaatgtattacgtagacgacaacggaatactacatagtatcctcaatatactagaagaaacaaacgaaaatttacaagaaatacttaacaacgaaaaatacggctttaatcaaaagatagcagactttaataacacactaaccgctgacaaaacaacagaagaacaaatagaagacattctagactccacacctgcactaatgaggcgatcaataatacagactttagcagtagtagatgatgtaataaaagcagccggaaaagcaccgcaaaaaataatgatggaagttacccgtactgatggcaaaaaagaagaaacaaaatcgcgatacgtacaactgaaaaaacaaatcacaaacgacaaggttctcacgtcagacgaaaaaaaggaactcttaacaaacctcgaaaacaaaaaaatccaactaaagggcaaacacatctacctctactttatgcaaatgggaatagatttctacactggaaaaataatggatataaacgacgttattaacggaaaatacgatatagatcacatcattccccagtcaatgatcaaagatgacagtttagataatatggtgttagtatcaaaagactataaccagaaggtaaaaaaagatatataccctatttgtgatgaaattagaaacaacatgttagataaatggaagggctattacgcaagaaaaatcatttccgaagaaaaatataatagattaaaaagaacaaaagaattaaacgctgatgaaataaacgccttcattaataggcaaatcaacgtagtaaattactctaacattcaaatcaaacgcatctttgaaataaaataccctgaaactaaaataatattctcaaaagctagctttcctagcctactacgaaaagagtatgaaattgcaaaaatgcgagaccttaacgatgcacatcacgcggtagacgcatacctcaacatagtctgcggaaatatcttaacaacactttacacagatatattttacatgttcaaagaaaaaaaagaagaccacaaaaacatctcattcaacatggaaaaacgtctcataaattacattgacaaaaacaatcttaaagacaaaataaaaacttcatgtctaaggcacgatgcattaataacctacaaaccagattacgattctggtaaattctacaaagaaaccatattcaaaaaatccggagataaagaaacaggcttaataccactgcatacaaaaggcccaatgagcgatacgaaaaaatatggaggctactctcaattatcacaatcatatatcattgcagtagaatataaattaaaaaacaaaacagtaaaaaaactatgtcgagtccccacgctatatctcaaacaatataagaacgatttaaataccatcgcaaaaatcatgatagacgacgaaaaagcaactgacataaaagtcctcaggaaaatatacctcaatcaaaaaatcagatacaacgggtgctattacctaatatatacgagcaaagaaaaacaaaacaagtacaaaatggcctatcaaaattatctcgacaacgattatctgatctacttaaataagtgtctaaaaaaaatagacgaacttgatgacggagaactcacatcccaagaatttattgttaacaaagacggagacaaattcttaatagacaagaaccataatttagaaatattcaaatcaataaaagaacagtacaataaaacaatttacgattatactccttatatcgtccaatcaagggaaatgaaagaagaagacttcaacaacctttcactaaaaaaacaaatcgatacactattaaacatgatcaaaatcctaagtagaagcaatgaacaagctaaatttgaaactgcattctttgaaaacttcacaaaagttttcctcaaaacaatgactataactaacgagaaagtttacatagtgaacgaatcaccatcaggattatttaaaggcaaggaagaattgatatga

SEQ ID NO: 8818 - RNA, 4047 nt, synthetic construct
  misc_feature 1..4047: note = Cas9 variant
  source 1..4047: mol_type = other RNA
atgaaaaagttcgaagactattacctaggactagacttaggaacctcatccataggctgggcagttacgaacgaaaaatacgacatattaagattcaataaaaaatttatgtggggaacccatttattcgacatgggaaatacagcatctgaacggagaatattcagaacaagcagacgtcgactcaagaggaaaaaaaacagaatagaactattacagactctattctcagctgagatgtcaaaaaaagacttcggtttcttccaaaggttaaaagaatcacaatacttcatcgaagataaaacctttaaaaacaaaaatacgctattcatggacgaaaactacacagaccaagactatcacatggaatatccaacaatatatcacctccgaaaagcactaatcgataacgaagaatcagccttcgagatcagaaaattatatctggcaatatcacacatactatctcatcgtggacatttcttatttgaaggagaattaagcgataatttagattttgacgacatttttaatgaattcgtaaaatatctaaatgaagaactcaacatagattttaaaataaaatcagacgtaagtctacaagccattaaagaaattctaacagataaaatgttaaatagaacaaaaaaaaaagaaaagctaagtgaattactagaggaggaaaagaataaaatctatcaagagatatggaaactactggtcggcaatgaggcaaagatgagtacaatattcgatgacaaagaatacgaagaagccaaaatagccttcagtaagggaaattacgacgaaaaagaggaagaatatgaaagcatactaggagaaaaaattcttttcgtacaaaaagcaaaagcaatatacgactggatgttattacaaaacatactcaaagaagacaaatacctatcatattcaaaagtcaaactttacaacgaacacaaaaaagatctaaagatattaaaagacgtactgaaaaaccttgataaaaaaatatacaaagagatattctctgaaaacggtctatacgaagagtatctacgcatagaaaaaaaaaaaataggatctaaagaagaaaaaacaaaagatatcctttacaacagactcaaaaaaattttcgaaaacagagataacatggctatagaggacattcttaacaaaatcgaactagatagtttcttacccaaacaaaaaataaaagacaacggcgttattccacgacaagtacatcaaaaagaactagagatcatattaaaaaacgctgaaaaatatttcaaatggctcatagaaaaagacgaaaccgggctatcagtctccgaaaaaattatgaaaatattcaagttcaaaattccttactacgtagggccattaaactcaaaatcacccttcgcatggatcgaacgaaaggaatacggaaaaattctaccctggaactttgaaaacatggtcgacatgagcaaaactgccgagaaattcataaaaagaatgactaataaatgcacttacctaccagaaaaagacgtcatacccaaaaactcacttctgtacacaaaatacatggtcctgaatgaattaaacaatctaaagatacgtggagaaaaaataaaagtagagttaaaacaaaaaatctatacagaactattccaaaaaaataaaaaaataggtatgaaaacactaatagaatttctaaaatcgcaaaatattgtagtgacaaaagtggaaatcaccggaatcgacggaaccttcaacacttccctaggatcctatatagacatgaaaaaaatattcggagaagaaaaaatagtcaaagactcctacaaaaaaatgatagaagatatcatattatggataactctatacggggaagaaaaaaaactcataaaatcaaagatagaagaaaaataccccgaaaaagtaacaccggaagaaatgaaattaatactaaaactaaaatacagagattggagtagattaagcaaagagttcttaactgaaattgaaacaatggacgaagagacaggcgaactcatatcaatcatcgaaatgctatggagaaaaaacgaaaacatcatggagttactttcatataaatacgatttttcaaacaggataaaagaatacaacggaatcaacgaaaaggaaaaaaacataacatatgaagacctagtcaaagacctccaaatctcaccatccgtcaaaaaaatgatctggagagctttagtgatagtaaaagaaatcaaaaaagttacgaataagtccccaaaaaaagtcttcattgaaatggcacgggacactcaaactgagaaaaaaagaaccgaaaaacgcaaagacaaacttttagagttatataaaaacataaaaaacgacgatagcatcaaagagctagagaagaatttaaaagacaagacaaacgacgatctcaaatctaaaaaattgtatttatactatctccaactaggtcgatgtatgtactccggagaagtaattagactagaagacttgatgaacgacaatctatatgacatagatcatatatatccacaatcaaaaataaaagacgactcattcgacaatacagtactcgtcaaaaaacaaataaacgccgacaaaaccaacgaatacccaatagataaaagtatacagaacaagtgcaaagcattctggacgtccctaaaagaacgaggcttaatgagcaacactaaatacgaacgattaacaagaactgagggcttctcagatgacgaattagcgggatttataagtcgacagatagttgaaacgcgacaagcaactaaagtcctagcagacttactaaaagtcatcttcggctccgatactagaatagtgtacgtaaaagcaggactgacatcagacttcagacaaaaattcggtatatacaaattcagagaactaaacgactaccatcatgcacatgacggatacctcaatatagttacaggaaacatatacaacactctatttacagacaacccgtataatttcataaaagacagaaagaaagataacagaacttacaatctcaacaaagtattcgaacgagagaatgacgtatggaatccggacgtaatgctcagcaaaatcgagaggtatatatataaaattagaccactttttaccagagcaagctacgaacaaaaaggcggatttagtgatcaaaacatatcctccgaaaaggacaaactacgaccattaaaatcaagtggtgtactatcaaatataaaatatggaggatatgacaaaataaaaaacagttatttctttatagtcgagtatacagaaaaaaaaaaaagagttagatctatcgaaacactgcccatatacatcaagaaatcaattagtacgaaagaagacttagaaaaatattgtaaagaagaactcaaacttcaagaacctaaagtcctcgtatcaaagctaaattacaaatccttaatttactctaatggccacgaatattatataaacagtaaaacggccgactccatcactatacaaaacggaatacaaattattctgacaaaagaaaactacgaaacctaccgaaaaatatacaagaatctagaatatctcaaactcatatataaagacgaaaaaattagagaagaaaaaatacttgagaaaattcccaaaatactgaaaaacaacaaaaatgatagagatctaagtgaagacgaaataagcgaaaaattctggaaactctacaaagaaatatttgaaaaaataaaaataggtatattctctaaatttaaaagcacactacctatatatatagaagattgcaaaaaactaaaagatttcaccacactcaataattacgcaaagagccggttcatacaagaaattttaaaatgcctgaattcccaacaaggagaatttgacacaaaatatacacacaattattcaaaaaaatacaacacaaaactatccaaatcgaaaatactggaaaatgatttctatattataaaccaaagcccgacagggttattcgaaaaaaaagtatttctagacaaatga

SEQ ID NO: 8819 - RNA, 4047 nt, synthetic construct
  misc_feature 1..4047: note = Cas9 variant
  source 1..4047: mol_type = other RNA
atgggagaagatggaaaaccattaagagtaaaaggaaaaaccgcaataggagctcgtctatttcaggaaggtaatcccgctgcagataggagaatgtttagaacaactcgaagaagattaaatcgaagaaaatggagactaaaactactcgatgaaatatttgatccatatataactccggtagactcaacatttttcgcccgtctaaaacaatcaaacttatcaccaaaagactctcgaaaagaatttaaaggatctatgttatttccagatcttacagataaacagtatcatttagactaccctaccatctaccacctccgacacgcattaatgacacaggacaaacaattcgacataagaatggtttatctagcaatccaccacattgtcaaatacagagggaactttctcaattcgacacctgtcgacagttttaaagcatcaaaagtcaacttcgacgaccaattcaagaaactcaatgaattgtacacagcaataaaccccgaagaatcctttcaaattaacttagcaaactcagaaaagatcggacaacaatttctagacccatctataagaaaatttgataaaaaaaaacagatacctaagatagtaccagtaacaatggatgacaaagcggtggataaattaaacggaaaaatagccagcgaaataatcaatgcaatattaggatacaaatcaaaacttgatgtagcagtacaatgtgatcctgaagattcaaatccttgggcagtaaaatttgatgatgaagacattgatgcaaaacttcaaaaaatcttaccggaaatggatgaaaaccaacaatcaataatcggcatcattcaagatttatactcccaagtaacacttaaccaaatagtaccaaatggcatgagtttaagtgaatccatgattaaaaaatacaatgatcaccacgatcatttaaaattatacaaaaaattaataggccaaatcagcgacagcaaaaaaaaaaccgcattaaaaaaagcatacgatcaatacgtaggaaatgatggaaaagttatcgaacaagatgatttttactcatcagtaaagaaaaatttagacgactccgaactttccaaacaaataatggaccttattgacgcagataagttcatgccaaaacaacgaacgtctcaaaacggtgtcatcccgcatcaactacatcagcgagaactcgacgaaatcatagaacaccagagcaaatactacccatggttagccgaatccaacccaaacaagcatgacctgcatctagccaaatataagattgaagaactcgttgcattccgaatcccatactacgtaggaccaatgataaccccagaagatcaaaaaaaaagcggagcagcagtattctcatggatgaagcgaaaagaaccaggacaaattacaccatggaattttgatgaaaaagtagatcgtatggaatctgccaacaaatttataaaaagaatgacaacaaaagacacttacctaatcggagaagacgtactacctgatgaatcactattatatgaaaaattcaaagtactaaacgaattaaacatggttagagtcaatggggatagtctaaaagtggccgacaaacaagcaatttatcaagatttgttcgaaaattataagcacatttccgtaaaaaaattacaaaattatataaaaggaaaaactggtctaccaaataaccccgagatttcgggactctctgacccagaccaattcaacaattcattaggaacatataatgactttaaaaaactcttcggcgataaagttgatgatcccgacctacaaaatgacttcgaaaagattgtagaatggtcaaccgtatttgaagataagaagatactaagagcaaaattaaatgagataacatggttaacagataaacaaaaagacgaccttgaatcatcgcgataccagggttgggggagactatcaaaaaaactactcacaggaatcgtaaacgaccaaggggaaagaataatagacgaactatggaacacaaataagaatttcatgcaaatacaatcagatgacgatttcgccaaaagaatccatgaagcaaatgccgatcaaatgaaatcaacaaatatggaagacgttcttgcagatgcctatacatccccccaaaataaaaaagcaatccgacaagtagtcaaagtcgtagacgacattcagaaagctatgggcggggtagctccaaaatttatatccattgaattcactagatccgaagacaggaaccctagacgcacgataagcagacagagacaactagaaaacacattaaaagataccgcaaaatcattagtaaaatctatgaatccaaatatcctctcagaactagacaacgccagtagaagcaaaaaaggactcacagatagattatacttatatttcacacagttaggaaaagatatgtataccggagaacctataaacatagatgaaataagtaactacgacatcgaccacatattgccacaagcatttataaaggacgacagtttaagtaatagggttttagtttctaaagcagtgaataacggaaaaagcgctaatgtaccactaaagcttttcggagcaaaaatgggacacttctggaaacaactagcagaagcaggcctaataaataagcacaaacttaaaaacctccaaactaatcccgatacaatttccaaattcgcaatgcacggcttcatacgaaggcaactagtagaaaccagtcaagtaataaaactcgtagctaacatactcggtgataaatatcgaaacgacgataccaaaataatagaaatcacagcacgaatgaatcaccaaatgagggatgaatttggttttattaagaaccgtgaaataaatgattatcaccacgcatttgacgcatatctgaccgccttcttaggaagatacttataccacagatatatcaaactccgaccatacttcgtctacggtgatttcaaaaaattccgagaagataaagtaacaatgagaaactttaacttcctccacgacttaacagacgacacccaagctagaatagccgatacagaaaccggcgaagtcatttgggatagagagacatctatcaaacaactacgtgacgtgtaccattacaaatttatgctaatcagccaagaagtttataccctcagaggagcgatgttcaatcagacaatatatccagcctctcaggctggtagaaaaaaactcatacccatgaaggcagataaacccgtagacgtatacggcggatatagtggttcaacagacgcctatatggcaatagttagaatccatgataaaaaaggagataaatacaaggtcgtgggagtaccgatgcgcgctttaaatcgtcttaacacggctaaaaatgttagtgacgcaaaatatgatcaagaactcaaagaagtcctaacaccccaattcactaaatccaaaaaaaacagaaaaaccggagaaataacccaaacagtggaagatttcgaggtagtactaggaaaagtaatgtatcgacaactagtcatagacggcgataaaaaatttatgttaggttcatcaacctatcaatataatgcaaaacaactggtactttcagatgaaagtataaaaacattagcgagtgagggaaaactaaacgaagcacaagaatccgccgcttacgacaaagtatacgatgaaatccttgacaaagtaaacaaatacttcgctttatacgacaccaacaaatttcgacaaaaactatcacttggaaaggacaaattcgtaggattacccaatcacaacgtttttgatgggagcaaaaaaataagctccggaaaacgggaaatccttaatgaaattttaaacggtcttcacgcaaacgcgacactaggaacattatcagatataggtttctcaactccatttggcaaaatgcaacaaccaagaggcatcggcctaagctctaacacctccatagaatatgaaagtttcactggtttatttaagagaaccatctttttaaaagatctttga

SEQ ID NO: 8820 - RNA, 4047 nt, synthetic construct
  misc_feature 1..4047: note = Cas9 variant
  source 1..4047: mol_type = other RNA
atgaagaaaccatatactatagcactagacatagggacaaactcagtaggctgggttgttgtcacggacgattacagagtaccaacaaagaaaatgaaagtactaggaaataccgaaagaaaaacaattaagaaaaatttaataggagcactactgtttgactctggtgatacagcagaaggaacaagactcaaaagaacagcaagaccaaggtataccaggagaaagaaccgactcagattcctaaaagaaatctttaccgaagaaatggcaaaagtggacgatggattctttcaaagattagaagattccttttacgtactcgaagacaaagaaggaaataaacatcctatcttcgccaacctcgccgacgaagtagcatatcataagaaatatccaacaatatatcatctcagaaaagaacttgtagataacccacaaaaagccgacctccgacttatatacctagcagtcgcacacataatcaaatttcgaggacactttctcatagaaggcaccttatccagtaaaaacaacaatctccaaaaatcattcgatcatctagtagatacatacaacttactcttcgaggaacaaaggttattaactgagggaattaacgcaaaagagcttctaagtgcagcattaagcaaaagtaaaagattagaaaatctgatctctctaattccaggccaaaagaaaaccggtatttttggcaacataatcgccctaagcctaggactcacaccaaattttaaagcaaatttcggattatcaaaagatgtaaaacttcaactagccaaagacacatatgccgacgatctcgattccttattagcgcagatcggtgaccaatacgcagacttgtttctagcagccaaaaacctaagcgacgcaatactcttatctgacatactaacggaatccgacgaaataactagagccccgctctcagcttctatggtaaaaagataccgagaacaccacaaagacttagttacactcaaaacattaatcaaagatcaactacctgaaaaatatcaagaaatctttctagataaaaccaaaaacggatacgcgggctatatcgaaggacaagtctcccaagaagagttctataaatatcttaaacctatccttgcaagattagacggcagtgaacccttactactaaaaatcgatagagaagatttcttgcgaaaacaacgaacatttgacaacggatcaataccacatcaaattcatctcgaagaattacatgcaatactacgaagacaagaagtattctatccatttttaaaagataaccgaaagaaaatagaatcactcttaactttcaggataccctattatgtaggacccctcgcaagaggacattcaagatttgcttgggtcaaaaggaaatttgacggagctattcgcccatggaactttgaagaaattgttgacgaagaagctagtgcccaaattttcatagagaaaatgacgaaaaacgatttatacctaccaaatgaaaaagtactacctaaacattcacttttatatgaaacatttacagtttacaacgaactgacaaaagtcaaatacgcaacagaaggtatgacaagaccacaatttctatccgcagaccaaaaacaggctatagtagatttactttttaaaaccaaccgcaaagtaacagtaaagcaactaaaggaaaattattttaagaaaatagaatgctgggactccgtcgaaataaccggagttgaagactcttttaacgcctccttgggaacctaccacgatttactaaaaataatacaagataaagattttctcgataacccagataaccagaaaattattgaagatataattttgacactaacgctttttgaagataagaaaatgatatcaaaaagactagatcaatacgcccacttgtttgacaaagtggtactaaataaacttgaaagacaccattatactggctggggtagactatcagggaaattaattaacgggataagagacaaacaatctggcaaaacaattcttgactttttaaaagctgatggatttgcgaataggaatttcatgcaactaatccacgatagtgaactctcgtttattgatgaaatagcaaaagcacaagtaatcggaaaaactgaatactcaaaggatttagtaggaaatctagcaggaagccctgcaataaagaaaggaatttcacaaacgataaaaatagttgacgaactcgtaaaaatcatgggctaccttccacagcaaatagtaatcgaaatggcaagagaaaatcaaaccacagcccaaggaattaaaaacgcaagacaaaggatgcgaaaactagaagaaacagccaagaaattagggtcaaatatattaaaagaacacccagtagataactctcagcttcaaaatgacaaaagatacctctactacctacaaaatggtaaagacatgtacacaggagatgatcttgacatcgactatctatcaagttatgatatagaccacataataccacaaagttttattaaaaataatagcatcgataacaaagtactaacgagccaaggcgcaaacagaggaaaattagacaatgtgccgtctgaagcaatagttagaaagatgaaaggatattggcaatccctacttagagcgggcgcaatatcgaaacagaaatttgataatttaaccaaagccgaacgaggagggctaactcaagtggataaagccgggtttattcaacttcagctagtggaaacacgacaaataacaaaacacgtagcacaaatattagatagtcgatttaacaccgaatttgacgatcataataagcgaattagaaaggttcacatcataacgttaaaaagcaaacttgtttcagacttccgaaaagagttcggactatacaaaatacgagacataaaccactaccaccacgctcacgatgcataccttaatgctgtagtagccaaagcaatcttaggaaaataccctcaattggcacctgaatttgtttacggagactatcctaaatataactcattcaaagaaagacaaaaagcaacacagaaaacactattttactcaaacattctaaaattctttaaagatcaagaatcactacacgttaatagtgacggggaagaaatatggaacgccaataaacatctacctataattaaaaacgtactaagcattccacaagtaaacatcgttaaaaagacagaagtacaaacaggaggtttttacaaggaatctatactaagtaaaggaaactcagacaagttaatcccacgcaaaaacaattgggatactagaaaatatgggggatttgattcacctacagtagcatattcagtactcgtaatagcaaaaatggaaaaaggaaaagcaaaagtcctgaagcctgttaaagaaatggtaggcataacaataatggaacggatagcatttgaagaaaatccagttgtattcctagaagcgaaaggatacagagaaatccaagaacacctaatcataaaactaccaaaatattcattattcgaattagaaaacggaagaagaaggttacttgcatctgcaagtgaactgcaaaaaggtaacgaactctttctaccagtcgactacatgactttcctatacttagcagcgcactatcatgaattaacagggagcagcgaagacgtccttagaaagaaatatttcgttgaaagacatctacactattttgatgacattatacaaatgatcaacgatttcgctgaaagacatattctcgcctccagtaacctagagaaaataaatcacacctatcacaacaattctgacttgccggtaaacgaacgtgcagaaaatatcataaacgttttcacctttgtcgctctcggcgcaccagcagcttttaaattctttgatgccactatagatcgaaaaagatatacatcaacgaaagaagtattaaacgcaaccttgattcatcaatcagtaactggattatatgaaaccagaatagatctctcacaacttggagaaaattga

SEQ ID NO: 8821 - RNA, 4050 nt, synthetic construct
  misc_feature 1..4050: note = Cas9 variant
  source 1..4050: mol_type = other RNA
atgaaacaaaaattttacgttgggttggatatgggaacagcaagtgtaggttgggctgtaacggatgacaaatataacataataaaacggcacggaaaagcattatggggagtcaggttgtttaaaacagcaaacacagcagaagaaaggagaatattccgagctgcaagaagacggacacaaagaagaaaacaaagaatggagctacttcaagaaatcttcggagacgaaatctcaaaaactgatatcggattctaccaaagaatgaaagaatcaaaatactggtttgaagataaaagagatataaatggtaaacaaccagaacttccttatgcactgttcgtagacgacgggttcactgataaagactaccacgaacaattcccaacaatttttcacttaaggaatgtattagttaacgaatggacacaaaaatatgatatacgacttgtctacctagcgatacatcacataataaaacacagaggtcatttcctgttcgaaggcaagaaaatgtctgaagtcactgactttggaagcgccttcgaggcattttgtaaagtagcctcagacaacgatatagaaattaccgtagatgaagaaaaactcaaagacatagaagacctcttgaaaagtcggcagaaaagtaaaacagccaagaaacaagaattgggaaaaataatagcgggggcagataaacaaaagaaagcgctcgcagcattagttacaggatgcatggtcaaattatcagaaattttcgccgacaaaagcctagatgatggagaacgaaataaaattagttttgcagatagtaattatgatgaatacatcgcgaatgtagaagaaacattagcagaacgctttctattaatagcagctggaaaagccctatatgactgggctgtgctttcagatatattagaaggatcaacatatattagcgaagccaaagtaaaaatatacaagaaacacggtgatgacctgagaaaattaaaaggactactaaaaacacgaccagatgaatacaaactcatatttggactacccgaaaaacaggctaactatagtgcatatataggaatggtcaagaaaaacggtaagaaagtccctatagataagaaatgcactaaagcagacttctattcatttcttaagaaaacgttaaacaaaatcaactttgaagatgaaaaagaaagagaaatcgctgaatctatcataaacgagatagaaaacgaaacattcttgcccaaacaagtcatcagtgataatggagtcataccatatcaattgcacgaagcagaacttgatcgaatactaaagaatgctgctttatattacccattcctgtctgaaaaagatgacgaaggctacaccaatatggataaaataaaagcaattttcaaatttagaataccatattacgtaggaccattaaatacttatcattccgataaaggcggtaacagctgggcagtacgcaaacaggacggtaaaatctatccatggaattttgaatctaaaatagacgcaggagaatcagctagaaaattcattggaagaatgacgaataaatgtacatacctaataggaaaagatgtactacccaaagaatccctattgtactctaaatttatggtcctaaacgaattaaataatctacgaattgatggagaaaaagttagtgtagaaattaaacaagctgtatacgaaaacgtattcaagaaataccagagagttacaggcaagaaagtgaaagactttttaatcagatcaggaattattggaagagaacaagaactatcaggatttgatcaaaatttcaaatcgagcctaaaagcatatcatgatataaaacaaatcgccggagacataaatctaagtcaaaaccaaaaagaagatattataaaagaaataacagttttcgcagacagtcagaaaatgctgaagaaaagattaaaaataaaatatcccgagctatcagataagcaagtcacaaaacttgctgccaagaaatatacgggttggggacgactaagcagagaatttctagaagaggttgaatccgtaaacaaagaaacaggtgaagtattaaacataatttcagcactctgggaaacaaatgaaaacctcatgcaattattatccaacaaatacgattatttatcagaaataaaacggctaaatgatgaggcagaggataaaagtgaagtcgtaacttatgacgacgtacaaaaactatacgtcagccctgcagtgaaaagaccagtatggcaaactttaaaaatagtagaagaaataagcaaaataatgggttcaaaaccagaacgtattttcgttgaaatggcaagagaaccgggacaaaaaggagatgttaaagtttcaagaaaatctagattattagaaaaatataaatattgtaagaaagaagcccccgaaatatatgaaaaccttgttaaagaagatgataacaaactacggagtgataaactatttctatattatacccaaatgggaaggtgtatgtatagcaatgaagtaatagacatagaagacctattcacgaaccgatacgacatagaccatatctaccctcaaagcaaagtcatggacgattctctcgacaacagagtattagtgaaaagagaactaaattcgaacaaaacagatgtcttcccggtaccgaaagaatacatggataaagcaaaaacactctgggacatgttaaagaagaaagatctaatttctaaagaaaaatatcacagattaactagacgagatggctttagtgaaaatgaactaagtggattcatcgcacgacagctagttgaaacgaggcaatcaaccaaagcggtgactcaacttctaacaaaagcctatccagaatcagaaatcgtgtacgcaaaagcaaatgcagtatccgaatttcggcataaatttggattcacaaaagtacgtagtataaacgactaccaccatgcaaaagatgcatacctgaacatagtggtaggaaatacgtattatgttaaattcacaaaagatgccgcctggttcataagaaataatcccggacgaacttataacctgaagaaaatgtttgaacaaggaacagtctcaagaggaggtgaaaccgcatgggtctcaggtgaagacgggactatcttcaccgtaaaaagagtcatgggtaaaaacaacatcttattcactagaaaagcatatgaagtaagaggtggattattcgaccaacaaataatgaaaaagggaaaaggacaaatacccgttaaaaacaatagtgaagatgatagattatgtgccaccgaaaaatatggagcttataataaagcatcaggggcatattttatgctcgtagagtcagaagacaagaaaggaaataaaataaggactttagagttcgtacccgtatatctcgccaaagaactagaaaaatcagaagacgcagcaatacggtactgcgtagaaaagctagaactcaaaaatcctgacgttagagttagaaaaattaaaatggatagtttatttaatgtagatggcttcagaatgcacttatccggaagaacaggcaaacaattgatattcaaatgtgcagaacagttggtattggacgaagaatcccagaaaattttaaagaaaacagcaaaagtttttgcagattataaagaaaataaaaacataaaaatatcagacaaaatagaattaacagacgaaatgctaattaaattatacgaactgttctacaagaaattaaaagatacagtatacaacattagactaagtacacaagttaaaacgctcgaatccggaaaagagaaatttgaaaaattaagtctattagacaaatgcctagtaattgaagagatattacacctattccaatgtcaatcagttgcagcaaaccttagttcgatcggaggtgcagcgacagcaggcatacttgtattaaacaatgagataagcagatgtggtaaagtggaaataataaaccagagtatcacaggtttttacgaacaagtaatagacctcaaaaacatttga

SEQ ID NO: 8822 - RNA, 4050 nt, synthetic construct
  misc_feature 1..4050: note = Cas9 variant
  source 1..4050: mol_type = other RNA
atgcaaaaatattacctaggtctagatataggaaccaatagcgtaggatgggcggtaacagacgaaaattacaacttatgcaagttcggaggaaaacgcatgtggggtatccgactatttgacggagcacaaaccgcagaagaaaggcgcatgaatagatcgaatcgaagaagattatcacgacaaaaacaacgaatagacctattacaagaattattcgcaaaagaaatcgccaaggtagatccaacattttttataagacttaacgaatcaaggttatatatggaagacaaatccacaggcacaaaattcccattatttgcagacccaggttacacagacaaagaatactataaagaataccctacgatatatcatttacgacaagaattaataaaaaatcctgaatcgcacgacattaggttagtatatctggcatgccatcacattcttaaaaacagaggtcactttttgataaacggctccttctcagatcttaagaaccttagttttgtatgccgagaaatgttagatgcattcaacgaactatcgaaataccaacttatgatatctgacatagatgccttagaaaagatactcagcgaccgaaaacaacaaaaaagcgctaaagtcaaagaattagtacaaatatttgagtgtgtacccagggaagataaatctgacgccaaaatctgcaaagaaatactatcaaatctgtgtaaattcttggttggagctaaaggaaatataactagactgtttgacaccgacttcgacgagatggaaacaagctcattttcttttggagattccaaatacgaagattcccttttaccatcactcgaagagaactacccagactacgccaatgtcattcaaaaaataaaagccatgtacgattggagcgtattggttgaaataatggcaggagaaaactacctttcatttgccaaagtgaatgcttataaaaaacataaagaaaatttatcaattctaaaaagtctaatgaaaaaatattgcacaccagacgtctaccaaagatttttttatgaaacagacgaaaagagttcatatggtaactacataggagcgatccacaataacggccactcacatacaatgaaaaaatgcgacgaagagacattctataaaagtctatctaaaattctagataaacttgtagtccagaaaacggatcaagacaccttggaaatattaaaaaaagaagctaagaatcaaacgctacttccccttgcacgcacaaaagcaaatggagtcataccaaaccaaatacatatccaagagcttagagcaatactagataacgcaaaaacatacttgtcatttcttaacgaagccgacgagtacgggacaatagcagagaaaataataagaatagcgaaatttaaaataccatattacgcagggccactgtcgacaagacacaaagaacagggcgccaacacatggattgtcagaaaacaagaaggcagaatatacccttggaattttgaggaaatggtagacctagaacgaagtaataacgaatttataaggagaatgacgaataaatgcacttatctaataggcgaggacgtattaccaaagaactcacttctatacagtaaattcatggttttaaatgaactcaataatttaaaaataagaggccacaaaatatctgtcgagttaaaacaagaattatataaagaattattttgcaagaaagcaaaagtcacaggtaaagccctactcgtatacctaaagaagaaagacgcagaactaacattggaagacatttctggatttgacgctgactttaaatcatcactatctatctacattgatttcaaaaaccatatactaagagaacaaatagatgacggaaaatatcaaagcatagtagaaaacataataaagtggaaaacaatattcgacgtagacagcaagatgatcgaaaaattaatagctagagaatacccaaatatgttctcatcagaacagataaaaaaaatctgccgactgaaatgtcgaggttggggaaactttagcagtagatttctcaatgggatccaaggagaaaatacagaaaccaaagaatgtttcactataatagaagctctttggaaaaccaactataacctaatgcagctcttaagcaaacaatttaccttcaaagacgctatcgactgcatcaacgcagataaagtaggaaagatagacaaggtaacatatgagaacacagtaaaggacttagtagtttcaccagcaaataagagagcgatctggcaaactgtacagattaccgaggaaataaaaaaagtaatgaaatgtgaaccagaaaaaatatttgtcgaaatggcaagaggaggagaaaaagaaaaaaaacgtacgatctcacgtaaagaacgattattaaaactgtatatggattacaaagatgaaaatagagattggataaaagaaatcgaatctagagacgaacaagattttacaaatagaaagttatatttatattacacgcaaatcggaagatgcatgtattcgggagaagaaataagcttagaagaactaatgcaaaagaattcaaaatgggacaaagaccacatatatcctcaatcaaagatcaaggatgattccctcgataaccttgttttagctagaaaagacataaataataacaaatctaataagttacttccaaccggaattcaagataaaatgaaaaaatattggaagatgctattaaagtatggattcatcagtaaaaaaaaatatgatcgattaatgcgaacagaagacttcagcgacgaagaactatcaggattcatagcaagacaaatagtggaaactagacaaagcagcaaagcggttgctgagctattagaacatttaaatgaacacacagagatagtatatgtcaaagctgaactagttagtgacttcagacacgacaataacatgttgaaaagtaggagaatcaatgactatcatcacgcaaaagacgcatttctcaatatcgtcgtaggtaacgtctataatgcaaaatttaccgctaacccacgaaattggataaaaaaaaatagaaatacaaactattcaatacgtagagtatttgattacaccgtaaaaagagggtcgacaatcgtatggcaaggagtaaaagatggcggacactctattgatggaataaagaaaactatggcaaggaatgatatattatacacagaaagaacttactgcgaacagggagagttgttcaacgcaactctaataaaaaaaggcaacccgaacgcaataggactaaaaaagggtctagatccaatgaaatatggcggttacagtagtccgaaaacctcggccttcgcttttattgaattcgatggaaaaaaaggaagacagaatcacctagtcgaaataccagtctacatagcaaacattgctgctaggcagccagaatacatcaaaaatcatctagaagaaaaaaaaggctaccaaaatgttatcgtaaagaaataccccatacaaaaaaacgcattaataaaattagatggatacccagcaagactaagaggagccaacgaaaaatcaatcacactaaaaaacgcagtacaactagtattaaaaccagagtaccatgaaactattaggaatgtagaaaagtatttagaatatatcgacaaagatgagagcgtatcaaaagcagcacgattctctcatacagaactcgataagttgtacgatgaattatgctttaaagcagaaaacagcatatataaaaagagacccgcaaatcaatcagcaaccttaaaaaatggacaaaaaacgttcttagctataaccaatttaaaagaaaaagcccaagtgataaacaacataattacaatgtttagatgcgacgccacaacaaccacaaacctaaaaacaataggaggatccgctaacgctggaggaatgcaagttaacaaaaacactctcacctcacaaaaagtagtactagtacaccaatcgataaccggtctatttggcactgaagaagaacttctgtga

SEQ ID NO: 8823 - RNA, 4053 nt, synthetic construct
  misc_feature 1..4053: note = Cas9 variant
  source 1..4053: mol_type = other RNA
atgaaaaaaccatattcaataggcttagatataggtacaaattcagtaggttgggcagtagttacagacgattataaagtacccgccaaaaaaatgactgtcctaggaaatacagataaatcccacataaaaaaaaacctattaggagctctactattcgactcaggaaatacagccgccgatagaagattaaaaagaactgctcgacggcgatatacacgacgcagaaaccggatactatacctacaagaaatattcgccgaagaaatgagcaaggtagacgattctttcttccaccgtctagaagattcattcctcgtaacagaagataaaagaggtgaaagacatccaatctttggaaacctggaagaagaggtaaaatatcatgaaaactttcccacaatatatcacttacgccaatacctcgctgacaaccccgaaaaagtagacctacgactcgtttacctagccctagcacacataattaaatttcgcggccatttcttaatcgaaggtaaatttgatacacgtaacaacgacgtacaaaggctatttcaagaatttttggcagtctatgacaatacattcgaaaattcctccctacaagaacaaaacgtacaagttgaagaaatcctgactgacaagatatctaaaagtgcaaagaaagaccgcgtcttaaaattatttcctaacgaaaaatcaaatgggagattcgcagaattcctaaaactaatcgttggaaaccaagcagattttaaaaaacattttgaactagaagaaaaaactccactccaattttcaaaagacacttacgaagaagaattagaagtactattagcacaaataggagacaactacgccgaactcttcctcagtgctaaaaaactatatgacagtattctactgtcgggaatattaacagttacagatgttagcacgaaagctccattatccgcctccatgatacaacgatacaatgaacaccaaatggacctagcacagttaaaacaattcatcagacaaaaactttccgacaaatataatgaagtattctcggatgtaagtaaagatggttatgcaggatatatcgacgggaaaacgaaccaagaagcgttctacaagtaccttaaaggactattaaataaaattgaaggatcaggatactttttagataaaatagaaagagaagactttttacgcaaacaacgaacgttcgataatggcagtataccgcaccaaattcatttacaggaaatgagagcaataatacgacgtcaagccgaattctatccttttcttgcggataatcaagatcgaattgagaagatactaacatttcgcatcccatattacgtaggccccctcgcaagaggcaaaagcgacttcgcctggctatctagaaaaagcgccgacaaaataacaccctggaatttcgatgagatagtcgataaagaatcctccgcagaagcatttataaaccgaatgacgaactacgatttatacctaccgaatcaaaaagtactacctaaacactccctattatatgagaaattcaccgtatataacgaactgactaaagtgaaatacaaaactgaacaaggaaaaacggccttctttgacgcaaacatgaaacaagaaatttttgacggagtctttaaagtatatcgaaaagtcactaaagataaactcatggacttcttagaaaaagaatttgacgaatttagaatagttgacctaacaggacttgacaaagagaacaaagctttcaatgcaagttatggaacttaccacgatttacgcaaaatactcgataaagattttttagataactctaaaaatgaaaaaattttggaagatatcgtattaacactcacactgtttgaagaccgcgaaatgatccgaaaacgcctagaaaactactccgatctattaacaaaagaacaagtaaagaaactagaacgacgacattacacaggatggggccggttatccgccgaattgattcatggtataagaaataaagaatcaagaaaaacaatactagattatctaatagacgacggtaattcaaacagaaattttatgcaattaataaatgacgacgctttatccttcaaagaagaaatagccaaagctcaggtaataggagaaacagacaacctcaaccaagtcgtctcagacatagcaggctctccggccatcaagaaagggatactacaaagtctaaagatagtcgacgaactggtcaaaattatgggacaccaaccagaaaacatcgtagttgaaatggcacgagaaaatcaatttacaaaccaaggcagacgaaactcacaacaacgtctaaaaggactaacagactcaataaaagaattcgggagccaaatactaaaagaacatccagtagaaaactctcaactgcaaaatgatcgcttattcctatattacttacaaaatggacgtgacatgtacacaggcgaagaactagatatagactatctgtctcaatatgacatcgatcacataataccccaagcattcatcaaagacaattcgatagataatagagtgcttacatcctcaaaagaaaacagaggaaaatcggacgatgtgccatcagaagacgtcgtaaacagaatgagaccattttggaacaaattattatcttcaggcctaatctcacagagaaaatacaacaatttaacaaaaaaagaactaacacctgacgacaaagcaggttttataaagagacaacttgtcgaaacaagacaaataacaaagcacgttgcaagaatgctcgacgaaagatttaataaagaattcgatgacaacaataaacgaatacgcagagtcaaaatcgtaacacttaaatcaaatctcgtaagctctttcagaaaagaatttgaactttataaagttagagaaataaatgattatcaccatgctcatgatgcctatttgaacgcggtagtagtcaaagcattactagtaaaatacccaaaattagaaccagaattcgtatacggagaatatccaaaatataacagctatagagaaagaaaaacagcaactcaaaaaatgttcttctacagcaacataatgaacatgtttaagtcgaaggtcaagttggcagatgatcagatagtagaacgcccaatgatcgaagtaaatgacgaaacaggagaaatagcctgggataagacaaaacacataacaacagtaaaaaaagtcctatcttatccccaagtaaacatagtcaaaaaagtcgaagaacaaacaataggccaaaatggtggattgttcgacgataacccaaagagccctttagaagtgatacccagtaaactcgtcccgttaaaaaaagcattaaaccccgagaaatatggaggttaccaaaaacccacaacagcataccccatactactaatagtagatacaaaacaattgatacctataagtgtaatggataaaaaaagatttgaacaaaaccccgtaaaattcctcaaagataaaggataccaacaaatcgaaaaaaacaactttgtcaagttacccaaatacacactagttgatattggaaacggtattaaaagactttgggcttccagtaaggaagtacacaaaggcaaccaattggtggtatcaaaaaaatcacaagatttactataccacgctcaccatttggataacgactacagcaacgaatatgtcaaaaaccattaccaacaattcgacatcctattcaacgaaattacgtcattttctaagaaatgcaagcttggaaaagaacatattcaaaaaatagaagaagcatacagtaaagaacgggattcggcatcaattgaagaactagcggacggtttcataaaactattaggattcacccaactaggagctacttcacctttcagttttttaggaatcaaattaaaccaaaaacaatacactggaaagaaggattaccttctgccctgtatggaagctacattaatacaccaatccatcacaggtctatatgaaacccgtatagaccttagtaaactaggaggagactga

SEQ ID NO: 8824 - RNA, 4053 nt, synthetic construct
  misc_feature 1..4053: note = Cas9 variant
  source 1..4053: mol_type = other RNA
atgggaaaaaactactacctcggattagatatgggaacatcaagtgtcgggtgggccgtaactgacgaaaaatatagaatcctaagggccaaaggaaaagacctctggggcgtaaggttattttcggaagcaaaaacagcagccgaaaggcggacacacagaacaagtcgaaggagactcgacagagaaaaagctaggatcgcatgcttaaaagaaatgtttgcagaagagataaacaagatagacccaggattctatcaaaggctcaacgatagcaaatacttccttgaagacaaaaaagagcatcaaccatacgctatctttgcagataccggatatacagataaagaatactacgacgaatacccaaccatatttcacttacgcaaagcgttattaaatatagaaaatgataaaaaaaaatacgatgtacgactagtatacttagcaatacttaacatgtttaaacaccgcggccatttcttgaacgcaaacctagacgacaagtcaggaggaaatttaaaggaatacatcgaaatgctacatcaaagcatggttaatattttaaacattaacttaaaaaacgtagagatagaaaaaatcgaaaagatactaaaatcaacacaatattcgaactcagaacgattagaaaatttgctcgaactttatgaactgagtaaaaacaaaaataaaatagaaaccgaaatattcaaattcatatgcggcctaaaaggcacaatctccaaaatttatgtagaagataaattcgaagatgaatttgcgaaaatgacactaagtttcagagactcaaacttcgatgaaaaaataatcgaaatcgaagacaacttagatgatgacaagtatgacatgtttctactcatcaaacaaatacatgattggagcgtactagcaaacataatgaatggtgaagaatatctatctgtagcccgagtcaagctatacgataaacacaagaaggacctagaagtattaaagaaatactacaaacaaaacagcatggaagaatataacaaaatgttccgacaaatgaacgacggtaactactctgcatacgtaggaagcgtaatatacaaagacaactcagtccgcagaggctgcaagtcaaaaaaagaagacttttataaaaacatactaaacacaatcaaatcatgggaggattgcgaagcaaaagagtacattacatccgaaatagacaaaggcaacttcctaccaaaacaaatcacagcaagcaacggggtaattcctaatcaagtacacaaaaaagagctcaaaaaaattctaaaaaacgcgtcagaatacctcaacttcctaaacgaaaaggatgaatcaggatacacaataagcgaaaagatcgtaaaactatttgaatttcaaataccatactacgtggggcctatagcctacaatatcggaaacgacgaaagcaaacacagacataacatgtggtcagttcgaaaagagaaggggccgatatacccttggaatttcgaacaaaaaatagatataaaaaagtcctcagagaaattcatcaggaacctaataaatcattgcacttatctaaacgatgaagaagtcttgcctaaaaattcactactatatgaaaaattcatggttctcaacgaactgaacaaactcaagataaatggagaaaaaattagcgttgaactaaaacaaaatatttttaacgacttattcaaaaagggtaaaaaagtcacaaaaaaagggcttataaaatacctcaaagaacaaggagaaatagataactgcgaagaagtagaaatatcaggaatcgacggagacttcaccaacaagctttcaaactacaaaaaatttgcagatatatttggtgtacaatcactgacttatgaacaaacggatattgcagaaaacataattcgatacagcacaatatatggagacagccgaaaattcttagaagaacgcattagggaggaatattcaaacgtattagatgaaaaacaaataaagagaatactaggcatgaagttcaaagactggggacgattaagcaaagaattacttgaattaagcggagtagataaagaaacgggggaaatagcgtctgtcatatcaaggatgtggaacgataattacaatttgatggaacttatagccactgaaagattcagctacgcatacgaaatagaacaacgaagcaaaaaattagaaaagacaataagtaccatagaatatgaagacctggacgaactatatatgagcaccccggtaaaacgaatggtctggcaaaccatattagtattaaaagaattagaagaggtacttggatgtccaccaaaaaggatattcgttgaaatggcacgagatgtaaacgcaccaaaggaccgaaaagatagcagaaaaaagaaactcttagaactttataaaaattgtaaaaaagaggaaggggactggagcaaagaattaaacgcaagagaagaaagtgaatttaaatcaaaaaaattatacctatattacatgcaaaaaggacgatgtatgtattcaggaaaaccgattgatttgaagaacttgttaaacgacaatctctatgacatagaccacatatacccacgacacttcgtaaaagacgacagcatagaaaataacttggtactagtagaaaaaaacttcaatgctcacaaaagtgataattacccaatagaaaacgaaatcagacaaaaaatgcatagtatgtggaaaatgttaagagacggaaacttcattacagaagaaaaatatagccgcttaataagaaaagaagaattcaccgacgatgaaaaggccaaattcatatcacgacaaatcgtagaaacaagacaagggaccaaagtaataaccgatctatttgaacaaacatttccggaaagcgatatagtatatgttaaggcaggcaatgtgtctgaattcagacacaagtttaaacttatcaaatgcagaaatgtgaatgactttcatcacgcaaacgacgcatacctaaacatagtcgtaggaaacgtatactacacaaaatttacgaagtcagcattaaattttattaaagattataaaaagaatcccgaaaaaaataaatatcacatggaccatatgtttcagtatcctgtcagtagaggaggggtcgacgcatggataacaaaaggcgcggagtccataagcatggtaagaaaaatgatggccaaaaacactccgatggtcacacgcatgaactacgaaaaacacagcggtcaaaaaggtggaatttccgatcaaaacatatgctctgctaaaatcgcaaagaaaaacgtatatttgcctataaaaatgggagatgaaaaactcaaaaatgtagaaaagtacggaggatatggaagcctcacagcaaaatattttttcctcgtagaacacaccatcaaaaaaaaacgcatacgaacaatcgaagcttatccaatgtatctagacgcgctcaacaaagaaaacaagttattaaactactgtgttcaggtgttagaatacgacgaacccaagatcattatggagaaaataaaagtaaaaagtttatttaaaataaatggttactactactacctcaatgctaaaagcgtaaaccgaataatatgggggaatgcaacacaacttttcctcgaaaacgacatcaacgaatacgttagaaagatcagtaaaaatattgagtgtatagacataaatagcgaaaacaacatcaaagtctacgacatcttcatagaaaaatatagcaataaacttttctcgaaccgcttgggaaaccttaaagaagccataatacaaaatagaaacaagtttatcgaattaaaaataaacgaacagatcaacgtaatactcgaactagtgcgatacagtcaagacggagtatactcaataaacctaagtcaactaggattatcttcaacatatgccattaatcgaaccagtaaggaaattagcaaaatgaaagaatgcaaactaattaatcaaagcgtcactggcttatacgagaatgagattgacttattaaccgtatga

SEQ ID NO: 8825 - RNA, 4053 nt, synthetic construct
  misc_feature 1..4053: note = Cas9 variant
  source 1..4053: mol_type = other RNA
atgcaacaatattacttaggtgtcgacatgggaagtgcctcagtaggatgggcagtaacagacgaaaaatatcaactcgtacggaagaaaggaaaagatttgtggggcgtaagaacctttgacatagcacaaacagcagaagtaagacgtgtaagccgaacaaatagaagaaggcaaaatagacgcaaacaaagaatccaaatactacaagaacttctaggcgaagaagtcctaaagatagatgccggattctttcaccgcatgaaagaaagccgatatgtagcagaagacaagagaacactggatggcaaacaagtagaattaccatacgcgctttttgtagatcaaggttttaccgacaaagacttttacaaacagttcccaacaataaaccatctaatagtctatttgatgaccacaagtgataccccagatatcagattagtatatttagcactacactactacatgaaaaatcgaggaaacttcctacacagtggtgacattaacgatgtcaaagatatccaatcaatactagaacaactagaaaatgtattgaaagaatatgtagacgactgggaactgtctttgaaagataaagtggacgcaattaaagaaatatataataaggacctgggcagaggcgagcgaaagaaagcgttcattaacacacttggtgttaaaactaaatcagcaaaagccttctgcagtttaatatccggaggatcaacaaacttagctgaattgtttgacgatagtggtctaaaagaatcagaatatgcaaaaatagagttcgcaaacgcgaacttcgaagacagcgtagaaggaatacaagctctcctcgaagatagatttgcagtaatagaagcagccaagcggttatatgattggaaaatactgacagatatactaggcgataacgcaagcctcgctgaagcacgggtaaaaagttacgaaactcaccatgaacagttagtagaactaaaatcatttatcaagaaatacttagatagaaaaatataccaagacatattcataaatccaaacattgcaaataattaccctgcttacgtaggacatactaaaataaacggaaagaaacaagaactggaagtaaaaagagctaaaaggaatgatttctacgcgtacataaagaaacaagtgattgacccaattaaaaagaaagtatcagacaaagcagtactagcacgattagcagagattgaatctctcatagaagttaacaaatacctaccgttacaagttaacagcgacaatggtgttataccctatcaaataaaactgaacgaactaagacgaatattcaacaacttggagaatagattaccggtactaaaagaaaacagggacaaaataattaaaacgtttagttaccgaataccctattatgtcggaccattaaatggagtaaacagaaatggaaaatctacaaattggatggttcgaaaagaaggggaagaaggaaaaatatacccatggaactttgaagaaaaagtcgatctagaggcgtcagcagaaaaatttataagacgaatgacaaacaaatgcacatacttagttaatgaagacgtacttccaaaatacagtcttttatattccaaatatctagtactaagtgaattgaacaacctacgactcgatggccgaccattagaagtaagtgtcaaacaagaaatttacgaaaacgtttttaaacgcaatagaaaagtaacgcttaagaaaatcaaaaattatctactaaaagagggcgtaatttcagaaaaagatgaactaagtggattagcagatgacgtaaaaagtagtctcactgcgtaccatgacttcaaagaaaaactaggtcacctaaccttaactgaagaccaaatggagaaaataatattgaacgtaacactattcggtgacgacaagaaacttctaaagaaaagacttgcagctctgtatccaaacatagatgagaaaagcctgtcaagaatggcaacgtttaactaccgagattgggggcgattgtctaagaaattcctttcagaaataacaagtgtagatcaagaaacgggagaactacgtactataatacaatgcatgtacgaaacacaaaataacctaatgcaactattatcagaaccatatcatttcgtagaagcaatcgaaaaagaaaacccaaaagtagatctcgaatcaatatcatatcgcatagtaaatgatctctacgtaagcccagcagtaaaaagacaaatatggcagacccttctcgtgataaaagacataaaacaagtgatgaaacatgacccaaaacgtattttcattgaaatggctagggaaaaacaagaatctaaaacgacaaaaagtaggaaacaagtattaagcgaagtctacaaaaacgctgaaaaatacaaaaacttattcgaaaaacttaattccttaaccgaggaacaactcaggtctaagaaagtatacctgtacttcacacaactgggtaaatgtatgtacacaaacgacgcaattgatttcgaaaacctcgtctccgctaactctaattacgacatcgatcatatatatccgcaatctaaaactatcgatgactccttcaataaccttgtattagtcaagaaaggcataaataacgacaaaagtgatcgatatccaattgataaaaacataagagatgacgaaaaagtcaaaaccctatggaatacgttactatcaaaaggactaatcacaaaagaaaaattcgaaaggctaattcgatcgacaccattctcggatgaagaattagcgggattcatagccagacaattagttgaaacacgacaatcaactaaagcagtagcagaaatattatctaattggtttccagaatctgaaatagtatactcaaaagcaaaacacattactaacttcagacaagacttcgaaatactaaaagtccgagaactaaacgattgccatcacgcgcatgacgcatacttaaacatcgtcgttggaaatgcgtatcacacaaaattcactaactcgccatacagattcatacaaaacaaagcaaaccaagaatataacctacgcaaattactacaaaaagcgaaaaagatagaatcaaacggggtaatcgcatggataggacaaagtgaaaataacccagggaccatagccaccgtgaagaaagtcatctctcgaaataccgtattaatttcacggatggttaaagaagtagacggccaattatttgatcaacaactaatgaagaaaggtaaaggccaagtaccaataaaatccagtgacgacagattgatagacatatcaaaatatgggggatacaataaagctaaaggagcttacttcgtattcataaaatcagtaagaagaggtaaaacaataaagagcttcgaatatatccctgtacacctagcgaagaaattcgattgcaacctagaactactcaaagagtatctagaatcagaaaaagaccttaacaacgtagaaatcttaatgccgaaagtaatgattaactcgctattcaactataacggaagcctaatacgtattcccggaagatacgacaagaaatccctactcataaacgtagacgtgcctttgctcctggaatcacagcatattaaacaactaaaagtaattgaaaaatacatgtataagaaaagagtatccaaaaattcgaatatattgcttacaaaattcgcatcagatcaactaaaagatcttgatgcactattcgacgtcctatcctacaaactaaacgaaaatatatataacgtaattaatgataaatacgacaaattagtcatatgccgagacaaatttatatctctagacacagaagtcaaatgcgaaatgatattcgagctactccatctattccaatgcaattcacaattagcaaatataacaaaaataggagccacaagcaaattcggttcaatatctatgagcaaaaacttaaaagagaatgataaaatgtccattatacaccaatcaccatctggaatattcgaacacgaaatcgagctaaccgcactttga

SEQ ID NO: 8826 - RNA, 4053 nt, synthetic construct
  misc_feature 1..4053: note = Cas9 variant
  source 1..4053: mol_type = other RNA
atgaaaagaattttaggtcttgatctcggaactgcatcaataggatgggctttagttaatgaaagcgaaaacgaaaaagagaaaagcgaaataataaaactaggagtccgagtcaatccactaacaacagatgaacaaacagattttgaaaaaggacgaccactaagtgtaaacgctgatagaacattaaaaagaggagcccgaagaaacttacagagatttaaacaaagaagaaaaaatctaattgaaatattaatcaagaaagggtttataacaaatatttctctacttacggaaattggctcaaatacaacctatcaaacccttgagttacgagctaaatccgtaaaagaaaagatcgaaaaagaagaatttgcacgtgtactattaactatcaataagaaacgtggatacaaatcatccagaaaagcaaaaaacgacgaggaaggatcacttatagacggaatgtccgttgcaaaagagctatacgacaataatttaaccgtaggacagtacgtatatcaacttctcgaaaaaggaggcaaatacatcccagatttctacagatcagatctccaaaatgagtttgacgtaatttggaatttccaaaaagaattctatcccaacatattgacaggcgagttatacaaaaaattacaaggccaaggacaacaaaactcaaggaaactattcctagccattcatcaaatatatactgcagaaaacaaaggtaaaagggatacggttaaaaagcaacactataaatggagaaacgacgcgataaacactcaattactaatagaagaagtagcgtatgtcttagtagaaattaacaacaatctgaacaaatcctcaggttacttgggagccatctccgatagatcaaaggaactctatttcaataaagaaaccgtaggtgaaaatctctataaacagatacaagagaacccacaaacatctctcaaaaatcaagtgttctatagacaagattatcttgacgaattcgaacaaatatgggaaacgcaggcaaagttctactccgaactaacaaaagaacttaaagaagaagttcgcgacgtagtcatattttaccaaagaaaattgaaaagtcaaaaacatctaatatctgaatgcgaatttgaaaagcaccacaaggcaataccaaagtcctcacccttatttcaagagttcaaaatatggcaaatcctgaataacatagaattcaaacacaaaaaaacaaaagagctaaaaatcctaagtgaagaactaaaagaaacactattcgaagaactaaacatcagaggaaactttacatcagacgcagtcctaaaatttgtcaaacttgacaaaaaagagtgggaactaaactataagaaaggtatagaaggtaacagaacgaacgaagtactgtacaacgtataccagaagattgccgaatacgaaggctatggtttcgattggagtaagaaatcagctgtcgaaattaaggaagaactaaacacaattttctcagaaataggtataaactctaaaatactagattttaacccagaaatcagtggtaacgattttgacaaacaagaatcctatcaactctggcacctgttatactccgcagaggaggacggatttttaaaacaaaaactccaagacaaatatggattcaaatcagagtacgccaatatgctcgcaaacgtgtcattccaatcagactatggaagtttgtcagcacgtgcgataaaaaaaatattacccaatctaatagccggccacgaatttagcgaggcatgtagcctatctggttacaatcattcgaacagtctcacgaaggaagagctagctaatcgaccactgaaaggaaagttagaactcctaaaaaaaaacagccttcgaaaccctgtagtggaaaaaatcttaaatcaaatggtaaacctagtaaaccaagttatcgaatcatatggcgaaatcgacgaagtcagaatagaactcgcacgtgagcttaagaaatcagcacaggaacgagcacttatgactaccaacatcaatgcatcaaaaacaaaatacgaaagcttcagaaaattactacaaaaggactttggaataaaaaatccaactcgaaacgacataataaaatacagattatatgaagagcttaaggcaaataagtaccatacaatctacacaaacaaatacataccgagggacaaactattcagcaaagagatagatatcgaacacataattccgaaagcaaaactgttcgatgatagtttctcaaacaaaacactcgcatttcgaaagccaaatcaagacaaaggaaacatgacagccatagattacatattaagctatcaatcaaaagatatcgacaactataaatcaagaatagaaaatctatttaagaatggaaaaggagacatatccaaagcaaaaagaaacaaactcctcatggaagaaaaagatataccagatggattcattgatagggacctaagaaacagccaatacatcgcaaaaaaagccaaacaactcctggaagaagtcatccgaactgtaaacacaacaacaggatcagtcacgaacaaattaagagacgattggggcctaattaacgtcatgcaagaacttaacatgccaaaattcaaagcaatagacgaatcactaatcgaacaaatagaaaaaaaagacggaacatttaaaactaggataaaggactggtctaaaagaaatgaccaccgacatcacgccatggacgctctaacagttgctttcacgcgttacaatcatatacagtacctaaacaatttaaacgctaaatcggataaaaaaggcgccatctacggcatccaagaactcgaaacatacgtaaactcaaaaggcaaacggaagtttatcaaaccaatgcacaacttccgtgaggaagcaaagaaacacatagaagacatactcataagctttaaagcgaaaaacaaagtcgtaacaaaaaatatcaacaaaataaaatccaaagatggattcataaagaaagtacagttaacgccacgaggtcaactgcataaagaaacagtatacggtaaaataaacgaagtcgtcgtaaaggaagaaaagattaacgcaaagttcgacctagaaaagatcaataaggtcacaaaacctatatatcgaaacgctctactaaaaagattacaagagtttaacggcgagccaaaaaaagctttcacaggaaaaaattctctaagcaaaaatccgatctacctagatgtagcccaaaccaagacgttaccagaaagcgtaaaagtacaattttttgaggaaaactacacaatacgaaaagaaatctccccagacttaaaaatagataaaattatcgacaaaggaatacaaaggatactactaaaaagattagacgaattcaatggtaaaccgaaagaagccttctccaacttagaaaaaaacccaatttggctgaataaagaaaaaggcattgctatcaaacgagtaaaaataaaaggcgttaaaaacgtagaaagcctccacaataaaagagatcacctcggaaacgagatcctgcaaaaaggaaaatcagcaccaaatgactacgtatcaacgggaaacaatcatcacgtagcaatatatcaggataagaatggaaagctacaagaaaaagttgtttcattctacgaagcggtagcaagagttaataacaaattgccaatcattgatcaagacttcaataaagacttagggtggaaattccttttcacaatgaaacaaaacgaaatgttcgtatttccgagcgaagatttcaaaccactagaaacagacctaatggacaaaaaaaacaacagcaaaattagcaaaaacttattcagagttcaaaagctcggaaacaaagattacacattcagacaccatttagaaacaaaaatagaagacatcaaaaaactcagagatttcacatacatcagaaaaagaaaccccgaatcaatcaaaaatattataaaagtaagaataaaccatcttggcaacatagtacacgtaggcgaatactga

SEQ ID NO: 8827 - RNA, 4056 nt, synthetic construct
  misc_feature 1..4056: note = Cas9 variant
  source 1..4056: mol_type = other RNA
atgagcaaaaaatactatttgggattagacattggaacaaactcagtaggttgggcagttacagatgaaaactataatttatgtaaatatgcaggtaaaaggatgtggggaataagattattcgaaggaggcgaaaccgctgaacaacgcagaatctcacggtcaaatagaaggagattgtcacgaaaaaaacagcgaatagacttactacaagagctatttgcagaagaaatagcgaaaatggaccccacattcttcatcagacttaacgagtcacgtctacacctagaggacaagtcaaccggagagaaatttcctttatttcgagataaagattatacagacatacaatactacaaagaatatccaaccatgtaccacctaagaaaagagctcatagaaaattctaaagtacacgatataagactagtatatttagcatgtcaccatatactcaaaaatagaggccacttcctaataaacggctcatttagtgacgtcaaaaaactaagctcagtctgtgaatcgatgttaaactcatttaacggaatcagtaaatatcaaatagaaataaacgacatagaaagattagaggaaattctaagcgatcgaaaaaaacaaaagtcagtcaaagctaaagaattaattcaaatatttgaatgtggaccatgtgaggacaagacagacgaaaaaacatgcaaagcaatagtttcaaacttatgcaaatggctaaccggacttaaaggaaatatcaatagtatttttgacatgcaattcgaagaaatagatactagctcattcagcttcacggaaccaaaatacgaagataccatttccgcagcacttgaagaaaaatatccagattatgccgacgtaatacaaaaaataaaagcagtatatgactggtcggtacttgtcgaaataatggccggcgaagattatctatcattcgcaaaagtaaatgcatacaacaaacacaaagaaaacctctgcatactaaaagaagttataaggaaatattgtgatagtgaaatataccacaaattcttcaatggctttgacgagaaaaatggttacggaaactacataggtagcatatacaaaaatggccactcatacgctatgaaaaaatgcagcacggaggacttctataaaacattggggaaaatactagataaaatacaaccagaaaaagaagacgaaaatgtattggaagaactaaaagtagaagtcaaaaatcaaactttattaccactagcaagaacaactgctaacggaactattccaaatcaagttcatatacaagaattacgtgcaattctcgataatgcaaaaaaatacttaccgttcctaaatgaagaagatgagtatggaacagtcgcggaaaaaataatatcgatagcaaaattcaggattccttactatgtaggaccactctcgacccgacacaaagaacaaggcgccaactcatggatagtgaggaaacaagaaggccgtatctatccatggaacttcgaagaaatggtagacctagaacagtcaaacaaagagtttatccaacgaatgactaacaaatgcacttatctgatcggtgaagacgtgttacccaaaaactccctgttatactcaagatacatggtgttaaatgaactaaacaaccttagaatacgaggcaataaaataagcgtcaagctaaaacaagaattatataaagaattattttgcaccaaggcaaaagtcacaggcaaaggactatttaattacctcaaaaaagaagatgaagaactagcactcgaagatatatcgggattcgatatagactttaaatcgtcattaacaagctatttagacttcaaaaaacaaatacttggcgaggaaatcgaaaaagataagtataaaggaatagtagagaacatcattaaatggaaaaccatttacgatgatgacagtaaaatgatgaagaaaatgatagaaagagaatacccaaacgtatttagcaaagacaaaataaaaaaaatttgcaggttcaaatactctgggtgggggaacttctccctaagttttttaaacggtatacgaggagcagaccgtgaaactggcgaatccttcacaattatagaggcactctggaaaactaattacaacttaatgcaacttctaagcaagcaatttacgtttcgcgaagaaatagacttaataaacgcagaaaaagtcggaaaaataaacaaagtaagttacgacaatacagtaaaagacctaattgtctcacccgcaaacaaaagggctatctggcaaacggtacaaataactgaagaaatcaaaaaagttatgaaatgcgaacccgaaagaatcttcattgaaatggccagaggaggagaaaaagaaaaaaaaagaacggtaagccgaaaagcacgcttgttagaactttatgcagcatgcaaagacgacgtaagagattggaccaaagaaatagaagacagagaagaaagagagtttaactcaaagaaattatacctgtactatacacaaatgggaagatgcatgtactctggagaagaaataaatattgatgaattaatgcaaaaaaattcaaaatgggacatagatcacatatacccacaaagcaaaatcaaagacgacagtctagacaatatggttctagcaaaaaaagtaataaacaattcgaaacaaaacaaattgctaagcagcgacattcggataaagatgaaaaaatactggaatgccttatacaaaggtaatttcatttcaaaaaaaaaatacgatagactgactcgaaccgaagatttcacgaatgaggagttaagtggcttcatcgaaagacaaatagttgaaacaagacaatcaagcaaggcggtagcagaactcctaaatagactatatgaacattcggaaatagtatatgtcaaagccggattagtatcagactttaggcacgataacaaattattaaaatcacgaagaataaacgattatcatcatgcaaaggatgcctttttaaacatagttgtcggaaacgtatacaacgcaaaatttacatcgaacccccgtaaatggataaaagaaaataggggaacaaattactcaattagacgagtatttgattacaacgtaaaaagaggaaacaccgtagtctggcaaggagtagaagacggcggtcactcaattgatgagataagaaaaacgatggctagaaacgatatcctctacacagaatatacatattgcgataaaggcgaactcttcaatgctacactaataaaaaaagggaatgataaggccataaatttaaaaaaagccttagactcagtcaaatacggagggtacaattcaccaaaaacaagtgcatttgctttcatcgaattcgacgggaaaaagaaagaacgtaaaaaccatatagtcgaaattccagtatatatcgtgaacatagcaaagagacagccagatacaataaaagagtacctagaacaaaaaaagggttacaaaaatgtcgtcgttaagaaatacccaataaaaaaaaatgcactaataaaaatagatggctacttagcacgtctacggggcgcaaatgaaacagacatcctactaaaaaatgctgtacaattaattttaaacgacaaatattatgaaataattagacgagtagaaaaatatttagaatacaacgtaagatatgaggcggaaagcatgtttgaaggatttgaccacgcggacctcaactcattatacgacgagcttacatcgaaattagaaacaagcatatataaaaaaagaccagccaaccaactaaatgcactagaaaaaggaaaggaaaaattcaaaaatatacagactcttagagaaaaagctcaaattataaaagaaatgttaattatgtacaggtgtgatgccgctacagtagccaacctaaaagcaatcggaggaagtgcaaacgccggaagtatgaaaataaagaaaaacacgctcacaagccgaagcttagttttagtgaatcaatcaattacaggtcttttcgaaactgaagaggaactagtatga

SEQ ID NO: 8828 - RNA, 4056 nt, synthetic construct
  misc_feature 1..4056: note = Cas9 variant
  source 1..4056: mol_type = other RNA
atgtataagaaatatggaatcggattagatataggaacatctagtattggttggtcagtggttgacgaatatggacatataatcagagtaaaaggacaaacaggcttaggagtgagattattccgagaaggacaaccggccgccgataggagaacgttcagaactacacgtagaagattagggcgacgccgctggcgattacgactactaagagaaatctttgatccatacatagctgctcaggatcctaatttctttgcccgacaaaaagcatccgcgatcgcaccaggagatagtagattcaaagcagtatacagacttttcaatgatcagaccgaccgccaattttatgataagtatcccactgtctaccatctgcgacagaaacttatgaccgagaaaagacaattcgacattagagaaatatatcttgctgtccatcatatcgtaaaatatagaggccactttctaaccggaggcgcagcgaaaaactttaaaccaggaaaattagatctaaatacatactttgcaactataaacgcacaactagctgcaatctttatggactcccaagtcgaacttccacaacttgattgggacgcagtagtcagtcttctcactaacgaccaagaatccccaagtgatagacaaaaagcgttaacaaaaatgctagtggcccaaggagatgcaacccagaaaagattctacacagaattttcgaaagcactattaggtttaaaagcgaaattatacgttctaacgggattcgaaggagacaaaacagaccagaaagcattaacactaagtctggaaacattagacgatcatcaagatgatgtgacgcaactactaggagacgaacagagacaattagtggaactcctagcacgggtacaatcagccatacaattagcgataataataccaaacggtaaaacattcagcggtcaaatggtacagcaataccaaacacactatgatcaactacgcctattaaaggactacagagaacaactaactgaccaaaagcaccgccgtgcacttaaacaagcgtatgccgactatttagcaaacgaccaagatcaggatgctctagtaaaagcagtcgaaaaggtattaaaacaaaatcaacctctgtcaactgttggagtccggttacaaacagccatcgatgccggagatttccttcccaaacaacgtactaaagccaactctgtaattccacatcagatacatcaacaagaactcgaccgaatcattgaagcacaaagcgtttattacccttggttggccgaagaaaatcccgtcgccgcacatagaagctacgcaccatacaaacttgacgaactcgtggattttagagttccttactatgtcggcccactcgtgcaaccacaggcagacaaagctgctaaggaaacaaaatttgcctggatgacccggaaagaagcccaatcaacaacacctatcacaccctggaatttcgaacaagaggttgatcggaatgcatctgcaaatgcttttatacagagaatgaaaactacagatacttacttactaggagaagacgtcctacccaaaaatagtctactttatcaacgctttgaagtactaaatgagttgaacaatgtacgcgtcgatggaaaattactgactatagcagaaaaacaacgattatttcaagatcttttcgttgacaggtctcaagcatccgttactatagcacagttacaagcgaatcttatcgctcacggagctgccaaagatagagtcgaaataaagggtttagctgacccaaaacgctttctctcctcgctaacaacttaccatgattatgcacaaattatcccagaagctcttgaacaaccagataaacgagctgatatagagaaaattataaattggtctaccatatttgaagacacgtcaattttcaaagaaaaattacaggaaatagcatggttaactccagaccaacgaagacaactaagccagaaacggtacagaggatggggacaactctccgacaaacttctaacacaactacgtgacgcaacaggacaaagcgtcatggacctattatggactgaaccaaacaattttatgcaaataatcaggaggacagaatttcaacaagcgattgcacgagtgaatcaaacagatttaaaacagcaagacttagccaccacaataaacgatctatatacatctccacaaaataagaaggcaataagacaagtattattagtagtcgcagatatacaaactgcaatgcacgaagttgcacctagctggttattcatagaggccgcaagaggtcccgaacagaatcctaaacgcaaactagcacgacaacaacaactacttgaagcatacaaaacatcagcgaaagaaattgtaaacgaagcggtcaaggaaaagttgctatctgcaatagatgatcatcaaaaatttgaagatcaagtagtcttatattttcaacaaaatggactagatatgtacaccggaaagccattagacttcgaaagactttcaaaatatcacatagaccacataattccacaaagtgttgtcaaagacgattcattagataacagagtactaacaacaccagaggaaaacgaaagaaaaggtgccagggtcccaggtccattatatgcaagtcaacagggacgatggagattacttcaacgggcagggttaatatcccaaagaaaactagaccatctactattaaggccagaagagttagaccaacaagcaacaggttttgtggcaagacagttagtagaaacacgtcaagtcattaaattaataactaatattctgtctcagcaatacgatcctgaacaaacgaagctagtatctgtaaaagcaggcttaagccatcaatttcgaactcgattaaatttacccaaactacgtgagttaaatgattaccatcatgcccacgatgcctatctagcagcccgaattggaacatatctcctacaaagatacccaaaccttgaaagattctttgtatatggacagtatcagaaaactaggtttgatttaaaacgacatttcaactttattggagaaatgttaaaaggtaaaccagaagacgccgtcatcgtgaaggcgcctcactcggagacagttatctgggacaaacaagatgaagtaaaacaactaaagaaaataatggaataccgacacctcttagtcacccacgaggtatacgacaatcatggagcactcttcaatcaaacaatacatccagcgaaaaatcctaaaaatagaaaattaataccaagaaaaaccacacagtcgacagaattatatggaggttacagcggcgaaacaacgggctacctagcaattgcaagaactgtaactaaaaacaaaatatcatatcaagtcctaagagtaccaacaagattagtcggaagattgcagaggtcatcagagtccgcacaaagacaaatcctaaccgattggtttgcgccatcctttgtaagcagaggcaaacaacaaccatttgaaatagtactaagacatgtattcaaaaatcaaacagtgattgatgacatacatgaacaaagccaccgatttggactacgttcagatacttattattgcaatcaacaacaactcgttttatcattagaacaacaaagaatgataatcgatcaaaaactaaataatacaaataaacttatggtagtatatgaggcagtatgcgaccaagtggcaaaatacttccccctctatagaatgaaccactttaaagaatcattattagaagctggaccaaaactagcagaactcccaatcaacaccgtacaatccaaaaatggaaaacttaaattgggccagcgttcagtacttctacaaacaatgcagggattacatgcaaatccagaaacaaaagatttatccatcattggatgtccaaaatacttcggcaaacttcaagtatcatcaggcatcaaactaacagagaacgcggtattaatccatgaatctcctacaggattgtttcaaagaagggtaagattatcagacttgtga

SEQ ID NO: 8829 - RNA, 4056 nt, synthetic construct
  misc_feature 1..4056: note = Cas9 variant
  source 1..4056: mol_type = other RNA
atgaaaatattaggtctagacttaggcacaaactcaatcggttgggcagttgtaaacgaagcagaaaacgaaagagaaagttcaagtataataagactaggagttagagtaaatccattaactgtggacgaacaaaataacttcgaaaaaggaaaacctattaccacaaatgccgatcgaactctcaaaagaagtatgagaagaaacttgcaaagatacaagctcagaagagcaaatcttgtatcactattgaaaacacaaggatggataaccgacgaaacattacttagtgagcaaggtaataatagtaccttcgaaacctaccgcctaagagcagaagcagccacaaaagaaataactttagagcaattcgcaagagttctattaatgctcaataaaaagcgaggatataaatcctcacgaaaaatgaaacatgacgaagatggatccttcgtaaataacttagacatagcaagagaattatatgactccggcctaacaccaggacaatacgcttacaatttattaaaagatggcaaaaaatacatacctgacttttacaggtcagatctacaagaagaattagataagatctgggcataccagtacgaataccatgaaaatattctaacccatagcttgaggagtgcaatcattgaccaatcaaaaacgggtacaaccaaaatcttcctgaaaacacacggcatattcacagcagatattaaaggcaatcgaaacgagagaaataaacaattatttgaactaagatgtggagctctcgagagagcgctaacagcggaagaattagcgacagtaattgctgaagtgaatggacaaattaactcatctagcggctacttaggtgctatcagcgacagatcaaaagcactatttataaaccatcaaactgtaggccaatacttaatgcaacaactagatcgcgacccaaataaatcattaaaaaatcaaccgttctacagacaagactatttagacgagttcgaacaattatgggaaacacaagcacattaccacccagagctgacggccgctttaaaacatgagattagagatataatcatattctaccaaagacgattaaaatcacagaaatggttagtagccaactgtccattcgaacaccgtaaagtatgtcccaaatccagcccattgttccaacatttcagaatatggcaagttttgaacaatgttacagtaacagtagacaataaaacgtatgtactaaacgaggagcaaaaatcaattctcagcaaagaactactatacaaggaaaagatcagtaaaagagacgcactcaaaatgctattcgttaaagcaaagggtgtagatatgaatttcgcatcacttgaaggtgacagaaccatgagcaacttattaaaagcagcacaagaaatagtatcaatatctggacatggtgattacgattttggcaaaatgcccgcggacgacatacataacataattcgcagtgtatttggtggattaggatttgcaacagattggctaaacctagatacagacgcagacgacctagaacaagagtcacaaatgagattatggcacctaatctactcatttgaaggggataactcgactaccggcgacaccaaattagtcgagagattaatgtctctcttaaacctaccacaggaatatgcaagattattcgcaaatgtacatttagaagatgactactgcggtatctcctcaaaagcactcaaaagaatactaccgttcatgaaagccggtcacatctattccgaagcgtgtgcacttgcaggatataaacatagcgaacaaagcttgaccagagaagaaaacaaaaataggccactgaaagatcatttagaacaattaccaaagaattccctaaggaatccggtcgttgaaaaaatactgaaccaaatggtcaacgtagtaaacagcatcatcgatacatacggaagaccagatgaaataagaattgagttagccagagaattaaaaaacaatgctctaggcagacaagcaatttttgaagcaataaacagaaataccaaagaatcagaacgtattcaacaaatattaaagaaagagtttggcctaactcacgtaagccgcaatgatataatcagatacagactataccaagaattatcaggtaacggatacaaaacattatacagcaacatttacattccacaagagaaactatttagtaaagaaatagatatcgagcacataataccccaagcccgtttattcgacgactcattcagcaataaaactctagaatacagagatgtaaatatcaaaaaaagcaatactactgccatagatttcgtcaggaacgaatacggagagaacgaagtggagcaatacaagaaaagagtaaacgatctcctaaagtcaggagcaatctcacaagcaaaagcaaaaaaactaaaaatgacagaagctgaaatacccaacgactttatcgaaagagatctgcgtaatactcaatacatatcaagaaaagcccaagagatgttacgagacgtcgcaagagtagtcacagcaaccacaggatcagttacggatagactcagacaagattggcaattggtagacgtaatgcaagaactaaactgggataaatacgaacgacaaggtttaactacagtaatcaatggaagagatggacaacaaattagacgcattaccgactggactaaacgtaacgaccatcgacaccacgctatggatgcattaacgatagcttttaccaaaccagcctatatcagttatctaaatcacctaaacgcaaggtcagaggacgacattcgatccatagaacgaagattcctagaaagagacgctaacggccacctaagatttatttcaccaatcgctcacaattttagaagcgaagcaaaaagacatcttgaaatgatattagtgtcaatcaaagcaaaaaacaaagttgtcacacgaaacaataacacaacaaaaacaaaaggcggcagaagaaataggatacaactaacaccaaggggacaactgcacgatgcaacagtatacggaagtattctcttacctcatacgaagacaatagccgtagatggaaaaatgacggccgaaataataggccaagtacaaaacccagtattccgacaagcactgagtcaacgattagaagcatgcggtaatgacccaaaaaaagcttttacaggtaaaaacagtttagaaaaagccccagtatggattgatcaagctcatactgagcatgtcccagcagaggtaacaattcaacgtctagaaccccaacacacaatccgtagagctgtaaataaagatctaaatattaataaagtcctagataaaggcatacaacatatcctccaagcgcgcttagatgcatatggcggcgatgcagcgaaagcattcgctaacttggacaacaacccaatttggctaaaccaagaaaaaggaatagctattaaacgagtaacgacagccgagaatataagcggagaacccctacatcacaaacatgataaagagggaagaccaattctcgatacaaatggaaagccaatgccatcagactttgttcgtctcatgaacaaccaccacgtagcaatctttcaagatgccgatgggaacttacaagaacatatcgtatcattttatgaggcagtagctagagtaacagaattaggcttaccagttatagacaaagaatataacaaagataaaggttggcaattcctgtttacactgaaacaaaatgagtattttgtattcccaaatcccgcacaaggattcaaccccgatgaaatagatctcacggacgagcgaaattacagccgaataagtcctaatttatatagagttcaaaaaatgtcgtcaaagtattacgttttcagacatcatttagaaacaacagttgaagataaaaaggaactacagggtataacttggaaaaggatccaatcactgaacaacttaaaaggaatagttaaagtccgcatagaccatatcggcaggattgtacaaataggtgagtactga

SEQ ID NO: 8830 - RNA, 4056 nt, synthetic construct
  misc_feature 1..4056: note = Cas9 variant
  source 1..4056: mol_type = other RNA
atgttttcacaacaaaacaacctttattgtgaatctttatcgaaactatactataacataaccaaaaactttctatctaaaaacgaagtctgcagaatatatgaaatcttcttctgcagcatcctaacatacttcctgaagaaatacaatcatgatatattcaagaaatcttctaccatgaaaactatactaggattagacctaggggtaacatctataggatgggcagtcatagtaacagatgatgacaataccccaataaaaatactaggcatgggatcaaggattatacctctaagcacggccgacaaagaagagttccagaaaggtcaagctataagtaaaaatcaatcgagaaccatagctaggactcaacgaaaaggctacaataggaaacaattaagaaaagaggaacttaagaaaatattaggagaactgggcattacaccttcaaaagaattactaaacttaccatcaattgaattgtggaaactacgtgctgacgcagcatcaggcaacgccccactaagcgcggaacaactaggtaggattttctacatgctaaaccagaaaagaggttacaaatcagcaagaagcgaagcaaaccaagataagaaagataccgattacgtagcagccgttaaaggaagacaccaacagctaaaagaaaaagggcaaacaataggacaacacttctatacggaaatgctaacattagaagaaaactctggccactttcaagtcaaaaataatgtatacccaagagaagcatacctagaagaatttaacgcaattatagctgcacaaaaaccacaacacgctttccttacagacgacgtagtagacagactaagagatgaagtaatattctaccaacgaaaactgaaaagtcaaaaaggtttagtaagcatatgtgagttcgaaggatttgaaagaacattctttgacaatgtaaaacaaaaagataaaacaattttcacaggacccaaagtagcaccaaaatctagtccactcttccaactatgcaaaatctgggaaacagtaaacaatatcaacttaaaagttaaaaatactgacggtagtaaaaataaatgggcagactacgtaccgacacttgaacaaaaacaagaaataatagaacatctcttcaaaaatgcaggcatatcattagacgctctccgaaaaatactaggttttaacaaagatgaaatattcgtgaacaaacaaatagaaaaaggtctacaaggaaacacaacttacgcggaaatacacaaaatactgggagactccaaacccgaactactaggattcaatataaatatagaaccatcaaaacattcggcattactcgtagacaaaagaacaggcgaaatactggctgaaaaagaaggacaacaagtttccgccgaaatagaaaaagaaaacttttaccagctctggcatacaatatactcaataaaagatctagacgaatgcgcagccgcgcttatcaaacgattcaacatcgatcccaacgtagcagcccagctagcaaaaatagattttagtaaaggtgcttttggcaacaaatcaaacaaagctatgagaaaaatcttaccgtacctcatgcaaggctacaattatgcagatgcgtgtagtttagctggatacaatcatagcgactcgcaaacaaagaaagaaaaagaggaaaatgttgtagacgataaactcaaactgctcgagaaaaacagtttaagacaaccagttgtagaaaagataataaatcaaatgatacatgtagtaaatgccattattgacaaatatggaaaaccagacgaaatcagagtcgaactagcccgtgatctaaagaaatcaaaagacgaaagaaatgaagcagaactacaaaacgcctccaacaagaaactaaacgaagaagtagctaacagacttaaagaactaggactgccagtcacaaaacgtttcgttcaaaaatacaaatttatatttccagtccgcgatcgtaaaataaaagaagcacaattagtaaatcaatgcatctactgcggagaaacattcaacgtgacagaagctctatccggggataattttgacgtagatcacattatccccaaatcaatgctttttgatgactcacaaactaacaaagtgttagttcatcgtaaatgtaacgcgaaagacaaatccaacaagacagcatatgacttcatcgcggcaaaaggagaaaacgaattagccatttacttagacagggtcgacgactggtttaaaagaggagtcttaagctatggaaaaatgcaaaggttaaaagttagctatgaacaatacgcagaaagaaaacaattaaagaaagaaacagaagcagacataaaactatgggaaaattttatagaacgagacctccggcaaacacaatacatcgcgaaaaagtcgaaagatctacttaagaaaatttgcaataacgtcaccgtaaccgaaggaaaaataactgcgcaactacgtaacctatggggctgggacgacgtattaatgaacctacaacttccaaaatacaaagcattagggcaaaccgaaataaaagaatggactagcgaacacggaagacgattacataagaaagaagaaataacaaattggacgaaaagagacgaccataggcaccatgctatagatgctctggtggtagcttgtacaaaacaaggtttcattcaacgcataaatacactaaacagctcagacacaaaagatgctatggacagggaaataaaagcagctaaagaaaaatacaatgaactatatgataagaaactactaacagaaactaatgaacaggtcaaaaaccatacagaaagatttaacaaacttgaaacttacttaaagagccaacagcccccgctatttacaacaaggtatgtagaacaggaagcagacaaaatcttcgttagtttcaaggccggcaagaaagctgcaacatacggaattagaaaaataaagaaagacggtaagaaagtagtagtacaagagaaaatagtagtcccccgaggcgcactacacgaacagagcgtatacggcaaaattaaaacacaagaaaaagataaacctctaaaatatttattcgaaaatccagaaacaatagtagacaatagaataaaaatcctagtcaaagagagacttgacaaatttgaaggagatgtaaagaaagcgctaacgtcactgaagaaagaaccactattcatagataacgagaaaaacacattattagaaaaagcggcatgttacaccgacgcaacagtattaaaatataaactacaagccttaaaagcaaatcaggtaaacgatatagttgatgaaggagtcaaaaggatagtgaaagcccgactcgctcaacacaaaaatgaaaaagaagcgttcaaagatacagtttggttcaatcaagagaaaagaatacccatagtcagtgttcgagtatttgcacgtcctgacgcctcaaaactggcgataataaaaacagatgaaaataacaaacctataggattcgccttaactggtaataaccaccatatcgcaatatacaaagataataccgggaaattagtacaacacatctgcacattttggagcgctgtggaaagaaagaaatttggagtcccgacagtagttaaaaatacaggtacactctggagcgaactcttgcacaaagacctacccgggacatttctagataaattaccacaagacggtttagaactcgaatattcacttcaacaaaatgaaatgtttgtattaggactcccaaaagaatcgttcgaagatgcaatcaaaaataacgatctgccattactaagcaaacacctatatctcgtctggtctatcagtgataacgattactggttcagacaccatttagaaactaaaaactccgaattaaaatctacaacaggcgcaaaagaatcaaaacgttactacagattccagtcagtaggtaccttcacgaaagaaaaccctatcaaagtacaattaaatcacttaggtgaaattacaaaaataggggaaccgtga

SEQ ID NO: 8831 - RNA, 4059 nt, synthetic construct
  misc_feature 1..4059: note = Cas9 variant
  source 1..4059: mol_type = other RNA
atgaagaaaagaaaccgagaagagtactatgtaggattagacattggaacatcaagtgtcggatgggcggttgctacaccagattatcgaatccctaaatttagaggacacaaaatgtggggatctagactattcgctgaaggcaagcgagctgctgagagaaggcaattcagaacaaatagacgaagactagcaaggagaagagatagactccaaattctggaggaactatttgcagaagaaatggcaaaggtagacaacacattctttatgagactcaaagaatcaaagttctttctagaagacaaaactgtgaaggagaaacatatactgttttcaacagataaatttgacgcagaccgattttacaaagacaatcccacgatctaccatgtcaggaaacggttaatggaggaggaacctcaagatataagggaattatttctagcagtccaccacatactaaaatatcgaggacactttctctttgcaggatcattagaacaaaacggagcaagtatagaggaactcgtaagaacgctattagggaaacaaggtttagcgattttagatgacactatagatagcaacgaaatggtaaatatattgaaaaacacaggagaaacaaaatcagatcgtaagaaagacgtacaagaactatggaaccccttgaaagacaaagtaaagaaagcccaagctgccgaaatggctggcctagtactagggctaaaaagtgacatcagcaaactctttgccaactcagactataaggatttggattccagtatcaaaaacataaactttagcagtggggactacgaggagaaaagggacgattatgccaacagtataggagacgatatagtcctactagacacaatgaaagcgctttacgatacacttattttatcacaaatcttacaaggtaaacgaagcatcagtgcagcaaaagtagaagattacaatacccacaaagaacaattaagagcattgaaggcaatactaaaaccgcataaaagactttataacgaaatgtttagagaaaacaacaagaaagatctatcaaattacgtagcctacattagcagctactcagaaggtaaaagagtaaacagggaaggtttctataaatatgtacaagcagtgctaaaacaagtagacgactcagacagcaaacaagcaatattagaagctatacgcctagaaacatttttaccacttctaagagttaaagataatgcggtaatacctcatcaaatccatcaagcagaattagaagccatattagaaactgccagaaagaaatataatttcttaaatgacgtatccgatggggtatccgtcaaagataaaataatacaactcttcacattccgtataccatactacgtaggaccccttaacccgcactcaggcgaaacagtagccgaccgtaaacaaggaacgggatgggtcgtgcgaaaacagcgagggaaagtatacccgtggaacttcgcagatatggtggacgtaaaagcgagcgctgaggcatttataacaaatctaaccaacaaatgtacctatctaatcggagaagatgtactaccaaaaagatcattattatactcagagttcatgctactaaatgaattaaatatgataaaatatgacggtcacgaattgccagtagcaataaaacaattatatatagaacaagtattcaaacaagaacacaaaaagcaaacaaagggaagggttctagactttctaaaaagaaacggcctaataacaggatcagcaaccgccgtcataacaggaatggacgatgcaataaaaggtgacctacaatcctatagagacatggtaagaattttcggcgcgggatttgatcactcaatggccgagagaataattagatgggtaaccctgtttggagaagcaaaagatattctggaaaataaaataagagaagtatatggaaatagcataagtgacagtcaaatgagagctattaagaaattaaaatacgcagactggggaagactatctcaggccttcctaattgcagtgaaaggttgcgataaatcaggagtagaacgaaatataataacatgtctacgagcatcaagccaaaatctaatggaaatactatcggatcaagggacttatataaaacagataaaagcatggaatcaccaacatactacaaacatgatggatacattagactatcagctagtggacgacttatacgtagcaccaagtgtaaaaagatcaatctggcaatcactctgtatagttgaggaattagtcaaaataatgggacaagcacccaagaaaatcttcgttgaagtaactcgtactaaacaagctgagaaaacaaagaaagatagtaggaagaaacgcctagtggaactatatactgcaataggaaaagaaggagcagcatggaagaaagaaattgaagcgcaccaagctggagattttagacgtaagaaattatacttatactacactcagatgggcagatgtatgtacagtaatgaacctatcgcaatggatgcactatttacaagcgcttatgatattgatcatatttacccccaatcacttaccaaagatggtagctgggacaatctcgtccttgttaaatctcaactcaacaaagaaaaatcagatcaatatccgctgaggccagcaatccgtgagaaaaacaaagctcattggcagtacttatgtagagcaggatttatatcagaaaagaaatacgaaagactaatgcggactacagaattgacagccgaagaattatcgggttttatagcacgacaactcgtagaaacttctcaagcaaccaaagccgtaacgggattactagaacgaatatacacgaacactgaaatatgcttcgtaaaagcagaaacagtatcacaatttcgccaccaacacaattttataaaaatacgagaacttaacaattatcaccatgccaaagatgcttatctaaatattgttgtaggaaacgtgtaccacgaaaaatttactaaaaacccatgggaatttatagcccgttcaacagaaagaagaccttacaatttaaatagaatgtacgacttcgatttattaaaacaaggccgggtaatttggcaagtgccaaaatcgctagaaacagtccaagctatgatgaaatcaaacgacgtaagaatcacaaagaaacttctagtacaaaaaggagaactatacgatgcaactattactaaagcccacaaagcgaaagaagggacatactttccattaaaaggcgcagatgcaagattacgggacgtacataggtacggaggatatgagaaaataaaaatagcctactattcagtttttagttgtcgagaaaaagcaagcaatactatacataccctaataatcccaataccagtatataaagctggattactacaaacagaagctgatttaactgcctacgcctggcaaactaaacagaaaacgaaaccaataaaagatatatattccgcaatcacacctatttataagaaactctgtattaatacagtggtaaaaatagatggatttaaatatttcctaggaggcaaaacaggggattacatgtggttagatcctgctataccggtagtattagacgagcaagcagcagcatatcttaaagcaatcagtaaagtgggcagagccgacgacgtagagaatactgctcaagcaattgacttaataacagctgaagcgaatgaagcattctatgatgtattactaaagaaaatggaagcgaaaatattcgcaaaagcatatcaaactatagtggaaaaattggcctcagaaacagcaagagaaaggttcagagaattaagcataggagcacaatgctcatgcttattagaaatattaaacctcttagcaaacaacaaaacaacttttacattctttaaagataaaatgggagttacaatgtcaagaagaaaacaaccaatggacttaacaaaacttgaagaatgcatagtctacgaaacatcaataaccggattgtatgaaaaagcggttagcttgttatga

SEQ ID NO: 8832 - RNA, 4059 nt, synthetic construct
  misc_feature 1..4059: note = Cas9 variant
  source 1..4059: mol_type = other RNA
atgggtaaacgatatcacatagggcttgacataggtacttcatcaattggatgggcagttatggatgatgattttaaaataatgagagtaaaaggtaaaaaaggtatcggagtaagactatttgaagaaggaaagactgcggctgaaagacgaggacatcgaacaactagaaggcgttatagccgaagaaaatggcgcctgaatctccttgaggaaattttcgaccccgaaattgcgaaagttgaccccaccttctttgcgcgattaaaagagtccaatctatcacctaaagacgaccgcaaacaatactccgggaatttaatatttccagaaaaagccaaagaggaaatacgtgaatggaccgaaaaatacccgacgatttatcacttaagaaacgcattaatgaccgagaacagacaattcgacatcagagaagtattcttggcattacaccacatcgtgaaatacaggggaaatttcctattcaacgggaatttccaaacaggagaagttaacctatctgatcgttttgatgacattaacagcgcttttatatcagcatgcggggaagaggaagcgcctcaaataccaagtgaactgtataacgatatccaagaacttctatttgacaaaaatactcggaagttagataaccagaaacagctcgccaccaagttatcacaggacaacgataaggactggagtactcaattctccaaagccctctttggctataagactaaatttaaggtagttctccaatctaatgaagacctagatgattttcaactggatagcgacgatgccgacgacaaaattgcatccattagtgaacaaatagacgatgacagaggatcaatcctcgacaatattaaaatattatattcaagaataacactaaacgaaattgtccctgacggcaagactctgtctcaaagtatgatagaaaaatacaatctacaccgagatcacttaaaagaaataaaagaccaactgaaacatactgacaactgggtcaaatttgacgacttatactctcaatacgttaacggcaaactagaatctgatagacataaaaaactatccagtgatgacttctataaaaaagtcttgacgctattcgatggtgaattaaaaacacgtgtaaaagaatggcaagaaaaaggagaatttctaccaaaacaaaggacaggatctaacggtgtcataccacaccaactgcaccaaaacgaattggatcaaataatagaaaatcagagtaaatactacccatggttagcaactctcaacccaaacgaaaaaagacaacgagtagcgaaatataaattaagtgaactagtagcgtttagaataccttactacgtaggccccatggtaacgaaagaccaaagcgactttgcatggatggtaagaaaatccgatgaaaaagaaataacgccgtggaactttgatcaagtagttgacagagacaaatctgccgaggaattcatcaatagaatgaccacaaaagacacatacctaataggagaagacgtattaccagccaagagtttactttatgaaaaatttaccgtactcaatgaactaaataatataagaatcaacggcaagccactaacaaccgatgaaaaacaccaagtttatagagatttatttcaaaacgcaaaaagtatatctaccaaaaaattccacaattatttagtttgtaaattaaataaaccaaaccacctcaatataacaggcttctcagatctcacaaaatttaacagctcactcgattcctacatagatttaaaaaaaatatttgcagatcaaatcgacgatcaatcactccaagatgacttcgaaaagatgatacgatggagcacagtattcgaagataaacaaatattcgagagaaagttaagcgaaataaactggctcactgatcaagagagaagtgaagtagcaaaactccggtacagaggctggggaagactctcaaaaagattactagcaggaatacacgatgagaacggtcaaagaattatagatgcactttggaatagtccaaaaaattttatgcaaatacaggcagaagtagcattcaataaacaaataaatgaccttaacactaaagaattatcagacaataacgtagaggacgtactagcagacgcctatacctcgccccaaaataagaaagcaataagacaagtacttttggtcgtagaagatatacaaaaagcaatgcacggggatgctccaacatcaatatcacttgaattcgctagggaagaacaagaatcaagtagaaccagatccagacgtgctgccttgagtgcaacttacagacaaatatcagacgagatagtatctgctacagtaaaaggagaattaggaaaagcaaccagtatcagcgacagactatacctatactttactcagggaggtagggatatgtacactggcgagcccataaacatcgacgaaattagcaggggatatgaaattgatcacatactaccgcaaagcttcataaaagatgactcgcttgacaacagagtattagtaaaaggcgccatcaacaatggaaaatcagcgaactatgttatggaccaaagctgggcaccagacaggttagcttggtggaaaaaactgttagataaccgactcatctctagaaagaaatatcaatcactcacattaacaccagggaaaatcaataaatactcacaaaatggattcataaatagacaacttgtagaaacaagacaagttattaaacttgtagcaaatattctaaatgaccaatatagtaacgacgacacaaaaataatagtagtaaaagcagcgctaaactcacagttgaggggatttttagagctatttaaaaacagaaatataaacgattatcaccacggcatggatgcatatctaagtacattcattggaaactatttgtacaaaaaatacccaaaactacgatcttattttgtctacggtgaattcaaaaaattctcaggtaaacagaatctaaaatcctttaactttcttcatgacctagaagacgacagtattaacataatatcaaatgatgatggcgaaatagtagggaatcatcatgagatgatagaagaactagaaaaagcataccaatacaaatatatgctagtaagccgagaagtctttgaaaaaactggtgacctatttaacgtgaccgtttatagcagaaaagcaaaaaagaccctaatacccataaaacaagacaaacctataaacatatatgggggttatagtggtaataatgatgcttacatggcaattgtgaagctcccaggaaaaaaaggaaagccagatacatataaaatagtcggtattccactaaggtttgcaggagaattagaaagagccaaacaactcggagaaagtgcgtacagagaaaaacttagcgcagtcataaccccccaattcacaaaagaaaaaaaagatagaaaaacaggcgaaataacaaaagtagtagatgattttgaagttgtactcgatagagtcccatatcgccaattattcaaagatagtgataaatggtttatgctaggaagtgcagcttaccaatataatgccaaacaactagtactaaacaacgatgatgttaaactactaaacgaacaaggcagaaaaaaactagaactaccaaacgaaaagcttagttcggctttaaacgatgtttttgaccacatcatacaaatcatgaattcaaagtttgggctatatgacaaaaacggatttcgtacaaagttgacagaagcagcaagtatattctatgatctaccactaagagcagaatacaatggaaacaagaaagtcacggacggcaagctggaagtattagataacatattaataggacttcacgcagatccatcattcggtaatctaaaacaattaaacatgagtacaccattcggccaaatgcaaacaaagggaggagtagtacttaatggaaatagtactttaatatatcaatcaccgaccggactctttgaacgaagagtaaaactcaaagacctaagtaaatga

SEQ ID NO: 8833 - RNA, 4059 nt, synthetic construct
  misc_feature 1..4059: note = Cas9 variant
  source 1..4059: mol_type = other RNA
atgaagaaaatcctaggattagacttaggaacgacatccataggatgggcattcataaatgaaggtgaaaacgacaatgaaacttcaagtataataaacgcgggtgtaagaatagtcccactgacaacagacgaagaagcagacttcaagaaaggaaacactatatcaataaacgcagaccgaacactaaaacgaggagcgagacgaggattgcaaagatttaaacaacgacgagacgcactactacaatcttttcggggaatcaactttatcagctcaaattacgtatacgcagaaacaggaaaacaaacaacattctcatcttacaaactaagagcaaaatctgccacagagttagtcacaaaagaggaactcgtacaagttctactaatgctaaataagaaaagaggttacaaatcttcaagaaaagcaaaaacagcggaagaaggggatgcgatagacggaatgaaaatagctaaagaaatattcgaaaataatttaacaccaggacaatgggtatacaattccttatccataggcgggaaattcataccagatttctaccgatcagacttacaaaaagaagtagagaaaatagtcagatttcaaaaccaattccatccagaacaaatgaatgaaaaattactcgaaaacattcaaggaaaagcaagaaccgtcacgtcacaatacttctccaggattctaaatataccactggctgaaaacaaaggcacaagagaagaaacaaaactacaacactacaaatggcgaaacgaagcactaacagaagaactcgacctcaaagtcttagcgttcataataacagaaatcaacaatcaaattaaccaatcaaatggctacctaggagctatatctgacagatccaaagaactttactttaatcaagaaaccgttggccaattccaatataaccaattaaaagaaaacgcacacacaaaactcaaaaaccaagtattctacaggcaagattatctcgatgaatttgagaaaatatgggaaacccaatcaaaattctatccagaacttaacgacgaactcaaaagcgaagtacgagatatcaccatattttaccaaagaaagttaaaaagccaaaaacacctagtatcgttctgcgaatttgaaaaaggacataaagcaataccgaaaagctcacccttattccaagagttccgtatatggcaaaacataaacaatatagtagtcaaaaatgaaacaacaaaagaaccattcttactcggtgaagatctaaagaaagtcatagcccaagaattaagtttcaaagaatctatgactgacagtcaattactcacattttgtgatctcaagaaaggaacacataccgttaatttcaagaaaatagaaggaaacagaacgaatacgagcctattcaaagcattcgagaaaattctagtcttagaaggatacgacgaactagatctaagtaaactcgatgcaagcgacatcaaatcaataataaaaagtgcctttagtgacttagaaatcagcacagccatcttagacttcgaccccacaatacaaggaaatgattatgacaaacaatcatattatcaactctggcacttattatactccagcgaagaagacgatttcctcaagaaatcattaatggataaattcggttttaaagaatctcatctaccctttttattaaacataaaccttcaagccgactacggatcattatctgcaaaagcaatcaagaaagtattaccacatctcatggatggtcacatatacgataaagcctgcacattagtaggctacaaccacagttctagcctgaccacagatcaaaataacgaacgagtactaaaagataccttggaactcctaaagaaaaatagcttgagaaaccccgtagtcgagaaaatcttaaatcaaatgataaacgttataaacgcaattatcaaagacccggccatgggaaaaccagatgaaatacgggtagaactagcaagagaacttaaaaacaacaacgaacaacgatcagagatgacaaaagcaataaacaaaagcaccacagaacacgaacaaataagaaaattattgcatacagagttcggcatacatagagttaccagaaatgacataatcagatacaaattatggaaagaatgtgacggtataagtttgtacacaggaaaaccaatagaaccaagtaaactattcacaaaagactatgacatcgaacacatcatacccaaatctcgattattcgatgacagcttttcaaacaaaacaatatgtgaaagacaacttaacatagacaaatcaaacaaaaccgcatatagctttttccaagaaaaactgtcagcggaagagttcgaccaatttgagaaaagagtaaaatctctatttggaaaaatctccagaaccaaacaaaataaactattaatggcaaacaacgaaataccagaaggatttattgacagacaactcagagagacacaatacatcgctaagaaagcaaaggaaatactactagaggtctctagaaatgtcacagctactatcggatctgttacagacaaacttagagacgactgggaattagtagacgttatgaaagaacttaattgggagaaatacgacaaactaggattaacttacatcgaagaaggcaaaaacggagaaagactttataaaataaaagactggacaaaaagaaacgaccaccgtcatcacgccatggatgcaataacagtggcatttactaaaccagcatatattcaatatttaaataatttaaatgcccgaaccaacacagacaagaaaggcaattcaataataggaatagaaaataagtaccttaaaagagataaaaataataaactccgattcatcgaaccgataccaaattttagagaagtagccaagaaacaactagagtcaatccttataagttataaggccaaaaacaaagtcgttacgaaaaataagaatgtaacgaagaaatctaacggaactaatcaaaagatacaactaacaccacgaggacaacttcataaagaaacagtatacggaaaattacaacaatacgtgacaaaagaagagaaaataaacgcaaactttacacccgaatatgtaacaaaagtcgccaaaaaggaataccgagaagcactcctgaaaagactcatagaaaatgaaaatgatcccaagaaggctttcacaggcaagaacgctctcagcaaaaaccctatctacatttctctagaaaacaacattctagtaccggaaaaagtcaaaatagtatggctaaagagcgactatactatcagaaaagacataacccctgatttaaaaatagataaagtaatagatataggtttaaaaactatcctacaaaatagattaaacgaatttaatggcgataccaagaaagcatttgtaaatctcgacgaaaatccaatatggcaaaataaggaaaaagggatagcaatcaaacgtgtaacaatctcaggagtatctaatgcccaggctttgcataccaaaaaggaccatctaggaaacgaaatcctagacgaaaatgggcaaccactaccggttgacttcgtctcgactggcaataatcaccatgtagcaatttacagagatgaaaaaggcaacttacaagaagaggtcgtgagcttctttgaagcagttactcgcaacaaccttggactatcgatcatcaacaaaaaccacgaaaaaggatgggaatttctctttagtatgaaacaaaacgagttctttatctttccaaccgatggatttaaccctcatgaaatagacttactcaacacagaaaattaccatttaatatccagaaacatgttcagagtccagaaaatagccaccaaaaactatatgtttaatcaccacttagaaactaaatccgttgacggagaaatgctaaaaactaagaaacaactgtcaaaaataagttaccattttatacaaaccccctcttaccttaactatataataaagatacgcattaatcacctcggccaaatagtacagctcggggaatactga

SEQ ID NO: 8834 - RNA, 4059 nt, synthetic construct
  misc_feature 1..4059: note = Cas9 variant
  source 1..4059: mol_type = other RNA
atgaagcaggattattatataggattagacatgggaacagaaagtgtaggatgggcagtaactgacgtagattacaatctgattaaaaaaagaggacaagactattggggagtatatctattcgatgaagcacaaaccgctcaaggacgaagagcatttagaactaaccgaagaagattagcccgagttcgtcacagattaaatctactacaggagctatttgattccgaaataagtgcgaaggactttggcttcttttacaggctagagaattcaaaatacttcgacgaagataaacccgaaatagcaagaggcaagttcctattattcaatgataaggattttggcgataaagaatattataaaaactacccaacaatttttcatttacgcaatgctcttagaacacaggagataaaggacgtccgattactttatttagcagtccatcatatattaaaaaatcgtggtcatttcctatttggagaacaagactttaatgtaaatgatgcatccgatgtaagcggggaatttgaaaaaataaatcgttttctatccgagaacgatggagctggatttgacagagagaaaatccctgaaatcttcgaaacactatgtaacgagaacctagcaaaacgagaacgaaaagaaaaaattctagaacttgcaggaaactcaaaaaacaaattattaggagaggcagtaaatgcagttgtaggtctgaattttagtttgtcaaaaatgttcggtgaggaccgagacttccaaggtgaaaacaaaatgtcatttacagactcgtcctttgaagaaaagttagccaaagccaggatggcactggatgatgatgaagcagactttcttgaaacattgaaaaaggtccagagtgtagcaagcctacacaacatactacacggaaaagaatttatatctgaagctaaaactgaagcttacgagacacatagaagagatctcagtgagcttaaaaaatatgtgagagaaaactgtccagaaaaatacgcgttagtgttcagaagacaagtaaaaaaaggaaaaaaaaacacttcaggcgccgatgaaaatgaaaaagacgacaaaaaggtaaacaactacgcagcatacatcgggatggacaaaggtaaaggctttgaaaaatgcaaaaaagaagatttctacgcatttctaaaaaaggaaataggaataaacgatgaatctctactggcaaaaattgatgaaggcatcttcttaccaaaacaaataagcgcagaaaactgtgatataccatatcaagtacatcttgccgaattaaaagcaatattagcaaatgcagaaaactattttcccttcttaaagcaaaaagatgaaaactgtgagatgacagtaagtgaaaaaatcatctcattgatgaagttcagagtaccatattatgtcggaccgttcacagataaagaaacaagattttcatggatgatcaagaaagaaggattgtcaacccaaaaaattacaccatggaacttcgatgacgtagtcgatagagacgcctcagaaaaaaaatttatagaacgaatgacaaacttctgtacctacttaacgggagaaaaagtactacctgcaagtagtttcctatatagcgaatacgcgtttctaaatgaactaaacaacctaaaagttaatggaacaaaggaccttcgtgtgaaaaatattctatttgatttcgcaaaaacgaacaaaaaactaacattaaaaaaatgctgtgaacagttagtaaaaaacggactactcccagaagggagcaaagcaagagacgtattttccggaacagatggtgattttaaaaattctctgagcagctatatagatttcaagaggataataggagacaaagccgatctatatcgcgacatgtgtgaaaaaattattttatggataacagtaatatcagataaagaacgattggttaaaataataaaggataaatacggaacagtacttagtgatgaagaaattaaaggcctgaaagcgctaaattatactaagtggggaagactatcagaaaaattgctagacggaatatttgaaactgatagcgaaggcgaagtaggaaatgtgtcaattatagaaaaaatgcgaacagacacagaaaactttatggagctactatcaaacaaacacaattataaaagagcaatagaactagcaaactcagaaagtatagtagatgaaagagtaacatatagagctgtcgaagaactatattgtagtccagccgtaaaaagaagtatatggtcagctctaaaaatagtcagggaaatagtcaaagtacagggacatagcccaaaaaaaatattcgtcgaaacaacaagagaaaagcctgatgtaactagaaaaggacagcgaacagtaagccgcaaacaacaactattagacaaatatagagaaaatttaaggaacgaaaccgaactaataaaaaaaatagaagaaaccgaagacagtaaatttaatagtgacaaattatttttttattttacacaaatgggcaaggatgcatatacaggagaaaaaatagagttcgacgacgtatttaaaacagaaaaatacgatatcgatcatatttacccaaggagtaagataaaggacgacagcttggacaatcgagtactagtaagaagaaaaataaatcaaagtgtcaaaaaagatagctacccgctaagtgccgagataaggaacagaatggaaggcctatggcgtcaacttagagataaaaaactaatctctgacgaaaagttttatagattaacaagaagtactcctttaactgaaaaagaatgtggcgattttataaatgcacaactcatcgccacaagccaatccgccaaagctgcaatacagctactgaaacgtatgctacctgaatctgagatagtgtactccaaagcgggtaacgtaaatgaatttaagaaaaggctagaatttgtgaaaatacgagaattaaatgacttacaccatgcaaaagacgcatatttcaatatcgtagtaggcaatgtattcaacacaaaattcaatcataaccctgccgtttttcaaagaagtaacggtacaggtaactatgatttcgaacgcctttatgattttgatataacaaacgcatggaaaaaaggcgatgaaaacagaataagatcagtagcagaaaaaaatacatgcagagtcgtccgattctcaaaaacagaaaaaggccaattttatgacgcaacaatatacccagcaggaaagaacgacaaactcgcacccgttaaaggaaaagcaccgctaaacgacactagcaagtatggaggatacgataaagaaacaacagcctacttcatgctcgtaaaatcaagagacaaaaaaaaaaaagataaaacgttactgtcattagaatgcgtaaccgtactagccgacaaaaatttccgcacagcagaagacaaattaaaatactgtgaaaaagaacttggcttgaaggaacctgaaatcctgatagagaaaattaagctaaacactttatttaaaataaatggtagctatgcgtggataagaggaagaacaaacgataggctagtcctttgcaacgcaaaccaactttggctagacaacggcagtgcaaaagaactaaaaaaaatatccaaccattttagggacgtaaaaaaatacaataacaaagacttaccagtaagagaggaagagtttagcaaagaacaaaatctcgctttatacgatttatttacagaaaaactaggtggaaaaatatatgcaggactaccagttcaagggcaaattaaaaatctcgaaaaaggacgcgataaattcgaagctttagaattgaaagatcaattattcgtactcatggagattttaaagttcatgcaatgtaacagtatgacgtctaatataaaattaataggaggagcagaaaatgctgggaagaacagaataagcaaactaatacaagattctgatgtcaaaatgattttctgtagtccaactggttatttttgcaaagttgttgatttcaaaagattcctgtga

SEQ ID NO: 8835 - RNA, 4059 nt, synthetic construct
  misc_feature 1..4059: note = Cas9 variant
  source 1..4059: mol_type = other RNA
atgaagaaaatattaggattagacctaggaacaacgtcaataggatgggcattcataaaagaaccagaaaaagacgttgtcggaagtgaaattgtagacatgggagtccgtatagtaccactcagttcagatgaagaaaacgattttgctaaaggaaacactatatcaataaacgcagacagaacattgaaaagaggagcaagaagaaacttacaaagattcaaacaaagaagaaacgctttactggaaatattcaaagaaaagaaactcatatcgacaaactttaaatatgctgaagacgggccttcatccactttctctaccttaaacctacgagcaaaagctgcaaaagagaaaatcgaactacaagatctagtaaaagttttattacaaataaataagaaacgtgggtacaaaagctccaggaaagcaaaaagtgaagaagatgatggatccgcaatcgattcaatgggaatagcaaaagaactatacgaaaacgatctgacacccggtcaatgggtatatgaagcattacaaaaaggacgaaagaatgttcccgacttctacagatctgatctacaagaagaatttaagaaaatagttaactaccaaagcgaatttttcccggacatatttaatgcctcatttgtagaagactggatgggaaaagcctccacaccgactaaacaatactttaacaagaaaggagtccaattagcggaaaataaaggcaaacgagaagaaagaaggctacaagaatacaaatggcgcgctgaagcagtaaactttaaaattgatttatctgaaatagccttaatactcagccaaattaacagtcaaatatcaaattcatcaggctacctaggagcaatatccgacagatcaaaagaattatattttaaaaacttaacagttggacaatacttataccaacaaatcaagaaaaatcctcacacccgcctaaaaggtcaagtattttatagacaagactacctagatgaatttgaaagaatttggtccgtccaatcatctttctacccacaactaaatgacgctttgaaacgagaagtaagagacataacaatattctttcaacgaaggctaaaaagtcaaaaacatctaatcagcaactgcgagttcgaggatcatcacaaagtagtgccaaaaagccaccctgtatttcaagaatttagaatatggcaaaatttaaacaatctattactcatcaagaaagacaatcttaatgaaaaatttgacctggaattggagtcaaaaatagccttagccaatgaactcgcatttaaacgagagctcaatgttaaagacgcactaaaaattctaggtctaaaaccgaatgagtgggaatttaactttaccaaaattgaaggaaacagaacaaaccaagcattcttcgacgccttcgcaaaaattatcgaactagaagacggagaaccaatagatttaggggatttaaaagccgacgacattttggatcaattctcagaagcattcttaagaataggaatagatacagaactactccaagtaaattctgacattgaaggagcagaatatgaaaaacaatcgtacatacaattctggcacttactttattccagcgaagatgatcaaaaattgaaattaaacctaatccgaaaattcggatttaaaccggaacatgctaaaattctagcttcgataagcctccaagatgatcatgcatccctatcatcaagagcaataaagaaaatcttacctcacctccaaagtgggcttatatatgacaaagcctgcacatacgctggatataaccactcaagcagctttacaaaagatgaaaatgaaaaacgagaattacgagcagagctagaattgctaaagaaaaacagcctaaggaaccctgtggtggagaaaattctaaaccaaatgatcaatgttgttaacgccattcttaaagatcccgaactcggaaggccagacgaaataagggttgaaatggcccgagaattaaaggccaacgcagagcaacgtaaaaacatgacgagcaacatagcctcagccacacgagatcatgacaaatacagagaaatactaaaatcagaatttggtctgaagagagtaaccaaaaacgatcttctacgctacaaactatggttagaaacagacggtatctcgttatatacagggaaacccatagaagcaagcaaactcttctcaaaggaatatgacattgagcacattatacccaaagcgagactatttgacgactcgtttagcaacaaaacaatctgtgaacgccaattaaacatagataaagcaaatgtaacagccttttcattcctccaaaacaagctcagcgcggatgagttcgaacaatatcaaagtcgtgttaaatccctatatggtaaactatcgaaagccaaaatacaaaaattgttaatggccaacgataaaataccagaagacttcattgcaagacaactacaagaaacgagatatataagtaagaaggcaaaagaaattctatttgagatatcaagaagagtttcagtcactaccggcacaattacagacaaattaagagaagattgggggctagtagaaataatgaaagaattaaactgggaaaagtacgataaactgggcttgacttacactattgaagggaaacatggagagcgtctaaacaaaataaaggattggagtaaaagaaatgaccaccgacaccacgcaatggacgcattaactgtggcactaactaaacccgcatacatccaatatttaaataacttaaatgcaaaaggcttaaataacaagaaaggcacggaagtattcgcaatcgagcagaaatacctaaaaagagaaaacggtaaactatgcttcataccaccaatagaaaacataagatccgaggccaagaaacacctttctagaatactcgtatcttacaaagccaaaaataaagtagtcacaataaataaaaacaaaactaaatcaaaagcaggcttaaatgagcaaatcgctttaacccctagagggcaattacataaagaaacagtctacggcaagagtttccactacagcactaaatttgaaaagatcggcgcatcgttcaacgtacagaaaattaacaccgtagccaagaaagaagaacgcgaagctctactaaaaagactagcagagaacggtaacgaccctaagaaagcattcacaggcaaaaacacactaaacaaaatgccaatatatctagacctcggcaaaaatataaagttatcagaaaaagtaaaaacagtcgtgcttgaacaaaattatacgataaggaaaaatatagacccagatctaaaagtcgataaagtcatcgatgtcggaataaaaagaatactagaaagtaggctagaagagttcggaggaaacgcgaaattagccttttcaaaccttgaagaaaacccaatctggcttaataaagaaaaaggcatctcaataaaaagagtaaaaatctcaggagtatcaaatgttgaatcattacatgtcaagaaagaccacttcggtgaaccaatactagaccaagaaggtaacgaaatacccgtagactttgtgagtaccggtaataatcaccatgttgcaatttacgaggacgaaaatggaaacctccaagaagaagtagttagtttctttgaagccgtcgtacgacaaaaccaagggcttccaataatcaagaaaaatcacacactcggttggaaatttctatttacactcaaacaaaacgaatatttcgtgttccccagcgacgactttgtaccggcagatgttgatttaatggatgaacaaaattatcacctaatcagcccgaacttatttcgtgtacagaaaatagctaggaaaaattacgtattcaacaatcacttagaaacgaaagcagtagataacgacctcttaaaatcaaagaaagagctttcaaaaataacataccatttttaccaaactccagagcatctaagagggattataaaaatacgtataaatcatctcggaaaaattatacaaattggggagtattga

SEQ ID NO: 8836 - RNA, 4059 nt, synthetic construct
  misc_feature 1..4059: note = Cas9 variant
  source 1..4059: mol_type = other RNA
atgaacaagaaatactatctaggattagatatagggacaaattccgtaggttgggcggtaacggatgaaaattataatttatataaatacgcaggcaaaagaatgtggggaatcaggttatttgaagcggcagacaccgcagcagaaagaagaatgaagagatcgaatcgaaggagactatctagaaagaaacaaaggatagatctattacaggaattattttctgaagaaattgtaaagaaagatttaacattcttcatacgcttaaacgaatcaagacttcattttgaagataaaagcaccggcgaaaaataccctcttttcgtagataaagaatacaccgatatagactatcataaacaatacccaacaatgtatcacttacgcaaagaacttatagagaatccagaacctcatgatattcgtttagtttatctggcatgtcatcatatccttaaaaatcgcggtcactttttaataaacggaagcataagcgacgttaaaaatctgagtttcgtatgtggtgagatgataaaagagttcaacagtgtaagtgaatatgaaatatcattaactgatatccgcgaactagaaagaatacttagcgacaagaaaactgctaaaagcgtaaaagcaaaacaagtagcccaactcttcgaatgtacaccagcggaagacaaagaacaacaaaagtgtgcaaaagcgataattacaaatctttcaaagttaatagtaggactaaagggcaacatatcgaaaatgttccaccaaccattagaagaaataagtacaaaatcattcaaatttacagaagcaaaatatgaagatgaaatcatgcccgcaatagaagaaaactatccagattatgcaagtgtaatcgatagaataaaaggagtatacgattggagcgtattagtagaaatactcgacggagaagactatctgagcttcgcgaaagtaaaagcctatgaaaaacatggcaagaacttacatatacttaaaaacgtaatgaagaaatactgcaaagatgaagtctaccaggctttcttcaatggaattaacgagaaaaacggctatggaaattatatcggtgcaatacgcaaaaatggccatacctataaaatggatagatgcaaatcagaagaagacttctacaaaggattacaaaagatactatcaacaatagtacccgaccaagaagacgaagaactattagaaaaattaaaagcagaagtagaaaaccaaacattattaccattagctagaagcaaagaaaacggaacaataccaaatcaagtccatctacaagaactaatgaaaattctagataatgcaaaagaatatcttgacttccttaagaaagaagatgagtacggtacaatagcagagaaaatcataagtatagcaaaatttaggattccttattacgtcggaccactatcgagaagacacaaagaagaaggctcaaattcatggatgataagaaaggaagaaggtagaatctatccatggaactttggagacaaagtagatgtagaacaaagcaataaagagttcatagaaagaatgacaaacaaatgtacttacctaattggagaagatgtactgcccaaaaacagcctcctatatagtaaatatatggttctgaacgagctaaataacctaaaaatccgagggaacaaaatttcagtggaacttaaacaacgtatatataaagatctattctgcacaatggcaaaagtaactggtaaaaggatactcgagtacctcaaaatggaagatccagaaatagtacaagaagacataagcggatttgatattgactttaaatcagctttagcaagctacctagatttcaagaaacaagtggtaggaaacgaaatcgaaaaagatcactacaaagagatcatagaagaaattatcaaatggaaaacaatatacgacgacgacagcaaaatgatgaggcgtatgatagaacgagaatacccagaggttttcgataaagaacaaataaagaaaatttgtcaactcaaatattcaggttggggaaacttcagcgacagatttctaaacggggtaagaggcgcagataaagaaaccgaagagtcatatacaataatagaggccctctggaaaacgaactataacttaatgcaactattatccaagcaattttcttttaaggaagaaatcgaccaaataaacgcagaaaaagctggtgacgtaggaaaaataaattacgaaaacactgtaaaggacttaatagtgtcaccatcaaacaagagagcaatctggcaaacaatacaaattgcggaagaaataaagaaagtaatgaaatgcgaaccagaaagaatttttatagaaatggcaagaggtggagaaaaagaaaagaaaaggacagtgagtagaaaaaccagattacaggaactatatgcaggctgcaaagatgatacaaggaattggatgaaagagataggggacagagaagaacgagaatttaattctcgaaaactatatctatattacacccaaatgggcaaatgcatgtatactggagacgaaatagacgtcgatgcactaatgaaaggaaacagtaattgggatattgaccatatataccctcagtcaagaattaaagatgacagtttagataatatggtgctcgttaggaaagacgttaataacaagaaaagaaacaaaatattatcgcccaaaattagagaagatatgaaaggatactggacaatgttgtgtcaaaaaggtctcatatccaaacgcaaatatgatagactaacaagaaccacagactttacagacgaagaattatccggattcatagaacggcaactcgttgaaacccgtcaatcttcaaaggcagtagcggaattattaaatcgattatataaagactccgaagtagtatatgttaaggccggtctagtatcagattttagacatgataatgatctactaaaaagtagaagagtgaatgactaccaccatgccaaagatgcgtttttaaacattgtagtgggaaacgtctaccacgtaagattcaccagcaaccctagaaagtggataaaggataacagagattcaaattattccatacgaagagtattcaactatgacgtcaaacaaggcgacaaaatagtatggcacggaagtgaaaacgggggacattcaattgatcaaatcaagaaaataatgagtaggaatgacattttatacacagaatacacatattgtgaaaagggacaactatttaacgaaactttagccaagaaaggtaatgaaaaagcaatagcactaaagaaaaacctggacccagtaaaatatggtggatatacaaccccaaaaacctcggcatttgcattcgtagagttcgatgggaaaaagaaagaacggaaaaatcatatagtagaaataccggtatacgtagtcaacattgccaagagagaacctgacgcagtaaagaaatatttagaagaaaggaaaggatattcaaacgtagtaatcaagaaataccccataaagaaaaacagtttaataaaaatggatggatatttagcacggctaagaggagcaaatgaaaaagacatcatactgaaaaacgccgtacaactcatactcaacaaagacctgtatgaaatagtcagaaaaattgaaaaatacctagaatataacctccaatatcaagcagacgcaaaattcgaaggatttacaatgaaagacctcaacatgatctatgaggagttatatttaaaacttaaagaatccatatttcagaaaagaccagcacaacaaatgaaaacactagaaaaaggaaaagaggcatttataagcatagaaaacttgggagaaaaagcaaaagtcataaacgaaatcattgcaatgtttcgatgtgacgcaacaaccgtagctaatctaaaggtcataaacggttcgcagaacgcaggatcaatgaaggtcaacaagaacacactcacctcaaaatctttaaaacttgtacatcaaagtataaccggattattcgaaaccgaagaagaactggtttga

SEQ ID NO: 8837 - RNA, 4062 nt, synthetic construct
  misc_feature 1..4062: note = Cas9 variant
  source 1..4062: mol_type = other RNA
atgaaaaagaaatattacctcggtctagacatcgggacaaacagcgtaggttgggcagttacagacgaaaactataacctatgcaaattcaacggcaagaaaatgtggggaattaggttgttcgaagacgcaaaaacagcagcagagcgtagaactaaaaggagtaacagacgaagaatagcgagaacaaaacaaagaatagaccttctacaagagctctgcgaaaaatcaatcttcgagaaagatccaactttcttcatcagattaaacgaatcaagtctacatctcgaagacaaatctacaggagaaaaatatccactatttgtagacaaagaatacacagacatagattaccacagggaataccccacagtctatcatctcagaaaagaattaatcgaaaacccagaaccacacgatcctagattagtttacctagcatgttgtcatattattaaatcgagaggtcattttcttgtaaatggatccatatccgatgctaaagatctcagcttcatctgtgaaaacatgataaattcattcaacgccgcaagtgattacaaaataaacatacaagacatgactgctcttgaaacgatactgacagacagaaaaatggccaaatcggtaaaagcaaaacaaatcgtacaactattcaaatgcatcccatgtgaggacaaagaacagcaaaaatgctgcaaagcaataataactaatctatcaaaactcatcgtcggtctaaaaggagacatatcaaaaatatttaacgaatctttcgaagaaatcaaatcgttcaaattcgcggagacaaaatatgaagacgaaatattgcctactatggaagaaatttatccagaccacgcagaaataatagagaaaattaaaagcatatatgattggtcaatactggacgaaatattggacggcgaagaatatctctcattcgccaaagtcaaagcatatgaaaaacacaagaaaaatctacacgacctcaaaatcctaataaagaaatattgcgacgacgaaacataccagagcttctttaatggaatgaatgagaaaaacaaatacagtaactacataggttcaatacgcaaaaatggacatacatataaagtcgaaaaatgtaagtcatcagaagacttctacaaagaattacttaaattattatccagtgtcaacccaggacaagaagatgaatcgcttctagaacaaatcaaattcgaaacagaaaaccaaacacttctgcctttactgcgaacaaaggaaaacggcacaatccctaatcaagtacacatgcaagaattaataaaaatattagataatgcctccaaatatttagacttcctaaatgaaaaagatgaatatggaactacagcagacaaaattataagcattgctaaattcaaaataccatactatgtagggccactctcagaccgccacaaagaaaatggctcgaactcttggatggtcagaaaagaaaacggaagaatatatccttggaatttcgatgacaaagtagatgcggaaaaatccaacaaggaatttatacaacgaatgacaaacaaatgtacatacttaattggagaagatgtactacctaaaaattcactcctttactcacgctacatggttctaaacgaactaaataacttaaaaattcgaggtaacaaaatatctgtagaactaaaacaacaaatatacaatgacctcttttgtacaaaagccagggtaacaggtaaaaatatcctaaattacctcaagaaagaagacccagaactcgcagcagaagatctaagcgggttcgacgtagactttaaatcggctcttacatcctacctcgactttaagaaacaagtagtaggcaacgaaatcgaaaaagattattataaagaaataatagaagaaataataaaatggaaaacaatatataacgaagacagtaaaatgatgaaaagaatgatcggcagagaataccctgaaacactaaatcaagaccagattaagaaaatatgccacctaaaatataacggatggggtaatttttcagaaacgtttttgaacggcattaaaggagctaacaaagaaaccggagaatgttacactataatagaagcactatggaaaactaattataatttaatgcaacttcttagtaaacaattttcatttaaagaagaaatcgaccaaataaacgctgagaaaacaggagccataggcaaaataacatatgaaaacctagttaaagatctagtagtcagtccagctaataaaagagctatatggcaaacaatacaaatcacagaagaaattaagaaagtaatgaaatgcgaaccagaacgaattttcatcgaaatggcaagaggaggagaaaaagaaaagaaacgtacagtatcaagaaaaaccagattacaagaactttatactggctgtaaagacgatactagagattggatgaaagaaattggagatcgagaagaaagagagttctcatcacgcaaactttatctatattatacccaaatgggaaaatgtatgtacacaggtgaagaaatagatgtagacttactaatgacagccaatagtaaatgggatatagaccacatatatccacaatcaagaataaaagacgattccttcgataacatggttttggtacgaaaagacataaataacaatgtaaaaggaaataatatagtaccctcttcaatacaaaaagaaatgacaagttactggaaaatgctgttacaaaaagaactaatctccaaaaagaaatatgaaaggctgacccgcagcacagatttcactgacgaagaactaagtggctttatagaacgtcaactggtagaaacacgccaaagttctaaagcagtagcggcattactgaacagattatataaaaacagtgagatagtttacgtaaaggcaggactcgtctcagacttcagacacgataacaaactactaaaatcaagaagaattaatgactaccaccatgcaaaagacgcatttctcaatatcgtggttggcaactgctaccgcactaaattcaccgcaaatccaagacaatggatcaaaaagaatagagacacaaactattcaatacgtagagtatttgatttcgatataaaacagggagacaaaattgtatggtacggtaacaaaaacgaaaacggaaaacatacaatcgaccaaattaaaaaggccatgtcacgaaatgacatactgtacacggaatatacatattgcgaaaaaggaaaactcttcgatgaaactctcacgaagaaaggcaacaagaaagcaattcctttaaagaaaaatttggacccattaaaatacggaggatacacctcagtcaaaacctcagcatttgcatttatagaatttgacgacaaaaagaaagaacgtaaaaaccacatcgttgaaattcccatatacgtagcgaatatagcaaaaagagagcctgaggccgtcatcaaatatctcgaagaacaaaaaggatatgtaaatatagtcgtcaagaaataccctataaagaaaaatagtctgttaaaaatagacggttacttagccagactaagaggtggagactctagtataataactctcaaaaacgctgtacaattagtactagacaagaaatcatacgaaataataagaaaagtagaaaaatatctagatcacaactctaaatacgaagcaaactctaaactagaaaaattcaatgaaaatgacctaaatataatctataacgaactttgcttaaaactaagaaactccatatatcagaaaagaccagtacatcaacttgaaaccttagaacaaggaatagacaactttcgaagcctagaatcactaaaagacaaagctaaaattataaatgaattattagccatgttcaggtgcgacgcaaaaacaggaatggacctacgcctcataggaggagcgtctaactccggaagaatgagaatatccaaatcccgattaacatcgaaatctctaaaactaataaaccaaagtgtaaccggattgtttgaaactgaagaagaattagtatga

SEQ ID NO: 8838 - RNA, 4062 nt, synthetic construct
  misc_feature 1..4062: note = Cas9 variant
  source 1..4062: mol_type = other RNA
atggagaaaaactattatttaggtcttgatatgggcacatcttcagtaggatgggccgtgactgatgaaaactataatttaatgcggaagaaaggaaaagatctatggggagtaagactcttcaaagaagcaaaaacctcagcggaaagacgagtaaaaagaacctcaagaagacggttacaacgcgaaaaagcaaggattggatacttaaaagaattattcgctgatgaaataaataaagtcgatgcaggattttaccaaagaatggaagactcaaaattcatctcggatgataaaacagtacaccaaaaatttacacttttcagcgatacaaactatacagacgaggactattataacgattacccaacaatatttcacttacgaaagaaacttattgaatctgatgatgaatacgatgtaaggatggttttcctggcacttttaaacatgtacaaacatcgaggacactttttaaacgcaaacttatcagacaatgggatgggcgacattaacgaacaatatgacaggctaaaagaactttgttccgaatatctaaacgtagaatgggaaaataaacctgataaatttgaagagattctgaaagaatgtaactgcagcaatagcttgaggaacgaaagactcttagaaacattcaatctaaaaaaaacagacaaagaaaagtgtgaaatgctaaaactaatctgtggattaagtgggacattatcaaaaatattcaaagacctagacgatgatagtgaaacaaaaaaaatgactatttctttcagatcatcaaactatgacgaagaagccattaacgtggaagaaatcatcggttcagaaaacttcgaaattatagcagtattaaaagaaatacatgattggagtatgttagcaaatataatgcgtgggaaaaaatatctaagtgtcgcaagagtagaagaatatgaaaagcacaaagatgatctgaagatcctaaaaaaagttattaaagaatactcaatagaggaatacaacaatttcttcagagtaatggcagacaacaattatagtgcctatgtaaacagtgttaactctaacaaggaaagtacaagaagaggagcgaaatgcgacaacgacacattctttaaagaaataaaaaaaatagtaaataaatgctacgacagcgaggaaaaggaatacattcttaaagaaatcgaaaaaggaactttcctgccaaaacagataataagctcaaacggcgtaattcccaaccaagtacacaaaatagaaatgaaaaaaatattacagaatgcagaaaaatacttaccatttctcacagagaaagacgactctgggctttcagtatcagaaagaatactacagatgttcagctttcaaataccatactatataggtccaatatctggaaagatcggcagcgacgaaaaatcaaaaaactcatggtcagttcgcaaagaaaaaggacgtatatacccttggaattttaaagacaaaatagatgaaaaagaaagcgcagaaaaattcatagaacgaatggtaaatcattgcacctacttaaataatgaaatggtactcccaaaaaatagtctactatacgaaaaattcatggttctaaacgaactaaacaacctaaaaataaacaacgaaaatataagtgtagagcttaaacagtcactatacaacaacctctttaaaactggaaaaaaagtcactgccaaaggtatcaaaagctatttagaacgaaacggcttatgcgaaccaaacgaagatataaacttgactggtatagatggcgattttacaaacaggctatcaaactacgcaaaatttaaaggcatattcaatactgacgaactcacctatgaacagtggaatatggcagagaaaataatcaagtggagcaccatatatggggacagtaaaaaattcttagaagaaaaaataagaaacgaatactctgaaaaactagattcacaacaaattaaaagaattctaggtatcaaatttagggattggggaagactctcagaggaattattgaacatggaaggagctgacgtaaacaccggagaaataaaaagtgtaatcggtcgtatgtgggatgaaaattacaacttaatggaattgatagcaaccgacaatttcacttacaaacaagtgataaaagagaaacaaaatggacttgataaatcattatcggaaatagattacgatgatttagatgaattgtacgtatcggcaccagtaaaaaggatgatatggcaaacactactaatcattaaagaacttgtcagtgtaatagggtatgaaccgaccagagtcttcgtcgaaatggccaaagatgttaacacagaaaaaaaaagaacagatagtcgcaaaaaaaaatttttagacctgtacaaacaatgcgaaaaggacgaaagagatttctggataaaagaaatagacgataaatcagaagctgaatttagaaaaaaaaaattatacttatactacacacaaaaaggaagatgcatgtacacaggagaacaaataaacccattagatttaactaacgacaatctttacgatatagatcacatatatcctagacatttcgtaaaagacgattctatagaaaataatttagtattagttaaaaaagaaaaaaacgcacacaaatcagatacttttccaattgaagatgacatacggaaaaaccaatacgccttctggaaaatgttatatgaaaaaaacttcattacaaaagtaaaataccaacgactcaccagaaaagaaccctttagtgacgaggaaaaagcaaactttataatgagacaaatagtagaaacgaggcaaggaaccaaagttattacagacatcttagaaaaatcgtttgacaaaacacaaatagtatacgtgaaagcggggaatgtctccttatttagacaaaaatacgaatgcataaagtgccgagaaatcaatgatttccatcacgcaaacgatgcttatcttaacattgttgttgggaacgtatacgacacaaaatttacatctgacccaagaaactttataaaagaataccgtaaaaaccctcaaaaaaacgaataccatatgtataaactattcgactataacgtacaaagaggggacagagtagcatggaccgcctccaatggcgaaagtatgaaagtagtaaaaggtactctcaaaaaaaatacaccccttgtaacattcatgagttatgaagaacatggcggcctatacgatcaaaacattataagcgctaaagatatagaaaaagtgaaaggcaaaggttatcttccgattaaatctagtgattccagacttaacaacacagagaaatatggaggatatgctaaagtatcgggtgcctacttctttgtagtagaacacacggtaaaaaacgtacgaatacgcacgatagaaccaatgccatgctacttaaccaaggtcctaaccaccaaagaaaagatagaagactactgctgtaatatattaaaatacgattcaccagttgttaaatacgaaaaaataaaaatgtactcattaataaaagtcaatggatatccgatgtacctaactggaagaacgggaaatcaattaattgttagtaacggaatccaattagttttaagctacgacgaagcaaaatacataaaagatttattaaaaatcaatcaagaagagtttgatcaaaacagactcgagaatcttggtatcaacaaattcagaaacgaaaaattatatgacacactcaacaaaaagtacaccaacgaaatatacaaaaaacgccccaacagcatgggcaacaaaatgatagaatggaaaaacacattccaaaatctatcaataaaagatcaaacagaagtactcctgcaactcatccaactgggacaaaaacaaaatagtggggttaacttggagaagttaggtgcaagtaaaaaaacgggagtatccctagtctcaaaaaaaatcactgataaagaatccttcgaacttatcaataagagcattacaggactatacgagaacaaagtagacctgttaagagtgtga

SEQ ID NO: 8839 - RNA, 4062 nt, synthetic construct
  misc_feature 1..4062: note = Cas9 variant
  source 1..4062: mol_type = other RNA
atggctgcatttaaatattatctggggttggacatgggaacaaacagtgtaggatgggctgtaacagacccaaactataatctccttaaagcaaaaggaaaagacttatggggtataagggaatttaacgaagcaagtacagccgtagaaagaagaacacaccgaatatcacgaagaagaagacaaagagaacaagtcagaataggattactaaaagactactttcacgatgctatcggagaagtcgatccagacttctttcaacgactagctaactcaaaataccatttggaggataaagatacagaggtaagatacaaaaacaatgtatttaacgatgatgactatacagataaagattacttcgaccaatatcctacaatttatcacctaagaaaagaacttatcgaaagcacagacaaacacgacgtgaggttagtgtttctagcattactgaacatgtttaaacatagaggacattttctaaatagtggattaggagaaaactcaggagaaaacaatataaataatgcctacttagaattgactaacctcctttcggagttcacacaatacaacttaaacgaaaccattgatggtaagaaaatagaagacatattaagtagaagggatatgagcagaacaagaaaagcagaaggcttagccgaaatactaggagttgactacaaaaataaaccatacaaggaactaataaggggcttatgtggactaaaatttaacgcatgcgcaatcttcccagaaatccaatcggatgaagtgccaaaattagatatatgcttgtctgaagccagcttcgatgagaaaagtgacgaaatagcaaatattctcggtgaagactactttgaaatcattatggcaatgaaagatatttatgatatcggatccctagcagggatcatgaaagggcataattatctctcccaggcaagagttacaagctatgaaaagcataaggaagatctaagactcctaaagaacgtcatcagaaaatattgctccaaagaagactatgacaatttctttaattccgaagccgatggaagctatgcaagttatgtgggatcatataatagcaaaacaaaacaacggagagtaggaaacaaaagatcgagcgaagaattatataaagcaataaagaaaatcctgaaaaacgtaccagctgaagacgccgacgtacagcgaatcctaatgagtatagaaaatgaaacatttctcccgaaacaacttacggcaagtaacggagtaataccaaatcaagtgcacgcaaaagaaataaagaaaatactcagtaacgcagaaagatacctaccatttctacgtgaaaaagatgaaacaggcttaagtgtaagcgagaaaataatgaaattattctcgtttcaaataccatattacgtgggaccgacaacagaaaaatctagtaaagatggaggcaatgggtgggtagttcgtaaagaagaaggacaagtacttccatggaatatagatgagaaaatagatatgaaagcaacgtcagaagcatttatatcaagaatggtcagacgatgcacatacataagtggcgaacccgtactgcccaaaagcagtctcgaataccagagcttttgtgttctaaatgaaataaacaacataaaaatagacggggaaaggatatctgttgaattaaaacaagacatatataaagaagtttttcaaaaaggaaaaagagtaaccaagaaacaactttgtaaatacttacacacacgcggaataatagaagcagaggaacaagtaacgggaattgacgtaacaattaataacgctttaacgacatacggaaaatttaaagctatactcggagacgatatatccaaggactctgtacagaaaatggtagaaaacattgtattttggtgcacagtttacggcgacagcaagaaattcttgaaggatagaatagaagaaaaatacggggaaaagctgacaaaagagcaaataaaacgaatagttggatttaaatttaaagactggggcaatctaagcaaaaattttctagaactatccggggcggatgtaagcactggagaatctgtcagtatcataagggctctctggaacaacaatctcaatttgatggaattaattaactcacgattatataactacaaagaaagactagccgaataccaaaacacaatgatgaaaacactatcggacatagaggcagaggacctagacgaatactacttttcagccccagttaagagaatgatatggcaaacgatattaattattaaggaacttgtcaaagtactcggatgcgaaccagacaggatctttgtagaaatgacgagaaggcccgatgaacgcaaaatgcgtacagaaagtagaagaaagaaatttgaagaactatacaagaaagtaaaagacgaagatgtagattggatgaaagtgatagcccacgctgacgagacaggcagcataagatcaaagaaaatgtacctttacttaacacaaaaaggacgatgcatgtatacaggtaaacatatagaattatcggatttattcaacaataacttatatgacatagatcacgtctatccacgacacttcgtaaaagacgataatatagacaacaatctcgtgctagtatgcaaagagaaaaacgcacacaaaagtgacatatatccccttgaagacgaaatactagccagccagaaaaacatgtggtcagaactcagacgaagtggcttcatcacagaagaaaaatacaatagattaataggaagaaactcatttactgatgaacaaaaagctggatttatagctagacaattagtagaaacaagtcaaggaacaaaaggagtagcaaacatattacaacaattattaccagaaagcaagatagtctatgcgaaagctagcaacgtatccgaatttaggaatacaagggatataccaaagtccagactaataaacgaatttcatcatgcccacgatgcatacttaaatatagtcgttggcaatgtatactacgtaaaattcacacaaaacccattaaacttcattaagaatgactacgatagagataaaacgaaaaataattataacttaagcaaaatgttcgattgggatgtcgaacggaatggtgaagtggcgtggattgcccaaaagaaagacggcgaagccggaactatagctacggtaaagaaagtactaggtagaaatacaccactaatgacacgatattctttcgaaggtaaaggagggctaactaatgaaacactatacagtgcaaagaaagccaaagaagaaggctatataccatttaaaagttcagacgagaaaatgaaagatgtaaccaaatacggtggcttcacatcagtaactggtgcatactttttcttagttgaacatacagaaaagaagaaacggtcacgaatgattgaatcagtcccattatacctagctcagaaaatagaacaaaatccacacgaattagaaaaatactgcgaacaagtattaggactaatagacttcgatattagagtacgaaaaatcaaaattggatcattaatcaaacgaaaaggatacttcttttacataaccggtaaaacaggccaccggcttatactccgtaacgctgtaaacatgtgcctgaagaaagaatgggtaaaatacatttcaaaattagaaaaagcagtagacaaaaataatgttgaaggaatcataacaaaagagaaaaacgagttactatactccgaactaattgaaaaattcaaaaactcaattttcagcaatcgacccaatccagttggagataaattagatgaggcgaaagaaaaattcatcaatctggatatagaaaaacaatgtatcgttctatgccaaatcctccaactctcctcagtgttaggaagcgaatgcgacatgacccttctaggagaaagtgcacattgcggcaagatcctaatatccaagaaaattggagatgaagacatatatcttattaatcaatccgtcacaggtttatatgaaaagaaaatcaatttaagaactgtatga

SEQ ID NO: 8840 - RNA, 4065 nt, synthetic construct
  misc_feature 1..4065: note = Cas9 variant
  source 1..4065: mol_type = other RNA
atgaaaaaaatattaggactcgacctaggcacaaactctataggctgggcattcataaacgaagcagaaaacgaaatagaagtctcatccattgtcaatactggggtcagaatagtgcccctaacaactgatgaagaaagcgacttcaaaaaaggaaataccatatcgataaatgcagacaggacattaaagcggggtgcgagacgggggctccagagattcaaacaaagacgtgaagcattactcgaaacattcaacaggataaaatttatagccacagatttcgtttatgccgaaaccggagccgcaacaactttttcttcataccaattaagagctaagtcggcagttgaagcagtgacaaaagaagaattggttaaagtattattaatgctcaacaagaaaagagggtataaatcatcaagaaaagctaaaacagctgaagaaggagacgctatagatggaatgaaaatagcaaaagaaatctttgagaacaacttaacaccaggacaatgggtatacaatagtctcagtaaaggtggtaaattcattccagatttctaccactcagatcttcagaaagaactagaaaaaattgtccgattccaaaatcagtttcactcagaacaaataaacgacaaactgttagcagacatccaaggtaaatcacggacacaaacatcacagcatttttcaaaaacgttaaacataccactagctgaaaataaaggaacacgtgaagagacaaagctccaacattatcaatggcgcaacgaagcactagcaaacgaactagacatgaaaatactcgctttcattataacggaaatcaataaccaaataaaccaatcatcaggttaccttggagcgatatcggataggtcaaaagaactatacttcaaccaagaaactgtaggccaataccaatacaaacaacttcaagaaaacgtacacgctaaactaaaaaaccaagtattttatcgccaagactacctggatgaatttgaaaaaatatgggaaacacaagccaaatttcactcagaattaaacgaaaaacttaaagcagaaataagagatataactatattctatcaacgaaaactgaaatcacaaaaacatttagtatcattttgtgaatttgaaaaaggacataaagcaattcccaaaagctccccgttgtttcaagaattcagaatttggcaaaacctcaataacgtagtcgtaaagaacgaaactaccaaagaggtcttcgaactaagcgaggaactaaaacaactaatagcagaggaactacaatttaaagagtccatgacagacgtgcaaatgttaacattctgtgaattaaaaaaaggtacacatacagtaaattttaaaaaaatagaaggaaatagaacgaacacttccatttataaggcatttgaaaagatcctggaagtcgaaggatatgaaatagactttagtaaaatgaaaccacttgaaataaaagaaacagttgctcctatatttgaaacactcaatataaacaccgtcatattagacttcgacccaacaattcaaggtaacgacttcgacaaacagccatattaccaattatggcacctactttactcggctgaagatgacgataaactaaaagaaaccttaaaaacaaaattcggattcaaagaaaaccaccttccttttattctaaacatcaatctacaagctgactacggaagcctttccgcaaaagccataaaaaagatattaccacatttaatggatggtcatatatacgacaaagcgtgtttaatggttggatacaatcattcctccagcttaactacagcccaaaacaacgatagggtacttaaagacacactagaacttctcaaaaaaaatagccttagaaacccagtggtagaaaaaatactcaaccaaatgataaacgtcataaacgccataatgaaggaccccgcaatgggcaaaccggatgaaatcagagtggaactagcacgcgaactcaaagctaataacgaacaacgaaaaaaagctacatctgatatcaatacggccacaacagaacatgaacgcataagaaaattactgcactcagaattcaacattccaagagtaaccagaaacgacatcattagatacaagctctggttagaaactggaggtatatccttatacacaggaaatccaattaaggcctcagacctgttttcaaaaaactacgatatagaacatattattccaaagtcacgcctctttgacgacagcttctcaaacaaaacattgtgcgaacgccagctaaatatagataagtcaaacaaaacagcatattctttcctccaagagaaactaagtgaaaacgactttgcggcatacgaaaatagagttaaagatcttttcaagacaggaaaaattaaaagctacacaaaatacaaaaaattactaatggcggacaacgaaatacccgaaggcttcatagataggcagttaagagaaacacaatacatagctaaaaaagcaaaagaaatactcctagaagtttccagaaacgttacagcaactataggcagcgtcacagacaaattacgacaagactgggaactagtcgacgtaatgaaagaactcaactgggaaaaatatgataagctagggctcacacatatagaagaaggtaaaaacggcgaaagattatccaagataaaagactggacaaaaaggaatgaccaccgtcaccacgcaatggacgccataaccgttgcattcacaaaaccagcatacatccaatatctaaataatctcaatgcaaagacccaaggagaaaataaagcaaatagcataataggaatcgaaaacaaacacctctaccgagacaagaataacaagttgagatttatatcgcccatgaaaaacttcagagaagaagcaaaaaaacaactagaaagcatcttaatcagctataaggcaaaaaacaaagttgtcacaaaaaataaaaataccacaaaaaaatctggaggtacaaatcaaaaaatccagctaactccaaggggacggctccacaaagaaaccgtatacggaaaattacaacaatacgctacaaaagaagaaaaagtcaacgcctcgttcactgaagactacatccaaaaggtcgcaaaaaaagaatacagagaagctttactgaaaagactagaagaaaacgataatgaccctaaaaaagcgttcacaggtaaaaacgcactaaacaaaacccccatatatattagtctaaaagataacatcatcgtaccagagaaagtaaaaacagtttggcttgaaaccgactatactataagaaaagacataacaccggacctaaaaatcgacaaagtaatagacgtcggaatcaaacgaatattacaaaaccgactaaacgaatttaatggagaccccaaaaaagcatttgtcaatctaggcgaaagcccaatctggctaaataaagaaaagggaatagcaataaaacgcgtcaccatatccggagtttcaaacgcacaagcattacataccaaaaaagatcatctaggcaacgaaattctagataaaaacggaaatcccatacccgtagatttcataagtacggggaataaccaccacgtagcgatatatagagatgaaaaaggaaacctgcaagaagaagtagtaagcttctacgatgcagtcatccgacgaaatttagggctgagtgtaattaacaaaaaccacgaaaaaggatgggaatttctcttttcaatgaaacaaaacgaattctttatttttcccagtgacggattcaacccacacgagatcgatctgcttaatcctaacaactatcatctaataagtccaaacatatttcgtgttcaaaagatatcaaccaaaaattatatgttcaaccatcacctagaaactaaagccgtggacggtgaaatgctcaaatcaaaaaaagaattatcaaagacgtcctaccattttatacaaacaccaacgaatctaaatggcataataaaagttaggatcaatcatcttggcaaaatagtacacctgggcgaatattga

SEQ ID NO: 8841 - RNA, 4065 nt, synthetic construct
  misc_feature 1..4065: note = Cas9 variant
  source 1..4065: mol_type = other RNA
atgaaaaagatattagggctagacttaggtacaaacagcataggttgggccttcataaacgaagcggaaaacgaaattgaagtctcatcaatagtaaatactggagtaagaatagtcccactaactacagatgaagaaagcgattttaagaaaggcaatacaatctctataaacgcagacagaacactaaaacgtggagcacgtagaggcctacaaagatttaaacaaagacgagaagcactactcgagacgttcaaccgaataaaatttatagccacagatttcgtatacgcagaaactggagcagcaaccactttcagttcttatcaattaagagcaaaaagcgctgtagaagctgtaacaaaagaagaattagtaaaagtactactaatgttaaataagaaaagaggatacaaatcatccagaaaagctaaaaccgctgaagaaggcgacgcaatagatggaatgaaaatagcgaaagaaatctttgagaacaacttgacaccaggtcagtgggtatacaactccctcagcaaaggaggaaaatttatacccgacttctaccactcagacctacaaaaagaattagagaaaatagtcaggtttcaaaaccaattccacagtgaacaaataaatgataaactcttagcagacatacaaggaaaaagtcggacccaaacctcacaacacttctctaaaacgttaaacattccgctcgcagaaaataaaggaacaagagaagaaacaaaattgcaacattaccaatggcgtaacgaggcgttagcgaacgaattagacatgaaaattcttgcattcataataacggaaatcaacaaccaaataaatcaaagttctggatacttgggcgcaattagcgatagatctaaagaattatactttaaccaagaaacagttggacagtaccaatataaacaactacaagaaaacgtacatgctaaattgaaaaaccaagtattttatagacaagactatctagatgagttcgagaaaatctgggaaacacaagctaagttccacagtgaattgaacgaaaaacttaaagccgaaatacgcgatataacgatcttttatcaaaggaaacttaagtcacaaaaacacctagtatctttctgtgagttcgaaaagggccacaaagctatcccaaaatcatcaccactatttcaagagttcagaatctggcaaaacctcaataacgtcgtggtaaagaatgaaacaactaaagaagtattcgaactatcggaagaattaaaacagctaatagcagaagaattacagtttaaagaaagtatgacagatgtgcaaatgctcacattttgcgaacttaaaaaggggacacatactgtaaatttcaaaaagatagaagggaacagaacaaacacatgtatatataaggctttcgagaaaattctagaagtagaaggctatgaaatggatttctcaaaaatgaaaccgttagaaataaaagaaacagtagcccctattttcgaaacattaaatatcaacacagtaatactagactttgatccaagcattcaaggcaacgacttcgacaaacaaccatactaccaactgtggcacctactctatagcgcagaagacgacgataaacttaaagaaacactaaaaacgaaatttggcttcaaagagaatcacctaccattcctactaaacattaatttacaagccgactacgggagtctgtcagcgaaagcaatcaagaaaatactaccacacctaatggacggacatatttatgataaagcgtgtctaatggttggatataatcatagcagcagcttaacaaccgcacaaaataatgacagagtattaaaagatactttagaactactaaagaaaaatagtttaagaaaccccgtagtagagaaaatacttaaccaaatgattaacgtaataaatgcgattatgaaagaccccgcgatgggaaaacctgacgaaatacgtgtcgaactagcccgagaacttaaagccaacaacgaacaacgaaagaaagccacatcggatatcaatacggccacaacagaacatgaaagaattagaaaattactacattcagagttcaacataccaagagtaacaagaaacgatataatacgatacaaactctggttagaaacaggtgggatttccctctacacaggaaatccaatcaaaggttcagaccttttcagtaaagattatgacattgaacatataatccccaaatcaagactctttgatgactcattttcaaacaaaacactatgcgaaagacaactaaatattgacaaatcaaacaaaacagcatactccttcctacaagaaaaactaagtgaaaacgatttcgctgcttacgagaacagagtcaaagacctttttaaaactggtaaaataaaaagctacacaaaatacaagaaactcctaatggcagataacgagatacctgaaggattcatcgatcgacaactccgcgaaacacaatacatagcaaagaaagccaaagaaatactattagaagtatcccgaaacgtaaccgcaactatcggaagcgtaacagataaacttcgcgaagattgggaacttgtagacgtaatgaaagaactaaactgggaaaaatatgacaaattaggcctaacacatatagaagaaggcaaaaacggagaaagactttcgaaaataaaagactggacgaaaagaaatgaccacagacatcacgctatggacgcaataacagtagcattcacaaaacctgcgtatatccagtatctcaataacctaaacgctaaaacacagggagaaaacaaagcaaactctattataggcatagaaaacaagcacctgtacagggataaaaataataaattaagattcatctcaccgatgaaaaacttccgagaagaagcaaagaaacaactagaaagtattctaataagctacaaagcgaaaaacaaagtagtaactaaaaacaaaaacacaaccaaaaagtcaggcggcacaaatcaaaagattcaactaacacctagaggccgacttcacaaagaaacagtttacggcaaattacaacaatacgcaacaaaagaagaaaaagttaacgcaagttttacagaggactacattcaaaaagtagccaagaaagaatacagagaagcactcctaaaaagattagaagaaaatgataacgatcccaaaaaggctttcactggtaaaaacgcattgaataaaacacctatatatatcagcttaaaagacaatataatcgtcccagaaaaagtaaaaacagtatggttggaaacagactataccatcaggaaagatataacaccagatttaaaaatagataaagtcattgatgtaggaatcaaacgaatccttcaaaacagattaaatgaatttaacggagacccaaagaaagccttcgtcaatttaggggaaagcccaatttggttaaataaagaaaaaggcatcgctataaaaagagtaaccataagcggagtatccaatgctcaagcactccatacgaagaaagatcatttgggaaacgaaatactcgataaaaatggaaatccaatccctgtcgattttatcagcacaggcaacaaccatcatgtcgccatatatagagatgaaaaaggcaaccttcaagaggaagtagtatcattctatgatgcagttattagaagaaacttagaattaagcgttataaacaaaaaccatgaaaaaggctgggagttcctattttcaatgaaacaaaacgaatttttcatatttccatcagatggttttaatccccacgagatcgacttactaaatccaaataactaccatctaatatctccaaacatattcagggtacagaaaatatcaacgaaaaactacatgtttaaccaccacctagaaacaaaagctgtagacggagaaatgttaaaaagcaaaaaggaattatcaaaaacctcttaccatttcatacaaacacccacgaacctaaatggaataataaaagtaagaatcaaccaccttggaaaaatagtacatctcggggagtactga

SEQ ID NO: 8842 - RNA, 4065 nt, synthetic construct
  misc_feature 1..4065: note = Cas9 variant
  source 1..4065: mol_type = other RNA
atggcggatttcgcaaaataccaaccaggaatggtcgctgatggtagaaaaatacctctagattggacactgtactatttacgaaagaaagcattaacgcaagcaattagaaaagaagaacttgcatggatactattaaatttcaatcaaaagcgaggatattatcaattgaggggagaagaagaagaagaaaactcaaccaaacacgaagaatactatgaattaaaagtggtatcggtagaagcagcagaagaaggtaaaggcgggaacacatggtacaacgtaactctcgaaaacggttggatatacagaagacaatcaaaaatcgagttaaacgattgggttgggaaagtacggccattcatagtaacaacggaatacgaaattgacggcgtgacaataaagaaagacaaaaacggagaagtaaaaagatcatttcgagcaccatcagagaacgattggggattacgcaagaaaagaacggaatcactgctggaagaatcaggtaaaacagtcggagctttcatatacaatcatattctatcagaaccagcagataaaataagaggaaatttcatcagaacaatagaaagaaaattttacaagaaagaactcgaagccatattaagagaacaaagtaaacatcaaaaagagctcaaagatatagatacactaatcgcatgcataaaagagctatatcccaataataaaccacaccaagatagtctgatcaagaaagatatgacatacctacttattaccgacctaatcttctatcaaaggccactaaaaagtaaaaagagcctcatagcagactgcccttatgaatactatgaatatgtaataaaggaaaccggagaaaataaacgacaatcaataaaatgtatagccaaatcgaacccgtattaccaagaatttaggctttggcaatttatcataaacttaagactctttgacaggaacaacgacaaagaagtgacatccgaatacctctcaagtatggaagattatacaaggctctttacatacctcaacgacaggaaagacataaaccaagaaacactcctcaaagactttttcaaacagaaaaaggttaaaagaggaatggaaaaagagttccccataagatggaactacatagaagataaagaaaagaaatacccatgtaatgaaacaagacacgaacttttaactgcattaggcaaagtgggaatagatcacagctggctagatgataaagaactattctataggctttggcacttattatatagcgttgaaagtaaagaagaagcggaaggcgctctaaggaagctagtagacaacgatgactttgtaaacgcctttctcaaaatcaaaccattcaagaaagaatatggagcatacagtgaaaaagcaataaagaaactactcgcagtcatgaggatgggaaatttatggaacgaagtcgatatttgcgaacaaacaagggacaggattcaaaacataataaaaggcgacatagacgagaaaatcaaagacagaatgggacggaccttcagccaattatcagatttccaaggtctaccagaatggctcgcatgctacgtcgtttatgggcaacattctgaagccacagacattcaaaggtggaccaaacccgaaaatttaatggcatacatcaatggatttaaacaacatagcttacgaaatccaattgtagaacaatgtatattagaaacattacgaacggtacatgacatatggaaagaagcaggacacattgatgaaatacatatcgaactagggagagggatgaaaagtacggctgatcaaagagcgaggatgagtaaaagtataatgcaaaacgaaaacaccaatctaagaataaagagcttacttatggaattgaaaaatgctaaagagttcgaaaatgtgagaccgtattccccaatgcaacaagaaatattaagaatatacgaagaaggagcattacaagaattaaccaaagaagacgctcaatacaatgaaataagtaaaattagccagatggcccaaccatcggccaatgaattactcaaatacaggttatggctagaacaaaaatactgttcgccgtacacaggcaaacctatatcgctcagtaaattatttacctcagcgtaccaaatagaacatataataccccaaagcagatatttcgatgatagcttcacaaataaagtcatttgtgaagcagaagtaaatcaacttaaaagcaacatgttaggatacgaatttatcaagaaacacggaggagaaatcgtgagatgcacaatgataggagatgtcaaactactagacgcaaaagaatactacaacttcgtaactgaacactacacaaacaatcgaaggaagaaagaaaaattgttaatggaagacataccacaagaatttctaaatagacaaatgaacgatagtcgatacataagtaagaaagtaatggctattctatcaaatatagtaagggaagaagatgaacaagaagctaaatcaaaatttgtaatagcctgcagcggcgggataactgacaggctgaaacaagactgggggctaaacgacgtctggaatagtattgtataccctagatttgaaagactaaacaaactaaccaatactgaaaacttcgggcgttgggaaaacaagaaaggaaaacaagtttttcaaacgtccgtaccgttggagctacaaaaagacttcagcaagaaaaggatagaccataggcatcatgcaatggatgctctagtcatagcatgtgcctcgaacaatatcataaattatctcaacaacgaatcagcaaaatcacaagagaaaagagaagatctaaggaagaaactctgcgacaaaaatcgaataataagaaaaccatgggaaacattcactcaggacgcccacaccgcattagaaaacgtcgtcgttagctttaaaaattacatcagagtaattaacaaagcaacaaattactacgaaaaatatgacaaaaacggtaagaaagaaattgcagaacaaaaagggcaagacatgtgggctataagaaaaccaatgcataaagagacagtatttggtcaagtcaacctaagacgcaaaatcacaataaaacttaaagatgcactagagaaaattccagctatatgtgacaaagaattacgagattacatcaacatattagtagccaaacaattcaataagaaacaaatactagctcattttaaaagcataaactatagactaaatatgaaaagtgtagataaagtagacgtttggcaattctcaaatgaaaaagaacccatggtagcaacccgtaaatcagtagacactagctttgatacaaaaaggatagctacaataacagacacgggcattcagaaaatactactaaactacctaaaagccaaaaacaacgaccctaatatagcctttacgccagaaggaatagctgaaatgaacaaacatattacagaatataacaacggaaaacaacatcaacctatacttaaagtacgtgtcagtgaaccgaaaggagcgaaatatcaagtaggtgagacaggaaataaacggtcaaaatttgtcgaagcccaaaaaggaacaaatctgtacttcgccatatacgaagataaagagggaaataggagttataatacaataccattgaatgaggtcatagagcgtttaaaacaaggattatcacccgtaccagacgcaaacgagaaaagtataccattaaaatttcatttgagcccaaatgacctggtatatgtaccaaaaaccgacgaagaaaacgaaataaaaatgggtcagatatataagttcgtagactcaagcgggacaacggctaatttcgtcccgcatagagtatcaaaccttatatacaacgtcgataagaaaatagccgaaaatttttgtaatcatgaaatcatacaaaacgagtatggaataggaagtccacaatccaaaaaccaaaaatcaataactggtgaaatgatcaaagcagtatgttggaaactagaagttgaccgactaggaaacatacataaaataatcaagtga

SEQ ID NO: 8843 - RNA, 4065 nt, synthetic construct
  misc_feature 1..4065: note = Cas9 variant
  source 1..4065: mol_type = other RNA
atgaaaaaaatattaggattagacttaggtaccacaagcatcggctgggcttttataaaagaacccgaaaaagatgtcgtgggttcggaaatagtagacatgggagtcagaatcgtgcccttgagttctgatgaggaaaatgactttgccaaaggaaacacgatcagtatcaacgcggatagaactttaaaacgaggtgcacgaagaaacctacagagatttaaacaaagaaggaacgcattattggaaacgtttaaggaaaaaaacctgattccatccaattttcagtacgcagaagatggtccatcctctacatttagtactctaaagttaagagataaagcagcgaaagaaaaaatcgagttagatgacttcgtcaaagtcctcctacaaatcaacaaaaaaagaggatacaaatcatcaagaaaggctatgtccgaagaagatgaaggtaccgcaatcgattctatgggtattgcaaaagaattatatgaaaatgatctaactcctgggcaatgggtttacgaagcactcaaaaatggaagaaagaatgtcccagatttctacagatccgatctacaagaagaattcaaaaaaatcgtaaattaccaaagcgaattctatccagatatactcaacaccagttttgttgaagattggatgggcaaagcatcaaccccaacaaaacaatactttaacaaaagaggagtacagttagcagaaaataaaggaaaaagagaagaaagacgactacaagagtataagtggcgagccgaagcagtaaacttcaaaatagacttaagcgaaatcgcactaatactaagtcaaataaatagccaaataagcaacagttcaggatacctaggagccataagcgatcgatctaaagaattatactttaagaatttgacagtaggacaatacctgtaccaacaagtaaaaaagaatcctcacacaaggctaaagggccaggtattttatcgacaagactacttagatgagttcgagaaaatttggtcagtccaatcaagtttttatcctcaactcaacgacgaactaaaacaagaagtacgcgatgtcacaatcttcttccagaggagattaaaaagccaaaaacatctaataagcaactgtgagttcgaagaacaccataaagtcgtaccaaaatcacacccgattttccaagaattcaggatatggcaaaacctaaataatcttacattaataaaaaaagacaatttgaacgaaaagtgtgaattggcactagaagacaaaacagcactagccaacgaacttgcatttaaaaaagagctctcggtcaaagacgccctaaaagtattaggactaaagccatcagactgggaatttaactttacgaaaatagaaggaaatagaacaaaccatgcattttttgaagcattcgcaaaaatcatagaacttgaagacggcgaaccaattgatctgggtaacctaaaagccgacgatatattagatcaatttagtgaagcattcctacgaatcggaatcgacactgagttattgcaagttaacagtgacattgaaggagcagaatacgaaaaacaatcatatatacaattctggcatctactctactcgtctgaagacgaccaaaaattgaaacaaaatttaattcgcaagtttggattcaaaccagaacatgccaaaatattagcctcaataagtctacaagatgatcacgcttcgttatcatcaagggctataaaaaaaattttgccacacctccaaagcggcttaatatacgataaagcttgcacatatgcgggatacaatcatagttcatctttcacgaaagacgaaaatgaaaagagagaactacgagcagagttagaattattaaaaaagaacagcctacgaaatccagtagtagaaaagattcttaaccaaatgattaatgtcgtcaatgcaatcttaaaagatcccaacctgggccgacctgacgaaatcagggtagaaatggccagagaattaaaagccaacgctgaacaaagaaaaaacatgaccagcaacatagcaagtgcaacacgagaccatgaaaaatacagagaaatactcaaaaaagaattcggtctaaaaagagtgacaaaaaacgatttattgagatacaaattgtggctagaaacggatggaataagtctctacacaggcaaaccaatagaagctagcaaacttttctcaaaagaatatgatatcgaacatataatacctaaagcacgactattcgatgactcattcagcaataaaacaatatgcgaaagacaactcaacattgacaaagcgaacgttacggcattctctttcctacaaaataaattatctgctgacgaatttgaacagtaccaatcgagagtaaaatcgctttatggaaaactatcaaaagccaaaattcaaaaattgttgatggcaaacgacaaaatacccgaagattttatagcaagacagctgcaagaaacaagatacatatcaaaaaaagccaaggaaatacttttcgaaattaccatgagagtctcagtaacaactggtaccataactgacaaactacgcgaagactggggactagtcgaaattatgaaagaactgaactgggaaaaatatgataaattagggctaacatatactatagaaggaaaacatggagaaagattgaacaaaatcaaagactggaacaaaagaaatgaccatagacatcacgccatggatgcattaacggttgcactaaccaagcccgcatatatacagtacttaaacaatctaaacgccaaagcgattggtaataaaaaaggaacagaaatatttgctattgagcaaaaatatttaaagagagaaaacggaaagttatgttttatcccacccatagagaatatcagagctgaagcaaaaaaacatttatccaaaatactagtatcatacaaagctaaaaacaaggtagttacgatcaacaaaaataaaacaaaaaaaaaagccggatttaacgaacagacagcactaaccccgcgagggcaattacataaagaaacagtatacggaaaaagtttccattatagtaccaaatttgaaaaaataggcgcatcatttgacgcacaaaagataaacaccgtcgcaaaaaaagaagaaagggaagctctattaaaacgactagcagaaaatggtaatgacccaaaaaaagcgtttaccgggaaaaactcgttaaacaaaatgccaatatacttggacttaggaaaaaacattaagctatcagaaaaggtaaaaactgtagttctagaacaaaattatacaatacgcaaaaacatcgatccagatttgaaagtagacaaagtaatcgatgtaggtatcaaaagaatactagagagtaggttggaagaattcggcggtaatgcgaagctcgcattctctaatctagaagaaaacccaatttggctaaacaaagagaaaggcataccgatcaaaagagtgaaaatttcaggcgtatcaaacgtcgaatcactccacgttaaaaaagaccattttggagagaaaatcttagatgaggaaggaaacgaaataccagtagatttcgtaagtacagggaataaccatcatgtagcaatttatgaagatgaagacggcaacctacaagacgaggtggtaaatttctacgaagcagtaattagaagaaatcaaggagaatcaataataaaatacagacacgaagaaggatggaactttctgtattcaattaagcaaaacgagttttttgtttttccaagtcaagacttcaaccctaacgacttcgacttactagatccaaaaaattatgacctaatttcgccaaatctatatagagctcaaaaattttcaaaggtaatgtacggtaactctgcagtacgagattatgtttttagacaccatctagaaaccgtactcaacgacgtaaaagaactcaaagatgtagcgtacaaacaattaaagagtttacaatatttaaacggtataaaaaaagtacgactaaaccatttaggacagattatacaagtaggagaatattga

SEQ ID NO: 8844 - RNA, 4065 nt, synthetic construct
  misc_feature 1..4065: note = Cas9 variant
  source 1..4065: mol_type = other RNA
atgacactacactacaacgtcggtctagatattggaaccaacagcgtaggatacactatagtcgacgacaacggaaaaatcctacaagtaaaaggtaaaaatgggtacggagtaagagtatttaaagaaggagccactgcagcagaaagacgaatatttcgtaccacacaccgtcgcctaaaaaggcgaaaatggcgactaagactacttcaagatttctttgaaccatatatacttccccaagatgacggtttctttatacgtagaaaagaatcaaatcttgtattaaatgatagagatgaggacacagcatcactatttaatgacagatcagatagagacttctatcaagcctaccctaccatataccatctgcggcaggcgcttatgacagagaaaagacaattcgatgtacgagaaatataccttgcaatgcaccacataataaaataccgaggacattttctccttaatgggacagtcaataattttacaaataacaaaatcgaccttcacagcgactttgaagaactcaatgcattactactcaatgtaataccagaattgaaattccaaatagatctggatcactcaacaatgttccaaacaaccctgctaaatacaactatctctagatcaggaagacaaagagatctcgttaaatcattttataatgggtcagatgataaacaattggcaaaacaacaaaaatctgttgccacagaactattaaaagcgatactaggcttgaaagccaaattccacaaactttttaatcttgatttacttgaaacaacggaatgggaattttcctttgatgccgaagatatagacgataaactagctaaactcgaaccactaatgacagaaaaccaacaacaagtaatggatattctccaaaggattttcgcagccataaccttaaacggaattgtacctgaaggcaaaacactatcagcatcaaaagttgattcgtatcaaaaacataagcaagatcttaagctacttaaagccatagcacaacactccgataagaaaaccgctacagtattgcaaaccgcttataatgaatacatcaatggcattgcctctaaaccattgaaacaagaagacttttacaaacgactaacaaacgcagtaaagaaaagctccgacccacaagtagcagacatgctagcactaattgaccaagagaaatttctacctaaacaaagaacaaaagaaaacggggctatcccccatcagctacaccaactcgaactagaacgcataatcgacaaccagaaagactattacccatggctagcagaactaaatccgaaccaagcacggcaaaaagtagcaaaatataaactatctgagcttgttgcctttagagtaccttattacgtaggaccactaattgaacctgaggttcaacaagcaacatcgaatgcccattttgcctggatggcaagaaaagaagccggaccaataacgccttggaacttcgatcaaaaagttgatcgaaacgtctcagctgaaagatttatcaaaagaatgacaacaaaagacacatatttgttagcagaagatgttttaccgctacactccctcctataccaaagatttatcgtacttaacgaactaaataacgtcagagtaaatggacagaaattaacgaagaaacaaaaacaagctgtttatcaagacctattcaaaagacaacctcacgtcaccaagaaacaatttaaaagctacctagttcaaaccggcgaatttgcggagtccagtaaaattgaaggccttgcaaacgaaacatcattcaactcaggtctaaccacagaaaatgaattacgtaaaatatttggagcgcaactagatgaagcaaggtatcaagttgattttgaacaaataatagaatgggccactctttttgaagacgccaaaatactaagaacaaaactagcagagataacatggctgacaacagagcaaatagaaaaactagctggtataagatatagaggatggggaagattttcacgaaaactattagcaggattacgagatcaaaatggccagcaaataatagacttactgtgggacacaccaaataacttcatggtaattgtatcacaagccgcctttagcgaagccataacaaaagaaaacgaaaaactcatcgatcgaaggggagcacaggacgtcatcacagatctttacacaagcccacaaaacaagaaagcactacgacaagtcctagccattgtcgcagatgttcaaaaagcaatgggaggcgtaccgccccagagaatatttatagaatttgccagagaagatgagaaaaacccgagaagatcagtagaaagaagcagacaattagaaaaattatatcaaactatctctaacgaatttctcataaactctgaagttagacaagaactaaaagaagccgtagatcaaaaagtaaatttcaaagatcgtctttttctttatttcttacaaggcggagtggacttatactctggaaaaagaatcaacattgaccaactatcacactacgatatcgatcacatactcccccaatcttttataaaagacgactcacttgacaatcgggttctagttagtcaaaaactaaatagaagcaaatcagactccgtgcccttgagtgaatttgcaaattacaaattcggtcccgcaatgcaagctaaatggcttcaactaaaagaagcaggtcttctatcaaaacggaaatacgataatctgacactcgatccaacaaaactttcaaaatttgctcctttgggtttcgtcaatcgacaacttgtagaaacaagacaagtaataaaactagctgccaatcttctagcctcagaagaaacaaaagtggtcacgataaaagcaaacatgacgcaccaagttcgcaaagaattagatttcccgaaaaaccgcaacgtcaacaattatcatcatgcatttgatgcgtatttaactgcgtttgtaggtatctttttgtccaaaagatacccaaaattaaaaccatactttacatatggagacttccaaaaaggaaataaactaccagacttgaaaaattttaatttcctatacgaattaaagaacaaagataggtccatcgattcaaatacaggcgaaataatttgggacaaacaaagagatttagcttatatgaataaaatctacaacttcaagaaagtaacagtagtacatgaggttttaaccaaatctggagccctttataatcaaacattatataaagcatctgaagacaaagcatcgggacgcggtacaaaacaactcatcaggaagaaagacaatatgccgaccgaattatacggaggttatacaggatccacctccgccttcatgagcattgtgcgtctatggaagaaagataaaccctattataaagtagttggcatccccactcgcatggctgcgaaactcgccaaccaagcacaactactcgactaccttacaaagaaattcaccacaagaaaacttgtgaagaaaacaggtgattataaaaccacggtagaaagatttgaattagtagttccaaaagttggattcaaccaactcgttatcgatggcggccaaccttttatgttaggatctgcgacatatcagtacaatgctagggaattattcataagcaaagaagctgtaaaagcccttaacaaacaactatcaacacacgtcgatctcgtacaagtcttcgacgaaattttagtacaagtaaatcggtggttcccattatatgatactaatggcttccgcgaaaaactttcccatggacgcgacagatttatgaaactaaacgattcattcgaggagaaatccgatacacagattgatgtattaaatcgaatactaatcggattccacgcgaatgccgcgcgtacgaatcttaaaatactaggactaggaaccgatctaggattcatgacacaacaagcaggtattcggttaacagaaaaagcgatattagtccatcaaagtccatctggattattcgaaagaaaagtagcacttagagacttaaaaggcctaagatga

SEQ ID NO: 8845 - RNA, 4068 nt, synthetic construct
  misc_feature 1..4068: note = Cas9 variant
  source 1..4068: mol_type = other RNA
atgacatacagcatagggttagatataggaacaggctctgtaggctgggcagtaataggcgacgattacagactcaaaagagctaaaggaaagaacttaataggggtaaggctattcgactccgccacaactgcagccgaaaggcgggggtatcgcacgacacgacgaagactaagccgaagacattggcgactccgtttattaaatgatatattcgcatccgacttagcagaacaagatgaaaacttcttaccaagattaaaatattcttgggtaaaccccgatgatgaacaaaatcctcagttaaactccgacgtagcaaacggagccctcttcggatcctcagaaacagataaagcctttcacaaaaattacccaacaatataccatctaagacatgagctcatgactgacacagccaaacacgatcttagagaagtctatctggcgatacatcatatagtaaaatacagaggcaattttcttaacacagcagataaaattaatgccgaaaacagtttcaacgtcgatttatttatcgcagcattagacgaatacaatgagttcctagaaactccaatcacttcaattaaagatgcacaattgttttcagataaacttacagacatcaatgctcgaaataaaagtgtaagagtagagaatgcaatgtccgagacatacgacgacaaatctaaaatattcaaagctatacttactgcattagtaggtaatacggcaaattttcaaacaattttcgatctttctgatctcgaaaaggatgaagctaaaaacttcaaattcaaacttgacttagaagacgtagaaacaaaactcgacgtcgtccgggcaaaactatctgatgaacaaaatgcatttcttgaagcagtactaatagcatacgatggaataacattaaaaatgatactaggtgattataaatccatttcccagtcaatgattgaatcatataaaagtcaccaaagggattggaaatacattaaaaacaacgtaagattaaatgaacagaaaattgaaccagacaaaaattccgtcaaatttttcaaactcgatccgaagaaactcatatatccttctaatctcgcttatctccaagtaatatcatcaaacgaagacgaacatcggaaaggtctcgattatttcaaaacagcaatacaggacgctgatatattgcaaagaatagaaaacgacacatttctaccccgtcaaagaactaaaagaaacggagtattgccataccaattacacctagctgaactagagcaaataattaagaaacaaagtaaatattatccattccttgctaacatttatacacaggacaataaaaccgaaaataagttaataggtctacttaaattcagagtaccatattatgtaggcccactcgtcgaagcagaaaaagtaactggcgacgggaaaaatcactggctaatcaaaaaggaactccaggaaaatacaccaataaccccttttaattttgacgacgtcgtggacaaggacaaatcgggagaacagtttattaaaagaataacaggcacggactcatacttaataggagaaccaactctaccagaaaacagtcttttatatcaaaaatataacgtcctgcaagaactaaacaatgtgagaaacgaaagacaccaaaggctaccaataaaagtaaaacaagacatattcgaacacgtatttaaaatcgataaaaatgtcaacgcaaagaaagtgatggcttacctcaaattaaatggttatggagatttccaaattgcaggactatccgacaccagaacaggtaaatttaactctaacttaagtagttataactatttcgtcgacctattgggacgtgaaaagacagaaaagattagagaagacagactcgaagaaataatagaaatacaaaccgtattcgaagacaaaattctagttgcaaaacgtctatcaaatctcgactttctgaccccacaagaaaaatcaaaactgagtgcaaaacactacaccggctggggacgtttatcacaaaagctcctcaccactcaatttataaaaacagcactctctgaagcaggggacataatcccacaatcacactcgataatagacttgctctattataccgacaagaatctgatggaaattctcaatgacaaaacttttaatgttcgaaactggctcactgaacaaaataaaggaactgaatcaggcaactctctatatgatcaaatagatgccctagccggaccgaaggatataaagagaggcataactcaagtattttccataatagacgatatcaagaaagcaatgggatccaaccctgaaacagtataccttgaatttgcacgagaaacccaaacctcccgtttgacaaacagtagactaaacagagtacaagaaatatataattcccctgaactcaagacagagttcgcctatttagcaaagaaactagaagcagaaacaaaagaatccattcatgacgatagactctatctatactacctacaagaaggacgggacatgtacacaggaaaagaaatacccttcgaccaaatatccagcaactacgatatagatcatatcatccctcaagcattcacaaaagacgactccctcgacaacagagtcttagtaaaccgagcaaccaatgcaagaaaaagcaattcaccaacgtttacaaatgatatcatagataaccgaaaatcatggtggcaatccctagtgaaacgaggactaatgagtaaagaaaagtttgaaagactcacagacaaaagaaaaacattctccgaaaaccaaacaaatcatttcatagcacgtcaactcgtagaaacccgccagataatcaaaaacgtagctgacctaattaaaaacaactacgatgggacacaagccgtagctatacgtgcttccctaacaggcgaaatgcgcagatacctcgactggcccaagaacagggacatgaacgactatcatcatgcacatgacgctttaatgatggcgacagtaggtaaatacgtagatagacgaggattcttcgataacggatcagtttcagatggagctggtaacgcatataacctatatacaaaagattggcttgtagcagctcgagtaggtactagaaatgactcacagcgcgtaaacccctatgggtttatagtaggtagcatgaactcaaaagcagtaagacagcaagtcaataaagaaacaggagaaatagtctggggaaatgaaaatctagactacctaagacatgtcttatcttacaagaaaatattagtaactcgaagactcagcggatcatcaggacgcctatatgcagaaacattattttctccaaaccctaaagcaaaacttatagcgcaaaaagcaaacaggagcgtggcactgtacggcggattcaccaaagctgaatctgcttatacagcattagttgaatttaataagaaaggagacagaagctacaaactgataaaagtaccaatggcgatagcaaacagggtaaacgataaacaaatcacagtaacagcttatatagcatcactgaatttgagagatttctcaagagtagtgttagagcatttacccttagggacattaataagagaatcagatggatcagaattttatgccgcaagcagcgaatataaacataatgccaaagagctatgggctccgaaagaaatactacgatcaagcaagaaattagacaaagctaccgcagataacctaatagatatatttgatttcctaactaacgataaaaccatcagcaacttcaaattctatgaaaaagacttactacatctgaaaaacgtgcgtgacaaattcgtagaagccagtgacgagatcaaaattaaagtgctatctgacgtcatatacgaactacataatgatgcaggatggagagatccattcaaacatatacaggaaaaaccggcctggaccatgctacaagtaaaaggcggtataaaactatcagaaaaagcagcaatagtatatcaatctcccactggcttatttgaaacaataaccattgtaggagagtga

SEQ ID NO: 8846 - RNA, 4071 nt, synthetic construct
  misc_feature 1..4071: note = Cas9 variant
  source 1..4071: mol_type = other RNA
atgaaaaagtttgaggaatattatataggcttagacatgggaactggatctgttgggtgggccgtaaccgattccgcatacaatataattaaacgacatggaaaagctctctggggcatccgactctttgagtcagccaaaacagccgaagaaagaagaatatttcgcacatcaaggcgtagaacagaacgaagaaaaaacagactccacttactacaagaaatattcgcagaagaaatatcaaaaaaagatatgggattttatcaaaggatgaaagaaagtaaatattggcacgaggacaaaaaagatataaacggaaatatgcctgagttaccatatgcactttttgcggatgacggtttcaccgataaagattactacaaaaaatacccaacaatattccacctacggtatgctctagcgacaaatactacagataaaccagacatacgcttgttatacttagccctccaccatataataaaacatagaggccactttttattcgaaggaaaaaaattaagcgaggtgaaggaattctcaacagcaatagaagctcttgtacaacaagcagaggaacaagaaatcgaccttaaatcacttacccaagaagaggtactgacacaactagaacacataatgagcgacgctcagtgtacaaagtccgacaaaaaaacgcaagttagcaagctaatagtaggaactgacaagcaaaaacaaaaacaagagaaagctatagctgcgcttataactggatgcaccgttaaactatcggacatatttgcagacccagaattagataaggaggaaataagtaaaatctgttttagtgacaatggctacgaagagaaggaagttgaaattgaatctgtcttagcagatagatttttactaattgcagcagcaaaaggtgtatacgattggacagtgttacacgacattctaggagacgcgagatttcttagcgaagcaaaagtaaaaacatatgaaaaacaccgcgacgatctaagaaaagtaaagcagctactaagaatggacaaagaagtatatgaagcagttttcggcgtctcggaaaaaaacgaggccaattacagtgcctatataggtatggccaaaaaaaacggaaaaaaacagccaattgaaaaaaaatgttctcaggaagatttctataaatttctaaaaaaacaactagaccgtttatctgtcgatgaaatgggtcaagaaattatcgatgaactcaaagcagagatggaccttggaacactattcccgaaacaaatgatacgagataatggagtaataccctatcaactacacgaaaatgaacttaatgcaatattagacaacgcacaaaaattctacccatttttgctggaaaaagatcaagatggatacacacctgtagaaaaaatccaaaaaatatttaggtttcggataccatactatgttggacccttaaataccgcacaccaagataaaggcggtcacagctggagtgtacgcaagaaagaaggtaagatttatccatggaatttcagcgaaatgatagacgaagaagaatcagcaacaaagtttatagagcgaatgaccaataaatgcacgtatctcataggagaagacgttctcccaaaagaaagcctactctacgcgaaattcaatgtcttgaatgaattaaataacttaagaatagatggcgaacttatcgcaccggaattaaaacaagatatttataataatgtattcaaaaaatatcaaagagttaccggaaaaaaagttaaggattacctaagaatcaatggagtaataagcaaggaacaggaactatccgggtttgaccagaacttcaaatcatcactcaaagcgtaccacgatttcaaacaaatagtaggaaccggagtcttatcagaaagcgaacaagaagacatagtaagagatataacattatttgctgactcccaaaaaatgttaaaacaaagaatacatcgtaaatatccaatgctaagtgacaaacaaattgcccaattggcaaacaaaaaatatgctggatggggtagactttcaaggacatttcttgaaaacatagaaagcgttaataaagaaactggtgaagtaatgaatattataacagctctttgggaaacaaatgaaaacctaatgaaactcttaagtggaaaatatgattacacaaaacaaatagaacaatggaatgcacgacaaatgaaaaagggagaaatagaataccaagacatagaagaactgtatgtctcgcccgcagtcaaacgcccaatctggcagacgataaaaatagtaagagaaataactaatataatgggaggtgctccaaaaagaatatttgtagaagtagccagagagccaggtgaaaaaggcgtcagaaaagtgagtagaagaaatcaactattagacctatataaagcatgtaaaaaagaggcacctgaactatatgatagactagcaaataaagaatcggataatgccctcaggtctgacaaactatttctctactacagtcaaatgggacgttgtatgtattctggcgatgcaattgatctcgacgaactattcacaaaccgctatgacatagatcacatctaccctcaaagtaaagttatggatgattcaatagataaccgggttcttgtcaagagggaccttaactccaaaaaaaccgacacatttccagtaagcgaagaatatagaaaagcgggcaaagcactctggagcaccttattaaaaaaaggactaataagtaaagaaaaatataaaagactcacccgaacagaaccttttggagaggacgaactagccggatttatagctcgacaactggttgagactagacaaagtacaaaagcagtagctcatctattagaagaggcgtatccggacgcagaaatagtttatgccaaagcacgagcagttagcgaatttaggcataaatttgacatgataaaagtacgagaggtaaatgattttcatcacgctaaagacgcatacttaaacatagttgttggcaatacatactatgtcaaatttaccaaagacgcagcatggttcgtaagaaataaccccggacgtacttataacctgaaaaaaatgtttgaaaacgagaccgtaaaaagaggtaacgagacagcatggatacctggggacaacggaacgatatgcaccgtaaaaaagtggatgagaaaaaacaatgtcctattcacaagaagagcctacgaagtcaaaggaggtctattcgatcaaaacatactaaaaaagggaaaaggccaaatcccgattaaaggaggagctgacgaacgcctaagatccagagataaatatggagcttacaacaaagcctcaggagcatacttcatgttagtagaaagtgacggaaaaaagggagaaagaaaaagaacaatcgaatttgttccagtatacttagcaaaatcactagaagaatcagtagagcttaggcgaagatattgcgaagaggaactaggcctagtgaaccctgatgtcagactaagcaaaattagaaaaaatgcgctaatagacgtcgatggtttcaagatgcacctagtaggcaggacagaaaataggctgttgctaataggagcaacacagttagtattaagtgaagatgaccaacaattgataaaaaaaataggaaaatactgcctagatcatagggaaaacaaagatgcggtcttatcagagaaatacgagttgacaatggatttattcgagaaattatatgatatatttgtatttaaactagaacaaacagtctatgcagttaaattaagtaaacaagcaaaagacctaaaagaagtcaaagaagaatttctggccctcgacgatgaacaaaaatgtctactactaatggaaattctgcatcttttccaatgcagcccacaattagcaaatttaacaaacataggtggaggaaaaagcgccggaagcctcaaaattctctcggacataacaaaacaacaatcagtgctactaatcaatcaaagcataacaggcttctacgaacaggtaatcgacttaaaaactatctga

SEQ ID NO: 8847 - RNA, 4071 nt, synthetic construct
  misc_feature 1..4071: note = Cas9 variant
  source 1..4071: mol_type = other RNA
atggaagtgggtaactattacttaggaatagatgcaggcacagattcagtaggatgggctgtaacagacaaccagtataacgtcatccgcaaaaagggaaaatccctctggggcattagattattcgacggagccaataccgcgcaagaaagaaggaccttccgtgcactaagacgccgaaacgaaagaaaaaaacaaagaattaaccttttacaagaattattctgcaaagaaatatgtaaattagacccaaattttttcataaggctacgcgactcatcactgtggagcgaggataaagaagaaaaacaaatatacagcctgtttaatgataaaaattttaacgaccgaaactaccacaacaattacaaaacaatctaccatttacgtgcagatttaatcaagaataaagaaaaacacgatgcgagactcgtttatcttgcaattcaccacatcatgaaaaatcggggacatttcctttttaacgggaatatcgaatcagtaacatcattcgaaaatacatttaacgagtttaaaaattgtcttctcgacgaactagaaataaatttagaatgtcccagcatatctgaattcgaaaacatacttaaagaccgcaccttcaaagggacccaaaaatgtaaaaaacttaaagaactatgctcaataccatcatccgacaaaaagttagacaatatttttaaactcatatccggactaaaagccgatctgtcgattatattcgaagacgaatctttcaaagaaaacgaacacaacaagatatcatttgccgactccaattacgaagaaacacgcgaagtactaaacagtgaaatacaagaaaaaacactgataatagatatattcaattcgatttacaattgggtcatcttatcagatatattaagtggcggagaatataatggaggcttatacctatccatagcaaaagtaaatacctacaacaaacactccaaagacctaaaaattttaaaatccgtcattaaaaaatatttcccacaaaaatatacagacattttcgcaagcaataaagaaaacaattattgtagctacatcggaatgtacaaatcagggggaaaaaaatattcagtaaaaaaatgttcagacaaacctgaagaattctataaaacaattaaaaacataattaataaaaatactgcggaagagatctcaaatgacaaagatgttcaatacatactatcagaaatagagaacaattcattccttccgttacaaattaacaaaaacaacggtgtaatcccttaccaagcaaataaaatagaactagaatctatactcaaaaatgccgaaaattacctcccctttctaaaagaaatagacacagaatgtaataagaccaccagcgaaaaaattatagacttattcgaattccgaatcccatactatgtaggaccactcaatacaagtaaaggtgaaaatgcgtggatgatccgaaaagaggatggcactatccgcccatggaatttcgaacaaaaagtagacatcgataaaacggctgccgagtttataacacgaatgaccaatcaatgtacatatttaaacaatgaaactgtactaccaaaatattccttgttatactccgaatacaccgttctaaatgagatcaacaatattagaataaatggtgaaaagatttcggttgaacttaaacaagatatattcaacatactatttaaaaacaataaacaagtaacttgcaagaaactcctctcacacttaaattcgaacggctataatctaaaaaaggatgacctcagcggttttgacggaaattttaaatcaagtctgtcctcctacatagacttaaaaaactatatattcggagacaatatagataaaccccagatatataacctagcagaaaagatcattctatggatcacactatacggagacgattctaaactcctcaaaagagttctacaaaaaaattgctcagaacaattaaacccagaacaaattaagaaaattacaaaattaaaatttaaaggttggggaagacttagcaaagcatttctatcagaattacgtggtgctgacagagaaaccggagaaaccatgactataataaaaggtctcagaaacacacaaaataaccttatgcaattgctttcccaaaactacactttcactgaagagtgcgaaaaaataaatagtggttattttattaacccaaacgagattagctatgactcaatagtaaagaatatagttgcatccccaagtataaaaagatccgtctggcaaacgatacaaattgtagaagaaatacaaaaagtaatggggagcaaaccaagaaaaatattcgtagaaatggctcgaggagaagaggaaaaagtaagaactacaagcagaaaacaaaaattactagatttatataaaaatatatcagacgaatgcgctaaaggaatgtatgatgaaatatacagtaaagatgagtccgacttcaaaaatatacgcctatatttatactatacacaaatgggctgttgcatgtacagtggaaaacacatagacctatcacaactgtcaaacacaaatatttgggacagggatcacatatacccccagtctaaaaccaaagacgactcacttgataatttagtcctagtttataaatctataaactcagaaaaatcagatgacataatatcaccgacaatacaaaataacatgcgcaccttttggaaactactattcgacagaaaatttatctccgaaaagaaatatcaccgtctaacccgcacaaccccattgaccgacgaggaactggccggtttcataaacaggcaactcgtagagacaagacaatctaccaaagtaatggcctcaatcttcaaaagaatctatccaaatacagaaataatatacgtcaaggcaaaaaacgtaagtgacttcagacacaggaaagattgcgagaacggtgtcaaggtgagagaactaaacgattaccaccacgcaaaagatgcatacctaaatatcgtagtcggaaatgtttacagtagtaaatttaccaataatcccttaatgtggcttaaaaacaaccgaaatgtaaaatatagcctaaaccggatgtatgatttcaatctcacagtcaataacgaaaacatatgggtggtaggaaacgaaggaacacaaaaaactgttaacaaatacttaggaaaaaacgacatcctatacactagatatgcaatgacaaataaaggcgaactattcgatcaaaacccactaaaagcgaccggtgataaatcaaaacaaacaaccctggtacccctaaaaaaaggaaaagaagtatggaaatatggaggttacaactcgataacaccatcatacttcatgttagtagagtcaaaagataaaaaaggtaattatatccgaacaatagaaacaatgcctctttacagagaaaaagaattttctaaaaacgaagaattcttattaaactactgtaaagaagtgcataaactaaaagaaccaaaaataatcctaaaatgtataaaaaaaaatgcactactaatagtagacggcttccccatgcacctcaagggctcaacaggattacaactaaaattgcaaggagccgtacaacttatacttgaatccgacatggtcatatatctaaaaaagctaatgaaattcgtaaacgagaacaatataaataaaaacaaactcgaagttactccttatatggaactaagcgctaaagaaaacatcaaactatatgacatattcatacaaaaattaacaacgggaatctattcaaaaagaccagcaaacccggttgagaaattaattaacgcaagagatatattcatcgaactcaccgtaaaggaacaatgtatagtcttatcagaaatcctacacttgtttcaatgcaaacctctaacatcagctaatctagtatcaataaatctaaaaaaaacagttggtataatccaaattgcaaaaaacattacagcaaaaaatgtaaaactagttcatcagtctccgaccggcatttacgagtataccgtcgatttaaacaaaatatga

SEQ ID NO: 8848 - RNA, 4071 nt, synthetic construct
  misc_feature 1..4071: note = Cas9 variant
  source 1..4071: mol_type = other RNA
atgacgaaaaaggaacaaccatataacataggactcgatattggcacaagttcggtcggctgggcagtcacaaacgacaattatgatttactaaacatcaaaaaaaaaaacctatggggagtacgattgttcgaagaagcacaaaccgcaaaagaaaccagacttaacagatcaacccgtcgacgatacagacgtcgaaagaaccgcatcaactggctcaatgaaattttcagcgaagaattagcaaaaacagatccctctttcctgatacgacttcaaaactcatgggtatctaaaaaagacccagacagaaaacgagataaatataacctttttattgatggaccctacaccgacaaagaatactaccgtgaattcccaaccatttttcatttgagaaaagaactaattctgaacaaagacaaagccgacatacgattaatttacctagcattacataacatactaaaataccgaggtaatttcacttacgagcatcaaaaatttaacatatcaaatctaaacaacaacctgtccaaagaactaatagaactcaaccaacaattaataaaatacgatatctctttcccagacgactgtgattggaaccacatatccgatattctaataggaaggggcaacgcaacgcaaaaaagctcaaacattttaaaagattttaccctcgacaaagaaacaaaaaaattattaaaagaagttatcaatttaattctaggaaacgtagcccacctcaacaccatatttaagacatcacttaccaaagatgaagaaaaactaaattttagcggcaaagacattgaatccaaactagacgaccttgactccatactagacgatgaccaattcactgtactggacgcagcaaatagaatatactccaccataacactaaacgaaatattaaatggagaatcatatttctcaatggcaaaagtgaaccaatacgaaaaccacgcaatcgatctatgtaaactaagagatatgtggcatacgacaaaaaatgaagaggcagtcgaacaatcacgacaagcttatgacgattatataaacaaaccaaaatacggcacaaaagaattatacacatctctaaaaaaatttctaaaagttgccttacccacaaatttagctaaggaagccgaagaaaaaatatcaaaaggaacctacctagtaaagccacgcaattctgagaacggagtagtcccctaccaactaaacaagattgaaatggaaaagataatcgacaatcagtcccaatattacccctttctaaaagaaaacaaagagaaattactaagcatacttagctttagaatcccttattatgtaggtcccctacagtccgccgaaaaaaacccatttgcctggatggagagaaaatccaatggacacgctagaccctggaacttcgatgaaatcgttgacagagaaaaatcctccaacaaatttataagacgtatgacagtcactgactcatatctagttggagaaccagtactgcccaagaacagtctaatctaccaaagatatgaagtattgaatgaactcaataacatacgtatcacagaaaacctcaaaacaaacccaattgggagcagactaacagtcgaaacaaaacaacgcatatataatgaactcttcaaaaagtacaagaaagttacagtaaaaaaattgacaaaatggctcatcgcccaagggtactacaaaaatcccatcttaatcggactctcacaaaaagacgaattcaattcaaccctaacaacttacttagacatgaaaaaaatctttggctcaagcttcatggaagacaataaaaattatgaccaaattgaagaactaatagaatggctaacaatctttgaagataaacaaatactaaacgaaaaactccactcgtcaaaatactcttatacaccagaccaaattaaaaaaatatctaacatgagatacaaaggctggggccgcctatctaaaaaaatcctaatggacatcacaacagaaacaaacacaccccaacttttacaattatccaactactcaattttagacttaatgtgggccacaaacaataatttcatctcaatcatgtccaacgacaaatacgacttcaaaaactacatagaaaatcacaacctaaacaaaaacgaagaccaaaatatatcagacctagtcaacgacatacacgtaagtccagcgctaaagaggggaatcacccaatcaatcaagatagtacaagaaatcgtaaaatttatgggacacgcacctaaacatatctttatagaagttacacgagaaacaaaaaaatccgaaataacaacatcaagggaaaagcgaataaaaagactgcaatcaaaacttttaaacaaagcaaacgacttcaagccccaattaagagaatatctagtgccaaataaaaagatacaggaagaattgaaaaaacacaaaaacgacctatcatctgaaagaattatgttatacttcctacaaaatggcaaatcactatattccgaagagagtctcaatattaacaaattatccgactatcaagtagatcacatattaccccgcacatacattccagacgattcactagaaaacaaagcactagttctcgctaaggaaaaccaaaggaaagccgacgacttactactgaacagcaatgtaatagacagaaatcttgaacgatggacttacatgctaaacaacaacatgatcggacttaaaaaattcaaaaatctaaccaggagagtaattactgataaagacaaactgggattcatacacagacaattagtacaaactagccaaatggttaaaggagtcgccaacatccttgacaatatgtacaaaaatcaaggtaccacatgcatccaagccagagcaaacctttcaaccgcttttcgaaaagccctaagtggacaagacgacacctaccattttaaacatccggaactcgtgaaaaatagaaacgtaaacgacttccaccacgcccaggatgcttatctcgcctcctttttaggaacatatcgactcagacgtttcccaacgaatgaaatgcttctaatgaatggagagtacaacaaattctatggccaagtaaaagaattatattcaaaaaaaaagaagctcccagactcacgaaagaacggtttcataattagtccactcgtcaacggaaccacccaatatgaccgcaacaccggagaaattatatggaatgtgggtttccgagataaaatcttaaaaatattcaactaccatcaatgcaatgttacaagaaaaaccgaaatcaagacaggacagttttatgatcaaacaatctactctccaaaaaaccctaaatacaaaaaactaattgctcaaaaaaaagacatggacccaaacatctacggcggattcagcggagataacaaatcttccataacaatcgtcaaaattgataacaacaaaataaaacccgtagcgatccccatacgccttataaatgacctcaaagataagaaaacgttacagaactggctcgaagaaaacgttaaacacaaaaaatctatccagattatcaaaaacaacgttcccatcggacagatcatttattcaaaaaaagtcggactactatcgctaaactctgaccgcgaagtagcaaacagacaacaacttatcttacctcccgaacactccgcactgctacgactattacaaattccagatgaagatctagatcaaatattagcattttatgataaaaacatcttagtagaaatccttcaagaactgataacaaaaatgaaaaaattctatcccttctataagggcgaaagggaattcttaatagccaacatcgaaaactttaaccaagccactacctcagagaaagtaaactcgctagaagaactaataacactattacatgctaactcaacttcagcccatttaatattcaacaacattgaaaaaaaagcattcgggagaaaaacacacggcctaacactcaacaacaccgacttcatataccagtctgtcacaggactatatgagacaagaattcacatcgaatga

SEQ ID NO: 8849 - RNA, 4071 nt, synthetic construct
  misc_feature 1..4071: note = Cas9 variant
  source 1..4071: mol_type = other RNA
atgactaaaaaagagcaaccctacaatatcggactcgatatcggaacaggatcagtcggatgggcagtcaccaacgacaattacgatctactgaatataaaaaaaaaaaacttatggggagtaagactatttgaaggcgcacaaacagctaaagaaacccgactaaatagatcaacgagacgaagatacagacgacgcaagaaccgaatcaactggctcaacgaaatatttagcgaagaattagcaaatactgacccaagttttttaatacgactccagaacagctgggtatcaaagaaagatcccgacagaaaacgagataaatataacctattcatagacaacccgtataccgataaagaatattatcgagaattccccacaatctttcacttacgtaaagaattaataattaacaaaaataaggccgacatcagattagtatatctagcactccacaacatactgaaataccgaggtaatttcacttacgaacaccaaaaattcaacattagtacactcaactccaacttatctaaagaacttattgaattaaaccaacaactaatcaaatatgacatcagcttcccagacaattgtgactggaatcacatatcagacatattaattggaagaggtaacgctacacaaaaaagctcaaacatattaaataactttacacttgacaaagaaaccaaaaaactattaaaagaagtaataaaccttatcttgggcaatgtagcacacctaaatactatctttaagactagcctcaccaaagatgaggaaaaactatctttctccggaaaagacatagaatcaaagttagatgacctagattcaatcttagatgacgaccaattcacagtgctagatacagcaaatagaatatactccactatcacattaaatgaaatcttaaatggagaatcttacttctcaatggctaaagtcaaccaatatgaaaaccacgcaatagatctttgtaagctaagagacatgtggcacacaacaaaaaacgaaaaagccgtcggactatccagacaagcatacgatgactatatcaataagccaaaatatggaacgaaagaactttatacatctctcaaaaaatttctcaaagttgcactaccaactaaccttgccaaagaagccgaagaaaaaataagcaaaggtacatatctagtgaaaccaagaaactcagaaaatggagtggtcccttatcaattaaataaaattgaaatggaaaaaatcattgataaccaatcccaatattacccctttctaaaagaaaacaaagaaaaactcctatcaattttaagcttcagaattccctactacgtaggaccactacagagctccgagaaaaatcctttcgcctggatggagagaaagtccaacgggcacgcgcgtccatggaattttgatgaaatcgttgatcgcgaaaaaagctcaaataaattcataagaagaatgactgtgactgacagttacttagtcggtgaaccggtactgccaaaaaactcactgatctaccaaagatatgaagtcctaaatgaactaaataacattagaataacagaaaacctgaaaactaatccgaccggttccagacttacagtggaaaccaagcaacacatttacaacgaattattcaaaaattacaaaaaaatcaccgtaaaaaaattaaccaaatggttaatagcccaaggatactacaaaaatcctatattaatagggctttcacaaaaagacgaatttaactccactctcaccacatatctcgatatgaaaaaaatcttcggtagttcttttatggaaaataacaaaaactacaatcagattgaggaattaattgaatggctaacaattttcgaagataaacaaatattaaatgaaaaattacactcctcgaactactcctacacaagcgaccaaattaaaaaaatctcaaatatgcgatataaaggttggggaagattatcaaaaaaaatactcacctgtataacaacagaaactaatacccctaaaagtttacaactcagtaattatagcgttctcgatctaatgtggaccacaaacaataatttcataagcatcatatctaatgacaaatacgattttaaaaactacattgaaaatcataacctaaataaaaatgaagaccaaaacatttccaatttagtcaacgacatccatgtctctcctgcacttaaaagaggaattacacagtctatcaaaatagtacaagaaattgtaaaatttatgggtcacgcaccaaaatacatatttatagaggtcacaagagaaacaaaaaaatcagaaataacaacatccagaggcaaaagaatacaacgactacaatctaaactattaaataaagccaacggcttcaaaccccagctcagaaagtacctagttccaaatgaaaaaatacaagaagaattgaaaaagcataaaaatgacctatccagcgaacgaataatgctctatttcttacaaaacggcaaatctctctatagtgaagaatccctgaatatcaacaaactgagtgactatcaagtagaccacatattaccacgcacttacataccggatgactcacttgaaaataaagccttagtattggcaaaagaaaaccaacgtaaggcagacgacttattacttaactctaatgtcatagataaaaatcttgagcgttggacctacatgctaaacaataatatgatgggcctaaaaaaattcaaaaacctcaccagaagagtaattacagataaggacaagctaggttttatacacaggcaactggttcaaacctctcaaatggtaaaaggcgtagctaacatactcaactcaatgtataaaaaccagggaacaacatgtatacaggcaagagctaatctttcaacagcatttagaaaagcattatcagaccaagacgacagataccatttcaaacaccccgaattagtgaaaaacagaaacataaacgactttcatcatgcccaggacgcttaccttgcctcgttcttaggaacctatagactcagacgattccccaccgacgaaatgttactcatgaatggcgaatataataaattctatggacaggttaaagaattatattcaaaaaaaaaaaaactacccgacagtagaaagaatggattcatcatttcgccactcgtaaatggcaccacacaatacgacagaaatacaggcgaaataatatggaacgtaggcttcagagacaaaatcctcaaaatattcaactaccaccaatgcaacgttacaagaaaaaccgagataaaaactggccagttctatgaccaaaccatttattcccctaaaaaccccaaatataaaaaactaatcgcccaaaaaaaagatatggatccaaatatatatggcggctttagtggagacaataaatcctccataacaattgtaaaaatagataataacaaaataaaaccagtagcaataccaataaggttaattaacgacttaaaagacaaaaaaaccttacagaattggcttgaagaaaatgtcaaacacaaaaaatctattcaaataatcaaaaataatgtacccataggacaaatcatctatagcaagaaagtaggactactatcattaaactcggaccgagaaattgcaaacagacaacaactaatactaccaccagaacactcagcactgctcagaatcctccaaataccagacgaagatccagaccaaatactagccttctatgacaagaatatactagttgaaatcctgcaagaactcataacaaaaatgaaaaaattttatcctttttacaaaaatgaacaagaatttctagcctcaaatatcgaaaatttcaaccaagcaacaacttctgaaaaaatcaattctctagaagaactaattacactcctccatgcaaactctacatccgcacacctaatctttaataacatagaaaaaaaggctttcggtcgaaaaactcatggactaacactaaacgacaccgactttatatatcaatcagtaacaggcttatacgaaacacgtattcacattgaatga

SEQ ID NO: 8850 - RNA, 4071 nt, synthetic construct
  misc_feature 1..4071: note = Cas9 variant
  source 1..4071: mol_type = other RNA
atgagtaaaaaggactcagaatattacatcggactcgacataggcacaaacagtgttggctgggcagtcacaaacggaaaatacgaccttctaaatatcaaaaaaaaaaacctatggggagttaggctttttgaagcagccgaatcagcagctggtaggcgcattaatagatcaactagaagacgttatcgaagacgacggaatcgaatcaattggctaaacgagatatttgcagatgaattatcaaaagtagacccatcatttctaacacgattaaattcatcctggatatcaaaaaaagatagttcacgaaccagagataaatataacctgttcatggacgccgattatacagataaaaactaccatcataaatatccaacaatatatcacttaagacgggacttgatgtttgacgataaacaattcgatatacgactagtttacctagcactccacaatataatcaaatacagaggaaacttcacctatgaccacagaaaattcaacgtatcagaaatgtcttcaaatctaacaaaagcattagaaaacttcaaccaagaacttatggaatttgaagacgcgtttccagataacacagactacagtgcaatatcggaagtactcctcaaatctaacaacgtatccacaaaaatagacgaaatcatttcgaatctagaactcgacaaagacacaaaaaagtatctcaaagaagtgctgaaactaatcttaggaaattccgcaaacctaaacactatctttcacacatcacttgataaagacgacgaaaaattaagcctaagcgcaaaagatatcgaattaaaactcaacaacctggacagccttctttcggacgaacagatccattttatctcttctgcaaatgaactatactcatcaataaccctcaacgacatattggacggcaaaacctacctgtcattagcaaaaataaaacaatatgatacacattgttccgacctacaagaattaaaggaaatgtggtataaaactacgaacccagaccttatcaaaaaatcaagaaaagcatacaaggaatatgtacacggtagttataatactgaagacttttataaagcaataagtcccttcctaaaaattgcaatccccgaggaccttgcaaaagatgcactaaagaaaatcgatgcaaatacctacctccctaaacaacgcacaagtaataatggcgtaataccctttcaactaaacctaatcgaactcgaaaaaatcatagacaaccaaagtaaatactatccatttttaaaagaaaatcgagaaaagataatatccatcctttctttccgaatcccatactatgtaggtccaatccaagcaccaacagataaaaatttttcatggatggtgaaaaagatacaagcaaaagctagaccttggaacttcgacgaagtaatagatcgtgagaaaagctccaataattttatcaaacgcatgactaccaccgatacttaccttgttggagaacctgtgttacctaaaaactcactcatatatcaaaaatttgaagttctcaatgaactaaacaatattagaatatctaaaaacttatctcaagacccactaggcagtaaattaagcgtagaagtaaaacaacaaatattcgaagaattatttaaaagatacaaaacagttaaaagcgatcaacttaaaaaatggctaattcgaaactcctacttcaccgaccccacaataataggattatcaaaaccatccgaattcaactcaagtctaagcaccttcatagatatgaaagccatctttggaatggacttcgtaaacaatccccgaaacagttctcaactagaagagctcgcggaatggttaacagtgttcgaggataaacaaatactatccgaaaaaatacgtcactccaactatccctactctgaccaacaaatccgcaaaataagcaatatgcgataccgtggatggggacgtatatccaaaaaattactatgcgatattaaagttgaatcaaccatatacaaatctcatcaacttcatccctattccatattagacctcatgtggtcaactaataacaatttctacagtatactccataaagacaaatacaattttgaatcaatactagaagattacaacctaggtaccgacgacaaaaccgatataaatgaactggtcgacaacatccatacctcacccgcactaaaaagaggaataatccagtcaatcaacatcgtcaaagaactagtcaaattcatgggacacgctccacaacacatatttcttgaatttacacgcgaagacaaaacttctacgctttccgaatctagaaaaaaacgcctaaagaaattatataacaatctatccgaagacacaaaaaaattcaaattagacctaagggactatcttgtcccagacaaatctatccagaaagaattagaatcacacgataaagatctttcaaaagaaagattgatgctttatttcctacagaatggaaagtccctctactcagacgaggcacttgacattaatagattgagcgaataccaagtcgaccacattttacccagaacctacattaaggacgattcactcgaaaataaagcgctcgtattagcgaaagagaaccagagaaaagcagatgatctattattacaaccctccataataaacaaaaacatggaacgatggatatacatgaaagatcacggaatgatatcacccaaaaagtttaaaaacttaaccagaaccacaataacggaagatgataaagtccactttataaacagacaacttgtacaaacttcacaaatcataaagaacgttgcaaatatcttagataatatgtataaagaacagggaacaacatgcgttgaaacaaaggctaacttatcatctgctttcagaacagccttctccgaacaagacgacaaatatcacttcaaacaccccgaatttataaaaaatcgagacgtcaatgacttccaccatgctcaagacgcttaccttgcatgcttactcggactatacagaatccaaagatttccatcagatgaaatgctgctgatcaaaaaagaatatcgaaaatttttcgcccaagcccaaaacagcgttaaaaatcacggaaaaatacctgattcacaaaaaaacggcttcatcttagcaccattagtaaatggagaaactctaatcaataataaaaccatggaaacgatttggaatatggactacaaacgaaaagttattaaaatattcaattacaaacaatataacataacaaaaagaactgaaataaaaacaggcgagttttacaaacaaaccttatattcaccacacgatgaaaatgtaaaaaatcctatacctcaaaaaaaaaacctcgatccaaaaatctacggaggatactcaggcgtacaatcatcttatttagcaatcataaaagtagatcaaaaaaaacccactatggttagtgtaccaatcagattctcaaaaatgatagacgacggaaagctatcgctgcaatcttggctcgagaataatataaaacataaaaaaacaatagaagtactcaaaacgaaaataccgataggtcagctaacttataaccccaaaaacggctacctttcagtacaaagtgaaaaagaaatagctaatgcccaacagctattcctacccttcgaacacgtagccttactcacactactacatgcacctacctctgaatatgatcaaatactatccttttacgacacagatatactgctggaaatattcgacgagataactaacaagataaaaacattctttccattctatatagacgaacaagaatatctcgtatcaattagggaaaacttccagagtgcaacagtaatcgagaaagttaacgtactacagcaacttttaataatgctacacgcaaattcaagtaggatctccatcaaactaggtgaagtctcgaaaaaagacttaggtagaaaaaaaaaacgcattccactagaaaacacagatttagtctaccaatcagttacaggtctttaccagacaaaattccacatagactga

SEQ ID NO: 8851 - RNA, 4074 nt, synthetic construct
  misc_feature 1..4074: note = Cas9 variant
  source 1..4074: mol_type = other RNA
atgaacgacagaaataaaaaatacaatataggactagacatcggaaccggctcagttggatgggcggtaacagacaacaactataacctactacacgctaaaaaaaaaaacctatggggcatcagattatttgacggcgccgaaactgcagcctccaggcgcacattccgaagcacaagacgacgataccgtagacgccgaaaccgtataaattggttaaacgaaatatttgccgacgaacttgcaaaaaaagaccagagcttcttagtaagaatgaattcctcttgggtatcaaagaaagataaaatcagacaacgagaccagtacaatctgtttatggacagcgactacactgacgttgaataccacagagaattcccgacaatcttccacttacgaaaaagactgatagaagacaaatcacaagccgacattagattagtttatcttgcactccacaacatcataaaatatagaggtaacttcacatatgaacaccaaaacttcgacgtatcacatatggactctggtttagccctactactaaatcaactaaaccaacaattacaggcattcgaagttgcattcccagatgaaacaaattttgaatcaatgtcaactatattgttagaaaaaaaaacacccacacaaaagatagacgagatagtagatcaaatacaacccgaaaaagacctacttcaaattactaaaaatataatgaaaatgttgttaggaaacaaagcggatctcgtaaaaatattttcactcgatagtgacgacaaaattacagttgaatttagttcaaactcgatagaacaagacctcagcaacctcgaagaaaccctttccgatgaacaattcaatattatcacactcgctaactcaatatattcttctatcgtattaaacgacatattatcgggtgaaacttacctatcgttcgcaaaagcaagacaatactcagaccacaaaaaagacttagcgaaactaaaaacaatgtggcgagaaagccccgaccgtaaagcagttggaaaagcgaaaaaagcctatgacgactacctacattctggcaaatatggcatcgaagacttctacaaagacatgagtaaattcctagaaacggccacgcccgttgagttagcaaaggaagctaatgaaaaaatactcaacaaatcatacctattaaaacaacgcaataacgaaaacggagtaatcccattccaactgaacaaaaacgaaatgatcgaaataataaataatcaagcaaagtactacccttttctcgccgaaaataaagacaaattattatcaatactttcatttcgaattccctactatgttggtccattacaatccaaaaaagacaacccattcgcatggatggaaaagaaatcacaaggcaaaatacgaccgtggaattttgacgaaatagtagacagagaagcatcatcaaataacttcatccgtagaatgacatcaacagatacgtatctaataggggaacccgtattaccattaaaatcacccatataccaaaaatatgaagtactcaatgaattaagtaatgtcagaataaacgccgatgaagtcgacaatccactgggtgataaattatccgtagatctcaaacaagcaatttacaacgaactgtttcttaaacacagatcagtctccaaagcgctattgaccaaatggctaatcaaccaatcctattttcagaatccacaaatctccggcctggctgatagcaaaaagtttaattccggacttacaacctaccatgacttcaaaaaaatcttcggagaagattttgtgaacgaccccactaatcaatcacaattagaacaattagctgaatggctcacaatctttgaagacaaaaaaatattaaaaattaaactagatgacagccaattcaactgcactccggaacaaataaaaaaaatcgccggtatgagataccaaggatggggacgactttcaaagaaactactatgcgacataaaaacaacaactgtcacctcgaaaaaccatcaacaagcttcttacagcatattagacttaatgtggaatacaaaccgcaacttcataagcgtcttaaaaaacgacacatacaaatttgaagataagatacagacctttaatttggacaaaaatgaagccgccactccacaagcaatgatcgatgaattacaaactagtccagcattaaaacgtggcatccgtcagtccgtgacaataattcaagaactcgtaaaattcatgggacacgcgccagaacatatctttctagaattcactcgagaagatgatgtttcttccttaacaaagagtcgtgactcccgacttaacaaactctatgcaagaatagcaaaaaatacaaaaaaaaccgacgacgaactaaaaaaaagcttacttccctcatctgacatcaaagccacactcaaagcaaacaaaaacaacctaagcaacgatcgactaatgctatattatttacaaatgggcaaaagtctctattcaaaccaacccctcgacataaacaggttatcagaataccaaatagatcacatactaccgcaatcctatatcaaggacaacagtctagaaaatagagctctcgtcttagcctcagaaaatcaacacaaatccagtgacctattactaaaaccagagatcatcaaccaaaatatcgcccgatggcgatacatgaaagatgcaggactaatgggcccaaagaaattcaaaaacctaacaaggatacaaataacggattcggaccaaaacaacttcatcaacagacaactagtccaaacatcccaaattataaaacacgtatcaaatattctagactccatgtatggagatcaaggcacacaatgtgtcgaaacacgcgcgcacctttcaactgaatttcgcaaagcattcagcaatgaagatgacaactaccattttcaacacccagaatttgtaaaaaataggaatataaacgattatcaccacgctcaggatgcttacttggcatgcctattggggctctaccaaatgaaaaaatacccaacagataatatgatactcttaaaaaaagaatacaaaagatttttcagtaatactaaaaaaatatacgacaaaaagcaccacttccctgattacgtcaaaaatggctggataataggatcaatgtttaatggagaaaaatacgtagatgaagaaaccggccaaataatatgggatcaacaaacgaaagacatggtgagctgcatcttccaatataagcagtacaacgtaaccaaaagaactgaagccgccaacggagagttctacaaccaaacagtttataaaaaagatcccaatgaaaaaagaaaactaatatctctaaaacaaggcttagataccaaactatatggaggatactccggtgacaacccagcctacatagtacttgttaaaatagatgataaaaaaaataaattagtcaaaatgcccatcaggttagcagaacaagtagataacaagactatagatttacaaacctggctagaagaaaatgtaccccacaaaaaaggaatccaagtgctcaaaacaaaaatcccattgggacaagtaatatatagcaaaaaaaacggctaccttgcactcaaatcagatacagaaattgtgaacgcacagcaattggtcctcccctatggttatgtagccctcttaaccctattacagaagatgccagaaaataaatacgatgaagtcttagcatgttatgatgacggaatattagacaacatattcgtagccatcatagataagatgaaacacttctatccatactactccggagaattaaaaactttgtcagataacatcgataatttcaaagaaagcccagacgtgaataaaattaagacactccaacaactactacttttacttcatgcaagtagcacaacagctagcatagaattcaataacgttaaaaaaaactcactgggacgaaagccaaattcaatcaacatccagaacacggatctactatcatttagcgccacaggactatatgagtcaagaatacatatagactga

SEQ ID NO: 8852 - RNA, 4074 nt, synthetic construct
  misc_feature 1..4074: note = Cas9 variant
  source 1..4074: mol_type = other RNA
atggcagctaaaaactataatatcggattagatataggcaccagtagtatcggctgggctatagtggacgacaattatcaacttatgcacgcaaaaggcaaatacggctacggtacaagaatatattcggaaggacaaactgccgcagatagaagaggatttaggacaacaaggagacgactcaatcgaagaaaatggaggttacgattactacaagacttctttgaaccctacatattaccacaagatgaagcattctttattcgacaaaaacaaagtaatttagtcccccaagataccaagaaacagtaccctgaatcagttttatttgatgatacctcggacaaagacttttatacagaatacccgacaatatatcatttacgtcaagcactaatgacagaaaaccgccagttcgacattagagaagtatacctagccattcaccatatagtaaaatatcgaggacattttcttaacaatgcaccggtaaaaacattcaaatcgggtaacctcgatttagcaatcaaatttaatgaactaaatgaggaatttaaatcagtataccctgaccttgaactacaatttaacctcgaccaaatagatgagattaagaaaatattactagactcaacgaaatcaaggtttgatcgacaaggagaggcagtcaaactaatctacactgtatcagaggtcaaaactatagaaaaactacaaaataaaattgtaaaacaattcctatctggtatactaggcttaaacacacgcttcgacgttcttacaaatacagagagtgacgattcaatgtggaaattctcccttgattcagaatcttcggatgatgcactcgatgaaattatcgcgcaacttgatgacccagcaatccatgtagtagagctagtaaacgaaatacactcatctataaccttagcaggcatcgtaccggaaggacaaggattaagtgaatccatggtagaaaaatacgaagctcataaagcacacctccaattactaaaagcagtagaaaaattagtagataagaaagccgccgataaacttgaggtggcctacgaccaatatatcaacggaaaagactccaaacaatttattaaagaagacttctataaagccgtacaaagtgaaattaaaggtgtagcaggagatgaagtggcagagataaaccaattaatagaattagatcaattcatgccaaaacaaagaacaaaggaaaatggagctataccacaccagctacatcaacatgagctagatgtaatcatagaaaaccaatcaaaatattacgactggctaggggagaaagttggaaatgaatacaaactagataagctagtgagctttagggtaccatattatgtagggcctctagtcgatacagcatcaaaagaaaagaaagacgagactagatttgcctggatggtaaggaaaaatccagaatccacagaagctataactccatggaattttgaagatatagtagataaaaacgcaagcgcggaaaacttcattaaacgaatgacaacgaaagataaatatcttctcaacgaagatgtattgccaaaatgcagtctactaacacaagattttgaagtctataatgaattgaacaacatccgtgtaaatggagaaaaattcacagcggaacaaaaacagctaatacacgacgaactatttacaaaacatgcatctgtaagtataaagcaactaaaagacttcctagtaagcgaactaatgtatgtaagagataacctaaaagtagaaggattagcagatgaaaagaaactaatgtcatcactatcaactcagtttgactaccagaaaatcataccggaccaaataaatgacgtcaaatatagagaggacatagaacaaataatagaatggtccacaattttcgaagatgccgctatatttaaaacaaagttaaaggagatcgactggttaacagacgaacaaagaaataaattagcaaacaaaagatatagaggatggggatcactgtcaaaacgattactagcatgtctagtagatgagaatggccaacgaataattgacattttgagagattcaagtgataacttcatgatgatagtaaatcgacctgaatttaaacaagcgatctttgatgaaaacgcaaacttaacagagacaaatagtaaaaaggatatgttcgaaatgatcgacaacttctatacatcacctcaaaacaagaaagcgatcagacaagtattattagttgtacaagatatacaaaacgccatgggcggtgtagcaccacagaaaatattcattgaatttgcaagggaggatgaggtaaacgggcgccgaacaaattccagatactcccaaataagagaaatgtattcaaaggtcacggatgatgttataaacaaaaccgtaagaggtgaattagaagcaaataaagggagcttaaacaaagaaaaattatttctatattttctccaaggcggaattgatctttacagcggcaagaccataaacatagacaatatctcgtcgtatgatgttgatcacgttctgccgcaatcgtttataaaagatgactctataaacaataaagttttagtaaacgcaaaaggcaatagagtcaaaaacgacaatgtaccaatggagttattcggagctaaaatgtatccaacatggaaacgaatggtagacaccggaataatgtccaaagctaaattcaaaaacttaacccttaatccagataacgtcgacaaattcaaagcggaaggtttcattaacagacagctagttgaaacaagacaaataataaaactcgtagcacaaatcctaaacgataaactaggagatgacacaaaaatagtcagtgtaaaagcaaacttaacacatgatatgagagtatttttcgacttcccaaagaacagaaatgttaataactaccaccatgcttttgacgcatatctaagcgcattcgtaggtacttacctatataaacgctatccaaaattacaaccatacttcgtctatggagagttcaagaaaatggacaaacttaaaaatatgacctctttcgatttcttaagagatctaaaacacacagataaagtcgttgataaagacacaggtgaaataatagccgataaactcgctgtaataacaaatatgaacaaaatatatgatttcaagaaagtcctagtaacccatgaagtacacgagaatagtggtgcaatgtacgatcaaacattgtatccagcaaaactcgacaaatcgctagggagaaaaggggcaaaacaacttatacctaagaaagacgatatgccaacagctctatacgggggctacactggatcaaaagacgcattcatgagcatagtaagattaaagaagaaagatgaagtatactataaagtcataggtatacccgtcaggatcgctgactcagtacaacatggaaaagaagtagatgtagaagcattaactcaattcatagaaactaaatttaccaaagaaaatctgaataagaaaacaggcgaaataaccaggaaagtggaatggtttgagctagtactacctaaagtactattcggccaagcagttttcgatggtggacaaccattcatgctaggatcgagtacatatccacataacttaagagaactcgttctaacaaaagacagtgttaagaaaatagccggtaaagaaagcaataaatcttatttagacgcatacgacgaaatcatggaagcgatgaataaatacttcccactctatgacacaaataaattcagagaaaaagtgatagaaggtagatccaaatttatagaccttccagataaagatgaatatgaaaataataaacttgttcaagttggtaaatcaaccatcattgatagaatgtttataggcctacacgcaaatgcagcaagaacagatcttaaaaatataggcataacaaccccatttggatttatgcaacaagcatcaggtattaaactaacaaaagacacagtggtcctatttcaatccagtaccggtctatttgaaagaaaagtagcactaaaagatctttga

SEQ ID NO: 8853 - RNA, 4077 nt, synthetic construct
  misc_feature 1..4077: note = Cas9 variant
  source 1..4077: mol_type = other RNA
atgaaagaaccttatggcgtcggcctagatatcggtactaatagtgttggatggaccgttgtagacgcatcgggtcatgtacgcaaaataaaaggacaaacagggataggagtaagattatttaaagagggagccgcagccgccgaccgccgcggatttagaactacaagaagacgtctaaaacgcgtaaaatggcgtttacgattattaagagaatttttcgaccaaccaatttccaaagtagatattaactttttcgcccgacgaaagtattccgatgtaagcccccgtgatcccaattataacggtctggagaaaacgttgtttaatgacagatcagatcaagatttttaccatgactacccaactatataccatttaagagaagctctaatgacacaacacagaaaatttgatgtccgggaaatctatctagctatacatcatatagtaaaatatagaggcaatttcttaagaaacgatgcagccacggcatatagaagtggaacactagacctgcaacaacatttcgaaactctaaaccatttgttctcccaagcagatctagagttaaatctaaatcttactaccgatgttgcacttcttgattcaatcaagcaaaccctagtaaggacagatatatctcgcagtgaccgacaaaaactcataatgccgcttttagctgttttaacaggtgcaacaaccgccgaaaagaaaagacaaaaagccgtagttacagagttcgctaaagcattagtcggaaataaaacaaaaattgatgttctcacattaaccgacatcgacgctacagaagctaaagattgggctttctcactcgaagaaaaccaagataaacttccaggaattgaagatcggttcagcgaagttgggcagcaaataatagatgaagtaatacgcttatatgccagtgtaaatctggcacaattaatccctgaaggaaaacgattcagccaatccatggtggaaaaatacaaacggcatggggaagacttaaaacttttaaaggcatacattcgaagccaatcagatgcaaaaagaggtcgagcaataagagctacatatgaccaatacatagatggagtaaagtcaaaacaagttacacaagaagcctttcaaaaagccttaggaaagttcgttgacgcagacgtagacttaaactcatgggccgctcagatcaaacaagcgatagactctgaacaattcatgcccaaactaagaacaaaacaaaacggcgcaataccttatcaagttcaacaaaacgaactggatcaaataatatcgaatcaaaaagaatattacccttggttaggtgaagaaaatccagtgattaagagacgaggaaaattcccatataaacttgacgaactatttggctttagagtaccctactatgtgggtccactcataacaaaggaaatgcaagcggcaacggctaacgcaggtttcgcatggatggtaagaaaagcagatggaccaattacaccatggaacttcgatgacaaagtggacagagtagcctcggctacagcttttattcaaaggatgcagacaaccgatacttatttaataggtgaagaagtcctccctgctaggagcttaatttatcaaagatttatggtactaaacgaacttaataacataagagtagatgatggacaacttacacctagacaaaaacaaagactatacaaccaagtatttaagaaacataaacgtgtaaccgccaaaaacatacaggataacttagttgcagcacgcgaatttccaacggcaccaagaataaccggactcgccgacccaaaagtattcaattcaagcctaagcacgtaccatgacttaaaacaagtgctcccagaagcaatgagcgatgtcagaaaacaagccgatatagagaaaataatattatggtcaacaatatttgaagactctacaatcttcaaacaaaaacttactgaaatctcatggttgacagcagcacaattaaaacaattaggccaattaagatatcgaggttggggtcaattacttcgaaaattgctaacagggttaaaagacgataataaccgatctataatggatggcttatgggaaaccaacgcaaattttatgcaacttcgatcacaaccagccatagaaaatcaaattaaatcagcaaatcaagctaatctaacgacagccgacctacaggatactatcaatgaactctatacgtcaccacaaaataagaaagctatacgtgaagtcatggtagtactcgcggacattaaagacgcaatgcacggtcaaacacctaattggattttcgttgaggcggcgagaggaggaggcgttgccggcagaagaacacaatcaagatcaaaacaaattgtagctgcatatcagggcacggctcaggcaatagtaagagatcaagtacaaagagaactcaaagagaaaatcaaaaacaaagcaaactttaacacacgactcgtactatacttcttacaaaatggcagagacctctacacaggcgacgcaataaacatagaccgactcagcgaatacgatatagatcacatacttccacagagcttagtcaaagacgactctttagacaatcgagtactaactaatgccagaatcaatagagagaaaaatgacacatttgcaagtgaaaaattcggaaagaaaatgggtgcaaaatggaaagaaatgcatcgaatgggacttatgactaaaagaaaacttgatcacctcttaatgcgacctgacgaaatatccaaatacgcgactggattcatcaatagacaattagttgaaacccgacaagtaattaaactcgtagaagaactcataaatgcagaatatccctcaacggctatagtaagcgtaaaagctaatctaacccatcaattcagacaaacatttgattttcccaaaattcgcgaagtaaacgactatcatcacgcttttgatgccgccctaacagcttttataggcacctacttactcaaacgatacccgaaactagaaagatttttcgtttatggaaaatttgcaaaacaaccagttaatctaacacgcttcaatgtcataagaaaattagcaaaaacggacactcctataacagatatcgacacaggagaagtactatgggacaaactaacagacataaaatactttgaaacattatacgattacaaaagactattagtcacaagagaagtaagtgaaaattatggagcgatgtttgatcaaacgttacttaaagcatctgataatggtaaacgattaatacgtaagaaacaatcattcgatacagcaatatacggaggttatacaggtaaaacattagcttatatggcaattgtcaaagtctcaacaaagaaagacgttcaatatcaagtagtaggggtaccgaccactatggtaacccaaatagaacaactcgaacaacaaggaatgacaaacaaacaagctgtcacgaaagtaatagaaccattaatagccgcaaacaataagaaaatgctaacatacgaagtacttctacccaaagtaagatttgaacaagttgtacgagacagaattaaaggccaaacacaccggtttgccttagggacagacacatattatcacaacatacaagagctgtacctacctctaacactgcagcgcgcgtttttgggcaaacaaaacgaaagcgaggtccaactgaaccaaaacttactaactgtttttgacgccaccctagcacaggtaaatagatactttcccctctacgaaatgaataaattcaagaaaatcttaaatagcgcaagagaccaaatagaactattagaagcgaaaaatcaatttgttaaaaacaaactggtattaggtaaacaaggaatattaaccaacatgtttatcggattacacgctaacgcctcgtatggagacctaaaagtactcggagtaaaaatcgattttggcaaattacaagtacccggagggataaaactaacaggggatgcagaaataatctaccaatccccaacaggtttattcgagagaaaaatagcgctaaaagacctatga

SEQ ID NO: 8854 - RNA, 4077 nt, synthetic construct
  misc_feature 1..4077: note = Cas9 variant
  source 1..4077: mol_type = other RNA
atgaatgaaccttatggagtaggattagatataggaaccaattcagtcggatggaccgtagttgatatgaacggacgtgtaagaaaagtgaaaggaaaaactgcgctaggagcacgactattcaaagagggagcgacagcagaagacagacgaggcttcagaacaactaggaggagacttaaaagagtcaaatggagactcaggttattgcgtgagttctttgatcaacccatttcaaaaatcgatccaaactttttcgcaagaaggaaatacagcgatatatctcccagagacccaaactacaatggtcttgcaaaaaccctttttaatgacagaacggatcaagagttctatcatgactatccaacaatttaccacctaagagataaactgatgacaagtgatcgaaaatttgacatacgagaaatctatctcgctattcatcatatagtaaaatataggggaaactttcttagaaccggccccgcctctcaatatggttcagcatcgttacacttagcaaccagctttcaaaaattaaatgatctattcgctcaaagtgaagagagcttaaactttaaattggtaacagatgaagcccaattacaacagattcaacagatattggtaagaacagatttaagcaggtcagaacaacaaagacaaatatggcccctaatggtagtattaatgggcgcaacggccgcagaaaagaaaagacaaaaagattttgccaaagaactagctaatgcacttgtaggactgaaagctaaactcaatgttgtcaccttaactaacgtagacacaacagtagtgaaagattggacattcacactggaagaatcacaagataaactccctgaaatagaagaacaactatcggaagtagggcaacaaattatggatgaagtaattcaactctacgcaagtgtgaatttggcccaattaattcccgccggcaaacgatttagtcaacatatggttgaaaaatacaatcatcatgagaaaaatctcgaattactaaaggcttacatccactcacaatctgacagcaaaagaggaagagaaatacgtgcaacctacgacagatacatagatggagtaaaaagtaaaccagtaacccaagaaatgttctacaaagatcttatgaaatatgtagaagctgacgcaacatccaaccatcttgcggctgaaatcaaagatgaaatagattccgaacaatttatgccaaaactaagaaccaaacaaaacggatcaataccataccaggttcaacaatatgaacttgaccaaataataagtcatcagaagaaatactacccatggttaggcgaagaaaatccagtagcagaaagaagaggaaaatttccctataaattagatgaattagtaggattcagggtgccttactatgttgggccattaatcactaaagaagatcagcaagcaacatcaggagccggcttcgcatggatggtaagaaaagcggacggacctatcactccatggaatttcgatcagaaagttgaccggatagcctctgcaacagcattcatacaaagaatgcaaacaacagacacatacctaatcggtgaagatgtactccctgccagatctctaatatatcaacggttcatggttctaaacgaactaaataatatgagagtagaagaccaaaaattagcaccaaggcaaaaacaaagattatacaaccaagtgttcaaacaacatcaacatgtaagtgtcaaaaacattcagcaaaacctaatggacgcaggggaataccgagaaacgccaaaaataacgggtctagccgacccaaagggatttaattcttccctgtcaacgtatcacgacttcaagaaaatacttcctgaagccatcgccgatgaacataaaagagccgacatagagaaaataatactttggagtacaacctttgaagactcagcaatattcaaacaaaaactagaagaagtagcctggttgactgatgcacaacgaaaacaactctctggtttaagatatcgaggatggggtcaactatcacacaaactcctaacagccttcaaagatgataacggaagaagtgtgatggacggtctatgggaaacttcagacaatttcatgcaattaagaaaacaacccgcaatagaaacacaaataaaagaagcaaaccaagcaaatttaacagacgcagatatacaagacacaataaacgaactttatacgagcccacagaacaagaaagctataagagaagtaatgcttgtacttgacgacatcaaaaatgcaatgcatggacagaccccgagttggattttcatcgaagccgcacgcggaggcggagtcgcaggcaggagaacacaatccagatcaaaacagatagttgaggcttacaaatcaacggcgaaagaaatagtatctgaaaaagtacaacatgaactcaacgagaaaataaaagcaaaagcggattttaacacacgcctagtactttattttctacagaatggaagagatctctataccaacgaagcgataaatattgatagattatctgaatacgatattgaccacatacttccacaatcactggtaaaagacgactctttagacaacagagtgctaacaagcgccagaataaatcgagagaaaaacgacacatttgcctcagaaaaattcggaagaaaaatgggagctcagtggcgagaattacacagaaacggacttatgacacaaagaaaactgaaacatttattgatgcgccctgatgaaatttccaaacacgctactgattttataaataggcaacttgtagaaacgagacaagttataaagctagtagaagaattaattagcagtgaatatccatctgcaagtatcgtcgcggttaaagcaaaccttactcaccaattcagacaaacattcaatttccctaaactacgcgaagtcaacgattatcaccatgctttcgacgcatcacttaccgcctttataggtatgtatctattaaaacaatatcctaaacttgaaagattcttcgtatacggaaaattcgctaaacaaccaataaacctcacaagattcaatgtaattcgaaaactagcagtcgcggaagaacccatagcgaatatcgaaaccggcgaaattctctgggataaaaccgcggatataaaatgtttcgaaaaattatataattacaaacgactattagtaacacacgaagtcagagaaaactatggggccatgtttgatcaaaccatattcaaagcaacagactcacggaaacgactaatccagaagaagaaaggatttgctacagaaacttatggcggatacactggaagaacactcgcctatttagccatcgtgaaagttgtcacaaacaaagatacacaatatcaagtagtaggaatccccacaacaatggttacgcagatacaacaactcgaagcgtccggtctaacgtctaaacaggcggtaaccaaagcgatcggagctatgataaacgagaacaataagaaattacaatcctatgaggtactcttaccaaaagtaaggtttgaacaagtcgtaagggacgaggtaaaaggccacatacatagatttgcactaggaactgatacctattatcataatatccaagaattatacctgccattaaccatacaaagagctttcctaggaaaaagaaatgacacagacgctcagaccgagcaaaacctcttaacagtatttgagaccactctagcgcaagtaaaccgatatttccctttgtatgaaatgaataaattcaaacaaatactgaacagtgctcaagaaaaatttgcggccttgcctactaaaaataaaacagtcaaaaataagctagttaccggcaaagatggagtgctaaataatctatttataggactacacgctaatgcatccctaggcgacttaaaaatacttggaatgaaaactggtttcggtaaactacaggtcccaggtggcttaaaattgactgatcaagcggaaataatatatcagtcccctactggattattcgaaagaaaagtagcactgaaagacttgtga

SEQ ID NO: 8855 - RNA, 4077 nt, synthetic construct
  misc_feature 1..4077: note = Cas9 variant
  source 1..4077: mol_type = other RNA
atgaacgagccttacggtgttggactagacataggcacaaacagtgttggatggacagtcgttgatatgaatggaagagtcagaaaagttaaaggtaaaacggcattgggggcccgattattcaaagaaggtgccactgccgaggaccgcagaggctttagaactactagaagaagattaaaacgagtaaaatggagactacgattactaagagagttctttgaccaaccaatatcaaaaattgatccaaatttcttcgcaagacgaaaatattcggacattagtcctagagatcccaattacaacgggctagccaaaacgctgtttaatgataggacagaccaggagttctatcatgattaccctacaatataccacttacgagataaattaatgacaagtgatagaaaattcgatatacgagaaatttacctcgcaattcaccatatagtcaaatacaggggaaatttcctgagaacgggacctgccagccaatatggaagcgcaagtctccacctggcaacgagtttccagaaattaaacgacctattcgcacaatctgaagaatctttaaatttcaaattggtaacagatgaagctcaactacagcaaatacagcaaattctcgtccgaacagatctatcacgaagtgaacaacaacgccaaatctggccattaatggtagttttaatgggagcaactgccgctgaaaagaaaagacaaaaagactttgcaaaagaactagccaacgcccttgtaggactaaaagcaaaactaaacgtagtcaccttaacaaacgtagacaccacagttgtaaaagattggacattcactttagaagaaagtcaagataaactaccagaaatagaagaacaactaagcgaagtaggacaacaaatcatggatgaagtaatacagctatatgcaagtgtaaatttggcacaactcattccagccggcaaaagattcagtcagcatatggtcgaaaaatacaatcatcacgagaaaaatctagaactcctaaaagcctatatccactcacaatccgactcaaaaagaggacgagaaatacgtgctacgtatgacagatacatagacggcgtcaaaagtaaaccagtaacacaagaaatgttttataaagaccttatgaaatacgttgaagccgatgctacatccaatcacctagcagcagaaataaaagacgaaatcgactcagaacaatttatgccaaaactacgaacaaagcaaaacgggtcaattccataccaagttcaacaatatgaacttgaccagatcatatctcaccagaagaaatattacccatggcttggtgaagaaaatcctgtagccgaaaggagaggaaaattcccctataagctagatgagttagttggattcagggttccttactatgtaggacctttaatcacaaaggaagaccaacaagccacaagcggcgcaggatttgcatggatggttcgcaaagcagatgggccaataacaccttggaactttgaccaaaaagtagataggatcgcatcagcaactgctttcatacaaagaatgcaaacaactgatacatacttgatcggcgaagacgtattaccagcaagatcactaatatatcaacgattcatggtacttaatgaactaaataacatgagagtagaagaccaaaaattagcaccacgacaaaaacaaaggctgtacaaccaagttttcaaacaacatcaacatgtatcagtcaaaaatattcaacaaaacttgatggacgctggcgaataccgagaaacccctaaaatcacaggacttgctgacccaaaaggcttcaactcatcgttaagcacctaccatgactttaagaaaatacttccagaagcaattgcagatgagcataagagagcagatatagagaaaattatcttatggtccactacatttgaagattcggccattttcaaacaaaaattagaagaggtagcttggctaactgacgcacaaagaaaacaactttcaggtttaagatacagaggatggggtcaactttcacacaaactactaaccgcttttaaagacgataacggtcggtcagtaatggatgggctttgggaaacaagtgataattttatgcaactgcgtaagcaaccagcaatagaaacacaaataaaagaagcaaaccaagccaacctaacagacgctgatatacaagatacaatcaacgagttatatacaagtccccaaaataagaaagccattagagaagtaatgctagttttggatgacattaaaaatgccatgcacggccagacgccaagttggatatttatagaagccgccagaggaggcggtgtagcaggcagaagaacccagagtcgatcaaaacaaatagttgaggcatacaaatccaccgcaaaggaaatagtgtcagaaaaagtacaacatgaactaaacgagaaaataaaggctaaagcagattttaacacacgtttagtactatactttctacaaaacggaagagatctatacacaaatgaagctataaatatagatagactatcagaatacgatatagaccacatcctaccgcagagcttagttaaggatgatagtcttgataacagagtacttacatcagcacgaatcaatagagagaaaaatgacacatttgcatccgaaaaattcggtcgaaaaatgggtgcacaatggagagaactacatagaaatggtctcatgactcagagaaaattgaaacatttattgatgcgccccgacgaaatatctaaacacgcaactgatttcattaaccgacaactggtagaaaccaggcaagttataaagctagtagaagaactaatcagttccgaatatccctcagccagtatcgttgctgtaaaagctaatctaactcaccaatttagacaaacttttaacttccctaaactcagagaagtaaacgattatcaccatgccttcgatgcaagtttaactgctttcatcggcatgtacctattaaaacaatatcctaaactagaaaggttctttgtgtatggtaaattcgcaaaacaaccaataaacttaacgagatttaacgtaatacgcaaactagccgttgctgaggaaccaatcgcaaatatcgaaacaggtgaaatattatgggataaaacagccgacattaaatgttttgaaaaactttataattacaaaagattactcgtaacgcacgaagtaagagagaactacggagccatgtttgaccaaacaatttttaaagccaccgatagtcgaaaaagactaatacagaaaaagaaaggatttgcgacagaaacatacgggggatataccggacgcacactcgcatacttagctattgtaaaagtagtgacaaacaaagatacccaatatcaagtagttggtattcctacaacaatggtaacacaaatccaacaactagaagcctcagggctaacatccaaacaagcggtaacaaaagcaataggcgcaatgataaatgaaaacaataagaaacttcaatcatacgaagtactcctaccgaaagttagattcgaacaagtcgttagagatgaagtcaaaggacatatacatagattcgccctgggcaccgatacatactatcataacattcaagaattatatttacctctcacaatccagagagcctttcttggaaaacgcaatgatacagacgcacaaacagagcaaaacttacttaccgtattcgaaacaactttagctcaagtaaatagatatttcccattgtatgaaatgaataaattcaaacaaatactgaatagcgcccaagaaaaattcgcagctctaccaaccaaaaataaaacagtcaaaaataaattagtaacaggaaaagatggagtattaaacaacttatttattggcttacatgctaatgcatcattaggagacctcaaaatactgggaatgaaaattggcttcggaaaattacaagttcccggcggactaaaactaaccgatcaagcagaaataatctatcaatctcctaccggactattcgaaagaaaagttgcactaaaagacctatga

SEQ ID NO: 8856 - RNA, 4077 nt, synthetic construct
  misc_feature 1..4077: note = Cas9 variant
  source 1..4077: mol_type = other RNA
atgaaagagccctatggcgtaggactagatataggtacaaacagtgttggttggacagtcgtagatgcaagtggacatgtgcgaaaaataaagggccaaacaggtattggcgtaaggttattcaaagaaggagcagcagcagcagatcgtcgagggttcaggacgacacggcgcaggctcaaaagagtcaaatggagattaagactccttagagaatttttcgaccaacctatcagtaaagtcgatatcaactttttcgcaagaaggaaatacagcgacatcagcccacgggacccaaattataatggattagaaaagaccttgttcaacgacagatccgaccaagatttctatcacgactatcctacaatataccacctaagagaggctctaatgacacagcacagaaagtttgatgttcgcgaaatttacctagctatacaccatatagttaaatacagaggaaactttctaagaaatgacgccgccactgcgtaccgatccggaacattagatctacaacaacactttgagactttaaaccatctattctcacaagctgatctggaattaaacttaaatctaacaactgatgtcgcactactagattcaataaaacaaactctagttagaactgatatcagccgaagcgaccgacagaaactaataatgccccttctagcagtattaacaggagctacaacggccgaaaagaaacggcagaaagcagttgttacagagtttgccaaagcattagtgggaaataagactaaaattgacgttctaacactaacagacatagatgcaacagaagctaaagattgggctttctctttagaagaaaatcaagacaaacttccaggtatcgaagatagattcagcgaagtaggacaacaaattatcgacgaggtaatacgattatatgcctcagtaaacctagcacaattaatcccagaaggaaaaaggttctcccaatcaatggtagaaaaatataagagacacggcgaagacttaaaactactaaaagcatatataagatcacaaagtgacgctaaaagaggacgagccatacgcgcaacatacgaccaatacatagatggagtcaaaagtaaacaagtaactcaagaagcatttcaaaaagcccttggcaaattcgtcgacgcggatgtagacctaaactcatgggcagcacaaataaaacaggccatagattcagaacaattcatgcccaaattacgaacaaaacaaaatggtgccatcccatatcaagtacagcaaaatgaactagatcagattattaataaccaaaaagaatactacccctggttaggagaggaaaatccagttattaaaagaagaggaaaatttccatacaaattagatgaattagtagggtttagggtgccttattatgtaggaccactaataacgaaagaaatgcaagctgctacggcgaatgcaggtttcgcatggatggtacgaaaagcagatggccccataacaccttggaatttcgacgacaaagttgatcgagtagcatcggcaaccgcctttatacaaagaatgcaaaccacagatacatacttaatcggagaagaagtcttacctgctcgaagtcttatttaccagagattcatggtcttgaacgaactaaacaatataagagttgatgacggacaactaacaccaagacaaaaacaaaggctctataatcaagtctttaagaaacataaacgagtcacagcgaaaaatatacaagacaacctagtcgcagcaggagagttccctacagccccaagaatcaccggactagccgatcctaaagtatttaatagttccctctcgacttatcacgatctaaagcaggtactaccagaagcgatgtcggacgtaagaaaacaagccgatatagagaaaataatactgtggagtacaatatttgaagactcaacaatttttaaacaaaagttaactgaaataagttggttaaccgcagcacaattaaaacaactaggacaactaagatacagaggttggggccaactctcaagaaaattactcacaggcctaaaagatgataacaatagatccataatggatggactttgggaaacaaatgcaaattttatgcaactaagaagtcaacccgcgatagaaaatcaaataaaatcagcgaatcaagcaaacctcacaacagcagaccttcaggataccatcaatgaattatatacatccccacaaaataagaaagcaatcagagaagttatggtagtactagcggatataaaagatgctatgcatggccaaacaccgaattggatttttgtcgaagcagcccgaggagggggagtcgcgggccgaagaacacaatcacgtagtaaacaaatagtagccgcataccaaggaacagcacaagtgatagtatcagatcaagtacaaagagaattaaaagagaaaataaagaataaggcaaattttaacacccgattagtgctttactttttacaaaacggcagagacctgtatacaggcgacgcaataaatatagacagactatccgaatatgatatagatcatatactaccacaaagtctagtgaaggacgattctcttgacaacagagtccttactaacgcgagaattaatagggagaaaaatgacactttcgcgtcagaaaagtttggaaagaaaatgggggcaaaatggaaagagatgcatagaatgggactcatgacgaaaagaaaattagaccacctactgatgagaccagatgaaatcagtaaatatgctacaggatttatcaatcgacaattagttgaaacaagacaagttattaagctagtagaggaactcataaatgccgaatatccgtcaaccgcgatcgtatcagttaaagctaacctaacacatcaatttcggcaaacctttgacttcccaaaaattagagaagtaaacgattatcatcacgcatttgacgccgcactaactgccttcatcggaacgtacctcctaaaaagatatcccaaacttgaaaggttcttcgtatacggaaaattcgcgaaacaaccggtaaatcttacaagatttaatgtaattcgaaaactcgcaaaaacggacacccctataaccgacatcgacacaggagaagtactgtgggataaattgacagacataaaatacttcgaaacattatatgattacaaaagactattagtaactcgtgaggtaagcgagaattatggtgcaatgtttgatcagactctattgaaagcatctgataacggaaaacgtttaatccgcaagaaacaatcctttgacactgcgatttatggaggatacacaggaaaaacccttgcatatatggcaatagttaaagtcagtactaaaaaggatgtccaataccaagtagtaggagtcccaaccactatggttacgcaaatagaacaattagaacaacaaggtatgactaacaaacaagcagtaactaaagtaatagaacccttaatagctgctaacaacaagaaaatgcttacctatgaagtattactaccaaaagtgaggttcgaacaagtagtacgcgatagaatcaaaggtcaaactcaccgatttgcattaggaacggatacatattatcataacatacaagaactatatctaccattaactctacaacgagcattcttaggaaaacaaaacgagtcagaagtacaactaaaccaaaacctcctgacagtattcgacgcaacattagcccaagtaaacagatactttcctctatatgaaatgaacaaatttaagaaaatattaaactcagcacgggatcaaatcgaactccttgaagctaaaaaccaattcgtcaaaaacaaattagtacttggtaaacagggcattctaaccaatatgtttataggacttcatgcaaatgcatcattcggagacctaaaatccttaggagtaaaaacttcattcggtcaattgcaagtgccaggaggaataaagttaacaggtgatgcagaaatcatataccaatctccaactggacttttcgaaagaaaaatcgcattgaaagacttatga

SEQ ID NO: 8857 - RNA, 4077 nt, synthetic construct
  misc_feature 1..4077: note = Cas9 variant
  source 1..4077: mol_type = other RNA
atgaaacaaggaaaacgggggtattatttaggactcgacataggaaccgactctataggatatgcagtaacagatgaacaataccatctattacggtttcacggcaacgatgcgtggggatcacacgtattcgactccgcatccctgtgtgacgaacgacgaggattcagatcagcccggcgtagactagatagacgacaacaaagagtaaaactactacaggaaatatttgctaaagagattgctaatattgacccaaggttctttatacgactatccgagagctacaggtggagagatgatacagacgacaggtatatatacttcaacgaagaagagtacacagatatccaatatatgagagattacccaacaatacatcacttaatatgtgaattgatggaaaacgaagaagaacacgacattagattagtatatctagcttgtgcatggctcgtagcacacagaggccacttccttagccaactaagcgtggacaatattgactcattaatagatatcgaatcggtatatcaaaaattcttacacttctttatcgataatggatgcgagaacccctggatacaagacgctgaactcgtaggcggaatattaaaagaacatattggtgtaacagaaaaacataaccgattaggcgaaataatgctcgggaatagaaaacccagcaaagacgtaagagatacattcttatattctgaatattgcataataagactattagcaggcggaacttgtaaattacgagacctatacggcaaagaagaatatgaagacttcggatccgtcagcctagaaatggacgacgataaactagccgaaataatgataaatataggagaagattatgaacttatagcggtactacgtagcttacatgattggagcgttttagccgatatactcgacggccaaaacggattgactaatatatccacagcaaaagtagcgatatatgaacaacataagaaagacttggctacgctaaaatactttataagaaaatattgccccgagaaatacaatgcgatattcaaagacgctagagaagacaattacgtagcctacagctaccactacaacaacaaacttgacggccagattaaaaagaaagccgatacagaaacgttcagcaaatttttaattaaaataatccactcaataaaacccgataaagaagatgaaattatttatcaagacatggataatagattaggactaagacaattcttaccaaaacaaaggaatacagacaaccgagtgataccccaccaactatacgaatacgaactgaagaaaattttagaaaatgcggcaaaatacttatcattcctaaaccagaaagaagatgggataagcaacacggagaaaattatctccatattcaaatttaaaatcccctactacgtaggaccactgaataaacactccgagttcgcatggatagatagaaaatcgggaaaaatattaccatggaattatgaaaacatgatcgatgacgatgcgagcgaagaagcattcataaagaaaatgactaaccaatgtacttaccttccaggagaatcagtattaccaaaagattctctatgctaccaaaaattcatggtattaaacgaaattaacaacataaaagtggatggtagaaaaatttcggttggagcaaaacagggcatatactccgatttatttttaaaatacaagaaagtaaaacgaagccaaatcgaagaatatttaatttcaaatggacaattagagaaaaatcgaagagaaaccctaagcggaattgacatccaaataaaatcatcactttcgagtcacatagcctttagaagattactcgaacagaaaatactaaacgaagctgacgtagaaaggataatagaacgtgcatcctacgcagaggataaaggcagagtagcaaaatggctaagagcaaaatacccacacctaacagaagcagacataaaatatatatgcaaagtcaaaattaaagatttcggtagactgagtcgaactttccttactggcatagaaggagcgtgcaaagaaactggtgaagtggcaacaataatatctatgatgtgggaatcaaacgataacctaatggaattactaagcgagagatatacatttgcagataccatactagaatttaaatcagattattatactgaaagaaaacaaaccctgtcagaaagattagatgaaatgtatgtatcaaatgctgttcgaagaccaatatatcgaacactagacattgtaaaagatttagaaaaagcatttggtaaaccggagaaaatctttatagaaatgaccagaggagcgatgccagaattaaaaggaaaaagaaccaaatcaagacaacaacaattactcgaatattatgacaaatgtaaagaagaagatgtcagagatctaaaacaacaactagaagcacttggagaatatgtagataacaaactccaatcagatagactcttcctatacttcatgcaattcgggaaatgcgcatactctggaatgccgatctcacttgaacgattgatggcaggcagcaaagaatatgatattgaccacatatatccacaagcatatgtaaaagatgactcgattatcaataacaaagtcctagtactatcagtcgccaacggagaaaagaaagatgtttacccaatcaaaagcgaaataagaaacaaaatgcagaaaacatggagcttctggcaccacgttggaacgatatccgacgaaaaatacaaacgcctaataagatcaacacccttcaccgaagatgaaaaatatggattcattaataggcaattaactgaaacaagccaatcaaccaaagttgtagcggaattactcaaagaaaggtatcccgaagcagaaatcgtatacagcaaagcaggactaatatcagatttcagacatgaatttgacctatataaatctcgatcgtacaatgatttgcatcatgccgtggatgcatacctaaatatagtagtcgggaatgtataccacatgcgattttcgcgacaatggttcaacgtgaactcttcatattcaataaaaactaaaacactatttacccatacagtaaactgcaatggaaaagaagtatggaacaaagatatgttacccggcgtattaaaaacggcaaagaaaaacacggcccatttcacaaaacacgctacattcaaaactggaggattattcgatcaaaatccagtaaagaaagctccgggtctaacaccattaaaagcgggtttacccacagaaaaatacggagggtacaataaagcaggcgtaatgttcttcatacccgtgaggtacaaatcaggaaagaaaacagtactaatggtactatcagtagagctcttatacggaaacagattcttagaggacgaaatattcgctaaagaatacgcaaaagataggcttcaacgaatgataggaaaatcagtagacgaaatcgattttccaataggaatgcgaccatggaaagtcaatacaatcctgtcattagatggattcagaatatgtataacaggaaacgcatctggagggaaatgtcttattgcacaacctataatgcaattctcttcagacgaatactggaaatactatttaaagaaagtggaaaaatttgtagagaaagtcaaaaacaatagttcttacgtatacgacgtagattatgatgcagtccaacacgaagataaccttaaactttatgacctttacctggataaactacagaatagcatatatagaaaaagaataaacgccccaatacaaactctaatagaaggaagagaaaaatttattgattgctcagtaattgaacaatgccaagtcttactcaatatacaccaagtttttggacggatgacttcaggatgcgatttgaccctaataggcggcaaaaccagatccgccagcacagtcaatttctcatcaataattcttaactggaagaaaaattatacagacgtacgaataattgaccaatccgcaagtggactctgggaagtcgtaagcgaaaatatactagaatacctttga

SEQ ID NO: 8858 - RNA, 4077 nt, synthetic construct
  misc_feature 1..4077: note = Cas9 variant
  source 1..4077: mol_type = other RNA
atgggtaaaatgtactacctaggcctagatataggaacgaactccgtaggatatgctgtcactgacccttcttaccatctactcaaattcaaaggggaaccaatgtggggcgcccacgtcttcgcagccggcaatcaatctgccgaaagacgatctttcagaacaagcagacgaagattagacagaagacagcaaagagtaaaattggtccaagaaatctttgcacctgttatctcaccaatagatccaagatttttcataagactacacgaatccgcattatggagagacgatgtagcagaaactgataaacacatattcttcaatgatccaacatacactgacaaagaatactactctgactatccaacgatccaccacctgattgtagacctaatggaaagctccgaaaaacatgatccacgattagtctacctagccgtcgcctggttagtcgcgcatagaggccattttctaaacgaagtcgataaagataacatcggtgatgtattatcatttgacgccttttaccccgaatttctcgcttttctgtccgacaacggagtctcaccttgggtgtgcgaatcaaaagcactacaagctacattactgagcagaaattcagtaaacgacaaatacaaagccctcaaatccctaatatttggctcccaaaaacctgaagataattttgatgcaaacatatcagaagatggcctcattcaattactcgctggaaagaaagtcaaagtaaacaaattattcccacaagaatctaacgatgcatcctttacattaaatgacaaagaagatgcgatagaagaaatcctcggaaccttaacaccggacgaatgcgaatggatagcacatataagaaggctgttcgattgggcaatcatgaaacatgctttaaaagatggaagaacaatatctgaatcaaaggtaaaactttatgaacagcaccatcacgacctcactcaactaaaatactttgtcaaaacctatcttgccaaagaatatgacgacatattccgaaacgttgactccgaaacaaccaaaaattacgtagcatactcatatcatgtaaaagaagtaaaaggtacactacccaaaaacaaagcaacccaagaagagttctgcaaatatgtcctaggtaaagttaaaaacatcgaatgctcagaagccgacaaagtcgatttcgacgaaatgatacagcggcttacagacaattcctttatgccaaaacaagtttctggcgaaaacagagtaattccttaccaactatactactacgaacttaaaacaatcttaaataaagctgcctcttacctccctttccttacacagtgcggtaaggacgcaatcagcaaccaagacaaactactatccatcatgacatttagaataccctatttcgtcggacctctaagaaaagacaattccgaacacgcttggctcgaacgaaaagccggcaaaatttatccttggaacttcaacgataaagtagatctcgacaaatctgaagaagcatttattagaagaatgaccaatacatgtacttactatcctggagaagacgtattaccactagattcactgatttacgaaaaattcatgatattaaatgaaataaacaatattagaatagacggctaccccatatcagtcgatgtaaaacaacaagtctttggactattcgaaaagaaacgacgtgtcacagtgaaagatatccaaaacttattgttatcgctaggagctctcgacaaacacgggaaattaacaggaattgacacaactatccactcaaactacaatacctaccaccattttaaatcattaatggaacgcggcgtgctaaccagagatgatgttgaaagaatcgtcgagagaatgacatattcggacgacacaaaacgagtccgattatggctaaataacaactacggaactctcactgccgacgacgtgaaacatatatcacgccttagaaaacacgacttcggacgactctcaaaaatgtttctaacaggtctaaaaggagtacataaggaaaccggcgaacgcgcgtcaatacttgactttatgtggaacaccaatgacaacctaatgcaacttttgtcagaatgttatacattcagcgacgaaataacaaaattacaagaggcttattacgcaaaagcccaattatcattaaacgacttcctagattctatgtacatatcaaatgcagtcaaaaggccaatatacaggaccctcgcagtagtaaatgacatcaggaaggcttgtggaaccgcaccgaaaagaatattcatcgaaatggcccgagacggcgaatccaaaaagaaaagatcagtaaccagaagagaacaaattaaaaatctatacagatctataagaaaagacttccaacaggaagtagatttcttagagaaaatactagaaaacaaatcagatggtcaattacaatcagatgcactttatctatacttcgcacaactcggaagggacatgtacacgggagatccaataaaactagaacatataaaagaccaatcattttataacatagatcacatatacccacaaagtatggtaaaagatgattcactcgataataaagtattagtacaatctgaaataaatggagaaaaatcctcaaggtaccccctcgatgcagctattcgtaataaaatgaaacccctatgggatgcttattataatcatggactaatcagcctaaagaaataccagagacttacacgatccactccctttacagatgatgaaaaatgggacttcattaacagacagctagtcgaaacccgacaaagtaccaaagcactagccatattactaaaaagaaaatttccagacaccgaaatcgtctattcgaaagcaggactaagtagcgatttcagacatgagttcgggttagtaaaatcgcgtaacatcaacgaccttcatcatgcaaaagacgcatttttagcaatagtcacaggaaatgtgtatcatgaacgatttaatcgaagatggttcatggtaaaccaaccatattccgtaaaaactaaaacattatttacacactcaatcaaaaatggtaatttcgtagcatggaatggtgaagaagacttaggacgcatagttaaaatgctaaaacaaaataaaaatacaatacacttcacaagattctccttcgacagaaaagaaggcttattcgacatacaacccctcaaagcatccacaggacttgtacctagaaaagcaggactagatgtagtgaaatacggtgggtacgacaaaagcacagctgcatattacctgctagtacgcttcacactagaagataagaaaacccaacacaaactaatgatgattcctgttgaagggctatacaaagcaaggatcgaccacgacaaagaatttttaaccgactacgcacaaaccacgattagcgaaatcctccaaaaagacaaacaaaaagtaataaatattatgtttcctatgggtacaagacacatcaaactaaactcaatgatatcaattgatggcttttatttgagcataggtggcaaatcatcaaaaggaaaatctgtattatgccatgccatggtaccactaatcgtcccccataaaatcgaatgctatataaaagcaatggaatcatttgcaagaaagttcaaagaaaacaacaaactaagaatcgtcgaaaaattcgataaaattactgtagaagacaacttaaatttatacgaacttttcttgcaaaaactccaacataacccctacaacaaattcttttcaacacaatttgatgtactcaccaacggacgttcaacttttaccaaactatctccagaagaacaagtccagacattattaaacatactgtcgatatttaaaacatgtcgttcaagtggctgtgatttaaaatccattaacggttcagcccaggccgcaaggataatgatctccgcagacctgacaggcctatccaagaaatactctgatatccggttagtagaacaatcggctagtggtttatttgttagtaaaagccaaaaccttttagaatatttatga

SEQ ID NO: 8859 - RNA, 4083 nt, synthetic construct
  misc_feature 1..4083: note = Cas9 variant
  source 1..4083: mol_type = other RNA
atgacaaaattaggaaaaccatatggaataggagtcgatatcggtagtaatagcataggcttcgcagcagttgatgaaaactcccacctaataagactaaaaggaaaaactgtcatcggtgctagattatttgaagaaggaaaagcggccgcggaccggagagcttcaagaacaacccgcagaagactttctaggaacagatggcgattatcattcctacgagatttctttgaatcacacatcacccctacagatcccaatttctttatgagacagaaatactcagaaatctcacctaaagacaaagcccgatacaaatatgaaaaacgactattcaacgacagaacggatgctgagttctatcaacaatatcccactatgtatcatctaagaaccagattattaactgaccccagcaaagccgatgtacgagaaatctactttgcgatacatcatattcttaaaagcagaggacacttcctcacatcaggatatgctaaggactttaatactaacaaagtagcactaaacgaaatttttccagcattacaagacgcctatgcacaagtttatccagatctagacattacgttcgatgaaaacaaagtaaacgagttcaaaacagttctactagacgaaaaagccacaccatccgacacccagagagctctagtaaatttattacttgctgaagatggagacaaagacatccttaaacaacaaaaacaggtactaactgagttcgcaaaggctgtagttggattgaaaacaaaactaaatgtagctctgggcaccgaagttgactcgtctgaagccacagcttggaacttctctctgggacaactagatgataaatgggctggtatagaatcggcaatgactgacgaaggaactgaaattttagatcaaatccgggatttatacagagcaagattgctaaacggaattgtgcccgcaggaaaaactctaagccaagcaaaggtagacgattatgaacagcaccatgaagatttagaactatttaaagactacttaaaacaactagaagacgatggaatggcaaaggctataagacaattatacgacaggtacatagacggcgacgacgctaaaccatttgttagagaagatttcgtaaaagcacttacaaaagaagttactgcacaccccaatgcaaaatctcccgagttattagaaaggctagtccaacctgactttatgttaaaacaaagaaataaagccaatggggcaataccagtacaaatgcaacaaagagaattagatcaaatcatcaaaaaccaaagcgtatattatgattggctagctgcacccaaccctgtagaaaaacacagacaatcaatgccctatcaatttgacgaacttctaaactttagaatcccgtattacgtagggccgttggtaacagctaaggaacaaaaagcagcacaaggcggagtattcgcatggatggtaagaaaagatccagacggaaacataacaccatacaatttcgacgaaaaggtggaccgcgaagcaagtgcaaatacatttattcaacgaatgaagacaacagatacttacctaataggtgaagatgttctacccaagcaatcgctgttataccagtcgtatgaggtactaaatgaactcaataatgttcgagtaaatgacaataaattatcattcgaccaaaagcaacaagtattgggtgaattattcgaacgacacaacactgtcacaatcaaacaatttgtcgacaacctcctagctcacggagactatgatagaatacctgaagtgcgagggctcgcggatgagaaaagattcctatccagtctctcaacttacaatcaacttaaaggtatactacacgaagctatagacgactcagacaaacaaacggatattgagaaaataatcgcatggtcaacaatctttgaagataaggcaatattcaaaacgaaactcaacgaaatttcatggttaaatgccggtatgattaactcactagcgaatataagatacagaggttggggacaattctctcataaattacttaatgaattaaccctctctacaggaaggacagtgttcgaagaactcctaatttcatcacataacttaatgcaaatattaacagatgaagttcttaaacagaaaattgctgaactaaacgcacacgaactaaaggcttcaggaatctacgccgctatagacgacgcatatacatctccatcaaacaagaaagctctaagacaagtcctcagtgtaattgatgatataacaaatgcagcaggccaagcgccaaactggctttacatcgaaacagcagacggagatggagtaccaggaaaaagaactaattctcgacaacgaaaaatacaagaaatatacgtaaacgcggctcaagaattaataacaggatcagtacgtggtgaactagaagacaaaattgcatcaagagcagactttactgatagactcgtactttactttatgcagggcggtcgagacatatacaccggagaaccactaaatatagataatctttctagttacgacattgaccacatattgccacaatctctaatcaaagacaactcattagacaatcgcgtattagttcatccactcgtaaacagagagaaagacactatttttgcaagtacacgattcgcaaaacaaatgaatggaatgtggagacagtggcacgcagcaggtctaattagttcaagaaaactacgaaaccttcaaatgagacctgatgaaattgataaatacgcaagtggatttgtagccagacagttagtagaaacacgacaaattattaaactaacagaacagatagtcgcagatcaatatccggatgccaaaatcatagctgtcaaagccggtttaagcagtcaattaagaaaagaattggattttcccaaaaatagggaagttaaccattatcatcacgcctttgacgcgttcctagcagctagaatcggaacatatttactcaaacgatacccaaatctagaaccattctttacatatggaaaatttaagaaaaccgaagtaaagaaattaaaatcctttaattttatacgggatatgacccacgccaaagataaaatagtagcaaaagagaccggagaaatagtatgggataatgctagtgacataaacgaactcgaccgcatttacaacttcaaaagaatgttaattactcacgaagtacgatttgaaacggcatcactattcaaacagacattatacgctgccaaaaactccaaaaaccgcggcggttcaagacaattaataccgaaaaagaaaggatatctcgtagatatctacggtggctatacacaagaaaccggatcatatctatcagtagtcagacttacaaagaaagccatgtatgccgttgttaaagtgtctacacgcgacgcagcaaaactagcagtagcaaaaagcatatccgagcaaaaagaaaatgagaccctaaagaaaatcattgatggaaaattatctaaaacgagcaagaaaggaaaaacaacacatcaactattcgaaatagtcctaccaagagtaggacagaaaactttatttaaaaattccaaatacaatcaatttttagtaaattcggatacttatatgcacaactaccaggaactttggatgccacgcgaatatcaaagaatgtggaaagatatccttctaagcaaccacggagacgcccaactagagggacaacttgaccaaatattcaaattcatagtctcccaagtaaactcatacttcaacctatacgacataaaccaattcagaaagaaaatcgcagatgccacagataaattcgcaaaattaccaacccatgacacagacaatgcacgaggaaaaatagccacaataggtcaattactgataggccttcaagctaatgcaatgagaagcgacttaagaaatttagacatcaaaacgccgtttggattactacaaataggaacgggaataacactagacttagatacttctattatttaccaaagtccaacaggactttttgaacgcgaagtaccattaaccgacttatga

SEQ ID NO: 8860 - RNA, 4083 nt, synthetic construct
  misc_feature 1..4083: note = Cas9 variant
  source 1..4083: mol_type = other RNA
atgacaaaactcaatcaaccttacgggatcggattggatatcggttcatcaagtataggttttgcagtagtagacgcaaactcccacttacttcgtttaaaaggtgaaacagcaataggcgctagattattccgagaaggtgagagtgcagctggaaggagagcttcaagaacaacaagaagaagattgagccacaacagatggagactaagattcctccaagactttttcgatccccatatttcatccatagatccagatttcttcctgcgacaaaaatattcagaaataagcccaaaagacaaagagagatttaaatatgaaaaacgtctctttaacgacagaacagacgcacaattttataaacaataccccacaatgtaccacttacgtctacacctcatgaatgacgccagcaaagcagatcctagggaaatattcttcgctatacaccatatactaaaatcacgagggcactttctcacaccaggagacgctaaaaactttaacacagacgatgtagacctaaaacacatatttcctgcacttacagaagcatacgcacaagcatatcccgatcttaccctcagtttcgaacccagcaaagcagaaaaatttaaaagcatattactagatgaagatgcaacaagtaacgatactcagaaagccctagttaaactattattatctgacgacggggacaaagaagtactaaaacagcagaagaaagtattaactgaatttgcaaaagcagtagctgggctaaaagtaaaatttaatgttgccctcggtattgaagtaaccgacgctgacgtagaaaaatggcacttcggcatggcccaactagaagataaatggtccgacatagaacctagcttgacggaccaaggtatggaaatatttgaacaaatacaagatttatatagagcaaggctactaaacggcatcgtaccagccggcaaaactttatcacaagctaaagtagatgactatgatcaacactgcaaagatttaaaactatttaaagaatatctaaaacaacttaatgatcacgaccttgctaagaggattcgactattatacgacagatacatcgatggagacgatgcaaagccattcctgcgagatgattttgtaaaagcactgaagaaagaagtaactgctcatccaaccgaattagctgaatctctactagaacggatggaacaagataattttatgctcaaacaaagaacaaaagctaacggatccatcccagtccaaatgcaacaacgagaacttgacaaaataatagcaaatcaagcagagtattacagttggctcgcagctgaaaatccagtaaaagaacacagagattctaagccctaccaactcgacgaactattaaattttagaataccctactacgtaggtcctatgataaccaagaaacaacaagaaaaatcaggacagaatgtgtttgcttggatggtccgaaaagatccctcaggtaacatcaccccctacaacttcgacgaaaaagttgatagagaagcctctgccaacgcatttattcaaagaatgaaaactaccgacacatacttaataggggaagatgtactaccaaaacaatcccttttatatcaaaaatatgaagttctcaacgaattaaataatgtaagggttaatggagaatccctcagtaccgaccaaaagaaacgactcataagagaactttttgaacgacactccagtgtaaccttaaaacaattcgttgaaaacctggttgcacatggagatgttgcaaaaagaccggacgtacgaggactagcagacgagaaaagattcttatcttcgctatcgacttatcatcagttaaggggaatattacatgatgcaatagacgacagaggaaaacaaagcgatattgaaaacataataacctggtctacggttttcgaagatgcatcaatcttcaaaagtaaactaggggaaatctcatggctagattcaaaaacacgaacaactctttctaacattcggtatcgtggctggggacagttctcaagaaaattactggatggattaaaattaggaaatggtcatacaattatacaagaactaatgctatcaagtagaaacttaatgcaaatattaactgatgaaacactgaagaaagaaatggcaactttaaaccaagaaagattaaaaccagattcaattaatgaagcaatagacgcagcatatacatcacctagcaacaagaaagcaataagacaagtactaaaagtagtagatgacattaaacacgcagccaacgatcaagcaccatcctggctatacatagaaaccgccgacggaggcggccatccaggaaaaagaaccctaagccgtcaaaaacaaatacaagcgatctacgagaatactgctaaagaattaattgactccgcagttcgtggtgagctcaaagataaaattgccgataaaacaaatttttctgataggttggtcttatactttatgcaaggaggtcacgacatatacaccggcacagcactaaacattgatcaactatcatcatacgatattgatcatatactacctcaaagcctaataaaagacgacagtctagataacagggtactggttcatgccaaaataaatagagagaaaaatgcagaatttgcatcaacattatttgcagcaaaaatggcgtctacatggcaccgttggagagacgctggtcttatatccggaagaaaattaaagaacctactaatgcgcccggacgaagttgataaatatgcaaaaggcttcgttgcacgccaattagtggaaactcgacaaataataaaattaacagaacaaattgttgctgcacaatatccagatactaagataatagcggtaaaagccgggttatcacaccaattaagacaagaattggatttccccaaaaaccgcgacgtaaaccattatcatcacgcctttgacgcgttcttggctgctcgcataggcacatacttgttaaaacgctatccaaatctggcaccattctttacctatggagagttcactaaaaccaacttaaagaaattacagtcattcaactttataggagctttaacacatacggatggaaaaataacttcaaaagacaccggagaagtcctttgggacaaccaacgagatatcgaagaactcgatcaaatttataatttcaaaaggatgttaattacccacgaagtttactttgaaaccgccggactctttaaacaaactgtctacgcagctaaagattccaaagagcgaggtggtagcagacaattaataccaaagaagaaaggatactctacaggcatatacggaggatatacccaagaaacagggtcctataacgcattagtacgcttaacaaaagcaggaaaagttgtgtatagagtattcaaaataagcacacaaaacgccgcagaaatagcagcagctcgaagcctatctgccgaggagggaaatgaacgtttatgccaaatccttgaacaatcgcttttaaaaacaaataaagacaagaaaaacacagtcgatctcttcgacgtagtaataccaagactcggcaaagaagcacttttccacaattccaaatatggactttttctcgttaatagtgatacttattatcataactatcaagaattatggttatccagggaaaaccagaaaattttaaagaaactcttcagtacaaaatatgatcaaagcgaaatggatagagatgcattacacttatttgaaaccattgccaaacaagtagaacaattctttaaattatacgatatcaaccaatttcgaacaaaaatatccagcgctttcgatgcatttgaaaaactaccagtagaaggcgaagaaggaaaagtagaaacactaaaacagctacttattgggctacatgcaaatccagttaggtcagaccttaaaaaccttggaataaaaactccttttggatttctgcaggccggaaaaggtatacatctagatgatgacaccgaaatcatccaacagtcgccagctggactatttaaaagaagagtacgactagccgatttatga

SEQ ID NO: 8861 - RNA, 4086 nt, synthetic construct
  misc_feature 1..4086: note = Cas9 variant
  source 1..4086: mol_type = other RNA
atgacaaaacttggcaaaccatatggaattggagtcgacataggatccaactccataggattcgcagcagtagacgaaaatagccatctaatcagactgaaaggaaaaaccgtaataggagctagactattcgaagaagggaaagcagctgcagatcgtagagcgtcacgcacaacaagaagacgattgtccagaaacagatggagactctctttccttcgtgactttttcgaatcccacataactccaaccgggccaaacttcttcatgagacaaaaatacagtgaaatttctccaaaagataaagctcgatataaatatgagaaaagattatttaatgataggacagacgctgaattttaccaacaatatccaacaatgtaccatctacgaaatcgattactaacagacccatcaaaagcagatgtaagggaaatatactttgcaattcatcatatactgaaatccagaggtcatttccttaccagtgggtacgcaaaagacttcaacactaataaagtagcactaaatgaaatctttccagcattacaagatgcttacgcccaagtataccctgaccttgatataacctttgacgaaaataaggtaaacgaatttaaaacagtcctattaaacgaaaaagcaacaccatctgatacgcaaagagctctagtaaatctacttctcgccgaggatggcgataaagatatactaaaacaacaaaagcaagtcttgacagaatttgcaaaagcagtagttggcctaaaaacaaagctaaatgtagcactcggaactgaagtcgactcatctgaagccaccgtatggaacttttcattaggacaactcgacgataaatgggccggaatcgaatccgctatgacggatgaaggtactgagattctagatcaaattagggatttatatcgggctcgtttattaaacggaatagtaccggctggcaaaacattaagtcaagcaaaagtcgatgactacgcacaacatcacgaagatttagaactgtttaaagattacctaaaacaactcgaagatgatggaacagccaaggcaataagacaactgtacgataggtacatagatggcgatgacgcaaaaccctttgtaagagaagattttgtcaaagcattaaccaaagaagtcacagcccatccgaacgccaagtcacctgaactactggaaagactagcacaaccagactttatgctaaaacaaaggaataaagcaaacggagccataccagtacaaatgcaacaacgagaactcgaccaaataatcaaaaaccaaagcgtgtattatgattggcttgcagcaccaaatccggtagagaagcacaggaaaagcatgccatatcaactcgatgaattacttaactttagaataccatattacgtcggaccattagtcaccgcaaaagaacaaaaagcagctcaaggaggagtattcgcatggatggtgcgaaaggaccccgatgggaatataacaccgtataattttgatgaaaaagtcgatcgggaggcaagtgctaacacctttatacaaagaatgaagacaactgacacatatctgataggagaagatgttctaccgaaacaaagcctactatatcaaagatacgaagttttaaatgaattaaataatgtgagagtcaacaatgaaaagctatcaattgaacaaaaacaacaagtcatacgagaattattcgaaagacacaactcagtaacgataaaacaattcgcggaaaatctaagagcacacggagactacgcacatatcccagaaatacgaggactagcagatgagaaaagattcctatccagtttaagtacttatagacagctcaaatcgctcttacctgacgctatagatgatccagccaaacaagcagatatagaaaacataatagcatggtccacagtattcgaagatgcagcgatatttaaaacaaaactgaaagaaataaactggctcgattctcaaactattactaaattatcaaacattagatatagaggatggggtcagttttcacacaaatttctaaacggattgacattaggtaatggtcacactataatacaagaattattcctaagtaacaataatctaatgcaaatattgacggacgaaacacttcaaaagaaaatgactgaactaaacgcagataaactaaaagccgccaatataaatgacgcaatagatgacgcatacactagcccttcgaataagaaagcactacgacaagtcttacgcgtaatagaagatataaaacgcgcagcggatggacaagatcctagctggctatatgtagaaaccgcggatggtggcggtacccctggaaaaaggaccagagcaaggcaacaccaattacaagaaatctatgccaacgccgcacacgaactcattgacagcgccgttagaggggaactagaagataaaatcgctgataaagcagattttaacgaccgcttagttttatatttcatgcaaggaggacgcgatatttacacaggcacaccactcaatattgaccaactctcgtcctatgatattgaccacatcctaccacagtctctaatcaaagataattcactagacaatagagtcctagtacatgcaataatcaatcgagagaaaaacgccacttttgcttctaccatttatgcacagaaaatgaatgcaacgtggagacaatggcacgaagccgggctaatctcaggacgtaaattacgaaacttacaaatgcgtccagatcaaatagataaatatgcatcaggattcgtagcacgacaattagtggaaacacgtcaaataataaaactcaccgaacaaattgtcgctgctcaatacccagaaaccaaaataatagccgtcaaagcaggcctaagccaccaactaagggaagagttagaatttccaaagaatagagacgttaatcattaccaccatgcattcgatgcatttttagcagccagaattggaacgtacctacttaaaagatttccaaacctacaagcctttttcacctacgggaaatttaagaaagcagatgtaaagaaactacgaggtttcaattttataagagacataacacatgcagaagacaaaatcgtcgttaaagatacaggagaagtaatatgggacaagaaaagagatgtagatgaactggatagaatctacaactttaaacgaatgttaataacgcacgaagttcacttcgaaaaagcagatctgttcaaacaaaccgtttacggagcaaaagatagcaaagaggccggtggaaagaaacaattaattagcaaaaagaaaggttatcccgtagacatctacggcggatatacccaagaaacaggatcatacttaagtgtagtacgcctaaccaagaaagcgatgtacgcggtcgtaaaagtcagtacacgagatgcagcaaaattggcagttgcaaaatcaatatcagagcaaaaagaaaatgaaaccctaaatgatattatagatgaaaaattatccaaaataagtaaaaatggcaaaatcacacatgaattattcgaagtagttctcccccgagtaggacagaaaacattatttaaaaatagcaaatacaaccttttcctagtaaattcagacacatacatgcacaactaccaagaactatggatgccccgagaataccagaaaatgtggaaagacatttccttaagtaaatacggtgatgcacaaaccgaagatcaactagatcaaatctttggtttcatagtctcacaagttaattcatatttcaatctatatgatatcaatcaatttcgaaagaaattaaatgacgccgctgataaattcgcgacactacctatgcgcgacacagatgatatgcaaggaaaaatagccacaattggccaactacttatcggattgcaagctaacgccgcccgatcagatcttagaaatctagacattaaaaccccactaggactgttacaaattccaaacgggatatcacttgactcagatacatctgtagtgtaccaatcaccaacaggactcttagagagagaagttcacttaagcgacctatga

SEQ ID NO: 8862 - RNA, 4086 nt, synthetic construct
  misc_feature 1..4086: note = Cas9 variant
  source 1..4086: mol_type = other RNA
atgaagaaaccctattccataggcttagacataggcacaaattcagtaggttggagcgtcgttacagatgattacaaagtaccagccaagaaaatgaaagtactcggaaataccgataaagaatatatcaagaaaaatctgattggcgccttgttattcgattcaggtgaaacggcagaagcgactcgaatgaaacgaacagcccggagaagatacactagaagacgaaatcgtatcctatacttacaagatatattctcaccagaactaaaccaagttgatgaatcatttctacacaggctcgatgatagttttcttgtagcagaggataaacgaggagaaaggcacgttatcttcgggaatattgccgatgaagtcaaataccacaaagagttcccaacaatctatcacctgaggaaacacctagcagattcaagcgaaaaagccgaccttcgacttgtctacttagcattagcacacatcatcaaatataggggacatttcttaatcgatgaacccatcgatatcagaaatatgaacagtcaaaatttgttcaaagaatttctcttagcattcgacggaatacaagtagattgttatttggccagtaaacataccgacatatctggaataataacagccaaaatatcaaaatcaagaaaagtagaagcagtcctagaacaatttcccgaccaaaagaaaaattcattctttggaaatatggtttcgttagtatttggactcatgcctaactttaaaagcaatttcgaactagatgaagacgcaaaactacaattttcgcgagacagttatgatgaagatctggaaaacctactcggcattatcggtgacgaatacgcagacgtattcgtagccgcaaagaaagtatacgatagcattttgctttccggaatactaacaactaataaccatagtactaaagcgcctttatcagcaagcatgatagatcgatacgacgaacacaatagcgacaagaaattacttagagacttcataagaacaaatataggtaaagaagtattcaaagaagtattttacgacacaagcaaaaacggatatgcaggatatatcgatggcaaaaccaatcaagaagacttttataaatacttgaaaaatctattacaaaaagttgatggaggagattatttcatcgagaaaatagaacgagaagactttctgagaaaacaaaggactttcgataacggaagcattcctcatcaagtacatcttgacgaaatgaaagcaatattaagaagacagggagaattttatccatttttaaaagaaaacgcagaaaagatccaacaaattttaacgtttaaaataccttattatgtaggacctctcgctcgaggaaattcacgctttgcatgggcaagctataactcaaatgagaaaatgacaccttggaatttcgacaatgttattgacaaaacgtcatcagcccaagcattcatcgaaagaatgacaaacaacgacctgtatctcccagatcaaaaagtgttaccaaagcacagcctattataccaaaaattcgctgtttataatgaactaaccaaaataaagtatgtaaccgaaaccggtgaagctagactattcgatgtttttctaaagaaagaaatatttgacggtttatttaagaaagaaagaaaagtaaccaaaaagaaaatattaaacttcttagacaaaaacttcgacgagttcaggatcaccgatatacaaggattagataatgaaactggcaatttcaacgcatcttacggaacatatcatgatttattaaaaattattggagacaaagaatttatggatagttcagacaatgtagatgttcttgaagacatcgtcctatcactaactttattcgaagaccgagaaatgatcaaacaacgtctattgaaatacgaagacatattcagtaagaaagtaatagccaacctaacacgacgacattacacgggttgggggagattatctgcaaaattaataaacggaataaaagacaaacattcaagaaaaactatcctagattacttaattgatgatggacactctaacagaaacttcatgcaattaataaatgacgacaacttaagttttaaagacgaaatagcaaactcccaagttataggggatggtgacgatttacatcaggtcgtacaagaattagcaggcagtccagctataaagaaaggcatactccaatctctcaaaatcgtagatgaattagttaaagtcatgggttacaatccagaacaaattgtcgtcgaaatggccagggaaaatcaaacaacagctagaggtagaaacaactcacaacaaagactagggagcttaacaaaagctattcaagactttggatcagatatcctaaaaagatatccggtagaaaataatcaactacaaaacgaccagctatatctatactatctacaaaatggaaaagatatgtataccggagacactcttgacatacataacttaagtcaatatgatatagaccacataataccacaaagtttcataaaagacaattccctggacaatcgcgtcttaaccaattcgaaatcaaatcgaggaaaatctgataacgtcccaagcaatgaagtagttaaaagaatgaaaggtttctggctcaagcaactagatgctaagctaatatctcaacgtaaattcgacaatctaactaaagcagaacgtggaggactgtcagctgaagacaaagcaggctttatcaagagacagctagttgaaacaagacaaattacaaaacatgtagcacgaattttagacgaaagatttaatcgcgattttgacaagaacgataaacgaattagaaatgtcaaaattgtaacactaaaaagcaatttagtttccaactttagaaaagaatttggcttctataaagtcagagaaataaacaactttcaccatgcccacgacgcatatctgaacgcagtcgtagcaaaggctttactaataagataccctaaactagaaccagaatttgtatatggcgaatatccgaaatataactcttatcgagaaagaaaaagtgctacagaaaagatgttcttttattctaacataatgaatatgttcaaaactactatcaaactagcagacggacgagtagttgaaaaaccagtaatagaagccaacgaggaaacaggagaaatcgcgtgggacaagaccaaacacttcgcaaatgtaaagaaagtactctcctatccacaagtctcaatcgtcaagaaagtagaagaacaaactggtggtttcagcaaagagtccatattaccaaaaggaggaagtgataaacttatcgcccgaaaaaccaaaaataactacttatccacacaaaaatatggtggttttgattcaccaacagtagcatactcaatcatgttcgtagcagacattgaaaaaggaaaaagtaaaagactcaaaacagttaaagaaatgataggaataacaatcatggaaagatcacgcttcgaatccaactctgttactttcctagaagaaaagggatatagaaacatcagagaaaataccatcattaaattcccaaaatattcactgtttgaactcgaaaatggccgaaggagactcctagcaagcgccatagaactacaaaagggtaatgaaatgttcctccctcaacaatttgtcaacctattatatcatgcacaacatgctaataaagaggattctgtcatatacctcgagaaacaccgccacgaattgtcagaattgtttcatcatatcataggagtctcggagaaaacaatactaaaaccaaaggtagaaatgacactaaatgaagcatttgaaaaacactttgagttcgatgaagtaagcgaactagcacaatcttttatatcattactcaaatttactgcctttggagcccccggcggtttcaaattcctagacgcggacattaaacaatcaaacctacgataccaaacagtcacagaagtactatcatcgactctaattcaccaaagtgtgacaggattatatgaaactagaatagacctatccaaactaggcggagaatga

SEQ ID NO: 8863 - RNA, 4086 nt, synthetic construct
  misc_feature 1..4086: note = Cas9 variant
  source 1..4086: mol_type = other RNA
atgggaaactattatttagggctagatatcggaacaaacagtgtaggttgggctgtaacagacgaaaactacaacatagaacgattcaaaaagaaaaatatgtggggaataagactattcgacgaagctaaaactgcagaatcaaggcgcatccatagacaagcaagaagaatgagacaaagaaaaatccaacgactaaatttactaatggagcttttcgatgtagaaatatcaaaagtggacgaaagctttttcattagaaaaaaagagtctgatcttcactacgaagataaaagccaagattcacgatacgctctattcaatgataaagaattcaacgacaaggactaccataacaaataccccaccatattccatctcataatggacctaatagaaaacgatgaaaaaaaggatattcgactactgtatcttgcatgccattatttaataaagaataggggccactttatattcgaagggcaaaaatttgacgtcaactcaagtttaaacaataacattaataaactaaagtcacatctagatcaattctacaacatatgtctggacttcgataacgataaactaattgagattttagtaaaccaaaacctaaatatctcagaaaaaagcaaaaaaataaaagaattactcagaaaaacaaaccttgaagttggcattgcaaatctaattgcggggggatcgataaaacttagcaacatgtttgatgatgacgagctaaaaaacttagactacaactcactctcatttaaaaactcgaactttgatgaaggtagagaactctttgaggaagtattagaagaccgatttgaactagtagaaattctgaaagacatacatgatgcaagcgttttagagacaatgctgagttcagcatcaatctctccagacggcggaaaatacatatcctcaagcatgatcaacagttacaacaaacacaaaagagacttaaaacttctaaaaaaaattataaaaaaatataaaaaaagcgaatatgacaacatctttagggacgaaaatatcaaaaacaattacctatcctacacacgtaccggaataaacaaaaataaaaaagttcaagcagaagataacacagatagtgacggattctataaatacattgttaaaatcctaaaagacataaaagaaaacgatagcgatgaagacattaaatacatactatcggaaattgacaaaaaaaacttcgtaccaaaacaacgaaccaaagaaaactcagtcataccataccaactcagagaaatcgaactcagaaagatcatcgataaccaaagcaaatatcacaaatttctaaacgaagtagacgaaaaaggcatctcagtaaaagagaaaattatatctttgttgacattcagaatcccatactacattggacctctaaaccccagctacaacgaagagaaaaactttacaactagttgggtgaaacgtctagcaaaaggaaaagtaacaccatggaacttcgaagacatggttgatatagatgcaagccgcgaggcttttatagaaaacaaactaaacaaatgcagcttcctattagacgagaccgtactaccaaaagactccttactataccaagagtacatggtactaaatgaactaaacaatctaaaaatcaatggccagtctataaatacagatctaaaaaaatccatatatgaagaactgtttaaaaaatacaagaaagtaaccagaaaaaggttaatatcatatataaaagagaaagaaaatatgtccggagacatagtaataaccggtatagacggagacttcaaacaaggactcaaatcatacattgcctttaaagatataataggagaaaaaatagatgatgacatatacagaaaagaagtcgaaaaaataatacgcgatatatcgctatatggagacgacaaatcattcatacaaaaaaaaattaagaacgaaaacaaattggaccttagcgacgaccaaatatcaaaaatagcaaaactcaaattcaaagactggggcagattttcaaaaaaattattagtcggaatcaaagccagtgacaagaatacgggcgaaattgacaacataataggcttcatgagaaattacaactataacataatgcaattaatggcaaatgtttttacattcaaggacgagatagagaaattaaattctaaatactatactgatgaaaaaatcaacatcgattatctagatgacctatatctatcatcgccagccaaaagaatgctttggcaatcattccaaatcgttgatgaaatcaaaaacataaaaaacagcgatccaaaaaagatatttattgagatggctaggtcaaaagaagacaaacctactagaaaaatgtccaggaaaagtagactagaaaagttatacaccgactcaaaaaaacaattcataaaactattcggacccgacgagtacgacaaactaaataacgaaataaagaacaaaagcgaatccgacttccgttgggataatctgtatctctactatacacaatttggcagatgtatgtacagcttagaccctattgacctagaagaactgtccaataaaaatctctacgatcaagaccatatatacccaaaatccaaaatctatgacgatagtatcgaaaacagggttctcgtaaaaaaacagctaaacctagacaagagcaacgaatacccaataccggatagggttctaaacaaagataaaaacaaactactagcgttctggaaaatgcttaacgaaaaggagctgataggcgacaagaaatatgctagattaatacgtaaaagcccatttactgatgaagaattaggagactttattgcaagacaattggtcgagacaagacaggccacaaaagaaacagcaaacatgctgaaaagactatgcccagactcaaagatcgtatacgtcaaagcaaaaaatgtctcagactttcgccgcaaatttgatatattaaaatgcagatccattaatgatttacatcacgcacatgatgcctacttaaatatagtagtaggcaatgtattcgacacaaaattcacaagcaacccgcttaattttataaaaaataattctaaaaataggtcgtataatctagaaaaaatatacgactacgatgtaataaggaacgaaaaaatagcatggctagccgaaagaaaagaagaaaatcaagatggatcaatagcaacagttctaaaaaacctaagtaaaaacgacataagagtaacaagaaggacatacataaaatgtgaagatctattcgatgaaaatatcgtcaggaaggggaatggcaaattcccgataaaagaaaacaataacaaatcggacacgaacaaatacggaggatacagtggaattaaaaatgcttacttcgtcttactggaggatgaaaagcacaaccgtatcctcgaagccataccatccttcatatacaaaaaagaaaagaacggagagaaagggagcgtgatcaattacctgcagaacatcctaggaataaaatccgcaaaaatactgcgagacaaaattaaaatcggatcactactaaaaatcgataaatttccatacaacctagcaggaaaaagcggaaacggaatactcatctccggaggtgtccaactaattttagataaaaacacttctaaatatatcaaaaagatcgaaaattacaaatataaattagacgaaaacaaagattatcaaataaatatatttgacaaattatcaaaagaagaaaatatcaaactatttgacttgtttgtagacaaatttgaaaatagcatatataaaaacagagtaaacattaaattaaaagaaataaaactagcaagaccaaaatttgaacacttaagcatagaagaacaaataaaaaccctaacccaaatgcttatactattcggacgagaaaacaacgccgtcaacctcgaatacatcggactaccaaaaaacacaggaaagacaaaaatcaataaaaaaattaacaacaaagatataaaaataattaaccaaagcataaccgggttatatgagacagaagaagatctcgcaaacatatga

SEQ ID NO: 8864 - RNA, 4086 nt, synthetic construct
  misc_feature 1..4086: note = Cas9 variant
  source 1..4086: mol_type = other RNA
atgactaaacttaatcaaccatacggtatcggtctagatattggatcaaattctattggctttgcagtagttgacgcaaactcacacctacttcgcctaaaaggagaaactgcaatcggggcaagactatttcgagaaggccaaagtgccgctgaaagaagagaatcacgaacaacacgtaggagactatcaagaacacgatggcgactaagcttcctcagagatttctttgctccacacataaccaaaatagatcctgacttctttctacgacaaaagtattcagaaatctcaccaaaagataaggataggttcaaatacgaaaaaagactttttaatgacagaacagatgccgaattctatgaagactatccctccatgtaccacttacggctacacctaatgacgcatacgcacaaagctgacccacgcgaaatatttctagcaattcatcacatattaaaatcacgaggacattttttaacaccaggagctgccaaagactttaataccgataaagtagatctagaggacatcttccccgcacttacagaagcgtacgcacaggtatatccggaccttgaacttacatttgatcttgctaaagcagatgactttaaagccaaattactagatgaacaagctaccccttcagatacccaaaaagcattagtgaatctcctattatctagtgacggtgaaaaagaaatcgtaaaaaaaaggaaacaagtattgacagaatttgcaaaagcaattacaggccttaaaacaaaattcaatctagcacttggtactgaagtagatgaagcagatgctagcaactggcaattttcaatgggtcaactagatgacaagtggtcaaatattgaaacatcaatgacggatcaaggaactgaaatatttgaacaaatacaagaactatatagagctagattattaaatggaattgtaccggcaggaatgtccctctcacaagcaaaagtggcagactatggccagcataaagaggacctagaattattcaaaacgtacctaaaaaaattaaacgatcatgaactagcaaaaacgatacgtggtctatatgatagatatataaatggcgacgacgctaaaccgttcctacgagaagactttgtcaaagctttaaccaaagaagtaacagctcatccaaatgaagtatcagaacaattgctaaaccgaatggggcaagcaaacttcatgctaaaacaacgaacaaaagccaatggagcgataccagtacaactccaacaacgagaattagatcaaataatagcaaaccaatcaaaatactatgactggttagccaaaccaaatcccgtagagaaacatcgtgcatccaaaccttaccaactagacgaattactcacatttcgcattccttactacgtaggtccattaataaccccgaaagaacaagcggaaagccgggaaaacgtttttgcatggatgataagaaaagatccatcaggcaacattacaccctataattttgacgaaaaagtagactgtccagcttccgcaaacatgtttatacaacgaatgaaaaataccgacacatatcttatcggggaagatgttctcccaaaacgcagcttattatatcaaaaatacgaagtactaaacgaattgaataacgtcagcatagatggaagaagattaggtgcggatcaaaaacaaagattaataagggaagttttcgaacgtcattcttcggtaacaataaagcaagtcgcagaaaatttagttgcccatggggactttgcgaaacgaccagaaattcgcgggctagcagacgaaaaaagattcttaagctcactttcaacttaccaccaactaaaaaaaatcctacatgaggctatagatgacccaactaaagaacacgatatcgaaaatataataacatggtcaacagtcttcgaagatgctgcaatattcaaaactgaactggcaaaaatttcctggctagactcagatacaataaaagcactatcaaacataagataccggggttggggacagtttagtcgcaagttgctagacggcttaaaactaggcaacggccatacggtaatacaagaattaatgctatcaaaccacaatctcatgcaaatactaaccgacgagacgttaaaaacaacaatggcagaactaaaccaggacaaattaaaagctgacgacattgaagacgtcattaatgacgcctacaccagtccaagtaacaaaaaagccctcagacaagtccttagagtagtcgaagacataaaacatgctgcaaacggccaagatccaagctggctctacatagaaaccgctgacggcccaggaaccgctggtaaacgtacccaaagtcgtcaaaagcaaattcaaacagtttacgcaaacgcggcacaagaattaatagactcagccgtaagaggagaacttgaagataaaatagctgacaaagcaagcttcaccgaccgtttagtactatacttcatgcaaggcggaagagacatctacacaggcgctccacttaacatagaccaattatcacactatgacattgatcatatcctcccacaatctctcataaaagacgattcacttgacaatagagtgctagtaaatgcaactataaatcgtgaaaaaaataatgttttcgcctctacattattcgcatcaaaaatggcagcaacttggcgaaaatggcatgaagccgggctaataagtggcaggaaactccgaaatctaatgcttagaccagacgagatagacaaatttgctcatggattcgtagcacgacaacttgttgaaacccgacagattattaaattaacagaacaaattgcagcagcacaataccctaacactaaaataatcgccgtaaaagccggactatcacaccaactccgagaggaactagattttcccaaaaatagagacgtaaatcattaccaccatgcattcgacgctttcttagcagccagaatagggacatacctattgaaaaggtatcccaaattggcacccttctttacatatggagaatttgcaaaagttgatgttaaaaaatttagggaattcaacttcataggagcattaactcacgctaaaaaaaacatagtggcaaaagacaccggcgaaatcgtatgggataaagaaagagacattcaagaattggaccgcatatataacttcaaacgaatgttgattacccacgaagtctactttgagactgcagacttattcaaacaaactatatatgcagcaaaggatagtaaagaaagaggaggatcaaaacagttgatccccaaaaaacaaggttatcccacacaagtctatggaggatatacaagagaaaacaccgcatatttggcagtagtaaaaacagtcgaaaaaaaagcagacgtctacagagttgttcgaatcgctacgtcccaagtcgccgcactaaaggaggcacgtgcccaatcaacagtaaaagaaagagaattattaaaaaaatttctaactacaaagttcacaaaaataggaaagaacggaaaaaaagcaatcactcccttcgatatagtcataccaagagtacctagggaacaactattccacaacaaaagatacggattttttatggtaaacagtgatacactaatgcacaactaccaagaactatggatgagccgtagtgaccagcaaatactatcaaaactagtcaaaagtgccaagaccgtagagaacggacaagtgggaagattatttgaaaacatagtagaacaaatcaacaaatatttcccactgtatgatattaaccaatttagaaaaaaactagatcaatccaaggatatcttctcaaaactaccattagaaggaaacggaacaacatcaggaaaaagagaaacaattcaaaacatattaacaggtgctggcacaggagcaaaaaacggagatctaaaaaatttaggaataaaaactccgtttggatttctccaggttccatcaggaatagtgctagatgacgacacaactttaatataccagagtcctacagggatgctaaaccgaatcgttagattgtcagaattatga

SEQ ID NO: 8865 - RNA, 4086 nt, synthetic construct
  misc_feature 1..4086: note = Cas9 variant
  source 1..4086: mol_type = other RNA
atgaaaaatgaagaaaatatatatttaggtttagatataggtacagacagcgtaggatatgcagtcaccgacgacaaatataaaataatgaaataccacggaaacgccgcctggggatcgaccatatttgatgcaggagccttaggtgcagatcgaagagtattcagatccgctagaagaagattagacagaagacaagaacgaatacaattattacaagaaatatttgctaatgaaatagccaaagtagatgaacgatttttcatacgactattggaatcaggtctatggcgcgccgatgcagaagacagatatgtgttcttcaatgacaaagaatacactgacgtacaatatatgagagactatccaactatacatcatttaatatgtgaactaatatataatccaaacaaacatgatgtacgattagtatatctagcatgcgcatggttagtaacacacagagggcatttccttagtaacatcaatacagaaaacatagcagacttagtagacatacataacgtatacaatggtttcatgagattctttgaagaaaatgaaataatttgtgattggagagaagtaaacgttgaagaattaggcagagtactagcagcgaatatcggtataaatgaaaaataccgaaacctcagcactgtcctattcgcaacccgaaaaccagacaagaaagccaaagaaggcttcccttacagcgaagatgcgatagtccgactgttggcaggcggaacatgcaaattaaaagatgtttacattaaagaagaatacgatgaatttggatcaatcactctgggaatggatgatgagaaaatgacggaaataatggcagacataggagacgacttcgatctaattaaagccctcaggtctctatatgattggggtatcttagcaaacatattagtcaatgaaaacaattcaccactaatatcacaatcgaaagttaaagtttacgaacaacatagagaagacctcgccaatctcaaatatctagtacacaaatacatccctcataaatacaatgaaatttttcgcgaaattcgaggcgacaactacgtagcatactcgtatcattatgaactcaaaaatgatgagaaaatgggtaagaaagctgatgtagaaaaattttctaaattcctgctaaaaatattagaaggaataagcgtagatgaacaagataaagtcgtatatgataatatgatagaaagattaacactaaggttattcctgccaaaacagaaaaatacagataaccgggtaataccacaccaactatacgaatatgaattaaaaagtatactcaaaaacacgaaaaattacttaccgttcttaaaagaaaaagactcggacggcatctcaaacgaagacaaaataataagcatctttaaatttaaaatcccatatttcgtcggcccattaaactgtaactcacaatttgcttggatacaaagaaaagcggatggcaaaatatttccttggaactttgaagataaagttgacttcgacgcaagcgaacaagccttcatacaaagaatgacaaaccaatgcacttacttaccagaagaatcagttctacccaaacaatcactgtactatcaaaaatttatggtattaaatgaaataaacaatatcaaaatcgatggtcgcaaaatttcagtcgcaatgaaacaagaactatacaacgaaatatttgaaaagaagaaacgagtaagaaagaaagacgttatagacttctttgtatcaaatggttacttagaaggaggcaaagaggctttaataagcggtttagatgaacaaatacacactaatctaagtagcttccatgcattccgacgcttactacagaatcacatactatcagtagaagacgtagaaagcattatagaaagagcgagctattcagatgacaaaagacgtgttcttttatttctcaaaaacaaatattcttttctgaccgatgaagacatcaaatatatttgcaaaataaaaatcaaagacttcggaaggctaagcaagaaattcttagtagacttcgaaggaacatgtaaggaaacaggagaaatttcaaccgtattaagattaatgtgggaaacaaacaataatctaatggaactactatccgataaatacacttttgctaatggtataaaagagaacaggaagaaatattatacagaacaacagaaaaccttagacgaccgactggatgaaatgtatatctccaacagtgtaaaaagaaccatatatcgtactctaagcgtggttaaagatgtaacaaaagcctttggggttcccaagaaaatatttgtagaaatggcaagaacaaataacccagacctcaaaggaaaaagaacaagaacgaggcaacaacaggtcatagaattatacgcaaaatgtgatgaagaagacgtacgggaattgaaacaccaaatggaatcattaggagagtacgtagataacaaactacaaagcgacaaactttttctttactttatccaattcggaaaaagtgcctatagtgggaaaatgatagatctagaaaaattaatgtcaggctcaaaagtttatgacatcgaacatatttatccccaggcttacgtcaaagacgactcaatcataaacaataaagtgctcgtattctcagaagaaaacggagcaaaacaagacatttacccaataaaaacagaaataagaaaacaaatgtctggaatatggactacatggcaccacgtaggagctataagcgacgaaaaatataaaagacttacaaggagcacaccttttaacgaagatgaaaaatatggatttattaacagacaactgactgaaacatcgcaatccaccaaagcaattgctcagatattaaacgaaaaatatccggaaacagaaatcgtatacgttaaagcaggtttagtaagcgatttccgacatgaatttggtttatgcaaatgcaggtcgtacaacgacctccatcatgctatagacgcatacttaaacgttgtagttggcaatgtctataacatgaaattcaaccgtaaatggttctccgtagattcaaaatattcaattaagacaaaaacaatatttagccatagtttagtatgcaacggtaaaataatatgggataaagagaaaatgttacccatggtactgaaaaacgcgaagaaaaataatgcccattttaccaaatatcaatttatgaaaactgggggattctttgaccaaatgccttgcaagaaagcaagcggtctagtccctaggaagaaaggactagataccgaaagatacggaggctacaataaatcaggaattatgtttttaacaccaatgcgatataaaataggaaagaaatcagatattataatactaagtattgaattattatatggcaaactcttcttaaaagatgaagtatttgccaagaaatatgcagaagaaaggctgcagaaaataattggcaagaaagccgatgaagtaagtttcccaatggggatgaaaccgtggaaaattaataccgtcttatcacttgacggatttaacgtatgcatcacaggaatcggcggcgggggtaaatgtttatccgctcaaccaattatgcaattatctttaccgtacgagctcgccaaatacctaaagaaaatagaaaaattcgtagagaaaaataaaaataatgcaaactatatttatgatgaacaatacgatagcgtatcagtcgacgaaaacataaaattatacgacgtttatctagacaaattagaaaattctatctacaataagagaatcaattcaccagaagctatactaaagaatggacgagaaaaattttgcaaattaaacgtacttgaacaagccgtcaccctcataaacatacaaagcatattcggcaggatgacgggaggatgcgatctggaaaacataggtggtaaaaagcattcagcagcaactgtaaacttctcgagcaacgtatcaaattggaagaaatactataacgacgtaagagtcgtataccaatcaccgagcggtatctgggaaagaaggagtcaaaacattttagaattattatga

SEQ ID NO: 8866 - RNA, 4086 nt, synthetic construct
  misc_feature 1..4086: note = Cas9 variant
  source 1..4086: mol_type = other RNA
atgaatgaaccatatggagttgggcttgatattggaaccaactcagtaggttggacagtagtagacatgaatggcagagtacgaaaggtaaaagggaaaacggcgttaggggctagattattcaaagaaggcgctactgcagaagacagaagaggattccgaacaacacgaagacgactaaagcgtgtcaagtggcgtctcagattactccgtgaattcttcgatcaaccaatttcaaaaatagatccaaactttttcgcaagaagaaaatactccgatataagccccagggaccctaactacaatggactggctaagacactctttaacgatagaactgacaaagagttttacgacgactatgcaacaatataccatctaagagacaaactcatgacatcgaaccgtaaatttgatataagagaaatctatctagctatacaccacatcgtaaaatacagaggtaattttctacgaactggtcctgcgtctcaatatggatcagcttcgttacacctcgctacatccttccaaaaactaaacgatttattcgcccaatccgaggaaacactaaatttaaaactagtaactgatgaggctctacttcagcaaatacaacaaattttagtacgcaccgatctaagcaggtccgagcagcaaagacaaatctggccgctaatggcagttctaacaggagcaagcgctgcagaaaaaaagcgccaaaaaaatgtagtagtggaactatctaaggcattagttggattaaaagcaaaaatgaacgtcgttacactaacagaagtagatgccgcagtagtaaaagactggactttcaccatggaagagagtcaagataaattaccggaaattgaagaacaactcagtgaagtcgggcaacaaattatggacgaagtcatacaattatacgcatcagtaaacctagcacaactaatccctgcaggcaaacgattcagccaacacatggtagaaaaatataaacatcatgaaaaaaatttagaattactcaaggcttacattcatagccaatcagattcaaaacgtggaagagaaatccgagctacatatgacagatatatagatggagtagattctaaaccagtaacacaggaaatgttttataaggacttaatgaaatatgtcgaagctgacgcaacatcaaatcacttagctgcagaaataaaggacgaaattgactctgaacagttcatgcccaaactacgaacaaaacaaaacggatcgattccttaccaagtacagcaatacgaactagaccaaatcatatcccaccaaaaaaaatattatccatggcttggagaagagaaccctgttgcagaaagaaggggaaaatttccctacaaacttgatgaactagtaggcttcagagttccttactacgtaggccctctcataacaaaagaagaccaacaagccacatcaggggcaggattcgcttggatggtacgtaaagccgacggccccattacaccctggaacttcgatcaaaaagtcgatagaatagcttcagccacagcatttatccaaagaatgcaaacaacagatacatatctaattggggaagacgtgctaccagcaagatctctaatctaccaaagatttatggttttaaatgaactaaacaacatgagggttgaagaccgaaaactcgcaccccaacaaaaacagcgactatacaaccaagtatttaaacagcaccaacacgtatctgtaaaaaatatacaacaaaaccttatggacgccggagaataccgaaaaacaccccaaataacaggacttgcggatccaaaagggtttaattcatccctatcgacgtaccatgatttcaaaaaaatactcttagaagcaatagctgacgaacataaacgtgctgacatagaaaaaataatattatggtcaacaactttcgaagatagtgccatttttaaacaaaaattggaagaagtagcatggctcacagatgcccaaagaaagcaactctccggcctaagatatcgaggctggggacaattatcacataaactattaaccgcttttaaagacgataaagggcgctcgataatggatgggttatgggaaacatcagataactttatgcaactccgaaaacaacctgcaatagaaacccaaataaaagaagctaaccaagcaaatctaacagatgccgacatacaagacacaattaacgaactttatacaagtccacagaacaaaaaagcaattagagaagtcatgttagttctggatgacataaaaaatgcgatgcatggacaaacaccttcctggatatttgtagaagcagcacgcggaggcggagtggcaggtagaagaacacaatcacgaagctcacaaatagtagaagcttacaaaggtaccgcaaaagaaattgtctcagagaaagtacaacatgaactaaatgaaaagatcaaagcaaaagcggacttcaacacaagactagtattatattttctacaaaacggaagagatctttatactaatgaagcaattaatattgacaggctctctgaatacgacatagatcacatattgccacaatccttagtcaaagatgacagcctagataacagagttctgactagtgcaagaatcaacagagaaaaaaacgatacatttgcatcagaaaaatttggacgaaagatgggcgctcaatggagagaattgcacagaaatggactaatgacacaaagaaaattaaaacacctattaatgagaccggacgagatctcaaagcatgcaacagacttcataaatcgtcaattagtggaaacacgacaagttataaaacttgtagaagaactgatcagtagtgaatatccggcagcgagtattgtcgcagtaaaagcaaacttgacccatcaatttagacaaacatttaacttcccaaaactcagagaagttaacgactatcatcatgcatttgatgcaagccttactgccttcattggcatgtatttacttaaacaatatccaaagctagaaaggttttttgtctacggaaaattcgcaaaacagcccataaatttaactcgcttcaacataatacgaaaactcgcagtagcagagaaaccaatagcgaatatagaaacaggcgaaattctatgggataaaacagcagatatcaaatactttgaaaaattgtacaactacaaacgattactagtcactcatgaggtaagggaaaattacggcgcaatgtttaaacaaacactattcaaagcaagttacaacaaatccaaaacactcgtaccaaaaaagaatcatatggaaacgtctgtatacggaggctactctaatcaagagaccgcttaccttgcaatcgtcagaataccttttaaatcaggctttaaattcatcgtagtagggatacctacaagaatggtagcaaaaatcaagcactatcaatcactaggagcaacactaaatcaagcaacacacaaagtaatcgaaccaaaatttacaaaaatctctcgaaaaacaaaacaaaccgtaataagtgactacgaagtagttctaccaaaagtatacttggaccaagttgtgagagatcaagtcaagggacaaatgtatagatttagcctaggatcagacaaagaatatcacaacgtacaggaattgtacctgcccttatcaatacaacaagcctttgtaggtcattatgatgaatcggatgaccaaagatcgaatgatctagtgaaagtctacgacgcagcactaaaacaattacaacgatacttccccttacatctttcacgaaactttgaccaagtcgcttcacaagcccatcagagcttcgaagggttaaaaaataacgtacaaacctcagacaaacaactaggcaagaaagaagtactaaactctttatttgtaggactacatgcgaacgctacgagaagcaacctaagcgtattaggtatgtcaaaagatttcggacgaataaaaagcaatggtataactctaacagatcaagcagaaattatttaccaaagtcctaccggattattcgagagaaaagttgctttaaaagatttgtga

SEQ ID NO: 8867 - RNA, 4086 nt, synthetic construct
  misc_feature 1..4086: note = Cas9 variant
  source 1..4086: mol_type = other RNA
atggggaattattaccttggtctcgacatcggcacaaattcagttggatgggcagtaacagatgaaaactataatatcgaacgattcaaaaaaaaaaacatgtggggaataagactctttgatgaagccaaaacagccgaaagccgtagaatccaccgacaagcacgaagaatgagacaaagaaaaattcaacgattaaatctactaatggaacttttcgacgtagagataagcaaagtcgatgaatccttcttcataagaaaaaaagaatccgatctacactacgaagacaaatcacaagacagccgctatgctctctttaacgacaaagaatttaacgacaaagactatcataacaaatatccaactatatttcatctaataatggatttaatagaaaatgacgaaaaaaaggatataagactactatacctagcatgtcattatttgattaaaaacagaggacattttatcttcgaaggacaaaaattcgatgtcaattcatcacttaacaacaacataaacaagttgaaatcacacctagaccaattctataatatatgcctagacttcgacaatgacaaacttatcgagatattagtcaatcaaaatctcaatatatccgagaaatcaaaaaaaataaaagagctattaagaaaaactaacttagaagtaggaatagcgaacttaatagcaggcggctcaataaaattatcaaatatgtttgacgatgacgaactaaaaaattttgactacaatagcttatccttcaaaaactcaaatttcgacgagggaagagaactttttgaagaagtactagaagatagattcgaattagttgaaattctcaaagacatacatgacgcgtcagtcctagaaacaatgctatccagcgcaagtatctcacccgacggaggcaaatacatctcatccagtatgatcaactcatataacaaacacaaacgagatcttaaacttctaaagaaaataatcaaaaagtataaaaaatctgaatacgacaacatcttcagggacgaaaacataaaaaacaattacctctcttatacgcgaacaggaattaacaaaaataaaaaagtacaagccaaagacaacacagattccgacggattctacaaatacatagtaaaaatcctaaaagacataaaagagaatgactctgacgaagacattaagtatatactaagcgaaatcgataaaaaaaatttcgtcccaaaacaaagaacaaaagaaaatagcgtcataccttaccagttaagagaaatagagttgcgaaagataatagataaccaatcaaaataccacaaattcttaaacgaagttgatgaaaaaggaatcagcgtaaaagaaaaaattatagcactactaacatttcgaattccatactatataggcccgctcaatccatcatacaacgaagagaaaaacttcacaacctcctgggtaaaaaggcttgcaaaaggaaaggtaacaccctggaacttcgaagatatggtagacatagacgcatcaagagaagcatttatagaaaacaaattaaacaaatgtagtttcttactagatgaaaccgtattaccaaaagacagtctgctatatcaagaatatatggtactaaatgaattaaacaatttaaaaataaatggacaatcaataaacacagatctaaaaaaatcaatatacgaagaactcttcaaaaaatacaaaaaagtaacacgaaaaagattaattagctacataaaagaaaaagaaaacacctctggcgatatagttataaccggaatagatggtgattttaaacaaggcttaaagagttatatagcctttaaagagataattggcgaaaaaattgataacgatatctatagaaaagaagtcgagaagataatacgagatatctccctctacggagacgataaatcattcattcaaaaaaaaataaaaaacgaaaacaaactagacctctccgacaatcaaatttctaaaatagcaaaactaaaattcaaggattggggtcgtttcagcaaaaagcttctagtaggaataaaggcctcagacaaaaacaccggagaaatagataatattataggattcatgagaaactataattacaacataatgcaactaatggccaacgtattcacgtttaaagacgaaatagaaaaattaaattcaaaatactacacatacgaaaaaataaacgtcgactatctagacgacctctacctctcagcacccgcgaagagaatgctatggcaaagttttcaaatcgtcgatgaaataaagaatataaaaaattcagctcctaaaaaaatattcatagaaatggcgcgaagcaaagaggacaaaccaacaagaaaaatgtccagaaaatccagattagaaaaactttatacagatagcaagaaacaatttattaaattatttggcccagatgaatatgacaaattaaataacgaaatcaaaaataaatcggagtcagactttagatgggacaacttgtacctctactatacacaattcggaaggtgcatgtacagtctagaccccatcgatctagaggaattatcaaataaaaacctttacgatcaagaccacatataccccaaatctaagatttacgacgattcaatagaaaatagagtacttgtaaagaaacaacttaacttagataaatcaaacgaatacccaataccagatcgagttttaaacaaagacaaaaacaagctactagcattttggaaaatgttaaacgaaaaggagctaataggtgataaaaaatacgccaggctaatccgtaagagcccattcaccgacgaagaactcggcgattttatagcacgccaacttgtcgaaacccgccaagcgacaaaagagacagcaaacatgctgcgacgattatgtccggattcaaaaattgtatatgtaaaagcgaaaaacgtatccgattttagaagaaaatttgacatattaaaatgtcgcagcataaacgacttacaccacgctcacgacgcctatttaaacatagtcgtaggtaacgtgttcgacacgaaattcacaagcaatccattaaactttatcaaaaacaactcaaaaaatagatcgtacaacttagaaaaaatatacgattatgacgtgataaggaatgaaaaaatagcatggttagcagaaagaaaggaggaaaaccaagacggcagtatagcaaccgtactcaaaaaccttagtaaaaacgacattagagtaacacgacgtacatacataaagtgcgaagatctgttcgatgaaaatatagtaagaaaaggcaatggaaaatttccactcaaagagaacaataataaaagtgacacaaacaaatatggaggatattcaggcatcaaaaatgcatacttcgtcctattagaggacgaaaaacataatagaattattgaagctattccttctttcatatataagaaagaaaagaacggtgaaaaaggcagtgttataaactacttacaaaacatcctaggaattaaatccgcaaaaatactaagagataaaataaaaattggaagcttgttaaaaatcgacaaatttccgtataacttagctggaaaatccggaaacggcatcctaataagcggaggagtacaactaatactagacaaaaatacaagcaaatatatcaaaaaaatagaaaactataaatacaaattagacgaaaacaaagattatcaaattaacatatttgataaattatcaaaagaggaaaatatcaaactattcgacttatttgtagacaagttcgaaaatagtatctacaaaaaccgagtaaatatcaaattaaaagaaattaaactagcgaggtcaaaattcgaacatctatcaattgaagaacaaataaagacacttacacaaatgctcatattatttggaagggagaataatgctgtaaacttggaatatataggactacccaaaaacaccggaaaaacaaaaattaataaaaaaataaacaataaagatataaaaattataaaccaatctataaccggtctatacgaaacagaagaagatctcgcgaatatctga

SEQ ID NO: 8868 - RNA, 4089 nt, synthetic construct
  misc_feature 1..4089: note = Cas9 variant
  source 1..4089: mol_type = other RNA
atgaaaaaaccttacagcatcggattagacattggcactaactcggtcggatgggccgtcataactgaggactacaaagtaccggcaaaaaaaatgaaggttctgggaaacacatcacgagattttataaaaaagaacctacttggcgctctattattcgatagcggcgaaaccgccgaggctagacgactaaaaaggacagcaagaagacgctatacaaggagacggaacagactaagatatctacaagaaatcttcctcgatgaaatgaataaattagattccggattttttcaccgattagacgattcgttcttagtaccagaagaaaaacggggatcacgatatccgatattcggcactctccaagaagaagtaaactatcatgaaaatttcccaacgatttaccacctgcgtaaaaaattagcagattccaaagagaaagcagatctcagattaatttatctcgcacttgcacatatgataaaatacagaggccattttttatacgaagaatcattcgactcgaataacaactcaattcaggaaattttcaatgaatttacagctgaatatcataatacgatagagggatcatgtctctccggtcaaatagaacaagtagaagcgattctcaccgacaaaatatctaaaagcgcaaagcgagaaagaatactaaaactattccccgccgaaaaatcaacaggcttgttttcagaattcctaaaactaatagtaggcaaccaagcagacttcaaaaagcactttgatttagaagaaaaaacaccattacaattcagcaaagacacttatgaagaagacctggaaaatctgcttgaacaaataggtgacgaatttgccgacttattcttactagcaaaaaaattatacgacgcaacattactagcaggaatacttacagcaaccgacgtaagtacaaaagcaccactatctgctagtatgataaatagatatgaaacccaccaacaagacctagcagcattaaaacaatttataaaaaacaaattacctgagaagtacagtgaagtattcagtgatttaagcaaagatggatacgcaggctatattaacggaaaaacgacccaagaagcgttttataaatatataaaaaacctattgataaaatttgaaggcgcagtagacttcctcgaaaaaatcgaaagagaagactttttaagaaaacaaagaactttcgacaacggttctattcctcaccaactccatttacaagaaatgaacgcaattttacgtcggcaaggagatcattatccatttctaaaagaaaatagagaaaaaatagaaaaaatacttactttccgaatcccgtactacgtcggacctctagctaggggaaaccgagacttcgcatggctcaccaggaactcagaccaagcaatcagaccgtggaattttgaagaagtggtggacaaaacctcatcagcagaagacttcattaataaaatgactaattacgatttatatctccccgaagaaaaagtattaccaaaacattccatactctatgaaaccttcgccgtctacaatgaacttacaaaagttaagtttatagcagaaggactacgagactaccaattcttagattcaggacaaaaaaaacaaataataaatctccttttcaaagataagagaaaggtaaccgaaaaagacataatacattacctccacacagtagacggatacgatggaatagaattaaaaggaatcgacaaacagttcaacgcatccctaagcacctaccacgatttactaaaaataataaaagacaaagacttcatggacgatgcagacaatgaagctattctagaaaacatcgtacacacattaacgatcttcgaagatcaagaaatgataaaacaaagtttggcacaatatgacgcaatattcgatagaaaagtaatgaaagcattgactcgaagacattacaccggatggggcgagctctctgcaaaactcattaacggcatacgagataaacaaactggaaaaatgatattagaatatctaaaggacgacggagaaataaatagaaattttatgcaactaataaatgacgactcactatcatttaaagaaactattcaaaaagcacaggttataggagaaaccgaaaatattaaacaaattgtacaagaacttccaggaagccccgccatcaaaaaaggaatactccaatcaataaagatagtagacgaattagtcgaaataatgggctacaatccagaatccatcgtcgtcgaaatggcaagagaaaaccaatttacaaaccaaggacgaagaaactctcaacaaaggctaaaaaaactaacagactcgataaataagcttggttcatcaatacttgaagaacaccctgtcgacaactcacaattacaaaatgatagattattcctctactacctacaaaacggtaaagatatgtatacaggcgaggccttagaattatcaaaactctcaagctacgatgttgaccacattataccccaagcgtttattaaagacgacagtctagataatcgtgtattagtatcctacgccaaaaatagaggcaaaagtgatgatgtaccatcactcgagatcgtccaaaaacgcaaagcattttggagacaactcttagatagtcagctaatttcagaaagaaaattcaacaacctaacaaaagccgaaagaggcggattaacggaagacgataaagcaggcttcattaaacgacaactagtagaaaccaggcaaatcaccaaacatgtagcacagatattagacgcacgatttaacacagaagtaacagaaaaaggaaaaaaaaagcgggccgttaaaatcataacactcaaatcgaatctagtatcaaatttccgaaaagatttcgagttatataaagtgagggagattaatgactaccatcatgcacatgatgcatacctcaacgcggtcgtaggtactgcgctgttaaaaaaatacccaaaattagagccagaatttgtatatggagattacccgaaatataacagctatcgagaacgaaaaacagcgaccgaaaaagtctacttctactcaaatataatgaacttctttaaaaccacagtaaaattagcggacggatctgaaaaaaaacgacatcaaatcgaaactaacgaagaaaccggagaaattgtttgggataaaacaaaacactttgaaatagttagaaaagttttatcttatccacaagtaaacatagtaaaaaaaacagaagaacaaacagtaggacaaaacggcggactcttcgacaataacattgtatccaaaaacaaggtggtagacgcatccaaactgatcccaattaagtcaggattaagccccgagaaatacggaggatatgcaaggccaactatcgcttactcagtacttgtgatagcagacattgaaaaaggcaaggccaaaaaacttaaaagaataaaagaaatggtaggaataactatccaagacaaaaaaaaattcgaagcaaatccaatagcttatctagaagaatgcggatttaaaaatatcaattcaaaccacattatcaaacttccaaaatactcgctgtttgaatttgatgacggtcaaagacgactactagcaagctccatagagttacaaaaaggaaatgaattaatactcccataccatctaacagctttactataccatgcccaaagaattaataaaatatcggaacctatacacaaacagtacgtagaagcccaccaaaacgagtttgaagaattactaaccacaattataagcctatccaaaaaatacatacaaaaaccaaacgtagaatccttgttacagcaagcattcgaccaaaccgacgaagatatctatcagttaagcgaaagttttatctcccttctaaaacttatatctttcggtgcccccggagcattcaaatttttaggagtagacatatcgcaaagtaacgttaggtaccaatccgtttcttcatgctttaacgcgacgctaatacaccaatcaataactggattatacgaaactaggattgatctctccaaactcggcgaagactga

SEQ ID NO: 8869 - RNA, 4089 nt, synthetic construct
  misc_feature 1..4089: note = Cas9 variant
  source 1..4089: mol_type = other RNA
atgaacgaaccatacggtgtaggcctcgacataggaacaaatagtgtggggtggactgtagtagatatgaatggaagagtaagaaaagtaaaaggaaaaacagcattaggcgccagactatttaaggaaggagcgacagccgaagacaggagaggattcagaacaacaaggcgaagactaaaaagggtaaaatggagactaaggctcctaagagaatttttcgaccaaccaataagtaaaatagatccaaactttttcgcaagacgcaaatatagcgacataagcccgagagatccaaattataatggcttagcaaagaccttatttaatgaccgaactgataaggagttctatgacgattatgcaaccatataccatttacgagacaaactcatgacatcaaatcgcaaattcgacattcgagaaatatacttagcaatccaccacatagtcaaatatagaggaaactttttgaggacaggaccagcttctcaatatggctcggcaagcctacacctagccaccagtttccaaaaattaaacgacctattcgcccaatctgaagaaactttaaatctaaaattagttacagacgaagcgcttttacaacagatacaacaaatattagtccgaacagacttatctagatctgaacaacagagacaaatatggccactaatggctgtattaaccggtgccagcgcagcggaaaagaaaagacagaaaaatgtagtcgttgaactaagcaaagcattggtaggattaaaagctaaaatgaacgttgttacactaacagaagtagatgccgccgtcgtgaaagattggacgtttactatggaagaatcacaagacaaattacccgaaatagaagaacaactatccgaagttggccaacaaattatggacgaagtaattcaactttacgctagcgtcaacctagcacaactaattccagctggaaaaagattttcacaacatatggtagaaaaatacaaacaccacgagaaaaaccttgaattgcttaaaacctacatccacagtcaatctgactcaaaaagaggacgagaaataagagccacatacgaccgatatatagacggagtagatagtaaaccggtaacacaagaaatgttttacaaagacctaatgaaatatgtagaagcagacgcaacatctaaccatttagcagcagaaatcaaggacgaaatagacagtgaacaattcatgccaaaactaaggactaaacaaaatggatcaataccgtatcaggtacaacaatacgaattagatcaaataatatcacatcaaaagaaatactacccatggctaggcgaagaaaaccccgtcgcagaacgaagaggcaaatttccttataaattggatgagctagtaggcttcagagttccttactatgttggacctttaataacaaaagaagaccaacaagctactagcggggcgggattcgcttggatggtacgaaaagccgatggcccgataacaccttggaacttcgaccaaaaagtagacagaatagcatccgcaacagcatttatacaacgaatgcagacaactgacacttacctaataggagaagatgtcttaccagccagatctctgatatatcaaaggttcatggttctaaatgagctaaataatatgagagtagaagaccgaaaattggctccacaacaaaaacaacgactttataaccaagtcttcaaacaacatcagcatgtaagcgttaaaaatatacagcaaaacttaatggatgcgggtgaataccgcgaagccccaaaaataacaggtctcgctgatcctaaaggatttaatagtagtctgtcaacatatcacgactttaagaaaatattacccgaagccatagcagacgaacacaaacgtgcagatatcgagaaaataatattatggtccactacttttgaagattcagcaatatttaaacagaaattagaagaagtagcatggctaacagatgcacagagaaaacaactatcgggactccgatatagaggttggggacaactctcacataaactcctcatcgcatttaaagacgacaacggtcgttcaataatggacggactttgggaaacttcagacaacttcatgcaacttcgcaaacagccagcaatagaaacacaaataaaagaagcaaatcaagccaaccttacagacgctgatatacaggacacaataaatgaactatatacatcaccacaaaataagaaagcaatccgagaagtaatgctcgtattagatgatatcaaaaatgcaatgcacggacaaactccatcatggatattcgtagaggccgcaagaggtggtggcgtagccgggagacgaacacaaagtagatcatctcaaatagttgaggcttacaaaggaaccgcgaaagaaatagtatccgaaaaagtacaacacgagctaaatgagaaaattaaagctaaagcagactttaacacacgtcttgtactatactttttacaaaacggacgcgatctctatactaacgaagcgatcaatatagaccgtttatcagaatacgacatcgaccacatactcccgcaaagtttagtgaaggacgacagccttgacaacagggtattaacatcagccagaattaacagggagaaaaatgataccttcgcaagtgaaaaattcggaaggaaaatgggagctcaatggagagaactacatagaaatggactcatgacccaacgaaaactaaaacatttgcttatgagaccagatgaaattagcaaacacgctacagatttcataaatcgacagctagttgaaactcgtcaagtaatcaagctagtagaagaacttatctcaagcgaatatccagctgcatcaatagtagcagttaaagcgaaccttacacatcaattccgacaaacgttcaattttcctaaattaagagaagtcaatgattatcatcacgctttcgatgctagtctaacagcatttataggtatgtatttactaaaacaatatccaaaactagaaagattcttcgtatacggcaagttcgcaaaacaaccaattaatctcactcgattcaatataataagaaaactagctgttgcggaaaaacccatagccaatattgaaactggcgaaatactctgggataaaacagcagatataaaatattttgaaaaactctacaattataaaaggctactggtaacacacgaagtacgcgaaaactacggagcaatgtttaaacaaacactatttaaagcctctgacaacaaaagtaaaacattagttcccaagaaaaaccatatggaaacatcagtatatggcggatactcaaatcaggagacagcctatcttgccatagttaggataccattcaaaagtggctttaaattcatagttgtaggtataccaacaagaatggtcgctaaaataaaacactaccaaagtctaggagccacactaaaacaagctacccataaagtaatagaacctaagttcacaaaaatatccagaaaaacaaagcaaacagtaatcagcgattacgaggtcgtactaccaaaggtttatttggatcaagtagtaagagaccaagtgaaaggacaaatgtatcgtttttccctaggctccgataaggagtatcataacgttcaggaactatatttaccacttagcatccaacaagcattcgtcggtcattacgatgaatcagatgaccaaagaagtaacgacttagtaaaggtttacgatgcagcattaaaacaattacaacgatacttcccgcttcatctatcacgcaacttcgaccaagttgcaaatcaagcgcatcaatcgtttgaaggactgaaaaacaatgtacagaaaagcgataaacaattgggtaagaaggaagtcttaaacagtttattcgtaggcttacacgcaaccgctacaagatcaaatttatcagtccttggaatgtcaaaggatttcggaagactgcaatctagatctggaatcacgttaaccgatcaagcagaaataatttatcaatcacctacaggcctgttcgaaagaaaagtggcattaaaagatttatga

SEQ ID NO: 8870 - RNA, 4089 nt, synthetic construct
  misc_feature 1..4089: note = Cas9 variant
  source 1..4089: mol_type = other RNA
atgacaaaactaggaaaaccctacgggataggtgtagatatcggttccaattccataggtttcgccgctgtcgacgagaacagtcatctcatacgcctaaaaggcaaaacagttattggcgcacgcttatttgaagagggaaaagcagcagcaaaaagacgagcaggacgaactacccgaagacgactctcaagaaacagatggcgtctatcctttctaagggatttcttcgaaagccacattaccccaactgatcccaacttctttatgaggcaaaaatatagtgaaatctcaccaaaagataaagctagatataaatacgagaaaagactgtttaatgacagaacagacgctgaattttaccaacagtattcaaccatgtatcacttacgtaatagactaatgaccgatccgtctagagcagatgttagagaaatctattttgcaatccaccatatactaaaaagtagaggccatttcctaacacctggagacgcaaaagacttcaacacaaacgacgtcgctcttgacgaaatatttcccgcattacaagatgcttacgcacaagtatatccagacctaggcatcacattcgacgaagataaggcaaatgagttcaaaacaatattgcttaatgaaatcgctacttctattgacacacaaagagcgctagtaaagttactcctcgcggaagaagatgacaaagacatactgaagcaacaaaaacaagtattaacagagttcgcaaaggccgtagtgggccttaaaacaaagctaaaccttgctctaggaacagaagtagactcaagtgaagcaaccgcttggaacttctcactaggtcaactcgacgataaatgggcaggaatagaaagcgccatgactgacgaaggaaccgaaattttagaccaaatcagagacctataccgtgctaggctgttaaatggaattgtcccaaccggtaagacgttatcacaagcaaaagttgatgattacactcaacaccacgaagacctacaactatttaaagcatatttaaaacaactggaagatgatggcacggctaaagctatccggcaattatatgacagatacatagatggagacgacgccgcaccattccttagggaaaattttgtcaaggctctaactaaagacgtaacggcccatccaaatacaaaatctccagaattgctagaaaggctagcgcaacccgactttatgctcaaacaaagaaataaagcaaacggcgcaattcctgtacaaatgcaacaaagagaactcgaccaaatcattaaaaatcaagcagtatattacgactggcttgccgcacccaatccagtagaaaagcatagaaaaagcatgccctatcaattagatgaactcctcaactttcgaataccatattatgtcggtccacttgtaacagccaaagaacaaaaagccgctcagggaggagtttttgcatggatggttagaaaagatcctgaaggaaacataactccatacaattttgatgaaaaagtagacagggaagcaagcgccaatacttttatacaaagaatgaaaacaactgacacttacttaataggagaagatgtcttaccaaaacaatcactattatatcaacgatatgaagtacttaatgaactcaataatgtcagagtcaataatgaaaaattatctatagagcaaaaacaacaagtaattagggaattattcgaaagacataactcagttaccataaaacaattcgccgaaaacctaagagcccatggagactacgctcacattcccgagataaggggactcgcagatgaaaaacggtttttatcttcactatcaacatatcgtcaattaaaatctctactccctgaagcaatagatgacccagctaaacaagccgatatcgaaaatataattgcttggtcaactgtatttgaagatgcagcaattttcaaaacaaaactcaaagaaatttcatggttgggatcagaagccataacaaaactaagcaacattcgttatcgcggttggggacaattctcaagaaaattcctcaatggcctaactttaggtaatgggcacactataatccaagaattattgctctcaaccaataacctaatgcaaatattaaccgacgaaactctccaaaagaaaatgacagaattaaacgcggacaaactcaagactgcaaacataaacgatgcgattgacaacgcttacacctccccatcaaataagaaagcactacgacaagtactaagagtagtggacgacataaaaagagcagctgatggacaagaccccagctggttatacgtcgaaacagctgacggcggaggtacaccaggtaaacgtactagagcaagacaacatcaactccaagaaatatacgcaaatgcagcacatgaattaatagatacagcagttagaggcgagttagaagataaaatcagtgacaaagcagatttcaatgacagattagtactgtacttcatgcaaggaggtcgagatatatacacaggagcacccttgaacatagaccaactctcgtcatatgacatagatcacatcctcccacagtcactaatcaaagacaacagcttagataacagagtgttggttcatgccataattaacagagagaaaaatgcaacctttgcctccaccatatatgcacagaaaatgaacgcgacatggcgacaatggcatgaagctggcctaatatcaggaagaaaactccgcaatttacaaatgcgcccagatcaaattgataaatacgcgtctggtttcgtagctagacaattagtcgaaacaagacaaattataaaacttacggaacaaatagttgcagctcaataccctgatactaaaataatagcagtaaaagctggactaagtcaccaattaagagaagaattagaatttccaaagaacagagatgtcaaccattaccaccatgcatttgacgcgtttttagcagcaagaatagggacttacctattaaaaagattcccgaaccttcaagcctttttcacgtatggaaaattcactaaggccgatgtaaagaaattaagaggtttcaacttcataagagacatcacccatgcagaagataaaattgtcgccaaagacactggagaagtcgtatgggataagcaaagagacgtagatgaactagacagaatatataacttcaaacgcatgctcatcacgcatgaagtacgtttcgaaacagccgatcttttcaaacaaactgtatacggtgcaagagattcaaaagaagctggaggtagcaaacaattgattcctaaaaagaaaggataccctgtagatatttacggaggatacttccgagaaaacactgcctatcttgcagtagtcaaagttactaagaaaacagaaaccatattcaaagtagtcaaaatagcaacaagtcaagtcgccgcattaaataaagcaagatcccgttcaactgcagaagaactttcagtcctaactgaactattaaaacctaaattctccaaagtagggaaaaatggaaaaataacagacacaccattcgaagtagtattaccccgagttccacgcgaacaactattttacaatgcaaaatatggattctttatggtaaattcagatactatgttccataatttccaagaaatctgggtatcaagatctgatcagaaaatattgcaacaaataagaaaagctaaaatcgattatccaaatgtcgatcaagacctagataacctgttccacaacctcgcagatcaaattgtaaaatacttcgatttatattctatagcaggattcaaagagaaaatatctcaatcacaaaatacatttaacgacttagccgtagacgataccgatcaaagcgtaggaaaaataacggtcataaatgaactactaaaaggagcacaagctaacggaatgacagggagcttaaaagtactcaaaatatcaacccctttcggattcactcaggataaatcaggagtactgacaaaagactcatcaatcatataccaatcacctaccggactgttcgagcgttcagtaagattaactgacttatga

SEQ ID NO: 8871 - RNA, 4089 nt, synthetic construct
  misc_feature 1..4089: note = Cas9 variant
  source 1..4089: mol_type = other RNA
atgaccaaactaggtaagccatatggaataggcgtagacattggatcaaattcaataggatttgctgcggtcgacgaaaatagccacctaatacgactaaaaggaaaaaccgtcataggagcgagattatttgaagaaggaaaagccgcagcaaaacgtagagcagggagaaccacaagaagaagacttagccgtaaccgttggcgattgtcattcttaagggacttctttgaatctcacattactcctactgacccaaacttctttatgaggcaaaaatattctgaaataagcccaaaagacaaagctagatacaaatacgagaaaagactatttaatgacagaacagatgcagagttctatcagcaatattcaactatgtaccatttacggaacagattgatgacagacccatcacgagcagacgtgcgcgaaatatatttcgctatacaccacatcctcaaaagcagggggcatttcttaaccccaggagacgcaaaagactttaacactaacgatgtcgcgctagatgaaattttcccagcattacaagacgcgtacgcccaagtttatccggatctaggtattacttttgacgaagacaaagaaaacgaatttaaaaccatattattaaacgagatcgcaacatcaattgatactcaacgagcgctagtaaaattattattagcagaagaagatgataaagacatacttaaacaacaaaaacaagtgttaactgaatttgcaaaggcagtagtggggttaaagaccaaactaaacttagcactcgggacagaagtcgacagtagcgaagcaacagcctggaatttttcgcttggacaattagatgacaaatgggcaggaatcgaaagcgcaatgacagacgaaggaacagaaatcttagatcaaattagagacctatacagagcgagacttctaaatgggatagtaccaacaggaaaaactttatctcaagctaaagttgatgactatactcaacatcacgaagatttacaactatttaaagcatacttaaaacaacttgaagatgatggaacagcaaaagctatcagacaattatacgatcgatatatagatggggacgacgctgccccgtttttaagagaaaacttcgttaaggctttaacaaaagacgtaacagcgcatcctaatacaaaaagccctgaattgctagaaagactagcacaaccagatttcatgctaaaacaacgaaataaagccaacggtgcaatacctgtacaaatgcaacagagagaattagatcaaatcattaaaaatcaagcagtatactatgactggttagcagcaccaaaccccgtagaaaaacaccgaaaaagcatgccataccaacttgacgaactattaaacttcagaatcccatactatgtagggccactcgtgacagcaaaggaacaaaaagcggcccaaggaggtgttttcgcctggatggtaaggaaagaccctgaaggtaacataactccatataacttcgatgaaaaagtagatcgagaggcaagtgcaaatacattcatccaaaggatgaaaacaacagatacctatctaataggagaagacgtactacctaaacaatcgctattgtatcaaagatatgaagttttaaacgagctgaacaatgtaagagttaataatgagaagctatcaatagaacaaaaacaacaagtaatacgagaattatttgagagacacaattcggttactataaaacagtttgcagaaaatctaagagcacacggcgactatgctcatataccagaaatacgaggactagcagacgaaaagagatttttatcatcactttcaacatacaggcagttaaagagcttattacccgaagcaatagatgatccggcaaaacaagcagatatagaaaacatcattgcttggtccacagtctttgaagacgcggcaatcttcaaaacaaaactaaaagaaatctcatggcttggcagcgaagcaattacaaaattatcaaacatacgatatagaggatggggacagttttcaagaaaatttctgaatggacttacactaggaaatggccacacaataatacaagaacttctactatcaacaaataaccttatgcaaatactcacagacgaaacattacaaaagaaaatgactgaattaaacgctgataaactcaaaacagcaaacatcaacgatgccatagacaatgcatacacttcaccctcaaacaagaaagcactcagacaagtcctaagggtagtcgatgatattaaaagagcagctgatggacaagatcccagttggctatacgtagaaacggcagatggcggaggaacgccgggtaaaagaacaagagcaagacaacaccagctacaagaaatatacgccaacgcagcacacgaacttatagacacagcagtgcgcggagaactagaggacaaaatatcagacaaagcagacttcaatgacagattagttctttacttcatgcaaggcggcagagatatctacacaggcgcaccactaaatatagatcaactcagctcttatgacatagatcacatactaccacaaagcctaatcaaagacaatagtctagataatagagtcctagtacatgcaataataaatagagagaaaaacgcgacgttcgcaagtactatatatgcccagaaaatgaacgctacatggagacaatggcatgaagcaggtctaattagcggtagaaaactgagaaatttacaaatgcgcccagaccaaatagacaaatatgcatcaggctttgtagcaagacaactggtagaaacacggcaaattatcaaacttacagaacagatcgtagcggcacaataccctgataccaaaataatagccgttaaagcgggcttatcacaccaactaagagaggaactcgagttccccaaaaatcgggacgttaatcattatcaccacgcctttgacgctttcttagccgctagaattggaacctatctcttaaagagattcccaaacctacaagcattcttcacatacggcaaattcacaaaagctgatgttaagaaattgagaggattcaacttcatccgtgatataactcacgcagaagacaaaattgtagcaaaagatacaggcgaagtagtttgggacaaacaaagagatgttgatgaattagaccgcatatataactttaagagaatgcttataacgcatgaagtgcgattcgaaacagcagatttatttaaacaaactgtctatggagctcgtgattcaaaagaagctggcggctctaaacaattaattcccaaaaagaaaggatatccagtcgacatttatggcggatactttagggaaaacacagcctatctagctgtggttaaagtgacgaagaaaaccgaaaccatcttcaaagtggtaaaaatagctacaagccaagtcgcagcactaaataaagcacgctcaagaagcacagctgaggaacttagtgttttaacagaactattaaaacctaaatttagtaaagtaggcaaaaacggaaaaataaccgataccccttttgaagtagttctaccacgtgtcccaagagaacaattattttacaacgctaaatatggattctttatggttaatagcgatactatgtttcacaattttcaggaaatttgggtttcaagatctgaccagaaaatacttcaacaaataagaaaagcaaaaatagattatccaaacgtcgaccaagatctagataatttattccataatctcgcagatcaaattgtcaaatatttcgacctatactcaatagccggattcaaagagaaaattagccaaagtcaaaatacatttaacgacttagccgtagacgatacagaccaaagcgtaggaaaaataaccgtcataaatgaactattgaaaggcgcacaagcaaatggaatgacaggctccctgaaagttttaaaaataagtacacccttcgggtttacacaagataagtctggtgtattaacaaaagactcatcaataatataccaatccccgacaggtttattcgaaagaagtgttcgacttacggatctttga

SEQ ID NO: 8872 - RNA, 4089 nt, synthetic construct
  misc_feature 1..4089: note = Cas9 variant
  source 1..4089: mol_type = other RNA
atgacaaaactagggaaaccctacggaattggagtagacataggtagtaattcaataggattcgcagcagttgacgaaaattcacatttaataagattaaaaggcaaaactgtaatcggcgcacgattatttgaagaaggaaaagccgcagctgatcgacgtgcaagcagaacgacaaggcgaagactatctcgaaacagatggaggctatcatttctacgtgacttcttcgaaagtcatataacgccgacagaccctaacttctttatgcgacaaaaatactccgagatctcaccaaaagataaatcaagatataaatacgaaaagagattatttaacgaccgtaccgatgcagagttctataaatatgaaaattgcccaaccatgtaccatctcagaaaccgattaatgacagatccatcgaaagcagacgtgagagaaatctatttcgcaatccatcacatactaaaatcaagaggacactttctcactccaggagatgctaaagactttaatacaaataaagtcgcagtaaataaaatttttcccgcgctacaagacgcttatgctcaagtatacccagatctagacatcacattcgacgaaaataaagtaaacgagttcaaaacagtacttttgaatgaaaaagcaacaccttctgacactcaaagggccctagtaaacttgctactggctaaagaaggagacagagatatccttaaacaacaaaaacaggcattaacggaatttgccaaagcagtagtaggacttaaaacgaaattaaatgtcgctctagggactgaagtggatagtagtgaagcaacagcctggaatttctccctagggcaattagacgacaaatggacaggtatcgagtcagcaatgaccgacgagggtacagaaatacttgaccaaatcagagacctatacagggctagactattaaacggaatagtacctgctggaaaaaccttatcacaagctaaagtagatgactatgcccaacaccacgaggatcttgaactcttcaaagactatctcaaacaactagaagacgacggtactgctaaagcgatacgacaactctatgaccgttatatagatggcgatgatgcaaaaccatttgttagagaagacttcgtaaaagcactaacaaaagaagtaacagcacatcctaacgctaaaagcccagagcttctagaaagactagcacaaccagatttcatgctaaaacaaagaaataaagcaaacggagctatacccgtacaaatgcaacaaagagaactcgatcaaataatcaaaaatcaatccgtatattacgactggttagccgccccaaatccagtagaaaaacatagaaaatctatgccttatcaactcgacgaattactcaattttaggattccgtactacgtaggtccacttgtcaccgccaaagaacaaaaagcagcacaaggaggagtgttcgcctggatggttagaaaagatcctgatggtaacatcactccgtacaattttgacgaaaaagttgatagagaagcaagtgcaaatacctttatacaacggatgaaaacaacagatacatacctaatcggcgaagatgtgctaccaaaacagagcttattgtatcaatcatatgaagttttaaacgaattaaacaatgttcgtgttaatgacaataaattatcatttgaccaaaaacaacaagtcctgggcgaattatttgaacgtcacaacaccgttacaataaaacaatttgttgacaatttactagcacatggggactatgaccgtattcccgaagtaagaggacttgccgatgagaaaagattcttatcgtcactaagcacatataaccaattaaaaggtatattacacgaagcaatagatgactccgacaaacaaaccgatattgaaaacataatagcctggtcaacaatatttgaagacaaagctatattcaagacaaaactaaatgaaataagttggcttaacgcaggaatgataaattcattagccaatatccgctataggggatggggtcaatttagtcacaaattacttaacgaactaaccttatcaacagggagaacagtttttgaagaactccttatcagttcccataacctaatgcaaatccttacagacgaagtattaaagcaaaagattgcagagctaaacgcacacgaactaaaagcatcaggaatatacgcagcaatagacgacgcttatacaagtccgtcaaataagaaagcattaagacaagtattatctgttattgacgacataacaaacgctgctggccaagcaccgaactggctatacatagagacagcagacggagatggggttccaggtaaaagaacaaactcgagacaaagaaaaatccaagaaatatatgcaaacgccgctcaagaacttataacaggatcagtaaggggagaattagaagacaaaatagcatcgagagcagattttacggatagattagtactatactttatgcaaggcggtagggatatctataccggtaaaccactaaacattgacaacctgtctagttatgatatcgaccatatcttacctcagagtctcataaaagataactccctagacaacagggtacttgtacatccacttgtaaacagagaaaaagacacaatcttcgcctcaactagatttgcaaaacagatgaacggtatgtggagacaatggcatgcagcaggactcatatcaagtcgaaaactacgaaacctacaaatgcgtccagacgaaatagataaatatgcaagtggattcgttgccaggcaattagtagaaaccagacaaatcataaagctcacagagcaaatagtagcagaccaatatccagataccaaaatcattgcagtcaaagcaggtctaagcagtcaactaaggaaagaattagacttccctaaaaatcgcgaagtgaatcattatcaccatgcatttgacgcattccttgctgcaagaataggaacatatttactaaaaagatatccaaacttagaaccatttttcacctatggaaaattcaaaaagacagaagtcaaaaagctaaaatcattcaatttcatcagagatatgacacatgcaaaagacaaaattgtagcgaaagaaaccggtgaaatcgtttgggacaacgcaagtgacataaacgagctagatcgaatatataacttcaaaagaatgttaatcacccacgaagtcagattcgaaactgcatctctttttaaacagacactctatgcggccaaaaatagcaaaaacagagggggatcaagacagctaatcccgaaaaagaaaggttatcttgtagacatatacggaggatacactcaagaaacagggtcatacttatcagtcgttaggctaacaaagaaagctatgtatgcagtagtaaaagtcagcacaagagatgcagcaaaattagccgttgcaaaatcgataagcgaacaaaaagaaaacgaaacacttaagaaaataatagatgggaaactcagcaaaacaagcaagaaaggcaaaaccacacaccaattatttgaaatagttcttccaagagtcggtcagaaaactctatttaaaaactcaaaatataaccaattcttggttaactctgacacgtatatgcataactatcaagaactatggatgcccagagaataccaaagaatgtggaaagacatattactatccaaccacggagatgcacaacttgaaggccaattagatcaaatattcaaattcattgtgtcccaagtaaactcatatttcaacttgtacgacatcaatcagtttaggaagaaaatcgcggacgctacagacaaattcgcaaaattaccaacccatgatacggataatgcaagaggaaaaatagccacaataggacaactactgataggtttacaagcaaacgccatgaggtctgacctacgcaaccttgatattaaaactcccttcggattactacaaatcggaacgggtataacattagacctagacacttcaataatatatcaaagtccaacaggactatttgaaagagaagtgcctttaactgatctctga

SEQ ID NO: 8873 - RNA, 4089 nt, synthetic construct
  misc_feature 1..4089: note = Cas9 variant
  source 1..4089: mol_type = other RNA
atgaaccaagagccatacgccatcggattagacataggcacttcaagtctaggatgggcaaacgcagacatggatggatacatagcaagagtcaaaggacaaacaggtttaggcgtaagactttttgaggaaggacaacctgcggctgaccgaagaagtttcagaacaaccagaagaagactatcaagaagacgttggcgactaagattactaagagaaatattcgacgagcctatctcatctatcgatccaaacttctttgcacgtcagaaagcgagttcaatatcacccaaagacgacagatttgaaactacatatcaattgtttaatgataaaaccgatcaagagttctactctaaatatccaacaatatatcacctaaggtgggcactcatgaccgaacacagaaaatttgacctccgagaaatctatctagcggtccaccatattgtcaaatacagaggaaacttcttaagatccggaaacccaaaaagtttcaaaccaagcgaactagatttctcccaaagattcaaagaagtaaacggactctggcacctgatctttgatgaagtagcgcctcaacttccaacagacaatttagaagaaataacaaagctagtactcgacactacgagaacacgagcagatcgacaacgagaaagcgtaaaattacttatggccgcaaccgataaccataaagattggaaaccttaccttacggagttcacaaaagcaatactaggactaaaaacaaaattatacctccttaccggagtagatgttgcaaaagcagaccagaaaacgtggactttcagcttagaagacattgaagatcatagggccgacctagagaccgccttcgacgaccgtagtctggaattaatagaaaaacttgtagacctccaagccgcaatccaactaacagaaattatgccatctggacaatacttcagccaatcgatgatttataggtacgaccaacacaaagaacatctcagatggctaaaagattacgcagaacaacaaacagacgccaataaaagaaaagctgtacggttagcttacgaccattacatagaaggagacgcaaaagggaaacccgaaattgcagacgatttttataaagaactaaacagaatcctaaaaggagatacaagtgaactcgctaagaaaataaatcatgaaatagcattagaacactttatgccaaaacaacgaactaaagaaaatggtgtaataccttatcagatacatcaacaagaactggactcaataatagacaaccaaaagaaatactaccagttcttgggcgaagataatcctgtcgtatctcaccatggatcacaaccatataaaatagatgagttagtatctttcagagtaccatactacgtagggccaatgataacagcagatcagcagaagaaaactgctgccgggcaattcgcatggatggtgcgaaaagactcaggggacataacaccttggaactttgatgacaaagtagaccgaacagcaagtgcaacgaattttatacaacgtatgaaaaccacagacacatatttaataggtgaagatgtccttcccttgcaaagtcttacctaccaaaaatttatggtcctgaatgaacttaataatatcaggataaacggcgaattattaactagagagcaaaaacagcgaacctataacgatgtatttaaaggtcatggaacagttaacgtaaaatccttaattaaatcattggaatgtcatagcgaagttaccggggcaataaaagtagagggactagcagatccaaaaagatttaattctgcactaaccacttatagagacttcaagaaaatactaccagttgctatcgatcagccccaaagacaagctgacattgaacgaataataaactggtccacaattttcgaagacgcagacatttttaaagcgaaattacaagaaattgattggttaactgacacacaaagagatcgactgagtactaaaagatatagggggtggggtcgtttatcagccaaattactattaaatataaaagacactcaaggcctatccatcatggaccaactatggaacacccaacataattttatgcaaattgtacatgaacctgactatgcagaaaagatagagaaaactaatgcgaaaggattaaaacagcaagacatattcgaaacaatcaacgaaatgtacaccagtccacaaaacaagaaagcactaaggcagatcctcgcagtggtacgagacattcaaaaagcccatcacggacaagcaccatcaaggatctttatagaagcagcacgtggagcagaacaaaatccacaaagaaccagacaacgacagaaacagctagctgaccttttcgcagaccaagcaaaagaaatagtaaatgaaacggtagcccaagaattaaacgatgagactgataacaaagccagatttacagaccgacttatgctatactttttacagaatggccaagacatgtacacaggagaaaaattgaacatagataaattatccacctatgacatagaccatatactccctcaatcacttgttaaagatgattcactcgacaatcgagtgttagtatctaaagttgaaaatttaaagaaaaatgaccattttgcttcagagctatacgcaagaaaaatgcagggcacctgggaattatggagatcagcaggactaatatcagcaagaaaacttaaacacctactcatgcgtccagatgaaataaataaatatgccacaggattcattcgtagacaacttgtagaaaccagacaagtaataaaactggttaccgatgtattatcaaatgaatatgatagcgataaaactaaaataatatctgttaaagcaggcctttcacatcaattaagaatggaactagatttacctaaagtaagagaacttaacgactatcatcacgctttcgacgcattcctcgcagtccgaattggaacatatttactcaaaagatacccgaagctcgaaagatttttcgtctatggccaatatcaagtcgcaccacaacttgacttacgtagatttaattttatacacgacctggtatcaggcaaacaagagaaaattgtggcagaagaaacaggagaaatagtgtggaacagagaaaaggatgtatcatacatgaaacacttactctccttaaaacacttattggttacccacgaagtaaaagaagaccatggcgcattgttcaaccagacaatatataaagcaaagaaagataacggcaatgtaggaggaaaaatgaaattactacctaccaaatcaaacaggccaacagaaatatatgggggacactcatcacaagcaatagcatacttagccatcgtacgcgtcaatggaaaagaaccttcatacagagtaatgggcgtccctattaggatattagaccaattaaaacaagcaaagaaacaaggagaatacgctgaaagattagccttgaaacaatttttcacaccagatttcaccaaaggaaaaggtaaaatagtatccgactttgatgtagtcatccctcatataccactattacaaccagtaatagatgaaatatcaggtcaaagccatcgttttgcactaggaacaaatacctattatagaaacttacaacaactaatactcacactcgccgaccaaaaagtactaatttctaaagaaactggagtggatgaagaaaagaaattagttgaagtttactcacacatatgtcaacaagtaatgaaattcttcccactttatgatagaaacaaattcagagaactacttgttgattcacgcagtcattttgaacaacttcctatagtaaacagatactcagatgcaggaaaactcgagattgcaggaaaaagaggaatattacaacaaatcatggtcggcctccatgcaaacgcaacaccaggagaccttaaagaattaggagtaaaaactccatttggaaaattacaagtcccaggcggaataaaattaacagaaaacgccaaactaatttatgaatcaccaactggactgttcaaaagggaagtcaaaataacgacagaatga

SEQ ID NO: 8874 - RNA, 4089 nt, synthetic construct
  misc_feature 1..4089: note = Cas9 variant
  source 1..4089: mol_type = other RNA
atgaaaaaaaaagcagaaaagatttatcttggtttaaatgtcggtacaaattcaatcggatatgccgtgacggatgaacaatatcgcttactaaaattcaacggcaacgacgcatggggatccatagtatttgatgcagccagcagtaacgaagatagaagaaaccatagattggcccgtaggaacttagatcgcagacaacaacgcatcgtatggctacaagaaatatttgcaaaagaaatatctaaggttgacgatcgattttttatacgtctctcagaatctttcaggtggagagaagacgtacaagaccgatatgtattctttaatgataaagaatatacggacgtccaatatatgaaagaatatccaactatccatcatctaatatgcgaattaatggataataaaactccccacgatgtaagacttgtatatcttgcatgtgcttggctaataacacatcgagggcattttctcaacaatctaaatgtagagaaactagacgaaataatggatttctccagcgtatatcaaaacttcataaactatttcacggaaaatggatacaaaaggccatggggggaaatagatgttagtgccctatccgaagtactaaaacaaaaaacaggtataaccgtaaaaaataaagaattacaaaacatacttcttgaaggcaaaaaaccagaaaagtcgggcaccgaggaattcccattctcgcaagactctataatcagactactagcaggaggacagtgtaaattaaaggacgtcttctgtaaagaggaatacttagatttaggcagcgttagcctgggcatggacgaagaaaagtttgacgaaatatccggaagcatcggcgaagattacgacctactaatagcattaagaggactatatgattggtcagttttagcaaacctacttaacggacattctgaaactatatcaatggcaaaagttcaaatgtacgagcagcacggaaaagacctacaaatcttaaaatactttgtacgtaaatatgtgccggataaatacaatgaagtgtttcgaaaggcaaaggccgacaattacgtagcctatactggacacatggacaaagacactgccagtcagatcaagaaaaaagccaaagcagaggaattttcaaaatacgtactaaaactaatgagcccaatcaaacctgaaaaaacagacctacaaagttatgaagacatgtgcgaacgattgaaactcaatagattcctaccaaagcaaaaaaacacagacaaccgtgtaattccacatcaattatatgaatacgagttgatacaaatcttaaaaaatgcctccgtttacttaccatttttaaacgacacaaataatggtatatcagaagccgacaaagtgctatcagtattcagatataaaataccatactatgtaggaccactcaatgaagaaagttcattcgcttggataagcagaaagcaaggaaaaattacaccatggaacttcaaggaaatggtagatgaagatgcatcagaaaatgcgtttatcagaaggatgactaataaatgtacatatctcccaacagaagatgtacttccaaaagactcgttatgttatcaaaaattcatggtcttaaatgagataaataacctacaaatagatggactaaaaattcctgttaaggctaaacaaggcatatatcatgaactgttcgaaaaaaataaaaaggttaagcgaaaagatatagaagaatatttaataaggaataactacttagacaaagattcgacggaactaatatcaggcattgacgaacaaatacattcaggcttaagctcatattgtgcattcttcaatctactaaataaaaaaatattatctgaagatgatgtagagcgaataatagaacgagcatcctacgcggaagataaatcacgagtaataaaatggctacgcaaagaataccctggactatcagaagacgatataagatatatcgcaagaataaagatcagggatttcggacgcttatctaaaacattcctcacaggcctgaaaggttgtgatgtatcaaagggattcgacggtcaggacgtagaaatgatatcgatattacaaactatgtgggagacaaacgacaatttaatggaaatccttagtgacaaatatacctttcttgaagcactagaagccttcactcaggaatactatacaggaaagaagaaaagtttaaaagaacgactcgacgaaatgcgagtttccaattcagtaagaagaccagtttaccgaaccctagctgtagtaaaagacatagagaaagcttttggaaaaccaaataaaatatttgtagagatgaccaggggtggacaagcggaccagaaaggtaaaagaataaaatctcgaaaacaacaaatattagatctctatgataaatgcaaagatgatgtacacgacttaatgtggcaattagaatcactaggagaatatgcagacagtagactacaatctgatcgactatatctatattttatgcaattcggtaaatgcgcatacagtggtgcgcacataggattcgaacaattaatggcaggaagcgttgaatatgatatagatcacatttatccacaaagctacgttaaagatgattcattgaacaacaaagttttagtcctatccgacttaaacggaaccaaggacaatatttaccccgtgtctcccgaaataaggggcaaaatgcagggtctatggtcttggtggaaccatgtaggagcaatttctgacgaaaaatataaacgactaataagaagcgcaccattcactgacgaagagaaaatgggatttataaacagacaattaacggaaacaagccaatcaacaaaattcatagcagacctattaaaagaaaggttccctgatgccgaagtagtatatgttaaagcgggcttagtaagtgatttcagacacgaattcgatttaccaaaatcacgatcatacaatgacttacacaacgcagcagacgcttttttatccgtagtcgcaggcaacgtctacgatatgaggtttagtaaaaaatggtttagaatcgacgaaaaatattctgtaaaagtaaaaacaatatttacacacgaagtgaaatgtagaggagacataatctgggatggaatgcctatgctggaaaaagttgaggatacagcacgaaaaaacactgctcattttgttaaatatgctgccttcaagacaggaggtttatttgatcaaaacccagttaagaaaggaacaggtttaataccgcttaaagcaggtttacctacagaaaaatatggaggatacaataaagcaggtattatgttcttgatcccagtccgctacaacataggtaaaaaatccgaaatactcattctcccagtcgaacttatgcacggtaaacattttttagaagataaagtattcgcaagaaactataccttcacaagactagaaaatatactcggcaaaaaagtaggtgaggtctcatttccaatgggtatgaggccatggaaaataaataccatgttatctttcgatggatttcgtgtttgcttaacaggtactagtggtcgcggaaaatgcctcgttgcccaaccagtaatgcagttttccgcagacgagcattggagattctatgtaaaaagactagaaagatttgttgaaaaaatagggataaacccagacctcttgtacgataaagatcacgacaaagtgagcaaagacgagaacttaaaattgtatgaactatacgttgataaattacaaaataccatatacaaaaaaagggtaaatagccccgtgcagacactacttaaaggaaaagaagaattcaaaaaactttctatagaagaacaatgccaagtattgttaaatatccaaagcgttttcggacgcatgactggaggatgtgatctaactttaataggaggtagtgctcactcagcggcaacaggctcattgagcaccacaataagtaactggaaaaaaaaatattcaacggttcgtataatcgaccaatcaccatcaggaatgtgggagaaatcatcagaaaacttactggattttttatga

SEQ ID NO: 8875 - RNA, 4092 nt, synthetic construct
  misc_feature 1..4092: note = Cas9 variant
  source 1..4092: mol_type = other RNA
atgacaaaattaggcaaaccctatggcataggagtagacataggcagtaattctattggatttgcagcagttgatgaaaatagtcatttaattagattaaaaggcaaaaccgtaataggagcacgcctatttgaagaaggaaaagctgctgctgatcgacgagcttcaaggacaactcgaagaagactatcaagaaacagatggaggctgtcattccttagagacttctttgaatcccacataacccccacagatccaaacttcttcatgcgacaaaaatactcagaaatctcaccaaaagataaagcccgatataaatacgaaaagagactgttcaatgacagaacagacgcagagttctatcaacaataccctactatgtaccacttaagaaatagattattaaccgacccatcaaaagcggacgtaagagaaatatacttcgcaatacatcatatattaaaatcaagaggacattttctaactagcggttatgccaaagattttaacacaaataaagtagcgctaaatgaaatcttccctgcattacaagatgcttatgcccaagtatacccagatctggatattacgtttgatgaaaacaaagtcaatgagttcaaaacagttctattagacgaaaaagcaacaccatcagacacacaaagggcattagttaacttactgttagcggaagatggcgacaaagatatcttgaaacaacaaaaacaagtgttaacagagttcgcgaaagccgtggttggattaaagatgaaattaaatgtcgcccttggaacagaagtagactcttcagaagcaacggcttggaattttagccttggacaattagacgacaaatgggcaggaatcgaatctgcaatgacagacgaaggcacagaaattcttgatcaaataagagatttataccgagcacgattattaaatggtatagtccctgcgggaaaaactctatcgcaagcaaaggtcgatgactacgagcaacaccatgaggacctcgaattattcaaagattatctgaaacaattagaggatgatggaatggcaaaagtgatacgccaactatacgacagatacatagatggagatgatgcgaaacctttcgtccgtgaggactttgtaaaggcccttacaaaagaagtaaccgcacatccaaacgctaaatcacccgaactgctcgaacgattagtgcaaccagattttatgcttaaacaaagaaataaagcaaatggtgccatccctgttcaaatgcaacaaagagaactagaccagataatcaaaaaccaatcagtatattatgactggttagctgcaccaaacccggtagaaaaacatcgacagtcaatgccataccaactagacgaactcctaaatttcagaataccatattatgtcggtcctttagtaaccgcaaaagaacaaaaagctgcgcaaggtggtgtctttgcatggatggtacggaaagaccccgatggaaacataacaccgtacaattttgacgaaaaagtagatagagaagcatcagcaaatacattcatacaaagaatgaagaccacagacacatatctaattggtgaagacgttctaccaaaacagtcacttttgtaccagtcatacgaagtcttaaatgaattaaacaacgtacgtgtaaatgataataaattgtctttcgaccaaaagcaacaagtcttaggggaactattcgaacgtcacaacacggtaacaataaaacaattcgtagataacctactagcccatggggactatgatagaatcccagaagtaagaggcttagccgatgagaaacgcttcctgagtagtttatccacttacaaccagcttaaaggaatactacatgaagcaatcgacgattctgataaacaaacagacatagaaaagataatagcatggagcacaatatttgaagacaaagcaatatttaagactaaactaaatgaaatatcttggcttacagccgggatgattaattcccttgccaacataaggtacagaggatggggtcaattttctcataaattactgaatgaactaacattgagcacaggaagaactgtctttgaagaactcttaatatcatcacataaccttatgcaaatcttgactgacgaagtactaaaacagaaaattgccgaactaaatgctcacgaacttaaggcatcaggaatatatgccgccatagacgatgcatacacctcacccagtaataagaaagcactccgccaagtactatcagtaatagacgatataacaaacgcggccggacaagcacccaactggttgtatatagaaactgccgacggcgacggagtgccaggaaaacgaacaaacagtcgacaaagaaaaatacaagagatatacgccaatgccgcacaagaacttataactggcagtgtgagaggcgaattagaagacaaaatagctagcagagcagactttacggacaggctagttttatattttatgcagggaggtagagacatatacacaggcgagccattaaatatagacaacttaagttcatatgacatagaccatatactgccacaatcattaataaaagacaacagcttagacaaccgggtactcgtccatcctttagtcaacagagaaaaagacacaatatttgcaagtacacgctttgcaaaacaaatgaatggaatgtggaggcaatggcatgctgcgggactaatatccagccgcaaacttcgtaatttacaaatgcgcccagatgaaattgacaaatacgcatcaggttttgtagcaagacaattagtagaaacaagacaaataataaaattaaccgaacaaatagttgcagaccaatatccggatgcaaaaataatcgctgtcaaagcaggtcttagttcacaattaagaaaagagcttgacttccccaaaaacagagaggtaaatcactaccatcatgccttcgatgcattcttagcagcccgaattggaacataccttttaaaacgttacccaaatttagaaccattctttacctacggaaaattcaagaaaacagaggtaaagaaactaaaatccttaaaaagtttcaattttataagggatatgacacatgcaaaagacaaaattgtggcgaaagaaaccggagaaatagtatgggataacgcttcggacataaacgaactagacagaatatataacttcaaaagaatgcttataacacatgaagtaaggttcgagacggcatctttattcaaacaaactctctacgcagccaaaaatagtaaaaatcgcggaggaagcagacaactaatacccaaaaagaaaggatatctcgtcgatatatatggcggatacacacaagagacaggttcctatttatcagtagttaggctcacaaagaaagcaatgtatgcagtagtaaaagttagtaccagggatgctgcgaaactagcagtagccaaatccatatctgaacaaaaagaaaatgaaacactaaagaaaataatagatggaaaacttagcaaaacttccaagaaaggcaaaactacacatcaactttttgagatagtcttaccacgagtaggacagaaaactctatttaaaaacagcaaatataatcaattcttagtaaactccgacacatatatgcataattatcaagaattgtggatgccaagggaatatcaaagaatgtggaaagacatacttctaagcaatcacggggatgcacaactagaaggacaactggaccaaattttcaaattcatagtaagccaagtcaactcgtacttcaatttatacgacattaaccagtttcgaaagaaaatagcggatgcaacagataaattcgcaaaattaccaacccatgataccgataacgccagaggcaaaatagccaccataggacaactattgataggtttacaagctaacgccatgagaagcgatttaagaaatttagatataaaaactcctttcggacttctacaaattggaacaggaattacactggatttagacactagcataatttaccaatcaccaaccggactttttgaaagagaagttcctctaactgacttgtga

SEQ ID NO: 8876 - RNA, 4092 nt, synthetic construct
  misc_feature 1..4092: note = Cas9 variant
  source 1..4092: mol_type = other RNA
atgagaggaaactatcacattggattagatattggaacctcaagcataggctgggcagtgattgacgataatgcaaaagtcatgcgcgcaaaaggaaaaacagcaataggagcacgattatataatgaaggacaaaccgcagcagacagaagactttttcgtacaacacgcaggagactaaatagacgaaaatggagacttaaacttcttgacgaaatctttgacccctatattacacccgtagacgccgcattctttgcgaggctcaaacaatctaatttatcaccaaaagaccaaaatagagattggacgggctcaatgctattccccgatcgaaccgatcgaaaattccataaagattacccaaccatataccacttaagacacaaattaatgacagaggatcatcaattcgacatacgtgaaatatatcttgctatacatcacatagttaaatatcgcgggaatttcttaaacacaacgcccgtaagctcattctccgtatcagacgtaaaatttgatgaacaatttgaccgactcaacgaactatatgcagcggtatcacccgatgaaccatttgctattaatggcgataactcaaaagccatcgaaacgttacttctttccgacgaaacaaagaaatttgataaacaaaaacaaagcgctaaactaatactaagtgaaaccggtgataaagcccttgacaaagaaaacaccaaagtcgccacacaaatcagcaaagccatccttggatataaaacacaactagacgttctattaaaatacgacgcaataaatagttctgcctggaaaattgaattagacgatgaaaatatcgatgacaccctcccgggcttattatcccaattagacgagaaccgacaagagatggttagcataatacaaaacttgtacgcacaagtaacccttaaccaaatcgtaccaaatggaatgagtctttctgagtccatgatagaaaagtacaacgcccacagagaccatctcaaactcctaaaacagctcgaagacaagatagacgaccctaaaaagaagaaaggcttagaagctgcttatgacgcatacgtaggcaaaaatatgaaagttgctaatcaagacgtattctacgcctcagtaaagaaaaaccttgatgacagcgatctagcaaaacaaatagcagatctaattgaagcccaaaaatttatgccaaaacaacgtacatcccaaaatggagtaatacctcaccaattacatcaattagagttagatcaaattatagaaaaccaatcaaaatattacccctggctcacagccgcaaaccccaatccaaaacggatacaccaagccaaatacaaattggatgaattagtagcattccgtattccatattacgtaggaccattagttaccccagaagaacaagaaaaatcagccaatcaagtattcgcgtggatgaaaagaaaacaaccgggcacaatcacaccctggaacttcgatcaaaaagtagacagaatggcatccgcaaaccgcttcattagaagaatgacaacaaaagatacataccttattggtgaagacgtactgcccgatgcaagtcttatctacgaaagattcaaagtcttaaacgaactcaacctagttaaagctaattaccacagattggctccagctcagaaacaagcagcctaccgagacctattcgaaaatcaaaaatctatttccaccaagaaactacaaaattatctagtagatcaaggatatttcacagctaaaccaaaaataacgggcttatcagatccagaacgatttaactcatcacttggtacatacatcgatttcaaagaaatcttcggagatcaggttgataatcccgatcgccaagacgactatgagaaaataatcgaatggtcaacagtatttgaagacaggcaaatctatgaagctaaactacgaacattagattggttaacagaagatcaaattcaagcactaaaaaccaaacgctataacggatggggtcgattatcaaagaagctactcactggaatagtagacgaaaatggagaacgtataatcgatgtactttggaatacaaatcaaaattttatgcaagtacaatcacaagaatcatttgccaaacgaatacatgaagcaaatgccaaacaaatgaaggtaactggagttgaagacattctagcagatgcgtacacgagccctcaaaataagaaagctatcagacaagtaattagagtagtagacgatatacaaaaagcgatgggaggtgtagcccctacgtcagtcagcatagaatttacacgttcagaagaccaaaatccacgaagaactcaatcaagagaatcacaactccaaaacacatttaaagtagacgccaaagaaatagtagactcagacctagtcaccgaactagaaacagtctcaaaatcgaaaaagggattaaccgataggttatatctatacttcacacaacttggtaaagatatgtacacaggcgacccactaaatatcgacgaactatcaacatacgacattgatcacatacttccccaagcatttataaaagatgactcgttagataatcgcgtactggtctcgaaagccgtcaacaatggaaaatcgaacaatgtccccgtcaaactttttggaggaaaaatgggtggattttggaaagaattagcagaccacagattaataagtaaacgtaaattaaaacatctattaacagaccccgacacaatagacaagtatacaatgagaggattcataagacgtcaattagtggaaacaagccaagtaataaaattggttgcacaaatattaggggacaaatatcagaacgatgacacaaaaataatagaagtaacagcaaaaatgaatcatcaaatgagggaaaatttcaaactaattaaaaatagagaagtcaatgactaccatcacgcagttgatgcgtatttaacagccttcgtcggacaatacctatataaaagataccccaagttaagaccatactttgtttacggaaattttaagaaattcaatgaagaccatgtcagctttaggtatttcaattttctacacgaacttatggatgaaaacaacaaaaggatagtagagcctgagactggagaagtagtattagaaagagaaccagcaatagcatatatgaaaagagtataccactttaaatttatgctcatctcccaggaagtctataccagacgcgacgcaatgttcaatcaaacgatatacccagcaaaagaagcaaacagacgaaaacttatagcaataaaacatggtaaaccagtagatgtatatggaggttactcaggctccgtagatgcctacatggcaatagtaagaatacatgacaagaaaggagataaatataaagtagtaggagtacctatgagagccttagaaattctaaacgcaacccatgataagaaagattacgatgcaaaactaaaacagattttagttccaaaatttaccaaagtgaagaaaagtagaaaaactggggaaataaccaagaaagttgaagatttcgagatagttcttggtaaagtgatgtacagacaacttgtcatagacggcgataagaaattcatggtcggttcttccacatacctttataatgctagacaactcgtattaagcgattccagcttagatactctagcatccaaaggaactcttgactcagacgcagattcaaaaagacttgtagcagtgtacgacgaaatagtcgaaaaagtagacaaatacttcccattatatgacaaaaacgcatttcgaagcggactacataaaggtagagacaaatacttattactacccaatagaagcacattcaatggagcaaagaaagtacattcaggaaaaagggaaattctaaatgaaatactcaacggacttcacgccaacgctaccttaggtggactcaaagatttaaaaatcagcacgccatttggtaaaatgcaaggacaaagtggtatacctctaagcagtaacacaattatatgctaccaaagtcccacaggcttatttgaacaccgagtttcattaaaagatctatga

SEQ ID NO: 8877 - RNA, 4092 nt, synthetic construct
  misc_feature 1..4092: note = Cas9 variant
  source 1..4092: mol_type = other RNA
atggaaaataacagatataatgtcggtttagacataggaacttcatctataggtttcgcagtcacagacgaacaagacgaacttgtacaagtaaaaggcaaaaattacataggagtacgcctattcaaagaaggccaaacggcctcagaaagaagaagttttaggactacaagacgcagactaaaaaggcgaaaatggagactaggcctattagaagaaatatttgctccatacctggcacaaggcgacccatatttcctagctcgaatgaaagaatcaaatataagtcctcgtgacgaaaggaagaaatactacggctcgctattatttagtgatgacacagtattctatgataaatacccaaccgtgtatcatcttagacacgcgttgatgacagaagacagaaaattcgatataagagaaatttacttagcagttcatcacatcatcaaatataggggaaacttcttaataaatacattaataaacgaattttctagcaaagccgtcgactttaagaaagacgctgatattttaaacgatctattcgaacaattttatatatctgatataaacgattctttccaactgaatacagcagatatgaatgaaattagtgaactactgttagacaactcaaaaacaagactagacagacaaagggaatcactcaagaaactcgcgaagaaagtcgatgacatcagcgttgcgaagaaacaccagaaaatagccacagagttcagcaaagctatattgggcaacaaagctaaatttgacgtaatactaaatgtcaccacagactcaagtaacgattggagtttcaaactagaagatgaagacgcagatgagaaaatagtagtactgctagaagaattaaacactccacaacaagaagctcttaatataatacaccaatggtattcccaaataagtttgaacggaatagtgccagacggaaaatccatcagcgaagcaatgataagcagttacgaacttcacaaagaacaccttgcgctattaaaacaacaaataaacaatactaaagataaaaagaaagcccatggcttacacgaagcatacaatgaatacgtacatggaaacaataataagaaattaaaccaagccgacttctacagcaaagtaaaacaaaatctagaatcatctttaataactgatgaaatactagaactaataaacgcagaaaattttatgccaaaacaacgaacgtccgcaaacggcgtgatccctcaccaacttcatcaacaagaactagaccgaataatacaaaaccaagcaaaatattatccattcttagccgaaacaaatcccaacgaaaaacgatcaaaagtggccaaatataaactggacgaactcgtagcattcagagtaccttactacgtgggaccactaataaccgcaacggatcagaagaaaacatccggaaaagaatttgcttggatggtacgaaaacagccaggacgaataacaccttggaacttcgatgaaaaagtaaacaaaatggaatcagcaaacacgtttatccgtaggatgacaaccaaagacagttacttaatagctgaagacgtactaccagacgaatccctactttatcaaaaatttaaagtcctgaacgaattaaataatctacgagcagacggtagaaaactaaaagtaagcgtcaaacaaaaagtgtttaaagaattgttccaacaacagaaaactataaccatagtaaaactgcaaaattatttaaaagctgaatgtagcttcttaacaacaccagaaatctcaggcttgtcaaaaccagaacatttcgtatcttcattagctacatacatcgacctcaagaaaatattcggagaagacatagataatccagcccgacaaaacgacttcgaaagaatgatagaatgggccactatctttgaagacaaaaatatctatagtgaaaaactcaacgaaataaaatggttaaatgaccgacaaaagaaagaattgaaaaataaaaattatcatggatggggaaagctatcagctaaacttcttaaaggactacgcgactctgatgaatgttcaatcatagaacacatgtggaacactcaacagaacttcatgcaagttcaagcggaagaagacttcgcacaaagaatacaagaagaaaacaaccagcatttaaaaggaaacactctagaagaagtcttagctgacgcttatacatcacctcagaataagaaagcgataagacaagtagtcaaagtaatcgaagacatacaaaaagcaatgggtggaatagctccacagaaaataagcattgagttcacgcgagccccagaagaaaaaccaaggagatcagtagaaagacaacaacaaatcgagaaaatatataaatcagttgccaatgaagtcgaaaatgcaggagtaaaagacgaactacaaagatttagtgacagaaaacaaacccttacagataaatactttttatactttacacaattaggaaaagatatgtacacaggaaaatccattaatatagatcaaataggtaattaccaaatagaccacatactaccccaggctttcataaaagacgatagccttgataaccgagtcttagtatcagcagctgtaaataatggtaaatctgataacgtcccaaccaaaaatgacaggtacaaagtgagagaacacggccaaaggctatatgaccaaggtctaattagcaaaagaaaattcaacaacctaatcacagacccagatagcataaataaattcacagcacgcggttttgtaaaaaggcagctagttgaaacatctcaagtgatcagattagtcgccgagttcctatataataaataccaaagcaaaagcgaaatcattgaagtccgagctaaaatgaactcccaactaagaaaagactttgggttaattaaaaacagaaacgtcaatgactatcaccatgcgctagatgcttacctaaccacatttataggtaattacctctatagacgatatccaaaattaagagcatactttacgtatggatgctttaagaaagtggatgacagtcaactcaaatattttaatttccttcatgacatagaagacgataagaagaaaataataaaagataatgatacgggggaaatactatggcacagagatgaagggatagccagattcaaacgcatatacaattttaaatacatgttagtcacacacgaagtactcacacgacaaggggccatgtttaaacaaactgtatattcagccgcagtcgccggctcgaagaaattaattcctgtaaaagaagacagaccaatagatatatacggtggatacacaaataacaatgacgcatttcttgccatagtcaaagtcaccaaaaagaaacaatacatggtagtcggcattccacaaagggcagtagtaaaactcaatgatgctgcaaaacaaggtagtaaagcataccagaaagttttatataatgtaataaaaccacaatttataaagaagaagaaagaccgtaaaacaggtaaaatcacacaaaaattagaaaactttgaaatagtcgtcagtaaaacattgtacagacagcttataatagatggggaccaaaaatacatgctaggttcatcagcgtataaatacaacgccaaacagctagtactatccgagtacgcattagaagtattagaccgttcaatctttgagaagaaagaatatacaacagtcgatctagacaatgtatatgacgaaatattagcacaagtagataaatatttcagcctctatgacaaaaacaaattccgacaaaaattacacgaatcaagaaaaatatttacagaactcccgattaacaacttattctccggaacaaaactactcaagagcggtaagagagaaacattaaatgaaatacttgaaggcctccatgcaaatgcgaccaagaaagacctgaaaagcctaaaattttccacacctctaggaatgatacaatacccctcaggtataatactcagtgaaaatgcaatattatgctatcaatctcccacaggcatatttgagagacgtgtcaccctaaaagatctatga

SEQ ID NO: 8878 - RNA, 4092 nt, synthetic construct
  misc_feature 1..4092: note = Cas9 variant
  source 1..4092: mol_type = other RNA
atgactaaactgggaaaaccatatggaatcggagttgatataggttccaattcaataggttttgcagcagtagatgaaaatagtcatctaatcagactaaaaggcaaaactgtaatcggagcacgactctttgaagaaggtaaagctgctgctgaccgacgggcatcacggactaccagacgtagactatctcgaaatcgatggcgcctaagttttctcagagacttctttgaatctcatataacaccaaccgatccaaatttctttatgcgacaaaaatacagtgaaatttctcctaaagacaaaagcagatacaaatacgagaaaaggctatttaacgatcgaacagacgcagagttctacaaatatgaaaattgtccaaccatgtaccacttaagaaatcgactaatgacagatccaagcaaagcagacgtacgagaaatatatttcgcaatccaccatatacttaaatcacggggacactttttaacaccaggagacgcaaaagactttaataccaataaggtcgcagtaaataaaatattccctgcactacaagacgcatatgcacaagtatacccagatcttgacataacatttgacgaaaacaaagtcaacgaatttaaaacagtattattgaatgaaaaggcaacaccctcagacacacaaagagctcttgtaaacctactacttgctaaagagggagatagagatatattgaaacaacaaaaacaagcactgacagaatttgcaaaagccgttgtcggattaaaaacaaaactgaatgttgccctaggaactgaagtcgactcaagtgaagcaacagcgtggaatttttccctaggacaattagatgataaatggaccggcatcgaatcggcaatgacagatgaaggaactgagatactcgatcaaatccgagatttgtacagagcacgattgctaaacggaatagtaccagctggcaaaacattatcccaagcaaaagttgacgattacgcacaacatcacgaagacctagaactattcaaagactatttaaagcaacttgaagacgacggaacggccaaagctataaggcaattgtatgatagatacatcgacggagacgatgcaaaacctttcgtacgagaagatttcgttaaggcactgacaaaggaagtcacagcacaccccaacgccaaatctccagaactattagagagattagcacaacccgatttcatgcttaaacaaagaaacaaagcgaacggcgccataccagtgcaaatgcaacaaagggaattagatcaaataatcaaaaaccagtcagtatattatgactggctagcagcccccaatccagtcgaaaaacataggaaaagtatgccatatcaattagacgaactactcaattttagaataccatattatgtgggccctctagtaacagcgaaagaacaaaaagcagcacaaggcggcgtatttgcctggatggtaagaaaagatccagatggaaatataacgccatataattttgatgaaaaggtcgatagagaagcaagtgccaatactttcatacaaaggatgaaaacaacagatacatatcttataggtgaagatgtacttccaaagcaatccttactctatcaaaggtatgaagttctgaacgagctaaacaatgttcgagtaaataacgaaaaattgtcaatagaacaaaagcagcaagtgataagggaactttttgagagacacaattcagtcacaatcaaacaatttgccgaaaatctacgagcgcatggcgattacgcgcatatgccagaaataagaggcctagcagatgaaaaacgattcttaagctccctatcaacctatcgacaattaaaatctcttctcccagaagcaatagatgacccagcaaaacaagccgatatagaaaatataatagcatggagcactgtctttgaagacgccgccatctttaaaacgaaactaaaagagataaactggttagactcgcaaaccatcactaaactaagtaatataagataccgaggatggggtcaattcagtcataaattcctaaatggactaactctcggaaatggacatacaattatccaagaactctttctctcaaataataaccttatgcaaatactaacagatgaaacactgcaaaagaaaatgacagaattaaatgcagacaaacttaaagccgccaatataaatgatgcaatagacgacgtgtacacctccccttctaacaagaaagcgctaagacaagtcctaagagtaatagaagacatcaaaagagcagccgatggacaagatcccagttggttatatgtcgaaactgccgacggcggagggaccccaggcaaaagaacacgagctagacaacatcaacttcaggaaatatatgctaacgcagcacacgaactcatcgattcagcagtccgaggagaattagaagacaaaatcgcagacaaagcagattttaacgacagactggtattgtattttatgcaaggaggaagggacatttatacaggaacccctttgaacattgaccaattatcatcttatgatattgatcacatactacctcaatccctgataaaagacaacagtctagacaatagagttctagtgcacgcaataatcaacagagagaaaaatgcaacttttgcttcaacaatttacgcacagaaaatgaatgcgacatggagacaatggcatgaagcaggtctaatatcaggtcgtaaactcaggaacctacaaatgagaccggaccagatcgacaaatacgcgtcaggttttgtagcacgacaactggtcgaaacaagacaaataataaaattaacagaacaaattgttgcagcacaatacccagagactaaaataatagcggtcaaagcaggcctctcacatcaactaagagaagaacttgagtttcctaaaaatagagacgtcaaccattatcaccacgcgttcgacgccttcttagcagcgagaattggcacttacttactcaaacgtttcccaaatctacaagccttctttacttacgggaaattcaagaaagcagatgtcaagaaattacgcggttttaattttataagagacataacacatgcagaagataaaattgtagttaaagatacaggagaagtaatctgggacaagaaaagagacgtagatgagttagacaggatctataacttcaaaagaatgcttataactcacgaagtccatttcgaaaaagccgatctttttaaacaaactgtatatggcgctaaagatagtaaagaggcaggagggaagaaacaattaatatccaaaaagaaaggctatccagttgacatctatggaggatatacacaagaaacaggttcatatctaagtgtagtacgactaacaaagaaagcaatgtacgcagtcgtcaaagtttcaacgagagacgctgctaaattagctgttgcaaaaagcataagcgaacaaaaagagaatgaaactctgaatgacattatagacgaaaaattaagcaaaatcagtaaaaatggaaaaataacacatgaattgttcgaggtagtgctaccgcgtgtaggacagaaaactttattcaaaaacagtaaatacaacttatttctagtaaatagtgatacatacatgcacaattaccaagagctatggatgcccagggaatatcagaaaatgtggaaagatatttcgttgtcaaaatacggtgacgcacaaaccgaggatcaattagatcaaatctttggattcatagtatcgcaagtcaactcatactttaatctatacgatattaatcaatttagaaagaaacttaatgacgcagcggataaattcgcaacgttacctatgagagataccgatgacatgcaaggtaaaatagccacaataggtcaactattaataggactacaagcaaacgcagcaaggagcgatttaagaaatttagatataaaaactccacttggattattacaaatccccaacgggatttccctagactcagatacgtcagttgtatatcaatcaccgacgggtttattagaacgcgaagtccatctgtcagatttatga

SEQ ID NO: 8879 - RNA, 4092 nt, synthetic construct
  misc_feature 1..4092: note = Cas9 variant
  source 1..4092: mol_type = other RNA
atgacaaaactaaaccaaccatacggtataggcttagacataggatcaaactctattgggtttgcagtcgtagatgcaaactcacatttattaagattaaaaggagaaaccgcgataggcgcccgactattccgtgaagggcaatcagctgcagatagacgcgaatcaagaacaacaaggcgtcgtttatctcgaacacgatggcgattatcttttctaagagactttttcgccccacatattactaaaattgatccggatttctttttaagacaaaaatacagcgagataagtcccaaagacaaagacagatttaaatacgagaaaagattgttcaatgacagaacagatgccgaattttacgaagcgtacccttcgatgtatcacctgaggctacgcctaatgacagatgcaagccaagctgaccccagagagatcttcctagcgatccatcacatattaaaatcgcgtggacactttctaacaccaggcgcggcaaaagactttaacacagatgaagtagatcttaaacacatttttccagctcttgcagaagcctatgctcaggtatatccagacctggaacttaatttcgactccgcattagcggatgattttaaagcaaaattactagacgaagatgcaaaaccatccgatatacaaaaggcattggtgaatttacttttatcttctgacggagaaaaggaaatcgtcaagaaaagaaaacaagtgttaacagagttcgcaaaagctataacaggactaaaaactaaattcaaccttgctttaggaactgaagtcgatgaagccgatgctagtaattggcaattctccatgggacaattagatgacaaatggtcaaatattgaaacctccatgacagaccagggaaccgaaatctttgaacaaatacaagaactgtatagagcaagattactaaatggaatcgtcccagctggaatgtcactaagtcaagcaaaagttgcagactatggtcaacataaagaagacttagaattattcaagacatatatcaagaaattaaacgaccatgaacttgccaaaacaataaggggactatatgatcgatacataaatggagatgacgctaaaccgtttttacgtgaagatttcgttaaagcactaactaaagaagtaacagcgcacccaaatgaagtaagtgaacaactgcttaaccgtatgggacaagcaaactttatgctaaaacagcgaacaaaagcaaatggagcaattccggtacaattacaacaacgagaactagaccagataatcgctaaccaatctaaatattatgactggctagccaaacctaatcccgttgagaaacatcgcgcatcaaaaccctaccaactagacgaactactaacattccgtattccctattatgtcggtccattaataaccccaaagcaacaagcagaaagcggtgaaaatgtatttgcctggatggtacggaaaaatccaagtggtaacataacaccttacaactttgatgagaaagtagatagagaagccagcgctaatacatttatacaaagaatgaaaactactgatacatacctgatagacgaagatgtattaccaaaacaatctctactttatcaaaaatacgaagtcttaaacgaactaaataatgtacgaattaataacgaagcgttatcaacggaccaaaagcaaagactaatacgagaagttttcgaaaggcatagttccgtcacaataaaacaggtagcggacaatctagtagcacacggtgattttgcccaaagacccgaaataaggggcctagctgacgaaaaacgatttttatcaagcctttcgacctaccaccaactcaaagaaatcttacacggtgccatagacgatccgacaaaacttcacgacatagaaaacataataacatggtcaacagttttcgaagatgccgccatattcaaaaccaaattagcagaaatcgactggttagatcccgcaactataaagaaactatctaacattagataccgaggatggggtcaattttcaagaaaattactagatggcctaaaactaggaaatggtcacacagtaattcaagaactcatgttaagtaaccacaatcttatgcaaatactagcagacgaaacgctaaaagaaacaatgacagaacttaatcaagataaattaaaaacagatgatatagaagatgtaattaatgatgcttacacaagtcccagcaataagaaggctctaaggcaagtgctcagagtcgtagaagatatcaagcatgcggccaatggacaggacccctcatggctatatatagaaacagcagacggacccggaaccgccggaaagagaacccagtctcgacaaaaacaaatccaaacagtatacgcgaacgcagcccaagaattaatagactcagcagtcaggggagaattagaagataaaattgcagacaaagcgagctttacagatagactggttctatacttcatgcagggtgggagagacatttatacaggcgctccactaaacatagaccaactttcccattatgacatagatcacatattaccacaatcattaatcaaggatgatagtctagacaatcgagttctagtaaatgctacaataaaccgagaaaagaacaacgtctttgcaagcacactatttgcaggaaaaatgaaagctacatggaggaaatggcatgaagcaggactaatttctggtagaaaattgagaaacttaatgcttcgtccagatgaaattgacaaatttgcaaaaggatttgtagcacgacaattagttgaaacaaggcaaataatcaaacttacagaacaaatagcagctgcacaatatccaaacacaaaaatcattgcagtaaaagcaggactcagtcaccagttaagagaagaactggactttcccaaaaaccgcgatgtaaaccattaccaccatgcattcgacgcttttctagctgctaggataggtacctacttattaaaacgatatcccaaactaactcctttctttacttacggagaatttgccaaagttgatgtcaagaaattccgagagttcaattttataggtgcactcactcacgccaagaaaaatataatagcaaaagatacaggtgaaatagtttgggataaagaacgagatatacaagaactagatagaatctacaatttcaaaaggatgttaataacacacgaagtccattttgacatggccgacctctttgaccaaacaatatatgcggccaaagacagtaaagagaggggaggttctaaaaatctaatacaaaagaaacaaggatatctaacaggaatatacggcggatattcaacggagagaggaagttatgtttcaataatacgaactttcaagaaaggtgcccccatatataacatcgtaaatattagcacagcagatgtttcactattaagtgataaacagagagtgtcagaagcatcagccgatgttcttctaaaagaactaataaagaagaaattagcaaaacgtaaatctggtgagaacacaaaaagcggtgctttcgaaatagttctacctagagttggtaaaaatacactttttaaaaacaagaaatatggccttttcttagttgagtcaacaaccgaatttcacaattaccaagaactatggctcccaagaaacgatcagatgctaataaaaagtatacaaagtcacaaaatagaagaaagtaaagcagattacgaactcacacgtatgtatcgaaatatagcctcccaagttgatcattactttggtctatatactataagaaaattttccgaaaaactaacagcatccataaacgattacggagcactacctgtatacaaatccgagacaacagatggaaaatatgaagtattatcaaatcttttcgaaggacttggatccggaacatcaaccggaaacctgacagcagtgaaactgcaacccaattttggacgagtatatttaacctcagggatagtactagaggacgatacttccatcatctaccaatctccaaccggcctctttgaaagatccgtaaaattagcagatttatga

SEQ ID NO: 8880 - RNA, 4092 nt, synthetic construct
  misc_feature 1..4092: note = Cas9 variant
  source 1..4092: mol_type = other RNA
atgacaaaattaaaccaaccatacggtataggcttagatataggctcaaactcgataggatttgcagtcgtcgacgcaaattcccatttgctcagattgaaaggagaaacagcaataggtgcaagactttttagagaggggcaatctgcagctgatcgccgaggcagccgtaccactcgaagaagattatcacgaacgagatggcgcttatcgtttctacgagacttctttgcaccacatatcacaaaaatagatccagacttctttctgcgccaaaagtactcagaaatatcaccaaaagataaagatagatttaaatacgagaaaagactttttaatgacagaacagatgcagaattttacgaagattatccatccatgtaccatttgagacttcaccttatgacacatactcacaaagctgatccaagagaaatatttctagcaatacatcacatcctgaaatcaagaggacactttctcacaccaggggcagctaaagatttcaacacggacaaagtagacttagaagatatattccctgcgttaacagaggcctatgcccaagtatatccagatcttgaactaacctttgatctagcgaaagccgacgactttaaagcaaagttattagacgaacaagcaacaccatccgatacacaaaaagcgttagtcaatctacttctttcgagtgacggtgaaaaagaaatagtgaagaaaagaaaacaagtgttaacggagttcgctaaagctataacagggctaaaaactaaatttaacctcgctctagggacagaagtagatgaagccgacgcatctaattggcaattttccatgggccagcttgacgataaatggagtaacattgaaacatcaatgacagaccaaggcacagaaatatttgaacagatacaggaattatacagagcaagacttttaaacggaattgtgcccgcaggaatgtcactatctcaagccaaagtggccgactacggtcaacacaaagaagatctagaactgtttaaaacctatcttaagaaattaaatgaccacgaattagcgaaaacgataaggggattatacgatagatacataaatggtgacgacgcaaaacccttcttaagagaagactttgtaaaagcactgacaaaagaagtaaccgcacatcctaacgaagtcagtgaacagcttttaaacagaatgggacaggcaaattttatgctaaaacagcgaactaaagcaaatggcgcgatacccatacagctacagcaacgcgaactagaccaaataatcgcaaatcaaagtaaatattatgactggttagcagctccaaatccagtcgaagcacaccgatggaaaatgccataccaactagacgaactactaaatttccatataccatactacgttggacctttaatcacaccaaaacaacaagcagaatcaggagaaaatgtatttgcctggatggtcagaaaagatccatccggtaatataaccccatataatttcgacgaaaaagttgatagagaagcatcagctaacacattcatacaacgtatgaaaacgaccgatacctacctaataggagaagacgttttgccaaaacagtcattactttatcaaaaatacgaagtattaaacgagctaaataatgtaagaataaacaacgaatgtctaggcacagatcaaaaacaacgactaatcagagaagtattcgaaaggcactcctcagtaacaataaaacaagttgccgacaatttagttgcccatggagatttcgcacgtagaccagaaattaggggattagcagatgagaaaaggtttcttagtagtttatcaacataccaccaattaaaagaaatattgcacgaagccatcgatgatccgacaaaattgctagacattgaaaatattataacttggagcacagtatttgaagatcatacaatattcgaaacaaaactcgccgaaattgaatggctagaccccaagaaaataaacgaattatcaggaatacggtatagaggatggggtcaattcagtagaaaattactcgatggtcttaaattaggaaacggacacacggtaatccaagaattaatgttaagcaaccacaatctcatgcaaatattagccgatgaaactctaaaagaaaccatgacggaactgaatcaagataaactaaaaacagatgatatagaagacgtaatcaatgacgcgtacacatcacccagcaataaaaaggctttaagacaagtcttaagagttgtcgaagacataaaacatgcagccaacggacaagacccctcttggttattcattgaaacagctgatggtactggaacagcaggtaaacgaacacaaagtagacaaaaacaaatacagacagtatacgcaaatgcagcacaggaacttatagactcagcagtaagaggtgaattggaagataaaatagctgacaaagcatcatttactgacagattagtgttatactttatgcaaggaggaagagacatatatacaggcgcaccactcaacatagatcaattatcccattatgacatagaccacattctaccacagtcactaataaaagacgattcattagataacagagtactggtcaatgccaccataaatagggagaaaaacaatgttttcgcatcaacactatttgctggcaaaatgaaagctacgtggagaaaatggcatgaagctggcttaatttcaggaagaaaattgagaaacctcatgttacgtcccgacgaaatcgataaattcgctaaaggatttgttgcaaggcaacttgtagaaacaaggcaaattataaaactaacggaacaaatcgccgcagcacaatatcctaatacaaaaatcatagcagtcaaagcaggattatcacatcaactgagagaagaactagattttcctaaaaatagagatgtaaaccattatcatcatgcatttgatgcctttttagcagcaagaataggaacttatttattaaaaagatatccaaagctagccccattcttcacctatggagagttcgcaaaagttgacgtgaagaaatttagagaatttaattttataggagctctaacgcatgccaagaaaaacatcatagcaaaagacactggagaaattgtctgggataaagaacgagacatacgcgaactggatagaatctacaatttcaaacgcatgttaataacccatgaagtttatttcgaaaccgctgatctatttaaacaaaccatatacgccgctaaagattcaaaagaaaggggagggagtaaacaacttataccaaagaaacaaggttaccccactcaagtatatggcggctatacacaggaatccggaagctacaatgcacttgtaagagtcgccgaagccgatactacagcctatcaagttataaaaatttcggcgcaaaacgcatccaaaatcgcatctgctaacttgaaatccagagaaaaaggaaaacaattactaaacgaaatagtcgtgaaacaattagctaaaagacgcaaaaactggaaacctagtgcaaacagcttcaaaatagtaattcctagatttggaatgggtacactcttccaaaacgctaaatacggattattcatggtaaattctgatacgtattacagaaattatcaagagttatggttaagtagagaaaatcaaaagttactgaaaaagctattcagtatcaagtacgagaaaacacaaatgaaccatgacgcccttcaagtttataaagctataatagatcaagttgaaaaattctttaaactctacgacataaaccaatttagagctaaactgagcgatgcaatagaaagatttgaaaaactaccaataaacacagatggtaacaaaataggtaaaaccgaaacattaagacaaatattaatagggctacaagctaacggaactagatccaatgttaaaaatctcggaattaaaaccgatttaggactattacaagtaggaagtgggataaaactagacaaagatacacagatcgtataccaatcaccctcaggattattcaagagaagaatcccattagcagatctatga

SEQ ID NO: 8881 - RNA, 4095 nt, synthetic construct
  misc_feature 1..4095: note = Cas9 variant
  source 1..4095: mol_type = other RNA
atgggagataggaaatacaacctaggtcttgacattggtacatcctcaatcggctttgcagctgtcgatgaaaataaccaaccaataagggtcaaaggaaaaaccgcaataggcgtaagactatttgaagaaggaaaaacagccgccgatagaaggggattccgaactacaaggagacgtctctcacggagacggtggagaataaatttattaaacgaaatatttgatgcccacctagccgaggtagatcctacattcctcgccagactaaaagaatcaaatcgctctaatcttgaccccaaaaaatcctttcaagggagtttactttttcctgaaagaaaagactatcaattttatgaggaatacccaaccatatatcatcttcgtaaagctcttatggaaaaagaccgaaaatttgattttcgagaaatttacctagcagttcaccacataataaagtatcgagggaattttctaaatggaacgccaatgcgtagctttaaggtagaaaacatagaattagatactttatttgaccaactaaaccaattatatgctgaaatcgtacccgacaatgagttggcctttgatttagctcaagttgcggatgtaaaagacgtactatcttcaacgacaatatacaaaatggacaaaaaaaaacaattagtaaaaatgatgctgttgccagcatcaaacaaagccttacaatccgaaaataaaaaaatagtcacacaattcgttaatgcgatactaaactacaaattcaaattagacgtattattacaagtcgaaaccgacgccgattggtcattaaagcttaatgacgaaggggcagatgataaactagaggaattcacaggtgacctcgatgaaaaccgattagaaataatcgatctacttcaaaggttacataattggtttagcttaaacgaaataacgaaagacggaaattcactctccgctgcaatggttgaaaaatatgaaaaccaccaccaccacctaggcttattaaaaaaagtaatagagaatcacccagatgccaaaaaagccaaggcattaaaagaaacatacacagcatatgtcggaaaaacagacgacaagacacaaaatcaagatgacttctataaagcggttgaaaaaaacctggatgattcacctgatgccaaagagataaaaaggctaatacagctagatcaattcatgcccaaacaacgcacaggacaaaacggagcaataccccaccaactccatcaacaagaattggatcaaataatagaaaaacagtctaaatattatccctttttagccgaacctaatcccaatgtcaaaagaagaaaagacgctccctataaattagacgaactaatagcattcaaaatcccatattacgttggtccactagtcacaccagaggagcaagctcaaaatggcgaaaatgtctttgcatggatgaaacgtaaagcagcaggaccaattacaccatggaactttgacgaaaaagttgacagaatggaatcagctaatcgatttattcgcagaatgacaacaaaagacacatacttattcggagaagacgtactaccggcagaaagcatgatatatcaaaaattcgtcgtactcaacgaactaaacaatttaaaaataaacggcagacatctatcattgaaagacaaacaagacgtttataacgatttattcaagcaacaaaaaactgtgtcaattaaagcactccaaaactattacgtcaccaaaaaaaaagcagcaacggctccaaccgtcggtggactagcagatccaaaaaaattcttaagttctctatcaacttacatagacttcaaaaacatgtttggtgaacgcgtcaacgacccacaatttcaggaagatttagaacaaatagtcgaatggtccaccatattcgaagatagaggaatattcaaagccaaactacaagcactcgggtggctttcggaaaaacagatacaacaactagtagcaaaacgatataaaggatggggcagactatcaaaaaaactactgactggactaaaaaatgcagaggggtatagcatattagacgaaatgtggagatctacgggcaactttatgcaaattcagtctagaccagagttcgctgcactaattcagcaggcaaatgaaaaacaattcgaaggaaacgatccagacaacgtatgggaaaatatcgaaaacatacttggagacgcctatacttcaccgcaaaacaaaaaagcaatccgccaagttgtcaaagtagttcaagatatagaaaaggcggtaggtaatccaccagagaaaatagcaatagaattcaccagagaagcagctgccaatcctcaacgaacacaatcacgtctaagaaccttggaaaaactatacgaaagtgctgaagaagtcgtagatgccggactaaccgcagaacttgctgaattcaaagaaaacaaacacgtattaagtgataaatactatctttacttcacacaattgggaagagatgtttacacaggagacacaatcagtttagataaactgaatgactatgatgtcgaccacatactcccccagagcttcataaaagatgacagcctcgataatcgcgttcttacaatcagagccgtaaataacggaaagagcgacaacgtacctgccaaaatgttcggaaaaaaaatgggatctttttggaggtacctactagataatggcatgatttcgaaaagaaaatataacaacctaatcaccgaccctgacaacatttcaaaatacgcccaaaaagggttcataaaccggcaattagtagaaactagccaggtcattaaactaaccgcaaatatcttaaacgggatctatgataaagatactgaaataatcgaagtcccagccaaaatgaattcacaaatgaggaaaatgtttgacctagtaaaagtaagagaagtaaatgattaccatcatgcattcgatgcttacttaacaatattcataggtaactatttgtacaagtgttacccaaagttacaaccatactttgtgtacgacaacttcaaaaaattcgggaacaaagaagacatcgggcacaaaagatttaatttcctaggcaaaattgaaagagaaaaaaaagtagtagcaccagaaacaggagagatactctggtcaaacgtagcacccaacgaaaccataaaacaaataaagaaagtatacgactataaatttatgattgtctcacgtgaaattactactagaagagcagaattattcaaccaaacggtctatcctaaaaattaccatggaaaattaataccaatcaaagaagatagaccaacagatctatacggcggatactcaggaaatacagacgcatatttagcgatagtagcattagaagacaaaaaaaaggggaagtactttaaagtagtaggaatacctacaagggtagcagcaaaactggaaaaattaaagcaacaagacagtcagcaatatttacaagcgttacataaagtaatcgcacctcaattcacaaaaagcacaaaaaaaggcattaaaaaaaccgaattcgaaatcgtcctagacaaagttcattatcgacaactcgtacaggatggaccagtcaagatgatgctaggaagctcaacatacaaatacaacgcaaaacaactagttctcagcgaaaaagcgctccaagttatagctgatgatcggaagtttgacgaaacacaaaaagatgataatctaattgccgtttacgatgaaatactatcaattgtaaatcaatcattcgatctatatgacattaatgggttcaggaaaaaattaaatgacaatagagatcagttcatagatttacccgcagaaacgaaatatgaaggaagaaaagtagttgcacatggaaaaagagaaatgattttagaaatccttaaaggactccacgcgaacgctgcatttggtaatctaaaacctattggattttcaacagcttttggacaactacaagtcccaaatggaataattctgtctaaaaatgcaatattaatacatcaatcgccctcaggtctatttgaaagaaaaataaaattatcagacctctga

SEQ ID NO: 8882 - RNA, 4095 nt, synthetic construct
  misc_feature 1..4095: note = Cas9 variant
  source 1..4095: mol_type = other RNA
atggaaaaacaagaatattatttaggcctcgatatgggaattagcagtgtaggttgggcagtcacgaacgacaaatacgagcttctaagaaagaaaggtaaagacatgtgggggataagagagttcgaagaagccgacagtagtgcggagaggagaacacatcgagttaaccgaagaagaaggcaaagacaagtagcaagaatgggcttattaaaagagtacttcagtgacgccatagaaaaagtcgacagtaatttcttcattagaatcgaaaattcaaaatacttctttgaagataaagacggtagattatcatctaaaaacggaatatttgacgacgcggattacaaggacgtcgattactacactgaatacccaactattttccatttaagaaaagcccttttagatatagaagatacaggaaaagagtatgatgtaagactggtatacctagccttagtaaacatgtttaaacatcgaggtcactttctgttaaatacggaaggggacgcactttcaagtgaacaagtgaacaccacatatcaagaacttctagagatactagaaaacaactatgatataagtttagaaagcagggatattaaagatgtaatcgatataataagttcatcagataatggacggaaaaagaaacatgaacaaatacttgagttatttggggtaaagaaaagtgacaaaagagcaaacgaattattaaagtgcctatgcggtttatcagtaaacgctaaattaatattcgatgaaaattacgaagaaaaagtagatctttgttttcatgatttcagttatacggacaaaattccagatctgatggaaaaattaagtgaagaagaatattacgtagttgaacaattgaaatcaatatatgattatagtatactagcaggaacattaaaaggatatgattacctttcgtgcgctagagtcgaactatatgaaaagcatcgcgaagacttaaaactgctaaaagctctatacaggagatacaaaacgaatgaagaatacaacgatatgttcaaaagcgacaaagaaggaacatattccgcgtatgttaattcgtttaacagttctgactcatcagtgaaaattaagaaatatagatggaacatgaaaggtagaacaatagataatctgtatggaacaataaagaaagcatttaaagacaacaccgacgataaagatgtccaatcaatgatggaaagcatagataaagagcaattcctaccaaaacaactaactggagctaatggagttataccaaaccaagtccataagaaagaaatggaacgaatactaaagaaagcacaaaactaccttccatttttaaaagaaaaagatgaaagcgaactcactgttagtgaacgaatactcagattgttcacgtttcaaataccatattacgtgggaccgctaggcgaaaattcaaaaacgggttgggtagtaagaagagagggaggtcgtgttctaccatggaatatagacgagaaaatcgacatgtctgcaacaagtgaagccttcatagggaacttaataagaaaatgtacatacttatcggacgaaaaagttatgccaaaagcatccctaagttatgaaagatattgcgtactgaacgaaatcaacaacatctgtatagacggtgaaagactagatactgaacttaaacagaaaatttacacagagtgcttcatgaaagggaaaagagtcacaaggaagcaaatctgtaactacttagtagcccaaggatgtataaaaagtgacgagcaagtaacaggtatagacattaatgttaacagcagcctatcaagttacggtaaaatgttcgccatattcggagagcatctgaaagaagacgccattagaaaagtagcagaagaaataatatactggggtacaatattcagcgactcgaagaaaatgtttagaaaacacctaaccaaatacgtagaacaaggtatattaggcgaatcacaagtcaaaagaatacttggctacaaatttaaagattggggtagattttcaaaagcactattgacactacaaggcatagataaaagtaccggagaactactaagcctcgaaaatgcaatgtgggaatattcactcaactttatggaattaataaactcagacgacttcacttttaaggatgaactagccaatagaagaacatctgcaataaaatccctatccgaatttacatatgaagatctagaagacacatatttctctgttcctgtgaaacggatgatatggcaaacaatcctagttgtacgagaaatagaacaaataatggggtacgcacccaaaaaggtctttgttgaaatggccagaagtgaagaagaaaaaggagacaagggaagaaaagattctagaggtactcaacttctcgaactgtacaagaatataaagaatacagaaaatcacgattggaagaaagaaataagcgaagccaatgaatcgggaaaactgagaagcaagaaattatacctatattacacccaaatgggtagagacatgtataccggagaagaaataaacatagatatgctttatgacgatagtatgtacgatatagaccatatatatcctagacattacgtaaaagatgactcaattgtgaataatctcgtgctcgttaatcgtagagctaaccaagacattaagaaagatttatacccaattcccgataaaattatctcgaacccaaaagtacaagaactatggaaaatgctacataaacaaaacttaatcacagacgaaaaatataaacgcttaatgagtagatctcctttcacagaaaaacaactaggagatttcatagcgagacaacttgtagaaactagacaaggcacaaaaggaatcgcagaattattagggcaattatttaaagacactgaaatagtatatgcaaaagcaacaaacgttagtgacttcaggagggacaatggatttgtaaaatccagattggtcaatgatttccatcacgctcaggacgcatacttgaatatagtagtaggtaatgtttactatacgaaattcactaaaaacccatggaatttcataaagaaagattttgacaaagacaggaataaaaacggatataacttagccaaaatgtttgaccgtgacgtagtacgaggagacgataccgcatggatagcatcaaagaaagatacacagggaactatagaaactgtacgaaaaatgatgcgcaaaaatacgcctcttatgacaagaatgtcgtttgaacaacacggaggcatagccaacgcaacactatactcagccaagaaagccaaagtagaaaactatatcccgctcaaatcatcagacataagactttcagatgtaaagaaatatggcgggttcacatcggctacagtagcatactacttcattgtacaccacaaagaaggcaagaaagaaaataccacaatagaggctttaccactatactgtaaaagaaaagtagaaaatgaagaaaatggtttattaaaatattgtgaagaagttttgggttatggagacgtcaaaatattatttaataaattaaaaattcaatccttacttgatataaacggataccaagcacacctatctgggaaaacggggaaccaattgacattaagaaatgcaatgaacctatgtgtacccgaaaaatggacagcatacattaagaaattggaaaaattagttgtaggccacgtaaaagagcaggaaatatcaagcgaggcaaatattgaactctatgacttactgaccgacaaacacctaaactcagtatatgcaaaaagaccaaatgcatatggacaaaaattgatagataaccgatcaaggttcgtaaacctgaaaccagaaagccaatgcgaagcaatattacaaatacttaaacttacgaaaataggtaataatgaaaccaatttaaaattaataggagaaagtgaacactcaggcaaaatgctcatatcgaaaaacttaaaagacacagataaacccgcaataatatgtcaatcagtgacgggcttatatgaacgaaaaatttatatatttgacgaacaactagacaaatga

SEQ ID NO: 8883 - RNA, 4095 nt, synthetic construct
  misc_feature 1..4095: note = Cas9 variant
  source 1..4095: mol_type = other RNA
atgaataagaggtacaatatcggactagacataggtacaaactcaataggttggagtgttgtcaatgatcaaagtcaacttgtcagaataaaaggaaaattgggttacggcgtaagattatatgatgaaggacaaacagctgaggacagaagattatttagaacaactagaagacgattaaaaaggcgaaaatggcgactaggtctgttgcgagaaatatttgaaccatacattactccacaagacgctaccttctttttacgacaaaaacaatcaaatttatcacccaaagacttacaaaaacaacaaccgcaaatcggcttattcaacgaccgactagactcagatttccactaccaatatccaaccatataccatttgagatatgctctcatgacagaaaaacgacagttcgatctcagagaaatatatctagcaatgcaccatatagtaaaatatagaggacacttcttaaatgcggccgctgcatcttcatttaaaagcggcgaaatagacctcgctaaagattttgcagccttaaaccagatattcggcaccatttttagcgaggtaggcttttcactaagcgaatccaacctcgatgaaatcaagtcaatcctcctagacaataatttatctgcatctgtaaggcaaagaaaagcgttaccgttaatatatcaaacagccgcatcaaaagattccgagaaacaatataaagccatcgcaacagaattactaaaagctatattaggtttaaaagctaaatttaacttaataacagggatagaggtagaagacgtaaaagcatggacactgtccttcaacgcagaagatttcgacgcaaaactatcggatcttaatatagcagacaacgatgatgcagtacaaattattgaaatcctgagagccttgtatagcggagtattgttaaccggcatagtgccagaaggacaaagtatatcacaggcaatgatagacaaatatgaagcacataaagcacacctcataatgctacgaagcatacgagaacaactatcagacaaagaaaataaggccttagaaaaagcgtatgatgattatattgatcatcccgaagataagcaacacggctcacgagaagatttctatgccgccatcacaaaagtactaaagaaagactcagaagacacaaacattattgaaattttaaaattaatcgaactagatcaatttatgcccaaacaaagaacaaaagataacggggcaataccccatcagttacaccaacaagaactagaccaaataatagaaaatcaaaaacaatactacccatggttagcagacataaatccgaacgaacaacggcagaaaatggccccatacaaattagacgagctagtaaccttccgagttccttactacgtaggaccgatgataacagcagaggaacaatttcaaacttccaacaagaaatttgcatggatgatcaggaaagagcctggggctataactccttggaatttcgatcaaaaagtcgaccgtcaagcatccgcgaatgaatttataaaaagaatgaccactacagacacatatctactagcagaagatgtactccccaaacagtctctcctttaccagcgatttgaagtgctcaacgaactaaatggaataaaaatagacgatcaacccataaccgtagaacaaaaacaagccatattcaacgataaatttatgcaacaagcccatgtaacagtcaaaaatattcaggcataccttgtatcagaaggtcaatatgcatctagacccaacataactggattgtctgatggtgagaaatttaattcttccctatctacctaccatgatcttaagaaaatattcggagacatgatagacgacccaaataaacaaacagattttgagaaaatgatcgaatggtcaacaatcttcgaagatggaaaaatattcgctgacaagctacgcgaaataaactggttaactgacgaacaacggcaaagattaagtaataaaaggtaccgcggttggggacaactatcaacgaaactcttaacaaaaattgtggatcaaaatggtcaaagaattatagatatattatggaacaccaatgataacttcatgcgtataatccacagtgatgacttcgaccaagcagtgacccaagcaaatcaaatgctcctcgcggacaatgatacacaagatgtcataaacgaactttatacatcacctagtaacaagaaagcactcagacaaatcctactggtagtcgctgatatacaaaaagccatgaaagggcaagcaccggcaagaatactcatagaatttgccagagaaaaacaagcaaatccgagattatctacccaaaggagacgacaagtcgaacaagtatatcaagaattaaacaacgaccaactaaacaaagaattagctgacccacaatacgctaatctatcaaaagacagattattcctatactttatgcaaggaggaagagatatgtacacgggagaatcacttaatattgaccgtcttagtgaatatgatatagaccatatactaccacaagcattcataaaagataatagtctagataacagggtcctcgttagcgcgaaaatgaacaggtcaaaaagtgatcatgttccattagacttcactgaagaaagatttggtcagaaaatgcgaagccaatgggaacaaatgcttagagccggtctactaacccgtaggaaatacaataacctcacactaaatccagatagtctaaacaaatatacaatgtcaggctttataaacagacaattagttgaaacccggcaagtgataaagttagcaaccaatctattagtagaccaatacgcagacgaagatgttcaactcgtcacggtaaaatcggggctaacacaccaaatgcgggaagactttgactttcctaaaaataggaacctaaataattaccaccatgcattcgatgcatatctaacagctttcgttggtttatatttacttaagaaatacccaaaactagcgcactatttcgtatatggacaataccaacaaggatttaaagcaaatgaccaatggcgcaactttaatttcctaaacggattgagacaagagcaacaagtggatgcggaaactggcgaacttatatggcaaaaagatcatgacttagcttacatgaacaaaatatatgatttcaagaaaatattagttacaagagaagtacacaccaaccatggcgctttatataaccaaactctctacaaagctaaagacgataaagcctcaggccaaggcggccgacaactgatagctgcaaaagaaaatagaccaactgcaatttacggtggctactcaggaaaaactgttgcatacatgtgtttagtaagaataacggaaaagaaaggagatttttatagaatatgtggcgtgcaaactgcatgggtagatgaactagaacacatagaagacgcaacaataaaattacaaaggctaacagccctcctaacgccacaattctcagctaccaagaaacaaaaagacgaagttgtaacagtagtaaaaccattcgaagtattactaccaaaaatattaataaaccaaaggttctatgatggaggacaagagctaacgttagcttccgcaacatacaaaaataacgcacaagaattagtattagacaagaaagcagtacaagttttaaatggacaactaccaaaagctgaattagaagctcaagccacagtagtttatgatcaaattctcgaacgagttcagaaatatttcccgctttatgatatgaactcatttcgcgaaaaattatttgttgggcgagacaaatttaatgaattaccctggcaagaccaatgggaaaatcacaaactcatacaagtaggacagaaaacaattcttgataggatactaataggtctccatgcaaacgccgcaatgggagatttaaaagccctaaacatgagcacaccatttggaaaactacaaaaatccaacggaatatcgctaagcccagaaacgcaaataatctatcaatcaccaaccggattgtttgaacgacgagtcgctttaaaagacttatga

SEQ ID NO: 8884 - RNA, 4095 nt, synthetic construct
  misc_feature 1..4095: note = Cas9 variant
  source 1..4095: mol_type = other RNA
atgaaaaacctcaaagaatattatatagggttagacataggaacagcatcagtcggctgggcagtaactgacgagagctacaacataccgaagtttaatggaaaaaaaatgtggggagtcagactttttgacgacgcaaaaacagctgaagaaagaagaacacaacgtggaagtagacgtcgactaaacagaaggaaagaacggataaatttactacaagatttatttgccacagaaataagtaaagtagacccaaatttcttcctgagattagacaatagcgacctctatcgagaagacaaggacgaaaaactgaaaagtaagtataccttatttaacgataaagacttcaaagaccgtgactaccacaaaaaataccctactatacaccacctgataatggatttaatcgaggacgaaggtaaaaaagacatacgattactatacttagcatgccattacttgttaaaaaacagggggcactttatctttgaaggacaaaaattcgacactaaaaactcctttgataaaagtatcaatgatttgaaaatacacctgcgagatgaatacaatatcgatttagaatttaataacgaagacttaatagaaattataaccgatacaaccctaaataaaacaaataaaaaaaaagaactgaaaaatatcgtcggagataccaaatttctaaaagcaataagtgcaataatgatagggtcaagtcaaaaactagttgatttgtttgaagatggcgaatttgaggaaacaaccgtaaaatcagtggacttttcaacaacggcatttgatgataagtattcggaatatgaggaagccttaggagatacaattagtctcctaaacatcttaaaatcgatatacgattcaagcatactcgaaaatctactgaaagacgcagataaatcaaaagacggaaataagtacataagtaaagccttcgtaaaaaaatttaataaacacggaaaagacttaaaaacactaaaacgtataataaaaaaatacctaccatctgaatacgcaaacattttccgaaataaatccataaatgataattacgttgcctacacgaaatcaaacatcacgagcaataagagaacgaaagccagtaaattcaccaagcaagaagacttttacaaattcataaagaaacacttagatacaatcaaagaaacgaagcttaactcatcagaaaacgaggatctaaaactaatcgacgaaatgctcacagacatagaattcaaaacatttataccaaaattaaagagctccgataacggagtaatcccataccaacttaaattaatggaactaaaaaaaatactagataaccagagtaaatactatgatttcctaaatgaatccgatgaatacggaacagttaaagacaaagtagagtcgataatggagttccgaataccatattacgtagggccactaaatcctgacagcaaatacgcctggatcaaaagggaaaacacaaaaataactccatggaacttcaaagatatagtagacctagatagtagcagagaagagttcatagacagactcataggaagatgcacatacctaaaagaagaaaaagtcttaccgaaagcctcgctaatatataacgaattcatggtcctcaatgaactaaacaacctaaaactaaatgaatttttaataacagaagaaatgaaaaaagccatcttcgaagaacttttcaaaacaaaaaaaaaagtaacactaaaagcagtaagtaatttgctaaaaaaagaatttaatctaacaggggacatattactcagtggcacagacggcgacttcaaacaaggattaaactcttacatagactttaagaatataatcggagacaaagtagatcgcgacgactacagaatcaaaatagaagaaattataaaactaatagtactctatgaggatgataagacatacctaaaaaaaaaaataaaatcagcctacaaaaacgactttacagacgacgaaataaaaaaaatagcagcgcttaattataaagattggggcaggctatcaaaacgcttcctaacgggaatagaaggcgtagataaaaccacaggagagaaaggttcaataatatacttcatgcgagaatacaatcttaacttaatggaattaatgtctggacattacaccttcactgaagaagtcgaaaaactaaaccccgttgaaaatagagaattatgctacgaaatggtagacgaattgtacttgtcaccctcggtaaaaaggatgctatggcagagcctaagggtagtggacgaaattaaacgtataataggaaaggatcctaaaaaaatattcatagaaatggcccgcgcgaaagaagccaaaaattcccgcaaagagtcaagaaagaataagttactagagttttacaagtttggaaaaaaagcattcattaatgaaataggggaagaaagatacaactatctgctaaacgaaataaacagcgaagaggaatcaaaatttagatgggataacctatacctatactatacacaattaggtagatgcatgtactcactagaaccaatagacctagctgacttaaaatcaaataatatttacgatcaagatcacatttatcccaaaagtaaaatctacgacgacagccttgaaaatcgagtactagtaaaaaaaaaccttaaccacgaaaaaggtaaccagtaccctataccagaaaaagtattgaataagaacgcctatggattctggaaaatattattcgataaaggactaataggacaaaaaaaatacacaaggttaacacgacggacaccatttgaagaaagagaactagcggaattcatagaacgacaaattgttgaaacccgccaagctactaaagaaacagcaaacctattaaaaaacatatgtcaagacagcgaaatagtatattcaaaagcagaaaacgctagcagattccgacaagaattcgatataataaaatgcagaacagtaaatgatttgcaccatatgcacgacgcctatttaaacatagtagttggaaatgtgtataatacgaaatttaccaaaaatccactaaactttattaaagataaagacaacgttcgatcgtacaacttagaaaacatgttcaaatacgacgtagttcgcggatcatacacagcatggatagcagacgacagtgaaggaaatgtaaaggctgccacaattaaaaaggtcaaacgagaattagaaggcaaaaattacagattcaccagaatgagctacataggcaccggaggtctttatgatcaaaacctaatgcggaaaggaaaagggcaaatcccacagaaagagaatactaacaagtccaacatagaaaaatacggaggatataacaaggctagctccgcttacttcgcactaatagaatcagacggaaaagccggtagagaaagaacactagaaacaataccaataatggtatataaccaggaaaaatacggaaacacagaagcagtagataagtatctaaaagacaacctggagctacaagatccaaaaatcttaaaagataaaataaaaataaatagtttaataaaactagacggcttcttatataacattaaaggaaagacaggagatagcctttcaatagcaggaagcgtacaactaatagttaataaagaggaacaaaagttaatcaaaaaaatggataagtttctagtaaaaaaaaaggacaataaagacataaaagtcactagctttgataacataaaagaagaagaactaataaagttgtacaaaacactcagcgataaattaaataatggcatatactcaaacaaacgaaacaaccaagcaaaaaacatatccgaagccctggacaaattcaaagaaatttcaatagaggaaaagattgatgtactaaaccaaattatattactctttcaaagctataataatgggtgtaatttaaaaagtataggtttaagcgcaaaaactggagtcgtattcataccaaaaaaactcaattacaaagaatgcaaattaatcaatcaatcaataacaggactatttgagaatgaagtagatctcctaaacctctga

SEQ ID NO: 8885 - RNA, 4098 nt, synthetic construct
  misc_feature 1..4098: note = Cas9 variant
  source 1..4098: mol_type = other RNA
atgtataagaaagactacacagtggggctagacatcggctcaaccagcgtaggatttgccgccatcgatgacgattaccaacctatacgtttgaaaggaaaaagggtaataggggtgagactgttcgaagaagggaaaaccgccgcagaaagaagaaacttccgaaccacaagaagacggttaaacagaaggaaatggagactgtccttactagaagagattttcgacccctacatggcaaaagtagacccaacattcttcgccagactcaaacaatctaatttattcccaaaagacaaaaacaagaaattcacaggatccctactattcccaaaaactacagattcgaaattctacgacgaataccctacaatttatcatctgagatatcatcttatgaatgatagccgaaaattcgatctccgtgaaatattcctcgcaatacatcacatcgtaaaatacagaggtaacttcctaaattcagcccccatagcgtccttcagtacagacaaaatcaacttagttgacgactttgaaactgttaacgcagcatatctccaaatcaactcctcaaacccagtacaactagatacagaccaagcagatcaagtatcccgtattctactagacaataaattatctaacttagacaaacaaaaacaagcagctaaagcacttgcacagaaaagtggcgacaagaaacaagataaaataaacaacacaaccattaaacaaatctgcaaagctctactaggttataaattcgacctagcagtcgtacttaacatagattctgacgaccacaataaatggaaactacaactatcagacgaaaacattgactcccgattagcagagttgacaggcgaactaaatgaagctcaacttgatatcctaaacgtcctgtcacgattatacagtcaaataaccctaaacgatatagtcccctcaggtatgacactatcagaggcaatgatagaaaaatataaagctcacaagaaacacctaaaaatgctcaaagattttgcaagatccttatcaaagaaagattatgggcaagtaatggaagcatatgcggaatacatcggaaacataccagaaagtgctagtagcaaagcacaaaagaaaatcagccaggatgatttctataagaaaatcaaaagatatctagatgacagcaaactaggccagaaaatcgccgaattaatagctaaaaatgagttcatgcctaaacaacgcacaaaccaaaacggggttataccttatcaactacatttgaaagaactgaaccaaataatcgaaaaccaaagcaaatattacccctggctggcggaattaaaccctaacgagaaaagacgaggcaaagctaaatataaactatcagagctagtagccttccgcataccatactacgtaggccctctaataacccaagaagaacaacagaaaacatccaacgcaaatttcgcatggatgatacgaaaatccgaaggaagaattaccccttggaactttgatgaaaaagtagatagaatcgctacagcaaatcgtttcataaaacgaatgacaacaaaagacacatacttaatcggcgaagatgtcctaccagcccactcactactatacgaaagatttaaagtcctcaacgaactgaacatgatacgcgtcaataaccatagactatcagtaggtcaaaaacaagatgtcttcgaaaaactgtttcaaaaacataaaaccgtaaaaaccagagaactaatcaaacaattgatggcctcaggcttacctacacaaccacgaataactggactatcagatccagctaaatttaacacatcattaggtacatataacaacttcgccaaaatcctaggagacgaaataaatcaaccggacagacaagaagatttcgagaaaattatcgaatggattactatattcgacgataaagacatattaaaaacgaaactttcagaactcagttggctagatgaaaaacaaattaacgcgcttataaataaaaactacagtggatggggtaggctgtccagaaaattattaaccgaacttacaaacaagaaaggccaatctatcatcgatcgaatgtggaacacacagaaaagttttatagaaataattaacgaaccagtattcgctgaacaaataaaagacgccaatcaagaccaactcgacgaagatgactacgaaacagttctccatgacgcttatacatctccacaaaataagaaagccataagacaagtaataaaagtagttgacgacatagtacgagcagctggccgagcaccaaaatttataagtctagagttcgctagagaagatcaagaatcaaggcgtacacaaagcaggctatcgagaataaagaaaatatacgaaacaacaaccaaagaattagtcgccaacgatcaaatcagagaagaattaggaaatgtaaaagatctaaacgatcgattatttttatattttacacaactaggccgcgatgcttacacgggtgaaagaataaatattgatgacataagcacgaaatacgacattgatcacatattccctagagcatttataaaagacgattctttagataacaaagtcctagtaaaacgagcagtaaataacgggaaatcaaataacgttccattaaaactctttggagcgaaaatgaaaccaatctggaaaatgtggaaagaccatcaattaatttcaaaacgaaaatatgaacatctcatgaccaacccagatgcgatagataaatataaagcaaatggtttcattaacagacaactaatagaaacacgccaaatcataaaacttgcagcaaacatacttgcaaaccgctattcaacagaagacacaaaaataatagaagttaaagcgaatctcaaccatcaactccgacaatcattacacctatataaaaaccgacaagtaaatgattaccatcacgcagtagatggatacttaagtgctttcgtgggccaatatctataccatagatacccatcactacaatcttatttcgtctacggtcagtatcagcgatttttcgataaacaagtacaggaaaacatgaaatttaataggtttaactttttatatgacttaacagatagagacaatgaccaaattgttgtaaaatcgacaggggaaatagtgggagaaaaatccaaactaattgaacaaataaaatgggtttaccgctacaaatttatgctcgtcagccaagaagtattcacaaagacaggtcctttattcgaccaaacaatataccccgctggaagcaataaatcgagactgatcccaatcaagaaagaccgtccaacagacatctacggtggttacagctcaagcacggatgcatatatgagcctaataagagttcctgacaagaaagaagataaatataaagtagtgggcgtaccttcaagatccctagcaagtctaaatagagcggaaaaacgcggccacgacgcatatcttgaccaactcagacaagtcatagcgaaaagccagaagaaagagttccaaataataatcccaaaactacgatataggcagctcatcatagatggaggacttaaatatacactaggatcctccgcctaccaatataacgcgagacaattagtactaagcgaaaaatcaatggaagttttagttaccgatttcagcaaagtgactacagatcttgacaaacagaaccaaaaactaatagccgtgtatgatgacattttagacaaagtaaacagatgcctcccactctacgataaaaatcaattcagaaaagcattaaacggcgctagagacaaattcgtccaacttccaatacttcctaaatttaacggcaataagaaagaagaagcaggaaaagtagaaatcctaaacgaaatactactaggactacacgatgatgcatcaacaggcaacctaaaacctctcggaataaaaactccctttggcatgctacaaactcaaagcggtataacaatgtcctccaacgctgtaatagtcaaccaatctcctactggcttattcgaacatagaatatatttgaaagctctactgaataaactcaataaatga

SEQ ID NO: 8886 - RNA, 4098 nt, synthetic construct
  misc_feature 1..4098: note = Cas9 variant
  source 1..4098: mol_type = other RNA
atgacaaaattgaaccaaccatacggaattggactcgatataggaagtaatagtatagggttcgccgtagtagacgcaaattcacatctgctacgacttaaaggcgaaacagcaataggagcaagactcttcagagaaggccaatcagcagcagatcgcagaggctcacgaactacaagacgcagattatcgcgaacaagatggagactgtctttcctaagggacttcttcgctccacacataacgaaaatagacccagacttcttcctaagacaaaaatatagtgaaatctcaccgaaagataaagacagattcaaatatgaaaaacgattattcaatgatagaacggacgccgagttctacgaagattatccatccatgtaccatctcagattacacctaatgacacatacacacaaagctgatccccgagaaatcttcctcgctatacatcacatacttaaatctcgaggacactttttgactcctggtgctgcgaaagattttaatacggacaaagtagacctagaagatatattcccggctctcaccgaagcatatgcacaagtttacccggacctagaactaaccttcgacctcgcaaaagcggacgattttaaagccaaattactcgacgaacaagcaacaccatccgacacgcaaaaagccctagtcaaactcctgctctcatctgacggtgaaaaagaaatagtaaagaaaagaaaacaagtattaacagagttcgcaaaagcaataacaggattaaaaacgaaattcaatttagcattaggaacggaagttgatgaagcagacgcaagtaattggcaattctcaatgggacaactcgatgataagtggagcaatatagaaacgtccatgacagaccaaggaacggaaatattcgaacaaatacaggaattatacagagcaagattactcaatggaatagtaccggcaggcatgtctttgtcacaagcaaaagtagcggattacggtcaacataaagaagatttagaacttttcaaaacatacctaaagaaattgaacgaccatgaattggctaaaaccataagaggcctctatgatcgatatataaatggagacgatgcaaaaccattcctcagagaagattttgtcaaagcattaacaaaagaagtaactgctcatccaaacgaagtgtccgaacaattgctaaataggatgggacaagcaaacttcatgcttaaacaaagaaccaaagctaatggtgcaataccagtacaattgcaacaaagagaattagatcaaataatagcgaaccaatctaaatactatgactggctggcaaaaccgaacccggtagaaaaacatagggcaagcaaaccataccaattagatgaattattaacattccgtataccctattatgtaggaccgttaatcactccgaaacaacaagcagagagtggtgaaaacgtgtttgcctggatggtaaggaaaaacccaagcggaaacataactccatacaactttgacgaaaaagtagatcgagaagcatcggcaaacacgttcatacaaagaatgaaaactacagatacatatttgatcgatgaagacgtactccccaaacaatccctattatatcaaaaatacgaagtacttaacgaactaaataatgtacggataaataatgaagccttaagcaccgaccaaaaacaacgactaatacatgaagtctttgaaagacatagcagtgtaaccatcaaacaagttgtagataatcttgtagcacatggagacttcgcacaacgtccagaaataagaggactcgctgacgaaaaacgcttcctatcctcactttcaacttaccatcagctaaaagaaatcttgcatggagctattgatgactcaacaaagctacacgacatagaaaacataataacatggtcaaccgtatttgaagatgcggccatatttaaaactaaacttgcagaaattgattggcttgatccagcaaccataaagaaattgagcaacatacgatatcggggatggggacaattctcacgaaaattattagacggattaaaattaggaaatggccatactgtcatacaagaactaatgttaagcaaccacaatctaatgcagatactagctgatgaaacattaaaagaaacgatgactgaattaaaccaagacaaattaaaaacagacgacatagaagatgtaattaacgacgcttatacatcacccagcaacaagaaagcattacgccaagtactacgagtggtcgaagatattaaacatgcagccaatgggcaagacccaagctggctctatatagaaacggcagacgggacgggaacagcaggaaaaagaactcaatcacgccaaaaacaaatccaaacggtttatgcgaacgcagcgcaagaactcattgacagtgcagtaagaggggaactcgaagacaaaatcgcggataaagcatcttttacggataggctagtcttatattttatgcaagggggaagagacatttatacgggtgcacctctcaacatagaccagctatcacactatgacatcgaccacatcctaccacaaagccttatcaaagatgattcactagataacagagtattagtcaatgccactataaatcgagagaaaaacaacgttttcgcttccacattattcgcgagcaaaatggcagcaacatggcgaaaatggcacgaagctggattaatcagtggaagaaaactaagaaatctaatgctacgacccgacgaaacagacaaatttgcgcatggattcgtagcaagacagcttgtagaaacaagacaaattatcaaactaacagaacaaattgcagccgcccaatatccaaacactaaaattatcgcggtaaaagcgggcttatcccaccaactaagagaagaactagacttccctaaaaatcgagatgtaaatcactatcatcatgcatttgatgcatttctagcagcaagaataggaacttacctcctgaaaagatacccaaaactagcgccatttttcacctacggtgaatttgcaaaagtggatgtaaagaaatttagggaatttaactttataggggcacttacacatgcgaagaaaaatatcattgcaaaagacacaggagaaatagtatgggataaagagagggacattcaagaattagaccggatctacaattttaaaagaatgttgataactcatgaagttcactttgagacagccgacttatttgatcagacaatatatgcagcaaaagatagtaaagagagaggaggaagaatgtcactcatacccaagaaacttggatacttaacgggaatatacggcggatatcaaacagaaagaggatcatatgtatctatcataagaacatttaagaaaggagaaaccatatacaaagtagtaaatatactcaccgccgacgtatcactcttgagcgaaaaagaaaaagtaagtaaaacgctggcagacatctatttaaaagaactcatcgcaaagaaattatcaaaaggaaaatcaggcaaaaacatagccagtgaaccttttgaaatcgtactaccgcgagttggaaaagattcattatttaaaaacaagaaatatggactcttcttaatagaatcagctactgaactacataattaccaagaactatggctaccaagaaatgatcaactactaataaaacgaatacaggcaagacaaatagaggaaagtaaagcagactacgagctaacacgaatgtacagaaatatagcatggcaagtggatcactacttccgactatacaaaatcagaaaatttgcagaaaaattacaagcatctgttgaagatttcgcaggattaccagtgtacaaaaatgagacaagtgacggaaaagttgaagttctcgcaagcgtacttaaacgattaaatggagcagctgataaaggaagaacaaacccaacaacagtcaaattacaatcagactttggaagaactttgttaactaacgggatagtactcgaagatgacagttcgatagtgtatcaatccccaaccggactcttcaaaaggagtgtaaaactcgtcgatctatga

SEQ ID NO: 8887 - RNA, 4098 nt, synthetic construct
  misc_feature 1..4098: note = Cas9 variant
  source 1..4098: mol_type = other RNA
atgaccaaagaatattacttaggattagatgtaggaacaaactccgtaggatgggccgtaacggactcacaatacaacctatgtaagttcaagaaaaaggatatgtggggaatcagactatttgagtcagcaaataccgccaaagacagaaggctccagagaggcaacagaagacgactagaaagaaaaaaacagagaatagatttactccaagaaattttcagcccagagatatgtaagatcgaccctacgttttttatccgtctaaacgaaagtagactccatttggaagataaatcaaatgacttcaagtacccattatttatagaaaaagattactcagacatagaatactataaagaattccccaccatattccatttaaggaaacacctaatcgaaagcgaggaaaaacaagacatacgactaatatacttagcacttcataatatcattaagacccgcggccatttcttaatagatggagacctgcaatccgctaaacagctccgaccaatactcgatactttcctactaagcttacaagaagagcaaaacttaagcgtatccttgagcgaaaaccaaaaagacgaatacgaggaaatattgaagaatcgttcaatagcaaaatcagaaaaagtaaagaaactaaaaaatttattcgagatctccgacgaattagaaaaagaagaaaaaaaagcacaaagtgccgtaatagaaaatttctgcaaattcatagtaggaaataaaggggacgtgtgcaaatttcttagagtcagtaaagaggagctagaaatagactcattcagcttctcagaaggaaaatacgaagatgatatagttaaaaatctagaagaaaaagtaccggaaaaggtatatttatttgaacaaatgaaagccatgtacgactggaatatattggtagacatattagaaacagaagaatatatatcctttgcaaaagtaaaacaatatgaaaaacacaaaacaaacctaaggttattgcgagatataatattaaaatactgtactaaagatgaatataacagaatgttcaatgacgaaaaagaagctggcagctacactgcgtatgtaggaaaactaaaaaaaaacaataaaaaatactggattgaaaagaaaagaaacccagaagaattttataaaagtctcggaaaacttttagacaaaatagaacccctgaaagaagatctagaagtattaacaatgatgatagaagaatgcaaaaaccatacacttcttccaattcaaaaaaataaagacaacggtgtcataccacaccaggtgcacgaagtggaacttaaaaaaatactagaaaatgccaaaaaatactatagttttttaaccgaaacagataaagacggatattcagtagtacaaaaaatagaatcaatttttcgatttagaataccatattacgtaggtcccctatccactagacatcaagagaaaggtagtaatgtatggatggtgcgcaaaccaggcagggaagatagaatatatccctggaacatggaagaaatcatagactttgaaaaatccaacgaaaatttcatcacaaggatgactaacaaatgtacttacttgataggcgaagatgtattacccaaacactcactactatacagcaaatacatggtcctaaacgaacttaacaacgtaaaagtaagagggaaaaaattaccgacaagcctaaaacaaaaagtgtttgaagatttatttgaaaacaaaagcaaagttaccggtaaaaatttactagaatacttacaaattcaagataaagacattcaaatagacgacttatccggtttcgataaggatttcaaaacaagcttaaagagctatctcgacttcaaaaaacaaatatttggagaggaaatagaaaaggaatcaatccagaatatgatagaagacattataaagtggataacaatatacgggaacgataaagaaatgctaaaaagagttattcgagcaaattatagtaaccaactgactgaagaacaaatgaaaaaaataacaggtttccaatactcaggatggggaaacttctcgaagatgttcctaaaaggtatttcaggaagtgacgtttcaactggagaaacatttgacataatcacagcaatgtgggaaaccgataataatctgatgcaaatattaagtaaaaaatttacgttcatggacaatgtcgaagacttcaactcaggtaaagtgggaaaaatcgacaaaataacctacgattcaacagtaaaagagatgttcttgagtccagaaaataaacgtgccgtctggcaaacaattcaagttgcggaagaaattaagaaagtaatgggctgcgaaccaaaaaaaatatttatagagatggccaggggcggcgaaaaagtaaaaaaacgaactaaaagcagaaaagcacaactactcgaactatatgctgcatgtgaggaagattgtagggaactaataaaagagatagaagacagagatgaaagagactttaatagtatgaaactcttcctatactacactcaattcggaaaatgtatgtacagtggcgacgacattgacataaatgaattaataagaggtaatagcaaatgggatagagatcacatatatccgcaatccaaaattaaagacgactcaattgacaacctagtactagttaataagacgtacaacgctaaaaaatccaacgaactactatcagaagatatacaaaaaaaaatgcatagtttttggttatcactactcaataaaaaactaataactaagtcaaaatatgacagactaacaagaaaaggcgatttcacagacgaagaactgagcgggtttatagcaaggcaactagttgaaacaagacaatccacaaaggcaattgcagacattttcaaacaaatatacagtagcgaagtcgtatatgttaagagttcacttgtatccgattttcgaaaaaaacccctaaactacttgaaatcgaggagagtaaacgactaccaccacgcaaaggacgcctatttaaatattgttgtaggaaacgtctacaacaaaaaatttacttcaaacccaatacagtggatgaaaaaaaatagagacacaaattacagtctaaacaaagtattcgagcacgacgtagttataaacggagaagtaatatgggaaaaatgtacctatcatgaagacacaaatacatacgatggcggtacacttgatagaataaggaaaatagtagaaagggacaacatactatacaccgaatacgcctattgcgaaaaaggcgaactatttaacgcaactattcagaataaaaacggaaactctacagtcagcttgaaaaaaggtctagacgtgaaaaaatatggcggatactttagcgcaaatacatcatatttcagtctaatcgaattcgaagataagaaaggcgatcgtgccagacacataatcggcgttccaatatacatagcaaatatgttagaacattcacccagtgccttcttagagtactgcgaacaaaaaggatatcaaaatgtacgcattctagttgaaaaaatcaagaagaatagcttactgataataaatgggtacccattacgaataagaggagaaaatgaggtagacacctcattcaaaagagcaatacaactaaagttagaccaaaaaaactacgaactagtgagaaacatagaaaaattcctcgaaaaatacgttgaaaaaaaaggcaactatcccatagacgagaatcgtgaccatataacacacgagaaaatgaatcagttatatgaagtactactatcaaaaatgaaaaaatttaataaaaaaggaatggcggatcctagtgatagaatagaaaaatcaaaaccgaaattcataaaacttgaagacttaatagacaaaataaatgtaataaataaaatgctaaacctactacgatgtgataacgatacaaaagcggacttaagccttatagaactaccaaaaaacgcaggctctttcgtagtgaaaaaaaatacgataggaaaatccaaaataattttagtaaaccaaagtgtaaccggactctatgaaaatagacgtgaactgtga

SEQ ID NO: 8888 - RNA, 4098 nt, synthetic construct
  misc_feature 1..4098: note = Cas9 variant
  source 1..4098: mol_type = other RNA
atggacacagccaaaactaacaaacaaccatactatattggtttagacatgggaacgagcagtgttggttgggcagtaaccgatgcaagctacaatgtagtcaaaaaacacggcaaagcattatggggagtaaggctatttgaagaagctcaaaccgcagctgaccgtcgactccatcgtaccgcgagaaggagaattcaaaggagaaaacaaaggctggcattattacaagaattattcgcaaaagaaatatgcaaagtagatccgggcttttttatacggttacacgaatcaagattatggcaagaagataaatcgattgatcaaccaaataccctttttaacgatgaagattttgacgacaaagcataccacaaagcatatcccacaatttaccacctaagatatgccttaatgaccgaaaataaaagcttcgatgtaagactagtatacttagcgattcaccacattatcaaacacagaggtcactttctattagaaaattacgatctatccaatcaagaaacttcaggatttgatgaaagttacatcgcattgactaacgctataaaggaactactgcaaaaagagatccctgtaggtcacgtggaaaagatacaaataatattaaaagataagtcactctcaaaacgagaaaagacagaaaaaatattacaagtttgggacgtaataaaagacaaacaactaaaagaagttgttcaactaatatgcggtgggacagcaaacctaagcacactcttcatggatgagagcctaaaagaggcattaaaagtatttgaaataaaggattcaaaaatttctttttctacagccgtttatgaagaaaaggaaagcgacttgcaaagtgttctagaacaacgttttgacttggtatacgctgccaagatgctttacgattggtcactacttgctgaactaatgggggaccgtaaaacacttagtgaggcaaaaattgccatctatgaaacacataagaaagatctagaagtcctaaaacgcctaacacgacaagataaaagcctctacagaaaactattccgcgggaccgataaagattcttattcggcctatgttggatcatgtatgattcatggagaaaaactggttatcgaaaaaagaggaagcacagaagaattttacaaatttctaaaaaaagaaatatcaaaactaccagactgcgaagataagatatacgtattgtccaaaatagaagcagaaaacttcttaccgaaggctgtcagcacaataaatggaatcatcccttatcagttgcaagaacaggaacttgacataatattaaaaaaagcagaacagtacttacccttcctcatggaaaaagacgcttacggaacgataagcgagaaaattaaacaactactaacattccgaatacctttttatgtaggaccactcaatagacactcagataaatcatgggcagtacatactgataaagaaggaagaatactcccatggaattttaatgaacgtataaacgaggaaaaatcagccgaaaaattcattacaagaatgaccaataaatgcacatatctattgggtaaggatgtattaccaaaaaacagcctactatacaccgaatatatgttgtttaatgaattgaacaatgtaaaaataggcaaggcaggaacatacctcaccgaagaacaaaaagaaaaactttggaaagaactattcttaacaacgaaaaaggttactttatctaaattttctaaattcttaataaaagaaggaatagacaaagaagaagcagttgaaataaaaggattagatggagggttcaagagttcattagcaccatggatagacttaaaaaatatactaggtgaagatttcacaagagataaagcagaagaaattataaaagctataacgctatttagcatggacaaaaaaatcttaaaaaaatacttaatgagaattgtaagcgaaccagtagcaaaacaattatcaaaattacgatatacaggctggggaagattctctaaagaattcctaactgaaatcacacccagagtaacagatgatgtacaagtattggtagatacctcaacaggtgaaatcatgaatataatcacagccctcaaaaaaacctcattaaacctaatggaaatattaagctccacttatgggtactcagcagcaattagcgaagcaaacaaagaactagtcggaaatacagtgctctcttatgaaactgtgaaagaattaacagtaagcccagctgtgaaacgacccatttggcaaacattaaaaattataaaagaaatcacccatatcatgggcgcagagccagcaagaatattcatagaaatggcgcgagataaacaaccagacaaaggacggacggactcccgcaaaaaacaactaatagaactgtacaaaaagtgcaaggaagatgtacgttcatggagcaacagagaatctaaggattgggtagaagaaatagaatcaaaatcagatagccaactcaggagtaacaaactatttctctactacactcaaatgggaaaatgcatgtacacaggaaaaccgattgacctgggagcactccttaaaggtcaactatacgacagagaccatatttacccccaatcacaaacaaaagacgacagtcttgacaatctagtcatagtagataatcgagaaaaccgagataaatcaaacacctaccccctatcaaaaaacataagagaacgacaaattgggttctggaaactactaagagataaaggattcatctcgaaagagaaatacttcagattaacaagaaatacaccgttttcagatgcagaaaaagccgaattcatcgcccgtcaactagtggaaacacgacaaagcacaaaagcagtggcagaaatattgaaaagagtattacctaaatcaataatagtatatgtaaaagccggtctaacttccagatttagacaatacggagaatttataaaagtaagggacctgaatgactatcaccacgcaaaagatgcctatctaaacatcgtcacagggaatgttcattacaccaagttcacaagcaatccaatacgattcgttaaagattgccaaatatattcactgaacgaacacgcgctgtataaatacaccgtagaacgcaatggagtcgtggcatgggcacccaacgaagaaggtatgatgccttcagtcacaagatggatgaataagaacaatatactggtcacgagaatgagttatgtgggccaaggagaactattcgatcaattacctctcaagaaaggcaaaggtcaagtgtcattaaaaaaagaaggagccatcagtgatatctcaaaatatggcggctacaactcagctagtactgcatatttcatgtatgtggaaggcgaagataacaaaggaaaaccggtttatgttatcgaaacaatgccattacatcttgcagctcgccttaccactttagaagaaaaacaaaaatactgtgaagaactttggatgagcacaggcggaaagttaaaaaatccaaaagtattaatagaacaaatcccaatccaatcattattttcagtagatggattcagagtaaccatcgctggaaaaacaggtaaacaatatggatgcagactagcagaagaacttgttttaaacaacggctacgcaatgacattaaaggctgtgcttaaattcgtaaaccgaagaaaaatgaataaggaggcactaattacatcttacgatcatctagaagaaagtcagctattagccttatacgatgtcttcttagataaattagaacactcatgcttcagtaaaagattcagtacgcagagagatgttctaaaaaatggaagagaatcatacatagcattaagtctagaagataaatgccaaatcctaagtgaaatacttcatttgttccaatgtaacgctactttaagcaatttatcacttctaggatctagtaaacaatcgggaagactgtacatgtcaaaaaatttatcagacaaagactcttggtacataattcatcaatcagtcactggattctacgaacaacatataccattagccccttacaaaaaatcgtga

SEQ ID NO: 8889 - RNA, 4098 nt, synthetic construct
  misc_feature 1..4098: note = Cas9 variant
  source 1..4098: mol_type = other RNA
atggttaaaaaaaaatacgcaataggaatcgacataggtacaaattcagtaggatggtcagttgtaacagacgattacaaagtaccatctaaaaaaatgaaagtattcggaaataccgagaaacgatatataaaaaaaaacctactagggacattactctttgacgaaggcaacacagctgaaaacagaagactcaaaagaactgcccgacgccgatatacacgaagacgaaatagaattttatacttacaagagatcttcgctgaagaaataaataaaatcgatgactccttcttccaacgactagatgatagcttcttaatcgtagaagacaaacaaggaagcaaacacccaattttcggaaccctacaagaagaaaaaaaataccacaaacaatttccgacaatataccacttaagaaaacagctagcggacagttctcaaaaagcagatatacgcctcatatacctggcacttgcacacatcattaaataccgaggacatttcctgtttgaaggagacctcaaatccgaaaacaaagatgtacaacatctatttaatgactttgtagaaatgtttgataaaacggtcgaaggaagctacctatcagaaaatctccccaatgtagcagatgtcctagtagaaaaagtatcaaaatccagacgcctcgaaaacatattgcattactttcccaacgagaaaaaaaatggactatttggaaattttttagctctagctctaggcctgcaacctaatttcaaaaccaatttcgaactcgcagaagatgccaagatccaattctctaaagagacatatgaagaagaccttgaagaattactcggtaaaattggagacgactatgcagacttattcatagcgactaaaagcctctatgacggtatcctattggctggaatcctctcaacaacagactcaacaactaaagctccattatcatctagtatggttaaccgttatgaagaacataaaaaagacctagcacttttgaaaaacttcatacaccaaaacttatctgacagttacaaagaagtgttcaatgacaaattaaaagacgggtacgcaggatatatcgaaggaaagacaactcaagaaaacttctataggttcataaaaaaagccatcgaaaaaattgagggatccgattacttcattgacaaaatcgatcgtgaggattttctaagaaaacaacgcaccttcgacaacggatcgattccccaccaaatacatcttcaagaaatgcacgcaattatcagaagacaggcagagttctatccatttttagtcgaaaaccaagacaaaatagaaaaaatattaacattcagaataccatattacgtcggcccattagctagaggtaaatcggaatttgcatggctaaaccgcaaaagcgatgagaaaataagaccgtggaacttcgatgaaatggtagacaaggaaacaagcgcagaaaattttatcactagaatgacaaactacgatcaataccttccagatcagaaagtactaccaaaacatagtctcctgtacgaaaaattcgcagtctacaacgaattaacaaaagtaaaattcatagcagaaggcatgagggactaccaattcctagacagcggacaaaaaaaggacatcgtaaaaaccctctttaaaacaaaacgcaaagttacagcaaaagatatcaaagcttacctagaaaactcaaatggttatgccggagtggagcttaagggcctagaggaacaatttaatgcaagcttacccacctaccacgatctcttaaaaatattacgcgacaaggcatttattgatgcggaggaaaaccaagaaatcttagaagacatagtcctaacattaaccctctttgaagacagagaaatgataagaaaaaggctagaaaaatataaagacatattaactgaagaacaaaggaaaaaacttgaacgcagacattatactgggtgggggagactcagtgccaaactaattaacggaattctagataaggtaactaggaaaacaatactgggatacctcatagacgacggaacaagcaataggaatttcatgcaactaattaacgatgacacactatctttcgtcgacgaaataagactagctcagggtagcggagaagcagaagactatcgagcagaagtacaaaatctagcaggatctcctgcaataaaaaaaggaatactccaatcattaaaaatagtagatgaattgatcgaagtcatgggatatgaccccgaacacattgtagtcgaaatggcacgagaaaaccaatttacgaatcaaggaagaagaaattcacaacaaagatacaaaaagatagaaaatgctataaaaaatcttgacagtaacttaaactctaaaatactaaaggaataccccacaaacaatcaagctctacaaaatgatcgactattcctctactatttacagaatgggaaagatatgtatacagacgaagaactagacatagatcaacttagccagtatgatatagatcatataataccacaggcattcataaaagatgactcgctagacaacaaagtattaacaaaatcagcaaaaaacagaggtaaaagcgacgacgttccatcactcgaaattgtacataaaaaaaagaatttttggaaacaacttctagattcacagctcatcagtcaacgcaaatttgacaacctcaccaaagccgaaaggggaggtctaacaaatgaagacaaagcaagattcatccaaagacaattagtcgagacacgccaaatcacaaaacatgttgcacgtatattagatacaagatttaataccaaactagatgaggcaggcaatagaatacgagaccccaaagtgaacattataacactaaaatcgaatctcgtaagccaatttagaaaagactatcagttgtataaggtacgagaaattaataactaccatcatgcccacgatgcctatttaaacgcggtagtagccactgccctactgaaaaaatatcctcaattagctccagaattcgtatacggagattatcctaaatataattcctacaaatcaagaaaatcagcaactgaaaaagtgctattctattccaatataatgaacttcttcagaagagtacttgtatatagtaaaacaggagaggtaagaataagaccagttatcgaagtcaacaaagagacaggagaaatagtttgggacaaaaaatcagatttcagaacagtacgcaaagtactatcatatccccaagtaaatgtcgtcaaaaaagtcgaaatgcaaactggaggtttcagcaaagaaagcattcttcagcacggagacagtgataagttaatcccccgaaaaacggaaaaattttacctagatacaaaaaagtacggtggtttcgacagccccactatagcatattcagttctccttatagcagatattgagaaaggcaaggcaaaaaaattgaaacgggtcaaagaacttatcggcatcactattatggaaagaatggccttcgagaaaaacccaatagaattcctcgaacacaaaggctacaagaacatacttgaaaaaaacatcataaaattaccgaaatactcgctattcgagttagaaaacggaagaagaagactactggcatcggccaaagaattacagaaaggaaacgaaatgatattaccacctcatctagtaacacttctataccactccagtaacatacacaaaataaccgaacctatacatttaaactacgtaaataagaataaacacgaatttaaagaactactgcgacatatcagcgatttctcaactagatatatattagcccaggatcgactatctaaaattgaggaactatatgataaaaatgacggagatgacatttcggacctaacaagctcatttgtaaaccttttgacctttactgcgatcggcgcaccagcagcttttaaatttttggggtcagtaattgacagaaaaagatacaccagtatagcagaaatattagaagctactctaatccaccaatctgtaacaggtttgtatgaaacaagaattgatctctctaaattaggaggtgattga

SEQ ID NO: 8890 - RNA, 4101 nt, synthetic construct
  misc_feature 1..4101: note = Cas9 variant
  source 1..4101: mol_type = other RNA
atgaagaaaccatattccataggtttagatattggaacaaactctgtaggatgggctgtcattacagatgactacaaagttccagcgaagaaaatgaaagtcctaggcaacacaaataagaaaacaataaagaaaaacttaataggtgccctgttattcgacgcaggcaacaccgctgcagataggaggttgaaaagaacagcaagacgaagatacacaagaaggcgaaataggatactatacttacaagaaatcttcgctgccgaaatgaacaaattagacgagagcttctttcatcgcctggacgactccttcttagtacccgaagacaaaggaggaagcaaatatcccatattcggcacattagaagaagaaaaagaataccataaacaattcccaactatctatcatctacgaaaatcgctcgccgattcaaaagagaaagccgacttaagactaatatacttagcccttgctcacataataaaataccgaggccactttttgtacgaagatacttttgatatcaaaaataatgatatacagaaaatcttcaacgagttcacctcaatctacaacaacatatttgaagaaagcagtttatcaaatgaaaacgcccaagtagaagaaatattcaccgacaaaatttcaaaatcagctaagaaagaccgagttctaaaattattccctgacgaaaaatcaaccggattattttcagagttcctaaaactcatagtaggaaacaaagctgactttaagaaacatttcgacctggaagaaatggctcccttacaattttctaaagatacctacgatgaagacctagaaagtctactaggacaaataggagacgattatgcagacctgttcgtagtcgccaagaaattatacgacgcgatcttgctagcaggaatactatctgtaaaagaccccgcaacaaaagcacccttaagcgcctcaatgatagaacggtatgacaaccatcaaaacgatctatcagctcttaaacaattcattagatccaacctcccagaaaaatatgccgaagtattctcagacgacagcaaagacgggtacgccggatatattgatggtaaaactacacaagaaggattttacaaatacattaaaaaccaaataagtaaatttgaaggaaccaaatacttccttgagaaaatagaacgagaagactttctacgaaaacaaagaaccttcgataatggctcaataccacatcaaatacatcttcaagaaatgaatgccatactacaaaatcaaggaggttattatcccttcttgaaagcgaacaaagaaaggattgaacaaattttgacattcaggataccatactacgtaggtcccctagcacgagggaactccgatttcgcatggctaacaagaaatagtgatgacgcgattagaccatggaacttcgaagaagtcgtagataaagcatcatcggctgaggatttcatcaacaaaatgacaaattatgatttatatctcccagaagaaaaagtcttacctaaacatagcttattatatgaaacatttgcggtgtacaacgaactcacgaaagtaaaattcatcgcagaagctatgaaagactacgagttcttggatagcggacaaaaacgaaaaatagtcgaaaacatattcaaaaaccatagaaaagtaaccgaaaaagatataataaactacttacataacgttgacgggtacgatggcatcgaaataaaaggaatcgaaaaacaattcaacgcatcactatcgacataccacgatttattaaaaatcataaaagacaaagagttcatggataaccccaaaaacggtgaaatcctagaatcaatcatccatactttaacaatattcgaagacagggaaatgattaaacagcttttggcacaatacaatagtgtttttgatgaaaaagtaattaaagctctatcaagaaaacattacacgggttggggaaaattatctgctaaactaatcaatggaattagagataaacaaacaggcaactcaattctcgattatctaatggacgatggtaaatcaaataggaatttcatgcaattaataaaagacgacggcttatcatttaaagaaattatcgacaaagctcaagtagttggcgaaacagataatctccgacaagtagtacaaaaccttccaggaagccccgcgataaagaaaggcatactccagtcaataaaattagttgacgaacttgttaaagtaatgggaagcgatccagaatccatagtaatagaaatggcaagagaaaatcaaactacaaacaaaggaaaatcaaaaagccaacaacgtctaaaaacactttcagatgctatatcagaattaggatcgaacattctgaaagaacatccaacggataacattcagctacagaatgacagattgtttctttattacttacagaacggaaaagacatgtatactggagaagcgctagatataaaccaactatcaaactacgacatagaccatatcataccacaagcctttataaaagatgactccctagacaattcagtactaacaagctctaaagacaatcgcggaaaatcagacaatgtacctagcttagaaattgtagagaaaatgaaaggtttttggcaacaactcctagattccaaattaattagtgaaagaaaattcaataacctaactaaagtagaacgaggtggcctagatgaaagggacaaagtaggcttcataaaaagacaattagtagaaaccagacaaataacaaaacatgtagcgcagatcctcgatgcccgcttcaacgcagaggtaaatgagaaaaatcaaaaattaagatccgtaaaaataattaccttaaaatcaaacttagtatcaaatttcaggaaagaatttggtctctacaaagtacgggaaataaacgattatcatcatgctcacgacgcatacctaaatgctgtaatcgcaaaagcaatactcaaagagtacccaaaactagaaccagagttcgtgtatggcgattaccaaaaatacgatctcaaaagatatatatcccgtacaaaagacccgaaagaaatagaaaaagcaaccgaaaaatactttttctacagcaatctactaaactttttcaaagacaaagtctactacgctgacggtacaatcatacaacgtggcaatgtagaatatagtaaagacaccggagaaatagcgtggaataagaaacgagactttgcaatagttagaaaagtcttatcatacccacaagtaaatatagtaaagaaaacagaagaacaaactggaggcttttcaaaagaaagtattctacctaaaggtaacagcgacaaattgataccaagaaaaaccaaaaatatacagctagacacaacaaaatacggaggtttcgactcacccgtaattgcatatagcatcttactcgtagcagatgtagaaaaaggcaaatcgaagaaactaaaaaccgtcaaatccttaattggaataacaataatggagaaagtaaaatttgaagcaaaccccgtagcattcctagaagggaaaggttaccaaaatgtagtcgaagagaacataatcagacttcctaaatactccctttttgaactagaaaacggccgtcgaagaatgctcgcatcctcaaaagaattacaaaaaggcaacgaaatggtattgccaagctatttactcgcactattataccacgctaagaaaattcagaagaaagacgaaccagaacatcttgaatatataaaacaacatcatagtgagtttaatgacctactaaatttcgtatcggacttcagtcaaaaatatgtactagcagaaagtaatttagagaaaattaaaaatttgtatatcgataacgaacaaacgaatctcgaagaaatcgcaaactcatttataaacctcttgacatttaccgcatttggagcaccagcagtttttaaatttttcggaaaagacattgaaagaaaaagatatagcaccgttacagaaatactaaaagcaactctaatacaccaatcaatcaccggattatatgaaacacgaatagacctgtcaaaattaggagaagaatga

SEQ ID NO: 8891 - RNA, 4101 nt, synthetic construct
  misc_feature 1..4101: note = Cas9 variant
  source 1..4101: mol_type = other RNA
atggataagaaatataatataggccttgacataggaacttcatctatcggatttgttgcaactgatgaggataatcatgtcatacgggcaaaaggcaaaaacgttattggagtacgcctattcgacgaaggtcaatccgctgcggaacgacgaggatttagaacaacaaggcgaagactcaatagacgaaaatggagattaaatctcctacgagaaatattcgagccgcatatatatccaatagacgcgagctttttcatgaggcaaaaatactcaaatcttagtaaacaagatccaaaccagaaaatcgagttcaaagacatcctattctcagacaaaagcgatgcagaattttacagacaatatccaaccatatatcacctacggcaagcactcatgactgagaaaagacaattcgatttaagagaaatctacttagcaatacatcatatagtaaaataccgaggacactttcttgatgaaacaccaactgacaaatttagttttgaccaactggatctcacacaagaatttgaaagattaaatgttctattttctgagcaaaacccagaagaaccgttcgaaatagtagtcaatcaaaaccaaagcattgaagacatcctctcaaaccaaagtatgacagctagcgatcgaagaaaacaagcacttgttgtgttctaccaacaaagtgaaaacaaagaaaacgaaaaacaatataaagctatagccacagaaattctcaacttgttactaggtaacaaagcaaaactaaacgtcatactagcacaagaagttgacaaagaagcagctaaagactggagcctttccctaagttctgaaactttcgacgacgacctcgaaaaagcctctagtggtttaaatgattcacagttagaaatggtcggaatctttgaaagaatatacagctcactaatattaaaatcgattataggagaccacaacagcctatcagcagccatggttgacaaattcaaaacacatgctcaacacagagacttgctcaaagacgtgatcaaaaatagcgacgcaactaaaggagaacagttacaatttgcatatgatcattacctccaaagacactccgcagacggcaaagcatatggtaaagacgatttttataaagaagtgaagaaaaacctagatgacagcgatgccgcacaacaaatacaacaacttatagatacagaccaatttatgcctaaacaacgaacgaaagcaaatggcgcaataccacaccaagtacagcaaaaagaacttgatttaataatagaaaatcaatgtcaatactatccatggctagcagaagagaatccaaattccgagcgccacaacgttgcaaaatacaaattagacgaacttgtaagtttccgtgtaccctactatgtaggcccattaataagtccggccgacgacgaaacagacccccaagcaattcaaaataccaaatttgcctggatgattaggaaagatgctcaaggccgtataacaccatggaactttgacgataaagtagatagagaaaagtcagcagataaattcataaaacgtatgacaacaactgatacatatttaatcggagaagacgtcctgcccgatcaaagcctcatctaccaacgttataaagtgctcaacgagttaaacaacgtacgaataaatggaaggccgatcgaagtacaaatcaaacaaaacatatatactgacctgtttaagaaattcaaatccgtatcagtcaagaaattacgatcatacctcgaagaaatgagttactatccagggagttttaaaatatcaggcctaacaaatccaggaaaattcgacaatggacttaccagttatctcgattacaaaaatattttaggcgattctgtagatgcaaacgacaaaagagctgatatcgaacaaatgatagaatggtcaaccatattcgaggataacaaaatatttgcgcaaaaattagaatctatgacttggctcactgcagaacaaaggaaagccatctccagaaaaagatacactgggtggggccgtctttcaaataaattattgacccaactcaaaaatcaagacaaccgaagcatcatggacctattatgggaaacagaagaaaattttatgaaaatacagagcgcaccagatttcagcaaaatgatagaggcccacaaccaacagttcatcaaaaatgaagctaacatacagcaagttatatctgacctatacacctcaccacagaacaagaaagcaattagacagatactgcttgtagtagacgatatccagaaagcagtaggacacgcccccgaacacattgctatagaatttgctaaaggagaggacaaaaatccaagacgaacaatcagcagagaaatgaaaatacaagacgtgtaccaacagatatcagacgacatactcgtgagcccagaagttagggcccaattaaacgaaaagatcgaaaaccgccatggaagattaagtgacagactctttctttatttcatgcaaggtggtagagatatgtacacgggtaaacctataaatataaacaacatatcacattatgacatagaccacatactaccacaagccttcattaaagatgattcactagacaaccgagtactcgtttccgataaattgaatagagaaaaatcagatacagttccacgtgacttatttggtagagaaatgatgagtacatgggaaaagatggccgatagaggcctaattaccaaacgtaaattagcaaatctcaaaactatacccggatctatcgacgctcataaagcacaaggcttcattaatcgacagctagttgaaacaaggcaagtcataaaacttgctgtcggcataatgatagaccaatatccagaaacgcaaatcgttagtgtaaaagcaaatctcacacatgaaatgcgcgaaatgttcgacttagtcaaaaatagagatgtaaacgattatcatcacgcattcgacgcttacctaacagcatttgttggaaattatttattacaaagataccccaaacttgaaccatatttcgtctacgataaatttaagaaactaaaagatcaaaatatttcaatgcgtgacttcaacctactatatgacttaaagaaaaacgaagacgtctacgaccagagaaccggtcattcagctcacaaaatatgggatcaacacggaagtatagattacataagacatctctttgcctacaagaaaattctagtctcacatgaagtacatcagaacggaggagcattatataacatgactgtctacggaaaagcagacgacgccaaaagaaaattaataccaataaaagctgataaaccaacagaattatatggaggttatacatcaagaaaattagcatatatggccattgtcaaaacaaagaaaggtaagaaagaacaataccaagtaaccggtgttcctgtatcagctctcacaacgctaagacagttcaaagaagattcaccagaacaaaaacaggctttggaagaaatcgttagaagaaactttgacgagaaaacagaggtagaaataattgtcccaaaagtcttattcaaccaattaatagtagatgaaaaatgcagattcatggtagggtcagatacataccgatataatgcacaacaactggtactatcagcagacgatctagaaattatcaatgcatcacataaagacatacaaaccattgacagtagcgattattcccaacaactagatcaagtttaccaaaatatcctaacaatagtagacaaacatttcccaatgtacgacatcaacaaattccgaactaaactacacgacatatacgaacaatacatagaactaccgaacgaggacgtgtgggaaaataataaactaacaactctaggcaaacatactatcataatcagaatacttcaaggcttacacgctaacgcaaccgtagtagatcttaaacaactgggtatcaaaacgccattcggcttcatgcaacaagcacgcggaatagtggttagccccgatgcccaactaatctaccaatcaccaacgggactatatgaaagaagagtaagactcggagacctatga

SEQ ID NO: 8892 - RNA, 4101 nt, synthetic construct
  misc_feature 1..4101: note = Cas9 variant
  source 1..4101: mol_type = other RNA
atgggagatcgtaaatacaaccttggactagatataggcacatcatcaatcggatttgccgcagtagatgaaaacaaccaacctatcagagtcaaaggcaaaactgctataggcgtacgcttattcgaagaagggaaaacagcagcagatcgccgcggcttcagaacaactcgacgacgattatctcggaggagatggcgaattaacctacttaatggaattttcgatgcacacctagcggaagtcgaccccactttcttagcaagactaaaagaaagcaacagaagcaatttagacccaaaaaaatcatttcaaggtagcctgctatttccagaaagaaaagattatcaattttataaagaatatccgacaatctaccacttaagaaaagctctaatggaggaagacagaaaatttgatataagagaaatctacttagctgtacaccacataattaaatacagaggaaactttttaaatggaaccccgatgcgtagtttcaaagtagaaaacattgaattagacaccttattcgaccgactaaatcaattatacgaagaaataattccagataacgaactagcttttgaccttgaacaagtcgcagacgtgaaagaagttcttagttcgacgactatatacaaaatggataaaaaaaaacaactagtaaagatgatgcttcttccaactagtaacaaagcattacagagcgagaataaaaaaatagtcacccaatttgttaacgccattttaaactataaattcaaattagacgtattattacaagttgaaacagatgcagattggtcattgaagctaaacgacgaaggagctgatgataagcttgaagaattcactggagatttagacgaaaacagactagaaattatagatcttttacaacgattacacaactggttttcacttaacgaaataacaaaagacggtaactctttgtcagccgcaatggtcgaaaaatataaagatcataggcatcatttggaacttctaaaaaaggttatagaagaccatccagatgcaaaaaaagcaaaagcattaaaggaaacatatacagcttacgtcggaaaaaccgatgacaaaacccaaaatcaagacgacttttataaggcagtagaaaaaaatctagacgattctccagacgccaaagaaataaagcgattgatccaattagaccaatttatgcccaagcaaagaacaggacagaacggagcaataccgcaccaactccaccaacaagaactcgaccaaatcatcgaaaaacaaagtaaatattacccattcctcgcagaacctaacccaaacgtcaaaaggaggaaagatgcgccatacaagctagacgaacttatagcatttaagattccatattatgtaggtccactcgtaaccccagaagagcaagcccaaaatggggaaaacgtctttgcatggatgaagaggaaagtcgcaggacctatcacaccatggaattttgataagaaagtagacagaatggaaagcgcgaaccggttcataagacgtatgactaccaaagacacatatctatttggtgaagacgtactacccgcggaatcaatgatatatgagaaattcgtcgtcttaaacgaactaaataaccttaaaataaacggtagacacttaagtttaaaagacaaacaagatatatataatgacttattcaaacaacaaaaaacggtaagtataaaagctttacaaaattattacgtaacaaaaaaaaaagctgctacagctccgacggtgggaggactagctgatccaaaaaaattcttatcatcactatctacatatatagatttcaaaaacatgtttggagaacaagttaacgacccacagtttcaagaagatctagaacaaattgtagaatggtcaactatatttgaagaccgaggaatattcaaagcgaagctccaagccctcggttggttgtcagaaaaacaaatacagcaactagtagcaaaaagatacaaaggatggggtcgattaagtaagaaactactaactggattaaaaaacgccgaaggatattcaatattagacgaaatgtggcgaagcacagaaaactttatgcaaatacaatctcgaccagaattcgcggcattaatacagcaagccaatgaaaaacagttcgaaggcaacgaccccaacaatgtttgggagaatatagaaaacatcctgggtgacgcgtacaccagtccacagaataaaaaagctatacgacaagtagtaaaggtagtacaagatatcgaaaaagcggtaggcaatccacccgaaaaaatagccattgaatttacaagagaagcagcagcaaacccacaaagaacacagtctagactcagaacattagaaaaactatatgaatccgccgaggaggtagttgatgcccgactgaccgcagaattagcggagttcaaagaaaacaaacatgtactatcggacaaatattacctttactttacacaattaggaagagacgtttacacaggagacactatttcactagaccgactaaatgactacgacgtcgaccacatccttccccaatcgttcataaaagatgatagcttggacaatagagtactcactatacgagctgttaacaatggaaagtcagacaacgtgccagcaaaaatgtttggtaagaaaatgggttccttttggagatacttgctagacaacggtatgatatctaaacgaaaatataacaacctcattacggatccagacaatatctcaaaatatgcacagaaaggttttatcaatcgacaactcgtggaaacatcacaggtcatcaagttaaccgcaaatatcctaaatggaatctatgacaaagatacggaaattatagaagtacctgcaaaaatgaactcccagatgagaaaaatgtttgaccttgtgaaagtcagggaagtaaacgattaccaccacgcttttgatgcgtatctcacaatctttataggaaactacttatacaaatgctatccaaaactccgaccatacttcgtttacggaaaatttaaaaagttttctgacaacgaagatatagaagtaggagacggaagatttaattttcttaaccgcatagaaagattaaaaaatgttacagacccagaaactggtgaaatactatggagtaacgttgccccaaacgagacaataaaaaggattaaaaaagtttataattacaaatttatgattgtatcgagagaaataaccactagaagagcagaactatttaaccaaacagtttatccaaaaaactacaggggtaaactcataccaataaaagaagatagacccacagacctctacggaggttactcgggaaacacggatgcatatctagcaatagtcgctttagaagataaaaaaaaaggtaaatatttcaaagtcgtcggtatacccacaagagcagcagccaaactcgaaaaattaaaacaacaagatagtcaacaatatctacaagctgtacacgaagtcatagcccctcaatttaccaaatcgacaaaaaaaggaataaaaaaaaccgaatttagaatagtcctagacaaagtacattacagacaattagtacaggacgggcctgtaaaaatgatgctaggttcttctacttacaaatataacgctaaacaattagtactctcggaaaaagcactacaagtcataaaagacgatagaaaattcgacgaaactcaaaaagatgataatctcatagctgtatacgatgaaatactcagtatagtaaaccaaagtttcgatctatacgacataaatggattcagaaagaaactcaacgacaacagaaatcaatttatagatttgccagccgaaaccaaatatgaaggaagaaaggttgtggcacacggcaaacgagaaatgatcctcgaaatactcaaaggattacacgccaacgcctcattcggtaatttaaaaccaatcggatttgcaactccattcggacaaatgcaatccaaaaacggaatagaactttcggagaatgcctttctcatacatcaaagtccaagtggtctatttgaacacaaaataaaattaagcgacctatga

SEQ ID NO: 8893 - RNA, 4101 nt, synthetic construct
  misc_feature 1..4101: note = Cas9 variant
  source 1..4101: mol_type = other RNA
atgactaaattggggaaaccttacggtatcggggttgacattggaagtaatagtattggctttgcagccgtcgacgaaaactcacatttaattcgattaaaaggcaaaacagtcataggcgcgcgcctattcgaagaaggaaaagcagccgcatatcggagagcgagcagaactacaagaagaagattatcacgaaatcgatggagactctcatttttaagagatttctttgaatcacatataacaccaacagacccaaactttttcatgagacaaaaatatagcgaaatcagtcccaaagacaaagctcgttacaaatatgaaaagagactattcaatgaccggaccgacgcagagttctaccaacaatatccaacaatgtatcatctgagaacacgactcctcacagacccgtcaaaagcagatgtgagagaaatttattttgcaatccatcatatcttaaaaagtcgggggcacttcttgacaccaggatacgcaaaagacttcaatacaaacaaagtagcactaaatgaaatctttcccgccttgcaagatgcctatgcacaagtctacccagatcttgatataacgtttgatgaaaacaaagtaaatgagttcaaaacagtacttctaaacgaaaaagcaactccgtcagatacacagagagctctggtaaacttattattagctaaagaaggcgatcgagatattctaaaacaacaaaaacaggttttgacagaatttgcaaaagcagtggtaggattaaaaacaaaactaaacgtagccctcggaacagaagttgattcaagcgaagcaactgcctggaacttctccttaggccaactagatgacaaatgggcagggatagaatcagcaatgacagatgagggaacagaaattttggaccaaataagagacttatatcgtgcaaggttattaaacggaatagtacctgcaggtaaaaccctctctcaagcaaaagttgacgattatgcgcaacatcatgaagatcttgaattgttcaaagactatctcaaacaattagaagatgatggtactgccaaagcaatacgacaactatatgaccgatacatagatggagacgacgcaaaaccctttgtgagagaagacttcgtaaaagcactaacaaaagaagtcactgcccacccgaacgccaaaagtcccgaactattagaacggctagcgcaaccagattttatgctaaaacaaagaaacaaagctaatggtgcaataccagtacaaatgcagcaaagagaacttgatcaaataatcaaaaatcaagcagtatactatgactggttggcagcaccgaatcctgtagaaaaacacaggcaaagtatgacctatcaactagacgaactcctaaactttagaatcccgtattatgtaggacctctcgtaacagccaaagaacaaaaagcggcgcaaggtggagtgttcgcatggatggttagaaaagatccagatggaaatataaccccctataactttgacgaaaaagtagatcgggaggcttctgccaacaccttcatacaaagaatgaaaacaactgacacatatttaatcggagaagatgttttaccaaaacagagtctactataccaatcatacgaagtcctcaacgaattaaacaatgtacgagtaaatgataacaaacttagctttgatcagaaacaacaagttctaggcgaattattcgaaagacacaacacagtaacaattaaacaatttgtagacaatctattagctcacggagactacgacagaatacctgaagtacgcggtttggcagatgagaaaagattcctatcatctttgtcaacgtacaaccaattaaaaggtatactccatgaagcgattgatgacgcggataaacaaacagacatagaaaatataatagcatggtcgactatattcgaagacaaagcaatattcaaaacaaaactcaatgaaataagttggcttaacgctggcatgataaattcactagcaaacataagataccgaggatggggtcaatttagccacaaactgcttaatgaactcacactatcaacagggaggactgtatttgaggaattattgataagctcaagaaatttaatgcaaatcctaactgatgaagtgctaaaacagaaaattgccgagctaaatgctcatgaattaaaagctagtggaatctatgcagccatagacgacgcttataccagtccaagcaacaagaaagctctcagacaagtcttaagcgtaatcgatgatattaccaacgcagctgggcaagctccaaactggctttatatagaaacagctgacggtgatggagtcccgggaaaacgaacaaactcaagacaacgtaaaattcaagaaatatacgcaaacgcggcacaagagttaataacgggatccgtcagaggcgaatttgaagataaaatagcaagccgagctgacttcaccgatagacttgtattgtattttatgcaaggaggcagggatatttatactggagaaccactgaacattgacaacttgagttcatatgacatagaccatatattgccacaatcgttgataaaagacaattctctagacaatcgggtcctagttcatcccttggtgaatagagaaaaagatacaatattcgcgtctacaagatttgcaaaacaaatgaacggtatgtggagacaatggcacgcagctggactaatatccagcagaaaactcagaaatttacaaatgagacctgacgaaatagacaaatatgctagcggtttcgtagcgagacaacttgtcgaaacacgacaaataataaaactaacagaacaaatagtagcagaccaatacccagacactaaaataatcgctgtaaaagcaggtttaagttcacaactacgaaaagaattggattttcctaaaaacagggaagtcaaccattatcatcacgcatttgacgcctttctggctgccagaataggaacatatttactcaaaagatacccaaatcttgagcctttcttcacatatggcaaattcaagaaaacagaagtcaaaaagttaaaatcactaaaatcattgaaatcgttcaatttcatacgcgatatgactcacgcaaaagataagattgtagcaaaagaaaccggagaaatagtatgggacaatgcctcagacattaacgaactcgataggatatataactttaaaaggatgctaatcacacatgaagttagatttgaaaccgcatcattattcaaacaaaccctatatgcagcgaaaaattcaaagaatcgaggaggaagtagacaactaatcccaaagaagaagggttatcttgttgatatatacggaggttacactcaagaaaccggatcatatctgagtgttgtacgactcactaagaaagcaatgtatgcagtagtaaaagtctcaacaagagatgcagcaaaactcgcagtagcaaaatcaatatctgaacaaaaagaaaacgaaacacttaaaaagataatcgatggaaaattatccaaaaccagtaagaaaggaaaaactacccatcaactatttgaaatagtactccctagagtaggacagaaaacattatttaaaaatagcaaatataaccaattcctagtaaatagcgacacttatatgcacaattaccaagaattatggatgccacgcgaatatcaacggatgtggaaagacatcctactctcaaaccacggtgacgcccaaatagaaggacaattagatcaaatatttaaattcatagtatcacaagtaaactcatactttaacttatacgacataaaccaattcaggaagaaaattgcagacgctacagacaaattcgccaaattacccacacatgacacagacaacgccagaggaaaaatagccactataggtcaactactaattggtttacaagcaaatgcaatgagaagcgatctaagaaacttagacataaaaacaccatttggcttactacagatcggaaccggtataacgctcgatctagacacttcaataatataccaaagcccaactggattattcgaaagagaagtgccgttaactgatctatga

SEQ ID NO: 8894 - RNA, 4101 nt, synthetic construct
  misc_feature 1..4101: note = Cas9 variant
  source 1..4101: mol_type = other RNA
atgaccaaagattacagtctaggactcgatatcggtacaggatcagttggatttgccgcattggatacaaattatcgactgttacgtgccaaaggcaataatgtgataggagtaagactattcacacctgccgagacagccgaagaacgaaggggatttcgtactgcacggcgcaggttatcacgaaggcgttggaggttaggagcgcttaacggaatcttcgcgcccgagcttgctaaagttgacccaaacttcttacatagattaaaatatgcatgggttcacccagcagaccaacaaaacaagggaaaatattcagcagcaccactatttaacgatgcagccttagatcggcaatttcatgatgattatccaacaatttatcacctaagattaaaattaatgacagacacaagtcagcatgaccttagagaagtttacttagccatacaccatataataaaattcagaggaaacttcctaaggggcgaaggtccgataaacgcaagcgaagcctttgacattaacacattcatcgaccaaatgaccgcattctatgaccaagcattcccagatttcaaaatagtcgatcaagtcgatcaacaaataattttcaaaggattaacagacatgactttatcaccagcagatagagcaaataaagctttaatgggtttcaacaatgcagcacagcaaccaaacaagagaatttttaaagctatcttatctggcctcgtaggcaatcaagttgatcttatggcaatatttcaattagacggaatacctaaagaagaccaaaaagaattcaaattcaaatttgtcgacaatgatatagaagagaaactagccgcactaggtgataacccggctctatcagacgaacaaaatgaatttttaaccactctatatgcagcattctcaggattaacgttgaaaggattactaggcgatgccacaagcatttctgccgcaatggtagcaagatatgcctcccacaggacagactggacgtacattaaagatcacgtactcacaccacaaaataacagagaattaagactagcatatgcagatctaatgacagataacgaagacgtacgactcaaggctggaaaaaaatttgctaaagcaattgaggctgcagatataccagcagcaaaaaaatctgaattttcactaaaaattgataataacgaattcctgcctaggcaacgaacaaaagccaatggaacaattccacaccaattacacttaaatgaattacaacaaattattgaaaaccagggacaatattacccgtttttaaaggctacatttgaacaagacggtcacaccctcaacaaaatagaagggttagttaaatttagagtaccatactatgtaggtccgctcgttccaaaacataaagtcgcaggtaataacgcgaatcattggatggtaccaaaagagcccggagccataacaccgtggaactacaccgaaaaagtagatagggataagagcggaaacgagttcatacgacgaatgacaggtactgatacatatcttttaggggagcctacacttccaaaaaatagtttagtgtaccaagaattcaatgtcttacaggaattaaataatttaagaatcgaaaagagacgcctagatattgcagttaaacaagatatatttgaacatgtcttcaaaacaaacaaaactgtgacagtaaaacgaattgaagaatatctaacaacagaattcgggtcgccagtaacactaagcggttttgcaaacgttaatgaaagaaagttaaattcatcattaagcacgtatcactacttcgtaggaattttcggcgccgaatttgtagatgacccaaaaaatttaactctactcgaacaaattgtagaactacaaactgttttcgaagacagaaaagccttacaacgacaactaaaattgagacccgaattaagcgaaaaacaagtaaagcagctagcaagaacgcattatacaggttggggacgactaagtcaaaaactattaacctctaaaatagtacatgtcgcacttgaaggcgagcgagaaccaggacaatattcaatactggaaacgctatatggcacacaaatgaattttatggaaatagtcaacgatatgaaagacaggtatggtgtaaaatcttggctagatcaagaaaattctggtagcgaaaataatttatccttaaaacagagaatactagatatgccaggacccaaaaatatcaaaagaggaatcaaccaggccttccacataatagacgaaataacaagggccgtagggaacgcaccctctcgaatttacatcgaatttgccagagaatctcaacaatcaaatctaacaaacgcaagagttaatagactaaagcaactctattcaaaccaagcacttaaaaaagaattcgctaaattagcctctgagataaaagatctgacaaaagagcaattaaaagacgacagactttatctatactacctacaacaaggcaaagatatgtacacagaaacagacatagacataactaaaatttcatcaaattatcaaatagaccacataataccacaagcctacacaaaaaataacagcctagataatagggtactggtaaatagtgaaatgaacgcacgaaaaagtgactcaccaactttcctcccaagtctgatacaagaaaggaaagcttggtggcgtcaattacgcgacactggactaatgagtaccattaagtacaataatttgactcgcacatctgatgatttctcagcagatcaaaaagaaagatttatagcaaggtcattggtagaaacacgccaagttataaagaacgtagcaactctaataaaagaatattatgatgacagccaagtagaagcactaccctctgaaataaccgcggagatgagaagatacctaaacgtccgaaaaaacagagacattaacgattatcaccatgcccacgacgcattactatttgcaaccgcgggcgaattttcgagaaaagtaggaataatggaaaaaggcagagttagcgatggtgcaggaaatatctacaatcgatataccaaagatataattcaacgcgctcgcgcaaaagccggacaggacaaaaaagttcgtccgttcacatttatcgtaggatcaatggcaaatccagacacaaaatttcaaacaaaccaaaccaccggagaaattgtatggacgccagaagacgttgcatatttaagaaaggtaatcgactacaagaaaatgcttgtcaccaaaatgacactagatcaaacgggcactttatacaacgaaacccgatacggctccggtgataaacatgtagcagttgcactatcaaaagacaaggctgcagacctgtacggcggctttggatccctaaaacccgcatatgcagccctagtatattctaaaaagaaatttcgcctcgtaaatgtattacgtctatggctacccgaaataaaaaaaaacgcatctgttctagaaagaaaagtacaatcagtattaggtgatgataacgcaaaagtaataagggctcatgtaccttgtggacaactactaataaaagacggcgccctagtaaccgtaagcagtgccaccgaacttcataacttcagacaattatggttaccaaaagcggactaccaagatatatcgattctattaggagcaccagataaagtaacggcggaaaaccgattacaagcagaatcacactttgatgatgtagaccaacgttttgaaagtttactaaaagatgttatagatcaagcacgccagtattaccctttaaaaacacaccaaacgtccctagaaaaactaataggaaaaattggaaaattcgatgaacttaaatttgcacaaaaacagcaagtatttagcaggctactgtctgcacttcatgcaaacgcaactaatagcgatttaaaacaaattggactatccacagcctgggggagattaatctacccaaaaggcgtatctcttacagacgaagacaaactaatcaactcttcatttacagggctatttaatgatgtaatgtccattaaagagtttcacgatttcagcataaattga

SEQ ID NO: 8895 - RNA, 4104 nt, synthetic construct
  misc_feature 1..4104: note = Cas9 variant
  source 1..4104: mol_type = other RNA
atgaaaaaacaaaaattcagtgactactacttaggcttcgatataggaactaacagtgttggttggtgtataacagacttagattacaatgttctcagattcaacaaaaaagacatgtggggaagccgacttttcgaagaagcaaaaacagcagccgagcgacgagtacaacgcaatagcagaagacgactaaaacggagaaagtggagactaaacctactagaagaaatatttagtaatgaaatactaaagatcgattcaaacttcttcagacgcctaaaggaatcgtcactctggctagaggacaaatcaagcaaggaaaaattcacattattcaacgacgataattataaggattatgatttttacaaacaataccctactatcttccatctacgcaacgaattaattaagaatcctgaaaaaaaagacataagactggtctacttagcaatccacagcatattcaaaagcagaggccacttcttattcgaaggacaaaacctcaaagaaataaaaaactttgagacactttataataacctaatagcatttctcgaagacaatggaattaacaaaatcatagacaaaaacaatatagagaaattggaaaaaatagtctgtgatagtaaaaaagggttaaaagacaaagaaaaagaatttaaagaaatattcaattcggacaaacaattggtagccatattcaaactctcagtgggtagtagcgtctcactaaatgacctgttcgacaccgacgaatataagaaaggcgaagtagaaaaagaaaaaatatcattcagagaacaaatctacgaagacgacaaacctatatattacagtattttaggagaaaaaatagaattactcgatatagcaaaatctttttatgactttatggtattaaacaacatactggcagattcacaatacatcagtgaggcaaaagttaaactctatgaagaacacaaaaaagatctaaaaaacctgaaatacattataaggaagtataacaaaggtaactatgataaattattcaaagacaaaaacgaaaataactattccgcctacataggattgaataaagaaaaagggaaaaaagaagtggtcgaaaaaagccgactaaagatagatgacctcataaaggtaattaaaggttacttaccaaaaccagaaagaattgaagaaaaagacaaaacggtctttaatgagattctaagtaaaattgaactcaaaacgatcctacctaaacaaagaataagcgacaacggaacattgccctaccaaatccatgaagtagaattagaaaaaatattagaaaatcaatccaaatactacgactttctcaactatgaagaaaacggagtaagcacaaaagataaactattaaaaacatttaaattccgaataccatactacgtaggcccactcaactcctatcataaggataaaggagggaattcatggatagtaaggaaggaagaaggaaaaatactaccgtggaattttgagcaaaaagttgatattgaaaagagcgcagaagaattcataaaacggatgactaataaatgcacatacctcaatggagaagacgtgatcccaaaagatacatttctctacagtgaatacgttatactaaacgaactaaacaaagtacaagttaatgacgaatttttaaatgaagaaaacaaacgtaaaataattgatgaattattcaaagaaaacaagaaagtctcagaaaaaaaatttaaagaatatttattggtaaaacaaatagttgacggaacaatagagttgaaaggtgttaaagatagcttcaactccaactacatatcatatataagattcaaagatatctttggagaaaaactaaatttagatatctacaaagaaatttccgaaaaatcaatattatggaagtgcctgtatggagatgacaaaaaaatatttgagaaaaaaataaaaaatgaatatggagacatccttacaaaagacgaaataaaaaaaatcaatacattcaaatttaataactggggacgacttagcgaaaagctattgacaggcatagaattcataaacctagaaacaggcgaatgctactcaagcgtaatggacgcacttcgacgcacgaactataacttaatggaattattatcctcaaaattcacattgcaggaatcaatcaacaacgaaaacaaagagatgaatgaagcatcataccgcgacctgatagaagagtcatatgtttcacccagtttaaaaagagctattttccaaacattaaaaatatatgaagaaataagaaagataacaggccgcgtacccaaaaaagtatttatcgaaatggcaagaggcggagacgaaagtatgaaaaataaaaaaataccagccagacaagaacaactcaaaaaactatatgactcatgtggcaacgacatagcaaacttcagcatcgacattaaagaaatgaagaactcactaatatcttatgataataactcattacgacaaaaaaaactctatctgtactacctacaatttggaaaatgcatgtatacaggaagagaaatagaccttgatcgattattgcaaaacaatgatacatacgacattgatcacatatacccacggtcaaaagtaataaaagatgatagtttcgataatctagtattagtactcaaaaatgaaaacgcagaaaaaagcaatgaatatcccgtaaagaaagaaatacaagaaaaaatgaaatcattttggcgctttctcaaggaaaaaaattttatctcggacgaaaaatataaacgactaactgggaaggacgactttgaactgcgaggatttatggcaagacaacttgtaaatgtaagacaaacaaccaaagaagtcggaaaaatattgcagcaaatagaaccagaaatcaaaatagtatatagcaaagctgaaattgcgagtagtttccgtgaaatgttcgattttattaaggttagagaactaaacgatacacaccatgccaaagacgcctatctgaatatagtagctggaaacgtatacaacacaaaattcaccgaaaaaccataccgatacttacaagaaatcaaggaaaattatgacgtaaaaaaaatatataattatgacattaaaaacgcatgggacaaggaaaactctctagaaatagtgaaaaaaaatatggaaaaaaacacagtaaatatcacacgtttcataaaagaagagaaaggtcaactattcgatttaaatcctataaagaagggagaaaccagcaatgaaattattagtataaaaccaaaagtctacaatggaaaagacgacaaactaaatgaaaaatacggatattacaaatcactgaatccagcatatttcttatatgttgaacacaaagagaaaaacaaaagaattaaaagtttcgaacgagtaaacctggtagacgtaaacaatataaaggacgaaaaatctttagtcaaatacctaattgaaaataaaaaacttgtcgaaccacgggtaattaaaaaagtatacaagcgacaggtcatactaataaaccattacccgtatagcatagtaacattagattcaaacaaattaatggatttcgaaaatctaaaaccactatttctagaaaacaagtacgaaaaaatattaaaaaacgtcataaaatttctggaagacaaccagggaaagagcgaagaaaactacaaattcatttatttaaaaaaaaaagacaggtatgaaaagaacgaaaccctagaaagtgttaaagatagatacaatctagaattcaatgagatgtatgacaaattcttagagaaacttgatagcaaagactacaaaaactacatgaacaataaaaaataccaagaacttcttgatgtaaaagaaaaatttataaaattgaacttgttcgataaagcattcacactaaaatccttcttagacctcttcaacagaaaaactatggcagattttagtaaagtaggacttacaaaatatctaggaaaaattcaaaagatatcgtccaacgtcttaagcaaaaacgaactttatctactcgaagaatcagtcacgggactatttgtaaaaaaaataaaactatga

SEQ ID NO: 8896 - RNA, 4104 nt, synthetic construct
  misc_feature 1..4104: note = Cas9 variant
  source 1..4104: mol_type = other RNA
atgaaaaaacaaaaatttagtgactattatctagggtttgacattggaaccaactcagtaggttggtgtgttacagatctcgattataacgtacttagatttaataaaaaagacatgtgggggagtagactctttgacgaggctaaaactgcggccgaacgccgagtacaaagaaattcccgtcgcagactgaaaagaagaaaatggaggctaaacttactggaagaaattttctccgatgaaataatgaaaatcgatagcaatttcttcagacgattaaaagaatcatcactttggctagaagacaaaaacagcaaagagaaattcaccttattcaatgacgacaattataaagattatgacttttacaaacaatacccaacgatattccatctacgggacgaactaataaagaaccccgaaaaaaaggacataagactgatatatctagcgctgcacagcattttcaaaagccgtggacacttcttattcgaagggcaaaatttaaaagaaataaaaaacttcgagacattatacaacaaccttattagcttcctggaagataatggaataaacaaatccatagataaggacaatataaaaaaactagaaaaaataatttgtgatagcggaaaagggttaaaggacaaggaaaaggaatttaaagaaatattcaatagtgataaacaactcgtcgcaatatttaaattaagcgtgggaagttctgtatcactaaatgacctattcgacactgacgaatataagaaagaagaagtcgaaaaagaaaaaataagtttcagagaacaaatctatgaagacgataaaccaatatactacagcattctcggggaaaaaatcgaactgctagacatagcaaaatctttttatgatttcatggtactcaataatatcttatcagattcaaactacatctctgaagcaaaagtaaaactttacgaagaacacaaaaaagacctaaaaaacctaaaatatattatacgtaaatacaacaaagagaattacgataaactattcaaagataaaaacgagaataactatccagcatacataggcctaaataaagaaaaaggtaagaaagaggttgttgaaaaatcaggactgaaaatagacgatttaatcaaagtaataaaaggctacttaccaaaaccagaaagaattgaagaaaaagataaaaccatctttaacgaaatccttaacaaaatcgaactcaagaccatacttcctaagcaaagaatcagcgacaatggaacactcccttaccaaatacacgaagtcgaattagaaaaaatactcgagaatcaaagtaagtactacgacttcctaaattatgaagaaaacggcgtaagcacaaaagataaactactgaaaacctttaagtttcgcatcccatattatgtagggccacttaactcatatcacaaagacaaaggagggaactcatggatagttagaaaagaggaaggcaaaatactaccgtggaactttgagcaaaaagtcgatattgagaaatcggcagaagaattcataaaaaggatgacaaacaaatgcacatacttaaacggcgaagatgtaataccaaaagattcattcctatacagcgaatatataatactgaacgagctaaacaaagtacaagtaaacgatgaatttttaaatgaagaaaacaaaagaaagataattgacgagctttttaaagaaaataagaaagtgtcagaaaaaaaattcaaagaatatcttctcgttaatcaaattgcaaaccgcacagtagaattaaaaggcataaaagacagtttcaactcaaattacgtatcatacataaaatttaaagatattttcggagaaaaactaaacttagacatatataaagaaatttcagaaaaatcaatattatggaaatgcctttacggcgatgataaaaaaatatttgaaaaaaaaataaaaaatgaatacggcgatattctaaataaggacgagataaagaagattaatagcttcaaattcaacacatggggaaggctcagtgaaaagctactcacaggcattgaattcataaatctggaaaccggggaatgctatagttcggtaatggaggccttaaggcgcacaaactataacttgatggagttactatcatcaaaattcacactacaagaatctatagacaatggaaacaaagagatgaatgaggtctcctacagagacttaatagaggaaagttacgtcagcccatctttaaaacgagccatacttcaaactctaaaaatatatgaagagataaaaaaaatcacaggaagggtgcccaaaaaagtattcatagaaatggccagaggcggagacgaaaccatgaaaaataaaaaaatccctgccagacaagaacaactaaagaaactctacgactcctgtgggaacgatatcgctaactttagtatcgacattaaaaaaatgaaaagtagtttatcatcatatgacaataactctttaagacaaaaaaaactttacctatattacttacagtttggcaaatgtatgtatacaggacgggaaatcgatctagatcgcctcctacaaaacaacgatacctatgacatcgaccatatatacccccgatccaaggtcatcaaagacgactcatttgacaacttggtgcttgttctgaagaacgaaaacgcagaaaagtcaaacgaataccctgttaaaaaggaaatacaagaaaaaatgaaaagtttttggcgatttctaaaggaaaaaaacttcatctcagacgaaaaatacaaaagactcacaggcaaagacgacttcgaactgaggggattcatggcaagacaactagtcaacgtacgacagacaacgaaagaagtcggaaaaatattgcaacaaatagaaccggaaatcaaaatagtatatagcaaagcagaaatcgcgagttcctttagagaaatgtttgatttcataaaagtgagagagcttaacgatacacaccacgcaaaagacgcatacttgaacatagtagcaggtaacgtttataatacaaaatttacagaaaaaccgtacagatatcttcaagaaatcaaagaaaattatgatgtaaaaaaaatatacaattacgacataaaaaacgcatgggataaagagaacagtctcgaaatagtcaagaaaaatatgaaaaaaaacacagtgaatataacaagattcattaaggaagaaaaaggacaactttttgatctcaacccaataaaaaaaggagaaacaagcaatgaaattatatcaataaagcctaaactatataatggaaaagaagaaaaactaaatgaaaaatacggctactacaagtcattaaacccagcatacttcttatacgtggaacataaagaaaaaaacaaacggataaaatcctttgaaagagtcaacctagtagacgtaaataatataaaggacgaaaaatcgcttgtcaaatatttaattgaaaacaaaaaactcgttgaaccaaggttaataaaaaaagtatacaaaagacaagtgatactaatcaatgattacccatattccatagtagctctagactcaaataaactaatggatttcgaaaatttaaaaccactattcctagaaaacaaatatgaaaaaatactcaaaaatgtaataaaatttttagaagacaaccaaggaaagtcagaagaaaattataaatttatctatctcaaaaaaaaggacagatacgagaaaaacgaaacattagaaagcgtaaaagaccgatataaccttgaatttaacgaaatgtacgataaattcctagagaaactcgattcaaaagactacaaaaactatataaacaacaaaaagtataaaaatctgctagatgtcaaagaaaaattcatcaaactcaacctgttcgataaagcgttcacactaaaaagttttctagatctctttaatcgcaaaactatggcagacttttcaaaagtaggactcaccaaatacctcgggaaaatacaaaaaatttcaagcaacgtactcagcaaaaacgaactatatttgcttgaagaatctgtcacgggattattcgtaaagaagatcaaattatga

SEQ ID NO: 8897 - RNA, 4104 nt, synthetic construct
  misc_feature 1..4104: note = Cas9 variant
  source 1..4104: mol_type = other RNA
atgaaaaaacagcaatttagcgattactatctcggttttgacataggaacaaactcagtaggatggtgtgtcacagatttcaactacaacgtactacgatttaacaaaaaagatatgtggggatccagactttttgatgaagcaaaaaccgcggcagaaagacgagtacaaagaaattccagacgaagacttaaaagaagaaaatggaggttaaacctccttgaagaaatcttcagtgatgaaatcctaaaaatcgactccaattttttccgacgacttaaagaaagcagtttatggctagaagacaaaagctcaaaagaaaaatttacactattcaacgatgataactacaaagactacgatttttataaacaatacccaacaattttccacttaagaaatgaacttataaaaaatccagaaaaaaaagacatacggttagtctacctagccctacacagcatctttaaatcacgtggacattttctttttgaaggacaaaacctcaaagacatcaaaaacttcgaaacactctataacaacctaatggcctttcttgaagacaatgacatatacaaaaatatagactctagctacataggtaacctagaaaacatcatatgtgattcaaaaaaaggactaaaggataaagaaaaagaattcaaagaaatctttaacagcgataaacaattagtcggatttttcaaattgtccgttggatccagcgtttcactcaacgacctattcgataccgacgaatacaagaaaggtgaggtagaaaaagaaaaaatatcttttagggagcaaatatatgaagacgataaaccaatatactattcaatcttaggagaaaagattgaattcttagacatagctaaatcgttctacgatttcatggtactaaacaacatactcgcagactcacaatacatctccgaagccaaagtaaagctgtatgacgaacacaaacgtgatttaaaaaacctaaaatacataattagaaaatacaataaggaaaactatgataaactcttcaaagataaaaatgaaagtaactacagtgcatacataggactcaacaaagaaaaaggcaaaaaagaagtaatagagaaatcacgtctaaaaatagatgacttcgccaagataataaaaggatacctaccaaaagccgaaaaaatagacgaaaaggaccgtagcattttcaatgaaatattagataaaatagaactaaaaactatacttccgaagcaaaggatatccgataatggaactctaccctaccaaatacatgaagccgaactagaaaagatattagaaaaccaggcaaaatattatgacttcctaaaccatgaagaaaatggtatttcaactaaagataaattactcatgacattcaaatttagaattccctactacgtaggaccactcaacagctatcacaaaaacaaaggtggaaattcatggattgtccgaaaggaagaaggaaaaattttaccatggaacttcgaacagaaagtagacatagaaaaatcggcagaagaatttatcaaaagaatgaccaacaaatgcacataccttaatggagaagacgtaataccaaaagacagttttctatactcagaatatataatattaaacgaactcaataaggtacaggtaaacgacgaattcctcaataaagaaataaaaaaaaaaatcatcgaagatttattcaaaaaaagcaaaaaaatatcagaaaagaacttcagagaatatctactagtaaatcaaatcacaaacaaaaccgtagagttaaaaggagtaaaagatgcttttaatagcaactacgtatcctatatcaaattcaaagatatatttggtgacaaactaaatctcgacatatacaaagaaataagcgaaaaaagtatattatggaaatgcctctatggagacgacaaaaaaatatttgaaaaaaaaataaaatctgtatacggtgatatacttacaaaagatgaaattaaaaaaatcaactcgttcaagtttaatacttggggaagactatcagagaaactacttacagaaatagaatttatagacctggaaactggagaatgctatagcagtgtgatggacgcactcagaagaacaaactacaatctgatggaactgttaagttctaaatttacattacaggagaatatagacaacgaaaataaagaggtttccgaattttcatatcgggacttagtcgaagaatcctacgtctcaccgtcactaaagagagccatcttacaaacactcaaaatatacgaagagataagaaaaataactggaagaataccaaaaaaagtattcatagaaatggcacgaggtggggacgaaacaatgaaaaataaaaaaataccggccagacaagagcagctaaaaaaattatatgattcatgtggaaaagatatatcaaacttctcaatagatataaaagaaatgaaaaactcattaaactcatatgataacaattcactgagacaaaagaagctctatctctactatttacaattcggcaaatgcatgtatacaggaaaggagatagacctcaaccgcctactacaaaacaacgatacatacgacatcgaccacatatatcccaggtcaaaagtgataaaagacgactctttcgacaacctagtattggtattaaagaacgagaatgcagaaaaatccaacgaataccctctgaaaaaagaaatacaggaaaagatgaaaagcttttggaaatttttaaaggaaaaaaacttcatatctgacgaaaaatataaaaggttaacaggtaaagatgaattcgagctaagaggctttatggcacggcaactggtgaacgttagacaaaccacaaaagaagcaggaaaaatacttcaacaaatagaacccgaaatcaaaatagtctatagtaaagcagaaatagcctcatcatttagagaaatgttcgactttataaaagtacgggaactaaatgacacccatcacgccaaagacgcatatttaaatattgtggcaggaaatgtttacaacaccaaatttaccgaaaaaccatatcgatacttacaagagatcaaagaaaactacgatgtcaaaaaaatatacaactacgatataaagaatgcatgggacaaagaaaaatccctcgaaattgtcaaaaaaaatatggaaaaaaacacagtaaacataacaagattcatcaaagaagaaaaaggtcaactgtttgatctaaacccgatacgaaaaggagagacaagtaatgaaatcatagctataaaaccaaaattttatgaaggatcaacagaaaaactcaacgaaaaatacggttactacaaatcacttaacccggcctatttcatatatgtcgaacataaagaaaaaaataaaatcatcagaagcttcgagcgagtgaacttagtagacgtaaataaaattaaagacgaaaaatcactaatcaaatacttgatagaaaacaagggattaatcgagccaaaagtaataaaaaaggtttacaagaggcaagtcatcctaataaacaacttcccttattcaatagtcgcccttgactccaacaaactgatggactttgaaaatttaaaaccactttttctagaaagaaaatacgaaaaaattctaaaaaacgcgataaagttcctagaagataaccagggaaaaaccgaagaatattataagtttctttacctaaaaaaaaaagacagaaatgaaaaaaatgaaactatagactcagtcaaagaacggtacaacatagaatttaacgaaatgtacgataagttcctcgaaaaattagatagcaaagattataaaaattatataaacaataagaaatactcagaactcgtcaacgtcaaagaaaagtttataaaactaaatttattcgataaagcattcaccctaaaaagctttttagacctctttaaccgaaaaactatggcagacttctcaaaggtcggcttaaccaaatacctcggtaaaatacaaaaaatatcgagcaacgtattatccaaaaacgaactccacttgttagaagaatcagtaacaggactctttgtcaaaaaaatcaaactatga

SEQ ID NO: 8898 - RNA, 4104 nt, synthetic construct
  misc_feature 1..4104: note = Cas9 variant
  source 1..4104: mol_type = other RNA
atgaaagattattatctagggctcgacatgggatcctcttcagtaggttgggcactgtctgatgaacggtacaacctactaagagcaaaaggcaaagatttgtggggcgttcgtctctttgatgaagcaaagaccgcggcagagcgccgtacttttcgatcacagcgacgacgactcgaacgctccaaatggcgattatccttactaaccagccttttcgaagaggaaatctccaaaattgacgataaattctttgatagattaaaagattcgaaattctttatcgacgataaatcagatcaacagccaaacaccttgtttaatgacgtaaactttaccgataaagaataccataaaagatacccatcaatctaccacctccgaaacgcattattcaaccaaaacgataaatttgacatacgactcatattccttgcgttatcacatatagtaaaaaagagagggcacttcctctttgatggagacaaagccggcttcggtgaagacatagacgtaattctcgacgaactaaaagcatatcttcaggatgctttccacacaaaactagaatttacatcagagtttaaatcaattatgctcgataaaaacctcagaaaaaaacagaaagaagaagaattaaaaaactccatcaaaatctcaagtgacacaataaacagcaaagacggcaaaagcattttgataaaactatttcttgggtatgaggcaaaccttaaaccgtttttcttagaatataaagtcgaaaaagacaacgaatataaaataaatttctcaaaagaggattacgaagaaaaactactagatatgactagcaaattcgaagaaacaacctacttcattgaaattgccaaaaaaatacacgattattttttacttgaagaaataatgctaggattcaaaaacatttcagcttcaaaagtgtcaatctaccaaaaacataaaaacgatctaaaaaccctaaagaacatagtaaaaaaccaaataaacaactcctataacgcaatcttcaaagacataggcctagataattatccagcatacgtttcatgttggaattcaaaaaaacacaaggaaaaacaaaaaggatgcacaaaagataaattctacgctttccttaaaacgaaattaaaaaatatcaacaacgcaaaagaaatattagactcgattgacaatgatgatttcttacctagattagtagacaagaactcaataatccctcaccaaattcatctcgcagagttaatcaaaataatagataatcaatcacaatactacccatttttaaaagaaattaaagataaaataataagtatattcaaatttaggattccattctacgtcggaccccttaacaatttccataaagataaagggggcaatgcatggatcgaaaagttgaaagatgagagaatatttccctggaattttaacgacgtcgtagacctaaataaaagcgcagctaacttcatcgaaaaaatgatcaacgaatgttcttacttaaaaggagaaaaagtactagcaaaaaactcattactctatactaaatacagtgtcttaaatctcataaacaaactaaaaataaacggtaccgctgtgtccgtggaaacaaaacagaaaatatacaacgaactattgctaaaacaaaaaaacataaaaaaaaccgcaattaaaaaatttcttataaataactcaataatcgacaaaaacgacgaaatttcaggcatcgatgactccttaacctcaaacttagcagtattcatagacttcgaaaaaatctctaaccgcctcaggtatgaccaaaaagaagacataatcaagtcgatctcgctgtttggctacgataacgcaatgctgaaaaaacagataataacaatagcacccgatctcagtgaagatgaactagaaaaactatctaaattgagatactcaggatttggacggttgagtaaacgcctgctcacctccataaaacacaatggtaaatccataattgaaatgctatgggatacaaacgataacctaatggaattattatcagatcgatatactttcatcgaacaaataaataaacacaatgatggattcaaagaagacatcaatttaaatttccaaaacgtagacacactatacgtctcgccgagcgttaaacgacaaatatggcaagcatttaaagtcataaatgaactaatctcagtcatgggccgtgaaccaaaaaaaatattcgtagagatggccagagaagaaggcgagaaaaagagaacccaagcaagaaaggacaaagtacttgaattatataaatcaataaaaaataacgaaatatccacatttttaactaatttcaaagatataaaaacaaaactagagggcgaatcaaatctaaacagtaaaaaattatacttatactatctacaactaggagtagatatatacaccggtgaaaaaataccattcgaaaaactattcgaccaaaacatctacgatattgaccacgtaataccacgatcattaaaaaaagacgacagtttcgataaccttgtactaacaagcaaaacaaataacgcaaaaaaaacagatgaattccctgtctcctcagaaatacaatcaaaaatgcaaaccttctggaaggttctaaaagacaaggacttaatgagtgaaatcaaatatacaaatctaacacgcaaaacacacctcagcgacgacgaactaggcgactttattgctaggcaactagtagaaacgcgccaatcaactaaagccctaacacaaatcctaaaaaatgtctatgctaacagcgatatagtttacgtaaaagccggcatagtctcagaatttcgacaacaattcgacatgctaaaaatcagagaattaaacgatttccaccatgccaacgatgcatatctaaacattgtcatcggaaacgtatacaacattaaattcacaaaaaatccaagaaattatgtaaaagaatactacaaaaaaggagaacattataacttaaagatcgaaaaaatgctagagaaagatatagcaaggggcggcaatttcggttgggataaaaaacattctatcgaaaccgttcaaaagaccatgaaaaaacagtcccccttaataacctacagaacattcgagaacaaaggtgaatttttcaatcaacagccatcaaaagcatcggctaacttactcgcattaaaatcctctgacaaacgcttactcgacacagtaaggtatggaggttataaaggaacacaatatgctcacatgttcttagtagaacacttcaacggcaaaataataaaagaaattatgggagtgccaatctacctatcaaaagaaataaaagacgataaagcaaaattactagagtattgcaatgacgtactaaaacttaaaaatcctaaaatactttttagtaaaataccatataattctctaatcgtatacaacggatacccaatcctactgagaggactcacaggagtaagaggggcagcccaattaaaacttgaccagacatccactcaagtagtaaaaaatatagtgaaactatacgattggttatcgcaaaaacaaaaagaactatcagacttgagcaagaaaatcgaatttttccaagaaaacaacaagaaagacgaagtgaaggcggccatgttagaagcagataacattctctttatattaaacgacagattcaaaaatacaaaaataggtaaagacataatgaatgataatcaccttaataacctatacgatacatttataaacaaattagaaaacagtatctataaaaacaaaccaggcggaaaacaagacgtattaatgaaagaaaagagagacctattcctgtccttctcgatgtcaaaaaaatgcataacactctacaaaataatcaaaatattcggaagttgcgatcaaggcgtcgacttcagtgatatcgccgaaaaaatttccaaatccggtggaataggcggcaaaaatctaggtaaaaacacattcgacctcgtgtttaaagaaaattcaacttacactttggtacaatccagcgttacaggtttatacgccaaaaaaaccgacctccacaaactctga

SEQ ID NO: 8899 - RNA, 4104 nt, synthetic construct
  misc_feature 1..4104: note = Cas9 variant
  source 1..4104: mol_type = other RNA
atgaaaaaacaaaaattctcagattactacctcggatttgacatcggaaccaactcagttggctggtgtgtcaccgatttagactacaacgtactacgatttaataaaaaagacatgtggggtagtagattatttgaagaagccaaaacagctgcagaacgtagagtccaaagaaacagccgacggagattaaaacgaagaaaatggagactaaacctcttagaggaaatattcagcaacgaaatacttaaaattgactccaatttcttccgaagactcaaagaatccagcctatggttagaagacaagtcatcaaaagaaaaattcacgctcttcaacgatgacaactacaaagactacgacttctacaaacaataccccacaatatttcacctaaggaatgagctcataaaaaacccagaaaaaaaagacatacgattagtatacttagctatccactctatattcaaaagtagaggacacttcttatttgaaggacagaacttaaaagagatcaaaaatttcgaaacattatacaataacttaatagcatttctagaagataacggaataaataagataatcgataaaaacaatatcgagaaactagaaaaaattgtatgcgactccaaaaaaggacttaaggacaaagaaaaagaattcaaagaaatctttaattcggacaaacaactggtagcaatatttaaacttagtgttggctcaagcgtcagcctaaacgatttattcgacacggacgaatacaaaaaaggagaggtagaaaaagaaaaaatctcattcagggaacaaatatacgaagatgataaaccaatctattacagcatacttggtgaaaaaatagaactactagacatagcaaaaactttttacgatttcatggtactaaacaacatcttagccgatagccagtatatatcagaggccaaagtaaaactatatgaggaacacaagaaagacctcaaaaacttaaaatacataatacgcaagtacaacaaaggtaattatgataaactattcaaagacaaaaacgaaaacaactattcagcttatatagggttaaataaagaaaaaagcaaaaaagaagtaatcgaaaaaagccgcttaaaaatcgacgatctaattaaaaacataaaaggatacctacctaaagttgaagaaattgaagagaaagacaaagcaattttcaacaaaatactaaataaaatagaactgaaaacaatcctcccaaaacaacgcatatcagataacgggacactaccataccaaatacacgaggccgaattagaaaaaatattagaaaatcaaagtaaatactatgactttctgaactacgaagaaaacggcattataacaaaggataaattgctaatgacctttaaatttcgaattccatattatgtagggcccctgaatagctaccacaaagataaaggcggtaattcatggatagtaagaaaggaagaaggaaaaatattaccatggaatttcgaacaaaaagtcgatatcgaaaaaagcgccgaggaatttataaaacgtatgactaataaatgtacctatctgaacggagaagacgtgattcccaaagacacattcctatactccgagtatgtaattctaaacgaactaaataaagtacaagtaaacgatgaatttctcaatgaagaaaacaaaagaaaaataatagacgaattatttaaagaaaataaaaaagtctccgagaaaaaattcaaagaatacctattagttaaacaaatcgttgacggaaccatagaattaaaaggagtaaaggactcatttaactcaaactatatctcatacatcagatttaaagatatattcggcgaaaaacttaacctagacatttacaaagaaataagcgaaaaaagcatattatggaaatgcctctacggcgatgataaaaaaatattcgaaaaaaaaataaaaaacgaatacggcgatatactgaccaaagacgaaataaaaaaaataaacacttttaaattcaacaactggggcagactgagtgaaaaattgttaacaggcattgaattcataaacctagaaacaggcgaatgctatagttcagttatggatgcattaagaagaacaaattataacctaatggagctgctaagctccaaatttacattacaagaaagcattaacaacgaaaacaaagagatgaacgaagccagctatcgcgacttaatcgaagaaagctacgtatcgccctcactgaaaagggctatatttcaaacactaaaaatatatgaagaaatacgaaaaataacaggtagagtgcccaaaaaggtatttatagaaatggcacgaggaggagacgaaagcatgaaaaacaaaaaaatcccagcgcgacaagaacaacttaaaaaactatacgactcatgcgggaacgacatagcaaactttagcatagatataaaagaaatgaaaaattctctcatatcatatgacaacaatagtctaagacaaaaaaaactatacctgtactaccttcagttcggaaaatgcatgtacaccggcagagaaatagatctagatagactcttacaaaacaatgacacatatgatatagaccatatttaccccagaagcaaagttataaaagatgacagctttgacaatcttgttctagtattaaaaaacgaaaacgccgaaaaatcaaacgaataccctgtgaagaaagaaatacaagaaaaaatgaaaagtttctggcgattcctaaaagaaaaaaattttatatcagatgagaaatataaaagattaacaggaaaagatgactttgaattaagaggctttatggcccgacagttggtgaatgttcgtcaaaccacaaaagaggtcggaaagatactacagcaaattgaaccagaaatcaaaatcgtctattccaaagccgaaattgccagtagtttcagagaaatgttcgacttcataaaagtaagggaactaaatgatactcaccacgccaaagacgcatacttaaacatcgtagcaggcaacgtatataacacaaagtttacagaaaagccgtatagatatttacaggagataaaagaaaactatgacgtaaaaaaaatttacaattatgacatcaagaatgcatgggacaaagagaactcattagaaatagttaaaaaaaacatggaaaaaaacacggttaacataacacgatttataaaggagaaaaaaggccaactattcgaccttaaccccataaaaaagggagaaacgtctaacgaaataataagtattaaaccaaaagtatacaatggaaaagacgataagttaaatgaaaaatacggatactacaagtctctcaatccagcttactttctatacgtcgaacataaagaaaaaaacaaacgcataaagagcttcgagcgagtcaacctagtagacgtaaacaacatcaaagacgagaaatccctagtcaagtatttaatagaaaataaaaagttagtagaacctagagtaattaagaaagtatacaaaagacaagtgatcttaataaacgactatccctactcaatagtaaccttagacagcaataaactaatggactttgaaaacctaaaaccactattcttagaaaataagtatgaaaaaatactaaaaaacgttataaaattcctagaagataatcaagggaagagcgaagagaactacaaatttatttatcttaaaaaaaaagaccgatacgaaaagaacgaaacattagaaagcgtcaaagatagatacaacctggaatttaacgagatgtatgacaagttcttagaaaaactggatagtaaagactacaaaaactatatgaacaataaaaaataccaggaactactagatgttaaagaaaaattcataaagttgaacttattcgataaagcatttactttgaagagcttcctagacctattcaatagaaagaccatggccgacttcagcaaagtcggacttacaaagtacttaggcaaaatacaaaaaatctcctcaaacgtactaagcaagaacgaactatacttattagaagaaagcgtaacaggattattcgtcaaaaaaataaaattatga

SEQ ID NO: 8900 - RNA, 4104 nt, synthetic construct
  misc_feature 1..4104: note = Cas9 variant
  source 1..4104: mol_type = other RNA
atgaaaaagcaaaaattcagtgactactacctaggttttgacataggaacgaattccgtcggatggtgcgtaacagatatgaactacaacgttcttagattcaacaaaaaggatatgtggggatcgcggttattcgaagaagcgaaaacggctgccgaacgtagagtacaaagaaacagtaggcgaagactcaagcgaagaaaatggcgccttaacctattagaagaaattttctctaatgaaatcctaaaaatagatagcaacttttttagacgattaaaagaatccagcttatggctagaagataaaagctcgaaagaaaaatttaccttgtttaatgacgacaactacaaagactacgacttctacaagcaatatccaacaatatttcatcttagaaatgaactaataaaaaaccccgaaaaaaaagacataagactagtatacctagcgatccacagcatcttcaagagcaggggccactttctatttgagggacaaaacttaaaagagataaagaacttcgaaacactatataacaatctaatcgcctttctcgaagacaacggtataaataaatccatcgacaaagataacctcgaaaaattagaaaaaatcgtatgtgactctggtaaaggcctaaaagataaagaaaaggaatttaaagaaatatttaactcagacaaacaactcgtagccatatttaaattatcggtaggactcagtgtctcactaaatgatttattcgatactgacgaatacaaaaaaggagaggtcgaaaaagaaaaaatcagcttccgtgaacagatatacgaagacgataaaccaatctactatagcatactaggtgaaaaaatagaactattagacatcgccaaaagcttttatgactttatggtactaaataatatcctcgcagatagccaatacatcagtgaagcaaaagtaaaattatatgaggaacacaaacgagatctaaaaaacctcaaatatataatcagaaaatataacagggaaaattatgacaagcttttcaaagacaaaaacgaatctaactatccagcatacataggactaaacaaagaaaaatcaaaaaaagaagtaatcgaaaaaagtaaactaaagattgacgaccttattaagtcgattaaaggatatctaccaaaggtagaagaaatcgaagaaaaggataaagcaatattcaatgaaatcttaaacaagatagaactcaaaatcatactccccaaacaaagaatatcggacaacggaaccttaccctatcaaatacacgaggcggagctagaaaaaatattggaaaaccaatccaaatattacgactttcttaactatgaagaaaacggaatcattacaaaagacaaactacttatgacatttaaattcaggataccatattacgtaggaccactaaattcataccacaaagataagggaggaaactcttggatagttagaaaagaagaagggaaaatattaccctggaattttgaacaaaaagtagacatagaaaaatctgcagaagaatttataaaacgaatgacgaacaaatgtacatatcttaatggcgaggacgtaataccaaaggattcttttttatattcggaatacataatactaaatgaacttaataaggtccaagtaaacgatgaattcctaaacgaggaaaacaaaaggaagataattgaagaattatttaaaggcaataagaaagtttccgagaaaaaatttaaagaatacctcttagttaaccaaataacaaccgggactatagaactcaaaggaataaaagactctttcaacagcaactacatttcatacataaaatttaaagacatctttggagaaaaactgaacctagacatttacaaagaaatttccgaaaaatcgatattatggaagtgcttatatggagacgataaaaaaatttttgaaaagaaaataaaaaatgaatatggagacatcctcacaaaagatgagatcaaaaaaataaacacatttaaattcaataactgggggaggctgagtgaaaagttattaacaggcatagaatttattaacctagaaacaggagaatgctacagcagcgtaatggaagccctcagacgcacaaattacaacttaatggaactactaagctcaaaattcactctacaagagaatatcgacaatgaaaacaaagacatctctcaattcagctatagggacctagtagaagaaagctatgtgtccccaagcctaaagagagcgatactccaaacattaaaaatatacgaagaaataaaaaaaataaccggaagggtcccaaaaaaagtatttattgagatggccagagggggagacgaaagcatgaaaaacaaaaaaataccggccagacaagaacaattaaaaaaactatacgacagctgtggaaacgatatagcaaactttagcatagacataaaagagatgaaaagctcattatcattatatgacaataactcactacgacagaaaaaattatacctatactacctacaattcggtaagtgcatgtatacaggaagagaaatagatctggatagactactacaaaacaacgatacatacgacatcgatcacatatatccaagatccaaagttatcaaggatgattccttcgataacttagttctagtactaaaaaatgaaaatgctgaaaaatcaaatgaatacccagtaaaaaaagaaatacaagaaaaaatgaaatccttctggcgctttctcaaagagaaaaattttatatcagatgaaaaatataaaaggttaacagggaaagacgatttcgagctaagaggctttatggccagacagctagtaaacgttagacagaccacaaaagaagtgggaaagatattacagcaaattgaaccagaaataaaaattgtatactccaaggctgaaatagctagcagcttccgagagatgttcgactttattaaagttagagaactcaatgatacgcaccacgcaaaagatgcatacttaaatatagtagcaggcaacgtttataacacaaagtttacagaaaaaccatatcgctacttacaagaaattaaagaaaactatgacgtaaaaaaaatatacagttacgatataaaaaacgcatgggataaagaaaactcgctcgaaatagtgaaaaaaaatatggaaaaaaacacggtaaatataacacgttttatcaaagaagaaaaaggtcaattatttgaccttaatccaataaaaaagggtgaaacaagcaacgaaatcatatctataaaaccaaaagtctacaacggaaaagacgataaactaaacgaaaaatacggatactataaatctctaaatccagcatatttcctgtatgtggaacacaaagaaaagaacaaacgaatcaaaagcttcgaaagagtaaaccttgtcgacgtaaataatataaaagatgagaaatccctgataaaatatttagtagaaaacaaaaaactcgttgaaccaagagtaatcaaaaaagtctacaaacgtcaagtcatattaataaacgattacccatactcgatagtggcattagattcaaacaaactaatggacttcgaaaacttaaaaccactatttttggaaagaaaatacgaaaaaatattaaaaaatgtaataaaattcctagaagataaccaaggcaaaagtgaagaaaactataaatttatatacctaaagaaaaaagacaggtacgaaaaaaacgaaacattagagtcagtccgtgaacgatataacattgaatttaacgaaatgtacgacaagttcctggagaagctcaattcaaaagattataaaaactacataaacaataaaaaataccaagatttactggatgtaaaagaaaaattcataaaattaaatctcttcgataaagcattcacactaaagagcttcttagacttatttaacagaaaaacaatggcagatttttcaaaagtcggactcacaaaataccttggtaaaattcaaaaaataagcagtaacgtcctgtcaaagaatgaactatacctattggaagaatctgtaactggactatttgtaaaaaaaatagaactatga

SEQ ID NO: 8901 - RNA, 4104 nt, synthetic construct
  misc_feature 1..4104: note = Cas9 variant
  source 1..4104: mol_type = other RNA
atggtcaaaaagaagtacgctatcggaatcgacatcggaacaaactcagtaggttggtcagtagtgacagatgattacaaagtccctagcaagaaaatgaaagtattcggtaatacagaaaaacgttatatcaagaaaaacttactgggaacacttttattcgacgaaggcaacaccgctgaaaatagaaggctcaaaagaacagcaagaagaagatacaccaggagacgtaacagaatattatacttgcaagaaatatttgcagaagaaataaacaaaatagacgacagctttttccagagattagacgactcctttttaatagtagaagacaaacaaggatcaaaacaccctattttcggcacattacaagaagaaaaagaataccataaacaattccctacaatttatcacttacgcaagcaattagctgactcatctcagaaagcagacataaggcttatatatttagcactcgctcacataattaaataccggggacatttcttatttgaaggagatctgaaatcagaaaacaaagacgtccagcacttatttaacgatttcgtagaaatgtttgacaaaactgtagaaggaagctacctaagtgaaaacctacccaacgtagcagacgttctagtcgaaaaagtctccaaaagcaggagactagaaaacatacttcactactttccaaatgaaaagaaaaatggactatttggtaacttcttaacattagcactcggactacagccaaatttcaaaacaaactttgaattagcagaagatgcaaaaatacaattttctaaagaaacctacgaagaagacctagaagaattactaggaaaaataggtgacgactatgcggacttatttatagcaacaaaatccctgtatgacggaatactcctcgcaggaatattgtcaacaacagactccactacgaaagcaccactaagctcgtccatggtaaaccgatacgaagaacaccaaaaagatctagcactattgaaaaattttatacatcagaacctatcagactcatacaaagaagttttcaatgacaaactaaaagacggttacgccggatacatagaaggaaaaaccacacaagaaaatttttataggttcatcaagaaagcaatagagaaaattgaaggtagcaactacttcattgacaaaatagatagggaagatttcctaagaaaacaacgaacttttgacaacgggtcaatacctcatcaaatacacctacaagaaatgcacgcaataatcagaagacaggcagaattttatccatttttagttgaaaatcaagataaaatagagaaaatattaactttcagaataccatactacgttggaccactcgcccgcggcaaaagtgaatttgcttggctaaatagaaaatctgacgagaaaattcgaccatggaatttcgacgaaatggtcgataaagaaacatccgctgaaaacttcataaccagaatgaccaactatgaccaatacctacctgatcaaaaagtcttaccgaaacacagtttactctacgaaaaatttgctgtttacaatgaattaacaaaagttagatatgtcacagaacaaggtaaatcctttttcttcgatgcaaatatgaaacaagaaatcttcgatggcgtattcaaagtttatagaaaagtaacaaaagaaaaattaatggatttcttgggaaaagaatttgatgaatttagaatagtagatttactaggactagataaagataacaaatccttcaacgccagcctaggcacctaccatgacctaaagaaaatagtatcgaaagacttattagataatccagagaacgaagacatattagaaaacgttgtcctaacactaacattattcgaagacagggaaatgatacgaaaaaggctagagaaatacaaagacgtcctaacggaagaacaaaggaagaaactagaaagaaggcattacacaggctgggggaggttatcagcgaaactaatcaatggaataagagataaagtcacaagaaaaacaattttagactatctcatcgacgatggaacatctaatagaaattttatgcaactaataaatgacgataccttatcattcgtcgatgaaatccgattagctcaaggttccggtgaagcggaggactatagagcagaagtacaaaacctcgctggtagccctgcaatcaagaaaggtatattacaatccctcaaaattgttgacgaactaatagaagtaatgggttatgatccagaacatatagttgttgagatggcacgtgaaaaccaatttacaaaccaaggtaggagaaactcacaacaaagatacaagaaaatagaaaatgcaattaaaaatctcgactccaacctaaattctaaaatacttaaagaatatcccacaaacaatcaagcattacagaacgaccgattattcttatactacctacaaaatggaaaagatatgtacacagacgaggagcttgatatagaccaactaagccaatacgacatagaccatataataccacaggccttcataaaagacgactcactagataataaagtcttaaccaaatcagctaaaaatagaggtaaatcagatgacgtaccatcattagaaatagtccacaagaagaaaaatttctggaaacaactacttgacagccaattaataagccaaagaaaattcgacaatttaactaaagcagaaagaggtggactaaccaacgaagataaagctaggttcatccaaagacaattagtggaaacacgacaaataacaaaacacgtagccagaatcctcgacacacgatttaatacaaaactagatgaggcgggaaaccgaattagagacccaaaagttaatattataacactaaaatcaaatttggtttctcaattcagaaaagattatcaattatataaagtcagagaaataaacaactatcatcacgcccacgatgcatacttaaatgcagtggtagccaccgcattactaaagaaatatcctcagctggcccctgaatttgtatatggtgattatccgaaatacaattcttacaaatctcgaaaaagtgcaacagaaaaagtattattctactcaaacataatgaactttttcagaagagtattagtatatagtaaaacaggcgaagtgcgcataagaccagttattgaagttaacaaagaaactggagaaatagtatgggataagaaatcagatttccgaactgttcgcaaagtacttagttatccccaagtaaacgtagtcaagaaagtcgaaatgcaaacaggaggtttctccaaagaatctatacttcaacatggtgattccgacaaactaattccacgtaaaactgaaaaattttacctagacactaagaaatacggaggatttgattctccaacaatagcctattcagtcttattaatagcagatatagaaaaaggaaaagctaagaaacttaaaagagttaaagaactcataggtattaccatcatggaaagaatggccttcgagaaaaaccccatagaatttttagaacacaaaggatataaaaacatcctagagaaaaacatcattaaactacccaaatattcattattcgaactagaaaacggcagacgacgtctattagcaagtgcaaaagagttgcaaaaaggcaatgaaatgatcctgccaccacacttagttacattattatatcactcatcaaatattcataaaataacggaaccaatccacctgaactacgtaaataaaaacaaacatgagttcaaagaactattacgacacatcagtgatttttcgacaagatacatattagctcaggacagactttccaaaattgaagaactctacgacaaaaacgacggcgatgacatatcagacctaacatcatcattcgtaaacttactaacattcacagccatcggagccccagcagcgttcaagtttctgggatctgttatagatagaaagcggtacacaagcatagctgagatactagaagcaacattaattcatcaatccgtcaccggattatacgaaaccaggatagacctaagtaaattaggtggcgattga

SEQ ID NO: 8902 - RNA, 4104 nt, synthetic construct
  misc_feature 1..4104: note = Cas9 variant
  source 1..4104: mol_type = other RNA
atggtgaaaaagaaatacgcgataggcattgatataggtacaaatagtgtaggatggagtgtcgtaaccgatgattataaagtccctagcaagaaaatgaaagtattcggaaacacagaaaaacgatacatcaagaaaaacctattaggcaccctactattcgatgaaggaaacacagcagaaaaccgtcgactaaaacggacagcaaggagaagatacacacgaagaagaaatagaatattatacctacaagaaatattcgctgaagaaataaacaaaatagatgactccttcttccaacgcttagacgactcgtttctgattgtcgaagataaacaaggatcaaaacacccaatatttggaaccctacaagaggagaaagaataccacaagcaattcccaacaatatatcacctccgtaaacaactagcagactcctcacaaaaagctgacataagactaatttaccttgcattagcacacattataaaatatcgcgggcactttctgttcgaaggggacttaaaatccgaaaataaagatgttcaacatctatttaatgactttgtagaaatgttcgacaaaacagtagaaggatcatatctatcagaaaacttacccaatgttgcagacgtattagtagaaaaagtatcaaaatcaaggcgattagaaaacatattacattacttcccaaacgagaagaaaaacggcttgtttggaaatttccttgcactagcactaggactacaacccaatttcaaaacaaactttgaacttgcagaagacgccaaaatacaattttctaaagaaacttacgaagaagacttagaagaactacttggaaaaattggcgacgactatgcagacctgtttatagcaacaaaatctctatacgatggcatattattggcaggaatactctcaacaacagatagcacgacaaaagcaccactatcaagttctatggttaatagatacgaagaacaccaaaaagatctagcactgctcaaaaatttcatacaccaaaatctttccgattcatataaagaagtcttcaacgacaaattaaaagacggttacgccggatatatagaaggaaaaacaacacaagaaaacttctacagattcatcaaaaaggcaatagagaaaatagaaggtagtaactactttatagataaaattgatagagaagactttttacgcaaacaaagaacatttgacaatggttccatccctcatcaaatacacctacaagaaatgcacgctataataagacgacaagccgagttctacccattcttagtcgaaaaccaggataaaatagaaaagatattaactttcaggattccatactatgtagggccactcgcaagaggtaaaagtgagttcgcatggcttaaccgaaaatcagatgaaaagataagaccatggaactttgatgaaatggtggacaaagaaacaagtgcagaaaattttataacgcgcatgacaaactacgaccaatacctaccagaccaaaaagttcttcccaaacacagcctactatatgaaaaattcgcagtgtacaatgaattaacaaaagttagatatgttactgaacagggtaaatccttcttctttgatgcaaatatgaaacaggaaatatttgatggagtattcaaagtatatcgcaaagttactaaagaaaaactaatggattttctaggaaaggagttcgatgagttcaggatagtagacctcctaggattagataaagacaacaaaagttttaacgccagtctaggaacctaccacgatctaaagaaaattgtgagcaaagacttactagataaccctgaaaacgaagacatactggaaaatgtagtactaactctaacactttttgaagatagggaaatgatcagaaaacgactagaaaaatacaaagacgtgttgactgaagaacaaagaaagaaactagaaagacgacattatacaggatgggggcgtctctccgctaaactaataaacggaataagagacaaagtaactagaaaaaccatccttgattacttgatcgacgatgggacatcaaatagaaattttatgcagttaattaacgacgataccctatcgtttgtagatgaaatcagattggcccagggatcaggagaggccgaagactatcgcgcagaggtacaaaacttagcgggtagtcccgctataaagaaaggtatattacaatccttaaaaatcgtagacgaattaattgaagtaatgggttatgaccctgaacacatagtagtagaaatggcacgagaaaaccaattcacgaaccaaggacgcaggaactcacaacaacgatacaagaaaatagaaaatgcgatcaaaaacctggatagtaaccttaatagcaaaatactcaaagaatatccaacaaataaccaggcattgcaaaacgaccgtctctttctctactacctacaaaacggaaaagacatgtatactgacgaagaactagacatagaccaattaagccaatatgacatagatcacattatcccacaagcattcataaaggacgatagcctcgataataaagttttaacaaagtctgccaaaaatcgtggaaaatccgacgacgtaccatccctcgagatagtgcacaaaaagaaaaatttttggaaacaattactagactcgcaattaatatcacaaagaaaatttgataacctgaccaaagcagaaaggggtggcctaacaaacgaagataaagcccggtttatccaaagacagctagtagaaactagacaaatcacaaaacatgtagctagaatcctagatacgaggttcaacacaaaactcgacgaagcagggaatcgtataagggaccctaaagtcaatataataaccctaaaaagcaatctcgtatcacaatttagaaaagattaccaactatataaggttagagagataaacaactaccaccatgcccatgacgcatatttaaatgcagtagtcgctacagcgctactcaagaaatacccacaattagcaccagagttcgtgtatggcgactaccctaaatacaattcatacaaatctagaaagtctgcaacagagaaagtactattctattcaaatattatgaacttcttcagaagagtcctcgtatacagcaaaacaggagaagtaagaatccgacccgtaatcgaagtcaataaagaaacaggagaaatagtttgggacaagaaatcagactttcgaacagtgagaaaagtactgtcttatccgcaagtaaacgtggtcaaaaaggtagaaatgcaaaccggaggcttttctaaagaatccatacttcaacatggagacagcgacaaattaatacctcgaaaaaccgaaaaattttatctagacacaaagaaatacggaggattcgatagcccaacaatcgcgtacagcgtactactaatagctgacatagagaaaggcaaagctaagaaattaaaacgagtaaaagaactcataggcattacaataatggaacgaatggctttcgagaaaaacccaattgaatttctcgaacacaaaggatataaaaacattttagagaaaaatataattaaattaccaaaatactcactctttgaacttgaaaacggcagaagaagattattggcatcagcaaaagagctacaaaaaggaaacgaaatgatactaccaccgcacttagtcaccctactatatcattcaagcaacatccacaaaataacagaacctatccacctaaactatgtaaacaaaaataaacatgaatttaaagaattattaagacatatttctgattttagcaccagatatatactcgcacaagacagactatcaaagatagaagaactatacgacaaaaacgatggagatgacatatccgacctaaccagctccttcgtaaatctattaacattcacggcaataggggcccctgctgcatttaaatttctcggatctgttatagacagaaaacgatacacatcaattgcagaaatactagaagcaacattgatacaccaaagcgtaacaggactatacgaaacacgaatagacctaagtaaactaggaggagactga

SEQ ID NO: 8903 - RNA, 4107 nt, synthetic construct
  misc_feature 1..4107: note = Cas9 variant
  source 1..4107: mol_type = other RNA
atggacaagaaatactcaataggattagacataggtacgtcaagcatcggattcgtgggagtagacgaaaacggatggcctcttaacataaaaggaaaaagagcgataggagcacacctttttcgggaaggcgaagcggcagccgagacacgaggattccgtaccacacgcagacgttacaaccgtagaaaatggcgcctgcgcttattacgcgaaatatttgacgaaccaatatccagagtggatcctacattctttgccaggatgaaagagtcatccgtatctccaaaagatccaaattatgacggacttgctaaagaaatactaattccgagggacaaagacggcaaaatattatatcccaccatataccacctcagacacgcactaatgtacgaagatcatcaatttgacatccgcgaaatatatttagcaatacaccacattgtaaaataccgaggacacttcctgctggatggagcagctaaaaacttcgaatcctcaaatttagacctcaaaagtgacattcatgaaataaacgcaattttagtaggcatatttggtaacgaacaagttcaatttaatgatcagtacgtcgaaaaattaaaagaagttctactagatagcacccaaagcagatcagatcgacaaaaagcagcagccaaagttttattacccacaaacgatttagacaaagatactacaaaaatattaaaaacagtaagcaccgaaattacgaaagcaataactggcttaaaagccaaattctttgtcataaccggtaacgatatcgcgaaagaccaacaaaaagattggacattttccatcgatacactcgatgagaaaatgtcagtcattgaaccatcattcagcgagaaaaactttagtctaataacaatacttcaaaaactatattctagtgtaactctagcaggcatagtcccaaatggactgtccttatcggaagctatgatacaaaaatacgatcggcacgcatctgatctagttttactcaagaaatactgggacaccaaaccaaaagtattaaagcatcaattacaaaatacctatgcagaatacattgaaattcatcaggtggtagacgagttctatagtgacttatcaaaactgattaaaaacgatgatgacacgcttgcacaggagataaaaagtaaaataactattggaaacttcttgccaaaacaacgaactacggaaaacggcgtaataccataccaactacaacagcgagagctagacacaataattaaaaaccaacaagaatattacccctggctcgcagaagaaaacccagtcgcagaccatcaaatagcctttccgtataagctggacgagttagtcggattccgcataccatactatgtaggaccaatgatagctaaagaagatacatctaacagcaaaaattctaaattcgcatggatgataagaaaacaatccggagaagtaacaccatggaatttcgacgagaaaatcgacagaacggccagtgctactgcattcatcgatcgcatgactacgacagacacctacctaataggtgaagatgtgttacccaaacaatcactcatatatcaacgctttgaagtactcaacgaacttaataaaatatcaatagacggacaaccgataacaagaaaacaaaaacaaagtgtctacacacatgtatttgaaaagaagaaaacagtacaagtaaaagatgtacaaaaatttctagtaagttcaggagaagtgatgtcacttcccaaaataggaggactcgccaatgaaaaacaattcaattcatcactcagcaccttatatgactataacaaaatcataccagacgccctagaagatcggaacaaagtggacgatatagagaaaataatactttggtcaactatatttgaagacaatagcatctttgttgaaaaattagactcgatagattggctaacatcgtcacaaagaaaacgtttagcccagaaaagatacagaggctggggaagactaagcctacgcttattaacaacattcaaaaataaagatggttattcaatactggatgaactatggaactctaatcacaatttcatggaaatacaagcacaaagtgatttttctgaacaaattgccacagcaaacaacaacaacctaagccaagttcttcccgctaaatgggaaccaggaagaaagaatttggcaagcctagatgaatttataagtaacttatatacctcaccacaaaacaagaaagcgttaagaaaagccatacgagttgtacaggacatgatgacagccgcaggacacatgcctgagaaaatattcattgaagtagcacgtgacacgtcaaactcacaccaacaaaccattgctagacaaagacaactccaacaattataccaaagcgaagcaaaagaagtaatagactcatcagttagaagcgaactcgacgacattcttaaaaaccgagccaatataaaagaccaactattcttatactttcaacaaggagggcgcgatctatatacaggaaaagctataaacatcgataaattatcactatatcacattgaccatatactaccacaatcgttagtcaaggatgattccttagacaacagagttctagtaagtcagaaaactaacgaagataaaggagtaacattcgtatcagataaatatatgaacaacatgttacctacctggaaaagatggcacgaaatgggattaataagtgccagaaaacttaaaaacctaaccatgagacccgacgaaatagacaagtacgcaccgggattcattcaaagacaattggtagaaacgagacaagtaactaaattggtgatagaactattggatgccttgttaggaaacagtcaaacagaaataataacaatcaaggcttctttatcacaccaattccgacaacaatttgatctagttaaaatacgtgaagtaaatgataaccaccatgcattcgacgccttcttagcagcacgcataggaacttacctctataaaagataccctaaattaagaccatatttcgtatatggccaatacatgcaaaaccacaaaaatttgaaaagtataaatctaataaaaactctcgactcagacaaagcaatagttgatgaaggaactggcgaaatcctatgggataagaaatctgacctagctaaaatgatcaaaatctataattaccaaaggctcctaattacacatgaatcaagaacatcatttggcgctatgtataaacaaaagatattaaaggctaccgacgctaaacaaaacgggggaggattcaagttagtaccaacaaagcgcaattggccagtagacatctatggaggctacacaggacaaacagccgcatatttaaccattgttcgagtctactccaaaaagacttcagaattacgcgtacttccaatatacacgaacaaagtccaacaaatagaaaaagcaatgactcaaggtgataaagcaaccatgctcgcctttaaaaaggtaatagcgcctcagttaggtaaagaaaacaagaaaacccacgaaatcaaaatacctgaatttgatgttgttatacccaaagtgctcttagatcagctagttattgatgacattgcaggaagcccgcacagatttcgattgggtacagacacttattaccacaacagtcaacaattgtttctacccttgtcaatgcaacgtcagctaatggatcgagaatcagatgacaaagtctatctcgacatcttcaacgacgttctgaaacaagtcgattcatactttaacttatatgacgtaaatggcttccgagcagcccttcagaaaagtaagaaagcattcgaacaactaccaataaatgacttccctaaagatgtacccgataataaaaagaagaaagggaaaagatcaattttaaaagaaatttttatcggactacacgccaatgctactcttggaaatctaaaacaaatgggcataaaaacagattttggaaaattacaaaaatccaacggactacgaataacagaaaactgtaaaattattcatcaatccccaactggtctttttgaacgaatagttcccataaaatga

SEQ ID NO: 8904 - RNA, 4107 nt, synthetic construct
  misc_feature 1..4107: note = Cas9 variant
  source 1..4107: mol_type = other RNA
atgtcacgaccatacaacatcggcctcgatattgggacctcatcaatcggctggtcagtagtcgacgatcaatcgaaactggtttccgtaaggggaaaatatggttatggagtacgtctctacgacgaaggccaaacagccgcagaaaggaggagctttcgaaccacgagaagaagactaaaacgacgaaaatggagattaggcttactccgtgaaatatttgaaccctatataactcccgtagacgacacgttcttcctacgacaaaagcaatcgaatctttcccccaaagatcaaagaaaactatacccacaaacatcacttttcaacgacagaacagatcgagcattttatgatgattaccccacaatataccatttaaggtataagttaatgacagaaaagcgccaattcgacataagagaaatatatcttgccatgcaccatatagtaaaatatcgaggtcacttcttaaatgaagcacctgtttctagctttaaaagtagtgaaatcaatctagtagctcacttcgatagacttaatacaatatttgcagatctattttctgaatccggatttcaattggaaaccgacaaacttgcagaagtaaaagccctactcctagataaccaacagtcggcatcgaaccgacaacgacaggccttatcactaatttacacaccttccacaaataaagcagttgaaaaacagaacaaagcaattgcaacggaattattaaaagcaatactaggattgaaagcaaaatttaatgttttaacaggaattgaagcagaagatgtaaaagcctggacccttacattcaacgcagaaaacttcgacgaagaaatggtaaaattagaatcaagcctagacgataatgcacaccaaataatagagtccctacaagaattatattcaggggttctattagcgggcatcgtacctgaaaaccaatccctttcccaagctatgataactaaatatgacgaccatcaaaaacacctaaagatgctcaaagccgtaagagaagcgctagctccggaagaccgacaacgattaaaacaagcctatgatcagtatgtcgatggacaagaaaatactaaagcgtatagcaaagaagacttctacggcgatataacaaaagccctcaaaaacaatcctgatcacccaatagtgagcgaaatcaagaaactcatcgaattagaccaatttatgcccaaacaacgaacgaaagataacggtgcaattccccaccaactgcatcaacaagaactagacagaataatcgaaaatcaacaacagtactacccatggctcgcagaactgaatcctaacagtaaaaggcaaacagtcgcaaagtacaaactagacgaactggttgcatttagggtcccatactatgttggaccactaattacagcagaacaacaaagacaatcaagcgatgcaaaattcgcgtggctcattagaaaagcagaaggtcgcataactccatggaacttcgacgacaaagtggataggcaagcatcagcaaatgagttcatcaaacgtatgacaacaaccgatacgtatcttttagctgaagatgtattaccaaaacaatcattaatctaccaaagatttgaagttctgaatgaattaaacggattaaaaatagacgaccaacccataaccactgaactaaaacaagccatatttaccgacctattcatgcagaaaatatctgtaacagttaaaaacatccaagattatctagtctctgagaaaagatacgcaagccgtcccgcaatcacaggccttagcgacgaaaacaaattcaactctcgattgtcaacatatcacgatttaaagatgattgttggagacgccgtcgacgatgtcgataaacaagcagacttagagaaatgtatagaatggtcaacgatattcgaagacggaaaaatttacagtgcaaaactgaacgaaatcgactggctaacagaccaacaaagggtacaattagctgctaaaagatatagaggatggggccgcttatctgctaaactattaacacaaatcgtaaatgcaaatggacaacgcataatggacttactttgggacactacagacaacttcatgcgaatagtacactcagaagactttgacaaacttataaccgaagccaatcaaatgatgttggcagaaaatgacgttcaagacgtaattaatgatctctatacttctccgcaaaataagaaagctctacgacaaatattattagtagtgaatgatatacaaaaagcaatgaaaggacaggctccagaaagaatcctcatagaatttgcacgagaagatgaagttaatccacgccttagcgtacaaagaaaacgacaagttgagcaagtatatcaaaacatttcaaatgaactattaaataatacagaaatcagaaacgaattaaaagacctttctaatagtgcattaagcaatacacgactgtttttatacttcatgcaaggtggacgagatatgtatacaggagactcattaaatatagaccgtctatccacatacgacatagaccacatactgcctcaatcatttgtaaaagacaacagtttagataatagggttctagtatcgcagaaaatgaacagaagcaaagcagaccaagtccccacagactttacaagcgtagaacttggcaagaaaatgcagctccaatgggaacaaatgctcagagcaggtcttataaccaaaaagaaatatgacaatctaactctaaatccagatcatataagcaaatacgcaatgaaaggatttatcaacagacaacttgtagaaaccagacaagtcatcaaattagctacaaacttattaatggaacaatatggcgaggataacatcgaactaatcacagtaaaaagtggacttacccatcaaatgcgcacagagttcgacttccctaaaaatcggaacctcaataatcatcaccacgcttttgatgcatacctaaccgcgttcgtaggattatacctacttaaacgatatccaaaactgaaaccatacttcgtatacggagaataccaaaaagcaagccaacaagataaatggcgcaacttcaacttcctaaatggcttaaagaaagatgaacttgtagacgaaaacaccgaagcagtaatttgggacaaagaaagcggactcgcttacctaaataaaatatatcaatttaagaaaatcctagtaacaagagaagtccacgaaaactcaggcgccctattcaaccaaacattatatgcagcaaaagacgacaaagcatcaggccaaggaggaaaacaattaataccagcaaaacaagatcgaccaacagcattgtacggcgggtattcaggcaaaacaagcgcatacttatgtctagtaaaaatcaaaaataaaagcgaatatatttaccgcatatttggtgtcaacacaagttggagtagtgaactaaaacaaattcaagatccggctgaacggttagtaagactagaaaaactattaactccgcaactaacaatcaataagaagaagaaaggtgagcccgtcccggtaacaaaagactttaaaattatactcccccgtatattaattaaccaaaaattttactcacgaggccaagatatatcaatcgcttctgagttctatttacataacgaacaagaattagttctagataaatcagatatcaaaattctaaacggtgcaatcaaagtgaataatagcaataaacaggtaatcaacctatttaaccatattctagaacaagtaaatcaatactttcctgtttacgacatatataaatcccgagaagtactaaactcaagtaaagaaatattcgaaaatctaacatggaacgaccaatggcgcaatcgaaaactaataaacgtaggccagaaaacaatcctaaataggatcctaatcggtctgcacgcaaacgcagcaagaattaagatatccgaactaggtttcaaaaacgactttggcttactaactcaaacatcaggcatcacattcactccagacacacaaataatctaccaatcaccaaccggcttgttcgaaagacgggtcgcattaagggacctatga

SEQ ID NO: 8905 - RNA, 4107 nt, synthetic construct
  misc_feature 1..4107: note = Cas9 variant
  source 1..4107: mol_type = other RNA
atgaaacgatcatacaacattggactagatataggcactaacagcatcggatgggcgattgtagatgaccaaagtaaactcatatccgtaaaaggaaaatacggatatggagtacgactttacgatgaaggccaaaccgcagcagaaaggcgtagtttccgcacaacaagaagaagattaaaacgaagaaaatggagactcggcttacttagggaaattttcgaaccatatatcacaccgatagattcaacattcttcctacgacaaaaacaaagtaacttaagtcccaaagatcaacgcaagttatatcctcaaacatcattgttcaatgacagaccagacgcagacttctaccaacaatatcccaccatatatcatttaagataccaactaatgacggagaaaagacaatttgatattcgggaaatttacctcgcaatgcatcacatagtaaaatacagagggcactttctaaatgaagctccagtagccagctttaaaagtagtgaaataaacttagccgaacattttgaccaattaaacactatttttgccgatttattcagggaatcaggattccagctagaaacagatgaattagtcgcagtaaaagctctactaatggacaatcagcaatccgcatccaaccgacaaagaaaagcactaccgaaactatatacacctagcgcagacaaaagtatcgaaaaacaaagaaaagctatcgctacagaaattcttaaagcaattctaggactaaaagccaaattcaatgtagttacaggcatagaagccgaagatgtcaaagcatgggccctaacattcaacgctgaaaattttgatgaggaactggccaaacttgagtctagtctagacgataacggccatgaagtaatcggaatattacaagaattatactcaggtatcttactcgccggtatcgtaccagagaaccaatcacttagccaggcaatgatcactaaatacgaagaacatcaagcacatctaaaaatgctaaaagcagtaagagacgatttagcaacagccgatcaacaaaaactaaagaaagcatacgaccagtatatagacggccaggaaaacacaaaagcctattcgaaagaagcgttctacgatgatgttacaaaagcattaaaggactactccgaacaacctttggtatcagaaattcaaaaactaattgagttagatcaatttatgcctaaacaaagaaccaaagacaatggagcaatacctcaccaattacaccaacaagaattagacagaattatcgaaaatcaacaacaatactatccgtggctggccgagttaaaccctaatccaaaaagacaaacagtagcaaaatataaactagatgaattggtcgcgttcagggtaccctattatgtaggacccttaataaccgcagagcaacaacaacaatcatcaaatgcaaaatttgcatggatgataaggaaaacggaaggaagaattacaccctggaacttcgatgataaagtagacagacaagcaagcgcaaacgagttcattaaaagaatgactacaactgacacctatttattagctgaagatgtactcccaaaacaaagtctaatataccaaaggttcgaagtactaaatgaactgaacggactgaaaatcgatgatcaacccataacaaatgaactaaaacaggcaatatttaacgacttattcatgcagaaaacatccgtttcggtcaagaatatacaagactatttggtgagtgaaaaacgttacgccagtcgaccagctattaccggactcagtgacgaaaagaaatttaatagcagacttagcacatatcatgatctgaaagtcatagtgggcgatgccgtagatgatgtagacaaacaagctgacttggaaaaatgcatagaatggtcaacaatattcgaagatggcaagatctactccgcaaaactaaatgaaattacatggttaacagaacaacaacgaggacaattagcaaccaaaaggtatagaggatggggacgtctcagcgcaaaattactcactcaaatcgtaaacgcaaacggacaacgtataatggacttactatgggacaccacagacaactttatgagaattgtacacttcgaggactttgataaactcataacagaagcaaaccaaatggttctagcagagaatgatgttcaagatgtaataaacgacttgtatacctctccacaaaataagaaagccctaagacaaatattattagtagtaaatgacattcaaaaagctatgaagggccaagcgccagaaagaatattaatagaatttgctagaggcgcacaaaaagataaatcactaaccgtaagaagaaaaagaaaacttgatgaaatgtactcccaaataagtgacgctgtacttgctgatgaatcagtacgacaagagctcaaatcttcaaaccaagatgacttagtcaaagaaaaagtatacctatacttcatgcaaggtgggcgtgatttatacactgggaatgccctcaatattgacagactaagtgattatcacgtggatcacatcattccacaagcatacatcaaggacgactcgttagataacaaagcattggtcagttccagaatgaacgaaatcaaagctgaccgggtaccccttcaagtagttcaaaaacaatttgggaaaaacatggcctcagaatggggatacatgcaccgagctggactcatatccagaaagaaatatgataacttaatgtttaatccagaaaatctaaataaataccaaattaaccgttttatcagccgacagctagtcgaaactcaacaagtcataaaattagtagccaacttactttctaaccaatatgaaggtgacaacgtaaaaataattacagtgaaatcaaaattaacacaaactataagatccgagttcgacttccctaaaaaccgagaagtgaataactaccaccatgcattcgatgcatatctaacagcattcgttggaatgtacttattaaaacgctatccaaaactgagttcatatttcacatatggcgagtacctaaaaggaaaccaacaagacaaatggtccagcttcaatttcctaaatgaccttaaacgggccaaacttgaagacaagaccaataaggagatattctggcacaaagaaagtggcctagcctaccttaataaaatctatcaattcaagaaaatactcgtaacaagagaagtacacgagaactctggagctctcttcaatcaaacactctacgcagctaaagacgacaaagcatcaggacaaggaggtaaacaactaattccagctaaacaagcaagaccgactgccttgtacgggggctacagtggaaaaaccgttgcatacatgtgtatagtaagaattaaaaacaagaaaggagacctatataaagtctgcggagtcgaaaccagttggctcgcacaactaaaacaactaaaagatgaagatagccaaaaagcattcttaaaacagaaaatatcccctcaattcacaaaagccaagaaacagaaaggaacaatagtaaaagtggtcgaagactttgaagttatagctccgcatatattaataaaccaaaggttattcgataatggccaagaattaacattagggtctgcgacttacaaacacaatgagcaagaattaatactagataaaactgcagtaaaattattaaacggagaactaccactagcacaatctgaagaattagcagaattagtatatgatgaaatcctggatcaagtgatgcactacttccctctatatgacacaaatcaattcagggccaaactattagctggaaaaaccgcatttatgcaactaccttggaaatcaaatcctgacgacaacaaaactgtccagataacacaacccattgttcttaagaaaatactccaggggttacacgcggatgccggtcgtgtctccctaaaagaacttggaatgacaacagatttcggaatgttacaaaaagcaacaggaattacctttacaccagatacccaaataatttaccaaagtccgacaggactattcgaacgccgagtcgcactacgtgatctttga

SEQ ID NO: 8906 - RNA, 4107 nt, synthetic construct
  misc_feature 1..4107: note = Cas9 variant
  source 1..4107: mol_type = other RNA
atggataagaaatatagtataggactagatataggtacaaacagcgtaggttgggcagtgataaccgacgactataaagtgccaagtaagaaattcaaagtattaggaaataccgatagacattcaataaagaaaaacttaataggagctctgctttttgattcaggagaaacagctgaagccacaagacttaaaagaacagcaaggagaagatatacaaggcgcaaaaatagaatctgctacctgcaagaaatcttctcaaatgaaatggctaaagtagacgattcatttttccacagactagaggaatcctttttagtagaagaagataagaaacacgaaagacaccccatttttggaaatatagtagatgaagtggcttaccatgaaaaatatcccactatataccatctcaggaaaaagctagttgattcaacagataaagctgacctaagactaatttacttggctctagctcatatgatcaaattcagaggccacttcctaatagaaggggaccttaacccagacaatagtgacgtagacaaacttttcatccagctagtacaaacttacaatcaactctttgaagagaatccaataaatgctagtggagttgacgcgaaagcaattctgtccgcacgactatcgaaatcaagaagacttgaaaacctaatagctcaattaccaggagaaaagaaaaatggattattcggaaatctaattgcattatctttaggtctaacgcctaattttaaatcaaattttgacctagcggaagacgcaaaactccaactctccaaagatacatatgatgatgacttggataacttactagcacaaattggggaccaatacgcagatctttttctcgctgctaagaatctttccgacgcaatactattaagtgacatacttagagtcaacacagaaataacaaaagccccactgagtgcaagcatgattaaacgttatgacgaacatcaccaagatctaaccctcctaaaagccttagtaagacaacaattaccagaaaaatacaaagagatattcttcgaccaaagtaaaaacggatacgcagggtacatagatggcggagcgtctcaagaagagttttacaaattcataaaaccaatattagagaaaatggatggcactgaagaactattagtgaaactcaatcgagaagatctattaagaaaacaaaggacattcgataacggatccatacctcatcaaatacacttgggagaattgcatgctatattaaggcgacaggaagatttttatccatttttaaaagataatagagaaaagatagagaaaatcctgacatttagaataccttattatgtaggcccgctggcaaggggaaactcaagatttgcatggatgaccagaaaaagtgaagaaaccatcacaccttggaatttcgaggaagttgtggacaaaggagccagcgcacaaagtttcatagaaagaatgactaatttcgacaaaaacctccctaatgaaaaagtactaccaaaacatagtttgctttatgaatattttaccgtatacaatgaactaactaaagtcaaatatgtcacagaaggcatgagaaagcctgcattcctatcaggagaacaaaagaaagctatagtagatttattgttcaaaacaaacagaaaagtaacagtaaaacaactcaaagaagattacttcaagaaaatcgaatgctttgattcagtcgaaataagtggtgtagaggaccgattcaatgccagcttaggcacgtatcatgaccttttaaaaatcataaaagataaagacttcctcgacaatgaagagaacgaggatatattagaagacatcgttttaacactcactttattcgaagatagagaaatgatcgaagaaagactgaaaacttacgcacacctcttcgatgataaagtcatgaaacaactcaaaaggagaagatatacaggatgggggagactatcacgaaaattaataaacggaatcagggataaacaatcaggaaaaacgatactagatttcttaaaatctgacggtttcgcaaacagaaacttcatgcaattaatacacgacgattccctaacttttaaagaagacattcagaaagcacaagtttccggccaaggtgattcactccacgaacacatagccaacttagctggatcccctgctataaagaaaggcatacttcaaaccgtaaaagtagtagatgaacttgttaaagtaatgggtcgacacaaaccagaaaatattgtaatagaaatggcaagagaaaatcaaacaacccaaaaaggacagaaaaattctcgtgaacgaatgaaaagaattgaagaaggcataaaagaactgggatcacaaattctaaaagaacacccggttgaaaacacgcaactacaaaacgaaaaactgtacctatactacttacaaaatggacgcgatatgtatgtagatcaagaacttgacataaacagattaagtgattacgacgtagatcacattgttccacagagctttcttaaagacgactccatagataataaagtactcacaaggtcagataaaaaccgaggaaaaagcgataatgttcctagcgaagaagtagtaaagaaaatgaaaaactattggagacaactactaaatgccaaattgataactcaacgaaaattcgacaacctcactaaagctgaacgaggtggtttaagcgaattagataaagctggtttcattaaaagacaattggtagaaacacgtcaaatcaccaaacacgtcgcccaaatactagactccagaatgaacacaaaatatgatgaaaatgataaattaatacgtgaagtaaaagtaataacactaaaaagtaaactcgtatcagattttaggaaagacttccaattttataaagtccgagaaataaataattaccatcacgctcatgacgcatacctcaatgcggtggtagggacagctttaataaagaaatacccaaaattagaaagcgagttcgtatatggagattacaaagtatatgacgtgagaaaaatgattgcaaaatcagaacaagaaatcggaaaagccacagccaaatacttcttctatagcaacataatgaactttttcaagactgaaataacactagcgaatggagaaatcagaaaaagaccactgattgaaactaatggtgaaactggagaaatcgtctgggataaaggaagggattttgcaacagttcgtaaggtcctttctatgccacaagtaaatatagtcaagaaaactgaagtccaaactggaggctttagtaaagagagcatattgccgaaacgaaactcagataagctcatcgcacgtaaaaaggattgggacccaaagaaatatggcggatttgatagcccaacagtagcctatagcgttctagtagtagcgaaagtagaaaaaggcaaaagcaagaaattaaaaagtgtaaaagaacttttgggaataacaattatggaaagatcgtctttcgagaaaaatccaatagacttcctcgaagcaaaaggatataaagaagtaaagaaagacttaattatcaaattaccaaaatattctctcttcgaactcgaaaatggcagaaaaagaatgctagcatctgccggagaattacaaaaaggtaatgaattagcattaccctcaaaatacgtaaattttctgtatttagccagtcattatgaaaaactaaaaggaagcccggaagataatgaacaaaaacaactgttcgtagaacaacacaaacactacctagatgagataatcgaacaaatatcagagttctccaaacgagtaatactagcagacgcaaatctagacaaagtactttcagcctacaacaaacaccgagataaaccaattagagaacaagcagaaaacataatacatctatttacattaacaaacttaggtgcgcctgcagcatttaaatacttcgacaccactatagaccgtaaaagatatacctcaacaaaagaagtgttagacgcaacactaatacatcaatcaattacaggtctatatgaaacgcgtatagatctttcacaactcggcggcgactga

SEQ ID NO: 8907 - RNA, 4107 nt, synthetic construct
  misc_feature 1..4107: note = Cas9 variant
  source 1..4107: mol_type = other RNA
atggacaaaaaatatagtataggtctcgatataggcacaaattctgtcggttgggccgtgatcacagacgactacaaagtcccaagtaaaaaattaaaaggactaggaaatacagatagacacggaattaaaaaaaacctaattggtgccttactattcgactcaggtgaaaccgcagaagccacgcgcttaaagcgtactgctcgccgaaggtacactagacgaaaaaatagaatttgctatcttcaagagatattctccaatgagatggctaaagtagatgattcatttttccatagactagaagaaagtttcctcgtagaagaagacaaaaaacacgaaagacatccgattttcggaaacattgttgatgaagtagcataccatgaaaaatacccaaccatttatcacttaagaaaaaaactcgcagattcaaccgacaaggtagatctaaggctaatctatctagctttagctcacatgattaaatttagaggacactttttaatagaaggagaccttaatcccgacaattccgacgtagacaaactattcatccaattagtacaaacatacaatcaactcttcgaggaaaatccaatcaacgctagtagggtagatgcaaaagcaatactatcagcacgtctaagtaaatctcgacgtctagaaaacctaatagctcaactaccaggtgaaaaaaaaaatggactatttggaaacttaattgccctatctcttggactaacaccgaattttaaatcaaatttcgatctagcagaagatgcgaaactccaactctcaaaagatacatatgacgacgacttagacaatcttcttgcacaaataggggaccaatacgcagatctgttcctggcagcaaaaaatctatctgacgcgacattgttatccgatattctaagagtaaattcagaaataactaaagcacccttatcagcaagcatgatcaaaagatacgacgagcatcatcaagacttaacattactcaaagcattagtaagacaacaactacctgaaaaatataaagaaatcttcttcgatcagagcaagaatggatacgcaggatatatagacggtggagccagccaagaagaattctataaatttatcaaacccattttagaaaaaatggacggaacagaggaattattagcgaaacttaatagagaagatcttctccgtaaacaaagaacattcgacaatggatctataccataccaaatacacctaggggaattacacgcaatcttacgaagacaggaagacttttacccatttttgaaagacaatcgggagaaaatagagaaaatacttactttcaggatcccatactacgttggtcctctagccaggggaaattcaaggttcgcatggatgacgaggaaatcagaagaaacaataacaccttggaatttcgaagaagtagttgataaaggtgcaagcgcacaatcattcatagaaagaatgaccaattttgataaaaatttacctaacgaaaaagtcttaccgaaacactcattactatatgaatactttaccgtatacaatgaactaactaaagtgaagtacgtaacagagggtatgagaaaaccagcatttctatccggcgaacaaaaaaaagcaatagttgacctactgtttaaaaccaataggaaagtaacagtaaaacaactgaaggaagattattttaaaaaaattgaatgctttgacagtgtagagatatcaggagtagaagaccggttcaacgcatccctgggcacataccacgatctattaaaaattataaaagacaaagatttcctagataacgaagaaaatgaagacatattggaagacatagttcttacattgaccctatttgaagacagagaaatgatcgaagaacggctcaaaacctatgcacatttattcgatgataaagtaatgaaacaattaaagagaagacgttatacaggatggggacgtcttagccgtaagttaataaatgggatcagagacaaacaaagtggcaaaacaatactcgattttctaaaaagcgacggcttcgcaaacagaaattttatgcaattaatacatgatgacagccttacctttaaagaagacatacaaaaagcccaagtcagcggacaaggagattcacttcatgagcatattgccaatctggcaggttctccagctatcaaaaaaggaattctacaaacagtgaaagtagtagatgagttagtaaaagtgatgggaaggcacaaaccagaaaacatcgttattgaaatggctcgagaaaaccagacaacacaaaagggacaaaaaaattcgcgggaaagaatgaaaagaatagaagaaggtataaaagagttaggaagtgatattctaaaggagtatccagtagaaaatacccaactacaaaatgagaaactctacttatattacttacaaaatggccgtgacatgtacgtagatcaagaattagacattaataggttgtcagattatgatgtagaccacatagtcccccaatcgtttttaaaagacgacagtatagataataaagtattaacaagaagcgacaaaaaccgaggaaaaagcgacaacgtcccttccgaggaagtagttaaaaaaatgaaaaactactggcggcagttgctaaacgcaaaactaatcactcaaagaaaatttgataacctaactaaagcggagagaggaggattaagcgagctagacaaagtgggcttcataaaaaggcaactggtagaaacacgacaaatcaccaaacacgtggctcaaatactggatagcagaatgaacacaaaatatgacgaaaatgacaaacttattagggaagtaagagtaataactttaaaatcaaaattggttagtgatttcagaaaagatttccaattttacaaggtgcgagaaataaataattatcatcacgcacacgatgcatacttaaacgcagtagttggcacagccttaataaaaaaataccctaaacttgaatcagaattcgtatacggggattacaaagtatacgacgtacgaaaaatgatagcaaagtcagaacaagaaatcggcaaggcaacagcaaaatacttcttctactccaacataatgaatttttttaaaacagaaattacactcgccaacggtgaaatacgaaaaagaccattgatagaaaccaacggagagacaggagaaattgtatgggataaaggtcgagattttgcaacagttcgcaaggtgctgtctatgccacaagttaatatcgttaaaaaaacagaggttcaaaccggaggcttctcaaaagaatctatactcccaaaaagaaatagcgataaattgatagcacgaaaaaaagactgggatcccaaaaaatatggaggatttgattcccctacagtagcatacagtgtacttgtagtagcaaaagtagaaaaaggcaaatcgaaaaaactaaaatcagttaaagaacttttaggaataacaattatggaacggagcagttttgaaaaagatccaatagattttttagaggccaaagggtacaaagaagtgaggaaagatctgatcattaagctgccaaaatatagcttatttgaactagaaaacgggagaaaacgaatgttagcatccgcaggtgaactacaaaaaggaaatgaactagccctcccatctaaatatgtaaattttttatacctcgcgagccactacgagaaattgaaaggttcacccgaagacaatgaacaaaaacaattatttgtcgaacagcataaacactacctagacgaaataatagaacaaatttcagaattttcaaaacgtgttatattagccgatgctaatcttgacaaagtgctatcagcctacaacaagcatagggataagccaatcagggaacaagcagagaacattatacatttatttacattaactaacttaggggcgccagcagcattcaaatattttgacactacaatagataggaaacgttacactagtaccaaagaggtattggatgcaacattgatacaccaatctataacaggattatacgaaacaagaatcgatctaagccaacttggcggggactga

SEQ ID NO: 8908 - RNA, 4107 nt, synthetic construct
  misc_feature 1..4107: note = Cas9 variant
  source 1..4107: mol_type = other RNA
atggataaaaaatattctatcgggctagacataggaacaaactcagtagggtgggcagtaattacagatgactacaaagttccttcaaaaaagttcaaagtgctaggaaacactgacaggcattccataaaaaaaaatttaataggagcccttctgttcgattcaggagaaacagcagaagcaactagactaaaacgcactgcacgcagaagatatacccgacgcaaaaacagaatctgttatctccaagaaatattttcaaatgaaatggcgaaagtagacgattcattttttcaccgattagaggaatcgttcctcgtagaagaagataaaaaacatgaacgacaccccatttttggtaatatagtcgacgaagttgcataccatgagaaataccccaccatatatcatctacgcaaaaaattagctgattcgaccgacaaagctgacctccgattgatatatttagcactggctcatatgatcaaattccggggccacttcttaatcgagggagacttaaatccagacaatagtgatgtagacaagcttttcatacaattggtccaaacatataatcaactatttgaagaaaaccccataaacgcaagtagggtagacgcgaaagccatactaagcgcgagattatcaaagtcccgaagactcgaaaatttaatcgcacaattacctggtgaaaaaagaaatgggctatttggcaaccttatagcactaagtttaggcctaacaccaaatttcaaaagtaattttgacttagcggaagatgcaaaactacagctttcaaaagacacgtacgacgatgacttagacaacttactcgctcaaataggagatcaatacgcagatctattcttggcagctaaaaatctgtccgacgcaattctgctatctgatattctaagagtgaactccgagattacaaaagcaccactgtctgcttcaatgataaaaagatacgatgaacatcatcaagacctaacattactcaaagctttagtgaggcaacaactcccagaaaaatataaagaaatattcttcgatcaaagcaagaacggttacgctggttatatagatgggggcgctagtcaagaagaattttacaaatttataaaacctatactagaaaaaatggatggtacagaagaacttttagccaaattaaacagagaagacctactcagaaaacaaagaaccttcgataatggatcgataccacaccaaattcacttaggagaactacatgcaattctcaggagacaggaagacttttacccatttctaaaagacaacagagaaaaaatagaaaaaatattaacatttagaataccatactatgtcggcccgcttgccagaggaaacagcagatttgcttggatgacccgaaaatctgaagaaactataacgccatggaattttgaggaagtagtcgataaaggagcaagcgcacaatcatttatcgaaagaatgaccaactttgacaaaaatctaccaaatgaaaaggtattaccaaaacattctttattatatgaatattttaccgtctataacgaattaacaaaagtcaaatacgtaacggaaggtatgagaaagcccgaattcctaagcggagagcaaaaaaaagcgattgtcgacttactcttcaaaaccaatagaaaagtcacggtcaaacagctaaaagaagattattttaaaaaaatagaatgtttcgactcggtagaaataagtggagtcgaagaccgatttaatgcctcattaggaacataccacgacctactaaagatcataaaagataaagattttttggataatgaagagaatgaagacatattagaagacattgtcttgacactaactttgtttgaagacagagagatgatcgaagaaagactaaaaacctacgcacatttatttgacgacaaagtaatgaagcaactgaaaagacgaagatacactggctggggccgactcagcagaaaactaattaacggaataagagacaaacaatcagggaagacgatattagactttctgaaatccgatggtttcgcaaatagaaacttcatgcaactaattcacgacgattcattaacattcaaagaagacattcaaaaagcacaagtatctggacaaggagacagccttcacgaacacatcgcaaacttagccggcagccccgcaataaaaaaaggaattctacaaactgtaaaagtagtcgatgaattagttaaagttatgggacgacacaaaccagaaaatatagtaatcgaaatggctcgggagaaccaaacaacacagaaaggacaaaaaaactccagagaacgaatgaaaagaattgaagagggcattaaagaattagggagtgatatattaaaagaatacccggttgaaaacacacaattacaaaacgaaaaactttacctatactaccttcaaaacggccgagatatgtacgttgatcaagaattagacattaatagactaagcgactacgatgtagaccacattgtaccccaatctttcataaaagacgatagcattgacaataaggtactaactagatcggacaaaaatagaggaaaaagcgacaacgttccttcagaagaagtagtcaaaaaaatgaaaaactattggaaacagctattaaacgccaaactaatcacccagaggaaatttgataatctcacaaaagcagaacgaggtggcctctcagaattagataaagcaggattcataaaacggcagttagtagaaactagacaaataacaaaacacgttgctcaaatactcgacagccgaatgaacacaaaatacgacgagaatgacaaactgattagggaagtaaaagtaatcacgctcaaatcgaagttggtatctgacttccgaaaagattttcaattttataaagtacgagaaattaacaactatcatcatgcccacgatgcgtatttaaacgccgtagtcggtacagccttgataaaaaaatatcctaaacttgaatcagaattcgtatacggcgattataaagtatatgatgttagaaaaatgatagccaaaagtgaacaggaaataggtaaagcaacagcaaaatatttcttttattcgaacatcatgaatttcttcaagacagagattacactggcaaatggcgagattagaaaaagaccattaattgaaactaacggagaaaccggagaaatagtctgggacaaaggaagggattttgctactgtaagaaaagtcctatcaatgccccaagtaaacatagtcaaaaaaaccgaagtacaaaccggtggattctctaaagaatctattttacctaagcgcaacagcgataaactaatagcaagaaagaaagattgggaccccaaaaaatatggaggatttgacagtcctacggtagcctattcagttctagtcgttgcaaaagttgaaaagggaaaaagcaaaaaactaaaaagtgtaaaagaattgctaggaataacaattatggaacggtcatcattcgaaaaaaatccaatagatttcctagaagcaaaaggatataaagaggtaagaaaagacctaataattaaattgccaaaatattcactatttgaactcgaaaatggaagaaaacgaatgcttgcgtcggcaggagaactacaaaaaggaaacgaactagcattgccctcaaaatacgtaaacttcctatacctagctagccattacgaaaaactaaaaggaagtcccgaggataacgaacaaaaacaattatttgtagaacaacataagcactacctcgacgaaataatcgaacaaataagcgaattttcaaaacgagtcatcttagctgacgccaacctcgacaaagtccttagcgcgtacaacaaacatcgagacaaaccaatcagagaacaagccgaaaatattatacatttattcaccctaacaaacttcggagcaccagctgcttttatatatttcgatacgactataggacgaaataggtataaatcaataaaagaggtactcgacgcaacactaatacatcaatccataactggattatatgaaacacggatcgacctctcccaattgggaggagactga

SEQ ID NO: 8909 - RNA, 4107 nt, synthetic construct
  misc_feature 1..4107: note = Cas9 variant
  source 1..4107: mol_type = other RNA
atgaaatatgaaagcgaagaatactatattggtctagatatgggaacctcatcagtaggttgggcagtaacagacccacattatcacttaatacgaaagaaaggaaaagatttatggggcgcacgcctatttgaaaaagcaaataccgcacaggaacgccgtacaaacaggataaaccgccgacgcaaccaaagacgaaaacagagaattgcattcatccgagaagcgtttcgaaaagaagtagaaaaagttgatgtaaatttctttcgccggctagacgaaagtcaactatatctagaagataaatccataaaagaaccatacctactatttaacgatttaaactacacagataaagacttttatcaccaatatcctaccgtcttccacttaatcacagatcttctaacatcagaccgaaaatttgatatacgtgaaatttacatagcagtaagctcactctacaatcatagaggaaatttcctaaataaaagtctcggaaacgaaacacaagatgaagatttagtgttcaaaaatctagacgaagcgttctccgcatgcgggatgaattggaataccaaagccgagaacatcgaagtcgtaaaacaaattctatgtgacagatcattaaataagaaagaaaaacaagatcaactagcacattgtctagaaataaataagaaaacagaaaaagagaaaatagaatttctaaaattgctaacaggtggtaaagcagactcaaagaaaatgttcccacaatatcactacgaaagagacgaaaaactatcatttgcattcgcagatgaaaacggagatgaaaactgggaagaaacactcaatgcaatcgaagaaagacttacctcagatgaatacggtctcatactagctcttaaaagcgtctacgactggtccattctagcagacctaatgaaaaatgagaaaacaggagaaacttatccatatctatcaatggctcgaaaagatagctatgaaaaacacaaagcagatttaagactattgaagtcagtaataaaacgattaataccaaacgaatacaatcacttctttagacagtacgacggaaaaggaaaaacttacactaactacataggaagtgtgcaataccacgagaagaggcatagattcaagcatataacaacaaaggagttctatgatgggctaaagaaattactaaaaccgtattcagaagatgaagaaattaaacaaatcctacaagacatcgaatcagagacattcctaccaaaacagatcacaaacatgaacggagtaatacccaaccaagttcacgcaaaagaattgaaagtaatattggagaaagcctcccaacattacgactttttaaatgaaactaatgaatcagggttaacagtaaaggaacaaatcatgcaaatgttcacgttccagatcccctattatgtaggacccctcgcaaacttaaatggcaaaggtaacggatgggccgtacgctacgtgggaaaagaaaggacaaaggtatatccttggaacatggatgaggtaatagatgaaaaagaaaccgctgaccaattcattaagagaatgatatcaacctgcacatatttaggggacgaatatgtactacctaagtccagtatactttacgaaaagttcgccgtgctaaacgaactaaatagcctcaaaatcaatggccagccggtatcagtcgaccttaaacagaaaatatatcgcgacctctttactaaaggaaaaagggtaacacaaaaaggattactgttatacttaaaacgagaaggagtaatttcaaaatctgaggaaacaatcttatcaggattcgatatagactttaaaaacactttaagtagttaccgaaaattctgcgaggtattcgccacaaacgaattgaacgatgaacaaataagaatggcagaggatataatagagtggttaactgtctttggagacagtaagaaatttgttcgagagaaaatacatgggaattaccctcaaataacagccaatcaactaaaaaggatattatcgttcaacttcaaagattggggaaaactatccaaacagtttctcgaacttgaaggcgaagatagagagaccggaaaaagctgttcactaattcaagcattatgggacacaaacaacaatttaaaccaattgctatcatcaagattcacatataaggaaaacttagaaaagaaaaggaagaaaatagaaatggatcttttcgagttcacacacgaagatctagatgacttatacatatccgctccagttaaaagaatgatatggcaagcactcaaaatcatgaaagacatagtaatagttatgaaagaatcgccaacaaaacttttcatagaaatgacaagaaacaatgaaaacgagaaaacacgtacagtttctcgaaagaacaaactcgtagacctatataagaaaatcaaaggagaatctagggactggataaaagaattagaaagatacgaagaaaaagactttcgctcaaagaaactatacctctactatacacaaatgggcaaaagtgcatatagtggagaaccaattgatatggataaattatttgataaaaatgtttatgatatagatcatatatatcctaaatcaaaagtaaaagacgatagcctactaaacaactgtgtattagtaaaacgaaaagaaaacatggataaaggaaataactttccaatcgaccctgacattcaaactaaacaggaacatctttggaaattctggctcgaaaaaggattaataactcaagaaaaatttaatagactaacaagaaagaaaccattcactaatgatgaacttgcagacttcgtaaatagacaattagtagaaaccggacaagctaccaaaaccatagcagatctattcaaaatgacattccccaatagtgacatagtatacgtaaaagccggaaacgtaacggacttcagacaatacatagaagtctataaatgccgtgaggtaaataacctccatcacgcatacgacgcttacctaaacgttgtcgtgggcaacgtttacgacacaaaatttacaaagaaccccatgaactatatcaaagaacaacgaaaagaaaattctaatgaacgctaccacatggataaaatattcgagttcccagtcatcagaaatgggaaggaagcgtggattactaaaaaggacgaaagtataaatatcgtacgaaaaacattagcaagaaaaacacccctagtaaccaaacgcaattttgaagcaaatggaacgatagcaaaagcaacaatctatcctaaagggaatgtcaaggatcaaggatacttaccacgcaaaacaagcataccagcactcagggacatgaagaaatacggaggcgtaacatctatacaaattgcttactttttccttgtagaacatgaagtgaaaaagaaacgaatccgaacaatagaatgcgtaccaatatatcgaaaagaagaattaaaaacaaaagaacaacttgaaagatattgtcgagaagaactcaaactaattaacccgagtataagactcgagaaaatcaagccatacagccttctcaaaatgaacggtaactttttctatatcacaggaaaaacaaatgaccgattctcgctcgctaatgcaatggaactttacgtagataaagtcagtgaaaatcacataagagaccttgtcaaatataaaaattgtggctactttaacgtagacgataaagaagcaagaaaacgtaatgaaagattatataccatcttaacaaagaaacatctaaccgtgtttaaaggatccccgaaacctatgggagagaaactacaacaataccaacaactatttctcgagctcgaagtatcaaaacaagtgtacgtactacttcaaatactacaactaactgcaacgaacgtgaaaaccaaagcagatctaacagcaatcggaggaaaggcaaatgaaggcacaatggacatatcaaagaatttagaaaatgtaattaaaaaccaaataaagaaaggtctagttccagaactaatgctaataaatcaaagccccacaggactatttgaatctgaaatagatctattaacaatttga

SEQ ID NO: 8910 - RNA, 4107 nt, synthetic construct
  misc_feature 1..4107: note = Cas9 variant
  source 1..4107: mol_type = other RNA
atgtcaaggccgtacaacataggactcgatattggaacaagttcgataggttggagcgttgtcgatgatcaatctaaactggtatccgttcgaggaaaatatgggtacggagtcagactatatgatgagggacagacagcagcggaaaggagatctttcaggacaaccagaaggagattaaaaagaagaaaatggcgcttagggctattacgagaaatattcgaaccctacatcacacccgtagatgataccttctttctacgaaagaaacaatcaaaccttagtccaaaagatcaacgcaagctatacccacaaacatcactattcaatgatagaactgaccgagcattttatgacgactatccaacaatatatcacttacgatataagctcatgaccgagaaaagacaatttgacatacgagaaatatatcttgcaatgcatcatatagttaaatacagaggacattttctcaacgaggcgcctgtatctagcttcaaaagtagcgaaataaacctagtagcccactttgatagattaaatacaatctttgccgatttattctcagaaagcggctttcaactcgaaacggataaacttgcagaagtcaaagccttactccttgataaccaccaatccgcaagtaataggcaaagacaagccttactactaatatatacaccatccaccaacaaagccgtagaaaaacaaaataaagctatagcgaccgaactactaaaagcaatactagggttaaaagcaaaattcaatgttctcactggtattgaagcagaagacgttaaaacttggacattaacatttaacgcagagaattttgatgaggaaatggtgaaactcgaaagcagtcttgacgacaatgctcatcaaattattgagtcactacaagaattatatagtggcgtactcctagcaggaatagttccagaaaatcaatcattatcgcaagctatgataacgaaatatgacgatcaccaaaaacacctaaaaatgcttaaagctgtacgagaagccctagcaccagaagacaggcaaagattaaaacaggcttatgaccaatatgtcgatggacaagagaatacaaaagcatacagtaaagaagacttttatggcgacataaccaaagcattaaagaataatccagaccaccccatagtatcagaaataaagaaattaatagaactagatcaattcatgcctaagcaaagaacgaaggataatggcgctataccacaccaattacaccaacaagaactcgacagaataattgaaaatcaacaacaatactatccatggctcgctgaattgaatccaaattctaaacgacaaacagttgcaaaatacaaactagacgaattagtagcgttccgagtaccttattacgtcggaccacttatcaccgcagaacaacaacaacaatcttctgacgcaaaattcgcatggatgataagaaaagcagaaggacaaataacaccttggaacttcgacgacaaagtagacagacaggcttcagccaatgagttcataaaacgtatgacaacaacggatacctaccttttggctgaagacgtcctacccaaacaaagtcttatatatcaacggttcgaagtactaaacgaactaaatgggttaaaaatcgacgatcaaccaataacaactgaactcaaacaagcaatctttacagaccttttcatgcagaaaacctcagttaccgtgaagaacatacaagactatttagtatcagagaaaagatatgcttctagacctgcgatcacaggtttaagcgatgaaaataaattcaattctaggctatccacgtaccatgatttaaaaacaatagttggagatgcagtagatgacgttgacaaacaagcggacctggaaaaatgcatagaatggtccacaatatttgaagacggtaaaatatattccgccaaactaaatgaaatcgattggctcacagatcaacaaagagtacaactcgctgccaaacgatatcgaggttggggccgattaagtgcaaaattattaacccaaatagtaaacgcaaacggacaaagaataatggatttactctgggataccacagacaactttatgagaatagtccatagcgaagacttcgacaaactcataacagaagcgaaccaaatgatgttggccgaaaacgacgtccaagacgtaataaatgatctttacacttcaccacagaataagaaagctctgagacaaattctattagtagtgaatgacatccaaaaagctatgaaaggccaagcaccagaaagaatcctaatagagttcgccagggaagacgaagtaaatcctagactatcagtacaacgaaagcgacaggtagaacaagtataccaaaacatatctaacgaattactgaataatacggaaattcgtaacgaacttaaagacttatcaaatagtgcactaagcaacacaagactatttttgtatttcatgcagggtggccgagatatgtacaccggagattcacttaatatcgacagattatcaacttacgatattgaccacattctaccccaatcctttataaaagataattcattggacaaccgcgttctagtatcacaaagaatgaatagaagtaaagcagatcaggtaccaacagacttcacatctgtagaactaggtcagaaaatgcaaatccaatgggaacaaatgctcagagcaggtttaataacaaagaagaaatatgacaacctaactttaaatccggaccacatttcaaaatacgctatgaaaggatttattaacagacagctagttgaaacaagacaagttattaaattggcaacaaacttgctcatggaacaatacggagaagacaatattgaattgataacggttaaatcaggcttaacacaccaaatgagaacagagttcgacttcccgaaaaatcgcaacctgaacaaccaccaccatgcattcgacgcttacctaacagcatttgtaggattgtacctattaaaaagatatccaaaactcaaaccttacttcgtatacggagaatatcaaaaagcatcacaacaagacaaatggcgcaactttaactttctaaacggtttgaagaaagacgaactggtcgatgaaaacaccgaagctgtaatctggaataaagaatcagggttagcttatttaaacaaaatataccaattcaagaaaatactcgttacaagagaagtccacgaaaactcaggggccttattcaaccaaacattatacgctgccaaagacgacaaagccagtggacaaggaggtaaacaactaatccccgcgaaacaagaccgaccaacagctctatatggaggttatagcggtaaaactgtcgcatatatgtgcatagtacgtattaaaaacaagaaaggagacctttataaagtgtgtggtgtcgaaacatcctggttagcacaacttaaacaacttacagacgaagactcaaagaaagcatttcttaaacagaaaatatcgcctcaattcaccaaagtcaagaaacagaaaggaaccatagtaaaagtagtagaagacttcgaagtaattgccccacatatattgatcaaccaaagattcttcgataatggccaggagttaaccttgggttcagcaacatacaaacacaatgaacaagagctaatactcgacaaaacagcagttaaactactaaacggagcactacctctcacccaatccgaggaacttgcagaacaggtatatgacgaaatactggaccaagtgatgcattacttcccactctacgacaccaatcaattcagagcaaaacttagcgcgggcaaggctgcattcatgaaattaccgtggaaatcacaatgggatggaaacaaaatggtacaagttggccaacaagtaatcttagatagagtcctaatcggactacacgcaaatgcagccgtatcagatctcggggtattaaaaatatcaacacccctaggtaagatgcagcaaccaagtggaatctcattatcacctgacacacaaataatctaccaaagtcctacaggtctattcgaaaggcgagtcgcactaagagatctatga

SEQ ID NO: 8911 - RNA, 4107 nt, synthetic construct
  misc_feature 1..4107: note = Cas9 variant
  source 1..4107: mol_type = other RNA
atgagccgtccctacaatataggattagatattggtacaagttcaattggatggagcgtcgttgacgaccaatcaaaattagtcagtgtacgaggaaagtatggatacggtgtaagactatatgacgaaggacaaaccgcagccgagaggagaagtttcaggacaacacgaagaagactcaaaagaagaaaatggcgtcttggattattacgagaaatattcgaaccctatataactccagtagacgacaccttctttctgagacaaaagcaatctaacctgagccccaaagatcaaaggaagctatacccacaaacatcactcttcaatgatagaacagacagagcgttttatgatgattatcctacaatataccacctacgctataaactaatgacagaaaaacgacaattcgacatcagagaaatatatctagcaatgcatcatatagtaaaatatagaggacattttctaaacgaagctcctgtaagttccttcaaatcatcagaaataaatctagttgcacacttcgatagacttaatactattttcgctgatttattttcagagtcaggatttcaacttgaaacagacaaattagccgaagttaaagccctgctactcgacaatcaacaatcagcatccaatagacaacgccaagcactatcacttatatacacgccaagtaccaataaagcagtagaaaaacagaacaaggccatagcaacagaattactcaaagcgatactaggactcaaagcaaaatttaacgtgttgacccgtatagaagcagaagacgttaaagcctggacattaacatttaatgctgagaattttgacgaggaaatggtcaaattagaatctagtttagacgacaacgcacaccaaattatagaatcactacaagagttatacagtggtattctccttgcaggaattgtacccgaaaaccagagcttgagccaagcaatgattatgaaatacgatgaccatcaaaaacacttgaaaatgttaaaagcggtgagagaagcattagctcccgaagatagacaaagactaaaacaagcctatgatcaatatgtagacggacaagaaaatacaaaagcctatagcaaagaagacttctatggagatattacaaaagcactcaagaataacccagaccatcctattgtaagcgagataaagaaacttatagaacttgatcaatttatgccaaaacaaagaactaaagataacggagcaattcctcatcaattacaccaacaagaactagaccgaattatagaaaatcagcaacaatactacccctggctagcggaactaaaccctaacagtaaaagacaaactgttgcaaaatacaaactcgacgagctagtagcatttcgagtgccctactacgttggaccattaatcaccgccgaacaacaacgccagagctcagatgcaaaatttgcatggcttatcagaaaagcagaaggaagaatcacaccctggaactttgatgacaaagttgataggcaagcatccgctaatgaatttataaaaaggatgacaacaactgatacttacctattagccgaagatgttcttccgaaacaatctctaatatatcaacggttcgaggtattaaacgaattaaacggtcttaaaatagacgaccagccaataactaccgaattgaagcaagcaatctttactgatttatttatgcagaaaacctcagtgtctgtgaaaaacatacaggactacctagtatcagagaaaagatatgcttcaagacccgcaatcacaggactatcagatgaaaataaatttaattcaagactctctacctaccatgaccttaaagctatagtaggagatgcggtagaagatgtcgacaaacaagtagatctagaaaagtgtgtcgaatggtcaaccatattcgaggatggtaaaatttattcagcaaaacttaatgaaattgattggctaactgaccaacaacgtgtacaattagcagcaaaacgatatagaggatggggacgcttatcagcaaaattattaacacaaatagtcaacgcaaacggacagaggatcatggaccttctctgggacacaacagataactttatgagaatagtacactctgaagattttgataagttaataacagaagcaaatcaaatgatgcttgcagaaaatgacgttcaagacgttataaatgacctatacacctcaccacagaataagaaagcgctgcgccaaatactattagttgtaaacgatatacaaaaagcaatgaaaggccaagccccagaaagaatactcattgaatttgcacgtgaagacgaagtaaatccaagactatcagtacaacgaaaacgacaagtagaacaagtataccaaaacatatctaacgaactcttaaataacaccgaaatacgaaacgagcttaaagacctatcaaatagtgccttatccaacacaagattatttttatacttcatgcaaggaggcagagacatgtacactggagactcattaaacatcgatcgactaagcacttacgatatagatcacatattaccacaatcatttatcaaagacaactcgcttgacaatagagtattggtaagtcagaaaatgaaccgctcaaaagcagatcaagtccctaccgatttcacaagtgtagaattaggtaaaaagatgcaattacaatgggaacaaatgttgcgagcgggtttaataactaaaaagaaatacgataatttaacactaaacccagatcatatcagcaaatatgctatgaagggattcataaaccgacaattagttgaaactagacaggtcataaaactagccacaaatcttctaatggaacaatatggcgaagacaacattgaactaataactgtaaaatctggcctaactcatcaaatgagaacagagttcgactttccgaaaaatagaaatttaaacaaccatcatcacgcattcgatgcatatctcacagccttcgtaggcttatacttactaaaaagatatccaaaattaaaaccttattttgtgtatggagaataccagaaagcctcgcaacaagataaatggagaaatttcaactttctaaatggactaaagaaagacgaattagtagacgaaaatacggaagcagtaatatgggataaagaatctggactagcatacctaaacaaaatctaccaatttaaaaagatattagtcactagggaagtacacgaaaattctggcgccctctttaaccaaacactatatgccgctaaggacgacaaagcctcaggacaaggcggaaaacaacttatccccgctaaacaagatagacccaccgccctttatggcggatatagcggaaaaactgtggcttacatgtgcatagttcgaataaagaacaagaaaggtgatctttacaaagtctgtggtgtagaaaccagttggcttgctcaattaaaacaattgacagacgaagactctcaaaaagcatttcttaaacagaaaataagtccacaattcactaaagtaaagaaacaaaaaggtaccatagtcaaagtagtagaagactttaaagttatagcccctcatatactaattaatcaacgcttctttgataatggccaagaattaacattaggatcagcaacatacaaacacaatgaacaagaactcatattagataaaacagcagtcaaacttcttaatggcgcactaccattaactcagagtgaagaactggctgaacaagtttacgatgaaattctagaccaggttatgcactacttccctctatatgacacaaatcaattcagagctaagttatcggcaggtaaagcggcattcatgaaattaccatggaaatccatctgggatggtaacaaaatgacacaaattggccaacaaataatattagatcggattctaattggattacacgccaacgcagcggtgtcagacttaggcgttcttaaaatatcaacccctttaggaaaaatgcaacagccttcaggaatttccctgtcacccgacactcagattatatatcaaagcccgacaggactatttgaaagaagagtagcactcagggacctttga

SEQ ID NO: 8912 - RNA, 4107 nt, synthetic construct
  misc_feature 1..4107: note = Cas9 variant
  source 1..4107: mol_type = other RNA
atggttgagaaaaagtcttatagcatagggttggatataggcacaaactctgtcgggtgggccgtcataacagacgactataaggtaccggccaagaaaatgaaagtactaggaaacacaagcagacagtcaataaagaaaaacatgatcggcgcactactatttgatgaaggcggccccgcagcatcaactagagtaaaacgaacaacacgtagaagatacacccgaaggaaaaatcgcctttgctacttaagagatatatttgaatcggaaatgcatacaattgacaaacatttctttctaagattagaggattcatttctccataaatctgacaaacgatatgaagcccacccaatatttggaacactacaagaagaaaaggcttatcacgacaattacccaaccatatatcacttacgaaaagcactggcagataataccgaaaaagcagaccttaggttaatctacctcgcactagctcatataataaaattcagaggacactttctcatcgaaggagcacttagcgcaaataacacggacgtacaacaattagttcatgcattagttgacgcatacaatattatgttcgaagaggatcaattagatattgaagcgatcgatgtaaaagcaatactaaccgagaaaatatcaaaaacaagaagactggaaaatctcatcagcaatatacccggacaaaagaaaaatggcctatttggtaacctaatagcattatccctaggactaacaccgaactttaaaagtcactttaatcttcctgaagatgcaaaactacaactagctaaagatacgtatgatgaagaactgaacaacctattaacccaaataggggatgaatacgcagacttgtttctaagtgccaaaaatttatcggacgctattctactctctgacatccttacagtcaacggagacggcacacaagcaccactatcagcttctcttattaaacgatacgaagaacatcgacaagacctagcactattaaaacaaatgttcaaagaacaattaccagatctttatcgagatgtatttacagatgaaaacaaagatggatacgccggctatatatctggaaaaacatcccaagaagcgttttacaaatatatcaaaccaatattagagacactagacggtgctgaagactttcttactaaaatcaacagagaagactttctgagaaaacaaagaacattcgacaacggaagcataccccaccaaatacacttaggcgaattgcaagcaattctcgaaagacagcaagcgtactatccgtttctcaaagataaccaagagaaaatagaaaagattttaaccttcagaataccatattacataggaccattagcaagaggaaacagcagatttgcatggttaaccagaacatctgatcagaaaattaccccttggaattttgatgaaatggttgatcaagaggcttcagcccaagcatttatagaacggatgacaaattttgacgaatacttaccacaagaaaaagtactgccaaaacactctctaacatacgaatactttactgtctacaacgaattaaccaaagtaaaatatgttactgaaggaatgacaaaacctgaatttttatcagcaggacaaaaagaacaaatcgtagaactattattcaagaaataccgaaaagtgacagttaaacaattaaaagaagacttcttctcaaaaatagaatgttttgacacagtggacatatctggagttgaagacaaattcaatgcatcacttgggacttatcatgacttactgaaaataataaaagataaagcgttccttgacaacagcgaaaacgaaaacataatagaagatataatactaacactaacattatttgaagataaagaaatgatagcgaacaggctcgccgtatatgaagatttgtttgaccaaaacgtactaaaacaattaaaaagacgacattacacaggctggggaagactatccaaacaattgataaatggcatgcgcgacaaacataccggtaaaacaatattagactttctaaaagccgacggattcataaacagaaatttcatgcaactaattaatgacgacaatctatcctttaaagaagaaataaagaaagcacaggagggcggcttaaaagactctatcaacgaccaaataagagatttagcaggttcaccagctattaagaaaggcatacttcagacaataaatatagtagacgaaatagtaaaaatcatgggaaaagcacctcagcatattgtagtcgagatggcccgagacgttcagaaaaccgacataggagttaaacaaagccgcgaacgcatgaaacgagtccaagaagttctcaagaaactaggttcccaactcctaaaagaacacccagttgaaaactttcaattacaaaacgaaagattatatttgtactacttacaaaacggcaaagacatgtacaccggcgaagaactatccataagcaatctatcccactatgacatcgaccacattatacccaggtcctttatcaaagacgattctatcgataacaaagttttaacaagaagtgaacataatagaggaaaaaccgacaatgtaccttcaatagaagtagtaaaaagaatgaaaccatattggcaaaaattacttgatacaaaagttatctcacaaagaaaattcgacaatctaactaaggctgaacggggaggacttcaagaatcagataaagccaattttatacaacgacagttagttgaaacccgacagattactaaacacgtagcccaaatactagacagcagattcaatactgaaagagatgaaaaggacagaccaatacgccgtgtaaaagtaatcacccttaaatcaaaattcgtatcagactttcgccaagacttcggtttctacaaactaagggaaatcaacgattaccaccacgcgcacgatgcatatttaaacgcagtagtaggaacagcattactaaagatgtacccaaaactagcatccgagttcgtctatggcgactatcaaaaatacgatctaaaacgcatggttggaaaatcgggaaaagctagtggacatgcaaccgcgaaatactttttctactccaacctaatgaacttcttcaaatcagaagtgaaactagccaatggaaatataatcaaacgatcacctattgaagttaacgaagaaacaggcgaaattgtttgggacaaaacaaaagattttggtactgtacggaaggtactatcagcaccccaagtaaacatagtaaagaaaacagaaatacaaacgggaggattcagcaacgaaaccattctttcaaaaggaaaatcatctaaattgataccacgcaaaaacaaatggcgagatacgaccaaatacggaggatttaatacccctaccgtagcatactcggttctagtagtagccaaagtagaaaagggcaaagcaaagaaactaaaaccagttaaagaactcgttggtattaccatcatggaaagaacaaaatttgaagctaatccaatagcattcctggaaagtaaaggatatcacgacatacaagaacatcttatgataacgctaccaaaatattcattatttgagcttgaaaatggaagaagaagacttctagcttcagctactgaattacaaaaaggcaatgaaatggtactaccacaacatttagtcacatttttatacagagttagtaaacgagacaaaggaactcaatcagagaacatggaatacatttccaaccataaagaaaaatttatagaaatattccattacataatacgatatgcagaaaagaatgtgatcaaaccgaaggttatagagcgattaaacgacacatttaaccaaaagtttaatgactcagacctcaccgaactatcaatatccttcttaaatctctttaagtttacatcattcggagcaccagaaaaatttacattcttaaactcagaaataaaacaagatgacgtacgatatagatcaacaaaagaatgcctgaacagcacattaatacaccaatccgttaccggtctttatgaaaccaggattgatctttcacaattcggtggggactga

SEQ ID NO: 8913 - RNA, 4107 nt, synthetic construct
  misc_feature 1..4107: note = Cas9 variant
  source 1..4107: mol_type = other RNA
atggacaagaaatattcaatcggactagacataggaacaaattcagtaggatgggctgtgataacagatgactataaagttccatcaaagaaattcaaagtattgggaaacacagatagacacagtatcaagaaaaacttaataggcgcacttttatttgactcaggcgagacagccgaagccaccagattaaaacgtactgcaagaagaagatatacaagaagaaagaatcgaatttgctatttgcaagaaatcttttcaaacgaaatagcgaaagttgacgactcctttttccacagattagaagaaagttttctcgttgaagaggataagaaacatgaaagacatccaatcttcggtaatatcgtagatgaagtagcatatcatgaaaaatatccaaccatataccacctcagaaagaaactagctgatagtaccgacaaagcagacttaagattaatctacctagcactggctcatatgataaaatttagagggcactttctaatagaaggagacttgaatcctgataactcagacgtagacaaactgttcatacagttagtacaaacatacaatcaactattcgaagaaaatcccattaatgcaagccgcgtagatgccaaagctattctatctgcaagactatccaaatcacgaaggctagaaaatcttatagcgcaactacctggtgagaaaagaaatggactattcggcaatctcattgcgttatctctcggattgacgcccaatttcaaaagcaattttgatctagccgaggacgctaaacttcaattaagtaaagatacatacgatgatgatctagataatctattagcccaaattggagaccaatacgctgacctattcttggcggccaaaaatctttccgacgcaatactattatcagatatacttagggtcaacaccgaaataaccaaagcacccctcagcgcaagtatgattaaaagatacgatgaacatcatcaagacctaacattattaaaagcactcgtacgacaacaactcccagagaaatataaagaaatctttttcgaccaaagtaaaaatggatacgctggatacatagatggaggagcaagccaagaagaattttacaaattcataaaaccgatcttagagaaaatggacggaactgaagaactacttgctaaattgaaccgtgaagatctattaagaaaacaacggacttttgataatggaagtatccctcaccagatacatcttggagaactccatgcgatactccgacgtcaagaagacttttatccattcctaaaagataatagagaaaagatcgagaaaatactaacattcaggataccatactatgtaggacccctagccagaggtaacagtagatttgcctggatgacacgaaaatcagaagaaacaataacgccttggaatttcgaagaagtagtggacaaaggtgcctcggcacagagctttatagaaaggatgacaaactttgataaaaatctccccaacgaaaaagtcctcccaaaacatagtctactgtacgaatattttacagtatacaatgaattaacaaaagtaaaatacgtaacagaaggaatgagaaaacctgcatttctatcaggcgaacaaaagaaagcgattgtagacttattgttcaaaacaaacagaaaagtaacagtgaaacaactcaaagaagactattttaagaaaatagaatgctttgattcagtagaaatctcaggagtagaagatcgattcaatgcatcgctcggcacttaccatgaccttttgaaaattataaaagacaaagattttctcgacaacgaagaaaatgaagacatcctggaagacatagtcttaacattaacattatttgaagatagagaaatgatagaagaaagacttaaaacgtatgcacacctattcgacgataaagtaatgaaacaattaaaaaggagacgatacacaggctggggaagactaagtcgaaaacttatcaacggaataagggataaacaaagcggaaaaacgatattagactttttaaagtccgatggatttgccaaccggaatttcatgcaacttatacacgatgattcactcacgtttaaagaagatctacaaaaagcacaggtctcagggcaaggagactcgttacatgaacacatagctaatttagcaggaagcccagcaataaagaaaggaatattacaaactgtaaaagtcgtcgacgaactcgttaaagtcatgggtcgtcataaaccagaaaatatcgttatcgagatggcacgggagaatcaaactacccaaaaaggccagaaaaattcgagagagaggatgaaaagaatagaagaaggtataaaagagttaggatcagacatactaaaagaatatccagtagaaactacgcaattacaaaacgagaaactttacttatactatctacaaaacggaagggacatgtacgtagaccaagaactcgacataaatagattaagtgattatgatgtggatcatatcgtaccccaatctttcctaaaagacgattccatcgataataaagttctaacaagatcagacaaaaacagaggaaaatcagataatgtaccctcagaggaagtagtaaagaaaatgaaaaattactggaaacaactactaaatgcaaaattaataacacaaagaaaattcgacaatctaactaaagcggaaagaggaggattatcagaactcgataaagcaggttttataaaacgacaattagtcgaaacaagacaaataacgaaacatgtagcacaaatccttgattctcggatgaacacaaaatacgacgaaaatgataaactcatacgagaagtaagagttattacgttaaaatcaaaacttgtcagcgactttagaaaagactttcaattttataaagtaagagaaataaacaactatcaccatgcacacgacgcatatctaaatgccgtagtaggaacggcactaataaagaaataccctaaactagagagtgaatttgtctacggcgattacaaagtctacgatataaggaaaatgatagcaaaaagcgaacaagaaattggtaaagcaacagcgaaatatttcttctattccaatatcatgaactttttcaaaaccgaaataacacttgccaacggagagatacgtaaaaggccattaatagaaactaatggggaaacaggggaaattgtgtgggataaaggaagagatttcgccacagttagaaaagttttatccatgccccaagtaaacatcgtcaagaaaacagaagtccaaacaggtggcttctccaaagaatcaatactaccgaaacgaaattcagacaaactaattgcaagaaagaaagactgggatcctaagaaatatggcggatttgactcaccaacagttgcctactcagtgctagtggttgcaaaagtcgaaaaaggtaaatcaaagaaactaaaaagcgttaaagaattagtaggcataacaataatggaacgatcatcatttgagaaagacccagtcgactttctggaagcaaaaggatataaagaggtacggaaagatctgataattaaactaccgaaatattccctatttgaattagaaaatggaagaaaacggatgttagcttcagctggtgagttacaaaaaggcaacgaactagcattaccgtccaaatacgtaaattttctatatctagcatcacactacgaaaaacttaaaggaagccctgaagataatgaacaaaaacaactcttcgttgaacaacacaaacattatcttgatgagattatagaacaaatttcagaatttagcaaaagggtaattctagcagacgccaacctcgataaagtcctaagcgcttacaataagcacagagataaacctatcagggaacaagcagaaaacattatacatttgtttactttaacaaacctaggtgcccctgcagcatttaaatgctttgatacaacaatcgggaggaatagatataaaagcataaaggaagtattagacgctacacttatacaccaatcaataactggcctgtatgaaactaggattgatctctcgcaattagggggagactga

SEQ ID NO: 8914 - RNA, 4107 nt, synthetic construct
  misc_feature 1..4107: note = Cas9 variant
  source 1..4107: mol_type = other RNA
atggataagaaatattcgataggactcgatataggcacatcatccataggcttcgtaggagtcgacgaaaatggttggcctctaaatataaaaggaaaaagagcaataggcgctcacttatttagagaaggtgaagcagccgcagaaactcgaggcttccgcacaacccgacgtagatacaacagaagaaaatggcgattaagactccttagggaaatatttgacgaacctatcagtagagtagacccaaccttcttcgccagaatgaaagaatcctcagtatccccgaaagacccaaattatgacggccttgccaaagaaattttaatacctcgagacaaagatggcaaaatactatatcctactatatatcacttacgtcatgcactgatgtacgaagaccaccaattcgatatcagggaaatttacttagcaatacaccacattgtcaaataccgtggacacttcctacttgacggcgcagccaaaaatttcgaatctagtaacctcgacttgaaatcagacatacacgaaataaatgcgatcttagttggaatattcggaaacgaacaagtccaattcaatgatcaatatgttgaaaaactaaaagaagttcttctagactccacacaatcaagatccgatagacaaaaagcagccgcaaaattactcttacccactaatgacctcgacaaagatacaacaaaaattctaaaaaccgtttcaaccgaaatcacaaaagcaataacaggcctaaaagcgaaattcttcgtcataactggaaacgatattgcaaaagaccaacaaaaagactggacattctcaattgatacattggacgaaaagatgtctgtaatcgaaccctcattttcagagaaaaatttcagcctaataacaatactacaaaaattatactccagcgtaacactggcaggaatcgtgccaaatggccttagcttatcagaagccatgatacaaaaatacgatagacacgcatcagatttagtattactaaagaaatactgggacactaaaccaaaagtacttaaacatcaattgcaaaacacatatgcagaatacattgaaatacatcaagtagtcgacgagttctattcagacctttccaaactgatcaaaaatgatgatgacacactagcacaagaaataaaatctaaaatcactataggcaattttctaccaaaacaaagaacaacagaaaatggcgttataccttaccaactacaacaaagagaacttgacactataatcaaaaatcaacaagaatactacccatggttggccgaagaaaatccagttgcggaccaccaaatcgctttcccgtataaacttgacgaactcgtcggattcagaatcccttactatgtaggcccaatgatagctaaagaagatacctctaactctaaaaacagtaaattcgcctggatgataagaaaacaatcgggagaagtaactccttggaacttcgatgagaaaatagacagaaccgcatcagcaactgcattcatcgatagaatgacaacaaccgatacctatttgatcggagaagacgttcttccaaaacaaagtctgatctatcaacgatttgaagtattaaatgaattaaataaaatatccatagatggacaacctatcacaagaaaacaaaaacaatcagtatacacacacgtcttcgagaaaaagaaaacagttcaagttaaagacgtccaaaaatttctcgtaagctcgggcgaagtaatgagcctaccaaaaatcggtggactagcaaatgaaaaacaattcaacagtagtttatctaccctatacgactataacaaaataatcccggatgcattggaagacaggaataaagtagatgacatcgagaaaataatattgtggtcaacaatattcgaagacaattcaatcttcgtagaaaaacttgactctatagactggttaacctcatctcaacgtaaaagactagcccagaaaaggtaccgagggtggggtcgactctcccttagactacttacaacatttaaaaacaaagacggctattcaatactcgacgaattatggaactcaaatcacaatttcatggaaatacaagcacaatcagactttagcgagcaaatagcaacagcaaataacaataatttatcacaagtactaccagccaaatgggaaccaggaaggaaaaatctcgcatcactagacgagttcatttcaaatttatacacatctccacaaaacaagaaagcgcttcgaaaagccatccgagtcgttcaagacatgatgacagctgcaggtcacatgccagaaaagatatttatagaagtagccagagacacatcgaacagccaccaacaaacaatagcaagacaacggcaactacaacaactatatcaatcagaagataaagaagtaattgattcctcagttaggagtgaactagatgacatattgaaaaacagagctaacataaaagatcaattattcctctatttccaacaaggtggtagagacttatacactggaaaagctataaacatcgataaattaagtttataccacatcgaccacatactcccacaaagcctagtgaaagatgactcattagataatcgagtcctagtatctcagaaaacgaatgaagataagggggtaacatttgtaagtgacaagtatatgaacaatatgttaccaacctggaaaagatggcatgaaatgggactaatatcagctcgtaaacttaagaatctaacaatgagaccagatgagatagataaatatgctccagggtttatacaaagacaattagtggaaactcgacaagttacaaaattggtaatagagttattagacgcacttttagggaactcacaaacagaaatcatcaccataaaagcaagtttatcccaccaattccggcaacagttcgacctagttaaaataagggaagtaaatgataaccatcacgccttcgacgcatttctagctgctcgtataggaacatatctctataaaagataccccaagctcagaccatattttgtttacggacagtatatgcaaaatcacaaaaaccttaagtccatcaatttaataaaaacactagactcagataaagcaatagtagacgaaggtaccggggaaatactttgggataagaaaagtgatcttgcgaaaatgataaaaatctacaactaccaaaggttactaattacacatgaaagccgaacctcttttggagctatgtacaaacagaaaattctcaaagcaacggatgctaaacaaaacggcgggggatttaaattagtcccaacaaaacgaaaccgcccagtagacatatacggaggttacaccggtcaaaccgcagcttatttaacaatagtccgagtctattcaaagaaaacctcagaattacgagtgttgcctatatataccaataaagttcaacaaatagagaaagcaatgactcaaggagataaagcaacaatgctagcatttaagaaagttatagctccgcagctaggaaaagaaaataagaaaacacacgaaatcaaaatacctgagttcgatgtcgtaattccaaaagtactattagatcagctagtaatagacgacattgccggatcaccacaccggttccgtctcggaactgacacatattatcataattcacagcaactatttttaccgttatccatgcaaagacagctaatggacagagaatcagacgataaagtatatttagatatattcaatgatgtcttgaaacaagtagactcatattttaacttgtacgacgtaaatggcttcagggcagcattacagaaaagcaagaaagcgttcgaacaactaccaatcaatgatttccctaaagacgtcccagataacaagaagaagaaaggaaaacgttccattctcaaagagatatttattggactccatgcaaacgcaacattaggcaatttgaaacaaatggggataaaaactgacttcggtaaactacaaaaatccaatggtctcagaattactgaaaactgtaaaataatacaccaatccccaacgggtctattcgaaagaatagtacccattaaatga

SEQ ID NO: 8915 - RNA, 4107 nt, synthetic construct
  misc_feature 1..4107: note = Cas9 variant
  source 1..4107: mol_type = other RNA
atggataaaaaatatagtataggcctagatataggaacaaacagtgttggttgggccgttataacagacgactacaaagtcccatccaaaaaattcaaggtacttggcaacacagacagacatagcataaaaaagaacctaataggcgcactactgttcgacagtggcgaaatcgcggaagctacaagattaaaaaggaccgcacgacgaagatacacaagacgaaaaaataggatctgctacttacaggaaatatttagcaacgaaatggcaaaagtagatgatagcttttttcacagactggaagaatcttttctagtcgaagaagataaaaaacacgaaaggcaccccatattcggaaatatagtcgacgaagtcgcatatcatgaaaaatatccaacaatatatcacctacgaaaaaaactagtagactcaacagataaagcagatttaagattaatttatctggcgctcgctcacatgatcaaatttagaggacacttccttatcgaaggcgatctaaaccccgacaactcagacgtcgataaattattcattcagttagtacaaacatacaatcaactatttgaagaaaatcctattaatgcatcaggagtagatgcaaaagctattctatccgctcgactatcgaaaagccgacgtctagaaaatctaattgcccaattacctggggagaagaaaaatggattgttcggtaaccttatcgcactctcactagggctaacaccaaacttcaaaagtaattttgatttagctgaggatgcaaagcttcaactatcaaaagatacgtatgatgacgatctagacaacttattagcccaaataggagaccaatacgccgatcttttcctagcagctaaaaatttatccgacgcaatactactatccgatattttaagacttaactcagaaatcacaaaagcaccattatcggcaagcatgataaaacggtacgacgaacaccatcaagacttaacactactaaaagctctcgtacgccaacaactacccgaaaaatacaaagaaatctttttcgatcaatcaaaaaatggatatgcaggctacatagacggcggagcctcgcaagaagaattctataaatttataaaaccaatattggaaaaaatggatggaacagaggaactgctagcaaaattaaatagagaagatctactgagaaaacaacgcacttttgacaatgggagtataccgcaccaaattcatctaggagaattacatgcaatcctgagaaggcaagaggacttttatccatttttaaaagataacagagaaaaaatagaaaaaatactaacctttagaattccatattacgttggccctttagcgcgtggaaatagccgctttgcgtggatgactagaaaaagtgaagaaaccattaccccttggaatttcgaagaagtggtagacaaaggagcctcagctcagtcattcatagaaagaatgacaaatttcgacaaaaacctccccaatgaaaaggtcttgccaaaacacagtttactctacgaatacttcacagtatacaacgaattaaccaaggttaaatacgttacggagggaatgcgaaaacctgcttttctctcaggcgaacaaaaaaaagcaattgtggacttattatttaaaacaaacagaaaagtgacagttaaacaactaaaggaagattattttaaaaaaatagagtgctttgactcagtggaaatttcaggagtcgaagatcgattcaatgcgagccttggaacctatcacgacctcttaaaaataataaaggacaaggatttcctagacaacgaagaaaacgaagacatattagaagatatagtcctgactttaaccttatttgaagatcgcgagatgatcgaggaacgactaaaaacttacgcccacctattcgatgacaaagttatgaaacaactaaaaagaagaagatatacagtctggggcagactaagtaggaaattgataaacggaattagggataaacaatcgggaaaaacaattttagattttctaaaatcagacgggttcgcaaacagaaatttcatgcaactcatacacgatgactctctcacttttaaagaagatatacaaaaagcacaggtgtcggggcaaggcgacagtctccatgaacatattgccaatctagcaggaagtcccgcaattaaaaaaggaattcttcaaacagttaaagtagtagacgaattagtcaaagtaatgggacgacacaaacctgaaaacatagttattgagatggccagagaaaatcaaacaacacagaaaggacaaaaaaatagcagggaacgtatgaaaagaatagaagaaggcataaaagaactgggaagtcagatactcaaagaacatccggtcgaaaatacccaactacagaacgaaaaattatatctatattatctacaaaacggcagagacatgtacgtagatcaagaacttgacataaatagattgtccgattacgatgtcgatcacatcgtaccacaatccttcataaaagatgacagcatagataataaagtattaacccgatccgacaaaaatcgcggaaaatcagataatgtaccaagcgaagaagttgttaaaaaaatgaaaaactactggagacaactcttgaatgcaaaattaataacccaacgaaagtttgacaatctgacgaaagccgaaagaggtggtctatcagaactagataaagcaggtttcattaaaagacagttagtagaaacccgacaaattacaaaacatgtagctcagatactagattcgagaatgaacaccaagtacgatgaaaatgataaactaataagggaagtcaaagtaataacactaaagtccaaactcgtaagcgattttagaaaagattttcaattctacaaagtcagagaaattaacaactaccatcacgcccatgacgcatatctcaacgcggttgtcggcacggccctaataaaaaaatacccaaaactagaatccgaattcgtatatggtgactataaagtttacgacgtgagaaaaatgctagcgaaatcagaacaagaaataggcaaagcaactgcaaaatattttttctattctaacataatgaatttttttaaaacagaaatcacattggccaatggagaaatacgaaaaagaccattaatagaaactaatggggaaactggagaaatagtttgggataaaggccgagactttgccactgttaggaaagttttatctatgccacaagtaaacatagtcaaaaaaaccgaagtacaaacaggaggttttagcaaagaatccatattaccaaaaagaaacagcgacaaattaatagcccgtaaaaaagattgggatccaaaaaaatacggtggattcgattctccaacagtcgcctactccgttctagtagtcgcaaaagtagaaaagggaaaaagcaaaaaactaaaatcagttaaagaacttctagggataactatcatggaaagaagtagttttgaaaaaaatccaatagatttcctagaagcaaagggatataaagaagtcaggaaagacctaataataaaactcccgaaatatagcctattcgaattagaaaatggacgaaaacgcatgctagcaagtgctggagaactacagaaaggtaacgaattagcactaccaagcaaatacgtaaactttctttacttagcttcacattacgaaaaactaaaaggctcacccgaagacaacgaacaaaaacaactattcgtcgaacaacataaacattacctcgacgaaatcatcgagcaaatttccgaatttagcaaaagagtgatcttggctgacgctaatctagataaagtcttatccgcttataacaaacaccgcgacaaaccaatacgagaacaagccgagaacataatacatttatttactcttaccaaccttggagcaccaaccgccttcaaatactttgacacaacaatagaccgcaaaaggtacacatccaccaaagaagtgctagatgcgacatttatacaccagtctatcactggactctatgaaacacgaatcgacctctcacaacttggaggtgactga

SEQ ID NO: 8916 - RNA, 4107 nt, synthetic construct
  misc_feature 1..4107: note = Cas9 variant
  source 1..4107: mol_type = other RNA
atggacaaaaaatattccatcggattagacataggtacgaactctgtcggctgggctgttatcacagacgattataaggtaccatccaaaaaattcaaggtattaggtaatacagatcggcactcaataaaaaaaaatctaataggggcactcttattcgactcgggcgaaactgcggaagcaacaagattaaaaagaaccgcaagaagaaggtacacacgtaggaaaaatcgaatctgttatttacaagaaatattttcaaatgaaatggcaaaagtagatgattcatttttccacaggctagaagaatcatttctagtagaagaagacaaaaaacatgaaagacatccaatattcggaaatatcgtagatgaagttgcataccacgaaaaatacccaaccatatatcatctgagaaaaaaattagtcgattcaacagacaaagctgacttaagactgatatacttagccctagctcatatgataaaattcagaggacatttcttgatcgagggagatctaaatcctgacaactcagacgtcgataaattattcattcaactggtacaaacttacaatcaattattcgaggaaaatcctatcaatgcaagcggtgtagatgctaaagccatactttcagcccgcctaagcaaatcgagaagactcgaaaacttaatagcccaattacctggagaaaagaaaaatggtttatttggtaatctaatagccctatcactaggactaacaccaaactttaaaagtaacttcgatttagctgaggatgctaaattacaattatctaaagatacatacgacgacgatctagacaacctactagcccaaattggtgaccagtacgctgatctattcctagccgcaaaaaacctctccgacgctatacttttaagcgatattttaagattaaactcggaaataacaaaagcgcctctctcagcaagcatgatcaaaagatacgacgaacatcatcaagatctgacgctattaaaagctttagtacgccaacaattaccagaaaaatacaaagaaattttctttgatcaatcaaaaaacggatacgccggttacatagatggcggggcaagtcaagaagaattctataaatttattaaaccaatactggaaaaaatggacggaactgaagaactactagccaagttaaaccgcgaagatctactaagaaaacagagaaccttcgacaatggaagcattccacatcaaattcatctaggtgagttacatgcaatccttaggaggcaagaagacttttatccgtttcttaaagacaatcgtgagaaaatcgagaaaatactaacttttagaataccatactacgtaggacctcttgcacgaggtaacagccgattcgcctggatgacaagaaaatctgaagaaacaataacaccgtggaatttcgaggaagtagttgataaaggggcgtccgcccagtcatttatcgaacgaatgactaacttcgacaaaaatctacctaatgaaaaagttctcccgaaacatagcctactatatgaatattttacagtatacaatgagcttactaaagtaaaatacgtaacagaaggcatgcgaaaacctgcgttcctatctggagaacagaagaaagcaatagtagacttactttttaaaacaaacaggaaagtcacagtaaaacaacttaaagaagactacttcaaaaaaatagaatgttttgactcagtggaaatctcaggagtagaagaccgattcaatgcgtctttggggacataccatgacctccttaaaatcataaaagacaaagattttctagataacgaagaaaatgaggacatactagaagacatagtgctcacattaacgctatttgaagaccgtgagatgattgaagaacgattaaaaacatatgcacatctttttgacgacaaagtaatgaagcaattaaaaagacgaaggtacacaggatggggccgattatcaagaaaattgattaatggaatacgcgacaaacaaagcggaaaaacaatactcgatttcctaaaatcagatggtttcgctaaccgaaatttcatgcaattgatccacgatgattcactaacgtttaaagaagatatacaaaaagctcaagtctcaggacaaggagactcactacatgaacacattgctaatctggccggcagtccagccataaaaaaaggaattttacaaacagttaaagtagtagacgaactagttaaagtaatgggaaggcacaagccagagaacattgtaatagaaatggcgcgtgaaaatcaaacgacacaaaaaggacagaaaaattcaagagaaagaatgaaacgcatcgaagaagggataaaagaactaggatcacaaattcttaaagaacatccagtagaaaatacacaactccaaaacgagaaattatatttatactatttacaaaacggtagagatatgtatgtcgatcaagaactagacattaacagattatcagattatgatgtagaccatatagtcccacaatcttttataaaagacgactccatagacaataaggtcctaactagatcggacaaaaatagaggaaaatcgaacaacgttccatctgaagaggtagtaaaaaaaatgaaaaattattggagacaactattaaacgcaaaactaatcacgcaaagaaaattcgataatttaaccaaagcagaacgtggaggattgtcagaactagataaagcgggattcataaaacgacaactagttgaaacgcgacaaataacaaaacatgtagcacaaatccttgatagccgcatgaacactaaatatgatgagaatgacaagttaattcgagaagtgaaagtaattacactcaaaagtaaattagtatctgatttcagaaaagacttccaattttataaagtacgtgaaataaataactaccaccacgcacatgacgcatacctgaatgcagtagtaggcactgccttaatcaaaaaatatcctaaattagagtcagaattcgtctacggagattataaagtatatgacgtaaggaaaatgattgcgaaaagtgaacaagaaataggaaaagcaacagccaaatattttttttattcaaacatcatgaacttttttaaaacagagataaccctagcaaatggagaaataagaaaacgtccactaatcgaaacaaacggagaaaccggcgaaatagtatgggacaaaggccgagacttcgcaacggtaagaaaagtactcagcatgccacaagtaaatatagtgaaaaaaacagaagtacagacaggtggattttcaaaagaatctatattaccaaagagaaattcagataaacttattgctagaaaaaaagactgggatccaaaaaaatatggaggatttgactcaccaacagtagcctatagtgtgctagttgttgccaaagttgaaaaaggtaaatctaaaaaattgaaatccgtcaaagaactattaggaataacaatcatggaacgaagctcttttgaaaagaatcccattgatttcctagaagcaaaaggatataaagaagtgaggaaagatctcatagtcaagttgccaaaatacagcttattcgaattagaaaatggtagaaagaggatgttggcatcagctggcgaactgcaaaaaggaaatgaactagctctaccttcgaagtacgtaaattttttatacttagcatcacattacgaaaaactaaaaggatcaccagaagacaatgagcaaaagcaactatttgtggaacagcataaacactatctcgatgaaataattgaacaaataagcgaattctccaaaagagttatacttgctgatgcgaacctagataaggtactcagtgcttacaataaacacagggacaaaccaatcagggaacaggctgagaacatcatacatctatttaccctgaccaacctaggagcccccgcggcatttaaatactttgatactacaatcgacagaaaaagatacacaagcacaaaagaggtcctcgacgccacctttatacaccaaagtataacgggattatatgaaacacgaatcgacttatcacaacttggcggagactga

SEQ ID NO: 8917 - RNA, 4107 nt, synthetic construct
  misc_feature 1..4107: note = Cas9 variant
  source 1..4107: mol_type = other RNA
atgtcaagaccatataatatagggttagacatcggaacatcatcaataggatggagcgtggtagacgaccaaagcaagctagtctccgtcaggggtaaatacggctatggcgtccgactatacgatgaaggccaaacagcagcagaaagacgatcttttagaacgactagacgaagactgaaacgtcgaaaatggagactgggattattacgagaaatttttgaaccctatataacacccatagatgacacgttctttttaagacaaaaacaatcaaatcttagccctaaagaccaacgcaaattatatacccaaacaagcctatttaatgatcgaacagacagagcattttacgatgattacccaactatataccaccttcgataccgattaatgaccgagaaaagacaatttgacataagagagatatatttggcaatgcaccatatcgtaaaatatcgaggacatttcttaaacgaagctcccgtctcgtcattcaaatcatccgaaatcaatctagtggcgcatttcgatagactcaacaccatttttgctgatttattcagtgaatccggatttcagctagagacagacaaattagctgaggtaaaagctctactgttagacaatcaacaatcagccagcaatcggcaaagacaagctctgtctctaatctatacaccatcgaccaacaaagcagttgaaaaacaaaataaagcaatcgcaacagagctcctaaaagcaatattaggactaaaagcaaaattcaatgtattaacaggtattgaagcagaagacgtaaaagcatggacgttaaccttcaatgctgaaaattttgacgaggaaatggtaaaattagaaagcagtcttgatgacaacgcacaccaaatcattgaaagtctacaagaattatattcaggagtcctcttagcaggtatagtaccagaaaaccagagcttaagtcaagctatgattaccaaatacgacgatcatcaaaagcatttaaagatgttaaaagcggttcgagaagcattggcaccaggagatagacaaagactaaaacaggcttatgaccaatacgtagatggccaagaaaatacgaaagcatactctaaggaagatttctacggagatataacaaaggcacttaaaaacaatcctgaccatcctatagtctctgaaattaagaaactaattgaactagatcaatttatgcccaaacaacgaactaaagataatggcgcaattccgcaccaacttcaccaacaagaattagatagaataatagaaaaccaacaacaatattatccgtggctagcagagctaaacccaaattctaaaagacaaacagtcgcaaaatacaaattggacgaattagtcgcatttcgagtaccctactatgtaggccctctcatcacggcagaacaacaacgacaaagcagcgacgccaaatttgcatggctaattagaaaagcagaaggtcgaataacaccatggaatttcgatgataaagtggaccgtcaggcttccgctaatgagtttatcaaaagaatgacgaccacagatacctatttattagcagaagacgtgcttcctaaacaatcacttatttaccaacgattcgaagtcctcaatgaattaaacggcctgaaaatagatgaccaaccaataaccacagaattaaaacaagcaatctttactgacctcttcatgcagaaaataagtgtgacagtcaaaaacatccaagactacttagtatcagagaagagatatgcctcaaggcccgcaataacaggattatccgatgaaaataaatttaacagtagattatccacatatcatgatttaaaaatgattgtaggagacgcagtagatgacgtagacaaacaagcagatttagaaaaatgtatagaatggtcaacaatttttgaagatgggaagatatactcagctaagttaaacgaaatagactggctaaccgaccaacaaagagtacaacttgcagcaaaaaggtacaggggatgggggcgactatccgcaaaattattaacacaaatagtaaacgccaatggccaaagaataatggacttattatgggacacgaccgacaattttatgagaatagtacactcagaagacttcgacaaacttattaccgaagcaaatcaaatgatgttagctgaaaatgatgtacaagatgtaatcaacgacctttataccagtccccaaaataagaaagctctaagacaaatactcctcgtagtaaatgacatccaaaaagcaatgaaaggacaagcaccagaaagaatacttatagagttcgcaagagaagacgaagtaaactcacgattatcagttcaacgcaaacgacaagtagaacaagtttaccaaaatatatcgaatgaactattaaacaatacagaaataagaaatgaactaaaagatctaagcaattcagcactgtctaacacacgcttattcctatacttcatgcaagggggcagggatatgtacacaggagattcactaaacatagacagactttcaacatacgatattgatcacatattaccacaatctttcataaaagacaattctctagataatagagtacttgtttcacaaaagatgaacaggtctaaagcagatcaagtaccgaccgatttcacctccgtagaacttggtcagaaaatgcaaatacaatgggaacaaatgctacgcgcaggcttgatcacgaaaaagaaatatgataatcttacattaaaccctgatcatattagcaaatacgccatgaaaggcttcataaaccgtcaattggtagaaacacgccaggtaatcaaactagccacaaacttacttatggaacagtacggcgaagataatatagagctgataacagttaaaagcggcctcacacatcaaatgagaaccgagttcgacttccctaaaaacaggaatctcaataatcatcatcacgctttcgatgcgtacttaacagcttttgtaggcctttatttattaaaaagatatccaaaacttaaaccctatttcgtctacggtgaatatcaaaaagcatctcaacaggataaatggaggaacttcaatttcttaaatggattaaagaaagatgagttggtagatgaaaatacagaagcagtaatctgggacaaagaatctggtcttgcatacctgaacaaaatatatcaattcaagaaaatattagtaacacgtggagtacacgaaaattcaggagccctcttcaatcagaccctatatgccgccaaagatgataaagcatccggacaaggaggaaaacaattaataccagcaaaacaagacagatccacagcattatatggaggatacagtggaaaaactgtggcttatatgtgcatagtaaggatcaaaaacaagaaaggcgacttatacaaagtgtgcggggttgaaacctcatggctagcccaattaaaacagctaactgacgaagactcacaaaaagccttccttgaacagaaaatatcaccacaatttacaaaagtcaagaaacaaaaaggtaacataatagaagcagttgaagaatttgaagtaatagcaccgcatatactaatcaaccaacgattctttgacaacggacaagaactaacactaggttcagcaacatataaacataatgaacaagaattaatcctcgataaaacagcagtaaaactgctaaatggtgcattacccctaacccaatctgaggaattagcagaacaagtgtacgacgaaattttagaccaagtaatgcactattttccactatacgacaccaatcaattcagagctaaactttcaacagggaaagccgcatttatgaaactaccctggaaatcacagtgggacggtaataaaatggtacaggtgggacaacaagttattctagacagaatattaattggtctacatgcaaacgccgcaatgtcagatttaaaagtactaaaaatgacaacaccattcggcatgatacaacagagcacaggaataacgctatctgcagacacccaaataatctaccaaagtccaacaggcctcttcgaaagacgtgtagctttaagagatctatga

SEQ ID NO: 8918 - RNA, 4107 nt, synthetic construct
  misc_feature 1..4107: note = Cas9 variant
  source 1..4107: mol_type = other RNA
atggacaagaaatactcaataggtttagatataggcaccaatagtgtcggatgggccgtaatcacagatgattataaagtaccttccaagaaatttaaagtactgggtaatacagaccggcacagtataaagaaaaatcttattggggctctactattcgattcaggcgaaactgcagaagctacacgactcaaaagaaccgctagacgacgatacactcgtcgtaaaaaccgaatatgttacctgcaggaaatcttcagcaacgaaatggctaaagtagatgattcattcttccatagactcgaagaatcatttctcgtagaagaagataaaaagcacgagcgacatcccatattcggcaatattgtggatgaagtagcctaccacgaaaaatatccaactatctaccatctacgtaaaaagctagtcgactcgaccgacaaagcagacctacgcttaatctacctggcattagcacacatgattaaatttcgaggtcatttcttaatagagggggatctaaacccggacaactcagatgtcgacaaactattcatacagctagttcaaacatataatcaactattcgaagaaaacccaataaacgcttctggagtagacgccaaagcgatattatcagcaagactaagtaaaagcagaagattagaaaatttaatcgcacaattacccggtgagaagaaaaacggcctatttggaaacctcatagcattaagcctaggcttaactcccaattttaaaagcaatttcgacttagctgaggacgcaaaacttcaactctcaaaagacacgtacgacgatgacctcgataacctactagcccagatcggcgaccaatacgccgacctattccttgccgctaaaaacttgtcagacgcaatattactttccgacatattacgcctcaattccgaaataactaaagcaccactaagtgccagcatgataaagaggtatgatgaacaccaccaagatttgacacttctaaaagctctagttcgacaacagctaccagaaaaatataaagaaattttctttgatcaatctaaaaacggatacgcaggatatatagatggaggagcatcacaagaagagttctataaattcattaaaccaattttagagaaaatggacggaaccgaagaattactagctaaactaaatagagaagatttgctaaggaaacaaagaacttttgacaatggatcaatccctcaccagattcatctcggagaattacacgcaatattacgccgtcaggaagatttctacccattcttaaaagacaacagagaaaagatcgaaaagatattaacattcagaatcccctattacgtaggtccgctagcaagaggcaattcaagattcgcatggatgacacggaaatccgaagaaacaataacaccctggaattttgaagaagtggtagacaaaggagcatccgcacaatcttttattgaacgaatgacaaactttgacaaaaacttaccgaatgaaaaggtactaccaaagcactcacttctatacgaatacttcacagtatataacgaactaactaaggtcaaatacgttaccgaaggaatgagaaaaccggcattcctctccggagaacagaaaaaggcaatagttgatttactattcaaaactaacagaaaagtaaccgttaagcaactgaaggaagattacttcaagaaaatagaatgctttgattcagtagaaatatcaggtgtagaagaccgtttcaacgcaagtttaggaacttaccacgaccttcttaaaataataaaagacaaagactttttagataacgaagaaaatgaagacatactggaggatatagtattaaccctaaccctctttgaagacagagagatgatcgaagaacggctaaaaacctatgcacatcttttcgacgacaaagttatgaaacaattaaaaagaaggaggtataccggttggggaaggctaagtcgaaaattaataaatggaattagagacaaacaatcaggtaaaacaatactcgactttttaaaatcagatggattcgcaaatagaaatttcatgcaattaattcacgatgatagtctaacattcaaagaagatatccaaaaagcacaagtcagcggacaaggtgactcactacatgaacacatagcgaatctcgcaggaagcccagcaataaagaaaggaatattacagacggtgaaagtggttgatgaattagtcaaagtaatgggcagacacaaaccagaaaacatagtaatcgaaatggctagagaaaatcaaaccacacaaaaaggtcagaaaaatagtagagaaaggatgaaacgcatagaagaaggcattaaagaactagggtcacaaatcctcaaagaacacccagtcgagaatacacaactccaaaatgaaaaactttatttatactacctacaaaatggaagagatatgtatgttgaccaagaattagacatcaaccgactttcagattatgacgtagatcatatagtcccacagagcttcatcaaagacgattcaatagacaataaagtactaaccagatcagacaaaaatagaggaaaatccgataatgtaccatcagaagaagtagttaaaaagatgaaaaactattggcgacaactactaaatgcaaaattgataacacaaagaaaatttgacaaccttacaaaagccgaaagaggcggattaagcgaattggacaaagctggattcataaaaagacaacttgtagaaacaagacaaataacaaaacacgtagcacagatattagactcaagaatgaatacaaagtatgatgaaaacgataaattaattagggaagtaaaagtaataacattaaagagtaaattagtctcagacttcagaaaagattttcaattctataaagtaagagaaattaataattaccaccatgcacatgatgcatacttaaacgcggtagtaggtaccgccctcataaagaaatacccaaaattggaaagcgagttcgtatacggggattataaggtatacgacgtaagaaaaatgatagctaagtcagaacaagaaataggcaaagcgacagccaaatatttcttttatagcaatataatgaatttctttaaaacagaaataactttagccaatggagaaataagaaaaagaccactgatagaaacgaatggcgaaacaggagagatagtatgggacaaaggaagagacttcgcaactgtaagaaaagtcctatcaatgccacaagtcaacattgttaagaagacagaagtccaaaccggcggatttagtaaggaatcaatcttaccaaaaagaaattccgataaactaatcgcacgtaagaaagactgggaccctaagaaatatggcggcttcgattcaccaacagtagcatatagcgtattagtagtagcaaaagtagaaaaaggtaaaagcaagaaattaaaatcagttaaagagctattaggactcaccataatggaaaggtcatcattcgagaaaaacccaatagatttcttagaagccaaaggctacaaagaagtaaagaaagacctaataataaaattaccaaaatatagtttattcgaattagaaaatggtaggaaaagaatgcttgcttcagctggtgaacttcaaaaagggaacgaactagcattaccatctaaatacgtgaactttttgtatctcgcttcacactacgaaaaactaaaaggctccccagaagacaacgaacaaaaacaattatttgtagaacaacacaaacactacctagacgaaatcatagaacaaatatctgagttctctaagagagttatacttgcggatgctaacttagacaaggtactttcagcttataacaaacacagagataaaccgatcagagaacaggctgaaaatataatccatttgtttacactaacaaaccttggagccccagcagcctttaaatacttcgatactacaattgaccgcaaacgttacacgagtacaaaagaagtactcgatgctaccctaattcaccaatcaatcactggcctatacgaaaccagaattgacttatctcaactgggaggagactga

SEQ ID NO: 8919 - RNA, 4110 nt, synthetic construct
  misc_feature 1..4110: note = Cas9 variant
  source 1..4110: mol_type = other RNA
atgaaacgaatactaggcctagacctgggaactaacagtataggatgggcacttgtaaacgaagcagaaactgtaaatgagaaaagctctatagtaaaactaggcgtacgcgtcaacccattaacagtcgacgaacagaaaaatttcgaagcaggaaaatcaatacctacaaatgcaggaaggacgttaaaaagagggatgcgacgaaacctgcaaagatataaactacgaagagattatctaatacaatgtttgaaagaatatggttggatcactagcgacacactattatatgaatgcggaaacaggaccactttcgaaacctacaggttacgagcaaaagcagtcgacgaagaaatagcattagaagaattaggtagagtgctactaatgataaataagaaaagaggctataaaagtaatcgaaaagcgaaatcttcggacgaaggacaattaattgacggaatggcaatcgctatggatatgtatcacaacggcactactcctggagaatatgtttattcacttcttagcaaaggcaaaaagtatatccctgtgttttatagatcagatttattagacgaatttgatagaatatgggattaccaatgtgcttactaccctgatatactcacgagccaattcaaggaattaatacgaggaaaatcatcgcaagtaacttccaaattatttaagcaacaatataatttatttacagcagacaataaagagaaagacaaaagattacaagcatactgtcgcagagccgacgcattaaagaaaagactcccagtagaagaagtcgcagccgcactttgcgatgttaacagagatgtaaatgcttccagcggatatttaggaacaatatctgacagaagtaagaaactattctttaataaacaaactgtgggtcaatatctgatgctagaattagataaagattcacacttctcagtcaaaaacgaagtattctataggcaagactaccttaacgagttcgaagcaatatgggaaaaacaagctgaatatcatccagaactcaccccagatagaaagaaaatactcagggacgtagtaatattttatcaaagaccccttaaaagtcaaaaagacttggtagcctgctgtgaactcgaacgcagaagaatagaagtaatgaaagacggaaaagtaagaagtgtggaaatcggcccaaaagtgtgcccgaaatctagcccactatttcaagacttcaaaatatggcatgttctaaacaatctaaaagtacgcgataaagcaacaggtgacgagaggttcctggaattggatgagaaagagatcctattttctgagttagcaataaaaagcaaattatcaaaaacagaagcacttaaacttttataccaaaaaccaaaaggactagacctgaattatgacagtgtagagggaaatacaactcaggcagcactatttgaagcataccaaacggtaatagctatgacaggacacggtgagtatgtattctcaaaaatgtcagcaagtgaagtcatgtcagtagtagaaggagtattcggtggactgggattcaatacatcagtattaaggttcgatagcctattacaaggcaaagaattagaaaaacaagacagttatcgactttggcatttactatactcatatgagggagataattccgttacaggaacagatggattagtggcgaaagttgcatcacttttgcgttgcgatgaagaatatgcaaaagtagtcgcgggtgtaacatttcaaccagactatggctctttatcagcaaaagcaatacgaagaattttaccccacatgagagcaggaaatgaatatagcttagcttgcgaatacgccggatacaaacattcaagaagatcgttgaccaaagaagaactcgaacaaaaagattataaagaccacctagaattactacctcgaaactcattaagaaatccggtcgtagagaaaatattaaatcaaatggtaaacgtagtaaatgcagtagtagacgcatatggcaaaccagacgaaataagaatagaaatggcacgggaattaaagaaaagtgcgaaagaaagggaagaaatgacagcagcaattaataaagccacttcagaacatgaaagaataaaagagatattaaataaagaatttgggatccaacacgtaagccataatgacatagtgagatataaactgtattgtgagctgaaaaacaatggatacaaaactttatatagtgatacatacattccgcaagaaaaattatttagcaaagaagtcgatattgaacacattctgccacaagccagactatttgatgattctttctctaataaaactctggaatatcgatcagtaaacatagaaaagagtaatcaaactgcatgggactatgtagccgctaagtggggagaggaaggatcactaagatataagaaaagagttgatgatctattagctgctggcgttatagggaaatcgaaacatgacaaactcctaatgaaacaagaagacattccaacagacttcattaaccgcgacctaagagatacacaatacatcgcaagaaaagctagagaaatactagaagacctcgtccctatggtagtatctaccacaggggccgttacagatcggctccgagaagattggcaattagtcgatgtaatgcaagaattaaactgggacaaatatgcaatgaagggattaaccgaagaatggacagataaagacggtcgaagaatatcaagaataaaggagtggaccaaacgaaatgatcatcgacatcatgcaatggatgctctaactatagcatttactaaacacagtttcatacaatacttaaataacttaaacgcccgcagtgataaaagtggaagtatatacgcaatagagcaaaaggaattatatagggacaatcatggaaaactgagatttataatgccctttgaaggattcagatcagaagcaaaaagacaattagagaatattttagtcagcattaaagcgaaaaacaaagtagttacacgtaacgtaaacaatgcaagaagaggttcaggcagacaagctaaagtacaactaacaccaaggggacaattacacaatgaaaccatatacggaagtatacatcgatatgtaactaaattagaaaaagtgggaggaaacttcgatggagaacaaattgccaaggttgcaaaccttcgatatagagaagcactacaagcccgtcatgaagcatttggcggtgacgctaagaaagcattcacaggtaaaaatgcactagacaaaaacccattatacctaaaagataccagaacagaagttccgttaaaagtgaaaactgtttctacagaaacactatataccattcgaaaagcagtggcaccagacctaaatgtagacaaagttatagatgctaaagttaggaaagttttagaagaaagattacaagaatatggaggagatccgaagaaagcattcgtcaatcttgatgaaaacccaatttatttaaacaaagctaaagggataacaatcaaaagagtggccataactggggttaataacgcgattgcccttcacgacaagaaagatgtaggaggacatgtaatgctagacgcaagtggtagaaaacaacctgtagattttgttaataccggtaataaccaccacgttgctatctatagagatgcagaaggcagtcttcaagaagtagtagtcagtttttatgaagcagtcgccagggtctcactagggttaccagtgatagaccgagagtaccgaaaagaggatggttggcaattccttttcacaatgaaacaaaatgaatatttcgtattccctaatcccgagaccggatttaacccccaagaggtagacttaacagacgaaaccaattacgctctaatcagccctaacttatttcgagtgcaaaaattcacgattaaagattactttttcaggcaccaccttgaaacaacagtagaagatagaaaagaactaaaagatatgacatggaaaagatgtggtttagggggaataataggcatagtaaaagtacgagtaaatcatataggaagaatagtatcagtaggtgaatattga

SEQ ID NO: 8920 - RNA, 4110 nt, synthetic construct
  misc_feature 1..4110: note = Cas9 variant
  source 1..4110: mol_type = other RNA
atggctaaaacatataatataggtctagacataggaactaactcaataggatgggccgtagtagacgaccaaaaccacttaatgtcaataaagggcaaatatggctatggagtaaggctatacgacgaaggaaaaactgcagaagaacgaagatcatttcgaacgacacggagacgattaaaaagacgaaaatggcgattatcattattaagagaaatatttgaacctcaaataacaccactcgacaacaccttcttcctaagacaaaaacagagcagcctaagctcaaaagacaatcgcaaactatacccagaaatgtccttatttaacgatagaacagacacagacttttatacgcagtacccaacgatataccatctatcgagagacttaatgaccaaaaataaacaattcgatataagagagatatacctggcaatgtatcatatcgtaaaatacagaggtcactttttaaatgaaagccccgtgtcatccttcaaatcctcagaaatcaaattagctgaaaacttcgaaacactaaatcagatctttaatgaaagatttaatgaatccatgtttcaactagccgtgaatgactttgacgacctcaaagcattactactaaacgatcaacaatctgcctcaaacagacaaaagaaagccctaggtatgatctacgtaccgaacgaaaataaatcacttgaaaaacaaaataaagctatcgcaacagaattattaaaagctatactagggctaaaagccaaattcaatgtcctcacgggaattgaagtcgacgacgcaaaaccttggaccctctcattcaactctgagagcttcgatgaagacatagacaaagctgcaacaaacattgacgatgattcaagagaaataattgcaatacttcaagggctttattccggcattctattagctggaataatacccgaaaatcagagcttaagtgaagccatggtagaaaaatatgatcaacatgcagcacatctaaaacaattgaagtcaatatatccacttctatccatatcagacaagaaagcaattcaacaggcttataactattacatagatggacaagacaacgctaaagcctattccagagaagacttttatgccgcaacaactaaggccctaaaatcctaccaagacaatgaaacaattgcggaaatactaaaactaatagaactagaacaattcatgccaaagcaacgaaccaaagacaacggagcgataccacaccaattacaccaacaagaacttgaaagaataattgaaaatcaacaaaaatattatccctggctcgcagaattgaacccaaacgaatctagacgcaagatagcaaaatataagctcgatgagctcgtcgcattcagagtgccctattacgttggaccactgataacttcagagcaacaacaacaatcatctaacaagaaattcgcttggatgataagaaaagcagaaggaaaaataactccatggaacttcgacgaaaaagtcgatcgacaagcgtcagcaaacgaatttatcaaaagaatgacaaccactgacacgtacctactagccgaagacgtccttcctaaacagtctctagtatatcaaaggttcgaggttcttaacgaattaaacggtatcaaaattgacgacgttcccataactgtcgaacaaaaacaacgaatattcaacgatctattcatgatgcaagcatcagtatcagttaaaaatattcaagactacctagtatcaaaaggatattttgcatcaaggcccgagataaccggactttcagacgaaaacaaagtaatatccagactctccacataccacgatttaaaagctattttaggtggaatagtggacgaagctaataaacaagcagacctagaaaaatgcgtagaatggtctacaatatttgaagacggaaagatcttcgtagagaaactaaatgaaatcgaatggctcacagacgaacaacgaaaaagattatctagtaaaagatatcgtggatggggtagactaagcaataaattactcaatcaaatagttaatgaaaatggacaaagaataatggacttgttatgggacacaaccgataattttatgcgaatagtccatagcgaggaatttgacaaactaattagcgcagcaaatcaaactctattgagcaaaaatgatgtacaagacgtaataaatgacctatacacatcaccacaaaacaagaaagcactacgacaaatattattggtagtctcagacattcagaaagcgatgaaaaatcaggcaccatcaaaaatcctaatcgaatttgcacgggaagacgaagcaaatccaaggctatctgtacaaagaaaaagacaagttgaacaagtttatcaaaacatcagtaaagatatactatctgactcagatgtaaaggcagaattaaaagatcttacaaacaccgccttagctaatactcgcctattcctttactttatgcaaggtggacacgatatgtacacaggggaaacactcaacatagatcggttatcagaatatgacatagaccatatcctacctcaggctttcattaaagataatagcctcgacaacagagtacttgtgtcagcaaaaatgaatagaagtaaatcagaccaagtaccacttaatgactacaccgaagaaagattcggatcgaaaatgcgcgtgcaatgggaacaaatgctacgcgcgggattaattaccaaacgtaaatatgacaatctaacactgaatcctgacagaattagtaagtacgcaatgaaaggcttcataaatcgacagctagtggaaactcgacaagttataaaattagtcacaaatttactcatggaccactatgaagacgacgaagtacaacttatcaccgtaaagtcaggactaatccatcaaatgagagaaatgttcgatttccctaaaaaccgaaacttaaacaatcaccaccacgcattcgacgcctatttaactgcatttgtaggtatatatctactaaagagatacccaaaactaactccctttttcgtttatggtagttatcagaaaaacaacacaaacgataaatggcgaaacttcaatttcttaaatgatttaaagaaagaagaggtcatagactcggatagccacgaagttatctggaacaaggcccaagggctagtagaacttgacaaaatataccaatttaagaaaatattagtaacacgagaagtacacgagaacaccggcgctctatataaccaaactctatactctgccaaagatgataaagctagcggccaaggaggtaaacaacttatacccgcgaaacaagatagacctacggcactatacggtggatactccggtaaaacagttgcatacatgtgcatcgttagaattaaaagcaagaaagaagatacatataaagtatgcggtgtaaaaacaagctgggttgcggaattggaaagattaagcgacagtaatgaacaactagcttcacttaaagcgaaactaatgcccaaatttaccaaaaacaaaaagcaaaaaggaaaaacaatacaggtcacagaagatttcgaaataatagtaccacgagtattaataaaccaaagattctacgacaacggacaagaaataacactaggcagcgctacgtacaaacataatgaacaggaattaatgttaaacaagaaagcagtcaaattattaaacggacagctatccttagtagaagcagaaacattagcgccccaagtctacgatgaaatactgaaacaagtgatgaaatactttccgttatacgatacaaaccaatttcgaacaaaactcaagatgggaaaagaacagtttattaaattgccctggaaaaacaagtgggacggtaataaattaatacatgtaggacaacaaactgtgttagaccgaatattaattggactccatgctaatgcagccgtatcagatctaagtacgcttaaagttactactccattcggaaaactacaacaaccttcaggaattgccttaagcctaaatactaaaataatataccaatcacccaccggattattcgaaagaagagtggcattaagaggactatga

SEQ ID NO: 8921 - RNA, 4110 nt, synthetic construct
  misc_feature 1..4110: note = Cas9 variant
  source 1..4110: mol_type = other RNA
atggacaaaccttataatataggactagacatcggatcccattctataggctggacggttgtcgacgataattctaaactagtaaggattaaaggcaaacttggatatggtgtaagactgttcgatgaaggaaaaaccgccgaagagagacgtcaattcagaacaacaagaagacgactaaaaagacgcaaatggcgattaagattattacgagaaatattcgaacctcacatagctcctttagacgaaacattctttctacgccaaaagcaaagcaatctcgtaccaacacagaaaaaactacctcaactatcactttttaatgaccgatccgacgcagaattttaccacaaataccctactatataccatcttcgaaacgcactaatgacagaaaaaagacaatttgatctccgagaaatctatcttgcgattcaccacattgtaaaataccgtggacactttctaaacgccgcaccagcagcatctttcaaatctggcaaattcgacctagaaaataagttcgaccaactaaatttactatttgcaagcgcgtacagcgatttagactttacacttcgaacagacaatgttgatcaagtaaaagcaatattattaaacgaggacttatcagctagtacacgacaacgacaagcactccctcttatatatcaaacctcagcggatcaaaaagcagcgaaaaaactaacgaaatcattagctaccgaattattaaaagcaatattaggattgaaagctaaattcgatgttctaaccggaatagaaacagatgataccaaagcatggcgacttacattcaacgccgaagattttgacgacaaactaaatgaattgaacgtcacagacaatgaagcagcaactcaaatcatagaaatcttaagagaactatattcatcaatattacttgcagcaatagtaccagaaaattatacgctaagtcaggcaatgatggctaaatacaacgcacataaacaacacttatcattgctaaggcaagtaaaaactaccctgccagcaaaaaaacaaaaggaattacaagcggcctacgacgattacatagaccaacacttacccttagacaaattttacgccaaacttacaaaagtactccccaaagaaaaagacaccgataacccacaaataatccaaatacttaatctaatagatctcgaccaattcttaccaaaacaaagaacaaaagacaatggtgcaattccacatcaactacatcaacaagaattagaccaaatcatagataatcaaaaagcttactatccttggttagctcaacttaatccaaacgagaaaagacaaaaaattgctaaatacaaactagatgaacttgttgccttcagggtcccgtattacgtaggtcctctaatcgaagcaaagactcaacaaaaaactagcggagccaacttcgcttggatgatcagaaaagaaccgggtacaacaacaccaataaccccatggaacttcgatgaaaaagtaaatcgacaagcttcagccaacgaatttataaaacgaatgacaacaacagacacttacttacttggagaagacgtccttcccaaacattccttattataccaaagatttgaagtcctcaacgaattgaacggtattaaaatagaccaaaaacgagttactgtccgacaaaaacaggccatattcaatgatttgttccttaaacaaccgaacgtaactgtaaaaaaactgcaacaatatctacaagcaaaaggcgaatatgcatcggccccaataataacaggcctaagtgaccccaaaaaatttaactcccaactctccacgtaccacgaatacaaaaaaatattcggtggtctaattgacgaccccgataaacaagcagactttgaaaaatgtatcgaatggtccaccatctttgaagattcccaaatactaaaagacaaactaaaggagataaactggctaacacctgaacagcgtcacaaagtagcaaataaacgctatcaaggctggggacgactatcaaaaaaattactgacacaactcgtagactacaatggacaaagaattattgacattttatggaatacaactgacaatttcatgcaaattgtacactcagaagcattcgacaaagccattatcaaagaaaatcaagccctactaacacaatataacccacaagcagtaatagatgatctatatacatcaccacaaaacaaaaaagctttacgacaaatactcctcgtcgtaaatgatatccagaaagcactaaaaggccaagcaccttcacgcattcttatagaattcgctcgtgaaggccaagagaacccaagattatcgacacaaagaaaacagcaagtcgaaaatgcatacaaagaagcaagcgacgccctacttagctcggccgaagtacgtcaagaactaaagggcctagacaacaaggctctagcaaacacaagactatttttatacttcatgcaaggaggccgcgatatatatacaggtaagtccctaaatattgacgatttatcaaagtatgacattgaccacatcttaccacaagcatttataaaagacaactcactcgataaccgtgttctggtctctgctaaaatgaaccggtctaagagtgaccaagttcccctcaacgatttcgccgagatcagatacggtaaacaaatgagacaacaatgggaaaaaatgttacgtgcaggattaataacaagaaaaaaatatcacaatctgacacttaaccctgaatctataaataaatacaccgccaagggtttcataaaccgacaattagtagaaacaagacaagtaactaaactagcgactaatctacttgtagaccaatacgctgaagatgacgttcaactgatcaccgtaaaatccaatctcacacatcaaatgcgtgaagaattcgattttccaaaaaacagaaatgtaaataatcaccaccatgcgttcgacgcatacctaacggcttttgtaggactatatctattaaaacgctatccaaaattagcaccatactttgtctacggagactaccaaaaaggagcatctcaaaactccaaatggcgaaactttaactttttaggcaatttacacagagagaaagtagttgataagaataccggtgaaatcatctggcaaagagatgcaggactaggcgaattaaacagaatatacaactttaaaaagatcctagtcacccgtgcattaagagttaatcgcgggccaatgtttaaacaaacaatttataaagcagaagaagacaaatcctccggtcgagggtccaaacaactaatccccacaaaaaaaaatcgtccaaccgaactatatggtggttacacgaacaaagaaacagcatatttatgcctcgttaaagaaccccataaaaaaggcgatatctaccgtatttgttcagtcttaaatatgtggttgacagaactagatcgaatcgcagatcctatagccaaagctcaaaaactaacagaattactcactccacaattcacaacaacgaaaaaaaaacaaggccaaaagattccagtcgtcaaaccttttaaagtagtaatacccaaaatattaataaaccaacgcttcttctctagaggtcaagaattgacagtagcgtcgcccatgtacatgcataatgaacaagaattatttctcaacaaaaaaactataaaactccttaacggacaactagctaaaaatgaagcccatgaacttgccccgaaaatctaccaacaaatcttagaccaagtaaacgactattttcccctatacgatatgtacaaattccgcgacaccctaaacgccagtaaagaaatctttgttaacttaccatggcaagaccaaagacaagataaaaaaattagtcaaagcggacaaaaatcaatactaaacaagatcctaataggattacacgcaaatgccgccagaatcaaactaacagaactgaacttcaaatcggacttcggcctattgtcacaacgttctggaattgctttctccccagatgaccaaatcatttaccaatccccaacaggactttttgaaaggcgtgtaactctaaaagatctttga

SEQ ID NO: 8922 - RNA, 4110 nt, synthetic construct
  misc_feature 1..4110: note = Cas9 variant
  source 1..4110: mol_type = other RNA
atgaaagtaaacaattatcatataggccttgatataggaacatcaagcataggttgggttgcgatgggagaagacggaaaaccactacgagtaaaaggaaaaacagcaataggcgcccgattatttcgagaaggaaacccggcggcagaccgtagaatgttccggacaacacgacgccgcttaaacaggcgcaagtggagactcaaactattggacgaaatattcgacccttatattaccccggtagatagcaccttcttcgcacgacttaagcagagcaactggtcacctaaagactctcgaaaagctttcaaggatagtaccttattcccagatctcacagataaacaataccatctagactaccccactatataccacctcaggcatgcattaatgacccaagacaaacaattcgatattagaatggtttacctagcattgcatcatatagtaaaatatagaggcaactttctaaattcgaccccggtagattcattcaaagcgtctaaagtgaactttgacgatcaattcaaaaaactaaacgaattatatacagcgatcaacccagaagaaagcttccagataaactttgccaactctgaaaaaataggccaacaattcctagacccatcaattcgcaaattcgataaaaaaaaacaaatatcaaaaattgtacccgtaacaatggatgataaggctgtagacaaactcaatggcaaaattgctagcgaaatcgtcaacgcgattctaggatacaagagcaaattggacgtggcagtacaatgcgacccagaggatagcaagccctgggctgtaaaatttgacgacgaggatattgacgccaaattacaaaaaatattaccagaaatggacgagaatcaacaaagcattataggtataatacaagatttatatagccaagtgacattaaaccaaatagtacctaacggaatgagcttaagcgaatcaatgatcaaaaaatataacgatcaccatgaccatctaaaattatacaaaaaacttataggtcaaatatcagattctaaaaaaaaaacagctttgaaaaaagcatatgaccaatacgtaggtaacgacggtaaagtaatagaacaagacgacttctactctagcgtaaaaaaaaacttggacgactcagaactatccaaacaaatcatggacctcatagacgcagacaaatttatgcccaaacaaagaacaagtcaaaatggagtaataccacatcaactccaccaacgtgaactagacgaaatcatagaacatcaatcaaaatactatccttggctagcagaatctaaccctaacaaacacgacttacacctagctaaatataaaatagaagaattagtcgcattcagaattccatattatgtcggtcctatgataactccagaagatcaaaaaaaatccggagcagctgttttctcatggatgaaaagaaaagagcccggccagataacaccgtggaacttcgatcaaaaagttgacagaatggaaagcgccaataaattcataaaacgtatgaccacgaaagacacatacttaattggtgaggacgtactacctgatgaaagcttattatacgaaaaatttaaagtactaaacgaactaaatatggtaagggttaacggggactcacttaaagtagctgataaacaagcgatatatcaagatctatttgaaaactacaaacacatcagcgttaaaaaaatgcaaaattatataaaagacaaaacaggcttaccaaataatcccgatatcagcggcctctcggaccccgaccatttcaacaacagcttaggaacatataatgactttaaaaaattatttggtgataaggtagatgaccccgacctacaagatgactttgaaaaaattgtagaatggtcaacagtattcgaagacaaaaaaatattaagagcaaaacttaatgaaattagttggctatccgataaacagaaagatgacctagaatcatccagataccaaagatggggcagactatcgaaaaagctattgactggaattgtaaacgaccaaggtgaaagaattatcgatgaactttggaatacaaataaaaattttatgcaaatacaatcagacgacgattttgcaaaaagaatacacgaagccaacgctgaccaaatgaaagcaacagacgtagaagacgttctagcagacgcgtatacatcaccacaaaataaaaaagctatacgtcaagtagtaaaagtcgttgacgacattcaaagagccatgggaggagtcgccccaaaatttatatcaatagaatttacacggagcgaagacagaaatccaagacgtacaattagccgagaaagacaattagaagatacattaaaagacactgcaaaaacattagtaaaatcaatgaacccagatatattaagcgaattagataatgctagtaaaagcaaaaaagggctaacagacagattatacttatactttactcaactaggtcgagatatgtacacaggaaaaccaataaacatagatgaaataagtaattatgacatagatcacatactaccccaagcattcattaaagatgattccttaagcaaccgagtattagtaagtaaggctgttaataacggaaaatcagctaacgtccctttaaagctatttggagtcaaaatggcccacttctggaaacaattagcagaagcaggtctaatcaacaaaaggaagcttaaaaatctacaaacaaacccagacacaatctctaaattcgcaatgcatggcttcattcgacgacaactagtagaaactagccaagtcataaaactggtagcaaatattcttggcgacaaatatagaaatgacgatacgaaaataatcgaaattaccgcgcgaatgaatcatcaaatgcgtgacgaatttgcgtttataaaaaatcgcgaaataaatgactatcatcacgcattcgatgcatatctaacagcctttttaggacgatacctatatcacagatatataaaactaagaccgtattttgtttatggagattttaaaaagtttagagaagataaagtaacaatgagaaattttaacttcttacatgacctgactgacgatacgcaagcaagaatagcggataccgaaaccggagaagtaatatgggatagagaaacatccatcaaacaactaagagacgtatatcactacaagtttatgctaataagccaagaagtatacactctgcgaggcgcaatgtttaatcagacaatctaccccgcagatgaagccggtaggaaaaaattaataccaacgaaagcagataaagcagtagatgtatacggcggatattctggatcgaatgatgcttacatggctatcgtccgaatacatgataaaaaaggggataaatacaaagtagtaggagtacccatgagagcactagatagacttaatgcagcaaaaaacgtatcagatgcaaaatatgaccaagtactcaaagacgtcctaactccacaatttacgaaatccaaaaaaagcaggaaaacaggagaaatcagtcaaacagttgaagatttcgaagtagttctgggcaaggttatgtataggcaattggtaatcgacggcgacaaaaaattcatgctcggatcgagcacataccagtacaatgccaaacaattagtactcagtgacgaatcagtcaagacgcttgcctcaaaaggaaaactggacgaagctcaagaatccgccgcatacgacaatgtatatgacgaaatattagacaaagtagatagatatttcgcattatatgatcaaaggaactatcgaacaaatctacacgaaggcgagcaaaaattcataggcctacccctacacgacacatttgatggaagcaaaaaagtcgccaatggaaagagagaaacaatatcagatatactaaatggccttcatgcaaacgctacaatgacgaaccttaaagtactgggaatatcatcaccattcggtatgttccaatcccatggcccaatcaatctaaatccggagactatcattctatgtcaatctccgactggattattcgagcgacgaataatactcagagacctttga

SEQ ID NO: 8923 - RNA, 4113 nt, synthetic construct
  misc_feature 1..4113: note = Cas9 variant
  source 1..4113: mol_type = other RNA
atgaaaaaaagaaattataacataggtttagacataggaacaagctctataggttggacgatagtagacgataacgcacaaataatgagagcaaaaggcaaaaacggatatggcgtaagaatatttgcagaaggcaagactgctgccgaccgaagaggctttagaaccacacgacgaagattaaaaagaagaaaatggagacttcgcctcctacaagaatttttcgaaccttatatcttaccgattgacgaaaacttttttatgagacaaaaagaaagcaatcttgttccacaagatccaaacaaacattttaaagggtctatattgtttaacgatcgaacagatcaagaattccacgagcaatatccaacaatttatcacttaagatatgcattaatgacggaacatagacaatttgacgtacgagaaatttactgggcaatacatcacatagtaaaatacaggggccacttcctcaactcaactttggcctccaaattcaaaggtggagagttaaggctagcagacaaattcgaatcattaaacaaactgtttttaagagtacaagctgaaacaggatttgagttaagtgaagataacgtagacaaaataaagacagttctattagataacggaaagagccgattagatcgacaacgagaagtcctcaaaattgtatatctaacatctgaagacaaagacaccgaaaaaaaaagaaaagctgtagcaacggaattcataaaagctgtactaggacttaaaacaaaactatttatagttttggcaaagaatcccacagcggagactgactggaaattctcatttgatgcagaagacatagatgacaaacttgactcaattagcgaacaactaacggacgatgatcatgaaatagttgaactcatatcagaaattcacagcataataaccctaactggtgttgtaccagaaggtatgggtctaagtgaatcaatgatagcaaaatacgaccaacatcaactagacttaaaaaaactcaaatcactcatgcgagacctagacgtcaaacaagctcgaaaactacaagacgcatacgatgaatatatcgacggacttaaaccatcagaagaagcattctatagtgctgtaagttctgtaatccaaaaaatggacgatccaagagctaaaaaaataactgccgaaattgagctggaagaatttatgcctaaacaaagaacaaaagcgaatggtcagataccacatcagcttcatcagcaagagctagaccaaatcatagaaaaccaaaaagaatattatccatggttggctgaagaaaacccaaacaagcgcgaacacaacgcagcaccacataaattagacggactcgttacttttcgagtaccatactatgtcggccctcttatcgaagcctcagttcaacaaaaaactagtaattcaaatttcgcttggatggaacgtaaagttaaaaatgatacctccagaatcacaccatggaacttcgaagagaaggtggatagaaacgccagcgcagaaaactttataaaaagaatgactacaaaagacacatatctacttaacgaggacgtactacctcagcaatcactactataccaacgctatgaagttttaaacgaactcaataatgtacgagttaatgacaaaaaattagaaaacaattgtaaacaagatgtctataaagaccttttcaaaaacaacaccaccgtatcaattaagaaattcaaagactacttagtagcaaattgcgaatatgcagataaccctaaaatagaggggctagcagatgagtctatattcttaagctcattatctacagaaaacaaattcaaagacatctttggcgcacaaatcgatgacccaaattacttcgaagactttgaacatatcatagaatgggcaactattttcgaagacaacaaaatattaagggcaaaactagacgaaatcagttggctcaatgaaagccaaaaaaaagaactagcgaaattaagaatgcgtggatggggcagattatcgcgaaaactgatagctgaaataacagacgaaaacggatcacgaatcattgacctgttgtgggaacatatggataacttcatggtagtggtaaaccaagatgtcttcaaagaaaaaatcgtggccgaaaacaaacaagttttcaaagaattaaacccattagatataataaacgaacaatttacttcccctcagaataaaaaagctcttcgtcaaatcctactagtagtagcagacatccaaaaagctatgaacggagttacaccatcaaacattttcatagaattcgcaagagaagacgaacgcaaccccagaagatcaatacaaagactaagacaagtggagaacatgtaccgcgacatttcagatacagtgctagccgacccagaagtaagaaatgaattgtcgaacataaaaaatacagagttagcaagagaccgagttttcttatacttcctacaaggaggaagagacgtatatacaggagaacctctcaacatagataaactcagcgaatacgacatagatcacatattaccccaagccttcatcaaggataatagcctagacaatagggttctagtctccgcttcattaaatcgaagtaagtcagatagtgtacctctcgacgactttaccagcgaaatgttcggaaggaaaatggaaccactatgggaacaaatgcaaagagctggattgatatcaaaaaaaaaacttgctaacttaaaatttaatccggaaaatataaataaatacacaagaaacggttttataaatagacaactagtagaaactcgccaagttatcaaactagcagctaacatcctaaaggaccactacggagaagaaacagaaatagtcaatgtgaaagctggactcacacaccaattccgaaaagattttgactttccaaaaaaccggaacgtgaacaattatcatcatgcattcgatgcatatctaacagcattagtaggcacatacctattaaaaaaataccctaaacttgaaagttatttcgtatacggaaaattcaaaaaaggagacggtatcacaaatcttaaaaactttaatttcctacacggattcaataagccgggtaaaataattaacaaagaaacaggagagatactattcgatagggacaaacaactcggatatatgaactctatatacgatttacgaaaagtaattgtaacacatgagctcagtacaagacacggggcaatgtacgatcaaacactttataaagctagcgacgacaaagattcaggacgcggaggaaagcagctaatccgtaaaaaagacaacctacctactgaaatttacggtggctataccggatcgacagacgccttcatgtctataataagaatgaaaaagaaagacaaactttactacaaagtaattggcgtacctacacgagtagcacatgaagtattacaatcagatggaaagattaacatctttacattaaataaattcatagaacaaaaattaactaaagaaaaagttaataaaaagactggagccataacaagaataaccgattggtttgagctagttatcgccaaagtaatgtatgggcaagtgatagacgatggaggacaaccatttatgttaggttcatcaacactaccatacaacgtgcgagaattatatctagcaaaagacctggtaaaagtgataaacaaaggcagtacctccaaatcctcatacctcgacgtatatgacgaactcgtcaaatccctaaacaaatattttccaatgtatgatcgtaacatgttcagacaaaaaataacagacgcaagagacaaattcgaaaaactgcccaaaagagacaaagtatctaacggaaaattacaacaaattggtcaagtaacaattattgacagaatattgattggacttcatacaaacgcaggagtttctaacttgaaagacctcggaatagcaacaccattcggattcatgcaacaaggaaacggcatcagcctaacttcaactgcaaaaataatctaccaaagctccacaggtttattcgaaaaatctaaagccctagatgacttaaacccgcttgcatga

SEQ ID NO: 8924 - RNA, 4113 nt, synthetic construct
  misc_feature 1..4113: note = Cas9 variant
  source 1..4113: mol_type = other RNA
atgaataaaccatactcaataggattggatataggaaccaactcagtaggatggagcatcataacagacgactataaagttcctgcaaagaaaatgcgcgtactcggtaataccgacaaagaatatatcaagaaaaatctaatcggagcacttttattcgatggaggcaacacagcagccgacaggcgattaaaacgaacagcaaggcgacgatacacccgaagaagaaacagaatactgtatcttcaagaaatatttgcagaagaaatgagcaaagtcgatgactccttcttccaccggttagaagactcgtttctagtagaagaagataaaagaggctccaaataccccattttcgcaacaatgcaagaagaaaaatactaccatgaaaaatttccaacgatttatcacttgcgaaaagaattagcagacaagaaagaaaaagcagacctaagactaatatacctcgccttagcacatattatcaaattcagaggccacttcctcattgaagacgaccgattcgatgttagaaacacagatatacaaaaacaataccaagcattcctagaaatatttgacactacattcgaaaacaatgatctgttatcacaaaacgtcgatgtagaagccatactaactgacaaaataagtaaatcagctaagaaagatagaatactagcccgatatccaaaccagaaaagtacaggaatctttgcagaatttctcaaattaatagttggtaaccaagcagattttaagaaacacttcaatctggaagataaaactccactacaattcgctaaagatagctacgacgaagatttagaaaatctgctgggacaaatcggagacgaatttgcagatttattctcagcagcgaagaaactatacgatagcgtattactcagtggaatactcaccgttaccgatctctcgactaaagcgcccttatcagcatcaatgattcaaagatacgacgaacaccgggaagacctgaaacaattgaaacaatttgtcaaagcatcacttccagaaaaataccaagaaatatttgccgatagttcgaaagatggatatgcaggatatattgaaggaaaaacaaaccaagaagcattttacaaatacctctcaaaacttctaaccaaacaagaaggcagcgaatatctcctagagaaaattaaaaacgaagactttcttaggaaacaacgcactttcgataatggatccatcccacatcaagtacaccttacggaactacgggcaataataagacgacaatcggagtactatccgtttttaaaagaaaatctagatcgcatagagaaaatcctaacattcagaatcccttattatgtaggaccactcgcaagagaaaaatcagactttgcatggatgacacgaaaaacagatgactcgatacgaccatggaatttcgaagatttagtagacaaagagaaaagcgccgaagcattcatacatagaatgacaaacaatgatctatacttacccgaagaaaaagttttacctaaacatagcctcatatacgaaaaattcaccgtatacaacgaattgactaaagtgcgatttttggcagaaggattcaaagattttcagttcctaaatagaaaacaaaaagaaactatatttaacagtctatttaaagagaaaagaaaagtaactgaaaaagacataatctccttcctcaataaagtagacggatatgaaggaatagccatcaaaggtatcgaaaaacagtttaatgcatctttatcaacataccacgatctcaagaaaatattaggtaaagacttcttagacaataccgataatgaattgattctagaagatatagtacaaacattaacactctttgaagaccgcgaaatgatacgaaaaagactggacatatataaagacttctttaccgaaagtcaactaaagaaactatacagacgacattacacaggatggggaagactatctgcaaaactgattaacgggatccgaaacaaagaaaaccagaaaaccatattagactatctaatagacgacggatcagccaaccgtaactttatgcaattaatcaaagatgcaggactctcatttaaacctataatagataaagcaagaaccggatctcattctgacaacctcaaagaagtagtgggagagttggcaggatccccagcaatcaagaaaggtatactacagtcgctaaaaattgttgacgagctagtaaaagtcatgggatatgaaccagaacagattgtggtagaaatggcaagagaaaaccaaacaactgcaaaaggattaagcagattacgacaacgcctcaccacactcagagaatcattagcaaatttaaaaagtaatatcctagaagagaagaaaccaaaatatgtaaaagatcaagtagaaaaccatcacttatcagatgatcgactattcctatactatctacaaaatggaaaagatatgtacacggacgacgaattggacatagacaacttatcccaatacgacatagacctaattatccctcaagcctttatcaaagacgacagcatagacaatagagtcctagtatcatcagccaaaaacagaggaaaatcagacgatgtaccttccgtagaaatagtaaaagattgtaaagtcttttggaagaaactactcgatgcaaaactaatgagtcagagaaaatacgacaacttaacgaaagcagaaaggggcggactaacatcagatgacaaagcaagattcatacaacgacagttagttgaaacaagacaaattactaaacacgttgccagaatactagatgaacgctttaacaacgaattagatagtaaaggacgaagaataagaaaagttaaaatagtaacactaaaaagtaatctggtatcaaactttagaaaagaatttggattttataaaatcagagaagtaaataattaccatcatgcacatgatgcatatctgaacgcagtagttgctaaagcaatattaacaaaatacccacaacttgaaccagagtttgtatatggcgattaccccaaatacaacagttataaaacaaggaaatcagcaacagaaaaattgttcttctattctaacataatgaacttctttaaaaccaaagtaacattagcagacggtactgttgttgtaaaggacgacatcgaagtaaacaatgatacaggggaaatagtgtgggacaagaagaaacactttgcaacagtccgaaaagttctaagctacccacaagtcaatatcgtgaagaaaacagaaattcagactggaggtttttccaaagaaagcattttagcacacgggaatagtgacaaactaatcccacggaaaacaaaagatatatacctggaccccaagaaatacggaggattcgactctccaattgttgcttattctgtcttagtcgttgcagacattaagaaaggaaaagcccaaaaactcaaaacggttacagaactattaggaattactataatggaacgttcaagattcgagaaaaatcccagcgctttcttagaaagtaaaggatacctaaatataagggacgacaaattaatgattctccccaaatactcattattcgaactagagaacggaagacgtcgtctactagcttcagctgacgaattacagaaaggcaatgaattggccctgccgacacaattcatgaaattcctgtatctagcgagtaggtataatgaactaaaaggcaaaccagaggaaattgaacaaaaacaagagttcgtagtacagcatgtatcttacttcgacgacatcctacagatcatcaacgatttctcaaacagagtaatcctagcagacgcaaacttagagaaaataaataaactatatcaagataacaaagaaaacatacctgttgacgaattagctaataatataataaacctatttacctttaccagcttgggagcaccggcggcgttcaaattctttgataaaattgtggaccgtaaaaggtacacaagtaccaaagaggtcttgaatagcacactcatacatcaatcaattactggtctctacgaaacaagaatagacctaggcaaactaggtgaagactga

SEQ ID NO: 8925 - RNA, 4113 nt, synthetic construct
  misc_feature 1..4113: note = Cas9 variant
  source 1..4113: mol_type = other RNA
atgactaaaaagaactactcaatcggccttgatataggaacaaacagcgtgggatgggctgtaataacagacgactataaagtaccagccaagaaaatgaaagtcttaggaaacactgataagaaatacattaagaaaaatctactaggtgctctactattcgactccggtgaaacagcagaagctactcgtttaaaacgaacagcaagaagaagatatactcggaggaaaaacagactaagatatttacaagaaatattcgcagaagaaatgacaaaagttgatgaatcattcttttatagattagacgagagctttttaactacagacgaaaaagacttcgaacgtcatccaatatttggcaacaaagcagaagaagatgcatatcatcaaaaattcccgacaatttaccacttacgaaattatctagctgacagcagtgaaaaagcagacctaagattagtatacttagctctcgcgcatatgataaaataccgagggcacttcttaatcgaaggtaaattaaacgctgaaaacactgatgtacaaaaactgtttacggattttgttggagtttacgacagaacattcgatgacagccacttaagtgaaatcacagtagacgtagcgagcactcttactgagaaaatttcaaaatccagacgactcgaaaacctaataaaatattacccaactgaaaagaaaaacaccttattcggaaatttaatagcactagctctcggattacaacctaactttaaaatgaatttcaaattatccgaagacgcgaaactacaatttagtaaagatacatacgaagaagacctggaagaactcttagggaaaattggagacgactacgcggacctcttcacatcagcgaaaaacttatatgatgcaattctactttctggtatccttacagtcgacgacaactccacaaaagcacccttatctgcttcaatgataaaacgctacgtagaacaccatgaagatttagaaaaactaaaagaatttataaaagcaaataaaagtgaactataccacgatattttcaaagacaaaaataaaaatggatacgcaggttacatagaaaatggcgtaaaacaagacgaattttataaatatctcaaaaatactttatcaaaaatagatggaagtgattacttccttgataaaatagaaagagaagactttttgagaaaacaaagaacctttgacaacggctcaataccccatcaaatacatctacaagaaatgcacgctatactaaggcgtcaaggcgactattacccctttttaaaagaaaaacaagaccgtatcgagaaaatactaaccttcagaataccatattatgtaggacccttggtacgaaaagattcaagatttgcatgggcagaatatcgtagtgacgagaaaataacaccgtggaatttcgacaaagtcatagataaagaaaaatcggcagaaaaatttatcacacgaatgaccttaaatgacctttatttacctgaagaaaaagtactgcctaaacatagtcatgtatatgaaacctacgcagtttataatgaactaacaaaaataaaatatgtcaacgaacaaggcaaagagagcttctttgactcaaacatgaaacaagaaatcttcgatcatgtattcaaagaaaatagaaaagttaccaaagaaaaactattaaactacctaaacaaagaatttcctgaataccgaatcaaagatttaataggactagacaaagaaaacaaatcctttaacgcctccctaggaacataccacgatctcaagaaaatcttagacaaagcattcctagacgacaaagtaaacgaagaagtgattgaagacataatcaaaacattaacattattcgaagacaaagatatgatacatgaacgtctacaaaagtattcggacattttcactgcaaatcaattaaagaaactggaaagaagacactataccgggtggggacgcttaagttacaaactcataaatggcattcgtaataaagaaaataacaaaacaatactagactatttaattgacgatggttcggcaaacagaaactttatgcaattaataaatgatgacacactaccgtttaaacaaattattcaaaaatcacaggtcgtaggagatgtagacgatatagaagcagtagtacacgatctaccaggatcacccgcgatcaagaaaggcatacttcaatccgtcaaaatagtagacgaactcgtcaaagtaatgggcgataaccctgacaacattgtaattgaaatggcccgtgaaaaccaaacaaccaaccgcggacgatctcaatcccaacaacgacttaagaaactccaaagttcactaaaagaattaggaagcaacatactaaacgaagaaaaaccttcctacatagaagataaagtcgaaaactcccacttacaaaatgatcaactctttctctactatatccaaaacggaaaagacatgtacaccggtgacgaactcgacatagatcacctgtcggattatgatattgaccacataatacctcaagcatttattaaagacgatagtatagataatagagtcttaacaagttcagccaaaaataggggtaaatctgatgacgttccatctttagacatagttcgtgctcgaaaagcagaatgggttcgactctataaaagcggattaatatcaaaacggaaattcgataatctaacaaaagctgaacggggtggtttaaccgaggccgacaaagccgggttcatcaaaaggcaattggtagaaactagacaaataacaaaacacgtagcacaaatattggacgcaagatttaacacggagcatgacgaaaacgacaaagtaatccgagacgtaaaagtgattacattgaaatcaaacctcgtatcacaattcagaaaagacttcgaattttataaagtacgggaaatcaatgattatcatcacgcccacgacgcatatttaaatgctgtggttggaacagccttactaaagaaatacccaaaattagcaagcgagttcgtatacggagaatataagaaatatgacatccgcaaatttatcactaattcaagcgacaaagcgaccgcaaaatacttcttttactctaatctaatgaacttctttaaaacgaaagtcaaatatgctgatggtacagtctttgaaagaccgataatcgaaaccaacgcagacggtgaaatcgcgtggaataaacaaatagactttgaaaaagttcgaaaagtactgagctatccccaagtaaacatagtcaagaaagtagaaacacaaacaggtggattctcaaaagagagcatactaccaaaaggggattctgacaaattgattccacgtaaaacaaagaaagtatattgggacacaaagaaatacggaggcttcgacagccccactgtggcatactctgtgttcgtcgttgctgatgtggagaaaggaaaagcaaagaaattaaaaacagttaaagagttagttgggatttccattatggaacggtccttctttgaagaaaaccctgtagagttcctagaaaataaaggataccacaacattagagaagacaaattaatcaaattacctaaatatagtctttttgaatttgaagggggaagacgtcgactactagcatcagcatctgagctacaaaaaggaaatgaaatggttctaccaggatacctcgtggagctactttatcacgctcacagggcagacaattttaattcgacagaatacttgaattatgtatctgaacataagaaagaatttgaaaaagttctaagttgtgttgaagactttgcaaatctctatgtagatgtagagaaaaatttaagtaaaattcgagcagtagcagattcgatggacaatttctcaatcgaagaaatctcaaactcatttatcaatcttctaacacttaccgcactcggtgccccagcagacttcaatttccttggtgaaaagatacctcgaaaacgctatacaagtacaaaagaatgtctaacagcaacgctaatacaccaatcaatcacaggactatatgaaaccagaatagacttatctaagctcggcgaagaatga

SEQ ID NO: 8926 - RNA, 4113 nt, synthetic construct
  misc_feature 1..4113: note = Cas9 variant
  source 1..4113: mol_type = other RNA
atgaaaaatgcaaacaaagtaacaggtaaatactaccttggtttcgacattggcacaaactcagtgggatgggcagtgacagacgaaaattacaacttatgtaaattcaaaaagaaatcgatgtggggcattagactttttgaagacgctaaaactgcggaagaacggagaggacaacgtgcaagtagacgacgactacagagaagaaaacagcggatagatttgctacaagaaatattcgctgaagaaataaataaagtagatgaaacattctttataagactaaatgaatcaagattacatttagacgacaaaacagtttctgaaaaacatccattatttatcggatccgaatatagcgaaaaagaatactatagagaatatcccacgatttttcatttaagaaaagaacttatggaatcatccgaaccacacgatatcaggttagtttacctagcaatccatcatatacttaaaaacagagggcacttcctaattgacggcgaactaagtaaagcaaacagttttgacgccgcattttatcaaatgaaagaagtattatgcaatgaactagacttagaaatagacggagaaaacacaacagaagttgaaagaacgcttcgtgatagaaatataagcaaaagtgataaagtcaaactattagccgctctgttagcgatgaaccaaaatgaaacagaatctaaagaaaccaaaaagaaaattgaaaacatatgcaaattactagcaggcaacaaaggagatatatccaaaatatttggacaaactccagaaggcgtagagaaaacttctttttccttcggggaagccgactacgatgaatcaatacgaccaaacttagaagaatcaataccagatcagtgttttgtaatcgattcaatcaaagcattatatgattggaatgtactagcagatattttaaacggtcagacatacttatcatgcgccaaagtcaaccaatatgaaacacacaaaaacaacctaaaagaattgaaattactggttaatagatattgttcaagagaagaatataaaagattctttaaatcagcagtagaaaaagcaaattattctaattatattgggtcagccaaacaaggcaacaaaataatcgacgtaaaaagatgcgcagaagaagatttctataaagaactaaaaatcctactatctaaaatagaacccgaagaagccgacagagaactatacgaaagaataaaaagagaagcagaagaaggctcattattaccgctacaaagaaataaagataactccgtagtacctaatcaaatgcataaagcagaattagctctaatactggaaaacgcgggatcatatctaggctttctaaacgaaaaagacgaagatggattaagccctgcagagaaaatcatagaattattttcttttagaataccatattatgttggacccttatcagatagacataaagatagaggatctaacgcttggatcgtgagaaaagcagaaggcagaatcttaccttggaactttgacgaaaaagtcgatagagaaaaatccaatgaagcattcatcgaaaggatgaccaacaaatgcacttacctactaggaaaagatgtagtcgctaaaaatagtttaatatactctcactttatggttttaaatgaattaaataacttatctgtctgtggaaataaaatctccgtacaagtaaaacaagacatatacagggaattatttcaaaggcatacaaaagtgtctaagaaaatgctcttacaatattgtcgagagaaaatgatgaacaaagacttagaagaagaagatctaagtgggtttgatggcgatttcaaagcaaaattgagcagctacctcgatttcgaaaagaaagtatttggagccaaaatggaagaagaccggataagaaaaataactgaagacataataagatggaaaacaatttatggagacgatggaaaaatgctacaagcggtagtagaaaaagaatatccaggtgaattagactcagaccaactaaaagctgtaaaacagtttaggtattcaggatgggggaacttttctgaagagttcttaaacggaatagtaggaaccgaaaaacccacaggtcaaatgttcacgatcatagaagcactttggcaaacgaactgcaacctaatgcagctactaagtaaaaactttacattcatggaagaaatcgaaaaacacaatagagaattagcgggacaaataacagacatatcctacgacaaattagtaaaagacctatatatcagcccagcaaataaaagggcagtatggcaaacagtcaggatagcggaagaagtcaagaaaataatgggttgtgaaccagccaaaatatttgttgaaatggcacggggaggtgaaaaagagaagaaaagaactatctccaggaaaaagaaactactagaactctatgcagcttgtaagaaagatgctagggactggaatagggaaatagaagatagggatgaacgagaatttaatagcgacaaattatacctctactatacccaaatggggcggtgtatgtatagtggtgaacgcatcgaccttcatgaattaatgtcagcaaatagtaaatgggacatagaccacatctatccacaaagcaaagttaaagacgatagtctagacaatcgagttctatcactcaagaaaattaataacgaaaaagggaataagcccctctcacgcgatatacaacaaagtcaacaaaaatggtggacagaactacttcaactcgaatttataacgaaaaagaaatacgatagacttatgcacagaggggagttatctgaagaagaattatctggatttatcaatagacaacttgtagaaacacgtcaatcaacaaaagcagcagcagaactattaggtcgtatgtacaataactcaaaagtagtatacgtaaaagcccccttagtaagtcaattcagaaaagatgacctaaatatcctcaaatcacgattagctaatgattaccaccacgccaaagatgcttatctcaacatagcggttggaaacgtttacaacgaaaagttcacggataacccactaagatggatagagaaacatgccggagaaaattatagcatcaacagagttttcgattatgatatagttgctggtgacggggccccagtatgggctgcacccctacgtgatgagaaaaacaagttgcgtaaaaatgaagtgggagaaaaatatggaggaacaatagatgtaatcaggaaaacggtaaagagaaacgacgtgctttatacagagcacacatattgcggtaaaggtgaactattcaatgcaacaatagctaagaaagacggaggagcggaaattcctttaaaagctgggctacagaccggaaaatacggcggctacaaaagtcccaatacaagttatttcgcagcaatagagtttgatgggaagaaaggcgaaagagttaaaaacataatggaagttccagtctatattgcaaatatactactccatgacatcgacgcgtacataagatactgcgaaacagtaaaaggactcaaaaacgtcaaaattttaagaccatgcatcaagaaaaatgcattaatatccgtagacggctacccaatgagaataagaggagctaatgaaaagaatatactcctcaaaaataatctacagccaatattcggaagacacgaagaaacagtacgacgaattgaaaaatacgtggagaaaaaccaagagttcgaagtagacgaaaagttcgatgggctaaatgaagcgaacttaacagatttatatgatgacattacagagaaattatgtggaccatatgttgaacgcccctcaaaccaaggagaatatctaatggaaaacagagaaaaattcctcaatatatctttaaaagaaaaagcaaaactactggcacaaatgattaagttagtcagatgcgacaccgagacgaaagctgacctcagaagcataggtgccagcaaaaacgcaggagtaataagcgtaaataaaaacacactcggaggaaagcgcctaatactaataaatcaatcagttacgggactatttgaaaaccgaatagaattatga

SEQ ID NO: 8927 - RNA, 4113 nt, synthetic construct
  misc_feature 1..4113: note = Cas9 variant
  source 1..4113: mol_type = other RNA
atgaacaaaccatactcaataggcttagatataggtacaaatagcgtaggttggtcgattattacagatgattataaagtaccagcgaagaaaatgagggtattaggaaacacagataaagaatacatcaagaaaaatctaataggagcactattattcgatggtggaaacactgcagcagataggcggctcaaaagaaccgcaagaagaagatatacgcggcgcagaaatcgtatattatacctacaggaaatattcgcagaagaaatgagcaaagttgacgactccttcttccatcggctcgaagattcgttcttagtcgaagaagataaaagaggctcaaaatacccaatattcgcaacaatgcaggaagaaaaatattaccatgaaaaattcccgacaatataccacttaagaaaagaactagcagacaagaaagaaaaagcagacctccgactaatatatctagccctggcacatattatcaaattccgaggtcatttcctgatcgaagatgaccgattcgacgtaaggaacacggacatacaaaaacaatatcaagcatttttagaaatattcgacactacattcgaaaacaacgatttacttagtcaaaacgtagacgtagaagccattcttacagacaaaatctcgaaaagtgctaagaaagatagaatattagcacgttatccaaatcagaaaagtaccggaatctttgcagaatttttaaaactcattgtaggcaaccaagcagacttcaagaaacattttaaccttgaagataaaacacccctacaattcgcaaaagacagctatgacgaagatcttgaaaacctccttggacaaataggagacgaatttgccgatttattttcggcagcaaagaaattgtatgattcagtattactaagtggaatactaactgtaacagacctatccaccaaagcacccttatcagcttcgatgattcaaaggtacgacgaacaccgagaagacttaaaacaattaaaacaattcgtgaaagccagcttaccagaaaaatatcaggaaatattcgcggactcttcaaaagacggatatgcaggatacatcgaaggaaaaaccaatcaagaagcattctataaatacttatcaaaactattaacaaaacaagaaggtagtgaatacctattagagaaaatcaaaaatgaagacttcttacgaaaacagagaaccttcgacaacggctcaataccccatcaagtacatttaaccgaactacgagcaataataagaaggcaaagtgaatactacccattcctcaaagaaaacctagacagaatagagaaaatactcactttccgtataccttattacgtaggaccattagcacgcgaaaaatcagattttgcctggatgacacgaaaaacggacgattcaattagaccatggaatttcgaagacttagtagacaaagagaaaagcgcagaagcatttatacaccgaatgacaaataacgacttataccttccagaagaaaaagttcttccaaaacatagtctaatatatgaaaaattcacagtctataatgaacttacgaaagtacgattcctagctgaaggattcaaagattttcaattcttaaaccgaaaacaaaaagaaacaatatttaattcactttttaaagagaaaaggaaagtaacagaaaaagacatcataagtttcttaaacaaagtagatggctacgaaggtattgccataaaaggcatagaaaaacaattcaacgcatcactatcgacatatcatgacctaaagaaaattctaggaaaagattttctagacaatacagataacgaactaattttggaagatattgtacaaacattaacgctattcgaagacagagaaatgataagaaaaagactagatatatacaaagactttttcacagaaagtcaacttaagaaactataccgacgacattacactggttgggggcgactcagcgccaaattaataaacggaatcagaaacaaagaaaaccagaaaacgatactagactaccttatagatgacggaagcgctaatcgaaacttcatgcaattaattaaagatgcgggcttgtcatttaaaccaattatagacaaagcaagaacaggatctcactcagacaatctaaaagaagtagtaggagaactagcagggagccctgcaatcaagaaaggaatattacagtcattaaaaatcgttgatgaacttgtgaaagtaatgggatatgaaccagaacaaatagtagttgaaatggcccgagaaaatcagacgaccgctaaaggattatcaagaagccgccaacgcctaaccactcttagggaatcactagctaatctgaaaagtaacatactagaagagaagaaaccaaaatatgtaaaagatcaagttgaaaatcaccatctaagcgatgatagactcttcctctattatttacaaaacgggaaagacatgtatacagacgacgaattagatatagacaacctctctcaatacgatatagatcatataataccgcaggcattcataaaagatgatagcatagataatcgagttctagtatcaagtgccaaaaacagaggaaaatcagatgacgttccatcggtcgaaatagtgaaagattgtaaagttttctggaagaaattattagacgcaaaactaatgagccagagaaaatacgataacctaaccaaagcagaaagaggtggactaacaagcgatgataaagcacgattcatacaacgacaacttgttgaaacaagacaaattactaaacacgttgcaagaatccttgacgaaagatttaataacgaattagatagtaaagggcgaagaatccgaaaagtcaaaattgtaacgcttaaatccaacttagtctcgaatttccgaaaagaatttggattctacaaaatcagagaagttaataactaccaccatgctcatgacgcatatctaaatgccgtagtagcaaaagcgattttaacaaaataccctcaactagaacccgagtttgtatatggcgactatcccaaatacaattcgtacaaaacaaggaaatctgctacagagaaactatttttctacagtaacataatgaacttctttaaaaccaaagttaccttggccgacggaacagtcgtggtaaaagacgatattgaagtcaacaacgatactggggaaatagtctgggacaaaaagaaacattttgccacggtaagaaaagttctatcatacccacaagtaaacattgtcaagaaaacagaaatacaaacaggtggattcagtaaagaaagtatactagctcatggaaactcagataaattaattccaagaaaaacaaaagatatctatttggatcccaagaaatatggcggctttgattcacctatagtcgcttattccgtcttagtagtagctgatattaagaaaggaaaagcacaaaaactcaaaacagtgacagaactcttaggaattaccataatggagagatcaaggttcgaaaagaaccctagcgcatttttagaatcaaaaggttatcttaacattagagacgacaaactcatgatacttcctaaatatagtctctttgaacttgaaaatggcagaagacgacttcttgcatccgctggagaactccaaaaaggcaatgaactcgcgctcccaacgcaatttatgaaattcctatacttagcgtcacgatataacgaactcaaaggaaaacccgaagaaatagaacaaaaacaagaatttgttgtacaacacgtatcatactttgatgacatattacaaatcattaacgatttttcaaaccgagtaatacttgcagatgcgaacctagagaaaataaacaaactttaccaggataacaaagaaaacattcctgtagatgaactagcaaataatattataaacttattcacgtttacgagccttggagcgcctgcagcattcaaattcttcgataaaatagtagatagaaaaagatacacaagcaccaaagaagttctaaactccacccttatacaccaatcaatcacaggcctatacgaaacaagaatagaccttggtaagctaggtgaagactga

SEQ ID NO: 8928 - RNA, 4113 nt, synthetic construct
  misc_feature 1..4113: note = Cas9 variant
  source 1..4113: mol_type = other RNA
atgacaaaaataaaagacgattacatagtaggactagacataggtacagacagctgtggatgggtcgcgatgaactccaataacgatatactaaaactccaagggaaaaccgcgatcggatcgagattatttgagggcggcaaatcagccgcagaacgacgcctattcagaactacacacagacgtataaaaagacgacgttggagactcaaactgctagaagagttctttgacccctacatggcagaagtagacccatacttctttgctcgtttaaaagaaagcggactaagccccctggataaacgaaaaacggtctcatcgatagtctttccaaccagcgccgaagacaagaaattttacgacgattacccaacaatatatcacctacgttataaactaatgacagaagacgaaaaatttgaccttcgcgaagtatacttagctatacatcatataataaaatatagaggaaactttctttacaacacatcagttaaagactttaaagctagtaaaatcgatgtcaaatctagcatcgaaaaattaaacgaattgtatgaaaacctcggattagaccttaacgtagaatttaatataagtaacacagcagaaatagaaaaagtactaaaagataaacaaattttcaaaagagataaagtaaagaaaatagcagaattattcgcaatcaaaacggataacaaagaacaaagcaaaagaataaaagacataagcaaacaagttgctaatgccgtattaggctataaaaccagatttgacacaattgctttaaaagaaatatccaaagacgaattatcagactggaactttaaactaagtgatatagacgcagatagcaaattcgaagctctcatgggaaacctcgatgaaaacgaacaagcaatattgctaacaataaaagaattgttcaacgaagtcacattaaatggtatagtcgaggatggcaacacactatccgaaagcatgataaacaaatacaacgatcacagagatgatctaaaactcctaaaagaggttatcgaaaaccacattgaccggaagaaagctaaagagttagcgctggcttacgacctctatgtaaataacaggcacggaagattacttcaagccaaaaagaaattaggaaaaataaaaccgcgatcaaaagaggacttttataaagtagtcaataaaaatctagatgattcgagggcatcaaaagaaatcaaaaagaaaattgaactagatagcttcatgccgaaacaaaggacaaacgccaacggagtgataccatatcaattacagcaactagaattagacaaaataatagaaaatcaatctaaatactacccgtttttaaaagaaattaatccagtatcaagccatttgaaagaggcgccatataaactcgacgaactaattcgttttagagtaccctattatgtgggaccactcataagcccgaatgaatcaaccaaagatatacaaaccaagaaaaaccaaaattttgcatggatgataagaaaagaggaaggtagaataacaccttggaatttcgatcaaaaagttgacagaatagagtccgccaacaaatttataaaacgcatgaccacaaaggacacatatctttttggcgaagatgtcctcccagccaacagtttactatatcaaaagttcacagtcctaaacgaactcaataatataaggattaatggcaaaagaatttcagtagaccttaaacaagaaatatatgaaaatttattcaaaaagcatacgacagtaactgtcaagaaattagaaaactatctaaaagaaaatcacaacctggtgaaagtagaaataaaaggactagccgatgaaaagaaattcaactcagggctcacaacctataatcgatttaaaaatttaaacattttcgataaccagatagatgacttaaaatacagaaacgacttcgagaaaataatcgaatggtcaaccattttcgaagataaatcaatatataaagaaaaactaaggtctatagattggctcaacgaaaaacaaatcaacgccctttcaaatataaggttacaaggatggggacgcctttcaaagaaattacttgcccaactacatgatcataacggacagactattatagaacaattatgggatagccaaaacaacttcatgcaaatagtaacgcaagctgatttcaaagacgcgatcgcaaaagcaaatcagaatcttctcgttgcgaccagtgtagaagacatactaaacaatgcatacacaagtcctgcaaataagaaagcaatccgacaagtaataaaagtagtagacgacatcgtaaaagcagcatcaggaaaagtcccaaaacaaattgcgatcgagttcacgcgtgatgccgatgaaaacccaaaaagatcacagacgcgcggcagtaaactacaaaaagtatacaaagacttatcgacagaactagcatcaaaaacaatcgccgaagaattaaatgaagctataaaagataagaaactcgtccaagataaatactatctttacttcatgcaattaggaagggacgcatacacaggagaacctataaatatagatgaaatacaaaaatatgatattgaccatatcctaccacaatcatttataaaagatgatgcgctagacaatagagtactggtatcacgagctgtaaataatggaaaatctgataatgtccccgtaaaactattcggaaacgaaatggcagctaaccttggaatgaccataaggaaaatgtgggaagaatggaaaaatataggcctcatctcgaaaacaaaatataataaccttttaacagatccagaccatataaacaaatacaaatcagcaggatttattagacgccaattagtcgaaacaagtcaaattatcaaattagtcagtactatattacaaagccgatatcctaatacagaaataataaccgtaaaagcaaaatacaaccactatctaagagaaaaatttgacctatacaaatcaagagaggtcaatgactatcaccacgctatagatgcatatctatcagccatctgcggcaatttactataccaaaactacccaaacctaaggccattctttgtctacgggcaatacaagaaattctccagcgatcctgacaaagaaaaagaaatatttaacaaaacaaggaaattctctttcattagccaaatacttaaaaacaaatccgaaaactcaaaagaaatagccgaaaaactaaaacgagcatatcaatttaaatacatgttagtatcacgagaaaccgaaaccaaagatcaagaaatgtttaaaatgaccgtctttcctcgagaaacgccaggtaacctaatacccaaaaagaaagggatggccccagaaatctatggaggatataccaaaaacagtgacgcatatatggtaatagttaaaatcgataaaaagaaagaaacagaatacagaatacttggaataccaaccagagagctcgttaatctaaagaaagctgaaaaagaagatcattacgaaagttaccttaaagagatattagcaccacgaatactatacaacaaaaacggcaaacgcgataagaaaatcacttcattcgagatagtaaaatccaaaataccatataaacaagtaattcaagatggtgataagaaatttatgctaggatcatccacatacgtttataatgcaaaacaactaacattaagtaccgaaagtatgaaagccataactaataatttcgacaaagactcagacgaaaacgacgcgctcataaaagcctatgatgaaatactagataaagtcgataaatacctacctttattcgacataaatgcattccgaaagaaattacattcaggcagagaaaaatttgtagaactaagcctagaggataagaaagacataatcttaaaagtcctaataggtttacatgacaacccggcaacatcagatctcaaaactctaggcttcagttcaaccgaactaggaaaaatgcagaaaaactcaggaattgtactaagcggaaacgcaaaactaatataccaaagcccaacaggcctctttaagaaatcagtaaaaatcagtgatctatga

SEQ ID NO: 8929 - RNA, 4113 nt, synthetic construct
  misc_feature 1..4113: note = Cas9 variant
  source 1..4113: mol_type = other RNA
atgactaaaatcaaagacgattacatagtaggactcgatatcggtactgattcatgtggatgggttgcgatgaactcagataatgacattttaaaattacaaggaaaaacagcgataggatctcacttgttcgaagctggtaaaagtgcagcagatagaagattatttagaacaacacacagaagaataaaaagaagaagatggagactaaaactgctagaagaatttttcgatccttatatggctaaagtagacccatatttcttcgccagactcaaagaatcagggttaagtcctctggacaaacgtaaaaacgtattctcgatagtattcccaaccgcagcagaagacaagaaattctatgacgactacccaacaatataccacttacgatacaaacttatgacagaagatgaaaaattcgacctaagagaagtatatcttgccattcaccacattatcaaatacagaggtaacttcttatacaatacaagtgtcaaagatttcaaagcatcaaaaattgatgtcaaaagctcaatcgaaaaacttaacgaactatacgaaaacttaggactcgaccttaacgttgaatttaacatttccaacaccgccgaaatagaaaaagtattaaaagataaacaaatatttaaacgagacaaagtcaagaaaatagctgaactatttgcaataaaaacagacaataaagaacaatccaaaaggataaaagacataagcaaacaagttgcaaacgcagtcttaggctacaaaacaagattcgacaccatcgcccttaaagaagtctcaaaagatgaactctctgactggaactttaaattatcagacattgatgcagattccaaattcgaggctttaatgggaaatctagacgaaaacgaacaagcaatattactgaccataaaagaactcttcaacgctgtaacccttaatggcatcgtagaagatggaaacacactgtcagaatcaatgattaataaatacaacgaccatcgagatgacttgaaactactcaaagaagtcatcgaaaaccacatagacaggaagaaagccgtaaaacttgcactagcctacgatctatatgtgaacaacaggcacggacaactaattcaagccaaaaagaaactagggaaaatcaaaccaggctccaaagaagatttttataaagttgtaaataaaaacctagatgactctcaagcaagtaaagaaatcaaaaagaaaatcgaactagattcctttatgccaaaacagcgaaccaacgccaacggagtaataccctaccaactccaccaacttgaactagataaaataatagaaaatcaaagtaaatattatcctttcctaaaagagataaaccctgtcagctcccaccttaaagaagcaccatacaaactagacgaactaatacgattcagagtaccatactacgtaggaccccttatttcacctaatgaatccacaaaagacatccaaaccaagaaaaatcaaaattttgcatggatgattagaaaagaagaaggcagaataacaccatggaatttcgatcaaaaagttgacaggatcgaatcagcaaacaaatttataaaacgcatgacaactaaagacacatacctttttggtgaaaacgttctcccagctaatagcttactatatcaaaaattcactgttcttaacgagctcaacaacataaggataaacggaaaaagaataagtgtagacttaaaacaagaaatttatgagaatctctttaagaaacatacaacagtaacagtgaagaaacttgaaaattatctaaaacaaaatcacaatttagtcaaagtagaaatcaaagggctcgcagacgagaagaaatttaactcgggattaacgacatacaacagatttaaaaacctaaacatatttgataaccaaatcgacgacctaaagtatcgaaaggacttcgagaaaataatagaatggtccacaatatttgaagataagagtatctacaaggaaaaattacgttcaatagattggcttaatgaaaaacaaatcaacgcattatcaaatataagactacaaggatggggtagactcagtaagaaactactagcacaactccatgaccacaacggtcaaactataattgaacagctgtgggactcccaaaataacttcatgcaaattgtaacccaagctgacttcaaagacgcaatagccaaagcaaaccaaaaccttttagtcgccacaagcgtagaagacatcctaaacgatgcatacacatcaccagcaaataagaaagcgattagacaagtgatcaaagtagtcgatgacatagtgaaagctgcctctggaaaagtgcccaaacaaatcgcaatagagtttacacgcgacgcagacgacaatccaaagagatcacaaaccagaggctcaaaactgcaaaaagtttacaaagacctatcaactgaactagcttccaaagcaatcgcagaggaattgaatgaagcaattaaggacaagaaattagtacaagacaaatactacctatattttatgcaattaggaagagacgcatatacgggtgaaccaataaatatcgatgaaatacaaaaatacgacatcgatcacattcttcctcagagctttattaaagacgatgcactagataatagagtcttagtttctaaggcagtaaacaatgataaatcagacaacgtaccagtaaaactatttggtaacgaaatggctgggaatcttggaataacaattagaaaaatgtgggaagaatggaaaaacatcggcctcatcagcaaaacaaaatacaataacttattaacagacccagatcacataaacaaatacgaatctgcaggattcataagaagacaattagttgaaacttctcaaatcataaagttagtatcaaccatcttacaatcccgctaccctaacacagaaataataactgtaaaggcaaaatacaaccattatctaagggaaaaatttgatctttataaatctcgagaagttaacgactaccatcacgcgatagatgcctatctatcagcaatatgcggtaacctactttaccaaaactacccaaaccttcggccattctttgtatacgggcaatacaagaaattcagctccgacccagataaagaaaaagaaatattcaataaaacccgtaaattctcatttatatcacaaatacttaaaaataagagtgaaaactcaaaagaaatcgcagagaaactaaaaagagcataccaattcaaatatatgctagtaagcagagagaccgagacaaaagatcaagaaatgttcaaaatgacggttttccccagagaaacaccaggcaatctaatacccaagaagaaagggatggccaccgaaatttacgggggatataccaaaaattcagacgcttacatggtgatagttaaaatagataaaaagaaagaaaccgaatacagaatacttggcatcccaacaagagaattggtaaacctcaagaaagcggaaaaagaagatcactacgaatcctatctcaaagaaatactagcaccaaggatactatataataagaatggcaaacgtgataaaaagataacatcatttgaaatagtgaaaagcaaaattccttataaacaagtaatacaggacggcgataagaaatttatgttaggatcctccacctacgtttataatgcaaaacaactaacattatcaacagaaagcatgaaagccataacaaacaattttgataaagatagcgacgaaaacgacgcactaataaaagcatacgacgaaatactagacaaagtagacaaatacctaccattattcgacataaacgcattccgcaagaaactccactcaggacgggaaaaatttgtagaattaagcctagaagataaaaaggacataatactgaaggtactaatagggctacatgacaacccggcaacctccgacttaaaaaccctcggattcagctctacagaactaggaaaaatgcagaaaaatagtggaatcgttctctcgggtaatgcaaaactaatctatcaatcacccaccggacttttcaagaaatcagtaaaaattagcgacctgtga

SEQ ID NO: 8930 - RNA, 4113 nt, synthetic construct
  misc_feature 1..4113: note = Cas9 variant
  source 1..4113: mol_type = other RNA
atgaataaaccttactcaataggacttgacataggaactaacagtgtaggctggtcaattataacggacgactataaagtgccagcaaagaaaatgcgagtattaggcaacactgataaagaatacatcaagaaaaacctaataggagcactactattcgacggaggaaatacagcagcagacagacggttaaaaagaaccgcacgccgaagatacactagacgaagaaacagaatactatacttacaagaaatattcgccgaagaaatgtccaaagtagacgattcatttttccaccgcctagaagattcatttctagtagaagaagataaacgtggatcaaaatatcccattttcgcaacaatgcaggaagaaaaatactaccacgaaaaattcccaaccatctaccatctaagaaaagaattagccgataagaaagaaaaagccgaccttagactcatatacttagcactcgcccatataataaaatttagaggccatttcttaatagaagatgaccgatttgacgtaaggaatacagatatacaaaaacagtaccaggctttccttgaaatattcgacacaacctttgaaaataacgacctactatcacagaacgtagacgttgaagccattcttaccgacaaaatatcaaaatccgccaagaaagaccgtattctagcaagatatccaaatcaaaaatcaacaggaattttcgctgagttcttgaaattaatagtaggtaaccaggcagactttaagaaacatttcaacctagaagataaaaccccactacaattcgcaaaagatagctatgatgaagatttagaaaatctccttggacaaataggagacgagttcgcagacttgttctcagcagccaagaaactatacgactccgtactattgtctggtattctaactgtaaccgacttaagcacaaaagctccgctatctgcgtccatgatacaaagatacgacgaacatagagaagacttaaaacaactaaaacaattcgtaaaagcatcactcccagaaaaataccaagaaatatttgcggacagtagtaaagatggatatgcaggatatatagaaggcaaaaccaatcaagaggctttctataaatacttaagtaaactgttgaccaaacaagaaggatcagaatatctactagagaaaatcaaaaacgaagacttcttacgaaaacaaagaacatttgataatggtagtataccccaccaagtacatctaacggaattaagggcgataattagaagacaatccgaatactaccccttcttaaaagaaaacttagacagaatagagaaaatacttaccttcagaataccctactacgtcggaccactcgctagggaaaaatcagatttcgcctggatgacaagaaaaacagatgactcaatacgaccctggaacttcgaagatctagtagataaagaaaaatcagccgaagcattcatacaccgtatgacaaacaatgatttatatttaccagaagaaaaagtcttacccaaacattctctaatatatgaaaaattcacagtatacaacgaactaaccaaagtacgttttctagccgaaggctttaaagacttccaatttctgaaccgaaaacaaaaagaaactatctttaattctttattcaaagaaaaacggaaagtaacagaaaaagacataatatcattcctaaacaaagttgacggatacgaaggtatagctataaaaggaatagaaaaacaatttaacgcatccttatccacataccatgacttgaagaaaattctaggaaaagactttttggacaatacagacaacgaactaatacttgaagacatagtacagacactaacactatttgaagaccgagaaatgattagaaaaagattagacatatacaaagacttctttacagaatcccaattaaagaaactttaccgacgccactatacagggtggggaagactctccgcgaaactaatcaatggaatcagaaacaaagaaaatcagaaaacgattctcgattacctaatcgatgatggatcagcaaatcggaacttcatgcaactcatcaaagacgccggactcagttttaaaccaattatagacaaagcgagaactggaagtcactccgacaatctcaaagaagtagtcggagaattagcaggtagccccgctatcaagaaaggaatattacagagcttgaaaatcgtcgacgaactggttaaagtaatgggctacgaaccagaacaaatagttgttgaaatggcgagagaaaaccaaacaacagctaaaggtctatctcgaagtcggcaaagactaacgactctacgtgaaagtctagctaatctgaaaagcaacatactagaagaaaagaaacccaaatatgtaaaagatcaagtagaaaatcatcatctaagcgatgacagactgttcctgtattatttgcaaaatgggaaagacatgtatacggacgatgaattagacattgacaacctatcacagtacgacatagatcacattattccccaggctttcattaaagatgactccatagacaatcgagtactggtatcatccgccaaaaaccgtggaaaatcagatgacgtacccagtgttgaaatagtaaaagattgtaaagtattttggaagaaactgttagatgcaaaattaatgagtcaaagaaaatatgacaatctaacaaaagccgaaagaggcggtctcacctcagatgacaaagcgagattcattcaaagacaattagtagaaacaagacaaatcacaaaacacgtagctcgtatactagacgaacgctttaacaacgaattagattcaaaaggtcgtaggatcaggaaagtcaaaatagtgaccctcaaatctaacttagtttccaatttcagaaaagagttcggtttttataaaataagagaagtcaacaattaccaccatgcccatgacgcttatctaaatgcagttgttgctaaagcaatactaaccaaatacccacaactcgaacctgagttcgtttacggagactatccaaaatataattcttataaaacgcgaaaatcagcaaccgagaaactatttttctattcaaatataatgaatttctttaaaacaaaggtcacactcgccgacggaacagtcgtagtaaaagatgatatagaagttaataacgatacaggagaaatagtatgggacaagaagaaacacttcgcaacagtccgcaaagtactcagttatcctcaggtaaacatagtcaagaaaactgaaatacaaacagggggattttccaaagaaagtatattggctcacggaaacagcgataaacttattccgcgcaaaacaaaagacatatacctagatcccaagaaatacggagggttcgacagcccaaaagtcgcatactccgtccttgtagtcgccgatatcaagaaaggtaaagcacagaaactcaaaacagtaacagaattacttgggataacaataatggaacgatccagattcgagaaaaatcccagtgcctttctagaatcaaaaggttatttaaacatccgcgatgataaactcatgatacttcccaagtactctttatttgaactagaaaatggaagacgcagattattagcaagcgcaggcgaacttcaaaaaggtaacgaacttgcactccccacacaattcatgaagttcctatacctagcatcacggtataacgaattaaaaggaaaaccagaagaaatagaacaaaaacaagagttcgtagttcaacacgtcagctacttcgacgatattttacaaattataaatgatttctcaaacagggtcatactagcggacgcaaatttagagaaaataaataaactctatcaagataacaaagaaaacatccctgtcgatgagctggccaataacataatcaacttatttacattcacaagtttaggcgccccagctgcatttaaattctttgataaaatagttgatagaaaacgatatacgtcaacaaaagaagtcttaaattcaactctcatacacaaatcgataacaggcctctacgaaactcgtatagacttagggaaactaggtgaagactga

SEQ ID NO: 8931 - RNA, 4113 nt, synthetic construct
  misc_feature 1..4113: note = Cas9 variant
  source 1..4113: mol_type = other RNA
atgaacaaaccatacagcattgggctcgatataggaaccaactcagtaggatggagtataataaccgatgattacaaggtcccagcgaagaaaatgcgagtattagggaatacggataaagaatacatcaagaaaaatttaataggagcgctactgtttgatggaggaaacacagcagccgatagacgcctaaaaagaacggctcgcagaagatatacacgcaggagaaaccgaatactatatctacaagaaatattcgctgaagaaatgagcaaagtagatgatagtttcttccaccggctggaagacagctttctcgtagaagaagataaaagaggttcaaaatacccaatatttgccacattacaagaagaaaaagattatcatgaaaaattctctacaatttatcacctaagaaaagaactagcagacaagaaagaaaaagcagatcttaggctaatatatatagcacttgctcatattataaaattcagaggccattttcttatagaagacgatagtttcgatgtcagaaataccgacatatctaaacaataccaagattttctagaaatatttaatacaacattcgaaaacaacgatttattatcacaaaatgtagatgtcgaggctatcttaacagacaaaataagtaaatcagcaaagaaagaccggatactagcccaataccccaaccagaaaagtacaggcatattcgctgaatttttgaaactaatagtgggtaatcaagctgactttaagaaatattttaacctggaagacaaaacaccacttcaatttgcaaaagacagctacgatgaagatcttgaaaatttattaggacaaataggagatgaatttgcagatctattctctgcggcgaagaaactctacgactccgtcttactatcaggcattctgactgtaatagacttatccactaaagcaccactatctgccagcatgatacaacgttacgatgaacaccgagaagacctcaaacaactaaaacaattcgtaaaagcaagcctgcccgaaaaatatcaagaaatatttgctgactcatctaaagatggatacgcaggatacatagaaggaaaaacaaaccaagaagcattttacaaatacttaagcaaactactaaccaaacaagaagacagcgagaatttcttggagaagatcaaaaacgaagactttttacgaaaacaacgtacctttgacaatggatccataccccatcaagtacacttaacagaactaaaagcaataataagacgacaatctgaatactatccatttcttaaagaaaatcaagacagaatagaaaagatactaacctttagaataccatattacataggacctttagccagggaaaaatcagatttcgcatggatgacacgaaaaacagacgactcaataagaccctggaatttcgaagatttagtagacaaagagaaaagcgcggaagcattcatacatagaatgaccaataatgacttctatttacccgaagaaaaagtcctacctaaacactcacttatatacgaaaaatttacggtttataatgaactaactaaggtcaggtacaaaaatgaacaaggagaaacttacttcttcgactccaacattaaacaagaaattttcgatggagtcttcaaagaacatagaaaggtctcgaaaaagaaattacttgactttttagcaaaggaatatgaagaatttaggatagtagacgtaattggtttagacaaagaaaacaaagcctttaatgcatcactaggcacttatcacgatctagagaaaatattagacaaggacttcctcgataatccagataacgaatcaatactagaagacatagtccaaaccttaacattattcgaagatcgagaaatgataaagaaacgactggaaaactacaaagacttatttacggaaagccaactgaagaaactttatagaagacattacacaggctggggaagattgtccgccaaactcataaatggaatcagagacaaagaatcacaaaagacgatattagactatttaattgacgacgggagaagcaacagaaacttcatgcaattaatcaatgatgacggtctcagcttcaaatcgataattagcaaagcgcaagcaggatctcattcagataatcttaaagaagtagtaggcgaattagcgggcagtccagccatcaagaaaggtatactacaaagccttaaaatagtagacgaattagtgaaagtaatgggttacgagcccgagcaaatagtcgttgaaatggcgcgcgaaaaccaaaccacaaaccaaggtagacggaacagcagacaaagatataaacttctcgacgatggagtcaaaaatctagcgagcgacctaaatggcaatatacttaaagaataccccacagataaccaagcactacaaaatgaacgattatttttgtactatttacaaaacggcagagatatgtatactggagaggctttagacattgacaacctaagtcaatatgacatagaccatataataccacaagcatttataaaagacgactctatcgacaaccgagtattagtgtcgtctgctaagaatcgagggaaaagtgacgatgtaccttctctggaaatagtaaaagattgcaaagtattttggaagaaactactggatgcaaaattaatgtcacaaagaaaatacgacaacttaacaaaagcggaaagagggggtcttacatcagacgacaaagcccgatttatacaaagacagctagtagaaacacgccaaattaccaaacacgttgccagaatactagacgaaagattcaataacgaattagattcgaaaggtaggcgaatacgaaaagttaaaatagtgaccttaaaaagtaacctagtcagtaatttcaggaaagaatttgggttttacaaaatacgtgaagtaaataattatcaccacgcccatgatgcttaccttaacgctgtagttgctaaagcaatcttaactaaatatccacaactagaaccagagttcgtatacggagactacccaaaatataactcttataagacaagaaaaagtgcgaccgaaaaattattcttttacagtaatatcatgaatttcttcaaaacaaaggtcacactagcagatgggaccgtagtagtgaaagatgacatagaagtaaacaatgatacaggagaaatagtatgggacaaaaagaaacacttcgctacggtacgaaaagtgttaagctacccacaaaataacatagtaaagaaaaccgaaatacaaacaggcggatttagcaaagaatcaattttagctcatggaaactcagacaaattaataccccgaaaaactaaagatatatatttagacccaaagaaatacggcggattcgactcaccaattgtagcttactcggtattagtggtagctgatataaagaaaggaaaagcccaaaaactaaaaacagtcacagaacttctcggtataacaatcatggaacgatcaagattcgagaaaaatcccagtgccttccttgaatcaaaaggatacttaaacatcagagctgataaactaatcatactacctaaatactccctctttgaattagaaaacggtcgacggcgattattagcctctgccggtgaattacaaaaaggaaatgaactagcacttcctactcaattcatgaaattcttgtatttagcatctcgatataacgaatccaaaggaaaaccagaagaaatagaaaagaaacaagaatttgtaaaccaacacgtatcttactttgatgacatattacagctcataaatgacttcagtaaacgagtgatactagcagatgcaaatcttgagaaaatcaataaactataccaagataacaaagaaaacatttcggttgatgaactagcaaacaacattataaacctgtttacgtttacaagtcttggtgcccccgcagcgtttaaattctttgataaaatagttgatcgcaaaaggtacaccagtactaaggaagttttaaattcaactcttattcaccaatcaattaccggactctacgaaacccgaatagacttgggcaaactaggagaagactga

SEQ ID NO: 8932 - RNA, 4113 nt, synthetic construct
  misc_feature 1..4113: note = Cas9 variant
  source 1..4113: mol_type = other RNA
atgaataagccttatagtataggactagacattggaacaaattcagtcggatggtcaattataactgacgattacaaagtcccagcgaaaaagatgcgtgtcctcggaaacactgacaaagaatacataaagaaaaatttaataggtgcattattgtttgatggtggaaacacagcagcagatcggagacttaaaaggacggcgagacgtaggtatactagaaggagaaacagaatcttatatttacaagaaatctttgccgaagaaatgagtaaagtggacgatagcttcttccatcgcctggaagatagtttccttgtagaagaagacaagcgaggttccaaatacccgatctttgcaacactacaagaagaaaaagattatcacgaaaaattttccacaatatatcacctaagaaaagaattagcggataagaaagaaaaagcagatttaagactcatatatattgccctcgcacacataattaaatttcgcggacacttcttaattgaagatgactctttcgatgtaaggaatacagacatctcaaaacaatatcaagatttcctagagatctttaacacaacgttcgagaataacgacttattaagtcagaatgtagatgttgaggcgatattaacagataaaatatcaaaatcagcgaaaaaggaccgaatacttgcccaataccccaaccaaaaatctaccggaatatttgctgaatttctaaaattaattgtcggcaatcaggcagacttcaagaaatattttaatttagaagacaaaacaccactccagttcgcaaaagactcatatgatgaggacctagaaaatctccttggacaaataggagacgagttcgccgacttattttccgccgcaaagaaactatatgatagcgtactacttagcggtatattgaccgtgatagacttgagtaccaaagctcctctgtcggcctcaatgatacaaagatatgacgaacaccgcgaggatttgaaacaacttaaacaatttgtaaaagccagcctaccagaaaaataccaagaaatttttgcagactcaagcaaggacggatacgcaggatacatagaaggaaaaacaaaccaagaagccttctataaatacctatcaaaattactaacgaaacaggaagatagcgagaacttcctagaaaagatcaaaaacgaggatttcctaagaaaacaacgtacattcgataacggaagtataccacaccaagtacatctaacagaacttaaagccataatacgaaggcaatccgaatattatccattcctaaaagaaaatcaagatcggattgagaaaatacttacctttagaataccatactatataggccccttagcaagggagaaaagtgacttcgcgtggatgacccgaaaaacagatgactcaataagaccatggaattttgaagaccttgtagacaaagaaaaatctgcggaagcatttatccatagaatgaccaacaatgatttctacctaccggaagaaaaggtattacccaaacacagcttaatatacgaaaaattcacagtctataacgaactaacaaaagtacgatataagaatgaacaaggtgaaacatatttcttcgattccaatataaaacaagaaatatttgatggagtgttcaaagaacatagaaaagttagcaaaaagaaactattagacttcctcgcaaaagaatatgaagaatttagaatagtagacgtaatcgggctagacaaagaaaataaagcctttaacgctagtttaggaacatatcacgatttagaaaagatattggataaagacttcttagacaaccccgacaatgaatcgatattagaagatatagtacaaacgctaaccttattcgaagaccgagaaatgattaagaaaaggttagagaactataaagatctattcacggaatctcaactaaagaaactttaccgcagacactacaccggatggggaagactctcagcaaaactcataaacggaatacgtgacaaagaatcacagaaaacaattctagactacttaatagacgacggaagatccaataggaatttcatgcaactaatcaatgacgatggacttagtttcaaatcaataatatcaaaagcccaagcagggtcacactcagacaatcttaaagaggtagtaggagaacttgcaggatcaccggcaataaagaaagggatattgcaaagtctaaaaatcgtcgatgaacttgtaaaagtaatgggatacgaaccagaacaaatagtggtagaaatggcacgagaaaaccaaactaccaatcagggacgacgaaattctagacaaagatacaaactactggatgatggagttaaaaacttagcatccgacttaaacggaaatatactaaaagagtaccctacagacaatcaagctctacaaaatgaacgcctctttctatactatttgcaaaatgggagagatatgtatacaggtgaagcactagacatagataacttaagtcaatacgacatagatcatataattccccaggcctttatcaaagacgattctatagacaaccgagttctagtatcaagcgctaaaaacagagggaaatcagacgacgtaccgtcactcgaaatcgttaaagattgcaaagtattttggaagaaactactcgatgccaaactgatgagccagcgaaaatacgataacctaacaaaagcagaacgcggtggactgaccagtgacgataaagcccgattcatacagaggcaattagtagagactcgacaaataacaaaacacgtagcccgaatattagatgagagattcaataacgagctagactctaaaggacgaagaataagaaaagttaaaatcgtaacacttaaatctaaccttgtatcaaattttcgaaaagaatttggtttttataaaatacgagaagtcaataactaccatcacgctcatgacgcttatctaaatgccgtcgtagcgaaagccatactaactaaatacccacaactagaaccagaatttgtatatggagactatcccaaatacaacagttacaaaacacgcaaaagcgccacagaaaaactatttttctactcgaacataatgaacttcttcaaaacaaaagtaacattagcagatggaacagtagtagtgaaagatgacatagaagtgaataatgacacaggcgaaatagtatgggacaaaaagaaacactttgcaactgtacgaaaagtactatcttatccacaaaataatatagtgaagaaaacagaaatccaaaccggaggtttcagcaaagaaagtatactagcacatggcaacagtgacaaactaatcccacgaaaaacaaaagacatatatttagatccaaagaaatacggaggattcgactccccgatagttgcttactcggttctagtagtagcagatataaagaaaggaaaagcacaaaaattaaaaactgtaacagaacttttaggaattacaatcatggaaaggagtcgcttcgagaaaaacccaagtgcattcctagaaagcaaaggctatctcaatatacgcgatgacaaactgatgatactaccaaaatattcactatttgaactggaaaacgggcgaagaaggctcttagcttcagcaggagaactacaaaaaggtaatgaactagcattaccaacacaattcatgaaattcctatacttggcaagtagatacaacgaatcaaaagggaaaccagaagaaatagagaagaaacaagagttcgtaaaccaacatgtaagctatttcgacgacatattacaacttatcaacgatttctcaaaaagagttatactagccgatgccaatctagagaaaattaacaaactgtaccaagataacaaagaaaacatttcggttgatgaattagccaataacattataaatctatttaccttcacctcattaggggcccctgcagcatttaaattctttgacaaaatagtagatcgaaaaaggtatacatctacaaaagaagtactaaattcaacactaatacaccaatctattactggtctatatgaaacccgaattgatttgggaaaactaggcgaagactga

SEQ ID NO: 8933 - RNA, 4113 nt, synthetic construct
  misc_feature 1..4113: note = Cas9 variant
  source 1..4113: mol_type = other RNA
atgaataaaccatattcaattggactagacatcggaacaaacagcgtaggatggtcaataataacagacgattataaagtaccagctaagaaaatgagagtgctgggtaatacagacaaagaatacatcaagaaaaacctgataggcgcactattatttgatggaggtaatacagcagccgatcgacgtctaaaaagaacagctagacgacgatacacgagacgcagaaataggatattatatttgcaagaaatttttgctgaagaaatgtccaaagttgatgattctttctttcacagattagaagactcttttctggtagaagaagacaaaagaggttcgaagtaccccatctttgcaaccatgcaagaagaaaaatactatcatgaaaaattcccgacaatatatcatctgcgaaaagaacttgcagataagaaagaaaaagccgatctaagattaatttacctcgctttagcacacataataaaatttaggggccattttctaatagaagacgatagattcgacgttcgcaatactgacatccaaaaacaatatcaagcgttcctcgaaattttcgatacgactttcgaaaacaatgatttactatcacaaaacgtagatgtagaagctatactaacagacaaaatttccaaatcagcaaagaaagacaggatactagccagatatccaaatcagaaaagtaccggcatatttgcagaatttctaaaattgatagtcgggaatcaagccgacttcaagaaacacttcaacctcgaagataaaacacctctacaattcgcaaaagactcttacgatgaagatttggaaaacctactaggacaaataggtgacgagttcgcagacctatttagtgcagcaaagaaactatatgattccgtcttactatccggaatactaacagtaactgatttaagcaccaaagccccactttccgcgtcaatgatccaaagatatgatgaacatagagaagacctgaaacaattaaaacaatttgtaaaagcgtccctccccgaaaaataccaagaaattttcgcagacagtagcaaagatgggtacgcaggatacatagaaggaaaaacaaaccaagaagcattttacaaatatctatcaaaattattgacaaaacaagaaggatctgaatacctactagagaaaatcaaaaacgaagactttttgagaaaacaacgtactttcgataatggatcgataccccatcaagttcatttaacagaattacgagccataattagaaggcaatcagaatattaccccttacttaaagaaaacctcgatcgcatagagaaaatattaacatttagaataccctattacgtaggtcctctcgccagagaaaaatccgatttcgcttggatgactagaaaaactgacgactctataagaccttggaactttgaagacctcgtagacaaagaaaaatccgcagaagcattcattcatcggatgacaaataacgatctgtatctacctgaagaaaaagttctacccaaacattctcttatttatgaaaaatttaccgtttacaacgaattaactaaagttagattcctagcagaaggatttaaagacttccaatttttaaatagaaaacaaaaagaaacaatttttaacagcttattcaaagagaaaagaaaagtaacggaaaaagatatcatctcgttcttaaacaaagttgatggctacgaaggcatcgcaataaaaggaatagaaaaacaattcaatgcgtctctgagcacttaccacgatctaaagaaaatcttaggaaaagacttcctagataacacggacaacgaactcatcctcgaagatatagtacaaacactaaccctattcgaagacagggaaatgataagaaaacgactagatatatacaaagacttctttacagaaagccaacttaagaaactttacagaagacactacacaggctggggtagactatcggcaaaactcattaacggtatcagaaacaaagaaaatcagaaaacaatcctagattatttaatagacgatggcagcgcaaacagaaactttatgcaactaattaaagacgccggactttcctttaaaccaataatagacaaagcaagaacaggaagccacagtgataaccttaaagaagtggtaggtgaactcgcaggcagtccggccataaagaaaggtatattacaaagtttaaaaatagtcgacgaacttgtaaaagttatgggatatgaaccggaacaaatagtagtcgaaatggcccgcgaaaatcaaactacagctaaaggactcagtagatcaagacaacgtctgactacattaagagaatcactagccaacttaaaatctaatatcttagaagaaaagaaaccaaaatacgtaaaagaccaagtagaaaaccatcatttaagtgatgatagattattcttatattatcttcaaaatggcaaagacatgtacacagatgacgaactggatatagacaacttaagtcaatacgacatcgatcatataataccccaggcttttataaaggatgactcaatagacaatcgcgttctagtatccagtgctaaaaaccgaggaaagtcagacgacgtaccaagtgtagaaatagtaaaagactgtaaagtcttctggaagaaactactagacgcaaaactgatgagccaaaggaaatacgataaccttacaaaggcagaaagaggaggtttaaccagtgacgacaaagctagattcattcaaagacaattagtagaaactagacaaataacaaaacatgtagctagaatattagacgaacgctttaataatgaattagacagcaaaggacgaagaatacgaaaagtaaaaatagtcactctcaaatcaaacttagtgtcaaattttaggaaagagttcggattctacaaaataagagaagtcaataactaccaccacgctcacgatgcatacctgaatgcagttgtggccaaagcaatactaactaaatacccacaactcgaaccggaatttgtgtacggagattatccaaagtataatagttacaaaacaagaaaatctgcaacagaaaaattattcttctattcaaacatcatgaactttttcaaaaccaaagtgacactggcagatggcacagtagtcgtaaaagatgacatagaagtaaataacgacactggagaaatagtatgggacaaaaagaaacactttgcgacggtaagaaaagtgctatcctatccacaagtaaatattgttaagaaaacagaaatacaaacaggaggcttttcgaaagaaagtatactagcgcacggaaactcagacaaactcataccaaggaaaacaaaagacatctacctagaccctaagaaatacggcggattcgacagtccaatcgttgcatattcagttttagtagtggcagatatcaagaaagggaaagcacaaaaactaaaaacagtaactgaactcttaggaataacgataatggaacgtagccgctttgagaaaaatccatcagctttcctcgaatccaaaggatacttagacattcgcgacgacaaactaatgattcttccaaaatatagtctatttgaacttgaaaacggacgacgaaggctgctagcttcagctggagaactacaaaaaggcaacgaactggcactaccaacacaattcatgaaattcctttacttagcttccagatacaacgaactaaaaggtaaaccagaagaaatcgaacaaaaacaagagttcgtcgtccaacacgtgtcttattttgatgacatactgcaaataataaatgatttctctaatagagtcattctagccgatgctaacctagagaaaattaataagctataccaagataataaagaaaacatcccggtcgacgaactcgcaaacaatataataaatttatttaccttcacttctctaggagcccctgcagcattcaaattctttgataagatagtagaccgtaaaaggtacacttccaccaaagaagtactaaacagtactctaattcatcaatcaattaccgggttatatgaaaccagaatagacttgggaaaacttggagaagattga

SEQ ID NO: 8934 - RNA, 4113 nt, synthetic construct
  misc_feature 1..4113: note = Cas9 variant
  source 1..4113: mol_type = other RNA
atgaagaaaccatatagcatcggacttgatataggaacaaacagcgtaggctgggcagtagtaacagatgactacaaagtcccagcaaagaaaatgagagtatttggtgacaccgacagatcccacataaagaaaaacctactaggtacccttctatttgatgacggcaacacagcagaaagtagaagattaaaacgaactgcaagaaggagatacacgaggagaagaaacagaatattatatttacaggaaatctttacagaatctatgaatgaaattgacgaatcattcttccaccgtttagacgattcgtttctagtccccgaagataaacgaggaagcaaatatccaatatttgcaacgcttcaagaagaaaaagaataccataaacaatttccaacaatataccacctacgcaaacaacttgccgattcaaaagaaaagagcgatgtaagactaatataccttgctctagcccatatgataaaataccgaggtcacttcctctacgaagaaacatttgatattaaaaataacgatatacaaaagatattcaacgaatttattaacatatatgacaacaccttcgaaggatccagcttaagtggccaaaatgcccaagttgaagcaatatttacggataaaataagtaaatccgccaaacgagaacgagtattaaaactatttccagatgagaaaagcacaggcctattttcagaatttttaaaattaatagtggggaatcaagcagatttcaagaaacactttgacctggaagaaaaggcaccactacaattctcaaaagacacatatgatgaagaattggaaaacttactgggccaaataggggacgattttgccgatctatttttaatagcaaagaaattatatgatgcaatattattgagtggaatactaactgtaacagatccatcaacaaaagcacctctctcagcaagcatgatagagagatatgaaaaccaccaaaaagatttagcagcactaaaacaattcatcaaaaacaacctaccagaaaaatatgttgaagtattctcagaccaaagcaaagatggatacgcaggctacatagacgggaagacaacccaagaagcgttctataaatacatcaagaacttgctaagcaagtttgaaggagcggactacttcttggataaaatagaacgtgaggattttctcagaaaacaaaggacattcgataacgggtcaataccccaccaaatacacttacaagaaatgaatgccatcttacgaagacaaggcgaacactatccgttcctaaaggaaaacagggagaaaatcgaaaagatactaaccttcaggattccatactacgttggcccactcgcacgagacaaccgggacttttcatggttaacaagaaattccgacgaaccaattagaccatggaattttgaagaagtagtagacaaagcaagatccgctgaagacttcatacatcgcatgacaaactatgacctctatttacccgaagaaaaagttttaccgaaacactcacttttatacgaaacattcgctgtatacaatgaactaacaaaagtaaaatttatagcagaaggactacgagattatcaatttctggacagtggccaaaagaaacaaattgtaaaccaattattcaaagaaaaacgaaaagtaacagaaaaagatataatacactatcttcacaacgtagatggatatgatggcatcgaactgaaaggtatagaaaaacaattcaatgcaaatttatctacctaccatgatctccttaaaataacaaaagacaaagaatttatggatgaccccaaaaatgaagaaatactggaaaatatagtccataccttaacaatattcgaggatcgagaaatgataaaacagcgactcgcccaatatgacacgttattcgacgaaaaagtaataaaggcactgacccgaagacactacacaggttgggggaaactcagcgccaagctaattaatggaatccgagataaacaatctggaaaaacaatcttagactatttaatcgacgacgataagataaaccggaattttatgcaactaatcaacgacgatgggctaagtttcaaggagataatacaaaaagcacaagttgtaggaaaaaccgacgatgttaaacaagtagtccaagaactaccaggctccccagctataaagaaagggatattacaaagcataaaaattgtagatgagctagtaaaagtaatgggctatgctctagaatcaatagttatagaaatggcacgtgaaaatcaaacaaccgccagaggcaagaaaaactcccaacaaagatacaaacgaatagaagatgcactaaagaatctagcaccaggattagattccaatattctgaaagaaaatccaaccgacaacatacagttaaagaatgaccgattatttttatattacctacaaaatggaaaagacatgtacactggtaaaccactggatataaaccaattatcctcatacgacatcgatcatatcatcccacaagcatttataaaagacgatagtatagataatcgcgtacttacatcatctaaagacaatagaggtaaatccgataatgtacccagccttgaagttgtacagaaaagaaaagcattttggcaacaacttctagactctaaactcattagtgaacgtaaattcaataatttaacgaaagctgaaagaggcggactcgacgaaagagacaaagttggattcatacgcaggcaattagtagaaacacaacaaattaccaaaaatgtcgctcaaatacttgacgctagattcaacacagaggtaaaggagaaaaatcagaaaataagaacagtaaaaataataacattaaaaagcaaccttgtttcaaactttcgaaaggaatttggcctatataaagtaagagaaataaacaattatcaccacgctcatgatgcttatttaaatgcagtagtcgcaaaagccatacttaagaaatatccaaaacttgaacccgaatttgtatacggggattaccaaaaatacgacttaaagaaatacatatcaagatttaaaccctcaaaagaaatcgaaaaagctacagaaaaatacttcttttatagtaacctattaaactttttcaaagaagaagtcctatatgcagatggtactattcgtaaaagagagaatatagagtactcaaaagatacaggtgagatcgcctgggataaagagaaagacttcgcaacgataaagaaagttttgtcatatcctcaggttaacatcgtaaagaaacgcgaagtacaaacaggtggctttagcaaagagtctatactcccaaaagggaatagcgacaaattaataccaagaaaaacgaaagacatattatgggatacaacaaaatatggaggctttgacagcccagtgatagcctactcaattttattaatagcggacatcgaaaaaggaaaagcgaagaaactaaaaacagtgaaaactctagttggaataactataatggaaaaagcagccttcgaggaaaacccaatcacattcttagagaataaaggctatcacaatgtaagaaaagagaacatcttatgcctcccaaaatattcattattcgaactagaaaatggccggagaaggcttctagctagcgccaaagaactacaaaaaggaaacgaaatagtattaccagtatgcttaaccacactgttatatcatagtaaaaacttacacaaattagatgaaccagaacatcttgaatacattcagaaacaccgcaacgaatttaaagacctattaaacctcgtctcagaattttcacagaaatacatattagctgaagctaacctagagaaaattaaagacttatatgcagacaatgaacaagcagacatagaaatattagccaacagtttcattaacctgcttacattcacagccctaggagcacccgctgcattcaaattctttggaaaagatgtcgatcgcaaacgttatactacagtaagcgaaatccttaacgcaacattaatacaccaaagtattaccggcctatatgaaacaaggatcgatctcagtaaactaggagaagaatga

SEQ ID NO: 8935 - RNA, 4113 nt, synthetic construct
  misc_feature 1..4113: note = Cas9 variant
  source 1..4113: mol_type = other RNA
atgaaaaaaccatactcaataggtttagacattggaacaaacagtgtaggatgggcagtcattaccgatgattacaaagtgccagcaaaaaaaatgaaagtactcggtaatacagataaaaactacataaaaaagaaccttttaggagctttactttttgattcaggaaatacagcagaagaccgaagactaaaaaggaccgcacgcagaagatatacaagaagacgaaataggttattatatttacaagacattttttctgatgaaatgaataaagtcgacgaaagcttctttcaccggctagaagacagctttctagtcagtgaggataaaagaggtgatcatcatccaatatttggtaatgtggtagatgaagtaaaataccatgaacaattcccaacaatatatcatttgagaaaatatctagcagacacaccagaaaaggcagaccttagattagtatacctagctctagcacacatgataaaattcagaggccactttttaatagacgatcctaaactcgacgtaaagaataccgactcccaagaattattcagccaatttctaacagcttacgatgtaacccaagaagactcacatttagccgatgtaaaaataaatatttcggacataattaccgaaaaaatgaataaatcacgtaaagtagaggctctattatttcactttcccagtcagaaaaaaaacagcttctttggtaaccttgtatcactagtatttggactgctccctaatttcaaaactaatttcaacctagctgaggacgcaaaacttcaattgagcaaagactcatacgatgaagatcttgaaaaccttttaggacagataggagacgaatacaccgacgtatttgtagccgcacgaaaactatatgattcaatattactatcaggaattttaacagtcaacgatctatccactaaagcgatactatcagccagcatggtaaggcgatatgaagaacataataaagatcttgcgaaactgaaagcttttgtaaaagcgaacttcacacacgacgttttcaaagaagtattttcagacgcgagcaaaaacggttatgcaggctatattgaaggaaaaacatcccaagaagacttctacaaatatgtcaaaaatttaattggtaaagttgatggaagtgcagacttcattgagaaaatcgaccgagaagattttctgcgaaaacaaagaacttttgacaatggatccattccacaccaagtacatctagcagaaatgaaagcgattttaagaagacaaggcgaatattatccattcctaaaagaacatgctgagaaaatacaacaaatacttacattccgaataccatattatgtgggaccactagacaggcatggacacagcgattttgcgtgggcatcattcaacagcgaagaaaaagtaactccatggaacttcgaggaaataatagataaaaataaatctgcccaagccttcatagaacgcatgactaaccaagacctgtacttgccaaacgaaaaagttctcccaaaacactcacccctctacgaaaaatatacagtctataatgaattaacaaaaataaaatacgttactgaaaccggaacagcaaaattcttcgatgctaatctaaaacaagaaatatttgacgggttatttaaaaaggagaggaaagttactaaaagaaaactcttaactttcttagaaaaaaacttcgatgagttcagaatcgtagacatccaaggtctagacaaggaaacagaaacatttaatgcaagttacggaatctatcaagacttattaaaaattatcaaagacaaagcattcatggacgatagtgagaacgcagacatactagaggacatagttctaacactaactttattcgaggacagggaaatgattaaacaacgacttgccaaatatgctgacttattcgacaaaaaagtaatagataatctcgcaagacgaagatataccggatggggaagactatcagcaaaactattaaacggaattagagataaacgttccagaaaaacaataatggattacttagttgacgatggacgatctaatagaaaccttatgcaattgataacagacgataatctaacatttaaagacgagatcgctaaagcacaatattcagacaattctgatgatctacatcaagtagtacaagatttagcaggatcaccagccataaaaaaaggaatacttcaaagtgtaaaaatagtcgatgagttagttaaagtaatggggtatgagcctgaacagatcgttgttgaaatggcaagagaaaatcaaactacagcaaaaggacgtagaaactcacaacaaaggtacaaacgacttgaagaggcaataaaaaacttagatcgagacctaaattacaaaattttaaaagaacatcccacggataaccaagccttacaaaacgacagactcttcttatattacttacaaaacggacgagacatgtatacaggagagtcactagatataaatcgactaagcgactacgatatagaccacataataccacaagctttcattaaggacaatagcatagacaatcgtgtgttagtttcaagcgcaaaaaatcgtggtaagtcagatgacgtacccagtgaagacgtagtaaaccgaatgaggcccttttggaataaactacttaactgcggactaataagtcaaagaaagtattccaatctaaccaaaaaagagttaactcccaacgataaagccggatttataaaaagacaattagtcgaaacacgacaaatcactaaacacgtagctagaatcctcgacgaacattttaacaaagaattcgacgaagacaagaagagaataaggaaagtaaaagtcgtcactctaaaatcgaatcttgtatcaaattttcgaaaagaattcgaactctacaaagtaagagaaataaacgattaccaccacgcacatgacgcttatctaaatgcagtcgtagccaaagcactgctaatgaaatatcccaaactcgagcccgaattcgtgtatggagaatatccaaagtacaattcataccgtgaaagaaaaaccgccacccagagaatgttcttctattcaaatattatgaatatgttcaaatcaaaagtgaaattagcagacgaacggataatagaaagacctatgatcgaagtcaacgatgaaactggagaaattgcatgggacaagacaaaacatatagcaactgttaaaaaagttttatcctatcctcagataaatatagtaaaaaaagttgaagaacaaacgggtggtctcacaaatgaaaccatatatccgagaggcagctttgacaaattgctgaacagaaaaaataccttagaagcaagcaaatacggtggatttggttcaccaacagtggcatactgcgtactagtagtggcagacagtaaaaatgaaaacggaaaagtcaaaaaattaaaacttggaagtgaattgttagggatcactatactagaaaaaaacgactttgaaaataactctctagatttccttagtagaaaaggatatcaaggagtgcaagaaaaaaaaataataaaattaccaaaatacagcctctttgaatttcaagatggttctagaaggatgctcagtagcgtaatggccaacgataacaaaaggggagacttacagaaagctaacgaaatgatactccccgcatacttagtaaaactactttaccacgcgaaacatatcaatagcgtaggtgagccagcgcataagaattacatcaacgaacattgtagcgaattccaggacctactaaattatattagacaatttgctgacaaatttgtagatgttgacaaaaatctatctaagatacgctcactaagtaaatctatggccgaatacagcgtatctgaaatatgttcaagtttcgtaaatttgttaaccctaactgcgcttggagcaccagcagacttcaaatttttcggaacaacaattccaagaaaaagatatgggagtccacaaagtatactatcagcaaccctcatacaccagagcattaccggtctatacgaaacgcgaatagatttgtcgaaattgggtgaagactga

SEQ ID NO: 8936 - RNA, 4113 nt, synthetic construct
  misc_feature 1..4113: note = Cas9 variant
  source 1..4113: mol_type = other RNA
atgaacaaaccttactctataggactagatataggaactaatagcgttgggtggtcaataatcacagacgattacaaagtaccagctaagaaaatgagagtactaggtaacaccgataaagagtatataaagaaaaatctaataggagctctcttatttgacggaggaaacacagctgcagacagacgactaaaaaggacagcaagaagacgctacacacgacgaagaaaccgaatactgtatctacaagaaatattcgcagaagaaatgtccaaagtagatgactccttctttcatagattagaagactcgtttttggtcgaggaagacaaaagaggatctaaatatccaatatttgccacgatgcaggaagaaaaatattaccatgaaaaatttccaacaatataccacttacgaaaagaactagcagacaagaaagaaaaagcagacctcagactgatctatctcgccctcgcacacataattaaattcagaggccacttcttaatagaagatgacagattcgacgttagaaacacagacattcaaaaacagtaccaagcgtttctagaaatttttgataccacattcgagaacaatgatcttctttctcaaaatgtggatgtggaagccattctaactgacaaaatctctaagtccgcaaagaaagatcgaatactagctagatatccaaaccagaaaagtaccggaatatttgcagaatttctaaaattaatagtagggaaccaagctgattttaagaaacactttaatctagaagataaaacccccttacaattcgcaaaagatagctacgacgaagatttagaaaacctactaggtcaaataggtgatgaatttgcggacctgttctccgctgcaaagaaattgtacgattcggtacttttgagtggtattttaactgtgacagatttatcgactaaagctccactaagtgcctcgatgatacaaagatacgacgaacatagagaagatctaaaacaactaaaacagttcgtaaaagcgtcgctcccggaaaaatatcaagaaattttcgctgattcatcaaaagatggttacgctggctacatagaaggaaaaacaaaccaggaagcattttacaaatatttaagcaaattgctaaccaaacaagaagggtccgaatatctactagagaaaatcaaaaacgaagacttcttacggaaacaacgcactttcgacaacggatctataccgcaccaagtacacctaacagaactgagagccattatacggagacaaagtgaatattacccttttctgaaagaaaacttagatcgaattgaaaagatactaacctttcgaataccatactacgttggccccctcgcacgagaaaaatcagactttgcttggatgacaaggaaaaccgatgattctattagaccttggaattttgaagacttagtggacaaagaaaaatcagcagaagcgtttatccacagaatgactaacaacgacttgtatctaccagaagaaaaagtcctaccaaaacattcactcatatatgaaaaatttactgtttataatgaactcacaaaagtaagattcctagctgaaggttttaaagatttccaattcttaaatcgaaaacaaaaagaaaccatttttaatagtttattcaaagagaaaagaaaagttacagaaaaagatataatctcctttctaaacaaagtagacggatatgaaggaatagcgataaaaggaatagaaaaacaattcaatgcttcattaagcacttaccacgacttaaagaaaatactaggaaaagacttcttagataacacagacaacgaactaatattagaagatatagttcaaacactcacactgtttgaagaccgcgaaatgataagaaaacgactagacatttacaaagactttttcacagaatctcaattaaagaaactatacagaagacattatacaggctggggccgacttagcgctaaacttataaatggaattagaaataaagaaaatcagaaaacaatccttgattatctgatagacgatggatcagcaaatcgtaactttatgcaattaattaaagacgctggactatcattcaaaccaataatagataaagcacgtactggaagccattcagacaatttaaaagaagttgtaggtgaattggctggatcaccagcaataaagaaaggtattcttcaatcactcaaaatagtggacgaattagtaaaagtcatggggtacgaaccagaacaaattgtagtagaaatggcaagagaaaaccaaacaacagcaaaaggcctaagcagactgagacaaaggcttacgactttaagagaaagcctggctaatttaaaatcgaacatcctagaagaaaagaaacctaaatatgtgaaagaccaagtggaaaatcatcatttaagtgatgatcgactctttctttattacctacaaaatggaaaagatatgtatactgatgatgaactggacatagacaacttatcacaatatgatatagaccacattataccacaagcatttataaaagatgactctatcgacaatagagtattagtaagctcagctaaaaacagaggaaaatcagacgatgtcccatcagtagagatagtgaaagactgcaaagtattctggaagaaattactagacgcgaaacttatgtctcaacgcaaatacgacaatctaacaaaagcagaacgcggaggattaaccagcgatgacaaagcgagattcatacaacgtcagttagtagaaacaagacaaataacaaaacacgtggcaagaatattagacgagagattcaacaacgaattagatagtaaaggacgcagaatacgaaaagtgaaaattgtaaccctaaaatccaatcttgtaagtaactttagaaaagagttcggtttctataaaataagagaagtaaacaattaccatcatgcgcacgacgcttatctaaacgcagtggttgctaaagcaatattaaccaaatacccccaactagaacccgagttcgtctacggagactaccctaaatataactcgtataaaactcggaaaagtgcaacagaaaaactattcttttactcaaacataatgaacttctttaaaacaaaagtcacactcgcagatggtacagtggtagtaaaagacgatatcgaagtaaataatgatacaggggaaattgtctgggacaaaaagaaacactttgctacagtcagaaaagtactatcatatccacaagtgaacatcgtaaagaaaactgaaatacaaactggtggttttagtaaagaatcaatcctagcacatggaaattcggataaactaataccacgtaaaactaaagatatttatttagatcctaagaaatacggcggattcgattcaccaatagtagcatacagcgttcttgtggtagcagacataaagaaaggtaaagcacaaaaactcaaaacagtaaccgaattactcggaataaccatcatggaaagatcaagatttgagaaaaatccttctgcatttctagaatccaaaggatacttaaacatacgggatgataaattaatgatattacctaaatatagcctgttcgaactagaaaatggaagaagaagactacttgcctcagcagacgaattacaaaaaggaaacgaattagcattaccaacccaattcatgaaattcctataccttgcatcaagatacaatgaactcaaaggaaagccggaagagatagagcagaaacaagagttcgtagttcaacatgtatcctacttcgacgatatcttacaaataataaatgatttctcaaacagagtaatactagcagacgcaaacttagaaaagataaacaaactatatcaagacaataaagaaaacataccggttgacgaactagcaaacaacatcataaacctatttacatttaccagcctcggggcaccggcagccttcaaattctttgacaaaatcgtagacagaaaaaggtatacaagtactaaagaagtactcaacagcacactaatacaccaaagcataacaggtctgtacgaaacaagaatagacttgggaaaattaggagaagactga

SEQ ID NO: 8937 - RNA, 4113 nt, synthetic construct
  misc_feature 1..4113: note = Cas9 variant
  source 1..4113: mol_type = other RNA
atggagaaaaataaagaatatgttatcgggttagatataggaacaggatctgtagggtggagtgctataagcactgataattatcaacttatacgacaaaaagggaaaaaccttattggtgtacgtcttttcaacagcgcagaaacagcagaagaaagacgaggttaccgcacgacaagacgcagactaagtagaagaagatggagaatgagtctcctcaatgacatatttagaccagaactaaatgaaattgacgaaaattttctagctagattaaaatatagctgggtttcaccactagatcagaaaaatccacaactaaatgaacaaggaacaaatgcaagtttatatggagatatagaagcagaccaagcatttcaccgcgcatacccaacaatataccacttgagaaaaacactgatggaagacaaccaaaaacacgacctacgagaagtatatttagctatacatcatattgtaaaatacagaggacacttcctcacaccagactttgacgcaaactcacaaacaattgatattaaaggcttgtttaaacaattaggtgacgtttccggctccattgaactccaagcagaccaaacaagtactgtaattgcagcatttcaatcaatactattagattttacaaaaaccccaacagaatcaggacgactagcaggtcaactattttccgaccaaaacaaagataaacaagccaagaaacaagttgaagaacttttcaaactactaagaggaggaaaaggctccctagcagacatgttcttactcaccgacctggacaaagtagtcaaaaaccaactcaaatttgcattcgatgacgcagtagatgaaaatcttaacctgatatcaaatttaataaatgaagaacaatatgaattactccttaatatacaaaaactaagaggcacgattattctcaaacaaatattaggtgacgacgaaacagtaagcgatgcgaaagtacgatcatatgaagaacacgcacatcaactaaaagaactaaaagctcaagtactaacaaaagacaacaaagaaaaattcgaagaagcataccaactaattcaaaaaggagacgcaagcaggatagatggccttaagaaactaaaaacaattataaatcaagaacatgaagcacttcgactagacaaatacgaagccgataaattactcaaacttatagaattagatcaactacttccagttcaacgatccaaaagaaatggagaaattccacaccaactacatgaatttgaattgaagaaaataatagaaaaacagggcagatattatcccttcctacgtgagacctttgaaagagatgggcaagaatttaacaaaataggccagttagtgaacttcaggattccatattacgtaggaccacttgtggaccctaggctggctggcatccagtccggtgatcagacaaatcattggatgactcagaagaaagcaggtaaaataacaccatggaactacacagaactaatagatatagataaatctgctgcagagtttataaaaagaatgacaggaacagacacatatcttgtgggagagccatctttacataaagcaagtcttatataccaagattataatgtattacaagaactaaataacttacgatacgacggcaaaccacttcctgtagacgcaaagcaagaaatatacagcaatctgcaggtaagcctcaagaatgcaaccaaaaataagataaattcattcttaatatccgaaggatatctacaggacggagaagaactcacaggatttgctggaaaagaactcaaaaacaaacttagctcatttcattactttaagaatatatttggtccagaaagaatgaatacgctaggcactgataacttagagaaaataacggagctacaaacggttttcgaggacagacatatgctgaaaagacaattacaaaagctgggctttctagacgacgacgaatgcgagaaattagccggaaaacacttcacaggatggggaaacctaagcaagaaactgttaaatacccctgcgataatagatccggaaataaatgaaaacaaaatatcactaatagacgcactctacaaaggtcagagaaacctaagtttttacgtaaataacatggacgacaaataccaattccgcgactggatagaatcagaaaaccagtcacaacaagttgaaataagccttgacgagaaaatcaaaaacttagccggaagcccagccataaaacgcggtataacacaatcaatggcagtaatacaagacattataagggcaaataacggtatttcaccaaaaagaatatatctagaatttgcacgcgaatcccaaaattcctatcaacccaactcaagaatcaaacaaatagagaaaatatatgaccaaaacaagaaagagctcatgaaagtatatcctgacgtttttaaagacgttcagggagtacttaacaacgtagatgaaaacaacagtctatccgaaaaagcattcttatattttatgcaactaggaaaagatatgtacacaggtgaagctctagactttgataaactatacacatatgacatagaccacataataccacaagccatgacaaaagacaactcatgggacaacaaagtattagtcacagctatcaaaaacagggaaaagtcaaatcaggtattagataacgcaatccaagccaaaatgcataatttttggttacaactgaagaaagttaatctattatctcagagaaaatatgataccctgatgaaaaccaacttctccaaaggagatgaaaagaaattcatagcacgatcattagtagagacaaggcaaataatcaaaaatgtcgcggaattgatcaaatctgagtttgatcacgttgaagctatcccgatcagacaggaactcacatcagacatgcgtcaactcatggactataagaaaaatagactcgtaaacgactatcaccacgcacacgacgcccttctaatagcaacagttggagagttcatgcaaaaacgaggatttatgcaaggtatgaatccatcacaaaatgtataccatggatatacacaatacgtcaagaaatggttatctatggccaagaaagccagatcagcagaaaaaccagaaagaatctttccactacagttcgttgtaggtagcatgagaatggcagtaagagatggacaagtagataaagtgacacacccggctactggagaaatatgctggaccgcagacaatgaagcatatcttcgcaaagtattaggatataaaaatatactcgtaacaagaaaagtcaaaaacgcaggtaaactctaccaacgagtaacagtaaaacccaaggggagtggagaagcacccgtaaaccaccaaaaatcagatataaacatttatggtggagtgacatccgagcaggccgcagaattagtattaatccgaataaaagcaaagaataacgctaaaaatatggtaatcaaaatacccaccgcaattgctaatcaagttgcaaacaaaacaactacatatgatgcatacgtgaggagcttaaatataccgaattacgcgggtatcattctggatcaaatacctctaggccaattagtctttgatgaaagaaccagcttttacctggcatcggcagaaataaaacataatgcccgacaattgtgggtcaaccagcacataaataatgtcttaacgaagaaaaatataaacgatgaggaaagggacaatatattaaatttactaacaaatgagaaaaacctagaaagattcaaactcctcgaaccggacctcaaaagggtaaaggcagcaaagcaacaatgggcaagctgtgatgaccaagaacaaatgcaaatactcaggattataattaataaaatgcacgacgacgcaagtcctcaaataccaggaaaaatagatccattcaaaaactacttagacaaacaagggaagggatggagagacctccgaacaaagaaaggtatgaaactttcggataacgctgagttcgtgtatcaatcaccaacaggactttaccacaggaaaatttccattaatgaactactaaaacaaaaacaactagagtga

SEQ ID NO: 8938 - RNA, 4113 nt, synthetic construct
  misc_feature 1..4113: note = Cas9 variant
  source 1..4113: mol_type = other RNA
atgaataaaccttattcaataggcttagatataggtacaaacagtgtcggatggtccattattactgatgattataaagtacccgcaaagaaaatgagagtattaggaaacaccgataaagaatacataaagaaaaatctaataggagccctactattcgatggcggaaatacagcagccgacagacggttaaaaagaacagctcgaagaagatacacaaggagaagaaatcgaatattatacttacaagaaatatttgcagaagagatgagcaaagtagacgattcattcttccaccgattagaagactccttccttgtagaagaagacaaaagaggaagcaaatatccaatattcgcaaccatgcaagaggaaaaatattatcacgagaaatttccaacaatatatcatcttagaaaagaattagctgacaagaaagaaaaagcagacctcagattaatatacttagctttagcacacataatcaaatttagaggacactttctaattgaagatgaccgttttgacgttagaaacacagatattcaaaaacagtaccaagcatttctagaaattttcgacacaactttcgagaataatgacttattatcccaaaacgtagacgttgaagccattttaactgacaaaataagtaaatctgcaaagaaagaccgaatacttgcaagatacccaaaccaaaaatccactgggatctttgccgagttcttaaaactaatagttggaaaccaagccgacttcaagaaacactttaacttagaagataaaacaccgcttcagttcgctaaagattcgtatgatgaagatcttgaaaatctgttaggacagataggagacgagttcgcagatttattttcggcagcaaagaaattatacgactcagttctactctcaggaatcttaacggtaacagacctaagcacaaaagccccattgagcgcgagcatgatacaaagatatgatgaacaccgagaagatctcaaacaattaaaacaatttgtaaaagcctcattaccagaaaaatatcaagaaatatttgcagacagttcaaaagacggctacgcgggatatatagaaggcaaaaccaaccaagaagcattctacaaatacctaagtaaattacttacgaaacaagaaggtagtgaatacctgctagagaaaatcaaaaatgaagatttcttacgcaaacaaagaacattcgacaatggctcaatacctcaccaagtacatcttacagaattaagagcaataattcgacgccaatcagaatactatccctttctgaaagaaaaccttgacagaatagagaaaatactcacattcagaataccatattacgttggccccctagcgcgcgaaaaatccgacttcgcttggatgactagaaaaaccgatgacagtataagaccatggaatttcgaagatctggtagacaaagaaaaatctgctgaagcctttatacacaggatgacaaacaatgacctttacctaccggaagaaaaagtactaccgaaacactctttaatctatgaaaaattcacagtatacaacgaattaaccaaagtacgattcctagcagaaggcttcaaggactttcaattcctaaatcgtaaacaaaaagaaacaatatttaattctttatttaaagagaaaagaaaagtaaccgaaaaagacattatttcattcttaaacaaagtagacggctatgaagggatagcaattaaaggtatcgaaaaacaattcaacgcatcactatcaacttatcacgacctcaagaaaatattaggaaaagacttcttagacaatactgacaacgaacttatcctagaagatatagtacaaactttaactttatttgaagacagagaaatgatacgtaaacgcctagatatttacaaagactttttcactgagtcgcaattaaagaaattataccgacgtcattatactggttggggaagattatcagccaaactaataaatggtatacgaaataaagaaaatcagaaaacaattttggattacctaatagacgatggctcagccaaccgtaatttcatgcaacttataaaagacgcaggcctcagcttcaaacccataatagataaagccagaaccggtagtcacttagataaccttaaagaagttgtcggagaactcgcaggatcccccgcaataaagaaaggcattttacagtcactgaaaatagtagatgaacttgtaaaagtaatgggctacgaacctgaacaaattgtcgtagagatggccagagaaaatcaaactaccgccaaaggattatcaagaagccgccaacgactcaccacacttagagaatccttagcaaacctaaaatcaaacattttagaagagaagaaacccaaatatgtaaaagatcaagtagaaaaccaccacttgtcagacgacagactgtttctatactatctgcaaaacggtaaagacatgtacacggacgatgaacttgacatcgataatctatctcaatatgatatagatcatattataccccaagcgttcatcaaagacgattcgattgacaacagggtacttgtaagctccgccaaaaacagaggaaaaagcgatgatgtaccatcactagaaatagtcaaagactgtaaagtattttggaagaaactacttgatgctaaactcatgagccaacgaaaatatgataatctcacgaaagcagaaagaggcggactaacttcagatgacaaagcacgcttcatccaacgacaattagttgaaacaagacaaatcactaaacacgtcgcccgaatattagatgagagatttaacaatgagttagactcaaaaggtagaagaattagaaaagtaaaaatagtgacgcttaagagcaacctagtaagtaattttcgcaaagagttcggattttacaaaataagagaagttaacaactatcaccatgcacatgacgcctacctaaatgcagtggtagctaaagcaatcctaaccaaatatccacaactagaaccagagttcgtatacggagattacccaaaatataactcctacaaaacaagaaaaagtgcaactgaaaaactattcttttattcaaacataatgaactttttcaaaaccaaagtaacactagccgatgggacagtggtagtcaaggacgatattgaagtcaataatgatacaggagaaatcgtctgggataaaaagaaacatttcgccactgtccgtaaagtattatcttacccccaagtaaatatagtgaagaaaacagaagtacaaaccggaggtttcagcaaagaatcaatactagctcacggaaacagcgacaaactcatacctagaaaaacaaaagacatttaccttgacccgaagaaatatggtggatttgactcacccatagtagcttattcagtgctagtagtagctgacatcaagaaaggaaaagcgcaaaaactcaaaacagtaacagaactactcggtatcacaataatggaaagatcacgtttcgagaaaaatccttctgctttcttggaatctaaagggtacttaaatattcgaacggataaactaattatactacctaaatattccctattcgaactcgaaaacggaagacggagattattagcctcagcgggtgaactacaaaaaggcaacgaattggcgttacctacacagtacatgaaatttctatatttagcaagcagatataacgaactaaaaggcaaacctgaagaaatcgaacaaaaacaggagttcgtagttcaacacgtttcatactttgacgacatattacaaatcattaatgacttttcaaacagagtaatcttggctgatgcaaacctagagaaaattaacaaactataccaagacaataaagaaaatataccggtggacgaattagccaataacataattaatctttttacattcaccagcttgggcgcaccagctgcattcaaattctttgacaaaatcgtagatcgaaaaagatacacgtcaaccaaagaagtacttaacagcaccctcatccatcaaagtatcacaggattatatgaaaccaggatagatttaggcaaattaggcgaaggatga

SEQ ID NO: 8939 - RNA, 4113 nt, synthetic construct
  misc_feature 1..4113: note = Cas9 variant
  source 1..4113: mol_type = other RNA
atgaacaaaccttattcaataggcttggacataggtacaaactccgttggttggtccataataacagacgactacaaagtaccagcaaagaaaatgcgagtactaggtaacacagataaagaatatattaagaaaaatcttataggtgctctcctgttcgacggaggaaatacagcagctgatcgtagactaaaacgaacagcaagacgacgttacacacgacgaagaaaccggattctatatcttcaagaaattttcgccgaagaaatgtcaaaagttgatgatagtttctttcatcgactcgaagactcatttcttgtagaagaagacaaacgaggaagtaaatacccaatatttgcaacactccaagaagaaaaagactaccatgaaaaattctccacaatatatcacttaagaaaagaattagccgataaaaaggaaaaagcagatttaagactgatctacatagcactggcacatattataaaattcagaggacactttttaatagaagatgattcattcgacgtaagaaacactgatatatcgaaacaataccaagactttctagaaatatttaacacaactttcgaaaacaacgatttactcagtcaaaacgtcgatgttgaagcaatattaacagataaaatatcaaaatctgccaagaaagaccgaatattagcgcaataccctaaccaaaaatcgaccggaatcttcgcagaatttttaaaactgatagttggcaatcaagccgactttaagaaatactttaacttagaagataaaactcctttgcaattcgcaaaagatagttatgatgaagacttagaaaacttactcgggcaaataggagatgaatttgctgacctattttcggcggccaagaaactatatgattcagtcctcctaagcggtatattgaccgtaatagatctcagtaccaaagcaccattatcggcttctatgatacaaagatacgacgaacatagagaagacctcaaacaacttaaacaattcgttaaagcatcgctaccagaaaaatatcaagaaatattcgcagacagttcgaaagacggttacgcaggatatatagaagggaaaacaaaccaagaagcattttacaaataccttagtaaactattaactaaacaagaagattcagaaaactttttagagaaaatcaaaaacgaagactttctcagaaaacaacgtacattcgataatggatcaataccacaccaagtccatcttacagagttaaaagccatcatccgacggcaaagcgaatactaccccttcctaaaagaaaatcaggaccgaatagagaaaatactaacatttcgaataccatattatattggcccactcgcgagagaaaaatctgattttgcctggatgacaagaaaaacagacgactcaataagaccctggaatttcgaagatctcgtggataaagaaaaatcggcggaagcctttatacatagaatgacaaacaacgatttctatctaccggaagaaaaagtattacctaaacattctttaatatacgaaaaatttacagtatacaatgaacttacaaaagttagatataaaaatgaacagggagaaacgtactttttcgatagcaatataaaacaagagattttcgacggagtttttaaagaacatagaaaagttagtaagaagaaattattagattttctagccaaagaatatgaagagttcagaatcgtcgacgtaataggactcgacaaagaaaataaagcctttaacgcctcattaggcacataccatgatcttgagaaaatattagacaaagactttttagacaaccccgacaacgaatcaatattagaggatatcgtacaaaccttaacactttttgaagaccgagagatgatcaagaaaagactagaaaactataaagatctattcaccgagtcacaacttaagaaactctatagaagacactatactggctggggtagattatcagcaaaacttataaatggaattagagataaagaatctcagaaaacaatactcgattatctaatagacgacggaagatcgaacagaaactttatgcagctgataaatgatgacggactaagtttcaaaagtatcatttccaaagcacaagcaggcagtcattcagataatttaaaagaggtggtaggagaactagcaggatcaccagcaatcaagaaaggcatcttacaaagcctaaaaattgtggatgaattagtaaaagttatgggatacgaacccgaacaaatagtagtagaaatggctcgagaaaatcagacaactaatcagggcaggcgaaattcacgacaacgttacaaactcctcgatgatggagtcaaaaatttagccagcgacttaaatggaaatatcttaaaagaatatcctacagacaatcaagcccttcaaaacgaacgactctttctatattatctacaaaacggaagagacatgtatacaggagaagcattagacatcgatgacttatcacaatatgatatagaccacatcataccgcaggccttcataaaagatgatagcatcgacaatcgtgtcctcgttagcagcgccaaaaaccgcggtaaatcagacgacgtaccctcgctagaaatagtcaaagattgtaaagtcttctggaagaaattactagacgcaaaacttatgtcacaacgaaaatacgacaatctgacaaaagcagaaagaggaggcttgactagcgacgataaagcaaggttcatccaaagacagcttgtagaaacacgacagataacaaaacatgtagcacgcatccttgatgaacgcttcaataacgagctagatagcaaaggacgacgaattaggaaagtaaaaatcgtcactctgaaaagtaatttagtttctaattttagaaaagaatttggtttctataaaataagagaagttaacaattaccatcacgcacacgacgcctatctcaatgcagtagttgctaaagccattttaaccaaatacccacaattagagcccgaatttgtgtatggagattacccaaaatataattcctacaaaacaagaaaaagcgcaacagaaaaattattcttttattcaaatattatgaatttcttcaaaacaaaagttaccctcgcagacggaacagtcgttgtaaaagacgacatcgaagtaaacaatgacacaggagaaatcgtatgggacaagaagaaacactttgcaactgtcagaaaagtattaagttacccgcaaaacaacatcgtaaagaaaacagaaatacaaacgggtggatttagcaaagaatctatcctagcacacgggaacagcgacaaactaatccctagaaaaacaaaagatatttacctggaccccaagaaatatggcggcttcgactccccaatagtagcctatagtgtacttgtagtggcagacattaagaaaggaaaagcccaaaaactcaaaacagtaacagaattactaggcataaccatcatggaaagatccagattcgagaaaaatccttcggcattcctagaatcaaaggggtaccttaacattagagcagataaattaataatactaccaaaatattcactattcgaactagaaaatggacgtagacgcctgctagcctcagccggagaactacaaaaaggaaatgaattagctctaccaacacaattcatgaaatttctatacctagcctccagatacaatgaatcgaaaggcaaaccagaagaaatagagaagaaacaagagttcgtaaaccaacatgtatcatatttcgatgacatattacaactaattaacgacttctccaaacgtgtaatcttagctgacgctaacctagagaaaattaacaaactctaccaggacaacaaagaaaatataagtgtagatgaactagcaaataatatcatcaatctctttacgtttacaagtctcggcgcacccgcagcattcaaatttttcgacaaaatcgtggaccgaaaaagatatacaagcaccaaagaggttctcaacagcacactgattcatcaatcaataacaggcctatacgaaaccaggatagatctaggcaaacttggagaagattga

SEQ ID NO: 8940 - RNA, 4113 nt, synthetic construct
  misc_feature 1..4113: note = Cas9 variant
  source 1..4113: mol_type = other RNA
atgaacaaaccatatagtattggcttagacatcggaactaattcagttggatggagcataatcactgatgattacaaggtacctgccaagaaaatgcgggtattaggaaacacagataaagaatacattaagaaaaatctaataggagcattattattcgacggtggaaacactgcagctgacaggagattaaaaaggacagcaaggagacgctacacccggcgacgaaaccgaatactttatctacaagaaatattcgccgaagaaatgagcaaagtagacgacagcttcttccacagactcgaagactcctttcttgtagaagaagacaaacgaggttcaaaatacccaatttttgcaaccctgcaagaagaaaaagactatcacgaaaaattcagcactatataccatctgagaaaagaactcgcagataagaaagaaagagccgatctaagattgatttatatagcattagcacatataatcaaatttcgcggacatttcttgatagaagatgacagttttgatgttagaaacacagatatatcaaaacaatatcaagattttctggaaatattcaatacaacatttgaaaacaacgatctactatcacaaaacgtggatgtagaagctatactaacagacaaaatatcaaaaagtgcaaagaaagacagaatattagcacaatacccaaatcaaaaatcaacgggcatattcgcagagttcttgaaattaattgtaggaaaccaagcagatttcaagaaatactttaacctcgaagacaaaactccattacaatttgctaaagattcctacgacgaagacttagaaaacctactaggtcagataggggacgagttcgcagacctatttagtgcggctaagaaattgtatgattctgtcctcctatctggtatcctgacggtaatagacctttccacgaaagctccactctcagcatcaatgatacaaagatatgacgaacaccgcgaagatctaaaacaactgaaacaatttgtcaaagcctcactaccagaaaaatatcaagaaatcttcgcggactcatcaaaagacggatatgctggctacattgaaggtaaaacaaaccaagaagcattctacaaatatctttcaaaactcctaaccaaacaagaagattccgaaaactttctggagaaaataaagaacgaagactttttaagaaaacaaagaacattcgataatggatccatacctcatcaagtacacctcactgaactcaaagcaatcatccgccgtcagtcagaatattacccatttttaaaagaaaatcaagatagaatagaaaagatactcacatttagaatcccttattacattggtccccttgctcgagagaaaagcgactttgcatggatgacaagaaaaacagatgactccatacgaccatggaattttgaagatctagtagataaagaaaaatctgcggaagcattcatccatcgaatgaccaataatgacttttatttacctgaagaaaaagttctgccaaaacacagcctaatatacgaaaaattcaccgtgtacaacgaactaaccaaagtacgttacaaaaacgaacaaggagaaacatacttcttcgactcaaacatcaaacaagaaatatttgatggggtattcaaagaacacagaaaagtatcaaagaaaaagttgctagattttcttgctaaagaatacgaagagttcagaatagtagatgtcatcggactcgacaaagaaaataaagcatttaatgcgtcactaggaacctatcatgacttagagaaaattcttgacaaagatttcctcgataacccagacaacgaatcaattcttgaagatatcgttcaaaccctaacattattcgaagatagagaaatgataaagaaaaggcttgaaaactataaagacctattcaccgaatcacaattaaagaaactctacagaagacactatacgggatggggaagactctcagctaaactgatcaacggtataagagacaaagaatcacagaaaacaatccttgactatttaatagatgatgggagatcaaatagaaattttatgcaactaataaacgacgatggactttcattcaaatcaataatatctaaagctcaagcaggaagccactctgacaacctcaaagaagtagtcggagaattagcaggctcaccagcaatcaagaaaggtattttacaatcactcaaaatcgttgacgagctagttaaggtaatgggctacgaacccgaacaaatagtagtagaaatggcaagagaaaaccaaactacaaatcaaggaagaaggaactcaaggcaaagatacaaactattagacgatggcgtgaaaaatctcgcaagcgatctaaatggaaacatactaaaagaatacccaacagacaaccaagccttacaaaacgaaagattattcttatactatctacaaaatggacgcgacatgtacacaggagaagcattagacatagatgatctttctcaatatgatatagaccatattattccccaagccttcattaaagacgattctatcgacaatagggtacttgtatcctcagcgaaaaatagaggaaaaagcgatgatgtaccatccctagaaatagtcaaagactgtaaagtattctggaaaaagctactggacgcaaaactcatgtcgcaaaggaaatacgataacctcactaaagccgaaagaggaggtttaacaagtgatgacaaagcccgattcattcaaagacaacttgtcgaaacaaggcaaattacaaaacacgtcgctcggattttagatgaaagattcaataatgaactagattctaaaggaagaagaataagaaaagttaagatagtaacattaaaatctaacttagtcagtaactttagaaaagaatttggcttttataaaattcgagaagttaataattaccatcatgcacacgatgcatacctaaacgctgtagtagccaaagcaatactaacaaaatatccgcaattagaaccagagttcgtttatggtgactacccaaaatataacagctataaaacaagaaaaagcgcaactgaaaaacttttcttttatagcaatataatgaacttctttaaaaccaaagtaacattggcagacggaacagttgtggtcaaggatgatatagaagtaaacaacgatactggcgaaatagtttgggacaaaaagaaacatttcgcaactgtacgcaaagtactgtcataccctcaaaataacatagtcaagaaaaccgaaatacaaacaggaggcttttcaaaagaatcaatccttgcccacggaaattccgacaaattaataccgcgaaaaacaaaagacatatacttggacccgaagaaatatggaggcttcgatagtcctatagttgcttattcagttctagtggttgcagatataaagaaaggcaaagcacagaaattaaaaaccgtaaccgaactattgggtataaccataatggaaagatctcgattcgagaaaaacccttcagcgttcttagaatcaaaaggatatttaaatattagagcagacaaactaataatactaccaaaatactcactatttgaactcgaaaacggacgaaggcgacttctggcatcagcaggagaactacaaaaaggaaacgagctcgcactacccacgcaatttatgaagttcctatacttggcatctcgttacaatgaaagcaaagggaaacccgaagaaatagaaaagaagcaggaatttgtaaaccaacatgtaagctattttgacgacatattacaactaataaatgacttctcaaaaagagtgatactggctgatgccaacctggagaaaataaataaattgtaccaagataataaagaaaacatctctgtcgacgaattggctaacaatataataaatctattcacatttacctcactgggtgcacccgctgctttcaaattctttgataaaatagtcgatcggaagagatacacctccaccaaagaagtattaaactcaacattaatacaccagtcaattactggcttgtacgaaacaagaatagaccttggaaagttaggcgaggattga

SEQ ID NO: 8941 - RNA, 4113 nt, synthetic construct
  misc_feature 1..4113: note = Cas9 variant
  source 1..4113: mol_type = other RNA
atgaataaaccgtatagtataggacttgatataggtacaaactccgtaggctggtccattataacagatgactataaagtaccagcaaagaaaatgagagtactgggaaacaccgacaaagaatacatcaagaaaaaccttataggagcactactgttcgacggaggtaatactgcatcagaccgaaggttaaaacgaacagcccgacgaagatacacgagaagaagaaataggattctatacctacaagagatatttgcagaagaaatgagtaaagttgatgacagctttttccacagattagaagactccttcctcgttgaagacgacaaaagaggtagtaaatacccaatattcgcaacaatgcaagaagaaaaagactatcatgaaaaattcccaacaatatatcatttgcgtaaagaactagcagacaagaaagaaaaagctgacttgcgtcttttctatttggctcttgctcatataataaaatttcgaggacatttcctcatagaagatgatagtttcgacgtcagaaacacggacattcaaagacaatatcaggctttcctagaaattttcgacacgacgtttgaaaataaccatctgctttcacaaaacatagacgtcgaaggtatattaacagataaaatctcaaaatctgctaagaaagatagaatactagcccaatatcccaaccaaaaatcaactggcatattcgcagagttcctcaaacttatcgtcggtaaccaagcagactttaagaaacacttcaacttagaagacaaaaccccactccaatttgcaaaagattcctatgatgaagatctagaaaatttactaggacaaatcggcgacgaatttgccgacctcttttccgtagcaaagaaattatacgactcagttttactatcgggcatcctaaccgtaaccgatctatcaaccaaagctccactgagtgcttcaatgatccaaagatatgatgaacaccgagaagatctaaaacagttaaaacaattcgtcaaagcatcgttacccgaaaaatatcaagaaatatttacggatagtagtaaagacggatatgcaggttacatagaaggaaaaacgaaccaaggcgcattctacaaatacttaagtaaactactaacgaaacaagaagggtcagaatactttctagagaaaattaaaaacgaagatttcctacgaaaacaaagaacattcgataacggatcaataccccaccaagtacacttaacagaattaaaagctataatacgcagacaatccgaatattatccatttcttaaagaaaatctagatagaatagagaaaatactaacatttcggattccttactatgtaggcccgctggcaagagaaaaatcagatttcgcgtggatgactagaaaaacggatgatagtatcaggccctggaatttcgaagaattagtagacaaagaagcaagcgcagaagcgttcatccacagaatgaccaacaacgatctatatctaccagaagaaaaagtactgccgaaacatagcctcatatatgaaaaattcacggtctacaacgaattaaccaaagtcagatacaaaaacgaacaaggtgaaacatacttcttcgactcaaacataaaacaagaaatattcgacggagtctttaaagaacatcgaaaagttagtaaaaagaaacttctagacttcttagcaaaagaatatgaagaatttagaatagttgacgtaataggattggacaaagaaaataaagcattcaatgcatcccttggaacataccatgatctaaagaaaatacttgataaagactttcttgacaatccagataacgaaagcatactggaagacatagttcaaacattaactctcttcgaagacagagagatgattaagaaacgacttgaaaactacaaagacttatttactgaatctcaactcaagaaactatatagaagacactatacgggttggggacgcctttcggccaaactaataaacgggatcagggataaagaatctcagaaaacaatccttgactacttaatcgacgacggaaaatcaaacagaaacttcatgcaattaatccacgacgatggattatcttttaaatcaataatatcaaaagcacaagctggatcccattccgataacctcaaagaagtcgtaggggaacttgcaggatcgccagcaatcaagaaagggatactacaatctctaaaaatcgtagatgaattagtaaaagttatgggatatgagcccgaacaaattgtggtcgagatggcgcgagagaatcaaacaacaaatcaaggaagacgaaacagtagacaaagatataaattactagatgatggagttaaaaatctagccagtgacttaaatggaaatatactaaaagaatatccaactgataatcaagcactacaaaacgaaagactattcctatattaccttcaaaacggacgcgacatgtataccggaaaagcactagacatagacaacctaagtcaatatgatatagaccatattataccacaagcctttataaaagatgattcaattgacaacagagtccttgtatcaagcgccaaaaacagaggaaaaagtgatgacgtaccttcacttgaaatcgttaaagattgtaaagtcttttggaagaaactattagatgcaaaattgatgtcacaacgaaaatatgacaatctaacaaaagctgaaagaggaggattaacaagtgatgacaaagcacgttttatacaaaggcaattagtagaaaccagacaaattacaaaacatgtcgctagaatactagacgaacgattcaataacgaattagatagcaaaggccgtagaatcagaaaggtaaaaattgtaacactaaaaagcaatcttgtctcaaatttcagaaaagagttcggtttttataaaataagagaagtaaacaactatcaccacgcacacgacgcttacctaaatgccgtcgtcgcgaaagctatattaaccaaatacccccaactagaacccgagttcgtctatggcgactatcctaaatataatagttataaaaccagaaaaagtgcaacagaaaagctatttttctactcaaatataatgaactttttcaaaacaaaagtaacactagctgatgggactgtggtcgtaaaagatgacatagaagtaaataatgataccggagaaatcgtatgggacaagaagaaacacttcgctacggtacgaaaagtcctatcttaccctcaagtgaacattgtcaagaaaacggaaattcaaacaggtggtttctcaaaagaatcaatactcgcacatggaaattcagacaaactaataccccgaaaaaccaaagacatatacctagatcctaaaaagtacggcggatttgatagccctattgtcgcatatagcgtattagtagtagcagatatcaagaaaggtaaagcccaaaaactaaaaactgtaacagaattattaggaatcacaataatggaaagaagtagattcgagaaaaacccctcagctttcctcgaatccaaaggatacctcaacattcgagacgacaaattaatgatattacctaaatattccctatttgaattagaaaatggaagaagaagactactcgcaagtgctggagaattacaaaaaggaaatgaattagcattacccacccagttcatgaaatttctatatctagccagcagatacaacgaattaaagggaaaacccgaagaaatagaacagaaacaagaatttgtagtacaacacgtttcatactttgatgacatccttcaaataattaacgatttcagtaatcgcgttatacttgcagacgcaaacctagagaaaattaataaactttaccaagacaataaggagaatatatccgtggacgaattagcaaataacataataaatctatttacttttacaagcctgggagctcccgcagcattcaaatttttcgacaaaattgtagatcgaaagagatacacaagcacaaaagaagtattaaactcaacacttatacaccaaagcataacgggtttgtacgaaacgagaatagacctaggaaaacttggggaagactga

SEQ ID NO: 8942 - RNA, 4113 nt, synthetic construct
  misc_feature 1..4113: note = Cas9 variant
  source 1..4113: mol_type = other RNA
atgaataaaccttactctatcgggcttgacattggaacaaattcagtaggatggagtatcatcactgacgactataaagtacctgctaagaaaatgcgagtactaggaaacaccgataaagaatatataaagaaaaacctaatcggcgcactcttatttgatggaggaaacacggctgccgacagaagactaaaaaggacagcaagaagacgttacacccgtagaagaaatagaatactctacctccaagaaatattcgcggaagaaatgagtaaagtagatgactctttcttccataggttagaagactcattcctagtcgaagaagataaaaggggctcaaaataccctatttttgcgacaatgcaggaagaaaaatattaccacgaaaaatttccgactatctatcatctgcgaaaagaacttgcagacaagaaagaaaaagctgacctcagactgatttatcttgctctagcacacataataaaatttagaggccacttcctcatcgaagacgacagattcgacgtcagaaacacagatatccaaaaacaataccaagcatttttagaaatatttgacacaacattcgaaaataatgatctactaagtcaaaacgtagacgtcgaagcgattctaactgataaaataagcaaatctgcaaagaaagataggatacttgccagatatccaaatcaaaaatcaacaggtatatttgcggaatttctaaaattaatagtagggaaccaggcagatttcaagaaacattttaatttagaagataaaaccccgttgcaatttgcgaaagatagttatgacgaagatctagaaaatcttttaggtcaaataggagatgagttcgcagatttatttagcgctgcaaagaaactatatgatagtgtgctattatccggaatattaaccgtaacagatctaagcacaaaagcccctcttagcgcaagcatgatacagcactacgatgaacacagagaagatttaaaacaactcaaacaatttgtaaaagcatccctccccgaaaaatatcaagaaatatttgcagactcatcaaaagatggttatgcaggttatattgaaggtaaaactaatcaggaagcattctataaatacctctcaaaactactaactaaacaggaaggatcagaatacttgcttgagaaaataaagaacgaagacttcctaagaaaacagcggacgtttgataatggttccatccctcaccaagtacatttaactgaactccgagctataataagacgacaatctgagtattatccattcttaaaagaaaatctagatcgaatagagaaaatcttaacattcagaataccttactacgtgggccccctagcacgagaaaaatctgatttcgcctggatgacaagaaaaacagacgacagtattagaccatggaattttgaagaccttgtcgacaaagaaaaatctgcagaagcctttatacacaggatgacaaacaacgacctgtacctcccagaagaaaaagtactacctaaacactctctaatatatgaaaaattcaccgtgtataacgaactaacaaaagtacgattcttagccgaaggatttaaagacttccagtttctcaatcgaaaacaaaaagaaaccatatttaactcgctgtttaaagaaaaacgcaaagtaacagaaaaagacataatttcattcctaaataaagtagatggttacgaaggcatagcaataaaaggaatcgaaaaacaattcaatgcaagtctatcaacgtatcacgacttaaagaaaatattaggaaaagacttcctcgataatacagataatgagttaatcctcgaagacatcgtccaaacccttacactatttgaagaccgcgaaatgataagaaaaagactagacatttacaaagatttcttcacagaatctcaactaaagaaattgtacagaaggcactatactggctggggtaggcttagcgctaaactaattaacggcataagaaataaagaaaaccagaaaacaatccttgactacttaatagacgacggatccgcaaacagaaacttcatgcaactaatcaaagatgctggtctgagttttaaaccaataatcgacaaagcaagaaccggatctcacagcgacaatttgaaagaagtcgtcggcgaactagcagggtcacccgccatcaagaaaggaatcttacaaagcctaaaaatagttgatgaattagtaaaagtcatgggatatgaaccagagcaaatagtggtagaaatggctcgagaaaatcaaactacggcaaaaggcctaagtagatcacgacaaagactaacaaccttaagagagtccttagccaacctaaaaagtaatatcttagaagaaaagaaaccaaaatatgtaaaagatcaagtagaaaaccaccacctctcagacgatcgccttttcctatattaccttcaaaatggcaaagatatgtacacagacgatgaactggacattgacaatctcagccaatatgacatagatcacatcattccacaagcatttatcaaagatgattccatagataatcgagtcctagtctcaagcgctaaaaatcgtggtaaatcagacgacgtaccctccgtagagattgtcaaagactgtaaagtattctggaagaaactcctcgatgccaaattaatgtcacaaaggaaatacgacaacctcacaaaagctgaaagaggtggccttacatccgacgacaaagccaggttcatccaaagacaactcgtagaaacacgtcaaattaccaaacacgtagcgaggatactggacgaaagattcaacaacgaactcgattcaaaaggaagacgtataagaaaagttaaaatagtcactttgaaatcaaatcttgtctcaaactttagaaaagagttcggtttttataaaataagagaagtgaacaactatcatcacgcacatgacgcttatttaaatgcagtagtagctaaagcaatcttaacaaaatacccacaactagaacctgagttcgtatacggggactatccaaaatacaactcctataaaacccgaaaaagcgcgacagaaaaactattcttttactccaatatcatgaacttctttaaaacaaaagtaaccctagctgacggcacagtagttgtaaaagacgacatcgaagtaaacaatgacacaggcgaaatagtctgggacaagaagaaacattttgcaacagtaagaaaagttctatcatacccccaagtaaacatagttaagaaaacggagattcaaacaggaggattttcaaaagaatcaatcctagcccatggaaactccgataaactcatacctagaaaaaccaaagatatctacttagatccaaagaaatatggaggttttgattcacctattgtagcatactcagtactggttgttgccgacattaagaaaggcaaagcccaaaaactaaaaacagtaacagaattattaggaataacaatcatggaacgatcgagatttgagaaaaatccatcagcattcctagaaagtaaaggatacttgaatatccgagatgataaattgatgatacttcctaaatatagcttattcgaattagaaaacggcagaagacggctactagctagtgcgggtgaacttcaaaaaggaaacgaactggcactacctacacagtttatgaaatttctctacctagcaagtcgatacaatgaattaaaaggcaaaccagaagaaattgaacaaaaacaggaatttgtggttcaacacgtatcgtatttcgatgacatactacaaattattaatgacttctcaaatcgagtaatactcgcagacgctaacctagagaaaatcaataaactttatcaagacaacaaagaaaacatacccgtagacgaattagctaacaacataataaatctcttcactttcacgtcattaggagcgcccgcagcatttaaattctttgataaaatagtagatcgaaaaagatatacctccacgaaagaagtactaaatagcacactcatacatcagagtatcactgggctatatgaaacgagaatagacttaggtaaattaggagaagactga

SEQ ID NO: 8943 - RNA, 4116 nt, synthetic construct
  misc_feature 1..4116: note = Cas9 variant
  source 1..4116: mol_type = other RNA
atgaaagtaaacaactatcatataggattggatataggaactagtagtattggttgggttgcgataggagaggatggaaaacccttaagaataaaaggcaaaacagccataggcgctcgacttttccaagaaggcaatcccgcagccgaccgacgcatgtttagaacaacccggaggaggctatcgcgacgtaaatggagattaaaactcctggaagaaatcttcgacccatacataaccccagtagactctactttttttgcaagactgaaacaatcaaacttgagtcctaaagactcaagaaaagaatttaaaggttctatgcttttccccgaccttaccgacatgcaatatcacaaagactacccaactatctatcatttacgccacgcgctcatgactcaagacgaaaaattcgatatacgaatggtctacctagctatacatcatatagtaaaatatagaggaaattttctaaatagtactcctgtagattctttcaaagccagtaaagtaaattttgtagaccaattcaaaaaactcaatgaactatacacagctattaaccccgaagaatcattccaaataaacttagcgaactccgaagatataggacatcaattcctagatccgtcaattagaaaatttgataaaaaaaaacagatacctaaaattgtacctgtcagcgtagatgataaagcaacagacaagataaacggaaaaatagcgtctgaaatcataaatgccatactaggctacaaatctaaactagacgttgtagtacaatgtacacccgtagactcaaaatcttgggcactaaaatttgacgaagaagacattgatgccaaactgcaaaaaatactgccagaaatggatgaaaatcaacaaagcataatagcgattctacaaaatctatatagtcaagttactctaaaccaaatcgtgcccaacggaatgtcattatctgaatccatgatagaaaaatataacgatcatcacgaccacctaaagttatacaaaaaaattatcgaccaattagctgacccgaagaaaaaagctgcactaaaaaaagcctacagccaatacgtaggtgacgatggaaaagtgatcgaacaggctgacttttggtcatcagttaaaaaaaatctagatgacagtgacctatcaaaacaaattatggacctcattgacgcagaaaaatttatgccaaaacaaagaacatcccaaaatggtgttataccccaccaattacatcagcgagaacttgacgaaataatagaacaccaatccaaatactatccctggctcgcagaaatcaacccaaataaacatgacttacaccttgcaaagtataaaattgaagaactagtagcttttagagttccttattatgtcgggccaatgataacccctgacgatcaggcaaaatcagccgaaacagtctttagttggatggaaagaaaagggaaagaggccggacaaataacaccttggaactttgatgaaaaagtagatagaaatgccagtgcgaaccgctttataaaacgaatgactacaaaagatacttacttaattggtgaagatgtacttccagacgaaagcttactttatgaaaaattcaaagttcttaatgagctgaacatggttagagtcaatggaaaattattgaaagtcgcagataaacaagcaatattccaagatttattcgagaattataaacatatatctgtaaaaaaacttcaaaactacataaaaagtaaaacaggcctcccatcggatcccgaaatatcgggcctaagtgatcctgaatacttcaataactccttaggtacctacaatgatttcaaaaaactattcgggaacaaggtcgatgaacccgacctacaagacgactttgaaaaaatagtcgagtggtcaaccgtatttgaggataaaagaatactcagggaaaaactcaacgaaattacttggctatcagatcaacagaaagacgtattagagagcagtagataccaaggatggggaagactatccaaaaaattactaacaggtatcgtaaatgaccaaggcgaacgaataatagacgaactatggaacactaacaaaaactttatgcaaatacaatctgacaatgatttcgccaaacgtatacacgaagcaaacgcagaccaaatgaaagcagtagacgttgaagacgttctcgccgatgcctacacctcgccacaaaacaaaaaagctattcgacaggtagtcaaagtagttgatgacatacaaaaagcaatgggaggggtagccccaaaatatataagtatagaatttacaagatcagaagaccgaaaccctagaagaacaatatcaagacaacgacaattagaaaatactctcaaagatacggcaaagagcctggcaaaaagcataaacccagaactattaagtgaactggataacgctgctaaatcaaaaaaaggcttaaccgatagactatacttatacttcacacaactcggtaaagacatctacacgggaaaaccaataaacatcgacgagattagtacatacgacatcgatcatatactcccccaagctttcgttaaagacgattctcttaataatcgagtcttggtctccaaagcaataaacaacggaaaatcggacaatgtaccggtacaactatttggagctaaaatgggccatttctggaaacagctagctgaagccggattaatatcaaaacgcaaactaaaaaacttacaaacagacccagacaccatatcaaaatacgcaatgcatgggtttataagacgacagctagtcgaaacctctcaagtaataaagctggtagctaacatcctaggtgacaaatatagaaatgataacacaaaaatcatagaaataacagcaagaatgaaccaccaaatgagagacgaattcggattcatcaaaaatagggaaattaatgattaccaccatgcgtttgatgcttacctaacagccttcttaggccgatacctttaccatcgatacataaaattacgaccatactttgtttatggagacttcaaaaaatttaaagaagacaaagtaacaatgaggaacttcaatttcctacacgatctaaccgatgatacacaagagaaaattgcagatgcagaaaccggcgaagtaatatgggatcgcgaaaatagcatccaacaactaaaagacgtataccactacaagtttatgttaatctcccatgaagtatacacactaagaggggcaatgttcaatcaaaccgtgtaccccgcatccgacgctgggaagagaaaactcatccctatcaaagcagaccgaccaatcaacgtatatggcggctattcaggcagtgccgacgcttacatggccatagtgagaatacataacaaaaagggcgataaatatcgcgtagtaggagtaccaatgagggcaagagacagactcgacgcagcgaaaaaagtgtctgacgccgactgcgatcgcgctcttaaagatgtattaacaccccaattaaccaagacaaagaaaagcagaaaaacaggggagattacacaggtggtggaagatttcgaaatagtcttaggaaaagtaatgtatcgacaacttatgatagacggagacaaaaaattcatgctaggaagctccacttatcaatacaatgcaaaacaattagtattatcagatcagtctgttaaaactttagcatctaaaggtcgactagacccactccaagaatcaatggactacaacaatgtatatacagaaatattagataaagtcaaccaatatttctccttatatgatatgaacaagttccgtcacaaactcaatctaggattttctaaatttataagtttcccaaaccataacgtcttcgatggaaatacaaaagcaagtagtggcaaacgtgaaatacttgaagaagtattaaatggcctccacgcaaaccccacatttggcaatctaaaagacattggaataacaacaccattcggacaattacaacaacctaacggtattcttttatcagacgaagccaaaataagatatcaatcacctacaggattattcgaacgtactgtgagtttaaaagacttatga

SEQ ID NO: 8944 - RNA, 4116 nt, synthetic construct
  misc_feature 1..4116: note = Cas9 variant
  source 1..4116: mol_type = other RNA
atggataaaaagtattcaataggtctagatatcggaactaattcagtcggttgggctgtaatcactgacgactacaaagtaccgagcaagaaatttaaagtactgggtaatacagatcgacactcaataaagaaaaatttaataggcgcattgctttttgattctggagaaacagcagaagcaacacgattgaaacgaactgccagaaggaggtataccagaagaaagaaccgaatccgatacttacaagaaatcttcagttcagaaatgtccaaagtagatgacagtttcttccaccgactagaagaatctttcttagttgaagaagataagaaacacgaacgacatccgatatttggaaatatagtcgatgaagttgcctaccatgaaaaatatccaactatatatcacctcagaaagaaattagccgactctaccgataaagcagaccttagactcatatacttagccctcgctcacatgattaaatttcggggacacttcctcattgagggagacctcaatcccgataactcagatatggacaaactatttatacaactcgttcaaacttacaaccaattattcgaagaaaacccaataaacgcaagtcgcgtggatgcaaaagcaatactatcagctagactatcaaaaagtcgacgattagaaaacttaatagcacaactcccaggagagaaacgaaacggactattcggaaatctgatagctctatcactaggcctaactccaaacttcaaatcaaattttgacttagcggaagatgcaaaactacaacttagtaaagacacatacgatgatgatctcgataacttattagcacaaatcggagaccaatatgcagacctatttttagcagccaaaaacttgtcagacgcaatactattgagtgacatcttaagagtaaacagtgaaataacaaaagcaccattatcagcctccatgatcaaaagatatgacgaacatcatcaagacctaacactattaaaagcattagttcgtcaacaattgcctgaaaaatacaaagaaatattcttcgaccaaagcaaaaacggttatgcaggatacatcgacggcggggcctcacaagaagaattttacaaatttataaaaccaatacttgagaaaatggatggaacggaagaattgctggcaaaactaaacagagaagatctactacgaaaacaacgaacattcgacaacggttcaatccctcaccaaatacacctaggagaactacatgcaattttacgaagacaagaagacttctatcccttcctaaaggacaaccgagagaaaatagagaaaattttaactttccgaataccttattacgtcggtccattagcaagaggcaacagccgattcgcatggatgacccgaaaaagtgaagaaactattacaccatggaacttcgaagaagtagtagacaaaggtgcaagtgcacaaagtttcatcgaaagaatgacaaactttgacaaaaatctccccaacgaaaaagtactacctaaacatagtctactatacgaatactttacagtatataatgaattaactaaagtaaaatatgtgactgaaggcatgagaaaaccggaatttttatccgggaaacaaaaagaagcaatagtagacttattattcaagacaaacagaaaagttacagtcaaacaattgaaagaagactactttaagaaaatagaatgcttcgatagtgtagaaatttctggagtagaagatcggttcaacgcatcactcggcacctatcatgacttgctaaaaattatcaaagataaagactttttagataatgaagaaaatgaagacatcttagaagatattgttctaacactcacattatttgaagacaaagaaatgatcgaagaacgcttgaagaaatacgcaaacttatttgacgataaagtaatgaaacaactaaaacgaaggcactacactgggtggggaagattatcacgaaaattaattaacggaattagagataaacaaagcggaaaaacaatactagactttcttaaatctgatggcttcgcaaaccgaaacttcatgcaactaataaacgatgattccctaacattcaaagaagccatccaaaaagcccaagtaagtggtcaaggacattcacttcacgaacaaatagccaatctcgctggtagtccagctattaagaaaggaatactacaaagtgtaaaagtagtcgacgaattagtaaaagtaatgggacataaaccagaaaatatagtaatcgaaatggctagagaaaaccaaacgacacaaaaaggacagaaaaatagtagggaacgcatgaaaagaatcgaagaaggtataaaagaactgggcagtcaaatccttaaagaacatccagtagaaaatacccaacttcaaaacgagaaactatatctttactacctacaaaatggaagggacatgtatgtagatcaagaactagacataaacaggctaagcgattatgacgtagaccacatagttccacaatcatttataaaagacgactctattgacaacaaagtactaacaagatcagacaaaaacagaggcaaaagcgataacgtaccatcagaagaggtagtaaagaaaatgaaaaattattggagacaacttctcaatgcaaaattaataactcaaagaaaattcgacaatcttaccaaagccgaacgtggcggactttctgaactagataaagccggtttcattaaacgacagctagtagagacacgacaaataactaaacatgtggcacaaatattggactcacgaatgaatactaaatacgatgagaacgacaaactaataagagaagtgaaagttattacactcaaatcgaaacttgtatccgacttccgtaaagattttcaattctataaagtacgggagatcaataattaccatcacgcacacgatgcgtacctaaacgcagtggtcggcacagcgttaataaagaaatacccaaaacttgaatcagaatttgtgtacggggactacaaagtgtacgatgtgagaaaaatgatagcaaaatctgaacaagaaatagggaaagctacggccaaaagattcttctactccaacataatgaactttttcaaaacagaaattacacttgcgaatggtgaaataagaaaacgaccgcttatagaaaccaatgaagaaactggagaaatcgtatgggacaaaggaagagactttgcaacagtccgcaaagttttatcaatgccacaagtgaatattgtaaagaaaacagaagtacaaactggagccctcacaaatgaatctatatacgcacgggggagctttgacaaattgatttcaagaaaacacaggtttgaaagttcaaaatacggaggatttggctcacccaccgtgacatatagcgttctagtagtagccaaatccaaagtacaagacgggaaggtaaagaaaattaaaacgggaaaagaactaatcggaataacattactagacaaattagtctttgagaaaaaccccctaaaattcatagaagacaaaggttacggaaatgtacaaatcgataaatgcattaaattaccaaagtattctttatttgagttcgaaaatggaacaagacgaatgttagcatcagtaatggctaacaataactccagaggagacctacaaaaggcaaacgaaatgtttttaccagcaaaacttgttacactactatatcatgcccataaaatagaatcatcaaaagaattagaacatgaagcatacatactagaccattacaatgacttatatcaacttctttcttatattgaaaggtttgcctcactatacgtagatgtagagaaaaacattagtaaagtaaaagaattattctcaaatattgaatcctattcaatatccgaaatatgctctagtgtaataaatctattaaccttaacggctagcggagctccagcggacttcaaatttctaggtacgacaatacccagaaaacgttacggatcaccacaatcgattctatcctcaacgttaatccaccaaagtatcactggcctatacgaaaccagaatagacctatcacaacttggaggagactga

SEQ ID NO: 8945 - RNA, 4116 nt, synthetic construct
  misc_feature 1..4116: note = Cas9 variant
  source 1..4116: mol_type = other RNA
atggataaaaagtatagcataggtctagacataggcaccaattcagtaggttgggcagtcataaccgacgattataaagtcccatccaaaaagttcaaagtactagggaacacagatcggcatagcataaagaaaaacctaataggtgcactcctgtttgacagcggagaaactgcagaagcaacaagactaaaacgcactgccaggcgaagatacaccagaaggaaaaaccgaatacgatacctacaagaaatctttagctcggaaatgtcaaaagtcgatgattcgttctttcacagacttgaagagagcttcctagtagaagaagataaaaagcatgaacgacatccaatatttggaaacatagtagatgaagtcgcctatcatgaaaagtacccaaccatataccatctacgaaagaaattggctgacagtactgataaagcagatctgcgccttatttatctagcgttagcacatatgataaaatttaggggacactttttaatcgaaggagacctgaaccctgataatagcgatatggacaaactattcattcagcttgtccaaacctataaccaactcttcgaagaaaatccaataaacgcttccagagtagacgcgaaagctatactcagtgctcgcctaagcaaatctaggcgattggaaaacctaatagcacaattacccggagaaaagagaaacggcttatttggaaacctaattgcactatctctaggcctaactcctaactttaaatccaatttcgatttagcagaagacgcgaaactccagctttcaaaagatacatatgatgacgacttggacaacctattagcacaaataggcgaccaatacgcagacttattcttagcagcgaaaaacctttcagacgcaatattactctcagacatcctacgcgtcaattcagaaattactaaagcaccacttagtgcatcaatgatcaaaagatacgacgaacaccaccaagatctaacccttctcaaagccctggtgagacaacaattaccagaaaaatacaaagaaatattctttgaccaatctaaaaatgggtatgccggatatatagacggaggagcatcacaagaagaattttataaatttatcaaacctattttagaaaagatggatggcacagaagaattactcgcaaaactaaatcgagaagatctattacgaaaacaaaggaccttcgataatggatcaattccacaccaaatccatttaggagaactacatgccatcttaagaagacaagaagacttctacccatttttaaaagacaaccgagagaaaattgagaaaatactaacattccgcataccatactacgtcgggccattagccaggggcaatagcagattcgcctggatgacaagaaaatccgaagaaaccataacaccatggaatttcgaagaagtcgtagacaaaggagcatcggctcagagctttatagaacgcatgacaaattttgataaaaacctaccaaatgaaaaagtcttaccaaaacacagtctcctttacgaatattttacggtttataacgaactaactaaagtaaaatatgtaaccgaaggaatgagaaaacctgagttcctatcgggaaaacaaaaagaagccatcgtcgatttactctttaaaacaaacagaaaagtaacggtcaaacaacttaaagaagattatttcaagaaaatagaatgctttgactcagtcgaaatatcaggtgtagaagacagattcaatgcttcgctaggtacctaccatgatctcctgaaaataatcaaagacaaagactttttggataacgaagaaaacgaagacatattggaagatattgtactgacattaacactcttcgaagataaagaaatgattgaagaaagattaaaaacatacgcacacctgtttgatgacaaagtaatgaagcaactaaaacgaagacactataccggatggggtcgcttgtcacgaaaacttatcaacggtatccgagataaacaatcgggaaaaaccattctcgatttcctaaaatcagatggcttcgccaaccggaatttcatccaactaatccatgatgacagcttaacatttaaagaagcaatacaaaaagcacaagtttcaggacagggtcattcactacacgaacaaattgcgaatttagcaggttcaccagctataaagaaaggcatactacaaagtgtcaaagtcgttgatgagctagtaaaagtgatgggacataaacctgaaaatatagtaatcgaaatggcacgggaaaaccaaacaacacaaaaaggccagaaaaattctagagaaagaatgaaaaggatagaagaagggatcaaagaattaggtagtcaaatacttaaagaacatcctgtcgaaaacacccaactccaaaatgaaaaactatatttatactacttacaaaacggaagagacatgtatgtagaccaagaactagatataaacaggctaagtgactacgacgttgaccacatagtcccccagagctttattaaagatgattctatagataacaaagtactgacacgctcagacaaaaacagaggtaaatccgacgacgttcccagtgaagaggttgtgaagaaaatgaaaaattactggagacaattactaaacgccaaactaataactcaaagaaaattcgacaatctcacaaaagcagaacgaggagggctttccgaactagacaaagcaggtttcatcaaacgacaacttgtagagacccgacaaattacaaaacacgtagctcaaatccttgactcaagaatgaacacaaaatatgacgaaaatgataaattgatcagagaggtaaaagttataactcttaaatctaaattagtttcggattttagaaaagatttccaattctacaaagttagagaaattaataattaccatcatgcgcacgatgcatatctaaacgccgtcgtaggtaccgctttaatcaagaaataccccaaactagagtcagaatttgtctacggtgattacaaagtctatgacgttagaaaaatgatagctaaaagcgagcaagaaataggcaaagccaccgcgaaaaggttcttctatagcaacatcatgaacttcttcaaaactgaaatcactctagcaaacggcgagataagaaagcgtccactcatagaaacaaacgaagaaactggcgaaatcgtatggaacaaaggaagagattttgccacagttcgaaaagttttatccatgccccaagtaaacatagtaaagaaaacagaagttcaaacaggcgcactaacaaacgaaagtatctatgcacgtggtagctttgacaaattgatatcacggaaacacaggtttgaaagcagcaaatacggaggcttcggttcaccaacagtaacatattccgttttagtagtagcaaaaagtaaagtacaagatggaaaagtaaagaaaataaaaaccggtaaagaactaatagggattacccttctagataaactcgtctttgagaaaaatcccctaaaatttattgaagataaagggtacggaaacgtacaaatagataaatgtataaaactacccaaatattcattatttgagttcgaaaatggaacaagaagaatgctagcctcagtaatggcgaataacaatagcagaggtgaccttcaaaaagcaaacgaaatgttcttacccgccaaattagttaccttattataccacgcgcacaaaatagaatcttcaaaagaactagaacatgaagcatatatactagaccattataatgacctatatcaattattgagctacattgaacgatttgcatcattatacgtagacgttgagaaaaacatctcaaaagtaaaagaactcttcagcaacatagaatcctattctataagcgaaatatgctcaagcgtaataaacttattaacattaacagctagcggtgcaccagccgacttcaaattcctaggcactacaatacccagaaaaagatacggatcccctcaatctatactatcatccacactcattcaccagtccataacaggcttatacgaaacgcgaattgacctctcacaactaggtggagactga

SEQ ID NO: 8946 - RNA, 4116 nt, synthetic construct
  misc_feature 1..4116: note = Cas9 variant
  source 1..4116: mol_type = other RNA
atgaataataacaattacagcataggtctagatataggaacaaatagcgtaggatgggcagtgattacagatgactataaggtaccatcaaaaaagatgagagtactgggtaatactgataaaagatttataaagaaaaacctcataggcgcacttctcttcgacgaaggcacaactgcagaagatcgtaggctcaagcgaaccgcaagaaggcgttatacaagaagaaaaaatcgattacgttatttacaggaaatattcgctgaagaaatgtcgaaagtagattccagcttttttcacagactagacgattccttcctagtaccagaagataaatccgggtccaaataccccatctttgcaacgctagcggaagaaaaagagtatcataaaaaatttccaacaatataccacctaagaaaacatctagcagattcaaaagaaaaggcagacctaagattaatttacttagctctagcacatataaccaaatatcgaggtcactttctttacgaggaagccttcgatattaagaataatgacatacaaaaaatattcaatgaatttataaatatatatgacaacacctttgaaggatccagtctatcaggccaaaatgctcaagtagaagctatatttactgggaaaataagcaaatcagtaaaaagagaacacgtgctaaaattatttccagatgaaaaatcgaccggacttttctctgaatttctcaagttgattgtcgggaaccaggccgattttaaaaaacactttgacttagaagaaaaagcaagtctacaattctctaaagacacctacgatgaggatcttgaaaacctacttggacaaattggtgacgactttgcagaccttttcttagtggcaaagaaactatatgacgcaatattgctatcagggatccttacagtaactgacccctcaacaaaagctccattatcagcatcaatgattgaacgatacgagaatcatcaggaagatctcgcagcattaaagcaattcatcaaaaacaacctaccagagaagtatgccgaagtttttagcgaccaaagcaaagatggatacgccggatatatcgacggcaaaactactcaggaagctttttataaatatatcaaaaatttactatctaagttcgaaggagcagactactttctagacaaaatcgaaagagaagattttttaagaaaacaaagaaccttcgataatggttcaataccacatcaaattcacctccaagaaatgaacgcaatactaagaagacagggggaacactacccactccttaaagagaacaaggaaaaaatagaaaaaattctgaccttccgaatcccatactacgtaggaccgctggctaggggaaatagagattttgcatggttgacaagaaattccgatcaagcaattagaccttggaacttcgaagaaatcgttgacaaggcatcatccgcagagagttttataaataaaatgaccaactatgacctatacctcccagaagaaaaagtactccccaaacattccctcttatacgaaacattcgctgtttacaatgaactaacaaaagtcaaatttatagcagaaggcttacgagattatcaattctttgactccgggcaaaaaaaacagattgtaaaccagctatttaaggaaaaaagaaaagtgactgaaaaggatataatacattacctacataacgtagacggctatgacggaatagaactaaaaggtatagagaaacaatttaatgcaagtctatctacatatcacgatctactcaaaataatcaaagataaagaatttatggataaccataagaatcaagaaatacttgaaaatattgtacacactctaaccatattcgaagatcgagaaatgataaagcaaagactcgcgcaatatgatagcattttcgatgaaaaagttataaaagctctcacacgacgacattataccggatggggtaaattaagtgcaaaactcataaacggaatatgcgacaaaaaaacaggcaaaaccatattagattacctcatagatgacggctacaataataggaatttcatgcaactcattaacgacgacggattatcattcaaagaaatcatacagaaagcacaagtcgtaggtaaaactgatgacctcacacaagtggtaagagagttatcgggttcccctgcaatcaaaaaaggtatactacaatcaatcaaaatagtagatgagttagtaaaaatcatgggatatgcccctgaatcaatagtaattgaaatggcccgagaaaatcaaactactgcaaaaggtaaaaaaaactcccaacaaagatataaacgaatagaagatgcactaaaaaatctagcccctggtctagattcaaccatatcaaaagaaaatccaacagataacatacaattacaaaacgacaggttatttttatactatctccaaaatggaaaggacatgtatacaggtgaagcattagatataaatcaactaagttcatatgacatagatcatataataccacaagccttcataaaagacgatagtctagataacagggtgctaacgagttcaaaagataaccgaggaaaatcagacaacgtaccatcactcgaagtcgtaaaaaaaagaaaagccttctggcaacaactactcgattccaaattaataagcgaacgtaaattcaacaatctaaccaaagccgaaaggggtggattagatgaacgagataaagtcggcttcataaaacgacaactagtagagacacgtcaaatcacaaaacacgtggccagaatcctagacgcgagattcaacacagaggtatcagagaaaaaccaaaaaatacgatcagtaaaaataataacactaaaatctaacctagtaagcaatttcagaaaagaatttaaactatacaaagtacgagaaataaatgattatcaccacgctcatgatgcatacttaaatgcagtcgtggcaaaggcaatactaaaaaaatacccgaaactagaaccggaattcgtctatggagattatcaaaaatatgatcttaaaagatatatatcaaaatcgaaagaccccaaagaagtagaaaaggccacagaaaaatacttcttctatagtaatttattaaacttcttcaaagaagaagtacattatgcagatggcacaatagttaaacgagagaacatcgaatacagtaaggacacaggagaaattgcatggaataaagaaaaggattttgttacaattaaaaaagtactcagctatccccaagtaaacatagtaaagaaacgagaagtacaaacaggaggttttagcaaagaaagtattttaccaaaaggaaattcggataaacttataccaaggaaaaccaaagacatcttatgggacacaacgaaatatggaggttttgactcaccggttatagcctactcaatcctcttaatagcagacatcgaaaaaggcaaagcaaaaaaactcaaaacagtaaaaactcttgttggaatcacaattatggaaaaagcagcattcgaaaaaaatcctataacttttttggaaaataaaggataccacaacgttcgaaaagaaaacattctgtgtcttccaaaatactcactttttgaactggaaaacggcagacgaagacttctagctagcgcaaaagaattacaaaaagggaatgaaatcgttttaccagtttatttgacaacgctcctttaccatagcaaaaatgtacataaactagatgagccagagcacctagaatacatacaaaaacaccgatatgaattcaaagacctattaaacttagtatcagaattttcacaaaaatacgtcctcgccgaagcaaacttagaaaaaataaaatccttatacgtagataacgaacaagctgacattgagatattagcaaactcattcattaacctcttaaccttcacagccttaggcgccccagccgcattcaaatttttcggcaaagatgtcgacagaaaaagatacaccaccgtaagcgaaatactaaacgcaactctaatacaccaatcaatcacaggcctatacgaaacacgaatagacctcagcaaacttggagaagattga

SEQ ID NO: 8947 - RNA, 4116 nt, synthetic construct
  misc_feature 1..4116: note = Cas9 variant
  source 1..4116: mol_type = other RNA
atgactgagaaaaattattcgattggtcttgatattggtactaattccgtcggatgggctgttataacagatgactacaaagtacctgccaagaaaatgaaagtattaggaaataccgataagaaatatatcaagaaaaacctactaggagcactacttttcgacaacggagaaaccgcagaagcaacaagactgaaacgaacagcgcgccgaagatatactcgaaggaaaaataggctaagatatttgcaagaaatatttgccgaagaaatggctaaagttgatgaaagtttcttttaccgcctagacgaatcgtttttaactacagacgacaaagactttgaaagacatccaatatttggtaacaaagctgacgaaataaaatatcatcaagaatttccgaccatataccacttgcggaaacatctagcagacagccatgaaaaagcagatttacgattaatttatctagcactagctcatatgatcaaattccgaggacacttcttaatagaaggagaattgaacgcagaaaatactgacgtgcaaaaactattcgaagcatttgtagaagtctacgacagaacgtttgatgattctaatctatctgaaattacagtagatgcatcatctatactaacagaaaaattttcaaaatcacggagattagaaaacttaatcaaacattatcccaccgaaaagaaaaacactctatttggaaaccttgtagctttagctttagggctacaaccaaattttaaaacatcattcaaacttagcgaagacgcaaaacttcagttctccaaagacacctacgaagaagatctagaagaattaatcggaaaaataggagatgaatacgctgacttgttcacttcagcaaagaacctttatgacgctatattactatcagggattctcacagtcgcagacaacaccacaaaagccccattaagtgcatcaatgataaaaagatataatgaacaccaagttgatctcaagaaactaaaagagttcattaaaaacaacgctagcgataaatacgacgaaatatttaacgataaagacaaaaatggatatgcaggatacatagaaaatggtgtaaaacaagatgaattttataaatacctaaaaactaccttatcaaaaatagatggaagcgactactttttagataaaatagaaagagaagacttcctccgtaaacaaagaacattcgacaacggatcaataccccaccaaattcatctacaagaaatgcatgctatcctaagacgtcaaggagaacattatgcatttctaaaagaaaatcaagcaaaaatagagaaaattctcactttcagaatcccctactacgttgggccattggcacgtaaaaacagtagattcgcatgggcggaatatcattcagacgagaaaataactccctggaactttgatgaaataatagacaaagagaaaagtgctgaaaaatttattacaagaatgaccctgaatgatttatatctcccagaagaaaaagtactccccaaacacagcctagtatatgaaacttacacagtctacaatgaactcacgaaagtaaaatatgtaaatgaacaaggaaaaagcaacttctttgacgcaaacatgaaacaagaaatttttgaacacgtctttaaagaaaatagaaaagtcacaaaagataaattcttaaactatctaaataaagaatttccagaatatcgaatccaagatctaattggtcttgataaagaaaacaagagcttcaacgcatccctaggaacgtatcacgacctcaagaaaattttagataaatcattcctagatgataaaactaacgaaacgattatagaagacattatccagacactaacactattcgaagaccgagatatgatacgacaaagattacaaaaatatagcgacatcttcactcctcaacaactcaagaaattagaaagacgacattataccggatggggtagattgtcttataaactgataaatggaatacgaaataaagaaaacgggaaatcaatcttggattacctcatagacgatggatacgcaaatcgaaacttcatgcaactcatatcagacgacactttaccatttaaacaaataataaaagatgcacagatcataggtgacatagacgatgttacatcagtcgtaagagaattacccggctcccccgcaataaagaaaggtatattacaatcagtgaaaatcgttgatgagctagtaaaagttatggggcacaaccctgataatatagtcatagaaatggctagagaaaaccaaacaacaaatagaggcagaaaccaatcacaacaaagattgaagaaactacaagattcactcaaagaattgggttcaaatatcctaaacgaagaaaaaccttcctatatcgaaggaaaagtcgaaaacaatcacctacaagatgatagactatttctatactatattcaaaatggaaaagacatgtacaccggtgatgaactagacatagaccacctttcagactatgacatcgaccacataatcccccaagcctttataaaagatgactccatcgacaaccgtgtattaacttcatcagccaaaaacagaggaaaaagtgacgacgtcccgagcctagacatagtacatgatagaaaagcggactggattcgactatataaaagcggtctaataagcaaaagaaaattcgataacttaaccaaagctgaaagaggcggactaactgaaaatgataaagccggattcatcaaacgtcaactcgttgagacgcgtcaaataactaaacacgttgcgcaaatactagatagtagattcaacactgaaagagatgaaaatgataaagtcatccgaaatgttaaagtaatcactctaaaatcgaacttagtctcacaatttcgcaaagactttaaattttacaaagtccgggaaataaatgattaccatcatgcacacgatgcatatttgaatgccgtggttggaaccgcactactaaagaaatatccaaaactagcacctgaatttgtatacggagagtacaagaaatacgatataagaaaatttataacgtcttcaggagacaaagcaacagctaaatacttcttttattctaatctaatgaacttcttcaaaagagtgattcgatattcaaatggaaaagtcgttgtaagaccagtaatagaatgttctaaagacactggcgaaatagcatggaataaacaaacagacttcgaaaaagtacgaagagtgttatcatatccacaagtaaacatagtaaagaaagtagaaacacagacaggaggattctcaaaagagtcgattcttcctaaaggcaattctgataaacttatcccaagaaaaaccaagaaatttcgatgggacacaccaaaatacggaggatttgactcaccaaacatagcctactcagtattcgtaatagcagatgtggaaaaaggtaaagccaagaaattaaaaacagtaaaagagctagtagggataagcattatggaaagatctagctttgaagagaacccggtagtatttttggagaagaaaggctaccaaaatgtccaagaagataatttaataaaattacctaaatattccttattcgaatttgaaggaggcagaagacgcctcttagcttcggcttcagaattacaaaaaggaaatgaagtcgtactaagcagacacttagttgaactactatatcacgcgcaccgagtgaactcattcaacaattcagaacaccttaaatatgtctccgaacataagaaagagttcggagaagtactcagctgcgtggagaacttcgcgaagagttatgtcgacgtagagaaaaatttaggtaaaattcgagcagttgcagataaaattgatacatttagcatagaggatatatctatcagctttgtaaacctcttaacgctcaccgcccttggtgcaccagcggatttcaacttcttaggagagaaaatacccagaaaacgatatacaagtaccaaggaatgtctaaatgcaacattaatccatcaatcaattacgggactatacgaaacaagaatagacctatcaaaattgggcgaagagtga

SEQ ID NO: 8948 - RNA, 4116 nt, synthetic construct
  misc_feature 1..4116: note = Cas9 variant
  source 1..4116: mol_type = other RNA
atgaatctaagaaatgtagaatcttaccaagtaggattagacataggtacaggtagtgttggatgggctgtacttgatgacaacggagatctatgtagatttaaagggaaaccaacatggggcagcagagtgttcccaacagcagaaacagcagctgaagcaagagtgcaccgcggacaaagaagaagatatgacagaaggagacaaaggatagatttgttacaacgcttctttgccgacgaagtagcaaaagtagacccagagtttttcataagattaaaccaagcaagactacatccagaaaatcgagatcccgctcatgccgattacagatggccccttttcaacggcagcaatttcacagagaaagattactatcgtcaattcccgactatatatcaccttcgtgctcatctactgaaaagtgacgaaccggctgatatacgattagtatatctagcactacacaatatagtgaaacacagaggtaactttttacatcaggacaacccttccttatcagctcgtaatgcaaatgtaggggacgctgtagaggctttgtgtttagctctcgatgaatggtgcggagctcatgatgtagaatgtgcatgtgacgaagcagcgctggcagaagcactcggagatgcttccttaagaccaggcgaaaaacgagaaagagccgaagcagcattaggtgttgaaaaagcacataagaaacttgctaaagcagttagttcagcagtagtgggatacgccgccgaatttggccatgtatttttcgcagaatcagaaggaagcaagtttgcactaagcaatgatgaaaaagttgaagcatatgtctgccctgatgagggaagagatttatttgatgcgatgcgagcagtccattcaagctacgttttgatgggaatattaagcgaagcacaaggcgagttattaagtgtctgtaaggtaggagaatatgaaagatacaaaagagacctggagacactaaaaagtttggtaagggcgtacggaccagaaagatacgacgagttcttctgtggaccgttctacgaaggcactagggactacgaccctggaaaggcacaaggttatacaaagtataatctcggagcatccaaactctcccatgaagatttcctaaaggaagtgcagaagctactcaaagatatcggcgcacaagccgatgaaaggtatgccgatatcgaacgagcaatcgaggcaggagcattcctaagaagattaaaaacaagtgacaatggaacaataccatatcaactacatttagaagaaatggacgctataattgagagacaagccgctttttacccgtttttagcacaggagaaagacaaactgaaatctttggtaagtttcagaataccatattatgtcggaccacttactcagaaaaacgcggccagagacggaaaaggagaagctagattcgcctggagttcacgaaaaccaggtatggaagatgcaagagtatacccctggaactgggaagatgtaatagataaagatcaaagcgccgaagattttattaggagaatgacagggacttgcacctatttaaaaggagaaccagtattagcaagatgtagtttagattatgaactattctgcgtattaaatgaattagcaggcgcaagatggacacaagacggagataaaagttatcgctttgatgctgctgatcgactaggaatagtagaagatctttttaagaaacgtaaaagagttacgtacgaagccgccgaaaaatggttagctcggacacatggaccagaatctgggaaaagtgcgggtggagcatatcacgtaagtggaggccaaggagaggacgcatttgagtcacaactgagtagccactatgacttttgcaaaattttgggtgttgatgaattatctgatgcagacgaagcaatggcggaagacataattctatggaacacagtattcgaagaccgttcaattttgaaaaggaaaataaaactcgcatatggcgatcgtttaggtgatgcccaagttagaaaactatgccagaaaagatacacagggtggggacgactaagcggtgaactactgagagggctaaggtcagcaacagataatggtcctaaaacaataatggatatattacttgaaggggatcctaaccacgcgcgtcgtatgggagctgctatgaacttaatggaaatattacatgatgacttattagaatttcaagcaaaaatagacgaacataatagagaaagagctctagcagtcgggggcatgtcagtagatgaagtcactggaagccctgcgctaaggagaggtatcaaccaagcactacgagttgttgacgaaatagcaggaattgcagggaaacccccagcacatatttacgtagaagttacacgagatgaaggggcacggaataaggggagacgcaccacgagcagatacagagcattagaagctgcactatcatcaataaaagcacaatgtgcagatgtgtacgcagaactcaaggaaagagatccaagggccctagacgatgaaagattaacgttgtattttatgcaatgtggaaagtgtatgtacagtggcgacgcattagatatcaacaagttacaaacatatcaagtagatcacatactaccgcaatcatatgtgaaggatgacagttttgaaaataaagttttagttagaccggacacaaaccaacgaaaaggagatacgctattgctcgacgaacgactcatagcaaggatgcgaggcttttggcgaacactcagggatgcagaattaataggtgaaaagaagtttaataatcttacacgaacaagtgtttcagacgagcagatgaagaaatttgtatcgagacaattagtagaaactggccaaatggtaaaacaagttcaacaattattgcaagcaagatatccagaatctgaagtacaacctgttaaagcaggagtgagtcaccaattaagagtcggctgcgcgttagcaaaaagtagggaaataaacgattttcaccatgcacatgacgcctatttagcatgtcaggtaggtagatttgtacaatacagacattcagccgtttattcagaacccgtgaaaatggcagctgtcgtaaaacaattcataaagaaacaagcagaagattatagacgaacgagagaattaccaggaagtgacggtttcatagtcagctcatttatgacacccggttttgacgtaaaaacaggcgaagtttttagggacgcgtgggatgctggagcagaaatagacagaattagaagatgttttgattataaagactgctttatttccagaatgccagaagaaacgcatggggcattctgggatgcaacaatttattcacctagggcagcaggcaaaaccttaagtctaccgctaaaaagaggattagacccaagaaagtatggaagttactctcgggaacaattcgcctacttctttgtgtatgaagccgttaaaccaaagaagaaacagcgagtcttagagttcgcacccgtcccagttagagtagcatcagcactcgctaatgatccagatgccctagaagactatgcaagggaactagcggaagcagaaggcctagttttcgaacgcattagaagaagaaaagtatataaatatcaacaaattattgtaggagattcaagactatatgttacaggacgggaggaagtacgaaacgctcgtcaactggctttttctcaagacgaaacgaaattgatatgcagaatagagcaaggtgaagaatgtgaagaaggtgaattactggatttatttaggtccatgcagcgtaaatatttagcatgcgcaccacgactggctagactgatgaaagttgcagaaatggaggaaggatttatagctgcgacagcatccgggaaaagggaagtattactaagtcttacatctatagcagcagcgcacagaaacagcatcgatcttaaaccaattggaagaaaaggatctagtggtcaaatgaaaataacattcagtaaagaactgagtacaaatggaatattgtttgttgactcatctgtaacaggtatgttcgagagacgttgtagattaggtttgtga

SEQ ID NO: 8949 - RNA, 4116 nt, synthetic construct
  misc_feature 1..4116: note = Cas9 variant
  source 1..4116: mol_type = other RNA
atggaaaataaaaattatagtataggactcgacataggaacaaatagcgtaggctggagcgtaataacagatgattataaagtacctagcaagaaaatgaaagttttaggaaacactgacaaacgcttcataaagaaaaatttaataggagcattattatttgatgaaggtactacagcagaagcccgaaggctaaaacgaacagcaagaaggagatatactcgaaggaaaaacagactacgatatttgcaagaaatatttgccgaagaaatgtcaaaagtagactcgtcattcttccatagactcgatgacagctttttaataccggaggacaaaagaggttcaaaatatccaatatttgcgaccctagctgaagaaaaagagtatcataagcaatttcctacaatatatcacttacggaagcaattagccgattccaaagaaaagacagacctacgacttatctatctagcattagctcacatgatcaaatatcgtgggcactttctgtacgaagacacctttgatattaaaaacaatgacatacagaaaatattctcagaatttatctcaatatatgacaacacttttgaaggatcttctctctctggacaaaacgctcaggtagaagcaatattcaccgacaagatttcaaaatccgcaaaaagagaaagagtacttaaattgttccctgacgaaaaatctactggattatttagtgaatttcttaaactaatagtgggtaatcaagcagactttaagaaacacttcgatttgggagaaaaagcaccacttcagttctcaaaagatacgtacgatgaagacctagaaaacttgttgggacaaattggagacgactttgcagatctattcctagtcgccaagaaattatacgacgcaatactacttagtggaatacttacagtaacagatccttctactaaagcgccgctatccgcatcaatgatagaacgttacgaaaaccaccaaaaagacctagcagtactcaaacaatttattaaaaacaatttgcccgaaaaatatgatgaggtgttttctgaccagtcaaaagacggatacgcgggctatatagacggaaaaactacccaagaggctttttataaatatattaaaaatttactcagcaaatttgaaggcaccgattacttcctagagaaaatcgaacgggaagatttcctaagaaaacaaagaaccttcgacaacgggtcaataccccaccagattcacttacaagaaatgaacgcgatcctaaggcgacaaggagaacactacccatttttaaaagataacaaagagaaaatagagaaaattctgactttccgtataccctattatgtgggaccgttagccagaggaaacagagacttcgcatggttaacccgaaattcagatgaagctataaggccgtggaactttgaagaaattgtggataaagcaagctctgcggaagactttataaataaaatgaccaactacgacttatatttaccagaagaaaaagtactaccaaaacatagtttactctacgaaacattcgcggtctataacgaattgacaaaagtaaaattcatagctgaaggactcagagattaccaattcctggatagtggacagaagaaacaaatagtaacacaattatttaaagagaaaaggaaagtcacagaaaaagacatcatacaattcctacataacgtagacggatatgatggtatcgaattaaaaggaatagaaaaacaattcaatgcaagcctctctacttatcacgatttactaaaaataataaaagacaaagaatttatggatgattctaaaaatgaagaaatattagaaaatatagtccatacattaaccatatttgaagatagagaaatgattaagcaaagattagctcaatacgattcactatttgatgaaaaagtcattaaagccctcatcagacgacactacacgggttggggtaaactctcagcaaaacttatcgatggaatatgtgacaaacaaacaggtaacaccattttagattacctaatagatgatggcaaaaataaccgaaattttatgcaactaataaacgatgatggtttatcattcaaagaaataacacaaaaagcacaagtagtgggtaaaaccgacgacgttaaacaagtagtacaagaattgcctggatcccctgcaataaagaaaggcatattacaaagcataaaaatcgttgacgaattagtaaaagtaatggggcatactcccgaatcaattgtaatagaaatggcacgggaaaaccagaccactgcacgaggtaagaaaaactcacagcaaagatataaaagaatagaagatgctctgaaaaatctagcatcaggattagattcaaacatactgaaagagcaccccacaaataatatacaattacaaaacgatcgtctatttctctattacttacaaaatggacgagacatgtacacaggtaaaccactcgatatcaatcaactcagtagctacgatatcgaccatatagtaccacaagcatttataaaagatgattcactagataatagagttctaaccagcttgaaagataatagaggaaaatctgataatgttccatcaatagaagtagtacagaaaaggaaagcattctggcaacagctcttagactcaaaattaatatcagaacgaaaatttaataatctaacaaaagcagaaaggggcggtttagatgaaagagacaaagttggctttattaaaagacaactcgtagaaacaagacaaataactaaacacgtagcacaaattctagacgctagattcaataaagaagttaacgaaaaagataagaaaaacagaacggtaaaaataataaccctaaaaagtaacttagtcagcaatttcagaaaagagttccgtctctataaagtaagagaaataaacgactatcaccacgcacacgacgcatacttgaatgctgtagttgccaaagctattttaaagaaatatccaaaactagaaccagaatttgtttatggagattaccaaaaatacgacttaaaacgatacatatcaagatcaagaaatccaaaagaagttgaaaaagcaacagaaaaatactttttctactcaaacctattaaactttttcaaagaagaagtacattacgccgacggtactatagtaaaaagagaaaatatagaatactctaaagacacaggcgaaatagcatggaacaaagaaaaagacttcgcaacaatcaagaaagtcctgagctacccacaagttaatatagtcaagaaacgagaagtgcaaacaggaggatttagcaaagaatccatattaccgaaaggtaactctgataaactaataccaaggaaaaccaaagatatactatgggaaacaacaaaatacggaggtttcgactcgccagttatagcctactcaatactactcatcgccgatatagaaaaaggtaaagcaaagaaactaaaaacagtgaaaacattagtgggcataacgattatggaaaaagcagcctttgaagaaaatcccataacctttttagaaaacaaaggataccataacgtaagaaaagaaaacatcctatgtcttcccaaatactcattattcgagttagaaaacggacgtagaagacttctagctagcgcaaaagaattacaaaaaggtaacgaaatagtacttccagtttacctaacaacattactctaccactccaaaaatgtacacaaacttgacgaaccagaacatttagaatatatccaaaaacacagaaacgaatttaaagacctactaaacctagtatcagaatttagccaaaaatatgtgctagcagatgctaatctagagaaaatacagaacttgtacgcagataacgaacaagccgatatagaaatattagcgaacagtttcattaatctactcacatttacagcactaggagcaccagcagcatttaaatttttcggaaaagatattgatcgtaaaagatacaccaccgtttcggaaatacttaatgcaacactaatacaccaatctataacgggattatatgaaacaagaattgacctctctaaacttggagaagattga

SEQ ID NO: 8950 - RNA, 4116 nt, synthetic construct
  misc_feature 1..4116: note = Cas9 variant
  source 1..4116: mol_type = other RNA
atggataagaaatactccataggtttagatataggaactaacagtgtaggctgggcggtaataactgatgactataaagtaccatcaaagaaatttaaagttctaggcaacacggaccgccattcaataaagaaaaacctaataggggcactcttatttgacagcggagaaaccgccgaagcaacaaggctaaaaagaactgcccggagaagatacacacgaagaaagaacaggattcgttatctgcaggagatattctctagtgaaatgagtaaagtagatgattcgttctttcacaggctagaagagagctttctagtagaagaagacaagaaacatgaacgacaccccatattcggtaatatcgtcgatgaagtagcataccatgaaaaatatccaacaatataccatctaagaaagaaattagcagactcaacagacaaagcagaccttagactaatctacctagcactagcacatatgataaaatttagaggacactttttaatagaaggagacttaaacccagataactcagacatggacaaactcttcatccaacttgttcaaacatataaccaactatttgaagaaaatcccataaatgcatccagagtcgatgcaaaagctatactatcagcgcgactaagcaaaagtcgacgactagaaaacctaatcgcacaattaccaggtgaaaaacgcaacggacttttcggcaacttaattgcacttagcctcggactaacacctaacttcaaatcaaatttcgacttagcagaagatgcaaaattacaattgtctaaagatacttatgatgacgatctagacaaccttttagctcaaataggagaccagtacgcagacttatttctggctgcgaaaaatctctcagacgctatactgttatcagacattttaagagtcaattcagaaatcacaaaagcaccactttcagcgtcaatgatcaaaagatatgacgagcaccatcaagacctaacactactaaaagcactcgtacgacaacaactgccagaaaaatataaagaaatatttttcgatcaatctaaaaacggttacgcagggtatatcgacggcggtgcctcgcaagaagagttctataagtttataaaaccgattttagaaaagatggatggtaccgaagaattactagctaaactaaacagggaagatttactccgtaaacaacgcactttcgataatggaagtataccacaccaaatacacctcggtgaattgcacgcaatattacggcgtcaagaagacttctacccctttcttaaagacaacagagagaaaatagagaaaatcttaacttttcgtattccatattatgtaggaccactagctagaggaaactcaagattcgcatggatgacacgaaaatcagaagaaaccataacaccctggaactttgaagaagtagtcgacaaaggagcatccgcacagagtttcatagaaagaatgacaaatttcgataaaaacctaccaaacgaaaaagtattaccaaaacatagtctattatacgaatacttcacagtatataacgaacttacgaaagtaaaatatgtaacagaaggaatgcgaaaacccgaatttttgtccgggaaacaaaaagaggcaatagtcgatctactatttaaaacaaacaggaaagtaacagtcaaacaattaaaagaagactactttaagaaaattgagtgctttgacagcgtagaaatcagcggtgtcgaggatcgctttaatgcttcattaggaacttatcacgaccttttaaaaataatcaaagacaaggatttcctcgataatgaagaaaatgaagatatcttggaagatatcgtcttaaccctaactcttttcgaagataaagaaatgatagaagaacgtttaaagaaatatgcaaacttattcgacgacaaggtcatgaaacaactaaaacgaagacattacactggatggggtcgtctctcacgaaaattaattaatggcataagagataaacaaagcggaaaaacaatattagactttttaaaatcagatgggttcgccaatagaaatttcatgcaattaataaatgatgattcattaaccttcaaagaagctatacaaaaagctcaagttagcggacaaggacacagtttacacgaacaaatcgccaacctagcaggtagtccagcaataaagaaaggcatactccaatccgtaaaagtagtagatgaacttgtcaaagtcatgggacacaaaccagaaaatatagttatagaaatggcacgggaaaatcaaactactcagaaaggacagaaaaatagccgagagagaatgaaacgaatagaagagggaatcaaagaactgggttcacaaatccttaaagaacatcctgtagaaaacactcaactccaaaacgaaaagttatacctatattacttacaaaatggaagagatatgtatgtagaccaagaattagatatcaaccgcctatcagattacgacgtcgatcatattgtaccccaatcatttatcaaagacgactcaatagacaacaaaattctaacccgaagtgacaaaaatcgaggcaagagtgataacgtacctagcgaagaagtggtcaagaaaatgaaaaattactggcgacagctattaaacgcaaaactaattactcaaagaaaattcgacaatttaacaaaagccgaaagaggaggattatcggaattagacaaagccggcttcatcaaaagacagctagtggaaactagacaaataactaaacacgtcgcccaaatactagatagccgaatgaacactaaatacgacgaaaacgataagctaataagagaagtaaaagtaatcacactaaagagtaaattagtaagtgattttaggaaagatttccaattctataaagtacgcgaaataaataattaccaccacgcccatgatgcatatctaaacgccgtagtaggtacagccctaataaagaaatatactaaacttgagtcggagttcgtatatggcgactataaagtatacgatgtcagaaaaatgatagcaaaatcagaacaagaaatcggtaaagcgacagcgaaacgctttttctattcaaacatcatgaacttctttaaaacggaaattacactggccaacggtgaaatacgaaaaagacccttaatcgaaactaacgaggaaactggagaaatagtatgggacaaaggaagagactttgcaacagtaagaaaagtattgagcatgcctcaagtaaatatagtgaagaaaacagaagtacaaaccggtgcattaactaacgaaagtatatacgcacgaggatcctttgataaactaatatcaagaaaacaccggttcgaatcttctaaatatgggggatttgggagtcccacagtaacctacagcgtgttagtggtcgccaaatccaaagtacaagatggcaaagttaagaaaataaaaacaggtaaagaacttataggaatgactctcctcgacaaattagtatttgagaaaaatccactaaaatttatagaagacaaaggctatggtaacgtccaaattgataaatgcatcaaactaccaaaatattcattattcgagttcgagaatggaacaaggcgtatgttagcatccgtgatggccaacaacaatagtagaggagacttacaaaaagctaacgaaatgttccttccagcaaaattagtaacactattatatcatgcccacaaaatagagtcaagtaaagagctagagcacgaagcatacatcttagaccactacaacgacttataccaactgttatcatacatcgaaagattcgccagtctatatgttgatgtagagaaaaatataagcaaagtaaaagaattattttcaaacatagaaagttacagtatcagtgaaatatgttcaagcgtaatcaatctattaactctcaccgcgagcggagcaccagcggactttaaatttcttggaaccacgatacctagaaaaagatatggatcccctcaatcaatactatcgtccacgctgatccatcaatcaattacagggttgtatgaaaccagaatagatctatcacagttaggtggagactga

SEQ ID NO: 8951 - RNA, 4116 nt, synthetic construct
  misc_feature 1..4116: note = Cas9 variant
  source 1..4116: mol_type = other RNA
atggacaagaaatatagtattggattagacattggaactaattcagtcggatgggcagtaatcacagatgactataaagtcccatcaaagaaatttaaagtacttggcaataccgacagacattctatcaagaaaaatctcataggagcccttctatttgattcaggagagaccgcagaagcgacacgtctaaaaagaacagcaagacgacgatatacacggaggaaaaatagaatcagatacctacaagaaatttttagcagtgaaatgtcaaaagtcgacgactccttctttcacagattggaagagagcttcctagtcgaagaagacaagaaacatgaaagacacccaatctttggtaatatagttgatgaagtagcataccacgaaaaatatccaacaatctaccaccttcgtaagaaactggccgatagtactgacaaagctgacttgaggcttatatatctagctctagcacatatgataaaatttagaggacacttcttaatcgaaggggatctaaacccagataattcagatgtagataaactattcatccaattagttcaaacgtacaatcagctattcgaagaaaaccccatcaatgcgagcagggtagacgccaaagcaattctatccgcccgtttatcgaaatcccgacgactagaaaacctaatagcccaactcccaggagaaaaacggaacggactattcggcaacctcatagcgctatcacttgggttaacccctaatttcaaatcaaatttcgacctagcagaagacgcgaaacttcaactaagtaaagatacatacgatgacgacttagataatcttctagcccaaataggtgaccaatatgcagacctattcttagcggccaaaaatctatccgacgctatccttttaagtgacatcttacgtgtaaatagcgaaatcacaaaagctcccctaagtgcatctatgataaaacgatacgacgaacatcaccaagatttaacactactcaaagccctcgtacgccaacaattgccagaaaaatacaaagaaattttctttgatcaaagcaaaaatggatacgctggttatatagatgggggtgcgtcacaagaagaattttacaaattcataaaacctatacttgagaaaatggatggcactgaagaactgctcgcaaaattaaacagagaagatcttttacgaaaacagcgaactttcgataacgggtcaattccccatcaaattcatctaggtgaacttcatgctatattacgcagacaggaagacttttaccctttcctcaaagataaccgagagaaaatcgagaaaatattaacattccgcatcccttactatgtaggccctcttgcacgagggaactcacgattcgcatggatgacacgaaaatcagaagaaaccattacaccatggaattttgaagaagtggtagataaaggagccagtgctcaatcctttatcgaacgaatgacaaacttcgacaaaaacctgccaaatgaaaaagtactcccaaaacactcacttttatatgaatatttcacggtttacaatgaattaactaaagtaaaatatgtaacagaaggaatgcgtaaaccagcattcctttctggcgaacaaaagaaagctatcgtggatcttttattcaaaacaaacagaaaagtaacggtaaaacaattaaaagaagactacttcaaaaagatagaatgttttgactcagtagaaatatctggagtggaagacagattcaacgccagtttaggaacataccatgatttattaaaaattattaaagataaagactttttagataatgaagaaaacgaagatatactagaagatatagtattaacgcttacattattcgaagacaaagaaatgatagaagaaagactaaaaacttacgcacacctgttcgacgacaaagttatgaaacaacttaaaaggcgacactacactggttggggccgacttagtcgaaaacttataaatggaatacgagataaacaatccggcaaaacaatcttagactttctgaaatcggacggattcgctaacagaaacttcatccaacttatacacgacgactccctaacatttaaagaagcaatacaaaaggctcaagtaagtggacaaggacatagtcttcatgaacaaatcgcaaacctagcaggttcacccgcaataaagaaaggaatattacaatcagtcaaagtagtagacgaacttgtaaaagtgatgggacataaacccgaaaatatagttatcgaaatggcaagagaaaatcaaactacccaaaaaggtcaaaagaactccagagaaagaatgaagcgaatcgaagaaggaataaaagaattaggatcgcaaatattaaaagaacacccagttgaaaacacccaactccaaaacgaaaaattatacctttattacttacaaaacggcagagacatgtacgtggaccaagaactcgatataaacagattatctgattacgacgtcgatcacatagtaccgcaatcatttataaaagatgattccatagacaacaaagtattaacaaggtcagataaaaacagaggaaaaagtgataacgtcccatcagaagaagttgtgaagaaaatgaaaaattattggagacaactactcaacgcaaaattaataacacaaagaaaatttgataatctgactaaagcagaacgaggcggattaagcgaattagataaagctggctttataaaaagacagctagttgaaacaagacaaattaccaaacatgtcgcgcaaatactagactctagaatgaatactaaatatgatgaaaacgacaaattaatccgagaagtaaaagtaattactctgaaatcaaagctagtctcagatttcagaaaagatttccaattctataaagtgcgagaaatcaacaattaccaccacgctcatgatgcatacttaaacgcggtagtgggtacagctctgatcaagaaatacccaaaactcgaatctgaatttgtatacggcgactataaagtctatgatgtaagaaaaatgattgcgaaaagtgaacaagaaatcggaaaagcaactgccaaacgtttcttttactcgaacattatgaatttcttcaaaaccgaaatcactttagcgaacggtgaaattcgaaaaagaccgttaatagaaactaacgaagaaacaggagaaatcgtctgggataaaggaagagacttcgcaacagttagaaaagtgctaagtatgccacaagtaaacatagttaagaaaacagaagttcaaaccggagctctaacaaatgaatccatatacgccagaggatcttttgacaaacttatctcaagaaaacacaggtttgaaagttcaaaatacggaggtttcgggtctccaacagtaacctattcagtcttagtagtagcaaaatcaaaagtccaagatggcaaagtaaagaaaataaaaacaggtaaagagttaatcggaataacattattggacaaattagtgttcgagaaaaacccactaaaattcattgaagacaaaggatacggaaatgtacaaatcgacaaatgcataaaattgcctaaatattccttgttcgagttcgaaaacggaacccgacgaatgttagcctcagtaatggcaaacaataatagtagaggagacctacaaaaagcaaatgaaatgtttttgccagcaaaattagtcacactactataccatgcacacaaaatagaaagttccaaagaattagaacacgaagcctatatattagatcattacaatgatctctaccaactattaagttatattgaacgcttcgcatcactatacgtggacgtagagaaaaatatatccaaagtcaaagaactattttcaaacatcgaatcttacagcatcagtgaaatttgctcatcagtaattaacctcctaacgttaaccgcttcaggagcgcctgccgacttcaaatttctaggaacaacgataccccgaaaaagatacggttcaccacaaagcattttaagctctactttaatacaccaatctataacgggattatatgaaactagaatagacctaagccaactaggaggagattga

SEQ ID NO: 8952 - RNA, 4116 nt, synthetic construct
  misc_feature 1..4116: note = Cas9 variant
  source 1..4116: mol_type = other RNA
atggaaaataaaaattactctataggactcgacattggaacaaattcagtaggatggtcagtaataactgacgactacaaagtaccttctaagaaaatgaaagtcttaggaaacacagataaacactttataaagaaaaacctaataggagcacttctcttcgatgaaggaacaacagcagaagcaagaagactcaaaagaacggctaggagacgttatacgcgacgtaaaaaccgactacgatatcttcaagaaattttcagtgaagaaatcggaaaagtcgacagtagtttctttcatcgactagatgactcctttttgatacctgaagacaaacgaggaagtaaataccctattttcgccaccctagccgaagaaaagaaatatcataaacaattcccgacaatttatcatcttagaaaacaattagccgattctaaagagaaaactgatctaagattaatataccttgctcttgcacacatgatcaaataccgaggccacttcttatatgaagaagcatttgatattaaaaataacgacatacagaaaatattcaacgaatttataagcatatacaacaatacatttgaaggaaattccctatcaggccaaaacgtacaagttgaagcaattttcacagataaaatatctaaatccgccaaaagagaaagagtattaaaactattccctgatgaaaaatcaactggtcttttcagcgaatttcttaaactgatagtaggcaaccaagccgattttaagaaacactttgacctagaagaaaaagcaccactacaatttagccgagacacctacgacgaagaccttgaaaaccttctaggacaaataggcgacgacttcgcagacctattcctcgtagcaaagaaattatatgatgcaatcttactatcaggaatactaaccgtcacaaacccatcgaccaaagcacctttatcagcatctatgatagaaaggtacgaaaatcaccaaaaagaccttgcgtccctcaaacaattcatcaaaaataacctaccagaaaaatacgatgaagtgttttccgaccagtcagaagatggttacgccggatacatcgatggtaaaaccacccaagaaacattctacaaatacatcaaaaacctattatccaaatttgaaggagctgattactttctagataaaatcgaaagagaagactttctaaggaaacaaagaacattcgacaatggatcaattccacatcaaatccacctacaagaaatgaacgcaattctgagaagacaaggagaacactatccattcctcaaagagaacaaagagaaaatagagaaaatactcacatttaggataccatattacgtaggcccactcgccagaggaaatcgagactttgcatggcttacacgcaattcagaccaagcaataagaccatggaactttgaagaaatcgtagacaaagcctcatctgcagaggacttcattaataaaatgacaaactatgacctctacctccccgaagaaaaagttttaccaaaacatagtctcctatatgaaactttcgctgtatataatgaattaaccaaagtaaaatttatagccgaaggacttagagattaccagttcctagactccggccaaaagaaacaaatagtaacccaactttttaaagaaaaacgcaaagttacagaaaaagatataatacagttcctacataacgtggacggctatgacggaatagaattaaaaggcatcgaaaaacagtttaatgcatctctaagtacgtaccatgatttattaaaaataataaaagataaagccttcatggacgacgctaaaaacgaggcaatattggaaaacatagtacatacccttaccatatttgaagatagagaaatgataaaacaaagattggcccaatatgacagtctatttgatgaaaaagtaataaaagcactaacacggcggcactatacaggatgggggaaactttcagccaaactaattaacggaataagcgacaaacaaaccggcaacacgatactcgattatttaatagacgatggagaaattaatagaaatttcatgcaattaataaatgacgacggcttatcatttaaagaaataatacaaaaagcacaagtagtcggtaaaacaaacgacgtaaaacaggttgtgcaagaactaccaggatcgccagcaatcaagaaaggtatcttacaaagcataaaaatcgtagatgaattagtaaaagtaatgggacacgccccagaaagtatagtcatcgaaatggcaagagagaaccaaacaacagctagaggcaagaaaaactcccaacagagatacaaacgaatagaagattccttaaaaattctcgcatcaggactaaatagcaaaatcctcaaagagcaccctaccgataacatacaactacagaatgacagattgtttttatattatttacaaaacggaaaagacatgtatacaggagaagcactggacataaatcaacttagttcttgtgatatagaccatataataccacaggctttcataaaagatgacagcctggataatcgtgtactaactagcagcaaagacaacagaggaaaaagcgataatgtaccaagccttgaagtggtcgacaaaatgaaagtattttggcaacaactattagacagtaaacttatatcttaccgaaaattcaataacctgactaaagcagaaagaggaggactgaatgaactcgacaaagtaggttttatcaaacgccaactggttgaaacacgacaaataacaaaacatgtagcccaaatccttgatgcacgattcaataaggaagtaacggaaaaagacaagaaaaaccggactgtgaaaataataacattaaaaagcaatctcgttagtaactttagaaaagagtttgaactttacaaagtcagagaaataaatgactaccatcatgctcatgacgcctatctaaacgccgtcgtagcaaaagcgatactgaagaaatatccaaaattagaaccagaatttgtttacggtgattaccaaaagtatgacctaaaaaggtacatatcaagaagcaaagacccaaaagaaatagaaaaagcaaccgaaaaatacttcttttattcaaatctactcaacttctttaaagaagaggtccactacgcagatggaacaattgtcaaacgagaaaacatagagtactcaaaagacacaggagaaattgcctggaataaagaaaaagactttgcaacaatcaagaaagtactaagtttaccccaagtgaacattgtcaagaaaagagaagttcaaactggtggattctcgaaggaatccatactaccaaaaggaaacagtgataaactcataccaaggaaaacaaaagatatcctttgggacacaactaaatatggcggattcgactcaccagtaattgcttattcaattctactcatagccgatattgaaaagggaaaagcaaagaaactcaaaacagtaaaaaccctagttggaataacaataatggaaaaagacgcattcgagaaaaacccaatagcatttctagaaaacaaaggatatcataatgtctgtaaagaaaatatattatgccttcctaaatatagcttattcgaattagaaaacggtcgaaggagattactagctagtgctaaagagttgcaaaaatgtaatgaaatagttctaccggtctacctaacgacactattataccacagcaaaaatgtacacaaactagacgaacccgggcatctagagtatatacagaaacacaggaatgaatttaaagacctgttaaacctcgtatcagagttctctcaaaaatacgtacttgcagacgcaaacctggagaaaatcaaaaacttatacgccgataatgagcaagcagatatagaaatccttgctaactcctttatcaacctccttacatttactgccctaggagcccctgcagcattcaaattctttggaaaagacgtagatagaaaaagatacactaccgtaagtgaaatactaaatgcaacactaatacaccaatcaataactggcttatacgaaacaagaatcgatctaagtaagctgggagaagactga

SEQ ID NO: 8953 - RNA, 4116 nt, synthetic construct
  misc_feature 1..4116: note = Cas9 variant
  source 1..4116: mol_type = other RNA
atgaaagtaaataactaccatatcgggctagatatcggaacatcttccataggatgggttgcaatcggagaagacggtaaaccactaagaataaaaggaaaaacagcaattggagctcgcttatttcaggaaggtaatcccgccgctgatagacgcatgtttagaacaactagacgtagactatcccgaagaaaatggagactaaaactcttagaagagatctttgatccctacataacaccagtcgatagcacgttctttgctcgactaaaacaatcaaatttatcacctaaagatagtagaaaagaatttaaaggctcaatgttattcccagacttaactgatatgcaataccacaaagactaccctacaatataccatctccgacacgcattaatgacacaggatgaaaaatttgacatacgaatggtatatctggcaattcatcatatagtaaaatacagaggcaacttcttaaacagcacacctgtagattcattcaaagcatctaaagtaaacttcgtagatcaattcaaaaaattaaacgaactgtacactgcgatcaaccccgaagaatcatttcagataaatttagcaaacagcgaagatatcggacatcaattcctcgacccatcaatacgaaaattcgacaaaaaaaaacaaattccaaaaatagtccctgtctctgtagacgacaaagccacagataaaattaatggcaagatcgcatccgaaattatcaacgcaatactcggttataaatccaaactcgacgtagtagtgcagtgcactcctgttgactcaaaaagttgggccttaaaatttgacgaagaagatatagatgcaaaactgcagaagatattaccagaaatggatgaaaaccaacaaagtataatagctatactccagaacctatattctcaagtaactctaaatcagattgtacccaatggcatgtcactcagtgagtctatgattgagaaatacaacgatcaccatgaccacttaaaattatacaaaaaaataatagatcagctggccgatccgaaaaaaaaagcagctctaaaaaaagcctattcgcaatacgttggagacgatggaaaagttatagaacaggctgacttctggagttcggtaaaaaaaaacttagatgactcggacctttctaaacaaattatggacttaatagatgcagaaaaatttatgccaaaacaaagaacaagccaaaatggagtcatacctcaccaattacatcaacgtgagctcgacgaaataatcgaacaccaaagtaaatattatccatggttagcagagatcaatccgaacaaacacgacctacacttagcaaagtataaaattgaagaactagtagcattcagagttccgtactacgtaggaccaatgataacaccagacgatcaagcgaaatcagcagaaacagtattttcatggatggagaggaaaggaaaagaagctgggcaaattaccccatggaatttcgatgagaaagtagatagaaacgcgtccgctaatcgatttataaagaggatgactactaaagatacttacctaattggagaagacgtactacccgacgaatcattactctacgagaaatttaaagttctaaacgaactcaacatggtacgagtcaatggaaaattattgaaagtagcagataaacaagctatattccaagacctattcgaaaattacaaacacatatcagtaaaaaaacttcaaaactatataaaatctaagactggactaccgtcagatcctgaaatttctggtctatctgatccagagtactttaataatagtctaggaacatataatgattttaaaaaattattcggcaacaaagttgatgaaccagaccttcaagacgatttcgagaaaatcgtcgaatggtcgacagtatttgaagacaaacgaatcttacgagaaaaactaaatgaaataacatggttgtctgatcaacaaaaagacgttctagaatcttccagataccagggatggggaagattatctaaaaaattactcaccggaatagttaacgaccaaggagagagaataattgatgaactatggaatactaataagaacttcatgcaaatacaatcagacaacgatttcgcaaaacgaatccatgaggcgaatgcagatcaaatgaaagcagttgacgtagaagacgtcttagcagatgcgtatacaagtccacaaaacaagaaagctataagacaagtagtaaaggtagtagatgatatacaaaaggcgatgggtggagtagcacccaaatacatatcaatagaatttactcgaagcgaagacagaaaccctcgaagaaccatatcgagacaaagacaattagaaaataccctaaaagacactgcgaaatccctagccaaaagtataaatcctgagttattatcagagttagataatgcggctaaatcaaaaaaaggcttaatagatagactatatctctacttcacacaattagggaaagacatctacacaggcaaaccaataaatatagatgaaatctcaacctatgatatagaccatatactccctcaagctttcgtcaaagacgatagtttaaataacagagtactagtctctaaagcaattaataacggaaaatcagacaatgtcccagtccaattattcggcgcaaaaatgggacacttctggaaacaactcgccgaggccggtctaatatccaaaagaaaactaaaaaacctacaaacagatcccgatacaataagcaaatatgcaatgcatggctttataagaagacaactagtagaaacttctcaagtaattaagttagtagctaacattcttggtgacaaatatcgcaatgacgacacaaaaatcatcgaaattaccgcaagaatgaatcaccaaatgagagatgaattcggattcataaaaaaccgagaaatcaacgactaccaccacgcctttgatgcctacctaaccgctttcttagggagatacttgtatcatagatacataaagctaagaccatatttcgtttacggcgatttcaaaaaatttaaagaagataaagtaacaatgcgaaacttcaatttcctacatgatctcaccgatgatacacaagaaaaaatcgcggacgcagaaacaggagaagtgatatgggatagagaaaattccattcagcaattaaaagacgtctaccattacaaattcatgcttatatcacatgaagtttacacacttagaggagcaatgtttaaccaaaccgtttatccagcatccgacgctggcaaaagaaaattaatcccaataaaagctgatcgccctattaacgtatatgggggatactccgggtccgccgacgcatacatggcaatagtaaggatccacaataaaaaaggagataaatatagagtagtaggagttcccatgcgagcaagagatagattggatgcggcaaagaaagtcagcgacgccgactacgaccgggccctcaaagacgtactcacacctcagctaacaaaaacaaaaaaaagccgcaagacaggagaaataacacaagtagtagaagacttcgaaatagttcttggtaaagtaatgtatagacaactaatgatagacggagataaaaaattcatgctaggctcgtcaacctatcaatataatgctaaacaacttgtactttcagaccagagtgtcaaaacattagcgtcaaaaggaagactagacccactccaagaaagcatggattataataacgtatacacagaaatattggataaagtcaatcaatacttttccttgtacgatatgaacaagtttagacacaaactaaatctaggtttctcaaaattcatatcattccccaaccacaatgtattcgacggtaatacaaaagcatcaagcggaaaacgagagatattagaagaagtactaaacggactccatgccaacccaacatttggcaacttaaaagacataggaatcacaacaccattcggtcaattacaacaaccaaacggcatcctcttgagcgatgaagcaaaaattagataccaatcccccacaggactcttcgaaagaactgtatcattaaaagatttatga

SEQ ID NO: 8954 - RNA, 4116 nt, synthetic construct
  misc_feature 1..4116: note = Cas9 variant
  source 1..4116: mol_type = other RNA
atgaaggtcaataattatcatatcggcctagatataggtacctcatcaatcgggtgggtagcgattggaaaagacggcaaacccctacgagtaaaaggaaaaacagctataggcgcacgattgtttcaagaaggtaaccctgccgcggaccgacgaatgttcagaacaacacgaagacgtctatcaagaagaaaatggagacttaaattactggaagaaatatttgatccctacataaccccagtcgattcgaccttctttgcaagattaaaacaaagtaatcttagtccaaaagatagccgaaaagagttcaagggatcaatgctatttccggaccttacagatatgcaatatcacaaaaattaccccacaatatatcatctaagacatgctctcatgacacaagacaagaaattcgatatacgcatggtgtacttagcaatccaccacatagtcaaataccgaggaaacttcttaaactcaacaccagttgactcgtttaaagcaagcaaggtagacttcgtagaccaatttaagaaacttaacgaactctatgcggcaataaatccagaagaatcattcaagatcaacttagctaactcagaagatattggacaccaatttctagatcctagcatcagaaaattcgacaaaaagaaacaaataccaaaaattgtcccagtcatgatgaacgacaaagtaacagacagattaaacggtaaaatagctagcgaaattatacatgctatactcggctacaaagcgaaactagatgtagttttacaatgcacgccagtagactcaaagccttgggcactcaaatttgacgacgaagatatagatgccaaactcgagaaaatattaccggaaatggacgaaaaccagcaatcaattgtggcaatattacaaaatctttattctcaagtgacactgaaccaaatcgttcctaacggtatgagtctcagtgaaagcatgatcgaaaaatacaatgatcatcacgaccatctaaaactttataagaaactaattgatcaacttgctgatcccaaaaagaaagccgtactaaagaaagcatactcacaatatgtaggcgacgatggaaaagtcatcgaacaagccgagttctggtcatctgttaagaaaaacctagacgatagcgaactaagcaaacaaataatggacctcatagatgcagaaaaatttatgccgaaacagagaacatcacaaaacggtgtaataccgcatcaactccaccaaagagaactagatgaaataatagaacaccagagtaaatattacccctggctggtagaaatcaatccaaataaacacgatctccatttagcaaaatacaaaatagaacaactcgttgcatttagagtcccttactacgttggtccaatgataaccccgaaagaccaagcggaaagtgcagaaactgtattcagttggatggaaagaaaaggcactgaaacgggccaaataacgccctggaatttcgacgaaaaagttgaccgcaaagcatctgccaacagattcatcaaaaggatgactacgaaagatacttatttaataggagaagacgtactacccgatgaatcattactctacgaaaaattcaaagtactcaatgaactcaatatggtcagagtaaacggaaaactactaaaagtagcagataaacaagcaatattccaagacctcttcgaaaactataaacacgtttcagtaaagaaactccaaaattacattaaagcaaaaacaggattaccgagtgatcccgaaatatcgggcctaagtgaccccgaacactttaacaatagtttaggaacatacaatgattttaagaaactatttggtagcaaagtagatgaacccgaccttcaagacgactttgagaaaatcgtcgaatggtcaaccgtattcgaagataagaaaatactaagagaaaaattaaatgaaataacatggctttccgatcaacaaaaagacgtactagaatcctcgagatatcaaggatggggtcgccttagtaagaaactcttaactggaatcgttaatgaccaaggagaaagaataattgacaaattatggaatacaaataaaaacttcatgcaaatacaaagtgatgacgactttgctaaacgaatacacgaagcaaatgctgatcaaatgcaggctgtagatgtcgaagacgtgttagcagatgcatacacatctccacaaaataagaaagcaattagacaggtagtaaaagtagttgacgatatacaaaaagcaatgggaggtgtagcaccaaaatacataagtatagagttcacacgctctgaagacaggaacccaaggcgaacaatttcacgacaacgacagctagaaaacacactaaaagatactgcaaaatcactagctaaaagtattaatccagaattactgtccgaattagacaatgcagctaaatctaagaaaggtcttacagaccgactctatctgtatttcactcaattggggaaagacatatacacaggagaaccaattaacatagacgaactcaataaatacgacatcgatcacatattaccacaggctttcataaaagataatagcttagataatcgcgtattagtcttaacagcagtaaataacggaaaaagtgacaatgtaccactcagaatgttcggggcaaaaatgggccacttttggaagcaattagcagaagcaggtttaatttcaaaacgcaaacttaaaaatctacaaacagatccagatacaataagcaaatatgcaatgcacgggttcataagaagacagctagtggaaacttcacaagtaataaagctagtcgctaacatactcggagataaataccgcaatgacgacactaaaataattgaaataaccgcaagaatgaatcatcaaatgagagacgaatttggatttatcaaaaatagagaaataaatgattaccatcatgctttcgacgcctatctaaccgctttcctcggcagatatttataccatcgttatataaaactcagaccgtactttgtctacggagactttaagaaattccgagaagataaagtgactatgagaaactttaatttcctacacgatctcacagacgacacgcaagagaaaatagcggatgcagaaacaggtgaagtaatatgggatagagaaaattcaatacagcaattaaaagacgtataccattacaaattcatgctaatatcacatgaagtatacactctacggggtgcaatgttcaaccaaactgtctatcccgcatcggacgcaggtaaaagaaagctcattcctgtaaaggcagacaggccagtgaacgtatatgggggatatagcggaagcgctgatgcatacatggcgatagtacgaatacacaacaagaaaggagacaaatacagagttgtaggagtgcctatgagagctctagatagattagatgcagctaaaaatgtaagcgatgccgattttgacagagctctaaaagacgtgctagctccacagctcacaaaaaccaagaaaagtagaaaaacaggagaaattacacaagtcatagaagacttcgaaatagttctaggcaaagttatgtaccggcaactaatgatagatggtgacaagaaattcatgctgggatcaagtacttaccaatacaacgcaaaacaactcgtcctctcagatcaaagcgtaaaaacactggcaagtaaagggaggctagatccactccaagaaagtatggactacaacaacgtatatacagaaatcttagataaagtaaaccaatattttagtttatacgacatgaacaaatttagacacaaattaaatttaggattcagtaaattcatatcctttccaaatcacaatgtcttagacggaaacacaaaagtaagttcgggaaaaagagaaatactccaagagatcctgaacggactacacgccaatcctacattcggaaacctaaaagacgtaggaataaccacaccatttggacaactccaacagcccaatggaatacttctatcagacgaaacgaaaattcgttatcaaagtccgacaggtctttttgaaaggactgtctcactaaaagatctctga

SEQ ID NO: 8955 - RNA, 4116 nt, synthetic construct
  misc_feature 1..4116: note = Cas9 variant
  source 1..4116: mol_type = other RNA
atggataagaaatactcaatcggattagacataggaaccaattcagtagggtgggcagtcattaccgatgactataaagtaccgtccaagaaattcaaagtactaggaaacacagaccggcatagtatcaagaaaaacctaataggagcattattattcgactcaggtgaaacagcagaagctaccagactaaaacgtacagcgagaagaagatatactcgaaggaaaaacagaatatgttatttacaagaaatatttagtaatgaaatggctaaagtagatgatagcttctttcatcgactagaagaatcgttcctagttgaagaagataagaaacatgaaaggcatcctatatttggaaacatagtagatgaagtagcctatcacgaaaaataccccaccatttaccaccttaggaagaaactagcagatagtaccgacaaagcagacttacgactgatatacttagcattagcacacatgataaaattccgaggacacttcctaatagaaggcgaccttaacccagacaattctgacgtagacaaactattcatccagcttgttcaaacctataaccaactattcgaagaaaacccaattaacgcgagtcgtgtagacgcaaaagcaatcctaagtgcaagactatcaaaatcacgccgactcgagaacttaatcgctcaattaccaggcgagaagaaaaacggactatttggaaaccttatagcattatcccttggattgacaccgaacttcaaaagtaactttgacttggcagaagacgcgaaacttcaactatcaaaagatacatatgacgacgacttggataacttgcttgcgcaaataggcgaccagtatgccgacttgtttttggcagccaaaaatctatcagacgcaacgcttctaagcgatatattaagagtaaatagcgaaataacgaaagcacccttatcagcaagcatgataaaaagatacgatgaacatcatcaagacttaacactgctcaaagccctagtacgacaacaactacccgaaaaatacaaagaaatcttctttgaccaaagcaaaaatgggtatgcaggatacatagacgggggagcctctcaagaagagttctacaaatttattaaaccaatactagagaaaatggacggaacagaagaactattagcaaaactaaaccgagaagatctgctacgtaaacaaagaaccttcgacaatggaagcatcccacatcaaatacacttaggagaactacacgctatcttaaggagacaagaagacttctatccattcctaaaagacaatagggagaaaattgagaaaatattaacattccgcataccatattatgtcggtccgcttgcacgtggtaattctagatttgcctggatgacaagaaaaagcgaagaaacaatcacaccttggaactttgaagaagttgtagataaaggagcaagcgctcaatcatttatagaaagaatgacaaactttgacaaaaacctgcccaacgaaaaagtactacccaaacacagcctactatacgaatatttcactgtatacaatgaactcacaaaagtcaaatatgtaacagaaggtatgagaaaaccggcattcttaagtggcgaacaaaagaaagcaatcgtcgatttactgtttaagacaaatcgaaaagtaacagtaaaacaattaaaagaggattacttcaagaaaatagaatgctttgatagtgtggaaataagcggtgtagaagacagatttaatgcctcactaggaacataccacgatttactaaaaattattaaagataaagatttcctagataacgaagaaaacgaagatatactcgaagacatagtactaaccctcaccttattcgaagacaaagaaatgatagaagaaaggcttaaaacatacgcacatttattcgatgataaagtcatgaaacaactaaaacgacgccattatacaggatggggaagattaagccgcaaactaataaacggcattcgggataaacaaagtggtaaaaccatattagattttcttaaaagtgatggattcgctaaccgtaacttcatacaactgattcacgacgatagtttgaccttcaaagaagcaatacaaaaagcacaagtatctggccaaggacattcattacacgaacaaatcgccaacctcgctggaagccctgctatcaagaaaggaatacttcaatcagtcaaagtagttgatgaattagtaaaagtaatgggacacaaacctgaaaacatagtaatagaaatggcacgcgaaaatcaaacgactcaaaaaggacaaaagaatagtcgtgaaagaatgaaacgaatcgaagaaggaatcaaagaattaggatctcaaatcttaaaagaacacccagtagaaaatacgcaactacaaaacgaaaaactctatctatactatctacaaaacgggagagacatgtatgtagatcaagaacttgacataaacagattatctgactacgatgtagatcacattgtaccacaatcatttataaaagatgacagtatcgataataaagttctaacaagaagcgataaaaacagaggaaaatcagacgatgttccatccgaagaagtagtaaagaaaatgaaaaattactggcgacaactacttaatgccaaactaattactcaacgtaaattcgacaatttaaccaaagcagaacgtgggggactttcagaattagacaaagcgggatttattaaacgacaactcgtagaaacaagacaaataaccaaacacgtagcacaaatcctagacagcaggatgaatactaaatacgatgaaaatgacaaactcatccgtgaagtaaaagtgataacgctcaaatcaaagctagtatcggattttagaaaagactttcaattctacaaagtaagagaaattaacaactatcatcacgctcatgatgcatacctgaacgcagtagtcggaacagccctcatcaagaaatatccgaaactagaaagcgagttcgtgtacggagactataaagtctatgatgtacgaaaaatgatcgcaaaaagtgaacaagaaataggtaaagcaacagctaaaagatttttctatagcaacataatgaatttcttcaaaacggaaataacgctagctaacggagaaataagaaaaagaccattaatagaaactaacgaagaaaccggcgaaatagtgtgggacaaaggacgtgatttcgcaacagttagaaaagttctatcaatgccccaagtaaacatagtcaagaaaacagaagtccaaactggtgccttaacaaatgaatcaatttacgctagaggctctttcgacaagctaataagtagaaaacatcgatttgaaagcagcaaatatggagggtttgggtcacctacggtcacgtacagtgttcttgtcgttgcaaaaagtaaagtacaagacggaaaagtcaagaaaattaagacaggaaaggaattgataggaataacacttctcgataagctagtattcgaaaagaaccccctaaaatttatcgaagataaggggtatggaaatgtacaaattgataaatgtataaaactacctaagtactcactattcgaatttgaaaacggtacaagacgaatgttagccagtgttatggcaaataataattcaagaggggacctacaaaaagccaatgaaatgttcctaccagcaaagctagtgacactattatatcacgcgcacaagatagaatcatcgaaagaacttgaacacgaggcttacatattagaccactacaacgatttatatcaattactatcctatatagaaagatttgcaagtttatacgtagacgtcgagaaaaacattagtaaagtcaaagaactattcagtaacatagaaagctattcaatatcagaaatctgcagctccgtaataaacctgctaactctaacagcatcaggagctcctgcagactttaaattcttaggaacaactataccaaggaaaaggtacggatcacctcaaagtatcctatcatcaaccctcattcaccaaagtataaccggtttatatgaaacaagaatagatttatctcaactaggaagtgattga

SEQ ID NO: 8956 - RNA, 4119 nt, synthetic construct
  misc_feature 1..4119: note = Cas9 variant
  source 1..4119: mol_type = other RNA
atgaacaatgaatacttcgttggatttgatatcggcacaaattctgtaggcgcggcagtcacagacgaaaaataccacgtcttaaaatttaaaggcaacgcaatgtggacaagtgctgttttcgaaagcgcacaacaatccgccgatagaagactcaacagaacagcaaggcgaagactagatagatcccagcaaagaagagacttattacaggaattgattgctccagccataaccccagttgacccaaggttctttgatagaatcagggaatccgcactatgggcagaagacaaaactacaggttccagatttacatacttttcagatgaaggatataccgataaacagtatcataaagaatacccaacaatacatcacttaatttgttcactaatgaatgacccagcaccacacgatccgaggctagtgtatatagcatgttcctatatgttaacacatagaggacattttctaaacgaagcagataaagagaaaattgatgatgtgcttgacattagaagggtgtttaatgaattatgtagctggtttactagctatggtattgaagttccattttcgtgctttccagaagagttcggcaatgtactcaccgcaaacagaggagtacaagacagaacgcgtgcattctacgacctattattcgccggcaagaaaccaaaaccatctgaagacgatcaggtagacatagatgtattaatcaaactaatatctggaggaaaaatagaattatctaaactatttcttaacgaagaatactcagaactagaaaacaacaaaatacaactgtccgatgcaggtttcgatgaaaaagaaccagaattaagaagtgaactaggagatgattttggactcgtggcagcagctaaaaacatctacgactggagcttactaacaggagtacttggagaatgcaaatcaatatcagaagcaaaagtaaaaacatacgaaaaacactcggaagatctggctgctcttagaagagtagtaagaaaatatcacccggataaatataaagaaatcttcaagaaatacgtagtaggaaattacacatcatactcaggcaatgtaaaatcagcgggaaaaatctcagaaacaaaattaaagagatgcaatcaagccgaattttgcgattatttaaaaagtaaattaaaggacgtaaaaccagcaccaggagacgatgaatgcgaaagagtattaaaagaaataagtaaacatacgttctgccctagacaagtaactacagataaccgagtaataccctatcaactttattatacagaactaaagaaagttttagaaaatgcaaaaagatatatccctcaactaaacgtaacagatgagtacggaagtgcagcagacaaaatattatcattgatgacatttcgaataccatattacgtgggccccctagtaaagaaaaatgacagcagtaatgcctggatagtccgaagaggagagggtagaattttaccatggaatttcgacgagctagtggacaaagataaatgcgaagacgaatttatacgccgaatgacatgcaaatgcacatacattgcaggtaaaaacgtcctccccaaaaattcattgttatattgtaagttcatggttctcaacgaaattaataacataaaaatcaatggagaaagaattagcgtcggagataaacagaaaatttatactgaactttttgaaaagaaaagaaaagtcactgtgagagatattcggaaccttctaacatcagagggaagactaaaagccggagatacgtttggaggaatagacataacagtgaaatcatcactcaaaccacaacatgaccttaaacgtttaatggcagccggagttataacagaggcagatgcagaagaaataatagaaagaataacctgcacaaccgacgttagcagattaagaacctggctgggtaaatttggactaagcgctgcagacgctaaatacgtgagcggactaaaatattctgatttcggccgactaagtcgcgagttcttaacggaagtcaatgatgtggatccagcaacaggagaagtaataaacccaaacatcataacgatgatgtgggaaaataatataaatttaatggaactccttagtcaaaaatacagttacagatctcaaatagaatcgatgaatagagaatactatgcagcaaacccattgacactagacgaaagaatgtccgaaatgtacataccatcagcagttagaagacccgtaaaacgaacgatagaaatgatgaaagaatacatgcatataatgagaaaaccccctaaacgaattttcatagaaatggcacgtgaacttacagacttggacaataaagggaaaagaacttcctccaggcgaaatacattattagagttctttaagaaatgtcctcaagatactactgaactaagagcgcaactcgaaaagaaatcagacgatgaattaagatcagaaaaactatatttatattttgcacaactgggaaaatgtatgtattccggtgaatcgatagatattgaacgactaggttctaaattgtatgatgtagatcatatctttccacaagccagagtaaaagacgatagcatcgaaaataaagtattagtgttgagcgatcttaacggtgcgaaaagcgaccgataccccataaatgcagacatccgtaataaaatgcacagtttttgggataaactacattctatcgggctcataggggagaagaaatatgaacgacttacaagatcaacgggattcacagatgatgaattggcgggattcataagccgacaattagtggagacacgacaaagcacaaaagctgtagccgcattattagcagaagaatttcccgaatccgaaatagtttacgtgaaagcaggactggcctcacaatttcgccacgagttcggattattgaaatgtagagaaattaatgatttgcaccatgcgaaagatgcctatttaaatatagtaatgggaaatatatatcatgtaaaatttaccaaagacccaatgaatttcgtcaaagaatacagacgaaaagaacaagtttttgatttgaaaattcaaagtatgcttacacatgacgcaattagaaacggagaaacagcttggataggagacggaacttggctagaaacagttaagaaacaaatggaaaagaacaacataagatatgtaagatattcgttcagaagaaaaggagccctttttaatttaatgccagaacggaaaaacccatcactacttcctcgcaaaaatggtaaaaatatggtcttacctgcggaaaaatacggaggatataacaatacagccgcatcatttttcagtttagtcaaatatcattcagctaaaggatctggagtggtcatcataccagttgaattaatacacgcacatcgatatgaacacgactcaagtttcgctgaagaatacgctttacgcgttctcgcagacatcgtgtcactcaagaaaggtgatgtattgcaatcagtcgagttcccgctaggatcgaggatactaaaagtaaatactctactagatatagacggctttagagctaatatcacaggaaaagattctggaggaaaatatctaggcatatcgtctgccagtagcctaattataagtcaagttgatacaacttacattaaacgcgtcatttcaataaacgaacgaatatccgcatgtgagaaaaacaaacaatcatataccattcgaccagaatttgatgtcataacaagcgaacgtaatatagaaatctacaatatgttatgtgagaaaatatcatctcgaccattttgcataaaatttgcaaacacaagcgacacttttgtttcaggaagagaaaaatttatagcactaagtctaaatgaacaagtaaaaacattaacaaatatgttatctgttttcaaaacaggcagagcatcaggatgcgatttaactaacatagggggaagtaaaaacacggcaatagtaaaactaaatgcagttttatcaaaccttaaagactttaaatccgtacgaataatagaccaaagccctacgggactatatgaaaaagtttcaccaaatttacttagcttatga

SEQ ID NO: 8957 - RNA, 4119 nt, synthetic construct
  misc_feature 1..4119: note = Cas9 variant
  source 1..4119: mol_type = other RNA
atgacaaagaaaaattacagtataggtctagacataggcaccaactcagttggatgggcagtaataacagatgactacaaaatacccgctaagaaaatgaaagtactaggaaacacagacaaagaatatataaagaaaaacctactaggagcgttgttattcgatagcggagaaaccgcagaagccacacgactaaaacgcactgcacgaagacgctacacccgaaggaaaaacagactcagataccttcaagaaatatttgcagaggaaatagcaaaagcagacaactcatttttccaacgactagatgaatcattcctgaccgatgacgataaagattttgactcacatccaatattcggcaacaaagctgaagaagatgcctaccatcaaaaattcagtacgatctatcatttaagaaaatatctagcagactctccggagaaaagtgatctacgcttagtatatttagcactggctcatatgatcaaataccgaggacacttcctaattgaaggcgaactaaaagcagaaaacacagatgtacaaaaattatttactgattttgtagaagtctatgatagaacattcgatgattcacatttatctgaagtaacagttgacgcctcaagcatcttaacagagaaaataagcaaatcaagaagattagagaacctaatagaatcatatcccaaagaaaagaaaaacacattattcggaaacctaattgcgttatcattaggcttacaaccgaattttaaaacaaatttcaaactttcagaagatgcaaaattacaattctctaaagacacatacgaagaagacctagaagaagtacttgagaaaattggtgacgattatgcagacttattcacaagcgccaaaaacctatatgatgccatcctactctcaggtatccttacagtagatgatagttcaaccaaagcaccattatcagcatcaatgataaaaagatatgcagaacatcatgaagacttagaaaaactgaaagcctttattaaaaccaacaaaccaaacctttaccatgacatattcaaagacgaaacccaaaacggatatgctggatacatagaaaacggcgtaaaacaagacgagttctataaatacttaaaaacaatcctatcaaaaaccgatgggtcagaatactttttagataaaattgaacgcgaagattttctacgaaaacaaagaacatttgacaatgggtcgataccccaccaaattcatctccaagaaatgcacgcaattttgagaagacaaggagattactatcccttcctgaaagaaaatcaagacaggatagagaaaatactgacatttcgtattccctattatgtaggacccttggcaaggaaaaactctagattcgcatgggcagaatatcattccgatgagaaaatcacaccatggaacttcaataaagtaattgacaaagaaaaatccgctgaaaaattcataactagaatgaccttgaatgatctttatctaccggaagaaaaagtactaccaaaacattcacacgtctatgaaacatttgcagtgtataatgaattaacaaaaataaaatatgtaaacgaacagggaaaagaagcatttttcgattcaaacatgaaacaagaaatattcgaccacgtttttaaagaaaacagaaaagtcacaaaagaaaaactacttaactacctcgataaagaatttcctgaatatagaatccaagacctaataggactagataaagaaaacaaatcattcaacgcaagtctaggaacataccatgatctcaagaaaatcttagataaatcatttttagacgataaagtcaatgaagaagttatagaagacataatcaaaaccttaacactatttgaagatagagaaatgatccaacaaagattacataaatacagcgatatcttctcaactcaacaattgaagaaattagaacgtcggcattacacaggatgggggagattaagttataaactaattaacggtataagaaacaaagaaaataataaaacaatattggaatacttaatagatgacggatatgcaaatcgtaattttatgcaactaattaatgatgatacactaccttttaaacaaattataaaagacgcacagattatcgggaatatagatgacatagcagcagtagtacatgaattgcccggatctcccgcgataaagaaaggcatcttacaaagtataaaaatagtagacgaactggtaaaagtgatgggtcataacccagataacatagtaatagaaatggcaagggaaaatcaaaccacaaacagaggcagatctcaatcacaacaacgactaaagaaattacaagatagcttaaaagaactaggaagcaacatattaaacaaaaagaaaccatcttatgtagaagacaaagtagaaaatgtccacttacaagacgaccgactcttcctttactacatccaaaacggaaaagatatttacactggcgaagaattagacatcgacaggctatccgactacgacatcgatcacattatcccacaggcattcataaaagacgattcaattgacaatagagtattaacatcctcggccaaaaatcgaggtaaaagtgacgacgtccccaacctagatatcgtaagggcaagaaaagcagactgggtaagattatacaaaagcgggctcataagtaaacgaaaatttgataaccttactaaatcagaacgtggaggtttaacagaagccgataaagcaggttttataaaaagacaactcgtagaaacccgccagattactaaacatgtcgcacaaatccttgacgcccgatttaacacagaacacgatgaagacgataaagtaatccgcaacgtcaaagtaattaccttaaaatccaacttaatatcacaatttagaaaagatttcaaattttataaagttcgagaaataaatgactaccatcatgcacatgatgcctacctgaatgcagtagtaggaactgctctcttacgtaagtatcctaaactcgcaccagaatttgtatacggcgaatataagaaatatgacgtcagaaaactaataacctcaagctctgataaggcaacggccaaatacttcttttatagtaacctaatgaacttctttaaaagagtagtaagatactcgaacggcagggtaatcgttagacccgtcatcgaatacagcaaagacacaggtgaaattgtctggaataaagaaacagattttcgaacaatatgcaaagttctatcatatccacaagtaaacatagtcaagaaagtagaatcacaaactggaggtttctccaaagaaagcatactaccaaaaggtgatagtgacaaattaatacccagaaaaaccaagaaagtatattgggacacgaagaaatacggaggtttcgactcacccataatagcctatagcgtctttgtagtggcagatgttgaaaagggaaaagccaagaaacttaagaaagtcaaggaattagtgggtatctcaataatggaaagaccatcttttgagaaaaatccaatagtattcctagagaagaaaggttataggaatgtacaagaagacacactaataaaacttcccaagtactctttgtttgaatttgaaggaggacgacgaagactccttgcctccgcatcagaactccaaaagggcaacgaggtcgtactgtcagaccggctagtggaactcctataccatgcccatagagtaaatagtttcaatagtacagagcacttaaaatacgtatccgaacacaagaaagagttcggggaagtattatcatgcgttgaaaattttgccaattcctacgtagacgtagagaaaaatttagacaaaatccgcgcagtgatcaataaaatagatacctttagcatagaagaaatctccacaagttttgtcaatttattaacactgaccgcactaggtgccccagcagattttaacttcctaggaaagaaaataccaagaaagagatacacaagtacgaaagaatgcttaaacgcgacattaattcaccaatcaataactgggctatacgaaacaagaatagacctatcaaagttaggagaggataaatga

SEQ ID NO: 8958 - RNA, 4119 nt, synthetic construct
  misc_feature 1..4119: note = Cas9 variant
  source 1..4119: mol_type = other RNA
atgacaaagaaaaattactcaataggtctagacataggcacaaattctgttggctgggctgtaataaccgacgactataaagtaccagccaagaaaatgaaagtactaggaaacacagacaagaaatatatcaagaaaaacctattaggtgcattactattcgactcaggcgaaaccgcagaagctacacgcctaaaaagaacagcacgcagacggtatacaagaaggaaaaacagattacgctacttacaagaaatattcgcgaatgagattgcaaaagttgatgagagctttttccaacgattagacgaaagtttcttaactgacgacgataaaacctttgatagtcatccaatatttggaaataaagctgaagaagacgcataccatcaaaaatttccaacaatctatcatctacgtaaacatttagcagactcatcagaaaaagcggacctacgcctagtttacctagctctcgcccacatgatcaaatttagaggtcacttcttaatagaaggtgaactaaatgctgaaaataccgatgtacagaaaatattcgcagactttgtaggagtctataacagaacgttcgatgactcgcatttaagcgaaataacagtagacgttgctagcatcctaaccgaaaagatatccaaaagtcgacgcctcgaaaacttaataaaatattatccaacagagaagaaaaatacactatttggtaatttaatagctttagctctgggacttcaaccaaactttaaaacaaacttcaaattatcagaagatgcaaaattacaattctctaaagacacatacgaagaagatctagaagaactactaggaaaaataggagatgactatgcagacttattcaccagcgcgaaaaacttatatgatgcaatcttactatcaggcatccttacagttgatgataactcaaccaaagcacccttatccgcctcgatgataaaaagatatgtagaacatcatgaagacctggaaaaacttaaagagttcattaaagcaaacaaaagtgaattataccacgatatttttaaagataaaaacaaaaacggatacgcaggttatatagaaaatggagtaaaacaagacgaattttataaatacctcaaaaatatactaagcaaaataaaaatagatggatcagattacttcctcgacaaaattgaacgtgaagacttccttagaaaacaaagaacattcgacaatggaagtataccgcatcaaatacacttacaagaaatgcatgctattctacgccgacaaggggactactacccattcttaaaagaaaaacaagatagaatagagaaaatacttaccttcagaatcccttactacgtagggccacttgtaagaaaagactcacgcttcgcatgggcagaatacagatccgacgagaaaataactccgtggaacttcgataaagtgatagacaaagaaaaatctgctgaaaaattcataacaagaatgaccttaaacgacttatacttacccgaagaaaaagtactaccaaaacacagccacgtatatgaaacttacgcagtgtacaacgaactaactaaaataaaatatgtaaacgaacaaggaaaagaatcattcttcgactctaatatgaaacaagaaatttttgatcatgtttttaaagaaaatagaaaagtaacaaaagaaaaactacttaattacttaaacaaagaatttcccgaatatagaatcaaagaccttataggattggataaagaaaacaagagctttaatgccagtctagggacatatcatgatctaaagaaaatactcgacaaggcattcttagacgataaagtaaatgaagaagtaatcgaagatataataaaaaccctaaccctattcgaagataaagatatgatacacgaaagattacaaaaatattctgatatatttacggcaaatcaactaaagaaactagaacgcagacattacacagggtggggcagactatcatacaaactaataaacggtataagaaataaagaaaacaataaaacaatattggattacttaatagatgacgggtcagcaaatagaaacttcatgcagctcataaatgacgacacattaccatttaaacaaataatacagaaaagccaagtagtaggtgatgtagatgacatagaagccgtagtccacgatctccccggatctcccgccatcaaaaagggaatccttcaatcagtaaaaatagtagatgaactcgtaaaagtaatgggaggaaatccagacaacatagtaattgaaatggcccgagaaaatcaaaccacaaatagaggaagaagtcaatcccaacaaagattaaagaaactacaaaactcactaaaagaactaggttcaaacatcctaaatgaagaaaaacctagctatattgaagataaagtcgaaaattcccatctacaaaacgaccaactttttctctactacatccaaaacggcaaagatatgtacactggcgatgaactagacatcgaccacctgtcagactatgacatcgaccatataataccacaagcattcataaaagatgactctatagacaatagagtgttaacaagcagcgctaaaaacaggggaaaaagtgacgacgttcccagcctagacattgtaagagcacgaaaagcagaatgggttcgactatataagtcaggattgatctctaaacgaaaatttgacaatttaactaaggccgaacgaggaggtttaactgaagctgacaaagcaggcttcataaaaagacaattagttgaaacacgacagataacaaagcacgttgcacaaatcctagacgctcgattcaatacagaacatgacgagaatgacaaagtcattcgagacgtgaaagtaatcacattgaaaagcaacttagtatcccaatttagaaaagactttgaattttacaaagtacgcgaaataaacgactatcaccatgcgcatgacgcctatctgaatgcagtagtaggaacggcattattaaagaaataccctaaattagcaagtgagttcgtatacggtgaatacaagaaatatgacattagaaaattcatcaccaacagtagtgataaagcaacggcaaaatatttcttctactctaatttaatgaactttttcaaaacaaaagttaaatacgccgacggaacagttttcgaaagacccatcatcgaaacaaatgcagacggtgaaatagcatggaacaaacagatcgactttgagaaagtaagaaaagtcctaagctacccccaagtaaacatcgttaagaaagtagaaacacagacaggcggattttcgaaggaaagcatcctacccaaaggggactccgataagttaatcccccgtaaaaccaagaaagtatattgggacactaagaaatatggaggcttcgacagcccaaccgtcgcctactcagtattcgtcgtggctgacgtagaaaaaggaaaagccaagaaactaaaaactgtaaaagaattagtgggaatttctatcatggaacgttcattctttgaagaaaacccagtagaatttttagaaaacaaaggctatcacaatataagggaagataaactgataaaactaccaaaatacagcctattcgagttcgaaggcggcagaaggagattactagcatctgcctcagaactacagaaaggaaacgaaatggtcctacctggatacttagtcgagttactataccacgctcaccgggcagataattttaactcaacggagtatttgaactatgtctcagagcataagaaagagttcgaaaaggtactaagctgtgtagaagacttcgcaaacttatacgttgacgtagagaaaaacctaagcaaaatacgagctgtagccgacagtatggacaacttcagcatagaagaaatatcgaacagcttcattaacctactgacactcactgccctaggcgctccagccgacttcaacttcctcggagagaagatcccaagaaaaagatacacttcaacaaaagaatgtctaaacgcaaccctcatacaccaaagcataaccggactatacgaaaccagaatagacctctcaaaacttggggaggaatga

SEQ ID NO: 8959 - RNA, 4119 nt, synthetic construct
  misc_feature 1..4119: note = Cas9 variant
  source 1..4119: mol_type = other RNA
atgaatagcgacaaacgagaggactactatgtgggactagacatgggcacaggtagcctaggaggtgcagtaaccgacacacaatatcaccttctcaaagtaaaaggaaaagacttctggttcgtacgcgaatatgaaacagccaaatctcagcttgatagaagaacacatagaatcgctaaaaggaggctacaaagacacaaggcacgaataggtctaatcagaagctactttgcagaggatatccttaaacatgacccccttttctacatacgtcaagataatagtaaatattaccacgaagataaagacgtacgcttgacaactaaggacagtatatttgcagatccaggatacggggacaaggaatatctagatgacaaagaatatcccacaattttccaccttcgacaggcccttctaagagaccaaataaaagacgaggaaagatactctagatttctttacttggcaattataaacatgttcgagcataggggacatttccttttaaatacagaaagtagcgacttaaacgcagatatgataaaagatgtaggggagctagtaatgaacgcgatatgtggcgtatcagaatacggctcagtcacctacaaagaaataatagaaatcctggaagacaaaaatatctctagaacagcaaaaaaagatcaaatagcaagtaaaatagacattaaaaaatccgaaaaagctcaaatggaaagaataaaatgtctttgtgggatggaagcagatgcaagagtaatgtttgaaatcgaagcagacgaaaaaataaaaatagcctttcaacaagcagcatttgaagatgaaaaagaagaaatagaagcagtaataggcgaagacagatatttaatcattgaaaacatgaaacaactatatgattacagccagttacaaagtgtcctaaatggatttgactatttatcagacgcaagagtacaaatgtatgagaaacataaagaggacttacacttgctaaaaaaggtatataggaaaaatttagacagagaaatctacgatcgtatgtttagaagcggagaagaaggaagctattgcgcgtattccaacagcaccaactccgtggatagcctagcagaagctaaaaaataccgaaggaacatgaagaaacgatcacaaaaagatctctacgacagaataaagaaagatcttaaagaagttcatgacgctgatgcagatgcgataagaaaggaaatggaacttgagagattcctaccaaaacaaatcacaggagcaaacggaattatacctaaccaagtacacagaaaagaattaaaaaaaatactagaaaatgcagaacaccacttagatttcttaaaagaaaaggatgaatcaggatatactgtatcagaacgaatactcatgctttttagctccaatataccatattacgtcggacccgtagggtcaggctcaaaaaccggatgggcaaaaatacaggaaagtgggcaggtactaccgtggaatatggagcaaaaaatagacatagaacaaacatccgaaagatttataacgaatttaatcagagaatgcacgtatctctcaggcgagaaggtcttacccaaacaaagcctattatacgaaagttattgcgttctaaacgaaataaacaatttaagaatacacggtaaacgaattgtaccagaattaaaacaagacatatataaagaggtattccaagggtttagactcggcaaaaaagtgactaaaaaaaatatatgtacatacctaataaaccgaggactaataactgaagaaagtgaagtcagtggaatagacaaagaaataaacgcatatctacccagttacggaaagatgtacggagtattcggtgaaagactccgtgaggaggcagttcaagagattgctgagaagataatttattatggcaccatatatggtgacgcaaaaagtatgttcagaaaaaaattgaaccaatatgtatcagatggatggatgaccgaataccaagcaaaaagaatatcaggatataaattcaaagattgggcaagacttagcagaagcatgttatgtttatcaggatgtgataagagcacaggagaaaaaatctcactcattcgagcaatgtgggaatataatcttaactttatggaactgatatacagagaagatttcacattccaaaaagagttggaagaaagacgtaaagccttaggaaaaacgttacaagaattccagtttgaagatctagatgaatactactacagtgcgcccgtcaagagaatgatctggcaagcagtacaagccctaaaagaaataactcaaataatgggacacaacccaaaacgcatttttatcgagatgacacgaacagaagaagaaaaaggagaacagggcagaaagaatagcagagaaaaacgtcttctcaaaatgtacgaatcaatcagggacgaaaggaattgggcagctgaaataaaaaacgctaacgctagtggaaagcttaactcgaagaagttatatctatattacttacaaatgggacgtgatgtctacacaggcgaacctattgacattgaagatctttttgatgacagtaggtacgacatagatcatatctacccaagaagtctcacaaatgacaacaacatagaaaacaacttagtactagtatcaaaaacaataaaccaaaatgaaaaaaaaaatgattacccggtccccgagaaaatacgacgaaacaaaaaagtaagaaatttatggcacacactacataagatgggattcatgaatgacgagaaatacaatcgactgacatccacagaaagattgtcggaagatcaactggctggctttatagctagacaacttgtagaaacagcacaaggagcaaaaggtatcgctgagctaatgaaagcaatgttgcctggtacagacatagtctatgctaaggcaaggaatgtaagcgacttccgtaaagaatacaagatgctaaaatcacgattagtgaatgactaccatcacgcccaagatgcatatctaaacatagttgtcgggaacgtttattttatgaaattcacaagaaatccaatgaacttcgttaaaacagaagccagaagagacggacgaaattatgactacaatctatacaaaatgtatagcaaagacataatcaggaatggagaaaaagcttggatagcaacaagtgaacaaggaccaggtacaataagactagtaaaagaaacaatgggtagaaataccccgattataacaagacaagcattcgaacaaagaggagaattatttaatttacaaccagtaggaaaatatagtgctaaaaaagacaactatgttcctttaaagattaatgacgaaaaaatgcaggacgtatctaaatatggcggctatacgagccttaacccatcctattttattttcatcgaacacggaccagaaaaaaaaagaaagaaatgcttcgaagtaattcacagctattatgctgctcaaataaaaacagaaaaagatttaatagacttcctactccaaaagggatacaaaaatccgcgagttattaatgcccggataaagaagaatgcgctaataaaatataatggatattttttatacataatagggatggacgcaaggaaaaatattgagttttcaaatgctacggcaatgtgtttaaagaacaaatatatacaatatgtttgcaagctagaaaaaatgaacaaagctatattactttcggaaaaacagaaaacaaatttacattgggatgaaaaaataacatgtgaaagcaatttagaactatatcgtgaattaacagaaaaacacttacatagcatataccaaaggcatccgagatcaataggtaaatgtttggcagatggagaaggagcattcaaacttctagatatagaagagcaagtaaaaattatttgtgatattgtacaatatacttcgttccaaagaggtgttttcagtctaaaagtattaggaggacctaaagaagttggtcgaataagaataagtggcaatatgacagaggctaaagaatgcaaattagtaaattacagcatcacaggaatgtataaaacggagatggatttactaaaaaaatga

SEQ ID NO: 8960 - RNA, 4122 nt, synthetic construct
  misc_feature 1..4122: note = Cas9 variant
  source 1..4122: mol_type = other RNA
atggaaaaaacatatagcatcggattagacataggcacaaattcagtcggatggtcggtaataactgacgactacaaagttccagcgaaaaaaatgaaagtcctaggaaatacagacaaaaagtacataaaaaaaaacctattaggggctttattatttgattcgggcgaaactgcagaagtaactagattaaaacgaaccgcccgaagaaggtatacaagaagaaaaaacagactaagatatctacaagaaatattcgcgaaagaaatggctaaagtagacgaatctttcttccaaagactggaagagtcttttcttacagacgatgataaaacattcgactcacacccaatatttggcaacaaagctgaagaagacgcgtaccaccaagaatttccaacaatttaccaccttcgaaaacacttagcggatagttcagaaaaagctgacctaagattagtttatctcgcactcgcccacatgatcaagttcagaggacatttcctaatcgaaggagaactcaacgcagagaacacagacatacaaaaactattcaacgatttcgtggaaacttacgacaaaatagcagatgaaagtcacttatcagaagttgacgcatcatcaatccttacaaacaaaataagtaaatctagacgcctagaaaacctcattaaacaatatccaacagaaaaaaaaaataccttattcggtaacctagtagctctagtcctagggctacagccaaactttaagacgaattttaaactaagtgaagacgcaaaattacaattctcgaaagacacgtatgacgaagacctagaagaattactaggaaaaataggagatgattatgctgacctatttaccgcagccaaaaacctttacgacgcaatattactttcaggaatcttaacagttgacgacaacagtacaaaggcccctttaagcgcgagcatgataaaacgatacgaagagcatcacgaagatctggaaaaattgaaaaaatttatcaaagtgaacaatttcgacaaatatcatgaaatctttaaggacaaatcgaaaaatggttatgccggatacatagaaaatggagtaaaacaagacatattctataaacacttaaaaagtataatatccgaaaaaaacggaggtcagtacttcctagacaaaatagaacgtgaagactttctaaggaagcaaaggacctttgataatggctcgatccctcaccaaattcatctacaagaaatgagagccatactgcgaagacagggcgaatattacccattcctaaaagagaatcaagccaaaattgaaaaaattctgacatttagaattccatattacgtaggtccattagcaaggaaagattcaagatttgcttgggcaaactaccactccgacgaaccaataacaccatggaacttcgatgaagtagttgataaagaaaaaagtgcagaaaaattcatcacaagaatgacgttaaacgacttatatttacccgaagaaaaagttttaccaaaacacagccatgtgtatgaaacttttacagtatataacgaactaactaaaataaaatatgtcaacgaacaaggagaaagctttttttttgacgcgaatatgaagcaggaaatatttgaccatgtatttaaagaaaacagaaaagtaacaaaagcaaaattactaagctatttaaacaacgaatttgaagaatttagaatcaatgatctaataggtttagataaagactccaaaagttttaatgccagtctcggcacttatcatgatctaaagaaaatattagacaaaagtttcctagatgataagacaaacgaacaaataatcgaagacatagtactcactctaacactatttgaagacagagatatgattcacgagagacttcaaaaatatagcgatttcttcactagtcaacagctaaagaaactagaaagaagacattatacaggatggggtagactatcatacaaactcataaacggaatcagaaacaaagaaaataataaaactatcctcgattttctgatcgacgacggacatgcgaaccgcaactttatgcaattaatcaatgatgaatcactatccttcaaaacaataatacaagaagcacaagtcgtaggagacgtcgacgacattgaagctgtagtccacgacctacctggaagccccgcaataaagaaaggaattttacaatccgtaaagatagtagatgaacttgtgaaagtaatgggagataaccccgacaacatagtaatagaaatggcaagagaaaaccaaacaacaaacagagaacgatcacaatcgcaacagagactcaaaaagctacaaaatagtttaaaagaactcgggtctaatatattgaacgaagaaaaaccaagctacatcgaagataaagttgaaaattcccacctacaaaatgatcaactgttcttatattacatccaaaacggaaaagacatgtacactggagatgaacttgatatagaccatctttcagattacgatatagaccatattatcccacaggccttcattaaagataattctatagataacagggtgctcacttcctccgcaaaaaacagaggaaagtccgatgacgtgccttctcttgacatagtaagagcgcgaaaagcggaatgggtacgtttatacaaaagcgggctaatctcaaaaagaaaattcgataatttaaccaaagcagaacgaggaggcttaacagaagccgataaagccggattcataaagagacaactagtcgaaacaaggcagataaccaaacatgtggcacaaattcttgacgctaggtttaacaccaaacgcgatgaaaacgacaaagtcatccgcgatgtgaaggttattaccttaaaatctaaccttgttagtcaatttagaaaagaatttaaattttacaaggttagggaaataaacgattaccatcacgcacatgatgcctacttaaacgccgttgtaggcaccgcattactgaaaaaatatccaaaactaactccagaattcgtctacggtgagtataagaaatacgatgtaagaaaattaattgccaaatccagcgatgactacagtgaaatgggaaaagcaactgcaaaatactttttttactcaaatctaatgaacttcttcaaaacagaagtaaaatacgccgatggtagagtattcgaacgtccagatattgaaactaatgctgatggtgaagtagtctggaataaacaaaaagacttcgacatagtccgaaaggtgctgtcgtacccacaggtgaatatagtcaaaaaagtagaagaacaaactgtaggtcaaaacggcggattatttgataataacatattagccaaacctgaaaaagacgacaaaaagaagttatttccaattaaaaaatcattgtcaaccacaagttacggtggatacgcacgagccacaatcgcttattctatcctcattgtctctgaattcggcaaaaacaaggaactaaagctattaggactacccctactcgacaaagtcaaatacgaaaaaaacccgatagcatatctaaactctataggcatcataaatgtcaaatcgatatttaaactccccaaatattgcctattcgaattccaagaaaagaacacaaactacagaaggtacatggtaagtaaccaagaactaaaaagagccaaccaacttttcctaacatgcaaggaaaccgagctggtatacaaatacataaaaagcgataatgacaatactcatttagtaggtaacgaaaaaaccattttatcaatttggaacaaactagttatcttcatggaacgtacaaaacttatagataaaaaacttttcgcttcactaaagcaattaaaagacgaagtagatttaatcaacattttagatatgactgccaaatcgctagactttacaaaaataagcgctgggcaaaaaaagataacgatttcggatagtctatcgttaccaattaaacgatggcaatttagctccgacgaaaaaatgttgaaacagctaaaaacggccacacttatacatcagagcgtaacgggactatacgaaacacggatagatttaagcaagctaggagaagaatga

SEQ ID NO: 8961 - RNA, 4122 nt, synthetic construct
  misc_feature 1..4122: note = Cas9 variant
  source 1..4122: mol_type = other RNA
atggaaaaaacatatagcatcggattagatataggaacaaatagcgtaggctggtcagtgatcaccgatgactacaaagtacccgccaaaaaaatgaaagtattaggcaatacagataaaaaatatataaaaaaaaacttattaggcgccctcctattcgattcaggtgaaactgcagaagtaacacgactcaaaagaacagccaggagacgatatactcgaagaaagaacagactaagatatctacaagagatattcgcaaaagaaatggctaaagttgacgagtcattttttcaacgattagaagaaagctttttaacagatgatgacaaaacattcgatagccatccaatctttggcaataaagctgaagaagatgcctatcaccaggaattccccaccatataccacttgagaaaacatctagccgactcctctgagaaggctgacttacgattagtatacttagcgctagcccacatgataaaatttagaggacactttctgatagaaggcgagttaaacgcagaaaatacggacatacaaaaactctttaacgactttgtcgaaacatatgacaaaattgcagatgagtcacacttatcagaagtagacgcttcttcaatattaacaaacaaaatatctaaatctagaagattagaaaacctcatcaaacaataccccacagaaaaaaaaaacacactatttggtaacctggtagctctagttctcggcctccaacccaattttaaaactaattttaaactgtcagaagacgcaaaactccaatttagtaaagacacgtacgacgaagatctcgaagaacttttaggaaaaatcggagacgactacgcagacttattcacagctgcgaaaaatctttacgatgcaatcctcctaagcggaatattaacagtagacgataacagcactaaggcaccattatcagcatccatgataaaaagatacgaagaacatcacgaagatctagagaaattaaaaaaatttatcaaagttaataacttcgacaagtaccacgaaatttttaaagacaaaagtaaaaacggatacgctggatacattgagaatggagttaaacaagatatcttctataaacacctaaaatcaataatatcagaaaaaaatggaggacaatacttccttgacaaaatagaaagagaagacttcttaagaaaacaaagaacgttcgacaatggaagtataccacatcagatccacttacaagagatgagagccattctcagaagacaaggcgaatactatccatttttaaaagaaaatcagagtaaaatcgaaaaaatccttaccttcaggatcccctactatgtaggaccactcgcccgtaagaactcaagatttgcatgggcaaagtatcactcagacgaacccattacgccctggaacttcgatgaagttgtggataaggaaaaaagcgcagaaaaatttattaccagaatgactttaaacgacctttacctaccagaagaaaaagtattaccaaaacattctcatgtatatgaaacttacgcagtctataacgaattaacaaaaataaaatacgttaacgagcaaggaaaagaatcattttttgattccaacatgaaacaggaaattttcgaccacgtatttaaagaaaaccgaaaagtaacaaaagaaaaactattaaactatttaaacaaagaattccccgaataccgaataaaagatctaattggacttgacaaagaaaataagtcgtttaacgccagcctaggtacctaccatgacttaaaaaaaattttagacaaatcattcctggatgataaagtcaatgaagaagtaatcgaagatatcataaaaaccttaacactcttcgaggacaaagacatgattcacgaaagactccaaaaatattctgacatattcacagccaaccaattaaaaaaacttgaaagaagacattatactggatggggaagattgtcctataaactcataaatgggatcagaaataaagaaaacaacaagacaatcctcgattacctaatcgatgatggaagtgccaacagaaatttcatgcagctaataaatgacgatacattacccttcaaacaaataatacaaaagagccaggtagtaggagacgtagacgacatagaagcagtagtacatgacctacctggatctccagcgataaaaaagggaatattacagagtgtaaaaatagtagacgaactcgtaaaagtaatgggcgggaatcccgataatatagttatagaaatggctagagaaaatcaaaccacgaacaggggcagaagccaaagccaacaaagactgaaaaaactacaaagcagtctaaaagagctcggaagcaacatcataaacgaggagaaacccagctacatagaagataaagtcgaaaattcacacctccaaaacgatcaattgttcctatattatatccaaaatggtaaagatatgtacactggtgacgagctagacatagatcatctgtcagactacgatattgaccatatcattccacaagcattcataaaagacgactcaatagataacagagtactgacatcttccgcgaaaaatagaggtaaaagtgatgacgtaccatcattagacatcgtcagagcaagaaaggcagaatgggtaagactatataaatccggcctgatatctaaacgcaaattcgacaacctaaccaaagcggaaagaggcggacttacagaagccgacaaagcaggatttataaaaaggcaattggtagaaacaagacaaataacaaagcatgtagcacaaatattagacgcaagatttaacacagagcatgatgaaaacgataaagtaataagagatgtgaaagtgataaccctaaaatcaaacctagtgtctcaatttagaaaggatttcgaattctataaagtaagagaaatcaatgactaccatcacgcacatgacgcctacttaaacgccgtcgttggcactgctctattaaaaaaatatcctaaactagctccagaattcgtatatggagaatataaaaaatatgacgtacgaaaactcatagcaaaatcctcagacgatcatagcgaaatgggaaaagctacagctaaatatttcttctactccaacctgatgaacttttttaaaactaaagtaaaatatgcagacggatccgtatatgaaagaccaataatagaaactaacgcagatggtgaagtagtctggaataaacaaaaagacttcgaaatcatccgcaaagtactatcctatccgcaagtaaacatcgttaaaaaagttgaagaacaaacagtaggacaaaacggaggacttttcgacaacaatatactagccaaaccagaaaaggacgataaaaaaaaactttttcccataaaaaaatcgctctcgacaacctcatatggtggatatgcaagagccacgattgcatactctatcctaatcgtttcagaatttggaaagaataaagaactaaagctccttggactacccctcctcgataaggttaaatacgaaaaaaacccaattgcctatcttaactcaataggcattataaacgtcaaatccatatttaaactaccaaaatactgtttatttgaatttcaggaaaaaaacacaaactaccgtcgatacatggtttcaaatcaggagttgaaaagagcgaaccagctattccttacatgcaaagaaacagaactggtctataaatacataaagtcagataacgacaatacccacctggttggaaacgaaaaaactatattaagtatatggaataaattagttatcttcatggaaagaaccaaattaatagataaaaaactattcgcctcactaaaacaattaaaagatgaagtaaacctcataaacatactagacatagcaagcaaaagcatagactttacaaaaatatcagctggacaaaaaaaaatagtcttaaatgattcattatcactaccaatcaaacgatggcagtttaaaagcgacgaaaaaatgcttaaacaactaaatgatgccactttaattcaccaatctataacaggcttatatgaaaccagaatagatctatcaaaactaggagaagaatga

SEQ ID NO: 8962 - RNA, 4122 nt, synthetic construct
  misc_feature 1..4122: note = Cas9 variant
  source 1..4122: mol_type = other RNA
atgaatctacgtagagctagggattattcaatcggactagatttaggaactggctctgtaggttgggctgttacagacgcggaaggaaacttatactcgtttaagggacgacccgcgatgggctccaggacttttccaaacgcagaaccagcctccgtagctagaataccacgaggtcaacgaagaaggtacgagagacgaagacaacgaattaaattgttgcaacaattttttatgagtgacatggaaagagtcgatccggatttttttacacgactaaatcaaagtacactactcgccgaggacaaagatgaacgaatagctagctgtgcatggcccatattcaattcatccgattttacggaaaaagattattacaaaaaatttccaacaatttatcacctccgagcattcctatgtgagagtgatgaaaaaggtgacttgaggttagtatatctggcgctacataacatagtgaaacatcgaggcaattttctatatcaggacaaccctgctttatccgcatcagacgcctccgtagatgaagcagtaaggcaacttgttgatgcattagcagagtggtgtcaaaataaagagatagaactctcatgtgatgccggaagaataatagaagtttttggggatgcgagcctaaggagaacggacaaaagagatcagttaaaaggattgttaggattacccgcagacttagctaaaacaatgggaaaggaactggcatctgcagttttaggttatgcagctaacttttcaaaaatatttttaatatcagatgccgaacataaattttccttaggaaacgatgagaaagttgaagaatttgagaccatatgtccaaacgagtgcacgtcactatttagcgcactacgtacggcatatagtgcctatctactatcgggaatactaagagatgcaaatgggaaaacactcagtttttgtaaaaaaaaagagtacgatagatatcatgatgatttggcactattaaaagctctagtccgagagtacgcaccggaaagctatcaatctttttttggaggcgagagattggtagttaacggtcgtatgaccaagagatatgaccctactaaagctaaaggttatacgaaatatgacttagtacattcagctggatcgtatgatgagcttgctaaagatgtaaaaaaattattaggcagcttggcagctgatgattcacgatatcaacgaatgatgcaagcctttgatgaagaacgttttctaaggcgacttaaaacctcagacaatggatccatcccatatcaattacatctagaagaattaagagcaataatagcaaggcagggagagttctaccctttcctaaaagaagaatcaaaaaaaatcgaatctttggtttcgtttagaatcccatactatgtaggtccactaacaacaaaaaatgcagctgttgatgtccatggaaacaaacgttttgcatggagtgaaaggaagccaggaatggagtcagctaaagtaagaccatggaattgggacgatgttatcgatcgtggcaaaagcgcagaaaattttattgtaagaatgacagggacctgtacttatttacaaaacgagaaagtcctaccaaaatgctcactattatatgaagaattctgcgtattgaatgaattaaacggtgctcactggtcagcagacggtgaccatgaatgtccgtttgatacatcagatagaagaggaatagtacaagacttattttgcggaaaaaggagagtttcatataaacaagtcgaggactggctaaggcagcacggatctagaagagctcgcgttagtggtggtcaaggagcctcaggctttgaaagcaaaatgtcaagttacatttttttctcaaaagacgtattacatgtagacagaatcgatcctgcagattttcctatgattgaagaaataatactctggaatacgttattcgaagatagagacatccttaaagaaaggatcgaagaagcatatggtgacagactgaacgcagaacaaatcaagactatatgcaaaaagagattcacaggttgggggagattgagcaggaggctcctaacaggcatcaaagcccaaactgatcaaggagacttaagcataatggacattttgcgcgaaggtgatcctaataatgaccacagaggaaaagctatggtttttatgggaattctccattctgaagacttaggattccaaaaaaaaatagatcaaataaaccaagagaaagtatcggcaggaaaagtatcccttgaagacttacctgggagtccggcactacgaagatccataaaccaggccatgagggtagtagatgaaatagtatccatagctaaatgccctccatctcatatatatttagaagtcacacgtgacgaagatggagcaagaaaaggacgacgctcaacaagaagatatgacgccataaaagcagcactcgaaaaatttaaagaagagagcccaacatggtttgaccaagatgtgttcggagaatttagacgttcaagagcagaagacttggatgagagacttagtctatattttatgcaaggaggaaaatcgctctattccgcaacaccattaaaactcgaactattacatacgaatcaataccaagtagatcatattatcccacaaagctatatcaaagatgactccttcgaaaataaagctttagtattagcaggtgaaaatcaacgaaagagtgacgccctactcatagattcatcaataaggaccgccatggcaccttattggcgcgcactccatcaagcaggcttaatgggtgacaaaaaatttaattccttaatgtgctccagtatcagtgataaaagagtaagaggatttatagcaagacagctggtagaaacaagccaaatagtaaaactagcgggcatgatgctacagtcaaactatccagaagcagacgttcaaccagtaaaagccagcctaggtcatgatttacgagttcaagccggttttataaaatgcagagaagtcaatgattttcatcatgcacatgatgcacttattgcatgtgaagtaggtcgatatataaaccaatgtcaccccggcatatatgataacccaataggctatgcaagagccgtaagagagttagtaagaaaacaaaatgaggaaatgagaaaatatggacgactaccaggatccgcaggctttatagtgggagggttcatgagaacacatgttgatgtcgatacaggagaagtagtatgggatgctgaagaagaacttagcaggatacgcgcatacctagactattcaaacgtatttgtaacaagaatgtcagaagaaacaagtggagcattgtggaatgctaccatatactcaccacactatggaaaaacagcaccaactttacacatcaaacaaggtctagacgtacagagatatggaggttactcaagcgcaacctttgcatactttaccctttatgtcgcagaaaaaggtaaaaaaagaaaagcagaattattagggattccaatatccgttgcacgaaaaatagagggtgaaccgagcaaattagatgcctttgtcgctcaagatgcagaagcgaaaaaactaaaacatccattaataataagagctagaatattaaaatacgccagatttgaaatggaaggaaatcagttttatttcgccgcacaagatgcagtttatagcgcaagacaattggtactaaaaggcgatttgtatagtgttgctgcaaaagcatgcgacaaacatttaaacgatagttgtatttcaaatgaagatctaataaggctgtatgatgaattagtacacaaaggagatctcctttgtaataaatttggtaacgtaacagacgttctacgagcaggtagagaaagatacgcaggcctatctatatcagaaaaacgacaattagtctgtaatgtattagcttattacagaagtgcaactgctagggtggatatatcactagtaggtggtcccaaacacgcaggtaatctaggtatagcatttgtgttgaacaacccagaagccatagtattcgtagatcaatccgtaacagggatgtttgaaaagagaaccagagtagaactatga

SEQ ID NO: 8963 - RNA, 4122 nt, synthetic construct
  misc_feature 1..4122: note = Cas9 variant
  source 1..4122: mol_type = other RNA
atgaaaaaaatcttaggactggacctaggaactaactcgatcgggtgggccctcgtaaacgaagctgacaacgaaagagaaaagtcatcaattatcaaaataggagttagagttaacccactaaccgtagacgaacaacagaactttgaaaaaggcaaaagtataacaacgaacgcagacagaacactaaagagaagcatgagacgaaatctacaaagatttaaactacgcaaagaaaacctcattgaaattttaaaaaaacaaaaattcataaatgatgagaccatcctcagcgaaaatggaaacaaatcaacattcgagacttataatttgcgagccaaatctgcaaccgaagaaataaccttagaacaattcgcacgagtattgttgatgataaataaaaagcgaggatacaaatcgtccaggaaagctaaatcacaagatgaaggacaattaatagatggaatggaaatagcaaaaaaactctataacgacaatctcactccaggacaattcgtatttcaaatactaaaagaaggcaaaaaatacatacccgacttctaccgcagtgacttacaggctgaattcgacaaaatatggagctttcaaaaacaattcaacccagatatattaacagaagaatttaataaacaaataatagggaaaggaaaagtgaatacaaccaaaatatttctagccaaatacggaatatacaccatagacaacaaaggagcagacaaaaaatcacaggcatacaattggagggtcgaagcattaactaaccaattaacaaaagaagaattagcattcgtgatttcagacttaaacggcataatcagtaattcatcaggatacttaggatcaatctctgaccgctcaaaagagctatacttcaacaaacaaacagtaggacaatacctaatagcacaactaaaagaaaaccctcacacacaattaaagaaccaagtattctatcgccaagactacctagatgaattcaataccatttgggaaactcaagcaaaattccacaaagaactaaccaacgaactaaaggaggaaatcagagatataatcattttttatcaaagaaaactaaaaagccaaaaaggacttataagcttttgcgaattcgaaagcaaacaaatagagataaacattgatggaaaaaagaaacttaaaaccgtagggtcgaaagtctgccccaaaagcagtccattattccaagtattcaaaatatggcaaatcctaaataacatacaagtaatcgaaaaatccactgggaaatccaaatttctagaacaagacgaaaaagaaatactatttaaggaactaaactttaaagataaaataagcaaaacagacgcgttaaaaatattatacaaaaattacaaggaattagatttcaatttcaaggagaacatagaaggcaaccgaacacaggccacattcctaaaagcctttcaatccataatagaactctctggacatgaagttagtgacttctcgaaaatcaaaacagacgagatcctcgaaattgttaccccaatctttgaaggatttggtttcaacaccaacctgttacaatttaactcaaatctaaaaggaaaagacttcgagaaacaagcggtataccaattatggcacctactttattccttcgagggcgacaattcaaacactggcaacgagaaattaatacagaagatttcggaattatatgggttcgaacgcgagtacgcaataataatagccaatatatcattccaaccagattacggatccctcagtactaaagcaatcagaaaaatacttccccacttaaaagaagggattgaattctcactcgcttgtgaatatgcgggatacagacactctaaaaactcactgacaaaagaagaaaaaaataagaaaatattaaaagataaaattgacatcttaccaaaaaactcactacgcaatccagtagttgaaaaaatcctaaaccaaatgataaatgtcgtgaacgcaactatagaaacctacggcaaaccagacgaaatcagaatcgaactagcccgggaactaaaaaaaagcgcaaaagaacgggaagacttaactaatgcaataaacaagtccaccctggatcatgaaaaatacaaagcactactacaaaaagaattcgggcttagtaatgtaagtcgaaatgacattatacgatataaattatacttagaacttgagcacaacgggttccacacattatactcaaacacttatattgaaccaaataaactctttagtaaagaatttgatatagaacacataatcccacaatcaagactttttgatgattcattttcaaacaagacaatagaaagtagaagcgccaatatcgaaaaaggcaatgaaacagcatttgactatgtaagtaacaaaaacggtgaagtaggattaaaagactacctaaaaaacatagaagacctatttaataatggaaagatctcaaaaacaaaatacaataaattgaaaatgaaaggtgacgaaataccaagcgacttcatagctcgcgacctaagagacacgcagtacatctccaaaaaagccaaaagtatacttgaagacctcgttaaggatgtagtatcaacaggaggcagtataactgacagactaagagaagactggcaactaattgatataatgaaagaactaaattgggataaatacgacaaactcggattgacagaagtaattgaaaacaatgatggtcataaaatcaacagaataaaagattggactaaaaggaacgatcaccgtcatcacgcaatggacgcactcacaatagcctttaccaaaagaagttatatacaatatctaaataacctaaacgctcgttccgacaaatcaggaagcatctacggaatagaacaaaaagaactttaccgagataagaacaataaactaaggttcaaaccacccatacctctagatgactttcgagcagaagctaaaaaacaactagaaaatacacttgtaagcatcaaagctaaaaataaagtcgctacaataaatattaacaacaccaaaaaacagggaggagaaaacaaaaaaaaacagttaacaccaagaggccagttacacctagaaaccatatatggctcaatccaacagtatgtaaccaaagaagaaaaagtaggagccaacttcaataaagaattaattgagaaagttgcgaacaaaaagtgcagagaagcactattaaaacgactaatagaatttgacaacgacccaaaaaaagcgttcacgcgaaaaaatagtttaaataaaaatccactatacatcgacaccataaagacctacaaagttccagaaaaagtcaaaactgtcacgacagaaacgatttacacaatacggaaggacataaatcctgatctcaaaattgataaagtagtcgacaaaaaaatcaaaaacatattagaactaagacttaaagaattcaacggagatgctaaaaaagcgttcagcaatctagatgaaaaaccaatatggttgaacaaagaaaaaggcatttccataaaaagggtaacaatcacaggcatcagtaacgccatagcactccacgacaaaaaagacaaagaaggaaacttcattttagacaaccaaggaaaaaaacaagccgtcgatttcgttaatactggaaacaaccaccatgtagctatttacaaagatgaaaaaggtaacctacaagagaacgtgataactttttatgaagccgtcgaacgagtcaaccagggaattcccataatagataaaacatacaaacaaaatgaagggtggcagtttctcttttccatgaaacaaaacgaatattttgttttcccaaacgagaaaacaggattcaattcaaacgaaatagacttactgaacccagaaaattatcatctaataagcccaaacctttttcgtgtacaaaaaatagcaacaaaggactacttttttagacatcacctcgaaacaaatgtagaaaacataacaacaacaaaagacttgacatggaaaagactaggaataaatggaataattaacatacttaaagtaagaattaatcacatagggcaaatcgtaagtgtaggggaatactga

SEQ ID NO: 8964 - RNA, 4122 nt, synthetic construct
  misc_feature 1..4122: note = Cas9 variant
  source 1..4122: mol_type = other RNA
atgacaaagaaaaactacagcataggtttagacatcggaacaaattcagtggggtgggcagttataaccgatgactacaaagtaccagcaaagaaaatgaaagtattaggaaataccgacaagaaatacataaagaaaaatttgttaggagccttattatttgacagcggcgaaaccgcagaagccactcgattaaaaagaacagcaagaagaagatatacacgccgcaaaaacagactccgatatctacaagaaatttttgctgaagaaatgaccaaagtcgatgaatcattcttccaaagactcgacgagagcttcttacgatgggacgacgacaacaagaaactaggaagatacccaatattcggtaacaaagcggatgttgtcaaatatcatcaagagttccccactatatatcatctaagaaaacatctcgcagactcatcagaaaaagcagatcttagattagtttatctagcactagcacacatgataaaatttcgaggccatttcttaatcgaaggagaattaaatgccgaaaacacagacgtgcagaaaatcttcgctgacttcgtgggagtctatgaccgaacgttcgacgactcgcacctatcagaaataactgtagatgccgcgtctatcctcaccgagaaaatctcaaaatccagacgactcgaaaatcttatcaaatattatccaacagaaaagaaaaatacactattcggaaaccttatagcattagctttaggattacaaccaaacttcaaaatgaattttaaactatcagaagatgccaaattacaattttcaaaagactcatacgaagaagatctgggtgaactattaggcaaaattggagacgattacgcagacctattcacatccgccaaaaacttatacgacgcaatactactctcgggaatactaatagtcgacgacaatagtaccaaagcaccactatcagcatcgatgataaaaagatatgtcgaacatcaagaagatttggaaaaactgaaagagttcatcaaagcaaataaatctgaactctaccatgatattttcaaagataaaaataaaaacggttacgcaggatacattgaaaatggtgtaaaacaagacgaattttataaatatctcaaaaatacattaagtaaaattgcaggatccgattacttcttagataaaatagaaagagaagatttccttagaaaacaaagaacatttgacaacggatcaataccacatcagatacacctacaagaaatgcatgctatcttgagacggcaaggagactactacccctttttgaaagaaaatcaagaccgaatagagaaaattttaacatttcgaataccttattacgtaggcccattagccagaaaagactcaagattttcgtgggcagaatatcactcagacgaaaagatcactccttggaacttcgacaaagttatagacaaagaaaagtctgcagaaaaatttatcacacgaatgacactaaatgatctatacctaccagaagaaaaagtattaccaaaacacagtcacgtttacgaaacttacgctgtctacaatgaactaacaaaaataaaatacgtgaacgaacaagggaaggactcattctttgactcaaatatgaaacaagaaatcttcgatcatgtatttaaggaaaacagaaaagttactaaagaaaaactactaaactatttaaacaaagagttcccagaatatcgaattaaagacttaatcggattagataaagaaaacaagagctttaacgcgagcctaggtacataccacgatttaaagaaaatacttgataaagcgtttttagacgacaaagtaaatgaagaagtcattgaagacataataaaaactctaacactatttgaagataaagacatgatacacgaacgactccaaaaatattcggatatcttcactgcagaccaactaaagaaattagaacgccggcactacacaggatggggacggttatcttacaaacttatcaatggtataagaaataaagaaaataataaaactattttagattacctgatcgacgatggatcagccaataggaatttcatgcaattaattaatgatgatacgttaccatttaaacaaataatccaaaaatcacaagtagtaggtgacgttgatgatatagaagcagttgtacacgacctacccggcagcccagctattaagaaagggattctacaatctgtgaaaatagtcgatgaattagtaaaagtaatgggagacaacccagataatatcgtaatagaaatggctcgagaaaatcaaacaactaacagaggaagatcacaatcgcaacagagactgaagaaactacaaaacagtctaaaagaactaggatctaatatactaaacgaagaaaaacccagttatatagaagataaagtagaaaactcacacctacagaatgaccaactatttttatattatatccaaaatggaaaagacatgtacacaggagacgaactagacatagatcacttatcagactacgacatagaccatataataccccaggcattcatcaaagatgattctatagacaacagagtcctaacatcctcagccaaaaacagaggtaaatctgatgacgttccctcactcgacattgtcagagcaagaaaagcagaatgggtacgtctatataaaagcggactcatatctaaacgtaaattcgacaacttgacaaaagcagaaagaggaggattaacagaagcagacaaagcaggctttataaaacgccaattagtggaaactaggcagataacaaaacatgtagcgcaaatattagatgcgcgatttaatacagagtccgatgaaaatgacaaagtaatacgtgatgtaaaagttataacactaaaatctaacttagtttcacaattcagaaaagacttcgagttctataaagtaagagaaataaacgactatcaccacgcccacgatgcatatctaaacgctgtagtaggcacggcattactgaaaaagtatcctaagctagccagtgaatttgtctatggcgaatacaagaaatatgacatacgaaaattcataacaaacagtagtgataaagcaacagccaaatacttcttttattccaatctaatgaactttttcaaaagggtcatacgatattcgaacggaaaagtaatcgtacgaccagtcgtcgaatactctaaagataccgaagacattgcttgggataaaaagagtaatttccgtaccatatgtaaagtactatcatacccgcaagtcaacatagtaaagaaagtagaaactcaaaccggaggtttctccaaagaatccatactcccaaagggagatagtgataaattaataccacgtaaaacaaagaaagcgtattgggacacaaagaaatacggcggatttgacagtccaacagtagcatacagcgtatttgtcgtggcagatgtagaaaaaggaaaagccaaaaagctaaaaacggtaaaagaattagtaggtatatcaataatggaacgcagtttcttcgaagaaaacccagtagaatttcttgaaaacaaaggctaccacaatatacgagaagataaactgataaaactcccaaaatattctttatttgagtttgaaggtggaaagagaagactattagcctcagctagcgaattgcagaagggaaatgaaatggtaattccgggacacctagtaaaactcctttatcacgctcaacgtataaactcatttaactctacgaaataccttgattacgtaagcgcccataagaaagagtttgaaaaagttttatcatgcgtagaagactttgcaaatttatacgtcgacgtagagaaaaacttaagtaaaattagagcagtagctgactcaatggataactttagcatagaagaaatatcaaactctttcatcaatctactcaccttaactgcactgggagcgccagccgacttcaatttcctcggcgagaaaatcccgagaaaaagatatacatcgaccaaagaatgtctcaatgcaacattaatccatcaaagcataacagggctatacgaaacgagaattgatttaagtaaaataggcgaagaatga

SEQ ID NO: 8965 - RNA, 4122 nt, synthetic construct
  misc_feature 1..4122: note = Cas9 variant
  source 1..4122: mol_type = other RNA
atggaaaataaaaattacagtataggtctcgacataggtactaacagcgtaggatgggccgtcataaccgatgactacaaagtaccatcgaagaaaatgaaagtactaggaaacactgacaaacgttttattaagaaaaacctcataggagcactactctttgacgaaggtacaactgccgaagcacgaagactaaaaagaacagcgagacgcagatatacgagacgcaaaaacagattacgatacctacaagaaatttttgcagaagaaatgagcaaagtagactcatcattctttcaccgactcgacgattcatttctaattcccgaagacaagaaaggttccaaatacccgatatttgcgaccttaatagaagaaaaagaatatcacaaacaattccccaccatatatcatctaaggaaacaattagcagactccaaagagaaaaccgacttaaggcttatatatctagctctagcacacatgattaaatatagaggacattttctctacgaagacacttttgatattaaaaataacgacatacagaaaatatttaatgagttcataagtatatataacaacactttcgaaggaaatagcctgagcggacaaaacgtccaagtcgaagcaatatttactgacaaaataagtaaaagcgccaaaagagaacgagtcctaaaactcttcccagatgaaaaatcaacaggactattcagcgagttcctaaaattaatagtaggaaatcaagctgattttaagaaacattttgacctcgaagaaaaagcacctctccaattctcgagagatacgtacgacgaagacttggaaaatctattaggacaaataggagacgacttcgcagatcttttcgtagcagccaagaaactatatgacgctatattattaagcggaatattgactgtcactgacccatcaactaaagcaccactatctgcaagtatgatcgaaagatacgaaaaccatcaaaaagaccttgccactcttaaacaatttataaaaaccaacttgccggaaaaatacgacgaagtatttagtgaccaaagcaaagatggctacgcaggatacatagatggtaaaaccacacaagaaagtttttacaaatacattaaaaacctactaagtaaattcgaaggtgccgactactttctagagaaaatagaaagagaagattttctgcgcaaacaacgtacattcgacaatgggtcaataccacatcaaatacatctccaagaaatgaacgcaatcttacgtagacaaggcgaacattatccattcttaaaagaaaataaagagaaaatagagaaaattctaacgttccgaatcccttactacgtcggtccactggcccgcggaaatcgagactttgcatggctcacccgaaactccgatcaagctattagaccatggaactttgaagaaatagttgacaaggcttccagtgccgaatccttcataaacaaaatgaccaactacgacctgtaccttcccgaagaaaaagtactaccgaaacatagcttactatatgaaactttcgctgtatataatgaacttacaaaagtaaaatttatagcagaaggcctaagagattaccaatttctagattcgagacaaaagaaagatatattttacacactatttaaagcagaagacaaaagaaaagttacagaaaaagacattatacaatatctacacacagtagatggatacgacggtatcgaacttaaaggcatcgaaaaacaatttaatgctagcttatcaacataccacgatcttttgaaaataataaaagataaagaatttatggacgacccaaataatgaagaaatacttgaaaatatcgtccataccctaacaattttcgaagacagggaaatgattaaacaacgattagcccaatatgattcactcttcgacgaaaaagttatcaaagcacttactagaagacactatactggctggggcaaattaagcagtaaattaatcaatggcattcgagataaacaaacaggaaaaactatacttgactacctaatggatgacggttataataatagaaacttcatgcaactaataaatgacgatgaactttcattcaaagaaataatcaagaaagctcaagttgtaggcaaaacagacgacgtaaaacaagtagtacaagaactacccggtagtccagccatcaagaaaggcattttacaatctataaaacttgtagacgagctagtgaaagtgatgggacacgaaccggaatcaatagtaatcgaaatggctcgggaaaaccaaactacagcaagaggcaagaaaaactcacaacaacgctacaaacgcattgaagatagcctaaaaatactagcatcgggcctaaatgctaaaatcctaaaagaacacccgacagataatatccaattacaaaatgacagattattcctttattatctacagaatggtagagacatgtataccggtaaaccattagacataaaccaactcagcagttatgacatagaccacatagtacctcaagcctttattaaagacgacagcttagataatcgtgtccttacctcgttaaaagacaatagagggaaatcagacaatgttccctcattggaagtagtcgagaaaatgaaaacattttggcaacagttactcgactctaaactaatatcgtaccgtaaattcaataacttaaccaaagctgaaagaggaggtttagacgaaagggacaaagttggattcataaaacgacaacttgtagaaactagacaaataactaaacacgtagcacaaatactcgatgctagatacaacacggaagtaaacgaaaaagacaagaaaaacagaacagtaaaaataattacactaaaaagtaacctcgtatcaaattttagaaaagaatttagattatataaaataagggaaatcaatgactatcaccatgcacacgatgcgtacctaaacgctgtagtagccaaagcaatcctcaagaaatacccaaaactggaaccagaatttgtatacggagactatcaaaaatacgacttaaaacgatacatatctcgatcaaaagatcccaaagaaatagaaaaagccactgaaaaatacttcttctatagcaacctattaaactttttcaaagaagaagtacattacgctgacggtactattgtaaaaagagaaaatatagaatacagcaaagacactggtgaaatagcttggaacaaagaaaaagacttcgctaccatcaagaaagtactatcactaccacaagtgaatatcgtcaagaaacgtgaagtacaaacaggaggattttcaaaagaatcaatactaccgaaaggaaatagcgataaattaattccacgaaaaactaaagatattctgtgggacacaacaaaatacggcggttttgatagtcccgtaatagcctactctatccttttaatagcagacatcgaaaaaggaaaagcgaaaagattaaaaacagtcaaaaccctcgttggaataacaattatggaaaaagcgacctttgaaaagagcccaatagcattccttgaaaacaaaggttatcacaacgtacgaaaggaaaatatactatgcctccctaaatattccctgtttgaacttaaaaacggcagacgcagaatgctagcctccgccaaagaactacaaaagggtaacgaaattgtactacccgtacacttaaccacccttttatatcacgccaaaaatatacacagactagacgaaccagaacatctagaatacatacaaaaacacaggaacgagttcaaaggcctactcaacttagtgagcgagttcagtcaaaaatacgtgctggcagacgccaacctggagaaaattaaaaatctttatgcagacaacgaacaagccgatatagaaatactagcaaattcatttataaatctgctaacattcacagcattaggtgcgcccgcagccttcaaattctttggtaaggacgtagacaggaaaaggtataccacagtgagcgaaatcctaaatgcaacactaatacaccagtcaataacaggattatacgaaactcgcatcgatcttagcaaactaggagaagattga

SEQ ID NO: 8966 - RNA, 4125 nt, synthetic construct
  misc_feature 1..4125: note = Cas9 variant
  source 1..4125: mol_type = other RNA
atggaaacaaaatttacttattatctagggttagacatgggaacagactcactgggatgggccgtcacagattcaagttatcacattttgagggctaagggtaaagatttatggggggtgagattgtttccatctgctgaaactagcgttgaacgacgaacatacagagtgaatcgaagaagaagacagagagaagttgcaagaataggtgccctaaaagaactctttgccgatgaaatagagaaagttgaccctggatttttcgttcgactcgatgaatcgaaatttcatatggaggatagaagtgaaaataataagcaaaaatatggcctctttgcagataaactattcagcgatgcgggatactataagaaatatcccacaatctttcatttaagaaaagaattattagaaagcgaagaaccccacgacgttagattagtatatttagccttattaaatatgtttaaacacagaggacatttcttaaattcaagccttcaaatagaaggagaaaattccaacatagcagaaagttaccaaatgtttgtagatacgctaactgacgaagacctagactttcctgagcaagtctcaggcgaaagattacaggagatttttcgaagcagtgattcgaggaagaaaaaagtagaaaacctactagcggaaatgaatctttcaaaaaaacaaaagagagaaatacaattcgtcaatctgatctgcggactaaaaggaaaactaagcgaattattcccagacaaggaatacgatgaagaacaaaagaagattgcattctcatttcaggacagcgactacgaagataaggaaaatacaatacaagaattattagacgaaagtgaaatgaacatgatatatgcagtgaaagcggtccatgattccggagtactaagtggcataatgaatggggaaaggtatttatcagtagctagagtcgctagctatgaaaaacataaaaaagacttacaaattttaaaggacattttaaaaaaatatgatactaaggagtatttcgaaatgtttcgaaatgaatcagctaaatcagaatcatattcagcatatgtaggatcagttaaatatcacggaacttttagaagaggactatcaggtggcaagcaagaagatttatacaagcacataaaaaaagtgttaggaaagttccctcaagacgacgaaggtgtgacatatattctcgaagaaatagaaacagaaagtttcctaccaaaacagctcacagcatcaaacggagttataccaaatcaagtacacgcaagagaaatgttagcaattttaaagcatgccgaactatatttacccttccttcaagaaaaagatgacacaggcctatctgtaagcgaaaagatcctgaaattattcatgttccaaatcccatattatgtaggtcccttagggcaagaatacaaagacaaaaaagggtacaacgtttgggctgaacggaaagcatcaggaaaaatatatccatggaatttcgaagataaaatagatgtgaaaaaaagtgcagaaaaatttattggacgaatggtacggaggtgtacttatctatcaggagaacaagctcttccaaagcaaagtctattatatgaaaaattccaagtactaaatgaactaaacaatctccgaattcgaggcgaaaaaatacctgtatccttaaaacaagaaatctatcacgatttgtttggagatggcaaaaaagtatctatgacgagacttactaattatctattacaaaatggagttatatcaggagaagaaaaagatagttgcatttcaggaattgatggaggctttcataattctttaagcagtgtaggtaaatttaagggtgtattcggtgacactgtacatacggatgaacatagaaaaatgatagaagacattatattctggggaactgtatttggtgatggtaaaaaactactaaaagaaaaggtagaagaagtatatggaaatcaactcactgaagcacaaaaaaaaaggatatttggattcaaatttagctcttggggcagactaagtaaagcgtttcttacaatggaaggggcatcgaaagatgatggtgaaattaaaggtctaatacaagcaatgtgggacacaaactgtaacctaatggaattattaagtgatagattcacttataaagataaattaaatgaaatggtaacaaccgcagaaaaaccgctatgtgaatggaaaatagaggacttagatgaaatgtatttaagcgcaccagtgaagcgaatggtatggcaaacaatacgcgtagtagacgaagtgcaacaaataatcggatgtccaccgaaaagaatatttgtagaaatgacaagatcagatggggaaaaaggaaaaagaacggtaagcagacaaaaaaaacttgtagacttatataaagccttaggaaaagaaggaaaaacctggtccgaagaactttcagacacaccagaatcgcaattcaggataaagaaattatatttatactatcttcaaatggggaaatgcatgtatacaggcgaggcaattgaactagaacaattaatgaacgacaacttatatgacatagaccatatttacccaaggcactttataaaggacgataacatatcgaataacctagtgctagtcaaaaaggaaaaaaacgcacataaatcagattcattcccgatagaaccagaaataagaaataaaatgatgcctttctggaaaagtcttagaaaaaaaggatttcttaccgaagagaaatacaatagactaacacgaatgtctgctttcacagacgaagaaaaggctgctttcataggaagacaactagtagaaacgtcacaagggactaaagctataacacaaatattcgaacaggcattcgcaaatagcgaaatcgtattcagtaaagccagtgttgtctcagcgttccgacaaaaatttgactgttacaaagtaagatgtgtaaacaactatcaccatgcacatgatgcatacctaaacatagtagctggaaatacataccgcgttaaattcactagcaatccactaaattttataaaagaagcgaaaaaaaatcctaacagtcgtgagaacaggtacaacatggacaaaatttttgaatgggacgtaacaaggaatggcgagacagcatgggtagcacaaacaaaagaacatccgggaacaatacaattagtaaaaaaatacctcaataagaacagtccacttataaccaaaatggtatatgaaaaacacgggggaataacacaaaaggcgacaatatggtcagcaaagaaagcagaaagtgggaacaccgatgcctatataccagtcaaaatgaatgacccaagactagcagatgtcacaaaatacggtggggtaaccacgatagcagtagcaggatacacattgctggaatataaggccggaggaaaaacagtacgctcacttgaagctctccctatctatttaggtggtagcaaaaaactcacagaagaacaaatggtagagtacttcagtaacgtgctacagcaagaaaataaagaaaaagtagtatctgacgtaattataaggaaaaaaatgataccttcagggtctttgataaaatacaacggattctattactaccttgcgggaaaaactggagacaggataatactaataagtgcagttcaactatgcctcccgatggatactatgctttacatcaaaaagatagaaaaagcatgctcaaccggaaattttgaagaaaaagataaaaacggaaaacaagtattaagcaaacaacagaatgaatttgtttatgaattgataattcaaaaatatcagcaaagtatatttaagaaaaaagtgggcgcgataggagataccataatagaaaaaagagagaagttcgcagaaatatccctagaagaacaatgtaaagtactcatgcaaatctttctaaactttcaatctggaatcggcgttgaattaaaaatcatagaaggaggaaaaaaaagcggagtaacatatctcaacaaaaaagttatgaacgttcaagagctaaaactaatcgaccaatcagtcacaggagttttctctagagaaatagatctattaacaatctga

SEQ ID NO: 8967 - RNA, 4125 nt, synthetic construct
  misc_feature 1..4125: note = Cas9 variant
  source 1..4125: mol_type = other RNA
atgaaaaaaagatactcatattccataggcttagacattgggaccaacagcgtggggtgggctgtcataaatgaagactacaaagtcccggcaaaaaaaatgaccgtcttcggaaacacagatcgaaaaacgattaagaaaaatcttcttggcaccgttctattcgacagcggagaaaccgcacaagcgcgaagattaaaaagaaccaacagaagacgatatacccgacgaagatacagactatgtcagctccaaaatattttcgcaacggaaatggtgaaagttgacgatacctttttccaacgcctatcggaaagtttcttttattaccaagacaaggcatttgataaacatcccatattcggaaattccaaagaagaaagagcatatcataaaacttaccccaccatataccaccttagaaaagacttagctgaccgagatcaaaaagcagatctacggttaatttacctagccctatctcacataataaaatttcgcggacattttttaatagaaggaaagttaaattcagaaaataccgacgttcagaaactatttatagctctagtaacggtatacaatctattatttgaagaagaaccaatcgcaggggaaacttgtgacgcgaaagccctactaactgccaaaactagcaaatccaaaagactagaatcgttaatctcagaatttcctggacagaagaaaaatggactattcggcaacttattagcgctggcattaggactcagaccaaacttcaaatctaattttggactatcagaagacgcaaagctgcaaataacgaaagacacatacgaagaagaattagacaaccttttagcagaaatcggagaccactatgcagacctattcctcgccgcgaaaaatttgtccgacgctatattactatcagatatattaacattatcagatgaaaacacacgcgcaccactatcagcatcaatgataaaaagatatgaagagcaccaagaagacttagcactattaaaaaaactcgtaaaagaacaaatgccggaaaagtactgggagatatttagcaatgcaaaaaaaaatggatacgctggttacatagaaggaaaagtgtcacaagaggatttttaccgctatataaaacctatattaagtcgattaaagggcggggacgaattcctagcgaaaatagatcgcgacgattttctccgcaaacaaagaacctttgataatggatcaataccccatcaaatacatttaaaagaactgcatgcaatcctccgccgacaagaaaaatactacccatttctcgccgagcaaaaagagaaaatagaacagttactttgcttccgaataccttattacgttgggcctcttgctaaaggagggaactcatctttcgcatggttaaaaagaaggagtgatgaaccgataacaccatggaatttcaaagacgtagtagacgaagaagcaagtgcacaagcattcatagaaggaatgacaaattatgacacctatttaccagaggaaaaagtacttcccaaacactcaccattatacgaaatgttcacagtttacaatgaactcaccaaagtgaaatacatagcggaaaacatgacaaaaccactatatttatctgcagaacaaaaagaagccattatagatcaccttttcaaacaaacccggaaagtaaccgtaaaagatttaaaagaaaaatatttttcccaaatagaaggcctagaaaatgtagacgtaaccggcgtagagggtgcatttaatgcaagcttaggaacctataacgacttattaaaaataataaaagataaagcgttcctagatgacgaggcaaacgcagaaatacttgaagaaatagttctaatcctgacactctttcaagacgaaaagttaatagaaaaaagactagccaaatacgcaaacctattcgaaaaatcagtattaaaaaagcttcgcaaacgtcactataggggctgggggcgactaagcaggcaattaatagacggaatgaaagataaagccagcggaaaaacaatactagattttttaaaagccgacgatttcgcaaacagaaactttatacaattaatcaacgatagtagccttgactttgaaaagttgattgacgacgcacaaaaaaaagcaataaaaagagaaagcctaaccgaagcagtagccaacctagccggctcaccagccatcaaaaaaggtatcttacaaagtttaaaagttgtagacgagatagttaaagtcatgggtcataatccagacaacatagttatagaaatgagtcgcgaaaaccaaaccaccgcacaaggcctaaaaaacgcaagacaaagattaaaaaagataaaagaagtacacaaaaaaacaggctcacgaatcttagaagacaattcagaacgaattaccaatcttacactccaggacaacagactgtacttatatttactgcaagacggaaaagacatgtacacgggacaagacctagacataaataatttatctcaatatgacatagaccatatcataccacaatcattcataaaagataattcaatagataatctagtcttgacaacgcaaaaggcaaaccgaggaaaaagtgataatgtgccatctattgaagtcgtgcgagatatgaaagacagagtatggagacgacaactagctaatggagcaatttcacgccagaaattcgatcacctcactaaagccgagcgcggtggacttgcagattcagacaaagccagattcctaaggagacaactagtagagacaagacaaatcaccaaacacgtggcccaactcctagatagcagatttaactcaaagtctaatcaaaacaaaaaattagcacgaaacgtcaaaataataaccctaaaaagtaaaattgtgtcagacttccgaaaagactttggattatataaattaagagaagtaaataactatcatcacgcacacgatgcgtacctaaatgcagtagtagggacagcattattgaaaaaataccccaaattggaagcagaatttgtttatggtgactacaaacactttgaccttgtgaaactaatctctaagtctgacccatcactaggaaaagctacagcaaaggtatttttttactctaacataatgaacttctttaaagaagaactaagccttgctgacggaactctcatgaaacgacccgtaatcgaaacaaacacggaaaccggagaagtcgtatgggataaagtgaaagactttaaaaccataaggaaagtattatcataccctcaagtaaatattgttaaaaaaactgagattcaatccggcgcctttagtaaagaatcagtattatccaaaggaaactcggataagctcatagaacgaaagaaaggatgggacccgaaaaaatacggaggatttgactccccaaatacagcatattccattttcgttgtcgcaaaagtagccaaaagaaaagcacaaaaactaaaaacagtaaaagaaatagtaggcataacaatcatggaacaagcagaatacgaaaaggacaatatagctttcttagagaaaaaaggataccaagacatacaagaaaaactcctcataaaattgccaaaatactcactattcgaattggaaaacggacgaagacgactactagccagcgcaaatgaatttcaaaaaggaaacgaactagcattaagtggcaaatacatgaaattcttatatctagcgtcacgatatgacaaactatcatcaaagatcgaatcagaacaacaaaaaaaattattcgtcgaacaacacttacattactttgacgaaatactagatatcgtagtcaagcatgccacatgttatataaaagcagaaaacaatctaaaaaaaatcatatcattatacaaaaaaaaagaagcgtattccataaacgaacaagcactgaacatgctaaacctatttatatttacgtcgctaggagcacccagcacattcgtattctttgatgaaactatagatagaaaacgatatacaacaagtagtgacgtactcaacgggattctcatccaacaaagtattacaggattatacgaaacacgcattgacttatcaaggttcggcggagattga

SEQ ID NO: 8968 - RNA, 4125 nt, synthetic construct
  misc_feature 1..4125: note = Cas9 variant
  source 1..4125: mol_type = other RNA
atgaaaaaacagaagttttcagactactacctcggttttgacataggaacaaactcggtcggctggtgcgtcacagacctggactacaacgtactgagattcaataaaaaagacatgtggggaagccgtctatttgatgaagccaaaacggcagctgagcgcagagtacaacgaaattcccgcagacgactaaaaagaagaaaatggagactgaatctgttagaagagatattctctgatgaaataatgaaaatagacagtaatttttttagaaggctaaaagaatcatccctatggctagaagacaaaaactcaaaagaaaaatttaccctgttcaatgacgataactataaagactatgatttctataaacaatacccaacaatatttcacttacgagatgagttaataaaaaacccagaaaaaaaagatatacgacttatctacctggcgctacactcaatttttaaatcaagaggtcatttcctattcgaagggcaaaatctgaaagaaattaaaaacttcgaaaccttatacaacaacctaatttcctttctagaggacaatggaattaacaaatcaattgacaaagacaatatagaaaaacttgaaaaaattatttgcgactcaggcaaaggattaaaagataaagagaaagaattcaaaggcatctttaactcggacaaacagcttgtagcaatatttaaactgtccgtagggagctccgtttccctaaatgatttatttgacacagatgagtacaaaaaagaagaagtagagaaagaaaaaatatcatttagagagcagatttacgaagacgacaagcctatttactacagcatcttaggggaaaaaatcgaactattagacatagcaaaatcattctacgatttcatggtattaaataatatactttcagattctaattatatatctgaagccaaagtcaagctttacgaagaacacaaaaaagacctaaagaacttaaaatacattatacgcaaatacaataaagagaactatgataaactgttcaaagataaaaatgaaaacaactaccccgcttacatcggactcaacaaagaaaaagataaaaaagaagtcgtagagaaatcaaggcttaaaatagacgatctgataaaagtaataaaagggtatttgccaaaacccgaacggatagaagagaaggacaagactatattcaacgaaatcttaaataagatagaactaaaaaccattctaccaaaacagagaataagtgataatggaaccctcccatatcaaatacatgaagtagaattagaaaaaatactagaaaaccaaagtaaatattacgatttcttaaactacgaagaaaatggagtctccacaaaagacaagctcctaaaaaccttcaaattccgcatcccatactacgtagggccactaaacagctatcacaaagataaaggcggaaactcctggatagtcagaaaagaagaaggtaaaatactaccatggaacttcgaacaaaaagtagatatagaaaaaagtgctgaggaattcatcaaacgtatgaccaataaatgtacctatttaaacggtgaagatgtaatcccaaaagatagcttcttatactctgagtacattatactaaatgaactcaacaaagtacaagtaaacgatgaattcctaaatgaagaaaacaaacgtaaaattatagacgaactttttaaagagaataaaaaagtatctgaaaagaagtttaaggaatatctacttgttaaccaaatagcaaaccgaacagtcgagctaaaaggaatcaaagattcattcaactcaaattacgtctcgtacattaaattcaaagacattttcggagaaaaattaaatttagacatatacaaggaaatatctgaaaaaagtatattatggaaatgcctatatggcgacgataaaaaaattttcgaaaagaaaataaaaaatgaatatggagacatactaaataaagacgaaataaaaaaaataaatagcttcaagtttaacacatggggtcgattaagcgaaaagctactaactggaatagaatttataaacctcgaaacaggagagtgctatagctctgtcatggaagcattaagacgaacaaactataatctcatggaacttttaagctcaaaattcactctgcaagaaagcatagacaacgaaaacaaagaaatgaacgaagtatcttatagagaccttatagaggaaagctatgtatccccaagcctaaagcgagctatcctacaaacactaaaaatatacgaagaaataaaaaagatcaccggcagagtacccaaaaaagttttcatagaaatggcaagaggcggggatgaatcaatgaaaaacaaaaaaatacctgcacgccaagaacaattaaaaaaactatacgatagttgtggaaatgacatagcaaatttcagtatagatatcaaagaaatgaaaaactctctcagtagttacgacaacaactcattaaggcaaaaaaaactatacctatattatcttcaatttggaaaatgcatgtacaccggaagagaaatagatttagacagactactacagaataatgatacatatgacattgaccatatatatccacgatcaaaagtaataaaagatgattcatttgacaatttggtcctagtgttaaaaaacgaaaatgccgaaaagagcaacgagtacccagtcaaaaaagaaatccaagaaaaaatgaaatcattctggagatttctaaaagaaaagaatttcatctcagacgaaaaatataaacgactcaccggaaaagacgatttcgaactacgaggtttcatggcaagacaactcgtaaacgttagacaaacaacaaaagaagtaggaaaaatcctacaacaaatagagccagaaataaaaatcgtctactcaaaagcggaaatagcatccagcttcagagaaatgttcgacttcataaaagtaagagagttgaacgacacccaccacgcaaaagacgcatacctaaatatagtggctggcaatgtttataacacaaaattcacagaaaaaccgtatagatacttacaagaaatcaaagagaattacgatgtaaaaaaaatatacaactacgacataaaaaatgcttgggacaaagaaaactctctagaaatagtaaagaaaaatatggagaaaaacacagttaatataaccagattcataaaagaagaaaaaggcgagctcttcaacttaaacccaatcaaaaaaggggaaacgagtaacgaaataatatctataaaacccaaattatacgatggaaaagacaacaaattaaatgaaaaatacggctattacacctcgttgaaagccgcctactttatatatgtggaacacgaaaaaaagaacaaaaaagtaaaaaccttcgaaaggatcacccgtatagactccacattaatcaaaaacgagaaaaacctcataaaatacttagtctctcaaaaaaaactactcaaccccaaaataatcaaaaaaatatacaaagaacaaaccttaatcatagactcatacccatacacattcaccggagttgacagcaataagaaagtcgaactaaaaaataaaaaacaactctaccttgaaaaaaaatatgaacaaatcttaaaaaatgcactaaaatttgtagaggacaaccagggcgagacagaagaaaattataaattcatatacctaaagaaaagaaataataacgagaaaaacgaaacgattgatgctgttaaagaacgatacaatatcgaattcaatgaaatgtacgacaaattcctagaaaaattatcaagtaaagactacaaaaattatataaataacaaactttacactaacttcctaaattcaaaagaaaagtttaaaaaactaaaattatgggaaaaatcactgatattaagagaatttctaaagattttcaacaagaatacatacggaaaatacgaaattaaagactcacagacaaaagaaaagcttttttctttcccggaagatacaggaaggataagactcggacaaagttcattaggtaacaacaaagaattactcgaagaatcagtcacagggttattcgtcaaaaaaataaaactctga

SEQ ID NO: 8969 - RNA, 4128 nt, synthetic construct
  misc_feature 1..4128: note = Cas9 variant
  source 1..4128: mol_type = other RNA
atgagcaacaaaccatatagcataggattagacataggaacaaacagtgtaggctgggcagttataaccgatgactacaaagtaccgagtaagaaaatgaaagtactgggtaatacagataaacactttatcaagaaaaatctcataggagccttattgtttgacgaaggaacaacggccgaagatcgacggcttaaacgaacagcccgccggagatatactagacgtaaaaacagactaagataccttcaagaaatatttttcgaagaaatgtcaaaacttgactctggatttttccatagacttgacgatttcttcctaatacccgaagataaacggggatccaaatatcctatttttgccacactagcagaagaaaaagagtatcacaaacaattccccaccatctatcacttacgaaaacaattagcagatagtaaagaaaaagccgacctacgactaatatacttaacattagcccatatgataaaataccgagggcacttcctttacgaagagagctttgacattaaaaacaatgacatacagaaaatattcaatgaatttataagtatatacgataatacatttgaaggaagttcactatcagggcaaaacgcacaaatagaagcaatatttacagacaaaataagcaaaagtgcaaaaagggaacgcgtacttaaactatttccagatgaaaaatccacaggcctttttagcgaatttttaaaactaatcgtaggaaatcaagcagacttcaagaaacactttgaactagaagaaaaagcgccactgcaatttcccaaagacacatatgacgaagatcttgaaaacgtgcttggacaaataggagatgatttcgctgacctctttgtagctgccaagaaactatatgacgcaatactactctccggcatacttactgtaacagatccgtctacaaaagcgccactgtcggcgagcatgattgaaagatatgaaaaccaccaaaaagatctcgctgctttaaaacaattcattaaaacaaatctaccggaaaaatacgtagaagtattttcagatcaaagcaaagacggttacgctggttacatcgacggaaaaacaactcaagaagccttctacaaatacatcaaaaatctactatccaaattcgaaggcacagactacttcctagacaaaatagaaagagaagactttttacgtaaacaaaggacattcgacaacggttcaataccccaccaaatccaccttcaagaaatgaatgcgattttaagacgccaaggagaacattacccattcctaaaagaaaataaagagaaaattgagaaaatactgacattcagaataccatactatgtaggaccacttgcaaggggaaaccgagattttgcatggctaacacgaaattctgaccaagctattcgaccctggaactttgagaaaattgtagataaagccagctcagcggaagattttataaacaaaatgacaaactacgatctatatctacctgaagaaaaagtactacccaaacattctctactatacgaaacattcgcagtgtacaatgagttaacgaaagtaaaattcatagcagaaggtctccgtgactatcaatttttagacagcggtcagaagaaacaaatagtaaaccagctatttaaagagaaaagaaaagtaaccaagaaagatatcatccactaccttcatactgtagatggatacgatgggatagaactcaaagggattgaaaaacaattcaatgcatcactttcaacatatcatgacctcctcaaaatcatcaaagataagaaattcatggacgattccaaaaatgaagcaatcctagaaaatatcgtccacacacttacaatattcgaagaccgcgaaatgatcaaacaaagattagcacagtatgattcactattcgacgaaaaagtcattaaagccttaacaagaagacactacacaggctggggaaaattaagcgcaaaattgatcaacggaatatgtgacaaacaaacaggaaatacaatcctagactatttaatcgatgacggcgaaataaacagaaactttatgcaattaatcaacgacgatggcctatccttcaagaaaataattcaaaaatcccaagttgtcggcgaaacagacgacgttaaacaagtagtgagagaacttccgggatccccggcaatcaagaaaggcattctacaatcaataaaaatagtagatgaattagtaaaagtaatggaccacgcaccagaaagtatcgtaatagaaatggccagagaaaatcaaacaacggcacggggaaagaaaaactcgcagcaaaggtacaaacgcatagaagattcattgaaaaacctagcatcgggactcgactcaaacatactgaaagaaaatcctacagataatattcaacttaaaaacgaccgtttattcttatattacctacaaaatggaaaagacatgtacacaggggaagcactagacataaatcaattgtcaagctacgatatcgatcacataatacctcaagcattcatcaaagacgactcactagataacagagtactgacgagttcaaaagataacaggggaaaatcagacaacgtaccctccttagaagttgttcaaaaacgaaaagcattttggcaacaactactagattcaaaattaatatcagaacgaaaatttaacaatctaacaaaagctgaacgcggtggactcaatgaaagagacaaagtcggcttcataaaacgccagctagtagaaaccagacaaataacaaaacatgtagctcagattcttgacgcaagatataacacagaagtcaacgaaaaagacaagaaaaatcgaacagtaaaaataataactctaaaatctaatctagtaagcaattttagaaaagagtttaggctatataaagttagagaaataaatgattatcatcatgcacacgacgcctatctaaacgccgtggtcgctaaagcaatactcaagaaataccccaaactcgaaccggagttcgtatatggagaataccaaaaatacgatttaaaaagatatatctctagatcacgcaaccccaaagaagtagaaaaagcaacagaaaaatactttttctattcaaatttactcaatttcttcaaagaggaagtccactatgcagacggaacaatagtcaaacgcgaaaacatcgaatattcgaaagacactggagagatagcctggaacaccgaaaaagatttcgcaaccatcaagaaaatattaagctatccgcaagttaatatcgtcaagaaaactgaagaacaaaccgtgggacaaaacgggggtctattcgataacaacatagtttcaaaagaaaaagtagtagatgcatcaaaactaatccccataaaaagcggactatccccaaagaaatatggaggctatgcacgaccaacaatagcctactccgtcctagtaacatataaacaaaacaataagattaaaaacacaatggtaggtatcccagtacttacaaaactcgagtttgaaagagatcctaacctatatctacgaaatcttggaatcaataacgtatcacatgtcataaaactcgtgaaatatacagtccttgagtttaaacataaatatggcacatacagaagatttatagtatccaaccaagaattaaaaagagcaaaccaaatctttgtaaccaccaaacaaatgaaactaataagccaatacaccaccttagacaaaaacgaacatgatagtttacttaaaaacaaccaacaactcattcaatcaatctggaaccagttcctagaatttatgttagcaacggacctagtaaacaagaaacaatacgatgaactaatattaacaaacaaccaaacaatagaagaatgtaggaatatcatgaaccgagtcatcacaacattgtcctttactaacatcaatgcaggacaaaagaaaataatttttgacgacaccttgagcctgcccataaaaaggtggcaatttacagacagcgacaaaatggtcaagaaaataatagagagcacgctgatacaccaatctataacaggtttatacgagacccgaatagatctatccaaactaggcgaagattga

SEQ ID NO: 8970 - RNA, 4128 nt, synthetic construct
  misc_feature 1..4128: note = Cas9 variant
  source 1..4128: mol_type = other RNA
atgaaagaatatcacatcggattagacattggtacttcatcaataggctgggcagtcaccgattcacaatttaaattaatgagaatcaaaggtaaaacagcaataggagtaagattatttgaagagggaaaaacggcagcagaaagaaggacctttcgcacaaccagacgtcgacttaaaagaagaaaatggagactccactacctagacgaaatatttgcaccccatctacaagaagtagacgaaaactttttacgaagacttaaacaatcaaatatacatcctgaagaccctgctaaaaatcaagccttcataggcaaactgctatttccagatctcctaaagaaaaatgaacgaggatatcccaccctaataaaaatgagggatgaacttcccgtcgagcaaagagcccactaccctgtaaccaacatctataaactgcgtgaagccatgataaatgaagatagacaatttgatttgagagaagtatacctggcagttcatcacattgtaaaatacagaggccactttttaaacaatgcatcagtagacaaattcaaagttggcagaattgatttcgacaaaagttttaatgttctaaacgaagcctatgaagaactacaaaacggcgaaggtagttttactatagagccaagcaaagtcgagaaaataggccaactactacttgacacaaaaatgagaaaactagacagacaaaaagctgttgcaaaattattagaagttaaagtcgcagataaagaagagaccaaaagaaataaacagatagcgacagccatgagcaaattggtactaggatacaaggccgactttgccacagtcgccatggtcaacggaaatgaatggaagatagatctctcttcagagaccagtgaagatgaaattgaaaaatttcgagaagaactaagtgatgcacaaaacgacattttaactgaaataacaagcctattctcacaaataatgttaaatgaaatagtccctaacggaatgtcaatttcagaatcaatgatggatagatactggactcatgaaagacaactcgccgaagtaaaagaatacctagctacgcaaccagcatcagcaagaaaagaatttgaccaagtatacaacaaatacataggacaagcacccaaggaaaaaggattcgaccttgaaaaaggattaaagaaaatcttaagtaagaaagaaaactggaaagagatagatgagttgctaaaagctggagacttcttaccgaaacaacgaatatctgctaacggagtaataccccatcaaatgcaccagcaagaacttgacagaattatcgaaaaacaagcaaaatactacccatggctggcaactgaaaaccctgcaacaggagaaagagatagacatcaagctaaatatgaattagaccagctagtatccttcagaataccctactatgtaggacccctagtaacccccgaagttcaaaaagcaacatcaggggccaaatttgcttgggcaaaaagaaaagaagacggtgaaattacaccatggaatctctgggacaaaatagacagagcagaatctgcagaagcatttattaaaagaatgacagtgaaagacacatacctactaaacgaagatgtactaccagcaaattcacttttatatcaaaaatacaacgtacttaacgagctaaacaatgttcgtgttaatgggcgtcgacttagcgtaggaataaaacaggacatatacaccgagttatttaaaaagaagaaaactgtaaaagctagtgatgtcgcttctctagttatggctaaaactagaggagtaaacaaaccttccgtcgaggggttatctgatccaaagaaattcaattcaaacttagctacatacctagacctaaaatcaatcgttggagataaagtagacgataacaggtatcaaatggatttagaaaacataatagaatggagatcagtcttcgaagatggagaaattttcgcagataaactgactgaagttgaatggcttacagacgaacaacgcagcgccctagtgaagaaacgttacaaaggttggggccgtctttcaaagaaattattaaccggtattgtagatgaaaacggacaacgcattatagacctaatgtggaatactgaccagaattttatgcaaatcgtaaatcagccagtattcaaagaacagattgatcaattgaaccaaaaagcaataactaacgatggaatgactttacgagaaagggttgagagtgttctagacgatgcatacacctcacctcagaacaagaaagcaatatggcaagtagtcagagtcgtggaagacatagtaaaagcggtaggaaacgctccaaaaagtatttcaattgagttcgctaggaacgaaggcaacaaaggggaaataacaaggtcaaggagaacacaactacaaaaactgtttgaagatcaagcacacgaattagtaaaagacacaagcctcacagaagaactggaaaaagtacctgacttgtcagaccgatattacttctacttcacgcaaggcggaaaagacatgtatacgggggatccaattaatttcgacgaaatttcaacaaaatatgatatagatcacattctgcctcaatcatttgtaaaagacgacagcctagacaatagagtgttaacatcacgaaaagaaaataataagaaatcagatcaagtcccggccaaactgtacgcggcaaaaatgaaaccatactggaatcaacttttaaaacaaggcctcataacacaaaggaaatttgaaaatctaactatggacgtagaccaaaccataaaatatagatcacttgggtttgtgaaaagacaattggtagaaacgagacaagtaataaaattaactgcaaatatattaggatcgatgtaccaagaggccggaactgacatcattgaaacaagagccggactaactaaacaactacgagaagagttcgatttaccgaaagtacgagaagtcaatgattatcaccatgctgtagacgcctatctgacaaccttcgccggacaatatctcaacagaaggtatcccaaattacgctctttctttgtctatggtgaatacatgaaatttaaacacggcagcgatttaaaattacgcaattttaacttctttcacgagttaatggagggtgacaaatcacaaggtaaagtagtggaccaacaaaccggagagctaatcacgacaagagacgaagtagctgactattttgattgggtacaagacctgaaactaatgctagtcacaaaagaactaaaacggtctaacggaaaactctttgacgccacaatacaaaacgcgaattatacaaaattaaatgaaaggaaaaaggtttttgtaccactaaagaaagaactagataaaacgctatatggatcatacagcggaatacagtcaagttacatgacaatagtaaagaaatttgataagaaaggttccacttatgctgtacaaagaataccagttatgtactcgaaattgttagagctagaaaaagaacaatcaaaactaaatagactcgtacaaagcatagtaacttccgacccccaagctccaaacaattttgaggtgctgatgccctgtgtcctctcgggacagctagtaatagacaacggtagaaaatttacactaacgtcatacagataccaatgtagcacagcccaattattcttacccaagaaagacctaaaatatatacaaaacaatttcaaagaacttaagaaaacccctgacaaacaagataaaatattcgaaacaatttacgatgacatattaaaacaagtagacaaatatttctcgctatatgatataaataaattccgttccaaattacatgacggcaaagacaaatttttggccctggaaaacttcggagaaaaagaaagtaaagataaagtcattacaaaaattttacgcggactacatgcaaatgcagagagaacatcattaaaagaaattggattatcaacaccgctcggacaattccaatccggggaaggaggtattactctctcagacaacacaaaaatcatataccaaagccccacagggcttttcgaacgacacgtatatcttaaagatttatga

SEQ ID NO: 8971 - RNA, 4128 nt, synthetic construct
  misc_feature 1..4128: note = Cas9 variant
  source 1..4128: mol_type = other RNA
atgaggaagaatcaagaaccatacaatataggactcgatataggtacttctagtatagggtggagtataatgaatgataacttcgatttaatgagagtgaaagggaaaaaaggaataggagtaagactatacaatgaaggtcaatctgcagcagaacgaaggatgcacagaactgcccgcagaagatatgggagacgaaaatggagattacgactattggaggatttcttcgatgaacacatggctgaagtcgacgacactttctttgcaagactcaaagatagtaatatatcaccaaaagatgataaaaaatatcgcaaaagcctactatttccaaaaagtaaaggcgtcacataccaagacgacggtgaattctataaaaaatatcccactatgtaccacctcagatacgcattaatgaccgaacaccgaaaattcgatttaagagaaatctacttagcttttcatcatatggtaaagtacaggggaaattttttatatgatacctcagttgactcctttgaagctaaaaacctagatataaagggaaaattcgacgaaataaatgatctcctatcatcatatacagacttttatgtagacaactcaaatgcagccctagttgaatcaatcttattggaaaaaaatacaacacgtaaagacaaaagcaagaaaatagcaaaactcctacacgttgaggataaagaaaaaggcaaaaacaaaaaagctaaagatttagcaacccaaatctcgaatgcagtattaggccttaaatgcaatttccacctcatcttcgaactacaacaaaaatattccttcgatctatgttccgaaaagaccgaagaaaacatagcaaaactcagcgaagtactggacgaaaaccagaaaatgctactaatgattctaaaagaagtacaggaccaagttatgttaaacgcattcgtaccttctggtatgagtttatcagaagctatgatgcaaaaatatgatgactacggagaacaattaaaaatataccacgagctcgaacactcagttagcgacgattcagcggcaaaactaagaggagcataccgagactataatgataatattattaaaagaattgatggtgataacaagaaagacactttttataaaagagtaaaaaacatactgacaaaaatatcaaaagaatatgtagatcaagatgtactagaatcctgcggaaagctaaaaaaattaatcgacgaaaacaaactatttattcgacaacgaactgcagctaacggagtccttccacaccaattacaccaaatagagatgagaaaaataatcgacaaccaaaaagaatactacccatggcttgcagaaccaaatcctaacgaaaaaagacgagtctatagtaaatacaaagtagaggaactaatagcgttcagaataccgtactatgtcgggccgttagttgacccaaataatgcagacaaaaataaagaagcaaggttttcctggatggtacggaaaaaggatggagaaatcacgccctggaatttctatgacaaagttgattgggcagaaagcgcaaacaatttcattgaaagaatgaaatcaaaagacacttatctactaggagaagatgtagtacccaaggaatctatgctttatcaaaagtatgaagtactaaatgaattaaacaacttacggataaatgatagcgggctgagcgactctttcgaagatgtaaaattaaaacaagcaatatataacgacctattcaaaaaacaaaaaatagtaaaaatcacggacctccaaaactatctcgtccaaaatcacaaatatttagtcaagccaaagatatctggcttagcagacgaaaacagatttctatcttcactatcaacatattccgacttaaaaaccatattcggagataaagtagatgacagaacatacttcaacgacttcgaaaaaatggtagaatactcaaccgttttcgaagacggtcacgattataatcaaaaactcgacgaatatacatggctgaccaaagaagaaaaatacaaaataggcaaaaaaagatacagaggctggggaaaattatcgaaaaaactactaacaggactcagagacaaaaataatcacacaataatggataatctatgggaaacaaatagaaattttatgcaaattcagactgcagatgaattctcaaaacaaatagccgaagaaaacgaaaggcatctcaagggttcagttagcgatgccataaatgacatgtacacttccccagcgaacaaaaaagctataagacaggtacttagagtcgttgatgacatccaaaaggccatgggatacgccccatctagtataagtctggaatttgccagagaagacggaccatctgtcagaacagtctctagggcgaaccgaatgaaatccatctacgaaaagtacgcttccgaggtatctgaagaagtgatgaaagacctggatggagtaatcaaagacaaaaaaggattaaacgatcgtttatacctatactttgaacaacaaggcaaagacatgtactcaggacatccattagattttgataaagttatatcaggacaagaatacgacatagaccatatactaccacaggcagtaattaaagatgattccctagacaatcgagtactaacaactaaggctctcaacaacgatgtaaaaagcaaaggagtaccgtgtagaatgttcaacggaatgcatagcttctggaaaaacttatatgacaaaggattcatatccagaagaaaattcaataacctgacaaccaaccccgaaaacattgataaatacaaaatgaaaggattcgtcaacaggcaattggtagaaacaagacaaataattaaacttgtagcaaacgtactaaacgataaataccaaaacgatgatgtagacataatagaagtcagagccgaacttacacacgacgttaggaaacacttcaaattctacaaaaacagaaatgtgaacgattatcatcatgcatttgatgcttacctaacaagtttcataggccactacctattcaagaaatatcctaatttaaggccactatttgactataatgatttcatgaaagttagcgacaacgtatttaaacaactacgaggaaacaacttcttaggcgaattcctcaacaaaacgggagacatcatatcaacagatggtaatttcgtattgaataaagaagaaatgataaacaaactaaacaaagcatacgcattcaagaaaatattggtcaccaaagaagttggacagagaaccggcgcaatgttcaatgaaacacgttacccggcaccgaatagtagaaaagcagcattgaaatacagaagaatgcctaaacctgactcgctaatcagcgtaaaagactacaaaaatacagacatttacggaggatacagtggtaaaaatgacgcatatatggtaatagtcgatatggggaaacaatatatggtcgtgggagttcctgtaaggtatacagaaaaattagacaaactaaggataaaacattcagaactttatagagacgaattgcgaaaggtattgagtagagataaaacactcctcgattcaaaaggcaacgtgaaacggttcgacatagtacttgacagagtattatatggacaactaatagaagatggaaatgaattatttacactaggaagttctaagtataaacgtaattttagacaattattcctagacaaacaatgtatagaaattttagatagctccgctacaccacaaccgacagacgaagaattaatctgggtatacgatcaaatattagataaagtagacaaatacttcgagctgtacgatataaacagacaaagggaaactctaagaaaaggacgagcagcattctgttctttaccgaacatatcaatgaaaaaagatgatgtgacaaaaaaaaaaatattaaacgagatattggttgcactacacgcaaacgaaagtgaaagtaattgtgaaaaaataggcaaaaaggtcttcggcagattacaagttcccggaggcattaaactaagcaaagaagcaaaactaatataccaatcaccaacaggactatttgagcgagtcgtatacctcaaagatctatga

SEQ ID NO: 8972 - RNA, 4128 nt, synthetic construct
  misc_feature 1..4128: note = Cas9 variant
  source 1..4128: mol_type = other RNA
atggaaaacaagaaatatagcattggtcttgatataggcacttcaagcatcggatttgccgttgtagacgaaaataatagagtcatgcgagtgaaaggtaaaaacgccataggagtcaggctgtttagcgaaggacaaccagctgcagacagaagaagtttcagaacaaccagacgaaggctatcgagaagacgttggagactacgactactaagagaaatatttgaaccctacataaaccctgtagatgaagcattcttcatgcgtttaaaagaaagtaacttaagtccaaaagatgcaaataaacactatagcggagatattctatttaacaatcaaaccgatcaagatttctatgaaaaataccccacaatatatcacctaaggcacgcgttaatgacagaacaccgcaagttcgacgtcagagaaatatatctggcaatccaccatatagtaaaattccggggacactttttaaatgcagcctccgcatcaaatttcacagtaggaaaactaaatctggaaggaaaattcgacgcccttaatgagatatatcaacgggtgctcactgatgacccgtttgctttgcgcacagacaatctagatcatataaaagaaattttgatcgataacaagagaagccaggccgatcgacaacgaacattaacaggagatgtatatcaatctagtgaagagaaagaaatagagaaaagaaataaagctatagcgacagaaatacttaaagcagcagtaggaaataaagccaaactaaacgttatcactaacgtcgaagttgataaggaagccgctaaagattggagtctgacattcgattcagaaactattgacgatgaattagcaaaagtagatggacaaatgacggatgatggaagagaaataatagaaatactaaggtcattatacagcggaataacattagccgccattgttcccgaaaaccatacactaagccaaagtatggttgaaaaatacaattcccacaaagcccatttaaaattactcaaagacctaattaataatatgacagacactaagaaagccaaaaacttaagagctgcttatgacggttatatagacggcgtaaaaggtaaagtacttacccgagatgatttttataaacaaattcagggtaacttagacgattcagctgaagcacagaaaattcaagacgttatggatcaagatgagttcatgccaaaacaacgaacaaaagcaaatggatcaattccgcatcaactccagcaacaagaattagatcaaatagtagaaaaccagaaagaatactatccgtggttagcagaagaaaatccaaacgaaacacgcagaggcgtcgctaaatataaacttgacgagctagtcacattccgcgtaccttattacgtagggccaatgataacagccgaagaccaagaaaaacaaagtggtgcatccttcgcatggatgaagagaaaggaaccaggtaatataacaccatggaattttgaccaaaaagtcgatcgaatggcatcagcaaaccagttcataaaacgtatgactaccacagatacctatctcctaggagaagacgtattaccagctcaatccctcctttaccaaagatttgaagttttaaacgaactcaacaaaataagaatagatcgaaaacctataagtatagaactaaaacaacaaatttttaatgatttatttaaaaagttcaaaaatgtgacaattaaacaccttcaggaatacttggtcgcaacgggagggtacgataaacggcccagaatagatggattagctgatgaaaaacgatttaatagcggactctcagcatatcacgatttacacggtattctaggagctgaagtagtcgacgctaatgacaaacaagatgacctagagaaaataatagaatggtcaacaatatttgaagacaagaaaatatatagagccaaacttgacgaacttacttggcttactgacagccaaaaagaaaaactagcaacaaaaagatatcagggatggggaagactatcgaaaaagctactatcaggcttaagaaactccgatcatagatcaatcctagatatattatggataacaaacgagaactttatgcaaatacaagcagatccagatttcgctgagctagtcaaaaatgccaatcaaggcatgctgggcaaaaacaatagtcaagatgtaattaacgatctttatacatcgccacaaaacaagaaagctataagacagatattacttgtagtacacgatatacaaaacgcaatgcatggacaagcccccgccaagatccacgtagagttcgcaagaggcgaagaacgaaatcctcgaaggagtatacaacgacaacaccaaatagaagcagcatacgataaagttacaagtgacttacttgttgatgcaggagtaagacaagaactaaaagacgctataaatgacaaaagagattttaaagatagacttttcttatactttatgcaaggtggaagggatatctataacggagaaccaataaatattgatagacttagcagttacgatatagaccacatcctcccacaggctttcgtgaaagacgatagcctaaataatagagtgctaactgacgcagaaggaaaccgacgcaaaagtgatgcagttccaagtgaactctttggagcaaaaatgcgcagcacatgggaactcatgagggaacaaggattgatctctaaagcaaaatatcgaaacttaaccatgaatcctgagaacataaacgctcatactgaaaatggatttataaataggcaattagtagaaacacgacaagtaatcaaacttgcggttaatatactagcagacgaatatacggaagacacacaaatagtatcagttaaagcagacctatcacaccaaatgagagaagactttgaactcttgaaaaatagagacgtaaatgactaccatcacgcattcgacgcatacctagctgcttttataggcaactacctcctagaaagatacccaaaattacaatcatacttcgtatatggagactttaagaaattttcacaaaaagatacgaagatgagaagattcaactttatctatgacctaaaacattcagatcaaatcgccgataaaaacggcaaaaagatttggcataaaactaatgacttagattacataagacatctatttgcatataagaaaatattaatatcacacgaagtaagcgaaagaaggggcgctctctacaatcaaacagtatataaagcgtcagacgataaagcgtccgggcaaggatctaagaaactaatacccataaaagccaataaaccaacagaaatctatggaggctatacgggaaaaacgctagcttatatggcaatagtaaaagtaattaaagggaagaaaatagcttacaaagtggttggagtccccacttcagcactcgtacaacttgcaggtatagaacatggcagccaagaggaactaaacagattgtacgatgtcttaaaaccccaatttacgcaattaaagaaaaacaataaaacaggagaaatatctgaaaccgtatcaaaatttgaaatagtcatccctagagtaaaatatcaacagctagtagaagacgacgataaattgttcatgataggcagtgatacctacccctataatgcacaacaactggtgctttcagaaggagccctaaaagtaattaataacgtataccgcaaaggagaaaacagcgacaaacaagagagttacaaattagacgacgtttatgatgaaatcataatagctatgaagaaatattttccactctatgacaacagaggatttagagaaaaagttgcagaaggaaaatcgacatttgaaaacctaccaataagcaacgaatttaaaaatggaaaactcacaaaaataggtaagaaagaagttattaatcgtatgctacaaggactacatgccaacgcaacaatgacggacctaaaaatactaggcatcaaaagtccgttcggcttcatgcaacaaccaactggaattgcattaagtgaaaacgcacaactaatatatcaatctcccacagatttatttgagagaagagtccaactaaacaaaataaaatga

SEQ ID NO: 8973 - RNA, 4128 nt, synthetic construct
  misc_feature 1..4128: note = Cas9 variant
  source 1..4128: mol_type = other RNA
atgaagaaaatacttggactggatttgggaaccacatctatcggttgggctctagtctatgaaagtgaaaatacagacgagaaaagttcaattgtacgattaggcgtaagggtaaacccactaagcgtagacgaaaaaggaaattttgaaaaaggaaaagcaataacgacaaacgcagatcgacaacaaacacacggcgcaagaatcaatttacaacgttacaaattaagacgagaaaatcttaaggactgtctacaaaaacaaggctggatagggaccgaagcactatgcgaagaaggtaagaccagtaccttcgaaacatatatgcttagagccaaagcagccgaggaagaaatctcactccacgaattgtgtcgcgtcctttttatgatgaataagaaaagaggatataaatcaaatcgcaaagcaaacaacaaagaagacggaaaactctttgacggaatgacagtcgctaagaaactttatgaagaacaccttacaccagctgaatacagttttcaactattatcatcaggaaagaaatttaaacaagaatattaccggagcgatttgaaagaagaatttgatagaatatggaatgaacaacaaaaatactatccagaaatcctaacagacgattttaaacaacaacttcaaggaaaatcaaaaggaaataccagcaaaatattcttaggtaaatatggaatttactccgcggacctaaaaggtctagacagaaaattgcagccactgaaatggcgagttgaagcattaaaacaacaagtcgataaagaagttttagctttcgtaattagcgaccttaatggacaaatcgcttcaacaagtggtcttttaggcgcaatatctgatagatcaaaagaattatattttaataaacaaacagtaggtcaatatttatggacatcattaaaagaaactccccatgttagcatcaaaaataaacccttttataggcaagattatttggacgagttcgagaaaatatgggaaacacaagcaacataccacaaagaattaacaccagaactgaaacaagaaataagagacataatcattttctaccagagacctctaaaaagtaagaaaggactcatttcagtatgtgaactcgaacaaagaaaagtaaaagttaccatcgatgggaaagaaaaagaaatttcaataggaccaaaagttgcaccgaaaagttcaccaatgtttcaagaatttcgcatatggcaaaatttaaacaatatattattaatagacaaaggtaataactctattcatcctttatatgaagaagagaaaaacctactctacgaagaattaagtgtaaaagaaaaattaagcaaagcagaagcactaaaagtattaaacaaaaactcaaaacaatgggacttaaattataaagaaatagaaggaaatagaacacaagcagtcctatacgactgctacaaccggataatagtcatgaccggacatgaagaatacaacttcaagaaactaaaagctagcgaaatacgctcatatgttaaaacgacatttacagggctagggttcaataccgacatacttgagttcgattcgtcgttaaccggacatgaacttgaaaaacaaccaatgtaccaattatggcacctactctacagctatgaaagtgataacagcaggacaggaaatgacgcactattaagaaaattagaaaccgcattcggattccctaaagaatatgctgcggtattatcagacgtagtgttcgaagactcctacggaaatttatcagtaaaagcgatgaggaaaatattacctcatttacaagcaggccttaattacagccaggcgtgtgaagaagcaggatacaaacacagtcgccgtagtctaactaaaaacgaacttgaccaaaaagaatacaaagaaaagctcgaattattaccgaaaaatagtctacacaatccagtagtagagaaaattttgaatcaaatgataaatgtaataaacgcggtaatagacgaatatggcaaaccagacgaaataaggatcgaactggcgcgagaactaaaaataggagctgcagagcgcgaaaatatgactcgatccataaatcaaggaaatgcagaaaataaaagaataagagaaatattggagaaagagttcgcattaagttatatatcacgcaacgacattattaaatacaagttatacgaagaattgaaatcaaacggtttcaaaacattatattctgatacctacataagtaaagacaaacttttctccaaggacttcgatatagaacatataatcccaaaagcacgactattcgatgacagtctgtcaaataagacaatagaagcccgagatgtaaatatagcgaaaagtaacaaaacagcttttgatttcatatcagaaaagtatgaccagcaaggaatagaagcctacaagaagaaattggatattttacttcaggatggatcaattagcaaagccaaatataacagactgctcatgaaagaagcagacataccgagcggattcattgacagagaccttagagacacacaatatatagcgaagaaagcatacgaaatattaagtgatctagtgagaaacgttactccaacaacaggagccgtgaccagtagactgagagaagattggcaattggtagacgtcatgaaagaactaaattttgaaaaatatcaaaaactcggcctcgtagaagttatagaagacagagacggccgtaaaataaaaagaattaaagactggacaaaacggaatgaccacaggcatcatgctatggacgctctgacaatcgcatttacaaaacctagttatattcaatatttgaacaatttaaacgcacgatctgataaaaattctagcatatacggaatagaaaacaaagagttacatagagaggataataaattaagatttaacgcaccgttacccataaacgaatttcgagcagaagcaagacgacatttaaaatcgatattagtgagtgttaaggctaagaacaaagtaatgacacaaaacgtcaacgtaatcaaaacgaagcacggagtaataaagaaagtacaactgactccccgaggagagttacacaatgcaacattctatggaacaaagaaacgaccgattatcaaaatggtcaaagttggagctgcattggatgaagtaacaataaagaaagtctcatcaagtttcataagagaggccttactagaccgactacacgaatacaatggagacgcaaagaaagcattcaccggcagaaatagtatagataaaaatcccatatacatagatgaagaacacaagaaaactgttccggctctcgtaaaaacgatcgaatgggaaatgtaccacccgacgagaaaattaataagcccagatctaaaaattgataaagtaatagataaaggtataagagaaatacttaaaaccagactagctaaattcaacggagacgcacaaaaagcattcagtaatctagacgaaaatcccatatacaaagatgaagccaagaaaataacacttaaaagagtttcactcgagggagtttcaagtgtcataccactacataccctgaaagatcgtgaaggaaaattagtcgtgggcaaagatggaaaacccgtattaggggactatgttcaaacttcaaacaaccaccacatagccttctatatggatgaaaatggtaacctgcaagacaatgtagtatcctttttcgaagctgcagagcgcaaaagtcaaggtgttcccgtaatagataaaaattacaatcacgataaaggatggaacttcctcttcactatgaaacaaaatgaatactttgttttccctaatgaagtcacaggcttcaacccgagcgaagtcgatctaatggacgaagctaattatagtattatatcgccaaacttatatagagtacagaaaatgtctaaagcgtcaggcagagactactggttcagacatcatctcgaagctatgttaaatgacgatcccaaactaagaaactcaatgtttaaacgaatcacatcgttaaaagcattagaaggaattgtcaaagtacgaataaactgcataggaaaaatagtcgcagtaggagaatatgactga

SEQ ID NO: 8974 - RNA, 4128 nt, synthetic construct
  misc_feature 1..4128: note = Cas9 variant
  source 1..4128: mol_type = other RNA
atgtcgaataaaagttacagcataggactcgacatcggtacaaactccgtaggatgggcagtcattaccgatgattataaagtcccaagcaaaaagatgaaagtactaggaaatacagacaaacatttcataaaaaaaaatcttataggcgccttgctcttcgatgaaggaactacagcagaagatagacgcttaaaacgtacggctaggcgaagatatactcgacgcaaaaacagactccgctatctccaagagatattctcacaagagatatcgaaagtagattcaagcttctttcacagactagatgatttcttcttagttcccgaagataaacgaggatcaaaataccctatttttgccactcttgtggaagaaaaagaataccacaaaaaatttcccaccatataccatctacgaaaacatctagccgattcgaaagaaaaaacggacctcagacttatctatctcgctttagctcatatgatcaaatatagagggcattttttatacgaagaatcatttgatataaaaaacaacgatatacaaaagatattttctgaatttatctccatttacgacaacactttcgaaggtaaatcactctctggacaaaacgcccaagtagaagcaatatttacagataaaatatcaaagtctactaaaagagaacgggtactaaaactattcccagacgaaaaatcaacaggtctattcagtgaatttctaaaacttatcgtaggaaaccaagcagactttaaaaaacacttcgacttagaagaaaaggcacctctacaatttagcaaagacacatacgatgaagacctcgaaaatttattgggacaaattggagacgattttgcagatttattcctagtagcaaaaaaactctacgacgcaattctactatcaggaatattaacagtaaaagatctcagtacaaaagctcctttgtcagcaagtatgatagaacgctacgaaaatcatcagaaggacttagccgcattaaaacaattcatacagaacaatctacaagagaaatacgacgaagtgttttccgaccaatctaaagacggctatgcaggttacatagatggaaaaaccacacaggaggctttctataaatatatcaagaatttactatccaaattcgaaggagcggactattttctcgacaaaatcgaacgggaagattttcttaaaaaacagagaaccttcgacaatggctcaatacctcaccaaatacaccttcaagaaatgaacgcaataatcagaagacaaggcgaacattatccatttttacaagaaaataaagaaaaaatcgaaaaaatattaacatttagaatcccatactacgttggtccacttgccagaggaaatggcgacttcgcgtggctaaccagaaactcagaccaagcaattagaccttggaacttcgaagaaatcgtagaccaagcaagttccgctgaagactttataaataaaatgacaaattatgatctctatcttcctgaagaaaaagtactaccaaaacactcactactctacgaaacgtttgcggtatataacgaactcacaaaagttaaatttatagccgaaggtttaacacgctaccaatttttagataaaaagcaaaaaaaagacatattcgataccttctttaaagcagaaaataaacgaaaagtgactgaaaaagatatcattcattacctacacaacgtcgatggctatgacggtatagaattgaaaggaattgaaaaacaattcaacgccagtctctcaacatatcacgacctactaaaaataataaaagataaagccttcatggacgattctaaaaatgaagagatattagagaacataatccacacactcacgatattcgaagatagagagatgattaagcaaaggcttgcacaatacgactcactatttgatgaaaaagttataaaggcattaacaaggcgacattataccggatggggaaaactatcagccaaactaataaatgggataagagataagaaatctggtaaaacaatcctagactatctaatagacgatggagaaataaacagaaattttatgcaactaatacacgatgacggcctttcatttaaagaaataatccaaaaagcgcaagtttttggcaaaacgaacgatgtcaaacaggtagtacaagaattaccaggatcaccagcaataaaaaaaggaatactacaaagcataaaaattgtagacgaactcgtaaaggtcatggggcatgctcctgaatcaatagtaatcgaaatggcacgtgaaaaccaaaccactgcacgaggaaaaaaaaatagtcaacaaaggtataaaaggattgaagattcattaaaaaatctcgcctcaggtctagattcaaacatattgaaagaaaaccctacagataacatacaactgcaaaatgaccgactattcttatactacttacaaaatggaagagatatgtatacaggcaaaccgctcgaaattaaccaattaagtaactacgacatagaccacattatcccacaagccttcataaaagacgactctttagacaatcgagttttaacatcaagtaaagataacagaggaaaatctgacaatgttccatcactagaagtcgttgaaaagatgaaagccttctggcaacaattacttgactcaaaactcatctcggaacgcaaattcaataacctaacaaaagcagagagagaaagaggaggacttaatgaattggacaaagtcggcttcataaaaagacagttggtagaaaccagacaaataaccaaacacgtagcacaattcttagatgcccgatttaacaaggaagtaacggaaaaagataaaaaaaataggaatgtaaaaattataacactaaaaagtaatctagtatctaatttcagaaaagaattcggactgtacaaagtccgtgagataaacgattaccaccacgcgcatgacgcctacctcaatgccgtactggcaaaagccatacttaaaaaatatccaaaattagagcccgaattcgtttatggagattatcaaaaatatgatctacaaagatacattagcaagtcacgagaaccaaaagaagttgaaaaagcaacacaaaaatattttttttacagtaatctcttaaatttttttaaagaagaagtacattatgccgatggtaccatcgtaaaacgagaaaacattgaatattcaaaagacaccggagaaattgcctggaacaaagaaaaagactttgcaactgtaaaaaaagttttatctctaccacaagtcaacatagtcaaaaaaactgaagtacaaaccggaggattctccaaagaatcgatccttccaaaaggaaattccgataaattaataccacgaaaaacaaaagaaatcctctgggacacaactaaatatggaggcttcgattcacccgtaatagcctatagtattttgttgatagctgacatagaaaagggaaaagccaagaaattaaaaaccgtaaaaaccctagtaggaattaccataatggaaaaggcaacattcgaaaaaaaccctataacctttctagaaaataaaggataccacaacgtaagaaaagaaaacatcctatgcctaccgaaatacagtctattcgaattagagagtgggaggagaagaatgctagcatctgccaaggaattacaaaaaggtaatgagattgtccttcccgtatatctaacaactttattatatcacagcaaaaatgtacataaactcgacgaaccggaacaccttgaatacatacaaaaacaccgctacgaatttaaagacttattgaaccttgtatccgaatttagccaaaaatacgtcctcgccgatgcaaacttagaaaaaattaaaaatctttacgccgataacgagcaagctgatatagaaattctagccaatagcttcattaacttactaacgttcacagcactcggagcaccagcagcctttaaatttttaggcaaagatgtagatcgaaagagatataccacagtgagcgaaatcttaaacgccactttaattcaccaatcaataactggattatatgaaaccaggatagacctatccaagctaggagaagactga

SEQ ID NO: 8975 - RNA, 4128 nt, synthetic construct
  misc_feature 1..4128: note = Cas9 variant
  source 1..4128: mol_type = other RNA
atggaaaagaaatattccataggtttagacattggcacgaactcagtgggttgggctgtgataacagacgattataaagtaccttcaaagaaattcaaagtacttggtaatacgaatagaaaaagtatcaagaaaaatttaatgggggctctactgtttgactccggagaaactgctgaagcaactcgattaaaacgtacagctcgacgaagatatactcgaaggaaaaatcgaataagataccttcaagaaatctttgctaatgaaatggccaaattagacgattcctttttccaaagactcgaagaatcctttctggttgaagaagacaagaaaaatgaaagacaccctatattcggaaaccttgcagacgaagtcgcataccaccgaaactacccgactatctatcacctaaggaagaaattagccgactcacccgaaaaagccgacctcagactcatatacttagccctagcgcatataataaaatttagaggacatttcttaattgaagggaaattaaacgcagaaaattcagatgttgctaaactattctaccagttaatacagacatacaaccaattatttgaagaatcaccactagacgaaattgaagtagacgcaaaaggtattctatcagctagattatcaaaatcgaaacgactagaaaaattaatcgctgttttccctaacgagaagaaaaacggactctttggtaatatcatcgcattagccttaggattaacaccaaacttcaaatcaaacttcgatctaaccgaagacgcaaaactacaattaagtaaagatacatacgacgacgacttagacgaacttctcggacaaatcggagaccaatatgcggacctattttcagcagcgaaaaacctttctgacgccatactcttgtccgatattttgcgatcaaacagtgaagttactaaagcacctcttagcgcttcaatggtaaaaagatacgacgaacaccaccaagaccttgcactactcaaaacactggtcagacaacaatttcccgaaaaatacgctgaaatatttaaagacgacaccaaaaacggttatgccggctacgtaggaattggaataaaacacagaaaaagaacaacaaaactagctacccaagaagaattttataaatttatcaaaccaattctagagaaaatggatggagctgaagaattacttgctaaattgaatcgagacgacctactaaggaaacaaagaaccttcgataatggaagcatcccacatcaaatacacctgaaagaacttcacgcaattttaaggagacaagaagagttctatccgtttttaaaagaaaatagggagaaaatagagaaaattctaactttcagaatcccatattatgtgggaccactagcaagaggaaactctagattcgcatggctaacacgaaaaagtgaagaagccataacaccatggaactttgaagaagtagtagataaaggagcatccgcacagagcttcatagaacgtatgacaaactttgacgaacaactaccaaataagaaagtcttaccgaaacattcgctcttatacgaatattttacagtctataatgaattaacaaaagtaaaatatgtaacagagagaatgagaaaacccgaatttctatctggcgaacagaagaaagctattgtcgacttattattcaaaacgaacaggaaagttacagtaaaacaattaaaagaagattattttaagaaaatagaatgtttcgattcagtagagataattggagtagaagatcgattcaacgcaagtcttggtacttatcacgatctattaaaaataataaaagataaagactttcttgacaacgaggaaaacgaagacatattagaagatatagtactcacactaacattattcgaagatagggaaatgatagaagaacgtcttaaaacatatgcacacctgttcgacgacaaagtaatgaaacaattaaaacgtagacattatactggatggggaagattaagccgcaaaatgataaacggaataagagacaaacaatcgggaaaaacgatactcgacttcttaaaatccgacggcttcagtaaccgtaacttcatgcagctgatacatgacgacagcttaacattcaaagaagaaatagagaaagcacaagtatcgggccaaggggattcattacatgaacaaatagctgatttagcaggatcacccgcaataaagaaaggaatcctacaaactgttaaaatagtagacgaacttgtaaaagtaatgggacacaaacccgaaaacatagtaattgaaatggctcgggaaaaccagacaacaacaaaaggattacaacagtcgagagaaagaaagaaacgaatagaagaaggaattaaagaactagaatcacaaatattgaaagagaaccccgttgagaatacacaactgcaaaacgaaaaattatatttatactacttacagaacggaagggatatgtatgtagatcaagaattagatataaacagattgtctgattacgacgtagaccatatagtaccccagtcattcataaaagatgacagtatcgacaacaaagtattaacacgatcagtagaaaaccgggggaaaagcgataacgtaccatcagaggaagtagtaaagaaaatgaaaaattactggcgacaattgttaaatgccaaattaatcactcaacgaaaattcgataacttgacaaaagcagagagaggcggattgagtgaggcagataaagcaggattcataaaacgacaattagttgaaacccgacaaattacgaaacacgtagcacgcatattggactctcgtatgaacacaaagagggataaaaacgataagcctataagagaagtaaaagtaataacattaaaaagtaagctagtatcagacttcagaaaagacttccaactttataaagttcgagatataaacaattaccaccacgcacatgacgcttacttaaatgctgtcgtagggacagctttaataaagaaatacccaaaattagaatcagagttcgtatacggtgactacaaagtatacgatgtcagaaaaatgattgcaaaaagcgaacaagaaatcggcaaagcaactgccaagcgatttttctatagtaacataatgaacttctttaaaactgaagtcaaactcgctaacggagaaattagaaaaagacctttaatagaaacgaacggggaaacaggcgaagtagtatggaacaaagaaaaagattttgccactgtaagaaaagtactcgcaatgccacaggttaatatagtcaagaaaacagaagtccaaactggaggattctccaaagagagcatattaagtaaacgggaatcagccaaactgatcccacgcaagaaaggatgggataccaggaaatatggaggttttggctcaccaacagtagcctattcaatattagtagtagcaaaagtggagaaaggtaaagctaagaaattaaaaagtgtcaaagtactcgtaggcataacaataatggagaaaggaagttatgaaaaagacccaataggattcctggaagctaaaggttataaagacataaagaaggaattaatattcaaactaccaaaatactcattatttgaactagagaatggacgtcgaagaatgctagcaagcgcaacagaactacaaaaagcaaacgaattggtattaccacagcatttagtaagacttttatactacactcagaacatatccgcaacaaccggatcaaataacctaggatacatcgaacaacatcgagaagagtttaaggaaatattcgagaaaataattgatttcagcgagaagtacatactcaaaaataaagtgaactcaaatttaaaatcctcatttgacgaacagttcgcagtatctgactccatcctactaagcaactcgttcgtgtcacttctaaaatatacctcattcggagcatccggtgggttcactttcctagatctagatgtaaaacaaggccgactaagatatcaaacagtcaccgaagttctcgacgcaaccctaatttatcaatcaataacaggcttatacgagacaagaacagacttatcacaactaggcggagattga

SEQ ID NO: 8976 - RNA, 4128 nt, synthetic construct
  misc_feature 1..4128: note = Cas9 variant
  source 1..4128: mol_type = other RNA
atgaagaagatcttaggtctcgacttaggcacgacgtccatcgggtgggccctagtgaacgaatccgaaaacaaagacgaacaaagctcaatagtaagactaggcgtacgagtaattcctctaactgtagacgaaaaaggcaacttcgaaaaaggaaaagcaattacaacaaatgcagacagacagcaagtacacgcggctagaattaacctgcaacgttataaactgagaagagaaaacttacgagattgcttgcaaaaacaagggtggattggaagcgaaccgatgtgtgaagatggaaaatcatcaacgttcgaaacttacaaattaagagcaaaagccgcagttgaagaagttagtctccacgaattcgctagagtattatttatgctaaataaaaaaagaggatacaaatcaaacagaaaagccaatgacaaagaggagggaaaattatttgatggtatgacaatagcaaaaaaactatatgaagagcatctgacaccagccgaatacagcctccaattgcttaacacgggcagaaaatttactccggaatattatagaagcgacctaattgaagaattcgaaaaaatatggaatgagcaacagaaatattatccagaaatactcactgatgaatttaaacaacagctagaagggaaagcgaaaagcaatacatcaaaactctttctaggaaaatatggaatttattctgcggacacgaaaggtctagatcgccgtctacaaccattgaaatggagagtagaagcaatgaagcaacaagttgacaaagacgtcctagcgttcgtaatatctgatttaaaaggccaaattgcaaacacatctggactgttaggtgccatatcagaccgaagtaaagagctatacttctcaaaacaaactattgggcaatacttatgggcatcactccaagagaatccacacatatcaattaagaaccaaccattctaccgccaagactacctcgatgaattcgagaagatctgggaaacacaggcaacatatcacaaagaactcacaagcgaattaaaacaagaaataagagacataataatattctatcaacgaccgttaaaaagtaaaaaaaacctgatcgcagtatgcgaattagaacagaggaaagtgaaagtaaccgtagacggtaaagaaaaagaaataactatcggaccaaaaatagccccaaaaagttcaccaatgtttcaagaatttcgtatttggcaaaacttaaacaacatattactattagatcacgaaacaaatagcaagcgaccactatacgaagaagaaagaaatttattatacgaagaattgagcgttaaggagaaactctccaaaacggaagcattaaaggtgctgggaaaaaaatcaaagcaatgggatttaaattataaggaactagaaggtaacagaacacaagcagtattgtatgattgctataacagaataatagtaatgtccggacacgaagaatgcaactttaaaaaactcaaagcaagtgacatacggcactatgtaaagatgatttttaaaaacctagcatttaacacagatatactatgcttcgactcatcgctaaaaggacacgaattagaacggcaacctatgtgccagctatggcatttgctttatagctacgaaggcgataacagcagaactggaaatgatgcacttttacgaaaactagaaacaagtttcggatttccgaaagagtatgcagccgtactggctgacgtcatctttgaagattcttacggaaacttaagcgtcaaagcaatgcggaatattctaccacatttacaagccgggaaagactattcacaagcatgtgaagaagctggatataaacactcccgaagatcattaacaaaagaagaactaaaccaaaaagtctacaaagaaaaactagaactattaccgaaaaatagtctgcataaccctgtagtcgagaaaattctaaatcaaatggtaaatgtaataaacgcggttatagaagaatacgggaaaccggatgagataagaatagaattagcaagggatttaaaaataggagcagcagaacgggaaaacatgacaagaagcataaatcagggcaatgcagaaaacaaacgaattcgcgaaatcttagaaaaggaattcgctcttagttacttaagcagaaacgacataataaagtacaaattatacgaagaattgaaatcaaatggctttaaaacgctatattcagatacttatataagcaaagacaaactcttctcaaaagactttgatatagaacacattataccgaaagcacgattatttgacgactcacttagcaataaaacaatagaggcccgagacgtcaacatagcgaaatcaaataagacagcattcgacttcatcttagaaaggtatggcgaacaaggagtaaaaacatataaaactaagctcttacgactactagaagatggagccatatccaataaaaaatacaataatttattaaaaaccgaagcggacataccctctggatttatagacagggatttgaggaacacccaatacatagcaaagaaagcttatgaaatactctccgaactggtaaaaatagtaactcccacgacaggaagtgtaacaaaccgtctaagagaggactggcaattagttgacgtaatgaaagaattaaatttcgaaaaataccaaaagttaggattagcagatgtaatagaggacagagatggacgaaaagtcaaaagaatcaaagattggacaaaacgcaacgatcaccgacaccacgccatggacgccctaacaatagcatttacaaaaccaagttatatccaatacttaaataacctaaacgcaagatccgataaatcctcatcaatttacggaattgaagtaaaggaattacacagagaagagggaaaatttcgcttcaatgcaccactacccataaacgaatttcgtgcagaagcaaaacgacacttaaaatctgtattagtttcaatcaaagcaaaaaaaaaagtaatgacacaaaatgtaaataaaataaaaacaaagcacggtattataaaaaaagttcaacttacacctagaggagagttacacaacgcaacatactatggcaccaaaaaacgtccactggttcgcatggtaaaagttggcgcagcccttgacgaagccacaattaaaagagtatgttcaccagcaattagagcagctttattaaaaaggctaaacgcatacaacggcgacgcaaaggaagccttcactggcagaaactcaattgacaaaaacccgatatatttagacattgaacaaactaaactagtaccagtattagtcaaaaccatagagtggggtatgtatcatccaatccgtaaaagaatcacacctgatctaaaaatcgataaagtaatcgacaaaggcattagagagaaactaaaagcccgtctagcagagtttaatggagatgcacaaaaagcatttagcaatttagacgaaaaccctatatacatggatgaagcaaaaagaattactttgaaacgagtatctatagaaggcgtcctaagtgcaataccattacacacacttaaagacaaagcaggcaaaccagtgataggatctgatggaaaaccggtgttcggagattacgtacaaacaagtaataaccatcatattgccttctatattgacgacaagggaaacctacaagataacccagtctcattctttgaagctgcagaaaggaaaagtcagggtgtacctgttatagacaggagatacaattgcgacaaaggatggcacttcgtatttactatgaaacaaaatgagtactttgtcttccctaatgaagcaacagggttcatacccagtgaagtagacctactagacgaagcaaactactgtataatatcaccaaatctatatagggttcaaaaattaagtaaagcctcgggccgcgactattggttcagacaccacctagaaactatgctaaatgatgatctcagactaaaaaactctactttcaaacgaatacaaagtttaaagggactggaagatatagtaaaagtaaggataaatagtatcggaaaaatagtcgccgttgggaaatatgattga

SEQ ID NO: 8977 - RNA, 4128 nt, synthetic construct
  misc_feature 1..4128: note = Cas9 variant
  source 1..4128: mol_type = other RNA
atggaaactaaattcacgtactaccttggcctcgatatgggaacagattcgctaggatgggcagtaacagattcaagttatcatatattgagagcaaaaggaaaggacctttggggagtgagattgttcccagctgctgaaactagtgtagaccgaagaacctacagagtcaaccgcagacgacgacaaagagaggtagctagaataggagccttaaaagagctattcgctgatgaaattgaaaaagtagatcctggtttctttgtaagactagatgaatccaaatttcatatggaagataggtcagaaaacaataaacaaaaatacgggcttttcgcggataaactatttagcgatgcagaatactataaaaaataccccacaatattccacctgcgtaaagaactactagaaagcgaggaaccacacgatgtaagactagtctatttagcccttctaaatatgtttaaacatcgtggacattttttaaactcaagtttacaaatagaaggtgagaattcaaacattgcagaatcatatcaaatgtttgtggatacactaaaagacgaagaacttgattttccagaacaggttagtggagaaagactgcaagaaatttttagaagttctgattcacgaaagaagaaagttgagaatctattagccgaaatgaacctcagtaaaaaacagaaaagggaaattcaatttgtgaacttaatatgcggacttaaaggaaaattgtctgaactattcccagataaagaatacgatgaggaacaaaaaaaaatcgcatttagtttccaggacagcgattacgaagacaaagaaaacaccattcaagaattattagatgaatctgaaatgaatatgatatacgcagtaaaagccgtgcatgatagtggagtcctatcaggaataatgaacggcgaaagatacctttccgtagcacgagtagcaagttatgaaaaacacaaaaaagacctacaaatccttaaagatatattaaagaaatatgacactaaagaatactttgaaatgtttagaaacgaatcagagaaatcggaaaattattcagcctatgtaggttccgtaaaataccacgggacttttagaaggggcttatcaggaggaaaacaagaagacctttacaaacacataaaaaaagtactaggtaaatttccacaagatgacgaaggagtgacatacgtacttgaagaaatagaaactgaatcctttttgcctaaacaactcacagcaagcaatggagtgatacccaatcaagtacacgctagagagatgctcgcaattctaaaacatgcagaattgtatttaccattcctacaagaaaaggatgacaccggactatccgtcagcgaaaaaatactaaagctttttatgttccaaattccatattatgttggtcccctcggtcaagaatacaaggataaaaaaggatataatgtatgggcagaaaggaaagaacccggaaaaatatatccatggaatttcgaagaaaaaattgatgtgaagaaaagtgcggaaaaatttattgggagaatggtgcgtagatgtacctatctaagtggcgaacaagctctacccaagcaaagtttactatatgaaaaatttcaagttttaaatgaattaaataatctacgcataagaggagagaaaatacccgtatccctcaaacaagagatatatcatgacttatttggagacggaaagaaagtatccatgacacgtttaacaaattaccttcttcaaaatggtgtcatatcctctgaagaaaaagatagctgtatatctggaatagatggaggcttccataattcactaagtagtgtcggaaaatttaagggggtgttcggagacacagtgcacacggacgaacacaggaaaatgatagaagatatcatattttggggaactgtgttcggcgatggcaaaaaactacttaaagaaaaagtcgaagaggtctatggaaaccagttaactgaagctcaaaaaaaaaggatatttggatttaaattttccggctgggggagactaagtaaagcctttcttacgatggagggcgctagcaaagacaatggagagataaaaggcttaatacaagcaatgtgggacacaaactgtaatttgatggaactattatcagaaagatttacatacaaagacaaactaaatgaaatggtaacaacagcagaaaaaccattatgtgaatggaaaattgaagatctggacgaaatgtatctatcagcaccagtcaaaagaatggtttggcaaacaataagagttgttgacgaagtacaacagatcatgggatgccctcctaaaagaatctttgtcgaaatgacaagaagcgatggtgaaaaaggaaagcgcacggtaagtagacaaaaaaaactcgtcgacttatacaaagcactagggaaagaaggtaaaatatggagtgaagaacttaataacacaccagaaggacaattccggataaaaaaattatacctttattacctacagatgggaaagtgcatgtataccggagagagtatagaactagaacccttaatgaatgacaatcatctatatgacatagatcacatatatccacggcattttattaaagacgacaacatttcgaacaatctagttttagtgaaaaaagaaagaaatgcgcataaatcagatagctttccaatcgaaccagaaataagaaacaaaatgatgcctttctggaaaagtctaaggaagaagggatttttaacggaagagaaatataatcgattaacacgaatgtcagcattcacagacgaagaaaaagcagcattcatcagtcgacaacttgttgaaactagccaaggaacaaaagcaataactcaaatatttaaacaggccttcgcagactcagagatagtattctcgaaagcatcggtagtaagtgcattccgacaaaaattcgactgttataaagtgagatgtgtaaatgactaccatcacgcacacgatgcatacttaaatatagtggcaggtaacacatacagagtaaaattcacctcaaatcctcttaacttcataaaagaagccaaaaaaaatccaaattctcgcgaaaataggtataatatggataaaacgtttgaatgggacgtaacaagaaacggggagaccgcttgggtagcccaaagtaacgaaaacccgggtacgatacagctagtaaaaaaatatttaaataaaaattcaccattgataacaaaaatggtgtatgaaaaacatggtggtataacacaaaaagctacaatatggagcgctaaaaaagctgagagtggaaacacggatgcctatataccagttaagatgaacgacccacgattagcggatgtcacaaaatacggaggagttacaacaatagcagtagcaggatatacattattagagtataaggcaggaggcaaaaccgtaagatcattagaagcactaccgatctatcttggaggaagcaaaaacttaacggaagaacaaatggttgaatatttttctaacatattacagcaagaaaataaagaaaaggtagtttccgacgtgataatacgaaaaaagatgatacctagtggatctctaataaaatacaacgggttctattattacttagcaggtaagactggcaatagaatagtcctgatatcagcagtacaattatgtcttccaatggacacaatgttatacataaagaagatagaaaaagcctgcagtacaggaaattttgaagaaaaagacaaaaacggaaaacaagtactaagtaaacaacaaaatgaattcgtctatgaactaataattgaaaaataccagcaatcaatcttcaaaaaaaaagtgggtgcaattggagacaccattattgaaaagagagaaaaatttgcggaaatatcactagaagagcaatgtaaggtactgatgcaaatctttttaaactttcagtctggcattggcgtagatttgacgagtgtcgatggatctaacaaatcaggggtaacctacttaaataaaaaaataatgaatgctcaagaactaaaacttatagatcagtcagttacaggagtattttcacgggaaattgatttacttaccatatga

SEQ ID NO: 8978 - RNA, 4128 nt, synthetic construct
  misc_feature 1..4128: note = Cas9 variant
  source 1..4128: mol_type = other RNA
atgtcaaacaaatcatattctataggactagatattggcacaaattccgtaggttgggctgtaataacagatgactataaagtaccgagcaagaaaatgaaagtacttggcaacacagataaacacttcattaagaaaaaccttataggagcattattatttgatgaaggcacgaccgccgaagatagaagacttaaaaggacagcccgacgtagatatacccggaggaaaaataggttgagatacctacaagaaatattttcagaagaaatgtccaaagtggattctagcttctttcatagattagacgacagctttttagtaccagaagataaacgaggttcaaaatacccaatattcgctaccctagccgaagaaaaagaatatcacaagaaattcccaaccatttaccacctccgaaaacacttagctgactcgaaagagaaaacagacctacgactaatatacctagcactagcccacatgataaaatatagaggccatttcctatacgaagaatcatttgatattaaaaataatgacattcagaaaatattctcagagttcataagtatctatgacaataccttcgaagaaagttctttaataggccaaaacgcacaagtagaagcaattttcactgataaaatatcaaaatcagctaaaagggaaagagtacttaaactattcccagatcaaaaatcaactggcttattctccgaatttttaaaactaatcctcgggaatcaagcagatttcaagaaacatttcgatctagaagaaaaagcaccactccaattttccaaagacacatatgacgaagatctagaaaatctactgggccaaataagagacgacttcgcagacctatttctagtagcaaagaaactatacgatgcgatattgctctctggcatattaacagtcaaagacctatctacaaaagctccactatcagctagcatgatcgaacattacgaaaatcaccaaaaagacttagctgctctaaaacaatttatccaaaataatctccaagaaaaatatgatgaagtgttttctgatcaatccaaagacggctatgcaggttatattaacggtaaaaccacacaagaagcattctataaatacatcaaaaatttgctgtcaaaatttgaaggagctgattattttctagataaaatagaacgagaagattttctacggaaacaaagaacatttgataatggctcaatcccccaccaaatacacctccaggaaatgaatgccatattacacagacaaggcgaacactatccatttctcaaagagaataaagagaaaattgagaaaattctaattttcagaataccgtactatgtaggtccattagcaagaggaaacagagattttgcgtggttaacacgcaatagcgatgaagctattcgaccgtggaacttcgaagaaatcgtagacaaagcatccagcgctgaagactttataaacaaaatgacaaattacgatttatatttacctgaagaaaaagttctcccaaaacactccttactctacgaaacctttgcggtctacaacgaattaaccaaagttaaattcatcgccgaaggactaactcgatatcaattcctcgacaagaaacaaaagaaagatatattttatacattcttcaaagctgaagacaaacgaaaagtaacagaaaaagatatcatacactacctacacaccgtcgacggttacgatggaatcgaattagaaggaatagaaaaacaatttaacgcctctctctctacttaccatgacttactaaaaataataaaagacaaagaatttatggacgacgataaaaatgaagcaatattagaaaacatagtacacacattaactatattcgaagaccgagaaatgataaaacaacgactcgcacaatacaattcactatttgacgaaaaagtaataaaagcattgacacgtagacattacaccggttgggggaaattatcagcaaaattaatcaacggtatccgagacaagaaatcaggaaaaacaatactagactatctaatagatgacggagaaattaaccgaaactttatgcaattaatacacgatgatggattatccttcaaagaaataatccagaaagcccaagtattcggtaaaacaaatgatgttaaacaagtagtacacgaactaccaggatctcctgccatcaagaaaggaatactccagtcaatcaaaatagtagacgaattagtaaaagtgatgggtcacgcaccagagtcaatagtcatagaaatggctagggaaaaccaaaccacagcgcgcggtaagaaaaacagccaacaacgatacaaacgaatagaagattcactcaaaaacctagcatccggattagattctaacatattaaaagaaaatcccacggacaacgtccaacttcaaaacgatcgactatttctctactacttgcaaaatggtagagatatgtataccggcaaaccgctagaaataaatcaattatcgaactacgatatagaccatataataccacaagcatttatcaaagatgacagcttagacaaccgagtcctaaccagtagcaaagataacaggggaaaatccgacaatgtaccctcattagaagtagttgagaaaatgaaagcgttctggcaacaactgctcgattctaaattaatctccgaacgcaaatttaataacctcacaaaagctgaaagagaacgaggaggtctcaacgaattagacaaagttggattcatcaaacgacagttagtcgagactcgccaaataactaaacatgttgcacaaatcctagacacgcgattcaacaaagaagtaacagaaaaagacaagaaaaatcgaaacgtaaaaataatcaccctgaaatcgaacctagtttctaatttcagaaaagagttcggtttatacaaagtgcgagaaataaatgactatcatcacgcccacgacgcttatctcaatgccgtagtcgcaaaagctattctaaagaaataccctaaactagaaccagaatttgtatatggtgaataccaaaaatatgatctaaaaagatatattagcagatcaaaagacccaaaagatattgaaaaagcaaccgaaaaatactttttctacagtaacctattaaacttctttaaagaagaagtacaatacgcagacggaactatcgcaaaaagagaaaatatcgaatacagtaaagacacaggcgaaatagcctggaacaaagaaaaagatttcgcaacagtcaagaaagtactctcattaccacaggtcaatatagtcaagaaaagagaagtacaaaccggtggtttctccaaagaaagcatcctacctaaaggcaatagtgacaaattaatccctagaaaaacgaaagacatactatgggaaacaactaaatatggtggctttgactccccagttatagcctactcaatcttactcatagctgatatagaaaaaggtaaatctaaagaactaaaaacagtcaaaacactcgtaggtataacaataatggagaaagcaacatttgaggaaaacccgataacattcctagaaaacaaaggataccacaacgtaagaaaagaaaacatactatgtctacctaaatactcattatttgaactagaaaacgggagacgaagattacttgcaagtgctaaagaattacagaaagggaacgaaatagttttaccagtttacttaaccacactcctatatcatagcaaaaacctgcataaactagacgaacctggacacttagaatacatacaaaaacatcggaacgagttcaaagaccttctaaacctagtatctgagttctctcaaaaatacatcctagcagacgcaaacctggaaaagatacaaaacctgtacgcagataatgaacaagcagatattgaaattcttgcaaacagctttataaatctactaacgtttactaccctaggcgctcctgcagcatttaaatttttcggaaaagacatagatagaaaaagatacacaaccgtctccgaaatactaaacgctacactaatccaccaatcaattacaggactgtacgaaacaagaatagacttatcaaaactaggtgaagactga

SEQ ID NO: 8979 - RNA, 4128 nt, synthetic construct
  misc_feature 1..4128: note = Cas9 variant
  source 1..4128: mol_type = other RNA
atggaaaaaagttacagtatagggctagacataggaacgaacagcgtaggatgggcggtaataactgacgactataaagtgcccgcaaaaaaaatgaaagtcctaggaaacactgacaaaaaatacataaaaaaaaatttactaggagccttactattcgacagcggggaaacagccgaagtaacgcgacttaaaagaacagctagacgcagatacacaagaagaaaaaatcgattaagatatctacaagaaatattcgcaaaagagatgaccaaagtcgatgaatcatttttccaaaggttagaagaatccttcctaacagatgacgacaaaactttcgattcccaccccatattcggaaataaagccgaggaagacgcataccaccaaaaattcccgacaatatatcatctaagaaaatacttagcagactcgcaagaaaaagctgatttgcgattagtatatttggcattggcacacatgatcaagtatagaggacattttcttatcgaaggcgaactaaatgcagaaaacacagatgtacaaaaactattcaatgtttttgtagaaacgtatgacaaaattgttgacgaatctcaccttagcgagatcgaagtagacgcatcctccatattgaccgagaaggtatcaaaatcccgcagactcgaaaatctaattaaacaatacccaacagaaaagaaaaatacactattcggaaacctaattgcactagccttaggactgcaaccaaatttcaaaacaaactttaagttaagtgaagacgccaaattacaattttccaaagatacttacgaagaagatctagaggaattacttggaaaagtcggtgatgattacgctgacttatttatcagtgctaaaaatctctacgacgcaatactattaagcggaatattaacagtcgatgacaactcaactaaagctcccttatcagcttcaatgataaaaagatatgtagaacatcatgaagacttagagaaactaaaagaatttataaaaattaataaactaaaactatatcacgacatttttaaagataagacgaagaacggatatgcaggatacattgataatggcgttaaacaagatgaattctacaaatacttaaaaaccatcctcacaaaaatagatgactcagattacttcttagataaaatagaaagggatgattttttacgtaagcaaagaaccttcgacaatggaagtataccacatcaaatacatctacaagaaatgcactccatattaagaagacaaggtgactattacccgttcctaaaagaaaaccaagcaaaaatcgaaaaaatactaacattcagaataccctattatgttggacctctcgcaagaaaggactcaagattcgcgtgggcgaactaccatagtgacgaacccataacaccgtggaacttcgacgaagttgtcgacaaagaaaaaagtgcggagaaatttataacccgcatgacgttaaacgacctctacttacctgaagaaaaagtcctacctaaacattcacatgtatacgagacgtttacagtatataacgaactaactaagataaaatatgtaaatgaacaaggcgaaagcttcttcttcgacgcaaatatgaaacaggaaatattcgaccatgttttcaaggagaataggaaagtaacaaaggccaagttgctatcctatctaaataacgaattcgaagaatttagaataaacgacttgattggacttgataaagacagtaaaagtttcaatgcctctctgggcacataccatgaccttaaaaaaatattagacaaatcattccttgacgataagactaatggacaaataattgaagatatcgtccttaccctaaccctattcgaagatagagatatgatccacgaacgtctacaaaaatattcagactttttcacttcccaacaactaaaaaaactagaacgacgacactatacagggtggggcagattaagctataaactgatcaatggaatacgaaacaaagaaaataataaaacaattctagattttcttatagacgatggtcatgctaacagaaacttcatgcagctcattaacgatgaaagtctttccttcaaaacaataatacaggaggcacaagtagttggcgacgtagatgacatagaagcagtagtacatgacttaccaggctcaccagccataaaaaaaggtatactccaatctgtgaaaatagtagatgaactagtcaaagtaatgggggataacccagacaacatagtaatagagatggcccgtgaaaaccaaacaacgggttacggacgcaataaatctaaccaaagacttaaacgattacaggattcacttaaagaattcggaagcgacatattaagtaaaaaaaaaccttcatacgtagactcaaaagtagaaaacagccacctacaaaacgaccgtcttttcctatactatatacaaaacggaaaagacatgtatacaggagaagaattagatatagaccgtctatcagactacgacatagatcatatcataccacaagcatttataaaagacaatagtatcgacaataaagtacttacttcctcagcaaagaaccgcggaaaatcagatgacgtacctagtatcgaaatagtaagaaaccgacgatcatattggtacaaactatataagtctggtctcatttcaaagcgaaagttcgataacctcacgaaagcagaaaggggtggattgacagaagcagacaaagcgggattcataaagcgccaactagtagaaacacgacaaataacaaaacatgtagcccaaatattagatgcacgattcaacacaaaacgcgatgaaaacgataaagtaattagagatgtaaaagtgatcaccttaaaaagcaacctggtatcacaatttagaaaagaattcaagttctacaaggttagagaaataaatgattaccaccatgcccacgatgcatatcttaacgcagtagtaggaaccgcactgttaaaaaaatacccaaaactaacccctgaattcgtttatggggaatacaaaaagtacgacgtgcggaaactaattgcaaaatcatcagatgattattccgaaatgggcaaagccaccgctaaatacttcttttatagcaacttaatgaatttcttcaagacagaggtaaaatacgcagatggacgagtatttgaaagaccagatattgaaaccaacgctgatggagaagtagtatggaacaaacaaaaagacttcgacattgtaagaaaagtgctttcctatccccaagtcaacatagttaaaaaagtggaagcacagacaggaggattttcaaaagaaagtatcttaagtaaaggggactcagacaaattgataccacgaaaaacaaaaaaagtctactggaacactaaaaaatatggaggcttcgattcccctacagtcgcctattcagtacttgtagttgccgatattgaaaaaggcaaagcaaagaaattaaaaacggtcaaagaactcgttggtatatctataatggaaagaagcttttttgaagaaaatccagtttcattcctagaaaaaaaaggctaccacaacgtccaagaagacaagcttataaaattaccaaaatacagcctttttgaatttgaaggcgggagaagaagactacttgccagcgcaacagaactacaaaaaggaaacgaagtaatgctaccagcacacttagttgaactactatatcatgcacacagaatagactcttttaactcaactgaacacctaaaatatgtgtccgaacacaaaaaagagttcgagaaagtcttaagctgtgtagaaaacttctcaaatctatacgttgacgtggagaaaaatttatcaaaagtccgagctgctgcagaaagcatgactaactttagtctcgaagaaatttcagccagctttataaacttattaacattaactgccctaggagctcccgccgatttcaactttctcggcgaaaaaattcccagaaaacgctacacatcgacaaaagagtgtttatctgccacattaatacaccaaagcgtaacaggcctctatgaaacaagaatagacttatcaaaattaggtgaagaatga

SEQ ID NO: 8980 - RNA, 4128 nt, synthetic construct
  misc_feature 1..4128: note = Cas9 variant
  source 1..4128: mol_type = other RNA
atgactaaaataaaagacgattatatagtaggcctcgacatcggtaccgactcatgtggatgggtcgctatgaactctaacaatgacatattaaaattacaaggcaaaactgctatagggagtagactgtttgaaggaggtaaatcagccgcagaaagacgactcttccggacgacccatagaaggattaaaaggaggcgctggaggctaaaactccttgaagagttctttgacccatacatggcagaagtagatccatactttttcgcgcgactaaaagaaagcggactatcgccacttgataaaagaaaaacagtaagttcgatagtattcccaacctccgctgaagataagaaattttatgacgactatccaaccatctatcatctaagatacaaattgatgacagaagatgaaaaatttgacctgagagaagtttacctagctatccatcacatcattaaatatagaggtaactttctatataacacaagtgtcaaagatttcaaagcctcaaaaattgatgtaaaaagcagtatcgaaaaattaaacgaactatatgaaaatttaggcctggacctaaacgtagaatttaacatatctaatacagcagaaatagaaaaggtcctaaaagataaacagatcttcaaacgcgacaaagtaaagaaaatagctgaattattcgctataaaaacggacaataaagaacagagtaaaagaattaaagacatttctaaacaagtagctaacgccgtgctaggttacaaaacaagatttgacaccatagctttaaaagaaatctcaaaagatgaactctcagattggaacttcaaattaagcgatatagacgcagattccaaatttgaagctctcatgggcaatttagatgaaaatgaacaagcaatactattaaccataaaagaattatttaacgaagtaactctaaatggcattgtagaagacggaaacactctctcggaaagcatgatcaacaagtataatgaccacagagacgacttgaagctattaaaagaagttatagaaaaccacatcgaccgaaagaaagcgaaagaactagcactagcttatgacttatatgtaaacaatagacacggccagctacttcaagcgaaaaagaaactcggcaaaataaaaccaagatcaaaagaagacttctacaaagtagtcaacaaaaacctcgatgatagtagagcaagtaaagaaatcaaaaagaaaatagaactagattcgtttatgccaaaacaacgaaccaatgcaaacggcgtgataccttatcaattacaacaattagaactagacaaaataatagagaatcagtcaaaatactacccattcttaaaagaaataaaccctgtatctagtcatctaaaagaagccccatacaaattagatgagcttatacgcttccgtgtgccgtattatgttggaccactaatatctccaaatgagagtacaaaagatattcaaacgaagaaaaaccaaaactttgcatggatgataagaaaagaagaagggcgtataacaccatggaattttgaccaaaaagtagaccgtattgaatctgccaataaatttattaaaaggatgaccacaaaagatacctacctatttggcgaagatgtacttccggccaatagtttactttaccaaaaattcacagtcttaaacgaactaaacaacatccgaataaacgggaaaaggataagcgtcgacctaaaacaagaaatatatgaaaacctgttcaagaaacatacaacagtcacagttaagaaattagaaaactatttaaaagaaaaccataacttagtcaaagtggaaattaagggcctagcagatgaaaagaaattcaacagtggactcacaacctacaatcgtttcaaaaatttaaatatattcgataaccaaatagatgacctgaaatatagaaacgattttgagaaaatcatcgaatggagcacgatatttgaagataaatccatttataaagaaaaactacgcagtatcgattggttaaacgaaaaacaaattaatgcacttagtaacatacgactccagggatggggcagactctctaagaaactacttgcacaactacatgaccataatggacaaacaattatagaacaactctgggactcacaaaacaactttatgcaaattgtaacccaagctgattttaaagatgcaatcgctaaagccaatcaaaatctactcgtagctacttcagtcgaagatatattaaataacgcatacacgtctcctgccaataagaaagcaatcagacaggttataaaagtagtcgacgacatagtcaaagcagcatctggcaaagtacctaaacaaatagcaatagaatttacccgagacgcggatgaaaacccaaaaagatcccaaacaaggggcagtaaactacaaaaagtttataaagacttaagcacagaattagcttctaaaactattgccgaagagttaaacgaagcaattaaagacaaaaagctagtacaggataaatattatctatacttcatgcaactaggcagggacgcatacactggtgaacctatcaacatagacgaaatacaaaaatacgatattgaccacatattaccacaatcttttataaaagatgatgcacttgataacagagtattagtaagtcgagcagtcaataacggcaaatctgacaatgttcccgtgaaattatttggaaacgagatggcagcaaacctaggaatgaccataaggaaaatgtgggaagaatggaaaaatattggattgatttcaaaaacaaaatacaataatttactaactgaccctgatcacattaacaaatacaaaagcgctggattcataaggagacaacttgtagaaacgtcacaaataataaagctagtaagtacgatattacaatcacgatatccgaatactgaaatcatcacagtcaaagctaaatataaccactatttacgtgaaaaatttgacctttataaatcacgagaagtaaacgactaccaccacgcaatagacgcatatttatccgccatttgtgggaacctcctatatcaaaactatcccaacttgagaccctttttcgtctacgggcaatataagaaattctcaagtgatcctgataaagaaaaagcaatattcaataaaaccaggaaattctcattcatcagtcaactacttaaaaacaaatccgaaaattcaaaagaaatagccaagaaattaaaaagagcataccagttcaagtatatgcttgtatcaagagaaacagaaaccagagaccaagagatgtttaaaatgacagtctatcctagattctcacacgatacagtaaaagctccaaggaatttaataccgaagaaaatgggaatgtctcccgacatatatggaggttacaccaacaatagtgacgcatacatggttatcgtgaggatagataaaaagaaaggtaccgaatataagatactaggtattccaactcgagaacttgtaaatctcaagaaagcagaaaaagaagaccactacaaatcataccttaaagaaatactaacaccacgaatcctatacaataaaaatggaaaacgagacaagaaaataaccagcttcgaaattgtaaaatcaaaaataccgtataaacaggtcatccaagatggagataagaaattcatgcttggaagcagcacatacgtctataacgcaaaacaactaacactaagcacagaaagtatgaaagcgataacaaataactttgacaaagattcagacgaaaacgacgctctcataaaggcttacgacgaaatactcgacaaagtagataaatacctccctctattcgacattaacaaatttagagaaaaactgcactcaggacgtgaaaaattcataaaactctcattagaggacaagaaagatacaatattaaaagtactagaaggattacatgacaacgcagtcatgactaaaataccaaccatcggactcagtacaccattaggattcatgcaattccccaatggtgtaatattgagtgaaaacgccaaattgatataccaatcacccactggactattcaagaaatccgtgaaaattagtgacctttga

SEQ ID NO: 8981 - RNA, 4131 nt, synthetic construct
  misc_feature 1..4131: note = Cas9 variant
  source 1..4131: mol_type = other RNA
atgtccaatttcgataaccacaaagatagtatatgcaaacacaaaggactaaaaaaagggaactattatataggacttgatatcggaaccaattcggtagggtgggcagctaccaatgaacaatacgaactcttgaaattcaaaagtcataaaatgtggggaagtagactatttgcagaagcacagacagcggtagacactagaatgaaaagatcagcaagacgacggctacaaagaaggaaatttagactaattcttctagaatcgttgttttccaaagaaataaatgcagtcgatgaaacgttctttatgcgtctacacgaatcaaactatcatgttgaagataaaaccaacctcgttaaatacacactatttatagataaaaattatacagacgttgattactacaaagaatttccaaccatttatcacctaagacatcatctgatgacagaaggaaccaaagatataagacttctgtttttagccatacaccatatcttaaaataccggggtaattttctttacggaaaaaaagaatttagcgttgatggagaaatgtacagcgtattgcgctcgacgcttgaagaactcggattcggatcatacgtagaagacgaaaacgttttacaatcaatagcaaacctagtcttagatcgagggattgccagatcagaaaaagtaaaacaaatcgaaccattaattgcacaaggcaaaaaattatcgtcagtagaaaaaaacagattaaaagcttgggcatacctaataatggggttaaaagctaatctcgtgaatttattcacagacgaagacgtcgaagtagtactccctgaagaaaaagaattcaaatccattaatcttcacgaaggcatatatgaggacgtaagagatgcatatgaagatgcatggggtgacagattcgccattgtagaccaatgcaaagtattacacgacatcatagttataagcagcatcataaaaccaggacaaagcctgagcgaggccaaaatagaaagctataatcaacataaagaagacctggttctattgaaaagcgttctaaaagaagacaaaaaactttatgacgacatgttcgtagttgatattgataagggaacaaattatgtaaaatatatcaaacaaggagttaacggcaatacgagcacaactcaagaagccttctacaagtacgtgcgaaaagtggtaagcgtactaccagaaactgaaaacacgagatgcatagtacaaaaactagaagaagggacatttcttcctttacaacgaatctctaaaaacggggtagtgccttatcaacttcacaaagaagagctcgttagaattttagaaaaagcgaaactaaatttcccatttttaaatgaagttgaagacggattaacagtagcagataaaataataagtatattagaattcaaaataccttactatgtcggccctttgaaccctacacattcgatcgaaaatggaggctttgcttgggtagttaggaaagaagcaggccaagttttaccctggaattttgaacaaaaagtcgacgttcaagcaagtgcagtaaaattcatagaaaatctcacaaataagtgtacttacttaatagaccaagatgtactacctaaatactcactactatacgcagaattttccctactcaatgaattaaataacataagagttaacgacaaacccctcccagcggatgttaaacaagccttcataagagaccatttcatctcattacaagattcaaaaacagcaactaaaaaagtcgtcgcaaaatatttagtagacaataactatgtctctcaacccccaattataacaggaatggaccaacaaattgcaaccaaactcactagccacagggatatgactcgcatattaggagaacattttgactacgctatggcggaagatataataagatatattacgatattcggtgaatccaaagatatgctgcgacaagttctaaaaaattattacggggatagactcacaaccgaacaaataaaaaaactcggaaagttgacgtatacaggatgggggagactaagtaaaaaatttcttagcgatatatggggaatgaagaaaaacgacgatgatgccgaagctggtacaatcattgaacacatgcgtgaaggccaagagaatttgatgcagctactatcgagctcatatagctttattgatgtagtacaagaatatgtcacaaatgtattgggagcaaaagaaaaaacagcttttgaaatgctggaagacctatcactctcgcccatggtaaaaagatctgtatggcagactctaagaatcttagacgaaatagtcagcattagaaaagaattaccaaaaaaaatcttcgtcgaagtagccagaacaaacaaagccgataagaagagaacacaatcacgaaaagcacttttagaagaattgtacgaacaaataaaagacgaagacgttcacgtactgcaacaagagttggaatcaaaagaggacagcgctctaaactcaaaaaaactttacctgtactttacacaaatggggaggtgtatgtacagcggacgaagaatagatatacatgaattattcacagacacttacgatattgatcatatataccctagatccttaacgaaagatgatagctggcacaatatagtcttagtagaaaaacaacttaacgcagaaaaaactgataggttcccaatattgagtgcaattcaatcaaaacaaaaaggattctggaaattattatgggatagaggattcatttctgagaaaaaatacgaccggctagtaagaacgactgatctaacagacgaagaattgaaccaattcataaatagacaaatcgtctcaacaaaccaatcagttaaagcagtaaccacactactacatcagctatacccagaaacagaagtcgtcttttcaaaggccgaaaacataagcgacttccgaagagactacggctttgtaaaagtcagaagtataaaccaccaccaccatgcaaaagacgcgtatttaaatatcgtcgtaggaaacgtttatcatgaaaaattcacaaaaaacttcttaagcttcgctaaacaaaaaggaacacacagaacgtataatctaacaaaaatgttcgaatacgagataaagttgactgaagaaagcaagaaagtaatttgggaccccaatatccatatggatatagtaaaaaaaatgatgaagtcaaacgatgttagggtgacgcagagagccgttccacaaaaaggaggactatcagatgaaacaatatacaagaaaggaatagcaaaaaggggagtatacctaccactcaagtccagtgacgaaagagtccgagatgttgaaaaatacgggggcagaacaagcataacaatatcagaatatataatactaaacatcagagatacctcagaccaagaccgtatagaaatattctcactccccctctacatagcaggcaaaaaagatatacacaaagcaattgaggaagcgtatctttccacatgcaaaaagccagccagcgtagttgatatccaaatcctatacagaggactctatataggaagtaaagtaaacataaacggattcacgtactacatgggaggaaaaacaggaagcaatgtaagcgtagacagcgcagtagatgtcgtcatggacataacatcatctgtatacataaaactcttagaaaaagtcgcaataaaaaaaatagagaattcaaaaacattccgaatcgaaaatattaaaacatcttacaatcacaaagaagtaaccgtgtctaaagaacagaacatcgcattatatcaagaattattgaaaaaacttgatacaccactattctcaaaaatgaaaggcaacaaattagaagagtttagaaccgtaggttttgatacattcatagcattaagcttagaagaccaagcttccgtattactagaagtattaaacgtcctcacaaattttaagaccaaaagagatataactaaaataggaatgacctcgagcagatctacactaggtataaacatctccaacacagaacaattcagcgtaattacaacatcgatcacaggactctatgaacaagaaataaaaataaaatga

SEQ ID NO: 8982 - RNA, 4131 nt, synthetic construct
  misc_feature 1..4131: note = Cas9 variant
  source 1..4131: mol_type = other RNA
atgactactaaaaaccgcgagaaaaataataaattccataaagctagtccattatacacattgggactggatattggaacaacatccgtaggttttacagctatcgacgaagcacaaagaccaatgagggcaaaaggaaagacagtaatcggagttagactcttccaagaaggacagtccgccgtaggcaggaaaaattttagaaccacaagacgaaggctaaaaagacgacgtcgaagactcaacttgctcaaacaatttttctctgcacctctaagaaaaatcgatcccacgttcttcaaacgtttaaaagcgtcctcactatctccagcagacaaacgcaggtaccttgcacccgggctgtttccaaatggtggagatataaaattctaccaaaaataccccacaatctatcaccttcgtctcgcacttatgacagaaaaacgtccctttgacctaagagaagtctacttagcaatccatcatattgtgaaatatagaggtaatttcctaaatccactaccagtatcagcatttagaggaagaaaccaaagatttgaagaccaattttctgaattaaatcaattatataagtcactagaaggcgaatcaccatttcaattcgatgaaaagattttctcagaattagacaaacaactattagtcaatgatgggagaaaaatcgatcgtcaaaaacaactagcaaaacgagtattcatcaaaactaatgaaaagcgaatagattcacaccatcagaaaatagcgagtgcattcagcaaggccgttttcggctataaattcagaccagacgtcttactaaatagcgatccaaatgaaagtattgacgaatttatcaaattcggagacgaagacttcgatgacaaacttgtaatcctcagagaaagcctgaatgccactcaaaaagaaatcttagcagttacacaaaggatatacagccaaatcattttaaatgaaatcgtacccagccgcgaaacacttagtgaagccatggtttccaggtaccaaaaacaccattctgatttacaactcttaacagaagcatgcaaaaagatgaccaaagcaaaagcagctcgcattcaagcagcttacacagactatataggaaaaggtgacggacacaagctagtccatgatcaattcgtggctttaatcaagaaaaacctcgacccttcagaagaaggcagagacttagcagagcgacttgctcaagacgattttatgcccttacaacgcactccattgaacagagttatcccacaccagctacaacaggaggaactagaccgaataatagaaaaccaaggagaatattacccctttttaaaaacattaaacccaaataggtcacgcgccggtgttgcaaattatcaattagatgaattagtttcctttagaataccatattacgtaggaccactcataacagcaactgatcaattacacacatcaggagccaaattcgcatggatgactagacgcgcagctggtgaaattaccccatggaatttcgatcaaaaagtcgacagattagcatctgcgaaccaattcatacgacaaaatatgccaaaagacaatcatttattagaagcagacgttcttcctgcaaactctctcacatatcaacgatatttagttttagacgaactaaacgccgtaaaagttaaccacaaaagtctcacagtatcccaaaaacaaagaatcttcaatgatttattcaaaagacaacgcactgtaacagtactaaatctacaaaattacctaaaatccatagaaaaactgccgacactacctgtcataactggagttagcgatagcgaaagattcaagactacgttatcaacctacctagattttaagaatatattcggaggcaaggtagacgatagttcccaaaaagaaaaattcgagaaaatcattttatacgctacaatcttcgaagatcatgcagtatacaaagccaaattggaccaaatagattggcttggtcaacaacagaaaaccgatctcctctccaaaaactatcaaggttggggacaactgtcagaaaaacttcttttaggccttaaaaaccaagctggccaaagcattttagatgaactatggcaaacaaacaaaagattcagggaaatcatgaatgaagcacacttcgctaaacaaataatggcctcaaacgcagcattattaaggaagaaaggtttagacgacgttttatcaaccgcatttttatcaccccagaacaagaaagcaataagacaaactgtagaagtagtagacgacatcgttaaagcgataggatgcccacctcagaaaatatcacttcatttttcaaaagcaccagctgacgccataagacatgaacgcgacaacgccaatatcatactacgaacatacagaaatttaccggctaaaatggttgatgatcaattgaaagcggaactacaagcaacagctgaaaaacaccaagttttatctgacaaactctacctgtacttcacacaattaggccgcgacttatacacaggtgaaatgttaaaaatgagtgagttagaaaatgacatgatagatcatataatgccacaaaccttcgcgtatgatgacagcgtgaacaaccgagtgcttgtttcgcaaaatcactcttcacagttaggaaaaacatcaggagaaaaatcagacgctaaaatgatacgtttctggcaagtacttcgagataataaattgatatcagaacaaaaataccaaaacttaactcttgattcagaccacttatcaaaatccactagggaacaactactcaataggtaccttgtggagaaaaaccctatcactcaatgggtagcatctgtacttaccgaaaaatacggtgataatggaacaagagttcttacaataaacccacgaatggtataccaaatgaggcgacaatttaatttagttaacctacctgaagtaaatgattatgatcacggtttagacgcatacttagccgcattcataggtaattacgttgaccgccgatatccaagattaagatcctatttcgtatatggcgactttagttctagtaaagaaatagtatttagactaaacagattcaattttctgttcgaccttggacaagccgaaccaaacgaattaacagactgggaaaccggagaaatgatatgggacaaagcagcagcaaattcagtactacgagacgtataccaatacaaattcatgttaatctctcaagcggtatatagtagacaaggagctatgttcaatcaaacaatataccctgcgagtcaagcagcaggacgacaactaatccccgtaaagaaaaaccgcgccaccaaattatatggaggctactcgggtaacgttgacgcctacctagccattgtccgcttgggcggtccaaaatcagaccaatacagagttgtaggtattccaacaagaatggtaggacgcctccaatctgcaatgaaacaaggagcggatacttacgccaatacactacataaaattcttcaaccccaattcacaaaacgtaagaaaaatagacaaacaggatactatgaagaaacgacagaaccatttgcagtcatactcgataaagtttattatcgacaactaattattgatggacaacaaaaattcatgctaggatcatcaacatatcaattcaatgcaaaacagctagtactctctagtcgtgccagacaaattttatctggagaagaacgcttaaccgacgaaaatggatctcaagatctaatagatgtatatgacgaaatattgacaaaaatagatagatacttcgaactttatgatcaaaggcatttcagacaatctctccatgacggtcgaaaacaatttatatctttaccgatacataacgtataccgagcaaatagattaatagaacatggtaaatatgaaactctcagtcaaatcttaaatggtctacatgcaaatactatgatgacaaacctcaggtatttaggtatatcaagcccctttggtaaattccaatcacccaatggcattaaactatccaaagacgctgttttagtgtaccaatcaccaagtggtctatttgaaagacgtgtcagattacgcgatctatga

SEQ ID NO: 8983 - RNA, 4131 nt, synthetic construct
  misc_feature 1..4131: note = Cas9 variant
  source 1..4131: mol_type = other RNA
atgaataacaaaccatattcaataggactagatattggaaccaattctgttggttgggcggttatcacagacgattataaagtaccttctaagaaaatgaaagttctaggcaatacagacaaacatttcattaagaaaaacctcttgggagctttactgtttgacgaaggtacaaccgccgaagacagacgtctgaaacggacagccagacgccgctacacaagacgcaaaaaccgattacgttacctacaagaaattttcacagaagaaatgtctaaagtcgatatatcattctttcatagattagacgacagttttctagtcccagaagataaaagaggatccaaatatcctatctttgcaacgttagaagaagaaaaagaataccataaaaattttcctacaatctaccacttaaggaaacacctcgcagactcaaaagaaaaagcagactttagactaatatatttagcactggcacatattattaaatacagaggacatttcctatatgaagaatcattcgacattaaaaataacgatatacagaaaatatttaacgagttcataagtatatatgacaatacattcgaaggatcgagtctaaacggacaaaatgctcaagtagaggctatattcaccgacaaaatctcaaaaagcgctaaacgagaacgagttctaaaacttttcccagatgaaaaatcaacgggactattttccgagttcctaaaactaatagtaggcaaccaagctgatttcaagaaacatttcgatctagaagaaaaagcaccattacaattttctaaagacacatacgacgaagacctcgagaaccttttagtacaaataggcgatgatttcgcagaccttttccttgtcgccaagaaattatacgacgcaatactactatcaggaatattaacagtaacggacccctccacaaaagctccactaagcgccagtatgatagaccgctatgaaaaccaccaaaaagacttagctgcacttaaacaattcataaaaactaacttaccagaaaaatacgatgaagtattctctgaccaatcaaaagatggttacgcaggatatatcgacggaaaaacaacacaagaagcattttacaaatatatcaaaaacttattatcaaaacttgaaggcgctgattacttcctagacaaaatagaaagagaagattttctacggaaacaaagaacttttgataacgggtcaataccacaccaaatacaccttcaagaaatgaacgcaataataaggagacaaggtgaacactatccattcctacaagaaaataaagagaaaatagagaaaatactaacattccgtataccatattacgtaggaccactcgcaagaggaaaccgagattttgcttggttaacacgaaatagcgaccaagcaatcagaccatggaacttcgaagaaattgtagataaagcgcgcagcgcagaagactttataaataaaatgacaaactatgacttatatctaccggaagaaaaagtacttcctaaacacagcctcctttatgaaacatttgcagtgtacaacgaactaacaaaagtcaagttcatagctgaaggccttcgagattaccaattcctcgacagcggtcagaaacaacaaatagttacacaactctttaaagaaaaacgaaaggtaaccgaaaaagatattatacaatatctccacaatgttgattcatacgatggaattgaattgaagggtatagaaaaacaattcaacgcgtcacttagcacataccatgacctgcttaaaattataaaagacaaagagttcatggatgactcgaaaaacgaagcaatacttgaaaatattgttcacacgctgacaatatttgaagatagagaaatgattaaacaacgcctggctcactacgcatctatttttgatgaaaaagtaataaaagcgctaaccaggagacactacacaggatggggcaaattgtccgctaaactaataaatggaatatatgataaacaatctaagaaaacaatcctcgattaccttatagacgacggagaaatcaacagaaatttcatgcaactaatcaacgacgatggactaagttttaaagaaattatacaaaaagcacaagtagtaggtaaaacaaatgatgtaaaacaagtcgtccaagaactgccggggtctccagctataaagaaaggaatcttacaaagcataaagctagtcgacgagctagtaaaagtaatgggacacgcaccagaatcaatagtaatcgaaatggccagagaaaaccaaacaacagccagaggcaagaaaaactcacaacaaagatacaaaagaatagaagatgcattgaaaaatttagctcacggattagattcgaatatactgaaagaacatcccacagacaatatacagctacaaaatgacagactatttttgtattatctacaaaacggaaaagatatgtatacaggaaaaagtctagatataaaccagttatctagctgtgacattgaccacataattcctcaggcattcataaaagacgactcactagacaatagagttcttacatcctcaaaagacaacagaggaaaatctgacaacgtaccatcactggaaatagtccagaaaagaaaagcattctggcaacaactcttagattctaaattaatatctgaaagaaaattcaacaatctaaccaaggccgaaagaggtggcttagacgaacgagataaggtgggattcataaaaaggcaactggtagaaacacgacaaattactaaacacgtcgctcaaatcctagatgcacgatttaatacggaagtcaccgaaaaagacaagaaagaccgtagcgtaaaaatcatcactctcaaatctaacttagtaagtaactttcgaaaagaatttagactatacaaagtgagggaaataaatgactaccaccatgcgcacgacccatatctgaacgcagtcgtcgctaaagcaattttaaagaaatatcctaaactagaacctgagttcgtctatggcgactaccaaaaatacgatcttaaacgatacatcagtcgaaccaaagacccaaaagaagtcgaaaaagcaactgaaaaatacttcttctatagcaacctactaaactttttcaaagaagaagtccactatgccgatggaacaatagtcaaacgagaaaacatagaatacagcaaagacacaggagaaatagcttggaataaagaaaaagattttgcaacaataaagaaagtcttaagtttaccccaagtaaatatagtcaagaaaacagaagaacagacagtaggtcagaacggtggcctttttgacaataacatagtatccaaaaagaaagtagtggacgcgtccaaactaacaccaataaaatcaggattgagcccagaaaaatatggaggatatgcgcgaccaacaatagcctactctgtccttgtaatagctgacatcgaaaaaggaaaagccaagaaactaaaaagaattaaagagatggtaggaataacagtacaagataaaaagaaattcgaagctaacccgatagcctaccttgaagaatgcggttacaaaaacataaaccccaatcttatcataaaacttcccaaatactccctattcgagtttaataacggacaacggaggctgctcgcaagtagcatagagttgcaaaaaggtaatgaattaatagtcccttaccactttacggccctcttatatcacgcacaaagaataaacaaaatttcagaaccaattcacaaacaatatgtagaaacacatcaaagcgaatttaaagagttactaacagctataattagtctatcaaagaaatacatacaaaaaccaaatgtagagagcttacttcaacaagcatttgatcaaagtgacaaagacatatatcaacttagcgaaagttttatatcattattgaaattaatctcttttggagcccctggtacttttaaatttctcggcgtagaaataagtcaatcgaacgtaagataccaatccgtctcatcctgcttcaatgcaacattaatacatcaaagtatcacaggcctgtacgaaacaagaattgacctatccaaactcggagaagactga

SEQ ID NO: 8984 - RNA, 4131 nt, synthetic construct
  misc_feature 1..4131: note = Cas9 variant
  source 1..4131: mol_type = other RNA
atggacaagaaatatggcataggccttgacataggaacaagtagcataggttggactgtcgtagacaaatacggacacataattcgagttaaaggccagactggaattggcgttagactattcagagaaggacaaacagccgctgaaagacgaacctttcggacaactagaagaagattaagcagaagacgatggcggttgagactattaagagaaatattcgacgaaccaatatcagcaattgatgaaaactttttcgcaagacaaaaagccagcagtctggcacctggagacgcacgataccaacaggctttccaactattcaatgaccgaaccgatcaagcgttttactgcaaatatcctactatataccacctaagacaagctcttatgaccgagtcaaggcaatttgacatacgagaaatctacctagcactacatcagataataaaatatcgaggtcactttttactgggaggagcagcaaaagacttccaaagcgacaaactagacctagaggcttacttcaccacaatcaatgcacaactagcaggaatctactcagacggctctgttcaattacccacccttgattggaatcaagcctgtcaggaactcacagatacatcaagaactcaatccgatcgcaaaaattggctagtaaaagaactaaaatcatacggagacagtcaactaaaaccaatatatacacaaatagcaaatgctattctaggatttaaaacagatttagcaaaaattatgggcataaatgatcccgaaaaagcactatcattcaatctagacgcactagacgatcacagagacgatgtcgcagaattgctcacagacgaacagataccattagtgaatctactcgcaaaactacatacagcattagaattagcggcaatcctaccagacggacaaactctaagtggaaaaatggtagaaatttatgaaacacatcgaaaacaactcaaaacatataaggctttcataagacaattaccagaccgacaacaacggttagcgctaaaacaggcctatgaccattatattgaccaaggtttaaatagagaagcattctattctgaagttaaagctatcctggaaaaacaaaaaccactgactgcaactggtcaggccatgaagaaagccatggaccaaaacgcctttctacttaaacaaaggacaaaaacaaacatagcaatcccatatcaagtccagcaacaagaaatggatcaaataatcgcaaatcaatccaaatattatccatggctagcgacacctaatccagtaaaatcaaggcgggtaatagcaccctataaactagacgagctagtatgtttcagagtaaactactatgtaggaccgctcgtacaatcaaaaccaggagaagcaactaaagaagccaaattcgcatggatgacaagaaaagatcctcagtctacggtggcgattacaccatggaacttcgaccaacaagtagacagacaagcaagtgcaaatgcatttattcaacgaatgaaaacaacagatacatatctgctaggagaagatgttataccgaaaaactctctcttgtatcagaaatacgaagtactgaatgaattgaacaacgtaagagtaaatggagactggctggacccacaacgaaaacaatacttatttaagaaattattcatggatcaaccacagtcagtagtaacagtcaaagcactacaaaagacactcgtagtcattggagcatgtccaacgttaccaactgttgaaggattggcaaacccaaaaagattcctatcccaactgacaacatatcacgacttctgtaaattactacccgacgacattcaaagagctgacaggcaagcggacatagagaaaataataaactggtccacaatattcgaagatacagccatatttaaagaaaaattaagagatataaaatggctttcagccgatcaaatcagaagactatcatctagaccaagataccgtggatggggaagattttcagcaaaactactatgcggactacacgaccgtcaaggaaacactgtgatggatgaactctggcagacgtccagaaattttatgcaaataattagacaatctgactttcaaaccgcaattgccgcagtaaatcagcaagacctagggcggcaagacttgcaacgtgtaatagacgacttatatacgtcccctcaaaataagaaagctataagacaggtattagctgtagttacagatatccaaaaagccatgcacggcaaagcacccagttggctatttgtagaagtggcgaagggtgcacagaaaaatccacaacgaacacaatctaggcaatctaaattagcggaggcttatagagaatccgcacgggaattagtcgacgaagctgtcaaagaacaactcttaacgctaccagacgacaggcaaacattcagtgatagattagtcctatattttcaacaaaacggaagagatatttacactggagaaccacttgattttgaacgactaagcaattatcacatcgatcatattattccacaagcagtagtaaaagacgatagcttagataatagagtattaacatctaaccaagccaatctcgaaaaaggagcgcatgtcccaactatattccgagacaagcaagaaccagtttggcaagaattatacagggttggattgataagtcatcgcaaactacgtaatttactcacaactcctgacgacctcgatgacagaggcagagcaaccggatttatagctagacagctagtggaaacaagacaagtaataaaattagtcatggaagttttaagccaatactatgacacaactgaaactgagttaatctcaatcaaagcagggttgtcccaccaattcagacaagagctcaacctaccaaaactgagagcactaaatgactatcatcacgcacaagacgcatacttagccgcacgtatcggcacatatctattacaacgatacccaaatctaaagagattctttgtatacggcgacttcaaaaagactcattttgatctacaacgaaggtttaactttatcggcggtatgatttcaagagaaaagcaaccatacaatctcattaaaaacccagtaacacaccaagttatatgggacgaagaaatggaaataggagactgtcaaaagaaaaaccctgaacaacctaaacatgatgcaacagtcaaaatgatgaacctaactaaaatcatgaacctgaaacacattctagtaacacacgaagtttatgaaaatcatggggcactatttaatcaaacaatatacccagcatcccaagcccacaaaaagaaattaataccgcagaaaactgaaaaaccgatagaactatatggcggacactcaagcgaacaagccggatacatggcaataataaggctgctaggtaaaagaccgggatacaaggtaatgagagtaccagtacgctatgtatcacaactacaacatcaagacgttgctgaacaaaagaaactactatataaaatatttgtaagtgaattaacatcacgcaataaagtgaaaccgtttgaagtcgtagtgccacacgtttgtttaaatcaacctgttgaagatatgataaaaggtcaatggcacagattcgcactcagaaccaatggctattaccaaaaccaacaacaactgatcttaagccttgtagcccaacgaaccctcgcgggttataaaccaaaagatgatgaactcatggcagtataccatgaaatatgtaagcaagtaaaatattattttccactatacaagatgaataaatttcaaagccgtttattcgcagcagaagaactactacaaaagcgaagcacagtaaactccttctcaataaccataggcaaaaatggaaaggaaaataaaacattaaacctcggcaagcgagaattactattacgcctccttggcggtctccacgcaaacgcaacgagggtcgatctaaaagacataggatgtactggacaatttggccagcttcaggtcaaaaatggaataaaattaactgaacaagcagtacttattcatgaatcgccaactgggttattccacagacgagtaagactaaatgatctatga

SEQ ID NO: 8985 - RNA, 4134 nt, synthetic construct
  misc_feature 1..4134: note = Cas9 variant
  source 1..4134: mol_type = other RNA
atgacaaagaaaaactactcaatagggttagatattggcactaactccgtaggctgggcagtaattacagatgactataaagtaccagctaaaaagatgaaagtactaggtaatactgacaagaaatatatcaagaaaaatttactaggagcattgctattcgattctggcgaaaccgcagaagcaacaagactgaaaagaactgcaagaagaagatatactagaaggaaaaaccgattaagatatctacaagaaatatttgcagaagaaatgacaaaagtagatgaaagtttcttttacagactagatgaatcatttctaacaaccgatgaaaaagactttgaacggcatcccatatttggaaacaaggctgacgaaataaaatatcaccaagagttcccaacgatctaccatctaagaaaacaccttgcggactcctcagaaaaagcagacttaagattagtatatctcgcgcttgcccatatgataaaattccgaggtcactttttaatagaaggtgaactaaatgctgaaaatactgatgttcagaaaatatttgcagactttgtaggggtatacgatcgcaccttcgatgactcgcatctttcagaaattacagtagacgcggcgtcaattctaactgagaaaatatccaaatcacgcagattagaaaatctcattaaatattacccaacagaaaagaaaaacacgttgttcggtaacttaatagccctagcgctcggacttcaacccaacttcaaaatgaatttcaaactatcagaagacgcaaaactacaattcagtaaagacagttacaatgaagacttagaagaactactcggaaaaataggggacgactacgcagatttattcacgtcagctaaaaatctctacgacgcaattttactatcaggaatcctcaccgtagacgacaactcaacaaaagcaccattatccgcatccatgataaaacgatatgcagaacaccacgaagatttagaaaaactcaaagaatttataaaagcaaacaaatcagaactttaccatgatattttcaaagatgaaaccaaaaatggttacgcaggctacatcgaaaacggagtaaaacaagatgaattttataaatatctgaaaaacacactttcaaaaatagcagggagcgactatttcctagacaaaatcgaaagagaagacttcttacgaaaacaacgaacattcgacaacgggagtatcccacaccaaatacatctccaagaaatgcatgccatcctacgcagacaaggcgactattaccccttcctaaaagaaaaccaagaccgaatagagaaaatactcacatttagaataccatactacgtaggcccactggcccgaaaagacagtagattcagctgggccgaatatcactccgacgagaaaataacaccctggaacttcgataaagttattgacaaagaaaaatcggctgaaaaatttatcacgagaatgacacttaacgacctctacttaccagaagaaaaagttctgccaaaacacagccacgtatacgaaacatacgctgtatataacgaactaacgaaaatcaaatatgttaatgaacaaggaaaagattcctttttcgattctaatatgaaacaagaaatatttgatcacgttttcaaagaaaacagaaaagtaacaaaggaaaaattacttaattatttaaacaaagaatttccagaataccgaatcaaagatcttataggcctagacaaagaaaacaaatcattcaacgcttcactcggaacatatcatgacttaaagaaaatactcgataaagcattcctagatgataaagtgaatgaagaagtaatagaagatatcataaaaaccttaacactctttgaagataaagatatgatacatgaaagattacaaaaatactcagatatatttactgctgatcagttaaagaaattagaacgaagacactacactggctggggccgcttatcatacaaattgataaatggcatacgaaataaggaaaacaacaagacaatactagactacctcatcgacgatggctctgctaatcgaaactttatgcagttgattaacgatgataccctaccatttaaacaaataattcaaaaatcacaagtcgttggtgatgtcgatgatatagaagccgttgttcatgatcttcccggctcgccagccatcaagaaaggcatattacaaagcgtcaaaattgttgacgaacttgtgaaagtcatgggggataaccctgataatatagtcattgaaatggcacgcgaaaaccaaacaacaaaccgaggaaggtcacaatcacaacaaaggcttaagaaactccaaaattcactaaaagaattgggatcaaacatcttaaacgaagaaaagccatcttatatagaagataaagtagaaaactctcacttacagaatgatcagttatttctatactacattcaaaacggaaaagacatgtacactggggatgaattagatatcgatcacttaagtgactacgatatagaccatattattccacaggctttcataaaggacgacagcatagataatagagtccttaccagttcagccaaaaaccgaggaaaaagcgacgacgtaccatcattagatatagtcagagccagaaaagcagaatgggtcagactctataagtcaggattaatatctaaaagaaaattcgacaacctaacaaaagcagaaagaggtggattaaccgaagctgacaaagccggattcataaaaagacaattagtagaaacaagacaaatcactaaacatgtagcccaaatattagacgcaagattcaacacagaaagcgacgaaaatgataaagttatacgcgatgtaaaagtaataaccctaaaaagtaacctagtttcacaatttcgcaaagacttcgagttctacaaagtaagggaaataaacgactaccaccatgcacatgacgcataccttaatgccgtagtaggaacagctttactaaagaaatacccgaagctagcttcagagttcgtatacggcgaatataagaaatacgacgttcacaaattaatagcgaaatcttctgacgaccactccgaaatgggaaaagcaaccgcaaaatacttcttttattccaacttaatgaatttcttcaaacgagtcataagatattcgaatggcaaagtcattgttagaccagtcgtagaatattccaaagacacagaagatatagcatgggataagaaaagcaacttcagaacgatctgcaaagtactgagttatccacaagttaacatagtaaagaaagttgagacccaaacaggaggtttcagtaaagaatcgatactacctaaaggagattctgacaaattaataccaagaaaaaccaagaaagcatattgggatacaaagaaatatggaggctttgactccccaacagttgcctactctgtatttgtcgtagccgatgtcgaaaaagggaaagccaagaaattaaaaaccgtcaaagagttagttgggataagtataatggaaagaagtttcttcgaagaaaacccagtcgagttcctcgaaaacaaaggataccataacatacgagaagacaaacttataaaactaccaaaatattcattattcgagttcgaagggggtaaacgtagattattagcgtcagcatcggaactacaaaaaggaaacgaaatggtaatacctggtcatttagtaaaactcctataccacgcccaaagaatcaactcattcaactcaaccaaatacttagattatgtaagtgctcacaagaaagaatttgaaaaagtcctatcctgcgtagaagatttcgccaacctctatgtggacgtggagaaaaatttaagtaaaattcgtgctgtcgcagattctatggataacttttcaattgaagaaatcagcaattccttcatcaacttgctaacattaacagcactcggagcacccgcagactttaacttcctaggcgagaaaataccaaggaaaagatatacctccacaaaagaatgtctcaatgccacattgatacaccaatcaatcaccggcctatatgaaacaagaatagatttatcaaaaatcggagaagaatga

SEQ ID NO: 8986 - RNA, 4134 nt, synthetic construct
  misc_feature 1..4134: note = Cas9 variant
  source 1..4134: mol_type = other RNA
atgaagaaaccatattcaataggactcgacataggaacaaattctgtaggctgggcagtaataacagacgactataaagtaccaagcaagaaaatgaaagtattaggaaacacagacaaacacttcattaagaaaaaccttataggagctctattatttgatgaaggcacaaccgcagaagataggagactaaaaagaacaagtagaagacgatatacaagaaggaaaaaccgactaagatacctacaagaaatattctcggaagaaatatcaaaactagattcatcattcttccacagactagatgatagctttttagtgcccgaagacaaaagaggatcaaaatatcccatttttgcaacattagaagaggagaaagaatatcataagaaatttccaacaatatatcatttgagaaaacacctagcggactccaaagagaaaaccgacttaagacttatatacctagcactggcacacatgattaaatatagaggacactttttatacgaagaatcatttgacatcaaaaacaacgatatacagaaaatttttaacgaatttataagtatatatgataataccttcgaaggttcgagtctatctggacaaaatgcacaagttgaagcaatcttcacagacaaaataagcaaatcaaccaaaagagaaagagtattaaaactcttcagtgacgaaaaatctacaggactgttctctgagttccttaaactaatagtagggaaccaagccgattttaagaaacatttcgatttggaagaaaaagcgccactgcaattttcaaaagacacctatgacgaagatctagaaaatctgctagggcaaataggcgacggttttgctgacctctttcttgttgcaaagaaattgtacgatgccattttactatcaggaatactaacggttacagacccaagtacaaaagcacccctgtcagcatctatgatagagagatacgaaaaccatcaagaagacctagcagccctaaaacaatttatcaaaaataacctatctgaaaaatatgccgaagtatttagtgaccaatcaaaagatggatatgcaggctttatagatggaaaaacaacccaagaagcattctacaaatacatcaaaaacttactatctaaacttgaaggagcggactactttctaaataaaattgaaagagaggacttcctacgtaaacaacgaacgtttgataacggatcaataccacaccaaatacatttacaagaaatgaacgctatattaagaagacaaggagaacattatctcttccttaaagaaaaccgagagaaaattgaaaagatactagcattcagaataccctactacgtaggaccactagccagaggaaacagagactttgcatggttaaccagaaattcagatcaagcaatacgtccctggaactttgaagaagtagtagataaagcaagttctgccgaagacttcataaataaaatgacaaattatgacctatatttacccgaagaaaaagtcctcccaaaacatagtttactttatgaaacgttcgcagtatacaacgaactaactaaagttaaattcatcgcagaaggcctgcgagactatcaattcctagatagcggccagaagaaacaaatagttaatcaattatttaaggataaaagaaaagttactgaaaaagacataatacactatctacataacgttgatggctacgatggaattgaactaaaaggtatagaaaaacaatttaacgcatccttgtccacataccatgaccttttaaaaataataaaggataaagaatttatggataaccccaaaaacggcgagattttagagaatatcatacacacccttacaattttcgaagacagagaaatgataaaacaaagactagcacaatatgacacactattcgatgaaaaagtaataaaggcgctaactaggagacactataccggttggggtaaactctccgctaaattaataaacggaatcagagacaaacaaaccggaaaaaccatactagaatatcttattgatgacggcgactgcaatagaaattttatgcaactaataaatgatgatggactttcctttaaagaaataatacaaaaagcccaagtagttgggaaaacggatgatgtaaaacaagtcgttcaagagatacccggctcacccgcaataaagaaaggaatattgcaatctataaaaatcgtagacgaattagtcaaggtcatgggccacaacccagaaagcattgtaatagaaatggccagagaaaaccaaacaacagctaagggcaagaaaaactcgcaacaacgctacaaaagaatcgaggacgcactgaaaaacctagcaccagggctggatagcaacattcttaaagaaaaccccacggacaatatacaacttcagaacgatagactattcctatactaccttcaaaatggaaaagatatgtatacaggcaaagcaatagatataaaccaattaagtaattatgatatcgatcacataataccacaagcatttataaaagacgattcgttagataacagagtacttacatcaagtaaagacaatcggggaaaatcagataacgttccgtctatagaagtagtccaaaaacgtaaagcattttggcaacaactattggattcgaaattaataagtgagagaaaattcaacaatctaacgaaagctaaaagaggaggactagacgaacgagataaagtgggctttatcaaaagacaacttgtcgaaacccgacaaataacgaagcacgttgcacaattactggatacccgctttaacacagaagtaaatgaagaaaatcagaaaataagaacagtaaaaataatcacgttgaagtctaacctcgtttctaattttagaaaagagttcggattgtataaagtaagagagatcaacgattatcatcatgcacatgacgcatatctaaacgccgtagtagccaaagctatattaaagaaatatccaaaacttgaaccagagttcgtatatggggactatcaaaaatatgaccttaagagatacattctaaaaagtaaagcatcaaataccatagacaaagcaacagagaaatacttcttttatagcaacctactgaacttctttaaagaaaaggttagatatgcagacggaacaatcaagaaaagagaaaacatagagtactcgaatgatacgggcgaaatcgcatggaataaagaaaaagactttgctaccataaagaaagtcctatccctaccccaagtaaatatcgtcaagaaaaccgaagaacaaacagtaggacagaacggaggtctattcgacaacaatatagtatccaaaaagaaagtagtagatgctagcaaattaataccaatcaaatcgtccctcagcccggaaaaatacggaggttacgcgcgaccaacaatagcttattcagtcctagttattgcggatatagaaaaaggcaaaggaaaagcaaagaaattaaaaagaataaaagaaatagtaggaataacaatccaagataaaaagaaattcgaatcaaatccagtcacttatctagaagaatgcggatacaaaaatatcaatagtaatctaataataaaattaccaaaatactcactattcgagttcaatgatggccagagacgattactagcatctagcatagaattacaaaaaggaaacgaactaatactgccgtaccacttaaccgcactcctttaccacgcacaacgaataaacaagatctcagaacccatacataaacaatatgttgaggcccatcaaaacgagttcaaggaactactaacgaccataatctcattaagcaagaaatatatacaaaaacctaacgtcgaattattactacagcaagcatttgaccaagccgataaggatatctaccaattaagcgaatccttcataagtctattaaaactaacatcatttggcgcaccaggagccttcaaattcttaggagtagagatatctcaaagcagcgttcgctataaacctaacagtcaattcctcgacaccacactcattcatcaaagtataacgggtctatacgaaacacgtatagacctctctaaactaggggaagattga

SEQ ID NO: 8987 - RNA, 4134 nt, synthetic construct
  misc_feature 1..4134: note = Cas9 variant
  source 1..4134: mol_type = other RNA
atgaataataaaccatattctataggactagatataggaacgaatagtgttggttggagtgtaataacggacgattacaaagtcccaagcaagaaaatgaaagtcctaggaaatacagataaacgattcataaagaaaaatctcatcggggcgcttttatttgacgaaggaactacagcagaagctaggagattaaaaagaacagcaagacgccgctatacgcgaaggaaaaatagattacgctacctccaagaaatatttgcagaagaaatgagcaaagtagacagtagcttcttccatagactagacgactcatttctgataccagaagacaaaagaggtagcaaatatccaatattcgcaacactcgtagaagaaaaagaataccacaaacaattcccaacaatatatcacctaagaaaacaattagccgactctaaagaaaaagcagaccttagactcatatacctcgttcttgcacatatgataaaatacagaggacatttcttatacgaagaagcatttgatattaaaaataacgacattcagaaaatcttcaatgagttcatctcaatatatgataatacgttcgaaggtagtagcctctctggacaaaatgcccaagtagaaacaatattcacagacaaaatatccaaatccgccaaaagagaaagagtactcaaattattcccagatgaaaaatcaactggactattcagtgagttcctaaaactaatagtaggaaaccaagcagactttaagaaacacttcgacctagaagaaaaagcacccctacaattttctaaagatacctatgacgaagatcttgaaaacctactagaacaaatcggagatgatttcgctgacctgttcgtggcagcaaagaaactatacgatgccattctactcagtggtattcttacagtaactgatccatcaacaaaagcacccttatcagcaagtatgattgaacgatatgaaaatcaccaaaaagacctagcagtcttaaaacaattcattaaaacaaaccttccagaaaaatacgttgaagtattcagtgatcaaagcaaagatggctacgcgggctacatagacggcaaaacaacgcaagaagcattctataaatatatcaaaaaccttctatcaaaattcgatggtgcagactactttctagacaaaatcgaaagagaagtatttctcagaaaacaaagaacatttgataacggaagcataccacaccaaatacacttacaagaaatgaatacaatactaagaagacaaggagaacattatccttttcttaaagaaaacaaagagaaaatagagaaaatattaacatttagaataccataccacgtcggaccattagcacgaggaaaccgagattttgcttggcttacaagaaactcagaccaggcgattagaccctggaactttgaagaaatcgtagacaaagcatccagcgctgaagactttataaacaaaatgaccaactacgacttatacctaccagaagaaaaagtcctaccaaaacactcactactatacgaaacatttgctgtatacaacgaattaacaaaagtaaaattcatagcagaagggatgcgggactaccagtttttagactcaggtcagaaaaagaaaataataaaccaactctttaaaaagaaacgaaaagttacagaagacgatataatcgactgtctacagaaaatagacaactacgatggaatagaattaaaaggaatcgaaaaacaattcaacgcatccttatccacttatcacgacattctaaaaataattagagacaaagagttcatggatgatcccaaaaacggagatatactagaaaacgtcattcatacccttaccatatttgaagaccgagaaatgataaaacaacgattagcccaatacaattctatctttgacgaaaaagtaataaaagcgctatccagaaaacattacacaggatggggaaaactaagtgcaaaattaattgacggaatccgtgataaacagactggaaaaacaatcctagattatttaatggatgatggaaaaagcaatagaaacttcatgcaactaataaaagacgatgaactatcattcactgaaattatacaaaaagctcaggtcgtcggtgacaccgataacctcagacaagttgtacagaacctacctggaagcccagcaattaagaaaggaatactccaaagcattaaaatagttgacgaacttgttaaagttatgggacacgcgccagaaagcatagtaatcgaaatggctagggaaaatcaaaccaccgcgcgcggcaagaaaaattcacaacaaagatataaaaggatagaagacagtctcaaaaacttagcctcaggattagatagtaatattttaaaagaaaaccccaccgacaacattcaattacaaaacgacaggctattcctttattaccttcaaaacggaaaagacatgtacaccggggaagcactgaatataaaccaattatcctcttatgacatagatcatataatcccacaagcatttattaaagacgactctttagataaccgagttctaacctcaagtaaagacaaccgaggcaaatcagataatgtacccagcctagaagtcgtagagaaaatgaaagcattctggcaacaactactagacagcaaactcatctcggaaagaaaatataacaaccttactaaagccgagagggaaagagggggactaaatgaattagacaaagtcggatttatcaaacgtcagttagtcgaaacccgacaaataactaaacacgtagcccaaatactagatgctcgatttaataaagaagtgacagagaaaaacaagaaaaaccgcaatgtaaaaatcattacattaaaatccaatatggttagcaactttagaaaagagttcggactctacaaagtgagagaaataaatgactaccatcacgcccatgatgcatatctaaatgcagtagtagccaaagccatattaaagaaatatccgaaactagaacccgaatttgtttacggggactatcaaaaatatgacctaaaaagatatattagtcgatctaaagaccccaaagaagtagagaaagcaactgaaaaatatttcttctatagcaaccttttaaactttttcaaagaagaagtccactatgccgatggtacaatagttaaaagagaaaacatagaatattcaaaagatacaggtgaaattgcctggaacaaagaaaaagactttgcaacaatcaagaaagtgctttcactcccgcaagtaaatatagtcaagaaaacagaagaacagacagtaggacaaaacggaggtttatttgacaacaatatcgtcagtaaaaagaaagtagttgatgcaagtaaacttattcccataaaatccggtttgtccccagaaaaatacgggggttacgctagacccaccattgcctatagtgtcttggtgacatataaacaaaacaataaaataaagaacacaatggttggaatacccgtgctcacgaaactagaatttgaaagagaccccaacctctatctaagaaatttaggaataaacaacgtaagtcacgttatcaaattagttaaatacaccgtccttgagttcaaacataagtatggcacataccgaagatttattgtttcaaaccaagaactaaaaagggcaaatcaaattttcgtaaccacaaaacaaatgaaattaatctctcagtacacaacattagacaaaaatgaacacgatagcttacttaaaaataaccagcaattaatccagagcatttggaaccaattcttagagttcatgttagcaactgacctagtaaacaaaaagcagtacgatgaattaatactaactaacaatcaaactattgaagaatgtcgcaacataatgaacagagttataacaacattatctttcacaaatataaacgcgggccagaaaaagataatattcgatgacacactgtcattaccaatcaaacgatggcaattcacagactccgataaaatggtgaagaaaattatagaatcaacgctaattcaccaatccataactgggctctacgaaacgcgaatagatttatcaaaacttggtgaagactga

SEQ ID NO: 8988 - RNA, 4134 nt, synthetic construct
  misc_feature 1..4134: note = Cas9 variant
  source 1..4134: mol_type = other RNA
atggaaagtaatcatgatggagaacaagtgaaatatacactaggccttgacattggaacatcatcaataggctacgcagccatagacaaacatcaaaagcctattagagccaaaggaaaacatgtcataggagttcgattgttccaagaaggccaaaccgctgcagacagaagagcattccgaaccacaagaagaagattaaaaagaagaaaatggcgattaaatctacttaatagactctttgatccatatcttagcgaagtagatcccaactttttaccccgacttagacaaagtaatctaagcccaaaagatgataataaacactttaacgggtcgacattattcccagacaaaacagatgcagctttctacagacaataccccacaatgtatcatcttagatacgcattgatgacagaaaaaagaaaatttgacatacgagaagtctatctcgctatacatcatatagtcaaatatcgtggcaactttttaaactctgccacagtagattcattcaaaacatccaacatagactttacttctcaatttgacagactaaacgaattatatagacaagttatcttagacgaaccgtttcaaattaacatggatcaagtagatgagatgacaaataagctactcgataacgatgcattgaaattagatacacaaaaacaagtagcaaaactcttaccagttatatataacgataaacccatcgacaaacaatacacacgaatagctaccgagttcagcaaagctatactgggttataaaacgaaattagacgtcatattaaatttagacacacagaatgcaaaagactgggtcattagattagatgacgaagatatagatgataaactacctgcacttgtagaaaatctagacgaatcgcggcaagaaatcgtaaccataatcagagatctttacgcgcaaatcacactcaacgcaatagtaccaaaaggaaagtcactctcagaatccatggtggataaatacaacgatcacaaagatcacctcgatttactaatgggacttatacatgaactaggagatgactcagctaaaggaataaaactccgtgaggcttacactcaatatgtaggtaagtctgatgacaaaaccctaaatcaggacgatttttatgcagcaataaaaaaaaatctagacgaagactctaagagaagccccaaaattcaacgccttatagaacaagcctctttcatgcccaaacaaaggacatctgcaaatggggttataccacatcaactacaccaactagaattagatagaataattgaaaatcaaggcaggtattatccattcttaaaaaaaccaaacccaaacacacataaaccgaatggaggaaaatacaaactagacgaactagttgcattcaggattccatattacgtcggcccacttatcactaaaagagatcaagaaaaaactagcggagctgatttcgcatggatgatacgaaaaccagggcaagaaggagagataactccatggaatttcgaccaaaaggttgatagaatggcctctgcaaatagattcataagaaggatgacaacaaaagattcatatctggtagccgaagatgtccttccagacgctagcctaatatatgaaaagttcaaagctctcaatgaacttaacatgctcaaagttaacgattcaagactatctccctcacaaaaacaggatctatttaacaatttgttcaaaaaacaaaaaacaataaggaccaaaaaacttcaaacatacattcgaaccaactgggaactaccaagcgttatgataagcggattggcagaccccgataaatttaactcttctttatcaacatatatagatttcagagatatcttcggtgaaaaagttgatgacccaaaccgacaagcagactatgaagaaatcatagaatggagcacagtcttcgaagacaggaaaatataccaagcgaaactaaaccaattagactggctaacagaaccacagagaaaagccctcttaaccaaaagatatacaggttggggtagactgtcaaagaaattgttgacaggcttaaaggatcaaaacggagacagcatattagaccaactctggaaaacaaatgacaacttcatgcaaatacaatcacgggatgaattcgccaaacaaatacatgatgaaaacgcaaaacaatttcatgaagcgaacaatgtagatgatatattagacgacgccttcacatccccccaaaataaaaaagcaatccgacaagtcgataaagtggtacaagatgtcgtaaaagcagtaggttatgctcctgacaaaatagcaatagaatttacacgttcactcgaaaacaatcctcaaagaactgtatctagacaaagacaattacaagccgcctacaaaaatatcccacgcgaaattatgaagtccggactgatggctgagctaggtagtgtggcagactccaaaaaagtcctgagcgataaactatacctctactttacacaaatgggaaaagatatgtacgaggataaaacaataaacattgacaatctaccaaattacgacatcgatcatattttaccacaagcgttcattaaagatgattccatagacaatagagtactaatcagcaaagaagaaaacgcccgtaaaagtaatcgagtccccctgaaattcttcggagctaaacgaatgggattctggaaagatttgctaaacaacggattgatatcaaatcgaaaattccaaaacctaacaactgatccagaaaaaattagcaaatattctgcaaagggctttatacatagacaactagttgaaacatcacaagtgataaggctagtcgcaaatatactaggaaatgaatactctcaagctggaaccacaataatagaggtttccgcaaaaatgaacagacaactgagggaagacttccacctcatcaagaacagaaatgtcaatgactaccaccatgcgatggatgcttacctaaccgcatacgtaggagactatttatatctacgataccccaaactccggccatactttgtatacggagacttcaaaaaagctgaagatcaagatttaaatataagaaatttcaactttcttcacgacttaaaagataatgaaagtttggacaaaatcgtggattctgaaacaggagaaatcgtctgggaaaaacatggatcggtcaaacaactaaaaaaagtataccattataaatttatgctagtttctcaagaagtatacacacgacaagatgcacttttcaaccaaactatatatcctgccagtgacgcagacaaaagaaaactaattccaataaaaaacagtaaaccggttgacgtatacggaggctacagcggcaacatagatgcatacatggctatagttcgtgtacacgggaaaaaggaagacaattataaagtcgtaggaataccaatgagagccgtcacaaaactaaaaaaagcagaaaaagaaggccatgatagttacctcaatgctgttcatgaagtattaaaaccccaattcacaaaaaaaaaaaaaaatcgaaaaacaggagaaattacagaaacagtagacgaattcgatgtactattaggaaaagtgtactacagacaactgatcgtggatggcaataaaaaattcatgctaggctcgtcctcctatcaatacaacgcgaaacaactagttctaagtgacaaagccatgcaagtactctcaaaaaatggaaaagtaaaatcccaagacgaaaaccaaaatttaatagacgtctacgatgaaatactagaaaaagtagaccaatacttcgaactctacgatcagcgacactatcgagaaagcttacacaaaggacgtgggatattcgtaaatttaccgttatcaaaccaatatgatggatcaaaacttacatcgtatgggaaatatgaaacaatagatgccatcctaaatggactacacgctaatgcaaccatgtcaaaccttcgttatttaggtatatctagtccttttggcaaaatgcaagcctcaaatggactaacaatagaccccgacagcataatatgttatcaaagtccaacaggattatttgaaagacagattaaattatccgatttatga

SEQ ID NO: 8989 - RNA, 4134 nt, synthetic construct
  misc_feature 1..4134: note = Cas9 variant
  source 1..4134: mol_type = other RNA
atgaataaaccttatagtataggtctagatataggcacaaactccgttggctggtctattataacagatgactataaagtaccagcgaagaaaatgagagtactgggaaataccgataaagaatacatcaagaaaaacctaattggagcactactattcgatggaggcaacacagcagccgacagacgattgaaacgaactgcaagacggaggtacacaaggcgaagaaatagaatattatatcttcaagaaatattcgcagaagaaatgtcaaaagtagatgactccttctttcacagactagaagacagctttctagtcgaagaagataaacgaggctcaaaataccctatattcgccaccatgcaagaggaaaaatactatcatgaaaagttcccaactatataccacctacgaaaagaattagcagataagaaagaaaaagcagatttaagattagtatacctagcattagcccatataataaaattcagagggcatttcctaatagaagatgaccgattcgacgtaagaaatacagacattcaaaaacaataccaagcattcctagaaatattcgacaccacttttgaaaacaatcatctactatcacaaaatgtagatgtagaagccattcttacagataaaataagcaaatcagcgaagaaagacagaatattagcccaataccctaaccagaaaagtacaggaatttttgcagaatttctaaaattaatagtaggaaaccaagctgatttcaagaaacacttcaacctcgaagacaaaaccccactacaatttgcaaaagattcgtatgatgaagatcttgaaaacttacttggtcaaatcggagatgagttcgctgatctattcagcgtcgctaagaaactttacgactctgttcttctatcaggaatattaactgtaactgatttatcaaccaaagcaccactaagcgcatcaatgatacaacgctatgatgaacaccacgaagacctaaaacacctcaaacaattcgtgaaagcatccttacccgaaaactaccgagaagtttttgcagacagttccaaagacggatatgctggctacatagaaggcaaaacaaatcaagaggctttttacaaatatttactcaaattactaactaaacaggaaggctcagaatacttcctagagaaaatcaaaaacgaagactttttacggaaacaaagaacattcgacaacggaagcattccacaccaggtacatctgacagaactaagggcaataataagacgtcaatctgaatactatccgtttttaaaagaaaaccaagatagaatagaaaagatattaacattccgcataccctactatgtagggcccctagccagagaaaaatcggacttcgcttggatgacgcgaaaaaccgatgactccataagaccatggaattttgaagacttggtagataaagagaaaagtgcagaggctttcatacatagaatgaccaacaatgacctttacctaccggaagaaaaagtattaccaaaacacagtctaatttacgaaaaattcactgtatataatgaactaacaaaagtgagattcttggcggaaggatttaaagacttccaatttctaaatagaaaacaaaaagaaacaatatttaactcactctttaaagaaaaacgaaaagtgacagaaaaagacataatatccttcctaaacaaagtagacgggtatgaaggcatagctataaaaggaatagaaaaacaattcaacgctagcctatctacgtaccatgatctcaagaaaatactcggcaaagactttctagacaatacagacaatgaactaatattggaagatattgtacagactttaacactatttgaagatagagaaatgataaagaaatgcctagatatttataaagacttctttactgaatctcaactcaagaaattatacagaagacactacaccgggtggggcagattaagtgcaaaactaataaacggtattcggaataaagaaaatcagaaaacaatattagattatctcatagatgatggttccgcaaatcgcaacttcatgcaattaataaatgacgacgacctatcttttaaaccaataatagacaaagcaagaacaggatcacatagcgacaacctaaaagaagtagtaggtgagctggcaggatctccagcaatcaagaaaggaatattacaatcattaaaaatagttgatgaactcgtcaaagtaatgggctatgaaccagagcaaatagtagttgaaatggctcgagaaaaccagacaaccgccaaaggacttagtagatcccgacaacggcttacgaccctacgagaatccttagcgaatttaaaatccaatatattagaagagaagaaacccaaatatgtgaaagaccaggtagaaaatcatcatctcagcgatgacagactatttttatactatttacaaaatggtagagatatgtacaccaagaaagcactagatatagacaacctatcacaatacgatatagatcacattatacctcaagcattcataaaagatgattctatagacaacagagttcttgtcagctcagccaaaaatagaggaaaaagtgacgacgtgccatcaatcgaaatcgtaaaagcccgcaaaatgttttggaaaaatctattagacgccaaacttatgtctcaaagaaaatacgataacttaactaaggctgaaagaggaggactcacatcagacgataaagctagatttatacaacgacagttagttgaaacccgacaaataactaagcacgtcgcaagaatcttagatgaaagatttaacaatgaagtcgacaatggtaagaaaatttgtaaggtaaaaatagtcactctcaaatcaaatttagtttcaaacttcagaaaagaatttggcttttataaaatcagagaagtcaacgattaccatcatgctcacgacgcatacttaaacgcagtagtagcaaaagctatactaacaaaatacccacaactagaaccagagttcgtttacggaatgtacagacaaaagaaattaagcaaaatagtccacgaagataaagaagaaaaatactcagaagcaactagaaaaatgttcttctactcaaacctaatgaatatgttcaaacgagtcgtaagattagccgatgggtccatcgtagtaagaccagtcattgaaacaggccgatacatgcgaaaaactgcatgggataagaagaaacatttcgcaacagtaagaaaagtactatcatacccccaaaacaatatagtcaagaaaacagaaatacaaaccggaggcttctccaaggaaagcattctagcacacggaaactctgacaaattgataccaagaaaaacgaaagatatataccttgaccccaagaaatacggcggctttgacagtccaatagtagcctactcagttctagttgtagcagatatcaagaaaggcaaagctcaaaaactaaaaaccgtaacagagctattgggaataactatcatggaaaggagccggttcgaaaagaatccctcagcgttcctagaatcaaaaggatacctaaacataagggatgacaaattaatgattctacccaaatacagcttattcgaactagaaaatggacgtagaagactattagcttctgcgggagaactccagaaagggaacgaactagctctaccgacacaatttatgaaatttttatacctggcttctcgctacaatgaaagtaaaggcaaaccagaagaaatagaaaagaaacaagagttcgtaaatcaacacgtatcgtactttgatgacatcttacaactaataaacgacttctctaaacgtgttattcttgccgacgcaaacctagagaaaataaacaaactatatcaagacaacaaagaaaatattccggtagatgaactagcaaataatataataaacttatttacttttacttcattaggagctccagcagcattcaaatttttcgataaaattgtagacagaaagagatatacaagcactaaggaagtattaaactcaaccctaatacaccaatcaatcaccggattatacgaaacgagaatcgacttaggtaaacttggtgaagactga

SEQ ID NO: 8990 - RNA, 4134 nt, synthetic construct
  misc_feature 1..4134: note = Cas9 variant
  source 1..4134: mol_type = other RNA
atggagaaaacatatagcatcggattagatataggtactaacagcgtaggatgggcagtcataacagatgactataaagttcctgcgaagaaaatgaaagtattggggaatacagacaagaaatacataaagaaaaacttactaggtgcattgttattcgactcaggagaaaccgcagaagcaactagactcaaaagagccgcacgaagacgttacacacgacgaaagaacagacttcgatatctacaagagattttcgcaaaagagatggcaaaagtagatgagagtttcttccaacgactagaagagagcttcctcactgatgatgacaaaactttcgacagccacccaatattcggaaataaagccgaagaagatacatatcatcaagaatttccaacaatatatcatctacgaaaacacttagcagatagccccgaaaaagtggatctccgtttggtatacttagctttagcccatatgataaaatttcgtggacatttcttaatagaaggacagttaaacgctgaaaacacagacgtacagaaaatcttcgcagacttcgttggagtttatgatcgtactttcgacgacagccatctttcagaaataaccgtagatgctgccagcatcctcacagagaaaatatctaaatccagaagattagaaaacctaataaaacaatatcctacagaaaagaagaatacactgtttggtaatcttgttgctctagcactaggcttacaacccaacttcaaaacaaatttcaaacttagtgaagacgctaaactacaattcagcaaagacacatatgacgaggatctagaagaacttttaggaaaaatcggagacgactacgccgacctattcactgccgctaaaaacctctatgatgctatcctacttagtggcatactaacagtcgacgacaacagtacaaaggcaccactatccgcatccatgattaagagatatgaagaacatcacgaagacctggaaaaactaaaaacatttataaaggttaacaacttcgacaaataccacgaaatatttaaggacaaatccaaaaacggatatgccggttatatagaaaacggagtaaaacaagatatattttacaaacatctcaagagcataatatcggagaaaaacggaggccaatacttcctagataaaattgaacgagaagactttttacgtaaacaaagaacatttgataatggcagcatcccgtatcagatacaccttcaagaaatgagaaccatactcagaagacaaggcgaatattatccatttctaaaagagaaccaagcaaaaatagaaaagatccttacatttcggataccatactatgtgggacctctcgccagaaagaatagtcgattcgcgtgggccaaataccattcagatgaaccaataacaccttggaactttgacgaagtcgtagataaagaaaaatcagcggaaaaattcataacaagaatgaccttaaacgacttatacttacctgaagaaaaagtactacctaaacattcatatgtttacgaaacgtttgcagtatataacgaattaacaaaaataaaatatgtaaatgagcaaggtaagagctttttctttgatgccaacatgaaacaagaaatattcgatcacgtattcaaagagaatcgaaaagtaacaaaagcgaaactactatcctacttaaacaatgagttcgaagagttcaggattaatgatctaatcggcctagataaagattctaagagcttcaacgcatcattaggaacgtatcatgatctaaagaaaatacttgacaaatcattcttagacgataaaaccaacgaacagatcatagaagacatagtacttacactaaccctcttcgaagatcgcgacatgatccacgaaagactacagaaatactcagacatttttacatcacagcaactcaagaaattagaaaggagacactacaccggatggggacgattaagttacaaactaataaacggaatacgcaacaaagaaaataataaaacaatccttgacttcctgattgatgatggagacgcaaacagaaacttcatgcaactcattaacgacgactcattgagttttaaaacaactatacaagaagcacaggtagtaggagatgtagatgacatcgaagcagtagtacatgacctgccaggatcaccagcaataaagaaaggtattctccaatcagtaaaaatagtagatgagctagtaaaagttatgggacataatccacaaaacatagtaatagaaatggcaagagaaaatcaaatcacggggtacggacgcaacagaagcaaccaacgcctcaaaagactacaagacagtctaaaagaatttggctcagacatattaagtaaaaagaaaccaagctacgtcgacagcaaagtagaaaattcccacttacaaaatgacagactatttctatactatatacagaacggcaaagacatgtacactggcgaagaactagacatagaccatctcagcgattatgacatagatcacataattccgcaggcttttatcaaagataattcaatcgataatcgtgttttaacgtcgtcagctaaaaatagaggaaaatcagacgacgtcccatcaatagaaattgttcgaaatagaaaatcctattggtacaaattatataaatccggactaatttcaaaacgcaaattcgacaatctaaccaaagcagaacgaggaggtctaactgaaacagacaaagcaggattcataaaacgtcaattagttgaaaccagacaaatcactaaacacgtggcacaaattttagatgcacggtttaatacaaaatgtgacgaaaatgacaaagtgatcagagatgtaaaagttattacactaaaatcctccctagtctcacaattccgtaaagagttcaaattttataaagttagagaaataaacgactaccatcatgcacacgacgcgtacctcaatgctgtggtcggaactgcactactgaagaaatacccaaaactggcaccagaatttgtctacggagaatataagaaatatgacgtaagaaaacttgtagccaaatcatcggacaaccacagcgaactgggaaaagcaacagcgaaatatttcttttactccaacttaatgaacttctttaaaactgaagttaaatatgcagatggacgtgtatttgaaagaccagacatcgaaacaaacgcagatggggaagtggtttggaataaacaacgcgactttaacattgtaagaaaagtcctcagttaccctcaggtaaacattgtaaagaaagtagaagtacaaaccggtggattttcgaaagaatcaatactacccaaaggcgacagcgacaaacttattccaagaaaaacaaagaaattacaatgggaaacacaaaaatatggcggctttgactcaccaactgtcgcatactctgtattagtggttgcagatgtcgagaaaggcaaaactagaaaattgaaaacagtaaaagaattggtcggcatctccataatggagcgaagctcatttgaagaaaacccagtctctttcctcgaaaagaaaggataccacaacgtacaagaagacaaactaataaaactccctaaatattcccttttcgagttcgaaggcggccgcagaagactcttagccagcgccactgaactccagaaaggcaatgaagtagtattaccgcaatacatggtaaacttactatatcattcacaacacgtaaacaattcgcacaaaccagaacacctgaactatgtaaaacaacacaaagatgaatttaaagacatatttaatttaatcataagcattgcacgaatcaacatactaaaaccaaaagttgtagacaatttaataaacgagttcactgaatacggacaagaagatataagcagcctttcagaaagttttataaatctactaaaatttatatcttttggcgccccaggcgcatttaaatttcttaaattggatgtaaaacaatcaaacctacgctacaaatcaacaacagaagccttaagcgccacactcattcaccaaagcgtcaccgggttatatgaaaccagaattgacttaagtaaactcggagaagaatga

SEQ ID NO: 8991 - RNA, 4137 nt, synthetic construct
  misc_feature 1..4137: note = Cas9 variant
  source 1..4137: mol_type = other RNA
atgaaaacctttgcagaagagtatgtaatggataaatcaaaaccctacggaataggcctcgacataggtaccaattcagtagggtttgtagcaacggacgcagaaggacaccttatacgtctaaaaggaaaaaccgtaatcggagcgtatctatttaatgcaggcatatcagctgcggaaagacgcggatttaggacgacaagacggcgattatcacgagtaaaatggcgtcttggccttctaagagaaatatttgaaacacatttccaagaaagcatgggtgaaaacgaggataacgacttctttctgagatttaaatatagtaacatatcaccaaaagatccacaatttagcacagcaaaaggactttttaacgataggacagacaaagagttttatgatcaataccctacaatatatcatttacgccgagcgctaatgacagaagatcaccagttcgatataagagaaatatatattgcaatgcatcacatagtgaaatacagaggacatttcctaaaagaagggagagctaaagattttaaagtaggagatcttagattattagataattttaaaatgatgaatgaacaaatagaagaaataaatccactctggcaattaaaactaccaacagacgacgcgagtatcaaaagcataaccgctattttgctagacaacacgcaaagtcaaaacgatagacaaaaagccgttactaaagttatattagctactttagtcaaagcatcagacaaagacattaacgcagcccgaaaaagattcgtcggagaacttagtaaagcgatggtaggattaaaaacgaaactttgggtattagctgacgtgtcccaaaatggagattgggaaataaaatacgaaaattacgccgattttgctgaaacaataggatcgggagagtccgacaccatacaatctttatttaacgaaatcaacgacctatatggagtaataacccttgctggtataattccaaaagaagctgaatcatttagtgatggtatggtccgaaaatatgagcatcacagaaagaatcttgaattacttaaagtatactgcgcggaacaaagtgacgggaaaagaggaagacaaatacgacaaacctacgacaaatacatagatggagtggatagcaaacaatttacacaagaagatttttacaaagcacttagcaagttcacagcgaaagacgaagcaacaagtgaaaacgcaaaactcatagcacaagaaatcgccgttgggacgtttatgcccaaactgcgtacaaaagcaaatggaacaataccacatcaacttcatcaaaaggaactagacgccataattgaaaatcaaaagaaatattacccctggttaggcgaagtaaacccagtagaatcccacagacgagcacttccatataaactagatgaactcgttagctttagaatcccttactacgtaggtccaatggtaactcctactaaaggagaccccgaaaaatccaaatttgcctggatggtcagaaaagaaccaggaactataacgccctggaactttgaccaaaaagtagatagaagcgcgtcgggagaagcatttattcaacgcatgaaaactacagacacattcctaattggtgaagacgtcttaccccaacaaagtcttctttaccaaaaatttgaagtactaaacgaacttaataaaataatgataaacggaaaaccgatatgtagagaacaaaaacaaaggttatttaagcaactcttcatgcaatataaaacagtaaccgttaagaaagtgcagcaaaacctaattgcaaatggagaagaatcggaaaacgtcccaatcacaggcctaagtgatccgctacgttttaactcatcttttagcacatatatagattacaaagacatacttggaacggctgcagtaaatgataatgcgaaacaaagtgacatagaacaaattatagcttggtcaaccatcttcgaagacgcggcaatctttcgagaaaaattaaatgacataacatggctaaacgatgatcaaagaaacaaactaagtcacaaaagatatcgcggatggggcagacactcaagaaaattacttgctggtcttcgagacggggaaggacaaactataatcgaacgactttggaacacaaacgacaattttatgcaaattcaaaacgacagcgaaatagcgagacaaattactgaagccaactcctcgaaaatggcaactgcagaaggaaccgatgaaataatagatggattttacacaagcccagaaaacaagaaagccctgagggaggtcatgaaagtcgttaaagacatacaacgagcccatcacggacaggctccagcttgggtttacatagaatcaccccgagaaacaccccgacccggtcaaagaactgtgtctagagaacaacaactaaccgatctctatgaaggagctgctaaagagattgttgacgacgctgtcttaaatgagcttaaagataaggtaaaaagcaaagaaaactttacagacaaacttgtcttatacttcctccaaaatggtcacgatatatacgcaaacgatagtataaacatagataatctaaacgcctatgacatagaccacgtactaccacaatcattaattaaggatgatagcctagataatcgagttttaaccacccacgaacgtaacctaaagaaatcaaaccgctttgcaacagaactattcgcagaccaacgaaagaaatgggaaaaatggcacagactaggcctaatttccagccgaaaactcaaacacctaacaatgcaacccaatagcgtcgaaaaatttgcacacggttttatcgctcgtcaacttacggaaactaggcagattatacacttgacagcaaacgtcttaagtaacttataccaagaaaacgatactaaaattgtcatgataaaagcaggactcaattccgagttcagaagaacgtttgattttcctaaaaacagatccgtaaatgactatcaccacgcctttgatgctttcctaaccgccaaaatcggacgatatctactggccagatatccaaaactagaaccattctttgtctatggcaattttgtcaaaaacccaaaagcgatgaagagattatcatcattcgatttcattgcacaattagcagcaaaaaccgatgacacctcacatatagaccaaagatcattaaaacaagtaccagtagtaaatgaagaaacaggagaaatagtatgggataaagacatagaattggcagaattagacaaaacttataattacaaaacaatgcttgtaaaaagagctcaaacagaaaacaatgcccaaatgtttaagcaaacagtttttaaagcaagagataatcaaaacaaaacactgatacctgttaaaaatggactatccacagatgtatatggtggtcacagtcaacaagcaatatcctatctctgcatagtatgggtaggacaaaagaagaaatacagagtccttggaataagtactgcccacgccggtatattaaacaactttgagaaaaactacggaagattcgaagctaaaaagaaactacaggaaatagtttcgaataccttggacaatgctgatagaaatgatttcaaaatagtcgctccaaaagtgttattcgaacaagtagtggaagacgacaacatgaaatttggattaggatccgcgagtgattacagaaatgtacaacaactatttctaagtcgcaaaaaccaacttctattagcaaacatgatgacagaccaaattcacgaccaagatttagtgcacctattcgatgaaatagtcggtcagatgaatgcacatttccctatcttcgacagaggagggtatagatcgtcattaactcaaagtcgagataaatttctaaaactaccatttaagaaaaatgaagacctcatcacaaaacaggaagtaatccgacgaatactagacggtcttcatgcaaacgcaaaccggaaagacctaaaaattataggtagcaaaggagactttgggcgccttggtactaagaaaatatatcttagtaaagatgcgaaactaatatataccagccctacctgtttatttacacgaacagttccattgtcatctttatga

SEQ ID NO: 8992 - RNA, 4137 nt, synthetic construct
  misc_feature 1..4137: note = Cas9 variant
  source 1..4137: mol_type = other RNA
atgacaaatgaaaaatactcaataggccttgacattggaacatcaagtataggcttcgccgtagtcaacgataacaatagagtcatacgtgtcaaaggaaaaaatgctatcggcgtcagattattcgatgaaggaaaagctgccgcggatcgaagatcctttagaacaactagaagacgtttatcaagaagaaggtggagactcaaacttttacgagaaattttcgacgcatatataaccccggtagacgaagcattcttcattaggttaaaagaaagtaatctcagcccaaaagactcaaaaaaacagtactctggagacatactttttaacgacagatccgacaaagatttttatgaaaaatatcctactatatatcacttaagaaatgcattaatgaccgaacacagaaaattcgacgtacgagaaatatacctcgccattcatcacataatgaaatttagaggacattttctaaacgcaactcctgcaaacaacttcaaagtaggaagactaaaccttgaagaaaaatttgaagaattaaatgacatttaccaaagagtttttccagacgaaagtatagaattccggacggataacctcgaacaaattaaagaagtactactagataataaacgatcgcgagcggatagacaaagaacattagtctcagacatataccaaagttccgaagataaggatatcgaaaagagaaacaaagcagtcgcaaccgaaatactaaaagcctcattaggtaataaagcaaaactaaatgtaataaccaacgtagaggtggataaggaagctgcaaaagaatggtctataacatttgattccgaaagtatcgacgacgatctagccaagattgaaggacaaatgacagacgatggccacgaaataattgaagttctgagatcactatactcaggtataaccctttcagctatagtcccagaaaatcacactctaagccagtctatggttgccaagtacgacctacataaagaccatctcaaactgttcaaaaagcttattaacggtatgactgacacaaaaaaagctaagaacctcagagccgcctacgatggttacatagatggcgtaaaaggaaaagtactaccacaggaggacttctataaacaagtacaagttaacctagatgactccgcagaagcaaatgaaatacagacatacatcgatcaagacatcttcatgccaaaacaacgaacaaaagctaatggatctataccacaccagttacaacaacaagaactagatcaaataatagaaaaccaaaaagcatactatccttggctcgcagaactaaacccaaatcctgacaaaaaaagacaacaattagccaaatataaactagacgaactagtcacttttagagtaccgtattacgtaggcccaatgatcactgcaaaagaccaaaaaaatcaatcaggagcagaattcgcttggatgataagaaaagaacctggtaacataacaccatggaatttcgaccagaaagtagatagaatggcaactgcaaatcagtttataaaaagaatgaccacaacagatacatacctactgggagaggacgtactgcccgctcaatcattattgtatcaaaaatttgaagttttaaatgagctcaataaaatccgaatcgaccacaaacctatctccatagaacaaaaacaacagatatttaatgatttatttaaacaatttaaaaatgtaacgattaaacatttgcaagactatttagtaagtcaaggacaatatagtaaaagaccactaattgaaggattagcggacgaaaaaagatttaactcttcactgtccacctattcagatttatgtggaatcttcggtgctaaactggtagaagaaaacgaccggcaagaagacctagaaaaaatcatagaatggtcaactatattcgaagacaaaaaaatatatagagcaaaactaaacgatctaacatggttaacagatgatcaaaaagaaaaattagcaacaaaacgataccaaggctggggaagattatctagaaaattactagtaggtctaaaaaacagtgaacatcgcaacattatggacatactatggattacgaacgaaaactttatgcaaatccaagcagaacccgattttgcaaaactggttacggacgcaaataaaggaatgctagaaaaaaccgattcacaggatgtcatcaacgacctttacacgagcccacaaaataaaaaagctatacgacaaatactactggttgtccacgacatacaaaatgccatgcacggccaggcccccgcaaaaatccatgtcgaattcgcaagaggagaggagcgaaacccaagaagatcagttcaaagacagcgacaagtagaagccgcatatgagaaagtaagcaacgaactcgtatcggctaaagttagacaagaattcaaagaagcaataaataacaaacgcgatttcaaagaccgactactactatattttatgcaaggtggcatagatatttacaccggtaaacaattgaacatagatcaactctctagctaccaaatagatcacatactaccacaagcatttgttaaggacgactccttaacgaatcgcgttctaactaatgaaaatcaagtaaaggcagatagcgtgcctatagatattttcggaaagaaaatgctgtctgtatggggacgaatgaaagaccagggattaatctcaaaaggcaaatataggaacctaaccatgaaccccgaaaatatatccgctcatacagaaaacggtttcattaatcgacaactcgtggaaactcgacaagtcattaaactcgccgttaacatcttagcggacgaatacggagactccactcaaataatctcagtcaaagccgacttatcacatcaaatgagagaagacttcgaactactgaaaaacagggacgttaacgactatcaccacgcattcgatgcatacctagcagcgtttataggtaactacctattaaaacgttacccaaagcttgaaagctatttcgtttacggtgatttcaaaaaatttacacagaaagaaacaaaaatgcgccgcttcaacttcatctacgatctaaaacattgtgatcaagtagttaataaggagactggcgaaatactatggacaaaagacgaggatataaaatacatcagacacttattcgcttataaaaaaattttagtatcacacgaagttcgagaaaaaagaggagcgttatacaatcaaacaatttataaggcaaaagacgataaaggctccggacaaggatccaaaaaattaattagaataaaagatgataaagaaactaagatttacggaggatacagcggcaaatctctagcctacatgaccattgtccaaattaccaaaaaaaacaaagtgtcgtatagggtaataggcataccaacacttgcactagccagactaaataaattagagaatgattctactgaaaacaacggggaactatataaaataattaagccacaattcacacactataaagtggacaagaagaacggcgaaataatagagactaccgacgatttcaaaatcgtagtgtcgaaagtacgattccaacaactcatcgacgatgcgggacaatttttcatgctagcatccgacacgtataaaaataatgcacaacagctagtaatatcaaataatgcattaaaagccatcaacaatactaacattacagattgtccgcgagacgatttagaaagactagacaacctaagactggactcagcattcgacgaaattgtaaaaaaaatggacaaatatttctctgcctatgatgcaaacaatttccgtgagaaaattagaaactcgaacttaatcttctaccaactaccagtagaagaccaatgggaaaataacaaaatcacagaattaggaaaaagaacagtactcaccagaatactccaaggcttacatgccaacgcaactacaactgacatgagcatattcaaaataaaaactccttttggacaactacgccaacgaagcggcatatcattatcagaaaacgcccaattaatctaccagtcccccacaggattgttcgagcggagagtacaactaaataaaattaaatga

SEQ ID NO: 8993 - RNA, 4137 nt, synthetic construct
  misc_feature 1..4137: note = Cas9 variant
  source 1..4137: mol_type = other RNA
atgaaaaacaaggattattcaataggactagacattggcacttccagcataggctttgccgtcgtagacgaaaataaccatgtaatgcgagtaaaaggaaaaaacgcgataggcgtaagacttttcgacgaaggaaaaccagcagccgacagacgagctttcaggacaacaagaagaagactatcgcgacgccggtggagactaaaactattaagagaaatttttgacagctacataacaccagtcgatgaagcattcttcataagacttaaggagtcgaatttatcacccaaggactctaaaaaacagtatagtggagacatcctattcaacgatagatcagacaaagatttctacacaaaataccctacgatataccatctcaggaatgcccttatgactgagcaccaaagattcgatatccgggaaatctacctagccattcaccatatagttaaattccgcggccatttcctgaatgcaacacccgctaacaacttccaggtaggaaaactagatttagaccaaaaatttgaagatttaaatgacatttatcaaagggtcttccccgatgattcaatcgaattcagaatagataatcttgaacaaatcaaagcagtactcctagacagcaaaagatctcggagcgaccgacaaagatcgcttgtagacgacgtgtaccaaacaagcgaagacaaagaggttgaaaaacaaaataaagcggttgcaacggaagtactcaaagccattctaggcaataaagcaaaactaaacatcatcgcaaacgtcgaagtagacaaagaagctgctaaagaatggacaatcacctttgacagcgaaagcatagatgatgatttagccaaaatagatggacaaatgaccgacgatggacgagctattgtagaaatacttcgttcattatactctggaatcacactaagcgctatagtaccagaaaaccacaccctgtcacaagccatggtagcaaaatatgatctacacaagaaacacctcacattactaaagaagctaatcaactcgatgacagatacaaaaaaagcaaaaaacttaagggcagcatacgacggctatgtagatggagtcaagggcaaggtactcacgcaagatgagttctacaaacaaatacaatcaaatctagacgaatcagttgaagccagtgaaatacaaacatacattgaccaagatatcttcatgccgaaacagcgcacaaaagctaacggttcaatcccacaccaattacaacaacaagagctagatcaaatcatagagaaccagaaagaatattatccatggctagcagaattaaatccaaacccagataaaaaaagacaacaactagctaagtataagctcgacgaactagtaaccttcagagtaccatactatgttggaccaatgatcaccgcagaagctcaaaaaaaacagagtggagcagaattcgcctggatgatacgaaaagaatctggcaacataacaccatggaacttcgatcaaaaagtagaccggatggcaactgcaaaccaatttataaaaagaatgaccactacagacacgtatttattaggtgaagatgtattaccatcccaatcactattgtaccaaagatttgaagttttaaacgaactaaataaaatacgaatagacaggaaaccgatatcggttgaacttaaacagcagattttcaacgatcttttcaaaaaatttaaaaatgtcacgataaaacatctacaagactacctagttgcccagggacaatactcgaaaagaccacttatagaaggacttgcagacgaaaaaaggtttaactcagggctatcaacatacaacgatttctgcggaatattcggcgcgaaattagttgacgagaatgacagacaggcagacctagaaaaaataatcgaatggtctacaatatttgaagataaaaagatctacagggcaaaattgaacgatttagcttggcttacagatgaacaaaaagataaattagccaccaaaagatatcagggatggggaagactctccagtaaactacttattggactccaaaactcagagcatcgaaacataatggatcttttatggattggcaacgaaaacttcatgcaaattcaagcagatagcgatttcgccaaattaataaaagacgccaaccaaaacgcactacaaaacaacgattctcaagatgtcattaatgatttatatacaagcccccaaaacaaaaaggcaattagacaaatcttactagtagtccatgacattcaaaatgcaatgcatggtcaagcacccactaaaatacatgtagaatttgccaagggtgaagaaagaaacccaagacgatcagtacaaagacaacgacaagtcgaagccgcttacgagaaagcaagtaacgaattggtaggagcaaacgtaagagaagaattaaaagacgcaattactaataaacgcgatttcaaggatcgtttatttctatatttcatgcaaggaggtgtcgatatgtattctggcgaaccaataaacatagataacttatcacgatacgatatagaccacatattacctcaagccttcgtcaaagacgactcattaaacaaccgagtgttaaccgacgcagaaaaaaatcgtagaaaatctgacgcagtacctaatgaactcttcggagcgaaaatgcgagtcacatgggaaagaatgaaagaacaaggactaataagcaaaggaaaatacagaaaccttaccatgaatccagaaaatataaacaaatatacagaaaacgggttcatcaaccgacaactcgtagaaacaagacaagtcataaaactggccgttaatatattagcagacgagtataaagaaaatacgcaaataatctcagtaaaagcagatctatcccaccaaatgagagaagattttgaactcctaaaaaatcgtgacgtaaacgattatcatcacgcttttgacgcttatttagcagcgtttatgggtaattacttattaaaaagataccctaaattaaggagctacttcgtatacggagattttaaaaaatttacacaaaaagagattaaattacgacgatttaatttcatatacgatctaaaacatgaagatcaagtaatcgataaagaaacaggtgagatactctggaacaaaaatgaagacatagcatacattagacatctatttgcgtacaagaagatattaatatcacacgaagtctcagaaagacgaggagcactatataatcaaacagtgtacaaagcttccgacgataaagccagtggccaaggcagtaaaaaattaatccccataaaatctgataaacccacagaaatatatggtggctacacaggaagaacccttgcttacatgacaatcgtcaaagtaaccaaaggcaaaaaaatatcatacaaagtagttggagtccctaccgcggtcctagcaaaaatggctggtgttagacaaggatcccaagaagaacaagataaactctatggcgtacttaaacctcaattcacacaccaaaaagaaaacaaaaaaacaggagaaataactgaaacggtagacaaattcgacatcatagttccaaaagtaaaatatcaacaattagtcaacgataatggccaacttttcatgatcggatcagacactctgccatacaatgctgaacaattagtcctcagtaaggaatcagttcaaacaataaacaatcccggaatcaaagacgaaggctcggacgaagaatcagaaaacaaaaaactagacaacgtatacgacgaaattgtgctatgtatgaacaaatatttccccctatacgataatagaggcttcagaaattcaataacgaacggaaaaaataaatttttaaaacttcccataaaaaacatttataagaacggaaaactcatcaatgtaggaaaaagggaagtaataaacagaatacttcaaggcttacatgcaaatgcgtcagtgacagacctttcgaatcttggcatcaaaagcccatttggttttctacaaaaaggagccggattaagtctttcaggagaagcacagttaatccatcaaagtgcaacaggtttattcgaacatagagttcagctaaataaaatcaaatga

SEQ ID NO: 8994 - RNA, 4137 nt, synthetic construct
  misc_feature 1..4137: note = Cas9 variant
  source 1..4137: mol_type = other RNA
atgagcaataaaccatactcaataggactggacatagggacaaactccgtaggttgggctgttattaccgatgactataaagtaccatctaagaaaatgaaagtactgggaaatacagataaacattttattaagaaaaatctgataggagcactattgttcgacgaagggaccaccgcagaagggagaagactgaaaagaactgcaagaagaagatacacaagaaggaaaaacagattacgatacctacaagaaatattctctgaagaaataagcaaagtggactcatcatttttccatcgtctagacgatagctttttagtaccagaagataaaagagggtccaaatatccaatattcgcaaccctagcagaagaaaaagaataccataaaaactttcccacgatataccatctaagaaaacaactagctgattcgaaagaaaaagctgaccttcgcctaatataccttgcattagctcatatgatgaaatatagaggtcactttctatatgaagaaagtttcgatattaaaaataatgacatacagaaaatattcaatgaatttatttccatatacgacaacacttttgaaggatcctcactgtcagaacaaaacgtacaagtagaagccatatttactgataaaattagtaaatcggcaaaacgagaaagagtgctaaaattgttcccagacgaaaagtctacaggattattcagcgagttcttaaaactcattgtaggcaatcaagcagaatttaagaaacactttgatttagaagaaaaagccccactacaattttctaaagacacatatgacgaagatctcgaaaacttactaggacaaataggcgatggattcgccgacctatttttagtagcaaagaaattatatgacgcaatactgctatcaggaatactaaccgtaacagacccatctaccaaagcacccttatctgcaagcatgatagaacggtatgaaaaccaccaaaaagatttagctagtctcaaacaatttatcaaaaacaatctaccagcggaaaaatgcgtagaagtatttagtgaccaaagtaaagacggatatgcaggttacatagacggaaaaacaactcaagaagcattttataaatacattaaaaatcttctatctaaactggagggcgcgtattactttttagataaaattgaaagagaggacttcttaagaaaacagagaacttttgataatggctcgatcccacatcaaatacacctacaagaaatgaacgctatactccgacgacaaggagaacattaccccttcctaaaagaaaatagagagaaaatagagaaaattctaacatttaggataccatatcatgttgggcccttagcaagaggaaaccgagactttgcatggcttacaagaaattcagatgaagctatcagaccatggaacttcgaagaaattgtcgaccaagcaagctccgccgaagactttataaacaaaatgacaaactacgacttatacttacccgaagaaaaagtactacccaaacattcacttttatatgaaaccttcgcagtatataacgaactgaccaaagtcaaattcatagcagaaggtcttacccgataccaattcctagataagaaacaaaagaaagacattttctatacctttttcaaagcagaagacaaaaggaaagtcaccgaaaaagacataatacactatttacacaacgtagacggatacgacgggatagaactgaaaggtatagaaaaacaattcaatgcaagcctctcaacataccacgatttactaaaaataataaaagataaagagttcatggatgaccccaaaaatgaagaaatactagaaaacatagtacacaccctcaccattttcgaagacagagaaatgataaaacaaagactggcgcaatacgattcattgttcgacgagaaagttataaaagcgttaacccgacgccactacacaggatggggaaaactatcggctaaactaataaatggtatctgcgacaaacaaacaggaaaaacaatcctagattatttaatagacgatggcaaaataaacagaaacttcatgcaattaattaatgacgatggactctcatttaaagaaatcatacaaaaagctcaagtagtaggtaaaacctatgacgtaaaacaagtagtacaggaactaccaggatcgccggctattaagaaaggcatcttacagtccgtaaaacttgtcgatgaacttgttaaagtcatggggcacgcaccggaatcaattgtcatagaaatggcgagggaaaaccagaccacagcaaaaggcaagaaaaactcacaacaaagatataaacgaatagaggatgccatcaaaaacctagctcctggtctcgactctacaatactgaaagaacatccaacagacaatattcaattacaaaacgatcgtttattcttatactatttacaaaacgggagggatatgtacactggaaaaccacttgaaataaaccagctatcgaactatgacattgaccacataatcccacaagcattcattaaagatgactcgctagacaatagagtactaacaagtagtaaagaaaacagaggaaaatcagacaacgtcccctcgctagaagttgtcgagaaaatgaaagccttttggcaacaactacttgatagcaaactgatcagtgaaagaaaattcaacaatctaacaaaagcagagcgaggaggactcgacgaactcgataaagttggattcattaaacgtcaactggtggaaactagacaaataacgaaacatgtcgcacagatattagatgcccgatttaacaaagaagtcacggagaaaaacaagaaaaaccgaaacgtcaaaataattacactgaaaagtaacatggtcagcaattttcgtaaagagttcggcttatacaaagtccgagagataaatgactaccatcatgcacacgatgcctacttaaatgcagtagtagcaaaagctatcctcaagaaatacccaaaactagaacctgagttcgtctacggagattatcaaaaatacgatttaaaacgttacatatctaaatcaaaagatcccaaagaagtagagaaagccactgagaaatactttttctattcgaatttactcaatttcttcaaagaagaagtacattatgccgatgggacaatagtgaaaagagaaaacatagaatacagtaaagacacaggtgaaatagcgtggaacaaagagaaagactttgctacaatcaagaaagttttatcattcccacaagtaaacatagtcaagaaaactgaagaacaaacagtaggacagaacggaggcttattcgataacaatattgtaagtaaagaaaaagtagttgacgcaagcaaattaatacctataaaaagcgggttatcaccggaaaaatatgggggctatgcaagaccgaccatagcgtactctgtcctagtaacatacaaacaaaacaacaaaatcaaaaataccatggtaggaatacccgtgctaactaaactcgagttcgaaagagacccaaatctatacttacgcaatttaggaataaataacgtatcccatgttataaaactcgtaaaacatacagtattagaatttaaacataaatatggaacatacagaagattcatcgtatcaaaccaagaacttaaacgggctaaccaaatatttgtgaccaccaaacagatgaaattaatatcacaatataccacattagataaaaatgagcatgactccttacttaaaaataaccaacaactaattcaaagtatctggaatcaattcctagaatttatgctagcaaccgatctagtcaacaagaaacaatacgacgaactaatactaacaaacaatcaaaccatagaagaatgtaggaatataatgaacagggtcataactactctatcatttactaacattaatgccggacagaaaaagattatatttgacgataccctaagcctaccaataaaaagatggcaattcaccgatagcgacaaaatggtcaagaaaataatagaatctactttaatacatcaatctataactggtttatatgaaacacggatagacttaaacaaacttggagaagactga

SEQ ID NO: 8995 - RNA, 4137 nt, synthetic construct
  misc_feature 1..4137: note = Cas9 variant
  source 1..4137: mol_type = other RNA
atgaacaagccgtattccattggcttagatataggaacaaacagtgtaggatggtcgataataacagatgactataaagtaccagccaaaaaaatgagagtgctaggcaacacagataaagaatacattaaaaagaatctgataggagctctcctattcgacgggggaaatactgccgccgatagaagacttaaaaggacggctagaagacgctacacacgaaggcgaaataggatattatacctccaagaaattttcgcagaagaaatgagcaaagtagacgacagctttttccatcgactggaagatagttttctagtagaagaagataaacgaggaagcaaataccctatcttcgcaacgatgcaagaagaaaaatattaccatgaaaaattcccaacgatctatcatctaagaaaggaattagcagacaaaaaagagaaagcagatttaaggctaatatatctcgcattagcccatatcataaaattcagaggccatttcttgattgaagatgacaggtttgatgtacgaaacacagacattcaaaagcaataccaagctttcttagaaatatttgatacaacatttgaaaataacgacttattaagtcaaaacgtagatgttgaggccatactaacagacaaaatatcgaaatctgcaaagaaagacagaatactagcgagatatccaaatcaaaaaagcacgggtatatttgcagaattcttaaagttaatagtaggcaatcaagcagattttaaaaaacacttcaacctagaagacaaaacaccactccagttcgccaaggacagttatgatgaagacttggaaaacttactaggacaaataggcgatgaatttgcagatttatttagcgctgctaaaaagttgtacgatagcgtgttactatcaggcatattaacagtaatagacctctcaaccaaagcccctttaagcgccagcatgattcagagatatgacgaacatcatgaagacctaaaacacttaaaacaatttgtgaaagcaagtctacccgaaaattacagagaagtttttgcagattcaagcaaagatggatatgcaggttacatagaaggaaaaacatcacaggaggcattctacaaatatctattaaagttactaaccaaacaagaaggatcagaatacttactggaaaaaattaaaaacgaagacttcctacgtaagcaacgaactttcgataacggcagcataccgcaccaagtacacctaacggaattaagagctataatacgcagacaatcagaatactatccatttctaaaagaaaatttggatcgaatcgaaaaaatattaacattccgaataccatattacgtaggacccctagccagggaaaagagcgatttcgcgtggatgacaagaaaaacggacgatagcatcagaccatggaattttgaggacctagttgataaagaaaaatcggcggaagcatttatccacaggatgacaaataatgacctctacttaccagaagaaaaagttctcccaaaacattcattaatatacgagaaatttaccgtatacaacgaactaacaaaagtaagattcctagcggaaggcttcaaagacttccagttccttaacagaaaacaaaaagaaacaatatttaacagtctctttaaagagaagagaaaagtaacagagaaagatatcatctctttcctaaataaagtagatggatatgagggtatagcgataaaaggaatagaaaagcaattcaatgcgtcactttcaacatatcatgacctcaaaaaaatactcgggaaagacttcctcgacaacaccgacaatgaacttatactagaagatataattcaaacattgactttattcgaggaccgagaaatgatcaaaaaacgattagatatttacaaagacttttttacagaatctcaactaaaaaaattatacaggagacactacaccggatggggaagattatccgcaaaattaattaatggaataagaaacaaagaaaaccaaaaaactatattagactacctcatagatgatggatccgcaaacaggaactttatgcaattaataaaagatgccggcttatcgttcaaaccgatcatagataaagcgagaacaggatcccactctgacaacttgaaagaagtcgtaggagaattagccggaagtccagccataaaaaaaggaattcttcaatcactgaaaatagtagacgaattggtcaaagtaatgggttacgaaccagaacaaatagtggtagaaatggctcgcgaaaaccaaacaacagcaaaaggactatcaagatcacgacaacgactgaccaccctaagagaaagcttaggtaacctaaagagtaatatattagaagaaaagaaaccaaaatatgtcaaggatcaagtggaaaatcaccacctgtcagacgaccgattgttcctgtactacctgcaaaacggaaaagatatgtacacggacgatgaactagatatagacaacttatcacagtatgatatagaccatataataccacaagccttcatcaaagacgattctatcgataatagagttctagtaagcagcgcaaaaaacagaggaaaatcagatgacgtaccctcaatagaaatagtaaaagcaaggaaaatgttttggaagaatctcctcgacgccaagttaatgtcacagaggaaatatgacaatttaacaaaagcggaacgaggaggcctaactagtgatgataaagcacgattcatacaaagacaacttgtcgaaacaaggcagataacgaaacatgtcgcacgcatacttgatgaaagatttaacaatgaattggactcaaaaggcaggagaattagaaaagtaaaaattgtaacattaaaaagtaacttagtttcaaactttcgaaaagaatttggtttttacaaaataagagaagtaaacaattatcaccacgcacatgacgcatatttaaatgcggtagtagcaaaggccattctgacaaaatatccacagctcgaacctgaatttgtatacggattatatcgaagaaaaaaactttcaaaaatagtccgagaagacaaagaagaaaaatactccgaagcaacacgtaaaatgtttttttatagcaatcttatgaacatgttcaaaagagtggtaagactagctgatggtagcatagtcgtaagacctgtcatagaaacaggacgttacatgggcaaaacagcatgggacaaaaaaaaacatttcgctacagttagaaaagtactatcataccctcaaaataacatagttaaaaaaactgaaatacaaacaggaggtttttcaaaagagtcaatattggcgcacggaaatagtgataaattaatcccaagaaagacaaaagacatatatttagatcccaaaaaatacggaggcttcgatagcccaatcgtagcatactccgttctagtagtagccgacataaaaaagggtaaagcccaaaaattaaaaacagtaacagaattactaggaataactatcatggaaagaagccgatttgagaaaaacacatcagctttcttagaaagcaagggatacttaaacattcgtgatgataaactaatgattctccccaaatactccttattcgaacttgaaaacggacgcaggcgcctactggccagtgcaggtgaactacaaaaaggtaacgaattagccctcccaacacaatttatgaaatttctgtacctagcaagtagatataacgaatcaaagggaaagcccgaggaaatagaaaaaaaacaagaatttgtaaaccagcatgtgtcttatttcgatgacatattacaattaatcaatgactttagtaatcgcgtgatcctagcagacgcaaacttggaaaaaataaacaagctatatcaagacaataaagaaaacataccagtagacgaattagcaaacaatataataaatttattcactttcactagcttaggagcaccagcagcattcaaattttttgacaaaatagtagaccgaaaaagatatactagcacaaaagaagtattgaatagcacgctaatccaccagtcaataacagggctatatgaaacccgcattgatctaggaaaattaggggaaggttga

SEQ ID NO: 8996 - RNA, 4137 nt, synthetic construct
  misc_feature 1..4137: note = Cas9 variant
  source 1..4137: mol_type = other RNA
atgacaaacgaaaaatatagcatcggtctcgatataggaacaagttctattggcttcgcggtagtaaacgacaacaaccgcgtcataagggtcaaaggcaaaaatgcgataggagttcgcctatttgatgaaggaaaagctgccgcagatagaagaagttttcgtactactagaaggagactcagccgaagaagatggagactcaaactattacgagaaatcttcgatgcatacataactcctgtagacgaagcatttttcattcgcctaaaagaatcaaacttatcaccaaaagattcgaaaaagcaatattcaggagacatcctattcaatgacagatcagataaagacttctacgaaaaatatcctacaatctatcatctacgaaatgcactaatgacagaacacagaaaattcgacgtaagggaaatatacctagcgatccaccatatcatgaaatttagggggcatttcctaaacgcaacgccggcgaataattttaaggtagggagattaaacctagaagaaaaatttgaagaactgaatgatatataccaacgagtatttccagatgaatcaatagaatttagaacagacaatttagaacaaataaaagaagtattactagataacaaaagaagtcgagccgatcgtcaaagaacgttagtatctgacatataccaaagcagcgaagataaagatatcgagaaaagaaacaaagctgttgcaacagaaatactaaaggcatcccttggaaacaaagccaaacttaacgttataaccaacgtagaagttgataaagaagcagcaaaagaatggtctattacattcgacagtgaaagcatagacgacgacctcgccaaaatcgaaggacaaatgaccgatgacggacatgaaataatagaagtcttgcgatctctttatagtggcataacactatcagcaatagtacctgaaaaccatactttatcacagtctatggtagctaaatacgatttacacaaagatcacctaaagttgttcaagaaactaataaacggtatgactgatacaaagaaagctaaaaacttacgagcggcttacgacggatatatagacggcgtgaaaggaaaagtactaccacaagaagacttctataaacaagttcaagtcaacctcgacgacagtgcagaggcgaacgaaatccaaacatatattgaccaagatatattcatgccgaaacaacgtactaaggccaacggcagcatacctcaccaactacagcaacaggaactagaccaaataatagaaaaccaaaaagcatattatccttggctagcagaacttaatcccaatccagataagaaaaggcagcagttagctaaatacaaattagatgaactcgtaacctttagagtaccttactacgttgggccaatgataaccgctaaagatcagaaaaatcaatccggcgcggagttcgcttggatgattagaaaggaaccaggaaatatcacaccatggaatttcgatcaaaaagtcgatcgaatggcaacggctaatcaattcataaaaagaatgactacaacagacacatatctcctcggtgaagacgtgctcccagcacaaagcctattatatcaaaaattcgaagtgttaaatgaactaaacaaaatcagaatagatcacaaacccatcagcatagaacaaaaacaacaaatatttaacgacctattcaaacaattcaaaaatgtaaccataaaacatctacaagattatctagtcagccaaggccaatactcaaaacgtccgctcatcgaagggttggcagatgagaaaagatttaattccagtttatccacatactcagatctatgtggaatatttggggcgaagctagtcgaagaaaacgatcggcaagaagatttagagaaaataattgaatggtcaacaatctttgaagataagaaaatatatagagctaaattaaatgacctaacttggctcacggatgaccaaaaagaaaaattagctaccaaacgatatcaggggtggggacgattatcaaggaaattattagtgggactcaaaaactccgaacacagaaacataatggacatactatggataacaaatgaaaactttatgcaaatccaagcagaacctgacttcgctaagctagtaaccgatgctaataaaggtatgctagagaaaacggactcacaagatgtaataaacgatctatacacatctcctcaaaataagaaagccatacgtcaaatattgcttgttgttcacgatatacaaaatgcaatgcacggacaagctcccgccaaaatacatgttgaatttgccagaggagaagaaagaaacccacgaagaagtgttcaaagacaacgacaagtagaagcggcctacgaaaaagtatcgaacgaactggtatctgctaaagtaagacaagagttcaaagaagcaattaataacaaaagagatttcaaagacagattgttcctctatttcatgcaaggtggaatagacatttacacaggaaaacaattaaacatagaccaactatccagctatcaaatagaccacatcctgccacaagccttcgtaaaagacgattctttgacaaaccgcgtattaacaaacgaaaatcaagttaaagctgattctgtaccaatagatatttttgggaagaaaatgttaagtgtttggggaagaatgaaagatcaaggactaatctctaaaggaaaataccgaaacctaaccatgaacccggaaaacatttcagcacacacagaaaatggattcataaacagacaattagttgaaactaggcaagtaattaaactcgcagtcaacatattagccgatgaatacggagattccacacaaattatttcagtaaaagctgacctatcacatcaaatgcgagaagatttcgagctccttaaaaatagggacgtcaatgactaccaccacgcattcgacgcctatctagcagcatttataggaaattatttattaaaaaggtacccaaaattagaatcatattttgtttatggcgacttcaagaaattcacacagaaagagacgaaaatgcgtcgattcaacttcatctacgatctaaaacactgcgatcaagttgtaaacaaagaaacaggtgaaatactatggacgaaagacgaggacataaaatatataagacatagtttcgcatataagaaaatcttagtctctcacgaagtccgagaaaaacgaggagcattatacaaccaaactatttataaagctaaagatgataaaggatctggtcaaggctccaagaaattaataagaataaaagatgataaagaaacaaaaatttacggcggctacagtggtaaatcactcgcttacatgaccatcgtacagattacaaagaaaaacaaagtctcctacagagtaatcggtataccaacactcgccctagcaagactcaataaactagaaaacgacagcacagaaaacaatggagaactctacaaaattataaaaccacaatttacacattacaaagtagataagaaaaatggagaaatcatagaaacaaccgacgatttcaaaatagtagttagtaaagtaagatttcaacaattaatagacgacgctggacaatttttcatgctagcatcagatacatacaaaaacaacgcccaacaattagttatatccaataacgcactaaaagcgataaacaatacaaacataactgattgcccgagagatgacttagaacgtttagataatctaagactcgactcagcattcgacgaaatagtcaagaaaatggataaatatttttcagcatacgacgcaaacaacttccgagagaaaattagaaattcaaacctaatattttatcaactaccagtagaagaccaatgggaaaataataaaataactgaattggggaaaagaacagtactaactagaatactacaaggtttacacgcaaacgcgaccactacagacatgtcgatatttaaaattaaaacaccatttggtcaattaagacagcggagtggtatttcactaagcgaaaacgcccaacttatttatcaaagtccaacaggattatttgagaggagggtacaattaaataagataaaatga

SEQ ID NO: 8997 - RNA, 4137 nt, synthetic construct
  misc_feature 1..4137: note = Cas9 variant
  source 1..4137: mol_type = other RNA
atgactaacgaaaaatactcaattggattggatatcggaacaagttcaattggatttgcagtagtaaatgacaataatcgcgttatacgggtcaaaggcaaaaacgctatcggagttaggctattcgacgaaggaaaagcagcagcagaccgaagatcgttcaggacaacaaggagaagattatcccgccgacgctggagacttaaattattgcgagaaatattcgatgcatacatcacccccgtcgacgaggctttctttataagactaaaagaaagtaatttatctcccaaagattcaaagaaacaatattcaggagatatactatttaacgatagatccgataaagacttttatgaaaaatatccaacaatctatcacctacgaaacgctctaatgaccgaacatcgcaaatttgatgtaagagaaatctatttagcaatacatcatataatgaaattcagaggtcatttcctaaatgcaacaccagcaaataactttaaagttggacgattgaacttagaagaaaaatttgaagaactaaacgacatataccaacgtgtttttccagacgaaagcatagaatttagaacagataacctagaacaaataaaagaagtcctactagacaataaacgatcgcgcgccgacagacaaagaaccttagtctcagatatatatcaaagttcagaagacaaagacattgagaaaaggaacaaagcagtagccacagaaatcttaaaagcgtccctggggaacaaagcaaaactaaatgtgataacaaacgtagaagtcgacaaagaagctgcaaaagaatggagcataaccttcgacagcgaatcaatagatgatgatcttgcaaaaatagaaggacagatgaccgacgacggacatgaaatcatagaagtattgcgtagcttatattccggtataacgttatccgcaatagtgccagaaaatcacacgctaagtcaatccatggtagctaaatatgacttgcacaaagatcatttaaaattattcaagaaattaataaacggaatgaccgacactaagaaagccaaaaacctacgagcagcgtatgatggttacatagatggagtgaaaggaaaagtactaccccaggaagatttttacaaacaagttcaagtgaatttagacgattccgctgaagcgaacgaaatccaaacatatatagaccaagatatttttatgccaaaacaacgtacaaaagcaaatggctcaattccacaccaactacaacaacaggaattagatcaaatcattgaaaaccaaaaagcgtactacccatggttagctgaactaaatccaaatccagacaagaaaagacaacaactagctaaatacaaattagatgagttagtaacctttagagtaccatactacgtaggcccaatgatcaccgcaaaagaccagaaaaatcaaagtggagcagagttcgcatggatgataagaaaagaacccggcaacataaccccatggaatttcgaccaaaaagtagacagaatggctacagcaaaccaattcatcaaacgcatgacaacaacagatacttatctactcggtgaagatgtacttccggcacaatcccttctctaccaaaaattcgaagtactaaacgaattaaacaaaatacgaatcgaccacaaacctatctcgattgagcaaaaacagcagatattcaacgatttatttaaacaattcaaaaacgtaacaataaaacatcttcaagattatctagtatcacagggtcaatactccaaaaggccattaatagaagggctagcagatgagaaaagattcaactcatcactaagcacctattcagacctctgtggaatttttggagcaaaattagtagaggaaaacgatcgtcaagaagacctagagaaaataatagaatggagtaccatttttgaagataagaaaatatatagagcaaaactcaacgatctcacttggcttacagacgaccaaaaagaaaaattagcaacaaaacgctaccaaggctggggaaggctatcgagaaaattattagtaggactcaaaaactcagaacacagaaatataatggacattctatggataactaatgaaaacttcatgcagatccaagctgagccagatttcgcaaaattagtgacagatgcaaacaaaggaatgctcgagaaaacagactcacaagacgttatcaatgacctatacaccagtccccagaacaagaaagctataaggcaaatacttttagtagtacatgatattcaaaacgcaatgcatggtcaagccccagcaaaaattcacgtagagttcgccaggggagaggaaagaaatcctagaagatctgtgcaaagacaaagacaagtagaagcagcgtatgaaaaagtaagcaatgaattggtatcagctaaagttagacaagaatttaaagaagcaataaacaataaaagagactttaaagatagactattcctatactttatgcaaggcgggatagacatatacacaggcaagcaactcaatattgatcaactgtccagctatcagatagaccacatactcccacaggcatttgtcaaagatgacagcctaactaaccgcgttttaacaaatgaaaatcaagtcaaagcagacagcgttcccatagacatattcggtaagaaaatgttatctgtatggggaagaatgaaagatcagggactcatatcaaaaggcaagtacagaaacttaacaatgaacccagaaaacatcagcgcacatacagagaacggtttcataaatcgacaattagtagagacaagacaagtaatcaagctagctgtaaacatactcgccgatgaatacggagatagtacgcaaatcatatctgtaaaagctgatttgtcacaccagatgagagaagatttcgaactcctgaaaaatcgagacgtaaatgattatcatcatgctttcgatgcatatctagctgctttcattggaaattatttgttaaaacgttatcctaaactcgaatcctattttgtttacggagatttcaagaaatttacgcaaaaagaaacaaaaatgaggaggttcaatttcatttacgatctaaaacactgtgatcaagtggttaataaagagacaggggaaatactctggacaaaagacgaagatatcaaatatattagacacctcttcgcgtataagaaaatcttagtatctcacgaagtcagagaaaagcgaggggctttgtacaaccaaacaatatataaagccaaagatgacaaaggaagcggtcaaggcagcaagaaattaataagaattaaagacgacaaagaaacaaaaatttacggaggttactctggaaaaagcctagcatacatgacaatagttcaaataaccaagaaaaacaaagtatcttatagggtaataggcataccaactctagcattagcaaggctaaataaacttgaaaatgacagtacagaaaataacggcgaattatataaaataatcaaaccacagttcactcattacaaagttgacaagaaaaatggtgaaataatcgaaactactgacgacttcaaaattgtagtatccaaagttagattccaacaactaatagacgatgcaggccaatttttcatgttagcaagtgacacgtacaaaaataatgctcaacagctagtaatatccaataacgccctcaaagcaataaataacactaatataacagattgcccaagagacgacctagaaagattagacaatctacgattggactccgcattcgatgaaatagtcaagaaaatggataaatacttttctgcatacgatgccaataatttccgagagaaaataagaaattcaaacctaatattctaccaattaccagtagaagaccagtgggagaataataaaataaccgaactcggaaaaaggacagtattaacccgcatactacaaggactacacgcaaacgcaacaactacagatatgtcaatctttaagataaagactccattcggacaattaagacaaaggtcaggaataagtctatcagaaaacgcacaattaatctaccaatcgcccaccggcctcttcgagcggcgcgtacagctcaacaaaatcaaatga

SEQ ID NO: 8998 - RNA, 4140 nt, synthetic construct
  misc_feature 1..4140: note = Cas9 variant
  source 1..4140: mol_type = other RNA
atgaaacaaatattaggtctcgacctagggacaaccagcataggatgggcattagttagagaagcagaaaacaaagacgaacagagctcaatagtcaggatcggagtcagagtcaatcctcttacaagcgacgaacagaaaaactttgaacaaggaaaatccattacaacaaatgcagaccgtacactcaaaaggagtatgaggcgaaacttacaaagatacaaattaaggcgggaccacctaaaagactgcttacagaaaaacggtataataacagacaaagctgtactatccgaaaatgggaattacaccacatttcaaacatactacttgagagcgaaagcagtaaatgagaaaatttccttagaagagttcgccagggtactattaatgctaaataagaaaagagggtacaaatcatcaagaaaaatgaaatcagcagatgaaggtcaactgatagacggaatgtcagtagcgaaacgactatataatgataacattactcccggacaatacgtattaagtctcttagaagaaggcagaaaatacataccagatttttatcgaagtgacctactagatgaactagacaaaatatggacctttcaacaatgtttctacccagaaatacttacgccagaatgccggaaattaatagcaggcaaaggaaaacaggcaacagcgaaaattttcttaggtaaatacaaaatatacaccgctgacaataaatcaaaagataaaagactacaagcatatcaatggagagtcgaagcattgtcaggtcaattacctatcgaagtagtagcatttgtcgtctgcgaaattaatggcgcaatacaagcatccagtggttatctaggtgccatcagcgatagaagtaaagaattatacttcgaaggtctaactgtaggacaatacctagtcaaacaattagagaaaaatccagatactagcctcaaaaataaagtattctaccgacaagactacctaaatgaatttgagaaaatttgggaaaaacaagcagaataccatactgaactaacacctcaattaaagaaagaagttagagacataataatattctatcaaaggacacttaaatcacaaaaaggtttagtaggattctgtgaatttgaatcaaggcaaattgaagtgatgatagacggaaaactcaaaaagaaaacggttggttgtagagtatgtccaaaatcgtcgcccctcttccaagaatataaaatctggcacaacctaaacaatctaaaaatagtagaaaaagaactaggaaaatcaagattcctcaatcaagacgaaaaagaatcactattccaagaattaaatatcaaagaaaaattaagcaagactgacatccttaagctcctatgcttaaaggcaaaagaatttgacctaaacttcgaaaaagtagaaggaaaccgaacccaagctgaactctttagggcataccaagcaataatagaaatgtctggcaatggcgactatgacttttctaaaatgacatccagtgaaatacaagacacggtcactggtgtatttaggggattaggatacaatacggacatactcagtttcgatgcagaaaaagaagaaaagaccttcgataaacaaccaatgtatctcttatggcatttattatattcctacgaaggagactcatcggacacgggtaacaaggctttaataacaaaaataaagaaattgtgtggcttcgaaagtgaagaatatgctagaatcttaacagacgtaacttttcagtccgaatatggaaacttatcaacaaaagctatcagacgaatactacctttcatgaagaaaggaagtgaatattcggaggcttgcagacatgcagggtacagacactcagaaagatcactaacaaaagaagaactagacaagaaagtgtacaaagatcatctggaactattaccaagaaacagtctaagaaatcctgtggtagagaaaatattgaaccaaatgatccatgtcgtaaacacagtagtcgacacatacggaaaacccgacgaaatacgaatagaattagcgagagaactaaagaaatcagcaaaagaaagagatgaaatgaccgcttcaatcaacaaaaccgcagcagaacataagaaatattgtgaagtactacaaaaagaatttggctttactcacgtttcacgtaacgatattatacgatataaactgtacttagaactggaaaacaatggatacaaaacgctttactcagatacttatataccaagagaaaaacttttctcaaaagagttcgacatagaacatataatcccacaatcaaaactatttgatgattcctttagcaacaaaactctggaatgtcgtagcgtcaacatagaaaaatccaacgacactgcgtatgattatgtcctaaacaaatacggggaacaaggtattctagattataaaaatagaatcgaaaatttatataaagactcaaaaatctctagaaccaaataccaaaaattaatgatgaaaaacagtgacatatcgggaaactttatagaaagagaattacgagattcacaatatatagcaaagaaagcgagggaaattctcgaagaattggtgaaattcgttgtacctacaacaggatccgtgactgccagactacgagaagactggcaattagtagatgtaatgcaagaattaaactggaagaaatacgataaactaggacttacagacgtaagatatgacaaagatggacgagaaattagatatataaaagactggtctaaaaggaatgatcaccgtcaccacgcaatggatgcactcactatagccttcaccaaaagaagtattatacaatacttaaataatttaaatgcgaaaagcgataaatccggatctatatatgccatagaacaaaaagaactatttagagataaaagaggaaaactaaaattcattcctccaatgccatgtaatatattcagagcggaagcaaaaagacacttagaaaacgtcctagtaagcgtaaaagctaaaaataaagtagtaacgcccaacataaataggtctaaaggtaaaaacggtattaacaagaaaatacaattaacgccccgaggccaactgcataacgagaccatatatgggtcgatgaaacgatacgaaacaaaatgggagaaaattgggagcggatttgatgaaagacagatagctaaagtcgcaaacaagaaattccgagaagctctactatcaagattagctgagttcggcaacgacccacaaaaagcctttacgggcaaaaactcattagagaaaaatccattatacgttgacgaattgcatacccaaaaagttccagaaaaagttaaaatcgttaccttagaaaatctatatactatcagaaaagaaataacccctgacctaaaaatagacaaagtagtcgacgcaggagttagacgagttctacaagaaagattagatgaatttgatgatgattcaaagaaagcgttcagtaacctagatgaaaacccaatatggttaaatggtaagaaaatgaaaagagtaacaatcatgggagtgagtaatgctgttccactccacgataagaaagattacaaaggaaatctagtattcgatagtaaaggaagaaaacaacccgtagattttgtaaacacaggatcaaaccatcatgtcgcaatatacagagatgaaagtggagaattacaagatatcgtcgtgtccttttatgaagcaactacgagatcaaccttaggaataccagtaatcgacaaagagtataagaaagcagaaggatggaactttttatttagtatgaaacagaacgaatatttcgtattccctaacgaagaaactggctttaacccaaaagaaatagaccttatgaatccagataattacactacaataagtcctaacctgtaccgagttcaaaaattttcaaaatgtatgtatggcaattcgtcagtaagggaatatgtatttagacaccacctagagacatctgtaaatgacagtaaaggcttgaaaaacatagcatataaaaacgtcaaaagcctcgtttacttagagggcatagttaaagtccgaataaatcacataggacaaatagtgagcgtaggagaatattga

SEQ ID NO: 8999 - RNA, 4140 nt, synthetic construct
  misc_feature 1..4140: note = Cas9 variant
  source 1..4140: mol_type = other RNA
atgcgtattgataatggtctcgaagaattaaaagtaaataatagaatttacaatataggacttgatatcggaacttcctcagttggcttcgccgtaacagacgcacaagataaattagtcagagtaaaaggaaaaactgcaataggcgttcgcttatttgaggaaggtcataccgcggcagaaagaagaggctttagaacaacaaggagaagactaagcaggagaaaatggcggataaacctattaaatcaaattttcgaaccatatatcagtgaaatagatcccacattcttcgcacgactaaaaaattcgagccttgcaggaaaagacaaaaaattcgaaggtagtcttttgtttccagatagaaccgactaccaattttataaagataatcctacaatgtatcacttaagaaaacacctgatggaaaaagatcgacaattcgatctccgagagatatacctagcaatgcaccacatcattaaatacagaggtaactttctcaatacaacccctatgaatcattttaaaaacgaagaaatagatttttcagctctgttttcaagactaaatgaactctaccaagaaattgacgacgaaaatatttttgaattgaacattgaaaacgtagacgaaataaaaaaaattcttctcaaccatgatctctttaaaatggaaaaacaaaaacaagtagcaaaattactaaatgtcgacactgatgacaaacaattaaagaaagaaaacaccgcgctagcttccaatttttcgaaagcaatactgggctataaattcaacttagcgttagtcactaaaataccagatcaagacaagaaggaatggactatatctttaggcgatgaggacttcgatgatagactagataacgtccccgtagcactaacagaatcacaactcgaagtagttgaagtcttacactcgatatttaatagcatatcactaaatgaaatcgtagaaaatggagagactcttagctcagctatggtaagaaagtataacgaccacaagcacgatttaaaactactgaaaaacgttatgacaacactagaagacagaaaaaaagcgaaaaagatacaagggatctacaatgtatttgttggtaaagataccgatcttatcagcgataaagacaagaacaaatacaaagataaagacgaattctataaggaaatccaaaaaaaccttgataactcttcagatgcggaagagattataaaacggattaagcaagaccaattcttaccaaagcaacgcacatcgaaaaatggagtaattccacatcaactacatcaaagagaactagacctaataatcgaaaaccaagccaaatactacccctttttaaaagaagcaaatccaaataaaaagagacttaaacaagcgaaatataaactagacgaactaatagctttcaaaattccctattatattggcccaactagcggggcagaaaacagcgacttctcctggcttaaaaggaaaaaagatggacaaataacaccctggaacttcgacgaaaaagtagacagaatcgaatccgcaaacagattcatacgcagaatgacaacaaaagatacgtatctactagcagaagacgtactgccactagaaagcctgatttacgaaaaatacagtgtgttaaacgaactcaacaatgtaagaattaaccgacaaaaactctcagttaacgataaacaagacatttacaatgaattatttaaaaacagtaaaacagttacactaaaacaattacaaaagtactttgaagtcaccaaaaaattgaaaacggttgtagtagaaggtctagccgacccaaaaaaatttctaagcaacttaggcacatatcatgacttcaaactaatatttggtgatatagtagatgaccctgaatatcaaacagacttagaaaatataatagaatggtccacaatcttcgaggatcgaggaatttttaactcaaagctcaatgaaattacatggctaactgacgaacaaagaaaaaaagtattaagcaaaagataccagggatggggaagattctctaaaaaacttttggttggattaaaaaattcacaaggaaattcaatattagacgaattatggaataccaacctaaattttatgcagctacaaagtcaggacgactttgccgagctcatacacgcagaaaacgctaagcagttcaaagctaatgacccagacaatccatggaacgggattgacgcaatactaaatgacgcatacacatctccacaaaacaaaaaggcgatacggcaagtagtaaaagtagtgcaggatatcgaaaaagctatggggaacaaaccacaaaaaatagctattgaattcaccagaagcgcagataaaaacccccggagaactgacagccgaataaaacgtttatcagacatctacaaagaagctgcagaaaaagtagttggagaatcactaaaattagaactcaacgaatacttaaccagtaaaaaaaaaatgacagacaaaatgtacctatattttacacaattaggaacagatatatatacaggcaaaaaaatagacatagaccaactaaataattatgatatcgaccacgtactaccccaatcctttctcaaagacgactcgctagataacagagttttaaccaaccgaagcgataacagcgaaaaatcagataccgtaccattgcataaattcggagctaaaatgggcaatttctggagacagttagcagacgaaggactaataaccaaaagaaaatacaaaaatcttacgacagacccagcgacaatagacaaatacacaatacaaggatttataagaaggcaattagtcgaaacaagtcaagtaataaaattaactgcaaatatacttggaggtctatacccagaagaaaccgaaatattagaaatcccagctaagctcaatcatcaatttagagacatgttcgacttagttaaagttagagaagtaaacgactatcatcacgcctttgatgcctacataaccgtattcgtgggcaatttcctctatagacgttacccaaaattacggtcatattttgtatacggcgatttcaaaaaactaaacaaaaccgatgacgacataagaaagttcaatttcttaaatttatttaataaagataaggtagaagacaatgaaactgatgaaatcctatggagtaaagccgagagcatcagagatataaaaaacatttacaattacaaatttatgctagtatcaagagaagtgtatacaagacatggtgcaatgtttaaccaaaccatctatccagcatccaaaaatgactccaaaaaactaataccaattaaaaaaggcaaagacacagccatctacggaggatattcagggaacactgacgcctacatggcaatagtcgcagtagaagacaaaaaaggtgaaaaattcaaagtagtaggagtcccaactcgagcagtaagtcggttggaacaattagccgcagacgaccatgaccagtacttgacagcattgcatgatgtcttaaaaccaaactttacgaagatcaaaacaaacagaaaaacaaaagcaaaggaggaagtaacaaccccatttagaatacttgtaggaaaggtcggataccgacaactaatccaagacggacaggtcaaaatgatgctaggctcaagcgcatataaatataatgcaaaacaactagtcctatcagaaaaaagtttaaaagtaatcaagaacaacaaaaaatataatccagatgacgaaaaccaagatttaatcgatgtctacgacgaaatacttggggttgtaaacagagcctttaatctgtacgatacaaatggatttcgaaaaaaactgaatgacaacagagtgaaatttgttgaactaccaataaataacatattcgatggtacaaaactagtacaaatgggaaaacgggcagtactaacgcaaatcctaaacggactacacgccaacgcggcactcggagacctcaaagctctaggaatatctacacccttcggaaaaatgcaaagcaaatcaggaatccctctatccatggatgcttcactagtatatcaatctccaaccggactatttgagcggaaattgaacttaagcgatctatga

SEQ ID NO: 9000 - RNA, 4140 nt, synthetic construct
  misc_feature 1..4140: note = Cas9 variant
  source 1..4140: mol_type = other RNA
atgacaaagaagaactatagcataggacttgacatcggtacaaactcagtaggctgggcagtcattaccgatgattataaagtccctgcaaaaaaaatgaaagttctgggaaacacagataaaaaatatattaaaaagaaccttctaggcgcattactatttgattcaggagaaaccgctgaagctacacgactcaaaagaacagccagaagacggtacactaggaggaaaaatcgattaagatatctacaagaaatattcgcagatgaaatggcaaaagtagatgaatcattctttcagcgactagatgaaagttttttgagatgggatgatgacaataaaaaactagggagatatccaatatttgggaataaagccgacgtagtaaaatatcatcaagagtttcctacaatatatcacctccgaaaacatctagccgacagttccgaaaaagcagaccttagattagtatacctagcgctagctcacatgatcaaattcagaggtcattttctcattgaaggcgaactcaatgcagaaaacacagatgtacaaaaaattttctccgattttgtaagggtatatgacagaacatttgatgattcccacctatctgaaattacggtagacgctgcaagtatactcacagagaaaatttcaaaaagtcgacgattagaaaacctcattaaatactaccccacagaaaaaaaaaacactttatttggaaatttgatagctttagcactgggcctacagccaaactttaaaatgaatttcaagctgtcagaagacgccaaactacaattttcaaaagatagttacaatgaagacctagaggaattacttggaaaaataggcgacgactacgcagacttattcacatcagcaaaaaatttatacgatgctattcttctatcaggaatactaactgtagatgataattcaacaaaagctccactctcagcatcgatgataaaacgatatgcagaacaccatgaagatctagagaaactaaaggaattcataaaagcaaacaaatcagagttataccatgacatctttaaagatgaaacaaaaaacggttatgcaggatacatagaaaacggtgtaaaacaagacgaattttacaaatacctaaaaaacaccctctccaaaatagccggttcagattacttcctagataaaatcgaaagagaagacttcttgagaaaacaacgaacattcgataacggttcaataccgcatcaaatacatttacaagaaatgcatgctatacttcgaagacaaggcgattactacccctttctaaaagaaaaccaagatagaatagaaaaaatactcacattcagaatcccatactacgtagggccattagctagaaaagatagcagatttagttgggcagaataccactcagatgaaaaaataacaccatggaacttcgataaggtcatagacaaagaaaagtcagcagaaaaattcataacacgaatgaccttaaatgatttatatcttcctgaagaaaaagtcttaccaaaacatagccacgtatacgaaacttacgccgtttacaacgaattaactaaaataaaatacgtcaacgaacagggaaaagactcgttttttgattcaaacatgaaacaagaaatatttgatcatgtattcaaagaaaacagaaaagtcactaaagaaaaactactaaactatctcaacaaagaatttccggaatatcggattaaagatcttataggtctagacaaagaaaataaatccttcaatgcctctctaggaacataccacgatctgaaaaaaatactagacaaagcattcctcgatgacaaggtaaacgaagaagtaatagaggatattattaaaacacttacattattcgaagacaaagatatgattcacgaaagactacaaaaatactcagacatcttcacagcagatcaattaaaaaaactagaaaggagacactacactggctggggacgcttatcatacaaactgataaacggaatacgaaataaagaaaacaacaaaacaatactagactatcttatcgatgacggctcagcaaatagaaatttcatgcaactaataaacgatgacacgctaccatttaagcaaataatacaaaaaagccaagtcgtaggcgatgtcgacgacatagaagccgtagtgcacgacttacccggttctccagcaataaaaaaaggaattctacaatcagtaaaaatcgtcgatgaactggtcaaggttatgggcgacaatccagataacatagtaatagaaatggcacgagagaaccaaaccaccaatcggggaagatcacaatcacaacaaagattgaaaaaactacaaaattcattaaaagaattaggatctaacatactaaacgaagagaaaccaagttacatagaagacaaagtagagaacagtcatctgcaaaacgaccaattattcctatactacatccaaaatggcaaagatatgtacacaggagatgaactagatatagaccacctgagcgactacgacatagaccacattatacctcaagcgtttatcaaagatgacagtatagacaatagggttcttacatctagcgcaaaaaaccgtggtaaaagcgacgacgttccatctttagatattgtccgagcaagaaaagcagagtgggttcgattgtacaaatccggcttaatatcaaaaagaaagttcgacaatctaacaaaagctgaacggggaggattaaccgaagcagataaagcaggattcataaaacgtcaacttgtagaaacacgacaaatcacaaaacacgtagctcaaattctcgacgcaagatttaatacggaaagcgatgaaaatgacaaagtaataagagacgtcaaagttattactttaaaatcaaatcttgtatcgcaatttcgcaaagactttgaattttacaaagtaagggaaataaacgactaccatcacgcccatgacgcatatctaaacgcagtagtaggtactgctctcctaaaaaaatacccaaaactcgctagtgaatttgtgtatggagaatacaaaaagtatgatgtccacaaattaatcgcaaaatcttcagacgatcatagcgaaatgggtaaagccactgctaaatattttttctactcaaaccttatgaacttcttcaaacgggtaatacgatattctaacgggaaagtaatagtaagaccagtagtggagtatagtaaggataccgaagacatagcatgggacaaaaaatcaaatttcagaaccatatgcaaagtactatcctatcctcaagttaacatcgtaaaaaaggtagaaacacagacgggagggttctcaaaagaatcaatcctaccgaaaggtgacagtgataaacttatacctagaaaaactaaaaaagcgtactgggatacaaaaaagtatggaggttttgacagtccaacagttgcatacagtgtatttgtggtagccgacgtagaaaaaggcaaagctaaaaaattaaaaactgtaaaagaactagtcggcatctctataatggaacgatcattcttcgaagaaaacccagtcgaatttctcgaaaataaaggatatcacaatatacgagaagacaaactaatcaagctacctaaatactcgttatttgaattcgaaggcggaaaacgcaggttacttgcaagcgcatccgaattacagaaaggaaacgaaatggtaatccctggacatttggtgaaacttttataccacgctcaaagaattaatagctttaattctacaaaatatcttgattacgtcagcgcccataaaaaagaatttgaaaaagtcctcagctgcgtggaagacttcgctaacctatacgttgatgtagaaaaaaatctatcaaagattcgagccgtagccgattccatggacaacttctctatcgaggaaatttcaaacagctttattaacttactaacactaacagctcttggggcccctgcggattttaattttttaggagaaaaaatccctaggaaaagatatacaagcacaaaagaatgcctaaacgcaaccctaatacaccaatcgataacaggcttatacgagacaaggatagatctctcaaaaattggagaagaatga

SEQ ID NO: 9001 - RNA, 4143 nt, synthetic construct
  misc_feature 1..4143: note = Cas9 variant
  source 1..4143: mol_type = other RNA
atgggaaaatataatctcggcctagatataggtaccaacagcgttggctgggcggtagtggacgaaaataatcagattgtcaaaaaaggcggcaaagccctctggggagtacgtatgtttgatgaagcacaatccgctaaagaaacacgcatatatagaaactctagacgaagaatcgtaagacgcaaccaaagacttctcctcctccaaaaagaattctatgacgaaataattaaagtagaccaaacctttttccaacgcttgaaggattcattcttcaaaaaagaagataaattaaataaaaacaactatacattcttcgacgacgatataacagacagagagtattttaaaaaattccctacaatataccacctacgttcccatttactttacaatgatgaaaaaatcgatattcgtatgctctacctagctttacatcatatcgtcaaatataggggccacttcctcgactctggtgaggtcaacgaatcaaacttctcaaaaattaaggatgtcttggatacattcaacaacaaaatgtcagaaatgagcctcgaatttgaagataatgaagactatttctgcaaaatagaattcgatgaaaatttcgaaaacaaactaaaagacataatgctatcccaactctccaaaaaagagaaaagacaagaactaatagacttatttaaagtagataaaaaaagcttagtaaacgaacttctgatcgaattactagtcaacaaaaaagtaaaactaaacagcctatctataaccaacggaaagaagtacgaagtctgtgaaatagacttcgaaaaagaagaactttttgaaaaacttgaagatgcaaaaaagattataacagaactatttgacatactagatgaaatagtaaatataaaaaaaattgtcgattattactatgtcctaaaaataattggagacaacgaatatctttccgaagccatggtcaaaaaatatgataaacatgacaaagacctgcgcgagctcaaaagcttcataaaaacctattgcccaaacaaatattacgaatgttttaggaaaacctctaatcctaatctatgtaactatcctaaatacgttggcataaattccgtaaataaaaaaatagaaaggttcgctcactgcaaaaaagaagaattttacaaatacctaaaatcattattcaacactataaaagacgaaaacgcaaaattaaaaatagacctctttcagaaagacatggaaaatgacgactttcttaaccgccaaaattcaaaccacaactcttctattcctatgcaacttaacttttgtgaattaaaaaaaattcttgaaaaccaaagcaaatactacccattccttatgctcaaaaactcggacggatacagcacaagcgacagaatcatagctattttcaaatacaaaattccctattatgtaggacctctaaacaaaaactctaaatatagttggctagtcaaaaaatcaaacgaaaatataacaccatggaactacgaaaaagtcatagacctcgatgcaagcgccaaagagttcatccagcgtatgcaaaataaatgtacatacctgaaaggagaaaacgattattgcttgccaaagaaaagtatcctctttagtgaatacaactgcctacaatacctaaacagacttattatcaacggtgccctaatagaaaataagctaaaaaatgaaatatatgagaacatatttttatgctacaaaaagcccacaaaaaaaagtatcgtcgaataccttaaaacaaattataactacgatgaaactacactcaaatccaacatcctagaggttaattgtgatatgtcaagctacattcaatttaaagaaatctatggagaagattttgagcaaaacttaaatatagtagaagacataatcaaagacatcacaatcttcgaagacaaaaaaatactagaaaaaagactaagagagatataccacctgtcagaagataaagtacagaaaataaaaggactaaactacaaaggatacgcaactctgtcaaaacactttctaaacaatttttatagcgttaatgaagaaacgggagagatatatggaccaatcattcaaataatgagggacaccaattataacttacaacaagtaatatacaatgacaggtataactttatgaaagccatcgacaaatacaataaaaaaaatctcgacacagaaaaaaaattaaatgtttccgacttcatcgacgaatacatatacgtaagcccaataatgaaaagatcactaatacaaagttataacattatccaagaactagaaaaaatcctaggagaaagcatatccaaatattacatcgaatgcgcgcgagtcagatcaaactcaaaagatgtcataaactcgcgctatcggcaactatcagaattatacaaagactgcgaacaccaagtaagcgacattagcaagaattacataaacataaacaagctaaagaaacaactagaagacaacaaaaacgaactgcgagcagacaaactatatttatattttactcaatttggaaaatgcatgtatacactgaaagacattgacttagacgacgtatttctaggaaaatatgacattgaccacatatacccacaatctcttatcaaagatgactcgctcaataatagagtgctagcatctaaagaaaaaaacggcaaaaaagacaatcaattcattttcaatattccagaattcctaccaaaaaatgctgaactcttctacaaaaaacttttagaatgcaaactaataactaaagaaaaatacagaagacttaccatgaaaaaaatagacgacgatgaattagacatatttgtcaacagacaactagtcgccacaaaccaatcggtaaaaggattagtagatgtactaaaaatatataaaggcgtcaagcccactaatatagtatatagcaaagctgtcaacatatctgactttagaaacaactataatctatacaaatcgcgaactgctaataattaccaccacgcgcatgacgcatacctaaatgtagtaataggcaaagcgcttgacgtctactaccaatgcaactactttcaaaactataaagacgtaataaaactcaaagaccgcaacataactataaaccccgaaatcatcctgagtaaaaaccgttacgtgaacaggaatggtgaaaaaaaggtaatttgggatttagataacacactcaaactcattaaaaataatctatataacagatttgatataactgaaactataatgacacgtaagtccaataaaatgtttagcaaatcatcaataagtccagctaaaaactctaaaaacttaatacccataaaaacatccgatccacgatgtaatgtcctaaagtacggaggaattaaatcaaatagctacaatttctattgcattgttgaactatacgacaaaaaaggcaagaaatcttatatactcgaagcaataccaaaaacacattcagataaattagaagaatacattaaaaacagcatagatgaaaagaacgtatcaaacttcaaaataatcaacaaaaacataaaaagtaacataataatagaatataaaaaactacgctatgttataactggcaaatcaggcaaatactatctaataaagaactttaaggaccgcaacttttcgtacaacgccataaaaactatcaaatatatcgaaaaatataactaccaaaaaaaatacgaaatcccatttgaagaaacaaaagaaaagatcattctagcacctaaaaaaaaagatacaaaagaaatatccctcaccctagacaactgccaagccctactagacgaaatcatatccttattcaaaaaagacatatacaattatgacatcatttataaaattacatcaaagttagaagaaaataaacaaaacctaaccctgacaaatctcatcaaagtccttaccgaaatccttattttgctcaaaaccaacgaacgaggtacagcagacctaactctaatcgacatgtcaaaagatacaggaactctctgcatcagcaaaacattaaaacctggaatgaaattcatatcagaatcaccaaccggatattacagaaaaatcatttttgaagtacctaacggcatctga

SEQ ID NO: 9002 - RNA, 4143 nt, synthetic construct
  misc_feature 1..4143: note = Cas9 variant
  source 1..4143: mol_type = other RNA
atgaaaaggatattgggactcgatctaggaacaacaagtattgggtgggcattagtcaacgaagcagaaaataataacgaagccagtagtatagtcagactgggggtgagagtcaatccccttactgttgacgaaaagagcaattttgaaaagggtaaagctattaccacaaacgcagacagacaattacgacacggtgccagaatcaacctacaaagatacaagctacgtaggcaaaacctacacgattgtctccagaaacagggatggctaggaacagaagcaatgtacgaagaaggaaaagcaagcacattcgaaacatacaaactccgcgcgaaagcagccgaagaagaaatttctctccatgaatttgcaagagtactatttatgctaaacaagaaaagaggctataaatcgaatagaaaagcaaacaataaagaggatggccagctttttgacggcatgacaatcgcgaagaaactttatgaagaacatctcactccggcagaatatagcttacaactactgaacaaaggcaagaaatttacacagggatactaccgcagtgacttaaatgcagaactcgaacgtatatgggatgaacaaaagaaatactatccagaaattctgacagatgagttcaaacaacaattagaaggaaaaactaaaactaatacatcaaaaatctttctagcgaaatatggtatctacagtgcagatcttaaaggtcttgacagaaaatttcaacccctaaaatggagagtagaagccctacaacaacaagtagataaagaagttttggcatttgtgatctcagacctaaaaggacaaatagcaaacacaagcggattactaggagcgatttccgatagatccaaagaattgtactttaataaacaaacagttggccaatacttatgggcatctctagaagaaaacccacacatctcaatcaaaaataaacctttttacagacaagattacctagatgagttcgagaaaatatgggaaacccaagccgctttccacaaacaactgacaccagaacttaaacaggaaataagggatataattatattctaccaaaggcccttgaaatctaaaaagtcattaatatcagtctgtgaactagaacaaagaaaagtgaaagcaacaatagacggcaaagaaaaagaaattacgattggccctaaagtagcacccaaatccagtccagtgttccaagaatttagaatatggcaaaatttaaataatgtcctactaattgataacgacacaaacgagaaaaggcccctcgatgaagttgaacgaaacttactgtacaaagaattatcaataaaagcaaaattaagcaaaacagaagcattaaagatattaaacaaaaagggaaaacaatgggacctgaattatcgcgaactggaaggaaatagaacccaggcgatactcttcgactgctataaccgtataataactttaacaggacacgaagaatgcgatttcaaaaagattaaagcaagcgaaatcagacattacgtaagcacaattttcaaaaatcttggattcagtacagaaatactagacttcgaccctagtctcaaaaagcatgaactagaaaaacaaccaatgtatcaactgtggcacttactctattcttatgaatccgataattcaagaacaggaaatgaaagcctgctaagaaaacttgaaacaaccttcggattccctgaagaatatgcaacagtactttgtgacgtagtattcgaagaagactacggaaacctatctgtaaaggcaatgagagaaatcctcccttatttacaagcgggtaatgactactctcaagcatgcgcatacgctggatacaaccacagccgacattcattaacaaaagaagagttagaccaaaaagtatacaaagaaagactagaactcttgcccaaaaattccttaagaaatccagtagtagaaaagatcctaaaccaaatgataaatgtaataaacgcaataatagacgaatacggaaaaccagatgaaatacgaatagaaatggccagagaattaaaatcaagtgcagccgatagaaagaaaaccacacacgctatatctcaaggaaatgctgaaaaccagcgtatacgtgaaatattagaaaaagaatttagtctttcatatatatcacgcaacgatattataaaatataaactatatgaagaattagaaccaaattattacaaaacattgtattcagacacatatatcaccaaagataaactattttcaaaagatttcgatatagaacatataatacctaaagcccgtttattcgacgacagtttttcaaataaaaccctagaggccagaaatataaacctagaaaaatcaaataaaacagcatttgattttataaaagaaaaatacggagaagacggagcagaagcatacaaaaagaaactcgacatgttactagaaaacgacgcaatttcacgtccaaaatacaacaacctgctaagagctgaagcagacataccttcagatttcataaacagagacttaagaaatacccaatatatagcaaagaaagcctgtgaaatactgggagaattagtaaaaactgtaacaccaaccacgggaaaaataacaaacagactacgtgaagactggcagctagtagatgtgatgaaagaacttaattttgaaaaatacgaaaaactaggcctcacagaaatcgtagaagatcgtgacggaagaaaaatcaaacgaattaaagactggactaaaagaaatgatcatcgccaccacgccatggacgctctagcaatagcttttacaaaaccgtcctttattcaatacctcaataacttaaacgcacgctcgaataaaggtgacagtatatacgctatagaaaataaagaactacattacgaagaaggtaaattgagattcaacgccccaatcccagtaaatgaatttcgagctgaagccaaacgacatctgtccgctatcttagtaagcataaaagctaaaaataaagtaatgacacaaaatgttaacaaaattaaaacaaaacatggaataattaaaaagatacaacttacaccaagaggcccactacacaacgaaacaatatatggaactaaaatgaggccaataatcaaaatggtaaaagtaggcgcagcattagacgaggctacgatcaataaagtaagtagccccgctattcgtgaagcattattaaaaagattaaacgaatacagtgggaacgcaaagaaagcatttacaggtaaaaatactttggagaaaaatccgatctacttaaacgcaggacgtacaaaaactgtcccatcacttgttaaaacagtggagtgggagtcgtttcacccaacgagaaaattaatagacaaagacctcaacgtagacaaagtagtcgataagggaataagagaaatattaaaggccagattagaagagttcaacggagatgcaaagaaagcattcagtaacctagaagaaaatcctatatatttagacgaagcaaagaaaatcgctttaaaaagagtaagtatagaaggtgttttatcagcaataccactccacaccctaaagaaccaagcaggcaaaccaataacaggtaaagacggcaaaccggtattaggaaattatgtccaaacatcaaacaaccaccatatagcattctactacgatgaagacggaaacctccaagataacgcagtgagcttctttgaagcagcagaaagaaaatcccaagggataccagtaattgataaagattacaatcgagataaaggttggagattccttttcacaatgaaacaaaatgaatatttcgtatttcccaatgaagcgacaggattcataccatcagaggtggacctaacggacgaagcaaactacggcataataagtcccaatctatatagagtacagaaagtaagtagaatcgataaaggaacatcagcaagtcgtgattattggtttagacaccacctcgagaccatactaaacgatgatgccaaactcaaaaatttagcatttaaaagaataagaggtttattagaattaaaagatattatcaaagtgagaataaactctacaggaaaaatcgtagcagtaggagaatatgattga

SEQ ID NO: 9003 - RNA, 4143 nt, synthetic construct
  misc_feature 1..4143: note = Cas9 variant
  source 1..4143: mol_type = other RNA
atgaaaaagatactaggattagatttaggaaccacaagtataggatgggctttagtaaatgaagcagaaactgaatccgaaaaatcatcaataataagattaggagtaagggtaaaccctttaacgatcgacgaaaaaggcaatttcgaaaaaggcaaagcaattaccacaaactcagacagacaacagagacatagtgcacgcataaacctacaacgctataaattaagaagacaaaatttatgcgattgcctacaaataggtggactattaggcagcgaaagtatgtacgaagaaggaaaagaatctacatttgaaacatacaaattacgagccaaagcagctactgagaaagttgcattacatgaattcgcaagaatcttattcatgttaaataaaaaacgaggatataagtcaaatcgaaaagccaatagtaaagaagatggacaggcattcgacggcatgacaatcgctaaaaaattatatgaagaaaacctaacgccagcagaatacagcttacaattattaaacaaaggtaagaaattcagtccctcctattaccgatccgatctggaatcagaactaaatagaatatgggaagaacagaaaaaatactatcctgagatactaacagacgacttttaccaacagttagaaggaaaaactaaagtaaatactacaaaaatatttcttgccaaatacgggatatatacagcagatttgaaaggactagacaaaaaaatgcaaccattaaaatggagaatagaagcactcaataaacaagtagataaagaagtacttacctttgttgtgagtgatttaaaaggacaaatagaaaaaacctcaggcctcttaggagaaatatcggatcgatctaaagaactatacttcaacaagcagacggtaggacaatatgtatgggcttcactgaaggaaaacccacacgtctccataaaaaataagccattttacagacaggattacttggacgagtttgaaaaaatctgggagacacaagctgcattccacaaagaacttactccagaactaaaaaaagagattagagatataataattttctaccagaggccactaaaatcaaaaaaaggtctcatctccatatgcgaactagaacaaaaaaaagaaaaagttatcatagaagggaaagaaaaagaaatcctaataggctctaaagtagccccaaaatcttcgcccatgtaccaagaatttaggatttggcagaatcttaacaacgtactgctaatagacaccgaaattaacgagtcaagacctcttgatgaagaagaaaaagcactcctttataatgaactctctgtacgagcaaagttgtccgaaacagaggcattaaaaaccatcaataaaaaaggtaagcattgggatctaaacttcaaagaactagaaggaaaccggacacaagctgtattatttgaatgctataacagaataataacgcaaaccgggcatgaagaatgtaattttaaaaaaatatcagctgaggacatacgacattacgttgcaaccatctttaaaaatctaggttttaatacagatatcttagacttcaaccccagcctcgaaaaacatgaactagaaaagcaaccaatgtatcaattatggcatttgttatatagttatgaatcggataagtctagaacaggtaacgaaagcctattgaacaaactagaagcaaactttggattcccccaagaatacgcatccgtattagcggacgctacattcgaagacgactacggcaatatcagtgtaaaagctatccgcaagatactgccacacctacacgacggatacgactacagcgaagcatgcgaaagggccggatacaaccacagcgttagaagcttaacaaaggaggaactagcacaaaaagtttacaaagacagattagatcttttaccaaaaaattcattacgaaaccctgtggtagaaaaaattctcaatcaaatgataaatgtcataaatgctataattgtagaatacggtaaacctgacgagatacggattgaaatggcgcgagaactaaaaagttcggcagcaaaacgagaagaaagaacaaaaagcataaatcaaaacgctgcagaaaataaacgcattaccgaaatactacaaacagaattcggactaagttatataagcaggaacgatatcgtaaaatacaaactatatcaagaattagaagcgaacggatttaaaaccctatattccaacacctacatacctaaagaaaaactattctccaaagacttcgacatagaacatatcgtccccaaagcacgactattcgatgactccttcggcaataaaacaatcgaagcaagggacgtcaatttagctaagtccaacaaaacagcatttgacttcgtaaaagaaaaatatggcgaacaaggaattgaagaatataaaaaaaaattagatacactccttaaagaaaatgcaatttcttcaggaaagtataaaaaattaatgatgtctgaagcagatattccatcagatttcataaaccgtgatctcagaaacacacaatacattgccaggaaagcatacgaaatacttggagagctagtaaaaactatcacgcctacaacaggaaaaataaccgatagactcagagaagattggcagcttatagacgtcatgaaagaactaaacttcgaaaagtatgaccgtctcggattaacagaagtaatcgaagacagagatggacgaaaaattaagcgcataaaagattggaccaaaagaaacgaccaccgacatcatgctatggacgccctcaccatagcattcacaaaaccaagttacatccaatatcttaacaacttaaacgccagatcagataaaagtggttcaatctacgcaattgagaccaaagaattacaccgcgagaataatacactcagattcaatgcaccaatgcctctgaatgaatttagaaaagaagccaaaagacacctgagtgccatacttgtaagtataaaagctaaaaacaaagtaatgacgcagaacgtcaataagatcaaaactaaaaatggaattataaaaaaagtccaactcacaccacggggagcactacataatgaaaccatctacggaaccaaaatgagaccaattataaaaatggtaaagattggcgcagcactagatgaagcaactataaacaaagtctcatctccaacaattagagaagcgttactaaaaagattaaacgaatactctggcgatgcaaagaaagcattcgcaggcaaaaacgcaataacaaaaaatccaatatatttaaatgcagaacatacaaaaacagcaccagctatggtcaaaatagttgagtgggaaatgtattacccgattcgaaagttaataactcccgatcttaaaatagaaaaagtaattgataatggaataaaggaaattttgaaaaaaagattaaaagaatttggcggtgacgcgaaaaaagcattttcaaacctagacgagtgcccaatatatttagacgaggaaaaaaatatcactctaaaaagggtttcaatagaaggcgtacttagtgcgatccctgtacatacactaaaaaatcatgctggcaaggaaataaaagatgaagacggaaaagcagtcctgggagattatgttcaaacatccaataatcatcatgtcgctatatatcaagacgcaaaaggaaacctacaggataatgtaatatcttttttcgaagctgcggagcgaaaatcacaaaatgtacccatagtcgacaaaaatctaaaccgcgacaaaggatggcacttcctatacaccatgaagcagaacgaatattttgtattcccaaatgaggaaacaggttttgtaccatcggaaatagacttaatggacgaaaacaactacgaaatgataagcccaaacttatttagagtacaaaccatgtcaagagttgactacggaaaaacaataataagagaatatgtttttagaaatcatctagaaaccatattgaacgataatctcaaattgaaaggactagtcttcaaaaaaataaaatcgttaaaagcattagaaggaattgtaaaagtaagggtcaacgccatcggtaaaattgttgcagtaggtgaatacgattga

SEQ ID NO: 9004 - RNA, 4143 nt, synthetic construct
  misc_feature 1..4143: note = Cas9 variant
  source 1..4143: mol_type = other RNA
atgaaaaagaaatatgctatagggatagacataggtacaaattccgtcgggtggtcagtagtgacggatgactataaagtaccatccaagaaaatgaaagtctttggaaataccgagaaaagatatattaagaaaaaccttctaggaaccttactcttcgacgaaggcaatactgccgaaaatcgacgactcaaacgcacggctagacgcagatacactagacgaagaaacagaatactctacttacaagaaatttttgcagaagaaattaacaaaatcgacgactcattctttcaaaggctagacgattccttcctaattgttgaagacaaacaaggatccaaacatcccatattcggtacccttcaagaagaaaaagaataccataaacaatttccaacaatctaccacttgagaaaacaacttgcagactctagccaaaaagctgacattagacttatatacctcgctctagcacacattataaaatacagaggtcacttcttatttgaaggggatctaaaatccgagaacaaagacgttcaacacctttttaatgattttgtcgaaatgttcgacaaaaccgtagaaggaagttatttaagtgagaatctgccaaacgtagcagacgtcctagtagaaaaagtatcaaaaagccgacacctcgagaacatattgcactatttcccaaacgagaaaaagaacggcttattcggaaatttcttggccctcgctttaggactccaaccaaattttaagactaacttcgaacttgccgaagatgctaagatacaattcagtaaagaaacgtatgaagaagacctagaagaattattaggaaaaatcggcgatgattatgcagatttattcatagcaacaaaatcactatacgacggaatcttactagccggcatcctctccacaaccaacagtacaacaaaagctccactttcatcctcaatggtaaatagatatgaagaacaccaaaaagacctggctttactgaaaaacttcatacaccagaacttgagcgactcatataaagaagtattcaacgataaactcaaggacggatatgctggctatatagagggcaaaaccacacaagaaaatttctatagattcataaagaaagcaattgagaaaatcgacggatcaaattacttcatagagaaaatcgaaagagaagacttcttaagaaaacaaagaacgtttgataacggatccataccacaccaaatccacttaagggaaatgcaagcgataatacgacgtcaagctaaattctatccattcctagaagaaaatcaggataaaatagaaaagatacttaccttcaggataccctattacgtaggacccttagcacgcggaaaatcggaatttgcgtggcttaatcgaaaatcagatgagaaaataagaccgtggaattttgacgaaatggttgacaaagaaacatcagcagaaaactttataacaagaatgactaactacgatcaatacttaccagaccaaaaagtattaccaaaacacagcctgttatacgaaaaatttgccgtgtacaacgaactcacaaaagttcgatatgtaacggaacaaggcaaatcattcttctttgatgcaaacatgaaacaagaaatattcgatagaactttcaaagtatatagaaaagtaacaaaagaaaaattaatggactttctaagcaaagaatttgacgagttcagaatagtcgacttactgggtctagataaagataataaatcattcaacgctagcttaggcacttaccacgacctcaagaaaattgtctcagaagatttcctggacaattctgaaaacgaagatattttagaaaatgttgtgctcactttaacattgttcgaagaccgcgaaatgatcagaaaaagactcgaaaaatataaagacgtactaactgaagaacaacgtaaaaagctcgaaagaagacactacacaggatggggaaggctctccgccaaattaataaacggaattagagacaaagtaacacgaaaaaccatcttagactatttaattgatgacggtacatctaacagaaactttatgcaattaataaatgacgacacactatcatttgtcgacgaaattcgactcgctcaaggaagtggaaaagccgaagattaccgagctgaagtacaaaacttagcgggaagccccgcaattaagaaaggtatacttcaaagtctcaaaattgtagacgaactaatagaagtaatgggatatgatccagaacatatagtagtcgaaatggcaagagaaaaccaatttacaaatcaaggaagaagaaacagtcaacagagatacaagaaaatagaaaatgcaatcaaaaatctagactcaaacttaaacagcaaaattctaaaagaatatcccacaaacaaccaagccttacaaaatgatagacttttcctatactaccttcagaatgggaaagacatgtatactgacgaagaattagatatagatcaactttctcaatacgatatcgaccacataataccacaagcatttattaaagacgatagtctagacaacaaagtcctcaccaaaagcgctaaaaaccgtggaaaaagcgacgacgttccatcactagaaattgtttataaaaagaaaaacttctggaaacagcttctagattcacaactaatatcacaaagaaaatttgataatctaactaaagcagaacgaggaggactcaccaatgaagacaaagcaaggtttattcagagacaactggtcgaaaccagacaaataacaaaacacgtcgcacgaatattagacacaagatttaatacaaaactagatgaagctggcaatcgaataagagaccccaaagtaaatataatgacactaaaaagcagcctagtatcacaattccgaaaagactaccaactatataaagtcagagaaataaacaattaccaccatgcccatgatgcatacttaaacgctgtagtggctacagccttactcaagaaatatcctcagcttgcgccagagttcgtctacggtgattacccaaaatataattcatataaaagcagaaaatcagccactgaaaaagtattattctacagtaacattatgaatttctttaaacgagtcctcgtttattcaaaaacaggcgaagtcagaataagacctgtgatagaagtaaataaagaaactggagaaatcgtatgggacaagaaatccgatttcaggacagtaagaaaagtactatcatacccgcaagtaaacgtcgtaaagaaaacggaagtacagaatcacggcctggaccgcggaaaacctaaaggtttttacaacgccaatctatctccaagacctaaagaagggtcagttgaaaacctagtacccgcaaaacaatcatttgataccaaacgatatggcggctacgcaggcatatcaaatagttacgccgttctagtaaatggcattatagaaaaaggcaaaaagaaatccaaagcagaagtaacagagttccaagggatttccatactagctcgaaaagactttgacaaaaatccaaaacaatatctacttaacttaggatataaagacataaaaagcataataaaactgccaaagtattctttatttgaattagaaaacggaagcagaagaatgctagcatctattctaagtacaaacaataaaagaggtgaaatacacaaaggaaacgaaatgtacctaccagacaaattcgtcacattactatatcacgcaatgcgagtcaaccgaactctcgaacccggtcacaagaaatatgtcgaagcacaccgccatgtattcgatgaactattaacatatattttagaatacaacgagaaaatagttggagcaaaagccaacgggaaaagaattgtagaagcatactccgcaagaaaagataccgataatttagaagaattatgcaacagctttataaacttacttaatctcacagcactaggttccgccgtggattttgaatttctaggaacaaaaatccctcgataccgagactatactccttccagtttgttgaaagcaacactgatccaccaatccgtaacaggattatatgagaccagaatagacctttctaaactaggaggagactga

SEQ ID NO: 9005 - RNA, 4143 nt, synthetic construct
  misc_feature 1..4143: note = Cas9 variant
  source 1..4143: mol_type = other RNA
atgaagaaaatcctgggccttgacttaggaacaacaagtataggctgggccttagtttacgagtcagagaatgccgatgaaaaatcgtcaatagtaagactaggtgtacgagtcaatcctctttcagtagatgaaaaaggaaactttgaaaaaggtaaatcaatcacaaccaacgctgatagacaacaaacccacggtgctcgaataaatttacaaagatataaattaaggcgagagaatttgaaagattgcttacagaaacaaggctggattggcactgaagcactgtacgaagaaggaaaaacttcgacatttgaaacctacatgttaagagcaaaagcagccgaagaggaaatctccttacacgaattatgtcgtgtattgttcatgttgaacaagaaaagaggatacaaaagtaatagaaaagctaacaacaaagaagacggtaaactatttgacggaatgacggtagctaagaaattgtatgaggaacacctcacacccgcagaatatagtttaaaattactgtcttcaggtaagaaattcaaacaggaatactacagatcggacttaaaagaagagttcgatcgcatatggaacgaacaacaaaaatactacccagaaatattgacggatgattttaagcaacagctacaagggaaatcgaaaggtaatacaagtaaaatattcctaggaaagtatggcatctatagcgctgacctaaaaggtctagatcgaaaattgcaaccactcaaatggcgagtcgaagcactcaagcaaaaagtcgacaaagaagtcctagcattcgtaattagtgacttaaacggacaaatagcaagtacttcaggtctattaggagctatctcggacagatctaaggaactctattttaataaacagaccgttggacaatatctctggacatcactgaaggaatctccacatgtatcaatcaaaaataagccattctatcgacaagactacttggacgagttcgagaaaatatgggaaacccaagcaacgtaccataaagaactaactcccgaactaaagcaagaaataagagatataattattttctaccagagaccactaaaaagcaaaaagggactgatcagcgtatgcgaactggaacaacgaaaagtaaaagttacaatagacggaaaagaaaaagaaatatcaatagggccaaaagtcgcaccaaaatcatcaccaatgttccaagaatttcggatctggcaaaatctaaataatatactacttatagataaaggaaacaacagcaacagacctttatatgaagaggaacgaaatctattatatgaagaactatcagtgaaagagaaactctcaaaagccgaagcactaaaagtattaaacaaaaatggaaaacaatgggatttaaattataaagaaatagaagggaacagaacacaagcagtattatacgattgttacaatcgaataataggtatgactggacatgaagaatgcaactttaagaaactaaaagcgtctgatatacgatataatgtgaaaaccattttcaaaaacttaggcttttcgaccgacatactagacttcgacagttcgcttcaaggacacgaacttgaacgtcaaccatcataccagttatggcatttactttattcatacgaatccgacaactcaagaaccggaaatgacgcactactaagaaaattagaaacagcattctctataccaaaagaatacgctgcagtgttatcagacgtagtattcgaagacagttatggtaacttatcggtaaaagccatgcgcaacattctgcctcacctacaggcaggcctcgattatagccaagcctgtgaaaaagcggggtacaaacactcacgaaggagcttaactaaaaacgaattagataagaaagaatataaagaaaaactagaactgctacctaaatcgtccttacacaatcccgtagttgagaaaatattaaatcaaatgatcaatgtaataaatgctgtgatagacgaatacggaaaaccagatgaaatcagaatagagctagcccgcgaattaaaaattggcgccgcagaaagagaaaatatgacacgctcaataaaccaaggaaatgcggaaaacaaaagaatcagagaaatcttagaaaaagagttcgcattatcatatatctcaagaaacgacataataaaatataaattatacgaagaattaaaatccaacggattcaaaacactatatagcgatacatacataagtaaagataaacttttctcaaaagacttcgacatagaacatatcataccaaaagcgcgattatttgatgactcactttctaacaaaacaattgaagcaagagatgttaatatagcaaaatcaaacaaaacagcattcgacttcataagcgaaaaatacgatcaacaaggcattgaagcatataaaaagaaactcgacatcctactacaagacggatctatatcaaaagcaaaatataataggctattaatgaaagaagctgatataccatctggcttcatcgatcgagacctacgagacacccaatacatagccaagaaagcatatgaaatattgagtgatctcgtcaggaatgtaacaccaacaacaggagcagtcacttcaagactacgtgaagattggcagctagtggacgtcatgaaagaactaaacttcgaaaaataccagaaactcgggctagtagaagtaatcgaagacagggacggaagaaaaattaaaagaataaaagactggacgaaaagaaacgaccaccgccatcacgccatggatgctctaacaatagcatttacaaagccatcttatatacagtacttaaacaacttgaatgcaagatcagacaaaaactcaagcatatacggaatcgaaaacaaagaattacaccgcgaagacaacaaactacgtttcaacgcacccttgccaataaacgagttcagggcagaagcaagaagacatcttaaaagcatattagtatctgttaaagctaaaaacaaagtaatgacacaaaacgtaaacgttatcaaaacaaaacatggagtcataaagaaagtccagttaacaccacgaggagaattacataacgcaacattctatgggaccaagaaacgaccaattataaaaatggtaaaagttggagcagcactggacgaagttacaattaagaaagtaagttctagctttataagagaagcactacttgatagacttcatgaatataacggagacgcgaagaaagcctttacaggacgaaatagtatagacaaaaaccccatatacatagatgaagaacataagaaaacagtacctgcactcgttaaaacgatagaatgggaaatgtaccacccaacgagaaaaatgatcagcccggacttaaaaatagataaagtaatagacaaagggatcagagaaatactaagaacacgattggcaaaattcaacggagatgcacaaaaagccttcagcaacttagatgaaaacccaatatacaaagacgaagctaagaaaataaccctaaaaagggtaagtctagaaggcgtgagttcagtaattcccctccataaactaaaagacatgggaggcaaaccagttgtcggtaaagacgggaaacccgtctggggcgactatgtccaaacaagcaataatcaccatatcgccttctatatggatgaaaacggaaatctacaagatgatgttgttaccttcttcaaagcagcaaggagaaaatcacaaggagtacctgtaatcgacaaaaactataatcacgacaaaggctggcactttctcttcacaatgaaacaaaacgaatactttgtattcccgaatgaagccacaggcttcatcccaactgaagtagacttaatggatgaagccaattatgatatgataagcccaaatctatatagagtacaaaagatgagcaaaacaaaacagggcataaccgacaaaagagattactggtttagacaccatctagaaacagtgcttaataacgacctaaaagtgcgaaattcgatatttaaacaaataaacagtttaaaacctctagagggcatcgtaaaggtaagaataaacgcaataggaaaaatagttgccatcggagaatacgattga

SEQ ID NO: 9006 - RNA, 4143 nt, synthetic construct
  misc_feature 1..4143: note = Cas9 variant
  source 1..4143: mol_type = other RNA
atgaagcgaatactaggattagatctcggaacgacatcaataggctgggcccttgtgaacgaagccgaatctaacaacgaagcgtcaagtatagtaagactaggagtacgagtaaatccattaacagttgatgagaaaagcaactttgaaaaaggaaaagcaatcacaaccaatgcagataggcaattgagacacggagcaagaataaatttgcaaagatataaactaagacgacaaaatttacatgactgtctacaaaaacaaggatggttaggcacagaggcaatgtatgaagaaggaaaggccagcacgtttgaaacatataaattacgggctaaagccgccgaagaagagatatcgcttcatgagttcgccagagtattgtttatgttaaataagaaaagaggatataaatcaaacaggaaagcaaataataaggaagacgggcaattatttgatggtatgactattgccaagaaactatacgaagaacacctcacgcccgctgaatatagtctacaactattaaataaaggaaagaaattcacccaaggttattacagatcagacctaaacgcagaactagaacgcatatgggatgaacaaaagaaatattatccagaaatattgacagatgaatttaaacaacaacttgaaggtaaaacaaaaaccaatacatcaaaaatttttctagctaaatatggaatttacagcgccgatttaaaaggcctagatcgaaaattacaacctctaaaatggagagtagaagcacttaaacagcaagtagataaagaggtactagcatttgtgataagcgaccttaaaggacaaatagccaacacctcgggtctcttgggagcaatatccgacagatctaaggaactttatttcaacaaacagacagtaggacaatatctatgggcctcgctcgaagagaatccacatatcagtatcaaaaacaaaccattctacagacaagattatttagacgaatttgagaaaatctgggaaacacaagcaacatttcataaacaactaaccccagaactaaaacaggaaatccgagacataataatattttatcaaagaccgcttaaaagtaagaaatcattaatatccgtatgtgaattggaacaaaggaaagtaaaagcaacaattgatggaaaagaaaaggaaatcacaataggacctaaagtagcacctaaatctagtcccgtattccaagagttcagaatctggcagaacctaaacaatgtactactaatagacaacgacacaaacgaaaagagacctctagacgaagatgagagatacctgctttacaaagaactaagtataaaagcaaaacttagcaagactgaggctttaaaaattctcaataagaagggaaaacagtgggacttaaattataaagaattagaagggaaccgaactcaagctatcttatttgactgctataaccgtattatcacactaaccggccacgaagaatgcgactttaagaaaataaaagcgtcagaaataagacattatgtttcaacaatatttaaaaatttaggatttagcacagaaattctagactttgatccaagcctcgaaaaacatgaactagaaaaacaaccaatgtatcagctgtggcatctactatactcctatgaaagcgataactcccgaactggcaacgaaagtctattaagaaaactagaaacaacatttggatttcctgaagaatacgccacagtactatgcgacgtagtttttgaagaagactacggaaatctcagcgttaaagcaatgcgaaaaatcctaccttatctacaggcaggtaacgattattcccaagcctgcgcatatgcaggatataaccactcgagacacagtttaacaaaagaagaactcgaccagaaagtatataaggagagactagaactattacccaaaaactcattaagaaacccagtagtagagaaaatactaaatcaaatgataaatgtaataaatgcaatcatcgacgaatacggcaaaccagacgaaattcgcatagaaatggcaagggaactaaaaagttcagcagcagacagaaagaaaacaacccacgcaataaaccaaggtaatgacgaaaatcaatgtataagagaaatattagaaaaagagttcgcactaagctacatctcaagaaacgacataatcaaatataagctatatgaagaactaaaaccaaacggattcaaaacattgtactcagacacctacataccaaaagacaaactgttcagtaaagatttcgacatcgaacacattatcccaaaagcaaggctatttgacgatagctactctaataagacactagaagcaagagacattaatctagcaaaaagtaacaaaacagcatttgacttcgtaaaagaaaaatacggggaacaaggtgccgaagcatataaaaagaaactagacatgctcttaggtaataacgtgatatctaaaccaaaatacaataaactactaatgaccgaagcagacatcccatcagactttatcaatagggaccttagaaacacacaatatattgccagaaaagcatgtgaaatacttggggagctagtgagaacagtaacacccacaacaggaaaaataacaaaccgacttagagaagactggcagttagtcgatgttatgaaagaactaaactttgaaaaatatgaaaaactaggattgacagaaatagtagaagatcgagatggtagaaagataaaacgcatcaaagattggactaagcggaacgatcacagacatcacgctatggatgcactagctatagcatttacaaaaccaagctatattcaatacctaaacaatttaaatgcaagaagcaacaaaggcgactcaatttacgctatcgaaaacaaagaacttcactatgaagaaggcaaactacggtttaacgcacccataccagtaaacgtatttcgtgccgaagccaaacgtcacttatcagctatactcgtctcaatcaaagcgaagaacaaagttatgactcagaacgttaataaaataaaaacaaaacatggcataattaagaaaattcaacttactccccgcggccctttacacaatgagacgatatatggaacaaaaatgcgaccaataattaagaaagtaaaagtaggagcagcattggacgaagccactataaacaaagtatcctcgcccgccatacgcgaagtcttactcaaacgactaaacgagtattcaggaaacgctaaaaaggcattcaccggtaaaaacacactggataaaaatcccatctacctgaacgcagaaagaactaaaacagtacccgcaagcgtaaaaacagtagaatgggaaaactatcacccaattagaaaaccaattacgccagatctaaaagttgataaagtaattgacaaaggaataggagaaatattaaaagctagattagaagagttcaatggcgacgccaagaaagccttcagtaacctcgaagaaaatccgatataccttgaccaaaccaagaaaatagcattaaaaagagtgtctattgaaggagtactatccaccataccattgcacacattgaaaaatcaagcaggaaaacctattatgggaaaagatggaaaacctgtactgggcaactatgtacaaacctctaataatcatcatatagctttttactatgatgaagacggaaatttacaagacaacgctgtttctttcttcgaagcagcagaaaggaaatcacaaggcatttcagttattgataaagactacaatcgagacaaaggatggagattcttattcaccatgaaacaaaacgaatatttcgtctttccaaatgaagcaacaggtttcataccatctgaagtagatctaacggacgaagctaactacggaattatatccccgaacctctacagagtgcagaaaatgagcagaattgaaaaagggacatccgtaagcagagattattggtttaggcaccatctagaaactattcttaatgacgacagccgcctcaaaaattcagcgttcaaacgcatcaatagtttaaaacccttagaaggcattataaaagtacgcataaactcaattggaaaaatcgtcgcagtcggtgaatatgactga

SEQ ID NO: 9007 - RNA, 4143 nt, synthetic construct
  misc_feature 1..4143: note = Cas9 variant
  source 1..4143: mol_type = other RNA
atgaagaaaggttattcaatcggattagatataggtacaaattcagttggcttcgcagtaattacggacgactacaaagtgccgagcaagaaaatgaaagtattaggcaacaccgataaaagattcataaagaaaaatctaataggtgcactcctatttgatgaagggacaacagccgaagcaagaagactaaaacgcacagcacgtagacgttatacaagacgtaaaaacagactcagatacttacaagaaatttttagtgaagaaatgagcaaagttgattcatcgttctttcaccgtttagacgactcatttttaatacccgaagacaaaagagaatctaaataccctatatttgcaacactagaggaagaaaaagagtatcacaagaaattcccaaccatataccacctaaggaaacatctggcagatagtaaagaaaaagcagatctacgactaatatatttagccctcgcacacatgatcaaatatcgcggacacttcctatacgaagacactttcgacatcaaaaacaatgatatacagaaaatatttaacgagttcatatctatatacgataatgcttttgaaggatcaagcctctctggtcaaaacgcgcaagtagaagcaatctttacagacaaaatttctaaaagcgccaaacgtgaaagagttttaaaactatttccagacgagaaaagtacaggattattcagcgaatttttaaaattaatagtgggaaaccaagcagattttaagaaacattttgatttagaagataaagccccactgcaatttagtaaagatacgtacgacgaggacttagaaaatttattaggccaaataggcgacgattttgcagatttattcgttgccgcgaagaaattatacgatgcaatcctcctatccggaatattaactgtaacagatccatcaacaaaagcaccactcagtgcctcaatgatagaacgctatgaaaatcaccaaaatgatcttgtcgtgctaaaacaattcattaaaaataacctaccagaaaactacgtcgaagtctttagtgacgactccaaaaacggctacgcaggatacgtaggcgtagattcaaaaataagaaaaaggaatgcaaaactagcaacagaagaagagttctacaaatacctcaaaaacatactaaacaacgtaaaaggggcagattatttcctagacaaaatagaaagagaagatttcctgagaaaacaaaggacattcgataacggttctatcccgcatcaaatacacctacaagaaatgaacgctatactcagaaggcaaggcgaacactatccatttttaaaagaaaaccgcgagaaaatagaaaagatattaaccttccggatcccatactatgttggaccgttagctagaggaaatagagacttcgcttggttaacaagaaatagtgatcaagccatcagaccatggaattttgaagaaattgtggataaagcctcctctgccgaggacttcataaataaaatgacaaattacgacttatatttaccggaagaaaaagtactaccaaaacactcactactctacgaaaagttcgcggtatataacgagctgacaaaagtaaaattcatagcagaaggtcttagagattatcaattcctcgattctggccagaagaaacagattgtgaaccaactgttcaaagagaaaagaaaagtaacagaaaaagatataattcactacctacatacagtcgatggatacgatggtatagaactcaaaggtatcgaaaaacaattcaacgccagcctttccacttatcacgacctattaaaaataatcaaagacaaagagttcatggatgatccgaaaaatgaagaaatcctagaaaacatagtccacacactaaccatatttgaagatagagaaatgatcaaacaacgattagcacagtatgactctttatttgacgaaaaagtgataaaaagtctaacaaggagacattatacaggatggggaaaattatcggccatgctcatcaacgggatacgtgacaagcaaactggaaaaaccatattggattatctaatagacgacgcatactacaatcgcaacttcatgcaactaataaatgacgacgggctatcttttaaagaaataatccaaaaagcacaagtcgtcggtaaaacagatgacgttaaacaagtcgtacaagaactcccaggttctccagcaatcaagaaaggaatattacaaagtattaaaatcgtcgatgagctagtcaaaataatgagacacaacccagaatcaatagtgatagaaatggcacgagaaaatcaaacaacggcaagaggaaagaaaaattcccaacaacgctacaaacggatagaagacgcgctaaagaacttagcaccaggacttgattccaacatactaaaagaacacccgaccgataacgtacaattacagaatgacagattattcttatattatttacaaaatggaaaagatatgtataccggagaagcactagacatcaatcaattgagttcttacgacatagaccacataataccacaagcattcataaaagacgactcattcgacaatagagttctaacatcaagcaaagataataggggaaaaagcgataacgttccctcaatagaagtagtacagaaaaggaaagcgttttggcaacaactattagatagtaaactcatatcagaaagaaaatttaacaatctgacaaaagcggaaaggggaggactagacgaacgagataaagtaggctttataaaaagacaattagtagaaacgagacaaataacaaaacacgttgcccagatacttgatgcgagatataacacagaagtaaacgaaaaagataagaaaaatagaacagtaaaaatcataacactaaaaagcaaccttgttagtaacttcagaaaagaatttagattatataaagttagagaaataaatgactatcaccacgctcatgacgcctatctcaacgcagtagtcgctaaagccatattaaagaaatatcctaaattggaaccagagttcgtatacggagaataccaaaaatacgacctaaaaagatacataagcagatcaaaagacccaaaagaagtcgaaaaagccactgaaaaatatttcttttactcaaacttactaaactttttcaaagaagaagtgcattacgctgatggaaccatagtaaagagggaaaatattgaatattcaaaagatacaggcgagattgcctggaataaagaaaaagattttgcgataataaagaaagtactaagtctaccccaggtaaacatagttaagaaaagagaggtacaaactggtggattctccaaagagtcaattttaccaaaaggaaatagcgataaactaattcctagaaaaacaaaagatatactatgggacactaccaaatacggtggatttgacagtccagttatagcgtactcgatcctactcattgcagacatagaaaaggggaaagcaaagaaactgaaaacagtgaaaacactcgtcggaattacaataatggaaaaagccgcttttgaggacaacccaataacattcctagaaaataaagggtatcataacgttcgaaaagaaaatatcctatgcctaccaaagtattccctatttgagctagaaaacggtagacgaagattactagcttctgccaaagaattgcaaaaaggcaacgaaatagtcctaccagtatatctgactactctgctgtaccacagcaagaacgtacacaaactagatgaaccaggacacctagagtacatacaaaaacaccgaaacgagttcaaggatcttctcaaccttgtaagcgaattttcccaaaaatacgtattagcagacgcgaacttagaaaagatcaaatcattatacgcagataatgaacaagcggatatcgaaattctagctaattcatttattaatctcttgacatttacagctctgggggcaccagcagcttttaaattcttcggtaaagacatagataggaaaagatataccactgtatcagaaattttaaatgcaaccttaatacaccagtcaatcacagggctatacgaaacaagaatagacctatcaaaattaggtgaagactga

SEQ ID NO: 9008 - RNA, 4143 nt, synthetic construct
  misc_feature 1..4143: note = Cas9 variant
  source 1..4143: mol_type = other RNA
atgaatttaaggcacgtaggaaactacaacataggcctagatatgggcacagcaagtgtaggatgggctgcaatagatgaacaaggagaattactacattttaaaggcaaaccaacatggggatccaggttattcgattctgcaaatacggcagctacagctagaatgcctaggggtcaaagaagaagatatataagaagaagatggagacttgatttattacaaaaatttttcagtgaggagatggcagaaaaagatcctgagttcttcataagattgaggcaaagctcattatggcccgaagacagagaaggaggtcacacagcctaccactggcctctttttaacgattctgatttcaatgaaaaagaatactatgaaaagttccccacaatttttcatttacggcaatggctcatggaaacagatgaaaaagccgatattagattgatttaccttgcattccataacatagtaaagcaccgaggtaactttcttcaagaaaacaacgatagtctatcagctcaaaacgccaatatgagagaaagtctagaatcattctgcatagctttagaagaatggtgtgatgaaaaggaacttacatgcagctgtgacccgcaaaagctagaacatttattcaaagaagtgaaatatagatccgatatcagagacggctttgctgcattgttagggttggcttgttctggagaaaatgaagtagacgtgaaagcaatggcaaaagagatgggtaaagctattgttggatacaaagctgatttcagtaaaatatttacagaatgcgacaaagaaggttcatcttttagattatcggatgacgaaggacctgaggcttttctggatatatgtccagatgatggcatcgcattgtttgaagcgatacaaatggtctatagctcattcatcctaacaggaatgctcacagagaagggcctatcacttagcaaaatctcagcgtacaaccaatatgggcaagatctagaatcattgaaagcgcttgtaaaagaatatgtgccaaatgaatactcgagtttctttcgtgggcccacatattcaggaagtactgaatacgaccctagtaaagcccagggttacacacgttataatttgggaccttcaaagaaaggatcaggagcaaaaccaatggcctatgaagattttaagaaatcagtagaacaattattcgcgaacaccaatgcgataaatgacgaaagatataaagaaatgatgggcaggtttgcagaagagaaatttctcagaagattaagaacatcggataacggaaggatcccctttcaactaaatttagaagagatgacagcaataataataaatcaaggcaagtattatccctttttattagaacagcaagaaaaattggagagtttggtgagattcagaataccatattacgtgggacctttaacacgaataaacgcaagattggacagtaagggcaacgcgtgttttgcatggagtaaacgaaaagatgggatggatagtgccagtataaaaccatggaattgggatgaagtaattgataaacacgcctcggcccaggctttcatagaacgaatgactggaacttgtacatatctgagaggagagccagtattaccgaggtgttcattactgtatgaggagtattgtgtactaaatgaattaaatggtgctagatggacacaagacggggataagtttatacgctttgactacaaagatagaagtgatataatagaagaattatttaagaaaagaagagggaggatacaatacgcagcagttgcggactggatgaaacaagaaagatctcacgcaaacgttcacgtaagtgggggacaaggtgaaaacgcatttgagtctcggttgtcatcataccactttttctgtaacgacgtcttcggagtcgacgagttacccggaagctatgtggatatggtagaagaaataatactatggagcacattattcgaggacagatctatcctaagagaagagatacaaagaaaatatggtgatgtgttgaacgaagaacaaataaagactatctgcaagaaaagattcagcggatggggacgattaagccggaaattactttgctctcttaaagctcaaacggacaatggaccaaaatccattatggatatactgcaggaaggtgaccagaataacggaagagtgggcagagcaatggtatttcaagaaatcctacacgacgaacaattaggattcgaacagaaaattgaagaggaaaatacccaaagcatgctagaaggagaaaacttactaattgaagaccttccaggttcacccgctataagacgcagtataaatcaagcagtaagaatagtagacgaaatcgtaggtatagctggacatgcacccgacaatatttttatagaagtaacgcgagaagatgatacaaagaagaaaggaaaaaggacaacgacccggtactcaaatattcaaaaagcactagaagcactgaaagaagaaggtgctgaagcattaagagagttaaaaacatataaacacaatgaattagacaaacgactttcactatattttatgcaaaacggtaaaagtttatactccggtatacccctggatattcggcgactgagcgaataccaaatagatcatatcattccacaatcatatattaaggacgatagttacgaaaatatggcgttggtcttgcccggggaaaatcaatcaaaagcagataacctccttatatcacaagatataagaataaagatgaaagcaacatggacagcgttacataaagcaggtttgatgggagataagaaatataataatttgatgaactcatctatatcagatgcgaaaatgaaaggttttataaatcgacaattagtagaaacatcgcaaagcgtgaaattaactcaaatgatgttgagtcaaaaataccctggggcaaaagtcagaccaataaaagcaagcataagctcacaattaagagatgcatgtgacttagtaaaatgtagggaggcaaacgactatcatcacgcacatgatgcgtatttagcatgccaagtagggaggtttgttttaaaaagacactccagtatgtttgacaacccaattggaatgacgaaagtaatcagagattttgtaaaaagacaaggccaagagttcaaaagaaatggtaaactgccagcgtatgccagtagatcaggatttatagtccaatcattcatgagatcaggatttgacgcggaaaccggggaattattacgagacgactggaacgcaccttttgaaatcgcaagaatcaaaagatgcctaaactatagagattgctatatttcaagaatgccaatggaagattcaggagcgttttgggatgctactatctatagccctaaagcaggtaagaaaggagcattgcctgtgaaacaaggattgccagttgaaaaatatgggtcatatagtagagaacagttcgcatatttctttgtatataaagcatacaatccgaaaaagaaagcctacaggttagaatttgaagcagtccctgtgagggtagcaagtgcagtggagaccagggaaaacgccctcgaagaatacgcgaagagtgtagctaaacaggcgggactagaatttgtagaagtagcgcgacctaaagtgtataaatatcaattgatagaactcggagaagatagactatatataacaggcaaacgggaggtacggaatgcaagtcaacttgcctttagtctagatgaaatagacttactaaaacgactagcagaaggagaagaaacaagcagcgaagaaagagaaaggttattcgatgtgttaatagagaaatacgctaggtacgcgccaagattagctcgccaactatcagtcgattcaatgagcgcgacattcgagacactcaatgcagaagaacaattgggcatcttacttagtctcgtggaaatagcgaacggcaaacgaaatatgattgatctatccagcgcaggcggaagtaaaaatgcaggatgtatgaacccaacatttagcagcgaactctccagtcctggatcaaatttcacatttattgatcaatccgtaacgggaatgtttgagcgacgtcaaagactagaactctga

SEQ ID NO: 9009 - RNA, 4146 nt, synthetic construct
  misc_feature 1..4146: note = Cas9 variant
  source 1..4146: mol_type = other RNA
atggtaaagaagaaatacgccatcggtatagacatcggaaccaacagcgtcggttggagcatagtaacagacgactacaaagttccaagtaagaaaatgaaagtatttggaaacacagaaaaacgatatattaagaaaaatcttctaggaacattactattcgatgaaggtaatacagccgaaaacagaaggttaaaaaggacagctcgccggagatacacacgaagacgtaaccgaatactatacctgcaagaaatattcgccgaagagatcaacaaaatagacgacagtttctttcaaagacttgacgacagttttctaatcgtagaggataaacaagggtctaaacatcccatatttggaaccctacaagaagaaaaagaataccacaaacaattccccacaatctaccaccttcgaaaacaacttgccgatagctcccagaaagccgatatacgcttaatatacttagctttagcccacatcatcaaatacagaggacactttctatttgaaggcgacttaaaatcagaaaataaagacgttcaacacctattcaacgatttcgtcgaaatgttcgacaaaacagttgaaggaagctatttatctgaaaacttaccaaatgtagctgacgtcctagttgaaaaagttagcaaaagcaggagattagaaaatatactgcactacttcccaaacgaaaagaaaaacggcctgttcggaaactttctagcattagcgttaggcctccaaccaaattttaaaacaaatttcgaactagccgaagacgcaaaaatccaattctccaaagaaacctacgaagaagatctagaggaactactcggaaaaattggagatgactacgccgaccttttcatagctacgaaaagtctatacgatggaatattacttgccggaatactatcaacaacagactcaacaacaaaggcgcctttatcgtcatccatggttaatcgctatgaagaacaccaaaaggatttagcacttctgaaaaacttcatacatcaaaacctatcagactcatacaaagaagtattcaatgacaaactaaaagatggttatgctggatacatcgaaggaaagacaactcaagaaaacttctatcgatttattaaaaaggctatagagaaaatagaaggctctaattacttcatagataagatagatagagaagacttcctacgaaaacaaaggacttttgacaacggaagcataccacatcaaatacacctacaagaaatgcacgcaatcataagaagacaagcagaattttacccatttctagtcgaaaatcaggataaaatagagaaaatactaacattccgtattccgtattacgtaggaccattagcaagaggaaaaagcgaatttgcgtggctaaacaggaagtccgacgagaaaataagaccatggaactttgacgaaatggtcgacaaagaaacgtcggcagaaaatttcataacacgcatgacaaattacgacagatatcttccagaccaaaaagtattgccaaaacactcattattatacgaaaaatttgctgtatataatgaactaacaaaagtaaaatttatcgcggaaggaatgagagattaccaatttcttgattcaggacaaaagaaagacatagttaaaacgctattcaaaaccaaaagaaaagttaccgctaaagatataaaagcatacttagaaaattcaaacggatacgcaggagttgaactaaaaggacttgaagaacaattcaacgcatcacttcctacatatcatgacctcttaaaaatacttagagacaaagcattcattgacgctgaagaaaaccaagaaatactagaagacatcgtcttaacactcacgttattcgaagacagagaaatgatcagaaagcgattagaaaaatacaaagatatcttaactgaggaacaacgaaagaagctagagaggcgacattacactgggtggggaagattaagtgccaaactaataaacgggattctcgacaaagtaaccagaaagacaatacttgggtatctaatcgatgatggaacatcaaaccgaaactttatgcaactaatcaacgatgatacattatcatttgttgatgagattcgactagctcaaggatccggagaggcagaagactaccgcgcagaagtacaaaatttagcaggatcacccgcaattaagaaaggaatattacagtcactcaaaatagtagatgaactaatagaagtaatgggctacgaaccagaacacattgtcgtagaaatggcgagagaaaaccaatttaccaaccaaggacgccggaactcgcaacaacgaattaacaggctagagaacgccctaaaagattttggtagtaaaatcctagaagaacaaaagccatatggcgtatccaaagtaaacaatatacacttacaatccgacagactattcctttactacctacaaaatggaaaagacatgtacaccgatgaagaactagatatagaccatttaagtgaatacgacatagatcacattatcccgcaagccttcataaaagacgattcactagacaataaggtactaaccaaatcagcgaaaaataggggcaagtcagacgatgtaccgagcatggaaattgtacacaataggaaaaatttctggcgacaactcctcaaaagtaaactaatttcacaaagaaagtttgacaacttaaccaaagcagaacgcggaggcttaactaacgaggacaaagctagattcatccaacgtcagctagtcgagacaaggcaaataaccaaacatgttgcacgaatgttagacacaagattcaatacaaaattagacgaggcaggtaaccgtataagagacccaaaagtaaatattattacattaaaatcgaacctcgtatcccaatttagaaaagactatcaactttataaaattcgagaaatcaacaattaccatcacgcccacgacgcatatataaacgctgtcgtcgcaaccgctttgctaaagaaataccctcaactagcacccgaatttgtatatggagaatatccaacttataacagctacaacagcagaaaatccgcaacagaaaaagtattattctactcaaatataatgaacttcttcaaaagaatcgtagtacacagcaaaactggggaagtaagaatacgcccagtcatcgaagtaaataaagaaacaggcgaaatagtatgggacaagaaatcagacttccgaacagtaagaaaagtactatcttatccgcaagtcaacgtagtaaagaaaacagaagtccaaaatcatggactagaccgaggaaaacccaaaggcttttataacgcaaacttgtcaccacgtccaaaagaagggtcagtcgaaaacctcgtaccagctaaacaaagttttgataccaaaagatacggtggatatgctggaataagtaactcttatgctgtcttagtaaacggcataatcgagaaaggtaaaaagaaaagcaaagcagaagtgacagaatttcaaggaatctcaatactcgctagaaaagacttcgacaaaaatcctaaacaatatttgttaaatctaggttacaaagatatcaaatcaatcataaaattacctaaatactcgttattcgaactagaaaacggttcgagacgaatgttggcatccatattaagtacaaacaataaacgaggcgaaattcacaaaggtaacgaaatgtatctacccgataaattcgtaactttattataccacgccatgagagtcaatagaacactggaaccaggacacaagaaatatgttgaaacccacagacacgtcttcgacgaactacttatatatatcctcgaatacaatgagaaaatcgttggagccaaagcaaatggaaaacgaattgtagaagcatactcagcaagaaaagataccgacaatcttgaagaattatgcaactcattcataaatctgctcaacctaacagcgcttggtagcgcagttgatttcgagttcttagggacaaaaataccaagatacagagactatacaccaagttctttattaaaagcaacattaatacaccagagtgtcacagggttgtacgaaactagaatcgatttaagtaaactcggaggtgactga

SEQ ID NO: 9010 - RNA, 4146 nt, synthetic construct
  misc_feature 1..4146: note = Cas9 variant
  source 1..4146: mol_type = other RNA
atgaattacgtgaaagagtaccacatcggactggacataggaacatcaagtataggttgggcagtaacagactcacaatttaaactaatgcgaataaaagggaaaaccgccataggagtccgcctatttgaagaaggaaaaaccgccgctgaaagacgaacatttcggacaacaagaagaagactaaaaagaaggaaatggcgactacattacttagatgaaatatttgcaccacacctacaagaagtagacgaaaactttttaagaaggcttaaacaaagtaatattcatccggaagacccagccaaaaatcaagcatttataggaaaattattattccccgacttgcttaagaaaaatgaaagaggatatccaacactaataaaaatgagagacgaactgcccgtcgaacaaagagcacactatccagtcaccaatatatataaactaagagaagcaatgatcaacgaagatcgacaattcgatctgcgtgaggtgtatcttgcagtgcaccacattgtaaaatatagaggacactttctaaacaacgctagcgtggataaatttaaagtcggtcgaatcgactttgacaaatccttcaatgtcttgaacgaagcatacgaagaattacaaaacggggagggctcattcacaattgaaccttccaaagtagagaaaattggacaattattactagatacaaaaatgaggaaactagataggcaaaaagcagtcgcaaaattcttagaagtcaaagtagcagacaaagaagagactaaaagaaacaaacaaattgctacagcaattagtaaattagtactaggctacaaagcggacttcgcaacagttgcaatggctaacggaaatgaatggaaaatagatctatcgtcagaaacctcagaggatgaaatcgaaaaatttagagaagaattaagtgacgcacaaaatgacatattaacagaaataacttcactcttctcacaaataatgctaaacgaaatagtaccaaacggaatgagcataagtgaatcaatgatggatagatactggacacacgagagacaactggcagaagttaaagaatacctagccacacaaccagcatccgctagaaaagaatttgaccaagtgtacaataaatatataggacaagcacccaaagaaaaaggctttgatttagaaaaaggcttaaagaaaattctatctaagaaagaaaattggaaagaaattgacgagttgttaaaagccggagatttccttcccaaacaacgtacaagcgccaatgtagttatacctcaccaaatgcatcaacaagaattagacagaataatagaaaaacaagcaaaatattatccatggctcgccacagaaaaccctgcaacaggtgaacgagatagacatcaagccaagtacgagctagaccaattagtctcatttcggattccctattacgtaggacccctcgtaaccccagaagtacagaaagctaccagcggagcgaaatttgcatgggcaaaacgcaaggaagacggggaaataaccccttggaatctatgggacaaaatagatagagccgaatcagctgaggctttcatcaaaagaatgaccgtaaaagatacttaccttttaaatgaagatgtgctgccggcaaattccttgttataccaaaaatataatgtactaaatgaactgaataacgtccgagtcaacgggagacggctcagcgtaggaattaaacaagacatctacagtgaattatttaaaaagaagaaaacagtaaaagcctctgatgtggcctcgctggtgatggcaaaaacgcgcggggttaacaaacccagtgtagaaggactaagtgaccctaagaaatttaacagcaatttggccacatacctagatctcaaatcaatagtaggagataaagtcgatgataattgctaccaaaccgatttagaaaatataatagaatggcgatctgtatttgaagacggagaaatattcgcagacaaactgactgaagtcgagtggctaacagacgaacaaagatcagccctagtgaagaaacgatataaaggatggggacgactctcaaagaaacttttaaccggaatagtagacgagaacggacaaagaattattgatttgatgtggaacactgatcaaaactttatgcaaatcgtgaatcaaccagtgtttaaagaacaaatagatcaactaaaccaaaatgcaatcacaaatgacggaatgactctaagagagagagttgaaagcgtcctcgatgacgcctatacaagcccgcaaaataagaaagcaatatggcaagtggtccgagtcgtcgaagacattgtaaaagcagtaggaaatgcaccaaaaagcatctctatcgagttcgctaggaatgagggtaataaaggtgaaataacaagatcccgaaggacccaactacaaaaactattcgaagatcaggcacacgagctagtaaaagataccagtctaaccgaagaactagaaaaagcactcgatctctcagatagatactatctttatttcacacaaggaggcaaagacatgtacactggcgatcctataaatttcgacgaaataagtactaaatatgacatagatcatatactaccacaatcattcgttaaagacgactctcttgacaacagagttctagtaagcagagcagaaaataacaagaaatcagaccgggtccctgcaaaattatacgcagcaaaaatgaaaccttattggaatcaattattaaaacaaggactaataacacaaagaaaatttgaaaacttgactatggacgtagatcaaaatataaaatacagaagtctaggcttcgtcaagcgtcaattagttgaaacaagacaagtgattaaattgactgccaacatactaggttcaatgtaccaagaagctggaacagacataatagagacccgcgcaggcctaactaaacaattaagagaagagttcgacctcccaaaagtgagagaagttaacgattatcaccatgccgttgatgcatatttaactactttcgcaggtcaatacttaaacagaagatatccaaaactaagaagtttctttgtctatggagaatatatgaaatttaaaaggggctcagatttaaaattaagaaatttcaactttttccacgaactcatggaaggagacaaatcacaaggaaaagtagtagaccaacaaaccggcgaactaatcacaaccagagacgaagttgcgaaatctttcgacagacttttaaacatgaaatatatgttagtctcaaaggaagtccacgacaggtcagatcaactatatggagcaaccattgttacagcaaaagaatcaggaaaactaactagccccatagaaatcaaaaagaatcgaccagtggacctatatggggcttacaccaacggtacaagcgccttcatgactattatcaaatttactgggaacaagcctaaatacaaagtaataggtgtaccgactacgagtgcagtaggactaaagagagtcgggaaacctggttctgaatcatataatcaagaactgcatcgaataatcaaatcaaatcctaaagtaaagaaagactttgaaatagttgtacctcacgtatcctatagtcaattaattgtagacggtgattgtaaattcactttagcctcagacacatatcaacaccctgcaacccaattagtactcagcaaagagtcaatggaaataatagcagatgactttaaatttgtgaaagaaaatccagcaaccgcagatgaacaattggtccgagtctttgacgaaatagtaaatcaaatgaaccactactttaccatatttgatcaacgatcaaataggcagaaggtaaccaaagctagagataaattcgtatctcttccaactgaaagtgaatatgaaggagccaagaaaactcaagtaggaaaaacagaagtaataaccaatttgctcatgggactacatgccaatgccgcccaaggagacctaaaagtattaggactatctaccttcggatttttccaaagtagtggcggactaaacttatccgaagatgcgatgattgtctaccaaagtccgaccggattgtttgaacgacgaatatgcttgaaagatatatga

SEQ ID NO: 9011 - RNA, 4146 nt, synthetic construct
  misc_feature 1..4146: note = Cas9 variant
  source 1..4146: mol_type = other RNA
atgaaacaaatactaaagaaagtgcagggatacaacataggacttgacattggaacaaacagcgtaggttgggtggttactgacgaaaatgctaacctgctgcagtttagaaagaaaaacatgtggggtgcacgacttttcgaaaaaggagataccgctcaaggaagaaggttatcaagatcaaccagacgaagatacgacagacgtcggcaaagaatacattatctccaagaaatgttagctacaatggtgttaccaatagatgaatccttctttataagactgaacgaagcatttttatggaaagaagacaagagtgtacaaagagactacatcctcttcgcagataaacaattcaccgacagagacttctacaaacaattcaaaacaatataccacctaagaaaatttcttctagatacgaaagaaaaagcagatccgagatttatatatctagcccttcaccatatgattaaatatcgaggaaactttctctaccaaggacaatcattcgatgttgtagaaaacgtgcaagagagcttcagagtactcctagaagaaatgtacgaacaacttggaaaagaatgggaatacggtgaacatttcgacgatattcaaagaatacttgaaaacaccacaatagggaagaaatccaaacaagaacaaatagcagccatactaacagaacaatacggaaacaagaaacttgcaaacgaagtaacaagagcatgcctaggatacagcttcgacctaacggtagtaatggaaaacgaaaatttattagatgaatcggggaagaaaataaaaatttcattcagtgacagtaaatatgaagaacaagaattagaattgcaaaaccgactagaagaaaaattcgcagtcatagaagcactaaaaagaatatacaactggttggtattaaaagatacactaagaggcaagaaatatatctcagaggcgatggtaaacaaatatgaagctcatcacgaggacttagtaaaactaaaaagactatttaggacctatctatcaactgaggaatacagttgtttctttcgaaaagaaaaacaaaaagataaatacatatcaaattatgtaaattaccgcaaaggagcagaaaggtgcagcaaagaaaaactatataaagctatacatgaattattcgacacagtggcgaaagacgacgtagtttaccaagaaatagtagagaaaatggaccaaggagaatttctaaccaaacaaaacgaagttagcaatgcatatataccataccaatgcaacgaagttgaaatgaaaagaatactaaaacaacaaggtgagttctacccagaactaaaagaaaacgcagataaaatactgcaactactgctatttcgaataccatattatgtaggacccctagtggacgaaaaacaaagcaaatttgcatggatgaaaagaagaacaggtatggaacaagtcaaaatatacccatggaatttcgaacaagtagtcgatatagatcaaacagcagaagcatttattaccagaatgacaaattattgtacttacctaccggaagaaaaagtactacctaaacaatcactgctatactcagaatatgaacttctacaagaactaaacaaaataaaaattaatggaaaattcagcctagaaacacgaaacaaaatcatcgaacaactttttaagaaacagaagaaagtcacagaaaaacaactcaagaaatggctagttagagaacaatattgcacgacaaaagtgacagagaaaatggtaaaattagatgaaaatgcatattatataaccggatttcaaaaagaaaatgaatttgcaagcagtctaacctcctacatagacttcacaaaaatacttggagaaatcactgaacgcaaccgtaaaatgatagaagaaataatatactggctaaccgtatttgaagaaaaatcaatcgtaaaaagaaaaatacagaagaaatatgggaacgaaataaacgataaacaactcgcacaaatactaaaactaaactatagtgggtggggacgattctccgaaaaattcctaaacggcatcaaaggatttgacagacaaggacaaaagaaaacaataatggaattactgcgggaagattcacgactattaaatataatgcaaataataaataacgaagaaatgggtttttgcaaaattatagaagccaaccagaagaaactatacggcaacgaaaatctactagatgtagtccaggaattacacggaagtccagcaatcaaaagaggaatatggcaaagcctgaaaattgtagaagaaataataagtattatgggaggggtgcctcaaaacatattcatagagttcgcaagagaagacgatgacagagtgagaaccaattcaagggtaaaacaaattgaacgtctatacaagaaattcaaagaagaagtgaacgacttcaacgaacatgcggcaaacgaactgaaagagaaaaggtatcaaaacagaattgacgaagagaaagtattcctatattttatgcaaaacggcaaaagtctatatagcggagtaactctcgatatagacagattaaacgaatatgaagtggaccacattattccaagaacacttgttaaagatgatagtttagaaaataaagccctagtattaaaaggggaaaaccaacgaaaaggagaaggactcatcccccacgaatggcaaaacagacaaaaagaggtctggaagaaactactaagttgcggccttatgggcaagaagaaatatgctaatctgtgcaaagagagcttcggaaacgaaaaagaacaaaaacacttcatagcgagacaaattgtggaaacacgtcaaataatcaaacaggtggcaaatatactggctcaatactaccaaggagtaaacgtggcagcagtgaaagcatcactaggaagtgaattaagggaaaattacactattgagaagaaagatgataacggattcttcatggaaaacaaatcgtatactatgttaaaatcccgaaagataaacgatttccatcatgcgcaagatgcttacctagcctgtgcagtcggattatacatcaaagcagcttttcccaaatacgagaaggaaattgattacgaaggatatcggaaatattaccagaagaaaaaccagcaaaaagacggagtaagaaacgaaaagagacagttcttttcctatgtaatgagtagattttccgaacaaatagtagacaaagaaacaggagaaatactgtgggacggcactcaaaagttggcatatattaagaaaatttttggctacagagactgccttattaccaagaaactagaagaaaacaccggagaattttacaaacaaacaattaacgcaaaaccagaaaaaggaaaggaaaataatacaaaactactgccaatcaagaaaggcctgtcagtggaaaaatatggtggataccaaggaggagaagcagcctactcatgtttagtaagatatcaacaaggaagaaagacaaaattaagtttagagaaaatatctgttataattgcaaagaaaatagccgaaaaagaagtatctttagacagatatcttaaagaaaagttaggagttgaagaaatcgttatattaagaaagaaagttatgaaaaatcaattaatagaagatagtgacggaaatcgtttctacttaactgcagccacagaagttgttaatgccaaacaattcatcctggacggaaaacaccaacatctactaagaactatagcaataatggagaaaggcgagtactatggatacagactagacgaattagaaaattcaatggatgaattatatgcatattatagaatgaaaatacaacaacaatatccagcatatgaaagtatagtcaagaaaatagttgaaagtcatgtctacgagagtcttcacgtagaagagaaaataaaggcagtccaagaaaaaggaaaatttctaatccaacttttaagattaacggaagcgaacgctgaatgtatagatctaaaaacaatatcggatggtagattagctgacaggatcggaaggaaaaaccactatactattaaagaaggaataaagttcatagatcaatccataacaggcctctacgaaagatacatgacagtgtga

SEQ ID NO: 9012 - RNA, 4146 nt, synthetic construct
  misc_feature 1..4146: note = Cas9 variant
  source 1..4146: mol_type = other RNA
atggattacgtaaaagaataccatataggtctagacatagggacctcatcaataggttgggcagttacagacagtcaatttaaactgatgagaataaagggaaaaactgctataggagtcagactgttcgaagaaggaaaaacagcagcggaaagaagaacattcagaacaaccagaagaagattaaaaagaaggaaatggagattgcattatctcgacaaaatctttgccccccatctccaagaagtagatgaaaatttcttacgaaggttgaaacaatctaacatacatcctgaagacccagcaaaaaatcaagcattcataggaaaattgctctttccggacttgctaaaaaaaaatgagagaggatatcccaccttaataaaaatgcgggatgaactcccagtcgaacagcgtgctcattaccctgtcacaaatatttacaaactaagagaggccatgataaatgaggaccgacaattcgacttacgggaagtatacctagctgtgcatcatatagtaaaataccgaggacacttcttaaacaatgctagcgtagacaagttcaaagtagggagaatagactttgataaatcgtttaatgtattaaatgaagcgtatgaagagctacaaaacggtgaaggatcatttacaatagaaccaagtaaggtagaaaaaataggacaattgctccttgacaccaaaatgaggaagcttgataggcaaaaagcagtagccaaactactagaagttaaagtagcggataaagaagaaacaaaaagaaataaacaaatagcaacagcaatgagtaagctcgtattaggctataaagcagattttgccaccgtagcaatggcgaatggtaacgaatggaaaattgatttatcctctgagacgtcagaagatgaaatagaaaaattccgcgaagaattaagtgacgcacaaaacgacattcttactgaaataacaagtctttttagccaaataatgttaaacgcaatagttccaaatggaatgagtataagtgaatcaatgatggacagatattggacacatgaaagacaactagcagaagtaaaagaatatcttgctactcaacccgcaagcgcacgaaaagaattcgatcaagtttataataaatatataggccaagtcccgaaagaaaaaggattcgacttagaaaaaggactaaaaaaaatattgtcaaaaaaagagaactggaaagagatcgatgaactactaaaagcaggcgactttctacccaaacaacgaacaagtgcaaatggagtaataccacatcaaatgcatcaacaagagttagacaggatcatagaaaaacaagcaaaatattatccatggttagcaacggaaaatccagccacgggcgagcgtgatcgacatcaagcaaaatatgaactagatcaattggtatcctttcgaataccatattatgtaggcccgctggtaactcccgaagtacaaaaagctacatcaggagcaaaattcgcttgggccaaacgcaaagaagatggtgaaattacgccatggaacctttgggataaaatagaccgagcagagagcgcggaagcatttataaaaagaatgacagtaaaagatacgtatttgttaaacgaagatgtgctaccagctaatagtctgctataccaaaagtataacgttttaaatgaattgaataacgttagagtaaatggtaggagattatccgttggcataaaacaagacatatatacagaattattcaaaaaaaaaaaaacagtgaaagcaggggatgtcgcatcattagtcatggctaagacccggggagttaataaacccagtgttgaaggcttaagtgatcctaaaaaatttaacagtaacctagcaacatacctagatctaaaatcaatcatgggggacaaagtagatgacaatagataccagatggacctagaaaacataatagaatggaggtcagtttttgaggacggagaaattttcgcagataaactcacagaagtagagtggctaacagacgaacaaaggtcagccttggtgaaaaaaagatataaaggatgggggcgcttgagtaaaaaacttctaacaggaattgtggatgaaaatggacaaagaattattgaccttatgtggaacaccgaccaaaattttatgcaaattgtaaatcaaccagtcttcaaggaacaaattgaccaactcaaccaaaaagctatcacaaatgatggaatgacattgagggaacgagtagaaagcgtccttgatgatgcatacactagcccacagaataaaaaagcaatatggcaagtcgtaagggtcgtggaagacatcgttaaagctgtaggaaatgcaccgaaatcgatcagtattgaattcgcaagaaatgagggcaataaaggtgaaattacacgtagcaggagaacccaactgcaaaaattattcgaggaccaagcccacgaacttgtaaaagatacatctttaactgaggaactagagaaagctcccgacctatctgatcgatactatttttattttacacaaggtggcaaagatatgtacacaggtgacccgataaacttcgacgaaataagtactaaatatgatatcgatcatatacttccacaatcgttcgtgaaagatgactctctagacaatagagtactagtatcccgtgcagaaaataacaaaaaaagcgatagggtccccgcaaaactatatgcagccaaaatgaaaccttactggaatcagcttctaaaacaaggactaataacacaacgaaaatttgaaaacctaacgatggatgtagatcagaacataaaatatagatccctcggatttgtaaaaaggcaactagtcgagacaagacaagtaataaaattaactgcaaatatactaggatccatgtatcaagaagccggtacggatataatagaaacaagagcaggactaactaaacaattaagagaagaattcgatctaccaaaagtgagagaagttaatgactatcaccatgctgtagatgcgtacctaactacatttgctggacaatatttaaatcgtcgatatccaaaactaagatccttcttcgtttatggcgaatatatgaaatttaaacacgggagtgatcttaagcttagaaattttaatttttttcacgaattaatggaaggagataaatcgcagggaaaagtagttgatcaacagactggtgaattaattactacaagagacgaagttgcaaaaagtttcgatcgattactgaacatgaaatacatgttagtatcaaaagaagtacacgatagaagtgatcaactatacggagctactatagttactgcgaaagaaagcggaaaattaacatctccaatagagattaaaaaaaatcgaccagtagatttatatggagcttataccaacgggacatcggcattcatgaccataatcaaattcacaggaaacaagccaaaatataaagtaataggcgtcccaacgacatctgcggtagggttaaaacgagtgggcaaaccaggttccgaatcatacaaccaagagctacatagaataataaaaagtaatccaaaggtaaaaaaagattttgaaatagtagttccacatgtatcatattcccaactcatagtcgatggagattgcaaatttacactagctagtgacacctaccaacatcctgcaacgcaacttgtattatcgaaagaatctatggaaataattgcagatgattttaaatttgtcaaagagaatccagctacagccgacgaacaacttgtgcgagtatttgatgaaattgtcaatcaaatgaaccattatttcactatctttgatcaacgatcaaaccgacaaaaagtaacgaaagcaagagacaaattcgtgagtttaccaactgaatcagaatacgaaggcgcaaagaaaactcaagtcggtaaaactgaagtcataacgaacctactgatgggactacacgcaaatgcggcacaaggcgacctgaaagttttgggcctaagcacctttggttttttccaatcctctggcgggttaaatctatcagaagacgcaatgatagtatatcaatcgcctaccggactattcgaacgaaggatatgtttaaaagacatttga

SEQ ID NO: 9013 - RNA, 4146 nt, synthetic construct
  misc_feature 1..4146: note = Cas9 variant
  source 1..4146: mol_type = other RNA
atgaagaaaagttacgccataggtattgacattgggacaaattcagtaggccactgcgtaatgtacacagaaaattataaagttccgtcgaagaaaatgaaagtattcggtaacacagaaaaacgatacattaagaaaaacctcttaggtaccctactgttcgatgaaggaaatacagcagaaaaccggagacttaaaagaacagcaagacgacgatacacacgcagacgtaacaggattctgtacctacaagaaatattcgccgaggagatcaataaaattgacgactcattcttccaaagattagacgacagcttcttaatagttgaagataaacaaggaagtaaacacccgatatttggaacgctacaagaagaaaaagaataccataaacaattcccaacaatatatcatttacgaaaacaacttgcagattccagccaaaaagcagacataagattaatttacttagcactagcacacataataaaatacagaggccatttcttgttcgaaggcgacctgaaaagcgaaaacaaagatgtacaacacctctttaatgacttcgttgaaatgttcgacaaaacagttgaaggcagctacctatctgaaaacctccccaacgtagctgatgtcttagtagaaaaagtcagcaaatctagacgtttagaaaacattctacactactttccgaacgaaaagaaaaacggattattcggaaactttcttgctctagccctaggattacaaccaaatttcaaaactaatttcgaactggcggaagacgcaaaaatacaattcagtaaagaaacatacgaagaagacctcgaagaactacttggcaaaataggagatgattacgcagatcttttcatagcgacaaaatcactatatgatggaatattattagcaggaatactctccactacggatagcaccacaaaagcacccctaagcagcagcatggttaatcgctacgaagaacatcaaaaagatttagccctacttaaagactttataagacaaaatttgagcgactcctacaaagagttctttaatgacacactaaaagatggatatgctggatatattgaaggaaaaacaacacaggaaaacttctaccgattcatcaagaaagctatagagaaaatagaaggatcaaattattttatcgacaaaatagaccgagaagactttcttagaaaacagcgtacatttgacaacggatcaatacctcaccaaatacacttacaagaaatgcatgcaattataagaagacaggctgagttctacccatttctagtcgaaaatcaagataaaattgagaaaatactaaccttcaggattccgtactacgtaggtcctcttgctagaggcaaaagtgagttcgcatggctaaaacgtaaaagtgatgagaaaataagaccctggaacttcgatgaaatggtagacaaagaaacaagcgcagaaaacttcataacaagaatgaccaattatgaccaatacctaccagaccaaaaagtactacctaaacattcgctactatacgaaaaatttgcggtatataacgaactaactaaagtacggtacgtaacagaacagggaaaatctttcttcttcgatgccaacatgaaacaagaaatatttgatggagtatttaaagtatacagaaaagtaacaaaagaaaaattaatggatttcctaggaaaagaatttgacgaatttcgaatagttgacctaatgggactagacaaagacaacaaatctttcaatgcgagcttaggaacatatcacgatctaaagaaaattgtctcaaaagatttattagataaccccgaaaatgaagatatactagaaaatgtagtattaacactcactttattcgaagatagggaaatgattagaaaacgcttggaaaagtataaagacgtcttaactgaagaacaaaggaagaaactagaaagaagacattacacaggatggggacgactaagcgcaaaattaattaacggaatcagaaataaaaccaccagaaaaacaattttagattatctaattgacgatggaacctcaaatagaaatttcatgcaattaatacatgatgatactttaagttttgttgacgaaataagactagcacaaggatcaggagaagcagaagattaccgaaccgaagtgcaaaatttggctggttcaccagcaatcaagaaaggaattttacaatcattaaaaattgtagacgaattaataggcgtaatgggatataacccagaacatgtcgtagtcgaaatggccagagaaaaccaatttacaaaccagggaagaagatcatcacaacaacgatataagaaaatagaaaatgccatcaaaaacttagattcaaatttaaactctaaaatccttaaagaatacccaacaaataaccaagcacttcaaaatgatcgcttatttttatattacttacaaaacggaaaagatatgtacactgacgaagaactagacatcgaccaactaagtcaatatgacattgatcatatcatcccgcaggctttcataaaagatgattcactcgacaacaaagtactgacaaaatcggcgaaaaatcgaggaaaaagtgacgatgtaccatcattagaaatcgtacataagaagaaaaatttctggaaacaactattagactcccaacttatatcacaaagaaaatttgataacttaaccaaagcagaaagagggggactgaccaacgaagataaagcgcgctttatacaacgacaattggttgaaacccgacaaataaccaagcatgtcgctagaatactagatacgagatttaacacaaaattagatgacgcgggaaacagaataagagaccctaaagttaatattataacacttaagagtagcctggtatcacaattccgaaaggattatcagctatacaaagtcagggaaatcaataattatcatcacgcacatgacgcatatttaaatgcagtagtcgcaactgcattactaaagaaatatcctcaattagcaccagaatttgtatatggtgattacccaaaatataacagttacaagtcaagaaagagtgcaactgaacgcgttctattctattcaaatataatgaatttcttcaaaagagtagtcaaatcgagcaaaactgggacagtaaaaataagaccaatcatagaagtgaataaagaaacaggcgaaatcgtatgggacaagaaaagcgatttcagaactgtacgcaaggtactaagctacccacaagtaaacgtagtaaagaaaaccgaagtacaaaaccatggtctcgatcgaggaaaacccaaaggcttctacaacgctaacctctcccccagaccaaaagaagggagcgtagaaaacttagtaccggctaaacaatccttcgacaccaaaagatatggaggatatgcaggcataagtaactcatatgcagttttagttaacggtatcatcgaaaaaggaaagaagaaaagcaaagccgaagtcacagagttccaaggtatttcaattctcgcaagaaaagatttcgagaaaaatccgaaacaatacttactaaatttgggatataaagatataaaatcaataattaaattgccaaaatacagcttatttgaactagaaaacggaagtcgaagaatgctagcatcaattttgagtaccaataacaaaagaggagaaatccacaaaggaaatgaaatgtatctaccagacaaatttgtcaccctactctaccacgcgatgagagtaaacagaacacttgaacctggccataagaaatatgttgagactcatcggcatgtcttcgacgaattacttacatatatcctagaatacaatgagaaaatagtcggagcaaaagcaaacggaaaaagaatcgtagaagcatacagcgctcgaaaagacacagataatcttgaggagctatgcaattcattcattaacctcctaaatttgacagccctaggttcagcagtagacttcgagttcctaggcactaaaataccacgatacagagattacactcccagctcattattaaaagccaccctaatacatcaaagtgttactggcttgtatgaaacaagaattgatctatcaaaactcggaggagattga

SEQ ID NO: 9014 - RNA, 4146 nt, synthetic construct
  misc_feature 1..4146: note = Cas9 variant
  source 1..4146: mol_type = other RNA
atgaagaaaataataggtctagatctaggaactacaagcataggctgggcttacgtacatgaggcagaaagtgcacaagaaagatctgaaatagtgagacttggagccagagtagtacctttaacaaccgacgaacaagacgaatttaagaaagggaaatcaatcacaaccaacgcagccagactcagcaaaaggtctctaagacgaaacgctgaccggtttcagctaagacgagatgaactagcgggagtcatgaaggaagcaggatggatagatgaaacaacggtattagccgaacagggaccaagatcgacattcgaaacattaagactaagagcaaaggcagcgtcagaggaagtaacgttggccgaatttgctaggatcttattacaaataaaccgaaaaagaggatacaagtcaaataggaaaactgatggtgatgaagagggagcattaatcgatggtatggatgtatcaaaacaattaaatgccagcggacaaactccgggagaatgggttctagctagaatgcaagaaggaaatgctgtaataccggctttttattgcagtgacttgtctgaggaacttgatcgaatatggagaaaacaacaagcatcacatcaagcatggatgacagaagaattgcatacagtcctaaggcacgcagatggaaggtcagcaattaggctaatggataaagcaggggtggtccccgactccgttaatgtaaaagaaagacgaagagtaatgtacgaatggcgcgccgcagcagtgagggactgtctaccagccgggcgagtagcagctgcattgatgcaagtatcgaaggaaataggcagagccgacagctatcttggaagaataggggatagaagcaaagaactgtactttcacaggcaaacagtaggtcaatatctctggagactaatatgtgataacccgaaccagagcttgaaaaacttagtattctatcgacaagactatcaacacgagttcgaaacactctggtcaatacagacaaaataccacgtcgaacttactgaagatttaagaaaaagagttggcagaatcatattctttcaaagaccattaaaaagcaagaaaggattagtgaataggtgcgaattggtacactactccgtttgtgaaaatagtggggacgacttaactgaaaaagtagatgtggggccaaaagtatgccctaaatcaagccccttatttcaagagttcaaagtatggcaagtgttaaataatgtagaagtaatacacccatcgactcaagaagcaagaagactggaaatggaagaaaaggaattactagcatcagagctattgtttcgagatagaatgaagaaaatcgatgtgttgaaattgctatttagcaattggagagatctagacttaaactacaaagaactagaaggaaaccgaactatggctgcattttatagagtatacgaacaagtaatagcacaaacaggacatggagactacgatttcgcaaaaatgagagcagcaaaggtaaaagaactcgcagaaggagtgttcgctggattaggttttgaagtggggttattaactttcgacgctgagttagatagccctgcctatgaacaacaaccttgttacagactatggcatttactttactcatacgaaggtgacaaaagcgctacaggaaacaaatgtttacttaagaaactatgtagacttacaggaatgaatgcagaattggtaggtctattcatgcaaatacggttcagcggagattacgggtccttatctacgaaagcgatgcggcgaatacttccctatctaaaagcgggaaatacttacgacgtggcttgcgaatacgcaggatttagacattccgctagatcattgacaagagaggagcttgcccagaaagagtataaggattacttagatctcttaccgcggaactccttgaggaatccagttgtagagaaaatcttgaatcaaatgattcacgtggttaatggattgtcgagcacatacggtaagccagacgaaataagggtagaaatggcgagagagctaaagaaaagtgctagagaaagggaagaaatgacatcagcaataagtaaaacaaccaaagaaaatgcagaaatcacagcgatattgcaaagagacttcggacttagatacgtttccagaaatgatatactacgatataaactttattgcgaattacgaataaaagggaatggatgtaggacactttatagcaatacttatataaatccaaatgaactattttcaagagagtttgacatcgaacatataataccacaaagtagactctttgacgacagtttcagcaataaaaccctggaaagtagaacagcaaacttagaaaaaggagataggaccgcatgggactatgtaaacgaaaaatatggagcagaacgtgcagatgagtatagagcacaggtagaggcattatacagagatggaactatttcaaaagcaaaaagagacaaattgttaatgcctggagacaaaatacccgaggactttatagacagagacataagaaacacccaatatatagcgaagaaagccctggaaatatttgaagactttgttccaagtgttgttgcaacgtctggaaatgtaaccgccagattgagagaagattggggactcgtagatgtaatgaaagaactaaattggtctaaatacgaatcacaaggcatggtacatatagaatacgacagagatggtcgaccaatcaggagaattgtagattggactaaaaggaacgaccatagacatcatgcaatggatgcactagcagtagctttcactaaaagatcatatatccagtatcttaatcatttgaacgcaaggaaagaagcaacaagcgttgcctacgcaattcagcataaagaaatggagttggatgggagtaacagatggagatttaaatgtcccttcggtgatcgatcagcatttagaagggaagcgaaagcacaactagaaagaatcctggtgtcaataaaatctaagaataaagttctgaccccaagcgtaaatagaacaaagaaaaggggagggttcaataagaaagtggaatggactcctagaggagcccttcacaacgaaactgtttatgggagaataagaagatacgatgtaaaagaactaagagttggatcatcatttacggcagaagtaatcggaaaagtagctgatagccgatacagggcagccttaatgcacaggcttgccgagttcggtggagatccgaagaaagcatttacaggcaaaaacagtcttgagaaaaatccactgtatacagatgaagcccatacggcatgtgtaccaagtagtgttaaagtcgtaagtttcgttgaaattggaacaatacgaaaaggcgtagacccaaatctaaatgtagacaaagtagtagacactcatatcaaaaatatattactagctagactaagcgcatatggaggggatgctaaaaaggctttttctaaccttgatgcagacccaatatggttaaacaaagagaaaggtatagctataaaacgagttacaatttctgacgattcggaggtaaggcccatccatgttaaaagagacatgagaggtagactggtatgcgatgagcatggacgccctgtgccatctgattacgtgcaattaaggaacaatcatcatgtagcgatttttagagacgctaatggagaacttaaagaaagggttgtaacattctttgaagcagtggaacgagtaaggcagttgagatcagaaggacgggctgtagaggttatagacaaaaactacaaatgcgaagaaggatggacatttttattcagtatgaaaataaatgaatactttgtctttcccgatgcagcatccggctttgatccaagagaaatagacttaacagatccagccaactatgcgttaatatctccacatctatttagagtacaaaaacttagtagcaaagattattatttcaggcatcacttagagactacagtaaacgatgtcaaacaattaagagacatcacatggaagagaataagcagtttacaggatctagcaggaaccgtaaaagttagggtaaatcatattggacaaatagttgcggtaggagaatattga

SEQ ID NO: 9015 - RNA, 4146 nt, synthetic construct
  misc_feature 1..4146: note = Cas9 variant
  source 1..4146: mol_type = other RNA
atggtgaaaaagaaatatgcaataggtatagacataggaaccaattcagtagggtggtcaatagtaacagacgattacaaagtaccaagtaagaaaatgaaagtattcggaaacacagagaaaagatatatcaagaaaaatctattagggaccttacttttcgatgaaggaaatactgctgaaaaccgaagactaaaaagaacagctagacgaagatacacaagaagaagaaaccgcattctatatctacaagagatattcgcagaagaaatcaacaaaatagatgacagcttcttccaacgactagatgatagctttttaatagtcgaagacaaacaaggctcaaaacatccgatattcggaactttacaagaagaaaaagaataccataaacaattcccaactatttatcatcttcgaaaacaacttgcagacagtagccaaaaagcagatattcggttaatataccttgccctcgcacatataattaaatacagaggacatttcctctttgaaggagacctcaaatcagaaaacaaagacgtacagcacctattcaatgacttcgtggaaatgtttgataaaaccgtagaaggatcatacttatctgaaaatctcccaaatgttgcagacgttttagtcgaaaaagtcagcaaaagtcgacgacttgaaaacatattacactattttcccaatgagaagaaaaatgggctattcggtaactttttagctttggcactaggtttacaaccaaatttcaaaacaaatttcgaacttgctgaagatgccaaaatacaattttcaaaagaaacgtatgaagaagatttagaagaactactaggaaaaatcggcgatgactatgcagacttatttatagccacaaaatccttatatgacggaatacttcttgctggaatactaagtaccactgactctacaacaaaagcaccactaagttctagcatggtcaataggtacgaagaacaccaaaaagacttagcactactcaaaaactttattcaccaaaatctttcagatagttataaagaagtcttcaacgacaaactaaaagatggttacgcaggatatatagaaggcaaaactacacaagaaaacttttatagatttatcaagaaagcaatagagaaaatagaaggatcaaactattttatagataaaatagaccgagaagacttcctgagaaaacaacgaacattcgataatggatcaataccccatcaaatccacctccaagaaatgcatgctataataaggcgccaagcagaattttaccctttcctggtagaaaaccaagacaaaatagagaaaatattaactttccgcatcccatactacgtcggcccattagcacgcggaaaatccgaatttgcatggcttaatcgaaaaagcgacgagaaaatacgaccctggaacttcgatgaaatggttgacaaagaaacttcagcagaaaacttcatcacacgaatgactaactacgaccaatacttaccggatcaaaaagtacttccaaaacatagcctgttatatgaaaaattcgccgtgtataatgaactcacaaaagtaaggtatgttacagaacagggaaaatcatttttcttcgatgcaaacatgaaacaagaaatctttgaccgcactttcaaagtgtacagaaaagtaacaaaagaaaaactaatggattttcttagcaaagaatttgacgaatttagaatagtagacttattaggactagacaaagataacaaatccttcaacgcatcattaggtacataccatgatctcaagaaaatagttagtgaagactttctagataactctgaaaacgaagatatacttgaaaacgtcgtactaacattaactctatttgaagacagagaaatgataaggaaaaggcttgaaaaatataaagacgtactaacagaagaacaacgcaagaaactagaaagacgacactacacgggatggggacgactatcagcaaaattgatcaacggcatacgagataaagttacccgtaaaaccatcctggactatctcatcgacgatggaacaagcaaccgtaacttcatgcaactaattaacgacgacactttaagttttgtagatgaaattcgcctagcacagggcagcggaaaagccgaagattacagagcggaagtacaaaatctcgctggctccccagcaattaagaaaggaattttacagtcattaaaaatcgtagatgaactaatagaagtgatgggatatgacccagaacacatagttgtagaaatggcaagagaaaaccagtttaccaaccaaggaagacgaaattctcaacagagatacaagaaaatagaaaacgcaatcaaaaatttagatagtaatctaaatagtaaaatactaaaagaatacccgacaaataaccaagcacttcaaaatgatcgattatttctatattacttacaaaatggaaaagatatgtatacagacgaagaactagatatagatcaactaagtcaatacgatattgatcacattataccacaagcatttattaaagatgatagcttagacaataaagtacttacaaaatccgccaaaaatcgaggtaaatcagacgacgttccatcactcgaaatagtatataaaaagaaaaacttttggcaacaattattggacagtcaattaatcagtcaaaggaaattcgacaacttgacaaaagccgagcgaggcggattaactaacgaggataaagcgagatttatacaaagacaattagtcgaaaccaggcaaataactaaacacgttgctagaatactagatactaggttcaacacaaaattagacgaagcaggaaacaggatcagagaccctaaagtcaacattataattctaaaatcaaaccttgtaagtcaattccgaaaagactaccaactatataaagtgcgtgagataaacaactaccaccatgcacacgatgcctacctaaatgcagtagtggctacagcgttactcaagaaatacccccaacttgctccggaatttgtttatggagaataccctacctacaattcatacaattcgagaaaaagtgcaaccgaaaaagtcttattttattccaacataatgaactttttcaaaagaatagttgtacattcaaaaacaggcgaagtaagaatcagacctgtaatagaagtgaacaaagaaacaggagaaattgtttgggataagaaaagtaactttagaacagtaagaaaagtcctatcatatccccaagtaaacgtcgtcaagaaaacagaagtccaaaatcacggattagatagaggtaaaccaaaaggtttctataatgcaaacttaagcccccgaccaaaagaaggtagcgtcgaaaacctggtaccagcaaaacaatccttcgacaccaaacgctatggagggtatgccggaatatcaaactcgtatgctgtcctagtgaatggaatcatagaaaaaggcaaaaagaaatcaaaggctgaagtaacagagttccaaggaatcagtattctagcccgaaaagactttgacaaaaacccaaaacaatacttactcaatttaggatataaagacataaaatccattattaaattacccaagtatagtttattcgagctagagaatggttcaaggcggatgctcgctagcatactttcaacgaataacaaacgcggagaaattcacaaaggcaacgaaatgtacctccctgacaaattcgtaaccttactctaccatgcgatgcgtgttaataggacactagaaccaggtcataagaaatacgtggaggcccacagacatgtgttcgatgaattacttacatatatactcgagtacaatgagaaaattgtaggtgccaaagcaaatggtaaaaggatcgttgaagcctactccgcaagaaaagacacagacaatctcgaagaactctgcaactcatttattaatctactaaatttaacagctttgggaagtgccgtagattttgaatttctaggcacaaaaatccctcgctatagagattatacaccttcgtcactgttaaaagctacactgatacaccaatccgtaacaggcttatatgaaacaaggattgatctatccaaattaggaggagactga

SEQ ID NO: 9016 - RNA, 4146 nt, synthetic construct
  misc_feature 1..4146: note = Cas9 variant
  source 1..4146: mol_type = other RNA
atggtaaagaagaaatatgcgataggcatcgacataggaacaaatagcgtaggatggagtgtggtaacagatgactacaaagtaccaagcaagaaaatgaaagtattcggaaatacagaaaaacgctatataaagaaaaatttgttagggactttacttttcgacgaaggtaatacagcagaaaatcgacgactaaaacgaacagcaagaagaaggtacacacgaaggcggaataggatactatatctacaagaaattttcgcagaagaaataaacaaaattgatgatagctttttccaaagactggacgacagctttcttatagttgaagataaacaaggatcaaaacacccaatattcggaacccttcaagaagaaaaagagtaccacaaacaatttccgactatataccatttaagaaaacaattagcggactcttcacaaaaagcagacataagattaatctacctggccttagcccatataataaaatatcgcggacatttcttatttgaaggagacctaaaaagtgacaataaagacgtgcaacacttatttaacgaatttgtagaaatgttcgataaaactgtcgaaggatcatacctatccgaaaacatacctgacgtagcagacatattagtggaaaaagtatcaaaatctcgtcgactggaaaatgtactacaatattttccgaatgagaagaaaaatggactactgggtaatttcttatccttagcactaggtcttcagcctaattttaaaaccaacttcgaactagcagaagatgctaaaatacaattctctaaagaaacatatgaagaagatcttgaagaactattaggcaaaataggcgacgactacgcagatttattcattgcaacaaaatcgctatacgacggaatcttgctagccggtattcttagcactaccgattcgacgacaaaagcacctctatcatctagcatggtcaacaggtatgaagaacatcaaaaagacctagccctattaaaagacttcatcaggcagaatctatcagacagctataaagaagtttttaacgatgccctaaaagatgggtacgcaggatacatagaaggcaaaacaacacaagaagacttttataaatttgtcaagaaaactatagagaaaatagaaggaagtgattatttcattgataaaattgatagagaagatttcttacggaaacaaagaacattcgataatggaagcatcccacatcaaatccatcttaaagaaatgcaggctatcattattagacaagcaaaattctatccatttttagaagaaaaccaggacaaaattgagaaaatcctgacatttcgtataccgtactacgtaggacctttggcccgaggcaactcagaatttgcatggttaaacagaaaaagtgacgagaaaatacgcccttggaatttcgacgaaattgttgataaagaaacctctgcggaaaatttcatcactagaatgacgaattatgaccaatacttaccagatcaaaaagtcttaccgaaacattcactactatacgaaaaatttgctgtatacaacgaattaactaaagtcagatacgtaacagaacaaggtaaatctttcttcttcgacgctaatatgaaacaggaaatattcgatggagtgtttaaagtctatagaaaagtgacaaaagaaaaactcatggactttctagggaaagaatttgacgagttccgaatagtagatttactaggactagataaagacaacaaatcattcaatgcaagtttaggcacataccacgatttaaagaaaatagttagcaaagacttactcgacaacccagaaaacgaagacattctcgaaaatgtagtattaactctaactctatttgaagacagagaaatgataagaaaaaggctcgaaaaatacaaagaagtacttacagaagaacagagaaagaaactggaacgtaggcactacacaggatggggtaggctatccgcaaaattgataaacggaattagagacaaagtaaccagaaaaacaatcctagattacttaatagatgatggcacgagcaatagaaactttatgcaactaataaacgacgataccttgagtttcgtagacgaaataaggttagcccaaggaagcggcgaagcagaagactatagagcggaagtacaaaatcttgcaggttctccagccatcaagaaaggcatattacagtcattaaaaatagtagatgaattaatagaagttatgggatatgaacctgaacacatagtagtcgaaatggcaagagaaaatcaattcacaaaccaaggacgcagaaacagtcaacagcgttacaagaaaatagaaaatgccattaaaaatctggactcaaatctgaactcaaaaattctaaaggaatacccaacaaacaatcaagcacttcaaaacgaccgattatttctatattacctacaaaacggaaaagatatgtatacagacgaagaactagacatagatcaactaagccaatacgacatagaccacattataccacaagcgttcatcaaagacgattctttagataacaaagttctaacaaaatcggccaaaaatcgaggaaaaagcgatgacgtcccttcgctagaaatagtatataagaaaaagagcttctggaaacaactactagacagccagctaatctcacaacgtaaatttgacaacttgacaaaagcagaacgcggcggcctaacaaatgaagacaaagcacgttttattcaaaggcaacttgttgaaacaagacaaatcacgaaacacgtggctcgaatgttagatactagatttaacaccaaactggacgaagctggaaacagaatacgtgacccaaaagtaaacataataacactaaaatcaaatcttgtcagccaattcagaaaagactaccaattatataaagtaagagaaataaacaactaccaccacgcccacgatgcatatttaaacgcggtggtagcaacagcgcttctcaagaaatatccccagttagctccagaatttgtatatggtgaatacccaacctacaactcctacaactctagaaaatctgcaacagaaaaagtattattttactcaaacataatgaactttttcaaaagaattgtagtccacagcaaaaccggcgaagtacggataagaccagtaatcgaagtaaataaagaaacaggagaaattgtatgggataagaaatcagacttcagaacagtgcggaaagtactgagttacccccaggtaaatgtcgttaagaaaacagaagtccaaaatcacggtttagataggggtaaacataaaggcttttacaacgcaaacctttcaccgagacctaaagaaggatcagtggaaaatttagtgccagcaaagcaaagttttgatacaaagagatatggaggatacgcaggaatatctaacagctacgcagtcctagtaaacggaatcatagaaaaaggcaagaagaaaagtaaagctgaagtaactgagttccaaggcatctcaatactcgcaagaaaagactttgataaaaatccgaaacaatacttactaaatctaggatacaaagacatcaaaagcataataaaattaccaaaatattcattgttcgagttagaaaatggaagtcgtagaatgctagcatctatattatcaacaaacaataaacgaggagagatccataaaggcaatgaaatgtacctcccagacaagtttgttacattattataccacgcgatgcgagttaatagaacattagaaccaggccataagaaatatgtagaaacccaccgacacgtctttgatgaattgctaatatacatacttgaatacaacgagaaaattgtcggagccaaggcaaacggtaaaagaatagtcgaagcgtatagcgctaggaaagacacagataacctagaagagttatgcaattcctttattaatctattgaacttaaccgctcttggttccgcagtagacttcgagttcctaggtacaaaaataccacgctatcgagactacacaccaagctcactacttaaggccacactcatacatcaaagtgttacagggctttatgaaacaagaatagacttatcgaaattaggcggtgattga

SEQ ID NO: 9017 - RNA, 4146 nt, synthetic construct
  misc_feature 1..4146: note = Cas9 variant
  source 1..4146: mol_type = other RNA
atggttaaaaagaaatacgcaataggaatagatattggaaccaattccgtaggatggtcagtagtgaccgacgattacaaagtcccgagcaagaaaatgaaagtattcggcaatactgagaaaagatatatcaagaaaaatctactcggtacactacttttcgacgaaggaaacacagcagaaaaccgacgactaaaacgaacagccagacgaagatatactaggcgacgaaaccgcattctctacttacaagaaatattcgcagaagaaatcaataaaatagatgacagcttcttccaaagactagatgattcgttcctaatagtagaagataagcaaggctccaagcacccgatattcggcaccctacaagaagaaaaagagtatcacaaacaattcccaacaatatatcacttaagaaaacaactggcagactcgtcacaaaaagcagacataagattaatatacctagcactagcacatataatcaaataccgaggacatttcctattcgaaggagacctaaaaagcgaaaacaaagacgtacaacatttgttcaatgatttcgtagaaatgtttgataaaacggttgaaggttcatatctaagcgaaaacttaccaaatgtcgcggacgtcctagtggaaaaagtctcaaaatcccgacacctagaaaacatactacattattttccaaatgagaagaaaaatggactattcggaaattttctagctctagccttaggattgcaacccaacttcaaaacaaatttcgaacttgcagaagacgcaaaaatacaattttctaaagaaacgtatgaagaagatctagaagaattgttaggtaaaataggtgacgattacgcagatctgttcattgcaaccaaaagcctctatgacggcattctattagcaggcatactctcaactacaaattcaaccacaaaagcaccactatccagtagcatggttaaccgatatgaagaacaccaaaaagatcttgccctcctcaaaaactttatccatcaaaatttaagtgacagctacaaagaagtctttaacgataaactaaaagacggatatgccgggtacattgaaggaaaaacaacacaggaaaacttttacagatttatcaagaaagccatcgagaaaatagatgggtctaattactttatagagaaaatagaaagagaagacttcttaaggaaacaacgtacctttgataatggaagcattccacaccaaattcacctacaagaaatgcaagcaataataagaagacaagcaaaattttacccatttctagaagaaaaccaagataaaatcgagaaaatactaacatttagaatcccatattatgtcggccccttagcccgcggaaaatctgaatttgcatggctaaaccgaaaaagtgacgagaaaatacggccctggaattttgatgaaatggtagataaagaaacttcagccaaaaactttatcacacgaatgactaattacgatcaatacttaccggatcagaaagttctccccaaacactccctcctatatgaaaaattcgcagtgtataacgaactaacaaaagtcagatacgttacagaacaaggtaaatcatttttctttgatgcaaatatgaaacaagaaatatttgacggagtattcaaagtatacaggaaagtcacaaaagaaaaattaatggatttcctaggtaaagagttcgacgagttcagaatagtagacctgttaggattagataaagaaaataaatcattcaacgcaagtttaggcacctaccacgacttaaagaaaatagtatctaaagactttctagataattcagaaaatgaagacatcctagaaaatgtcgtgttaacattaacattgtttgaagacagggaaatgatacgtaaaagattagaaaaatacaaagatattctcacagaagaacaaaggaagaaattagaaaggagacattataccgggtggggaagactatctgcaaaacttataaatggaattagagacaaagttaccagaaaaacaattctagattatctgatcgacgacggaacctctaattgtaatttcatgcaactcatcaacgacgatacactcagcttcgtagacgaaatccgcctagcccaaggaagtggtgaagcagaagattaccgcgcagaagtacagaaccttgcagggagcccagcaatcaagaaaggaatactccagagcttaaaaattgtagatgaactcatagaagtaatgggatatgatccagaacatattgttgtagaaatggcaagagaaaaccagttcacaaaccagggcagaagaaacagccaacaacgatacaagaaaatagaaaacgcaatcaaaaatttagatagcaacctcaactcaaaaattctaaaagaatatccaacgaataaccaagcacttcaaaatgatagattatttctatactaccttcaaaacggaaaagacatgtatacagacgaagaactagatatagaccaattatcacaatatgatatagatcacatcataccccaagcattcataaaagatgattcgcttgataacaaagtattaacgaaaagcgccaaaaatagaggtaaaagtgacgacgtaccttctcttgaaatagtatacaagaagaaatctttttggaaacaactgctagacagtcaattaatcagccaaagaaaatttgacaatcttacaaaagcagaaaggggtggtctcacaaatgaggacaaagcacgatttatacaaaggcaacttgtagaaactagacaaattactaaacatgtggccaggatgttagacactagattcaacactaaattagatgaagctggaaatagaattagagatcctaaagtaaacatcataacactaaaatcaaacttagtatcacaatttcgcaaagattatcagttatataaagtcagagaaataaacaactatcaccatgctcatgatgcatatctaaacgcagttgttgccaccgcactcttaaagaaataccctcaattagctccggagttcgtgtacggagaatatcctacatataattcctacaactccagaaaaagcgccacagaaaaagtacttttctattcaaatataatgaatttctttaaacgaatagtagttcacagcaaaactggtgaagtccgaatccgaccagtcatagaagtgaataaagaaacaggcgaaatagtctgggataagaaaagtgactttagaacagtacgaaaagtgctaagttatccccaagtaaacgtagtcaagaaaacagaagtgcagaaccacggactagacaggggaaaaccaaaaggattttataacgctaatctatcaccacgaccaaaagaaggttcagtcgaaaacctagtcccagcaaaacaatcgtttgatacaaaacgatacggaggatatgccggaatatctaattcatatgcagtcctagtaaatggcattatcgagaaaggtaagaagaaatcaaaagcagaagtcaccgagttccaaggaataagtatacttgcaagaaaagatttcgataaaaatcccaaacaatatctattaaacctaggctacaaagacatcaaaagtatcattaaattacctaaatactccttatttgaattagaaaacggaagtcgtagaatgctagctagtatactaagtacaaataataaacgaggagaaatacacaaaggaaacgaaatgtatctacccgataaattcgtaacacttctctaccacgctatgcgagtcaatagaacgctagaaccaggccacaagaaatatgttgaaactcatagacacgtatttgacgaattgttaatttacatacttgaatataatgagaaaattgtcggagccaaagcgaacggaaaaagaatcgtagaagcctattcagcaagaaaagatacagataacctagaagaattatgcaactctttcataaatctactaaatctcaccgcattaggatcagcagtcgatttcgaatttcttggaacaaaaataccacgataccgagattacacaccaagctcactacttaaagcaactctcatccaccaatcagttacaggattatatgaaactagaatcgatctcagtaaactagggggcgactga

SEQ ID NO: 9018 - RNA, 4149 nt, synthetic construct
  misc_feature 1..4149: note = Cas9 variant
  source 1..4149: mol_type = other RNA
atgaagaaaatagtaaactacaatctcggcttagatataggaacaagcagcataggatatgccgcaattgacgatcaaggacgaccagtacgtcatcaaaacaaaaccgtgatgggagttagactctttaaagaagggaaaacggctgaatcaacaagaatatttagaggaacccgaagaagactctcacacaggcactggagactaggctatctagacagaatatttgataatgaaattgctaaagttgatgaaaacttcttaccaagactaaaagccagtaaaagagcacgcagcgatgaaaaacgatccttcaggggaagccttttattccccgaaacaggagatgatgcttactaccaaaaatatcctaccatataccacctacgatacgcacttataacccaaaagaaacagtttgacatacgactaatttacctagcactacaccacatgattaaatatagaggaaacttcctagacacaacacctgtttcagctttcaacatccatgacatcgacctaacagatcaattcgcctcactaaatgactgttatcaattactcgacatggatttcgaatttcaattcgacctaaacaacatagaacaagtacagaaattactattagacgaaacattatcaaaaactaaacgacaggcagctgtttcaaaggtattagtgatgtctacaggcaataaggctttcgacgaccaacaaaatggaatagccagtgaatttataaaagccctactaggaggaccatttgatctatcaaaaattctaaaccttagcgtagcagatgttaaatcatggaagttacacatgacagacaaggatgtagacgataccttaaactccctcgttgaagaattggatgagaatcacaagcagattgtcaatttactacaaatgatttattcacaagtaatgatgctaggcctactaaatggtcaacaaagtatctctgcctcaatgatagaaagatatgatgatcacgcgaaacattgggcggcattaaagaaacttctaccagcattaggggaacaagaacaatccacaatcatacatgcatacacagcctatactggtcattcccggactaaacaactttcccgagcagagttctacacaaaagtaaatagcatcctcaagaaacacgaaaatatagcagaagccaccggcctaatagaacttatcgacagaaacgagttcatgccgaaacagagggacgccgttaacggcgttattccgcatcagctccaccaaagagaattacaactcatcatccaaaaccaacaaaaatattatccctttctggcagccaaggcttatccagatgctgatgaaaccatgatcgaacaattactctccttccgagtcccctattacgcaggaccactcgttgatcgagacttcataaatgaaagctccgaccaggagcaagcaatgcaaaacaccaaatttagttggttgaaacgacgcgaagctggggaaataacaccatggaacttcgaacaaaaagtagacgtgcaggaaacagcaaacagattcataaaacgcctaacaactaaagacacctacttgatgaccgaagacgtattaccaaaagaatccctaatctatcaaagatttgaagtattaaatgaattaaacgcgatcaggataaacgaccgaaggcttaccgccgaaaacaaacaactagcctttcaacaactcttcatggcgggcaacactaaaaacgtatcaatcaagaaattccgcaacttcgtgttcgattctctcaaattcccggaaaaagttaaaattacaggatttgcaggacaacacaacttcctagcaaaactttcaacatatcacgacttcaagaaaatatttggagaaagagtagaccacactgacttacaacctgactttgagcgaatagtagaatggtgtacaatattcgaagatagacacatttatagagaaaaacttaaagagatccaatggttgagtcaaagcgaaatcgaccagctcgtattaataagaaatcatggttgggggcgtttaagtaaacgattattaacaggaatccgagactcagatggcagaacagttatggaccaactatggttcggaacggacaatttcatgagaatcatctcccagtctgattttgctgcagccatcgctaacgaaaacaggacacagctaaaccaacatggactagaagacgtcttagattccgcatttatgagtccacaaaataagaaagcaatacgacaagtactaaaagtcgtagatgatatagaacaaacattaggatgcccaccaaagaaagtcatgatcgagttcacaagatcaccagacaaaaagaaacaacgcaccgtgaccagactagaaaaagttcaacaggcttacaaagcagtagccgatcaattggccggacaatcaatagtatccgaactagatcaatacgctaatactcattccaaactatccgacacgtattatttatattttatgcaactagggcgagacctctactctggcaaaccaatcgatatcgattcacccatgctcgacgatgaccacatactaccccgtgcattcatgaaagacaattcattggataaccgagcactaacagaaaaaccaataaacaataccaaagcggccaaattcccgtcgaaagttttcggacaacaaaaagaagtaacagacttctggaaattattaagaagatgcggattgatgtcaaacataaaagaaaaacacctttacttagaccctgataacgtagataaatggacgcgcagaggatttatacaccgacaattagtagaaacatcacaagtaataaaaattgtagccaacattctcaatgatagataccaacaatcacaaaccgaagtcttagaagtgccagcaagactcggaactgaacttagagaatgcttcggatggtacaaagtaagagaagtaaatgactaccatcacgtttttgatgcatacttggcagcgtttataggcaattatttatatcgtagatatcccaaactacaaccttacttcgtatacggcaactttgcagaactaaataaagcacaactcaaaaacattaagagcttcaatttcctatataacataacagacaacaaacgcgtagtcaaagatatagaaacaggacaaaccctatgggacgaccaaatccggcagcagattcaacacatctacgaatacaaatatatgcttacatcacatgaggcatttacacaacacaaagagttatacggccagaccatatacccaagacgagagttcaaacctggtacgttgaaagcaattaaacaagatcaaccacaagaactttatggtggatacaaaaaccttactgccgcatacatgtgcatagtaaaaatacaagcaagaaaacggagagcagctgaatatagagtagtaagagtcgcaacagagtcactaagtgcgctacaacaagccaaaagactaggagtacaagcatatgaacgatgtttacgtcaagagctagtcagaaacaatgaaatactacgcacgaatgcagaccctaacagcgccccaagagagttcgaagtcctactcgatagagttctatgccatcaaatgataataagtgacggacaaaaatacttactaggatcacatgcttataaaataaactgcatgcaactcgtactttcaaataattctatgaaaatactgtctacctctattgtaaaattgaaacaaatgacgaacgaaccacttgtccaagtatatcgagaaatattagatgtagtaaacaaatatttcaccctttatgatgtaaattcattcagagaaaacttgaaccaattctttgataaatttagaactttgcctatcacaaacgaatacgaatcaagcaaatcaggtaagaaactcatacacagaggacaattagaaacacttaccttaatcctaaggggactacacgccaacagcgacaaagtacaatacggagatcagtcaacactgctaggtggtttccaaacaaaagacggaataaaactaagcaaagactccgtaattcaatatacatccccggccggtcttaatgttagaacagtaaaattaagggacttggaacagaaggaagcccaaaaatga

SEQ ID NO: 9019 - RNA, 4149 nt, synthetic construct
  misc_feature 1..4149: note = Cas9 variant
  source 1..4149: mol_type = other RNA
atggtagacgagaaaatattttggggcctagacataggaaccgatagcgttggatgggcggttacaaactctgaatataaactaaaaaaatataaaaacaaccttatgtggggcgtccacttgtttgatgaagcaaaacaaagtgcggaaagaagaagtttccgtactgcacgcagacgtctagaccgcagaaagcaaagaattatcctactacaagaattttttgttagagcagtatgcgaaaaagatgaaaattttttcagaagactgaaagaatcagctttattaccggaagatgccgaacatagaacaaataatatcttcttcgatgatccagactacacagataaagactatttcgaagaatacccgaccatacatcacttaatctgcgaactaatggaatcaaaagaaccacacgacgtacgattagtatatctcgcatgcgtatatctactagcgcaccgaggtcatttcctcctacccgtatcagaagatgatattagtaaagttacagaattcgaacctttatacgaatctttctataaagctctagaagaaaagctagatgacgaaccaccattcgatagatcggcagacgactttgccgaaattctaaaaagtcataagacagtatcagcaaaaaacaaagatttcgataagctattattcggaggaaaagtaaaaacctacgacaacgaaaatatatcatacagtgcccttataaagttactctcaggtggaacagaaaaactatccaagttcttcgctaacgaagaatacactgacttagaaaaagactccgtatgcgtacgaaatgctgacttcggagacactctggaaatgctagaaggtcaaatagacgaactagatttcgcattactaaaaagcgtaaagtccttatacgattggtcactactagttgacattctagaaggaaaatcccttatatcggaagcaaaaaaagataaatacgacgaacatggttatgatttagatgcattaaagtatctttttagagaatatttaactaaagatgattacaacgaaatgttcaaagaagtctcaggaaagcaaaactacgcctcatacgtttacaacgcatctagcgacaagacaagagactcaaaatacaaaaaatgttcacaaaaagatttctgcaaattcacaaaaaaattcctaagcaaaatcaaaccaaacgaaaaagacaaaccctgcctggataaacttttagaaaaatgtgaacaaaattccttatgcccaaaacaagtaactaccgacaacagagtcattccataccaactatactacgtagagttaaaaaagatattagaaaacgcatgcggatacttaccttttctaaatgaaagagatgaatacggaacggttgcagataaaatattaagcattatgaagtttagagtaccctattacgtgggaccactagttgactctaagaaatcgcctaatgcttggctggtacgaaaactagacggtaaaataacaccgtggaacttcacagacatggtgaatgaagacgaatcagagaacgcatttatacgaagaatgacgtgcaaatgcacatatgtagctgggcaagatgtactacccaagtattcgcttctatattcaaagttcagtgttttaaacgaaataaacaacatcaaacttaacggcgaaccaattagcgtacaaacaaaacaagaaatatacacagaattatttgaaagaaacaagtcaagagtatcaaaaaagaaaattcgcgattgcctaatttcccatggttatgctgccgacagcgatgaagttacaggcattgatgacatagctaaatcagccctgagaagttatcacgactttaaaaagatgctaagtaacggaatcctaacggaacaacaagttgaagaaataattgaacatattacagtaaccaccgataatatacgcttaaaaaaatggttaaaaacccaattcccaatgctagctgatgaggacgtaaagtatataacaaaactaaaatataaagattatggaagactatcaagatgcttcctagaggacgtcttaccagtggatacaaaaaccggagaagctgaatccgataagaacataatcacgatgctatgggagacaaatgaaaacataatgcaactcttatcatcaaaatatagatactcagagaatatcgaacacatgaatagacaatactatgcactacccgaaaaccataaatctatgtcagaacgcttgaaagacatgtatgttccaactgctgtccgaagggcagtaacgcgtacgttcgatatagttaaagaactaaaaaagatacaaggacgagacccagataaaatatttatagaaatggcgcgaggaactggagagacaccaaaaggaaaaagaactaacagcagaaaagatcagatcctagaacactggcatggactggataacaaagacatcaatgatctgaaaaaatcaggaatatgggaacacttagatactattgacgacgcaaaactaagatcggacaaatatttcctatatttcatgcaattaggtcgatgcatgtataccgaaaaacccatcccttttgaagaagtagaaaacgaacacaaatggaacattgaccacatctggcctcaagcaaagattaaagacgactcattggataataaagttttagtatcatctaatgaaaatggaaaaaaaagcgacagctatccaattagcgatgatatacgacattccatggcaggactttggcatagcttatacaagaaaggactaatatccgaaaaaaaataccagcgtttaaccagatccacaccgttcacagatgatgaactttccggatttatcgctagacaacttgtagaaacaagacagagcaccaaagcagtagccacccttttaaaagaacaatttccaaacacagaaatagtctacgttaaagcaggcctagtgagcgatttccgacaagaaatgggcatgctaaaatgcagagaagttaatgatttacaccatgccaaagatgcataccttaacatagtactgggcaacgtatataatacacgatttaccaaagaccccctcaacttcgtgaaaaataacgaaaaatactcaataaaaattttccagaaaaacagtgacggaaaaaaaactggagtaataacacgcaaggttgaaagaggcggagaagttgcatgggacccggaaacatcattcgcaatcgtccgtaagatgatgtctaaaaacagtataagatatgtaagatacgcatacatgcgtaaaagtggtcaaaatggaggtttcttcgatcagaatcccttaagaaaaggtaaaggcatggtatctatcaaacataacctttcaatagaaaaatatggtggctacgataatgcaacaatctccttctttagtctggtaagtataaaagattttggcgtaatattactagcagttgaactattaagcgccaataaattcctaaagaatataagtgaagcaaaagaatacgccgcagataaactaagcaaagaactaaacgtaaaaatagttccaaatgacgtagcatttcctctaaataatagatacaacgtagttaaaatcaacgcagtacttgaactagatggctacagagtcatgattgccgccaaacagaacagttcaatcaaattcgtcagtaatgaatcattaatattaagtagtcaacacatggcgtacgtaaaaaaaattaccaaattcatagagaaaagaaaacaagacaaagtctgcatgattaatgcctttagcggaataagtatagaagacaatatcgaattatacgacgttttagtgtcaaaatgtaacattaaaccatttaatataatgtatgaaaacttgggaatcaaattaagtgacaatagagataactttattaaaaaaagtgtagaaaatcaagttcttattctatcagaaatggttagattattcaaaacaggaaggaaagcaggagtaaacttagaagaagtcggaggccgaaagaattctggagtaaagaccctcaacacctgcctctacaaagtaaaagattacagcaatatcttcttagtcgatcaatctccaacaggtttaatagaacataaatcaccaaacttattggacctatga

SEQ ID NO: 9020 - RNA, 4155 nt, synthetic construct
  misc_feature 1..4155: note = Cas9 variant
  source 1..4155: mol_type = other RNA
atgaataaaccatattcaatcggcttagacatcgggacaaactccgtgggatggagcattataacggacgattataaggtaccagcaaagaaaatgcgcgtactcggaaatactgacaaggaatacattaagaaaaatttgataggagcattgttgtttgacggagggaacaccgctgcagatcgacgattaaaaagaaccgcaagaaggagatataccaggcgcagaaataggattctatatttacaagaaatatttgcagaagaaatgtcaaaagtagacgactcgttcttccacagactagaagattcattcttagtcgaagaagataaaagaggatcgaaataccccatattcgccacattacaagaagaaaaagattaccatgaaaaatttagtacaatatatcaccttagaaaagaactcgccgataagaaagaaaaagcagacctaagattgatatacatagcactagctcacattattaaattcagaggacactttttaatagaagatgatagcttcgatgttcgaaatacagacatatcaaaacaataccaagacttccttgaaatcttcaataccacctttgaaaacaatgacctactctcacaaaacgtagatgtagaagcaatactaacagataaaatttcaaaaagtgcaaagaaagaccggattttggcacagtatcccaaccaaaaatcaacaggaatatttgcagaatttcttaaattaatagtcggaaatcaagctgactttaagaaatacttcaatttagaagacaaaacacccctacaatttgctaaagattcttatgacgaagatcttgaaaatcttctagggcaaataggagatgaatttgcagatttgttctcagcggccaagaaattatacgattccgtactattatcgggtatactaaccgtaatagatctctcaaccaaagcaccactttcagcatccatgatccaacgatatgatgaacatcgcgaagatttaaaacaactaaaacaatttgtcaaagcctcacttcccgagaaataccaagaaatatttgctgattcatcaaaagatggatacgctggatatattgaaggaaaaaccaaccaagaagcattttataaatacctatctaaactcttaaccaaacaagaagacagcgaaaatttcttagagaaaatcaaaaatgaagactttttgagaaaacaacgcacattcgacaatggaagcataccacaccaagttcacttgacagaattaaaagcaataataagacgtcagtcagaatactaccccttcttaaaagaaaaccaagatcgcattgagaaaatattaactttcagaataccttattacatcggcccactggctagagaaaaatcagattttgcgtggatgacaagaaaaacagacgacagcatacggccttggaactttgaagatctagtagacaaagaaaaatcagcggaagcattcatacatagaatgacaaataatgacttttacctacctgaagaaaaagtgctacctaaacatagcctaatatatgaaaaattcacggtatataatgaacttacaaaagttagatataaaaatgaacaaggagaaacatatttctttgatagtaatattaaacaagaaatatttgatggcgtttttaaagaacatagaaaagtctccaaaaagaaacttctcgacttcttagcaaaagaatatgaagagttccgaattgtagacgtcataggcctggacaaagagaacaaagcgttcaacgcaagcctaggaacctaccatgatttagagaaaatactggacaaagactttcttgataatccagataacgagtcaatattagaagatatagtacagacactaacgttattcgaagatcgtgaaatgataaagaaaaggctcgaaaattataaagacttattcacagaatcacaacttaagaaattatatagacgacactacacaggttggggcagactatcggcgaaactaataaatggaataagagacaaagaatcacagaaaacaatcttagactatctcattgatgacggccgaagtaacagaaattttatgcaactaattaatgatgatggacggtcaaatagaaattttatgcaactaataaatgatgatggactctcatttaaaagtataataagtaaagcacaagcaggttcacactccgacaatctaaaagaagtagtaggggaactcgctggatcaccagcgataaagaaaggaatattacaatccttaaaaatagtcgatgagctagtaaaagtaatgggttacgaacctgaacaaattgttgtagaaatggcaagagaaaatcaaaccaccaaccaaggacgaagaaatagcagacaacgctacaaactacttgatgatggagtcaaaaacttggcctcagatcttaatggaaatatactaaaagaatacccgacagataatcaggcattacaaaacgaaagattattcctatattacctacagaacggaagggatatgtatacaggcgaagcattagatatagataatctttcccaatacgacatcgatcatattataccacaggcttttattaaagacgactcaattgataatagggtcctagtaagcagcgctaaaaacagaggcaaatcagatgatgtcccatcattagaaatcgtaaaagattgcaaagttttctggaagaaattactcgacgcaaaactaatgagccaaagaaaatacgataatcttacaaaagcagaacgaggaggtcttacgtctgatgataaagccagattcatccaacgtcaattagtcgaaacaaggcaaatcactaaacatgtagcacgaatactagacgaacgatttaacaacgaactggattcaaaaggaagacggataagaaaagtgaaaatagtaaccttaaaatctaatctagtgtctaattttcgaaaagagttcggcttttataaaatacgagaagtaaataactatcaccacgcacacgacgcatatttaaacgcagtcgttgcaaaagcaatactaacaaaatatcctcaacttgaaccggaatttgtatacggagattatcctaaatataacagctataaaacacgaaaaagcgcaacagaaaaattattcttttactccaatataatgaatttcttcaaaacaaaagtcacactcgctgacggaactgtagttgtcaaagatgatatcgaagtaaacaacgatacgggagaaatagtatgggacaaaaagaaacatttcgctacagtaagaaaagtgttgtcttacccgcaaaataacatagtaaagaaaacagaaatacaaacaggaggattctcaaaagaaagcatactcgcccacggaaactcagacaaactcataccgcggaaaacaaaagacatatatctagatcccaagaaatacggaggcttcgatagccccatcgtcgcatattcagttctagtcgtcgcagatataaagaaaggaaaagcacagaaattaaaaacagtaactgaattactaggaattactataatggaaaggtcaaggttcgagaaaaacccatccgcttttctagaaagcaaaggttatctaaacatccgcgcagataaactcattatcctgccaaaatattctctattcgaactggaaaacgggcgaagacggctattggctagtgcaggagaactacagaaaggaaacgagctcgcattacccacacaattcatgaaattcttatatttagcaagccgttataatgagtccaaaggtaaaccggaagaaatagagaagaaacaggagttcgtaaatcaacatgtatcatactttgacgacatactacaattaataaacgatttctcgaaacgtgtaatactagcagatgcaaatctcgagaaaataaacaaattataccaagacaacaaagaaaatatatcggtagacgaattagcgaataacataattaatctatttactttcacatcacttggcgccccagctgcatttaaattcttcgataaaatagtcgacaggaaacgttatacatcaactaaagaagtactaaactccacactaatacatcaatctataactggcctttatgaaacacgaatagacttaggaaaactaggagaagactga

SEQ ID NO: 9021 - RNA, 4155 nt, synthetic construct
  misc_feature 1..4155: note = Cas9 variant
  source 1..4155: mol_type = other RNA
atgaagctccgtgggatcgaagatgattattcgattgggttagacatgggcacaagctcagtcggctgggcagttactgatgaaagaggcacattagcgcattttaaacgtaagccaacgtggggttctaggctatttagggaagcacaaacggctgcggtagcaagaatgccaaggggccaacgaagaagatatgtaagaagaagatggaggttagatttattacagaaactttttgaacagcaaatggaacaggcagaccccgactttttcatccgcttaaggcaatctagactcttacgagatgaccgtgctgaagaacacgcagattatagatggccactttttaacgactgcaaatttacagaaagggactattatcagcgctttcccacaatataccatgtaagatcttggttaatggaaacagatgaacaagcagatataagactaatatatttagcattgcataatattgtcaaacacagaggtaatttcttaagggaaggtcagagcctgagcgcaaaatcagcaagaccagatgaggccttaaaccatctgcgagagacacttcgagtctggtcttcagaaaggggattcgaatgttcgatcgctgataatggatctattttggcaatgctaacacatccagacttatcgccaagcgataggcgcaagaaaatagcaccactatttgatgtaaaatcggatgatgcagcagccgacaagaaattgggaatcgcactcgcaggagccgttataggattaaaaacagagttcaaaaacatatttggagattttccatgcgaagactcttcaatatatcttagtaatgatgaagcagtagatgctgtgagatcagcatgccctgacgactgtgccgaactattcgacagattatgtgaagtatattcagcatacgtcctccagggattattaagctatgcaccaggacaaactattagcgcaaacatggtcgaaaaatatagaagatatggagaagaccttgcactattgaagaaattagtaaaaatttacgcaccagatcaatacagaatgttctttagtggagctacttaccccggtaccggtatctatgacgctgctcaagcaagagggtataccaaatacaatttgggaccaaagaaatctgaatataaaccaagtgaaagcatgcagtatgacgatttcagaaaagctgtcgaaaaattatttgcaaaaacagatgcccgagcagatgaaagatatcgaatgatgatggacagatttgataaacaacagtttttacgaagactaaaaacctcagacaacggttcaatatatcaccaattacacttagaagaattaaaagcaatcgtggaaaatcagggacgattttacccctttctaaaaagagatgctgacaagctagtaagtcttgtgagcttcagaataccatattacgtaggacctctctcaacacgcaatgctagaacagatcaacacggtgaaaatcggtttgcgtggtcagaaaggaaaccggggatgcaagatgaaccaatatttccgtggaactgggaatcaataatagatcgatcaaaatctgctgaaaaatttatattacggatgacaggtatgtgtacctacttgcaacaagaaccggtattgcctaaaagcagtctattatatgaagaattttgcgtcctaaacgaattaaatggtgcacattggagtattgacggggacgatgaacatcgtttcgatgctgcggacagggaaggaattattgaagaattattccgaagaaaaaggactgtaagctatggtgatgtcgcgggatggatggaacgtgaacgcaatcaaataggcgcacatgtatgtggaggacagggagagaaaggattcgaatccaaattaggtagctatatcttcttttgtaaagatgtatttaaagttgaaagactagaacaaagcgactatcctatgatagaacgaataattctctggaatacactatttgaagataggaaaattttatcacaacgactaaaagaagaatacggtagcagactatcagccgaacaaataaagacaatatgtaaaaagagattcacaggctggggaaggttatcagaaaaatttttaaccggtataaccgtacaagtagatgaagattcagtatcaataatggatgttttaagagaaggatgccccgtaagcggaaagagaggtagagcaatggtaatgatggaaatacttagagatgaagaattaggatttcaaaagaaagtagacgattttaaccgagccttctttgcagaaaacgctcaagctctaggagtcaatgaattaccagggtcaccggctgtgcgtaggtcattaaatcaatcaatcagaattgttgacgaaattgcatctatcgctggtaaagcaccggctaatatatttatagaagtaacacgagacgaagatccaaagaagaaagggcgtcgtacaaaaagaagatacaatgatttaaaagacgcattagaggcttttaagaaagaagatccagaattatggagggaactttgcgaaacagcacctaatgatatggacgagagattatcactttattttatgcagagaggcaaatgcttatactcaggtagagctatagatatacaccaactttcgaatgcaggtatatatgaagtggaccacataataccacgaacttacgtaaaagatgatagtctagaaaacaaagccttagtatacagggaagaaaatcaaagaaaaacagacatgctattgatcgaccccgaaataagacgaaggatgtctggatattggagaatgttacacgaagcaaaattaataggagataagaaatttaggaatctattaagaagtaggatagacgacaaagccttaaaagggttcatagcgagacaactcgtcgaaacaggacaaatggtgaaattagtaaggagtttattagaagcacgatatccagaaactaatataatatcggtcaaagcctctatatcacatgatctacgcactgctgcagaattagtcaaatgtagagaagcaaatgattttcaccacgctcatgatgcttttctggcgtgccgagtcgggttattcatacagaaaagacatccatgtgtctatgaaaaccccataggattaagccaagtggttagaaactatgtaagacagcaagcagatatattcaaaagatgtcgaacaatacccggaagctcaggatttattgtaaattcatttatgacaagcggattcgacaaggaaacaggggaaatttttaaagacgactgggacgctgaagcagaagtcgaaggtataagacgatcattaaattttagacaatgttttatatcacgtatgccatttgaagatcacggtgtattttgggatgccactatatattctccaagagctaagaaaacggcggcattaccacttaaacaaggtctcaatccatcacgatatgggtcattcagcagggaacaatttgcttactttttcatttataaagcaagaaatccacgtaaagaacagacattatttgaatttgcgcaggttccagtgagattatctgctcaaatcagacaagatgaaaacgccttagaaagatatgcgagagaattagcgaaagatcaaggacttgagttcataagaatagaacgatccaaaatcttgaaaaaccaattaattgaaatagacggagatagattatgcataacaggtaaagaagaggtgagaaatgcatgtgaactggcgtttgcccaagacgagatgagagttataagaatgttagtatccgaaaaacccgtatcaagagagtgtgttatctcattatttaacagaatattattacatggagaccaagcaagtaggagattaagtaaacaactgaaactagcactattatctgaggctttttccgaggcttctgacaacgtacaaagaaatgtagtattgggattaatagccatctttaatgggtcaacaaatatggttaatctaagtgacataggaggtagtaaatttgctggaaacgtacgcataaagtataaaaaggaactagcatccccaaaagttaacgtacatcttatcgatcaatctgtgacaggaatgttcgaaagaagaactaaaattggactatga

SEQ ID NO: 9022 - RNA, 4158 nt, synthetic construct
  misc_feature 1..4158: note = Cas9 variant
  source 1..4158: mol_type = other RNA
atgacaaaaccttacagtatcggtctcgatattggcacaaactccgttggctgggccgttataaccgacgattacaaagtaccatctaaaaagatgaaagtacttggcaatacctccaaaaaatatataaagaagaacctcttaggtgcactccttttcgacagtggaataacagcagaaggaagacgtttaaaacgaacagcaagacgtcgatatacccgacggcgaaataggatactttacctgcaagagatattctcaacagaaatggcaactcttgacgacgctttttttcaacgactagatgacagtttcttagtcccagacgacaaaagagactcaaaatacccaattttcggcaacctcgtggaagaaaaagtgtaccacgatgaatttccaactatataccatctcagaaaacacttagcagactcatcaaaaaaggcagacctaagactcgtttatctagccctagcccatatgatcaaatatagaggacactttctaatagaaggagatttcaattcaaaaaacaacgacctacaaaaaaactttcaagacttcctagacacgtacaatgcaatattcgaatctgatttgtcactagaaaacagcaaacaactagaggaaattgtaaaagacaaaatatcaaaaagcgccaaaaaagacagaatattaaaactctttcccggagagaaaaactctggaatatttagtgaattcttaaaattgattgtaggaaaccaagcggactttagaaaatacttcaatttagacgaaaaaacatccctacaatttagtaaagaatcttatgatgaagacctagaaacattattagggcacataggtgacgactattcagacgtatttttaaaagctaaaaaattgtacgatgctatattgctaagtggaattttaacagtcactgataatggtacggaagcaccactttcttcagcaatgataatgagatacaaagaacacgaagaagacctagccctacttaaggcttatataagaaacatttcattggaaacatataacgaagtatttaaagataatactaaaaacggttacgcagggtatattgacggaaaaactagccaagaagatttctacgtttacctcaaacgattgttggcaggccttgaaggagcagattatttcttagaaaagatagaccgagaagatttcctcaggaaacaacgaacgtttgacaacggttctattccctatcaaatatatctacaagaaatgagagcaatattagataaacaagcgaaattttatcccttcttagcaaagaataaagaaagaattgaaaaaattcttacattccgaataccatactacgtaggacccctagcccgagggaattcagattttgcgtggtcaattagaaagagaaacgaaaaaataacaccatggaactttgaagacgtcatcgataaagaaagcagcgctgaagcattcataaacagaatgacatctttcgacctctacctacctgaagaaaaagtactaccaaaacactccttattatatgaaaatttcactgtatacaacgaactaacaaaagtccgatttatagcagaaggaatgcgagactatcagttcttagatagcaaacagaaaaaagacatagtaagactatattttaaaggaaaaagaaaagtaacggataaagacattattgagtacttgcatgccatagatggatacgacggcattgaactaaagggaatagaaaaacaattcaactcgtccctatcaacataccatgatctccttaacataataaatgacaaagaatttttagacgactctagcaatgaaacaattatagaagaaataatacatactttaactatgttcgaagaccgtgaaatgataaaacagcgactaagcaaattcgacaacatatttgacaaatcagtccttaagaaactatcaagaagacactacaccggatggggaaaactttcagcaaaactgataaacggaatccgcgacgaaaaatccggtaatacaattctagactaccttatcgatgatggggtaagcaatcgtaacttcatgcaattaattcacgatgatgcactcagttttaagaaaaaaataaagaaggcacaaataatcggagacaaagacaatataaaacaagtagtaaaaagcttaccaggctcaccagcaataaagaagggaatccttcaaagtataaaaatagtagatgaattagtaaaagtaatgggacgagaacctgaatcaattgtagtagaaatggcaagagaaaaccaatacacaaatcaaggcaaaagtaattcacaacaacgactgaagagattggaggaatccctaaaaggactaggtagtaaaatactaaaagaaaacgtgccaactcgactatcgaaaatagataacaacgcactacagaatgaccgattatatctttattaccttcaaaacggtaaggacatgtacaccggcgaagaattagatatcgataggttgtcaaactacgatatagatcacattattccccaagcgttccttaaagacgacagcattgacaataaagtgcttgtatcatcagcatctaatagaggaaaatcagatgacgtcccatcactcgaagtagtaaagaaaagaaaaacgttatggtaccaactcctaaaatcaaaactaatatcccaaagaaaattcgacaacttaacaaaagcagagcgaggagggttaagtcaagaggaaaaagctggatttatccaaagacaactcgtagaaacacgacaaataacaaaacacgtagcccggctactagatgaacggttcaacaacaaaaaagatgaaaacaacagaacacttcgcacagtgaaaataataactctaaaaagttcgctagtttctcaattccgcaaagattttgaattgtacaaagtcagagaaatcaacgacttccaccacgcacatgatgcatatctaaatgcagtggtagcttccgcactcttaaagaagtatcctaaactggaacctgaattcgtatacggagactatcctaaatacaactcttttcgagaaagaaaatcagcaacagagaaagtatacttctatagtaatataatgaatatatttaaaaaatcaataccattggcagatggaacagtaatagaccgaccactaatagaagtcaacgaagaaaccggagaatcagtatggaacaaagtagcagatctaaacacagtacgcaaagtgttatcatacagccaagtaaatattgtaaaaaaagtcgaagaacaaaaccacggacttgacagggggaaaccgaaaggcttgtttaatgcaaatctcagtagcaaaccaaaaccaaacagtaaagaaaaccttgtaggcgccaaagaatatctagatcctaaaaaatatggcggctatgcgggtatatcaaattcctttgcaattttagtaaaaggaacgatagaaaaaggcgcgaaaaaaaaaattaccaacgtcctagaattccaaggaatttcaatattagaccgtatctattacagaaaagataaattaaacttcctcctcgaaaaaggatacaaagatatcgaattaataattgaactccctaaatactccctatttgagctcagcgatggtagcagaagaatgctagcttcaattttatcaacgaataataaaagaggggaaatacacaaaggaaaccaaatattcattagccaaaaatttgtaaaactactgtaccacgcaaaacgtattagctcaacattcaatgaaaaccatagaaaatacgtagaaaaccacaaaaaagaatttgaagaactattttattatattttagaattcaatgaaaattacgttggtgccaaaaaaaatggggaattgctgaaatcagcgtttcagagttggcaaaatcactccattgacgagctctgcagttcattcataggaccaaccggctcagaaagaaaaggtctgtttgaactaacaagcaggggaggagccgcagacttcgaattcttaggggttaaaatacctcggtatagagactacacaccttcctccctactaaaagacgcaacgctgattcatcaaagcgtaaccggattatacgaaacaagaattgatttaggaaaactaggagaagactga

SEQ ID NO: 9023 - RNA, 4158 nt, synthetic construct
  misc_feature 1..4158: note = Cas9 variant
  source 1..4158: mol_type = other RNA
atgcaaacatacttcggtatgaaaaaaatattaggtttggatctaggaacaaactccataggctgggccctggtaaacgaagctaatgatgataacgaaaaaagttcaatcattaaactcggagtacgtgtgaacccattaacagtagacgaacagagcaacttcgaaaaaggtaaaagtataacaacaaatgcggagaggacgataaaaagatccattcgaaggtcacttcaaagatacaaattacgcagagaaaatctaatagaaatactcaaggaacacaattttatcactgatgacacaatactgagcgaagacggaaacgcttctacatttgaaacttatagactaagagcaaaagcggcaagtgaaaaaataagcctcgaagaattagggcgtgtgctgttaatgataaataaaaaaagaggctacaaaagctcacgtaaagcaaaaaaccaagaggaaggacaacttatcgatggtatggaagtggccaaggaactatatgaaaaaaatataacacctgggcaattcgtattccaattactcaagcaagggggaaaattcattccagatttctaccgttccgacttgcaagcagaattcgataaaatttgggaatttcaaaaattatttcatgcagaaattctagtagacgactttaaaaaacaactagaacgtaaaggcaaactaaactcctcaaagatattcttaggaagatttggaatttacacagccgaaaacaaaggaaatgacaaacgattacaagcctatcaatggagagtcgacgcactaaccaaagaactcactaaagaagaattagcctatgtaatctctgaccttaacggaataataagcagcagttccggctacttaggaagcatatccgacagatcaaaagaattatacttcaacaatcaaactgtcggacaatttctaatggcacaattagaccactcaccacatacatcccttaaaaaccaagttttctaccgacaagattacttagacgaatttaacacattatgggaaaatcaagcacactatcacaaagttctaaccagcgacctcaaatcagaaatcagagatgtaataatattctaccagagaagactaaaaactcaaaaaggcttaatatcattttgtgagttcgagtccagaaaaatagaagtggaaatcgacggaaaaaaaaaaatcaaaaatgtgggaagtagagtatgcccgaaaagctcaccgatctttcaagaattcaaaatatggcaaatattaaacaacattgaactattagagaaatccagcaaagcaaaaagattcttggaccaagaagagaaagaacttctattcaaagaattgtctataaaaagcaagatctcgaaatctgatgcattaaaattgctctttaaaaattccagggaattagatttaaactataaagaaatagagggaaacaggacacaaagtgctctttttgacgcttatagcaaaataatagaattatccggtcatggagaatatgattttagtaagatggaagctagcaacatcatagaactcgttcaagaagtttttacaggcctaaactacaacacggaaatactatacttcgacagctcactagaaggaaaagactttgaaaatcaaccaatgtaccgtttgtggcatctactctatagcttcgagggagatgactctaaaaccggaaacgaaaaattaatcaacaaattatcagaactttacggcttcgaaaaaaaatacagcatagtattagcaaacgtatctttccaagaagattacggatcacttagtactaaagccataaggaaaatacacccatatttaaaagagggcatacaatatgacgtggcctgtgaattcgcaggttacaggcatagcaaatcatccctgacgaaagaagaaatcgaaaacaaaatattaaaggaccaattagaaattttaccaaaaaattctttacgaaatcctgtagtcgaaaaaatattaaaccaaatgataaatgtcgtcaacgctctcaatgaatcttacggcaaacctgacgaaatccgaatagaactagccagagaattaaagaaatcagcaaaagaaagagaggaactaacggctagcataggagagacaactataaagcacgaaaaatacagagcgattttagaaaatgagttcggaataagtcacgtaagccgaaatgacataataagatacaaactttacctagaacttgaaaataggggatataaaacattatactctaatacttatgtatcgcaagaaaagctattctcaaaggaattcgacatcgatcatatcatcccacagtcttgcttatttgatgatagtttctcaaacaaaaccctggaatcaaaaagcgtcaatatagaaaaaggtaatgataccgcattcgactacgtatttgccaaatacggcgaagccggattatccgactatataatacatatagaagaactttttaaagacggtaaaatatcaaaaaccaaattaaacaaactaaaaatgaaaggcaacgaaataccatcagatttcatagcacgagatatacgagacacacagtatatagcaagaatcgcaaaaaacatattagaagaaacggtaagaaacgtggtctcaacgagcggatcaatcacagacagattacgagaagactggcaactaatagacgtaatgcaagaacttaattgggaaaagtattctgcactaggtctaaccgagatctatgaaaatcgagaaggacacacaataagaagaatcaaagattggacaaagagaaacgatcaccgacaccatgcaatggacgcattgaccatagccttcacaaaacgctcgcatatacaatatctcaacaatttgaacgcacgctctgataaatccggaagtatatacggaattgaaaccaaagagctctatcgtgatgaccatggaaaactaaaatttaaacccccaataccattaaatgaattccgagcagaagctaaaaaacacctagaaaacacactaatatcgataaaagccaaaaataaagtagcaaccataaacataaacacgacgtcaaccaaagaaggcaaaaacaaaaaaagacaattgacaccccgaggccaactacaccttgaaacaatatacgggtcaatacaacaatatgttacaaagcaagaaaaagtcggtgcttcatttaacgaagaacaaatatcaaaagtagcaaaacagaagtatagacaggcattgctaaaccgattacgcgaattcgataacgatcctaaaaaagcattcactggaaataattccttcgaaaaaaatcccatataccttgacgtactacaaacgcagaaagtaccagacaaagtagaaacagtaagtaaagaaatcatctacactattcgaaaagacataaccccagaattgaaaatagaaaaagtaattgacaaaaagataaaaacgatactccaatcacgactgaacgaatattcaggagattcaaagagggcctttagtaaccttaaagaaaaccctatttggctaaaccaagagaagggaatagaaataaaacgggtaacaatatctggaatatccaacgcagttgctattcacgataaaaaagataaaaacggtaatttaatcctcgataatgagggtagcactcaagcagtagacttcgtaaacacaggtaataaccaccacgtagcaatatataaagacgaacgtggaaatttgcatgaatcagttgtctcattcttcgaagcctgtacacgagttaacctaggaggtccagtaatatttaaaaactacaacaaatccgatggctgggaattcctatttagcatgaaacaaaatgaatattttgtatttccaaacgagaagaccggcttcaatcccaatgaaatagacctactcgaccccgataattacagattaataagccctaatttattcagagtccaaaaaatttcatccaagaattatgtcttcaatcatcacctcgaaacatcagcaattactggagaaaccctaaaaaacaagaaacaattaagtagcgtcacataccatttcatacaatcattaccacctatcaaagacatagtaaaagtaaggataaacaacatcggccaaatagtgtgggtgggagaatattga

SEQ ID NO: 9024 - RNA, 4158 nt, synthetic construct
  misc_feature 1..4158: note = Cas9 variant
  source 1..4158: mol_type = other RNA
atggacgaactacaaaattttgaaaaaggaaaatcaataacaacaaatgcagatcgaactgcgggacgttcaatgagaagaaatcttcaacgatataaattaagacgtgaaaacctaattgaagtgttaaaagaatacaacttcataacagatgaaatgatattaagtgaaaatggaaatcgtacaacattcgaaacgtatagattaagggcaaaagcagcagtagaagaaatatcattagaacagtttgcacgagtactactaatgataaacaagaaaagaggatacaaaagctcaaggaaagcgaaaggggcagaaaatggaacacttattgacggaatggaagtagccaagaaaatgtatgatgaaggtattaccccgggtgaattatgtttacaactactaaccgcagggaaaagatacttccctgatttctatcgctcagatttgcaagctgaatttgacagaatttggaattttcagaaacaattctatccagacagccttattgataaagtgaaagacgaagtacgaggcaaaaacaaaagtcagacgtgggccatcctagcgaaatattttgtctggaaagaagtagaaaatagctggaatgaagaagaagctcaaaccagacgcgtagaaaaagaatatcggctagtaggaatcaaaagaggagtaaaaagagaagaacttaaattagaaaattttcaatggagagtaaaagccttaagtgaaagaatgaatccagaagaattagcaatagtattacaagaaatcaacgaacaaatctcaaactcaagtggctacttaggagccatatccgaccgttcaaaagaactatacttcaacaggcaaactgtcggccaatatcaaatggcagtcctagataacaacccaaacattggattaagaaatatggtattttatagacaggggtacctgggagagttcaatacaatatgggaaaaacaagccgagttccataaagaactaacagaagatcttaagaaagagatcagagatatagtcattttctaccaacggcgcctaaaatcccaaaaaggcttgataaacatatgcgagttcgaaagaagacagatagaagtagaaatagatggcaaaaagaaaattaaaactatcggtagcagagtcatcccaagatccagcccactctttcaagagttcaaaatatggcaaacattaaatgacatagaagttagtgttctaggtgttaaaaacaaaagaaagaaacaggatgataatagtaccactctgttagattcggcagaaaatatagacagcctgaaactaaacgtaagtagaccactagacgctgatgaaaaatcactgctagcaaaagagctatttattagagataaattaacaaaatcagatgtactaaaattattattcaataaccctcaaaacttaaatctgaactttaaaaatatagacggaaaccggacaggatccgcactatatcaagcattttcaaaaatactagaaatatcaggacacgaaagtataaactttaagaaatcggcagacgaaatagtagaacaagtaaaaacaatattcagtgccctgggttggaataccgaggtattatgttttgactcggaaaaagaacttgacaaacaaccgtatttcaaactatggcatctactatactcatttgaaggggatagcacaccaactggtgatggaaacttaatacagaaaatcgcggatctctgtgggtttgaaaaagactatgcttcaatattggcaaacataacatttcaagaagattacggtagtttaagcacgaaagcaataaggaaaatactaccacatctaaaagatggcaaccaatatgacgtagcatgcgagtatgctggatacaaacacagtaaatcatcacttaagaaagaagaaatcaaaaataaagtactgaaagacaaactagaacttttacccaaaaatagtctcagaaatcctgtcgtagagaaaatattaaaccaaatggtcaacgtaataaacgcgataattacaacatatggaaagccagatgaaattaggatagaattggcaagggaactcaagaagaaagctaagaaaagagaagaattaactaaaacgatagttgatacaactaaaacacacgaaggtattagagctatactccaaaatgattttggtatgtcacatgtctcaaggaacgccattatacgatacaaactttatgaggaactaaaagacaatggatataaaacattatacagcaatacatacatacctaaagaaaaactatttagtaaagactttgatatagagcacatcataccacaagctagattgtttgacgattcattttctaataaaaccctagaagttaaatccataaacatagaaaaaggaagcaaaacagcatacgacttcgtagaagaaaaatatggtgaacaagggttacaagaatacctaaacagatgcgaagtactatttagagacaagaaaacaaaacttagaaaactaaaaatgcaagaatccgaaattccagaaggatttattgatagggatttaaggaacacacaatacatcgccaagaaagcattaagtatgctcaacgaaatatgcagacgagtcgttgcaacaactggtgcaataacagacgaactacgagaagattggcagctagtagatgtaatgaaagaactaaattgggaaaaatataaagtactagggctggtcgaatacttcgaagacaacgacggtagattaattggaagaataaaagattggacgaaaagaaacgatcacagacaccacgcgatggacgcattaacagtagcattcacaaaagatgtattcatacaatattttaacaataaaaacgcctcgctaaaacccgacacaaacgaagctgcaataagaaataaatactttcaaaatggaaaagcaatcccaccaatgagcttagacgagttcagggctgaagcgaaaaagcatctaaatgataccctaatctccattaaaaccaaaaataaagtcgtaacaattaatttaaatcgaacaaagaagaaaaatggtatcaataagaaacagcaacaaacgccaaggggacaacttcacttagaaaccgtttacggaagccataaacaatacgttgtcaaagaagagaaggtaaacgcctcatttgatgcggccaaaatagccacagtaaacaaaccagcgtacagggatgccttactacggaggctccaagaaaatggaaatgattccaagaaagcattcacaggcaaaaatagtcttgataaacagccagtatggttggacgccaaacaaaatgaatgtgtgccagaaaaagttaaaactgtaatgctagaaacagtttatacggttaggaagccaatagacgaaaaactgaacgtagataaagtagttgacgccaggataagaaaactattacaagacagaataaaagaatacggaaacgcaaaatcagcattcgcaaacttagatgaaaatcctatatggcttaacaaagagaaggggattacaattaaaagagtctccgtatctggaatatcgaaggcacaaagtcttcatgagaagaaagataaagacggtaactttatcctcgacaaagattcaagaagaatacccgtcgatttcgtaaacactggaaataatcaccatgtagcaatatataggaaaccggtactcgataagaaaggacaagctgtgtttgacgaaaacggagaactaaaattcgaactagaagaagtagtggttagctttttcgatgcagtaacgcgagtaaacttaagtcaacctattattgacaaagattacaaaaggagcgaaggatggaaatttctattttcaatgaaacaaaacgaatactttgtctttccaaatgagaaaacgggattcgacccgaaagagattgacctactaaatcccgaaaattatgccttaatatctcccaatctctttcgtgttcagaaaatagcatcaaaagactacgtatttcgccatcacctagaaacggtagtcgcagatagaaaagagctccaagaaatcacatggaaaagaattagctccctttcaatcttaaatcgaattattaaagtacgagtaaatcatataggtcaaatcgtcatgataggagagtattga

SEQ ID NO: 9025 - RNA, 4158 nt, synthetic construct
  misc_feature 1..4158: note = Cas9 variant
  source 1..4158: mol_type = other RNA
atgacaaaaccctattctataggcttagatatcggtactaactcagtcggatgggcggtaataacagatgattataaagtaccatcgaaaaagatgaaagtactaggtaacacttcaaaaaaatatataaaaaaaaatctccttggggccctgctattcgactctggaattacagcagaaggtagaagactcaaaagaacagccagacgacgatatacacgaagacgcaatagaatcttatatttacaagaaatattctcaactgaaatggccactttagatgatgcatttttccaaaggttagatgactccttcttagtcccagacgacaaaagagactctaaatatcccatattcggaaaccttgttgaggaaaaagcatatcatgacgaatttccaaccatctaccaccttcgcaaatatcttgcagatagcaccaaaaaagcggacctacgcctggtgtatctagctctagcacatatgataaaatacagaggacactttttaatcgaaggggaatttaattcaaaaaacaacgacatccaaaaaaactttcaagatttcttggacacatataacgcaatattcgagtcagatctatccttagaaaattctaaacagttagaagaaatagtaaaagataaaatttcaaaatctgctaaaaaagacagaatattaaaattatttccaggcgaaaaaaacagtggaatctttagcgaatttttaaaacttatcgtaggcaaccaagcagacttcaaaaaatacttcaatctagacgaaaaagcaccccttcacttctcaaaagaatcatatgatgaagacctagaaacattactaggatacataggagatgactactctgacgtttttttaaaagcaaaaaaattatatgatgcaatcctgctttctggaatattgacagttacagacaacggtaccgaagccccactttcatcagcaatgatcatgagatacaaggaacacgaagaagatctagctttactaaaagcgtatataagaaacatcagtctcgaaacctataacgaagtctttaaagacgacactaaaaacggatatgcaggttacatagatggtaaaacaagtcaagaagacttctacgtgcatctgaagaaactactagtgggccttgaaggagcggattacttcttagaaaaaatagatcgagaagacttcctaagaaaacaaagaactttcgataatggatcaattccatatcaaatacatctccaagaaatgcgcgctatactcgacaaacaagcaaaattctaccctttcctagcgaaaaataaagaacgaatagagaaaatcctcacattccgcataccatactacgtcgggcccctcgctagagggaactccgatttcgcatggagcatcagaaaaagaaacgaaaaaataacaccctggaatttcgaagacgtaattgacaaagaaagtagcgcggaagcattcatcaacagaatgacttcattcgacctatacctaccagaggaaaaagtattacccaaacattcacttttatatgaaacatttaatgtatacaatgagctaacaaaagtccgcttcatagctgaaagcatgagggactaccaatttctagacagtaaacagaaaaaagacatagtaagattatactttaaaaacaagcgcagagtcactgataaagatatcatagaatacctacacgctattgacggctatgacggaatagaattgaaaggcatcgaaaaacaattcaactcatctctttcaacataccacgatctgctcaacataattaatgataaagaatttctagacgactcctcaaacgaagctatcattgaagaaatcatacataccttaacaatattcgaagatcgagaaatgataaagcaacgattatctaaattcgaaaatatattcgacaaatctgttcttaaaaagctcagccggcgacactacacaggatggggaaaattgtcagcaaaattaataaatggaattcgagatgaaaaatccgggaacacaatcttagattacttaatagatgacggtgttagtaacagaaattttatgcaactaatacatgacgatgctctatcatttaaaaaaaaaattaaaaaggcccaaataataggagacaaagacaatataaaacaggtagtacaagctttaccaggtagacccgctataaaaaaaggaatattgcaaagtataaaaatagttgatgaattagtaaaagttatgggacgcagaccagaaagtatagtagttgaaatggctagggaaaatcagtatactaatcagggcaaaagcaacagtcaacagagactaaagagacttgaggaaagtctaaaagaattaggttcaaaaattcttaaagaaaatatccctgctaaattaagcaaaatagataataatgcattacaaaacgatagactctacctgtactatttgcaaaatggtaaagacatgtataccggtgaagaattagacattgaccgtctatcaaattatgatatagatcatattatcccccaggccttcctaaaagataatagtatagacaataaagtgttagtatcaagcgcctcaaatcgtggaaaatcagacgatgtgccctcattggaagtagtaaaaaaacgaaaaacgctatggtatcaactactaaaatccaaattaataagtcaaagaaaattcgataatctcacaaaagcagaacgaggcggactcagtccagaagctaaagccggatttatacaaaggcaattagttgagacacgacaaataacaaaacatgttgcaaggctcctggatgaaagattcaacaataaaaaggacgaagataacaaaacacttagaactgtaaaaataattacactaaaatcatcactcgtgtcacaatttagaaaagattttgaattatataaagtaagagagatcaatgactttcaccatgcacacgatgcttatctaaatgcagtcgttgcaagcgcattactaaaaaaataccctaaattagaacctgagtttgtttacggagactacccgaaatataactccttcagagagcgaaaaagcgctaccgaaaaagtgtatttctattccaacattatgaacatttttaaaaaatcaatatcactagctgacggaactgtcatagaacgaccactaatagaagtcaacgaggaaaccggagaatcagtatggaataaagttgcagatttaaacacagtaagaaaagtactatcttactcacaggtaaatatcgtgaaaaaagtcgaagaacaaaatcatggattagatagaggaaaacctaaaggacttttcaatgcaaacctaagttcaaaacccaaaccgaacagcaaggaaaatttggtaggggcaaaagaatacttagacccaaaaaaatatggtggctacgcaggcataagcaactcatttgccgtgctcgtaaagggtaccatagaaaaaggagccaaaaagaaaattaccaacatcttggaattccaaggcatatcaatattagatagaataacatatcgaaaagacaaatttaattttctactagaaaaaggatacaaagacatcgacttaattatcgaactaccaaaatactcactttttgaattaagcgatggttcacggcgaatgctagccagcattctaagtacaaacaacaaacgaggtgaaatacacaagggaaaccaaatatttattagccaaaaatatgttaagttgctctatcatgcaaaaagaatatccaacactttcaatgataatcacagaaaatatgtagagaatcataaaaaagaattcgaggagctgttttattatatactagaattcaacgaaaattacgtaggagcgaaaaaaaatggcgagttactcaaaagcgcattccaatcctggcaaaaccattcgatagatgaattatgttcgagttttatcggaccaactggctcagaacgcaaaggactttttgagttaactagccgcggaggagcagcagacttcgattttctaggcgtcaaaatacctagatacagagactacaccccaagctctctcctaaaggacgccacccttattcatcaaagtgtcacaggcctttatgaaactcgtatagatttaggcaaactaggcgaagactga

SEQ ID NO: 9026 - RNA, 4158 nt, synthetic construct
  misc_feature 1..4158: note = Cas9 variant
  source 1..4158: mol_type = other RNA
atgaaaaacaaaacatggtatcttggcctaggcgtaggccctacaagcataggctgggcagcaaccgactcaaactacaaacttttacgaaaaaacaaaaaacgactgtggggagtgaggctattcgaagaagccaaaacagccgtagaccgaaggacctttagagcagaaagaagaagactcgccagaaggaaatggaggatatccttactagaagaattatttgcaaaagaagtttcaaaaaacgaccccaacttcttccttcgcctaaaagaaagcaaatatcatttcgaagataaatcattaatgaacgaatatatattatttaacgataaagattacacagacaaagactactacaaagaatatcccacaatctatcaccttagattatcgttaacaactgaagaaaatccagatatacgcaaagtttacttagctgtacactccatgctcaagaatcgaggccacttcctcttacaaggacaaagctttaatgattctaacatagactcagtcataaaagaactactagaactcgagaccgtaaaaataaacttcgaagtaaccgacgaagtaatccattcgctaaaaaaaattgccctagaaaaaaaaaatctgtccgataaaaataatgatgtcaaaaaattatacccaaaagaaaaacaactacaggaaatatttaaattagtcttcggaggcaaaacatcgctcgataaactatatgatatcgaagaatataaagaattagataattctgtgaaatcaatatcattcaaagaaaaagtctatgaagaagtacgtccagactatgaacaaatactgagcaactacatagaattattagatttagcaaagctcgtatatgacagcatagtcttagctgacatcaaaaaggaaggtaaaacgataagcgagtcgaaggtagaactttataacaaacacaaagacgatctggccaaccttaaaaaattagtcaaaatagatagtaagctctcagaagacaaaaaaaaagaagtttattttaccatatttaaagaggataaagaaaaaggaactaactatgtcaattatacacacagatcacaggaaggtaagtcatgttcatatgaagacttcaaaaagttcctgaaaaaagaactagaaaaactagaagactcaccaactaaaacaaccatactcgaggaattagacctagaaacattcttaccactacaaaggacaaaagataactcagtagtgccataccaaatacacaaagaagaactcgtcaaaatactcgataatgcagcaaaatatcacagtttcctggctgaaaaagatgactcaggatacagcacgcgagaaaaagtagtacaattattcgaatttagaatcccatactacatcggaccactaaacgcacaccacaatacagaaaatggcggctattcatgggctataagaaaaaaaggtatggaaagtgttccagtaacaccgtggaattttaaagacgttattgacgaatctgcgtcagcggaagcattcgtcaataacttaaaaaataaatgtgcatacttatctggcgaagacgtgctacccaaaaactcacttctatatagtgagtacgctctcttaaacgaactaaacgccttacgatacgaaggaaacagaatatcagtagaggcacgagacgtaatagttactaaacttttcaaagaacagggaaaaaaggtaacaaagaaaacaataaaagaactgctcaaaacagaaggattcatagacggtaaaggagaaatagtaggcatagataatatagttaaaaatgacttaaaatcatatagagactttaaaaaaatactagcggataaattcgacaaagaacgagtggaaaacattatattatggataacactatacggagaaagtagaaaactaataaaagaaaaaataacaaaagtatatggagacttctatactgtagacgaaatcgaaaaaatgtcgagattaacatataaagactggggaatcttatcacgcaagctattaacagaattagtatcagaaaagctatacaatgaagaaactggtgaatgtctcaatataatcggagcaatgagacaaggaaccattttatttatggaactattagccgataaattcgattacatgtcccaaatcaaaaaccacaacaaagaaaataaagacgacataactgaaataacaccagatatattagaaaacctgcacgcatctccagcggtaaaacgatcaatatggcagacagtaaggatcgttgaagaacttaaaacaatcataggatgcgtccccactaaaatcttcatagaaaccacaaagcgaaacaacgcaccatacaaagtacccacactaaacagaaacgacttagtcacaaagtacaaaacaatccgggaacatgaaatatttgaactcgagaaagaactaaagaacacgcttgatttcacattaaacaaaaatcgactcataaatgaggaaccctcaaaattaaaagccacaaaattatatctatattacacacaattaggaagatgcatgtacaccggtaaaaaaatagatttaggcgagctttttgataacaataacaaatacgacatagaccatatctacccacaatcgaaagtaaaagatggttcatttaataatattgtgttagtcacaaaagcatctaacgatatgaaagcagatgtatttccattaaaatcaaagttccaaacaaaagaaaataaaatattctggcgtttcctgaaagaaaaaaaactaattacagaagaaaaatacaatagacttgtacgaacggaagaattcagcaatggcgaattaaccggttttatcacccgacaattggtcgagacatcgcaagctatcaaagtaataagcaacgtattaagagaattaaacccagaaacaaccatatgctattccaaagctgaaaacgtgtcatcctttagacaatcatttgggaaaattaaagaagcaaacagaaaagcagagaacaatgaaaagttaataagagtacaagaaataaacgattactacaacgcaaaagatgcatacctgtcaattgtagtggggaatgtgtacgacgtaaaattcacgagaaacgtacacaatttcataaaaaataacaaagatgcacgaagatacagcctaaatgggctcttctataccgacgttaagaacgcaaataccatagcgtgggaaatggataaaacagtccacgtagtagaaaaaaccatgaacaataataatatcctgataacaagacgaactagcgagcaaaaaggcgctctttacgacgcgacattatataaagctaaagttgcagaaaaagcgaaggaaggaacatactacccgcttaaaaccacagactcgaaaataaaagatgtaggcaaatatggcggttttacaaaaattaagatagcatactactcaatcttcgaatacacgctggatggaaagaaaggaaaacaaaagataactaggatcgtacccataccgatttacattagtcagaacatcaaagacgacaaagcgttacttgaatacgcacaaacaagactacccgggaaagacctgaaaataaaatataggaaactatgcatagggtccctcgttaaaataaacaactttaattattacataggaggaaaaacgaataacaacttcaccttcgacagtgccgtacaagtaatactcgataaggactcagaaagctatattaaagaactagccaaatatctaaattggaaaaaagaaaacaaggatggtaagttatgggaatccataacagaagataaaaatatccaactatatgatagtttagttaaaaaaatgaacacgggcatattcattagaaaaactccaaacaaatacaccgaactactaacgctagaagtcaaaaataaattcatcaacatagatattgacgaacaagtgaaactattactggaaatcttaaacttactcacaaataaaaaattcacttccaaactaaatgagataggaataacagcctcacgaggagtatgttccttcaacctaagcaaccaatcgcaattttcaattatagaacaatcagtaaccggagtgtatgagaaagaaaaactcatcattgagaaaaaaaaggaaggaatactatga

SEQ ID NO: 9027 - RNA, 4161 nt, synthetic construct
  misc_feature 1..4161: note = Cas9 variant
  source 1..4161: mol_type = other RNA
atgaatcagaaatattccataggacttgacataggaacaaactcagttggatgggctgttataactgacgactacaaagtaccagccaagaaaatgaaagtgcttgggaatacagacaaacaatcgatcaagaaaaatttacttggtgcactactctttgactcaggagaaactgcagaagctacaagactgaaaagaacggcaagaagaagatacacccgcagaagaaatagactgagatatctccaagaaatctttgccgaagaaatgatgcaagttgatgaatcattctttcaacgattagacgatagctttttggtagatgaagacaaaagaggggaaagacacccaatatttggcaacatagcagcagaagtaaaataccatgacgaatttccaactatataccatctacgaaaacatctagcagatatttcacaaaaagccgacctaaggttagtatacctggcgttagcacatatgatcaaattccgcggccactttctcatagaaggacaacttaaagcagaaaacacaaacgtgcaagcacttttcaaagatttcgtagaagtctatgataaaactgtagaagaaagccacctaagtgaaattacggtagacgcattaagcatactaacggaaaaagtatcaaaaagcagacgattagaaaacttaatagctcattatccagcagagaagaaaaacaccctgttcggaaatttaatcgcattattcctcgggctccagccgaattttaaaacaaattttcaactatccgaagacgctaaattacaatttagtaaagatacctacgaagaagatctcgaaggattgctaggagaggtaggtgatgaatacgcagacctttttgcaagtgccaaaaacctctatgatgcaatactattaagcggcatattgacagtagacgacaattccacaaaagcaccgcttagcgcatcaatggtcaaaagatatgaagaacaccaaaaagatctcaagaaatttgaggatttcataaaagtcaacgctttagatcaatacaacgccatcttcaaagacaaaaataagaaaggatacgctggatatattgaatcaggggtgaaacaagatgaattttataaatatctcaaaggaatactactacaaatcaacggaagcggagactttctcgataaaatagatagagaagacttcctaagaaaacaaagaacctttgacaacggatctataccacaccaaatacacctacaagaaatgcatgcgatacttagaagacaaggagaacattacccctttctaaaagaaaatcaagataaaatagagaaaatcctaacattcaggattccatactacgttggccccctcgcccggaaaggaagtcgattcgcttgggcagaatataaagcagatgagaaaataaccccatggaattttgatgatatactagacaaagagaaaagtgccgaaaaattcattactcgcatgaccttaaacgacctttacctcccagaagaaaaagttttacctaaacatagtctactatacgaaactttcacagtctacaatgaactaacaaaagtaaaatatgtaaacgaacaaggagaagctaaatttttcgacgccaacatgaaacaagaaatatttgaccatgtatttaaagaaaacagaaaagtaacaaaagataaactactcaattacttaaacaaagagttcgaagaatttagaatcgtaaatttaacagggctcgacaaagaaaacaaagtattcaactcgtcacttggaacatatcacgatttgcgaaaaatcttaaacaaatcatttcttgacaataaagaaaacgcacagataatcgaagacataatccaaactctaacattatttgaagatagagaaatgataagacaaagattacagaaatatagcgacatatttactaaagcacaactaaagaaactagaacgaagacattatacaggttggggtagacttagctacaaactaattaatggtatacgcaataaagaaaacaagaaaacaatacttgactatctaatagacgatggatacgcaaatagaaacttcatgcaattaattaatgatgacgccctatccttcaaagaagagattgcaaaagcccaaattattggagacgttgatgatatagctaacgtggttcacgacttaccaggcagtcctgctatcaagaaaggtatattacaatcagtaaaaattgtcgacgagttagttaaagttatggggcacaatccagcgaatataataatagaaatggccagagaaaaccaaaccaccgatagaggcaggcgtaatagccagcaacgactcaaactactacaagactcactaaagaacttagacaacccagtcaacatcaaaaatgtagagaatcaacaattacagaacgaccgactattcctctattatatccaaaacggcaaagatatgtatacaggagaaactcttgacatcaacaatttatcacaatatgatatcgatcatataatacctcaggcctatattaaagatgacagtttcgataatagagtattaacatcctcaagtgagaacagaggcaaatcagataatgttccatcgattgaagtagtatgtgctaggaaagcagattggatgcgactacgaaaagcaggattaatttcacaaagaaaattcgacaacttaactaaagcagagcgcggagggcttacagaaaatgataaagccggatttattaaacgacaactcgtggaaacacgacaaataacgaaacacgtagcacaagtattagatgcccgatttaacgctaaacacgacgaaaataagaaagtaattcgagatgttaaaataataactctaaaatcgaatctagtatcccaatttcgaaaagacttcaaattttataaagtacgagaaataaacgattaccaccacgcacacgatgcatatctaaacgccgtaataggaacagctctgctcaagaaatacccaaaactagccagcgagttcgtttacggagaatttaagaaatatgacgtaagaaaattcatcgccaaatcagataaagaaatcggaaaagcaacggcgaaatacttcttctattctaacctaatgaatttctttaagaaagaagtgaaattcgctgacggtacagtcgtagaaaggccagatatcgaaacaagtgaagacggagaaatagcctggaacaaacaaaccgacttcaaaatcgttcgaaaagtactctcttacccacaagtaaatatagttaagaaaacagaagtccaaacacatggcttagacagaggcaaaccaagaggcctgtttaatgctaatccatctccaaaacccaaaccagatagctcagaaaacttggtaggggtaaaacgaaatctagaccccaagaaatacggaggctacgcaggaatatcgaacagttatgccgtactcgtaaaagcgataatagaaaaaggagtcaagaagaaagaaaccatggtgctagagttccaaggtatatcaatactagataggataacctttgaaaaagataaacgcgctttcttactcggtaaaggctacaaagacatcaagaaaattattgagctccctaaatattccctatttgaattaaaagatggatcgaggagaatgttggcaagtatactatcaactaacaacaaacgtggagaaatacacaaaggcaacgaattgtttgtaccacaaaaattcacgacgctactctatcacgcaaaaaggataaacaatccgattaataaagatcacatagaatacgtaaagaaacacagagacgactttaaagaattattaaactacgttttagaatttaatgaaaaatacgtaggagcaaccaaaaatggagaaagactcaaagaagctgtagccgactttgatagcaaaagcaacgaagaaatatgcacatcatttctaggagccgtcaattctaaaaatgcaggtctgtttgaacttacctccctcggatcagcatcagactttgaatttttaggtgtaaaaataccaagatatagggattatacaccatcgtccttattaaaagatagcacacttatccaccaaagtatcacaggtttatacgaaacaagaatcgatctatctaaattaggagaagattga

SEQ ID NO: 9028 - RNA, 4161 nt, synthetic construct
  misc_feature 1..4161: note = Cas9 variant
  source 1..4161: mol_type = other RNA
atgacgaaaataaccgaagactacatcgtaggtttagacatcggaacgaactcttgcggctgggtcgccatggactcaaaaaacactatattgcgaatgcacggcaagactgccataggatcacacctattcgacgcaggaaactctgccgcagaccgaagagcatttcggacaactagaagaagaataaaaagaagaaaatggagactaaagttattagaagaaatatttgactcacacttagcgaaagttgacccctatttttttgcacgattaaaagaaagtggactgagcccattggatactcgcaaaaatgtctcatcaatcatatatcctacctcattagaagacaaaaaattttatgttgacaaccccaccatatatcatcttagatacaagctaatgacagaagacagaaaatttgacctaagagaagtctatttggcaatacaccacatagtcaaataccgaggaaattttctatacaacacacctgtcaaggcattcgaagcatcaaaaatagacgtaaaaggtagcttaaaaaaactaaacgaactatacgaagggctcgatagcgaattcaatgtagagctggatagtaataacgcgctggagatagagaacataatccgtgacaaaaaaatatttaagataaacaaagtaaaagaaataaaccaattgctatcactaaaaaccgaagacaaagaaagaacaaaacttatgaaggatgtctcaaaacaaatagtaaacgcaatattaggctataaaaccaaatttgaaaccatattgctcaaagatgtatcaaaggacgaagcggacgattgggaatttaaattaacagacgtggacgcagacaataagttcgaaaacctaataggagatcttaatgaaaacgaacaagaaatattacttgtaataagaaagctagccaacgccattaccttatcaaacattgtagaagaaggaaaaactctatcagaatcaatgaaagataaatacaaaaaacactccgatgatcttaaactacttaaacaagtaatctctgaccatccagacagagacaaggccaaaaaactagcccttgcatatgacttatacgtaaataacagacatggaaaaatactacaagccaaagacatacttgaaaagaaaaaaacgctaagcaaagaagacttttacaaagaaataaaaaaaaacttggatgacagtaaagagtcacaagaaatattagatgcaatatcactagactcatttatgccaaaacaacgaacgaacgaaaatggggtaatcccgtatcaacttcatcaactagaattagataaaatcatagaaaaccagggaaaatattacccgtttctaaaagaagtaaacccagtatccagccatctaaaacaagcaccatacaaattagatgaattaataagattccgcgtcccatattacgttggcccactcatatcacctaatgaatcaactaaaaataaacagacaaaaaaaaaccaaaattttgcctggatgataaggaaagaacaaggacaaattacgccatggaatttcgatcagaaagtagatagaatggccagcgctaacaaatttataaaaagaatgaccacaatagacacatacctcctgggggaagacgtactaccagcaaactcactattatatcaaaaattcacagtactcaacgaactaaacaatgtaaaaattaacggaaagaggatttcagtacccctaaaacaagaattatacaataatttattcaaaaaaaactcgactgtcacaacaaataaattaaaatcgtatttaaaagaaaattacaaattaatcaaagtagaaataaaaggactaagtgacgaaaagaaattcaactctggcctaacaacttataacaaactaaaaaacttaaaaatattcgatcagcaaatagacgaccctaattacaataaagatttcgagcgcataatagagtggtctacaatatttgaagacaaagcaatttataaagaaaaattaaaaactattgactggctatcagaccgacaaatcgacaaactatcaaaaatcagaatgcaaggttggggacaactaagcaagaaactactaagtcaacttacagacaataatggccagacaatcatcgaacaattatgggactcacaaaataatttcatgcaaatcgtaaatcaagctgatttcaaagatgcaattgcagtcgcaaatcaaaacctcttagtagatacgtccgtcgaggacatactcaacgaggcgtatacaagccccgccaacaaaaaagcaattcgacaagtagtaaaagtggtagatgacatagtaaaagcgacaagcggaaaagtacctaaacaaatagcaatagagttcaccagagacgctgatgataacgccaaaatatcgcaatcacgagccaataaattacgaaaagtctacaaagaaatgagcaatgaactagcgtccgaaactataagaaacgaacttgaaagagttgcaaaagatcaaaaattattaaaagataaacactatctctactttatgcaattagggagagacgcctacaccggagaactaatagacattgataacttagaacagtacgatattgaccacgtactaccccaatcattcataaaggatgattcattggaaaacagagtactagtaaaaaaagccgtaaataacggcaaatctgataatgttccagtaaaactatacggaaacaggatggcaacagacctaggaatgaccattagacatatgtgggaaaaatggaaggaacaaggcttaataacaaaaacaaagtacaacaacttaatcatcgaccccgataaaattaacaaatatgaatcatccggtttcatccatagacaactagtagaaacgtcccaaataataaaactagtttctacgatactacaaagcaaatatccagatacagaaatcattgtcgtaaaagcacgatacaaccactatctacgcaagagactcaatctctataaaagcagggaagtcaacgattatcatcatgctatagacgcatatttatcagcaatatgcggtaatttattgtatcaagtatatccatacttgagaccattcttcgtatacggacaatataaaaaattctcgtcagaaccagagaaagaaaaaattatatatgataagacaagacggtacaacttcataagtcaaatctttgagaacaaagacaacgacatcataagccgcgagacaaagaaaaaagtttttgacaaaaaagatatcatagaaaaacttaaacgagcctataattataaatacatgttagtaagccgcgaaacagaaacacacgaccaagaaatgttcaaaatgactgtatacccccgactatcaagggatacaaaaaaatcacgaaatctcatacctaaaaaaaaagacatgccaactgaaatatacggcggatatacaaataattcagacgcatatatgataattgctagaataaataaaaaaaaaggcccagaatacagagtatttggagtacctatgcgagagttagttaatttaaggaaagctgaaaaaaatggacactataaagcatacttaaaacaggtacttgaacccgaaataatgtattcaaaaaacggaaaaaaaaacaaaacaatctcaagcttcgaaattgtaaaagcgaaagtaccctacaaacaagtaattcttgacggagacaaaaaatttatgctcgcctcttctacttatgtccaaaacgccaaacaacttacactctcacaatattcaatgcaagccataacagacaattgcgaaaacgacacagaagaagaaaaagcactagtagaagcatacgatgaaatactcaccaatatagataaatatttgccactattcgatataaataaatttcgggaaaaattacacgccggacgcgaaaaatttgtagacctaccactagcggagaaaaaagaaacaatactgcaagtattaaacggacttcatgataatgcagtcatgccaaaaattaaatctctcggattatcaaccccactcggattcatgcagtttcataccggggtctcactaagcgagaacgcaaaattgatatatcaatccccaactgggctatttgaaaagaggctaaaaataagcgacctctga

SEQ ID NO: 9029 - RNA, 4164 nt, synthetic construct
  misc_feature 1..4164: note = Cas9 variant
  source 1..4164: mol_type = other RNA
atgtcggactcaaaaaaatttgaaggcgaaaatgtaaaaagcggagataaaaaaacaaacaaaaatcatggcaaagttctaaaaagttcaccaaaagaaataagaaaaaacaccgaatattttatcggtctagatataggaaccagctcagtaggatgggccgtaaccaatacagattacgaaatactaaaatttaacggcaaacgcatgtggggttcaagattattcaatgaagcttccaccgcagaagaaagaagaggacatcgtgtcaacagaagacgtatccaaagaagaagagacagattgaacttactagaggagatattttctgaggaaatggcaaaagtagatccggaatttttcatgagactaaaagagagtaagttccacttagaagacaaggacgaacgaatattaggagaatcaaatataatcttcaaaggaagtgaagacggcgacaaaaaatactacgaaaaatatccaacaatctaccacctacgccacaaacttatgcaatcgtgcgaggatgtcgacatacgcgaactatatatggcactacatcatataatcaaataccgtggacatttcttattcaaaggagatttcgaagaaactggtacttcaatagaaaacataattatagagttattagagctgataaacaataatcttggagtcaaaaaattcgaatacaatgaatcacttataaacgaattaaaaaacatagtatcaaacacatctaacacaataaccaataaaaaaaaactcctgggagaatttttcaataaaaaagagtataaagcgcataagtcactcttcatactatcaataggggcctcagtaaaacctgtcgacctcttcctagaagaagaatataaagacatagatgacataaaaaatatatcatttaaaaacctagaatatgaccaagtacgagatacatatgaatcgatattcctagacaaaatcgaattcatcgatgtagcaaaacgactatatgatgcaactatactattatcaataaaaccggagggtaaaacactaagtgaggccaaagtggatatatacaacaaacaccataacgacttagaattgctgaaaaaggtattaaaaacagacaaagaaaaatatgactccatattaaaactagacattaagaaagggaataactatgtgaattacgtgaagaagagcaaaaatggcataagctgcagcaaggaagaattccataatgcattgaaaaaagtactagttaaaattgaaaaaaccgacgatatcaaatacatactaaatgaaatagaactagaaaggtttcttcctctgcaaagggtcaaagataactcagtaatcccctaccagatacatcgatacgaactaaaaaaaatacttgaaaacgcatcaaaaaaatttacctttctaaatgaagaatccgacggacacacaaacatcgaaaaaataatcaaaattatggaataccgcatcccttactatgttggacccctcaatgaccaccactcagtatacaacaacggcttcgcatgggtttccagaaaaagatcaggaagaatcacaccgtggaattttgatgaaatggtggacaaagaagagagtgcagaacgattcatagaaaatctcacaaataaatgctcatatcttataggcgaagatgtcctaccaaaagaatctttactttattctgaatttagtctactaaacgaactcaacaatataaaatacgatggaataagtctcccaatcgatataaagaaatcaatagttgaaaaaatattcagagtagagaagaaaagagtaactaaaaaatatataaaagagttcttaaaacaagagggatattctgatggaaaaggagaagtttcaggaatcgacatagatataaaatcagaccttaaaagttacagagacatggtcaaaatcttcgggactgagattgattatcgtatggctgaaaatataataaaatgggtaaccctatttggcgactccaaagacctactaaaaactaaaatcaacaaagaatatggcgaaaaagtatccaaagatcaattaaaaaaagtatgtaaactgaaatatagagattggggacgactgtcaaaaaaattcctgaccggaatccgcagctcagtacttgtaaacgatgcaacaggagaaggctatacaataatagaagcaatgagaaatacagataataacttgatgcaactacttcgtaacgagtatgactacctaaaaaagattgatcaaataaacatgctaagcagaaaagacattgacgagatcagccatgatatattagacgacttatactgttcacccgcagtaaaacgatctttatggcagactattaaaatagtggaggagatcaaaaaaattatgggtcacgagccaaaaaaagtattcgtagaagtaacacgaacaaataaggcagataaaaaaacaacaataacaagaaagaacagactactcgaactatacagcgccataaatgcagaatccagagattgggttaatgaactaaattccacagaagtatccaaatttaactctaaaaaactatatctatattacacacaaatgggcaaatgcatgtacaccgggaaaaacatagacatagagagcctattcacggatatgtatgatatagaccacatattcccccgatcaaagacaaaagacaactcattcgaaaacctagtcctagttacccgaaaagctaacgcagacaaaagagacgtatatccaatagatcctaaaatacaaactgaaagaaaaagcctatgggatatgttacacgataagaaactaataggagacaaaaaatatgatagacttacacgaacaacaggattcacagatgatgaaatgtcaggatttatcgcacgacaacttgtagaaacttcacaggcgagcaaagcggccgcagaaatgctaaaactaataaacaatgacagcgaaatagtctacgtaaaagcagaaaatgttagtgacttcaggcatgaaaatgaattcataaaggtgagagaaatcaacgaccaccatcacgccaaagatgcctacttaaacatagtcgttggaaacgtgtataatgaaaaattcacaaaaaacccagcaaattacataaagaaaggagggggaaataattacagtctaaattgtattttcaacaggaacctagacagaaatggcaaaagaatatgggacgaaaaaaagagcattgatactgtcaaccgaatgatgaaatcaaacgatgtacgagtaacattcaaaaatagagtagataaaggccctatccttaataaagtcacaatacacaaagcaagtgaattcatggatgacggaaaaaaaaacaaaaaaggttttccaataaaatcatcagaaaaaaatggaaacaacagattatgcaacctatacaaatatggtggttataaagatctaaactatagccactataccatcgtgagatacaatgtgtacgaaaagaaaggattagacatcaaatattacatgataccgataccgtactacctctgtctatgtaatataaaccagcacgattatgtatatgactacatttcaaaccgaagcaaaaaagatgtaaacaacatagaaataatagtaaatgaattaaaaatggggtcactaataaatatagatggttataactattacttaggtggatcgaaacctaaaacattctacgttgacccagcgtaccaaataatattagacaaggaaatagaaaggtgcataaaagaaatcgtaaaagcaaaaaacaacgaatatagatttataaatacggataaaataaataaaaacctcaatatgaaaatatacaaatacattgttaataagaaaattataggagtcttccgaaatcgaaaatgggacaaaggggaatacctaaactcctcagagactatagaaaaattctccgggctttcagtcgaatcacaatgcaatgtaatattgcggctaataaatgatatgcgaggatcaaataaaggcggggccaatagcaagtttgacgaactagaaatgacaataagtcgagcagagataccacaaaccctctccaacgtttcatcattcaaaataattaaccaatccattacaggattgttcgaaaatgaagtaacaatagtatga

SEQ ID NO: 9030 - RNA, 4167 nt, synthetic construct
  misc_feature 1..4167: note = Cas9 variant
  source 1..4167: mol_type = other RNA
atgactaagccatacagcattggactagacatcggaaccaattcagtaggatgggcggtaatcactgacgactacaaagtgcctagcaaaaagatgaaagtcctaggaaacacatctaagaaatatataaaaaaaaacctcttgggtgcattattgttcgacagcggtataacagcggaagggagacgactcaaaagaacagcaagaagaagatacactcgccgaagaaatcgaattctatatctacaagaaatattcagtacagaaatggcaacactagacgatgccttctttcaaagacttgacgacagctttctggtaccagatgacaaaagggattcaaaatacccaatatttggcaatttggtagaagaaaaagcatatcacgacgaattccctaccatctatcatctaagaaaatatctcgcagattctacaaaaaaagctgatttgagattagtatacctggcccttgcacatatgatcaaatatagaggtcattttttaatagaaggagaattcaacagtaaaaacaatgacatacaaaaaaactttcaagacttcctggatacttacaatgctattttcgaaagcgacctcagcctcgaaaatagtaaacaactagaagaaatagtcaaagataaaatatcgaaactagagaaaaaagacaggatcctaaaactttttcctggtgaaaaaaattcaggcattttctcagaatttctaaaattaatagttggaaaccaagctgattttaaaaagtacttcaatctggatgaaaaagcatctttacatttttccaaagaaagctacgacgaagatttagagactctactaggctatattggagatgactactcagatgtatttctaaaagctaaaaaactatatgatgccatattattaagcggaatcttaacagtcacagacaacggcacagaagcaccattaagtagcgcaatgataatgcgttataaagagcacgaagaagaccttggactactaaaggcatacattagaaatatatccctagaaacctacaacgaagtctttaaagacaactcaaaaaacggatatgcaggatatatagatggtaaaaccaaccaagaagatttttacgtatacttaaaaaacctgctgtcaaatttcgaaggagctgactattttctcgaaaaaatagatagggaagacttccttagaaaacagagaacatttgataacggttctataccataccaaatacatctacaggaaatgagagcaataatagataaacaagccaagttctatccttttctagctaacaacaaagaaagaatagagaaaatattaacattccgcatcccctactatgtcggaccactagccagaggcaactcagactttgcatggtctatacgaaagcgaaacgaaaagataaccccatggaacttcgaagacgtaatagataaagaatcctctgcagaagctttcatcaataggatgacatcctttgacctatacctacctgaagaaaaagttctacctaagcatagtctactgtatgaaacattcaacgtctataacgaacttacaaaagtccgatttatcgctgaatcaatgtcaaaatatcaatttttagattccaaacaaaaaaaagatatagttagactttatttcaaagacaaaaggaaagtaactgataaagacataattgaatacttgcatgctattgacggatatgatggtatagaactaaaaggaattgagaaacaatttaatagcagcctatctacatatcacgacctcctaaatataataaatgacaaagaatttcttgacgactcatcaaacgaagctataatagaagaaataattcacacgctaacaatattcgaagacagagaaatgataaaacaaagactcagcaaatttgaaaacatcttcgacaaatctgtactaaaaaagttatcacgcagacactacacaggctgggggaaactatccgcaaaacttattaatggaatcagagatgaaaaaagtggcaacactatcctggactaccttatcgatgacggtattagcaacagaaattttatgcaactaatacatgacgatgcactatcctttaaaaaaaagatacaaaaagcgcagattattggagacgaagacaaaggcaacattaaagaagtagttaaaagcctccctggatccccagcaataaaaaaaggaatcctgcaatcaataaaaatagttgacgaactagtaaaagtaatgggaggaaggaaaccagaatcaatagttgtcgaaatggcaagagaaaatcaatacacaaaccaaggaaaatcaaatagtcagcaacgactcaaaagactagaaaaatctctaaaagaattaggcagtaaaatactaaaagaaaacataccggcaaagctatcaaaaatagataacaatgcgctgcagaatgacagattatacctatattacttacaaaatggaaaagacatgtacactggggatgatttagacatagatagactatcaaattacgatatagatcatattataccacaagcattcctaaaagacaactcaatagataataaagtacttgtcagcagcgcatccaacagaggaaaaagtgacgacgtaccctccctagaagtagtaaaaaagagaaaaacactttggtatcaactcttaaaatcaaagcttatatcacaacgaaagtttgacaacctcactaaagcagaaagaggagggctttcacgagaagataaagcgtcctttatacaaagacaactagtggaaaccagacaaatcacaaagcacgtagcccgtctattggatgaaaaattcaataataaaaaggatgaaaacaacagagctgtcagaaccgtaaaaataataaccctaaaatcaacgcttgtatcccaattcagaaaagacttcgaactatataaagttagagaaataaacgacttacatcatgcacacgacgcatacttaaacgcagtcgtagcaagcgccctgctaaaaaaatacccaaagctcgaacctgaattcgtgtatggagactacccgaaatataatagcttccgagaacgcaaatcagcaacagaaaaagtatatttctatagtaacatcatgaacatatttaaaaagtccataagcctagcagatggcacagtgattgaaaaacccttaatagaggtaaatgaggaaactggagaaagtgtttggaataaagaatctgacctagcaaccgtacgacgagtactatcataccctcaagtaaacgttgtaaaaaaagtagaaaaacaaaaccacggcctggaccgtggaaagccgaagggattatttaatgcgaatctctcgagcaaacctaaaccaaacagcaatgaaaatttagtcggcgcaaaagaatacttggacccgaaaaaatatggaggttacgccggaatctcaaacagctttgctgtattagtcaaaggtacaatagaaaaaggcgccaagaagaaaataacaaacgtactcgaatttcaaggaatcagcatcttagacagaataaactacagaaaagataaacttaacttccttctcgaaaaaggctataaggacattgaactaattatagaattgccgaagtattccctatttgagcttagcgacggatcaaggagaatgctagccagcatattatcaactaataacaaaagaggtgagatccataaaggcaatcaaatatttctctcccaaaaatttgtaaaattgttatatcacgccaaaagaatatctaacacgataaacgaaaatcatagaaagtatgtagaaaatcacaaaaaggaatttgaagaattattctactatatactagaatttaacgaaaattatgttggtgcaaaaaaaaatggcaaactattaaatagcgctttccagtcctggcaaaatcattctatcgacgaactgtgtagttctttcataggaccaacaggatccgaacgaaaaggtctatttgaactaacaagtagaggttccgctgctgatttcgaattcctgggggtaaaaataccacgctaccgagattacacgccctcgtccttactaaaagacgcaacattaatccaccaaagcgttactggtctatacgagacaagaatcgatttagcaaaactaggagaaggttga

SEQ ID NO: 9031 - RNA, 4167 nt, synthetic construct
  misc_feature 1..4167: note = Cas9 variant
  source 1..4167: mol_type = other RNA
atgacaaaaccatattctattggactagacataggaactaattcagtgggatgggcagtaattacggataactacaaagtaccaagcaagaaaatgaaagtattaggaaacacatcaaagaaatatatcaagaaaaacttattaggtgttctacttttcgactcaggaattacagccgaaggccgaagattaaaaaggacagcacgccggcgatatactagaagacgtaacagaatcctctacctacaagaaatatttagcactgaaatggcaactcttgatgacgcatttttccaaaggcttgacgactcctttttagtacctgacgacaaacgagattccaaataccccatatttggtaatttagtagaagaaaaagtctaccacgatgaatttccaaccatataccatctcagaaaatacctagcggactctactaagaaagcagacctacgattagtatatctggctttagcacatatgataaaatatagaggtcactttttaatagaaggagagttcaatagcaaaaataacgacatacagaaaaactttcaagactttctagacacctataatgccatattcgaatctgacctgtccctagaaaactcaaaacaactagaagaaatagtaaaagataaaatatcaaaacttgagaagaaagatcgtatattgaaattattcccaggggagaaaaactcaggtatatttagcgaatttctaaaactaattgtaggcaaccaagctgattttcgcaaatgcttcaacctagatgaaaaagcatctttgcattttagcaaagaatcatacgatgaagatcttgaaaccctactcggatatataggagatgattattccgacgtttttctaaaagcaaagaaactgtacgatgcaattctactgagcggatttttaaccgtaacagataacgaaactgaagcaccactttcttcagcgatgattaaaagatacaatgaacacaaagaagacctcgctctactaaaagaatacataagaaatatatctcttaaaacatataacgaagtgttcaaagacgacaccaaaaacggatacgcaggttatatcgacgggaaaacaaatcaagaagatttttacgtatacctcaaaaaccttctagccgaatttgaaggcgcagactacttcttagagaaaatagatagggaagatttcctaagaaaacaaagaacattcgacaacggatcaataccctatcaaatacatttgcaagaaatgagagccatattagataaacaagcgaaattttacccattcctggccaaaaataaagaaagaatcgagaaaattctcactttcagaataccctactacgtagggcctctcgctcgagggaactcagattttgcatggagtatacggaaacgtaatgagaaaattacaccttggaattttgaagatgtaatagataaagaaagtagcgccgaagcatttataaatcgaatgacaagttttgacttataccttccagaagaaaaagtacttcctaaacatagtctactatacgaaacatttaacgtttacaacgaactgacaaaagttagatttatagcagaatcaatgcgggattaccaattcttagacagcaaacagaagaaagacatagtaaggctatattttaaagataaaagaaaagtaacagataaagacataatagaatacctacatgcgatctacggatacgacggcatagaattaaaaggtatagaaaaacaatttaattcatcattatcaacataccacgatctgttaaacattataaacgacaaagagttcttagacgatagcagtaatgaagctataatcgaagaaataatacacaccttaacaatattcgaagatcgcgaaatgataaaacaacgactaagcaaattcgaaaatatattcgacaaaagtgtactcaagaaactctcaagacgccactatacaggttggggaaaactgtcggccaaactaataaacggaatcagagatgaaaaatccggaaatacaatacttgattacctaatagacgatggaattagcaatcggaactttatgcaactcatacatgatgatgctctatcattcaaaaagaaaatacaaaaagcccaaatcatcggagacgaagacaaaggaaacataaaagaagtagtcaaatctcttcccgggtcaccagcaatcaagaaagggatattacaaagcattaaaatagtggatgaattagtaaaagtcatgggtggacgaaaaccagaaagcatcgtagtagaaatggcccgcgaaaatcaatatactaatcaagggaaaagcaactctcaacaacgattaaaacggctcgaaaaatcactaaaagaattaggtagtaaaatactcaaagaaaatatccctgctaaattatccaaaatagataacaacgcactacaaaacgatcgtttatacctatattatttgcaaaatggcaaagacatgtacacaggtgatgaccttgacattgaccgtttatcaaattatgacatagatcacataattccacaagcattcctaaaagacaactcaatagacaacaaagtgctagtctcatccgcatctaacagaggaaaatcagacgattttccttcactcgaagtggtaaagaaaagaaaaactttctggtatcaacttctaaaaagcaaattaatctcacaaagaaaattcgataatctcacaaaagctgaaagaggaggcctactgcccgaagataaggcaggatttatccaaagacaacttgtagaaaccaggcaaataacaaaacacgtagcccgactccttgacgaaaaattcaacaataagaaagatgaaaataaccgagcagtgaggacagtcaagataattaccttaaaatcaacactggtatcacaattccgaaaggactttgaattatacaaagtacgagaaataaacgacttccatcacgctcacgacgcctatctcaacgcggtcatagcttcagccttactcaagaaatacccaaaattagaaccagagttcgtatacggtgactatccaaaatataatagcttcagagaaagaaaatctgctacagaaaaagtatacttctactcaaacatcatgaatatatttaaaaagtcaatatcacttgcagacggccgagttatcgaacgaccacttatagaggttaatgaagaaacaggagaatcagtatggaataaagaatcagacctagcaacagtcagacgagttctaagttatccacaagtaaatgtagtcaagaaagtagaagaacaaaaccacggattagacagagggaaacccaaaggactttttaatgcaaacttaagttcaaaaccaaaaccaaactccaacgaaaatctagtaggagcgaaagaatacctagatcccaagaaatatggaggctacgcaggaattagcaactcattcgctgtccttgtaaaaggaacaatcgaaaaaggggctaagaagaaaataacaaatgttctagagttccaaggaatatcaatcttagatagaatcaactatagaaaagataaactaaactttctcttagaaaaaggatacaaagacatagaattaataatcgaactccctaaatacagtttattcgaactatcagatggatcccgacgcatgctagcatctattctaagtactaacaacaaacgaggagaaatccacaaaggaaatcaaatcttcctatcacaaaaatttgtaaaactcttatatcacgcaaagagaataagtaatacaattaacgaaaatcatagaaaatacgtcgaaaatcataagaaagagttcgaagaactattttattatatactggagttcaacgaaaattatgtcggcgctaagaaaaatggcaaattactcaatagcgcattccaatcctggcaaaatcactccatagacgaattgtgcagctcatttataggaccaacaggctccgagagaaaaggtctcttcgaactaacatcaagaggctcggcagccgatttcgagttcctaggcgtcaaaatacccagatatagagattataccccttcttcactactgaaagacgccaccctaatccatcaatcagtaaccggattgtatgaaacgcgaattgaccttgcaaaactaggagaaggctga

SEQ ID NO: 9032 - RNA, 4167 nt, synthetic construct
  misc_feature 1..4167: note = Cas9 variant
  source 1..4167: mol_type = other RNA
atgactaaaccttactcaatcggactagatattggaacgaattcagtagggtgggctgtaatcacagataactacaaagtcccctccaaaaaaatgaaagtcctaggcaatacttctaaaaaatacataaaaaaaaacctcctcggagtattgttatttgattccggaataacagcagaaggaagaagactaaaacggacagcgagacggcgatacacacgcagaagaaatcgcattctgtacttacaagaaattttctccactgaaatggcaacattagatgatgcattcttccaacgtctagatgactcattcctagttcccgacgacaaacgtgattctaaataccctatatttggaaacctagttgaagaaaaagcataccatgacgaattccccacaatttaccacctcagaaaatacctagcagactcgacaaaaaaagccgacttaaggcttgtatatttagctcttgcccatatgataaaatacaggggacacttccttatagaaggtgaattcaattccaaaaataatgatatacaaaaaaacttccaagactttttagacacttacaatgcaatcttcgaaagcgacttaagccttgaaaactcaaagcaattagaagaaatagtcaaagacaaaatctctaaattagaaaaaaaagaccgtatcctaaaactattcccaggcgaaaaaaactcagggatattctcagaattcttaaaattaatagtcggtaaccaagccgactttagaaaatgctttaatctcgacgaaaaagcatcattacatttttcaaaagaatcatacgacgaagatctagaaacactgcttggctatataggagatgactacagcgacgtattcatcaaagcaaaaaaattatatgatgctattctgttatcgggctttctcacagtaacagacaatgaaacagaagcccctctttcatctgccatgataaaaagatacaacgaacacaaagaagaccttgctctattaaaagaatacatcaggaatatttccctaaaaacgtataacgaagtattcaaagacgatacaaaaaacggatacgcaggatacatcgacggaaaaactaaccaagaagacttctatgtatatctaaaaaacttattagcagaattcgaaggagccgactactttttagagaaaattgaccgagaagactttcttcgaaaacaaagaacatttgataatggtagcataccttatcaaatacacttacaagaaatgagagcgatcctagacaaacaagccaagttctatccattcctcgcaaagaataaagaaagaatagaaaaaatattaacttttaggataccctattatgtaggacctctagcgagaggaaactcagatttcgcgtggagcataagaaagcgaaatgaaaaaattactccctggaactttgaagacgtaatagacaaagaatcaagtgccgaagcatttataaatagaatgacctcattcgatctatatctaccagaagaaaaagttttaccaaaacattcactactctacgaaacgtttaacgtttataatgaactaaccaaagttcgatttatcgcagagagcatgagggactatcaatttttagactcaaaacaaaaaaaagatattgtcagactatatttcaaagataagcgaaaggtaacagacaaagacataatcgaatatttacacgcaatatacgggtacgacggaatagaactaaaaggaatagaaaaacaatttaactcatccttatctacttatcacgacctattaaatatcatcaatgataaggaattcctagacgactcaagcaatgaagcgataattgaagaaataattcatacactaactatattcgaagacagagaaatgataaaacagagattaagcaaattcgagaatatatttgataaatcggtattaaaaaaacttagtagaaggcactacacaggatgggggaaactctccgcgaaattaataaacggtataagagacgaaaaatctggcaatactattctagattatttaatagatgacggcatatcaaatagaaattttatgcaactcattcatgacgatgctctatcattcaaaaaaaaaattcagaaagcccaaattattggagacgaagataagggaaatatcaaggaggtagttaaatcacttcctgggtcccccgcaatcaagaaggggatccttcaatccattaaaatcgtagatgaactagtaaaagttatgggaggaagaaaacccgaatctatagtcgtcgaaatggctagagagaaccaatatactaaccagggaaaaagcaactctcaacaacgactaaaaagactagaaaaatccttaaaagaacttggtagtaagatacttaaagaaaacataccagctaaactatcaaaaatagacaacaacgcactacagaatgatcgactttacctatattacctgcaaaacggcaaagatatgtacactggagacgacctggatatagatagactgtctaactatgacatagatcatataatacctcaagcgtttctaaaagacaattcaatcgataacaaagtcctcgtaagtagtgcttccaacagaggaaaatcagatgatttccctagtctagaagtagtgaaaaaaagaaaaaccttctggtatcaactactaaaatcaaaattgatcagccaacgaaaattcgacaatcttacaaaagcagagcgtggtggcttattacctgaagataaagctggcttcatccaaagacaattagttgaaaccagacaaatcacgaaacatgtagcccgcttacttgacgaaaaattcaataacaaaaaagatgaaaacaacagagcagtaaggacagtaaaaataataaccctgaaaagtacgttagtaagtcaatttcgtaaagatttcgagctttacaaagtcagagaaatcaatgattttcaccacgcacacgatgcataccttaacgcagttatagcatcagcactcttaaaaaaatatccaaaattagagcctgagtttgtttatggagactatccaaaatataatagcttccgcgaaagaaaatcagcaacagaaaaggtgtacttttattcgaatatcatgaatatttttaaaaaatcaataagtctcgcggatggaagagtaatagaaaggccattaatagaagttaacgaagaaacaggcgaaagcgtttggaacaaagaatcagacttagcaacagtacgacgagtcctttcctacccacaagtcaacgtagtaaaaaaagtagaagagcaaaaccacggcttagatcgaggtaaacccaaaggattattcaatgcaaacctcagttcaaaaccgaaaccaaactcaaacgaaaacctagttggagccaaagaatacctcgacccaaaaaaatatggtggatatgcaggtataagcaattcctttgcagtacttgttaaaggaacaattgaaaagggagcaaaaaaaaaaataacaaacgtactagaattccaagggatatcaatacttgatagaattaactaccgaaaagataagttaaacttcctactagaaaaaggatacaaagacatcgaactaatcatagaactcccaaaatattccctattcgagctttccgacggaagtagacgaatgttagcaagcatattatcaactaacaacaaaagaggagagatacacaaaggaaaccaaatctttctatcacaaaaattcgtaaaattactataccatgcaaaaagaatcagcaacacaataaacgaaaatcatagaaagtacgtagaaaatcacaaaaaagaatttgaagaacttttctattacatactagaattcaatgaaaattacgtcggagccaaaaaaaacggcaaactacttaattctgccttccaaagctggcaaaatcactcaatagatgaactttgctctagtttcatcggaccaacaggttcagaacgtaaggggctcttcgaacttacttcaagaggatcagctgcggatttcgagttcttaggagtcaaaattcaacgataccgtgattacaccccatcatccttgctgaaagatgcaacattaatccatcaaagcgtcactggactatatgaaacaagaatagatctagctaaattaggagaaggttga

SEQ ID NO: 9033 - RNA, 4167 nt, synthetic construct
  misc_feature 1..4167: note = Cas9 variant
  source 1..4167: mol_type = other RNA
atgaaaagaatcttgggcctagatctgggaacaaacagcataggttgggccctcgtaaacgaagcagaaaatgaaaaagaaatttcaaaaataattaaactgggagtaagagtaaatcccctcacgattgacgaaaaaacaaacttcgaaaaaggaaggccactatccaccaatgcggacagaacacttaaaagaggagcaaggagaaatttacaacgatataaattacggcgagaaaacttaatagagatattaattgataaccatattataactaaagaaaccccattaaccgaaatcggaaaaggaacaacataccaaacattaagccttagagctaaagcagtacgagaaagaatagatcttgaagatttcgcaaaagtattactagctattaataaaaaaagaggttataaaagtagcagaaaagcatctaatgatgaggaaggtcaagcaattgatgggatggcgattgcaaaagaactttacgaacgcggaatcacaccaggtcagtatgtcctagaattattagaaaacgatagaaagtacatcccggatttttacaggtcagatttaaaacaagagttcaacaaaatatggaataatcaaaaaactttttaccccgaaatcctcacagacgaactctttaaagaactagatggaaagaacaaaagtcagacctgggcaatatgccaaaaaccattcaatattaaaggaatcaaacgaataactaaaggccgtgaaaagacaatagagaattaccattggcgagtgaaaggcctctccggaaaactaaatttagaaaaactagccattatactgcaagaaataaataacgacataaatcaatctagtggctacttaggggggatttccgacaaatctaaaaaactataccttaacaaagaaaccgtcggcgaattcctatataaacagatagcaaaaaacccccatacaagcctaaagaatcaagtattttaccgtcatgactacctggatgaattcgagcaaatatggaagacgcaaagcaatttcaatgcaaatctcaccgacgaattaaaacaggaaataagggatgttattatattctaccaaagaaaaatcaaaagccaaaaatcattaatatcattctgtcaatttgaaagctgggaacaagaatactttgataaagaaactggaaaaacaaaaacacgaacagtaggacgccgcgttataccaaagtcgagtccattatttcaagaatttaaaatatggcaaaacctcaatcacctcgtattcactaacagcgaaactgacgaaaagatcgaaataaaagaagtagaacaggaaatccgaaaagaacttttcgaagagttaaacctccggggtgacctaaacccgaatgacctattgaaaatcttaaggagtcaatttaaaatagggaagttaagcaactggaaatgtaacttcgagaaaattgaaggaaacagaacaaacgcagcgttatttaacatataccaaaaaatctcagattttgaaggttatggaatcgattggaataaaagcaacgccaagaaaattcgcaaagaattgaaagcaacatttcctgaaataggaattgatgcctcaattctagaatttgacgcatacaaaaagcaactcacgaaccaaagctcatacgaactctggcatctattatactccgcagaagaagactttaaaatatcagaacaagacaaacttatctatggtaattctagcgtcagtttaaaaaagaaactacatttaaaatttggatttaacccagagtatgccaaaatgttagcaaacctatctcttatgtcagactatggcaacttgtcagccaaggcaattaaaaaaatacttccctatctagaagatggccacctatattcagaagcttgccgattagcaggatataaccatagcaaaagtctaacagccgaggaattagaaaaattcgaacccaaagccaaactcgacttattaaaaaaaaattcacttagaaatccagtagtcgagaagattttaaatcaaatggtaaatgtagtcaaccaagtcatcgacacatacggaaaaccagacggagtgcggatagaactagccagagagctcaagaagtcagcaaaggaaagggccgaaatgaccaaaggcatcgcagacggaactaggcgaaacgaagaaataaagaaaataataacacaaaaattcggaataccaaatccaacaaaaagcgacctagttagatacagactctggcaagaactcgaaagcagaggatataaagacatattcacagacaaatacataagcccggataaaattttctcctcagaaatcgacatagagcatataatacctaaagcgctcttatttgatgactcattcagcaataaaacactaagtttcagaaatgtaaacctcaaaaaggcaaatcggacagctttagactttatcacacaagactaccagtccaatgtagaagcatataaagaacgagtggaaacgtggaacaaagataatcatatttcaaaaggcaaaagaaacaaattattaatgtcattgaaagacataccggacggcttcatagaaagagatctccgtaatagccaatatatagctagaaaggccaaaagaatgctttacgaagtcttcccaaatgaagtactagcaactagcgggagcataaccgacaaactcagaagcgattgggacctgatcaacgtaatgaaggaactcaatctgccaaaatacaaagctttaggattaactgaatacgaagaacgcctcgacaaaggtacggaagaattatttaaacacgaagtaataaaagactggacaaaaagaaacgatcatcgccaccacgcgatggacgccctggctgtagcattcactacccacaatcatatacaatacataaacaatttaaatgcacgcaaagacataacacaggacaatcacccaataattaaaaacattgaaaaccttataacagaagtaaatagcaaaggcaaaagagtattcaaagcacccatgagctctttcagagaatcagccaaggaacagatagaagccatactggtaagctttaaaaataaaaacaaagttgtcaccaaaaatataaaccaaaccaaaaaagaaggcgggtttaactatcaaaacgcaaaaacacctagaggacaactccacaaagaaacaatttatggcaaatcaaaacaacccttagaaaaaccagtgaaaataaacaataggttctgcaaaaagcaagtaggattaatcataaatttcaaagaacaagaagcagtcctccatcacctcaaaaaatatgacaataacgaaaaaatagcattttcaaataaaactttaaagagtgaccccatacaagttaatgggtccccattacgagaagtaaaaatttttgaagaaatatttacaataagaaaagacatcaatcccgataatttcaaaacgcagaaacacctagacaaaataatagacaaaggaataaaagaagttatgaaaaaaagactagaagaatacaatggcgactttaaaacagctttcagcgatttagacaaaaatccgatttggctaaatcagtcaaaaggaataacaatcaaacgggctacaatttcgggagtgacaaatgcagaaccattacaccaagccaaagaccatttaggaaacatcattttagacgacaacggcaaggaaataccaatagattacgtaagcaccggaaataatcatcacgtggcaatataccaagatgaaagtggaaatttacaagaagaagtcgtaagtttctatgaagcagtaatacgaaaaaaccaagatcagccaattattaaaaaaagacatccaaaaggttggaaatttttatttacgatgaaacaaaacgaaatgttcgtattctcatcagaaaacttcaacccaagtgaaatagacctactggatgaaaaaaatgcagctatcatatcacctaacctgttccgagtgcaaaaaatagcaactaaaaactatatgtttagacatcatctagaaacagaagtaactaataaccttgattttacgtaccgacactttcaggcaacagaatggctaagaaatctatgcaaagtgagaatagatcacatagggagaatagtacaaataggtgaatactga

SEQ ID NO: 9034 - RNA, 4170 nt, synthetic construct
  misc_feature 1..4170: note = Cas9 variant
  source 1..4170: mol_type = other RNA
atgatcataagaacctatgaacttaaaacaataacaaccatagctattctaaaaatgttccaactactaactggcggactatccatgacaaaacttggaaaaccatatggcataggtgtagacatagggagcaatagcatcggctttgcagcagtcgacgaaaatagtcatcttataagactaaaaggcaaaactgtcattggtgctagactatttgaagaaggaaaagccgcggccgatcggagagcctctagaacaacacgacgaagactaagcagaaacagatggaggttgagctttctacgagatttctttgaatcacatataacacctactggaccaaactttttcatgagacaaaaatattcagaaatatcgcctaaagacaaagcgagatacaaatacgaaaagagattatttaacgacagaacagacgcagagttctatcaacaataccccactatgtatcatcttcgaaaccgattattaacggatccaagcaaagctgacgttagggaaatttactttgccatccatcatatattaaaatcacgaggacactttcttacgtcaggatacgcaaaagatttcaatactaataaagtagcattaaatgaaatattccctgcattacaagatgcttatgctcaagtatacccagacttagatataaccttcgatgaaaacaaagttaatgagttcaaaacagtacttctaaacgaaaaagcaacacctagcgatacacaaagggctctagtcaatctattacttgcagaggatggcgataaagatatattaaaacaacaaaaacaagtccttacagaatttgctaaagccgtcgtcggtttgaaaaccaaactgaatgtcgctctcggaacagaagttgactcatctgaagcaaccgtatggaatttttcacttggacaactagatgataaatgggctggaatcgagtcagcaatgacagacgagggcacagaaatacttgatcagattcgtgacctgtatagggcgcgcctactaaacggaattgtacctgcaggaaagacattatcacaagcgaaagtagatgactatgcacaacaccacgaagacttagagctattcaaagactacctaaaacaactagaagatgacggaacagccaaagccatacggcaactatacgatcgatacatagatggagacgacgcaaaaccttttgtcagagaagattttgtaaaagcgctaacaaaagaagtaacagcccatcccaatgctaaatcacccgaactgctagaaaggctagcccaaccagactttatgctaaaacaaagaaataaagcaaacggagcaattccagtacaaatgcagcagagagaactagatcaaataattaaaaaccaaagtgtatattatgattggctggcagcacctaatccggtagaaaaacatagaaaaagtatgccataccaactcgacgaactactcaattttcgtataccatattacgtaggaccacttgtaacagccaaagaacagaaagcagcacaaggcggagtcttcgcatggatggtaagaaaagatcccgacggcaatataacaccatataattttgatgaaaaagtcgatagggaagcgtcagccaacacattcatccaacgaatgaaaacaacagacacatacctaattggcgaagacgtactaccgaaacaaagtttgctttatcaaagatacgaagtattaaatgaactaaacaacgttcgagtcaacaatgagaaactatctatagaacaaaaacaacaagtaatacgcgaattatttgaaaggcataattctgtaaccataaaacagtttgccgaaaatttaagagcacatggggattacgcccatataccagaaatacgaggccttgcagacgagaaaagatttttatcttcacttagtacatatcgacaattaaaaagcctattacctgatgcgatagatgatcctgcaaaacaagcggatatcgaaaacataatagcatggagtactgtattcgaagatgcagcaatattcaagacaaaactaaaagaaataaactggctagactcacagacaattaccaaactatcaaacatccgatatagaggttggggccaattcagccacaaatttctcaacgggttaactctaggcaatggacatacaataattcaagaactatttttaagtaacaacaatttaatgcaaattctgacagatgaaaccctacaaaagaaaatgacagaattaaacgcagataaacttaaagcagcaaatataaacgatgccatagatgacgcttacacgagcccatcaaataaaaaggctttaaggcaagtactgcgggtaatagaagatataaaaagagctgcagatggccaagatccatcctggttatacgtggaaaccgcagacggcggaggtacacccggtaaaagaacacgagcacggcaacaccagctccaagaaatctatgccaatgctgcgcacgaactaatcgattctgcagtaagaggagaattagaagataaaatagcagacaaagcagatttcaatgacagacttgtattatactttatgcagggaggcagagacatctatacaggaacacccctgaacatcgaccaactaagttcctacgatatagaccatatcttgccccagtcactaatcaaagataactcattagacaacagagttctagtgcatgctattataaatagagagaaaaatgcaacgttcgcatccactatttacgctcagaaaatgaatgcaacgtggagacaatggcacgaagcaggtcttataagcggaagaaaattaagaaatctacaaatgagaccagaccaaattgacaaatatgcttcgggatttgttgcccgacagttagtagaaacaagacaaataattaaattaactgaacaaatcgtagcagctcaatatccagaaaccaaaataattgctgtcaaagcgggcctctcacatcaactacgagaagaactagaatttccgaaaaacagggacgtcaaccattatcaccatgccttcgatgcatttctggctgcaagaattggcacatatctactcaaaagatttccaaatttacaagcattctttacatacggcaaatttaagaaagctgatgtaaagaaattaagaggatttaatttcataagagacattacacatgcagaagataaaatcgtcgtaaaagacactggagaagtcatttgggataagaaacgtgatgttgatgaattagatcgtatatataattttaaaagaatgcttatcacacatgaagtacacttcgaaaaagcagatctatttaaacaaaccgtttatggggcaaaagattctaaagaagcaggcggaaagaaacagctaataagcaagaagaaaggctatccagttgacatctatggtggctacacccaagaaacaggttcatacctctcagtagtacggctaaccaagaaagccatgtacgcagttgtaaaagtgtccaccagagatgctgcaaaacttgccgtagcgaaatcaatttccgaacaaaaagaaaatgaaacccttaacgatattatagacgaaaaactttctaaaattagcaaaaacggaaaaatcacacacgaactttttgaagtcgtattacctagggtcggacagaaaacacttttcaaaaactcaaaatataatttgttcctggtaaattctgacacatatatgcataattatcaagaattgtggatgcccagagaataccagaaaatgtggaaagatatatcactctctaaatatggagacgcccaaacggaagatcaactagatcaaatatttggttttattgtatcacaagtgaatagctactttaacctgtatgacatcaaccaattcaggaagaaactaaatgacgcagcagacaaattcgctaccctaccaatgagagatacagatgatatgcaaggcaaaatagcaactatcggacaactgctaattggcctacaagcaaacgcagctagatcagaccttcgcaatctcgatataaaaacacccttaggactactccaaattccgaacggtatatcactagattcagataccagtgtcgtttaccaaagcccaacaggactactcgaacgagaagtacatttaagtgacttatga

SEQ ID NO: 9035 - RNA, 4170 nt, synthetic construct
  misc_feature 1..4170: note = Cas9 variant
  source 1..4170: mol_type = other RNA
atggccagggactattctgtaggattagacattggtacatcctcagtaggatgggctgctatcgacaataaataccacctcataagagctaaaagcaaaaacttaattggcgtcagactctttgattcagcggtcacagcagaaaaacgccggggttacagaacgacgagaagacgactctctagaaggcattggagactaagactattaaacgatatatttgctggtcctttaaccgactttggagacgagaactttcttgctaggctgaagtattcatgggttcacccacaagatcaaagcaaccaagcccattttgcagccggcttactatttgactcaaaggaacaagataaggacttttacaggaaatatcccacaatttaccatcttagattagccctcatgaacgacgaccaaaagcatgacctacgagaagtatacttagcaatacatcacctcgtaaaatatagaggtcacttcttaattgaaggagatgtaaaagcagattcagcatttgacgtgcacacattcgccgacgcaatacaacgatacgctgaaagcaacaattcagacgaaaatctccttggtaagattgacgaaaaaaaattatcagccgctctaactgataaacacggatctaaatcacagcgagcagaaactgcagaaactgcttttgacatactagatttacaaagtaaaaaacaaatacaagctattctaaaatctgtagttggaaatcaagcaaatcttatggcaatatttggtctggattcaagcgctataagcaaagacgaacaaaaaaactacaaattttccttcgacgacgcagacatagacgaaaaaattgctgattccgaagcattgttatcggacactgaattcgaattcttatgtgatctaaaagcagcattcgatggactaaccctcaaaatgctactaggggatgacaaaacagtatctgcagcaatggtaagacgattcaacgagcatcaaaaagactgggaatacataaaatcccatatcagaaacgctaaaaacgcaggaaatgggctctacgagaaaagtaaaaagtttgatggaataaacgctgcatacttagcactccaatcagacaatgaagacgacagaaaaaaagcaaagaaaattttccaagatgagatatcctctgcagacataccagacgacgtaaaagcagacttcttaaaaaaaatcgatgatgaccaatttctcccaatacaacgtacaaaaaataacggaacaattccacatcaactacacagaaatgaactagaacaaataatagaaaaacaaggaatatactatccatttttaaaagatacctaccaagagaattcacacgaattaaacaaaattactgctctaattaacttcagagtaccatattacgttggaccgttagtggaggaagaacaaaaaatcgcagatgatggaaaaaacatacctgatccaactaatcattggatggtacgaaagagtaatgatacaataacaccatggaatttaagtcaagtcgtcgacttagataaatcaggacgaaggttcatagaacgtttaacaggaacagatacatacttaataggcgagcccacattaccaaaaaattcattactatatcaaaaatttgatgtacttcaagaactcaataacataagagtttccggcagacgactagacattagagcaaaacaagacgccttcgaacacctatttaaagtccaaaaaaccgtatctgccacgaatttaaaagattttctggtacaagcaggatatatctctgaagacactcaaatagaaggattagcggatgttaatggtaaaaatttcaacaacgcactcacgacctataattacctagtatcagtcctaggcagagaatttgtggaaaacccttcaaacgaagaactattagaagaaataacagaattacaaacagtatttgaagataagaaagtccttagaagacaactagatcaactcgacggactttcagaccacaatcgcgaaaaactatcccgaaaacattacacaggatggggaagaatatcaaaaaaactactcacaacaaaaatagtacaaaatgccgacaaaatcgacaaccaaacattcgacgttccgaggatgaaccagtctatcattgacacactatataacactaaaatgaatctgatggaaataataaacaatgcagaggacgactttggagtcagagcgtggatagataaacaaaacacaaccgacggagacgaacaagatgtctatagcctaatagacgaacttgcaggccctaaagaaataaaaagaggcatcgtacaatcgttcaggatattagatgatataactaaagcagtcggttatgccccaaaaagagtatatctcgaattcgcaagaaaaactcaggaatcacacctaaccaacagcaggaaaaatcaattaagtacattacttaaaaatgcgggactcagcgagctcgttacacaagtatcccaatacgacgccgccgcattacaaaacgaccgcctctacttatacttcctccagcaaggaaaagacatgtactccggcgaaaaattaaatttagataatctaagcaactatgacatagatcatataatcccacaagcttatacaaaggataactccctcgataacagagtacttgtcagcaatatcacaaaccgcagaaaaagcgactcaagtaactacttgccagcattaattgacaaaatgagaccattctggtctgtactaagcaaacaaggtctgttatcaaaacataaattcgcaaatctaacacgtactagagactttgacgatatggagaaagaacggttcatagcaagaagtcttgtagagacacgacaaattataaagaacgtcgcctctcttatagattcccacttcggtggcgaaacgaaagcagtagcaattcgttcgtcactaacagccgacatgcgaagatatgtcgacataccaaaaaatagagacataaatgactaccatcacgccttcgacgcgctactattctccacagtaggacaatatacagaaaactcaggtctaatgaaaaaaggtcaactatcagacagtgccggcaatcaatataacagatacatcaaagagtggattcacgcagctcgcttaaatgcccaaagccaacgagttaatcccttcggtttcgtcgtaggatccatgagaaacgccgcacccggtaaacttaatcctgaaactggcgaaataactcctgaagaaaatgcagattggagcatagctgacttagactacctacacaaagtaatgaattttcgaaaaataacggtcacaagaaggttaaaagaccagaagggccagctatacgacgaatcacgttatccctccgtccttcatgatgctaaatcaaaagcatccataaattttgacaaacacaaacctgtagacctatatggcggtttctcttcagcaaaaccagcttacgcagcgctcatcaaattcaaaaacaaattccgtcttgtcaatgtccttagacaatggacctactccgataaaaactcagaagattatatactcgaacaaatcagaggtaaataccccaaggctgaaatggtactatcacacataccatacggccagctagtcaaaaaagacggagcactcgtcaccatcagtagtgcaacagagttacataactttgaacaattatggctgccattggctgattacaagctaataaataccttattaaaaacaaaagaagacaatctggtagacatcctgcacaatagactagatctaccagaaatgaccatagaatccgccttctacaaagccttcgattccatccttagctttgcattcaatagatacgccttacaccaaaatgcattagttaaacttcaagcccaccgagatgactttaacgctttaaactacgaagacaaacaacaaacgcttgaaagaatcctagatgctttacacgcaagtccagcatcttcagacttaaaaaaaataaacctctccagtggttttggccgactatttagcccctcccacttcacactagccgatacagatgaatttatctttcaatcagtaactggactattttcaacgcagaaaaccgttgcacaactataccaggaaacgaaatga

SEQ ID NO: 9036 - RNA, 4170 nt, synthetic construct
  misc_feature 1..4170: note = Cas9 variant
  source 1..4170: mol_type = other RNA
atgaagaattacaacatcagcctcgtcccaagtccctccggagttggatacgctgtgacagacgacaacttaaacataataaaaccagtacaccatgtaagtggaataggtagtagactatttaacgaaggatcatcaaaacaagatagaagaaacagtcgaagcgcgcgtagaagccgacacagacaacaaggaagaataaaagcattaaattcaattatgaaagatgagataataaaagtcgaccctaccttcttcgaccgcctttatcagtcagaattaagcccactagacaaaaacaaaaaatatagaaatataatattcgataaaccatccgttgaatcctactactacaagaaatttccaacgatttatcatctagagaaatacttgataaatacggacggaaaagctgacataagactaatatactgggcactacattcattattaactcatcgaggacatttctacaatacgaccccggtatcccaattcaaacctggcgcactaaacataaaagacaaatttatagaactaaatcaactcaaccaagtaaaaacatttgaattctctgtagcaaacacccccgaaatagaacacatactaaaagaccgatacatcagcaaacaaaacaaaatcaatcaattagcagaacttttattcgaacaagaacccgaaaaagacattcaaaaagcaaataccaaagtcgctaaaacaattgctaaagccatattaggtaacaaattccaactagacgaaataataggactagatgttaataaatccgaaaaaaaagaatggtcacttcaactttcagacctaaacttagacagcaaaatcgatgaactgtcagactcactaactgatcagcaattgagaatccttgaaattttgcaagaaatgtacgcagcaactacactcctagatatactacaaggctcagacagcctcttagacgcaaaaataaaatcttacaacgaatacaaacaaaaccgactgttgttctttgacttattaaaaaccctaccggataagaaagcacacttactcagacaaggttatacattataccttaacaaccaccatcgggacctagcgtctgcaagaaaagatcttggaatagtagctgctacaaacttctccaaaacagacctatatgcactaattaaaaaaacattaaaagatgaaccagaaacacctgaatccaagaaggtcctaggactaatagataaaggtgaattcctaaacaaacaaagaactgatttaaatacctatatcccataccaactaaacgcactaattttaaacaaaattctcaaaaatcagggcaaacattacccatttttaattaaagaaaatcccgccgaacctgaccgaaaagaagctccctacgaaatatcacaattaatgcaatttacaattccatactactgtggtccactcgctactccggaagaacaaaaaaatctccctgaatcgagccggttcggctggctagtaagaaaagaagaaggccgaatcaccccatggaatttctacaacaaaatcaatgtaatagaaacagcaaacgccttcataaagagaagtattggaaaagatacataccttttaagtgaacctgtactaccagataacagtttactataccagaaatataaggttctcaacgaattaagctcaatatcactagtagatgccaatacgaaaaaggaaaagaaattaactgcaaaaataaaacaactactatataaagaagggtttaaaaaacatgtaacagtctctaagaccatggctttaaaaatactcaacgacaacaatgtaccaacgtccgatatactaggcctaagtacaggtaaaaaattcgataactcactgtctacatataattcatggaagaaagcgtttcccgagcaaatcgacaacccacactaccgacaagatttagaatacatgatagaatggtcaaccgtgtttactgacaggaaaatactcgtagaaaaacttaaggaaatagaatggcttaggcctgaacaaataaaattcgtgctagaacataggttaacaggctggggcaagttgagcaaacgccttctcgtggaactcaaagacaacaaaggcaaatcgaatatcgataacctcttcaacacaaaaaaaaactttatgcaaatagtctcccaacaagtttacaatacacaaatagaagcaatagccttaaaaacaacaaaaaatcaatcgctagataacatattagaggcagcatatacttctccagctaaccgaaaagcaatacgacaaacaatgaaagttgtaaacgaaatagttaccctcgcaggaaaaggaacacatcccgacaaaatatttttaactttccaacgaagcaaagaacaagaaggaaaactaacaaccgaccgagccagcagtctactaaaaatataccgaggtataaaagatccactttgcacaaaagagctcgtggatgaactatcgaaaaacgtcagagctaatttaatcaaaacaaaagaatatctctattatcaacaattaggacgcgacgcactaaccggagaaataattgacaaaaccgacttacgaaattatgcagtgctacatatcataccacgctccgtagtagtagatgactcaattaacaacctcgtactaacaaaagtaaaaaatgcaaaagaatcaattgttgtacaatatggaagcaaaaatatctccgacattagcatgagcgtgaaagatttctggaaccgactacagaaacttggcctcttttcaaagggaaaacttcgaaacctaaccactgatctcacagaactaaaccaatacgaaaaacaaggtttcatcgcaagacagctcgtggaaactaatcaaatagtaaagttactggcgacaatactacaagggcaattccctcatacaaagattatagaagttcgacaagagcaaatcgcaaacatcaggtatcaactagacatatacagactacgcgacttaaatgtttactaccggggcatggatgcatacttagctgcagttgtaggaacatacctgtacacggtctatcccaaagcccgaagattcttcgtatatggcaaatacctaaaacaggacaaaaacaacagagaagaaggacagttcaaaacgtcaggtcactcattcaatttcctctggaagctattctacggtggtgaagacgaaatatatgttcagggaacaaacaacatcgcattcaataaaaaggatcttctacagaaaattaaagaagtgaacaattacaaattccaaaacgtgtcactagctacaggaacgagacgatctgaccttttcaaacaaactatttatcctcgccaagagcgggacgtgaaaaaatcaagaaccctaataacaaaaaaaaacggactattcacagatatatacggaggatacacaggaaacgtaaatagttactttgtacttgttcagacaaaatacaagaaagatccagataaattcaatctgtacggcgtaccaaacagatatgttgcgatgttagaacaatcaaaatcaaaaggaaattacgaaacaaagttaaaagaagtcatggaacccataatcaaaaactctaacaaacgaatgataggctataaaatactcaaagatagaatactctacaatcaaatcatagaagacaacgggtataaattctttataacatcatcgcaatatcgacataactttagacaaatgatactatcggaccaaagcaagaaaatactcatggattacgtatttgaccccaatttttatcgacacaaaaaaacggaagacgttaacaacgataaagatgcaaaactaataaaagtatatgatgaaattttataccaaattgatcattacttacaaatatttacaataggacatcacatcgataaactcaaaaaagcccgacctctatttgaaaagtgtacactagcagaaaaagcccaggtacttaatgacatactaataatagcagggtcaaaccaaactgaactggcgttaaaaccgcttaaaacaacaaaattaacattctcaaaacaaaattgcccattaaccaaagacgcaatattttactaccaatctccaaccgggatgataacaagaaaagaatcaataaaagacatcctaaaacaaaacatatga

SEQ ID NO: 9037 - RNA, 4173 nt, synthetic construct
  misc_feature 1..4173: note = Cas9 variant
  source 1..4173: mol_type = other RNA
atgagtaggaaaaatatagttgaagattatgcaatcagtctagatataggtaatgcaagcgtagggtgggtagcatttacacctaattatcgtttggtacgtgctaaaggacatgaattaataggagcaagattatttgaaccagcatcaacagctgaagaaagaagaatggcgagaacaacaagacgacgatactcacgaagaagatggcggctacgaatgttagattctatgttcgatcaagccctatccgaagtagatccatcctttttaatgagaagaaaatactcatgggtgcatccagaagataaaaataatgaagctcactggtttggaggcgtactattcgattcaaatgaacaagataaacgtttttatgaaaaatatccaacgatctaccacctcagaaaatcactaatggaagatgatgaaagacatgacatacgagaagtatacttagcaatacatcatatgatgaaatacagaggaaactttttaactgaaggagaattagcaccatcatcagtttttgacgtagaagactttttaaaactacttacggaaattcttcaatacgcagacgaaggtgaaacggacgaagacttagaactacaagccgacgcaaacggcctgacagaagcgctctgtacgactaaaggatcaagaagcataagagccaaaaatgcaatctcgatcttgaaagaaggtgcagcactttcgaaaagacaggaagcaataataagcgcagtatttgccggactggaaggaaataaacttgacctaacaaaagtatttccaaataaagaatacacaccagaagacaagaaaactctggctttatatttcaataaagcagactacgacgagaaaagagttgcaataggcgacagtggactactagaagataacgaatgtgatttcctagattgtatacgaagacaatattcagctatagcattaaaacaattactaggtgatttcacttctatctcggaatcgatgtgcgcccgatacgagcaacatcaacgaaactgggatttaatcaaacggtactgccgagaagaaagcaatgcagaaaatattaataaaaattacggggctttagtaggatgggaaattgtaggaggccagagacgatctattagaggagcaaaagattatgaaaataaacgaaaagccgccaacaaattctttgaggagttaattaaagggtctgctttaccggaccaagaaaaagaaagactactacacgacatagaaaatgatgaattatttccagtacaaagagatagtggaaacggagttattccttaccagctccatctaaacgagctaaagaaaataattcaaaaacaaggaagatactatccatttttattagaaacctacataaaagatggcaaagaagtgaacaaacttgaagggttactagcatttagagtaccttattatgtaggacctctagtgagtcgagacgacatgcagtcatcagataaccgtgaaaatcattggatgatacgaaggaagaaaggtgttattaccccatggaatttcgatgaaatggtagataaagataaaagtgggcatgaatttataaaaagtctcgtcggtactgattcatatttactaggtgaaacaactttaccgaaaaatagccttttatatcaagaatttgaagtattaaacgaactaaataatgtacgactttctataaggacaggtaaccactgggctgacaagagacgagttcgacttggacacaacgagaagaaactcttactagaagaactcttcgcaaaacaggcaaccgtaaccaagaaagcagcggaaaatctattaaggcgcacatacggaaacacttatgaaattagtggtctagccgatgagaagaaatttgtcagctcattaagttcatatggaaaaatgtgcagaaccttaaaagcaagctacgtaaacagccataaagatgtagttgagaaaataatagaactacaaacagtatttgaagataagaaaacccttaaacaccaattacagttattaggagaactagcagaaacaaactgtgaactcctcagtaatacacattatacaggctggggcaaacttagtcgaaaactactaactagcaaagtggtggtttgcaaaattggcaatgactttgcaccagcaaagcacagcataatagaaatcatgcgagaaacagataggaatttcatggaaataataacagataaagatttgggagtcggagaatggataaatcaacaaaacgttggcgctgaagatggaaacagctatcaagatataatagatgatcttagagtaagcccaaaagtcaaaagagggataaaccaagcaataagggtaatagatgacatttcaaaagcggtaggaaaggaaccatcgaggatatttctcgaattggcaggagacgtgcaacaatcggcaagaactgtttccaggaaatcgagattacagggactatacaagtccgcaggattacaaaaagaatttagagatcttgcagaaagtttaaacgaatgcagtgataacgatctaagagatgaccgactcttcctatactacacacaactaggaaaagacatgtatacaggcgaacccctaaatttagatcgtctctccagtgattacgacattgatcatataataccacaggcagtcacacaaaatgactcattagataatagagtcttagttgcacgagttgcaaacgctagaaaaaccgattcattccagtacctaccagaaatagcaaaccggatgcgaaatttttggcaagaactactcgatgcaggtctaattagtcgcgtcaaatttgaccgtctcaatcgacaaaacgatttcagttcccatgaaaaagaaagatttgtacaacgatcacttgtcgaaacaagacaaataatgaaaaacgtagcaacaattatgagaaaacgatacggaaattcagccgccgtcataggattaaacagtgaattaacaaaggaaatgagacaatacttagggtttagtcacaaaaaccgggatattaacgactaccatcatgcccaagacgcgctatgcttaggcatagcaggacaattcgcagtgaatcgtggattctttgcaaacggcatggtatccgacggagcagtaaattcgtataacctatatttacaagattatctaagaggttacagagaaaagatgtcagcaggagaaagaagaagaaacaaagcattcgggtttatagttggtagtatgaactctcaagactccgataaaagaattaacccaaaaactggagaaatagcatgggatgacgaagataaagtgtacctgaggaaggtaatgaattatagaaaaatgttaattacacaaaaagtaggagattcatttggagctctatataatgaaacgcgatacgggacaagtgctaaagaaggagttaatgggataccatttgacaagcataaacaagatactgctttatacggaggtttctcgagtgcaaaaactgtatatgtcgtactaatagaagcaaagaagaaaaccaggctagtaaacataacaatgcaagaatatgcggaattgggagatcatcctagcgacgatgcactgagagctgttttagctaagaagaaaccagagtacggtaaagctagaatcctacttagacatatacccccaatgcaactcatacgatatggaggtgcattagttacagtaaagagtgccaccgaattaaataacgcacaacaattgtggcttccatacaaagaatattgtttgtttgatgacgttatatctagcgcgatagacgtagacgaagccaggctctgtcaaatgctagacgtaattttagacgctattcaaaaatactatccaaaacaaaggtttgacgagacaggactatccgcattccacaacgcttttaatgaagttagtgcagaagataagaaaagaatagtaggtgaaatggtaggaatgttacatgctgatgccaaaaatgcaaatcttaaagcgctaggaatgtcaggaagatggggccgtatgtccaatcaatcaggatatacttttgcggactctgatgaatttatattccaaagtccaagtggactattcgagaaaaggataagtgtcggggaacttaagaaaagaagggccaggtga

SEQ ID NO: 9038 - RNA, 4173 nt, synthetic construct
  misc_feature 1..4173: note = Cas9 variant
  source 1..4173: mol_type = other RNA
atgaaagaggtaaaagactacataataggcctagacataggcaccaattcatgcggatatgtagtaaccgacaaacaaaataatatactaaagttaaaaggaaaaacagcaataggcgcaagattatttaaagaaggggaagcagccgcagatagaagagcttttaggacaacaagacgacgactcgctcgacgtcgatggcgtttaggtttacttgaggaaatattcgacgaagagatggcaaaagtagattcatccttttttcgacgcttaaaagaaagtgactattcacctaaagattcgcgtaaacaatttaactcaatagtatttgaatcatcagaagcagataaagacttctacgacaagtacccaaccatataccacctacgcaatgcactcatgcacgacgaccagaaacacgacttaagggaaatttttctagcagtgcaccatattgtaaagtatagaggcaattttcttcgcgaagattcggtcaaggcattcaaagcggcgaagtttacgcttcaaggagaagacggtattggccccgttgacaaactcaacgacctccttaaagaaatttacattgaagctgcacctgagctagctacagacaacctaagtaaaatagaagaaataataaaagacaagaaattatacaaacaagacaagctaaaacaagtagcaacactattgactaaagaagccgatacaaaggataaagctaaactcaataaagatgtagccaaacaagtagcaaatgcatttatgggatacatgatcatattcgacacaatatttaatctatcagatgtagacagtaaagattacaaggtaaaattcagcgatgcaaacattgatgaaaaattagataccttgacaagcttattgactgataagcaaacagaattcgtacttgaactccaaaacatttacaataccatcgtactaaacgaaattgttccagatggtaagagcctttctgaaagtatggtaaaaaaatacgacgatcataaagaagatctaaaattatttaaagcttatctaaacagtttaaccgacgtaaaaaaagtaaaagaactgaaagctgcatacgtactatacgtaaacaacagaaaagctaacttattagctgctaaaaaattacttgggaagaaggcagacaatatgaataacttcgaaatattctctaagttcgtagccgacaatttagacgacagtgaattagctaacaaaattcgggcaagactagaccttggagaatttttacccaaacaaagaactaatcaaaacggagtcataccatatcaactacatcaagtagaactgacacaaatattagaaaaacaaggaaaatactatccatttcttattgcgcctaaccccgtcgaatctcaccgtaataatgccccatacaggatcagcgaactcgtaagtttccgagtaccatactacgttggccccttaattgatccaaacaacgctgaaagtgaacaagataaagccaatagttcattcgcttggatggtccgtcaaaaacaaggacaaatcacaccatggaactttgaagaaatggtagacacaaccgaatcagccaacaaatttataaaaagaatgacaactaaagacacatacctcctaggagaagacgttttaccagccagctcacttatatatcagaaattcgttatactcaacgaactaaacaacataaaagttaacggcataaaactcaccagtgaagaaaaacaccaaatattcgatgaattattcaaagtgcaaaaatcagtgagtctaaaaaacttagtaaactttctaacggcccatggctgtgtagctcctaatgtaacaggcttatccgacggaaccaaatttaattcttcttactccacctatatagattaccgtaaaatctttggagcagaaatagacaacaaagacaaacaagcagacttcgagaaaatgatagaatggtccaccgttttcgaagatcgaaaaattttcaaaagaaagctagaagaaattacatggcttacaccagaccaaataaaacaagtaagttccaaacgatactccggatggggtagattaagtaaaaaattactaacacaaatcacagacgaaaatggggtaaacatacttcaacgactatggaacgagtctgaaaatctgatgcaaatactcagcgatcccgtaatcaaagaaaaaatagtagcagctaactccagttttaccaaagcaaccgacatggaggacatattagcagaagcatacacatcaccacagaacaaaaaagcaataaggcaagtaatgagagtagtagatgacataatcgccgcagcacatggtaaaaaacccagtcaaatcgccatagaattcgcaagagaagatcaagacaacccacaaatgacaaaatcacgaaaagcccaattagatcaaatctacgccaaaatatcagacgaattcttagacaatgcggtcaagaacgaattaaaaaatatgaaagacaataaaccactagcaaaagacaaggtatttctatacttcaaacagatgggaagagatgcatacacaggcgaaaaattaagtctagacaatctccaagactatgacatagaccacatatacccacaatcctttataaaagacgattcattcgacaacagggtcctagttcaacgtgcagttaacaacgggaaatcggataacgtacccgtactgctatttggaaacaagcaagcagccgacttaggaatgacaatcaggcaaatgtggaaaaaatggcttgaattagggttaataagtaaaagaaaattcaacaatctaatcactgatcccgaaaaaatatcaagttacatggcatccggattcgtaaatcgacaactagtcgaaactagccaagtaattaagctagttgccaacattttacaagccaaactacctgatacagaaataatagaagttaaagcaagttacaatagtatattaagaaaagaatttaatctttacaaaagcagagaagtcaatgactatcatcacgcaattgacgcatatctcacaacaattgttggtaactatttgtatcaagtttatcctaagctaagaccgtatttcgtctatggccaatttaaaaaattcggaaaggctgaatcaaaagaagatgacccagttaaaaaaataaaacagttcaattttatctatcagttactatggggaaaagacgatgcaatatgtatttcacataccgatcaacaagtgtttagccgatccgacataataaacaaactaacgactgcatacaatttcaaatatatgaacgtgtcacaagaagtatataccaactcaaacaacgttttcaaacaaacagtcttcccaataatcgaacgagatactgctaaaagcagaagcctaattccgaagaaattagaccgaccaacagacatctacggcgggtattcaaacaataacgacgcctatttggcacttgtaaaagtagataaaaagaagggaagtgagtacagagtggtaggtatcccgatgagagcagcagcaatgctaaaagcatcaaaaaactatgacgaagacctgcgaaaagttatagaaccaatggtcatgttagacaaaaacggcaaagcaaaacgcggaattgaaggtttccgggtactcgtgggtaaaatgccctttaaacaagcagttcttgacggtgacaaaaaattcatgctcacaggcacaaatgatatgccaaacctaaaacaattagtcctatcccaacaaaacatgaaatatatactagactatatagacgacatagattgcagaaaacataaatttggaaataagacgcaagacggaaataaatgtttactagaagtattcgatgaaatcatacaaatagtagacaaacattttgaactcttcgacaaccggtcatttagagaaaaactccgcaatagtcgagtaaactttattaacctagcccttagtaaaaaagcagaagctttactcgcaatactaaacgggttacatgcaaactccatgagaacaacgatcaaggaactcaaaattagcgacttaggtagaatccaatcctcagtaatatctccagaagcacagttgatctaccaatccccaacaggactctttgaaaggcgagtaaaagtcaaagatttatga

SEQ ID NO: 9039 - RNA, 4176 nt, synthetic construct
  misc_feature 1..4176: note = Cas9 variant
  source 1..4176: mol_type = other RNA
atggaaaacaaacaatattatatcggcctagacgtaggcaccaacagcgtcggatgggcagtaacagatacatcttacaacctcttgagagcgaaggggaaagacatgtggggagcgcgattatttgaaaaagcgaatacagcagcagaaagaaggaccaaaagaactagtcgaagaagatctgaacgcgaaaaagcacgtaaagcaatgctaaaagaactatttgcagacgaaataaaccgagtagatccgagcttcttcatacggctagaagagagcaaattctttttagacgataggagtgaaaataaccgtcagagatataccctcttcaacgacgcaacattcacagacaaagattattatgagaagtacaaaacaattttccacttaagaagcgcccttataaactcggatgaaaagtttgacgtcaggctagttttcttagccatacttaacttatttagccacagaggacatttcctaaatgcgagtttaaaaggagatggagatatacaagggatggatgtattctataacgatctagttgaatcatgtgaatactttgaaatagaacttcctaggattactaacatcgataacttcgaaaagatactctcacaaaaaggcaaaagtcgaacaaaaatattagaagagcttagtgaagaactcagtataagcaaaaaggataaaagtaaatacaacttgattaaactaatatcaggtctagaggcttcagtagtagagctatacaacatcgaagacattcaagatgaaaacaaaaaaataaaaatcggcttcagagagagtgactacgaagagtcgtcactaaaagtgaaagaaattataggagatgaatatttcgatctagtagaacgagcaaaatcagttcacgatatgggacttctatccaacattataggaaattctaaatacctttgtgaagcaagagttgaggcatatgaaaaccaccataaagaccttctcaaaattaaagaattgttaaaaaaatatgacaaaaaagcatataatgacatgtttagaaaaatgacagataaaaactactctgcgtatgtcggctcagttaattcaaacatagcgaaagaaagaagaagcgtcgacaaaagaaaaatcgaagacctttataaatatatcgaagatactgcattaaaaaatataccagacgataacaaagacaaaatagaaatattggaaaagataaagctaggcgaattcctcaaaaaacaactgaccgcatcaaatggagtcatacctaaccaactacaaagccgagaattaagagcaatcctaaaaaaagcggagaactatttgcctttccttaaagagaaaggagaaaaaaatctaacagtatcagaaatgattatacaattatttgaattccaaatcccatattacgtaggacccttagacaaaaacccaaaaaaagacaacaaagcaaatagttgggcgaaaataaaacagggtggaagaattctaccatggaactttgaagacaaggtagatgtgaaaggatcaagaaaagaatttattgaaaaaatggtaagaaagtgtacatatatatcagatgaacacacactaccaaaacaaagtctgttatatgaaaaattcatggttctaaacgaaataaacaacattaaaatagatggtgaaaagatttcagtagaagcaaaacaaaaaatctacaatgaccttttcgttaagggaaagaaagtctcacaaaaagacataaaaaaagaattaataagtctgaatataatggacaaggacagcgtcctaagtgggacggacaccgtatgcaatgcatatttatcgagtataggaaaattcactggagtctttaaagaggaaataaataaacaaagcatcgtagatatgatagaagatataatattcttaaaaaccgtgtatggcgatgaaaaaagatttgtaaaagaagagatagtagaaaaatacggcgatgaaatcgataaggacaaaattaaaagaatactcggcttcaaattcagcaattgggggaatttaagcaaatctttcctcgaattagaaggagcagacgtaggtacgggagaggtcagatcaataatacaatcattatgggagactaattttaacctaatggaactgttatcgagccggtttacatacatggatgaattagagaaaagggtaaaaaaattagagaaacctttgtctgaatggacgattgaagatttagatgatatgtacctatcatcacctgtcaaaagaatgatctggcagagtatgaaaatagtagatgaaatacaaaccgtaatcggatacgctccaaaaagaatatttgtagaaatgacgagatctgagggcgaaaaagtacgtacaaagagtaggaaagaccgtctgaaagaattatataatggaatcaaggaagattcaaaacaatgggtaaaagaattagatagtaaagatgaatcatattttaggtcgaaaaaaatgtacttatactaccttcaaaaaggtaggtgcatgtattcaggcgaggtaatcgaattagataaattaatggatgataatctatacgatatagatcacatctatccacgatcgtttgtaaaagatgactcactcgacaatctagttttagttaaaaaagaaatcaataatagaaaacaaaatgacccaatcacaccacaaatccaagctagttgccaaggattctggaaaattctacatgatcaaggtttcatgtccaatgagaagtattccagattaactcgaaaaacacaagaattctcggacgaagagaaactcagtttcataaatagacaaatagttgaaactggacaagcaactaagtgcatggcacagatattacaaaaatcaatgggcgaagacgtcgatgtagtcttctccaaagcaagactcgtatcggagttccgacacaaattcgaactatttaaatcgaggctaataaacgactttcatcatgcaaacgacgcgtatctgaacattgtagtaggaaattcatattttgtaaaattcacacgcaatcctgcaaattttataaaagatgcacgcaaaaacccggacaatcccgtgtacaaatatcacatggacagatttttcgaaagagacgtcaagtcaaaaagtgaagtagcctggatcggtcaatcagaaggaaatagtggaacaatagtaatagtaaaaaaaacaatggcaaaaaattcgccattaataactaaaaaggtagaggaggggcatggtagtataacaaaagaaacaatagtgggagtaaaagaaatcaaatttggtaggaacaaagtcgaaaaagcggataaaacaccaaagaaaccgaacttacaggcgtatagaccaataaaaacgagcgatgaaagactatgtaatatattaaggtatggtggtagaacaagcatcagtatttcgggatattgtctggtagaatatgttaaaaagagaaaaacgatccgatcattagaggcaattccagtataccttggaaggaaagacagcctgtcagaagaaaaactcctaaactacttccgttataacttaaacgacggagggaaggatagtgtatccgacatccgtctatgcctcccattcatatcaacaaattccttggttaaaatagatggctatttatactacttaggaggcaaaaatgatgatagaatacaattatacaatgcatatcagctaaaaatgaaaaaagaagaagtagaatatatacgcaaaatagagaaagccgtatccatgagtaaattcgacgaaattgatcgcgaaaaaaatccagtcctaacggaagaaaaaaacatagaattatataataaaatacaagacaaattcgaaaacacagtttttagcaagagaatgtctttagtaaaatacaataagaaagatctgagcttcggagactttctaaaaaacaaaaaatcaaaattcgaggaaatcgacttagaaaaacaatgcaaagtattatataacataatatttaacttaagcaacctgaaagaagtagatttaagtgacataggtggatcaaaatcgacaggaaaatgtagatgcaaaaagaatataactaactataaagaattcaaactcatacaacaaagtataacaggattatatagttgtgagaaagatttaatgacaatctga

SEQ ID NO: 9040 - RNA, 4176 nt, synthetic construct
  misc_feature 1..4176: note = Cas9 variant
  source 1..4176: mol_type = other RNA
atgaaagaaataaaagattatattattggattagacatcggtacaaactcatgtggatacgttgttacagacaaacaaaacaatattttaaaacttaaaggaaaaactgcgataggcgcacgtctcttcaaagaaggcgaagcagcagcagatagaagggccttcagaacaacacgaagacgattggccagaagaagatggaggttatctttgttagaagaaatattcgatgaagaaatgaataaggtagacccaagctttttcagaagactaaaagaatcagactactccccaaaagatcgacgaaaacaattcaacagcatagtgttcgaaagttcagaagctgataaagcattctacgagaaatacccaaccatataccatctaagaaacgcattaatgcacgataatcagaaacacgaccttcgagaaatattcctagccgtacaccatatagtaaaatacagaggaaactttctccgcgaagatagcgtcaaagcatttaaagcagccaaatttacgttgcaaggcgaagacggaataggaccagtagataaactaaacgacttactaaaagaaatatatattgaagcggcacccgaactagctacagataatctaagcaaaatagaagacattattaaagataaaaaactatataagcaagataaattaaaacaaatcgccaatctactaccaaaagcggtcgactcaaaagacaaagctaaattaaacaaggatattgcaaaacaagttgcgaacgctttaatgggatacatgttccgattagataccttattctcattcaccgacgtagatgtaaaggattataagctcaaattttcagacgcgaacatcgatgaatcacttgacgccctaacttcgcttctcactgacgctcaaatcgaatttgtacttgaactacaaagcatctacaacactattgtacttaacgaaatagtaccagatggaatgagtctcagtgaaagtatggttaaaaaatacgacgaccacaaaaaagatctcaaactatataaagaatatatagactccctaagcgaccagaaaaaagcaaaacaactagaggcggcatacgcactctacgtaaattaccgaaaagcagatctactagcagcaaaaaaactattcgaaaaaaaaaaaattggtgataaaaaattcgtggatgtaatcagcaattttgaagtctttggaaaattcgtttcggacaacctcgatgatagcgaattagccaataaaatcaaagcaagactggacttaggcgaattcctaccaaaacaaaggacaaaccaaaatggagtaataccataccaactgcatcaagttgaactaacgcaaatcctcgagaaacaaggtaaatactacccgttcctaatcacacctaacccagtagaaagccaccgaaacaatgcgccttatgagatatcagaactcgtaagctttagagtcccctactatgttggaccgctcatagacaaccaatcaatcaaagataagcagaacaagaataaatttgcctggatggttagacaaaaacaaggccaaattaccccatggaattttgaggaaatggttgacaccaccgaaagcgcaaatcaattcattaaaagaatgactagaaaagatacatacttactcgccgaagacgtcctaccaaaaagtagcctaatctaccaaaaatttatgattctcgacgaactaaacagaattaaaatcgacggtaaaaaactcacttcaaaacttaaacatgatatattcgaaaaactattcaaaaaacaaaagtcaataaacctcgataatttaaaaaattacttactcgccgaggggaatatcccagggctgatagaaggactatcagacggcataaatttcaataattcattttcaacttacatagactacagaaatatcttcggagatgaaatagacaatccaaacaagcaggcggactttgaaaaaatgattgaatggtcaacagtattcgaagatagaaaaatttttaaaagaaaattaaaagaaataacctggctcacaccagaacaaattaaacaagtatcctcaaaaaggtacagcggctggggaagattatctaaaaagttactaacacaaataactgacgaaaatggagtcaacatattgcaaagattatggaacgaaccagaaacactaacggaggtcctagctaaccccgtaataaaaagaaaaatatcagaagccaatagcctcttcgtccaaataaataaagtagaaaacattcttgatgatgcatacacatccccccagaataaaaaagcaatacgacaagtaatccgcgtggtcgacgatataatagctgcagcgcacggtaaaaaacccagccaaatagccattgaatttgctaggagttcacaaaacaaagcgaaagtcccagacacacgaaaaaagcaacttgacaagatctataacaaaatatcatcagaaatacttgacagctccataaaaaacgaattaaaaaacttaaaatcaaataaatacttatcaaaagataagctcttcctatactttaagcaaatgggtcgagacgcctataccggcgataagctaagccttgatcaattacaaaattacgacatagaccacatatttccacgttccttcattaaagacgactcactagacaatcgagttctaactcagaaaccaatcaatgcaaaaaaatcggattacggcataccagcactagagtttggcaacaaatacgttccagatttaggaatcacagtaaaagaaatgtggaaactgtggcaagaaaatggactcatatcaaaatcaaaattaattaacctctgcacaaacccaaaaaaaatcggcagcaaaagggcttcgggatttataaatcgccaactcgtggaaacgtcacaagtgataaaacttgtagctatcatactacaggcagaattccctgacactgaaataatagaagtaaaagcattacaaaatactacactgcgagagtcatttcatctctacaaaaatcgtagcgtcaatgattaccatcacgcaatcgatgcatatctcacaaccatagttggtaactatttatatcaggtctacccgaaattacgaccttactttgtatacggacagtttaaaaagttcaaccaagaaaaaaatattgatatattaaaaagactaaaaaactttaatttcttaagacaattaatatttaacacagacgataacatatacatatcaggcacaaaagaaatcgtatttaacaaaaaggacattattcataaattagagactgcatatgggtataaatacatgaacatctcacgagaatgttaccaagaaacgagctcgctatttaaccaaaccttatacgctcacaattcctcggtaaaaaattcactcattccaaaaaaaaaagggctcccaacggaaatttatggtggatatagtggcaacaaagactccttcttcgtcctagtaaaaatcgtcaaaaaaagaaccaacctctacagaattgtcggaattccgacacgtgaacttgcaaaactaaattcaagtaataactataaccaagctttaaacaaaatagtagaatctaaactatgccttaaagaaacagagtcattcaaaattctgataaaaagactattatacggaacattaatagtagacaatggacagaaatttagaattggttcttttaaagaaaaacataacgtacaacaacttgtacttcaactaaaaagcatgaaatacatcaaattctatatagatggaggacaaaactactttacggacgttgaaaggaaaaaattagaaaaacaagacagggataaatgcttattatacgtattcgacgacataatgaatgtagtaaataaacgctttacactattcgacatgagtaaatacgaaaaagacggagactcattaagagaaaaattcaattgcctcgatttcaacgacaaagtaagtattttatctgatttactcaaagcattccacgcaaactcagatagaacatcaatcaccaaattaaaaataacaaacctaggaaggcatcaagcaggaaaaaatggaataacattaactacaaacgcacaaataatctatcaatcccccactgggttattcgaacgacgtatcaagatcaaagatttgtga

SEQ ID NO: 9041 - RNA, 4176 nt, synthetic construct
  misc_feature 1..4176: note = Cas9 variant
  source 1..4176: mol_type = other RNA
atgaaaaagatactcgggctggacttaggaactaattcaataggatgggccttagttaacgaagcagaacacgaacatgagcaatcaagtattgtaaaattaggggtaagagtaaatccactaagtgtagatgaaaaaaccaatttcgagaaaggcagaccactttcgataaacgccgaccgaacatcaaaaagaagcgcaagacgcaatctccaacgttttaaattaagaagaaaaaacttgattaacctactactgaagcaccacataataagcaatgaaaccatccttaccgaagtcggtaaaaatacaacacaccagacactaaaattaaggtcaaaagctacccaagaaaaaatatctttagaagaatttgcccgaatattattatccataaataaaaaacgaggatacaaaagcagtcgcaaagaaaagaatgaagatgagggatttaccatcgatggcatggcaatagctaaagaattatacgataaccaattaaccccgggccaatatgtttacaatatactacaagacgggaaaaattacataccagatttctaccgcagcgatctgcaagccgagttcgatgatgtatggcaattccaaaaaaaattctatagcagcatattaactgatgaattttacttaaagctgaaaggacaaggtaaagaaaatacacgtaaattattcctagccattcaccaagtctatacagccgaaaacaaaggtaaaagagacgcggtcaaactacaatattataagtggaggagtgaagcagtaaaaaaacaattatccatcgaagaggttgcttacgtcctcgtagaaattaataataatattaacaagagcagcggctacctaggtgcaatcagcgacagaagcaaagcactatatttcaacaacgaaacagtcggcgaatacttatacggacaactagtaaaaaacagacataactctttacgaaaccaagttttctaccgacaagactatctagatgaatttgaaaaaatatgggagactcaagcaaaattttatgatgaactgacaaacgaactcaagcaagaaatacgggacgtcgtcatattctaccaaagaaaattaaagtcccaaaagcatttaatctctgattgcctattcgaaaaacaccataaagctattcccaaatcgagccctctatttcaggaattcaaaatatggcaaaatttaaactacttagaatttgtccatacacaatcaaaagaaaaaatattcttctcagaactcgacgatgaaacacgacagtttgtgttcgcagaattaaatattaggggaacgctaaaaataaaagaaataaaaaaactcatcgggttagaaacacccgtatattggaaatcgaattttgacgaaatagaagggaacagaacaaaccaagtactctacaatgtctaccaaaacatcgcagacgatctcgggtatggcttcgattggtccaaaaaacatgccttcgaaataaatgccgaactacaagctatatttaaagacgtaggaatcgacacagcaatactcaatttcgatgctagtatcgaagaaaacgacttcgacaaacagaaatcttatcaactgtggcatcttctctactcagctgaagataccgacaaagccacagaagaagacaaactcatatacggaaacataaacacaaaactgaaaaaacaacttcatcaaaaatatggatttgaagcaaagtacggaaacctactagctaatatttcactccaacaagactatggcaacctttcagcaaaagctataaaaaaaatattaccttatttagaatcaggcaactcattctacgaagcttgtacaatagttggttacaacccatcaaactcattaacaaaagagcaacagcaaaaccgcaaactcaaagataaacttgagctacttccgaaaaactcactcagaaacccagtagtagaaaagattctaaaccaaaaagtaaacctaataaatcaattaatagacgaatacggcaaacccgacgaagtcagaatagaattagccagagaacttaagaaaagcgcaaaacaacgagcagatttatcaaaacacatcaacgacgcaactttaaaaaaccagaacataagaaagaccctacaaaaagatttcggaattcaaaatccaagcaaaaacgatgtaatacgatacaaactatacgacgaattaaaagacaacggatataaaactctatttacgaataaatacatacccaaagagcaattattcagcaaagatgttgatatagaacatataattcctaaagccatactcttcgacgactctttttcaaataaaacgctcgcatacagaaacgtaaacctagctaaagccgatgcaaccgcctttgacttcatcagttctaaacatttagacgatcttgataactacaaagcaagagtagaaacattattccaatcaaaacggatatccaaaggcaaatacaaaaaactactaatgacaaggcaaaacctaccagaagatttcattgaacgagacctccgaaattcacagtatattgctaaaaaagctacagccatgttaaaagaagtcttccgatcagttgttcccacaagcggacgaatcacggacaaattgagagaagactgggacttagtaaatgtaatgaaggaactaaacctaccaaaatatcggacgctaggactcacagaatttatagagcgtaaaaacggcaataaaatagaacaaattatagactggacaaagagaaatgaccacagacatcacgccatggacgcattaacagtagcttttacaacacacaatcacatacaatacttaaacaatctaaacgtaacgcacgggttaaacggcgtcgacacagatcacgaaaagtcgcgactatacgccataaaacaggccataaccaaagtctacatagtaggaaaaacaaaaaaaagaaaattcattcccccaatggaaaactttagatcccacgcaaaaaatcacctcgagggcatcctcataagcttcaaaaataaaaataaagttgtgaccaaaaataaaaacagaacaaaaaccaagacaaaaggggtgtttaacgaaaaaatacaactcacacctagaggacaacttcataaagaaacaatatatggccacgctaaaaaagtaatcgtaacaaaagagaaagtgagctctaaattcacacatgaaaaaatcctacaagtaacaaaacccgcctatcgggaagcattattaaaacgattagctagttttaaaaatgaccccaagaaagctttcagcggcaaaaacgcgctgtccaaaaatcccttgtatttcgatataacgagcgggaaaaaagtaccggatacggtaaaactctcttatttcgaaaactcatacgtaatcagaaaagaagtaaattcagacaacttcaagaacgaaaaaagcctacaaaaagtccttgatgttggaataagacgaatattagaaaaacgattagcagactataatggcaacgcaaaagaagccttctccaacctagaaaaaaatccgatttggaaagataaagaaaaaggcgtatgcatcaaaaaagttcgtattgaggccttaaaaaacgccgaaccacttcacgttaaaaaagaccatttaggcaaaataatcctagacgatgaaaataaatcaacaccagtcgatttcatatctactggcaacaaccaccacgtagcaatatacgaagacaaagacggcaaattacatgataaagtagtctccttttacgaagtcgttagtagagtaaacttaggcttaccaataatagacaaatccttcaactctcatttagattggaaatttttattcagtatgaaacaaaacgaaatgttcgtctttccatccgaagatttcaatccaaaagaaatagacattggaaacccaaagaacaacgaacttataagcaaatacttgtttagagtccagaaattctcaaaagtaacatacggtaattccgcggtccgcgactatgtttttagacaccacctagaaacagaactaattgataaaaaggaactcaaaggcattacatactatcaattaaaaagtatcggtatgctagaaaaattagtaaaagtgcgcataaaccacattggaaaaattgtacatattggcgaatattga

SEQ ID NO: 9042 - RNA, 4176 nt, synthetic construct
  misc_feature 1..4176: note = Cas9 variant
  source 1..4176: mol_type = other RNA
atgaaaacaatcctgggactagatctaggaacgaatagcataggatgggccttagtcaaagaagcagaaaacgaaaatgaagtttcagacataataaaactaggagtaagagtaaatcctctcactgtagacgaactaacaaactttgaaggtggaaaagcatactccaataatgcagaaagaacattaaaaagaggtgcacgacggaacctacaaaggtataaattacgcagagaaaatctgatagaaatattactcaaaaacgggttaattaacaaagacactgcattgacagaagtaggcaaagaaacaacacatcaaacactgaaactaagatcaaaatcagctaatgaaaaagtgagtttggaagacctagcaaaaatactactttccataaataagaaaagaggctacaaatcttcaagaaaagtcaatgcagaagatgatggagtagctattgatggaatggaagtcgccaaactcctgtatgatgaaaacatgacaccaggagaatacgtgctacgactcctagaatcaggtaagaaacacttacccgatttctatagaagcgacttacaagaagaatttaatctagtttggaagaaacaatcagaattttatccactaatcttaacaaaagaactattcttcgaattacacggcaaaaataaatcacaaacatgggcaatatgcaaagaaccactcggtatagttggcgttaaactcaaaggatcagcaaaagaacaaaaattcgctcgatatagattaagaaaagaagccctgacacaacaaattgagctggagcacctagctatcgtattacaagatattaataatgactcgaacaaatcatccggctatctcggcgcaatatcagatagaagtaaagaattattcttcaacaaagaaacagtcgggcaatatcaatacaaacaattacaaaaagacccaaacacctcgctcaaaaatcaagtgttctataggcaagactacctcgatgagttcgaagtaatatggagaaaccaagcaaaattctatccacagttaacaaatgaactaaaacaagaaataagagacgtagtaatattttaccagagaaaactaaaatcgcagaaaaacttaatttcattttgccaattcgaaagtacccaacagaattacgtagaaaaagagactggcaaaaccaaaatcagaacgatagggagaagagtaattccacgctcaagcccactattccaagagttcaaaatctggcaatccctaaataaccttaagtttgtaaattctgagtccaaccaaataattcaatttatagaactagaagatgacgtcaagaaagtagtcttcgacgaactcaacttgagaggagatctcaaaccaaaccaagtgcttaaaattctgagcaaatatatgaaaataggaaaactaacccaatggaaatgcaacttggaagaaatcgaaggtaaccgcacaaattcagcgttatataatgtattccaaatgattgcagaagaggaaggctatggattcaactggggcaagaaaagcgcattagaaataaaatccgaattaaaagctatcttctctagcataggcattaacgattcgatacttgattttgacttctccaagaaactcgaccaacaactatcttaccaactatggcatttattatactcagcagaggaaggtaactccaaaatcaccgaagaagataaatttacgtacggcaatacaggtgtagctctcaaaaagaaactacacctaaaattcggcttcaaaccagagtacagtacactgatcagtaacctaagatttacatccgactacggaaacttatcatcgaaagctatttcaaaaatacttcccttcttacgtgatggatcggattacagtaaagcatgccagtatgccggatacaaccactcaaacagtttatcagcagacgaactagataatagggaattaaaacctaaattagaactattaaagaaaaattctctaagaaatccagtagtcgagaaaatcttaaaccaaatggtaaacgtagtcaaccaagtaatcgacaactacggaaaaccggacgaagtacgaatagaattagccagagaactcaagaaaagcgctaaagagagatcgcaaatgaccaagaacataagcgacgctacgcgcagaaacgccgagattaaaaagtaccttagtaaggagttcggaataccaaacccgactaaaggcgatgtcataagatacagactttgggaagagttagcttcaaatggctataaagatctattcagagacaaatatataccaaaagaaaaattgttctcaaatgaaatcgatatagaacatatcatacctaaagctctgctatttgatgattctttttcgaacaagactctagcattcaaagttgataacctgaaaaaggctgacaggacagcttttgactttatgagcacggatttctcaaaagatgttgactcgtatataggccggatagaaactctgcataaagatggaaaaatatcatcatcaaaatataagaaactaatgataccaaaatccaaattagtagatggattcatagaaagagacctgaggaacacccaatatattgctaaacaagcacgtaaaatgttactcgaagtgtttaagacggttgtgccaaccactggcaaaataacagataaactacgcgaagactgggacttaataaatgtaatgaaagaattaaatttccctaaatacaaagcactcggcctcactaagaaaatagaacgtttcgacgtaggctccgagaaaattaaatcaataaacgtaatcgaaggctggtcaaaaagaaatgaccacaggcaccacgcgatggacgccctagcagtagccttcaccacacataatcacatccaatatctaaactatttaaacgcaaggaaagacattcatcacgaaatgcacggaacaataaaatcaatagaaaaccaaataataggtaaagatgtaatgggaaaaaggcggtttatcccacctatttcagatttaagaatgaaggccaaactacaaatagaaagtatattaatatcatttaaaaacaaaaacaaagtcgtcacatggtcggttaataaaactaaacttaaaggaaaagataattacaacaaaaggagacaattgacaccgcgggggcaattacacaaagaaacagtctatggcaaaatcaaactaatagacccaaaaccactaaagttaaataacaaattcaccctcgtaagagcctcaatgatcgtagacaaagtacatagagaaatagttctccagcatctatcaaaatatgacaacaacagcgaagtagctttcgactccaaaacaataaaaatagatccaatcttgatcgaaggaataggattaaaagaagtagtttgttacgaagatgtatttaaaataaggaagaaaatatctggagataactttaaaaatgaaaaacacttagaaaaagtgatcgacgagaaagtaaaacaaatactcaaagatagagtaataaagtttcaaggaaattttaaagaggcattctcaaatctagaagaaaatcctatatggttaaacaaatccaaaggtatagccgtgaaaagtgttgcgatcaaaggtgtaaataacgcagaatcattacatgagggcaaagatcattttggagatcaaatcctggacaaaaataagaaacaaataccagtagacttcgtaagcactggaaacaaccatcatgtaggaatctacgaagacaaagacgggaacttacaagaaagagtagtctcgttctttgaagccgtaacaagagttaatgaaggcttacctataatagacaaaacatataacagcgacatcgggtggaaatttaaatttacaatgaaacaaaacgaaatgttcgtatttccaagcgacgacttcgaccctaatgagttcgatctaacagacgggaaaaacgcagccaaaataagcccaaatctttaccgcgtgcagaaaatcgctaccaaaaattatatgttccgtcaccacttagagactgtggtaacaaatgatctagagtttacatataagtcaatacgttctaccggatggttgcgaaaccttgttaaggtacgaataaatcacctaggtgaaatagtttatgttggagagtactga

SEQ ID NO: 9043 - RNA, 4176 nt, synthetic construct
  misc_feature 1..4176: note = Cas9 variant
  source 1..4176: mol_type = other RNA
atgaaaaaaatcctaggcttagacttaggcactaccagcataggatgggctctggtaaacgagaaagaaaacaacgaagagttaagttcaatcataaggctgggagtgcgagtaaatcccttaaccgtagatgaaaaatcaaactttgaaaagggcaaagacataactacaaacgcagaccgcactaaatgtagaagcgcaagaagaaatctacaaagatttaaactccgaagagaagcactagccgattgcttaaaaaggcatggactcatgactgacgaaacaccactatgtgaaacaaataatagtataatatttaaaacatacagcaatagggcgaaagctgtatgcgaaaaaatagctctggatgactttgtaagagttcttttcatgataaataaaaaaagagggtacaaaagtagtagaaaactaaatactgatgacgaaggcacactagttgacggtatggatgtagctaaactcttgtacaatgaacagataacaccaggcgagtatctgctaagactattcaaaaaaggaaaaaaaacccgcccagatttctatctttcagaccttaaagcagaattagaacgcatttgggattttcagagaaccttctatccagaaatcttatgcaatgcacttaaagaagacctaaaaggaaaatcaaggacgcaaagtagtgcgatcttttacgctaaatataaagtatcaactgccaaaatagcagggaaagataaaagactacaagaactaacatggagaactgatgccttacgtaaacaacttacaatagacgaggtagcatatgtaatttgcagtataaatggagaagttaacggatcatctcaacgattatccatgataagtgataggtcaaaattattgtatttcaaccaccaaaccataggtcaatatctcatgcaaagactcgaagaaaatcccaatgcaggtttaaagaatataattttttaccgacaggactacgaagatgaatttaacgacatttggaactcgcaagcaacatatcacaaagaactaacgccagaactgaaaaaagaagtaaaagacattattttctaccaaaggggactaaaatcgtgcaaatggctaatcaactactgcgaattagaacacgaagaaattgaagtaaaaacacctgaagggaaattaagaaaaataactataggctcaaaaacatgtcccaaaagtagccccttattccaagaatttaaaatctggcaagtcttaaataacttacaagtttcacccctaaactcaagacgaaaagcaaaaagaaaaaaagacgaggaaccatctctcttcagcgacgaagacatgaacactgcatgccgttatttaaatgaggaagaaaaattaaccctgttcaaagaactctcaataaaaaaagaattaaagaaaaaagatgccttaaaactcttatttgaaaactacaaggaactagatctaaattataaggtaatctcaggcaacgttactatggcaaacctatacagagcatttcaagacatcataagtttaactggcaatggagaattcgatttccaagctatgcccgcagaagaagctgaaaaaacagtagaagaaatatttggtggattaggctataaaacggcattcctgcatttcgatgcatcattacatgacaaagaatttgaacggcaacctgcatatagattatggcatctactctactcttatgcaggtgaccaatcgaaaacaggcatagaagcactagtaaaaagaatccaagaactctgtgggtttgaaccagaatatgcaagaattctggcaaatataagcttcataccagactatggaaacctaagcagcaaagccatgagaaaaatactaccatacatgcaagatggttatgaatattcagaagcatgctccaaagcaggatacagacacagtgcaagcagcctaacaaaagaagaaataaataaaaaaaattacaaaactcatctagacgaaataaaaaggaattcgctacgcaatcccatagtagaaaaaatcttaaaccaaatggtgaatgtagtaaacagcgtaatagatacctacagcaatatcgacgaaattcgaatcgaaatggcaagagaactaaaaaaatccaagcctgaaagagaagatatgtcgtttgcaataagtaaagccacaaaagaaacagagagaataaaaggaatactagaacaagaatttaaaatacaacatgttactagaaacgacattatcaggtacagactttacgaagaactaaagcctaatggatataagacactatactcaaacacctacataccacgagaagacttattctccaaaaaattcgacatcgaacatataatacccaaagcccgtctattcgacgactcatattcaaacaagacattagaattacgagacataaatatcgaaaaaggaaatcaaacagcctacgattttgtactatcaaagtatggggaagagggactctacaaatatgaacaacgagtggaagaattcaaaaagaataatgagcaagcgggcactaaatgccgaaagctcctgatgagggaagcagacattccatcagattttctaaatcgcgacctaaacgactcacaatatatagcaaaaaaagcacacgaactactccgggaaatagttccaaccgtaacagcaacaacaggatcgatcacaaacagactgagagaagattggaaattagttaacgtaatgaaagagttaaactgggaaaaatacgataaactaggactcactgaagaatataaagataaagatggtaacactgtaagacatattaaagactggaccaaaagaaacgaccatcgacaccatgctatggatgcacttacaatcgcattcacaaaacctagtttcatccaatacttaaataatttaaacgcaagaagcaaccgaggtggttccatatatggaatagaacaaaaggaactcgaacgagaaaataataaactagtattcattccaccaattgacccaaagatatttagaaagcaagccaaagaacacctgagcaatatattaataagcataaaggcaaagaacaaagtagtgaccaaaaacgtaaataaaactaaaagcaaatccggaacaaatcgaaaggtacaattaactcctagaggacaattacatctagagactgtgtacggaaaaattcgcacatacaaaacagaggaaattaaagtaggtacaaaactaaccgaagaattaatagcaaaagttgcagataaaaaaataagggaagccctaatgcaaagactcagtgaatacggcggcaatatcaaaaaagcatttcaaaatatctcaaaacaccctatctggttaaatggctcacatacaaaacacgtgccagagaaagttaaaattgtattcttcgaagatgttttcacaataagaaaagccattacacctgatataaaaatagacaaagtgatcgatagcaaaatccgccgaattttacaagaaaggttaaacgaatttgggggtgaagcctctaaagccttctcaaatctagacgaaaatccaatatggtttaatagagacaaaggaatagcaataaaatcggtaaaaataagaggaatcgcaaagggaaccgctattagggttaaaaaagacatacatgggaagaccataatagggaacaatggttacccagtagctaatgattatgtaaacaccggtaacaatcaccacgtcgctatatttagagacaaggacggcaaccttcaagagcatatagtctccttctacgaagccacagcacgtgcaatccaaaatttacccatcgtagatcgaaattacaacagcgaaaaagattggaaatttctattctctatgaaacaaaatgaatattttgttttcccgaatccaaatacaggtttcaacccgtcagaaatctcgctcaaggacgaaaaaaactacgctctaataagtcccaacttgtttagggtccaaaaactatcacattattactatgtattccgtcatcacctcgaaaccaacgttgatacaaacctccagttaaaagatataacctggaaaagaatcacagccgtaaataacttaacaggtgcagttaaagtacgaatagatcacttaggacgaattgtagacgtaggagaatataaatga

SEQ ID NO: 9044 - RNA, 4176 nt, synthetic construct
  misc_feature 1..4176: note = Cas9 variant
  source 1..4176: mol_type = other RNA
atgaaaaactaccacatcggattagacataggtacaagctctgtaggattcgcagcccgcgacgacgacaacaacctaattagagtaaaaggcaaaaacgtgattggagcacgtctattttccgaaggacaaacagcccaagaacgaagaatggctagaacgtcacgccgacggtacaatagacgaaaatggcgtctacgactactagacgaaattttccacgacgaaataatacacaaagacgcagaatttttcaatagactcaaacaatcatttttatccccaaaagatgaacgaaaacaatattttggatcattactatttccggaaaccggggactcagaatactatcacaatggaaatcaaaccatctaccatcttagacacaggctaataacacaagatgaaaaagcagacatacgagaaatttatctagcactacgacatattataaaataccgaggaaacttcttagacgatactccagtaagcagctttgaagcatcagacctcaaactagctagttttgtaccaacaatcaacgaccttttcgaaaccatagacgtcaattacgagttcagcatggacaacataaacgagatcgaagatatcttattgaataataaacttaggaactcagataaaagtaaacaactcacggatttgctcaccgaaccgatagtcaacatagacgataaatctctcgaaaaacagtttaataaagaaaggacagacatatcaaaagaaattgcaaaatctgttgtcggttcaaaaatgaacgttaacaaactcctatcattcgaatcttccgagggctcaaaaatcgcattttccttctcagacgcatcttccgaggataaaatgatggaactatcagatatcttggatgattcaagaatgaacatattaaatatattaaaagttatctactcgcgagtcagactaaatcaaatcataccatccggcatgggacttagcgaaagcatggtcgccgcgtacgacagtcacaaacaacaattgaaagatctaaaaacgcttctaaatgtactaccatttaacgaacgatacgcggtaaaaatcgcatacgcagcctacatcggaaatattgataaacaaaaatttactaaaagtgaaattaaagcaatcgataaactcaaagaaaaatcagccattatgaatgtcctagacttcaaatctggccatataacaaatgaagaacttagcaatgtcataaaagcagttatagtggacaaatacctaaatgatgaagattttgaataccacggaatagtagagaaaataaatcaagacatatcaaacggttcatacttacttaaacaacgaaataaccaaaacggtaacattccacaccaattacatcaaatggaattagaccaaataatagaaaatcagagcaaatactatcatttcctcggagaactaaatccaaacagcaacagaaatcatatcgcgaaatataaaataagtgaattagttgctttcagagtaccatactacgtagggcctctaataacacccgaagaacaagagaaaacatcaggtgcatcgttcgcgtggatgaagagaaagaaagacggagcaataacaccttggaattttgaagaaaaagtcgataaggaagaaactgcaagtcgatttataaaaagactaacagtaaaagacacatacttattaaatgaagacgtattacccgacaattctctactatatgaaaaatttaaagtcctaaacgaattaaacgtagtaaaagccaataataaacgactcacagtagaagaaaaacaaggtgcattcgacaacctattcaagaaaatgaaaactgtaaccgcaaaacgattaaagaactacctggtgtcaaatcataaccatatcaactcagtcgaaatcacaggcttatcagatggagacaagtttaacaacagtctaagcacttacatagacttcaagaaaatctttggtgataaaatagacaatcccggcctgctagacgacttcgaagacataattgaatggtccaccgtatttgaagacaggaaaatattcgaagaaaaagtacgaaaagacataagttggatatctgagtccgaaattaaaagtgttgtaagcaaaagatacagcggctggggcagactatcaaagaaattactaaattgcataacgaataacgaaggtcgaaacataatagatgaactatgggaagagagcgaaactttcatggaagcagtatccaaacctgaagtaaaagaacaaatagacggtataaactcagactttattaaaaatacagatattgaaagcgtcttagccgacgcgtacacgtccccacaaaacaagaaagcaatacgcgaaacacataaattagttaaagatatacaaaaagcaatgggaggacaagcacccgcctcgataagtatcgaatttacaagaaacccacaagataaaggacaactcacacgatccagacacagcgaagttagtcgtaaatacaaagagatatccaaagaaatatcaaaaactctaaacgatgaattaaagtcaaagaaaaattcaatggatgttgacaaatattatttatactttatgcaaatgggcatagacctttacgatggaagttccatagacatagatgatttaaacaactatcaaatagatcacataataccacagagcttctacaaagacgattcttttgacaacagggtcctaacccattatagtaacaaccagaagaaaggcaataacacaccgctaaacgggctaaacattaacgacaaaacaagagccatatggaaccacctacgagacctaggtctaattaccaaaaagaaatacaacggactaacactaaaaggaatggatcaactaagcaaatacaccaaacacggattcatcagaagacaacttgtagaaacaagccaagtgatcaaattagtggcaaatatcctttccgacgaattttcaacagacgacacaaaaataatagaggtcaaagctaaaatgaactcccaaataagacaagttttcaatctttataaagtacgagaactaaacgactatcaccatgcagtcgacgcttacttaaccacattcataggaggttatttatataacagatacccgaatctccgaaacatgttcgtatatggagattttaagaaattctcagcagacgtcgacaacctaaaaacatttaactttctccacgaaatcaccaatccctctgacaaatttgaagacagaatcttcgatgaaaaatcaggagaattaatacttgacagaaaacacgcaatagaaacaattaaaaagatataccaatataaatatatgctaataacaagagaagtatcaacgaaaaacggtcaattatcagatcaaacagtatattccgcaaaacgaatcaataatgtaaaggccccaataccagtcaagaaagatttcaatccggaactgtacggcttcaggacgggtaacgtcgaccaccacatggtaattgtcaaatatcccaagaaagattcatacgactataaagtcgtaggcatacctctacggttcgttcaaaaactaaaagaaacaaaagacaataaagactacgaaaatctcttaaaccaaatagtccaaatgaaattaaacagaaagaaacaagactttatagtagttgtggacaacgtgatgtacggacaactaatacaagacggaggtcaaaaattcactctgggatcctccacatatagatacaatgctaaacaacttgtgatagacaatggatacttaaaacttatagcagacgaacgctataaaaatagtttaacggacgaagagaaaagcaatcaatatataacgctttataacgaaatactaaaagtagtaaacggacggttcgacgtcttcgacgtaaatagctttaggaagaaacttaacaacggagtcgataaatttataaaacttaacacagtagataaacgaataataataatgaaaatattatcaggcctgcactgtgggccctcaatagtaccactaaaagaactaggcctaacaacacctctaggacagctccaatcaacgtcaggaatatcactttcagaaaacacaatcattatttaccaatctccatccggactattcgaaagaaaagtcagactcggcgacctatga

SEQ ID NO: 9045 - RNA, 4176 nt, synthetic construct
  misc_feature 1..4176: note = Cas9 variant
  source 1..4176: mol_type = other RNA
atgaaaaattaccatatagggctggacataggaacctcatcagttggctttgcggccagagatgacgacaataaccttattcgagtcaaagggaaaaacgtaatcggcgccagattattcagcgaaggcaaaacagcccaagaaagaagaatatcaagaacatcaagacgtcgatacaatagacgaaaatggagactccgcctcctagacgaaatattccacgatgccatagtacacaaagacgcagagttcttcaacagactaaaacagtcctcactatcaccaaaagatgaacgaaaacagtatttcggatcactactatttccagaagtcggagacggagactactttagagatggtaaccaaacaatatatcacttaagacatcgactaatgacgcaggatgaaaaagccgacattcgagaagtatacctagcattgagacacataattaaatacagaggcaacttcctagatgatacacccgtctcatcctttgaagccagtgaccttaaactagcctcgtttgtacccacactaaacgacttatttgaaactattaacgtgaattacgaactaagtattgataatgtaaaccaaattgaaaatatattattaaataacaaactccgtaactcagataaaagcaaacaacttactgatctaatagctgaacctgtaacaaacatcgacgacaagagtctcaagaaacagttcgataaggaacgcaaagatatcagtaaagaaatcgccaaagccgtagtaggcagcaagatgaacgtaaataaactgttatccttcgaatcaagtgacggatctaaaatttcattctcattttccgacgcatcgtccgaagacaagatgttagaactatccgatatcttagacgacagtagaatgaatatactgaacgtattaaaagtaatatactcacgagttcgattaaatcaaataataccttcaggtatgggcctatccgaaagcatgatcgcagcctacgacctgcacaaacaacaacttaaggacttaaaaacattactcgacgtcgtacccttcaacgaaaaatatgctgtaaaaatcgcatacgcggcctacataggaaatatagacaaacaacgcttcactaaagctgaagtaaaaacaattgataaattacgagacaaaaagtcaattacctcagtattagattttaaatctggacacataacaaatgaagaactaaataatgtaattaaagaagtaatagtagacaaatacctcaatgacgaaacgttcgaataccatgatatagtagagaaaataaaccaagacatatcgaatggcaactatctcttaaaacagagaaataatcaaaatggcaacattccacatcaactacatcaaatggaactagaccaaatcatagaaaaacaatcaaaatactacccatttctcggtaaattaaaccctaactcaaagcgttcacacatcgctaagtacaaaatatcagaattggttgccttcagagtcccctattatgtaggcccattaattacgcctgaagaacaagagaaaactagcggtgcttcatttgcatggatgaaacgaaaggaagatggtgcgatcacaccctggaactttgagaaaatggtagacaaggaatcaaccgcgtcacgattcataaaacgcctgaccgtaaaggatacatatttactaaacgaagacgtattaccagacaacagcttactatacgaaaaatttaaagtacttaatgaattgaatgtagttaaagccaataacaaaagactcacagtagaagaaaaacaaggtgcattcgacaacctcttcaaacaaatgaaaacagttacagcaaagagactcaaaaattacttagtatcaaaccataaccatattaactcagttaaaatcactggtctatccgacggagaaaaattcaacaattctctatctgtatacatagattttaagaaaatatttggagataaaatagacgactcaaaactctttgacgatttcgaaaacatcatagaatggtccacagtttttgaagatagagacatctttgaagaaaaagtcagaaaagacatttcatggatctcagaatcagaaataaacgctgtagtatcaaaaagatactcaggatggggtcgactttccaagaaactcctaaatggtataacaaacgatgaaggccgaaacataatagatgaactatgggaagaatcagaaacgtttatggaagcagtatcaaaaccagaagttaaagagaaaatagacgaaatcaattccaactttatcaaaaatacagacatagaatcagtccttgcagacgcatatacatcaccgcaaaacaagaaagccataagagaaacctacaaacttgtaaaagatatacaaaaagcgatgggagggcaagcaccatcaagtatttccattgagttcacaagaaatccacaagataaaggagaattaacccgatccagacacagcgaaatagctaagaaatataaagaactaagtaaagaagtaagcaagaaattaaatgatgaactaaaatcaaagaaaaactccatggacgtcgacaaatattacctctacttcatgcaaatgggaatcgacctctacgacggcacctcaatcgacatcgacgatctaaataactatcaaattgaccacatcgtccctcaaagtttctacaaagatgattccttcgataacagggtactcactcactattcaaacaaccaaaagaaaggaaataacacaccactaaacggattaaacatagattcaaatacacgagaagtttggaaccacctaattggacttggcctaataacaaaacgaaaatataataaccttaccctaaaaggtatggaccaactttcaaaatacacgaaacacggatttattcggcgacaactcgtggaaacgtctcaagtcattaaattagtagccaacatattaagcgacgaatattcaaaagacgatacaaaaattatagaagtgaaagcaaaactaaactctcaaatccgtcaagttttcaatctatacaaaattagagaattaaacgactatcatcacgctttagatgcatatttaactaccttcatcggtggctacctctacaatagatatccaaatttacgaaatatgttcgtatatggagattttaagaaattcagcgctaaaattgataacttagaaacttttaacttcctccacgacattaccaacccaagtgataaattcgaagatcgcattatagatgaaaaatccggtgaagtcatactcgatagacgacacgcaatagaaacaataaagaaaatctaccaatacaactatatgctgataacaagagaagtaagcactaaaaacggacagctatcagatcaaacagtttattcagcacgtcgcataaataaagtcaactcacccattcccgtcaagaaagactcgaatcctgaactatacggatttaggacaggtaacgtagaccatcacatggtcatagtaaaataccttaacaaagataaatacgattacaaaatcataggtataccactcagatttgtacaagttctaaagaactcgaatgacaatacagaatacaaaaacattttaaataaaattgtacaatcaaaactaaaaggcaaatcaacagatttcagagttatattagacaacgtgatgtacggtcagttaattcaagacggaggacaaaaattcaccctaggaagttcaacatataaatataatgcaaaacaacttgtaatcaatatggacgatatccgaatattagtagacaacagatattttaactcgctaagtgacgacgatgcttcgggagagttcataaaaatttataatgaaatactaaaagtaattaatgcaagatttgacctattcgacataaataaatttagagaaaaattaaacaatggaaaagaatattttgaaaacctttcaattgacgagaaaaaccaagtactgctcaaaatgctcagcgggctacactgtggaagcgcaaatgtacctataaaagaacttggactaactacaccgctaggtaaactccaaatcccatcaggcatagtattatccgaagatgctatcgttatatatcaatcaccatcaggcttattcgaaagaaaaatccgattaaaagacatatga

SEQ ID NO: 9046 - RNA, 4176 nt, synthetic construct
  misc_feature 1..4176: note = Cas9 variant
  source 1..4176: mol_type = other RNA
atgaaccttagaaactatccaggggaatacagtattggtctcgatatggggacaggcagtgtaggatggtcggtagtagacgaaaaaggaaatctgctccacttcaaaaagaaaccaacctggggtagtagactatttgactcagtaatgccagcatctgaagctagagttcacagaggacaaaggagaagatatgaaagacgtagatggagattagatctattgcaaggtttatttaaaaatgaaatgaacaaagtagatcctgaatttttcatgagattaaaccaaagtagaaccatagaaggagatccaattttcacaaaaagttttacaaaagcggactactatgatagattcccaacgatataccaccttagagcatatcttatggaaagcaatgaaccagctgatttacgattaatatatcttgctatgcataatatcattaaacatagaggtaacttcctacgagaagaagaaaaatccttgtcagctaaacatgcagattcaaagaaagctgttactcaattcgtagatgccttgaaagaatggtgcttctctagaggatacgaatttgggaaagacccagccaaatcaatcgaaaaatgtttaagtgactcaaaatccagtagaagccaattagcgagtgaaatagcaaaagcactcgcagtgagcacagatgctgctgcggctgataagaaattagcagataatctcgcaaaagcaatggtcggactgcaatgtgaatttaaatacgtatttggggaatttgattgtgaaagcactaaattagcactgtcagatgacgaaaaattagaattattaagggcagcttgccctgatgatagcgtagaactcctagatgcgttatgcgcagtatacagcgcatatgttttacagggtttgttatcatacgcaccagggcaaacaatatcacacaatatgatagcaaaatacgatttatataaaacagatctaaaaaccttacgtgcattagttagagaatatgctccgggagcctatgacgagttcttcagaggcgcaacatatcatgatgcgaatccagatgattccagtaaagattatagctatgcggacgcagaaggatatactgcatataatctacataaattaagttacgatgactttgctaaagccgtcaagaaattactaggtggcactgatgcagtcactgacgaacgctatctcaacatgatggaacgatttgaaaaacaacaatttttgagaagactaaaaacatccgacaacggagccatatactaccagttacatttagaagaactaacagcaattattaaaaatcaaggcagattttatagctttttaaaagaatacgagggtaaattcgaaagtctagtgagcttcagaataccttattatgtaggaccgttaacttcagtaaacgcagcacaagacagccacaaccataatagatttcaatggtcagaaagaaaaccaggtatggaaagagaagtaataacaccatggaattgggatacaatcatagataaaaataaaagcgcagaaaattttataatgcgaatgacaggagactgcacgtatctggcaggagaaaaagtactacccaaacaaagtcttttatacgaagaattttgcgtactaaacgaattaaatggcgtaagatggagcgacgacggtgatgactggcaacgttttgatgcggcacaaagagaaggaatagtaagggaactgtttcataaataccgaagagtaacctataaaatgttagaagactggcttgtaagagagggcgatgcaaatcatccaatagttaaaggaggacagggggaaacaggtctagaaagtaaaatgggcagttatcttttctttgcgaaaggaatatttggtctgggagaactttctccggcggagtatcctgctatcgagaaaatgataaaatggaatacactattcgaagatagatccatattaaaagaaaaattagaagatgaatttggtgaaagaggcaacgggatgcttgacgcaagccaaataaaagcaatctgcaagaaaaggttcactggttggggacgtctatcggaacaatttctaacgggattgaaagtcgaatctccggcaggcagagcagtctcaataatggatgttcttagagaaggaaatccgtgcagtgaaagaaggcaaggagaaacagtcgtaatgatggaggctttaagggatgaaggactaggattccaaaagaaaatagacgaacataatagaaactactatggtcaacatggaaaagatttaggagtaaatgaactaccaggatctcctgctatccgaagatcattaaaccaggccataagaatagttgaggaaatagcatcaatagccggacacgcaccagcaaatatcttcatagaagtgacccggggcgaagatgctggaaagaaaggaaaaagaaccgtaaaaaggtgggataaaataggggaggccttgaagaaattaaaagaagagggggtagccgtagaagttatggatgattttaaagaacaaaaagcaataaacgctaatctggatgaaagacttagtctatatttaatgcaaaacggaaaatgcttatattcgggtaaagcaataaacttagaaaaactattagccggaagtggtgaatatgaagtagatcatataattcctagagcatacataaaagacgatagcattgagaataaagccctagtgttacgtgaagagaatcagcataaaacagaccagttactaatagacaaatctataagatggaaaatgagagaaacctggtcccaattacatgacgcaggattaattggagataagaaatatcataatctactacgaagtaacattaacgaaaaccaattgaggggcttcatagcaaggcagctagtagaaacatcccagatggtaaaattagcacaagcactattagaagctagatttgcaaatgaggaaacacgaatagtgccagttaaagcatctatgtcccacaacttaagagaagcggcggatctagcaaaatgccgagaagctaacgacttccatcacgcacacgatgcatttctcgctagtagaataggactctttgtacaaatgcgtcatccaggtatatacgaaaatcctattggttacagccacgtaatcaagaaatacgtacaagaacaaagtgaagtatttaagaaaacacataggatgcccggatcagcaggctttgtgataaattcatttatgagcagcgggttcgataaagatacaggagaagtgtttaaagattcatgggacgctgaagccgaagtagatggaatacgaaaagcattaaattataggcaatgttacataagccggatgccccagcaagacaccggcgcattctggaacgcgactgtatactcaccaagagatccgaaaatgggtcccaaattagctctaagtacaaagcaaggcttagatccaaaactttatggaggctttagtagccagcagtttgcatacttctttatatatgaagctaagaagaaaggaaaaccaacttttagatttagtcaagtaccagtctggttagcagcacgtatagaagcaaacccacttgccctggaagaatatgcaagaggactcgcgaaaggtgaaggactagaatttgtatcaatccaaagacccaaaatctacaagaaacaactaatagaggtaaatggtgacaaactaataataactggggcaaaagaagttagaagtggagctgaactagcttttaatcaagatgaaataagcgcaatctcgatgtgtagtaaactacgtgcagcagaagcaggcttagatggagccttctcggaggaagtctcagcgatttggaatagaatctcaaacgcacctgtacaatcatgcggtagactactaagacaattgacattaccaaaatatcaaagtaattttgatagttccagcaacgaagagaaagctgcagttgtgttgggattaatcgcactcctaaatggaaataatagaatagtagacttaagcggagtaggtggaagttctcatgctggagcaatgatgatgtcgtatccaaaacttctagacgatccaaaagtgccgttctttataatagaccaaagtgtaacagggatgtttgagagaaaaaccagagtaggcttatga

SEQ ID NO: 9047 - RNA, 4176 nt, synthetic construct
  misc_feature 1..4176: note = Cas9 variant
  source 1..4176: mol_type = other RNA
atgaagaaaatcttagggctagacttaggtaccacatcgatcggttgggcactggtaaatgagaaagaaaataatgaagaacaatcttccataattagactaggagtgcgagtaaacccgttaacagtagatgaaaaatcaaattttgaaaaaggaaaagatataactacaaacgcagatcgaacaaaatgtcgttcagcaagacggaatttacaacgcttcaaactacgaagagaagcactagcagactgcttaaaaagacatggactcatgacagacgaaaccccattatgcgaaaccaataacagtattattttcaaaacatatagcaacagagcaaaagcagtatgtgagaaaatagcattagatgattttgtccgagttcttttcatgataaataagaaacgtggatataaatcgtcaaggaaactcaacaccgacgacgaaggcactttagtagacgggatggacgtagcgaaacttttgtacaacgaacaaataacacctggtgaatacctactacgactttttaagaaaggaaagaaaactcgtccagatttttatttgtcagatcttaaagcagaactagaaagaatatgggatttccaacgaacattctatccagagatactttgtgatgccctcaaagaagacttaaaagggaaaagccgaacacaatcctcagcaattttctatgccaaatacaaagtttccactgccaaaatcgctggcaaagataaaagattacaagaactcacttggcgaaccgatgcgctaagaaaacaattgacaatcgacgaagtagcctacgtaatctgttctattaacggcgagataaatggtagctcacaacgattaagtatgatctcagaccgcagcaaattactttattttaatcatcaaacaatcggacagtacttgatgcaacgattagaagaaaatcctaatgcagggcttaaaaatatcatcttctacagacaagactacgaagatgagttcaacgacatatggaactcacaagccacataccacaaagaattaacaccagaactaaagaaagaattaaaagacataatattttatcaaagaggattgaaaagctgcaagtggctaattaactactgcgaattagaacacgaagaaattgaggtaaagacacccgaagggaaactaagaaaaatcacaataggtagtaaaacgtgtcccaagagctctccactttttcaagaatttaaaatatggcaagtcctcaacaatctgcaagtatcaccactaaacagtagaagaaaagcaaaacgaaagaaagatgaggaacccagccttttctctgacgaagacatgaacaccgcctgtcgatatcttaatgaggaggaaaaactaactttatttaaagaactaagcattaagaaagaactaaagaagaaagacgcgttaaaattattattcgaaaactacaaagaactagatttaaattacaaagtcataagtgggaatgtaactatggcaagtctctatcgagcatttcaagacattatcagcctgacaggaaatggtgaatttgatttccaagctatgccagcagaagaagctgagaaaactgttgaagaaatattcggaggtctgggatataaaactgcatttctacatttcgacgcctctctacacggaaaagaatttgaaagacaaccagcatatcgcctatggcacttattatactcatacgcaggagaccaatcaaaaacaggaatagaagcattagtaaaacgcatccaagaactttgtggtttcgaacctgagtacgcaagaatactagcgaatattagcttcatcccagactatggaaacctttcatcaaaagcgatgagaaaaattcttccatacatgcaagatggatatgaatattcagaggcttgtagcaaagcaggatataggcactcagcatcatccttaacaaaagaagaaataaacaagaaaacatacaaaacacatttagatgaaatcaaaagaaactccctgcggaatcccatagtagagaaaatattaaaccaaatggttaacgttgtaaactctgtaattgatacatatggatcaatcgatgaaatacgtattgaaatggctagagaactcaagaaatcaaaacctgaaagagaagacatgagcttcgcaataaacaaagccacgaaagaaacagaacgtataaaaggcatactagaacaagagttcaaaatacaacatgtcaccagaaacgacataataagatatcgattatacgaagaactaaaaccaaatggatataaaaccctttactccaatacatatatcccacgagaagacttgtttagcaagaaatttgacattgaacatataatccctaaagcgcgtctcttcgatgattcatactcaaataaaacacttgaattaagagacattaacatagaaaaaggaaaccaaacagcctatgactttgtactcagtaaatacggcgaagaaggcctatataaatacgaacagagggtagaagagttcaagaaaaacaatgaacaagcaggatctaaatgcagaaaattacttatgcgcgaagcagacataccatcagattttctgaatagagatctaaatgactcacaatacattgctaagaaagcacatgaacttctacgagaaatagttcccaccgtaacagcaacaacaggaagcataacaaaccgtttacgagaagattggaaattggtaaacgtaatgaaagaactaaattgggaaaaatatgataaattaggtctaaccgaagaatacaaagacaaagatggaaatactgtgagacacatcaaagattggacaaaaagaaatgaccacagacatcacgctatggacgccctcaccatcgcatttacaaaaccatcctttatccaatacctaaataatctaaatgcaaggagcaataaaggaggatcaatatacgggatcgaacaaaaagaattagaaagggagaacaacaaattggtattcatacctccaatcgatccaaaaatattcagaaaacaagcaaaagaacatttgtcaaacattcttatcagtatcaaagctaaaaacaaagtcgttactaaaaatgtcaacaaaacaaaaagcaaaagtggtaccaaccgtaaagttcagctaacacccagaggacaactacacttagaaacagtctatggaaaaatcaggacttataaaaccgaagaaataaaagtaggcacgaaactcaccgaagaactaattgctaaagtagcagataaaaagatcagagaagcacttatgcagagactttcagaatatggaggaaacataaagaaagcattccaaaatattagcaaacacccaatttggttaaacagttctcacaccaaacacgttccagagaaagtaaaaatagtgttcttcgaagacgtattcacaatccgtaaagcaataaccccagacatcaaaatagacaaagtcattaacagcaagattcgaaacatcttacaggagagactaaacgaatttggtggggaagcagcaaaagcgttctcaaatctagatcagaaccctatttggttcaacaaggacaagggaatagcaataaaatcagtaaaaattagaggaatagcaaacgggacagctataagggttaagaaggatatccatggaaatacaattattggtaataatggttaccccataccgaacgactacgtaaatacaggaaacaaccatcacgtagcaatatttagagatagagatggaaacctacaagaacacatagtcagcttctacgaagcgacagcaagagctatccaaaacctcccaatagtagaccgcaactacaactctgaaaaagactgggaatttctatttagtatgaagcaaaacgagtacttcgtattccctaatccaaataccggttttaatccattagaaatagatctaagaaacgaagaaaattatgctctcatatcccccaatctttttcgcgtacagaagctatcccactactattatgttttcagacaccaccttgaaacaaacgtcgacaccaatttacagctcaaagatataacttggaaaagaattaaggcaattaataatttaaccggagtagtgaaagtaagaatagaccatttaggtagaatagtagacgtgggagaatacaaatga

SEQ ID NO: 9048 - RNA, 4176 nt, synthetic construct
  misc_feature 1..4176: note = Cas9 variant
  source 1..4176: mol_type = other RNA
atgaagaaaagaatagatgactatatcttaggcttagatatcggaacaaatagttgtggttgggcagtgactgacaagaaaaacaatctactcaaacttagaggtaaaacagcaataggaagtcacttatttgaagaaggacacacagcagcagatcgacgaggcttcagaacaacaagacgaagactgaaacgccgaaaatggcgactacgcctcctcgaagaaatattcgcagaacccatggcagaggtcgaccccggatttttcgttcgactacatcaatcttgggtcagcccactcgataaatcacggaagaaataccaagctatagtattcccaacagcaaaagaagaccaagaatactatcaaaaatatccaacaatctaccacctaagagatgccttaatgacacaagacagacaattcgatttacgcgaaatatttctagcaatacaccacatagtaaaataccgcggaaattttctacaagacactgcagtaaaagacttcgaagcaagtaagatagaggtaggacccatcctaactaatataaacaacgcatttgccgataaaatagtagaggggcaggatttaatagaactaaatgtagctaacgcagccgagatcgaagccgtcataagagggaaagatgcagacaagaccctctacaaaatggacaaagtaaagaaaattgcgaaattattaaccgactcaacagctaaagaacagaaaaacgttgcaaaacaaatagcgaatgcgataatgggatacaaaactcaattagaaacaatattaggtaaagaaattgataaaaatgataaagcccaatgggagtttaaactaagcgacgccgatgacaaactagacgcactactccccgatctcgacgaatctgaccaaaccgtggtagctgaaatagaaaaactattctccgcaattacactctccaccatcgtagacgaaaacaaatctctatctcaaagcatggttgaaaagtacaataagcaccaccaagactataaacttttaaaggcttacattgagagtctgccagaccgtgcacaagctaagaaacttttactggcatacgatttatacgtaaacaatagacacggtcacttactagaagctaaaacagaatttaaacaagacagcaccctaactaaagaagacttttataaaacagttaaagataatttagacgacagtgaactggcacataaaatagcacaagaaatagcagctgataactttatgccaaaacagcgtaccaattcaaacggcgttataccctttcaactccaccaaattgaactcgataaaataatagcaaatcaaagcaaatattatccatttttagcagcagaaaacccagtagaagatcaccgaaaacaagcaccttacaaattagatgaattggtaagatttagggttccatattacgttggtcccatgataacagccgatgaacaagagaaaacgagcggcaagagcttcgcatggatggttcgaaaagaacaagggcaaatcacaccatggaacttcgaacaaaaagtcgatagacaagaatcagccaacaaattcatcaaacgcatgacaataaaagacacctacctactaggcgaagacgtactacccgcaaatagtctactatatcaaagatttgaagtactaaacgaacttaacaatatcagagtcaatggatccagaatttccgtagatttaaaacaacaaatattcaatgatctattcgaagaaaagaaaaccgtcaccgaaaaagccctcatctcttacttaaaacaaaacctccaccttccaactgtcgaaattaaaggattagcagaccccacaaaatttaattcctcattagcaagctactatcacctcaaaaatctacacgttttcgacaaagaactagctgacccacagtaccaaaaagagttcgagaaaataatagaatatagctcaatcttcgaagacaagaaaatattccaagacaaactccacgccgagttcaaatggctaacccccgcacaatttaaagccatatctacttggagattacaaggatggggcagattaagccgcaaacttctagtggaactacatgacaccaacggacaaaacatcatagaacaactttgggacagtcagaaaaatttcatgcaaatagttacagaaccagatttcaaagaagcaattgcgaaagaaaatcaaaacataacacaagaaaacggagtcgaagaaatactggcagacgcatacacttcaccagccaataagaaagctataagacaagtagtaaaagtagtcgccgacgtagttaaagcagcatccggaaaagcccccgcacaatttgcaatcgaatttacacgcgatccggataaaaatccccaactcagtcacatcagaggtacaaaactcctcaaagcatatcaagaaactgcaggagaattagtagatcaaaacttaaccaatagtttaaaagaagcaatgacaagcagaaaattattaaaagataaatactttctatacttcatgcaaacaggcagagatgcatacacaggtaagaaaattaacatagacgaagtctctacaaactatcaaattgaccatatactgccacagtcattcataaaagacgattctttcgacaaccgtgtcctaacagcaacaccactaaacgcagaaaaatcagatgacgttccttacaaaagattcgccaataattacgtttctgacttaaaaatgacagtaggtgaaatgtggaaacactggcagaaggcagggataattaacaaacacaaactgggaaatttgctcttagaccccgaccgactatcaaaatttcagaaaagtggatttatcaaccgacaattagtagaaaccagtcaaatcgtaaaactcgtctccgtcatactccaaaataaatacccagacgcagaaataatcacagttaaagcaggcgacaatagtgcattacgccaacgcctcgacttatataaatctcgtgacgtcaacgattaccatcatgccattgatgcatatttatcaatagtttgcggtaactttttatatcaagtttaccccaaatatcgcccatacttcgtatacggtcagttcaagaaatttagccaagatcctgacttgcaaaaagatttaataaaacattttaaaggattcacgtttatgtggccactactacaaaaggacaactccgaaagaaaagctctagaagaaatcaaagaaaacaacagcgaccgaatcgttttctacaaacacccagacatattcgacaaattaagaaaagcatacaactataaatatatgctagtttctagagaaacctcaactgagtcatcatctatgtttaatatgacaatatacccacgaggcgaaagagataggaaaaagacaagaaaactaatacctaaaggcaacggtctggatccaaaaatctacggaggatactcaggaaatacagacgcatacatggtaatagttaaaattgaaaaagcaaaggagtccatatataaagtcatagggataccaatgagagcattggcgggacttaaacaagctaaaaatcaaggtaattataaagaggaactccataaagtagtcgaaccacagataatgctcgacaaaaatggtaaaccaaagagaggagtagaaggattcagagttgtgaaagatcacgtcccattcaagcaagtcgtacttgacggagacaagaaatttatgctatacagcgctaaatatgaaacgaatgcaaaacaacttactctgtcacaggaaacaatgcgcattgtaactgacaacctaaagaaatcagaagaccaagacaaactattagtgaaggcttacgatgagatcttacagaaagtagaccaatatctaccattattcgacgttaacaaatttagaaacagtcttcatctaggtagagcaaaattcttagacttagcagtgaatgataagaaaatcacactttcaaatatcctaaatggattacatgacaacctagttgtaccaaacctcaaaaacataggtataaaaacacctttcggattgatgcaaagtccgagcggtatcacattgtcaagtaacgcaatattaatcttccaatcacccactggactgtttgagaaaagagtaagaatcgcagatttatga

SEQ ID NO: 9049 - RNA, 4176 nt, synthetic construct
  misc_feature 1..4176: note = Cas9 variant
  source 1..4176: mol_type = other RNA
atggaaaataaacaatattatataggcttagatgtaggaacaaactcagtcggatgggcagtaacagatacgtcctacaacctactaagagctaagggaaaagacatgtggggagcgcgcctcttcgacgaagcaaaaacggctgtcgaaagacggacgaagagaacgtctcgaagacggtcagaaagagaaaaagcacggaaggcgatgttgaaagaattatttgcagatgagattaataaggttgacccaaacttcttcattagactcgaagagagtaaatttttcctagatgacagaagtgaaaacaacagacaaaggtatacactatttaatgacgcaaagttcactgacaaagattactatgaaaaatacaaaacaatcttccatctacgatcagcattaataaattcagacgaaaaatttgacgttcgactcgtttttcttgcaatattaaacctattcagtcaccgagggcattttttgaacgcatcactaaagggagacggagaaatacaaggtgtagacatattttataatgatttgtacgaggtatgcgaagagttcgaaatagatttaccacaaataagtaatatagacaactttgaaaaaatactaagtcaaaaaggaaaaagtagaactaaaatcctagaagagttatcagaagagctaagtatttcaaaaaaagaaaagattaaatacagtctactgaaactcatctgcggaatgaaaattaaagtagtagatatctatgcagacgaagacatacaagaagatgataaaaaaaaagacttaggatttcgtgagagtgactatgagaaatcaagcttagaggtaaaagaaattattggcgacgatcattttgaacttatagaacgggcaaaagcagtccatgacataggcttgttagccaacataattggaaacagtaaatatttatgcgaagcgagagtagaagcatacgacaaccaccataaagacctgcagaagatcaaggaacttctaaaaaaatacgacataaaagcgtacacggatatgttccgaaaaatgaccgataaaaattactcagcatacgtaggttctgtaaatagtaacattgcaaaagaacgaagaagcgtagacaatagaaaaatagaagacctttatgaatacatcaaaaagatcgcactaaaaaacatatcggatgataatgaagataaaatagaaatactaaaaaaaatagaaacaggcgaatttttaaaaaaacaattaacagcatctaacggagtaatacctaaccagcttcaatcaagggaactacgagcaatattaaaaaaggctgaaaactatttaccattcttaaaagaaaaaggtgaaaaaaatctaacagtatcagagatgatcatacagctatttgaatttcaaataccatactatgtgggacccttagataagaatcccaaaaaagacaaaaatgcgaacagttgggctgtaataccaagcggcggaagaatcctaccctggaactttgaagacaaagttgacgtaaaaggcagcaggaaagaattcatagagaaaatggtaagaaaatgcacatacctaagtgaggaacatacactacccaagcaatcattattatacgaaaaatttatggtattaaacgaaataaacaatatcaagatagacggcgaaaaaataagcgtagaagctaaacaaaaaatatacaacgacctatttatgaaaggcaaaaaagttagccagaaggcaataaaacaggagttaatttcactaaacataatgtccaaagatagcgtgctaagcggaatcgacacagtatgtaatgcatatttaagtagtatagctaaatttagaggagtttttgacgaaaacgttaataatcagtcaacaattgatatgatagaagatataatatttttaaagacagtatattcagatgaaaagcggtttgtcaaggaagaaatagtggaaaaatatggagacgaaattgacaaagataaaataaaacgtattctaggtttcaagtttagcaactggggaaatatatccaaatctttcttagaacttgaaggtgcagatgttggaacaggtgagatccgatcaataatacaatcattatgggagaccaattttaacttaatggaactcttatcttcacgatttacatacatggacgaactagaaaaaagggtgaaaaaattagaaaaacctttgtcggaatggacaatagaagatttagacgacatgtacctatccagtccagttaaacgaatgatatggcagtcaatgaaaatagtagacgaaatacaaactgtaataggatacgcacctaaaagaatctttgtagagatgactcgaagtgaaggagagaaagtacggaccaaaagcagaaaagatagactaaaggaactatatagtgcgatcaaagaagactccaaacaatgggttaaagaacttgatgcaaaagacgaaagctactttagaagtaaaaagatgtacttgtattatctccaaaaaggacggtgcatgtactcaggcgaagtaatagaacttgacaaactaatggatgataacctctacgacatagaccacatatacccaagaagcttcgtaaaagacgactcattagacaatctcgtattagtaaaaaaagaaataaacaatcgtaaacaaaacgacccaattacacctcaaatccaagcatcatgccaaggattctggaaagtcctacacgagcagggctttatctccaacgagaaatactctcgcctaacgcgaaaaacgcaagaattctcagatgaggaaaaactgagcttcattaatagacaaatagtagaaacaggacaagcgactaaatgtatggcacaaatactacagaaatcaatgggcgaagatgttgacgtagtatttagtaaagcaaggctcgtaagcgaattcagacataaatttgaattattcaaaagcagactaattaatgattttcatcacgcaaacgacgcatacttgaacatcgtagtcggtaacagttactttgtaaaatttacccggaatccagccaatttcataaaagacgcaagaaaaaatccagataatccggcatacaaataccacatggatagattctttgaaagggatgtaaagagtaaaagtgaggttgcttggattggacaatcggagggaaatgcaggaacaatcgcaatagtaaaaaaaacaatgagcaaaaactcaccacttatcaccaaaaaagtcgaagaaggtcacgggtctatcacaaaagaaacaatagtcggagtaaaagagataaaatttggaagaaacaaagtagaaaaagcagataagacacccaaaaaggcaaacttacaagcatatagaccaatcaaaacctctgacgaaaggctatgcaatattttacgatatggtggcagaacatccatatccatatcaggttattgcttagtggaatatgtaaaaaagagaaaaacaatacgatcactcgaagcaatacctgtatatttaggaagaaaagattcacttagtgaagaaaaactcctaaattacttcagatataatttgaacgatgggggcaaagatagcgtgtccgatattagattatgtctaccgtttatatcaacaaattcattagtaaaaatcgatggatatttgtactacttaggtggaaaaaatgatgatagaatacaactatacaacgcataccaacttaaaatgaaaaaagaagaagtggaatacattagaaagatagaaaaagctgtcagtatgagtaagtttgacgaaatcgaccgagaaaaaaacccggtattaacagaagaaaagaatattgagctttataacaaaattcaagataagttcgagaatactgtctttagtaaaagaatgtcattagttaaatacaataaaaaagacctatcatttggggatttcttaaaaaacaaaaaaagtaaattcgaagaaattgatttagagaaacaatgtaaagtcttatataacataatatttaacttatcaaatcttaaagaagttgatttaagtgacataggaggatcaaagtcaactggaaaatgccgatgtaaaaaaaacataactaactacaaagagtttaaactcatacagcaatccataaccggcttatatagctgcgaaaaagatttgatgacaatatga

SEQ ID NO: 9050 - RNA, 4176 nt, synthetic construct
  misc_feature 1..4176: note = Cas9 variant
  source 1..4176: mol_type = other RNA
atgaaaagaaataacgactattatattggattagatatgggaactaacagcgtgggatgggctactacaaaccctcaaggacgattattacgcttcaacaagaaagacatgtggggaagccgtttattcgaagaagcaaaaacagcagccaaaacgaggacattcagaaccagtcgaagaagatatgaccgcgtaaggcaaagaatagaatttctccaagatatcttcgcaccaattatcgccaagaaagatttcgagttctttatgagactaaaagaatcaaaatttcatttagaagataagaaaacagacggaaaattcgcactattcaacgacgcagattttacggatgtagaatatttcgatagatatcccacaatataccatctcagagctgcattaatcaaaccaaatcatataacagacccaagactgttatatttagccatacatcacataattaaaaatagaggtcattttctgttcgcaggaacagatatggaaagcataagatcttttcaaatagtctatacacaattaagtgaacacttgaaatcgataaatttagacttcgaactaccagtcgatgcccaagataaattcgctgcaatcctactcaatgaaaaactaaataaaagggataaaaagaaacagctcaaagaactctgcccacataaagacaaaagactagaatacgcatttaatgccataattggagggaaaacaaaattaaaagacatctttggagttgaagaatacgatgaagggacaaagaaagctgtagatttcgaaaaagcagactatgatgaagacaaagatgaaatagaaagcgttattaaagaaaacattcatgtccttaacgcgctaaaagccgtctacgattggacaattctaacgaatatattaggtgattatgcatatataagtgaatcacaagtagcactttatgaggctcacaagaaagatttaaggatccttaaatcactcataaagaaatatgcaaaatcacaatacgctgacgcatttagacatgaaaatgttaaaggaaactatgcaaattatgtaggtagtactaactatgataacaaacaacccgtaatcgataatcctagtgtgacgcaagaagatataaataaatattttgcggacatactactatcaataacccctgatgaatcagatcgagaaagttatcaatacataactgaacgacttcataaaggtgaagcattacctaaattacgaacaaaagccaactcggtcctaccacatcaaatacataaaatagagctcgagaaaattttagcgaacgcagccaaaaacttccccttcctacaagaaaaagacagtagtggctacacagcagcacagaaaatagtaaaaattatgatgtttagaatagaatattatgtgggtcctctcaatacatatcatcacgtagaccaaggcggacatgcgtggatggtcaggaaagcagaaggaaaaataacgccctggaactttgatgaaaaagtagacaaagaagcatcagcagaaaaatttataagaaacatgaccaataaatgcacatatctcatcgggaaagacgtaatccctaaacaaagtcttctctattcccgttataaagtcctaaacgaactgaacaatctaaaagtaaatggtgcacctatatcagtagcgctcaaacagaaaatctatgaagaactatttaagaaacaagttaatgttacatttaatcaactaaaaacttttctaaaaacccaaggcgaggacgctgacgaaatcattttatcaggagttgacgaggctgcgcataaattcacaaacaacttacaaacatatcataaatttagagcgatactacgggacaaaatcgagttcgaaccacaaagaagtatggtcgaagatataattagatggaaatgcctaatgggtgatgacataactatgtggaaacacaaaattgaaaaagaatacggagatcaactatctgaagaacaactaaagaaaatcacacgattgaacttcaatggttggtcacgcctaagtcaagaatttctaacggatgtaccaggggtcgatatagaaagcggtgaagtatactctggcatcatggatgcactatggcgcacgaacgaaaatattatgcaattactcagttcacgcttcactttcgccgccgaagtaaagaaacaaaaccaaggaactggaagaatagagaaaataacttatgacgaagtcatgaaagacacctatttaagtcctgctgttaaaagaagtgtatggcaagccattaccctagtagaagaaattcgcaaaatacgaaaagctgaccctaaaagaatattcgtcgagatgacaagacaaccagacgcaaagaaagaaaggaagttatcaagacgtacccaactactaaatgcgtatcgagccataggcaatgatattgccgaatacgaaaaagaacacgtatccacactaataacccaactggaatcaaagaaagatgaagacttaaggaggaagaaactctatttatattttacacaaatgggcagatgcatgtatacaggagagcgcatagatctttcctcgttactaagggacaccaacagtaatatatacgatattgatcatatatacccaaggagcttaacgaaagatgattcactggataacacggtactatgtaagaaagagataaacctcaagaaaggcaataaatacatacaccgagtatttacagacaaagaattaaagaaacaatatggatattggaaagccctaaaagaaaagaaactaatatcagagagaaaattcagccgtttaatgagaacgacagacctaaccgctgatgaattagctggattcatatcaagacaattagtagaaacaagccaaatggtgaaagcaaccgctgacatactcgagaaaatatatccaaatgttaccatagtctatgtaaaagccagaacagtcagcgatttccgacacgattacgaactacctaaagtaagagctttaaatgattgtcaccacgctcacgatgcctatctaaacatagtcgttggcaacgtatattacgaaaaatttacaaaatcaccattcagatttatagcaaaccaaaaaggaaaaggagacattaaatacaatttatatagattattcgacaaagacgttaaagtaggagatcgaataatatggaatgccaaagaagatcttgctagagtaaaagccaccttagaaagagacacagtaaatgtagtccggatgccagttgaacaaagagggcaatttttcgatgccacaatccaaaagaaaggaacgaccaaaaatatgcttgtcctaccgttaaaaggctcagacgaacgactacaagacacaagtaaatatggatattatgttagaccatctggtatgtcatttatggttgtacaacatgaagtcaaaggaaaatcaagagttacaattgaaccagcattattagtatataaaaacaaactaaaaagcgaagacgactacgcaaaatattgtgaagacgtattaaaactacaaaaaccgaaagtgctgttcaaaaacattaaatttggatcaaaaatcctattcgatggatatcctttcttgttaaaaggaagaacagaaaatcggataataatggccgacgcccaatcactattcctaggaaatcaagaactcaaaatattaaaaagagttacaaaaatctccgatgatattgaccacaaagttgaaagccgaatcaaaataacagacgaagaatggacaacactatggaaaagtgtggttgaacaaatagtgacaggaaaatttagaaatagactaggaacactcaacggaattttacaaggaaggaaaataaaactatctaaagacgaagaagcaaggctgaacgagctagattcaaaagaccaagaaactttcctcagccaaatattattagaacgattcttacaattcagcactgaagagaaaacgaggctactactacaagtaattagcttctcaggaaatacaacaggagtcgacctccgactcataggaggttcttccggtactggaaccataaaaacgaacaaaaatataactgaccactcagtaatactaattaacgaaagcccaacaggactcttcaccaacagaaccgttctcaatcaaccatga

SEQ ID NO: 9051 - RNA, 4176 nt, synthetic construct
  misc_feature 1..4176: note = Cas9 variant
  source 1..4176: mol_type = other RNA
atgaaaagaaataatgactactatatcggcctagatatgggaacaaactcagtcggttgggcgaccaccaatccacagggacgactcctacgatttaacaaaaaagacatgtggggaagtagactattcgaagaagcaaaaacagcagcaaagacacgtacgttcagaactagtcgccggcgatatgacagagtcaggcaaagaattgaatttctgcaagatatcttcgccccgataatagctaaaaaagattttgaattttttatgagactaaaagaatccaaatttcatcttgaagataaaaaaacagacggaaaatttgcactatttaatgatgcagacttcactgatgttgaatattttgatagatatcctactatatatcatttgcgagcggccttaatcaaacccaaccatataactgacccgcgattattatacctagccattcaccatattataaaaaaccgcggccattttctatttgcagggactgatatggaatcaattagatcatttcaaattgtatatacgcaattatctgaacatctaaaatccataaatctagattttgaactaccagtcgacgcacaagataaatttgcagccattctattaaatgaaaaactaaacaaaagagataaaaaaaaacagctaaaagaactatgcccacacaaggataaaagattagagtatgcgtttaatgcaataattggcgggaaaacgaaattgaaagatatatttggagtagaagaatatgatgagggaacaaaaaaagcagtagattttgaaaaagcagactacgatgaagacaaagacgagatagaaagcgtaataaaagagaatatacacgtcctaaacgcattgaaagcagtatacgattggacgatattaacaaacatactcggagattatgcatatatctccgaaagccaagtagccctatacgaagcacataaaaaagatcttagaattctaaaaagtttaattaaaaaatatgccaaaagtcaatacgctgatgcattcagacatgaaaacgtcaaaggaaactatgcaaactatgttggttcaaccaattacgataacaaacagccagtaattgataatccgagcgttacccaggaagacataaataaatatttcgccgacatcttattatcaattacacctgatgaatctgatcgcgaatcataccaatatataacagaaagattacacaaaggagaagcgttaccaaaattaagaaccaaagcaaattcagtcctaccacaccagattcacaaaatcgagttagaaaaaattttagccaatgcggcgaaaaactttcccttcctacaagaaaaagattcatcaggttatactgcagctcaaaaaatagtaaaaataatgatgtttaggatcgaatattacgttgggcccttaaacacataccaccacgtagatcaaggaggccacgcatggatggtcagaaaagccgaggggaagatcacgccctggaatttcgatgaaaaagtagataaagaagcttcagcagaaaaatttatcagaaacatgactaacaaatgcacatatctcataggcaaagatgtcatacccaaacaatcactactctactcaagatataaagttttaaacgaacttaataacttaaaagtaaatggtgtaccaatatcagtagccttaaaacaaaaaatttatgaagaattattcaaaaaacaagttaacgtcacatttaatcaactaaaaacattcctgaaaacgcaaggagaagatgcagatgaaatcatactctctggagttgatgaggcagctcataaatttactaacaatttgcaaacataccataaattccgagcaatattaagagacaaaatagaattcgaaccgcaaagatcaatggttgaggatatcatacgctggaaatgcctaatgggagatgacattacaatgtggaagcataaaatcgagaaagaatatggagatcaactttcagaggaacaattaaagaaaataactagactaaatttcaatggttggtctagactctcacaagaatttttaactgatgtaccaggagtagatatagagagtggagaggtgtacagtggaatcatggatgccctttggcgaacaaatgagaatataatgcaattattatcaagccgattcactttcgcagcagaagtgaaaaaacaaaatcagggaactggtcgcatagagaaaataacatacgacgaagtaatgaaggacacgtatttaagtccagcagtcaaacgatcagtatggcaagccattaccttggtagaggaaataaggaaaataagaaaagcagacccaaaacgtatatttgtagaaatgacaagacaaccagacgcaaaaaaagaacgtaaattaagcagaaggacgcaactattaaatgcatatagagccataggtaacgatatagcagaatacgaaaaagagcatgtgtcaacactcataacacaactagaaagcaaaaaagacgaagatctaaggagaaaaaagttatatctatatttcacacaaatgggcaggtgcatgtatacgggagaacgaatagacctcagctcacttctaagagatacaaattcaaacatatacgacatagatcacatctaccccagatccctaacaaaagatgactcgctagacaatacagttctttgcaaaaaagagataaatctaaaaaaaggtaacaaatatattcatcgtgtgttcacagacaaagaactaaaaaaacaatatggatattggaaagctctaaaagaaaagaaattaatcagcgaacgtaagttctctcgtttgatgaggacaacagacttaacagcagacgaactagcaggatttataagtaggcaattagtggaaacatcccaaatggttaaagcaacagcggatatattagagaaaatataccctaatgttaccatagtatacgtaaaagcaagaaccgtatctgattttaggcatgattacgaattacctaaagtacgagcgttgaacgactgccaccacgcacatgacgcttacttgaacatagtcgtaggcaatgtctattacgagaaatttacgaagagtcctttcagatttatagcaaatcaaaaaggcaaaggagatatcaaatataatctatacaggctattcgacaaagacgtgaaagtaggtgataggataatatggaatgcaaaagaagacctagcacgagttaaagctaccctagaaagagacacagtaaacgtagtaagaatgccagtagaacaacgtggccaatttttcgacgctacaatacagaaaaagggcacaactaaaaacatgctagtcttacctctaaaggggtccgacgaacgacttcaagacacatccaaatatggatactatgtgcggccaagtggaatgtcattcatggtagtacaacatgaagttaaagggaaaagcagagtgaccattgagcctgcattactcgtatacaaaaacaaactcaaatccgaagatgactatgcaaaatactgcgaagacgtattaaaattacaaaaaccaaaagtattatttaaaaatattaaattcggctcaaagatcttatttgacggctacccttttttacttaaaggtcgtacagaaaatagaataataatggctgatgcccaatccctattcttaggcaaccaagaacttaaaattttaaaaagagtaacaaaaatttctgatgatatagaccataaagttgagtctagaataaaaatcacagatgaagaatggacaacactatggaaaagcgtagtagaacaaatcgtaactggaaaattccgaaatcgactaggtacactgaacgggatcttacaaggaagaaaaataaaattgagcaaagatgaagaggccagacttaacgaacttgactccaaagatcaagaaacatttctttcacaaatattactagagagattcttacaatttagcaccgaagagaaaacccgcctattactacaagtcatcagcttctcagggaatacaacgggggttgaccttaggttaattggtggatcatccggaacaggtacaataaagacaaataaaaacataacagatcattccgttatactaatcaacgaaagtccaacaggcttatttacaaacagaacagttctgaatcaaccctga

SEQ ID NO: 9052 - RNA, 4179 nt, synthetic construct
  misc_feature 1..4179: note = Cas9 variant
  source 1..4179: mol_type = other RNA
atgaaatccatactaggactagatctagggacgacaagcataggctgggcgctagtaaaagaatcagaaaatgataatgaaaaatcagaaatagtaaaactcggagtaagattagttccactcactacagatgaacgaacagattttgaaaaaggaaaaagcataacaacaaacgcagataggacatcaaaaagatcaatgcgtcgaaatttacagagatataagttaagaagagaagctctagtaagtgaattaaagaaggaacactggatagacgaaggataccgatttagtgaagacggtccaggaagtacattctcgacgctacgactccgcgcaaaagccgctgaagaagaaattagtctacaggacttagctaaagtacttcttcaaataaataagaaaagaggatacaaatcatctaggaaattaaattcagctgaagatggacaagcgatagatggcatgtcggtagctaaagtcttgtacgatagagggcttactccaggagaatatgtctatcaaagaatgcttgatggccaatacgcaattccagaattttataaatcagatttacaagcagaatttgacaaaatatggaacttacagaaaagttattatccagaattgaccgctgagctatatgacaaactaacagataaaaataaaagtcaaacatgggcaatttgtagggacgagcttggtgtacagggattcaaaagcagtttcaccggaaaagaacggttaaaagaggcttattttaacagacaacaagcatctaaacagaaagtcgatttagaagtcctcacatgcgtattacaagatataaatggacaaaaagccagtctttcgggactactaagcgcaatttcggacagaagcaaagaattatatttcaatagaatgactgtaggacaaatgcttgtgagacaaatccaagaagatcccaacagatcattacgtaacacagtattttacagacaagattacattgacgagttcgagaaaatctggtcagtacaaagcagatttcacccagaattgacacaagaaagaaagaagaaattaaaagacattataatattttatcaacgaccattaaaatcccaaaaaggactcatatcattatgtgaatttgaaagtcgcgaagtggatataagtgtagatggagtaatcaagaagaagaaaatagggccacgagtctgtccaagaagttcaccactattccaggaatttaaagtctaccaaacagtaaacaatattctagtcaacggagaaccattggacgacaatgatagagaaaaattagtcggtgaactggcattccgagagaaaatgaaaggacaagatgttctaaaattgctatacaaaacatctaaaggcatgagaataaatttcgaagaagtagaaggaaatagaacgatggcgacaatactaaaggcttgtgagaaaatagttgaaggcttaggttacgacacaagagatttgagtaaaataaccgcttcagaaaaagtatcaagaattgaagaaattttcgcaaaagaaggttttaaaagtgactttttacatttcgattcaagtcttccatcaccggaatttgaatctcaagcatcatacagtttgtggcatttactttatagttacgaaaacgataaaagtgtatccggaaatgaatcactggtagagaaaattaaaaagttatgctcgatggatgaggcttcagcaaaaatattgagcggatgtacattcttatcagactatggtagtctatctgcccgagcgatgagaaaaatactgccgtacatgaaggacggactagaatattccgcagcgtgtgcaatggcaggatatagacacagtaaaagatccttgacaaaagaagaattggattcccgagtgtatgttgaccgtcttgaactactaccgaaaaattccctaagaaacccagtcgtagagaaaatcttaaaccaaatgataaatgtagtgaactcagtagtagatacctatggtaaaccagacgaaattagaatagaaatggctagggaactaaagaaaagcgcctcagaacgagaaaaagcacaaaaagacattgcagcagctagcaaagtaaatgaaagcatagtggcaactttaaaaggaagtccctttttcatagactctccaagcagaaacgatatcattagatacagactttgggaagaactcaaaccaaatggatataaaacactatattcggggacatatattccaaaagaaaggctgttttctaaagatttcgacatcgaacatataattccacaggcacttctttttgatgactcattcgcaaataaaacaatagaatcgcgacaatgtaatatcgaaaagtcaaatagaaccgcaatggactacgtcaaaagtaaatacgacagtttcggagtgcaagcatacatagacagagtgaaagggctcacaggtgtaagtaaaactaaaataacacgactacttatggaatcgaaagatattccagaagattttataaacagagaattgcgggacagccaatacatagcaagaaaagcacgtgaaattttagaaagtatggttaaatttgtagtaccaacaacggggagtgtcactgcaaggttaagagaagactggcaattagtaaacgtaatgagggaattaaattgggacaagtacgaaaaactaggattaacatcatttcgggaagatagagacggcagagaaattcctgtaattgaagattggacaaaaagaaatgaccatcgacatcatgccatggacgcattaacaatagcattcacaaggcgacaattcatacaatatttaaatcacttaaacgctaaaatagacacggtagataaaacagacatcgatttacgagattataatctcgaagatatttcctttgatggcttaagagatggggataagttcggcatagtaaaagcactacaaaagaaatacctatataaagacgacaaacaaaaatacaggtttgttccacctatgccactagacgagttcagaatagaagcgaaacgccaaatagaagacgttttggttagttttaaagctaagaataaagtatgtactaaaaacgtaaatacaacaaaggtgaggggaggacaacaacgaaaaatacaattgacgcctaggggacccttacacgaagatactatatacggaaaaagacttcaatatgtaacaaaagaagaaaaagtcggagggtcattcgatgaagccaagatcgctagtgtgtgcaagaaaagttatagagaagcgttaatgaggagattaatggaatgcggcggtgacccaaagaaagcatttacaggtaaaaatagcctagagaaaaacccagtatgggtagacgagttccacagtggagaagtccccctaagggtaaggacagtgagcatggcatcagtttacacagttagaaaaagtgttggacaaagtttaaatatagaaaaagtattagacaaacacataaaagaaatactacgtgcccgattagaagaatatggaggtaacgctagtaaagccttctcaaaccttgacgaaaatccaatatggttaaacaaagaaaaaggaattgcagtaaaacgagtaacaattgacagcgggaaaaatccaattcccctgagaagcaaactcgacaaggatggacaaataatttatggagaaggacaaaacccccaagaatcggattttgttgtaccaggcggaaatcaccatgcagcgatctatagaactccgagcggtaaattacaagatgtagttgtatcattttatgaagcagtatcaaggaaaaatttaggattagaagtaattgatagaaatttcaaaaaggatgaaggctgggagttcttatttacattaaaacaaaatgaatatttcgtttttccaaacccagctacagggttctccccggaagattacgatttaacagatccagccaacaatgctataatatcaccaaacctatatcgcgttcaaacagtgtcagtaggcgactatagattcagacaccacttagaaacaactgtcgaagacaatgaaaaacttcgagatatcgcatggaaaaggatcgggccatcaggtctcgtaggagccgttaaagtacgtatcgacaatttaggaagaatattggcagtaggcgaatatgattga

SEQ ID NO: 9053 - RNA, 4179 nt, synthetic construct
  misc_feature 1..4179: note = Cas9 variant
  source 1..4179: mol_type = other RNA
atggaaaacaaaaattattccatagggttagatataggtacaaattcagtaggatgggccgtaataacggatgactacaaagtaccatccaagaaaatgaaagtttttggcaatacagacaaacattttatcaagaaaaatctaattggtgcacttctattcgatgaaggtgctacagcagaagataggcgactaaaaaggaccgccagaagacgatataccagacgcaaaaatcgtttaagatacttacaagaaattttctccgaagaaattagtaaactagactcgtccttctttcataggttagacgacagttttctagttccaaaagacaaacgcggctcaaaataccctatatttgcaaccctagaagaagaaaaagaataccacaaaaagtttcccacaatatatcatctacggaaacaccttgcggattccaaagagaaaactgacctacgactaatatatctggcgttagcccacatgataaaatatcgcggccactttttatatgaagaatcatttgacatcaaaaataacgatatacagaaaatattcaacgaatttatcagtatatacgataacacattcgaaggctcaagtttatccgggcaaaatgcccaagtcgaagcaatattcaccgacaaaatatcaaaaagcgcaaaacgcgaaagagtattaaaattattcagcgacgaaaaatcaacatcactattctcagagttcctaaaattaatagtaggaaatcaagctgattttaagaaacatttcgatctcgaagaaaaagcaccattacaattctcaaaagatacatatgatgaagacctcgaaaacctactaggtcaaatcggtgacggatttaccgatctattcctcgtagccaagaaattatacgacgctatactactttcaggcatactaacggtcacagacccgtctacaaaagccccattatcagcctcgatgatagaaagatatgaatctcaccaaaaagacctagcagcacttaaacaattcatcaaaaacaatcttccaaaaagatacaacgaagttttctctgatcaatcaaaagatggatacgcagggtatattgatggcaaaactacacaagaggctttctacaaatacattaaaaacttactatccaaattcgaaggagccgactatttcctagataaaatagaaagagaagacttcctacgtaaacaaaggacatttgacaatggaagtataccacaccaaatacatctgcaggaaatgaacgccatactaagaagacaaggcgaacattatccattccttaaagaaaaccgagagaaaattgaaaagatacttacattcagaatcccttactatgtcggacctctagcacgaggaaacagagatttcgcatggttaacaagaaattccgatcaagctattcgaccttggaacttcgaagaaatagttgacaaagctagtagcgccgaagaatttatcaataaaatgaccaactacgacctatacttaccagaagaaaaagtattacccaaacattctctcttatacgaaacattcgctgtctacaacgaacttacaaaagtaaaatttatagctgaaggactacgtgactaccaattcttagactccggtcagaagaaacaaatcgtcaatcaactattcaaagaaaagagaaaagtaactgaaaaagacattatacattatctccataacgttgatggatacgacggaatagaattaaaaggaatcgaaaaacaatttaacgcatcattatccacgtaccacgaccttttaaaaataataaaagataaagaatttatggacgaccccaaaaacgaagaaattctagaaaatattgtacataccctaacaatatttgaagatagagaaatgataaaacaacgacttgcgcaatacgattcaattttcgacgaaaaagtcataaaagcattaacaagaagacattacacgggctggggtaaactgtccgcaaaactcataaatggaatctgcgacaaacaaacaggtgacactattttggactatctaatagacgatggaaaaataaaccgaaatttcatgcagctgattaatgatgatggactatcatttaaagaaataatacaaaaggcacaagtagttggaaaaacagatgacgtcaaacaagtcgtccaagaactaccaggctcaccagcaatcaagaaaggcatcttacaatctatcaaaatagtcgatgaactcgtcaaagtcatgggatacgctcccgaaagtatcgtaatagaaatggcaagagaaaaccaaaccactgctcgaggcaagaaaaattcacaacaacgatacaaaagaattgaagactctctcaaaaacctggcccccggattagatagtaatatactaaaagaaaacccaaccgacaacatacaactacaaaatgacagattattcctctattatttacaaaatggcaaagatatgtacacggggaaacccctcgatatagatcaactaagctcttacgacatagaccatattatcccccaagccttcatcaaagacgactcaatcgataaccgagtattaacaagttccaaagacaataggggaaaatctgacaacgttcccagcttagaagtagtacagaaaagaaaagcattttggcaacaacttctcgacagtaaactcatatcagaaagaaaattcaataacttaaccaaagccgaaagaggtggattagatgaaagggacaaagtcggattcataagaagacaattagtggaaacaagacaaataacaaaacatgtagcgcaaatattagacgcctcgttcaataccgaagttaacgagaaaaatcagaaaatacgaactgtgaaaattataacactaaaatccaacctcgtaagcaatttcaggaaagaatttgaactatacaaagttagagaaattaatgattatcaccacgcacatgacgcatacctaaacgcagtagtggcaaaagcaatactcaagaaatacccaaaactcgaacccgagttcgtttacggtgactatcaaaagtatgatttgaagagatacatttcaaggttcaaaccatcaaaagaaattgaaaaagccaccgaaaaatacttcttctattcgaaccttctaaacttctttaaagaagaagtacactatgcagatggcatcattgtaaagagagaaaacatagaatattcaaaagatacaggagaaatagcctggaataaagagaaggactttgctacaattaaaaaggtactaagttacccacaagtaaacatagtaaagaaaacagaaatacaaacccatggcttggaccgaggcaaacccaaaggactctttaacagtaacccgtcaccaaagccatctgaagactcaaaagaaaacctcgtccctataaagcaaggtttagatcctcgaaaatacggaggatacgctggaatctccaactcctacgccgtactcgttaaagcaatagtcgagaaaggagccaagaaacaacagaaaacgatactagagtttcaaggcatcagcattcttgataagattaatttcgaaaacaataaagaaaactacttactaaagaaaaggtatatagaaatactaagcaccattacactccctaagtactcattatttgaatttccagatggaaccagaagaagactcgcatcaatattatcaacaaacaacaaaagaggcgaaatccacaaaggtaatgagttagttctccctggcaaatatacaacactattataccacgctaaaaatatcaataagaaactagagccagaacacctagaatatgtcgaaaaacaccgtaacgactttgcaaaactactagaatgcgtcttaaattttaatgataagtatgtaggagccttgaagaacggtgaacgtatccgacaagcatttactgattgggaaaccgttgacatagagaaactttgcttctcattcataggaccagaaaactccaaaaacgccggcctatttgaattaacatcacagggatcagcttctgactttgaatttctcggagtaaaaattcctcgctaccgtgattatgccccatcctcactcttaaaagcaacattaatacatcaaagtattacaggtctatacgagacacgcatagacctgtcaaaactaggagaggactga

SEQ ID NO: 9054 - RNA, 4179 nt, synthetic construct
  misc_feature 1..4179: note = Cas9 variant
  source 1..4179: mol_type = other RNA
atgaacaataataattattcaataggcctggacataggaaccaattccgtaggctgggcagtaataacagatgactacaaagttccaagcaagaaaatgaaagtgctaggcaatacagacaaacactttattaaaaaaaacttaataggtgccctcttgtttgacgaaggcgcgacagctgaagaccggagattcaaaagaactgccagaagaagatacacaagaagaaaaaatagactgcgctatctacaggaaatattctcagaggagatgtcgaaagtcgactcatcatttttccatagattagacgactctttcctagtacccgaagataagcggggaagtaaatatccaatattcgcaacacttgctgaagagaaagaatatcacaaaaaatttcctactatttatcacctgagaaaacatcttgctgattccaaagaaaaaacagacctcagactaatttatttagcccttgcacacatgataaaatatcggggtcactttctatatgaagaatcgttcgatataaaaaacaacgatatacaaaaaatattttcagagtttatatccatatatgataatacattcgaaggaagtagccttagtggccaaaatgctcaggtggaagcgatattcacagataaaatatctaaatccgcaaaaagagaacgaatattaaaactatttgcctatgagaaatcaacagacttattcagcgaattcctgaaacttatagtgggaaaccaagcagatttcaaaaaacattttgacttagaagaaaaagctccacttcagtttagcaaagacacatacgacgaagacctagaaaatcttctaggtcaaataggtgacgattttgcagacctatttctagtcgcaaagaaattgtatgacgcaatattacttagtggaatactaaccgtaacagacagctcaacgaaagcaccactcagtgcatccatgatcgagcgatacgaaaaccaccaaaaggatctcgcagccctaaaacaatttatacaaaacaatctacaggaaaaatatgacgaggtattttcagaccaatcaaaagacggatacgcgcggtatatcaatggcaagaccacacaagaagcgttttataagtacataaaaaatttactttctaagtttgaaggcagcgactacttcctagacaaaattgaaagagaagattttctaagaaaacagagaacctttgacaatggatcaataccacatcaaatacatctacaagaaatgaacgctataattagaagacaaggagaacattacccgtttcttaaagaatacaaagaaaaaattgaaaccatcctgacttttagaataccatactatgtgggcccacttgctaggggcaacagaaattttgcatggctcactagaaacagtgatcaagcaataagaccatggaatttcgaagaaatagtagaccaagcatcaagtgcagaagaatttataaacaaaatgactaattacgacttatacttacctgaggaaaaggtattaccaaaacattcattactttacgaaacattcgcagtatacaacgaactcacgaaagtaaaatttatatcagaaggcttaagagattatcaatttctagatagcggtcaaaaaaaacaaatagtaaatcagctctttaaagaaaaacgaaaagtcacggaaaaagatattatacaatatttacacaatgtcgatggctatgacggaatcgaactaaaaggaattgaaaaacaatttaatgcctctctatcaacatatcacgaccttctaaaaataataaaagataaagaatttatggatgacccaaaaaatgaagaaatcttagaaaacatagtacacacgctaaccatttttgaagacagagaaatgatcaaacaaagattggctcaatacgcttcaatctttgataaaaaagtcataaaagccctaacgagacgacattatacaggatggggtaaattatcagcaaaattaataaacggaatatgtgataaaaaaactggaaaaacaatattagattatctaatagatgacggatattcaaacaggaacttcatgcagctgataaacgacgatggactctctttcaaagacataattcaaaaagctcaagtagtaggcaaaacaaacgacgtgaaacaagtcgtccaagaactaccaggttcccccgcaattaaaaaagggatattacagagcataaaacttgtcgacgaactagttaaagtaatggggcacgcacccgaaagtatagtaatagaaattgcacgggaaaaccaaacaacagcccgaggtaaaaaaaatagccagcaacgttacaaaagaatcgaagacgcactcaaaaacttagcacccgggttagactccaacatactaaaggaacacccaacagacaatatccaattacaaaacgaccgactcttcttatactatcttcagaacggaaaagatatgtacacaggagaagcattagatatcaaccagctaagcagttacgacatagaccacatcgttccgcaagcgtttataaaagatgactcactcgataatagagttctgacatctagtaaagataacagaggtaaatcagataatgttccgtccctagaagtcgtacaaaaacgcaaagcattttggcaacaactattagatagtaaactaattagcgaacacaagttcaataatctcacaaaagccgaaagaggaggacttgatgaaagagataaagtaggattcatacgacgacaattagttgaaacaagacaaatcacaaaacacgtcgcacaaatattagatgctcgattcaacacggaggtaaacgagaaggataaaaaaaaccgaaccgtaaaaataataacgttaaaatcaaacttagtctcaaactttcgaaaagaattcaaactgtataaagtaagggagataaatgactaccaccatgcccacgatgcatatcttaatgccgttgtcgcaaaagctatacttaaaaaatacccaaaactagaaccaggctttgtatatggagattaccaaaaatatgacattaaaagatatatcagcaggtccaaagacccgaaagaagtagaaaaagcaactgagaaatacttcttttacagcaatctactaaattttttcaaagaagaagtacattatgccgacggaacaatcgtaaaaagggaaaatatcgaatacagcaaagatacaggggaaattgcatggaataaagagaaagacttcgcaacaataaaaaaggtccttagcctaccccaagtaaatattgtgaaaaaaacagaaattcaaacacacggattagaccgaggaaagcccaggggtttattcaactcaaatccttcgccaaaacccagtgaagacagaaaagaaaatctagtaccaatcaaacaaggactagacccaagaaaatacggaggctatgctggaatatcaaattcctatgcagttctagtcaaagcaatcatagaaaaaggagcaaaaaaacagcaaaaaaccgtgcttgaatttcaaggaatatccatacttgataaaataaatttcgaaaaaaataaagaaaattaccttctcgaaaagggctacatcaaaatattatcaacaataacactgcccaaatattccctattcgaattcccagacggaacaagaagaagattagcatcaatactttccacaaataacaaaaggggcgaaatacataaaggcaacgagttagttattcccgaaaaatatacaacattgctctaccatgctaaaaatattaataaaaccttagaacccgaacatcttgaatacgttgaaaaacaccgtaacgattttgcaaaactcttggaatacgtactaaatttcaacgataaatacgtaggagcgttaaaaaatggagaaaggatacgacaagctttcattgactgggagaccgtcgacatcgaaaaactatgcttctcgttcataggacctagaaattcaaaaaacgcaggtttatttgaattaacgtcacaaggcagcgcatcagattttgaattccttggcgtgaaaataccgagatatagagattatacaccttcttccttactaaacgccaccctaatacaccaatccataacaggattgtacgaaacgcgtatagatctatcaaagctaggagaagattga

SEQ ID NO: 9055 - RNA, 4179 nt, synthetic construct
  misc_feature 1..4179: note = Cas9 variant
  source 1..4179: mol_type = other RNA
atgaagaactaccatataggactagacatcggaacctcatccgtaggattcgcagcacgagacgatgaaaacaatttaattagagtaaaaggtaaaaatgtcataggagcgcgactatttgccgaaggcaaaacagcacaagaacgtagaatggctcgaacgtcaagacggagatacaatcggagaaaatggagattacgactacttaatgatatatttcatgacgaaatagtacacaaagacaaagatttctttaatcgcctaaagcaatcttcaatctctccaaaagacgaccgaaagaaatattttgggagcctacttttcccagaactgtcagactctgagttctatcataacggaaatcaaacaatttaccatctccgacatagactaatgacttcgaatgaaaaagccgatatacgtgaaatatatctcgcactaagacatatagttaaatatagaggcaactttttagatgacacaccagtatcgtcgttcgaggcttcagacttaaaactagggagcttcatacccactctaaacgacctattcgaaacaattgacgtaaactacgtattcaattctgaaaacacaaatcagatagagtcaatactgctaaataacgatcttagaaactcagacaaaagcaaacaattagttgacttactataccggaacgtatccgatgttgatgataagagcttagaaaaacaatttaacaagtttcgcaaggatatttctaaggaaattgcaaagagcttcgtgggatcaaaattcaacgtaaacaaacttcttgcctatgaaacagatgatggaagcaaaatcagtctgagctttagcgacgccagcagcgacgataaaatgttagaattagccgataatctagatgatgaaagaataaacattttaaacgctctaaaagtaatatattcacgtgtaagattaaatcagataataccaaatggcatgggattgtcagaaagcatgatagcatcctatgaattacacaagaaacaactcaatgacctaaagaaactcctcaacgttttaccttttcacgaaaaatacgccgtaaaagttgcctatgcagcttatatagggaatatggatgctcaaaaatttactcaagccgaacttagtacaatcgagagtttgaaagaaaaagattctataaagaaagtaatagattgcaaaacaggccacataacaaatgaatcgctaatatctgttataaaccaaatagttgtaaacccatatctagaaaattcagacttcgagttaatagacatcgttaagaaaatagaccaagacattaaaaacggcgaatatctattaaaacaaagaaataatcaaaatggaaatattccccaccaactccatcaaatggaaatggatcaaataatagaaaaacaatcaaaatattatcccttcctaggagaactaaatccaaacgaaaacagacgccatatagcaaaatataaaatttccgaacttgtagcttttagggtaccatactacgtcggaccacttataacccctgaagaacaggctaaaacttccggagcatcattcgcatggatgaaaaggaaagaagacggtgaaatcacaccatggaatttcgatcagaaagttgatcgcgaagcaaccgcatctcgctttataaaacgcctaaccgtgaaagacacctatctatttaatgaagacgtcctaccagacaactcattactctatcaacaatttaaagtcttaaacgaactaaacgttgtaaaagttaacaataaacgcttatcacaagcagaaaaacagggcgcattcaatgatctattcaaagtaacaaagactgtaacagctaaaaggttaaagaattacttagtttcaaacttcaaccatttagacacaatagaaataaccggattatctgatggagaaaaattcaataacggactaacctcatacgttgatttccaaaagatattcggagacaaaattaacaatttggaattaatggatgactttgaatctttaatcgaatggtccaccgtattcgaagaccgacacattttcgaagaaaaagtgcgtaacgagatcaactggatcagcgaaagtgaattgaaacagctagttgctaaaaggtactcaggatggggcagattatcctcaaaactattagtaggaataaacaacgacgaaggccgaaacatcatcgaacaattattcgagacttcagaaacatttatggaagcaatttcaagaccagaagtcaagaaacaaatcgatgaaataaactcagatttcattaaaaatacagacatagaatcagttttagcagacgcctataccagtccacaaaacaagaaagccataagagaaacatataaaatcgtaaaagatatacaaaaagccatgggaggaaaagcacccgagagcatctctatagagttcactagaaatccagaagacaaaggagaactaacaagaagcagacatagtgaaatttccagaaaatacaaagaactatctaaagaaatcagcaaagaattaaacgatgagttaaaatcgaagaaaaactccatggacatagataaatattacttatattttatgcaaatgggaaaagacctatacgacggaaaaagcatcgatatagacgacttaaacaattatcaaatcgatcacatcgtcccccagagcttttataaagatgacagctttgacaacagagtactaacctattacacaaataatcaaaagaaaggaaacaacactcccctaaatggattaaatatttctaatgaaacacgaaaattatggtcccatctccacgacttaggacttatatccaaacgcaaataccttaacttaacgatgcagggactagacagtctctccaaatacaccaaacacggcttcatcagacgacagctagtagaaacaagccaagtaataaagctagtagcaaatatactctcagatgagttctcagcagataatacgaaaataattgaagttaaagcaaaaatgaactcacaaatgcgccactctttcaacttatataagatccgagaacttaacgactatcaccacgccctcgatgcatacctaaccacatttattggaggctatctatataacagatatcccaaacttcgtggaatgtttgtatatggtgacttcaagaaatttgacgtaaacgacgctaataatgtaaaaacactaaatttcctacatgacataactaatccttcagacaaatttgtgaaccagatctacgacgagcaaagcggcgaattaatacttgatagaaaacatgcaattgaaacaatcaaaaagatataccaatataaatttatgctcataactagagaagtaagtacaaaagatgacaaactctcggaccaaacagtatactccgcaaaacgtataaataatgtcgcttcacctatacccgtaaagaaagattcaaatccagaactatacggcttcaggacaggaaacgtcgaccaccacatggtaatagttaaatacccgaagaaagacagctttgtatataaagtagtaggaataccaatacgattcatgcaagaactaaggtcaagtaaaaatcaatcagaatacgaaaatactttgaaccagatagtacaagctaaactcaatcgcaagaaattcgattttagagtcgtagtagacaacgtcatgtatggacaattaatacaagacggaggccaaaaattcacgcttggttcgtcaacatataggtataatgctaaacaactcgtattggacatggattcattaagaatcctgtctgatgaaaaataccgaaattccctaaccgacgatgagaaaaattcagagttcataaacatataccaacaagttctaaatgtggtcaatgaaaaattcgacgtattcgatgtaagaggaactcgagacaaacttacaaaaggacttgacaaatttctcaacataacatcaaatgataaagaaatagtattattaaaaatactatcaggcctacactgcaacgctgcaagagtaaaaatcaatgaaatcggaataaacaccagctttggagaactacaaacaacccatggaattgtactaagcgaaaacagctatatcatttaccaaagcccgagtggtttattcgaacgtaaagttagattaaaagatttatga

SEQ ID NO: 9056 - RNA, 4179 nt, synthetic construct
  misc_feature 1..4179: note = Cas9 variant
  source 1..4179: mol_type = other RNA
atggcgaataaaacctggtacctaggcctagatatcggatcagcaagcgtaggatgggccgcaacagacactggctataagatcataagaaaaaataaaaaacgactctggggagttagactattcgaagaagcgaaaaccgcggaagacagacgaggctataggtcatctcgtagaagattagcaagaagaaaatggagactaaatctactagaggagctattcaccagtgaagtaaaaaaagtagacgaaaacttcttcttacgccttaaagagtctcaatatcactacgaggataaaacacacaaagtaccatacgcaattttcaacgataaagattacacggataaagactactataaagactatccaacgatataccacctaagatctaaattaatgaccgaagaaaatccagacataagaaaagtgttcctagcaatacatcacataataaaaaatagagggcattttttattacagggacaatcctttaaagacggtaatctaaataacctaataaaagaactactagaattagatatattacatgtggggtttgaagtgaccgaagaagtagtagacaaaatagccgacataagcctggaaaagaaaacaagtaaagataagttgaacgatataaaagaattgtatcctaaagagaaacaattgttggaagtatttcgattgatatttgggggcaaaacgagccttgacaaactattcgcaatagatgaatacaaagaattagatgcagcaataaaatctgtaagctttaaagagaaaatttacgaagaagtccgacacgactatgaacaagtcctatccaactatatcgaacttctagacctagcaaaactagtctatgattcaattattctcagcgacataaaaaaggaaggaaaaacactatcagaatcaaaagtagagttattcgaaaaacatagagatgacctattaaaactaaaaaatctggtaaagaacgacagtaaactatcagaagacaaaaaagtagaactatatgcgctaattttcaaagaagataaagataaaggaaccaattacgtaaattacatacggaaaagcgaagagggcaaaggttgtaattacgaagactttaaaaaattcttagtcaaagaacttgcaaaactagaagagagcagtgtaaaaacggaaatcataaaagacttagaattagaacaattcctaccattacaacgaacaaaagataattcagtagtcccatatcagattcacaaagaagaactagtaaaaatactagataatgcagcacggtaccatagcttcttaaatgaaaaggacgaatcaggatacaatgtaagagaaaaagtgatacaattgctagaatttagaatcccatattacgtcgggccattaaacagttcaaaaaaggccaaagaaggtggatttgcctggagtgtaagaaatacaggttatgaaaacacgcccgttacgccttggaattattcaaaggtcatagacgaatcagcaagtgccgaaaaattcattacaaatttaacaaacaaatgcacctacctcaagggggaagatgtattaccaaaaagctcactcttatactcagaattcgcactactgaatgaactaaacgcactaaaatatgatgggaacagaatatccttagaggcaagaaataccataatagagaaattattcaaacaacaaggaaagaaagtcacaaaaacatcaataaaaaatctactaaaagcggaaggttatatcgacggcaaaggggaaataaccggaatagacattaccgttaaaaatgaccttaagtcataccgtgatttcaaaaagatattaggaaataagtttaacagcgaacacgttgaaaatatcatattgtggataacgctatacggcgaaagccgaaagttaatcaaagcaaagatagaaagcgtctacggagaagtttacagtaaagatgaaataacaaaaatgtcaagactagtttacaaagattggggtcgcttttcacgaaaactactaactgaacttgtatctaaaaaattatataatgaagaaactggggagtgcctcaatataataggagcaatgcgtcagaataatattctattcatggaattactagctgatagattcgattacagtaaacaaattgtcgagttcaacaaagaactacaagaagacgtcacagagatcgcacccgaaatcctagacgacctatatgtttccccagccgtcaagcgcagcatatggcaaacagtaagaatagtcgaagaacttaaaaaaatcataggatgcgccccagcaaaaatatttgtcgagactacacgtagtaaccaagaaaaaaaaaaaccaacagactccagaaaaaaacaattagaactagcatacaaagcagttaaaaaagatgtaaaggaactagagaaagagataggcacgatcaatttcgacgtgttaaacgaccgcctaagttcggttgaaccatcaaagctaaaagcaaaaaaattatacctgtactacactcaactcggaagatgtatgtactccgaggaaccgataaacatttcagagttatttgacaataacaaatacgacatagaccacatatatccacaatccaaaataaaagacgatagctttactaacaccgtcctagtcaagcgagaatcaaacgcggccaaaaccgatcgatatccacttggaagcgacatacaaacaccttcaaaccgtcgcttttggaagtttttaaaagagaaggggctcattagcgacgaaaaatacaatagactagtaagaacagaagaattcagcgatgaagaactttcagggtttatagctaggcaattagttgaaacaagccaaagtgtcaaagcagtagctagcattttaggagaattgaatccagaaacatcgatttgttactctaaagcagaaaacgtgtcaagttttcgccaaaattttggaaagatcaaaaagggcgaccgagatagcaaaaataacgaccagttaatcaaagtacgcgaaatcaacgactatcaccatgctaaagacgcatatctgaatgtcgtagttggaaatgtttacgatacaaaattcacacgaaacgtatttaacttcattaaagacaaaaaagacgggagaaaatattcactgaataaggtattttatgaaaatgtcagtgactcaaaaacagttgcatgggagatggataaaacaattcaccaagtcgaaaaagttatgaacaacaataacataatggtaacacgtagaacatcagaacagaaaggaggattgttcgatgccacagtgtataaagctaaggtcgctgccaaagctaaagatggagtatactatcccttaaagacctcaaactcagtagtaaaagatgtagctaaatatggtggatatacaagcataggaatagcatactactcgatattcgaatataccatagtaaataaaaaaggagaagaaaaaataacaagaatcataccaatacccatatatatatcacaaaacataaaggactccaccgcactaatcgaattcggcaaatcacaaatattctgcagggcgtacgaaaaaatcaaagactttaaactcctatatagaaaactatgtataggaagcaaaataaatataaacaactatcaatattatataggaggaaaaagcgacgaacgtttctactacgattcagcaatccaagtaacccttgacaaaaaatccgaaaaatatttaaaaattctgtcaaagtatcaaaattggaaaaaagaaaacaaagatggcgaattatgggagaacataacaaaagaaaataatatagaactttacaataaattggtagaaaagatgaacagtgagattttcaccaaaaagaaaagcaataaatacaatgaactaaacagcgaagaaatacgaaacaatttcataaaaatatcggtagaagagcaagcgaaagtgctactagagatcttaaaccttcttacaaacaaaaaatccattttcgacttaaagtcaattgatataaaagcagcacgaggaaaaattagttttaatttaacaagcttgatacaattcagtatcatagaacaaagtataaccggattttatgaaaaagaaataactattattggagataaaggaaatgatatggaaaacaacaacagttga

SEQ ID NO: 9057 - RNA, 4179 nt, synthetic construct
  misc_feature 1..4179: note = Cas9 variant
  source 1..4179: mol_type = other RNA
atgaataataataactatagtataggactggacatagggacaaatagtgtaggttgggcggtcattactgacgattacaaagtaccctctaaaaaaatgaaggtattagggaacaccgacaaacactttattaaaaaaaacctaataggagcgctactatttgatgagggcacaacagccgaagatagacgacttaagcgcacagcaagaagaagatacacaagaagaaaaaatagacttcgctacttacaagaaatattttccccggagatctcaaaggtcgactctagtttttttcatcgattagacgactcttttctagtacccgaagacaaacgtggaagcaaatacccaattttcgccaccttagcagaagagaaagaatatcacaaaaattttccaaccatatatcacctaagaaaacaactcgcagattccaaggaaaaagccgacttaaggctaatatatttagcactagcccacatgatcaaatatagaggccacttcttatacgaagaaagcttcgacattaaaaacaatgatatacaaaaaatatttaatgaatttatttcaatatatgataacacatttgaaggaagcagcctaagtggtcaaaacgcccaggtggaagcaatattcacagataaaatctcaaaatccgccaaaagagaaagagttctcaaactatttcccgacgaaaaatcaactggtctattcagtgaatttttaaaactcatagtgggaaatcaagcagaatttaaaaaacatttcgaccttgaagaaaaagcaccactccaatttagcaaagatacctacgacgacgatctagaaaacctgttaggtcaaattggtgatggatttgccgaactattcgtagcagcaaaaaaactctatgacgcaatactattaagcggaatcctcaccgtcactgacccttcaaccaaagccccattaagcgcctcaatgatagaaaggtatgaaaaccaccaaaaagatctggctgcactgaaacaattcatccagaacaacctacaagaaaaatacgacgaagttttttcggaccaatccaaagacggatatgcaggatacattaacggaaaaaccacacaagaagcattttataaatatataaaaaatttactaagtaaatttgaaggttcagattattttctagacaaaatcgaacgtgaagatttcttaaaaaaacaacgcacatttgataatggatccatcccacatcaaatacaccttcaagaaatgaacgcaataatacggagacagggtgaacactacccattcctacaagagaataaggaaaagataaagaaaatattaacatttagaatcccatattatgtaggccctcttgcaagaggaaacggagatttcgcatggctaacaagaaacagtgaccaagcaatacgaccgtggaacttcgaggaaatagttgaccaagcatcttcagctgaagactttataaacaaaatgacaaactacgatctctatctaccagaagaaaaggtactaccaaaacactcactactatacgaaacatttgcagtatacaatgaactaacgaaagtaaaattcattgcagaaggactaagagactaccaatttttagatagtggacagaaaaaacagatagtcaatcagcttttcaaagaaaaaagaaaggtaactgaaaaagacattacacaatatttacacaatgtcgacggatacgacggtatagaactgaaaggaatagagaaacaatttaacgctagcctcagcacataccatgatttattgaaaattatcaaagataaagcatttatggacgatgcggaaaacgaggcaaccttagaaaacataattcacaccctcactattttcgaagatagagaaatgataaaacaacgattagcacaatatgactccctgttcgacgagaaagtcatcaaagctctcatccgaagacattacacaggttggggtaaacttagtgcgaaattaatcaacggaatttgcgataaaaaaaccggtaaaacaatattagactacttaatagatgacggctactcaaaccgtaatttcatgcaactaataaatgatgacggactctcatttaaagatattatccagaaagcacaagtggttggaagaaccaacgatgtgaagcaaatagtccatgaattaccagggtcaccagcaataaaaaaaggtatcctacaatccattaaaatcgtagatgaactagtaaagataatgggacacacacctgaatcaattgtaatcgaaatggccagagaaaatcaaacaactgcacgaggtaaaaaaaattcacaacaaagatataaaagaatagaagacgctctaaagaatttagcaccaggactagactcaaatatactaaaagagtacccaacagacaatatacaattacaaaacgatcgcttattcctctactacctacaaaatggcaaagatatgtacacaggagaaccattagatataaaccaactaagttcctacgacatcgaccacatagtacctcaagcctttataaaagatgactccctcgacaatcgagtactaaccagctcgaaagacaatagaggaaaaagcgacaacgtaccctcactagaggtcgttcaaaagagaaaagccttctggcagcaattgctcgattcaaaactaatatcagaaagaaaattcaacaatctgacaaaggcagaaagaggggggttggatgaaagggacaaagtcggcttcatacgccgacaactagtggaaacccgtcagatcacaaaacacgtagctcaaattttagacgcaagattcaatacagaagtaaccgaaaaagacaaaaagaatcgaaacgtaaaaataatcacgctaaaaagcaacttagtaagcaacttcagaaaagaattcaaactatacaaagtaagagaaataaatgattatcaccatgctcatgacgcatatctgaatgcagtagtagcaaaagcaatccttaaaaaatacccaaaactggaaccagaattcgtatacggtgattaccaaaaatacgatttaaaacgctacatatcaagatcaaaggacccaaaagatgttgaaaaagcaacggaaaaatatttcttttactccaatctactaaattttttcaaagaagaagtacactacgcggacggtacaatagttaaacgcgaaaacatagaatacagtaaagacaccggcgaaatagcttggaataaagaaaaagattttgctactataaaaaaagtattatcattaccacaagtcaatatagtaaaaaaaaccgagatacagacacatggcctagataggggtaaaccccgaggtctatttaatagcaacccttcaccaaaaccatcagaggatagtaaagaaaatcttgtgccaatcaaacaaggattagatccaaggaaatatggtggatatgccggtattagtaattcatacgcagtactagtcaaagcaataatagaaaaaggcgctaaaaagcaacaaaaaacagtactggaatttcaaggcatctccatacttgacaaaattaatttcgaaaaaaataaagaaaactatctattagaaaaaggatacataaaaatcttatcaactataacactaccaaaatatagcttatttgaattcccagatggtacacgccgacgactagcctcaatactgagtactaacaacaaaagaggagaaatccataaaggtaacgagctagtaatatcagaaaaatatacgacgctactttaccacgcaaaaaacataaacaaaacattagaacccgaacatcttgaatatgtagaaaaacatcgcaatgactttgccaaattacttgaatccgtcctagattttaacgataaatacgtaggcgctctgaagaacggagaacgaataagacaagcctttatagactgggaaaccgtagatatcgagaaactttgtttttccttcatcggacctagaaactccaaaaatgcaggacttttcgaactaacaagccaaggttcagcttctgattttgaattcctaggtgttaaaatccctaggtatcgtgactataccccctcatcattgttaaatgcaactctcatacaccagagtataaccggcttatatgaaacacgaattgatctaagtaaattaggagaagactga

SEQ ID NO: 9058 - RNA, 4179 nt, synthetic construct
  misc_feature 1..4179: note = Cas9 variant
  source 1..4179: mol_type = other RNA
atgaacaataacaattacagtataggtctagatataggaacaaacagtgttggttgggcagttataacagacgattataaagtaccgagcaagaaaatgaaagtattaggtaatacagataaacattttataaagaaaaacttgattggagctctactgtttgatgaaggcgcaacagcagaagatagaagattcaaaagaaccgcaagacgaaggtataccagacgcaaaaatagactacgatacctccaagagatcttcagtgaagaaatgagtaaagtagacagcagtttcttccaccgacttgacgatagcttcttagttcctgaagacaaaaggggtagtaaatacccaatattcgcaaccttagcagaagagaaagaataccacaagaaattcccaacaatatatcacttacgcaaacacctagctgactccaaagagaaaaccgatcttagattaatatatctcgcccttgcgcacatgataaaatacagaggacattttctatacgaagaatcattcgatatcaaaaataacgacatacagaaaatattctcggaatttatatcaatatacgacaacactttcgaaggatcctccctaagcggccaaaatgcacaagtagaagccatttttactgataaaatatcaaaaagcgcaaaaagagaaaggatactaaaactttttgcctatgaaaaatctactgacttattctctgaatttctgaaactcatagtaggaaaccaagcagactttaagaaacacttcgacttagaagaaaaagcaccattgcaattcagtaaagatacatacgacgaagacctagaaaatctcttgggccaaataggtgacgattttgcagatctatttttagtagccaagaaactatatgatgcaattttactgagcggaatattaacagtgacagattcaagcacaaaagcccctctatcagctagcatgatagaaaggtatgaaaatcaccaaaaagacctagcagcgctgaaacaattcatacaaaataacctgcaggaaaaatatgacgaagtattttccgaccaatccaaagacggctatgcccgttacataaatggaaaaactacacaagaggctttctacaaatacatcaaaaatttattgagcaaatttgaagggtcagactactttttagataaaattgaaagagaagacttcttacgcaaacaacgcacctttgacaacggaagcataccgcaccaaattcacttacaagaaatgaacgccataatcagaagacaaggagaacattatccattcttaaaagaatacaaagagaaaattgaaacaatattaacattcaggataccttactacgtaggcccactagctagaggaaaccgcaactttgcatggctaacacgaaattctgaccaagcaattagaccatggaatttcgaagaaatcgtagaccaagcatcgtccgcagaagaatttataaacaaaatgaccaactacgacttatacctgcccgaagaaaaagtattaccaaaacactcactattgtatgaaacattcgcagtatataacgaattaacaaaagtaaaatttattagcgaaggactacgagattatcagtttttagattctggacaaaagaagcaaattgtaaatcaattattcaaagagaaaaggaaagtgacagaaaaagacataatccaatacttacacaatgtagacggatacgatggtatagaattgaaaggaatagaaaaacaatttaatgccagtttgtcaacttaccacgacctattaaaaattattaaagataaagagttcatggacgatcccaaaaacgaagaaatattagaaaacattgtacatacactgacaatatttgaagacagagaaatgatcaaacaacgacttgcccagtacgcatcaatatttgacaagaaagtcataaaagctcttacacgaagacactacacaggttggggtaaactctcagcaaaattaataaacggcatttgcgataagaaaaccggaaaaactatcttagattacctcatagatgatggttacagcaatagaaatttcatgcaactaataaacgacgatggactatcattcaaagacataattcaaaaagctcaagtggtaggaaaaacaaatgatgtaaaacaagtagtacaagaactgccaggaagtccagcaataaagaaaggaatactacaatcaataaaattagtagatgagctagtaaaagttatgggacacgcacctgaatccatcgtcatagaaatagccagagaaaaccaaacaaccgcgagaggcaagaaaaattctcaacagcgatataaaagaatagaagacgctcttaaaaacctagcaccaggattagactcaaatattctaaaagaacacccaacagataatattcaattacaaaacgacaggctatttctttactatctacaaaatggcaaagatatgtataccggcgaagcgcttgacatcaaccaacttagttcttatgacatagatcatatagtaccacaggcattcataaaagacgactctttagacaatcgagttctgacgtccagtaaagacaacagaggcaaaagtgacaacgtaccatctttagaagtcgtacaaaaacgtaaagcattctggcaacaactacttgactcaaaactcatatcagaacataaatttaacaatttaaccaaagccgaaagaggaggcctcgacgaacgagataaagtaggattcattaggcgccagctagttgaaactagacaaataactaaacacgttgcacaaatattagatgcacgattcaatactgaagtgaatgaaaaagacaagaaaaacaggaccgtaaaaatcataacccttaaatctaatctagttagtaacttcagaaaagaatttaaactatacaaagtaagagaaataaacgattaccatcacgcccacgacgcatacctcaatgctgtagtcgccaaagcaatactcaagaaatacccgaaattagaaccagaatttgtatatggtgattaccaaaaatacgatattaaaaggtatatatcaagatcaaaagatcccaaagaagtagaaaaagcaacagaaaaatacttcttttactcaaacctcttaaacttctttaaagaagaggtccactacgcggacggcacaatagtcaaaagagaaaacatagaatacagcaaagatacgggcgaaatagcatggaacaaagaaaaagattttgcaactatcaagaaagtcttatctctgccacaagtcaacatcgtcaagaaaacagaaatacaaacacatggtttggatcgaggaaaacccagaggcctcttcaatagcaacccaagcccgaaaccttcagaagaccgcaaagaaaacttggtcccaattaaacaaggcctagacccaagaaaatatgggggatatgccggcatatcgaactcctacgcagtcttagtaaaagcaattatagaaaaaggagctaagaaacaacaaaagacagttctggaatttcaaggaatatcgatattagacaaaatcaatttcgagaaaaacaaagaaaactatctactggaaaaagggtacatcaaaatattatctactatcacactaccaaaatactccctattcgagttcccagatggaacaagacgaagactcgcatctatcttaagcaccaacaataaaagaggtgaaattcataaaggaaacgaacttgtaattccagaaaaatatacaactctattatatcatgccaaaaacataaataaaacgctcgaacctgaacacctcgagtatgttgaaaaacatcgaaatgactttgctaaattgcttgaatacgtactaaacttcaacgacaaatatgtaggcgcacttaaaaacggagagaggataagacaagcattcatagattgggaaaccgtcgacatagaaaaactttgtttcagctttataggaccgagaaacagcaaaaacgcaggattattcgaattaacctcgcaaggatctgcctcagattttgaatttctaggtgtaaaaatcccacgataccgtgattacaccccatcctcattattaaacgcaactctaatacaccaaagcattacaggactatacgaaacccgaatcgatttatcaaagctaggagaggactga

SEQ ID NO: 9059 - RNA, 4182 nt, synthetic construct
  misc_feature 1..4182: note = Cas9 variant
  source 1..4182: mol_type = other RNA
atgaaaagagtaacagaggactatatcctaggattggacataggcaccaattcatgtggttgggctgttacagacaagaaaaataatttgttgaagctacgaggaaagaccgcaattggatcacatttatttgaagaaggacacactgccgcagataggagaggattccgtactacaagaagaagactaaaaagaagaaaatggagacttcgcctactagaagaaatcttcgctgaaccaatggcaaaagtagaccctggattttttgttagattacaccaatcttgggtaagccctttagataagagccggaaaaaataccatgcaattgtattccctactgccaaagaagataaagcattctaccaaaagtacccaacgatttaccatctacgagatgcattgatgacacaagatcggcaattcgacttacgcgaaattttcttagcaatacatcacatagttaaatttcgaggaaattttctacaagatacaccagtaaaagacttcgaagcaagtaaaatcgaagtaggacctatactatcgaaaataaacggggcattcgcagaaaaaatagtagaagatcaagacccaatagaattgaatgtagccaacgccgcagaaatagaagcagtcataaggggcaaagatgccgacaaaactctgtacaaaatggataaagttaaaaaaatagcaaaattactcacagactcaacggctaaggaagaaaaaaatgttgccaaacaaatagcaaatgccgtgatgggatacaaaactcaattcgaaaccatccttggtaaagaaatagacaaaagcgacaaagcccaatgggaattcaaactaacagatggagacgcagatgacaaactcgaagcactcttaccggaccttgatgaaaacgaccagaccataatcgcagagatcaaaaagctattctcagcaataacattatcaacaatagtcgacgaaaacaaatctttatcccaatccatggtagctaagtacaacaaacatcatcaagattataaattactaaaagcgtacatcgacactttacaagataggtccatcgcgaagaaactactcctagcgtacgatctctatgtaaataataggcatggaaggctgttagaagcgaaaacagaattcaaacaagatggtacgttaacaaaagaagatttctacaaaaccgtaaaagacaatttagatgactcagaattagctagaaaaatagcccaaaaaattgccgcagacaattttatgccaaaacagagaacaaatagtaacggagtaattccctttcaactgcaccaaatcgaattagacaaaattatagcaaatcaaagcaaatactacccattcttagccgcggaaaaccccgtagaagaccaccgaaaacaagcaccatataaactagacgaactagtgcgctttcgggtaccatattatgtaggtcccatgatcacacctgatgaacaagaaaaaacttcagggaaatccttcgcatggatggtacgcaaagaagacggccaaattaccccatggaactttgaacagaaagtagacagacaggaaagtgctaataaatttattaaaagaatgacaataaaagacacttatctactaggagaagacgtattaccggctaattctttattataccaaaggttcgaagtcttaaacgaattaaacaacatacgtattaatggatcacgtatctcaatcgacctcaaacagcaaatatttaatgatctattcgaagaaaagaaaaccgtgacagaaaaaagtctaacatcctacctaaaacaaaacctgcacttaccaacagtagaaataaaagggttggcagatccaacaaagttcaacagttcactagcatcctattaccatttaaaatcgttacatgtatttgacaaagaactagcagatccgcagtaccagaaagatttcgaaaaaatcatagaatacagctctatattcgaagataaaaaaatttaccaagacaaattgcacgctgaattcaaatggctaacacccgaacaatttaaagctataagcacctggaggcttcaaggttggggaagacttagctgccgtttactcgttgaactccacgataccaatgggcaaaatattatggagcaactctgggactcacaaaaaaacttcatgcaaatagtaacagaaccggacttcaaagatgctatcgcaaaagaaaatcaaaacgtaacccaagtgaatggtgtagaagaaatattagccgatgcctacacaagtccagcaaacaaaaaagcaatcaggcaagtagtaaaagttgtcgcagacgtagtaaaagcagccggaggtaaaaaacccgcgcaatttgctatagaattcacacgagacccagacaaaaacccacaactatcccatatccggggaacgaagctattaaaagcatatcaagaaactgcaggcgaactagtcgaccaaaaactgacagacagtctcaaagaagcaatgaccagcagaaaactactaaaagataaatactttctatactttatgcaaactggtagggatgcatatacaggcaaaaaaatcaatatagatgaagttacaaccaattatcaaatagaccacatattaccacagtcatttatcaaagacgattcattcgacaacagagttcttacggcaacccccctcaacgctgaaaaatcagacgatgttccctacaaacggttcgccaacaattacgtgtcagatcttaaaatgactgtaggtgagatgtggaaacattggcaaaaggcaggaatcataaataaacacaaattaggtaacttattattagaccccgaccgacttaataaattccaaaaaagtggctttataaacaggcaacttgtagaaacctcccaaatagtcaaactagtatctgtaatactacaaaacaaataccccgatgccgaaataatcacagtgaaagccggagacaactcagctttacgacagagactcaacctttataaaagcagagacgtaaacgattaccatcacgccatagatgcatatctatcgatcatctgcggaaactttttatatcaagtatacccgaaatatagaccatacttcgtttatggaaaatataaaaaattttcacaagaccctgacttgcaaaaagatttaataaaacactttaaaggatttacatttatgtggcccctcctacaaaaagacaactcggaaagaaaagctcctgaagaaataaaagaaaacaactcagaacgtatcgttttttataaacaccccgatatattcgataaactacgaaaagcatataattacaaatacatgttagtaagtagagaaaccacaacagaatcatcatcaatgttcaaaatgacaatcttcccgagaggagaaagagatcggaaaaaaacaagaaaattaatcccgaaaggaaatggcttagatccaaaaatttacggaggttattcaggtaatactgacgcatatatggtcattgtaaaaatagacaaagcaaaagagtcaatatataaagttatcggagttcccatgagagccttaactcgtctaaaccaggcaaagaaacaagggaattaccaagaagaactacaccaagttttagaaccccaaatcatgttagacaaaaatggaaaacccaaacgcggcgtaaaaggttttcgtgtgataaaggaccatgtaccatttaaacaagtcgtacttgatggagataaaaaatttatgctgtactcagctcaatacaaaacaaacgcaaaacaactagcactcagtcaagaaacaatgcgaatagtaactgacaatctaaaaaaaggtgaagatcaagacaaactactagtcaaagcatacgatgaaatactacaaaaagtggactgttatctatcgttatttgacacatcaaactttcgcaatggactacatctaggccgtaacaaattcattgacttagaagtcaacgataaaaaaataacactatcgaatatactaaacggactacatgacaatatggttttaggaaatttaaaaaacatagggattggcacacctctaggtcaaatgcaggaaaaatcaggcatcactttaagcccagaagcagttttaatatttcaatcacccactggattattcgagaaacgcgtcaaaatcgccgatctatga

SEQ ID NO: 9060 - RNA, 4188 nt, synthetic construct
  misc_feature 1..4188: note = Cas9 variant
  source 1..4188: mol_type = other RNA
atgaagaaagaaattaaagactattttctaggattagacgttggaacaggttctgtaggatgggctgtcaccgataccgattacaaattgcttaaagcaaaccgtaaagacctatggggaatgcgatgcttcgaaacagcagaaactgcagaagtacgacggctacaccgtggagctcgccgccgaatagaaagaagaaagaaacgaataaaactattacaagaactattttcccaagaaatcgcaaaaattgacgaaggattctttcaacgaatgaaagaatccccattctacgccgaagacaaaacaatcttacaagaaaatgctctattcaatgataaagacttcacagataaaacataccacaaagcgtacccgacaataaaccatttaattaaagcctggattgaaaacaaagtaaaaccagatcctcggttgttatatttagcctgccacaacatcatcaagaaacgaggacacttcctattcgaaggagacttcgacagcgaaaatcaatttgatacatccatacaagctcttttcgaatacctacgagaagacatggaagtagacatagacgccgactcacaaaaagtaaaagaaatcctgaaagatagttcactcaaaaacagtgaaaaacaatctagacttaacaaaattcttggactcaaaccttcggacaaacagaagaaagctatcacaaaccttatatcgggaaataaaattaatttcgcagacctatacgacaacccagatttaaaagatgcggagaaaaacagcatctccttctcaaaagatgactttgatgccctatctgacgacctagcgtcaatcctaggagactcattcgaattattgctaaaagccaaagctgtgtacaactgctcggtactgagcaaagttataggagacgaacaatacctcagctttgcgaaagtaaaaatatatgaaaaacataaaaccgatctaacaaaactaaaagctgtcatcaagaaacacttccccaacaactacaagaaagtattcggttataaccaagataatgaaagtaaaaataactacagcggatatgttggtgtttgcaaaaccaaaaacaagaagctagtcataaataatagcgtcaaccaagaagatttctacaaattcttaaaaccaatcctctcggccaaaagtgaaatcaaagaagtcaatgacatattagccgaaatagaaactggtaacttcctcccaaaacaaatttccaaatctaacgccgaaataccttatcaactacgaaaaatggaactagagaaaatattatcgaatgcagaaaaacacttttcattcttaaaacaaaaagacgaaaaaggcctcagccattcagagaaaatcattatgctactgacattcaaaatcccatattatatcggtccaatcaacgacaatcacaagaaatctttccctgatcgatgctgggtagttaagaaagaaaaatcaccaagcggcaaaaccacaccctggaacttctttgaccacatcgacaaagagaaaaccgcggaagagttcataacttcacgtacgaacttttgcacatacctaatcggtgaaagcgtattacccaaaaattcactcttatacagtgaatatactgtgctgaacgaaataaataatttacaaatcataatcgatggcaaaaacatctgtgatacaaaactaaaacagaaaatatatgaagatttgttcaagaaatacaagaaaataacacaaaaacaaatttcaaccttcataaaacatgaaggaatctgtaataaaacagacgaagtcataatactcggaatagacaaagaatgtacatcgtcgttaaaatcctacatcgaactcaagaacatttttggtaaacaagtcgacgaaatatctacgaaaaatatgctagaagaaatcatccgatgggccactatctatgacgaaggcgaaggaaaaaccatactgaaaacgaaaatcaaagctgaatacggaaaatactgcagtgacgaacaaatcaagaaaatactgaacctgaaattctcaggatggggaagactttcaagaaaattccttgaaactgtaacaagcgaaatgccaggcttctccgaacccgtaaacataataacagcaatgcgcgaaacacaaaacaatctaatggaattactaagttctgagttcaaattcacagaaaacatcaagaaaataaactcaggattcgaggatgcagaaaaacaatttagctatgacggtctggtaaaacccttattcctaagtccatcagtaaagaaaatgttatggcaaacactaaagttggtaaaagaaatatcacatatcactcaagcacctcccaagaaaatattcatagaaatggcaaaaggtgctgaacttgagccagcaagaacaaaaacaagattaaaaattctacaagacctatacagctcttgcaaaaacgatgcggacgcattctcatccgagattcaatacctatccgggaaaatagaaaatgaagacaacttacgactaagatcagacaaactatacctctactacacacaattaggtaaatgtatgtactgcggaaaaccaattgaaataggtcacgtttttgacacatctaactacgatatagatcacatttatccacaaagcaaaatcaaagatgactcgatatcaaacagagttctagtatgttcctcgtgcaacaaaaacaaagaagataaatatcctctaaaaagtgaaatccaaagcaaacagaggggattctggaactttctacagagaaataatttcataagtttagaaaaactaaatagattaacaagaaccacacccatctcagatgacgaaacagcaaaattcattgctagacaattagtagaaacacgtcaagcaacgaaagtagccgcaaaagttctagagaaaatgttcccagaaacgaaaatcgtatactccaaagccgaaacagtgtcaatgtttagaaataagttcgacataataaagtgccgagagatcaacgatttccaccatgctcatgacgcatacttaaatatcgtcgtcggaaacgtttacaacacaaaattcacaaacaacccttggaactttataaaagagaaacgggacaaccctaaaatagcagacacatacaactactacaaagtatttgactatgacgtcaaacgtaataatataacggcttgggaaaaaggcaaaactatcataactgtaaaagatatgcttaaaagaaacaccccaatttatacccgacaggcagcatgcaagaaaggtggactatttgaccaaacaattatgaagaaaggcctcggacaacacccgctaaagaaagaaggaccattctccaatatatcaaaatacggtggctacaataaagtatcagcagcatattataccttaatcgaatatgaggaaaaaggaaataaaatacgatcattagaaaccatccccttatatctagtcaaagatatacaaaaagaccaagacgttctaaaatcttatttaactgaccttctgggcaagaaagaatttaaaatattagtgccaaaaattaaaataaattccttacttaaaataaatggcttcccatgccacataacaggaaaaacaaatgattcttttcttcttcgacccgccgtgcaattttgttgctcaaacgacgaagtattatactttaagaaaataataagattttcagaaataagatcccaaagggagaaaataggcaaaacaatttctccctacgaagatctatcatttcgctcatacatcaaagaaaacttatgtaagaaaacaaagaatgatgaaatcggagaaaaagaattttatgacttactacagaagaaaaacctcgaaatatacgacatgctactcaccaaacacaaagacaccatttacaagaaaagacccaattccgcaaccatagatatcctagttaaaggcaaagaaaaattcaaatcactaatcatagaaaaccaatttgaagtcattttagaaatactaaaactattctcggcaaccagaaatgtcagtgaactacaacacattggtggatcaaaatattctggcgtagcaaaaattggtaataagatatcgtcacttgacaactgcatattaatctaccaatccataacaggaattttcgaaaaacgtatcgatcttctcaaagtctga

SEQ ID NO: 9061 - RNA, 4188 nt, synthetic construct
  misc_feature 1..4188: note = Cas9 variant
  source 1..4188: mol_type = other RNA
atgaaaaaagaaataaaagattattttctcgggttagatgtaggaacagggtccgtaggctgggcagttacagacacagactacaaactactaaaagcaaatagaaaagacttatggggaatgcggtgcttcgaaacagctgagaccgcggaggtacgaagactacaccgaggagcgagaaggcgtattgaaaggagaaagaaaagaattaaactgctacaggaactattttcacaagaaatcgcgaaaatagatgaaggattcttccaaagaatgaaagaaagtcccttttatgcagaagataaaactatacttcaagagaacactctctttaatgataaagactttacagataaaacataccacaaagcatacccaacgatcaaccacttaataaaagcatggatagaaaacaaagttaagccagatccccgtctcttatatctagcatgtcataatattataaaaaaaagaggacattttttattcgaaggtgattttgacagtgaaaatcaatttgacacatcaatccaagcactatttgaatacctcagagaagacatggaagtagacattgacgcagattcacaaaaagtcaaagaaatattaaaagactcaagcttaaagaactcggagaaacaatcaaggttaaataaaatattaggccttaaaccttctgacaaacaaaaaaaagcaattactaatttaatatccggcaacaaaattaactttgcagacctatatgataatcccgatttaaaggacgctgaaaaaaactctatatcattctcaaaagatgatttcgacgcattatctgacgacctagcatcaatactaggcgattccttcgaactcttattaaaagcgaaagcagtatacaactgctccgtgctttcgaaagtaattggggatgaacaatatttaagctttgccaaggtaaaaatatacgaaaaacataaaacggatcttacaaagttaaaaaatgttataaaaaaacacttccctaaagattataaaaaagtattcggatacaacaaaaatgaaaaaaacaacaataattattctggatacgttggagtctgtaaaacgaaatcaaaaaaacttataataaataactctgtaaatcaagaggacttttataaatttttaaaaaccatactaagtgcaaaatccgaaataaaagaagtcaacgacatattaacagagatcgaaaccggcacattcttaccaaaacaaattagtaaatcaaacgcagaaatcccctatcaattacgtaaaatggaattagaaaaaatattaagcaacgccgagaagcacttttcgtttctaaaacaaaaagacgagaaaggtttatcacactctgaaaaaataataatgttactaacatttaaaattccctactacataggcccaataaatgacaatcacaaaaaatccttcccagaccgctgttgggtcatcaaaaaagaaaaatcaccatcaggaaaaaccaccccttggaacttttttgatcatattgacaaggacaaaacagccgaagcatttatcacttcccgaacgaatttttgcacatatctagtcggggagagtgtacttccaaagagttcactactatactcagaatacacagttttaaacgaaattaacaacctgcaaattatcatcgacggcaaaaacatctgcgatatcaaactaaaacaaaaaatatacgaagagctattcaaaaaatacaaaaagataacccaaaaacaaatctccacatttataaaacatgaaggaatatgtaataaaacagacgaagtaataatattagggattgacaaagaatgcacaagtagcctaaaaagctacatcgagttaaagaatattttcggtaaacaagtcgacgaaataagtacaaaaaacatgcttgaagaaataataagatgggcaacaatatatgatgaaggagaaggaaaaacgattctaaaaactaaaattaaagctgaatacggaaaatactgcagtgatgaacaaatcaaaaaaatacttaacttaaaattttctggttggggacgactgagcagaaagttcttagaaacggtaactagtgagatgccaggattctctgaacctgttaacataataacggctatgcgagaaacccaaaacaacttaatggaactactcagctcagagtttaaatttacggaaaatataaaaaaaatcaattctggattcgaagatgcagaaaaacaattttcatacaacggactcgtgaaaccattatttttgagcccaagcgttaaaaaaatgctctggcaaaccctaaaattagtaaaagaaatatcacacattacacaggctccacctaaaaagatatttatagaaatggcaaaaggtgcagaactagagcctgccagaacgaaaactcgattaaagatactacaagatctatacaataattgcaaaaatgatgcagacgcttttagttcagaaatcaaagacctaagcggtaaaatagaaaacgaagataacttaagattgcgttcagacaaactgtatctatactatacacaattaggaaaatgtatgtattgtggaaaacctattgaaataggtcacgtattcgacacaagcaactacgatatagatcatatatacccacaatcaaaaataaaagatgatagtatcagtaacagagtactggtatgtagcagttgcaacaaaaataaagaagacaaatacccattaaaatcagaaatacaatcaaaacaaagaggcttctggaatttcttacaaagaaacaactttatttcgctcgaaaaattaaataggttaaccagaacaacaccaattagcgacgatgaaacagcgaaatttatagcacgacaactcgtggaaacccgtcaagcaacaaaggtagcagcaaaagtattagaaaaaatgtttcctgaaacgaagatcgtatacagtaaagctgaaacagtatcaatgtttagaaataagttcgacatcatcaaatgtagagaaataaacgatttccaccacgcacatgacgcctacttaaacatcgtcgtcggaaatgtttataacacaaaatttacaaataacccatggaactttataaaagaaaaaagggacaaccctaagatagcggacacatacaactactacaaagtcttcgattacgatgtaaaacgaaacaacataacagcttgggaaaaaggtaagactattataaccgtcaaagatatgctaaaacgcaacacacccatttatacccggcaagcagcctgtaaaaaaggcggattatttgaccaaacgatcatgaagaaaggactaggacaacacccgctcaaaaaagaaggggcttttagcaatatatcaaaatacggaggttacaacaaggtaagcgccgcttattatacgctaatcgagtacgaagaaaaagggaacaaaattcgcagcctggagacaatcccgctctatctcgtcaaagacatacagaaagaccaagacgtactaaaatcttacctaacagatctcctcggtaaaaaggaaattaaaatattagtacctaaaataaaaataaactcactattaaaaataaacggtttcccatgtcacattacaggcaagacaggagacagcttcgtacttcgacctgcagtacagttctgctgtagcaacgatgaggtactatacttcaaaaaaataatcagattcaatgaaataagaagtcaacgagaaaaaatgggaaaaactataagcccatacgaagaccttagttttagaagctatataaaagaaaacctatgcaagaaaacaaaagcagatgaaataggcgaaaaagaattctatgacctcttgcaaaaaaaaaatctggaaatatacgacatgctactgaccaaacacaaagatacaatatacaataaacgaccaaactcaaccaccttaggtatgttaacaaaaggccgttacgaattcataaatctaaaaccaaaagaccaaataattgtaatgctagaaatattaaaactgttctgcacaacacgagaagctatagatctcggattgataaaaggcaaaccagcagcaggcgtagcaaccttaggtaaaaagataagcaatcctgataactgcatcttaatataccaatcaatcacgggaatatttgaaaaacgaatcgatctattaaaagtatga

SEQ ID NO: 9062 - RNA, 4188 nt, synthetic construct
  misc_feature 1..4188: note = Cas9 variant
  source 1..4188: mol_type = other RNA
atgggagataccgtaaaaaactaccacatagggctcgatataggaacatcttcagtagggttcgcagctagagacgatgacaacaacttaatcagagtaaaaggaaagaacgtcatcggtacccgactattctctgaaggacaaaccgctcaagaaaggcgaatggcaagagcttcacggagacgctacaaccggagaaaatggagattaagattattagacgagatattccatgacgaaataattcataaagacgcggaattttttaatagacttaaacaatcatccttatcacctaaagatgaaagaaaacagtactttggatctctactattccccgaagtcggtgactcagaatattatcatgacggtaatcaaacaatttatcatttaagacaccgtttaatgacgcaagacgaaaaagcggatattcgagaaatatacctagcacttagacacatcatcaaatacagaggcaatttcctagacgatacgcccgtatcatcctttgaagctagtgacttaaaactagcgtccttcgtcccaacacttaacgatctctttgaaaccatcgacgttaactacgagttcagtatggacaatataaacgaaatagaagacatactactaaataataaactacgtaattccgataaatcgaaacaacttccggacttgctaactgaaccaattgtcaacattgacgataaatcattagaaaaacaattcaacaaagaacgaacagatatatccaaggagatcgcaaaatcagtcgtcggaagcaaaatgaatgtaaacaaattactaagctttgaatcatcaggaggctacaaaatcgccttctctttctctgatgcgtcatcagaagataaaatgatggagctatctgacgtgctggatgactccagaatgaacatattaaacatattgaaggttatctacagtagagtccgactgaaccaaataatcccatccggaatgggcttatcagaatctatggttgctgcgtatgatttacacaaacaacaattaaaagacctgaaaaagcttttaaacgttctgccttttaatgagcgttacgcggtaaaaatcgcatacgccgcatatataggtaatatcgataaacaaaaatttaccaaatctgaagtaaagacaatagacaaactcaaagagaaatccgcaattatgaatgtactcgactttaaaagtggacatatcacaaatgaagagctttcaaatgtaattaaagtcgttattgtagacaagtacttgaatgatgaaaactttgaataccacagcatagttgaaaaaataaatcaagacatatctaatggctcataccttctaaaacaaagaaataatcaaaacggaaatatcccacatcaacttcatcaaatggagctcgaccaaattattgaaaaccaatcaaaatattacccctttttaggagaactcaaccccaattcaaacagaaatcatatagcaaaatataaaatcagtgaactagtcgccttcagagtaccctactatgtaggcccattaattacaccagaagaacaagaaaaaactagcggagccagtttcgcctggatgaagagaaaagaagatggcgcaataacaccctggaactttgaagaaaaagtagacaaagaagaaacagcaagccgattcataaaacgattaacagttaaagatacatacctgctcaacgaagacgtcttacccgacaattcactcctatacgaaaaattcaaagtactcaacgaactaaacgtagtaaaagccaataacaaacgattaacagtcgaggaaaaacaaggcgcattcgataatctattcaaaaaaatgaaaaccgtaactgcaaaaaaactaaaaaactatttggtcagtaatcacaaccacataaacagtgtagaaataactggattatccgacgtagacaaattcaacaattcactaagtacttacattgactttaagaaaatcttcgatgataaaatagataatccagacttattagatgattttgaagatataatagagtggtcaacagtattcgaagatagaaagattttcgaagaaaaggtacgaaaagatatatcttggatatcagaatcagaaataaaagcagtagtatcaaaaagatattccggatggggaagactatcaaaaaaactattaaacggaataacaaataacgaaggaagaaacataatagacgaactgtgggaagaatcagaaacctttatggaagcagtaagtaaacccgaagttaaggaacaaatagacggaatcaattcagactttataaaaaacacggatattgaaagtgtattagcagatgcatatacttctccgcaaaacaaaaaagcaatcagagaaacccacaaacttgtaaaagacatacaaaaagctatgggtggacaagcacccgccagcatctcgattgaatttaccaggaatccccaagataaaggacaactcacaagatcacgacattcagaagtatcaaggaaatataaagaaatatcaaaagaagtttcaaaaaccctcaatgatgaattgaaaagcaaaaaaaacagcatggacgtggataaatattacttatacttcatgcaaatgggaatcgacctatacgacggctcgtcgatagacatagacgatcttaacaactatcaaattgaccatataattccccaaagtttctataaagacgatagttttgacaatagagtactaactcactactccaacaaccagaaaaagggaaataacacacccctcaacggtctaaatatcgacgataagacaagagccatatggaatcatttgcgagacttaggtcttataacaaaaaaaaaatataacggactgaccctgaaaggtatggatcaactatctaaatatacgaaacacggcttcatacgaagacaactagttgaaacctcacaggtaataaaactagtcgccaacatcctatctgatgaattttcaaccgatgatacaaaaataatcgaagtaaaagctaaaatgaacagccaaataagacaagtgtttaacttatataaagttagagaattaaacgattaccatcatgccgtagatgcatatctaacaacattcataggaggatacctatataatcggtatccaaacctaagaaatatgtttgtatacggagacttcaagaaattctcagcagatgtcgacaacctcaaaactttcaacttcctacacgacattacaaacccgtctgataaatttgaagatcgcatattcgatgaaaaaagtggagaactaatattagaccgaaaacatgcgatagaaacaattaaaaaaatataccaatacaaatacatgttaataactcgagaggttagcacgaaaaatggacaactctcagaccaaacagtttattcagccaaaagaataaacaatgttaaagcacccatacccgtcaaaaaagactcaaatcctgaattatatggattcagaaccggaaatgtagaccaccacatggtaatcgtcaaatatccaaaaaaagacagctatgactataaagttgtaggaatccctctgcgatttgtccaaaaattaaaagaaacaaaagacaacaaagactacgaaaacctgctaaaccaaatagtacagatgaaactaaacagaaaaaaacaagacttcattgttgtagtagataatgtcatgtatggccaattaatccaagatggaggcgaaaaatatactctaggctcgagcacctataaatacaacgcaaaacaactagtaataaatatggacaaaacacgaatattagaagacaaccggtacttaaattctttagatgaaggagaagtaagtgaaaaattagttaacatatataacgacataatgaaagtagttaactcccgatttgacctattcgacatcaataaatttagagaaaaactgaatgacggtctaaataaatttaaaaacattagtaacgagcaaaaagaagaaactctccttaaaatactatcaggtctacattgtggtagtgcaaatgtgcctatcaaggaattaggcctcactacaccactaggcaaactacaattacccagtgggatcgtactttcagaagaagccgtagtaatctaccaatcaccttctggactattcgaaaacaaagtgaggttaaaagatctatga

SEQ ID NO: 9063 - RNA, 4188 nt, synthetic construct
  misc_feature 1..4188: note = Cas9 variant
  source 1..4188: mol_type = other RNA
atgaagaaagaaatcaaagattactttttggggctagatgtaggaacaggaagtgttggatgggctgtaacagatacagattataaactacttaaagctaataggaaagacttatggggaatgcgatgttttgaaacagccgaaactgctgaagttagaagactacatagaggagctagaagacgcatagaacgaagaaagaaaagaatcaaattgctacaagaactatttagtcaagaaatcgcaaaaaccgacgaaggattctttcaacgaatgaaagaatctcccttctatgcagaagataaaactatacttcaagaaaatacattatttaatgataaagatttcgccgacaaaacttatcataaagcatatcctacaataaatcatctaatcaaagcgtggatagaaaacaaagtaaaaccagatccccgattactatacctagcttgccacaacattatcaagaaaagagggcactttttatttgaaggagacttcgacagtgaaaatcaattcgataccagtatccaagcattgtttgaatatctacgagaagacatggaagtagatatcgatgctgacagtcaaaaagttaaagaaatcctaaaagattctagtctgaaaaattcagaaaaacaaagcagactaaataaaattctaggactaaaaccatcagataaacagaagaaagcaattacaaacctaatatccggaaataaaataaacttcgcagatttgtacgacaaccctgatcttaaagatgcagaaaagaactccatctctttttccaaagacgatttcgatgcactatcagatgaccttgcatcaatattaggagactcttttgaacttctgctaaaagcaaaagcagtatacaattgcagcgttctaagtaaagtaatcggagatgaacagtatctatctttcgcaaaagtaaaaatatacgaaaaacataaaactgacctaacgaaactcaaaaatgttatcaagaaacactttcccaaagattataagaaagtcttcggatacaataaaaatgagaaaaataataataattactcaggttatgtaggcgtatgcaaaactaaatcaaagaaactcataataaataactctgtaaaccaagaagacttttacaaattcctaaaaactatcctctcagctaaatcagaaataaaagaagtaaacgatatcctcacagaaatagaaacaggaacatttctaccaaaacaaatcagcaaatctaacgcagagataccataccagctacgtaaaatggaactagagaaaattctaagtaatgcagaaaaacacttcagctttttaaaacaaaaagatgaaaaaggactttcacacagcgagaaaatcataatgctccttacatttaaaataccatactacataggccctataaatgacaatcacaaaaagtttttccccgatagatgctgggtagtcaagaaagaaaaatcacccagcggtaaaacaacaccctggaacttctttgatcacatagacaaagagaaaaccgctgaagcatttataacttcacgcacaaacttttgtacctatttagtgggcgaaagcgtcctcccaaaaagttcactactatacagtgaatataccgtcttaaatgaaataaacaacctacaaattattatagacggtaaaaatatatgcgacatcaaactcaaacagaaaatatatgaagacttatttaagaaatacaagaaaattacacaaaaacaaattagcacctttatcaaacatgaaggaatatgcaacaaaacagatgaggtcattattttaggcatagataaagaatgtacctccagtctcaaatcatacatagaactcaaaaatatatttggaaaacaagtagacgaaataagtaccaaaaacatgctagaagaaataatacgatgggcaacaatatacgacgaaggagaaggcaaaacaatactaaaaacaaaaatcaaagctgaatacggcaaatattgcagcgatgaacaaatcaagaaaatattaaatttaaaattttccggctggggcagactatcacgtaaattcctggaaacagtaacaagcgaaatgcccggattcagcgaaccagtcaacataattacagccatgcgcgaaacccaaaataaccttatggagttactttctagcgaatttacatttacagaaaatatcaagaaaataaactcaggatttgaagacgctgagaaacaatttagctatgatggcctagtaaaaccattattcctatcaccctcagtaaagaaaatgctatggcaaacacttaaattagtcaaagaaataagccatatcacccaagcaccacccaagaaaatattcattgaaatggctaaaggcgcagaactcgaaccagccagaacaaaaacacgactcaagatattacaagacctatacaacaactgtaaaaatgatgcagatgcattctcatcagaaataaaagacttatcaggaaaaatagaaaacgaagacaaccttagacttagatcagacaaattatatttatactacacacaacttggaaaatgcatgtattgtggtaaaccaatagaaataggccacgtatttgacacaagtaattatgatatagatcacatatacccacaatctaaaattaaagacgacagtataagcaacagagtactcgtatgttcatcttgcaacaaaaacaaagaagataaatatcccttaaaatcagaaatccagagcaaacaaagaggtttctggaactttctgcaaaggaacaatttcataagcctagagaaattaaatagattaacacgtgccacgccaatttcagatgacgaaacagcaaaattcatagctcgacaactcgttgaaactcgacaagcaacaaaagtagccgccaaagtattagagaaaatgttcccagaaacaaaaatagtatactcaaaggcagaaactgttagcatgtttagaaataaattcgacatagttaaatgccgagaaatcaacgatttccaccatgctcatgacgcatatctgaacatagtggtcggaaatgtatataatacaaaattcacaaacaacccgtggaactttataaaggaaaaacgcgataatccaaaaatagcagacacatataattattacaaagtattcgattacgacgtcaagagaaacaacataaccgcctgggaaaaaggaaaaactataattacggtaaaagacatgttaaaacgaaacacacccatttataccagacaagccgcctgcaaaaagggagaactctttaaccaaactattatgaagaaaggactaggacaacaccccctcaagaaagaaggtcccttttccaatatctccaaatatggtggctacaataaagtcagtgcagcatactatacactgatagaatacgaagaaaaaggaaataagatcagaagtcttgaaaccatacccttatatctcgttaaagacatacaaaaagaccaagatgtactgaaatcctacctaacagatctattgggcaagaaagaatttaaaatattagtacctaaaataaaaataaacagcctccttaaaataaacggattcccctgccatattacaggaaaaacaaatgatagttttctactacgcccagcagtccaattctgctgttccaacaacgaagttctttattttaagaaaataatacgatttagtgaaatacgttcacagagagagaaaataggaaaaaccataagcccatacgaagatttgtcattccgatcatatataaaagaaaatctttggaagaaaaccaaaaacgatgaaatcggtgaaaaagaattttatgacctattacagaaaaagaatctagagatatatgacatgttactcactaaacacaaagatactatatataagaaacgaccaaactcagcaacaatagacattctggtaaaaggcaaagagaaattcaaaagtctcattatagagaatcaatttgaagtaatcctagaaatcctaaaactgttttcagctacaagaaatgtctctgacttacaacacattggcggctcaaaatactcaggagtagctaaaataggcaataaaatttcttccctagataactgtatactcatataccaaagcataaccggaatatttgaaaagagaattgatttattaaaagtatga

SEQ ID NO: 9064 - RNA, 4188 nt, synthetic construct
  misc_feature 1..4188: note = Cas9 variant
  source 1..4188: mol_type = other RNA
atgaatgcaaatagagaaatggcatactacataggtatagatatgggtacgggttccgtcggcatggcaatcacagatgaaaactacaatctcttaaaagttaaaggacaagactactggttcgtaagagaattcgaaaccgcgaatacacaaataaaaagaagaatgcaccgtatatcaaaaaggagattacggcgacatcaagttagagtagctttaataagatcttattttgctgaagaaatactcaaaaatgaccctttattttttatcaggcaagataactcaatatactacctcgaagacaaagattctgtactaaaaacaaaagactgcctcttcgcggactataattaccacgataagaactattacaaagattacccaactatctttcacctaagacaagccttcataaaagatacagtaaaagatgacgaaaatcacacaagatacgcaagactcctatacctcgcaatcataaacatgttcgaacacagaggtcactttttattaaacagcgtgagcgaagacataaacaaagaaatggtaaaagatgcaggagaaggcttcacactatatcttcaagaaagaatcaaagaaataaaaccagtctcatactcagacatattagatgtactagttgaaaaaaatatcagcaggtctgaaaaaaaagaaagaatcgtcgaattattcggaatcaaaaaaagctgcaaaaatggaatggaaataatcaaatgtctctgtggtttagaggcaaacgtagccataatgttcaatctagatgatatcgaaaacaaattaacgatcgtggtatcgaaagatgattatgaagacaaacttgcagaagttcagcctcttgtagatgaagaatcctttgaattactttcccgtattaaacaactatatgactatagtcaactacagtcgatattaaaaggatacaaggaaaaagaagacggtgaagataaatacctaagcgacgtaagagtggaactttatgaaaaacataaagcagatttaaaattactgaaaaaagtatacaaaagagatcttgataaaaaaggaaaaatatgtgaaggtaaaaatatccaacggagctcaaagtataatttcatgtttagatctggaaaagacgggacttatagtgcatataccaacagccttaacagcttctgctcaaaaacaatagaaaacaaatacagaagaaacatgaaaaaccgagatagagcaagtttatatgatactataaaaaaagacctaagtggcatagaaaacgatgacgtcaaaaaaattttacgagacatagaaacagaaaaatttcttccaaaacaaataacaggagaaaatggtgtaataccaaaccagatccacgcaaaagaattgaaagcaattcttaaaaacgcagaaaaacacctacctttccttacagaaaaagacgatagtggattaacggtatctgaaaggataataagtctgttcaggtattgtattccatactacataggaccagtcggaaaagactcgagaacagggtgggcttcaataaaagaagaaggacaaatattcccttggaacatcgaacaaaaaatcgatgtggacaaaacttcagaagaatttataaccagattaataaaaacatgtacatatctcagcaacgaaaaagtagtccctaaacaatccctagtatacgaaagatactgcgtactaaatgaaattaataatattaagataaggggtaagagaatagacccacaactcaaacaagagatcttcaaagaactgtacataggaagtaagtgcggaaaaaaagtaacaagaaaaaatctttgtcaatacttagtaaacaaaggagcaatagaagaagatagcgagatctccggcatagataaagatctaaatacatacatgagttcctatggcaaaatgtatcaaatatttggcgacaaaataaaaagagacgatataaaagaagtagccgaagaaataatctattacggtacgatatacggtggagcaaaagagatgttcaagaagaaaatagaacaatatgtaagtgaagacatcttagatgaagctcaaatgaataggatattaggatttaaatttaaggactgggcacgattatctaaaaaattcctatacctggaaggatacgacaaaggtaaccaaaaccaacttacaacactaatgcaagctctatgggactacaatctaaacacaatggagttaatgaatagtccgatgtttaccttcaaagaaacactcgaaaaacaaaaaaacaaaatggaaaaagtcctatgcgattttgaatacgaagacctagatgagtactatttctctgctccagtaaaacggatggtatggcaaacgatagcttgcctcaaagaagtagttcaaataatgggacacaatccaaaaagaatatttatagaaatgccgagagcagacgaagaaaaaggcgaacaaggccgaaaggcatcccgaaaaaatagattattgtccctctacgaagaaatagaagacgaaagaccatggaaaaaagagattgagaacgccgcagaatctggtagattaaattcaaaaagaatgtatttatactatctacaaatgggaaaagatgcatataccggggaagatattgacatcgaagatttattcgataattcaaaatacgatatagaccacatatatccaagaagcctaactgatgataactcactcgaaaacaacctagtactagtaagcgctaccatcaatcaagacgttaaaaaaaatgactaccccataccatacgataaaatacgaggaaattccaaggtgcgagaattatggagatttctccatgaaaaaaaatttatgaacgacgaaaaatataatcgactaatgagcgatgtaccactaacacaagaacagttagctggatacatagcaagacagctcgttgaaactgcccaaggaacaaaaggaatcgctgatataataaagagcgttatcccagacgccgacataatttactcgaaagctaaaaacgtttcggattttagaaagagatacggaatgttaaaaagcagactgaccaacgattttcatcacgcaaaagacgcctatttaaatgtagttgtaggaaacgtatattttaccaagttcacacaaaaccccagaaagtatatcaaggatgaaaatgatatagaaaataaaaaatataactataacctatcaaaaatgtatgataaagatgtaatcagaaacgggaaagtggcctggattgctcaaaacgggaagaaagcaggaaccatacaaacaataaaaaaagtcatggaccgcaacacacccattattacacgccaggcatttgaacaacgtggagagttatacgacctacaaccaatatcaaaacacaaagccaaaaaagaaaactacgtaccaattaaagccacaaacgaaaagatgaaagacgttacaaaatacggaggattcacaagtctaaaccctgcgtattttgtgtttgtagaatacgggagcgcaaagaaacgacagaggtgttttgccgtcgttcattcttattgggccagttcaatcaaaaataacgaagatctcgtaacacatctaaaagatagagggtatgaaaatccaattgtcatcgccgacaaaatcaaaaagaactctttaattaaatacaatggatactttctctacatagtcggtatggacgcccgaaaacaagtagaatttagcaatgcaacctccatgtgtcttaacaacaacttcatacagtatattcaaaaaattgaaaaggcaaacacactgatagcagaagctaagaaacgacgaccctacattgatgaatcaatcacagcagaaagaaatatagcattatataacgaactcaaaaagaaacacttagactccatattcaaaaatcacccaaaaggaatcggatctgtcctggaatcaggcgaaggtgcgttcgtccaactaagcttagaacaacaaataggcatactctactcaatcatacaattctcatcatttaaaaaagggacattcagtcttaccctaataggagggcccaaggaagtaggtcgtataagaatatcaggtaatatgccaaaagctcgagaactcaaacttatacactactcaataactggcatgtacaaaaaagaaatcaatctactcgactga

SEQ ID NO: 9065 - RNA, 4188 nt, synthetic construct
  misc_feature 1..4188: note = Cas9 variant
  source 1..4188: mol_type = other RNA
atggaaacccaagcctcaaatcaactaatttcatcacacttaaaaggataccctataaaagactattttgtaggcttggatataggaacctcaagtgtaggatgggctgtaaccaacaaagcatatgaattactaaaatttagatcacataaaatgtggggttcaagattatttgatgaaggtgaaagtgctgtcgctcggcgaggttttcgaagtatgcgtagacgactagaacgaagaaaattaagattaaaacttctagaagaacttttcgcggacgcaatggcgcaagttgatccaaccttctttatgcgcctgagagaatcaaaatatcattacgaagacaaaactacaggacacagttcaaaacatattctattcatagacaaaaactatacagatcaagattactataaagaatacccgaccatatatcatctgcgagtagcattaatgaaatcaggaaccgacgacattcgaaaactgtttttggcagttcatcatatacttaaatatcgaggaaatttcctctatgaaggggcaacatttgacagcaacgcctcaactttagacgacgtattgaaacaagcgctagaaaacataacatttaactgctttgattcaagtgccgctataggcagcataggacaaattttaatggaattgggtaaaacaaaaagcgataaagccaaagctatcgaaaggttagtagacacttatatcattaccgatgaagtggatacaagtggaaaaacacagaaagaacaagtcaaagaagataagaaacgcttgaaatcgttcgcaaacctagtattagggctctcagcgagccttacagatctattcggaagtgtagaagatctagacgaggacctcaagaaacttcaaatcatcggagatacttatgacgaaaggagagatgatctagctaaagtttggggagatgagatccatattatagacgattgtaaaagtgtctacgacgcaataatactaatgtcaataaaagaaccaggactaacaatatcagaatctaaagtaaaagcctttaagaaacataaagatgacctagcaatactaaaatcactattaaaaagcgatagatctatctataatacaatgttcaaagtcgacgaaaaaggcttacacaattacgtccattatataaaacaaggaagaacagaagagacatcgtgtaatagagaagatttttacaaatatactaagaaagtagttgaagggttaccagactcaaaagataaagaatatatattatctgaaattgaactacaaaccctcttaccattacaaagaataaaagacaacggtgttattccataccaacttcatctcgaagaattaaaagtaatcttggcgaaatgtggaccaaaattcccatttctgaatgaagttgccgatggattctctgtagcagaaaaactaataaaaatgcttgaatttcgaataccttactatgttggaccattaaacacacatcataatgttgacaatggcggtttcgcatgggcggtaagaaaagcatctggccgagtaactccatggaatttcgacgacaaaatagacagagagaaatcagcagcggcttttatcaaaaacttgaccaataaatgtacgtacttactaggcgaggatgtattaccgaaatcatcattgctatactcagaatttatgttactcaatgaactaaataatgtacgcatagatggaaaaccactcgaaaaagcagttaaagaacaccttatagaagcagtgtttaaacaagaccacaagaaaatgaccaaaaataggattgaacaattcctgaaagacaacaattatatacctgagaaacacaaacctgaaataacaggactggatggtgaaattaaaaacgaccttgcaagctatcgagacatggtccgaatattaggaaacaacttcgacctatcgatggctgaagagataatcacagacatcaccatatttggagaaagcaagaaaatgttacgcgaaacactcagaaacaaattcagcagccggctggacgacgaagctatcaagaaactgtcgaaattacgatatagagattggggacgtttaagccgaaaactattaaacgtaatagaaggttgcgacaaagcaggcgacggaaccccagaaactattataatcctgatgagaaacttctcatataatttaatggaattacttggcgacaaattcagtttcatggaaaggatacaagaaattaatgccaaactcatagaaggacaaatcgtaaatccacatgacataatagacgacctagcattaagccctgcggtaaaacgtgcagtatggcaggctttaagaatagttgacgaaatcgttcacatcaagaaaacactgccagctcgaatttttgtagaggtaaccagatccaataaagcagagaaaaagaagaaagattccagacaaaaacggctatccgacttatatgcagcaatcaagaaagatgacgcattactaagcggactcaccaatgaagagttcggaggactaaaatcaggcttagcaaaatatgacgatgccgcgctcagaagcaagaaactatacctatactatactcaaatggggcgttgtgcttacacaggagaagtaattgatttatcacaattaaatacagacaattatgatatcgatcacatttacccaagatcactaacaaaagatgattccttcgataacttagtcctatgtaaaaggaccgccaacgcacaaaaatcagacacttaccctataagcaaagaaatacaaaaagcgcaaaaagcattttggatattcttaaaacaacaaggactgatcagtgaaagaaaatatgaacgcttaacgcgaataacaccattgactgcagacgacttatctggctttatagctcgtcagttagtagaaacaaatcaaagcgtaaaagctgcaacaacattgcttagacgactctatccgggcgtagatgtagtatttgtcaaagctgaaaacgttacggacttcagacatgacaacgatttcataaaagtacgaagtctaaatcaccatcatcatgctaaagatgcatacttaaacatagtagtaggcaatgtgtaccatgaacgattcaccagaaactttcgagcattctttaagaaaaacggtgctaaccgtacgtacaacttagcaaaaatgtttaattacgatgtaaaatgcacaaatgcgaaagacggaaaagcatgggccgtaaaaacatcaatggacaccgtcaagaaaatgatggatagcaacgacgtacgtgtaacaaaacgagtctacgaacagaaaggacaactgtctgatattaaccttacaaaagcatcgaaagtaaaagcagatatatacctacccattaaagcgaacgacccaataatgagccaaaacatgaaatacggaggatatagcgatattaaaaatgcctattatactattattgaatattcagataagaaaaataacagtataaaagcatttatacccattcctatttttattgctaccaaaacccttacgaaacaagcattattagaatacatcaaaacagtcctaccgaaagcaaacaatctaagaatcatttataagaaagtttacaatgatcaattactaaaaatcgatggatttaattactacctaggcggtagaagcaacgatagattctgtattgacaatgcaattcagttgatagtacctctcgaaatacaattctacataaaactcgtggaaaaattcacagctataatctcagaaaataaaaatatagccctaaaagcgagtagcgtgaaatcaagaaacccaataaacaaccaggtagagaacattacattagaatacacccaaaaattatttgattatctcgtcagcaaattcaacgaattaatatacctaaaaatgagaggtaacaaattaaccgacgtaaataatatcggaagaaaacaatttataaaattatccctagaagaaagatgtaaagccctagcagaactattgaacatattcacaaatatgaacaagaaactatctctctcaacaataaatgtaagcgcaagcagaaaagtagttaactttaaaatatcatcattagatgaatttaaaatcgtcaatgaaagtataacaggactctacagtcacgaaataactatagtatga

SEQ ID NO: 9066 - RNA, 4188 nt, synthetic construct
  misc_feature 1..4188: note = Cas9 variant
  source 1..4188: mol_type = other RNA
atgaaccttcgaaatactacagatgagtacaatataggattagatatgggaacaaattctgtaggatgggcagtaacagacaaagtaggagccatagcacactttaaaggaatgccaacattaggatcacgactattcgacgcagctcaaacagcagcagaagcgcgagcacaccgaggtcaacgaaggcggtatgtcagaagacggtggagattagatttactacagagtctatttcaagatgaaatcgataaagtagattccgagttcttcatccggcttcgacaatctaggttacacgtggaagatagagaagatggacatgcggattataaatggccaatatttaatgattccgactttactgaagtagattactacaaaagattcccaacaatataccatctaagaaaatggttaatagaaactgaccaaaaagccgacatacgcttaatatatttagccgttcacaatatagttaaacaccgaggaaactttttacgagaaaataataaaaatctaagctcgcggaatgcagacccagcagaagcggtcggacacttacgtttagctctaaataattggtgtttggaaagagggtatgaatgtgcatggaaaagtggaggaaacgataatgcaattttaaatgtacttattgatggagagaaaagaagaagtgaccaagttagagaaatagcaaaattgacaggtatcgattgtggagatgcaaaacaatcaagacaatgtaacgaagcaatagcaaaagccatcgtaggattaaaagcagaaatgaaaaacatatttggcgagttcccggcagaaaagacactaatatacttatcatcagatgatgatgttgaagtagtaagagatgcatgtccagacgatagtgtagaacttttccaagctctctgtgaattatacgctgcttacatattacaaggattattgagttacgcaccagggcaaacaatttctgtgaatatggtgaagaaatacgacagatacggagaagacctccatttactaaaagaactgactagaacatacgcgtcaaaaagatatgatgctttctttagaggtgaaacctatgaaggatcgtctgactacgtagtagataaggcacaaggttatactagatataatctggggactactcaactttcatacgatgattttcaaaaagcggtaaaagaattatttaaaggaacagatgcattacaagacgaaagataccaaggaatgatggttgcttttggcgagcaacgatttcttagaagactaaaaacctcagacaatggtagtatttattatcagttacatctcgaagaactgcatgctatattagaaaaccagggaaaacactacccgtttctgttagcagaagaagataaaatcgaaagcctagtttcattcaggattccctattacgttgggcccttaaccagagagaacgcggcagtaggtcatgatgggaaagaaagattcgcatggtcgtctagaagagacggaatggaacatgcagtcataacaccatggaattgggaagaaatcatcgaccgggataaaagcgcggaagacttcatcatacggatgacaggtgattgcacttacttgcaaggcgaaccggtacttccaaaatgcagcctactatacgaagaattttgtgctctcaatgaattaaacggagcacattggacaatcgacgaagatgacgaacggcgtttcgatgccgcacaaagagaacgaataatgtgcgatctcttccgtagcactaggaaagttacttataagaaagtttctgattggctcgaaagagaagattcctttgtaggagcaagagttcatggaggccagggagaacatggctttgaatcacaattaggttcatatatatttttctgtaaagatgtttttaaaacagattcattagatgaagctgactatcccatgattgaacaaataatattatggtcaacactttttgaagatcgcgacatactccggagaaaaatagaagaagcatacggcgataggttgactactgagcaaataaaagtgatatgtaagaaaaggtttgcaggttggggtcgattatcaaagaaactactcaccggtataaaagtcgacactgatactggacgtaaaagtataattgacgtcttaagagaaggcaatcccaatgatggacaaagatctcgaactatggttttcatggaggtactacgagacgaaggactaggattccaaaaagcagttgatgattttaaccgggattattttagcgaacataacaacggattaatggatgttaatgatctacccggatcaccagccatacgtcggagtataaaccaagcagtaagaatagtagacgaaatagtaagtatagcaaagaaagaacctgctaatatttttattgaagtaacacgggaagaagatgatccacgtaagaaaggtaaaaggacaaaaagacgatatgacgcaattaaatcggctttagaagtattcaagaaagatgatccccaactttggaaagaactaacaaagaaagattcaaacaatatggacgagagattaagcctatatttcatgcaaagagggaaatgcatgtattccggtcggccaataaaaattgaagagttacataccgggaaatacgaagtcgatcacatcataccacgctcttacatcaaagatgatagcctagagaacaaagtattagtttacagagaagaaaaccagcataaaacagatacattattaatagattcttctatacgcagaaaaatgggaaaatattggcgaatgttacacaatgcaaaactaataggcgataagaaatttagaaatttattcagggatcacatagatgataaaaccatgaaaggtttcgtagccagacaaatcgtagaaacctcgcaaatggttaaattggtacaaactctactagaggcgcgctacccgggtgcgcgaatagtaccagtaaaagcaaatataagccacgacttaagagacgctgccggattagtcaaatgcagagaggctaacgacttccatcatgcacatgatgcatttctagcgtgtcgtgtaggattatttatacagaaaagacatccaagtgtatatgataatccaatcggtctagcacacattatgcgagactacgccagagcccaagctagagaatacaagaaatcgcattatttagctcataccaaaggtttcatagtgaacagttttctttcaagcggattcgacaaagaaaccggagaggtattcaaagatgattgggatgcggaggccgaagtggaaggcatacgaagggtgcttaattatcgacaatgtttcatttcaagaatgcccgtagaagcaaccgggactttctgggaccaaacaatttatagtccaaaatgcggaaagaaattaacactacccttaaaaagaggcttggatcccgataggtacggttcatatagcagagaacaattcgcatactttttcatatacgaggcaagagacttgaaacatgagcgacatatccttcaatttgcacaagtaccagtaagagtggccgcacatatagcaaaagacccatcacaactagaatcatatgcagtaaaactagcaggacaagcaaacctcgccttcgtaagaatagtaaggagaagaatattaaagaaacaacttttggaattaaatggagataggttaattataacaggcgttagagaagtaagaaacgctacagagttcgcattcagtttagacgaagaaacattaatagaaagatgtgttcagattgcgaaagtaggatctcttattggcgtagtaaacgatgaagatgaagaacaactatctgcagacttaaatgaactgttctcaagcctagtcaaaagaggcccgaaactatgcaataggttatatgcacagttaaaattagataaatacctttcgaaatttgacgaattgactttgacagataaagcaaaagttgtattacaactaattgcaataacaaatggctctataaacatggcggatttatcagcgttgggatcaagcaaatatgcaggatgtatgcaagtttcttattttaaacaattaaatgcaccaataggagaagtaaacataatcgatcaatcggttactggaatgtttgaaaggagaacacatatagggctatga

SEQ ID NO: 9067 - RNA, 4188 nt, synthetic construct
  misc_feature 1..4188: note = Cas9 variant
  source 1..4188: mol_type = other RNA
atgaaggaaattaaagattacataataggcctagacataggaacaaattcctgtggttacgtagtgacggacaaacaaaacaacatattaaaattaaaaggaaaaactgccatcggcgccaggctatttaaagagggccaagctgcagcagatcgacgatcgtttcgtacaaccaggcgaagattagcccgaagacattggagactaggtctattagaagaaatatttgaccccgaaatggaaaaaattgaccccaatttcttcaggagactaaaagaaagtgactattcgccaaaagatagccgaaagcaattcaacgctatagtttttaaatccattaaagcggataaacgattctacaaaaagtaccccacaatctatcacttaagaaatgcgttaatgcatgacaatcaaaaacatgacctaagggaaatattcatggcagtccaccacatagttaaatatagaggaaactttctaagagaagattctgtaaacgcatttaaggcagcaaaattctcattaagaggagaagatgggatcggtccagtagataaactaaatgatctactaaaagaaatttattcagaatattcaccagagctagcgactaataatctatccaaaatagaagatataataaaagacaaaaatttatacaaacaagataaactaaaacaagtagccactttactcattaaagaggcagacagcaaagacaaggcaaaattaaacaaagacatcgcaaaacaagtagctaactccttcatgggatacatgtttagattagacacactgttctctttaactgatgtcgacgtaaaagactacaaactaaaatttagcgacgccaatatagatgaatcactagacgatctaacaagcctcttaacggacgcccaaatagaattcgtacttgaattacaatcaatctacaacacgatagtattaaacgaaatagtgcctgatggtatgagtctatcagagtcaatgatcaaaaaatatgatgatcacaaagaagacttaaagatattcaaagaatacattgacagcctttcagatcaaaaaaaagcaaaaaaactgcttagtgcatacaatctctatgttaattacagaaaatcagaccttgtggaagctaaaaacttgttcaaaaacaaaaaggtaggcgataaaaacttcgccgacgtaatttccaacttcgaagtattcggaaaattcgtcagtgacaacctcgacgatagcgaactagcaaataaaataaaagcaagattagacttgggagaatttctcccgaaacaacgaaccaatcaaaacggcgttattccctatcaattacaccaggtcgaattaacacagattcttgaaaaacaaggaaaatattaccccttcctcatcacacccaatccagtcgaaagccacagaaataacgcgccatacgaaataagcgaactcgtatcatttagagtcccatattacgtaggaccactgatagacaaccaaagtataaaagataaacaaaataaaaacaagtttgcatggatggttagacaaaaacagggccaaataacaccatggaatctcgaagaaatggtggacactacagagagcgcaaaccaattcataaaacgaatgactcgaaaagacacatacctgctagctgaagacgtattaccaaaatcatcattagtataccaaaaattcatgatcctcgatgaactaaacagaataaaaatcgacggaaaaaaactcacatccgaactaaagcatgatatatttgaaaaactctttaaaaaacaaaaatccatcaacctagacaatttgaaaaactatttacttgttgaaggaaacatacccggactaatagaaggattatccgacggaataaacttcaacaactcattcagcacatacatagactacaggaacatattcggcgacgaaattgataacccaaataaacaagcagatttcgaaaaaatgatagaatggagtacagtcttcgaagaccgtaaaatattcaaacgtaagcttaaagaaataacatggcttacttcagaacaaatcaagcaagtttcctcaaaacgatattccggctggggcagactcagcaaaaaacttcttacacaaatcacagacgaaaacggagtcaacattctccaacgactatggaacgaaccagaaacactaacagaagtacttgcaaacccagttataaaaagaaaaatagttgaggcaaactcctcctttacgaaagcgaaagatatgaaagacatcttagtagaagcttacacctccccacagaacaaaaaagcaattagacaagtaatgagagtagtcgacgatatcatcgctgcggcacatggaaaaaaaccctcacagattgctatagaattcgctagagaagaccaagacaacccacaaatgacgaaatctcgtaaagcacaattagatcaaatatacgctaaaataagtgatgaattccttgacgacgcagtcaagaatgaactaaaaaatatgaaagataataaaccattagcaaaagataaagtatttttatacttcaaacaaatgggaagagatgcatattcaggagaaaaactctccctagataaccttcaagattatgacattgatcatatctacccccagtcttttataaaagatgacagtttcgataacagggtcctagtacaaagggcttacaataatggaaaatcagacaatgtaccagtgttattattcggaaataaaatagcagccggattgggaataacaataagacagatgtggaaaaaatggcttgaactcggactaatatcaaaaagaaagtttaataaccttataacagatcctgaaaagatcagcagaaacatggcaagcggatttgtaaacagacaactcgttgagacgtcacaagtaattaaattagtggcaaatatcctccaagcaaagctcccggacacagaaataatcgaggtgaaagcctcctacaattcaatattaagaaaagaatttaacctatacaaaagccgagaggtgaacgattaccaccacgcaatagacgcatacctcacaaccatagtagggaactacttataccaagtatatccaaaactcagaccctacttcgtgtacggacaatttaaaaaatttggcaaagcagaaaatcaagaagatgatcctgtaaaaaaaattaaaaaatttaatttcatataccaactcatatggggaaaagatgatgcgatatgtataagccataccaaccagcaagtgttcagcaaaaaagatataatcgacaaattaacaacagcctataactttaaatatatgaacatttcacacgcagtttacaccaggaacaataacatgtttaaacaaacattgtttcccataattgaaagaacgaccgcgaaaaccaagagtctaatcccgaaaaaacttgaccgacccactgacatatatggaggctatagcaacaacaacgatgcctatttggctttagtaaaagttgataaaaaaagaggatccgagtaccgcgtagtaggaatccctatgagagcagcggccatgctaaaagcgtccaaaaattatgacgaagacctaagaaaagtaatagaaccaatggtaatgtttgataaaaacggcaaagcaaaaagaggtattgaaggcttcagagtccttgtcggcaaaatgccatttaaacaggccgtcctagatggcaataaaaaatttatgctcacaggaacagttgacacacccaacctgaagcaactcgtattaagccaacaaaacatgaaatacatcttagactacatcgaggatgtagactgtcggaaacataaatttggagataaagttcaaaaccctgacaagtgtcttttagaggtattcgacgaaattatagaaatagtggacaaatattttgaactattcgactctcgcgactttagagaaaaattaagaaatagccgaaacaaatttattaaattagaggctagtaaaaaagcggatacaatattagcaatactaaaaggcttacaagccaaaagcaccagggctaccataaaagaactcaacatatcagactttggtagaatcataacttcaagtatatcaccagaagcacaactcatctatcagtctcctacaggactttttgaacgtagagttaaagttaaggacttatga

SEQ ID NO: 9068 - RNA, 4188 nt, synthetic construct
  misc_feature 1..4188: note = Cas9 variant
  source 1..4188: mol_type = other RNA
atgtcaaaaaaataccaaaatacaaaatattacgtaggattagatattggaacatcctcagtaggatgggcagtaacagacgccaattacgaattactaaaagtcaacggacataagacttgggggtcaagattatttacggaagcagaaacagcactagagaggcgaacacatagggcaacgcgaagacgtttacaacgcaggaaacagcgcctagacctacttgacgaactattcgcagaagaactcgcaaaagtagacccacaattcctcttacgattaaaggaaagtcaatatcatatggaagataaatcaaccgatgacaaatacgttctattcaacgaccaaaatcgaacagacggagaattcttcacagaatatccaacaatttatcatctaagatccgaactaatgcaaggaaaaaaagaggacataagagcggtctacctcgcattacaccacatcgtcaagtatagaggacactttctactacctggcgataactatgacatgcaaggtaatctatccgaactcataaaaagactctttaaattcatagaagaaacgcttttcattgaagatttagggttaacagacgaaatacagtcaaaaattgaagaaatcctactaaccaagacaaaaacaagattggatagacaaaaggaaatagtaaaattattcaacacaaaacatcaaaagttagatgacaaacaaaaaaaattactggaagccattttcaaactttgcctaggattaaaaggcaacatggtaaatatatttggagacaaaggcgaatacggaattgatttcacagacgtagaggataagaaaaagaaagtagagttcagcgcggattacgacaataatataaacgactatgtcgatttctttggtgaatatttcgaattacttgaaataacaaagaagatcaacgatactgtaatattttcagaaatactagttgatggcaaaggcttttcggaaagtaaagtaataagctacgagaaacaccaacaagacttacgaaaactgaaaaccttactaaaaagccttgataaaacactaggctataaatatggagaaggtttatatcaaaaaatattactagacgacgtaaaaagcaattacgtcaattattcaggcaactcacaaaaactaaaaaaatgcacaaaagatgagttttacggcttcataaaaagcaaactcaattcggtaactaaaaaagaaaaagttagtgaagcccaacaaaaagaaatagcacaaatactagcagatatggaattcggagactatctcccactccagcgaacaaccgataacggtgtaataccaaatcaactgcacaagaaggaactgattgaaataatagaacaacagactaaatatcatgattttttcaacgatgtagatgaaaatgggctaacaataaaagacaaaattatatcactaatgacatttcgcataccttactatgtaggtccacttaatgattaccacaaagttgccgatggaacaggacacgcctggatagaaaaaaaaaaagacggcaaaatatacccatggaattttgacgaaatggtagatactgaagccactgcagaaaaatttataaagaacctcactaacaagtgcacataccttaaaggggaagatgtattaccaaaagagagcaaactatatagtgaatttatgttattgaacgaactcaacaacataaaaattgataaccaaaaattagacccaaaattaaaaatgaaaatggttagcgaacttttcatgaaaaagaatgaaaaaataaccaaaaaaaagatagtggattacctaagaagtataggccaagccaacggaaacgaaatggtatcaggaatagatcgggaaataaaatcggacctaaagactatacacaaaatacaacattattaccaagacgcttccttagaaatggcggagaatataataagatggaatacaatatttaacgacagcacctcagatatactaaaagacaaaataacaaaagcatatggagatgtcctaacgccaggccagatcaaaggactatcgaacctagcgtgcaaagattggggaaaactctccgaaaaattcttaacaggcatcagatgcgatgttggtgaattcaaaaatatatcgattatacaagccatgcgagatacaaacaacaaccttatggaattactgtcaaataaatacgaattcatggacaaaatacaagaatacaacaaagagtactacggagacttcacatttaaagcggaacccagtataatggatgacctctatgtaggaccaggaccaaaaagagcgatttggcaggctgtaagaatcgtagaagaaatcaaaagaataatgggacatgacccagagaaaatattcctagaaactacaagaactaacagagccccaaaggtcaaaaatacaaaaagatatgacgctttagaaaaaaagtacgaatcagtcaaagaacatgaatacgctgaagtcaaaaaagaatttgaaatcgaaaaaaatgactctctaaacataaaaaaactattcctatattttacacaattaggtcactgtatgtatagtgatgaaaaaattccatataacgagctatttacgaataggtatgacatcgaccatatctacccgcgttcaaaaacaagagataacagcatggacaacctggtactcgtaaaagctgaatgcaacagagacaaaaaagataattacccaataaaactaaaaaccaatatacaacagaaatgccaggttagatgggcataccttagggataagaaattaataacagaagaaaaatacaacagactagttaggaaaacaccattgacagaggatgaactttctcaattcatagcaagacaactagttttcacttctcaatccgtgaaggcgacggccgaagtttttaaaaggttatacgaagactcaaaaatatgttacgtaaaagcagaaaacgtatcagatttcagatacggatctacccgtaagatgtccaaagacgaccaacctcaacccttcatcaaaaatcgcgacgtaaacgattttcatcacgcaaaagacgcatacttaaacatagtcgtcggaaatgtatacgatgtcaaatttacacagaatccaacccgtttcatcaaagctaacaaagattattcattaaactacatattcagatatcccgtaaacaaaaaaggtgaaaatgtatgggatccagaacaatcaatgaaaatcgtggaaaaaaccttaaaatcaaacgacgtaagagtcaccaagttagttaagcctattacgtcaccgatttctaacgaaacactacacaaagcactaaaatgcaaacctggctcttatttaccaagaaaaagctctaaaggcacccctctagctgacgttacaaagtatggtggatacgaaaaaataaaaaacgcatattattcaatctataaatatacatatatgaaaaaaaaagaatgcatggaagaatttcttctcgtcccaattccaatccatttagtaaataacgatgaagaattaccgaaatacataaatgataagattgccgaaagagcaaaaaaaaaaaagttagaaacagtcgaatgcatcgtaaaagaactttatcaaggaacattagtaagaattaacggatacgattaccgcattgcaggctcatcaggaaaacaattcgaattacataatggaataaacttaatagtagaaccatgggtggaaaaagttctcaaagaaaccgacaaatttgtgagaaaaagtaactccaaactagacaaaaaacaacaaaaagaaaataccacggaaactctaatagagaaacaattaaatgacgttttcgaatatctttgcagaaaattaaatcaaggtatctttaaaaataataaacatacactaccagcaaagcttctcggagactccattcaaaaaaggtttgaagacgcgagtatagaagatgaattcgaagtaataaaagagctaatcagtgcgatagcaaaaaacccacaaaacttcaaaactatacaaaaagtcctagacatatccggctcaagtatcccaagattcaacttaaaactcaccaaaaacaacgtagatgagttcataattaaaaacgaaagtgtcacaggactattcacacatgaaaaagtcatcttcagaaaatga

SEQ ID NO: 9069 - RNA, 4188 nt, synthetic construct
  misc_feature 1..4188: note = Cas9 variant
  source 1..4188: mol_type = other RNA
atgaagaaagaaataaaagattactttctaggcctggatgttggtactggctcagttggttgggctgtaacagatacggattataaattacttaaagcaaacaggaaagacctctggggcatgcgatgttttgaaaccgcagaaaccgcagaagtaagaagactgcatcgaggagctcgaagaagaattgaaagaagaaagaaacgaataaaactcctacaagaactttttagtcaagaaatagcaaaaattgatgaaggattctttcaaagaatgaaagaatcaccactatatgcagaagacaaaacaatattacaagaaaatacacttttcaacgataaagactttacagacaaaacctaccacaaagcatacccaacaatcaatcatttaatcaaagcatggatagaaaataaagtaaaaccagacccaagacttctatatctagcctgccacaacataatcaagaaacggggacactttctattcgaaggcgactttgacagcgaaaatcaatttgatactagcatacaagcattatttgaatatttgagggaagacatggaattagatatagacgcagattcgcaaaaagtaaaagaaatactaaaagattcaagcctcaaaaatagtgaaaaacaatcaaggctaaacaaaatgttaggattaaaaccaagtgacaaacaaaagaaagccataacaaaccttatatccggaaacaaaataaattttgcagatttatatgataatccagacctaaaagacgcagagaaaaactcaatctctttcagcaaagacgatttcgacgcgctaagtgatgatttagcctcaatccttggcgacagcttcgaactattgttaaaagcgaaagcagtatataactgttcagtactcagcaaagttataggtgatgaacaatatttatcattcgctaaagtaaaaatctacgaaaaacataaaaccgatttaacaaaacttaaaaatgtaattaagaaacatttcccaaaagattataagaaagtcttcggctataacaaaaatgagaaaaataacaacaactattctgcatacgtcggagtttgtaaaatcacacacaagaaattagttatcaaaaactcggcttcacaagaagacttctacaaattccttaaaactatactatcagctaaatcagaaataaaagaagtcaacgatatactcaccgaaatagaaacaggaacattccttccaaaacaaatatctaaatcaaacgcagaaatcccttaccaattgcgtaaaatggaattagagaaaatactcagcaacgccgaaaaacacttctcttttcttaaacaaaaagatgaaaaaggactgtcacactctgagaaaataataatgctactaaccttcaaaatcccatactacatcggtccaataaacgataaccacaagaaatcgttcccagatagatgttgggtcgttaagaaagaaaaatcaccatcagggaaaacaacaccatggaacttctttgaccacattgacaaggagaaaactgctgaagaatttataacaagcaggacaaacttctgcacatacctcataggagaatcagtactaccaaaaagcagcttactatacagcgaatacaccgtactaaatgaaataaacaacttacaaataataatagacgggaaaaacatatgcgacataaaacttaaacaaaagatatacgaagaactattcaaaaagtacaagaaaataactcaaaagcaaatctctaccttcataaagcacgaaggaatatgcaataaaacggacgaagtaataattcttggtatcgacaaagaatgcacatcatctttaaagagttatattgaattaaagaacattttcggcaaacaagtagacgaaatctctactaaaaacatgctagaagaaatcataaggtgggctaccatctacgatgaaggagaaggaaaaacgattctaaaaacaaaaataaaagctgaatatggaaagtattgtagcgacgaacaaattaagaaaatactgaacctcaagttctcaggctggggcagactctctagaaaatttctagaaacagttacatcagaaatgccaggattcagcgaacccgtaaatattatcacagctatgcgtgagacacaaaacaaccttatggaactactatcgtcagaatttaaatttactgaaaatatcaagaaaataaacagtggcttcgaagacgcggagaaacaattttcatacaacggacttgtcaaacctctattcctcagcccttccgttaagaaaatgctatggcaaaccctaaagctagtaaaagaaatctcgcatataacacaagccccacccaagaaaatattcattgaaatggctaaaggagctgagctggaacctgctcgcacgaaaacaagactcaaaatactgcaagacctatattcttcctgtaaaaatgatgcagacgccttctcaagcgaaatacaatacctatcaggcaaaatagaaaatgaagacaatctacgtctaaggtccgataaactttacctatattacactcaactaggcaaatgcatgtattgtggaaaaccaatagaaataggacacgtatttgacacaagcaactatgacattgaccatatttacccccaaagcaaaattaaagatgattcaataagcaacagagtcctagtttgctcaagctgtaataaaaataaagaagacaaatacccactaaaagccgaaatacaatcaaaacaacgagggttttggaacttcttacaacgtaataacttcatttcactagaaaaattgaacaggctaacacgcacctctcctatatcagacgacgaaactgcaaaatttatagcaagacagctagtagaaaccagacaagccaccaaagtcgcagcaaaagtattagagaaaatgtttccggaaaccaaaatagtatatagtaaagcagaaacagtctcaatgtttcgaaacaaatttgatattataaaatgccgagaaataaacgatttccaccatgcacacgacgcgtacttaaacatagttgttggaaacgtttacaacacaaaatttacaaataacccatggaactttataaaagagaaaagagataaccctaaaatagcagacacttacaactattataaggtgttcgactacgacgtaaaacgtaacaacataacagcgtgggaaaagggaaaaacaattatcacagttaaagacatgctaaaaagaaacactcctatatatacccgacaagcagcttgtaagaaaggcgaactcttcaaccaaacaatcatgaagaaaggtctcggtcaacatcctctaaagaaagaaggtccattatcaaatataagtaaatatggaggatataacaaagtcagcgccgcatattacacactaattgaatacgaagaaaaaggatcgaaaataagatcactcgaaacaataccactctaccttgtaaaagacattcagaaaaacaaagacggactaaaaagttacctcacagaccaaattggaaagaaagaaataaaaatattaatcccaaaaataaaaataaacagcttactaaaaataaacggttttccgtgccacataacaggcaaaatgggagaagccttcgtcctccgacccgccgtacaattctgctgttccaatgacgaagcactatacttcaagaaaataataagattcaatgaaatccggaaacaaagagagaaaatgggaaaaactatatcaccctatgaagatctttcattcagaagctacattaaagataatttatgtaagaaaacaaaagcagacgaaatcgaggaaaaagagttctacgatctattacaaaagaaaaatttagaaatatatgacatgctactaaccaaacataaagacacgatttataagaaacgtccaaacagtgctactattgatatcttagtgaagggcaaagaaaaatttaaaagtctcatcatagaaaatcaatttgaagtgatcctagagatactaaagttattcagtgctacaaggaatgtttcagatctccaacatatcggaggttcaaagaatgccggtaatgctcgagtaggaaacaaaattagctcgctggataactgtatactcatctaccaatcaataactgggatattcgaaaaacgcatcgacctattgaaaatctga

SEQ ID NO: 9070 - RNA, 4188 nt, synthetic construct
  misc_feature 1..4188: note = Cas9 variant
  source 1..4188: mol_type = other RNA
atgagttttaaaaaaatcttaggccttgacgtaggtgtcgcctcaataggatgggctgtcgtaagagaaaatgaagaaaacccgaactttaacacaataaccaaactaggagttcgtgtagtaccaatcacctcggacgaaaaactaaattttgagaaaggcaaatcgataacaagcaacgctgaacgcacattagcaagatcatcgagaagaaatctacaacgattccgactcaggagaaaaaacctaatagcaatactactccaaaatcagattataacccctactacccctttaacagagaaaggtaaatttacaacatttgagacactcaaaataagggcaaaagcaactaaagagaaaatagaactcgaagaactagcaagagtattgttacatataaataaaaaacgaggatataagtcatctcgcaaagtaaaaaactcagaagacggtaaagcgatagacgggatggaagcagcgaaaatactgtatgaaaacaagctaacaccaggccaatacacgtatcaactcctcgaaaaaggttctaataaaataccagatttttattgcagtgacttacaaatcgaatgggaagttatatggaacttccagaaacaattttaccctaaccttctaacggaagattttaaaaaagagctaaaaggcataggacaacgcgctaccgcagctctatttcttaaaaaatatggcatatacaccgcactaaacaaaggaaaaagggaggaaaaaaaattacaggcctacaaatggcgctccaaatcggtatccgaaaaaattccagtggaagaactagcctacgtgatcgccgaaatcaacagtcacataactaatagttcaggctacctaggaaccatatcagatcgctcaaaggaactatacttcaaccaacaaacaataggagaaaacttatatgcacaagtagccaaaaatacgcacgcaaaactaaagaatcaagtattcttaaggcaggactattcagcagaattcgaacaaatatgggaaactcaagcgaagttccatccccaactaacacccgaattgaaaaaaaaaataagagactccataatattctatcaacgaaaactacgatcacaaaagcgcctaatatccatatgtgagttcgaaaatcgtgaaatcgaaattattaaaaacgggaaaaaaaaaaaaaaaaaaataggcctaaaagcagcaccgaaatcatcaccgctttttcaagaatttaagatatggcaagtacttaataacatagtcataaaacaagaaggcaaagaccgtttgcttacatgggaagaaaaagaactgctttttacagaattaaacataaaaggaaacatatccggccagaaagcattagcactactcaaactatcaccaaaggacaccaaaataaatgttacaatattggaaggtaatcacacgcaagaacaactctacagagtctatctccgaatcctcggtatggaaggctacgacgtatttgatttattaaaaataccagaaaaccaagatgaaattaaacccgcagattcgaaaattagtgctgcagaaatcaaagaaacagtaaaatcagtattcaaaacctgctcaatctccccatccatactagattttgatccacttctccccaacccagaattcgagaatcaaagttcctatcaactttggcacctactatactcatacgaaggtgactctagtccatcaggcaacgaaaaacttctagaactccttaaaaataaatttggcttcaaaaaagaacatgccttattactcgcgtcaatctcttatacctacatatatggcaacttaagctcaaaagcgatgagaaaaatctacccatacagtaaagaaaacacctacagtgaagcctgcatgctagcaggatacaggcattctaaaaacgccttacccagggaagaattagtgaaataccaactaaaagacagacttgaaatccttcccaaaaactctctaagaaaccccgtagtagaaaaagtgctaaatcagctaataaacctagttaattcacttatggacgaatatggagcatttgacgagattagattagagatggccagagaactcaaaaagaatgcaaaagaacgcgaaaaatggtcaaaaaatattgcagatgctacctcgagaaaccaaaaacatgccgaaattctcaaaaaagacttcaaaatcagcaacccttccaaaaacgacctaataagataccgattgtacctcgaacttaaagccaacggctataacgatttatacaccaatacctatatcgatataaattacttattcacacacagatatgatatagaccacatcataccacaaagcaaggttttggacgattcattcagcaacaaagtcttagtcccacgacaagcaaatcttgaaaaatccaatttaactgcattcgactatatctctcaccaaggaaaagaaaaagaagaacattatttaaacgtaataactgaactatacaaaagaggatcaatatctgaaacaaagtacaaaaatctgcaaaaaaaaggcaacgaaataggagaaggattcatcaatcgagatctgaagaacacccaatacatagtccgaaaagctcgagaaatactctctttaatcacccccaacgtcgtgacaactactggcgaaataacggcaaaattacgaaaagattggaatctcataaatagcatgaaagaattgaacatggacaagttccgaaatgctagattaactgaactagtagaaaacagcaggggggaaaaaaaagaaataataatcgactggaacaaacgtaatgaccagagacaccacgcaattgacgccctagtcgtcgcctttaccacccgaaatcacgtacaatacctcaattacatgaatgccagagaagatgaatcacataaacaacattcccatatactatcaatagaaaaaaaaataaagtacgacaaattccacgaaaatggttcaagacaatcacgatttatctacccaacatctaatttccgagaagaagcaaaaaaaaaactaaaagaaatcctagtttcgtacaaaacaaaaaataaggtcgtcacggtgaacataaataaaccaaaaaagaaaggaggatactcaccgaaacatgaactaacgcccagaggaccactccacaaagaaacaatctacggaatgataagaatattacacaccaaagaaataaaagtctccagtaagcttaatttcgaaacagttgttagaatccaaaacccgagatatcgcaatgcactcttagaaagacttaaagacaattttaacgaccctaaaaaggccttcagtggaacaaacagtctaacaaaaaatcccgtcttccttaccgcgaacagtacagaaacagtaccagaaaaagtcacaatccaatggttcgaaaaagtatacacaatcagaaaacccataaatcctacaaatttcaagaatgaaaaaaacatagaaaaagtactagatcccaccataagaacacttctaaagaaaagactccaggaatacaacggaaacgcgaaagaagcattcagtgaccttgaaaaaaacccaatttggctaaaccaagaaaaaggtatatgcataaaaacagtaactatcacaggcatttctaacgtagaatcactccacaccaaaaaagatcacttcggaaaagaattactagatatcaacggaaatcccatacccgtcgattttgtatctactggaaacaatcatcatgtcgcaatctatgaagattcagaagggaacctacaagaaaaagtagtttccttctatgaagcagtagaacgggtaaaccaaggactaccagtaattgatacactctataacctagatctgggttggaagttcctatttacgatgaaacaaaacgaaatgtttttattcccagcggatgattttgacccaaacgatatagacatatacgatgaaaaaaatctcattttaataagcaaacacttgtttcgagtacagaaattaagctccaaagattactgctttaggcatcatttagaaacaagtatcaatttcaacgatcctgcactaaaaggaataacctggcgccgcgaatccccaaacggccttagaaatctagtaaaggttagattaaatcatttaggaaaaatcgtacacatcggagaatga

SEQ ID NO: 9071 - RNA, 4188 nt, synthetic construct
  misc_feature 1..4188: note = Cas9 variant
  source 1..4188: mol_type = other RNA
atgaagaaagaaatcaaagattatttcctaggactcgatgtaggaacaggatcagtcggctgggcagttacagatacggactataaactactaaaagcaaaccacaaagacctgtggggtatgcgctgcttcgaaacagctgaaacagcagaaaaacggagactattccgcggagcgagaaggcgcatagaacgtagacgaaaaagaattaaactactacaagaactattttcgcaagaaatagcgaaaatagacgaagactttttccaacgaatggaagaatccccattctacgcagaagataaaacaatattacaagaaaacacattgtttaatgatcgtgacttcacggacaaaacataccataaagcatacccaactataaaccacctaatcaaagcatggatagaaaacaaagtgaaacctgaccctagactcctctatctagcttgccacaatattatcaagaaaagaggacacttcttatttgaaggagattttgactcagaaaatcaattcgacaccagtgtacaagcactattcgaatacttacgcgaagatatggaactggacatagatgcggactccaagaaaataaaagaaattttaaaagattcagcacttaaaaattctgataaacaaaaccgattaaacaaattactaggcttaaaatcgtcagacaaacagaagaaagcactaaccaacctcatatctggcaacaaagcaaactttgccgacttatacgataaccccgatttaaaagacgctgagaaaaactcaatctcattctccaaagatgatttcgacgcattatcagatgaactcgcaagtgtattaggagactcttttgaactattactaagagcaaaagccgtctataattgctcagtattatctaaagtaataggagacgaacaatacctctctttcgcaaaagtcaaaatatatgaaaaacacaaaaacgatctcacgaaattaaaagaagttgtcaagaaatatttcccaatagaatacagaaacatattcggatataaacaatcagaaaacaacaattgtaattattcaagatatgtaggagtatgcaaatcaggcagcaaaaagaaagttataaacaaaaccgcgtcccaagaagatttctacaaattccttaaagacattttattaaaacgaagtgacgttccagaagccaacggaatcctaacagaaatagaaacaggaacctttttacccaaacaaataagcaaaaacaacgccgaaattccatatcaattaagaaaaatagaactagagaaaatactcacgaatgcagaaaaattcttttccttcctgaaacaaaaagacgaaaatggactatctcattcagagaaaataataatgctattgacatttaaaataccctactacattggacccataaatacttctcataaacaatatttccccgatagatcctgggtaataaagaaagaaaacgctccgcaagagaaaataaccccatggaatttctttgaccatatagataaagagaaaactgccgaagccttcatcacaagtcgtacgaatttctgtacttacctaataggagaatccgtactacccaaaaactccctactctattcagaatacacagtacttaacgaaataaacaacttacagataatcatagatggcaaaaacatatgtgatgtcaaattaaaacagaaaatatacgaagaacttttcaaaaagtacaagaaagtaacacaaaaacaaatatcaacttttatcaagcatgaaggaatctgcaataaaactgatgaagtaatcatactaggaatcgacaaagaatgcacctcaagtctaaaatcatacattgaacttaaaaacatattcggaaaacaagtggacgaaatatcaaccaaaaatatgctagaagacataatccgatgggcaaccatatatgatgaaggcgaaggaaaaacaatcctaaaaactaaaatcaaagcagaatatgaaaaatattactctgacgaacaaattaagaaaatattaaacctaaagctaagtggatggggaagacttagccgcaaattcttagaatcaatcacatcagaaataccaggctttatagaacctgttaacatcattactgccatgagagaaacccaaaacaatcttatggaattgctatcaagtaaattcaaatttaacgaaaacattaagaaaatcaactcaggcttcgaagatacagacaaacggttctcatacaacagcctagtcaaacccctctttctgtcgccctccgtaaagaaaatgttatggcaaacattaaagctagtaaaagaaatctctcacataactcaagcaccccctaagaaaatcttcatagaaatggcaaaaggtgccgaattagaaccagctcgtacaaaaacaagacttaaaatattacaagacctatataacagttgtaaaaatgatgccgacgccttttcatctgaaatacaatacttactgggaaaaatagaaaatgaagacaacctaagactcagatcagataaattatatttatattacacgcaactaggcaaatgcatgtactgcggtaaacccatagaaataggacatgtcttcgatacatctaaatatgacatagatcatatatatccgcaatcaaaaataaaagacgacagcatcaacaacagagtattagtatgctcatcatgtaacaaaaacaaagaagacaaataccctttaaaacccgagatacaattaaaacaaaagaaattctggaactttctacaaagaaacaactttatatcaatagaaaagttcaatcgtctgacaaggacgactcccataagtgacgatgaaacagccaaattcatcgcacgccaattagtggaaacccgacaagccacaaaagtagcagcaaaagtgctagagaaaatctttcctgaaacaaatattgtatactccaaggctgaaacagtctccatgttccgaaataagttcgacataataaaatgtcgagaaataaacgatttccatcacgcccatgacgcatatcttaacatcgttgtaggaaacgtatacaacactaaattcacaaacaacccttggaactttataaaagagaaaagagacaaccccaagattggagacacatataactattacaaagtattcgattacgatgtaaaaaggaacaatataaccgcatgggagaaagagaaaacaatcataaccgtaaaaacaatgctaaaacgaaacactcccatttacacaagacaagcagcctgcaagaaaggtgaattatttaaccaaactataatgaagaaaggattaggccaacaccccttgaagaaagaatgtcccttcagcaacatatcaaaatatgggggctataataaagtatccgccgcgtattacaccttcatagaatacgaggaaaaaggaaacaaaatacgatcgttagaaacaatacccttatatttagaaaaagacatacaaaaatcacaagatggactcaaaggatacttaacggatcaactaggcaagaaagaaatcaaaatactcgtacccaaaatcaaaataaactcattattgaaaatcaatggttttccatgccatatcactggtaaaactggtgcttcatttgttctacgaccagcagttcaattctgttgctccaatgacgaggtgctatacttcaagaaaataataagatttaacgaaataagatcacaaagagagaaaatgggcaaaacaattagtccatatgaagatctatcattccgatcgtacatcaaagaaaatttatgtaagaaaaccaaaaacgacgaaataggagaaaaagaattttacggtttcctacaaaagaaaaaccttgaaatctacgacatgcttcttataaaacacaaagatacgatatactcaaaacgacccaacagcactacactagacatgctaataaaaggccgctacgaatttataaatctaaaaccagaagaccaaattcgtgtcatgctagagattttaaaactattctgtacaacccgggaagtaattgatctcggactaattaaaggaaaatcagaagccggagttacaaccttaggcaagaaaatatcaaacctagactcatgtatactaatataccaatctattacaggaatattcgaaaaacgaatcgatttacttaaaatctga

SEQ ID NO: 9072 - RNA, 4188 nt, synthetic construct
  misc_feature 1..4188: note = Cas9 variant
  source 1..4188: mol_type = other RNA
atgaaaaaagaaattaaagattactttctcggcctagacgttggaactggctctgtaggttgggccgtgaccgatacagattacaaattactcaaagcaaaccgaaaagatctatggggaatgcgctgcttcgaaactgcagaaacagccgaagtacgacggctccatagaggagcaagacgacgaatcgaacgcaggaagaaaagaataaagctattacaagaacttttcagtcaagaaatagcaaagaccgacgaaggattctttcagagaatgaaagaatcaccattttatgccgaagataaaaccatcctccaagaaaacgcattatttaacgatagagactttacagataagacttaccacaaagcatatccaacaataaaccatctcataaaagcctggattgaaaacaaagtaaaaccggatcctagattactctatttagcatgccataatatcataaaaaaacgaggacactttctcttcgaaggggactttgacagtgaaaatcaatttgatacatccatacaagcactgttcgaatatctaagagaagacatggaagtagacatagacgcagattcacagaaagtcaaagaaatcctgaaagatagttcattaaagaactctgaaaaacaatccagactaaataaaatgttgggattgaaaccatcagacaaacaaaagaaagcaataaccaatctcatatcaggcaataaaattaactttgcagacttatacgataacccagacttaaaagacgctgagaaaaattctatatctttttccaaagatgattttgacgcattatcagacgatctcgcatcaattctcggagattcttttgagcttttacttaaagctaaagcagtatataattgttcagtactatccaaagtaataggagatgaacagtatttatcgtttgctaaggtaaaaatctacgaaaaacataaaacagatctcacaaaactgaagaatgtaataaaaaaacactttccaaacgattataaaaaagtctttgggtataacaaaaacgaaaaaaataataacaactattcagcatatgtcggtgtatgcaaaaccaaatcaaaaaaactagttattaacaacacagtaaaccaagaagacttttacaaatttttaaaaccaatacttttagctaaaagcgagataaaagaagtaaatgatatattgacggaaatcgaaacaggaacgttcctacccaaacaaatatctaaaagtaatgccgaaataccataccaactaagaaaaatggagcttgaaaaaattctatccaacgcagaaaaacatttctcctttctcaaacaaaaggacgaaaagggtctgtcacattcagagaaaataataatgttattaacattcaaaatcccctactatatagggccgataaacgataatcataagaaatcctttccagacagatgttgggtaatcaagaaagaaaaatcccctagtggaaaaacaacaccatggaatttctttgaccacatagacaaagataaaacagcagaagcctttatcacaagtcgtactaatttttgtacatacctagtaggagaatctgtattgccaaaaaattctctactatacagcgaatacacggtgttaaatgaaataaacaacttacaaatcataattgacggcaaaaacatatgtgacataaaactaaaacaaaaaatatatgaagaactattcaaaaaatacaaaaaaataacacaaaaacaaataagtacttttataaaacacgagggaatatgtaacaaaaccgatgaagttataatattaggaatagacaaagaatgcactagcagtttaaaatcttacatagaactaaagaacatatttgggaaacaagtcgatgaaatatcaacaaaaaacatgctagaggaaatcataagatgggcaaccatatacgatgaaggcgaaggaaaaacaattctaaaaaccaaaataaaagctgaatacggaaaatattgctccgacgaacaaataaaaaaaatactcaatctaaagttctcaggatggggcagattatctagaaaattcctagaaaccgtaacaagtgaaatgcccggtttttccgaaccagtaaatattatcactgcaatgagagaaacacaaaataacctaatggaactcctaagctcagagtttaaattcacagaaaacatcaaaaaaatcaactcaggcttcgaggatgtagaaaaacaattctcctacgattccctggtaaaaccactatttttatccccttccgtaaaaaaaatgctctggcagactttaaaattggttaaagagataagtcacataacccaagcaccacctaaaaagatattcatagaaatggcaaaaggggctgagttagatccagtgagaaccaaaacaagactcaaaatcctacaggacctatacaataattgtaaaaacgacgcggatgcattcagctctgaaataaaagacctatcaggaaaaattgaaaacgaagataacctacgattaagatctgacaaactgtacctatactatacacaactaggaaaatgcatgtactgcggaaaaccaattgaaataggccacgttttcgacacttcgaactatgatatcgaccacatatacccccagagcaaaataaaagacgattcaatatctaacagagtactagtttgcagctcctgtaacaaaaataaagaagacaaatatccactaaaagcagaaattcaatcaaaacaacgaggtttctggaacttcttacaaagaaacaactttatttccttagaaaaactaaaccggctaacgcgaacaagcccaatttcagatgatgaaacagcaaaatttatagccagacagctcgtagaaacacgacaagcaaccaaagttgcggcaaaagtactagaaaaaatgtttccagaaacaaaaatagtctatagcaaagctgaaacagtgagcatgttcagaaataaattcgatataataaaatgcagagaaatcaatgacttccaccatgcgcacgacgcctacctcaacatcgtagtaggaaacgtttataacacaaaattcacaaacaatccatggaactttataaaagaaaaaagagacaacccaaaaatcgcagacacatacaactattataaagttttcgactatgatgtcaaaagaaacaatataacagcctgggaaaaaggcaagacaataatcacagtaaaggatatgttaaaaagaaacactccaatctacaccaggcaagccgcctgcaaaaaaggtgaactattcaatcaaactatcatgaaaaaaggcctaggacaacaccctctcaaaaaagagggcccattatcaaatataagcaaatatggaggatataacaaagtatccgctgcgtattatacattaatagaatacgaagaaaaaggaagtaagatacgcagtctcgaaaccatcccactataccttgtaaaggatatccaaaaaaataaggatggtcttaaatcgtatcttacggatcaaatcggcaaaaaagagataaaaattctaataccaaaaatcaaaattaattctttactaaaaataaacggatttccttgccatattacgggaaaaatgggagaagcattcgtattaagacccgcagtccaattttgttgtagtaacgatgaggcactctatttcaaaaaaataatacgattcaatgagatccgcaagcaaagagaaaaaatgggaaaaacaatatcaccgtatgaggacctatctttcagatcctacattaaagacaatttatgcaaaaaaactaaagcagacgaaatagaagaaaaagaattttacgatctgctgcaaaaaaaaaacctagaaatatatgacatgctactaacaaaacacaaagataccatatataaaaagagaccaaactcggcaacaattgatatactagtaaaaggcaaagaaaaatttaaatccctaatcatagaaaaccaattcgaagtcatacttgaaatcttaaaactattcagtgcgacaagaaacgtatcagacctacaacacattggcggctcaaaaaacgcaggtaatgctcgagtaggtaataaaatatctagcctagacaattgcatactcatctatcagtcaattacgggaattttcgaaaaacgaatcgacttattaaaaatttga

SEQ ID NO: 9073 - RNA, 4188 nt, synthetic construct
  misc_feature 1..4188: note = Cas9 variant
  source 1..4188: mol_type = other RNA
atgaaaaaagagattaaagactatttcctaggactagatgtcggaacaggatctgtaggatgggcagtaaccgatacagactacaaactcttaaaagcaaatcgaaaggatctttggggcatgaggtgtttcgaaacagccgaaacagccgaagtaaggagactacataggggcgcacgaagaagaattgaaaggcgaaagaaacgaataaagctcctacaagaattattctcccaagaaatagcgaaaatagacgagggtttctttcaaagaatgaaagaaagtcctttctatgccgaagacaaaacaatattacaagaaaacgccttattcaacgataaggacttcacagacaaaacataccataaggcatatcccacaattaaccatctcataaaagcatggatagaaaacaaagtaaagcctgaccctcgattactatatctggcctgtcataacataattaaaaaacgtgggcatttcctatttgagggcgactttgattcagaaaaccaattcgacacatccattcaagctctatttgaatacctccgtgaagacatggaagtagatatagatgccgactcacaaaaagtcaaagaaatcctcaaagattcttcactaaaaaactccgaaaaacaaagcagattgaacaagatcctaggcttaaaaccaagcgacaaacaaaaaaaagcaatcacaaacctaatatcaggaaacaagatcaactttgcggacctatatgacaacccagatctaaaagatgctgaaaaaaacagcatatcattttccaaggacgactttgatgccctgtcagacgatctagcatcgatactaggagatagcttcgaattactcctgaaagcaaaggcagtatataattgctccgttctctctaaggtcataggagacgaacaatatctcagttttgctaaagtgaaaatatacgaaaaacataaaaccgacttaactaaactaaaagcagtaataaaaaaacactttccaaacaattacaaaaaagttttcggatacaatcaagataatgaatcaaaaaataattactcaggctacgtcggagtctgtaaaacaaagaataaaaaattagttattaacaacagtgtaaaccaagaggacttttacaagtttttaaaaccgattctgtcggcaaaatcagaaataaaagaagtcaatgacattctcgcagaaatagaaacagggaactttttaccaaaacaaatctctaaatctaacgctgaaataccatatcaactaagaaaaatggaacttgaaaaaatactctcaaatgcagaaaagcacttcagcttcttaaaacaaaaagacgaaaaaggattatcccactcagaaaaaataataatgctactgacttttaaaataccatattacattggacctataaacgacaaccacaagaagagttttcctgatagatgttgggttgtcaaaaaagagaaaagcccaagcggaaaaacaactccatggaacttcttcgaccacatagacaaggaaaaaaccgcagaagagttcataacatcaaggacaaacttctgtacatatttaataggtgaatctgtcctccctaaaaatagtctgctttacagcgagtacaccgtactaaacgaaatcaataacctacaaataataatagatggaaaaaacatatgtgacacaaaattaaaacagaaaatatatgaagacctatttaaaaagtataaaaaaataacccaaaaacaaatttccacattcataaaacatgaaggcatatgcaacaagaccgacgaagtaatcatattaggtatcgacaaagaatgcacatcaagcttaaagtcatatatagaattaaaaaacattttcggaaaacaggttgatgagatatcaactaaaaacatgctagaagaaataataagatgggcgacaatatacgacgaaggtgaaggtaaaacaatactaaaaaccaaaataaaagctgaatatggaaaatactgtagtgacgaacaaataaaaaaaatactgaacctaaaatttagtggatggggtcgattatcaagaaagttcttggagacggtcacaagcgaaatgccaggattctccgaaccagtgaatatcatcaccgccatgagagagacacaaaacaatttaatggaattactcagttcagaatttaaattcactgaaaatattaagaaaataaactcaggattcgaggacgccgaaaaacaattctcctatgatggactagtaaaaccgcttttcctatcaccatcagtcaaaaaaatgttatggcaaacactcaaattagtaaaagaaattagtcatataacacaagcaccccctaaaaaaatattcattgaaatggccaaaggcgccgaattagaaccagcaagaacaaaaaccaggcttaaaatactacaagatttatactccagttgcaaaaacgatgccgatgccttcagctctgaaatacagtatttaagcggcaaaatagaaaatgaagacaacttacgattacgatcagataagttatacctctattacacacaactagggaaatgtatgtactgcggtaagcccatagaaataggacacgtatttgacaccagcaattacgacatagaccacatatacccacaaagtaaaattaaagatgacagtatatctaatagagttctagtttgctctagctgcaataaaaacaaagaagacaaatatcctttgaaatcagaaatccaatcaaaacaacgaggattctggaattttctacaacgtaacaatttcatatcactagaaaaactaaatagacttaccagaacaaccccaatttcagatgatgaaaccgcaaagttcattgctagacaactcgtcgaaactcgccaagcaaccaaagttgcagcaaaagtcctcgaaaaaatgtttccggaaacaaaaattgtatacagcaaagctgaaacagtatcaatgtttcgaaataaatttgacataataaaatgtagagaaataaacgattttcatcatgcacatgacgcatatttaaacatagtagtcggcaacgtttataacacaaaattcacaaacaacccctggaactttataaaagaaaaacgagacaacccaaaaattgctgacacatacaactactacaaagtgtttgattatgatgttaaacgaaataacatcaccgcttgggaaaaaggaaaaaccatcataaccgtaaaagatatgctaaaacgtaataccccaatatacacaagacaggcagcatgcaaaaagggagaattattcaatcagaccataatgaaaaaaggactcggacaacacccattaaaaaaagaaggcccattctcaaatatatctaaatatggaggatacaacaaggtttcagcagcttattacaccctaatagaatatgaagaaaaagtcaacaaaatccgtagtctcgaaaccatacccctataccttgtaaaggacatccaaaaagatcaagacgtactcaaatcgtacctaacagacctcttaggtaaaaaagaaatcaagatacttgtaccaaaaatcaagataaacagccttttaaaaattaacggatttccttgccatataacaggcaaaacgggagactcatttgtattaaggccagccgtccagttttgctgctcgaacgacgaagtcctatacttcaaaaaaatcatccgattcaacgaaattcggtcacagagggagaaaatgggaaaaacaatcagtccttacgaagacctttcttttcgctcctatattaaagaaaatctttgtaaaaaaacgaaggcggacgaaatcggagaaaaagaattttatgatctacttcagaaaaagaacttagaaatatatgacatgctattaaccaagcataaagatactatatataacaaacggccaaacagtacaacattgggaatgttaaccaaaggacgatacgaattcataaacctaaaaccaaaagatcaaattatagtcatgctcgaaatactaaaactattctgcaccacccgcgaagcaatcgacttagggctaatcaaaggaaaaccagcagcgggtgtagcaactctaggaaaaaaaataagcaacctcgacaattgcattttaatttaccaaagcataactggcatcttcgaaaaaaggattgacctactaaaagtctga

SEQ ID NO: 9074 - RNA, 4188 nt, synthetic construct
  misc_feature 1..4188: note = Cas9 variant
  source 1..4188: mol_type = other RNA
atgaaaaaagaaataaaagactactttttgggactagacgtaggaactggatctgttggctgggcagtcaccgatacagattacaaactactaaaagctaatcgcaaagatctatggggaatgagatgttttgaaaccgcagaaacagccgaggtaaggaggcttcacagaggagcacgcagaagaatagaacggcgaaaaaaaagaatcaaactcttacaggagctatttagtcaagaaatcgcaaaaatagatgaaggatttttccaaagaatgaaagagagccccttatacgctgaagacaaaaccattttacaggagaataccctttttaatgacaaagacttcactgataagacataccataaagcatatccaacaataaatcatctcatcaaagcatggattgaaaataaagtcaaacctgacccacgactattatacctagcctgtcataatataattaaaaaaagaggacatttcttatttgaaggagactttgactccgagaatcaatttgacactagcatacaggcacttttcgagtatttaagggaagacatggaagtagatatagatgcagacagtcaaaaagttaaagaaatactaaaagactcatccttaaagaactctgagaaacagtcccggctaaataaaatgcttggcctaaaaccgagcgacaaacaaaaaaaagccataactaacctaattagtggaaacaaaatcaatttcgccgatttatacgataatccagatttaaaagacgcagaaaaaaattcaataagcttcagtaaagatgacttcgatgctctatctgatgaccttgcttcaatacttggggacagcttcgagctcttattaaaagcaaaagcagtctacaattgcagcgtcttgtcaaaagtaattggcgatgaacaatacttaagttttgcaaaagtaaaaatctacgaaaaacacaaaaccgacttaactaaactcaaaaacgtaataaaaaagcactttccaaaagactacaaaaaagtatttggttacaataaaaacgaaaaaaacaacaacaactactcgggatatgtaggagtatgcaaaacgaaatcaaaaaaattaatcataaacaattcggttaaccaggaggatttctacaaatttctaaagacaattcttagcgctaaatcagaaataaaagaagtgaacgatatactaaccgaaatagagaccggcacattcttgccaaaacagatctctaaatcgaacgcagagatcccataccaactgcgcaagatggaactagaaaaaatattgtcaaacgctgaaaaacatttcagtttcctaaagcaaaaagacgagaaaggactatcccacagtgaaaaaattataatgctattaacttttaaaataccctactacataggtccaataaacgataatcataaaaaatcatttccggatcgatgttgggtagtgaaaaaagaaaaaagtccatcaggaaaaaccactccatggaacttcttcgaccatatagacaaagaaaaaaccgctgaagaatttatcacttccagaacaaacttttgtacttatctaataggagaatcagtcctgcctaaaaattcactcctatatagcgagtacacagtactaaacgaaatcaacaacctccaaattattatcgacgggaaaaatatttgcgatacaaaactaaaacaaaagatttacgaagaactcttcaaaaaatacaaaaaaatcacgcaaaaacaaataagtaccttcattaaacatgaaggcatttgcaataaaaccgatgaggtaatcatccttggcatagacaaagaatgcacttcttcactgaaatcttatattgaactaaaaaatattttcggaaaacaagttgacgaaatttcaaccaaaaatatgctagaagaaattatacgatgggcaacaatctacgacgaaggtgaaggaaaaacgatattgaagacaaaaataaaagcagagtatggtaagtactgcagcgatgaacaaatcaaaaaaatacttaatttaaagtttagcggatggggtagactgtcccggaaattcctcgaaacagttaccagcgagatgccaggattcagtgaacccgttaacataataacagcgatgcgagaaacacagaacaaccttatggaacttttatcaagtgaattcaaattcacagaaaacataaaaaaaatcaacagcgggtttgaagacgtagaaaaacaattcagttatgatggcctagtaaaaccattattcctttcacccagcgtcaaaaaaatgttatggcaaacactcaaactggttaaagaaatatctcacattacacaagcacccccaaaaaaaatattcatagaaatggcaaaaggagctgaactagacccggtaagaacaaaaacaagactcaaaatcctacaagacctatacaataactgtaaaaacgatgcagatgcattcagttctgaaataaaagacctaagtggtaaaatcgaaaatgaagacaatctccgtctcagatctgataaactatatttatactacacacagctaggaaaatgcatgtattgtggaaaacctatagaaatagggcacgtatttgacaccagtaactacgatattgaccacatatatccacaatcaaaaataaaagacgattcaatctcaaatagggttttagtatgttcgtcctgcaacaaaaacaaagaagacaaatatccgttaaaagcagaaatacaaagcaaacaaagaggattctggaattttctccaaaggaacaatttcatatcattagaaaaattcaacagactcacaagagcaacacccataagcgacgatgaaacagctaaatttattgcaagacaactagtagaaaccagacaagccacaaaagtagcagcaagagttctagaaaaaatgtttccagaaacaaaaatcgtatattcaaaagccgaaacagtatcaatgttcagaaacaaatttgatatagtgaaatgcagagaaattaacgactttcaccatgcacacgacgcctaccttaacatcgtagtcggaaatgtgtataacaccaaattcaccaacaacctctggaactttataaaagaaaaaagagataatccgaaaatcgccgacacatataactactacaaggtctttgattatgatgtaaaaagaaacaacataaccgcttgggaaaaaggcaaaacaataataaccgtcaaagatatgctaaaaaggaacacaccaatctatacgagacaagcagcctgcaaaaaaggcggactattcgaccaaacgataatgaagaaaggattaggccaacatccactaaaaaaagaaggtccatttagcaacatatctaaatatggggggtataacaaagtatctgccgcatactatacactaatagaatacgaagaaaaaggtaataaaataagaagccttgaaaccattcccttatacttggttaaagatatacagaaagatcaagatgttctaaaatcatatctaacagacttactagggaaaaaagaatttaaaatattagtcccaaaaataaaaattaattccctactcaaaattaacggctttccatgtcacatcactggaaaaacaaacgattcctttttattacgccccgcggtccaattttgttgtagcaatgatgaagtcttatattttaaaaaaataatcagatttagcgagatccgaagtcaaagagaaaaaattggtaaaacaatctctccctacgaagacctaagcttccgttcatacataaaagaaaacctgtgcaaaaaaactaaaaatgacgaaataggcgaaaaggaattttatgacctactacaaaaaaaaaatctcgaaatctatgatatgctattaaccaaacataaagacacaatatacaaaaaacgtcctaattcagctacgatagacatacttgtaaaaggaaaagaaaaatttaaatcactgatcatagaaaaccaatttgaagttatcttagaaatactcaagctttttagtgcgacccgaaatgtatcggacctacaacatattggtggatcgaaatacagcggagtagcaaagataggtaacaaaatatcttctttagataactgcatattaatttatcaatcaataacaggaatattcgaaaaacgaatagacttactaaaggtttga

SEQ ID NO: 9075 - RNA, 4191 nt, synthetic construct
  misc_feature 1..4191: note = Cas9 variant
  source 1..4191: mol_type = other RNA
atggatagctcaaaacaaggcctacgacggtaccatttagggcttgatataggaacaaattctattggatggacagcaattgatgaccacttcagcctacttcgagtaaaaggcaaaaacgctattggtgtacgaacgttcaaagaaggagaaactgccgcagacagacggggcttccggacagcacgacgccgactgagcagaagaagatggagactacaatttctggatgaatttttcgcaccttatctggcagaagtagatccaaactttcttgcccgcttaaaacaatcagacatatccgctaaagatccagcgaaaaaccaagaatacatgggaaaactactcttcccagatcaagaagcagcatccgacggcaatggatatccaacacttatccaaatgagaaaagcaatgccagcggaaaaagctgcagatttcccagtattcaacatatatcagctcagatatgctctgatgaacgagaaaagaaaatttgatctccgggaaatatacttggcggtccatcatatcgtaaaatatcgcggtaatttcctaaataacaccagcgtagataaatttaaagcagatcagatagacttcaacaaatcatttgaaacactaaacgacctcttcagacaagtccagccaatagcaccgtttcaaatcgatttaacaaaagtcgatgaactaggtaaattattattagacacaaaacagaaaaagttagacagacaaaaagcagtagccaaactattacctctcatagaagatggcaccgacaaagaaattgttaaagctcatcaacaaacagcacgcgaaatatctaaactaatactaggatacaaagcgaaagtaggtttaatattacaaaacaatttagaccaaaccttagacatgagtacagagaactccgacgatcaactgatgcaaattgcagaagaattagacgattatcaaatggaattaataaaccaattatctctactatactcacaaataatgctcaacgaaatagtacctaatggagaaactgttagcgccagtatgctaaatcgttactataaacatagatgtcaacttaaagagcttaaagattatggtgcagcgcaagacaaaaagacaagagaacaattagatcacctctatgcagaatatataggccaaataccgaaggacagtaaattcgacttcacaaaagacctcaagaaactgatggataaaagtgatcttggtcagaaaattaaagatgaaatcgaagcaggagactatctccctaaacaacggacttctgcgaacggggttatcccacatcaaatgcaccaacaagaactagaccaaattatagaaaaccaaaaagaatattacccctggttagctgagcccaatcctgtagagaaaaatataaagaacgcaaaatataaactagaccaattagtatcattcagagtaccatattatgttggacctatgataacattagcagaccaacaaaagaccagtaaagcaagttttgcctgggccgttcgaaagaaagctggcaaaataactccctggaacttttatgacatgatagacagagaaaaatcagccaataattttattaaacgaatgactaacaaagacacttacttgctatcagaagacgtactacccgcttcatctcttttataccaaaaatttacagtccttaacgaactaaacaacataagagtaaacggaagaaaattacaaccagctctgaagcaagcaatatacacagacctatttcagaaaagaaaaacagtaaatttaaaaacactcacaaactttctagcaatccacgaaccaacacttacgaagccaaaaatagaagggctatcaaatgggagaagttttaattcgagcctcggcacctatattgacatgtcaaaaattttaggcgacagcctggatgatttgaattatagagacgatatagaaaagataattgagtggtccacggtctttgaagacagcgaaatctatggagtaaaacttcaagagatccaatggctaacaaatgaacaaagagaaaagctagtaagaaaacgttaccaaggatgggggaggctatcaaagaaattactaacaggcatcacagacgaaaatggacaacgtataatcgatctgatgtgggatacaagtaaaaatttcatgcaaattgtccaccaacccgtattcgaagaacaaatcgctgagttaaatcaacaattactacaagacgccgataaagcaccacttgaagtcgtcgatgacattttagcagacgcatacacatcaccccaaaataagaaagctatacggcaagtagtaaaagttgtagcagacgttgtaaaagctgtaggaaacgcaccagcatcaattagcatcgaatttgcacgcaatgaagatagaaataaagaactcaaaaactcacgacgacactcaatagaaaaattatatcacgaaacagctgagaaattagtaaaacaaactaatttgcttgaggaactagggaacgttaaggatctaaacgataggtactatctatatttcactcaagcaggtagagacatgtacgacggaacacctataaacatagacgaaattagtacacattacgaaatagatcacatactgccacaatcattcttaaaagataactcattggataaccgagttctagtaaagaaatcagaaaatgcggccaaatccgatcgagtaccagccaaattatatggggccaaaatgcgagccttctggaaacaactaaaagagagccaacttatatcaaatagaaaatacttaaatctcacgactgatccagaacaagtcgataaatatcaaatgcagggatttgtacaccgacaactcgtagaaacccgacaaataataaaacttgcagcaaatatcttcgggagtctatatccagatagcgctgtaatagagacaagagcggaactaacgaaacaattaagagaaaaattttcattatacaaagttagagacgtaaatgactatcaccatgcagttgatgcatatttaacggcgttcgcgggtcactatctttaccaaagatacccaaaactaaggccaatgtttgtctacggagactacgccaaaatatacgcagatgacctcaaaagactaagatcagtaaatctgtttcacgatctagaaaaagaccaatacaacagtggaactgcggtcaatccagaaaccaaagagaaaatagtagatgtagactggctttcagactatgtttctaaaatacaacacttcaaatatatgctaattagcaaagccgtctatacacaacatggtcaattgtacggtgcaaccatactaccagtcgcacaagttgacaaaatatctgcacccataggaatcaaagacgacaaaccagtggatatatacggcgcatatactaacgaagtagctgcatacatggcaatagtaagagttaacggtaaaaagccgaaatataaagttgtcagcgtaccagtaagaatgttacagagactaaaaatggcagaacagaaaggccatgatcaatatatgcaaactctacatgatgtactccttagaaactttacaagcctgaagaaaaacagaaaaactggactaaaagaagccgtagttaaagattttgatgttcttgtaccctgcgtaagatataaccagctagtaatagacggagacaccaaatttaccttaggctcagccacatatcaacataacgcaaaacaattggtcctatgcaaccattcactagaaactctagccaacaacttcgaatatgtaagaaaacacccagatgaagcagatgaaagaatgattatgttatatgacgatatattagaccaagttaaccattactttaccctctacgacaaaaacaaatttcgcgaaaaactaaatgcaggccgggacaaatacctaaaactacctaccttttcacagtttgaaaataacaaaaagactgccattggaaaatctgaggccataataaatatacttagaggactacatgcgaatgctgcaattacaaatctaaaatgtctaggcgtatctacccccttcggacaattacaatcaccaagtggaattgaattatcggaaaacgcaaaattagtataccaaagtccgacaggactattctccagagaagtattactcaaagatttatga

SEQ ID NO: 9076 - RNA, 4191 nt, synthetic construct
  misc_feature 1..4191: note = Cas9 variant
  source 1..4191: mol_type = other RNA
atggcaaacttgcgcaactataaaggagattataacattggattagatatgggaactgggtcagttggctgggcggtaactgatagcgaaggaaaattgttacattttaagaaacaacctacgtgggggagcagactttttgattcagctgagacagccgcctcagcccggattccacgaggtcaaaggagaagatacgttagaagacgatggaggttagacttattacaacaattgtttcaggatgaagtatcaaaagctgatcctgagttcttcattcggctacgacaatctagacttttaaaagaagatagagaagaaggtcatagagactacaatcacccactgtttaacgactctgatttcacagaaacagattactataatagatttcctacaatttatcacttaagaaaatggctaatggaaacggatgagaaagccgatataagattagtatatcttgcagcacataatatagtaaaacaccgtggaaactttttaagacaagaaaatacatcattatcggcgaaaaatgcaagaccactcgatgcactgagagaatttaggtctgcattagtagactggtgtgcagaattaggatacgaatgcaatccagacgaaagtggggaaataagtaacgaaatattgagtgtgttagaagaagaacatgtagccaattcagataaaaagaaacggattagtagtttaattggagttgcaatgaacgaaggtgcaaaagaaagcaaagcatgtaatgatgcacttgctggagccatggtaggattaaaagcagagttcaaaaacgtattcggagaaatctcagcagaacaaacaagtatctatctatcaaatgatgaagcagtagatgctttacgtgaaggaataccagatgaaggactagagctgttcgggaaattgtgctcggtctattccgcatatgtattacaagggctactttcatatgcacctggacaaaccatcagcgtaaacatggtggcgaaatacgaaaaatatggaaatgatttgaaaacccttaaagccttagtatgtgaatacgctcgagctgaatatgattcatttttcagaggagaattttatagagatcaagatggacatgaacttaacatatacaatgcctctaaagcgcaaggatatacaagatacaatctaggtacatcaaaaatgtcgtatgaagactttgaaaaagcggttaagaaactattcgcgggcacagccgctgaagaggacggacgatacttacaaatgatgaaagagttcggcgaacaaagatttcttcgaagattaaaaacatctgataatggaagcatatattatcaactacatttggaagaactcactgccatattatcaaaccagggtaaacactacccatttttagttgaagacgcagagaaaataaaaagcctggtatcttttagaataccgtactatgtagggcccctgacagatagaaatgcaaggaaagataaacacggcaaaaatagattcgcatggtcggaaagaaaatccggaatggaagatgcagtaataactccctggaattgggatgaagtaatagatagaggcaaaagtgcagaagcgtttataaccagaatgacggggatgtgtacctatctgcagggggaagacgtactacctaaatgcagtctattgtacgaggagttctgcgtgctgaacgaactaaacggaagtagatggggaatggatggtgataaagaacatagatttgatgcggcagatcgtgaagcaatcattgaggaactatttaaaaagaagaaaactgtcaaatataaagatgtagcaaattggctagagagagaagcaggtagaatgaacgtgcatgttatgggtggacaaggcgaaacagggtacgagagcaaattgagtagttattatttctttcgaagggatatttttgatgttgaggaattagaccgagcggactacccaatgatagaacaaatcattctttggaacactctgtttgaagaccgaagaatattaaaagaaaaactagaagacgcgtatggccctaaaggaaatggaagattagatgacgaccaaataaagaaaatatgcagaaaacgctttacaggatggggccgtctaagtaagaaatttttaacagggataaaagtagatactgattgtggtcctcgatcaataatggacgtgttgagggaaggcgacccaaatgcaggatttagaggtaaaacaatggtaatgatggaagttctgagagacgaaaacttaggatttcaacaaaaagtcgatgagttcaacaaaaattattttgggcagaaaggaaaagcgttggaagtcaatgaactacccggatccccagccataaggcggtctttaaaccaagctataagaattgtagacgaaatagctaaaatagctggaaaagatccggaatctatatttattgaagttacaagagatgatgaactagacaagcgaggaaaacgcacgaaacgtcgatatgatgcattaaaggaagctctaacagtattcaagaaagaagacccagaaatctgggcagagctacaagctacgagtccgagtgatttggacgaacgattaacattatacttcatgcaaagaggcaaatgtttatattccggggaaccaatagatatcaataaattgagtagcggagaatacgaagtggaccatataataccaaggagctatataaaagacgatagtttagaaaataaagcattagtatgcagaaaatataaccaatcaaaaactgatgctatgctattagacccaagcatccgtagaaaaatgagatcatattgggatatgctactggacgcaaaattaataggtccaaagaaacaccgtaacttattaagggaccacattgacgagaaagccatgaaaggtttcgtcgcaagacagctagtagagacatcacaatccgttaaattagcaggatcattactatctgtcaggtacccaaatgcaaatatagttccagtcaaggccagtatgtcccatgatctaagagaagcagcaggattcgtaaaatgtcgcgaagcaaacgattttcatcatgctcatgacgcatatttggcatgtcgaatggggttatttatacaaatgcgacacccaaaagtctacgaaaacccaattgctatgacaagagtgatgcaaaaatatgcacaacaacagtcgaaagagtttaatagaaatcatcgagtccccggaactagcggattcattgtaaacagcttcatgagcagtggatttgacaaagaaactggagaaatctttaaagatacttggaacgctgaaacagaaatagaagggatccgaaaagcattaaattatagacagtgctacatttcaagaatgccaatggaagatacgggcgcattttggaatgcaacagtgtattctccaagagaccccaaaatggggcccaaattggccttaccattaaagaaaggtttagatcctaagaaatatgggggattttcatcccaacaattcgcttacttctttgtttacgaagctagggataagaaagacaaacaagtgttcagattcgcagaagttccagtatggctagcgtcacaaatagaaagcgataaaatagcattggaaaggtacgccacgggcttagcagaagcagaaaaactaaaattcgttagaattgaaagggcaaaaatacttaagaaacaattaatagaaatagatggcgatagattcatcctcacaggaaagaaagaaatgaggaatggaagagaactagcacttagtcaaaaagagacattgaatctaatagtagccggagacgaaaatgcttcacttgatgatagaggaaatgcatccgatgcggtatttgacgcaatagttagacagggagatgaaattggacttagactatataaacagttaaaaatagcagaaatagctgagagatatcgatcagtaggagcagacgcaaaagtaggggcagtaatgtcgttgttaagttcaattaatgcatcatccaacatggtaaacttatcaatggttggaggatcaaaatacgctggtaatctgcagcctaattactccaatttactgtcagatccagaaactaattttgtaatcatcgatcaaagcgtaactggaatgtttgaaaggagaacaagaataggattgtga

SEQ ID NO: 9077 - RNA, 4191 nt, synthetic construct
  misc_feature 1..4191: note = Cas9 variant
  source 1..4191: mol_type = other RNA
atgacgaaaccatattcgataggcctagacatagggactaactcagtaggatgggcagtaataacagatgactataaagtacccgccaagaaaatgaaagtactaggtaatacaaaccgagactatatcaagaaaaatctactcggtgctctcttatttgacggaggagaaacagctgaaggcagaagacttaaaagaactgctagaagaagatacacacgacgtaaaaatagacttagatacttacaagaaatatttgccgaggaaatgatgcaagtggatgaatcattctttcaacggttagacgacagtttcttagtcgaagaagacaaacaaggaagtaaatatccaatatttggaacactcaaagaagagaaagaatatcataaaaagtttaaaaccatatatcatcttcgtgaagaattagcaaactccaaagaaaaagctgatttgagattagtatatttagcactagcacatatgataaaattccgaggacatttcctgtatgaaggagatcttaaagctgaaaatacagatgtacaagccctctttaaagactttgtagaagaatacgacaaaacaattgaagaaagtcatctctccgaaataacagtagacgcacttagcatactgaccgaaaaagtgagcaaaagctcccgtttagaaaacctgatagcacattatcctacagagaagaaaaacaccttgtttggaaacctgattgcattatctcttggtctacaagcaaattttaaaacaaatttccaattatcagaagacgccaaattacaatttagtaaagatacatatgaagaagacctagaaggattgctaggtgaagtaggtgacgaatatgcagatcttttcgtatccgccaaaaacctttatgacgctatactactatcaggaatacttacagttgacgataattcaacaaaagcacctctttcagccagcatggtcaaaagatacaaagaacacaaagaagaactggccgcatttaaaagatttataaaagaaaaattaccaaagaaatacgaagaaatatttaaagacgatactaaaaacggttacgcaggatatgtgggagccgacaagaaactaagaaaaagaagtggaaaattagcaacagaagaagaattttataaatacgtcaaaggtattcttaacaaagtcgaaggtgccgactactttctagacaaaattgacagagaagacttcctaagaaaacaacgcacatttgataacggaagtataccacaccaaatacacttacaagaaatgcacgcaatattaaggagacaaggtgaacattacccgtttctaaaagaaaatcaagacaaaatagagaaaattttaacctttaggattccttattatgttggaccactggctaggaaaggaagcagattcgcctgggcagaatacaaagctgacgaaaagataacaccatggaactttgatgatattcttgataaagagaaaagtgccgaaaaattcattactcgaatgacattaaatgatttgtatttacccgaagaaaaagtattgccaaaacattcacccctctatgaaacatttaccgtgtacaacgaactaaccaaagtaaaatatgtaaacgaacaaggcgaagccaaattctttgacacaaacatgaaacaagaaatattcgaccacgtatttaaagaaaatcgaaaagttacaaaagacaaactattaaactatttaaacaaagagttcgaagaatttagaatagtgaatctgactggattagacaaagaaaataaagccttcaatgccagtctgggaacttaccatgatctccggaaaattctggacaaatcatttctagacgataaagtcaatgagaaaattatcgaagacattatccaaaccttaacactcttcgaagaccgagaaatgataagacaaagattacaaaaatacagtgatatattcacaactcaacaattaaaagaactggaaaggagacactacacaggatggggacggttatcctacaaattaatcaatggaatcagaaataaagaaaacaagaaaacaatattagactacctaatagacgacggctacgccaatagaaatttcatgcaactaataaacgatgatgctctatcattcaaagaagaaatagcaagagctcaaatcataggtgacgtagatgacatagcaaatgtagtccacgacttaccaggcagcccagctatcaagaaaggaatcctacaaagtgttaaaatagtagacgagctagtaaaagtaatgggacacaaccctacaaacataattatcgaaatggctagggaaaatcaaacaactgacaaaggtcgaagaaacagccaacaaagactaaaacttttacaagattcactcaaaaatctagataaccccgtaaacatcaaaaacgtggagaaccaacaattacagaatgatagactattcttatattacatacaaaacggaaaagacatgtacacaggcgagacattagacataaacaacctatcacaatatgatatagaccatataataccacaagcattcataaaagataattcactagataatcgggtacttactagatctgacaaaaatagaggaaaaagcgatgacgttcctagcatagaagtagtccacgaaatgaaatcattttggtcaaaactactctcagttaaactaataactcaaagaaaattcgataatttaactaaagcagaaagaggtggattgacagaaaatgacaaagcaggatttataaaaaggcagttagtagaaacaaggcaaataactaaacatgtagcgcaagttctagatgcaagattcaatgctaaacacgatgaaaacaagaaagtcattagggacgtaaaaatcataactctaaaatcaaatttagtctcccaattccgaaaagattttaaattttataaagttcgtgaaataaatgactaccaccatgctcatgacgcatacttaaatgcggtaataggtactgccctgctaaagaaatacccaaaattggcatccgagttcgtatatggagagttcaagaaatatgatgtcagaaaattcatagcaaaatcagataaagaaataggtaaagcaaccgcaaaatacttcttttattcgaacctaatgaactttttcaagaaagaagtaaaattcgcagacggcacagtagtcgaaagacccgatatagagacttcagaagacggcgaaattgcctggaataaacagacagacttcaaaattgtgcgtaaggtactatcttacccacaagtaaatatcgtcaagaaaacagaggtccaaacccacggtctagatcgcggaaaacctagaggtttgtttaatgcaaacccatcacctaaaccaaaaccagattcatctgaaaatctagtaggaatcaaaagaaatttggaccccaagaaatacggtggatatgcagggatctcaaatagctacgctgtattagtcaaggccataatcgaaaaaggagtgaagaagaaagagaccatggtacttgaatttcaaggaatatctatactagatagaataacattcgaaaaagacaaaagagcattcttattaggtaaaggatacaaagatatcaagaaaataatagaactacccaaatattcattattcgaattgaaggatggaagcaggaggatgttagcaagcatattaagtacaaataataaacgaggagaaattcataaaggcaacgaactatttgttccccaaaagtttacaactttactttaccatgcaaaacgcatcaataaccctataaataaagaccacatagagtacgtcaagaaacatagagacgacttcaaagaactactaaactacgttctggaatttaacgagaaatatgtaggtgcaaccaaaaatggcgagagacttaaagaagccgttgccgacttcgattctaaatctaacgaagaaatatgtacatcgttcttgggcgcagtcaactccaaaaacgcaggattattcgaactaacatctttggggagcgcttctgatttcgagttccttggcgtcaagatcccaagatacagagactacacgcccagttctttattaaaggactcaatattgatccatcaaagcatcacaggtctctacgaaacaaggattgacctaagcaaactaggcgaagattga

SEQ ID NO: 9078 - RNA, 4191 nt, synthetic construct
  misc_feature 1..4191: note = Cas9 variant
  source 1..4191: mol_type = other RNA
atgaaacgagtaaatgaagactatattctaggattagatataggcactaactcctgcggttgggccgtcactgataaaaaaaataacctactaaaactgagaggtaaaactgccataggctcacatctctttgaagaaggacatacggcagcagatagaagagggttcagaaccacaagaagaagattaaaaaggaggaaatggagactacgactcttagaagaaatattcgccgagccgatggcaaaagtagatcctggattcttcgtaagactccaccaatcatgggtatcacccttagacaaagaccgaaaaaaatacaacgctatagtattcccgacagcaaaagaagaccaagcattttataaacattatgccacaatttatcaccttcgagacgaactcatgacgcaagaccgacaattcgaccttcgagaaatatttttagccatacaccacatagtaaaatatagaggaaacttcctacaagacacacccgtaaaagatttcgaagcttcaaagatagaggtgggaccaatactgtctcatattaataacgctttcgctgaaaaaatagtcgaggatcaagaccctattgaattaaatgtcgccaatgcagcagacatcgaagatgtaataagaggaaaagatgcagaaaaaaccgtctacaagttagacaaagtaaaaaaaattgcaaagttattaactgacagcacggccaaagaagaaaagaacgtagcaaaacaaatagcgaatgcaatcatgggctataagacccaatttgaaacaatccttgacaaagagatagacaaaagcgacaaggcccaatgggagttcaagctcagtgatgcagatgccgacgacaaacttgacgccttactaccagatctcgacgaaactgatcaaacagttgtcgcagaaatagaaaaactcttctccgccataaccctatcgacaatcgtggatgaaaataaatccttatcccaatcaatggtagaaaaatataaaaaacacaaaaaagactacaagaaactaaaaaagtacataaatacgttacaagatcaaacaaaagcaaaaaaactactattagcctacgatctttatgtaaataaccgccatggaagactactagaggctaaaaaaactttcgaagacaaaaaaaaaaaaaaagcgctcacaaaagatgaattttacaaaatagttaaagataatttagacgattccgacttagcacatgaaatacaacaagaaatagcagcagacaattttatgccgaaacagagaaccaacagcaacggggttatcccctttcaactccaccaaatcgaattagacaaaattattgcaaatcaaggaaaatactatccctttctagcagcagaaaatccagtcgaggaccacagaaaacaagcaccttataaactagatgaactagtcagatttagagtaccctactatgtaggaccaatgataactgcagacgaacaagaaaaaacttcaggcaaaagctttgcttggatggttagaaaagaagacggacagattacaccatggaacttcgaacaaaaagtagacaggcaagaatcagctaacaagtttattaaacgaatgacaataaaagatacctatctcctatctgaagatgtactaccagctaactcccttttataccaacgatttgaagtgctaaacgagcttaacaatatccgcataaatggatcacgaatatctgtagacctaaagcagcaaatcttcaacgacctatttgaagaaaaaaagacggtaacagaaaaaagccttacatcttatctaaaacaaaacctccatttacctacagtagaaataaaaggtctagccgatcctacaaaatttaactctagcctcgcctcctattaccaccttaaatcattacacgtattcgacaaagaactagcagatccccagtaccaaaaagacttcgaaaaaataatcgaatactcatcaatatttgaagacaaaaaaatattccaagataaactacacgccgaatttaaatggttaacccccgaacaatttaaagccatttcaacctggcgattacaaggatgggggagactatcgcgaaaattattagtagaactacatgacacaaacggacaaaatatcatggagcaattatgggattcccaaaagaatttcatgcagatagtgaccgaaccagacttcaaagatgccatagccaaagaaaaccaaaacgtaacaagagcaaatggagtcgaagaaatactcgccgacgcctacacttcaccagcaaataaaaaagctattcgtcaggtagtgaaagtcgtagcagacgttgtaaaagccgcagggggaaaaaaacccgcacaattcgctatagaattcacacgcgatcccgacaaaaacccacaactatcccacatacgaggcactaaactcctcaaagcttatcaggaaacagccggagaactagttgatcaaaaattaactgattcccttaaagaagccatgacaagtagaaaactcctaaaagacaaatacttcctctacttcatgcaagcgggacgtgatgcgtacaccggccaaaaaatcaatatcgacgaagttagcaccaactaccaaatagaccatatacttcctcaatccttcataaaagatgacagcttcgataatcgcgtattaacagcaacgcccctcaatgcagaaaagtcagacgatgttccatataaacgattcgccaataactacgtttccgatatgaaaatgacagtaggagaaatgtggaaacactggcaaaaagctggaataataaataagcacaaattaggtaatctactattagatccagataggctaaataaatttcaaaaatctggattcataaaccgacaattagttgaaacttcacagataattaaattagtatcagtaatactccaaaataaatatccagacgcagaaatcattacagtaaaggcaggggataattccgcactacggcaaaggttaaacttgtacaaatcaagagatgtaaacgactatcaccacgccattgatgcctacctaagtataatatgtggtaatttcttataccaagtctaccccaaatatagaccatatttcgtttatggcaaatacaaaaaattctcccaggaccccgatttacagaaagaagttataaagcactttaaaggctttacctttatgtggccacttttgcagaaagacaattcagaaagaaaagctcctgaaaaaatcaaagaaaataactcagatagaatcgttttctataaacacccagacatcttcgacaagctcagaaaagcctataattataaatatatgttagtctcgagagaaacaacgaccgaaaactcgggtttatttgatgtcacaatctatccaagaggggaacgtgatttagctaaaacaagaaaactaattcctaaatcgaatggactagatccaaagatatatggtggatacagtggcaacaccgacgcatacatggtaatcgttaaaatagataaaggaaaagagtctatctacaaagtcataggagtcccaatgagagcactagcaagcctgaatcgggccaaaaaacaaggtaattataaagaagaattacaccaagttctagaaccacagataatgtttgacaaaaacggtaaacctaaacgatcagtaaaaggatttcggattataaaagatcatgtcccttttaaacaggttgtcctcgacggagacaaaaaatttatgctaaattcctctacatatgaaataaatgctaaacaattaacactgacgccggaaaccatgagaatagtcaccgataacttaaaaaaaggagaagatcaagatcaactactagttaaagcgtacgacgaaatcctacaaaaagtcgatcaatatttacccttattcgacgtcaacaaatttcgaaattcgctacacttaggaagagctaaattcctagacttggctgtaaacgacaaaaaaataacgcttacaaatatcctcaatggattacacgacaacttagtcactccagatttaaaaaacattggaataaaaacaccgttaggcaaattacaagtaccgtctggaatagtattatcgtcagaagccattctaatattccaatcccccactggactgtttgaaaaaagagtccgaatcgctgatttatga

SEQ ID NO: 9079 - RNA, 4194 nt, synthetic construct
  misc_feature 1..4194: note = Cas9 variant
  source 1..4194: mol_type = other RNA
atgaaggattataatataggattagatataggtacatcatcaataggctttgccgcaatcgatgatgacaataatttaataagggtcaaggggaaaaatgtgatcggttcaaggttatttgccgaaggaaaaacagcggcagaaagacgaggatttcgaaccgccagacgcagatacaatcgacgaaaatggcgtctaaaactacttgatgaaatattctacgaagaaattatacatatagacccagaattctttaatcgacttaagcaaagttcaatttcacccaaagacgaatcaaaaaaatatttcggatctctattattcccagacaaaacagatagcgcgtattaccatgacggtaaccaaacaatataccacctaagaaacagattagtccaccaaaaagaaaaagctgatatccgcgaaatatatttagcactacgacatatcgtaaagtacagaggaaatttcctagattcgacaccagtaagttcttttgaagctgataatttaaaattagacgagctagtacccgtcattaatgatatgtacgaaaacatagatatcgactttagcataaatgtagacaacatatctgagatagaaaaagtcttattagacaatcacctcaagtcagcagataaacaagacagactaaaagaattactgtatgacaatccggaatacccagatgacaaagtaaaacaaaaagaaattagtaaatttcggaaagatctggacaaagaaatcattaaagtaattgtcggatataaattcaacgcatacaaaatagtaaactacatacccgacgacggatcaaaattctcattctctttttcagatgaatcatcagacgacaaactagacgatctgtcggaagtacttgatgatagtcaaatggaaattctaaatacattaaaagtaatatattctagagtaagactaaatcaaatcatccctaacggcatgggactatcagaaagcatggtagcgaaatacaatagacatcatgaacaactagaagacctaaaagaattactagacgtactgccaaatgacgaaaaaagaagcatagaatacgcatacaccgcatatatcggcaacgtagataagcaaaaatacaataataacctagtagcaagtctcaaagacctcccaattaaaggagacataaacaaaaaaatacaagccgtattcgagtacgcaaaaggtcacatatcatcacaagacctatatgatgtaataaagacaatcataatagacaaatacttagaagacgaatcattcgaataccatgatctagtcgaaaggatatctaatgacattgataacaaagactatctattaaaacaacgctcaagccaaaatggtaacattccccaccaagtgcatcaaatggaaatggataaaatcatagctaaccaatctcaatactatccctttttgggcgtcttaaacccaaacgagagcagaaggcatatcgcaaaatataaaatatctgaactcgtaagttttagagtcccatattacgtgggacccctaataactccagaggaacaagaaaaaaccagcggaaagcatttcgcatggatgaaacgtaaagaagcaggaaaaataaccccgtggaacttcgaagaaaaagtcgacaaagaagcgacagccgctaaattcataaaaagattaacagtgaaagatacttacttacttaacgaggacgtgctacctgacaacagcttattatatcaacaattcaaagtattaaacgaattaaacattgtaaaagtgaacaacaaaagactgaccctaagtgaaaaacaaggagtatataacgacttattcaaaaataccaaaagcataaccgtaaaaagactaaaaaattatttgatatcaaattacaaacacttagaaaacatagaaataaccggcttaagtgacggggataaattcaataacagtcttggaacatacaacgactttaaaaagatttttggggcaagaattgatgatgtgaattactcagcagactttgaaaacataattgagtggtcaacagtatttgaagatcggtccatcttgaaagagaaattagaaaaagatattgactggataactccagaagagataaaagctgttgtcgcaaaacgttacagcggctgggggcggttatcagctaaactactaactgagctattagacgacgacggacaaaggataatagatatattatggaacgactcaatcacatttatggaagcagtatcaaaaccagaaataaaagcccaaatccaaaatataaaccgagacttcataaaagctacagatattgaaacagtgctagacgaagcctacacaagccctcaaaataaaaaagccattagagaagtttataaattagttaaagatatccaaaaagcaatgggaggaaaagcaccaagcagtatcagcattgagttcacacgctcacccgaagacaatggttctgtgacaaaaaccagatataataacatgcaaaacaaatataaagaacttggcaaagaacttagcgatgatctctccgcccaattaaaagaatacaaaggacgcatggaccaagacaaattctatctatatttcatgcaaatgggtaaagacctctatgacggaagcacaataaatctagatgacctaaactcataccaaattgaccacatagttccacaaagcttctataaagacgattcaatcgacaaccgagtattgacacactacaccaataatcagaaaaaaggcaaccatacaccactaaacggattaaacatagacgcccagactcaaaacttatggaaacacttaaataaactaggactaatcagcaaaaaaaagctacagaacttatgttttaaagacataaaccagctatcaaaatacacaaaacatggatttgtcagaagacaactagtagaaacctcgcaagtaataaagttagtagcaaatatccttagtgatgaatttgcaaatgacggtactaaaataatcgaagtcaaagccaaaatgaactcactaatgcgcgacacttttaatttatataaagtcaggcaattaaacgactaccatcatgcagtcgacgcctacttaaccacgtttgtcggaaaatacttatacaaacgatacccaaaacttagaagtatgtttgtttacggtgatttcaaaaaattttcggcggaagacgatctaaaagatattaaaacttttaattttcttcatgacataactaaccccaaagaaagtaacaaagagaaaatctatgacgagaaaagtggagaactcatattagaccgaaaacacgctatcgaaaccatcaaaaaaatataccaatataaatttatgctcatagtacgcgaagtatcgaccaaatctggtcagttatttaaacagacgatctactcagcaaaaaaaacaaacggccttaaatcggccatacctgtaaaaagcaatctagaacccagcatatatggatatagatcaggaaacgtagatcaccacatggttatcgtaaaaattaaaaaaggaacaaaatatagcttcaaagtaataggaatctctgctcgggctatacaagaattagaaatcgcaaaaaaaatcggaaactacagagacaaactttacgaggtcgtctctgaccgattatcacaaagtatgaaatcagtagaaagcttcagaataatcctagataatatcatgtatggacaactcatagtagacggaaatgataaatttactttaggaagcgctgattaccgaaaaaattcaagacaactagtattgtgtaccaactcactaaaaatattaaaagatgaagactacatgaatagactatcagacattcaaagaagcaaactcatggtacaggtatacgatgaaataattaagataatgaaaaataaatactcactatttatttcaaatacagaaaaactactcgaaaaaagagatattttttgcggactctcattcgatgaacaaaaaattgttatttggaaaattataatagacttacacaatggaccatttacaaaaatacaagaactaggaatcaacaataaaatgggaacatttcaaacaaaacatggcattatactcaccgaaaatgcgattgtaatataccaatcaccttcaggcctttttgaacggaaggttcgactgaaggatttatga

SEQ ID NO: 9080 - RNA, 4194 nt, synthetic construct
  misc_feature 1..4194: note = Cas9 variant
  source 1..4194: mol_type = other RNA
atgaaaaaagtactaggactagaccttggaacaaatagtataggatgggcgctagtaaacgaagctacaaaagaagaaaaaaaagaaggaaaatcctcagaaattataaagctaggcgtccgagtaaatccattaacagtagacgaaaaaacaaatttcgaaaaaggacgtcccttaagcaccaatgcagatagaactctaaaaagaagtgcccgtagaaatctacaaagatataaattacgacggcgtaatttgatcgaaatccttattaaaaatggtttcattactaaagatacgccattaacagaaacaggcaaagacacaactcatcaaacactcaaactacgagcaaaatcagcaaaggaaaaggtagacctcaaagattttgcaaaaatactactcacaataaataaaaaaaggggatataaaagcagcagaaaagttaacagtgatgaagacggattagccattgacggaatggcagtcgccaaacacttatatgaacaaaatctaacaccaggacagtacgtattgaatttactacaaaaaaacaaaaaatacgtaccagacttttatagatcagatctccaagaggagttcaaaaatatatggaacaatcaaaaaacctattacttcgacattctgacagatacactctttgaggaactcaaagacaaaaacaaaagccaaacctgggcaatttgcaaaaaaccattcgacattgcaggaattaaacaaatcggtaaagcgagcgacaagagactcgaaagatacaaatggagaacagaaggactaactcagaaattaaatttagaatatctagcaatcgcccttcaagaaatcaacaacgatataaataaaagctcaggctatctgggagcaatatccgatagaagtaaagaactctttttcaataaagaaaccgtaggtgagaacctatatagacaacttgtaaaaaccccacacacatcactacgcaatcaagtgttttaccgccaagattacctcgacgagttcgaaactatctgggaaactcaagcaaaattttacccgcagttaacacataccctaaaagaagaaataagagacgtgataatcttctaccaaagaaaattaaaatcacaaaaaagtcttataagtttttgtcaatttgaaagctgggaacaaacctacatagaaaaagaaaccggcaaaagcaaaactaggacagtcggcaggaaagtaatccccaaatcaagccctctattccaagaatttaaaatatggcaaaacctcaacagtcttgaattccgtaacagcgacgaaggagaaataatagaattcatcaaactagacgaagacatccgacaaaccgtcttcgaagaattgaacctaagagggaacttaaagccaaacgatgtactcaaaattctaggaaattatatatctctaggaaaagtttcccaatggaaatgcaattttgaagaaatagaaggaaaccggacaaatgcagcactatacaacgtatatcaaattatagcagaaaatgaaggatatggattcgattgggcaaaaaaaaccgcttcagaaatcaacaaagaactaaaaaacatctttccacaacttggcatagatgcaagcatacttgacttcgacttcacccaagcaaactttgataaacagacatcatatcaactctggcacctactctactccgccgaagaagattttaaaatcagtgaagaagataaagtcttgtatggaaactcgagtgtcagcctaaaaaagaaactacatcaaaagtatggtttcaagccagaatatacaaaattattaactaacataagcctacaacctgactacggtaacctatccgccaaagccatttgtaacatactaccctaccttaaagaaaataatgtatactcagaagcctgcgacttaacaggttataatcattccaatttcttgacagcagaagaacaagcaaaaagacccttaaaacctattcttgaactactaaaaaaaaacagtctaagaaacccagtagttgagaaaatactcaatcaaatggtcaatgtagtaaatcaagtgatagaaacttatggaaaacccgatgaaatacgcatcgaattaactagggaactaaaaaaaagtgcaaaagaaagagcaaacatgaccaaatcaatagctgacgcaacaagacgaaatgacgactatagaaaaacaataataaaagaatttggaatccctaatcctacaaaatctgatgtagtaagatacagattatggcaagaactcgcatccagaggatacaaggacatatttaccgataccgagatcaaaccacaagaattattttcaaataaaatcgatattgagcacataataccaaaagcactactattcgacgattcattctccaacaaaactctagcatttaaaaaggataacttgaaaaaagcaaatcgtacagcctatgattttattgctaatgactacgcacccaacttggagaactacattgaacgcgttgaatctctacataaagatcgcaaaataacaagggccaaacgaaacaaactattaatgctccaaagtaaactaccggatgggttcatcgaacgagacctccgaaacagtcagtacatcacaaaggaagctaaaaaaatgttatatgaagtctgcaggaccgtagtaagcacatcagggtcgataaccgacaagctgagagaagattgggatctcattaatgtaatgaaagaacttaattttcctaaatataaagcactaggactaacggaaaaaatcgaaaggtatgacataggggctgaaaaaatgaaagaagtcgaaatcatcgaagactggaacaaacgtaacgaccatagacaccacgcaatagatgctctgacagtagcgttttccacccattcacacatacaatacctgaaccaccttaacgcccgccgagacgaaggtcacaaaaaacatgcagcaataatagctatcgaaagtacaataaccgaaaaagaaggaaacaaaaaacgcagattcatagcaccacttccaaactttagactacaagccaaagaacacattgaatccatactagtatcatttaaaaataaaaacaaggtagttactaataacataaataaaaccaaacggataaaaaaggacaaattcaatacgaaggtacagctaaccccaaggggacaactccacaaagaaacgatatatggaaagataaaacaaccactagaaaaacatataaaattaaacaagtcatttaccctcgaacaagcaaaattgataatagataaaagacaacgagaaaaagtattaaaccacctagaaaaatacgcacataactcggatatagcattcaactcaaaaacactaaaaaaaaacccactgctcatatcagatgaaccactaaaagaagtactttgttttgaagaggttttcactatccgtaaggatatctcatacgataattttaaaaatgagaaacagttagacaaagtaattgacgagaaagtgaaacaagcactaaaagaacgaataaatcagtataacggagactttagagaagcattttctgacatagaaagaaacccgatatggcttaataaagcaaaaggcatctgcgtgaaacgagctaccattaaaggtgtaagtaacgcggaaccacttcatacagccaagaaccatctaggagaagaagtattaacagaaaataaagagcaaattccggtagactatgtcagcacaggcaataaccatcacgtagccatatacgaagatgaagatggaaacctacaagaaaaagtcgtttcattttatgaagcagttatccgcgttaatgaaggcctaccaataatagacaaggaatacaacaaaagtctaggatggacattcaaattcacaatgaaacaaaatgaaatgttcgtcttcccatcggaggatttcaatccaacagaaatagacctattagatcaaaaaaacgcatcgctcatctctccaaatctattccgagtccagaaatttacaataaaagattatttcttccgacaccatcttgagacaactgtggaaaacaacaatacgctcaaaaacacaacatggaggcgtgagggtttatccggcatctatgggatcataaaaatcagattgaaccatctaggagaaatcgttcaagtaggagagtattga

SEQ ID NO: 9081 - RNA, 4194 nt, synthetic construct
  misc_feature 1..4194: note = Cas9 variant
  source 1..4194: mol_type = other RNA
atgaatgaaaacaaagaatggttcttagggctagacataggtacagcatccgtgggatgggcggcaacagacacaaattacaacctactaaaattaaaaggcaagaaatcgtggggagtacgactgttcgatgaagcccaaactgcaaaagaaagaagagattgcagatctaaaagaagacgtctagccagaagaaaatggagactaggattactagaagaattatttgccgaagaaataaacaaaatcgatccaaacttcttcatgagactacgcgaaagtaagtacaaagtatcggacaagacaggtaacgtacccagcatattgtttaatgagaaaaattacactgacaaagaatactatagaaactacaaaacaatctaccatttaagagctgatttaatacacaaaaacaatccagatatccgcgaattattccttgccatacaccatatattaaaatacagaggccactttttattcgcaggccaacaattcaaaggcagcgaaatcaaagacaatatcagagaattgttacaatacaactcactaaatataaaaatagacataacagatgaactaatcaataacatagctgaaattcttctcaagaagaaaaacagtacagacaaaatcatagaatttaagaaattatttgcagatgaaaaacaattaatcgaagcactacgccttgcactgggaaacaaaacacaacttgctaaattattcgacatagaagcatacaaagaactagacataagcattaaaactatctcttttaaagagaaaatatatgaagatgttagatccaattacgaagaaatcctaggcgaatacataatcgttttagatacggcgaaattaatatacgatgcaataatattatcaaaaattaaaatcaaaaatatgactatcagcgaatcaaaagttgtcagctatgaaaaacatggaaaagacttgaaacaattaaaacacttgattaaagaagattgtaaactatcgaagaaagaaaaacgacaactattcgaaaatatattcgtcaaagaagatgaaaaaggggccaattatgtaaattatattggcaaaaataacgcaggatcctcaaaatcctcttgctcttacgaagactttaagaaattcctaactaaagaactaaaatgttgtgaagaatccaaattaaaacaagacatattagcagaacttgaattagagactttcctaccaagacaaagaacgaaagacaattcagtaatactctatcaaatacataaagaagaattagaaaagatactaaataacgcagtacaatatcatccatttctaaacaacaccgacgaatacggcatttcaataaaagagaaaataatacaattactagagttcagaataccttattacgtcggtccactgaatacatctcacaaagtaggagacggaggattttcatggtcagtaagaaacaaagggtatgaacacatcgctgtaactccctggaatttcaacaaagttattaacaaagaagaatcagccaaaaactttatagaaaacctaacaaatcaatgtacatatttactatacgaggacgtgctaccaaaacactcattattatattctgagtttgccctactaaacgagctaaactccataaactacggaggcaaaagattaacagtcgaacatcgaaatctcataatcgaaagattctttaaacaaagcgctcccaaagcgacaggaaaagaacttaagaagttcctaatgagtgaaggagtgatagatggtaaagatgaacttagcggcttcgatgtgtcaatcaaaaacgacctaaaatcatacagagattttaagaaaatacttggtgataaattcgactccgaaaaagtagagaaaatgataagatggatcactctatttggcgagagcaagcaattacttgtagacaaaataacaaaggaatatggagacatatacagtctagaagaaatcaagaaaatatcgggacttacttacaaagattggggaagattaagcgaaaaactactcaccgaaatagtcagcagccaactatatgatgaaagtactggagaatgcttcaacataataaatgccatgcgaaacaacacgctattatttatggaattactgggcaccaattacgactacttcgagaaaataaatatatataaccgaagactaagaaaagaaataacagaaataacaccccatatactcgatgatctatatgtgtcacccgccgtaaaacgatcaatatggcaagtagtaaggatcgtcgaagaactaaagaaaataatagggagtgaaccaaaaagaattttcgttgaaaccactagatccaacaaagagaagaaaggagatgatggacgcaaagactcgaggaagaaagcacttcttgaactctataaaaagattaaaacctccgatatagttgaactagagaaagctctgggacacacagtagatttcgacaagaagaaacaggatttaaccgacatcgacaataacaaacttaaagcccggaaactatacctatactacacacaactaggtcgatgtttatacacaggcaaagcaatagatctaaataatttgctttcctcgaacagcgaatatgatgtcgatcacatatacccacagtcaaaaacaaaagatggaagttggaacaatctagtcctagtcaataaaaccgaaaacagcaagaaatccaacggattaatttccgaatcaatacaaaggaaaaacaaacacttttggagattcctaaaagccaaaaacctaatttcagaagaaaaatacaaaagattaacacgaacagaagattttaccgacgacgaattatcagggttcatagctcgacagctgatagaaacatcacaatcagttaaagcagtatcacaaatactacaaaacctaaacccaacaaccgaaatatgcttttctaaagcagaaaatgtgcacgactttagacaagaatttggaaagatcaaagtaggaaaaaggagaaatcttaccgaagaacaacaaaaagaagcaaaagaaggacaacttataaaagtaagagacttaaatgatctacaccacgcaaaagacgcatatcttaatatcgtagtaggaaacgtctaccatataaagttcacaaggaacccgaaaaactttataaggaaaaacagtaagaaccgcgaatacacactgaacactttgttttattccgataaaatagaacgaaatggtgaagtagcatgggaaaaaggaaaaaccgagaaaattgtttcatcggtaatgtgtaacaatttaataaacgtaacaagaaggacctctgaacaaaaaggggcactatacgatgcaacgatttacaaagccaacgcagcaaaagaaggaagttactatcccgtaaaaacaaagaataagaacttaaaagacgtcacaagatacggaggtttcacatcaataaaaattgcatactattcaatcttcaagtatgacataagaaataaagataaagtaaaggaaaatataaaaattattccgataccaatatacatatcgcaaaatattaaaaccgatttagacctaataaactttgcagaaaaacaaattaagctaaagaaaggtgagaatatagagaacttgcaactaatatacaagaaactaaacataggcgcactggtaaaaatagactattatccctattacgtaggtggcaaaacaaatgataacttttacatcgacggcgctgtccaagtgctactaagctcagacattgagaggtacctaaaagaagtcgtaaaatttgtaaactttcagagagaaaataaagaagccaaggtatctaaggaacacatatcatctgaagaaaatatagaactttacaacacattactttgtaagatgacagcaaagatcttcacacacaccaaaaataataaatacaatgatcttgcacaagacaaagcaaagaacactttcaaaaacctttcattagaagaacaatgtaaagtgttactggaaatattaaatctattaacaaataagaaaacaactttcgacttaagcctaataaacgaaaaagcgtctagggtaaaatgcggatttaacctactaaatcaaaaacaattctcaataatagagcaatctgtaaccggactttacgagaaagaaataaaaataattgaagattga

SEQ ID NO: 9082 - RNA, 4197 nt, synthetic construct
  misc_feature 1..4197: note = Cas9 variant
  source 1..4197: mol_type = other RNA
atggaaacacaagcaagtaatcaactcatatcatcccacttaaaaggatatcccattaaggactattttgtaggtttagacataggaacgtcctctgtagggtgggcagtgaccaacaaggcttatgaacttctcaaatttagatcacataaaatgtggggtagcagactatttgatgagggtgaatcggccgtagctcgtcgaggtttcagatcaatgagacgacgactcgaaagaagaaaactgagattaaaactattagaagaattgtttgcagacgcaatggcacaagtcgatccgacgttctttatgagattaagagaatccaaatatcattacgaagacaaaaccacagggcactcaagcaaacacattttatttatagacaaaaattacaatgaccaagattactttaaagaatatcctaccgtataccacctacgaagcgagttaatgaaaagtggcacagatgacatacgaaaactatttctagcagttcaccatattttaaaatataggggaaactttttatatgaaggagcaacctttgacagtaatgccagtacattagatgacgtgataaaacaagcccttgaaaatataacattcaactgcttcgactgcaactcagctatatcttccatcggacaaatacttatggaagccggaaaaacaaaaagcgacaaggcaaaagctatcgaacatctcgtcgatacttatatagcaacagacacagtagacacatcgagtaaaactcagaaagatcaggtaaaagaagataagaaacgtcttaaggctttcgcaaacctagtacttggactcaatgcatctctaatcgacttatttggatcagttgaagaactagaagaagaccttaagaaacttcaaataacaggtgacacatatgatgacaaacgagacgagctcgcaaaagcatggtcagacgaaatttacattatcgatgattgcaaatccgtctacgacgcaatcatcctgctaagtataaaagaaccaggattaaccatatcagaatcaaaagtgaaagcattcaataaacacaaagacgacttggcaattttaaaaagtttactaaaatccgaccgatccatatacaacacaatgtttaaagttgatgaaaaaggtctacataattacgtccactacataaaacaaggtcgaacggaagagacaagttgtaaccgagaagacttctacaaatacactaagaaaatagttgaaggcttaagtgatagtaaagataaagaatatatactctcacaaatagaactacaaattctactcccactacaacgaatcaaagataacggcgtaataccctaccaactacatttggaagaattaaaagcaatactcgcaaaatgcgggcctaaatttccgttcttaaacgaagttgcagacggcttctctgttgccgaaaaactcatcaaaatgttagagttccggattccatactacgttggacccctgaatacccaccacaatgttgacaatggcggatttgcgtgggcagtaagaaaagcatccggacgtgtgacgccctggaatttcgacgataaaatagacagagaaaaatcggcagcggcatttatcaagaacctaaccaataaatgcacatacttattaggcgaagatgtacttccaaaaagtagcctcctctattcagaatttatgttattaaacgaattaaacaatgtaagaatagatgggaaacctctagaaaaagtagtaaaagaacatcttatagaggcagttttcaaacaggatcacaagaaaatgaccaaaaatcgaatcgaacaatttttaaaagataacggatatatatctgaaacacataaacatgaaataaccggcctagacggtgaaataaagaatgaccttgcatcctatagagacatggttcgcatattaggagatggattcgacagaagtatggcggaagaaataataactgacataactatattcggagagtcaaagaaaatgttacgcgaaaccttacgtaagaaattcgcatcatgtttagatgacgaagcaattaagaaactaacaaaactaagatatcgagattggggtcgtctatcacaaaaattactaaatggtatagaaggctgcgataaagccggagacggcacacccgaaacgataattatcctcatgagaaatttttcttataacctaatggagcttttaggtgacaaatttagcttcatggaacgaatacaagaaataaacgccaaattaacagagggacaaatagtcaaccctcacgacattatagatgacttagcgttaagcccagcagtcaaaagagcagtctggcaagccttaaggatcgtagatgaagtagctcacattaagaaagcgcttcctgcacgtatattcgtagaagtaactagatcaaacaaaaacgaaaagaaaaagaaagattccagacagaaaagattgtctgacttatacgcagcaataaagaaagatgatgtactattaaatggattgaataatgaaattttcggagaactaaaatccagtcttgccaaatacgatgacgcagcactaagatcaaagaaattatatctatattatacacaaatgggtcggtgtgcatacacgggagaaataatagaattatcactacttaatacagacaactatgacatagaccatatttaccccaggtctctcacaaaagacgacagctttgataatcttgtgttatgtaaaagaaccgcaaacgcccaaaaatcagacgcttacccaatctcagaagaaatacagaaaacacaaaaaccattttggacatttcttaaacaacaaggactaattagtgaaagaaaatacgaaagattaacaagaataacaccactcacagctgatgatctatcaggattcatcgccagacaacttgttgaaacaaatcaaagtgtaaaagctgcaaccaccttactcagaagactatatccaggtgtcgatgtagtttttgtaaaagcagaaaacgtgacagattttcgacacgataacaacttcataaaagtaaggtctttaaatcatcaccatcacgcaaaagatgcatacttaaatattgtagttggcaatgtatatcatgaacgctttacaagaaattttcgagcatttttcaagaaaaatggtgccaaccgtacctacaacttagctaaaatgttcaactacgacgtaaattgtactaacgccaaagacggaaaagcatgggacgtgaaaacttctatggatacagtgaagaaaatgatggattcaaacgatgtaagagtaacaaaacgactacttgaacaaactggagcgttagccgatgcaactatatacaaagcaacagtggcaggaaaagccaaagacggtgcctatataggtatgaaaacaaaatcatccgtatttgctgatgtatcaaaatacggcggaatgacaaaaattaaaaatgcatatagtataatagtgcaatacacaggtaaaaagggagaagttataaaagaaatagtaccattacctatatacctcacaaatagaaatacgactgatcaagatctaatcaactacgtagcctcaataataccacaagcaaaagacatatcaattatttatggaaaattgtgtattaaccaactcgtcaaagtaaacggattttattactatctaggaggaaagactaacagcaagttctgtatcgataatgcaattcaagtaatcgtcagtaacgaatggatcccatacttgaaagttctcgaaaaatttaacaacatgcgaaaagacaacaaagatctcaaagcaaatgtcgtaagtacaagggctctagataataaacacacaatagaagtacgcatagtcgaagagaaaaatattgagttcttcgattatctagtttccaaattaaaaatgccaatatatcagaaaatgaaaggcaataaagctgcggaattaagcgaaaaaggatatggattatttaagaaaatgagcttagaagaacaatcaatacatctcattgaacttctaaatttactaaccaaccagaaaacaaccttcgaagtcaaaccacttggaattacggctagcagaagcactgtgggttcaaaaatatcaaatcaagacgagttcaaggtaataaatgaaagtatcacaggcctatactctaacgaagtgacaattgtatga

SEQ ID NO: 9083 - RNA, 4197 nt, synthetic construct
  misc_feature 1..4197: note = Cas9 variant
  source 1..4197: mol_type = other RNA
atggaaaaatcatacagtataggcctcgatataggaacaaacagtgtaggatggtcagttattacagatgattataaagtaccagcaaagaaaatgagagtattaggaaataccgataagaaatatattaagaaaaatctactaggagcacttttatttgatagcggtgaaacagcagaagccaccagactaaaacgaaccgccaggagacgatacacacgacgcaaaaacaggttgcgctacctacaagaaatattcgccaaagaaatggcaaaagtagatgaatcatttttccaaagacttgatgaatctttcctcacagacgacgacaaaacatttgattctcacccaatattcgggaataaagctgaagaagacgcctatcatcaaaaatttccaacaatataccacctgagaaaacatttagcagattcccaagaaaaagctgacttaagactaatctacctagctctagcccatatgattaaatttagaggacattttctctacgacaactttaacgatgacaactttgattggagaaatatcgacatacagaaaaggtacgaagaatttatagaaacatacgatagtacgttaggtgaaagctatttagcagatatatcagtagacgccgcatcgatactagaagaaaaagtatcaaaaacagaacgactagaaaacttactaaaatactacccaacagaaaagaaaacgacattctttggaaatctaataaaattgatactgggacaacaagcaaaattcaaagcaatatttaacctagaagatgaaataagccttcaattcgcgactccaacctatgacgaagatctagaagaactattaggaaaaatagacaatggagacagttattcagagttattcgtagccgcacaaaacctatataatactatactactagcaagtttcttaaaaacagacaataaaagcgcaaaagccccactatcgacatcaatgatagaaaggtatgaaaatcacaagaaagatttagccaaactcaaagacttcgtcaagaaaaattgtcctgaccaataccatgacatcttccgtgataaaagtaaaaacggttatgcgggatatatagacaacggagtatcacaaaatgacttctacacattcataggcaaatgcctagaggaatccttgaagaaagacaaaggagcccaatattttctagataaaatagaccgcgatgactttttgcgaaaacaaagaacatttgataacggggcgtttccataccagatacaccttcaagaaatgcacgcaatattaaggcgtcaaggcgactattatccatttttaaaagaaaaccaagataaaattgagaaaatacttacgtttcgaatcccatactatgtaggacctctagcacgtaaagactcacgttttgcatgggctaactacagatcagacgaagccataactccttggaacttcgatgaagtagtagataaagagaaaagcgcagaaaaatttattacgcgaatgactctaaacgacctataccttccagaagagaaagttctcccaaaacattcattaatatatgaaacttttacagtctataacgagctgacaaatataaaatatgttaacgaccaaggaaacgctatacattttgactcagaactgaaagagaaaatattcaatcaactcttcaaagaaaacagaaaagtaagtaagaaaaccctaatcgatttcttaaacaactcagaaggcatatatacagacaaattagtaggaatcgacgaagaagtaaaatatttaaacgcatctctcggaacctaccatgatctaaagaaaatattagaatcctttatggatgatgaaataaacgagaaaataatagaagacatcattcaaaccttaaccttattcgaagatatagaaatgaaaagacaaagactacaaaaatacgatgatatatttactccaaaacaactaaaagaattagcccgaaggaactatacgggttggggtagactaagctacaaattaatcaatggaataagaaacaaagagaataataaaacaatcttagattatctgaaaaatggaaatcggaactttatgcaattaataaacgatgatagattgagcttcaaacaaataataatcgatgcccgtaaaatagaaaaattagataatatagaatcagtagtatacaatttacccggatcaccagcaattaagaaaggtatacttcaatccataaaaatagtagatgagctcgttaaagtaatgggacataacccagacaatatagtaatagagatggctcgagaaaatcaaacaacaaaccaggggaaaaatagaagccaacagcgactcaaaagactacaagacagcatgtctaacttcaaagacagctcaatcagcttaaaagatgtcgataacagcgatctccaaaacgacagactatttttatactacatacaaaacggaaaagatatgtatacaggcgaagaactagacatagatcacctttcagactacgatatagaccacattatcccccaatcttttataaaagacaacagcatagataacagggtcttaacaagctcagccaaaaatcgaggaaaatctgacgatgttcctggacgagatgtagttctaaaaatgaaaccattttggaagaaactatatgacgtaaaattaatatctaaacgtaaatttgacaacttaaccaaaagcgaacacggaggacttacagaatctgacaaagcaggttttattaagcgacaacttgtagaaacaagacaaataacaaaatacgtggctcaaatcttagacggaaggttcaataccaagcgcgatgataacaataaggtaatacgcgatgtcaaagtcataactctaaaaagcagcttagtatcacaattcagaaaagactttggattttacaaagtacgagaaatcaacgattaccaccacgctcatgatgcatatttaaatgcagtagtaggtactgctatactaaagaagtatccaaaattagccccagagttcgtttatggagaatataagaaatgcgatgtccgaaagttgatcgcaaaatccggagataaatctgaaatcggaaaagctacagcaaaatatttcttctacagcaatttaatgaacttctttaaaagagtaattagatattccaacggcatgatcgtcgtacgacccgtcatcgaatactcaaaagatactggcgaaatagcatgggacaaagaaaaagactttaaaacggtctgtaaagtactcagttgcccccaagtcaacatcgtcaaaaaggtagaaaagcaatcccatggactagatagaggaaagccaaagggattctataacgccaatccaagccccaaacccaagaaaggatccaaagtaaatttagtacctatcaaagccaaccttaaccccaaaaactacggcggatatgcagggatatcaaatagttatgcagttttagtagatgctactattgaaaaaggtgccaagaagaaactgacaagaatacaagaatttcaaggcatttccataatagaccgggagaagtacgagaaaaacaaagtagagtttcttaaaggattaggatataaagaaatttattcaattatcacactacccaaatactcactctttgaattagcagacggtagccgaaggatgctagcaagcatactatccacaaataataaaaggggagaaatacataaaggaaatgaattagtactcccggcgaaatatataccattattatatcacgcaaacagaatacataacacgttcgaaaccggacaccgcgagtacgttgaaaaacacatagcagagttcaaggaaatagcagaaataatcctagagttcaataacaaatatgttaacgccaagaaaaacagcagcattatagaaaaagcgctagagtcttttgattctttttctctagatgaaatatgtgacagctttgtcggaaaactaaagaaaaataacaccaagaaaaacagtggattattcgagctagtatccctgggatccgcatctgatttcgaatttctagaaactaaagtcccccgatacagagattacacaccatcatctctactaaacgcaacattaattcatcaatcaattaccggattgtacgaaacaagaatcgacctaagcaaacttggagaagagtga

SEQ ID NO: 9084 - RNA, 4197 nt, synthetic construct
  misc_feature 1..4197: note = Cas9 variant
  source 1..4197: mol_type = other RNA
atggaaacacaagcctctaaccaattaataagttcgcacctaaagggatacccaatcaaggactattttgtcggtttagacatcggaacctcatcagtaggctgggccgtcacaaataaagcctacgaactcctaaagtttcggagccataaaatgtggggtagcagactatttgatgaaggagaaagtgcagtcgccagacgagggtttcgttccatgagacgtagactagaacgtagaaaactcagactcaaacttctagaggagctattcgcggatgcaatggctcaagtagacccaactttctttatgcgactaagagagtcaaaataccattatgaagataagaccacaggacactcatcgaagcatatcctatttattgataaaaattatacagatcaagactactacaaagcctacccaactatataccacctaagggcagaactaatgaaagatggaacatatgacataagaaaattatttttagcagtgcaccatatcctaaaatacagaggaaacttcttatatgaaggcgcctccttcgacagtaacgcttcaacattagatgacgtacttaaacaagcactagaaaatattacttttaattgcttcgattcatcagctgccataggatcaattggacaaatattaatggaaaccggtaagacgaaaagcgataaggcaaaaactatcgaaagacttgtggatacatacattataacagacgaagtcaatgcatcaggtaagacgcaaaaagaccaagtgaaagaagacaagaaacgattaaaagcattcgccaacttagttttaggtctgaacgcatcccttatagatctattcggaagtgttgaagaacttgaagaagatcttaagaaacttcaaatcacaggcgatacatatgatgataaacgagatgaactagcaaaagcgtggagtgatgaaatttatatcatagatgactgcaaaagcgtatacgatgctataatactattatcaatcaaagaacctggattaacaatttcagagtccaaagtaaaagcgttcaacaaacacaaagacgacctggctatattaaaaagtctactaaaatctgatagatcaatatataacgcaatgttcaaagtagacgaaaaaggactacacaactacgtccattatattaaacaaggaagaacagaagaaacatcatgcaatagagaggacttctataaatacacaaagaaagtggtcgaaggcctacctgattcaaaagacaaagagtatatacttagcgagatcgagttacaaacactgttacccttacaaaggataaaagacaacggagtcatcccgtaccaactacatctagaggaactaaaagttatccttgcaaaatgtggtcccaaattccccttcctaaacgaagttgcagacggatttagcgtcgcagaaaaacttataaaaatgttagagttccgaataccttattatgtcggacccttaaatacgagccataatgtagacaatggaggcttcgcatgggcagtaagaaaagcctcaggacgtgtaacaccctggaacttcgacgataaaattgacagagaaaaatcagctgcagcgtttatcaaaaacttgacaaacaaatgtacataccttcttggagaagatgttttacccaaatcatccttactatattctgagttcatgttactaaacgaattaaacaacgtacgcatagatggaaaaccattagaaacaaaagtcaaagcccatctaattaaagcagtattcaaacaagaccacaagaaaatgaccaaaaacagaatagaacaatttttaaaagataataattacataccagaaaaacacaaacccgaaataacaggacttgacggagaaattaaaaacgacttagcaagctaccgagatatggtacgaatattaggaaataacttcgatctttcaatggctgaagaaattataacagatataaccatatttggggaatcaaagaaaatgctacgcgaaactttacggaagaaatttgccagttgtttagatgacgaagcgataaagaaactatccaaattaagatatagagactggggtcgactatcaaagaaattactaaatggaatagatggatgcgataaagccggtgacgggacaagcgtaaccatcatagaagcaatgagagatttcagttacaacctgatggagcttctaggcgaccgcttcctgtttatggaaagaatacaagaaataaacgacaaactcactgaaggtcaaattgtcaatcctcatgacataatagacgatctcgctctatcgccagcagtaaaacgcgcagtatggcaagcattacgtatagtcgacgaaatagtccacataaagaaagctctaccagcaagaattttcgtggaagttaccagatccaataaagcagaaaagaagaagaaagattcacgacagaaaagattatctgatctctacgcagccataaagaaagacgacgctctattatcaggactaactaatgaagaatttggtggactcaaaagcgaactagcaaaatatgacgacgcagccttacgttcgaagaaattatatttatattatacacaaatgggaagatgtgcatatacaggagaagtaatagatttgtcccaattaaatacagacaattatgacatagaccacatatacccacggagcctaaccaaagacgatagcttcgacaacctagtactatgcaaaagaactgccaacgcacagaaaagtgatacttaccccataagcaaagaaatccaaaaagctcaaaaagccttctggattttcctgaaacaacaaggcctaatatcagaaagaaaatatgagagactcacacgcatcacaccacttacagcagatgatctatctggatttatagcaagacaattagtcgaaacaaaccaaagcgtgaaagccgcaactacgctattaagaaggctgtacccagatatagatgtcgtcttcgtaaaagccgagaatgtaacagattttcgtcatgataacaactttataaaagtccgttccctaaatcaccatcaccacgccaaagatgcctatttgaatatagtagtaggtaacgtttaccacgaaaaattcacacgcaactttagagctttcttcaagaaaaatggagcaaatcgcacgtataacctagccaaaatgttcaattatgatgtcaaatgcacaaatgcaaaagatggaaaagcatgggatgtaaaaacttcaatggatacagtcaataaaatgatgacttcaaatgacgtaagggtaacaaaaagactattagaacaatcaggcgccctagcagatgccacagtatataaagccactgtagctgcaaaagcaaaagatggagcatatataggaatgaaaaccaaatcatcagtatttgctgacgtaaccaaatacggcggaatgaccaaaattaaaaatgcatacagtataatcgttcaatacatcggcaagaaaggcgaagttgtaaaagaaatagtacccctaccaatatacttaaccaatcgcaacataactgatcaagacctaatagattatgtagcaagtattactcctcaagcaaaagatataagtatcatatacagaaaattatgtataaaccaattagtaaaagttaatggattttactactatttagggggaaaaacaaattcaaacatatacattgataacgccgtagaagtagtggtaccggccaacatcgccgtatatataaaagtactagagaaatttgcactgttacataaagacaacaataatataaaagcgagtacggttaccacacgtatatacaatgaaggcagtacaaatattgtatccattactgataaagacggcttaatagtgtatgattacctaatgtcaaaactgagaacgccactttacatgaaaatgaaaggaaacaaagttgacgaattatcaactgtcgggcgtagcaaatttatgaacatgacactagaagaacaatcaatatacttattagaagttctaaatttactaacaaattctaaaacgacttttgatgtaaaagcgttaggaattacagcatcgagaagcactataggagttaaaatacatacccttgacgaatttaaaataataaatcaaagcataacaggcttatatagtaacgaaataactatagtatga

SEQ ID NO: 9085 - RNA, 4197 nt, synthetic construct
  misc_feature 1..4197: note = Cas9 variant
  source 1..4197: mol_type = other RNA
atggaaacccaaacgagtaatcaacttataacttcgcacttaaaagattatccaaaacaagattacttcgtcggcttagacataggaactaactccgtcgggtgggcagtaaccaacacatcctacgaattattaaagtttcattcacataagatgtgggggagccggctatttgaagaaggagaaagcgcagtaacacggaggggctttcgcagtatgcgcagacgcctagaaagaaggaaattaagactaaaattactcgaagaattattcgcagacgcaatggcccaagtagattcgacattcttcattagacttcatgaatcaaaatatcattacgaagataaaaccacgggacattcatcgaaacacatattattcatagacgaggactacactgatcaagactactttactgaatacccaactatttaccacctacgcaaagacttgatggagaacggaacagacgacataaggaaattattccttgccgtacaccacatactcaaatatcgaggcaactttctatatgaaggagcaacattcaattcaaacgcattcacctttgaagacgtcttaaaacaagcactagttaacattacattcaattgttttgatactaactcagcaatatcgagtatatcgaatatattaatggaatctggaaaaactaaaagcgacaaagctaaagcaatcgagagactagttgacacttacaccgtattcgacgaagtaaatacgcctgataagccgcagaaagaacaagtcaaagaagacaaaaaaacattaaaagccttcgcaaatttagtgcttggtctgagcgccaatctgatcgacctgtttggatcagtcgaagatatagacgatgatcttaaaaaattacaaatagtaggtgacacatatgacgagaaaagagatgaattggcgaaggtatggggagacgagatacatattatagatgattgcaaatcagtctacgacgcaataattttaatgtctataaaagaacccggattaacaatatcacaatcaaaagtaaaagccttcgataagcataaagaagaccttgtgatattaaaatctctattaaaactagaccgaaatgtgtacaacgaaatgtttaaatcggataagaaaggattacataactatgtgcactatataaaacagggaagaacagaagaaacatcatgctcaagagaagatttctataaatacacaaaaaagatagtcgaaggactagccgacagtaaagacaaagaatacattctaaacgaaatagaattacaaacattactaccactacaaagaatcaaggacaacggggtaataccttatcaactacacctcgaagaattgaaagtaatactagacaaatgtgggcctaaattcccctttctacacaccgtgtcagatggattttctgtcactgagaaattaattaaaatgctggaatttaggattccctactatgtcggcccgttaaacacacatcataatattgacaacggtggattctcttgggcagtaagaaaacaagctggaagagttacaccttggaattttgaagaaaaaatagatagagaaaaatcagcagcagcattcataaaaaacctaacaaataaatgtacttatttattcggagaagatgttttaccgaaatcaagtcttttatactccgaattcatgctacttaacgaactaaacaacgtacgaatcgacggaaaagcactagctcaaggagttaaacaacatctaatagactctatatttaaacaagatcataaaaagatgacaaaaaacagaattgaactatttctaaaagacaacaattatataacaaaaaaacacaagccggaaatcacgggactagacggagaaatcaagaacgatttaacatcatatagagatatggtaagaatacttggcaacaatttcgacgtaagcatggctgaagacattataacagacataacaatttttggggaatcaaaaaagatgctacgacaaacattaagaaacaaatttggatcacaactgaatgacgaaacaatcaaaaaattgtccaaattgcgatacagagattggggtagactcagtaagaaactattaaaaggaatcgatggatgtgataaagcaggaaacggagcaccaaaaacaattatcgaactcatgagaaacgactcttataacctaatggaaatactaggagataaattctcgtttatggaatgtattgaggaagaaaacgcaaaactagcacaaggacaagtcgtaaaccctcacgacataatagatgaactagcactatcacctgctgtaaaaagagcagtatggcaagcgttaagaatagtggacgaagttgcgcatattaaaaaggcactacctagccgcatatttgtagaggtagcaaggacaaacaaatccgaaaaaaagaaaaaagattctagacaaaaaaggctatccgacttgtattcagcaataaaaaaggatgatgtattacaaagtggactacaagataaagaatttggagcactaaaaagcggattagcaaattatgatgatgcggcccttagatcaaaaaaactttatctctactacacacagatgggaagatgcgcatatacaggaaatataatagacctcaatcaattaaatactgacaactatgacattgatcacatttaccccagaagtttaacaaaagatgatagttttgataatttggtcttatgcgaaaggacagccaatgctaaaaaatccgacatataccctatcgataatagaatacagactaaacagaaaccattttgggcatttttaaaacaccaaggattaatatcagaaagaaaatacgaaagactcacccgaattgcgccactgactgcagacgatctaagcggctttatagcgagacaactagtggaaacaaaccaatctgtaaaagccactacaacgctcttaagaagactataccctgacatagacgtagtattcgtaaaggcggagaacgtcagtgacttccgacacaacaacaactttataaaagtacgatcattaaaccaccatcatcacgccaaggacgcatacctaaacatagttgtaggtaatgtataccacgaaaaattcacaagaaactttcgcttattctttaaaaagaacggcgcaaatagaacatataacctagcgaagatgttcaattacgatgtaatatgcacaaacgcacaagacggaaaagcgtgggacgtaaaaaccagcatgaatacagtaaaaaagatgatggcttcaaatgacgttagggtaaccaggcgcttactcgagcaatcaggtgcattagcagatgcaaccatatacaaagcatcagtagcagccaaggcaaaggatggagcatatattggtatgaagacaaaatactcagtattcgcagatgtcacaaaatacggaggaatgacaaaaatcaaaaacgcatacagtatcatagtacaatatactggtaaaaagggtgaagaaataaaggaaatcgtcccactccctatatacttaatcaatagaaacgcaactgacatagaattgatagattatgtgaaatcggtaatcccaaaagcaaaagacatatcaataaaatatcgcaaattatgcataaaccaattagtaaaagtcaacggattttactattacttaggtgggaaaactaatgataaaatatatatagataacgctatagaactggtagtccctcacgatatcgccacctacataaaactccttgacaaatatgatttgttacgaaaagaaaacaaaacactcaaagccagctcaatcactacaagcatatacaatatcaacacatcaactgtagtaagcctctcaaataaagttggtatagatgtattcgactacttcatgagcaaattaagaacccccttatatatgaaaatgaaagggaataaagtcgacgaattaagctcgactggtagatcaaagtttataaaaatgaccttagaggaacaaagcatttatctattggaagttttaaacctactaacaaattcaaaaacaacatttgacgtaaaaccactaggtataacaggatcacgttcaacaatcggagtaaagatccacaaccttgatgaattcaaaatcataaacgagtctataacaggactatactccaacgaagtgacaatagtgtga

SEQ ID NO: 9086 - RNA, 4200 nt, synthetic construct
  misc_feature 1..4200: note = Cas9 variant
  source 1..4200: mol_type = other RNA
atgaaaacaatactagggttagacttaggaacaacatcaataggttgggcactcgtgaaagaagcagaacccttctctgacgaaaaatctgaaatcgttcgactcggcgtaagagtaatacctttaacagtagacgaaaggacttcattcgaaaatgggaaaagtataaccactaatgcgctacgtacacaaaaacgcggaatgcgaaggaatctacaacgatataaactccgtcgtcaagcactaatagaagagttaaagagtaccggctggataggaaacgattttatattcagtgaaaccggacccggaagtacctttaggacactaaggctaagagctaagtcagcgtcagaagaagtaactcttggagatctagcccgaatattactccaaataaataagaagcgaggatataaatctagtcgaaaaatggtaagcagtgacgatggtcaagcaatagatgggatggctgttgcgaaagaaatgtacgataaaggcttaacccctggagaatacgtatatcaaagaatgttagaaggcaagtatgctataccggaattttataaaagcgacttacaagaagaatttgatagaatatgggcgcttcagaaatcgtttcacatagaacttacagatgagctataccgaaaattaagtgatcgaaataaaagtcagacttgggcaatctgcagagatgaattaggaatacaaggattaaaatctagctttataggaaaagaacggctaaaagaagcatataggtataggcatctagcggcaacacaagaagtaaatatggaggtactaacatgcgcactacaagaaataaatggtcaaaaagctagcctatccggcctattatcaaaaatatcggaccgaagtaaggaactctacttgaacaacttaaccgtaggacaaatgctattaaaaagaatagaagataacccaaataactcattaaagaatatcgtattttacaggcaggattacttagacgagttcgaacgaatctggacggtacaatccaaataccacactgaattgactcatgaactgaagaaaagattacgagacataataatattttatcaaagacctttaaaaagtcagaaaggattaatatcactctgtgaattagaaacaaaagacattgaagtagcaattgatggcgtgaagaaaatgaagaacataggaccacgggtatgtccgagaagttcaccattattccaagagttcaagatatggcaaacaataaacaatatatttgtaaacggagcagccctagatgacgaagataaatccgtaatagcgaaggaactcatgttcaaagacaagttaaaagacagcgatttacttaaattgttatttaaaacaacaaaagggcaaagtgttaacttcaaagaagtagatgggaacaggaccatggcgacattgatgaaagcatgctttaaaatcgctgaaaacctaggatacgatgacatcggattaagcaaattatcatctgaagaccaaatggtgagaatcgaaggaatttttaaagaacaaggattcaaaactggatttctgcatttcgacagctcactagcgtcaccagaatttgaaaaccaagattcatacaggttatggcatctactatattcatacgaaggagacaagtctgcctcaggtaatgaatccttagtaaaatgtataatggatctatgtagtatggacgaagggtcggcaaaaatacttgcgagctgtacattcttaccagactacggaagtctttcggcaaaagcaatgagaaaaatactgccatacatgaaagacggacttgaatacacagctgcatgtgcgatggcaggctatcgacactcgaaaaggtccttaacaaaggaagaactagacaccaaagaatacagtgaccgactcagcctcttgcccaagaatagcttaagaaacccagtagtagagaaaattctaaaccaaatgataaacgtagtaaactctgtaatagatgtttacggaaaacccgatgaaataagaatagaaatggccagagaactaaagaaaagcgcaaaagaacgtgaagaagctcaaagagacatcgcatcatccacagctgaatctcaaaaagtaatagaaatactaaaaggcgaaccattcttcctacagtttcctacacgaaatgacattatacgctatagattataccaggaattagcccaaaatggattcaaaaccctatacagtaatacttacatacctaaagacaaactattttccaaagagttcgacatagaacatataattccccaagcactaatatttaacgattcctttgcaaacaaaacattggaatcacgacaatgtaatctagaaaaaggaaaagaaacagcaatggattatgtgaaaagcaaatatgatgaaacaggcgtacagacatactgcgatagagtaaacggcttaatagggaaaggtatttcaaaaacaaaagccaaatggctacttatggaaggaaaagacatacctgaagactttatcaacagagaattgagagatagccaatacatagccaaaaaggcgcgtgaaatcttagaaagccttgttaaatttgttgttccaaccaccggtagtgttactgctcggcttagggaagattggcagctggtaaatgtaatgcaagaactaaattgggaaaaatacgcacgacttggcctaactggtgtaagggaagataaagatggtagaagaataccatttattcaagattggacaaaacgcaatgatcacagacaccatgcaatggatgcattgacaattgcattcacacgtagacaatttatacaataccttaatcacctaaattcaaaaatagacgttgttagttgggacaagaaagatttagatttacgcgattatgatctcgaagacatcaaattcggcaacttatcagctggtgacaggtatggcatagtgaaagcgttacaagacaaatttctatacaaagacggaaacgataaatatagattcgtaccacccattcccctcgatgagttcaggagacaagcaaaagaacaactgtcagacatcctaatatcattcaaagccaaaaataaagtttgtacacgaaacgtcaatgtaactaaaaacaaaggaggagcaaatagaaaagcacagttaacacctagaggaccactccataatgaaacgatctatggaagttctttggaatacgttacgaaggaaaatgagaaaataggatcatcatttgatactgaaagaataaccactgtatgcaaaaagaaattcagggacgccttagcaagaagactcgaagaatttggcggagatcccaagaaagcattcacaggtaaaaacagtcctgagaaaaatcctatctgggtcgatgaacatcacagcgaacaagttccagcaaaagtacgaacagtaacaatgggacaaagatttacaggaagaaaacccattgatgctacattaaaaatagaaaaagtaatcgacaaaagaattagagaaattctacaagctcgcctagatgagttcgatggaaaagcagcgaaagcattttcgaatcttgacgaaaatccaatttggctaaacaaagaaaaaggaattgcaataaaaagagtaacagtatctggcccagcaaatccagtgccggtgcgtttcaaacgagacaaagacggcaaacccataatcgatgatgcgggcaaaacaatcggcgcggactttgttacgccaggaaataaccatcacattgcaatcttccgcgacagttcaggaaaactccaggaacacccagtctccttcttagaagcaaccattgctaaatcacatggtttagatgtcattgacaggaactacaacaaagatgaaggatgggaatttttatttactctcaagcaaaatgaatactttgtatttccaaattcagaaactggttttaatccactagattatgacttaaccgatcctcgaaactacgcagaaatttcacccaacctctatagggtccaatcaatcagcacaaacgattactttttcagacatcatctagaaactacgagcgagaaaaataactctctatatgggataacatggaaaagaatacgtaatgcaagtgccttagaaggacttgttaaagttcggatagataatctcggtagaatagtagcagtgggagaatatgattga

SEQ ID NO: 9087 - RNA, 4200 nt, synthetic construct
  misc_feature 1..4200: note = Cas9 variant
  source 1..4200: mol_type = other RNA
atggagacacaagcaacagcacaactcataagcggccacctcaaaggatatccaatatatgattatttcgttggactggacatagggacaaatagtgttggctgggcagtaactaataggatatacgaacttcttaaatttagatcccacaaaatgtggggtagtcgtctattcgaagaaggacaaactgctgtagtaagaagaggttttcgaagcatacgaaggcgacttgaaagacgaaggttacgattaaaattactggaagcactcttcgcagatgctatggctagggtcgattccacattcttcataagattgcgagaatccaaatatcattatgaagacaaaacgaccggccacaaatcaaaacatatcctattcatagatgacaactacacagaccaagattacttcgcagaatacccaacaatttatcatttacgcgcagatttaatggagaatggcacgtcagatatccggaaactattcttagccgtccaccatatcctaaaatacagaggaaattttctatatgagggcgcaacttttgactcaaattcaagcctagataccgtattgaaaagggctttagaacaaatagaatttcatatatttaatgcgacaagtgaagacgcactccattccatactagacatcgtaaaattacaagataaaacgaagtcagataaagcgaaagcgatagaatccctagtagacacctatataactgacaaagtagagagctcatgcaccgacaaggaaaaaaaagatttgttgaaagcagataaaaaaagacttcgcgcattcgcaaacctaatactaggactaaacgccaatctaacagatctattcggaacaatagaagaaatagaagaagacttcgtcaagctacagattactggtgatacatacgaagaaaagcgagacgactacgcaaaagtatggggtgacacaataagaattatagatgactgcaaaagtgtttatgacagtatcatattaatgagtataaaagaaccaggattaacaatatcccagagtaaagtaaaagcatttaacaaacataaagaagatttagccatactaaaaagactgttaaaatcagacaaatatatctacaaaaacatgtttaaagcggacgaaaaaggcttggccaattacgtacactacatcaaacagggaagaaaaaacgaaaccggatgtagttgtgaagacttctataaatacacaaaaaaagtagtcgaaagtctcccagatagctcagataaagcatacatcctcaacgaaattgaactccaaaaactgctcccgctccagagaatcaaagataacggagttataccataccaactacatctagaggaactcaaagcaatcttagaaaaatgtaaagatacttttcctttcttaaacactgtctctgatggatttacagtcgcggaaaaactcataaagatgcttgaatttagaataccatattacgtcggaccactaaacccaagtcacagtattgacaaaggcggcttcgcgtgggttgaacgaaaagaacctggtcaagttacaccctggaatttcgaagacaaaatagatagagaaaaatcagcagaagccttcatcaaaaatctgaccaataaatgtacctacctcataggagaggatgtattaccaaaatcaagtttactatattccgaatttatgcttctgaacgaacttaataacttacggatagatggcaaacctcttgaacaagctgtaaaaatgcacttaatagacgcagtttttaaaaaagaacacaaaaagcaaacaaaaaataggattatagaatttctcaaagataacaattatatcctaggaaaacacaaacccgaagtagacggtctagatgagtcaataaaaggagatctagcgagctacagagatatgaaaagaatcctaggagacgacttcgacgtatcaatggcagagtcaatcattacttcaataacaatatttggggaaagcaaaaacatgttaagagaaacacttcgcaaaaaattcggctcgatccttagcgaagatcaaataagaagcctagcaaaactaagataccgagattggggacgattatctaaaaaatttttaataggcattgacggctgcgtgaaaggagaggacggcactcccggaacaataatagatatgatgagaaacaccagtcacaatctaatggaactcctcggcgacacttttagtttcatggatgtaataatcgaagaaaatgacaaactaaccaaaggtcaagtagtcgaccctcacgagattatagaagaactaggattatcaccagcagtcaaaagagctgtctggcaggcgttgcgaattgtagacgaagtgattcacataaagaaagcattaccatccagaatattcgttgaggtagctcgaacaaacaaggatgaaaaaaaaaaaaaagatagcagaaaaaaaagacttcaagaattatataaatcaatacaaaaagaatcaccggaatggctctctgtaacacgagacgaatcagataaacttataagtaacctggacagagccgacgacagttccctgcgaagtaaaaaattatatttatactatacacagatgggtagatgtatgtacagcggaagagtaatagacttagaccaattgaatacagataaatatgatattgaccacatctacccgaggtcactaacaaaagatgattcattcgacaatttagtactctgtgaaagacaggaaaatgctaagaaatcagataattatccaatcgacccagacattcaaaatgcacgaaaaccattttggacattcttaaaagatcaaaatctaattagctctagaaagtacgaaagactaacaagagtacttccattagaagcagatgatcttaccggtttcattgcaagacaattagttgaaaccaaccaatctgtgaaagccgtgacaaccctactacgaagattatacccaggggtagacgttgtattcgtaaaagccgaaaatgtaaccgattttagacacgataacgacttcattaaagtacgttcgttaaaccatcaccatcacgcaaaggatgcatatctaaacatagtagtcggcaatgtatatcacgaaaagttcacaagaaacttcagaaaatttctaaagaagaacggcgccaaaagaacctacaacctcgccagaatgttcgatttcgacgtcatgtctacgaatgcgaaagatggcaaagcctgggacataaaaacaagcatgaacattgtaaaaaaaatgatggcttcaaacgacgtaagggttacaaaacgattaatggaacaaaagggagcgctatcagatgctacagtttataaagcatcagtagcaggaaaagcaaaaggaggtgcatatataggaatgaaaacaaaagatagcgtcttttcagatgtttcgaaatacggaggacgaacctccataaaaaacgcatatagtatagttgtagaatatacgggaaaaaaaaacgagataataaaagaaattgtcccactaccagtttatctcattaatagaaataaaactgatcaagaattgatccattatatagtatctataattcctcaagccaagaatgtgtctataatatataaaaagctatgcataaaccaacttgtcaaagtaaacggattttattactacttaggaggtaaaacaaacaattatttttggattgacagcgcaatccaagtagtcatcgctgacgaatggataccatacctcaaagtattagaaaaatttgacgtcatgcgtaaacagaataaagaactaaaagttggaacagtatcaacttctatacagaaccaaggaaaaaaagtagtcatcaaaattcttgaagaaagaaacgtggaattcttcagttacctagtaggtaaattacactccagtatttacagcaaaatgaaaggaaataaagcaggcgaactggcaactaaatcactagagatattcgtaaacatgtcactagaaaatcaatgtatctatttaatggaacttctaaacttacttacaaacaaaaaagcacctgacgtcaaacccctaggaatcacagccagtcgtgggacaataggttcaaaagtaagcaaccaagatgaatttaaaataattaatgaatccataactggtctttactctaatgaagtgactatagtatga

SEQ ID NO: 9088 - RNA, 4200 nt, synthetic construct
  misc_feature 1..4200: note = Cas9 variant
  source 1..4200: mol_type = other RNA
atgaacttacgtaacacaacagatgaatataacataggtctagacatgggtacaaattcagtaggatgggcagtaacagacaaagcaggcgccatcgctcattttaaaggcaaaccaaccctaggaagcaggctctttgatgcggctcaaacggcagcaggagccagaatccaccgatcacaacgaagaagatacgtaagaagaagatggagactagacctgctacaaagcctcttccaagatgaggtaagtaaagttgatagcgaatttttctgtagattaagacaaagcagattatatgtaggcgacagagagaaaggacatgctgattacacgtggccaatttttaatgattcagattttaacgaagtcgattattataaaagatttccaacgatatatcacctaagaaaatggctaatggaaacagatgaaaaagccgatatacgattgatttatctagcgacacacaacatagtgaagcaccggggaaactttcttagagaaaacaataaatcattaagtagtagagacgccaacccagcccaagcggtgaaatccttgcgacttgcactcaacgattggtgtagcgaaagagattatgagtgtgcatggaaaggagaagaagatgatggagcaatagatgaagccattctcaatgtcctagctgatggtgagaaagggagatcagaccaagctaaggaaatagcaaaactaactggcgttgattgtggagatgcgaaacaaagtaaacaatgcaatgaagcaatagcaaaagcaatcgtaggattaaaagtagaaatgaaaaatatatttggcgaatttccggccgagaaaaccagctatatctatctatcctctgacgaagatgtagaagcagtcagagaatcatgtccagatgatagtggagagctatttcaagcgctgtgcaaactatatagtgcttacatactacaagaactgctttcatacgcagatccctctggacagacaatatcagccaacatggttgcgaagtacaagcaatacggtagagatttaagactgctaaaagaactcactagaacttacgcaccacaaaaatacgatcttttctttagaggagaaacctatgcaggtagcagcgattatgtagttgacgaagcaagaggatacacacgatataacttaggaactacaaaggcaaactatgacgattttcaaaaatcagttaaagaactatttaaaggaaccgatgctctccaagatgagagataccaagaaatgatggtagccttcggtgaacagaaattcttaagaagactgaaaacttccgacaacggaagtatatactatcaactgcacctagaagaactccatacgatattagaaaaccaaggaaaacactatccttttctattatcagaagaggacaaaatagaaagtctagtcagtttccgaatcccttattacgtgggcccattaacacgaaagaacgctgcgataggtcacgacggaaaagagagattcgcttggtcaagtagaaaagacggtatggaacatgcagtaataacaccatggaactgggaggagataattgatcgcgacaaatccgcagaagatttcatcatgaggatgacgggagattgtacatatttacaaggtgagccagtattaccaaaatgcagtttattatacgaggagttctgtgcattaaacgaatttaacggcgcgcattggacagtggacggtgacgatgagcgtcgcttcgacgcagcacaaagagaaaggataatgtgcgatttattcaggagaacacgttcagttacatataataaagtttccgactggttagaaagaaaatataactttaccggagcaagagtcagaggcggacagggcgaacatggatttgagtcaaaactaggaagctatatattcttttgcaaagatgtatttaaaacagatggcttagacgaggccgattacaccatgatagaacaaataatactttggtcaacactctttgaagacagagatatactgaaacgaaaaatagaagaggcttatggaggtgacagattaacatcagaacaaatcaaagttatatgcaagaaaagatttacagggtggggaaggctttcaaaacgactccttacagatattaaagtaaacacagatactgggagaaaaagcataatggatgtattaagagaaggaaacccaaataacgggcaaagatccaggactatggtattcatggaagtattaagagatgaagacttaggatttcagaaagcaatagatggattaaacagggactattttcgagaacacaataatggtttgatggatgttaacgatttgccgggatctcccgctatcagaaggtcgataaatcaagcagtacgtatagtagatgaaattgcatccatagcaagaaaagaaccaactaatatcttcatagaggtcacaagagaggaagacgatccacgaaagaaaggcaaaagaactaagcgaaggtacgatgcgatcaaatcagcattagaaaaattcaagaaagatgaccctagtctgtggaaagaactatgcgaaaaagcaccaggagacatggatgaaagactaagtctatatttcatgcaaagaggaaaatgcatgtatagtggacgaccaataaaaatcgaggaacttcatacggggaaatatgaagtagatcacataataccaagaagttacataaaagatgacagttttgaaaataaagtcctagtatatcgagaagaaaatcaacataaaaccgacgctttattgatagatagctccataagacagaaaatgggcggttattggcgtatgttgcatgatgcaaagctagtaggtgacaagaaattccgaaacttatttcgcaatcacatagacgataaagcgatgaaaggttttgtagcaagacaaatcgtcgaaacatcgcaaatggttaaattagtccaaactctattcgaagctaggtaccctaacacacgaatagtacctgtcaaagcaggaatatcacacgatttaagagaggcagcgggtctagtaaaatgtagagaagcaaatgattttcaccacgcacacgatgccttcttagcttgccgaataggattatttatacaaaaacgacatccatcagtgtacgataatcctataggactagcaaggataatgagagattatgcgcgaatgcaagcaagagaatataagaaatcacactgtttagcacatacacaaggttttatagtgaactcatttttatccagcggatttgatgaagaaaccggtgagatatttaaagatgattgggacgcaaaagcagaggtagaaggtataagaagagtattaaactgcagacaatgttttatctctaggatgccagtagaaggcgacacccgatacggaggacgatattggggtgaaacaatatattctcctaaaggaaaacataaacatgaaatcccacttaaacaaggactagatcccaacttatatggtggatactctgacttgctttactcctactttttgatatatgaagcaagcgatgtatcttctggtgaacgtgtactcagatttataggcataccgacaagtatcgccgcaaggatggctaaccaaaaacgactcgaggaatacgtttctagactcgcacttcaagaaaatttagaacacgtaaggatggttaggaaaataatgaagaaacaattaatcgaagtagataattgcagattattagtaactgctgcagatgcagtaactaatgcaactgaacttgcgtttagtctagatgaaatgaaaatcatctctacgtgtgctaaatgtataaatggggctgatccatccgccattgataaaataggcaatgctcaagatagtttctttgataacctaaaaagaagaggaagcgacagatgcgctctactattctctcagttaaaattagataaattgagccaaaatttctacatgatatcatcagatgacaaatccaaaattttgatcagtatacttgacagaataagagcaaaatcaaattcagtagatctgtcgttggttggaggggcaaaacacgcggcccaaatgaaattcgatttcaacgctaagctaaataatccagcaagcagtttcgttttaatagaccaaagtgttacaggtatgtttgaacgaaggactagaataggtttatga

SEQ ID NO: 9089 - RNA, 4203 nt, synthetic construct
  misc_feature 1..4203: note = Cas9 variant
  source 1..4203: mol_type = other RNA
atgaatctaagaaatgccactggagactactcaataggtttagatttagggacaaattcagtggggtgggcagtcacagattccaatggatcaatggcacattttaaaggtaagccaactttaggttcaaggttatttgacgcagctgaaacagcagcaggagcaagacagcatcgagggcaaagacgacgatatgtacggagaagatggagattagacttattgcaaggtttatttcaggatgaagtaaacaaggtcgattctgagttctttataagacttagacagtcaagactccatgtagaagatagagccgaaggacatgccggttacagatggcctttatttaatgacactgactttactgaaaaagactattataaaagatttccaactatctatcatttaagaaaatggttgatggaaacagatgaaaaagcagacatacgactaatttatttagcagcacataatatagtgaaacatagaggtaattttctgcgtgaagataataaaaacctaagcagtcacaacgcaaatccagcagaagccgttaggagtttaaggcaagcactggacgattggtgtgcggaacgaggctatgtttgcgcttggacaagtgtcgacgatttagccgaggctgactcacacatcttggatatactaacaaacagcaaagagagacgagcagaccaagctaaagaactagcgaaactttttggagttgattgtggagatacaaaacagtctaaaagctgcaactcagcattagccaaagccgtcgtaggattaaaaacagaactaaaagacgtttttggtgagttttgcgcagagaaaacagctatccacctaagtagcgacgacgatgtagaagctataagagacgcaattccggatgactcaggcgaactattccaagttttatgcgcagtttatagtgcatatgtattacaagaactattatcctatgcgccgggacaaactatatcagcaaatatggtagcaaaatatgatcaatacgggaaagatctcaaacttctcaaaaatctagcaagaacctacgtatctcgggaaaactacgatgcattctttagagggcagacctacgaggattcgaatgattacaacgtcgataaagcacaaggctacactaggtataatttgggaacaaccaaggcgtcctacgatgactttaaaaagagtgtagaaaaactatttaaaggtacacaagctgagcaagacaaacgatatcaaggtatgatgaagagatttgcagaagaaaaatttttaagacgtctgaaaaccagtgacaatggttcaatctactatcaattacacctagaagaactacgggccatacttaaaaaccaaggaaaacatcacccgtttctcttagaagaagaaaagaaaatagagagtctagtaagttttaggattccgtactatgtagggcccctctcatctaaaaatgcatcattagatcacaaaggaaaacaaagatttgcctggagtgaaagacgaccaggaatgaaagatactgttataacaccttggaactgggatcagattatagattgtgatcagtctgccgaaaaatttatacttagaatgacaggtgactgtacctacttacaaggtgaacccgtattaccaaaatgctcattactatacgaagaatattgtgtgttaaacgaattaaatggagcaagatggactattgacggagatgactggagaagattcgacgtggcacagagagagggcatattacatgatctctttaggaaaactcgatcggtagcttataataaagtagcggactggcttgaaagagaagaaaattgggcaaacgcacatgtccgtgggggacaaggagaaaattcatttgaatcaaaattgggtagctatattttcttttgcaaagatgtattcaaaactgccgcgctagacgaggctgattatccaatgattgagcaaataatactttggaatactctattcgaagatagagcaattttaaaaagaaagatagaacaagcctatggagaacatcacggaggaaaattaaccgacgaacaaataaaagtcatttgtaagaaaagatttacaggctggggcagattatcaagaaaactactaacaggaataaaggtcgatgcagacacagggcgcgtttcaataatggatgtgttaagagaaggaaatccaaatgaaggtcagcgaagcagaaccatggtcctaatggaagtactgagggacgaagacctaggatttcagaagaaaatagatgattttaataaggcatattttgcaggacaaggggaaggattaatgtcagtcaatgatctcccagggtctccagcaataagacgatcaataaatcaagcaatacgaatcgtagacgaaatagcatcaatcgcaggaaaagccccaagcaacgtttttatagaggtaacaagggaggaagatgatccaaggaaaaagggaagaagaaccaataggaggtatgaagatattaaaaacgcattagaaaattttaaaacagaagatcaggaactttggagcgaactattaggaaaagcaccaaatgatctagatgaacgactcagtctttatttcatgcaacgaggcaaatgtatgtacagtggtagaccaattaaattggaagaattacatacaggaaaatatgaagtagatcatataattccgaggtcatatataaaggatgactcctttgaaaacaaagttttggtatgtagggaagaaaatcaaaggaaaacaaatgaaatgttaatagacccagcaattcgtcgtagaatgggagattattggcgaatgttacacaaagcaaaattaataggggacaagaaatttaataacctattcatgagggatagaatcgacgacaaaacattaaagggcttcgttgccagacagctagttgaaacaagtcaatcagttaaattggtacaaaccttgctagaagtacgatatccaaacacaaaaattgtgcctgtaaaagctaatataagtcatgatctaagggaagcagccgacttagtcaagtgccgtgaagcaaacgactttcaccatgctcatgacgcatatctggcatgtcgagtggggctatttattcaaaaacgccatccaagcgtatacgcaaatcccattggcctatcgcgagtaatgagggattacgcacgaaaacaagcaggcgagttcaataagacacattcaatggcacacacaaaagggtttatagtaaatagttttatgacttctgaatttgacaaagaaacaggagaaatattctgggatgcagaggctgcagtagaagacatcagaagagtcttaaattatcgacaatgttttatctcacgtatgcctgtagaagacacaggagcattttgggatcagacaatatattcccctcgaagcaacaaaaggttagaattgcccctaaaagacgatctagatccaaataaatatggttcatactcaagagaacaatttgcatactttttcatatatgaagcaagagacgcaaagaaatcaaaaacagtattaagatttgcacaagtaccagtacgagtaacaagcgcaatcgcaagggatagctcaaaattagatgagtatgccagcggtttagcagtacaagaaggattagagttcaccaaaataataagaagaaggatactaaagaaacaattacttgaattaaatggagataggctcgtaataacgggtgcaaaagaagtaaggaacgcgacagaatttgcatttactctcgaagaaacagctttagtggcaatgtgctcagaaatagctagagaaggagtcccaagtgaaattgcatccgatgttcaaagcattagctcccaattatctgacctatttttagcacttattgaaagaggattaacaataggagttcgactccatggtcaattaaaattgggacaatatcttagacagtttgaagacgcagcactaagagacaaagcaaaagtcataatagggattataagtattactaatggggcaactaacactctagatctaagcagcttaaacggtagtaagaacgtaggacaagtaagaataactcataacaagttattaaacgataaatcaacatcctacgtgctgatagatcaaagtgtcactggaatgttcgagagacgaacacggatcggtttatga

SEQ ID NO: 9090 - RNA, 4203 nt, synthetic construct
  misc_feature 1..4203: note = Cas9 variant
  source 1..4203: mol_type = other RNA
atgaaaactattaccgaagattacatcttaggactggacataggaaccaattcctgtggatgggcagtaatggataagaaaaatcgcctacttcgactacgagggaaaagagcaattggaagccacctattcgaagaaggacattcggccgccgatagacgctcattcagaacaactagaagacgcctaaaacgaagaaaatggagactacgacttctcgaagagttcttcgcagaaccaatggctaaagtcgacccagcctttttcgtaagattacaccaatcatgggtatcacccttagataaagacaggaagaaataccacgcaatagtattccccactgcaaaagaagatcatgagttctaccatgactacccaacaatataccacctaagagatgccttaatgagagaagaccgacaattcgacttgagagaaatatttttggcgatccaccacatcgtaaaataccgtggaaatttcttgcaggacacacccgtaaatagcttcgtagctagcaaaatagatgtagcatcatttctcacaaatgttaaccaagcatacgctgataaatacggagaagaacaaaattttattgaattaaatgaaaacaacgctgctgctatcgaagcagtaatccgcggaaaagacaaagataaaacaacaaaacaactagataaagctaagaaaataactaaattactacaaagcagtacaaacaaatatgagaaaaatgtcacacgacaaatagccaacgctataatagggtacaaaactcaattcgaaactattttaggaaaagatatagacaaaaatgataaagctgactgggaatttaaactttcggacggagacgccgacgacaaacttgaaaacctacttccagagttcgacgacaacgaccaatatattgtagccgaaataaagaaactcttcggaagtattgcactctcacagatagtctacgaaaatatgacacttagccagtcaatgaaatgcaaatacaaagaccacggagaagactatgatctactaaaacagtatatagcaacacttagtgaccactctcaggttagaaaacttctactcgcatacgacctgtacgtcaataacagacacggaagactattagaagctaagaaagaatttaaacaagacaaagcgcttacgcaggacgaattttacaaaatagtaaaagaaaacttagacgatagccaattggcacagaaaatattgcagaaaattgacgaaggcaaattcatgccaaaacaaagagtcaacaaaaacggctatataccctatcaacttcaccaaatagaattagatcaaataatagcaaaccaatccaaatactatccattcttagcggaagaaaaccccgttaaagaacaccgaaaacaagcgccatacaaactagatgaattagttcggttcagagtgccatattatgtaggaccgttaatcagtccggatgacaaaagaaaagacgaacaacagaacaaaaatcatgaaatgttcaaattcgcttggatgaaaagaaaagacgacaacggggcaataacaccctggaatttcgcccagaaagtcgaccgagaaaccagcgcaaatagatttataaaacgcatgacggttaaagacacatatctaatcggggaagatgtgcttcccgctagatcactattataccaaaaattcgaagttctcaatgaactcaataatatacgagtaaatgggaaaaggcttgaaccaaaattcaaacaaaaagttttcaatgaactctttaaacagaaaaataaagtaactaagaaagcctttaaagaatttattcttcaaaatacaggcatgaaaacagctgaaatcgatggactagcagacccaacaaaatttaactcatctttgtcatcttattaccatttaaaatctaccaaagtctttgacaaacaactagacgatccgcaataccaagcagatttcgagaaaatcattgaatatagcagtatttttgaagacgcagaaatataccaagaaaaactacacaaagaaataaaatggttaacgcctgcccagtttaaagcaattgctaactggcgcctacagggatgggggagattatccagaaaactcttagtcgaattaaaaggcaaaggcggagaaaatatcatctatcaattatggaccacacagaaaaatttcatgcaaatagtcaatgaaccagaactaaagaaagctatagtaaaagaaaaccaccaggctaccgaagaaaaaggaattgagaaaatattagatgattcattcaccagcccagctaataagaaagccatacgtcaggttattaaagttgtagatgacgtagtaaaagcggcagggggcaagaaaccagcacagtttgcaattgaatttacaagggaaccaaaatggaatccacatctcagcaacatccgtggaacaaaactacttcaagtatacgaagacacagccaaaaagttagtagatcaatccttaacagactcattacgagaaaacatgacaaatagaaatctactcaaagacgaatatttcttatactttatacaagggggaagggatgcatacacaggaaagaaaatagacatcgatgatatacccaagaaataccaaatagaccatatcttaccccaatccttcattaccgacgacagcttagacaacagagtactaacggaaatagaaatcaaccagaaaaagggtaagaaatatgcatctcacctattcgcgccaaagccagcctttggacttaatcaatccatatcagaaatgtggaagacatggcaaaaggctggtttaatctcccaacgcaaactaaataaccttctattcgacccagacctagtaaaggacaaacaaaagaaaggattcataaatagacagctagtagaaacaagccaaattattaagctagtcagtattatacttcaggataaatttcccgacacagaaataataacagtaaaagcgggctacaatacagcacttcgcaaagaattgaaattatacaaatctagagaagccaacgattaccaccatgcaatcgacgcgtacttaactgcaatttgtgataactttttgtatcaagtatatccaaactttcgtccatttttcgtgtacggacaattcaagaaattctcccaagacacagataaacagaagaaagccgtgaaatactacggtcttaaaaattttctactaccactattagatgactccactggagatgaagtgatggtaaatcacacgaagcacgtagtcttccacaaacaaagagatatatttaacagattaatacaagcatacaactacaaatacatgctagtcagcagagaaaccacaacagaaaacagcaatatgttcaacatgactatatatccacgtggagaaagagaccgcaaaaagacaaggaaacttataccaaaaggaaaagatctagatccagccatatacggcggatatagcggaaatacagatgcatacatggtcatagtcaaaatagagaaaactaaagaaacattatataaagtcgtaggagttcccatgcgcgccctagcttccctcaagaaagcacaaaaagaaggtaattacgatcaagaactcaacaaagtattagaaccactaataatgttcaataaaaatggaaaaagtaaagcagggataaaaggctttacagtggtaaaagatcacgtacatttcaaacaagttgtgatagacggtgactccaaattcatgttatattctgctcaatacagagcaaatgccaaacaactgacactatcacaagaaaccatgaaagtggtaacagataacacagatgatatggaccagaaaaatgcagacaaagaccaattgctattaaatgcttatgatgaaattcttgaaaaagtagaccaataccttcctttatttgacataaatggcttcaggcagggcctacatgacggtcgagctaaattcgctgctctcaagacatctgagaagaaatacactctcaaaaatgttttaaatggcctacatgataacctggtaacaccaaacctaaagaacataggtataaaaacaccattcggactaatgcaaagttcaagcggtataacattaagcccaaatgcaaaacttgtattccagtcaccaactggattattcgaaaaacgtgtaaaattaacaaacctctga

SEQ ID NO: 9091 - RNA, 4203 nt, synthetic construct
  misc_feature 1..4203: note = Cas9 variant
  source 1..4203: mol_type = other RNA
atgggcaaacaaaaatttaatgactattatctaggctttgacataggaacaaacagtgccggatgggctgtcacagacttgcaatacaaattactacgatttaacaaaaaagacatgtggggaagcagattattcgacgaagcacaaaccagcaaagaacgccgcgtttatcgcaatagtagacgacgtttggatcgacgaaaaaaaagacttaaactattagaagaactattcctagacgaaatatctaaaatcgacaacactttttttaagagactaaaagaatccaacttatataacgaagacaaaagcattaaatttaactaccccctctttaacgataaagactacacagatatcgacttctacaatgaatataaaacaatatatcatctaagaaaagatttaatatttgaagataaaaaattcgatataagactagtattcattgccctgcatcacattttgaaatacagagggcatttcatatttgaaggacaaagcttcgaagaaattaaaagttttgattccatattcacacaactatcctcatatttcctagagaacttcgacttcaacatagatgtttctataaaagaaaaattagaagaaatcattcttagtgacaacaccaaaagtatcaaaaaaaccgaattcaagaaaatatttagcgacaacaaagtactaagtgttctaaacatggccatcggttcaaaagtatcattgaaggatgtattcaataacgaagaattaaaagaacaaaaaatctcatttagcgagatcgattacgaaaacgaaaagagagatgaattctatcaactattaggggaagatattttcctaatcgatctagcaaaaaaaatttacgatttcatggttcttaaaaaaatcctgaaaaatacagacagtttctcagcatcgaaagtcgcattatactgcgagcataaaaaggaccttgatgacttaaaatacatcttcaaaaaataccttacgaaagaagactactttaaattctttagatctaacgtagaaaaaataaactatcccagttacataggcttgaataaaattaaatctaaaaaaataattaaagaaaataaatgctcaatctccgacatcaacaaagaattaaaaaacaaatacttaaaagacataaagctagaagctaaagacaaagagctgttcaaccgcatcttcaacaagctcgatgaattcaaatttctggagaaactaaaatcatcagagaattcgacagtcccctaccaggttcatgaaatagaactaaaaaaaatactagacaatcaaagaaaatactacccattcctaaacgaaaaaattgacggaaaaagtgtttacgaaaaaattatacaacttttcgaattcaaaatcccttactacatcgggccactaaacactgacccaaatgtaaagggaaaaaacacatgggttgtaaggaaggacgaaaataacaaaacacctataacaccctggaactttgaacaaaaagtcgatatgcagaaatcagcagaagaattcataaaacgaatgacaaatagatgcacatacttaaaagcagaagacgtcatagccaaaaattcattgctgtacgaagaattcatactcttgaatgaattaaacaaagtaactgttgacaacgaaatattgcacccaaccctcaagaccgaaataatcaatgaactcttcaaaacgacagtaaaagtaacaaagaaaaagttcatagaattcctaaaaaagaaacaagcagttaacgacgtagaatcaataaccggcataggagttgaatttaattgcaaactacaaggttacaacacattcagaaaaatattaggtaaaaagatagaaaatgttaacgtcaaaaacttcgtcgaaaaatgtattgaactaaaatgcctatatggatctgacaagaaattattcgaaaacgccattggaaagatataccgagagtacaacataacagacgaggaatttaataaaataaatcgtctaaatttcaacaagtgggctcgcctgtctaaaaaatttctaaccgaaatatcattcgaaaaaacagacggcacaaaaaggttcgaatcagttatagaagcattaagatctacaaattacaacctcatggaacttctctcagacaaattcaacctccaaagtaaaatagatgagataaacggagaagatgacttctcgaatatagacatcaaagaatatgttgacaaactatatgtatcaccttcagtaaaacgcagtataatccaaacatacaagatagccatggaaataaaaaaaataaccaaaaaagaccctaagaaaatcttcatcgaaatggcaaaagataaaggagaaaaaggcaaaacaacagaaaaacggaaagataaaataaaaaaattatataaaaacataaaagacactctatcggactactgcaacaacttacaagacctcacgctacaagtagagaaatatgatgataacagactgcgacaaaaaaaattgttcctatatttcatgcaaatgggcaaaagcatgtacacgggtcgatgtattgacctcgaagacttattcaacaacaatgtttatgatatagaccatatttacccacagagcaaagtcaaagatgactcattcgacaacatcgtgttagtagagaaagaagagaatcacagaaaatccaacgaactactaaaagaagaaatccaatcacgaatgaataactattggatttttctacgggaaaacaaattcatatcaaaagaaaaatacaatagactaacaagaaaaaaagacttcactgatgaagaactaggagacttcgtagccaggcaactagtaacaacacgtcaaagtaccaaagaaattgccaaattcttcgagaaaattttcgaaaaaacaacggtagtgtacagcaaagcatcacttgtatctgaatttcgtgagaaatacgatataataaaggtccgagaagttaacgatgcacatcacgcacaagacgcatacttaaacatagtagtaggcaacgtattcaacacaaaatttacaaaaaattattggaaatttacaaaagacataaaacgacaaaacgaagaaaacccaaacgaaaaaaaaggatacaacctgagaaaaatatacgagtcagatgtattctgcaatgattccgttgcgtgggtatactcaaaagaaaatcccaaatataacacaataaacacagtcaaagacatggtctacagaaaaaccgcaaatataactagaatgttagtagaaggcaaaggtcaactattcaacttgacgataaaagacaaaacacagctcaaaaaaaatgtaggaaacattgtcgcaaacaccccaatctcactaaaaaacagaaaacttcaccttaatagcgtagaaattgcaaaaaaatacggatactttgacagtttaaacaatgcttacttcgtactcttcaaatatgaagagaaaggtaaagaaaaaatcgggtttgactcaataaccatagcttataaagaaagactaaaaaagaacctagatatcgaaaaatttctggaaaataaagggtacaaaaattctaaattaattaggaaaatatttaaaaaccaaaaagttcttatcaacggttatccctacttattaaaatcattcaataaacaatcacaaattaaattcaacaattttaaaatattatatttaaatgaaaacaatctaaaatttgccaaagacgccatcaagttcgaaaagaacaacgcaaacgtggacctcaaaaaacaaaaatacatagtctcatttttaaaaaaaaaaaaacaaaatgagattaatgaaacatatgaggaatgcatcgatagactcaacgacgaattcgacacactgtttttaaaactttgcgatatacaaaaaagcagcatatacactaactacaaacttcaagatttctcaagcaacaaaaaatcgatagagataaaagacaaatttgatatctttaaatccctcgacttatataaaaaaagcaaactcataaaagaattcttaaactattataaatatgaaaaaaatgatctagactttagtttgatagacatcgacaaaaaggcaaattgcatacagaaacacttcacagaagacctagtgaaagacttcgtaattgtagatgaaagtgtcactggcctttttgtcaaaaaagaaaggctaaagtga

SEQ ID NO: 9092 - RNA, 4203 nt, synthetic construct
  misc_feature 1..4203: note = Cas9 variant
  source 1..4203: mol_type = other RNA
atgaaaacaatcacagaagattatattttaggcttagacataggcacaaattcatgcggatgggctgtaatggataagaaaaatagactattacgtctaagaggaaaaagagcaataggctcacacctattcgaagaaggccattcagccgccgacaggcggtctttccggactacacgaagaagactaaaaagaaggaaatggaggctaagactactagaagaaatatttgctgaaccaatggccaaagtagatcctgcctttttcgtgagattacaccaaagttgggtatcaccgctagacaaagacaggaagaaatatcacgcaatcgtatttccaacagccaaagaagaccacgagttctaccatgattatccaactatataccatctacgagatgccctaatgcgagaagaccgacaatttgacttacgcgaaatcttcctagctatacatcatatagtgaaatatagagggaatttcctacaagacactccagtaaactcatttgtagcatcaaaaatagacgtggccagttttcttacaaatgtcaaccaggcttatgcagacaaatacggagaagaacaaaacttcatagaactaaacgaaaacaacgcagcagctatcgaagctgttatacgcggcaaagacaaagataaaacaaccaaacaactagacaaagccaagaaaatcacaaaattattacaatcctcaacaaacaaatacgagaaaaacgtaacaagacaaattgcaaacgccataatcggttataaaacgcaatttgaaacgatactaggaaaagacatcgataaaaacgacaaagctgattgggaatttaaactatcagatggagacgctgatgacaaactggaaaatttattaccagagttcgacgacaacgaccaatacatagttgccgagataaagaaattatttggatcaatagctttaagccaaatcgtctatgaaaatatgactttatcccaatccatgaaatgtaaatacaaagaccacggagatgactaccacctactgaaacaatacatcgcaacactctcagaccatggtcaagtgagaaaactcctactcgcatacgatctctacgtaaataaccgacacggaagattattagaagccaagaaagaatttaaacaagacaaagcattaactcaagatgaattttacaaaatagtccgagaaaatctagataattcccaacttgcccagaaaattttacagaaaatagaagaagaaaaatttatgcccaaacaaagagttaacaaaaatgggtttataccgtaccaactacaccaaatcgaactagaccaaataattgccaatcaaagtaaatactacccgttcttagcagaagaaaatcctgtaaaagaacaccgaaaacaagcaccctacaaattagacgagctagtaagattccgcgtaccctactacgtgggtcccctaatttcgcctgacgataaacgcaaagacaaacaacaaaataaaaatcatgaaatgtttaaatttgcatggatgaaacgcaaagataacaacggagcaattacaccatggaattttgcacaaaaagtagatagagaaacttcagctaacagattcataaaaagaatgactgtaaaagatacatacctcataggagaagatgtactaccagcaagatctctgctttatcaaaaattcgaagtactaaatgaacttaacaacatacgcgttaatggaaaacgcttagaaccaaaatttaaacaaaaagtgtttaacgaactattcaaacagaaaaataaagtcactaaaaaggctttcaaagaatttatattacaaaacacgggaatgaaaacagcggaaatcgatggactagcagatccaaccaaattcaattctagtcttagctcttactatcacttaaaatcaacaaaagtatttgataaacaactagatgacccagaataccaagccgatttcgagaaaattattgaatattcaagtatatttgaagacgcagaaatttaccaagaaaaactccacaaggaaatcaaatggttaataccggcacaatttaaagcaattgcaaattggagactacagggctggggtagattaagtagaaagctactggttgaactaaaaggcaaaggaggcgaaaacattatataccaactatggacaacacaaaagaacttcatgcagatagtaaacgaacccgaacttaagaaagctatagtaaaagaaaatcaccaagctacagaagaaaaaggaatcgagaaaatacttgacgactccttcacatcccctgcaaataagaaagcaattcgtcaagtcataaaagttgtagacgatgtagtaaaagcagccggaggaaagaaacccgcgcaattcgcaattgagttcacccgagaaccgaaatggaacccacaattatctcatattagaggaacaaaactacttcaagtatatgaagacacagcgaaaaagctagtagaccaaagtcttacagattcattgaaagaaaatatgactaaccgcaatttactaaaagatgaatacttcctatatttcattcaatgcgggagagacgcatatacaggtaagaaaatcgatattgcagacatacacaagaaataccagatagaccacattttaccgcagtcattcataactgacgactccttagacaatagggttttaaccgaaatagaaattaatcagaagaaacacaagaaatacgcctcccacttattcgccacaaaacctgcattcggattaaaccaatccattagtgaaatgtggaaaacttggcaaaaagccggactaataagtcaaaggaaattaaacaacttgttattcgacccagacttagtaaaagataaacagaagaaaggattcatcaacagacaattggtagaaacctcccaaataatcaaactcgtcagtataatacttcaagataaatttccagacactgaaataataacagtaaaagcgggctacaacaccgcactccgtaaagaactaaaactctacaaaagcagggaagccaacgattaccatcacgccatagacgcctatctaacagccataaacgacaacttcctatatcaagtttaccccaattttagaccattcttcgtgtacggccaatttaagaaattttcgcaagacaccgacaaacagaaagaagcaataaaatattacggtctcaaaaacttcttggaaccccttcttgacgattcaacaggagatgaagtgatggtcaaccacacgaaacacgtagtctttcataaacaacgtgacatatttaatcgactcattcaagcatacaactacaaatacatgctagtaagcagagaaaccactacagaaaattcaaacatgtttaatatgaccatataccctagaggggaaagagataggaagaaaacaagaaaattaatacccaaaggaaaggacttagacccagcaatctatggaggttattcaggaaatacagatgcttacatggtcatcgtcaaaatagaaaagaccaaagaaacattatataaagtagtaggcgttccgatgagagcactagctagcctaaagaaagcccaaaaagaaggaaactatgaccaagaactgaataaagtactcgaacctctaataatgttcaataaaaacggaaaaagtaaagccggaataaaaggattcacagttgtcaaagatcacgtacacttcaaacaagtagtaatcgatggtgactcaaagtttatgctatactcagcacaatatagagcaaatgcaaaacaactaacgctgtcccaagaaactatgaaagtcgtaactgacaacacagacgacatggaccagaaaaacgcagataaagatcaactactgttaaatgcatatgacgaaatactagaaaaggtggaccaatatctgcccctattcgacatcaacggttttaggcaaggattacacgacggcagagccaaattcgcagccctgaaaacatcagaaaagaaatatacactcaaaaacatcttgaacggattgcacgacaaccttgtcacacccaacctcaaaaacataggaattaaaacaccatttgggctcatgcaatcatcgtcaggaataaccctatcaccaaacgcaaagttagttttccaatccccaacaggattgttcgagaaaagagtaaaactcacaaatttatga

SEQ ID NO: 9093 - RNA, 4203 nt, synthetic construct
  misc_feature 1..4203: note = Cas9 variant
  source 1..4203: mol_type = other RNA
atgaaaactattttaggactagacctaggaactaactcaataggatgggctctagtaaaagaaacagaaaattcaaacgaaaaatcagaaattataaaactgggtgtaagagtaaatccactaacggtagacgagaaaacgaacttcgaagcaggaagacctctatcaactaatgcagaccgaacagctaaaagaagtgcaagaaggaatctacagagatataaattaaggcgtaaaaatttaatagatctacttatcaaacacaggctgatagacaaagacacacctttaacagaaatcggcaaaaatacaacacaccaaacattagaattaagagcaaaagcggcaagggaaagaatcgaactagaagatttggctcgagtattcttggcaataaacaagaaacgcggttacagatcctcacgcaaagtgaacaacgaagaagaaggacaagtcgtggatggaatggcggtagctaagaaattatatgacgaaaacctcacaccgggacaatatgcctacgaactactcagtaaaggaaagaaatatgttccagacttttatcgatcagatctacaagcagagttcgactctatttgggaataccaaaaacaattttacgcagacatacttgacgacgaactttacaacgccctaaaaggacaagggcaacaaaactcaagaaaacgattcctagcaataaaaggtgtctacacagctgaaaacaaaggaaaaagagacgaagtaaaacttcaacactataaatggcgatccgaagctataacacaaaaactgagtatagaagaagtcgcatacgtcttagtagaaataaacaatgacttaaataaatcatctggttacttaggagcaatatcagacagatccaaagaactctattttaataaagaaacagtaggagagaacttatggaaacaaatacagaaaaacccgcatactagcttgaaaaaccaagtattttacagacaagactacttagacgaatttgaacaaatttgggaaactcaagctcaatttcacccacaacttacattagccttgaaagaacaaatacgagacgttgtaattttctaccagcgcaaactcaaatctcaaaaaggactgttatcattctgccaatttgaaagctgggaaatcgaaaggaaagacgaaaatgggaatgttattttaaacaaaacaacacagctaccaaaacgtcaaacagtaggccggagagttgccccaaaaagttcgccactattccaagagttcaaaatctggcaaaacataaacaacctagaaatcgctaaaattagcgatggaaacagcaaaaacaagaaagaaacggaagcactatcagatgacgaaagaaaactactatttgaagagttaaatctaagaggaaatctatcacaaaaagaggtattacaaatacttgggttaaaagacaaagaatacaaaacaaattttccagagggactagaaggaaacagaactaatgcagcgctattcaacatatatcaacaaatagctgaaaatgaaggctacggagactggaccaagaaaagtgcacaggagatcaaagaagaattgaaagccgtattcccccagataggaatacaagcggatatactcgactttaatgcagaactagatggaaaagagttcgaaaatcaagcctcatatcaattatggcatctactttatagcgcagaagaggatgataaaataaacgaggaggaccaaataatatatggtaactccgcagtatctctcaagaagaaactatgcgaaaaattcggttttacaccagagtatgcaaaatggatagcaaacgtcagtctacaagatgactacggtaacctgtctacgaaagccatgagaaaaatcatcccatacctaatagatggcaacgattactcagaagcatgtgccctcgcaggatacaatcatagcaattcgttaacgaaagaagaaaacgacaacagagaaagactaaataaacttgagttactccccaaaaactcgttaagaaatccagtcgtcgagaaaatattaaaccaaatggttaatgtagtaaatcaagtaatcgaaacatacggaaaaccagacgaagtccgcatagaattagcgagagaattgaaaaagtcagcggaagaacgtgccgaaatgacaaaaggtataaatgaagctacaagaagaaacgaagacatcaagaaattaattaccaaaaatttcggcattcccaacccaaccaaaaacgatgtagtaagatataggttgtgggaagaactagctcccctggcgtataaagatgtcttcacaggccggcaaatcaagaaagaagatctattttcatcaaaaatcgacattgaacatataatcccaaaagccctgcttttcgatgacagtttcagtaataaaacgctagcttttcgagagactaacctaaagaaggctgatagaacagcatacggtttcatcgaatcagactataatgcaacactagacgactatattcagcgagtagagacactatataacaacgcaaaaggaacgatatcaaaaggcaaacgcaacaaattgttaatggctcagaaaaatctaccagacggatttatagaacgggatttaagaaattcccaatatatagccaagaaagcaaaatcaatgatagagaaagttttcaatgacgtaaatgtaacaagtggaagcattacagatagattacgtgaagactgggacctaataaatgtcatgaaagaactcaattttccaaaatataaagcactaggactaacggaaatagaagaacgatacgacataggacaagagaaaactaagaaagttgaagtcattacagactggaccaaacgaaatgaccatagacatcacgctatggacgcattaacagtcgccttcacaactaaaagccatgtacaatatctcaacaaccttaacaccatacacagtttaaaaggggatgaagtagacctagaactgtctaaactatatggccttaaaaacacaattacagaggtagtaaacaagaaaagaaaattcataccaccaatgccaaattttcgcgaggaggccaagaaacacatagaaaccatcctagtttcgatcaaaaataaaaataaagtatacactaaaaatattaataaaaccaagaaagaaagcggttatcatacaaaagagcaactaacaccacgtggacagctacacaaagaaacagtatacggtaaaagcaaaagacctatgaataaaccgacaaaaatcaacaaaaacttctcattagagcaagcacaactaataataaacgtacaagaaaaagagttagtactacgtcacttagcacaatttgacaataatccagcagttgcattcgacaccaaaaccctcaagaaaatgcccctactcaaaaacggagaaccactcaaggaagttctctgtttcgaagaaatatttacaatacgaaaagatataacacccgacctcaaaatagaaaaagttgtagatgagaaaataaaagcaatattagaacaacgaaagaaagactttggaggaaatgcaaaagaagcattctcagacttagacaaaaatccaatatggctaaataaagaaaaagggatatgtataaaaagggtaacaatcacaggcgtatccaatgccgaagccttgcatcaccaaaaagatcacctaggacgcgaaatactagatgacaacggaaatccaatacctgcagacttcgtaagtacgggaaacaatcatcatgtagccatatatgaagatgaaaaaggaaaattacaggagaaagtagtctccttatacgaagcagttgcgagagcaaatcaaggactgcccgtcgtagataagggtctaaatgaagatctcggttggaaattcttatttacgatgaaacaaaatgaaatgttcgtatttcccaacgatgacttcgacgtaaatgacattgacttactagacgaaaataatgcgaagatcattagtcaacacctattccgggtacagaaattggccaccaaaaattacatgttcagacatcacctggaaacaaatgtacaagaagtaaaagaattaaacgacatagcatacaagtcaattaggtccacagagccgctcaaaaacatcaagaaagtccgaataaaccacataggcaagattgtacaagtcggagaatactga

SEQ ID NO: 9094 - RNA, 4209 nt, synthetic construct
  misc_feature 1..4209: note = Cas9 variant
  source 1..4209: mol_type = other RNA
atggctaagaaagactatacgatcggtttagacataggaaccaatagcgtaggctgggcaataatcgatgataacctcaaactcctaaaacgtaatatgaccatcaaaggaaacacagacaagaaaagtgtaaaaagagacttatggggatctttactttacagtgggaactcagataaaacaacaagtgcagccgatgcaagatcgaaacgcggactcagaagacgattacgacgacgaaaatatagacttgatcgtctaaaacaaatctttagcgaaataataaatgataaagctcccaactttttcgacaaattaaacgaatcattcttaaaccctaaagataagaaatacggaaaatatcaaatatttgatacagaaaaagaagaaaaagattactatagaagataccctaccatctaccatctaagaaaagacctaatagaaagctcaaagaaacaagacatccgattagtatacctagcacttgcgcatatattaaaatctcgcggaaattttctcttcgaaggcaacatagatgacctgaaaaacgactttgctggaatatatgaagaggtagtcgaattatgtatgacaataaatgctgaagacgtcgacctagagtttgaggaagtcgacaaacaaagtctgaatagcatcattaaaaatgaagatatatccgagatagaacaaggccttgaaaacttcgcggacgaacacgttatatttaaagagcaaaataaaaagaaaaacgacttattctcaaactgttgcaaaataatatgcggacatacagtaaaagcaaataaattcgcatcagaactagattcagaactttttataagtttcaaaagcgatgattacgtcgacgtaatcgatgtaatacaatccggaaacgagaatatagccaacctgcttctcgcttgccgcaaagcatacgattacataatgttcaatagactggtcgacctaaatatagactcaccagctaaactgagctcaaatatggtaagcctctacaatcaacacgaaaaagacctcaaagcatacaagaaattgataaaagaatttaacaaatttaaacgctcaaatggttgtaaagatctcgagatgataatactaacagcagacgatatcgactctttcagaaagaaagtagacaagaaagagggcaaactaaacggaataaacaagaaaatcacccacgaacaggcactaaagaaacagttaaaagacatgaagaaaatacttgaagacaaaaacactgaggcggaagataaacaaataaacgatatactgaaaatgataacaagtatagaagaaagagtaaacaaaagttgtttcttgaaaaacctacgaagtacagacaacgcaagcataccgaaccaaatacaacgacaagaaatggaagctatcctcgacaaacaagccaaattctacccattcctcaacgaacacaaagacgaattactccaactactctcatttcggattccctactacgtcggaccactggtaaacaagaaatacagccgcttcgcttggctagtaagaaaagaaggtcaagtccagaaaataacgccaaccaacttcgatggcgtggttgacaaacataaaacggctgaaaaatttatggaaagactaataggaaaagacgtatatttaccaaatgaaagagtactaccaaaagcaagtctcttatatcaagagtactgtatcttcaatgaactaacaaaagtggcatacatagattcaacaggtaaaaagaacaacttcagcagcgaagaaaaattaaatatattcgaaaaactctttaaaactaagcgagaagtaactaaaacagatctatgtaaatgcttaaataacgtatgcaagctgaaagaaaaagtaaaagaaacagaaattattggaataaaggcaaaatttaacgctaaatactccacctatcatgacttaaagaaaataaatggaatggaacaattaatagccgacgaggagggaaaacctctatgcgaagatatcatttcaatactcactatattcgaagacaaggatatacgactggtcagactaaaagaattactatgccaaaacaaggacttaatcaataaatttagtcttagcgcagaaaaattagcaaaagtgttatcaacaaaacattacaaaggattcggcaatgtatcggctaaattaatcaatggtataagagataaaaattgcaaaacaattcttgattatctcatagaagacgataaagaagcctattatggacgaaataacccaaatcgaaatctcatgcaactggtaaatgactcgcgtctagcctttaagggacaaattgacagggaacaaaatacacacctcgaagatctcagcctagacgagtttttggatgacctgtacgtgtcaccaagcattagacgcggtattagattaacaatccgattagtagacgaactcgtagaaataatgggctacctaccaaagaatatagtaatagaaatgcccagagaagacggagaaaaaggaaagatagcagatacgagatactctaaacttgagaaaatgttgaaaaaggatgcagcattagaagatctttatagagtattaaaaacatacgagaaaaacaagaaagcattagcaaatgacgctctttatctatatttcctccaaaacggaagagacatgtatactggaaaagaaattaatttatccgaattacattcgtatgacatcgaccacataatacctaaatccttcaaatacgatgatagcttagataacaaagtactgacagcaaagaaaatgaatatggataaaagaaccggagccttagaccacaatataatcgaaaatcaatgcggattttggagggtactcttacaacaagataaaatatcactagaaaaatatacaaacttaatgaaaacagagttcaccgaagctgacaaagcgggtttcattatgagacagctagtagaaaccagacaaattacgaaatttgttgcacgctacttagacaacaaattcaatggacttataagcgatccaaacgacaaagtcaacattttacttcctcgagctagcttatgccatcaatttcgcgaaacattcggcttctacaaagttcgagaattaaacgatatgcatcacgcacacgatgcatatctaaacgcagtaatagccaataccctaaataaaaacgcatacctaagcgatctattaaaatacggagcttactcaaaatataagaaaaacgggtttaataacagcaatggtattatggactactttggtaacacgcaattcaactgcttattcgtagtcgaaagaaccctagataaatgcagagtcaatatagtcaaacacccagaaacagcaagtggggagttctataatgaaacaatacagaaaaataaagtaaatggaggctcgtcaacaagatcactaaaaagctcagtaaaggtcctacaaaatacagaacaatacggtggttttacaaatgttaataacgcatactttatattattcgattataaagcaaaaagtaaactaaaaagaaaattaatcggagtaccaatagtagatcgacaaaaattcgaacaagacccagtaacatacttagaagccaaaggtttcgatgaacctaaattagtgcaaaaattactaaaatatactctattagaatacgaagatggaaaacggcgctacttgactggagtgacaggaaaaagatgtgaattagtaagggctaatcaactcctgctcccacgaaatatgatggcacttctgcaccacctacaagagtggcaaaagcacgatttcgggataaaagagatgacaaaagttattaaaaacaccaacaacatcgaagctaaattcgataaactattcgaacacatgatgaagtttatagataaatatagcgaaccacccaaaatagtatcatcaaaaatctcagaggagtatcataaactcagggaaagtttatgccaagatgacaacaaaataaaaatatacgcagaaatcgggaaagcgctacttagcttactacatttagtcgattccaaaagcgcctgcgtatttaaattctctggcctagaaataaacagaatcagatatcaatcaatcaacgaaaagaaagaaccagtaatcatattccaatctctaagcggattaagagagtcacgatataaatacaatcaatga

SEQ ID NO: 9095 - RNA, 4209 nt, synthetic construct
  misc_feature 1..4209: note = Cas9 variant
  source 1..4209: mol_type = other RNA
atgaaactccgaaatgcgaaagactacagcataggtttagacgtaggtactggaagtaccgggtgggcagttaccacattagatggagacctttttacattcaatcacagaccaacattagggagcagattatttgaaagtgcgagtacagcacaagaaacaagagaagcaagaggtgctcgacgaagattaaaaaggcgtcgatggcgcatctcactattacaagaacagtttgctgcagaaatggaatcatgtgacagtaactttttcatacgattaaaccaatcacgattatggcaagaagatcgcaccgaacagggaaaaggctaccttttcggaggaaaacccattttatgcggagctcaaatattcgccaatgaacaagaatattaccaacaatttccaacaatctttcacttacgcaaatttcttgtggaatgctccgaacaagttgatctaagactaatttatctggcgcttcataatatagtcaaatatagagggaatttcttataccaagataacaaaacacttaacgtccgtaatttcaatttagactcccaaatagctgacttcctcgatcaattacaactatggtgcgaaaataacgacttatgcttccatgaaatcgacggtacaacaacactcgcctcccaactaaatacttgttttcaccaacaatccaatcaacaaaagaaagacacattaaaaactttcttcgctacatgtatagaaaacgataaaatcgcaggcgaactcacaaaagcactactaggatacaaaacagattttaaaattatatttaatattgaaggagaaaaagatgaatacaaagccaaatgcaacgaagaggagaaaattcttaaattacaagaaactatagatgatgccaaccaggttcttttacaatcaatattgaacttatactccggaataatagtagaaaagatattaaacaatacagctgtcaaaaatgaatcagctcaatgcaccctatcggcataccattgctatagttacgctctctattcgaaacagttaagaactttaaagaaacttgtccgcaaatataatccacaacgttataacgaatgctttaacctttcagctgaagacccaaaagcaaagaaacaattatgcacatatgcacgatacaacgcacaacactcaactgattacgatgagttcaagaaatacataaaagacctattcgaaaatacagacgccgtaaacgacgccgcttatcaacaaatgaaacaagattttgatgaagaaaaattcttaagaagacagaaaacatccgacaatggagtctacccataccaatttcatctagaagaaatgcaactaataatcgaaaatcaagcacaacactacccctttctcacaaaaattaaacctaaactcgagtcactcgtcacattccgaatcccatattatgttggacccttaacccaaaaaggaatccaaaggaatggtagaaaatttgcctggagcaaacgcaacaaagatgccgaaaaccaaagaatatacccatggaattgggatagcatcatagataaatctgcgtcagccgaagcattcatcctcaggatgacaggaaaatgcacttacctatacggagaagatgtactccctaaagaatcattactatatcaagagttctgcgtactaaacgaattaaacggtgcaagatggaattgcgacggtgaacgaagaatgccattatcaaacaaagactgtaaagcaatatacagacaattattcctaaagaaacaaaaagtaagctacgcagacgttagtaattacttgaaagcacaaggtcatatcaacaacagtgtagccgggggacaaggtgaacacggtttcgaaagcacgctatcaagccaccacttctttagaaaactatttaatgtagacgcagccaatgatttaaccgcgcaacaaatcgaaactgcagaacaactcatactatggggcactatatttgaagataaagaaatatttgaacagaaaataaaagaaagatttggagatatgttttctaaagacgaaataaaaacgatagctagaagaaaattttctggttggggaaaatgtagtaaacaactattaagcggtcttactgttgaaacaccacgaggaagagaatcaattatcgacgtactcagaaatggacatcctgaaaacggacgaaccctagtcttcatgcaagtaataacagacaagaaactcgagtttgataagaaaatcgaggaatacaataatgaacatttagcaaaaacaaacgaatcggtcctcgataccgctataatgtccccggccatcaaacgaggagtaaatcaggctctccatatagtcggtgaaataagaaggataacaaaacacgatccaacatgcatatatattgaaaccaccagagacgagaaagatggaaaacataacacacgaacatccagtcgctactcttcattaaagaaaaacctagaaactttaaaatccatagacaaagcaaacgctcccgcaattaaacactcactagaactcttagaaacatacaagaaacaaaacatagatgataaacttttcttatatttcactcaaaacggaaaatgcatgtactccggtaaatcactagacataaataatctaagcagctaccaaatagatcatgtgataccacaatcatacatcactgacaattctttcgacaacagagtactggtctacgcatcagagaatcagagaaaatctgacagtttacttttatcctcagttatccaagcaaaacaagaaccattctggaccagcctcgaaaaagcaggcctaatttcagagaagaaacacaataacctaaaaagaaaatcactatcagacgcacaaattaaaggattcataaacagacaattagtcgaaacatcacaaatcgttaaagtactacgagatgaactcagccgaatactccccgataccaaaattatcccagtaaaagccagcctatctcacgacgttagaatagcctgcaatctctacaaatcacgtacagccaattcattccaccacgcgcatgacgctctacttgccagcacaatgggtcgattcgtacaaacaagattcccagatatgtacgaaaatccagtccgatacgtaaaaatattgagagcctatatagcacaaagcaaattacagcatagtgctcaaacacgaaactttgattcacgcagctttatggcccattctttcttttgtgactactcaaatgaaaacggcgataccatctggaactcagctagtgaaatagaaagactcagacgagccttaagttataaaaatttatacttaacaagacgaccattcattgacgcaggacaattttgggaccagaccatttattcgccccacgataaaaagaaaactccagattccctaattcctctcaagaaaaacctagatacacaaaaatatggaggatattcaggcaaagactacgcacacttcttcatatattcagttttaaacaaacaaggcgacgtcgaatatcgtttcgacggagtaccactctatatagcggccaatatcaaccgcgacgatcgtggggccttagcccagtatgctaaacagctcgtagagcacgaaaatgtacctaatgctaaacgaaaaaccaaagacttggtcttccaacgaatcgaacgcgcatgcgtaccaaaataccaattaatatgtatttctcaatgcagtggagattccgatcgttcagtttcggattactactacatcaccggtaagaaagaggtgcgtaatgctttacaactagcatttccaatgcatctatatggagctataaacgcgatcgaagataagaaagaattagatgatagcgcgttagaggaactcgtagtctatatactacgaaacgcacctcgtatagctccagatgtgttccggagactaaatctaaccgaaaaattagccgactgcttagacatccccgatagaatagaactccaaaattcaatttatggtctattcaatttaatcaatgcagaatcaaacgtcgtgaacctacaaatatttgggggcgcaaaaacagccggagtgaaattaataaacctaaacagtctcttaaatgatccagctaccacggtcacatttatcgatcagtctgtaacaggcatgtttgaaaggaaagaaacgataggaatttcttga

SEQ ID NO: 9096 - RNA, 4209 nt, synthetic construct
  misc_feature 1..4209: note = Cas9 variant
  source 1..4209: mol_type = other RNA
atgggcaagcaagaatttaatgactattacttaggctttgatatagggacaaactccgtcggatgggctgtaacagaccaacaatacaaattactccgattcaacaaaaaagatatgtggggcagccggttgtttgaagaggcaaaaactgcaaaagaaagaagggtgtacagaaactccagacgaagactagatagaagaaaaagaagactaaaactactggaagaactctttctcgatgaaatactaaaagtagactccacatttttcaagcggctagaagaatcaaacttatacaacgaagacaaaagcatcaaattcaattaccccttatttaatgacaaagactatactgatatcgatttctataaggaatataagaccatataccacctaaggaaggcgctagtattcgaagatagaaagttcgacataagactattattcatagcccttcaccatatactaaaatatagaggccacttcatatttgaaggacaaagttttgaagatataaagagctttgactatatctttacagaaatccaagattggatattagaaaatttcgaaataaacatagacattaatctaaaagagaaactagaagaaataatactaagtaataacaccaaaagtataaaaaaaatagaatttaaaaaaattttctcggacaatcgtatactcgctattctcaacatgggagtcggttgcaaagtcgacttaaaagatgtattcaacaatgaagagctaaaagatcagaaaatctcattcacagagattgattacgaaaatgagaaaagggacgaattttatcaacttctaggagaaggcatattcatcgtagatttagccaaaaagatctacgattttatggtcctaaagaaaatcctcaaaaattccgactacttttcagaatcaaaagttgcattatatgaagaacataaagaggatctaaacagactaaagtacatattcaaaaaatacttaaaaagcagcgattactataaattcttcagatcaaactcagaaaagactaactacccgtcatacatcggactaaacaaaataaaaacaaaaagactaattgagaataacaaatgctcgatcagtgacattaataaagaactaaaaaacaaatacctaaaggatatccaagttgaggcagaagacgaagaacttttcaaccgcatactacataaaataaacgaaaacaagttcttagaaaagttaaaaagttctgaaaacagtaccgtgccatatcaagtacacgaaatcgaattaaaaaaaatcctagataatcagagaaaataccatagttttttgaatgaaaaaagcgacggaatgacactttgcgaaaaaataatcaaactgttcgaattcagaataccatattacgtaggcccattaaacaccaaccccaacatgaataaaaaaaacaaaaacacatgggttgtcaaaaaagaagaaaactcaaaatcatcaataacaccctggaacttcgaaaaaaaagtagatgaacaaaaaagcgcagaagaattcataaagagaatgacaaatagatgcacctatctcagaggagaagacgtaataccaaagaacagtctcctatacgaggaatttgtattactaaacgaactgaacaaagtaacagtcgacaatgaacttctacacccaacactaaaaaatgaaataatagatgaactatttaagacaaccgtcaaagtaacgaaaaaaaaaattacagaatttctaaaaaaaaaacaagctatatcagacgtcgaatcaatcacagggatcgacgtagaattcaatggaaaactacaaggatataacactttccgtaaaattttaggagaaaaaatagaaaatctcaatattaaaaaattcgtagaacgttgtatcgaactaaaatgtttatacggatcagataaaaaacttttcaaaaacgcagtcggcaaattatataaagaatacaacgttaccgatgaagaatttacaaaaatcaacaaactaaatttcaacaaatggggaagattaagcaaagaattcttaactggaattagattcgaaaaaaccgacggaactgaaagatttgaatcggtaatagctgctctaagaagtacaaactacaatctaatggaattgctatcagacaaatttaatttgcaatcaaaaatagacgagataaatggagaggacgacttcagtaacattgatataaaagaatatgtaaacgaattgtatgtatcaccatcagtaaaaagatctataatacaaacatataaaatcgccatggaaatcaaaaaaataacagggaaaaatcctaaaaaagtattcatagaaatggcgaaaggaggaggtgaaaaagggaaacgaactgaacgacgaaaagacaaaataaaagaactgtacaaaaacatgaaagactctctgtccgattactgcaataatcttcaagacttaagctcgcaagtcgaaaaatatgatgataataggttaagacaaaaaaaattattcctatacttcatgcaaatgggcaaaagcatgtataccggaaacgatatagacctctcagaactattcaacaataacatatacgatatcgaccatatctacccacaaagtaaagtcaaagacgactcattcgataatatagtcttagtagaaaaacaagaaaaccactcaaaatccaacgaactgttaaaaccagaaatccaaagcaaaatgaataactattggatcttcttaagagaaaacaaattcatatctaaagaaaagtataacagactaacgagaaaaaaaaactttaccgatgaagaattgggagacttcgtcgcaagacaactagttaccacaagacaatcaactaaagaagtcgcaaagctatttgaaaaaatattcgacggaaccgaagtagtatattcaaaagcaagtcttgtctcagattttagggaacgattcgacataataaaagtacgggaggtaaatgacgcccaccatgcacaagatgcctatctaaacatagtggtaggtaatgtatttaacacaaagttcacaaaaaactattggaaattcataaaagaaaacaaccgtaagaacgaagaaaatccaaacaaaaaggaaggatataactttaaaaatatatacgaaagcgacgtattcagaaatgaagatgttgcatgggttttcagcaaagaaaataaggaaattaatacgataaaaacagtcaataagatggtatacaggaaaacagtaaacataaccgaaatgttagtagagggaaaaggccaactattcaatcttaccataaaggacagaacacaactgaaaaaaaaggtaggtaacatcgtcgcaaatatccctaaaagtttaaaaaaccgaaatacaaagttaaaaagcgacgagctagcgaaaaagtacggatacttcgattctttaaacaacagctattttgtattattcaaatacgttgagaaagaaaaagaaaagataggatttgacggaattacaatagttgacaaagaaaaattaaaaaagaactcagacatagaaagatttctagaaaacaaaggcaacaaaaacgctaagttaataagaaagatcttcaaaaaccaaaaagtactgatcgatggatacccatacttactaaagtcatgtaacaaagacaaagctataagattcgacaacttcaaatccttatacctagacgaaaacgacctaaaattcacccgagacgccattaagtttgaaaaaaataatgcagacatcgacttaaagaaacagaaatacattatcagcttcttaaaaaaaaaaaaacaaaacgaaatcaacgaaacttacgaggagtgtattgaaaggcttaataatgaattcgatacattatttctaaatctatgcgacatccaaaaatccccaatatacaaaaactacaaattgccagacttcataagcaaaaaaaatgtcgtcgaagtaaaagataagttcgaagtgttcaaaaacttggagctatataacaaatcaaaattaataaagaattttcttaactacttcaaatacgataataataaactagaccttatagctattggcatagattccaaagcaaactgcatccaaaaacatttcacagaggaccttataaaagatttcgtaatagtagatgaaagtgttaccggactttttgccaagaaggaacgactagaatga

SEQ ID NO: 9097 - RNA, 4209 nt, synthetic construct
  misc_feature 1..4209: note = Cas9 variant
  source 1..4209: mol_type = other RNA
atgacctatcgcaattaccacattggcctcgacataggaaccagcagcgttggttttgcagtacgctacgacaatggggaactggtccacaagaaagggagtaacctcgtgggagcacggctattcaaagaaggtgaaaccgctgaagaaagaagactgaatcgaggagctagaagaagatataatagaagaaaatggcgcctaaacctgctaaatcaaattttcaaacccttaattgaagtaaacgatccaacattctttaaacgactggaacaaagtaatttagtaaattacgataagtccgaatcatttagcctcctcaataaccaatcagacgacaaactccaccaacaattcccaaccatttaccaccttagagactatcttatgaagtcaaccgaaaaagcagacatacgattaatttatctagctgtccatcacatagtaaaatatcgaggcaacttcctagatgcaagcccagttgactcatttgaagctagtaatttgaaagtagacgaaattttaacacaaataaacctactgttagataaccttacagatgaccttcgtttaaacacccaatatgtcacagatatagaacaaacactgctgtcaaataccgaatcaaataaagacaaagaaaaagtaatccaaaaacttttactccacaaagaagccatcaaaattgataaggaccgcacagcacaaatcgcaaagctagttctaggatataaagcagacatagccaaactatttggaataacagaaaaactacaaactccaaaattagaattgagtgcagccaattcggacgatgcactaatggaactaagcgccgaattaaacgaagatcaaattggaattttactacaactcaaaacattatattcaagggtaagactcaatcaaatcattcctagtggcacgtctcttagtaaatccatgatagaaaaatacgaactacatcacacacaacttaaatctttcaaagaaaatatactactaaaactgcggcgtaacacggcagtacgtcgcaatctcgaactagcatatgcattgtatgtaggcaacgcccaaaccaaacaagaggtatttgaacctaagaaagcaagattcacttctgatgatttcgcaagtcttaaagccaacgctaaatcagcaagcagcgtcaaagaagcacccaaaaatacaaaaacgaaactaacaacagacgacttttacaacatacttactgaactattcgccaccttcgaatccgaactatctgccgacgaagacatgatcaaagaagtagaacaaatcaagaaagcaattaccggagacaattaccttccaaaacaaagaacagatcaaaacggaaacatcccacaccaattacatcaaatagaactaagacaaatcttgcaaaaccagctaccacactatccagaaatggacaaaataaatgagcaaaaaccaatcgaaaaactcgtaacattccgtgttccatactatattggacccctcatcacccctgaagaccaacaaaaatcaagcgccgcgaacttcgcatggatgaaacgaaaagaacaaggggctataaccccctggaatttcgacgataaagtagatcgcatgcaaagtgcaacaaatttcataaaaagaatgacagtaaaagacacctacctaataaacgaagacgtactaccagaccgatccctattataccaacgttttaaagtacttaatgaactcaatctcgtaaaagtaaacaaccaactgttatccataggcgaaaaacaagcaatttaccacgatctgtttgaaaaacagaaaaccgtctccacaaagaaactccaatcatatctacaaagtgaacaaggatacggagacaacatcgaaataagcggcctatctaatccagataaattcaacaacggactaacaacatacatcgattttaaaaacatcttcggagacctagtagaggacacgacaaaacaaaaagagttcgaacaaatcatagaatggtccactgtatttgaagaccgagcaatttttaaagcaaaactccaagaagtaaactggctgacggaagaacaaataaaagcattagtcgctaaacgttactcaggatggggccgactgagttaccgattacttgcagaactcgtgaatgacaacggtgaacgcataatcgacatactatggaataacaaaggatcgaatcttatgtcaatagtcagtcaagacgaatttcaacaacagatagcaagaatcaattcgcatgaagtacaagaactaggaatggaatcggttttagctaatgcatacacatctccacaaaacaagaaagcaataagacaagtcatgaaagtcgtagacgacatacagcttgccatgaatggacaagccccaacaagcatatcgatcgagttcacacggaaacccgaagaaaactcagaaatatcaaaaagcagatatgaaaccataacttcgatatatcagagcttatcgaaagacatagaaaaagaagtaaaagataacttaaacaaaaacaaatcctcactaaagaaaaacctcagtgacaaatactacctatactttactcaactcggtagagacatatatactaatcaaccaattccattcaatgaaataccttactacgatattgaccacatagtcccacgttccgtcgaaatgaatgactcactcaacaatagagtgctcgtcgctaaaagcataaaccaaataaagaaaaacaatgcccctattgactcttctctaaaaataacatcagagacaagacaattatggaagaaattgctcgatagcggcttaataactaaacaaaaatactataaattatcatcttctatcaaaaacacagtaagtccctacgtcaaacaaggctttataaaccgacagctagtagaaacatcccaagtaataaaactcgtcgcgaatattttaggaaccaaataccaaaacgatgacaccgaaattatagaggtaaaagcccatttaaatagcgaaatacgaaaaacctttgagttctacaaactcagagaattaaatgactatcaccatggattcgacgcgtacctaacgacgctagtaggcggctatctatacaacagatatcccaaactacgcagctacttcgtctacggcgaccataaacgactagataaagcacaactaagtgaactgaaaaacttcaacttcttgcatggactaacaaatcctaaatccgggtcggatggattaataacagccagcggttctcaacaagtagttctcgatcgaaacgaaacaattaaaagattaaataaaatataccgatacaaatacatgctcatatccagagaagtatttactaaacaaggacaattttataatgaaacaatataccctgcaaaaccaaatactgcgaaaatgattccactgaaagataataaaccatcagaagtgtacgggggatactcaagtagtaacgtctcaaaaatagcacttattaaagagaaaaacactgacaattatcaattcataggcatccctatcagatccattgcaaaattaaaacaagccaaagcaaactctaaaacagtctaccaaactgaattgaacagagtaattaaaagcgtcttagcatcacagaaaactaagaaacaaaaagagttcgaagtaatactagacaacgtaaaatataatcaagtagtcgtagaccaaggagaaaaatattacctggggtcaccttattataaaaagaacgccaaacagctagtcattagcccagaaagtgtaaaaatattagcggataaagccacagcggacctacccgaacaagaagcacacaataaacttatgacagtataccaagaaatcgtagacgtactaaacaaacattttgcattatacgatatcaacaacgtgagaaagaaattaaacgacggtctaattaaattctctcaactccccaactacgacgaaacgagtaaaaatagattcgacatatccaaaagtatcaaaaccaaatacgcagtcattatgagaatattatcaggaatcaaaaatcaaacaagcgaagtacccgaattaggccttaaatcgccattaaacaaaatgcaaactaaaggaggcatcaaaatatcaccagaagcaaaaatatactactctagtccaacaggcatattcagtcactttaaacaagtgaaaaatctatga

SEQ ID NO: 9098 - RNA, 4209 nt, synthetic construct
  misc_feature 1..4209: note = Cas9 variant
  source 1..4209: mol_type = other RNA
atggaacgtattctagggctagacctaggggtatcatctatagggtgggccctagtagaagaagatgtgaaaaacccagaaaacaataaaattataaaacttggagtcagagttaatccactaacaatagacgaaaagacaaactttgaaaaaggaaaatctatcacaactaatgctggccgcacaagcgcaaggagtgcacggagaaacctacaaagatttaaactaaggcggaagaaattattagaaatactaatacattataagataataaagaacgatgccgtcctggcagaaactggtaaaaatacaaccttccaaactcaatatctgcgagctaaagcagcaagagagaaaatagaattggatgaattagcaagagtactattacttatcaataagaaaaggggatataaaagcagcaggaaagtccaaaacgatgatgacggaaaagcaatagacggactatcagtagctaaagaattatatgagaaaaactatacaccgggacaatacgcatatgatctactgaaaagaggtaagaaacaaataccagacttctacagatcagatttacaaaacgaactagacagaatatgggaatttcaaaaacaatatcatccagacatactaacggacgaatttaagaaagaactagaaggaaaaggacaaagagcaacagccgctatctttttgaacagatataaaatatacactgccgacaataaagggacaagagaagagaagaaaatacaggcttatcaatggagggtagaagcgctgtcgcagccactcgacgttaaagaagtcgcatatgtaatagcagaaattaacaacaacctaaacaactcatcaggctatttaggagcgatatctgacagaagtaagaaactatactttaacggacaaacaattggcgaatacctttttgaagaactgtcggctaatccccatactagactcaaaaaccaagtattctatcgacaagactatcaagatgaatttgagaaaatttggaaaattcaaactaaattccacccagaattaacaaaagagctaaaagaacaagtgagagatatcgtaatattttaccaaagaaaactaaaatcacaaaaaggactaatctctttttgcgagttcgaaagcagggaaatagaaatcgaagaaaatggaaaaagaaaaagaaagaaagtgggtttaaaagtagcaccaaaatcgtcacccttatttcaagaatttaaaatctggcaagtattaaacaacatagaaatcaaaaacgaagatgaaagaaggtacctagaaccagaagaaaaagaattgctattcaacgaattaaactgtaaaggcaacctaacatcacaaaaatgcctggaactattaggattcaaaagcaaagacgcgaaactaaattttaaagtggtagaaggaaaccgaacaaacgaaaaattatacgacgcattcctaaaaatactcgaactccaaggatacaacgtattcgaattactcaaaattaaagaagacaaagacgaagcaaaactaagcgaactgaaagcatccgccgatgaaattaaaggcatgatcaaagaaatcttcaatgcaaatttaattaatacatccatattggacttcaacgcagaactcgaaggcaaagactttgaaaaccaagctagttatcaattctggcatctgatgtactcctatgaaggcgacaacagcccatcaggcaacgaaaaactatatgaacttttggagaagaaattcggcttcaagaaagaacattcaaaaattctaagcacaatcgtatttagccaggaatacggatcgttatctacgaaagccatgcgcagaatatacccatacatcaaagataacaaatatagtgaggcttgtttactcgcaggatataaccattcaaaacatagcctaaccaaagaagaattagagaacagaaaacttaaagaacaattagaagtactacccaaaaacagcctaagaaatcccgtagttgagaaaatattaaaccaaatgataaacttagtcaacgcaacaattagtgaatacgggaaactcgatggagtaagaattgaattagcgagagaactcaagaaaagtgcacaggaaagagaagacatggctaaaagtatcaacgaagcaacacttctacaccaaaaatacgcaaccatattaaaacaagagttcggagtagtaaacccaagtcgtaacgatataataaggtataaactatacatggaactcacagttaacggttacaaagatttatataccaatactaaaatagaaaaagaaaatctattcactgataaatatgacatagatcacataataccccagtctagattctttgacgactcattttcaaacaaagttcttgtgcccagacaatctaacctagataaaggcaaccttactgcgtatgattttatgtcaaacaaaggcagcgaaagggaagaacactttttaaatgtgatcaaagaactactggacaaaggaagcatatctaaagcaaaatacgaaaaactgaaaaagaaaggattggaaatcggagacgggtttatagaacgagacttgcgagacacacaatacatagccaagaaagccaaagaaatattattcgaaataacaaattcagtagtgaccacaagtgggcgaatcacagataaattaagaaaagactgggatcttgtcaacataatgaaagagttgaacttagataactacagaagactaggtctcacggaaatagtccgtaacagcaaaggagaggagaaagaactcatacccgactggacgaaacgaaacgatcatagacaccacgcgatggacgcattgacagtggctttcacaacccggaatcacatacaatatcttaattatcttaatgctcgaaaagacgaaaaacataaagaacaccaaaacatatacgccatcgagaatatcatcaccgaagtcatagaaaagaaaaacggatcaaaaacccgaagatttaaagcgccaatgaactcattcagacacgaagcaaaacaacacctaaaagaaattctagtgtcacacaaaaccaaaaataaagtagtaacttcaaatataaataaaaccaaaaagaaaggaggaatccataagaaaacagagctaactcccagaggacaattacacaaagagacagtatatggatccaagaaattcctacagtcgagagaggaaaaagtatcagcaaaattcgactatgaaacaatactaatggttgtaaacccgatacatagaaacgctctcttaaacagattaaaagaatacggcaacgatcctaaaaaggctttttcagggaaaaatgcaatcaataagaacccagtatatctagacgactcgaaaaccgacatattaagcgagaaagtaaccttatcatggtacgaaaccggatacaccataagaaaatcagtcaccccagacaacttcaaagattacaaaaacttagaaaagataaccgatttaggaatcaaaaagatactgaaagaaaggttagaccaatttaaaggaaatgcaaaagaagcattcagtaatttagataaagacccaatatggctaaatgaagaaaaaggaatagcaataaaaaccgtaacaataacgggagtaagtaatgccgagagtttgcactttaagaaggaccatttgggaaaagaaatattagacgaaaacgggaataaaattcctggagactttgtaagcacgggaaacaaccaccacctagcaatatacctcgatgaagaggaaaaactagatgataagatggtaacgttctatgaagcagtactacgagtaaaccaaggactacctgtcatagataaagactacaacaaggagaaaggctacaaatttttaatgacactaaaacaaaatgaaatgttcgtattcccaaacgaagattttgaccctaatgaaatagatctactagacgaaagaaatctagaaaggatatccaaacacctatttcgcgtccagaaaataagcaaagtaggctatggcaatagcttcgtcagggatttcgtcttccgccaccacctagaaacgacagtggaagaaagaaaagaactgcgaaacatcacctacatacaactaaaaagcctcgaaggcctccgcaacataataaaggtccgactaaaccatttaggaaaaatagtacaaataggtgagtactga

SEQ ID NO: 9099 - RNA, 4215 nt, synthetic construct
  misc_feature 1..4215: note = Cas9 variant
  source 1..4215: mol_type = other RNA
atgaccaaaaatatactaggattagacctaggagtatcatcgataggttgggcacttgtccaagaagacagtaaaaacccagaaaataaccgaatagtaaaattaggagtcagagtaaaccctttaacagttgatgaacaaataaatttcgaaaaaggaaaaccaataacaacaaatgcaagccgaacacttgcaagatcagcaagacgcaacctgcaaagattcaaattcagacgagcaaacctaattgacgtattgaagaaatgtaacattttaaaacaaggggacctactgacagaaataggtaaaaattcaacatttcaaacccaggaactaagagcaaaaagcgctaaagaaaaagtagaactatccgatttcgtacgggtactacttctcatgaacaagaaaagaggttataggtcctcaagaaaagctaaaaacgaagacgaaggccaaataatagacggaatgtctgtagctaagaaactgtacgaagaaaatcttacaccaggagaatacagctaccaactattaatagaaaacaagaaacaactgcctgatttttatcgcagcgatttacaaagtgagttcgatcgcgtgtggaaatttcaaaaacaatttaaccctgaaatacttacggacgacctatataaagaattgcagggcaaaaacaaaaatgccacttgggcagtattaaaagaaccgtttagccttgtaggaattaaacaaattggtaccatccaagaaaagaaagcagaaaaatacttttggaggtcagaggctgttaaaagacaactggatttcgaaagtttagcagtcgttttccaagaaatcaacagcaacttaaataattcatcaggctacttaggtgctatatcagacagatcaaaagaactttacttcaacaatcaaaccgtcggcgaatacctatttcagcaattaaaagaaaacagccacaccaaactcaaaaaccaagtcttttatagacaagattacttagatgagttcgagaaaatatgggaaacccaaagcaaatactacaaagaactaacaaaagaactcaaagaagaaataagagacattataatattttatcaaagaaaactgaaatcacaaaaaggtcttatatccatatgcgaatttgaaaatagggaaattgaaataacagaaaacggcaaaatcaaaaagaaaacagtaggactcaaagtagcaccaaaatcctcccctctatttcaagagttcaaaatctggcaggtactaaataacctagtcttccaaagtattgaaagcaaagaactatttccactcgatctagacatcaaagaatccatatttaacgaagtaaatataaaaggcaatttaagtgccaaaaatgtattagatctaatgggatactcaggtaaagaatggaaaactaattttaaaaatatcgaaggaaatcgtacaaatgaaaacctatacactgcttttcttaaaataatagcgtccgaaggtatcgaatttccaaaagaatttaaattatcaattgacgatgacatcaaagtatccaaaatagatataagtagcgagaaaataaaagagttcatcaaagaaaacttcttaaaattaggaataaatacgtcgatcttggatttcaatcctgaattagacggaaaagacttcgaaaaacaagaaagttaccaactctggcatttattatattcatacgaaggagacgactcagcaagcggcaacgttaaactctacgaactcctagagaagaaattcggattcaagaaagaacactccaaaattctagcggacgtaggcttttcacccgactatggatctctgagctccaaagcaatgcgcaaaatatatccatatattaaagaaaataaatactcagatgcgtgtcacctagcaggttacaaccatagcaaaaactcatttactaaagatcaactcgcaaacagaatcctaaaagaacaactcgagatccttcctaaaaacgctctacgaaacccagtcgtagagaaaatactaaaccaaatgataaatctggtaaatgaagtaataaaagcatacggaaaacccgatgaaatcagaatcgaattagctcgcgaactgaagaaaaatgcagaagaacgtgccaacatgacatcagacattagcaaagctacactactacaccaaaaatacgcagaagttctacaaaaagagttcggcatcaaagcgccatccagaaatgacataatacgatacaaattatacttggaacttgagaaaaatctctttaaggacttatatacagatgtacaaataaaaagagaagaattattcactgacaaatacgatattgatcacataatacctcaaagcagattcttcgatgattcattctccaacaaagtcctagtacctagaggagcaaatctaaagaaaggaaattttacagcattagattacatggaaatcgaaggcaaagaaaaactcgaaaagtttctaaatattatcaaagaactcttcgacaaaggcgcaattagcaaagcaaaattcgaaaaacttcagaagaaaggatcagaaataggagaaggatttatagaaagggacttaagggacacccaatacatagccaagaaagcaaaagaaatacttttcggaataacaaactcggtgatttcaacatccggcagaataacagacaaactaagagaagattggaacttagtaaacacaatgaaagaactaaatctagagaaatacagaaaattaggactcactgagcttattgtaaactctaaaggtgaggaaaaagaaagaatcatagattggacaaagagaaacgaccaccgccaccatgcaatggacgctttaacagtcgctttcacaacccacaaccacattcagtatctaaattacctcaatgctcgcaaagatgaaaaacacaaagaacaccaaaatatatttgctatcgagaatacgataactgaaatagtagagaagaaaaatggttcgaaagaaagaagattcaaactaccaataaagaacttcagaactgaggcaaagaaacaattagaagaagtcctcatcagtcacaaagccaaaaacaaagttgtcaccaaaaacatcaacaagatcaagaagaaaggttccattatagcaaaaaccgaattaactcccagagggcaactacacaaagaaacaatttacggatctagcaaattcttaaaaacaaaagaagaaaagatatcaggtaaattcgacttagaaatgatacaaaaagttcaaaatgaaaaatataggaacgcactcttaaaacgacttcaagagttcggtggagattccaagaaagccttcacaggcaaaaacgtgatatctaaaaacccaatattcctaaatgcagaaaagacagaacaactaccggaaacagtaaccctagcatggtacgaaaccggatataccatcaggaaagtcgtcaacccagataacttcaaagatttcaaaaacatcgaaaaagtgatagacaaaggagtcagggatatcttaacagaacgtctcaaagagttcaatggtaattcaaaagaagccttctcaaacctagagaaaaatcccatatggcttaacaaatcaaaaggaatatcaataaaaacggtaaccataactggaattaataatgccgaagccctacactataagaaagaccatctcggaaaagaaatcttagacgaaaatggccaacgaatcgcagtcgatttcgtcagtaccggcaataaccaccacgttgctatatatgaagacgacaacggaaatcttcaagaaaaagtagtatcattttatgaagctgtcgaaagagtaaatcaaaacctaccaattataaacaaagaatataacttcgaactaggatggaaattcctattcacaatgaagcaaaacgaaatgttcctctttccaagtgatgactttgacccaaaagaagttgacctattcgacgacaagtatctatcacttataagtaaaaatttattccgagttcaaagcatctcaatagtgcaatatggaaacagtgtaattagagactttaaattcagacaccacctcgaaactagcgtatcagacgaaaagaaacttcaaggagttacatatcaacaaatcaaatctctacaaccacttaaagatataataaaaataagactcaacaatctcggaaaaatcgtgcaaatcggagaatactga

SEQ ID NO: 9100 - RNA, 4215 nt, synthetic construct
  misc_feature 1..4215: note = Cas9 variant
  source 1..4215: mol_type = other RNA
atgaaagggaacatcgagaagaaaaaacaagaattcaacgactactacctaggctttgacattggcacaaatagcgtaggatgggccgtaagcgatctaagctacaaccttctacgttttaataaaaaagacatgtggggagctagactctttgacgaagcaaagacggcaaaagataggcgagtaaaaagaaactcaagacgacgcttagaaagaagatccaaaagattaaaatacctagaagaaattttcgaaacagaaatatgcaaaatagacaaaaacttttttagaagactcgaagagagtacattacacaatgaagacaaaacattcgattttcgattccccatattcaacgacgaaaattatacagacaaagagtattataaagatttccccaccgtatatcatcttagaaatgagcttattaaaaacgaaaacaaaaagttcgacatacgcctaatctacctggcaatacataatatcctaaagtataggggtcacttcatctttgagggccaagactttgactcagtcaccgatttcaaagaagtctttagcgaactatcagcttacctaagcgaaaacttggaagaaaacttagacataaacctatgcgataacataaaagacataatatgttcaaaagaaaacaaaacaagcaaaggaaaaagcttcgtatcactcatcgactccaaagtaatccaatcagtactacggtgttgtataggataccgcgtaaaattcaaggatattttcataaattatgaagaaaaagaaaaaaatgagggtataaacctctcagagatcgaatacgatgaaaaacgcgacgaaatagcgctatcccttggcgaaaacatattattaatagacatctgcaaaaaagtatacgactttatgattttaaataatatattgaaagggaacaaatacataagcgaatctaaagttaacttatatgacgaacacaaatgtgatctctgtaacctcaaatacatctttaaaaaatacttaccaaaaaaagattatttcgaattcttcagaaacgaaaacaaagaaaaaaactatgtatcatatatttcatcaagcctaaataatggaaaaaagaaaaacacctgcacacaagaagacctcaataaagaaataaaagaatatatagcaaaaatcaaggagtacgaggaaaacgatgccgttctagaaaagatcaacctaaaattaaacgaaaacaaactattaccaaaactgaaaacgaacgacaacggggtcattccctaccaaatccataaaatagaactagaaaaaatactccagaatcaaagcaaatattatgactttttactcgagaaaatagacggaatcacaaacatagaaagaatagaaaaacttttcacttttcgaatcccatactatataggaacactaaaaggtaaatttagctgggccaaactaaaagagaacaaaaaaataacaccgtggaatttcgaaaaaatagtcgacatggaagaatcagctaaagccttcatagagagaatgtcaaacaggtgttcgtatttaaaaaccgaaaacgtcttaccaaaaaactcactcctatactctgaatatgaactccttaacgaactgaacaaggtaaaaataaaaaacgaattcatcaatgtcgtgctcaaaaacgaaataatagatgaattattcaaaacaacatccaaagtaacaaaaaaaaaattcgttgactatcttaagaccaaacaaatattcgtagaaaaagaagacatatcaggtttagacaacgaattcaaatcaaaacttgatagctatataaaattcaagaaagtaatcggcgacaaaatcgacacattacgcggatataactttgttgaaaaatgtatagaattcaaatgcttctacggagatgataaaaaactcttcaaaaacgcaataaacaatacggaattcaaagactacgttagcgacgacgaattaaaaaaaataaacaaaatgaaatttaacaaatggggcagattgtcaaaacgactcttaacagaaatctgcttcgaaaacgttattgaatcagaatcttttgaaaatatcatcgtagccctcagatccactaattacaatttcatggaattcacaagcaaaaaattcaacctcagtgaaaaagtggcagaggaaaaccaagaaaacacattagaaaaatttaacattaatgaatatgtggacgagctatacgtcagtccatcagtcaaaagaagcatcattcaaacctacaaaatagccatggaaataaaaaagataacaggaaaaaatccaaaaaaaatattcattgaaatggcaagaggaggaggagaaaaaggcaaaaaaacggaaaaacgtaaagaaagaattaaaacattgtatgcaaatatgaaggacagcaacgaagaatttcttaacaatctagacaatttaaaactctccgtagacaattacgatgataataggttgcgtgaaaagaaattgtttctatatttcatgcaattaggcaaatctatgtacacgggaaaaaatattgacctaaacgaactcttattcgctaatacgtacgatatcgaccacattattccacaaagcaaacttaaagatgattcatttgataacatagtcttggtcgagaaaacaatcaataaggacaaagacaacagagactatctagacgagagtatcagactccgtatgaacaaattttggaactttctgcgggaaaaaggattcatcacaatagaaaaatataatcgattaagacgcaacacatacttctcagacgatgaactatcaggtttcatatcccgacaattggttaccacaagacaaagcacacttgaagtaaaaaaactgttcgaattcatatttcaaaatacagacgtggtctgttcaaaagcaaatttagtctccgattttagagaaaaatacggcataatcaaagtaagagacttaaacgatgcacaccacgcccaagacgcctatctcaacatagtagttggaaatgtcttcgatactaaattcacaaaaaactactggaaattcatcgaagaccgaaggaaagtagataacatacgagaaacatacaacttcaaaaaaatattcgactatgacgtgtccagaggagaaaacgttgcgtggctaaaagactactcaattaacacaatatcggagatgataaacaaaaaaacggcaaacataacacaaatgataacagagggaaaaggccaactcttcgatttaacaatattaaaaaaaagtaaaattgataaaaaactaaccgtaataccaaatacacctaaaatactaaaatcttccttaaaagattcgtgtaaaatagcagaaaagtatgggtactttagcacactaatgccagcctactttgttgtgtttaaatacattgacaaaaataaagaagtcttcggttttgacagaatattcatatttgatcgcgaaaaaattaactcaaacgaagatatagaaaaatatctagaagacaaaggatacaacagtccaaagttcataagaaaagtaaatttaaagcaaaagatactactaaacggctatccctacagaatagtaggttttacagacaacaaactagagataaagaacagcaaacaattctactccgatggggaacacctcaaatacatcaaacacttatcagccttttacaacaacaataacaacgttaaaaacggagaatacagaattaacttcctcaaaaaaaccagcgaaaatgatcgcaatgaaaccacagatgaagccaaagaacgacttaacatcgaattcataaaactatacgaatatttttgcgaaagattaaacagtaagatatatgccaattattacaactcaaaaaaatacgacgaactaatagaagtgttcgattgttttaaaaacctaaaccttctcgacaaagcaaaattactcctagagttccttaaaatattcaagaaggacacttacggaaattttaaattactcgaaaaaccagaactagataaaaatggaaaacaaaaattagacaaaaatggaaatctatcattcgaaggattgagcatggcctttgggaaactaaacggaaaaaagttcaaacaactagtcgaaaaagatatccaatttgtcgatgaaagcgtaacgggactattcgaaaaaaaagagggactagagaaatggcaagacggcgaacaatga

SEQ ID NO: 9101 - RNA, 4215 nt, synthetic construct
  misc_feature 1..4215: note = Cas9 variant
  source 1..4215: mol_type = other RNA
atggccaaaaaaatacttggattagatctgggagtaagctctataggttgggctatagtggaggaagatgcagaaaacgtaatgaacaacaaaattgtaaagttgggagtaagagtaaacccattaacagtagacgaacaaataaactttgaaaaaggcaaaccgattacaaccaatgcaggcagaactcttgttcgaggtgcaagaagaaaccttcaaagatttaaattgagaagattgcacctaatagatatattacaaaaacgaaacattctgaaacaagcagatctacttgcagaaagcggaagaaattcaacatttcaaacacaagagataagagctaaaagcgccaaacagaaagtggaattaagtgaacttgctagagttttattgttaatcaacaaaaaacgaggatataagagtagcagaaaagcaaaaaatgaagacgaagggcagatcgttgacggaatgtcagtagccaaaaaattatatgaagaaaataccacaccaggagaatactcttacgaactccttaaaagcggaaaaaaacaactgagtgacttctatagaagcgatttacaagcagaattcgatagagtatggaacttccagaaacaattttaccccgaaatttttagtgacaatctttacaaagaactccaaggaaaaaataaaaatgccacatggaagatactagaaataccttttagcctggttggaatcaaacaagtaggaacgacacaagaaaaaaaaatagaaaaatacttttggagatcagaagctgtcaaaaaacaactagattttgaaagcctagctgtagtatttcaagaaataaattcaaatttaaacaacagttcaggatatctaggtgcaatttcagataggtccaaagaattatactttaacaatcaaactgtcggagaatatctgcattgccaactaaaagaaaatccgcacaccaaactaaaaaatcaagttttctacagacaggattacctagacgaatttgaaaaaatatgggagatacaatcaaaataccacacagtgctaacaaaagaactcaaagaagaaataagggatgtaatcatattctaccagagaaaactcaaaagtcaaaaaggacttataagtatatgtgaatttgaaaatagagagatagaaataacagaaaatggtaaaataaaaaaaaaagaagtaggattaaaagttgcaccaaaatcctcactactgtttcaagaattcaaaatctggcaagtgttaaacaatttacaatttcaaaacatagaaagcaaagaaattttccctcttgacctagactgtaaagagtcaatctttaacgaagttaatataaaaggacgaatatctgcaaaagcagtgcttgatgtattaggatatagcggaaaagaatggaaaaccaacttcaaagacatcgaaggaaataattcaaatgaaaacctatataatgcgtatttaaaaataatagctaacgaaggaatagaattcccaaaagaattcaaatgcaacctcgatgacgatatcaatgtatcaaaaataatatgcagtgcaggcaaaataatagaattcgtaagagaaaaattttccgaactaggaattaacacgtccatacttgatttcaatagcgaactagaaggtacaaatttcgaaaaacaaaagtcgtatcaattatggcacctattgtactcttatgacggtgacgactccccatcaggcaaccaaaagctctatgagctactagaaaaaaagtttggatttaaaaaagaacactccatcatattagcagatataggttttccccaagaatacggttcactaagtacgaaagctatgaggaaaataatacctcatttaaaaacaggattaccatttgcaaaaaaaagcgataacgacacaatattatcagcaaccgcaatggctggatacaaccatagcaagagcttaacaacggaagagctaactaaaagagtactaaaagaacatcttgaaatactacccaagaactctctaagaaacccagtcgtcgaaaaaatattaaaccaaatgataaacgttgttaatgaagtaataaaagaatatggaaaaccagacgaaatcagaattgagctagcaagagaattaaaaaaaaacgcagaagaaagggcaaacatgacatctgaaataggaaaggcaactatacaacatcaaaaatatagtgaaattctccagaaggaattcggaataaaatcaccttcacgtaacgatataataaggtacaaattatacctagaactaagcaacaatggcttcaaggatctatatacagacattcaaattaaaagagaagaactatttacagacaaatacgacatcgaccatataataccacaaagtcgtttctttgacgatagctttagcaataaggtactagtaccaagaggcgcaaacctaaagaaaggtaatttgacggcttttgactatctagaatctgagggtaaggataccttggagaagttcatcaatacaattacagaattctatgataaaggcataataactaaagcaaaatatgaaaaactgcaaaaaaaaggcacagaaataggagatggatttatagaaagagacctgagggacacccaatatatagctaagaaagccaaggaaattttattcggcataacaaacagcgtagtaagcacctcgggaagaatcacagataaactccgagaagactggaatctagtaaataccatgaaagaaatgaacttagaaaaatatcggaaacgaggactaacagaaacagttatcaactcaaaaggagaagaaaaagaaaaaataatagactggagcaaaaggaacgatcaccgacatcatgccatggacgcactaacggtagcatttacaacacacaaccacatccaatatctgaactacttgaacgcacggaaaaacgaagaccataaacaacataaagtgattagtaatattgaaaacttaatcacaaaggtattcgaaaaaaaaaacgggtcaaaacaaaggagattccttgagcccatacataacttccgaatagacgccaaaaaacacttagaagaaatattaatatctcacaaagctaaaaataaagtagtaactaaaaatataaacaaaattaaaaaaaaaggatcaatcatagcaaaaattgagttaacaccaagagggcaactacataaagaaaccatatacggaagtagcaaatatttgaaaacaaaggacgaaaaactctctggaaaattcgacttagaaaccattaacaaagtacaaaatgaaagatacaaaaatgcactactcgaacgacttaaagtgttcggatacgacagcaagaaagccttcacgggtaaaaacatcctcgcaaaaaatcccatcttcctaaatatagaaaaaacagagcaactccctgaagtccttacactagcctggtacgagacaatctacaccataagaaagtctataaacagcgacaattttaaagactataaaaacatagacaaagtaacagataaaaaggtacataacatactgactgatcgactacgggaattcaatggaaatagcaaggaagctttctctgatctagaaaaaaaccctatatggttaaataaaccaaaaggtattgctatcaaaacagtaaccattactggagtaaacaacgtggaagcactacattataagaaagaccatttcggtaaagaattcctagatgaaaagggacacaagatcccagttgattttgtgagcacaggaaacaaccaccacgtggcgatatacgaagacaccgcagggaatctacaggaaagagttttatcattctacgaagctgtcgaacgcgtcaatcagggactctctgtgatcgacaaagaatacaatagtagtttaggctggaaatttctttttacaatgaagcagaacgaaatgttcttatttcacagcgaagatttcaatccccaagagatagacctatacgacgaaaaaaacctgcgattaatttcaaaaaacctatttagagtacagaaattcacagtaaaagactactttttccgccatcacctagaaactaatgtagaggacaattcaaaacttaagggagacacttggaaaagagaaggcttaaatggaataagaggaatactaaaagttagactaaatcatctaggcaaaatagttcaggtaggtgaatattga

SEQ ID NO: 9102 - RNA, 4215 nt, synthetic construct
  misc_feature 1..4215: note = Cas9 variant
  source 1..4215: mol_type = other RNA
atgtcaaagaaaatactagggcttgacctcggaactacctcgataggatgggcattcgtaagagaagctgaagattttcaagaagaatcctcaattgaaagaataggagtcagagttaacccacttacaacagacgaacaaataaatttcgaaaaaggaaaacccataagcgtaaacgctgaccgcacacttaaaaggggagcacgtagaaatctacagaggtataaacaaagaagaacgaacttaatacaattattaaaacagtacaaaataataaatgaaaacacaattcttgcagaagacgataaaaacacaacgcattcaacatatgcactaagggcaaaagcagtaagcgagaaaatatcaaaagaggctttcgcacgagttttactaatgatcaacaagaaaagaggttataaatcaagccgtaaagccaaaaatgaagatgaaggacaagctatcgatggtatgtccgtagcgaaaagattatacgaagaagacattacgccaggacaactttgcctacaactgctaaaagaaggcaaaaagaaattaccagacttctacctttcagacctacaagctgaattggagaaaatctggaattttcagaagaaattttatccagaaatactaacagacgaatttaagaaagaaatagaaggaaaaggacaaagagcaacaagtgccagtttttgggccaaatacaaatttaatactgccgaaaacaaaggaagtagagacgagaagaaaatgcaagcatgggaatggcgaagtaaagcaattaatacacaacttacacgggaagaagtagcttatgtcataacagaaattaacaacaacataaataacagttcaggttacttaggagccataagtgatagaagcaaagaattatattttaataaagaaacagtaggcgaatatcttttcagacaacttcgttactcaccacatactagagttaaaaaccaggtattctacagacaggattatcttgacgagttcgaaacaatatgggaaaaccagtctcgataccacaatgaactcactaacgagttgaaatctgaaatacgagacgttgtgatattctaccaaagaaaactcaaatcacaaaaaggcctcatatcattttgtgagttcgaatccaaacaaatcgaaatccaaaaagatggcaaaatagtcaagaaaataattggtctgaaagtatctcccaaatcatctcccctattccaggaatttaaaatctggcaaatcctacagaacctggaatttacaaacaaagagacaaaagagaaaaaggttccagattttgaagctaaaaatcttttattcgaagaattaaatattaaaggcaatttaaaaggagaaaaagccatcgaaattctaggatataaaccaaaagaatggctagttaactacaaagaattagatgggaatagaactaaccaagtattatatgaagggtatttaaaaatactagaagttgaaggatacgacataaaagacctcttaaaaataaaaagcaacaaagacgaagtaaatctatcagaattatccaaaccagtaagtgaaatcaaagacctgataaaaagtatattcgaatccttgaatatcaacaccgccatattagatttcaaccctgaattagaaggaaaagactttgagaggcaagcaagttaccaattgtggcacctcttatattcatatgagggagacaatagtaatacaggaaatgatgaactatatcgtctactctaccaaaaatttggatttggtaaagaacacgcacaaatattggctaacctaagttttagccaagattacggtagtctaagtgcaaaagcaatgagaaaaatatatccctttattaaagaaaactcatatagtgaagcatgttccctcgcaggatacaatcactcatcctcaataactaaagaagaaaacgacaaaagagaattaaaggaaaaacttgaactgttacccaaaaatagtctcagaaaccccgtagtagagaaaatattaaatcaaatggtaaacgttatcaatgcaataatagcagacccatcaatgggacgaccagatgaaataaggatagagctagcaagagaactcaagaaaaatgccgcagaaagagcagaaatgacgatccatataaataaagctaaaagcgaacatgataactatagaaaaattttaacaacagagttcggtataccaaacccaactcgaaatgacataatcagatataaattgtacgaggaactaaaagttaacggttacaaaacactatacagtaatacgtatataccacgagaaaaactattttcaaaagaatttgatgtagaacatataatacctaaagccttattatttgacgactcattttccaacaaaaccatctgcgcgagacaagaaaatctagacaaaggtaacaaaaccgcctttgacttcattcaatcattctacggaaaagaaaaattcgaagaatacctacaaaggattgagtcattagccaaaatcaaagaaggggatacgttcgtaatatcaaaagctaaatacaagaaattactcctcccagaaatagagataggagaaggattcatcgaaagagatttacgaaactcacagtatatcgctaagaaagctaaatcaatgttacttgatatatgtaaaactgtcgtccccacaacaggctctattaccgacagattacgagaagattggggactaattaacataatgcaagagctaaatttcgaaaaatataagaaactcgggctaatagaaatggtcgagaagaaagacggatccttcaaagaaagaatcaccgactggacaaaacgcaatgaccatcgacaccacgcaatggatgctctcacagtagcttttacaaaacacaatcatatacaatatctaaattatttaaatgctaggaaaaatgaaaatcataaaatgcacggcaacgtcatagccatagaacaaaaagaaaccgaattattagtcgatagcgtgggcaaacgaaaacggaaatttaaattaccgatatcaaactttcgtgaagtagcaaaaatgcatcttgaaaatattctagtcagttacaaagctaaaaacaaagtagccaccaaaaacaaaaacagattcaagaccaaaaacggagaaaaagtcaaaattgaactaactccccgtggtcaattacacaaagagacagtatacggaaaaatgaagaaatacgaaacaaaagaagaaataatcggatctaaatttgacgaagctacaatcctaaaagtagcaaatttagaacaacgcaacgcactactacagaggcttaaagaaaacaataacgaccctaagaaagcgtttagcggcaaaaacagcttaaaaagcaacccactctattatggagtagactcaaaaccaataccagaaagaatcaaaatagtatggctagaagacgactatactattagaaaagaaatcacacccgacctaaaaatagacaaggtaatagatattggaatacgcagaatactcgaaaatagattagcagaatttaacggcaacgcaaaagaagcattctccaacttagagaaaaaccccatatggctcaatgaaggaaaaaggatcgcgatcaaaagagtaacaatatcaggggtaaagaacgcagagacactacactacaagaaggaccatcttggacatgaaatgttagataaacaaggaaaaagaatacccgtagatttcgtatcaactggaaataaccatcacgttgcaatatataaagatgacaaatcagatctacaagaaaaagtagtatcattctacgaggcagtcgaaagaataaatcaagaattaccgatcatagataaatcatttaatcacgacctaggctggcaatttttattcaccatgaagcaaaacgaatatttcgtcttccctcgtgacgggtttgacccttatgaaatagatctactaaatcccgataactacaaaataatatcaccgaatctatttcgagtgcagaaaatagcgaccaaaaactatgtatttaaccaccacttggaaacaaaagctgtagacggagaactactaaagaccaagaaagacttatcggacataacctaccgattcatacaaacaccagtcaacctcaaaaatatcataaaggtacgaataaatcacatcggacaaatcgtaaaaataggagagtactga

SEQ ID NO: 9103 - RNA, 4218 nt, synthetic construct
  misc_feature 1..4218: note = Cas9 variant
  source 1..4218: mol_type = other RNA
atgaaaacgattcttggattagacttaggaacaaactcaataggttgggctttagtaaaagaagcagaaaactctaatgaaaaatccgaaataataaaactaggtgttagagtcaatccactcacagtagacgaaaaaaccaattttgaagccggaagacctttgtctaccaatgccgataggaccgcaaaaaggagcgcaagacggaatttacaaagatataaactaaggcgcaaaaatctaatagatttattgattaaaaaccaacttatcgacaaagatactccacttactgaaataggcaaaaacacaactcaccaaacactggaactaagagcaaaagcagcaagagaaagaattgaattagaagatttagcgagggtgtttcttgcaataaacaagaaaagagggtatcgaagctctagaaaagtaaataatgaagaagaaggccaagccgtggacggtatggcagtagctaaaaaactatacgacgaaaatctgacacctggacagtacgcatatgaattattaagtaaaggaaaaaagtatgtaccagacttttacagatccgatcttcaagctgaatttaacgcaatttgggagtaccaaaaacaattctacgctgatattttggacgacgaactatacaatgcacttaaaggccaaggtcaacaaaactcgaggaaaagattccttgcaataaaaggagtatataccgcagaaaacaaaggaaaacgcgacgacgtaaagctaagacactacaaatggagaagcgaagcaatcagtaaaaaaatcaacatcgaagaggttgcatatgtattagtcgaaatcaacaacgaccttaataaaagttcggggtatttaggcgctatatcagacagaagtaaagaattatactttaataaagaaaccgtaggagagaacctatggaaacagatccaaaaaaacccacacacatccctaaagaatcaagtattttaccgccaagattacctagacgagttcgaacaaatatgggaaacccaggctcagtttcatccacaactgacgctagcgctaaaggaacaaataagagatgtcataattttttaccaaagaaaactaaaaagtcaaaaaggcctattatcattttgtcaattcgaatcatgggaaatcgaaagaaaagatgaaaatggtaacgtgattctaaataaaaccacgcaactgccaaaaagacaaacagtaggacgaagagtcgcacccaaaagttcacccttattccaagaatttaaaatctggcagaatataaataacttagaagtaacaaaaatatctgaaggcgcaagcaagaacaaaaaggaaacagaaaccctgtcagatgacgaacgtaaattactatttgaagaattaaacttgagaggtaacttgtcccaaaaagaagtactacagattctaggactcaaagacaaagaatacaaaactaacttctcggaaggtcttgaaggaaacagaacaaatgcagctctgttcaacatatatcaacaaatagcagaaaacgaaggttacggttttgactggtccaaaaaatccgcacaagaaataaaagaagaattaaaagccgtgtttccacaaataggaatccaagccgatatacttgacttcaatgcaaatctagatggaaaagaattcgagaatcaagccagctatcaattatggcacctactttattcggcagaggaagacgataaaatcaacgaagaagaccaaataatatacggaaactccgccgtatcactgaaaaaaaagctgtgtgagaaattcggatttacacccgaatacgctaaatggattgccaatgtcagcttacaagatgactatggaaaccttagtactaaagcgatgagaaagattataccatacctaatagacggaaacgactattcagaggcctgtgctttagcaggctacaatcattcaaactcactaacaaaagaagaaaacgataacagagaactacttgacaaactagaattattacccaaaaattcactacgaaacccagtagtagaaaaaatattaaaccaaatggtcaacgtcgttaaccaagtaatagaaacctatggtaagcccgacgaagtgagaatagagcttgctcgcgaattaaaaaaaagcgccgaaaaacgtgcagaaatgacaaaaagtataaatgaagcaactagacgcaacgaagacatcaaaaaattaatcacgaaagatttcggtatacctaaccccactaaatcagacgtagtacgatatcgactatgggaggaactagccccgcttgcctataaagacgtattcacaggtaaacaaataaaaaaagaagacctcttctcatcaaaaatagatatcgagcatataataccaaaagctctattattcgacgatagctttagtaataaaacgttagtgttcagagaaacgaatctaaaaaaagcagaccgaacagcatacgattttatagaatcagactacaatgcaactctagatgactacatccaaagagtagaaacactatacaacaacacaaaaggaactatcagtaaaggaaaacgaaacaaattgctaatggctcaaaaaaatctcccggacggatttatagaacgagaccttcgtaactcacaatacatcgcaaagaaagctaaagcaatgctataccaagtattcaaagatgtcaatgtaaccagtggttctataacagaccgccttagggaagactgggatttaatcaacgtaatgaaagagctcaacttccccaagtataaagctttagggctaacagaaatagaagaaagatatgacatcggtcaagaaaaaacaaaacgtgtagaagtcatcaccgattggacaaaaagaaatgatcacagacatcacgcaatgaacgcactaaccgttgcatttacgaccagtagccacattcaatacttaaactaccttaacgcccgcaaaaacgaaagccacaaagaacacaagaatataaaaggaatcgaaaataaaataactcataaacaaaaagacaaaaggaaattcataccaccgatgccgaatttcagagaagaagctaaaaaacatatcgaaactatattagtgtcaataaagaacaaaaacaaggtctacacaaaaaatataaataaaactaaaaaaaaatcaggtcacaataccaaagaacaattaacaccacgaggacaactccacaaagaaacagtatacggaaaatcaaaaagaccaatgtcaaagcctacaaaaataaacaaaaatttctctctagaacaagctcagctcataattaacgtacaagaaaaggaattagtattaagacacctcgctcaatttgataacaacccagccgttgcatttgatacaaaaacactaaaaaagatgccattactgaaaaacggtgaaccactaaaggaagtactctgctttgaagaaattttcacaataaggaaagatataacacctgatttaaagatagagaaagtagtggacgaaaaaataaaggctatcttagaacagcgcaaaaaagacttcggaggaaatgcaaaagaagctttttcagacctggacaaaaacccaatatggctaaacaaaaaaaaagggatttgcataaaaagggtaacgataaccggagtctccaatgcagaagcactacaccaccaaaaagatcaccttggcagggaaattctagacgacaacggtaatccaataccagcagatttcgtatcaactggtaacaatcatcacctggcagtctatctcgactctgagggtaaactccaagataatatagtctcattctatgaagcagtggtccgtacttcgcaaggtttaccagtcgtagataaaggacttaacaaagacctgggctggaaattccttttctcgttaaaacaaaatgagatgttcgtctttcctaatgatgatttcgacatcaatgatttcgatttattagatgacaaaaaagcagagttaatctcaaaacatttgtatcgcgtccaaaaaatatcaaaagtatcagctggaaactcatttgtccgggacatagtctttagacaccatctagaaacaacagtcaaagaagtaaaggaattaaaagatatatcctatatacaacttaaaagcctagaaggactaagaaatataaaaaaagtaagaatcaatcacataggcaaaatcgtccaagtgggagaatactga

SEQ ID NO: 9104 - RNA, 4221 nt, synthetic construct
  misc_feature 1..4221: note = Cas9 variant
  source 1..4221: mol_type = other RNA
atggaaaagaaaataataggcattgacttaggggtaacctctataggatgggcatacgtaatagaagacgaaaacggacactcaagaatattacgtatcggtactagagtcaacccactaacaacagaagaactcaaaaacttcgaacaagggaaaccgataacagaaactgcagaaagaacactcaaaagatcaatgaggagaaacctacaaagatataaacaacgaagaactaacctcataaacgtccttctcaaaaacaaactaataacagaaactacagcactagcagaagacggaaaagggacaacacatctaactcatgcattaagagcaaaagcagcatacgcgcagattccattagaagactttgcaagagtcctgttaatgcttaacaagaaaaggggttatagatcttccagaaaagtaaaaacagaagcggatggtcaagcaatagacggcatggcagttgcaaagaaattgtatgaagaaaacattacaccgggacaactctgctacacattactgttacaaggaaagaaaacgctaccagacttttatcggtcagacttacaagtagaaatggaaaaagtatggacttttcaaaaacaattccatcaagcaatcctaacggatgaatttagaaaatatattgcaggcaaaggacaacgagccacagctgcctcgttttggggaaaatatggtttcaatacagccgaatttaaaggatcaagagaagagaagaaactcaaatcatatgaatggcgcagtcaagctataactacacccctatcacaagaagaagtggcagctgtgatcacagacatcaattcgaatattgcaaattcaagcggatatcttggagcaatatcagatagatcaaaagaattgttcttcaataaacaaacagtcggacaataccaatataatctcttacaacaaaatccacataccaacctaagtgggcaagtgttctataggcaagactacttagacgagttcgaaacaatatgggaaacacaagcaacattccacacaatgctaacaccatctctcaaagaagaaatacgtgacatagtaatattctatcaacgaaaactaaaatcacagaaaaagctagtcagcatatgtgagttcgagaaaagaatcttggaaccactacagggtgataaagtagtaggttataaagtagcaccgaaaagcagtccattattccaagaatttaaaatatggcaagccctaggaagaatggaaattcaacataaagttacaaaagaacgacacttcctggacctagacgctaaacagctactattcgacgaactaaacgtaaaaggagacctcacaaaagaaaacgcactaacaatactcggttttaaaccaaaagaatgggaatgcaacctattaaaattagaaggaaatcgaaccaatcaggccctctatgaagcatatcttaaaatacttgaacttgaaggttacgaagtgaaagacctattaggcctaaaactagataaagatgatataaaactatcagaactcccagttgatgcagcagatatcaagaaaatggtaagagaaattttcgagactcttaacataaaaacctctttattggattttaacgcgacattaccgggcaaatccttcgaacaacaacacgcataccagctatggcatttgttatattcatatgaaggagataacagcccatccggcaataagaaacttcaagacctactccaggcaaaatttggatttacaaacgcacacggacaaatccttgcaaatgtcagcctagaaacagactacggatctctgtcagctaaagcaatacgaaaaattttcacacatattaaagaaaatcactactcggcagcatgcgcgttggcaggctacaatcattcatcatatctaagcaaagaagaaaatgaacaaaggatactaaaagatcgtctaacaatattacccaaaaacagcctcagaaatccagtcgttgagaaaatcctcaatcaactaattaatctactaaatactatattcgacgacccatatctaggaaaaccagacgaaataagaatagaactggctcgcgaactcaagaaaaatgttcaggaaagacaaagattaaatactgagataaccaaaaataacacagaacacgaacgtataactaaaattctaatcaaagaagataatatcaaaaacccaacaagaaatgatataataagatacaaactatatcaggagctcaaacacaatggttataaaacgctatactccaacacctacatacctagagaagaattattcggtaaaaactttgacatagaacatataataccacagtctatactctttgacgatagcttctccaacaaaacactatgtgtaagaaaagaaaacatagacaaagcagatagaaccgcaatggatttcataggaccatacttcggagaggataaagtccaagagtacataaacagagtagaaatgcttcaccaaattaaccttaaaaaccctgaagaagggataggaaaaggaaaatataagaaactactaatgaaagccagcgaaataggacaaggattcatagaaagggatctaagagatacacaatacatagccaagaaagcccgacaaatgctacttgaagtaacacgaacagtagtagctacaacaggatcaatcacaaaaagattaagagaagattggggcctagttaacgttatgcaagaactcaacatggataaatatagacagcaaggactcacagaactgatagagaagaaagatggttcgaccaaagaaaggattacagactggaccaaacgaaacgatcacagacatcatgctatggatgcactaacaattgcgttcacaaaacatagtcacatccaatacctaaataatctcaatgcaagaaaatcagacgacaagaaaggcaaagagattttcggaatagaacaaaaagaaacagaaaaggtgaaagatgacaccggtcagacgcaaagaagatttaagttaccaatgcctgatttccgtcaagcggccaaacatcacttagaacacttactcatttcattcaaagccaaaaacaaagtattcacaaagaataaaaacaaatataagaccaaaaatggagaacaagtgaaactcgaactcacaccgagaggtcaactacataaagagacaatatacggcaggatcaagaaatatgtcacgcatgaggaaaaagtcagctcaaaattcaacgcccaattaatacaaactgtagccaacagtaaatacagatacgccttattaaaacgcttagaagaaaacggaaacgatcccaaaaaggcgttcacaggtaagaactctttagataaaactcccctattcgtagacgctactcaacaagagaaaatcccaccagtagtaaagctagtttcaattgaacaaggatatactatcaggaaagatattacgccagaaaatttcaaagatgcaaaatctattgagaaaattgttgatgttggcatacgaaatctactccatcacagattagaaacttataatggtaacgaaaaagaggctttctacaatctagacaagaaccccatatgggttaacgaaagcaaaggaatatgcatcaaaagagtaactattacaggagtcacaaacgcagagccactacattataaaagagaccaccatgggaaacccattcttgataataacggaaacagaacccctgctgacttcgtttcaacaggcaataaccatcatgcagccatttatcgagacgctgcagggaatttacaggataacgtagtatcattctatgaagctgtagcacgagtcaaccaaggattaccaataattgacaaatcattaaataaagaactagggtggcagttcttattcagcctaaaacaaaatgaatgtttcgtcttcccaaatgaagggttcgatccattagaaatagacctctataatccagccaacaacaaattaatagccgcaaacttattcagagtccagaacttttcaagactccaatacggcaacaatattattagagactacaattttagacatatatatgaaacgagcgtggaaaatcgcaaagaactcaaagacatagcatataaacaagtaaaatcactaccaatattcgagaagatcataaaagtaagaataaaccatataggacaaattgtaaaaacgggcgaatattga

SEQ ID NO: 9105 - RNA, 4224 nt, synthetic construct
  misc_feature 1..4224: note = Cas9 variant
  source 1..4224: mol_type = other RNA
atgatcaggaatattttaggactagatctcggagtatcaagtattggatgggcatatgtacaagaagattccaaaaactcagaaaacaatagaataattaaacttggagttcgcgtgaaccctttgactgtagatgaacaactaaactttgaaaaaggtaaaccaattacaacaaacgctgggaggacattagcacgaagtgcaagaaggaacttacaacggtttaaactgcgacgatcaaatctaatggatgtactcaagaaaaataacatactcaaagaaacagatttacttgcagaagtaggcaaaaactctacatttcagacacaagaattacgcgccaaaagcgcaaaagagaaaatagaactttcagaatttgcgagggtccttctattaataaacaagaaaagaggatataaatcaagcagaaaagccaaaaatgacgaagacggacaaatagttgacggaatggcagtagctaagaaactcttcgaagaaaatctaacaccaggagaatacagctaccaactacttcagcaaggaaagaaacaattaccagatttctatcgatcagacctccaagcagaatttgacaaaatctgggactttcaaaaacaatttaaccccgaaattttcactaacgaattatacgaaaaactacaaggcaaaaatagaaacgccacgtggaaagaacttgaatttccatttagcctagttggaattaaacaaacaggaacaatgcaagaaaagaaagtagagaaatacttctggagaagcgaggcagtaaagaaacaattagatttcgagagcttagcagtcgtgttccaagaaattaattccaatttaaataactcttccggttacttaggtgccataagtgacagaagcaaagaactatatttttacaaccaaactgtaggagaatacctattccaacaactcaaaaccaatccgcataccaaattgaaaaaccaagtcttctatcgacaagattacctagatgagttcgagaaaatatgggaaacacaatcaaaatatcacaaagaattaacaaaagaacttaaagaagaaataagagacataactattttctaccaaagaaaactcaaatcacagaaaggtctaatctcaatatgcgagttcgaaaacagagaaatagaaataacggaaaacggaaaaactaaaaagaaaacagttggactaaaagtagctccaaaaagttctcctttatttcaagaatttaaaatttggcaagtcctcaataaccttcaatttcaaaacatagaaacaaaagaagtattcccaatagatttagattttaaacaaagtatattcgatgaagtaaatataaaaggcaaactatcggcaaaagatgtactagacctcgtgggctattctggaaaagaatggaaaaccaactttaaagaaatcgagggaaactacaccaacgaaaatttatacacagcctttttaaaaatcatagcatcaaaagaaatagaatttccaaaagagttcaaaataacaatagacgatgaaataaaagtctcgaaaattaacgcatcggcagaaatcattaaactgttcgtccgagaaaaatttagtgaattaggtatagatacatccatactcgattttaacccggaacttgaaggttcagatttcgaaaaacaagcaagctatcagctctggcacctactatattcttacgaaggagatgactcttcctccggcaacgaaaaattatacgaactcttagaaaacaaattcggattcaagaaagaaaatagtaaaattttagccgaaataggattctcacaggattatggaagtctatcgagcaaagcgatgcgtaaaatctatccatacattaaagaacataaatactcagtagcctgctcgtacgcgggatataatcatagcaaaaattctcttacaaaagaacaactcgaaaaccgcatattaaaagaaagacttgacatactccccaaaaactcgttaagaaatcctgtcgtcgagaaaatactaaaccaaatgattaacttagtaaattgcctcatcgatgaatacagcgaaaaagacaaagacggtcaaatcgtcaaatactttaaattcgatgaaataagaatagaattggccagagaactcaaattaaatgcggaagaaagagctaccatgacctcggaaattaataaagccacgatacaacatcaaaaatatgctgaagttttacaaagagagttcggactaaaagcaccaagtagaaatgatatcattcgctataaactataccttgaacttgcaaacaacggattcaaagatctttacacagatgcaaaaattgaacgtgaaaatctatttacagacaaatacgacattgaccacataataccccaatccagatttttcgacgatagctttagcaataaagtattagtaccacgcaacgctaacctaaagaaaggaaatttcacagcgttcgactatctcgaaatagaaggaaaggaaaaacttgaaaaattcctcaacataataaaagacctatatgacaagggtgcaattactaaagcaaaatatgaaaaactacaaaagaaggatttcgaaataggcgatggattcatcgaaagagatctaagaaatacgcaatacatagccaagaaaagcaaagaaatattatttggaatcacgaactctgtggtaacaacatccggacgaataacggataaactcagagaagactggaacctcattaacacaatgaaagagcttaacttagagaaatatcgaaaactaggtttaacagaaacagtaattaactctaaaggcgaagaaaaacaaaggataatagattggaccaaaagaaacgaccatagacaccacgccatggatgcattaactgtagcattcacaacacacaatcacatacagtacctcaactacttaaatgcccgtaaagacgaaaaacataaagagcatcagaacatatttgctatagaaaacctcataactgagattattgacaaaaagaatggatccaaggagcgaagattcaaagaaccagtcaaaaatttaagggcagaggctagaaaacacctagacgaaattctaatatcacacaaagtaaagaacaaagtagtcaccaaaaatataaataaaatcaagaagaaaggatcagtaatagctaaaaccgaactcactccaaggggtcagctccataaagaaactatttacggatcatctaaattcctcaaaactaaagaagagaaaatatcaggaaaattcgacgtagaaacaatccaaaaagttcaaaacgaaagataccgaaacgccctacttaaacgactgcaagaatttggtggtgactccaagaaagcattcacaggtaaaaacgtgatatccaaaaatccaatattcttaaacaacgagaaaacagaacaactaccagaaacagtcactctggcatggtacgaaatgggctatacaataagaaaagcggtaaaccccgacaattttaaagattttaaaaatatcgagaaaacaattgataaaggaataagagacatactcacaaaaagacttaaagagttcaacggcaactctaaagaagccttctccgatttggataaaaatccaatttggctaaacaaatccaaaggaataagcataaaagcagtaacaataacaggaatcaataatgcagaagcccttcattacaagaaagatcatctaggaaaagattttctagatgaaaatggcaaacgcattgcagtagattttgtctcaacaggaaacaatcatcatgtagcgatctatgaagacgaaaacggaaacctgcaagaaaaagtcgtgtctttttacgaagcagtagaacgagtaaaccaaaatttaccaataatcgacaaagaatataattccgaaagcggatggaaattcctattcacgatgaaacaaaacgaaatgttcctattccctagtgaagactttaaccctaaagaaatggacctcttcgatgagaaaaatgtaaatttaataagtaaaaacttattcagagtacaaaaatttacaatcaaagactacttcttccgacatcacttagaaactaacgtagaagattcttcaccactcaaaggaattacatggaaacgtgagggcttaaatggaatagagaacatcctgaaagtcagactaaaccatctaggaaaaatagttcaaataggtgaatattga

SEQ ID NO: 9106 - RNA, 4227 nt, synthetic construct
  misc_feature 1..4227: note = Cas9 variant
  source 1..4227: mol_type = other RNA
atgacaaaaaacatattaggccttgatgtaggagtttcgtctatcggatgggctttaataaatgaagacatagaaaatccgaaaaataacaaaataatcaaactaggcgtgagagttaaccccctaacagttgacgaacagataaattttgaaaaaggaaaaccaattacgaccaacgcgggaagaacacttgcgagaggggctagacgcaacttacaacgatttaaactaagaagattccatctcattgacatactgcaaaaaaataatatacttaaacaagccgacctattagctgaagtcggaaaaaattcaaccttccaaactcaagaaataagagcaaaaagtgctaaacaaaaagttgaactatccgaattggctagaatatttctcttgatcaacaaaaaacgtggctacaaatctagcagaaaggcaaaaaatgaagacgagggtcaaataatagacggaatgttcatagcaaaaaaactatacgacgagaagctaaccccaggagaatattcatatcaactattaaaagaatccaaaaaacaactgccagatttctatagatccgatttacaatcagaattcgataaaatctggaatttccagaaacaattttaccccgaaaatttctcagacaatctatataaagaattacaaggaaaaaataaaaatgcaacttggaaaacactggaaatcccctttagtctagtgggcattaaacagaccggaaccctacaggaaaagaagttagaaaaatacagctggcgatctgacgcagtcaaaaaacaactagattatgaaaaactcgcagtcgttttccaggaaatcaactcaaatatctacaattcttcaggctatttaggagcaatatcagatagatctaaggaactatactttaataatcaaacagtcggtgaatatctatacaaccaaattaaagaaaaccctcacaccaagctaaaaaatcaggtattctatcgacaagactaccttgacgaattcgaaaagatttgggaaacgcaatccaaatatcacacaacattgactaaagaactaaaagaagagatacgagatataataatattctaccaaagaaaactcaaatcacaaaagggattaataagtatatgcgagtttgagaatagagaaattgaaataaaagagaatggaaaaataaaaaaaaaaacagtaggcctaaaagtagcaccaaaatcatcgcccctatttcaagaatttaagatttggcaaatactaaacaacctccaattccaaaatatagaatcaaaagagatcttcccaatagatctagatttcaaagaaagcatatttaacgaggtaaatataaaaggaagaatatcagctaaagcagtcttagatctactgggctacagcggaaaagaatggaatccaaatttcaaagacatcgaaggaaacaacactaacgaaaacctatataacgcttacttaaagataatagcggatgaagaattcgaattacccaaagaatttaaactaaacggtgatgatgatctctacgtttccaagatagcatgctctgctagtaaaataaaagactttgtaaaagaaaaattttctgaaataggtataaatacatctatattggactttaacccagaactagaaggcaaagattttgaaaaacaagcctcgtaccaattctggcatctactatactcttacgaaggcgatgatagtcaatcaggaaacgaaaaactatacgaacttcttgaaaaaaaattcggattcaaaaaagaacatagcaagatactatccaacataggattcccactggactatggtaacctaagcacaaaagcaatgagaaaaataataccgcacttaaaagcgggcttaagctttgccaaaaaatccaaagaagataacatactatcagcaaccgcgatggctggatacaaccactcgaatagctacacaaaagaggacttagctaaacgcgtactaaaggaaaaactcgaagtcttcccaaaaaactccctgcgtaatccagttgtagaaaaaattctaaaccaaatgatcaacctagtaaatgaagcagtagaggaatacgggaccatagacgaagtaaggatagaactagcacgagaattaaagaaaaacgcagaagaaagagcaaatatgacatcagaaatcgggaaggcaacgctactccaccaaaaatacgctgaaatactaaaaaaagaattcgatatcccagtaccaagcagaaatgacatcataagatataaattatatctggaactagcaaacaacggatacaaggatctatacacagacgttcaaataaaacgagaagaactctttaccaataaatatgacatagaccacatcataccgcaaagcagattctttgatgactccttcagtaataaagtattggtgcctagaggagcaaacctcaaaaaagctaaccaaacagcattcgattacctagagaatgaagacaagcaaaaactggaaaaattcctcaacataattaaaaacctctacgacaagggtgaaataaccaaagcaaaatacgaaaaacttcaaaaaaaaggaagtgatataggggaaggttttatcgaaagagatttaagagacacccaatatatcgcaaaaaaagcaaaggagatccttttcggcataactcatagcgtaataagtacatccggaaaaataacagacaaactaagagaagactggaatttagtaaacacaatgaaggaactaaatcttgacaaatataaaaaactaggcctaacagaaaccttattgaattccaaaggcgaagaaaaagaaagaatcatagattggagtaaaagaaatgatcaccgacaccatgcaatggacgctttaaccgtggcatttaccacccacaaccacatacaatacctcaattacctaaacgcccgaaaagacgaagatcataaacaacacaaagtaatctctaacattgaaaacttaataacaaaagttttcgagaaaaaaaatggtgcaaaacaaagacgcttcatcgaacccataaataacttcagagtcgatgctaagaaacatctagatgaaatactcatatctcacaaagccaaaaacaaggtcgtaaccaaaaatatcaataaaataaaaaaaaaaggatctgtcgtcgcaaaaacagaactaacacccagaggacaactacacaaagagacgatctatggctccagtaaatttctcaaaacaaaagatgagaaaatctcaggaaaatttgacctagaaacaataaacaaagtacagaacgaaaagtacaaaaatgcactacttcaaagattaagagagttcggtgaagattcaaaaaaagcttttacaggaaaaaacgttataagcaaaaaccccatatatttagatgaggaaaaaaccctacaaatccctgaatcagtaaccctggcttggtacgaaatgatctacacgatacgcaagccagtcaatcctgataattttaaagattacaaaaatatagataaagtaacagacgaaaaaatacgtgcagtactcaccgacagattacgaaaattcaatggaaacagcaaagaagcttttagcgatttagaaaaaaatccaatatggctaaataaatcaaaaggcatagcaatcaaaactgtcaccataaccggaatgtcaaatgttgaagcattacactataaaaaagaccacctgggaaaagagattcttgataagaaaggcgatagaatgccagtagacttcgtctcaacaggaaataaccaccacgctgccatctatgaagacgccaaaggaaatttgcaagagagagttgtgtcattttatgaggcagtagaacgagtcaaccaaggactatcagtcgtaaataaagactacaacgcaggtttagggtggaaatttctatttactatgaaacaaaacgaaatgttcctattccccagcgaggactttaacccaaaagaaatagatttatacgacgaaaagaatttaaaattaatagcaaaaaatttattcagagtacaaaaattcggggaactcagcaaatcgggattctggttccggcaccatctagaaacatcagtcgatgtgaaaaaagaattgagaaactattcttacttggatttctactcaaaagacttcatgaaaaccattgttaaagtaagactaaatcatcttggtaaaatcgtccaggtcggcgaatattga

SEQ ID NO: 9107 - RNA, 4230 nt, synthetic construct
  misc_feature 1..4230: note = Cas9 variant
  source 1..4230: mol_type = other RNA
atgtcaataattaacttccaaagacgaggtctaatggaaacacaggcttcaaaccaactaataagctcccaccttaaaggatatccgataaaagactacttcgttggcctagacataggtacctccagcgtcggctgggctgtaacgaacaaggcttatgaactcctcaaattcagaagtcataaaatgtggggaagtcgattgttcgatgagggagaatcagcagtagcacgacgaggatttcgttcaatgagaagaagactagaaagaagaaaactacgcctcaaattacttgaagaactattcgctgacgctatggcgcaagtagatccgactttctttatgagactacgtgaatccaaataccactacgaggacaaaacaacaggtcattcctcaaaacatatattatttatagacaaaaactatacagaccaagactactataaagcatacccaaccatataccacctaagagcagaactcatgaaagatggaacagatgatattagaaaactattccttgctgttcatcacatactaaaatacagaggcaacttcctatacgaaggagctacattcgactccaacgcaagtacattagacgacgtgataaaacaagccttagagaacatcacatttaactgcttcgattgcaactcagccatctcaagcatcggacaaatactcatggaagcgggtaaaactaaaagtgataaagcaaaagcaatcgaacacttagtagacacttacatagctacggatactgtagacacttcctcaaaaacacaaaaagatcaagtcaaagaagataagaaacggctaaaagccttcgcaaatttggtattagggctaaacgcttcactaatagatttatttggcagtgtagaagaattggaagaagacctgaagaaattacaaataacaggagatacatacgatgataaacgcgacgagttagccaaagcatggagtgacgaaatatatataatagatgactgtaaatcagtatacgacgcaatcatattattgtcaatcaaagaaccaggactaactatatcagaatcaaaagttaaagcctttaacaaacataaagacgacctggccatattaaaaagcctgttaaaatcagatcgatctatctacaatacaatgtttaaagtagacgagaagggattacataactacgtacattacataaaacaaggaagaaccgaagaaacaagctgcaatcgtgaagacttctacaaatatacaaagaaagtcgtcgaagggctaccggactcaaaagacaaagaatacatactgtccgaaatagaattacaaacacttttaccattacaaagaataaaagacaacggagtaatcccataccaactacaccttgaagaattaaaagtcatattagcaaaatgtgggcccaaatttcccttcttaaacgaagttgccgacggcttctcagtcgccgaaaaattaataaaaatgctggaatttaggataccatactatgtgggtccattaaatacgcaccataatgtagataacgggggcttcgcgtgggctgttaggaaagccagcggcagagttacaccttggaatttcgatgacaaaattgacagggaaaagagtgcagccgcattcatcaaaaatcttaccaataaatgcacatatttgttaggtgaagacgtactaccgaagtcgagtcttctatactcggagttcatgctactcaatgaactaaataatgtacgtatagacggaaaaccactcgagaaagcagtcaaagaacacttaatagaagcggtgtttaaacaagaccacaagaaaatgactaaaaacagaatagaacaatttttaaaagataacaactacatacctgaaaaacacaaacctgaaataacaggcctagacggagaaatcaaaaatgatctcgcatcatatagagatatggttcgaatactaggtaataatttcgatcttagtatggcagaagaaattatcacagacataacaatcttcggagagtcaaagaaaatgcttagagaaaccctaagaaacaaattctcatcaagattagacgatgaggccatcaagaaattatctaaactacgatatagagattggggtcgcttgtccagaaaattactaaacgtaatagaaggctgtgacaaagcaggagatggtacccccgaaactataataatactaatgcgaaattttagctacaatttaatggaactccttggagacaaatttagttttatggagagaatacaagaaataaacgccaaattaatagaaggtcaaatagttaatccacatgacatcattgacgatttagcattatctccagccgtaaaacgagcagtttggcaggctttaagaatagtagacgaaattgtacacataaagaaaacactaccagccagaatatttgtcgaagttacaagaagcaataaagcggaaaagaaaaagaaagacagcagacaaaaacgcctaagtgatctttatgcagcaataaagaaagatgatgcactactaagtgggttaacaaacgaagagtttggagggctaaaatcagggcttgcaaaatatgatgacgccgcattacgttcaaagaaactatacctatattacacgcaaatgggcagatgtgcttacacgggagaagtcatagacctaagtcaactaaatacagataattacgatattgaccacatatacccaagatctttaaccaaagacgactccttcgataaccttgtattgtgcaaaagaacagctaacgcccaaaaatcagacacatatccaattagtaaagaaatccaaaaagcccaaaaagcattctggatatttcttaaacaacaaggactaatatcagaacgtaaatacgaaaggctaacacgaataacaccactaactgctgacgatcttagtggatttattgccagacaactggtcgaaaccaatcaaagtgtcaaagcagcaacaaccctactaagaagattatacccaggagtagatgtagtatttgtaaaagcagaaaacgtcacagattttagacacgataatgattttataaaagtaagatcattaaatcaccatcatcacgccaaagacgcatacttaaatatagtggtaggtaacgtttaccacgagcgatttacccgaaactttagagcattctttaagaaaaatggagctaatcgaacatataacttagcaaaaatgtttaattacgacgtaaattgcacaaatgcgaaagacgggaaagcatgggacgtcaaaacatcaatggacacagtcaagaaaatgatggcctcaaatgacgtccgtgttactaaacgactcctagagcaaagcggcgctctcgccgatgcaacagtatataaagccgccgtagccgaaaaagctaaagatggcgcatatataggtatgaaaacaaaatcatccgtgttcgcggatgttagcaaatatggtggaatgacaaaaatcaaaaacgcctacagcataatcgttcaatacgctggaaagaaaggcgaagtagtcaaagaaattgtgcccctaccaatttacttgaccaatagaaatactacagatcaagatcttatagactatgtagccagcataataccacaagctaaagacatttcaataatctacagaaaactatgcataaaccaattagtgaaagtgaatggtttttactattatctaggtggtaaaacaaactcaaaattttgcattgacaacgcaatccaagtaatcgtttcaaatgaatggataccatatctcaaagttctagagaaatttaacaacatgcgaaaagataacaaagacctcaaagctaacgtaatttccactagagcattagataacaaacacacaatcgaggtcagaatagtagaagagaaaaacatagagttctttgattacttagtttcaaaacttaaaatgccaatctaccagaaaatgaaaggcaataaagcagcggaactaagcgaaaaaggatatggactctttaagaaaatgtcattagaagaacaatcaatacatctaatagaattacttaatctactaactaatcagaaaacaacttttgaagttaaaccactcggaataaccgcaagcaggagcacagtaggctcgaaaataagtaaccaagatgaatttaaagtaattaatgaatcaatcacaggattatacagtaacgaagtaaccatcgtgtga

SEQ ID NO: 9108 - RNA, 4233 nt, synthetic construct
  misc_feature 1..4233: note = Cas9 variant
  source 1..4233: mol_type = other RNA
atgaccaaaaacatactgggccttgacctaggggtctcctccataggttgggcacttgtccaagaaaatagtaaaaaccctgaaaataacaaaatcgtcaaactaggtgtacgtgtgaatcctctaacagtagatgaacaaattaactttgaaaaaggaaaacctattacaacaaacgcatcaagaacactagctcgcagtgccagaagaaatctacaaagatttaaactaaggagagctaatttaatcgatgttttaaagaaagggaatatactcaaacagggagatctactaacagaaataggcaaaaactcaacattccaaacgcaagaactgagagcaaaatcagcaaaagaaaaagtagaactatcggactttgtaagaatattattactaataaacaagaaacgagggtacaaaagcagcaggaaagccaaaaacgaagacgaagggcaaatcatagatggaatggcggttgctaagaaactatatgaagaaaacatcactcctggagaatacagctataaactcttacaagaaggacgaaaacaactcccagatttttaccgaagcgaccttcaagccgaatttgataaaatttggaactttcaaaaacaatttaacccagaaattttcacaaacgaactctacaaaagattacaaggcaaaaaccgaaacgctacatggaaagaattagagatacccttttatctcgtaggaatcaaacaaatcggtaccatgcaagagaagaaaatagaaaggtacttctggaggtcagaagctgtaaagaaacaacttgattttgaaagtctagcagtggtgttccaagaaataaactcaaacttaaacaactcttcaggatatctaggggcaatcagcgaccgatctaaagaactatactttaataaccaaactgtaggagaatacctatacaatcaactcaaaattaacccacatacaaaactgaaaaatcaagtattttacagacaagattacctagatgaatttgagaaaatatgggaaacacaagcaaaatatcataagaaattaaccaaagaattaaaagaagaaataagagacatagtaatattttaccaaagaaaattgaaaagtcaaaaaggactgatatcattctgcgagttcgaaaatagggaaatagaaatcacggtaaatggtaaaaccaaaaagaaaactgtaggtcttaaagtagttccacgaagctctccactttttcaggagttcaaaatctggcaaaggctcaatgatctcgaatttaaaaacgtagagacaaaagaaatttttccgctagagctcgaacataaagaaatattattcggaaacttaaatataaaaggaaatctcagcagcaaagaattaatagaacaattaggatatccgagtaaggaatggaaatgtaattttaaagaaattgacggcaacaaaacccacgaaaatctatacactgccttcctaaaaataatagctaatgaaggaattgaatttccaaaagagttcaaattatcaatagacgacgacattaaagtaagtaaaatagatgtcagcagcgagaaaataaaagagttcataaaagaaaatttcttaaagctgggaataaatacatccattttagacttcaatccagaacttgatggtaaagactttgaaaagcaagaatcctaccagctctggcatcttttatatagttacgaaggagacgactccgcatcaggaaatgaaaagttatacgaactcttagagaagaaattcggatttaaaagagaatactcaaaaattttagctgacgtaggatttagccaagactatgggtcattaagtagcaaagcaatgaggaaaatatttacatacataaaagaaaacaaatacagtgaagcatgtcacttagccggatacaatcacagcaaaaatagccttactaaagaacagctagcaaacagaatattaaaagaacaactagaaatcttacctaaaaatgcactaagaaaccccgtagttgaaaagatactaaatcaaatgataaacttagtaaacgaagtgataaaagaatatggaaaacccgatgaaataagaatagaattagcgagagaattaaagaaaaatgctgaagaaagagcgaacatgacatcagatattagtaaagcaacactactgcatcaaaaatatgcagaggtactacaaaaagagttcggaataaaagcaccttctcgtaacgacattataaggtacaaattatatttagaattagcaaacaacggatacaaagacttatatacaaatcagaaaatagaaaaagaaaatatattcacggataaatatgacatcgaccacattataccgcaaagtagattctttgatgactcattttcgaataaagtgctagtaccaagatgcgccaatcaagataaagacaactacaccgcagtggattatatcgaaaagaagtatggagagcgaggtaaagaagactttttaaacagaatacacctagtatttaaatcaaaagaggctatagcaggcaagtcagaatcccaaataagcagcatgaatacaaaattcctgaaactacaaaagaaaggatccgagataggcgaaggattcattgaaagagaccttagagatacacaatacatagctaagaaagcaaaagaaatactatttggaattacaaattcagtcatatcaacatcaggtagaatcacagataaattaagagaagactggaatttggtaaacaccatgaaagagctaaaccttgaaaaataccggaaactaggcttgacagaattaatagcaaattctaaaggagaagaaaaagagagaataatagactggaccaaaagaaacgatcatagacaccacgcgatggacgctctcacggtagcattcacgacccataaccatatacaatatctcaactacttaaacgcaagaaaggatgaaaagcataaagaacatcataacatatttgccattgagaacatcataacagaaatagtcgaaaagaaaaatggctcaaaagaacgacgatttaaattaccaatcaaaaacttccgaaccgaagcgaagaaacaattggaagaagtactaatttcacataaagccaaaaacaaagtggtcaccaaaaatatcaataaaacaaagaagaaagggggtgtagtatcaaaaattgtgttaacaccaagagggcagctacataaggaaacgatatatggttccgctaaattcttaaaaacaaaagaagaaaagatatcaggaaaattcgatctcgaaaccataaacaaagtacaaaatgaaaaattcaaaaacgcactactagacagactcaaagaatttaatggagattccaaaaaggcattcactgggaaaaatgtaccagctaaaaatccaatatatctcaatgaacagaaaacagaacaagtacccgaaagtgtagtactcgcatggtatgaaaccggatacaccattcgtaaagcagtaaacgcagacaacttcaaagattacaaaaatctagagaaaattatagataaaggagtcaaggaaatccttaaaaaccgtctcaatgcttttaacgggaatgctaaagaagcatttagcgacttagaaaagaaaccaatctggttaaaccaatcaaagggtatagcagtaaaaaccgtaacaattacggggatcaacaatgccgaaacactacactacaagaaagatcactttggaaacgaactactagatgaaaacggaaagaaaattccggttgatttcgtcagtacaggaaacaaccatcacgttgcaatctatgaagatgctgatggtaacctccaagagagagtagtatcattctatgaagcagtagaaagagtcaaccaaggattaagtataatagataaagaatataaccaagacttaggctggaaatttctatttactatgaaacaaaatgaaatgtttctattcccttcagaggactttaaccctaaagaaacagacctcttcgacgagaaaaacttaaacctaattagcaaaaacatgttcagagtccaaaaattcggatcacttcttagtggtttctggtttagacaccacctagagaccacagtcgatctcaactcaagtctcaaagataccagttacaaagtaattcaaagctgtaacaacttaaaactaatagtaaaagtccgactaaatcacctcggaaaaatcgtccagataggagagtattga

SEQ ID NO: 9109 - RNA, 4236 nt, synthetic construct
  misc_feature 1..4236: note = Cas9 variant
  source 1..4236: mol_type = other RNA
atggtaaagaaagaatatttcataggattagatatgggtacgagtagcgtcggatgggcagtcgcagatacaaattataatctactaagagccaaaggaaaagatatgtggggagttagactctttccagaagcaagtaccgctgcggatagacggtcgcaccgaacagcgagaagaaacaacaaaagaaaagcagctcgggaaggattcttaagagaaattttcgaagatgaaataaacaaaatagatcctggcttcttcgaaagactaaaagaaagtaaatactacttggaagataaattaacagatacaccatttgtccttttcgcagacaaaggctacacagacaaagaatactacgatgaatacccaacggtattccatctgattaaagaactaatttccgaaaaaggcttagaaccacatgatataagactggtctacctggcttgtctaaacatttataaacacagaggccacttcttgaatgatacattatcaggcgacgggatagataatataaactccttatgtaatgattttacctcctatttagccgactataatcaaaactcagaagatgatggaactgagaaaatggacttggatagcacagtgcttgcaggagtttttgaagaaacattatgtaacaaacatcttagcaacagtgccaagaaacgagacttaatagacaaactaggaattacaaacaaaacgaaatatttaacagaaatgatggctctcatcagtggattggcatcaagcgtgtcgaacatgtttgctaaagacacctatgacgaagaacagaagaaatttaaactatcattcagatcaagcaatttagacgaagatatggtaaaagtacaggcaatgctaactccagaagaatacgaaatgatctgtattatgaagaaaatacacgattggtcagtagtatcagtcataatggggagccacaaatacataagcgatgcacgtgtagaactctatgaaaaacataaacaagatctagctaaactaaaagctatatacaaagaatacctaccagacaaatatgacgcaatgtttcgagaaatgacagacaactcttatagtgcatacgtaggtaaagtaagttcaaacaagaaaagtcaaactggtaaccataaagtaagaatgcaaagaagaggtgcaaaatgcaaacaagaagacttttatgatcgaatcaagaaagaaataaatagtgttccacaagaagagaaaattgacatactacaagacatggaaactaactcctttctacctaaacaattaacaaatgaaaacggagtaataccttatcaactccatttagccgaactgaagaaaattctcgataacgcttccacatatctaccctttttaaactcagcagatgaaacaggtataagtaataaagacaaaattatacaattgttcgaatttagaatcccatattacgtaggccccttattcaaatcagagaaaaataaaactaatgcctgggttgtacgaaaagaaagtgggaaagtgtacccgtggaacttcaacgagaaaatagacgaaaaacaaagcgcagaaatatttatagaaagaatggttagacattgcacctacttaaataacgaaagtgcattacccaaaaacagcttaaaatatgaacgatttagggtactcaatgaactaaataatctgagaataaacggggaacgtatatcacctgaacttaaacaacgaatctacaacgaattattcaaagtgaaaaagaaacgaataaccaaatctatgctttgtgaatatttatacaaaaacggaatcgcagacaaagactcagaacttagtggattcgacggcacattcgcaaatgcactactaagttatggtaaatttagagaattattcaacgtagataccttgaccgacaaacaagaagccgcagccgaagacataataaaatggtcgacagtatatggcgatagtaagaaattcctacaagagaaaatagaagagaactacggaccagaaagcgaaaaccctctcttagacaacaaacaaatcaaaagagtaatgggatataaatttacagactggggaaacctgtcgcgagaatttctaaacttagaaggagcggataaagacaatgatactacaacaggcgaagtcatgccattaataacgcgaatgtgggaagaaaactataacctaatggaactaatgtctaacaaattcagctaccgagacgctctcgcagagaaaacagaagaaatagagaaaaccctaactgacatagaatacgaagacttggaagacctatatatatcggcacccgtaaaaaggatgacatggcaaaccctacttatactaaaagaaatataccaaataatgggatatgcaccaaagaaaatattcgtcgagatggccagggaggaagaggagaaagtaaatggcaaaggagcccgtaaaagctcaaggaagaaaagactagaagatttatacagaaactgcaaagatgcctcaaaagaactctcgacaggaatcaaaaacgcagacgaagcaatactccgaagaaagaaattatacctatattatttacaaaaaggaaaatgcatgtacagcggtaaaacaatagactttaaaagcctcttcacgaataactacgacatagaccatatatacccgcaatcagtagtaaaagacgattccttagaaaataacatggttcttgtggaacgcaactacaataataagaaaagcgacacttttccaatattcagcgattggcaaaataaaatgaaaccattctggacaatgctaaaagaacaaggatttataaatgaggaaaaatacaaaagacttacaaggacagacgaattaactgatgatgaattagcaaacttcgtaaatcgtcaactcgtcgagacaaggcaagccactaaagtcatagcggaactcctcaaaaatagctttgatgatatagactcaaaaatagtatacgctaaagccgggaatgtaagcgagttcagacataaattttcaatgaaatacgataaagaaacagaaaaatcaagtgttatccacccagaactggttaaatgtagaataataaatgacttccaccacgcaaatgattcgtatttaaacatcgtagtaggaaacatttatgatgtaaaatttacacaaaacccatacaattacattaaagaatataagaaacagaaaaataatagcgctctaagtgagcaagaaaaggagaaataccacatggacaaaatcttcaattttgatgtaaaaagaaacggtgaagtggcatggatatccagaggggataataaaaccctagaaacggtattaaaagtgatgagaaagaacacccccatagtgacacgaatgaactttgaagaacacggacagttagccgatttaacaatttattcagcgtccgatgcactatctaagaaaggagtaggatatataaaagtaaaagcatcggacgctagactggatgttctaaaatatggaggatacaaaaagtataaaggagcatacttctttttagttgagcataccgaaaagaacaagcgagtacgaacaatagaaaatatgcccttatatctgaaaaacgaacttaacactaaagagaaaatcgaattatggtgcgctgataaagaaaatggactaggccttgtagacccggacgtcagactaggaaaaataaaactctactcaaaaattcgaattgatggtttcgacttatatcttacgggaagaaccggaaataatttactcacgtcaaacgctgtccaactcaaaatagggtcaaataaaccgagtgataacgacaaactattttggagatattacataaataaattgagcaagtacacagaaaactccgaatttgtcagtattcaaaataacattaaattatatgatctatttgtagaaataaataatgctggagtatatagtaaaagacaaaatccaattggggacaaactcctagaaggaagaagtaaattcataaacctaaccctctccaagcaagtagaaacactcctcggaataatacgaatatattcactagaaaatcaaggagcagatttatcaaacattggaggacaagagaaaaacggtacaatgaaacctcataaaagaatcagcgacaagaaagaagttctactcataaatcaatcagttaccggactatatgaatcaaaaatagacctactaaaaatctga

SEQ ID NO: 9110 - RNA, 4236 nt, synthetic construct
  misc_feature 1..4236: note = Cas9 variant
  source 1..4236: mol_type = other RNA
atgaaaaatatcttaggcttagacctcggaacaaactctataggatgggcattaatcaaacaaaatgcagaagaaagacaaggaagtattctaggtatgggtacaagagttctaccaatgagccaagacgtcttaggagactttggaaagggaaacagtgtatcacaaacggccgcacgaacgggttatcgtggtattcgaagactcagagaacgcttcttactacgaagagaaagattgcatcgagtattaaatatcttaggattcctcccatattactacgcagcccaaatagattttgataaacgatttggcaagtttaaggcagaaacggaaccaaaattgccatacaacaacgaaggatttatctttaaaaattcttttgaagaaatgctatcagatttcaaaatatcccagccagaactactatcgggaaataagaaagtcccatatgactggacgatctactaccttcgtaagaaagctgtgagtcagaaaatagagaaagaagaactggcttggatacttttaaatttcaaccagaaaagaggctactatcaattaagaggagaagacttcgacgaagaaaaagacaaaacattcgtaacattaaatgtcgacaaagtaattgacagcggggaaaaagtaaaaggcaatattctatttgatatatactttacaaacggatggaagtacgagaagcaaacaacaaaaccagaagattggctaggcagatcaaaagaatttataattacagaatcactattgaaaaacggagaagtaagaagaacgtttaaagccgtggactcagaaaaggattggatcgctattaaagccaaaacagaacaagaaatcgagacggctcataaaactgttggaagttatatatacgatgcaatcctacaaaaccctaaacagaaaatcaaaggaaagctagtacgaacaatcgaaagaaaattctacaaagaagaactacgtaaaatcttagaaaaacaaaaagattttcatttagaattacaaaacgaggacctatacagcgattgtgtaagagaattatatagaaacaatgacacccatcaattgagcttagcaaagaaatcttttatccacctatttcttgaagacataatattttatcaaagacctctaaaaagccagaaaagtagtgtttcaaactgtacccttgagtgcagaaaatacagagataaaaacggagcggaggggattcaatttttaaaagtcataccaaaatcaaacccatactatcaagaatttcgtatatggcaatggatgagtaaccttaaaatatatcgacgagacgatgatgtaaatataacaagtgaatgtctcaaaacggccgaagattatgaagatctcttcgtatttttaaatataagaaaagaagtagatcaaaaagcatgtctacgacactttaaactatctgagaaaactcacagatggaactatgtcgaagataaaaagtatccatgtaatgaaacaggaacaatgataagtgaaagacttaagaaagtaggagacagccctgataacatctttacgagggaaatggaacaacaaatctggcatataatatatagcgtaaatgacaaaacagaatatgaaaaagcattaaaatcattcgccaagaaaaatgaactagacaacgacagcttcttcgaagcctttaggaaattcccgccattcgatagtgaatatggaagtttttctgaaaaagcaattaagaaattattacccttaatgcgaataggaaaacattggaattgggaagcggtagacgagaaaattaaaaatcggattcagaaaattataatcggagaatacgacgaaaacatcaaagataatattagagagaaaacactaagcctgcaaaaagaaagtgactttcaaggactacctctctggctagcacaatatgtagtttatggaagacactccgaagcgtcagtagcaggaaaatggaacagcgttgacgatattgaagaatatcttaaagagttcaaacaacattcactcagaaatccaatcgtggaacaagtaataatggaaacagtaagagtagtcaaagatatttggattaaatatggcaacggagccgcagactttttcgatgaaatacatatagaactcggacgagaaatgaaactcccagcgaaagaaagaaacaagatgacacaaaagataagcgaaaacgaaaacacaaatctacgaattaaggcattactggcagaaatgatgaatgactcagaagtacaaaacgttcgaccatacagcccaatgcaacaagaaatattaaaaatttacgaagatggagctttaaatagtgaaatatcagtagacgatgatatactgaaaatatcaaaaacagcacaacctagtccatcagatctcaagaaatataaattatggctggaacaaaaatacaggtctccctacacaggagatataatacctcttaataaactatttacaacagaatatgaaatagaacatattataccccaatcacggtattttgacgacagctttagcaacaaagtgatatgcgagagcttagtaaaccgtctgaaagacaactacataggcttaggatttatcaaacaatttcatggatataaaatatcggataaaacaaaagtttttgaagtggaagaatatgaagattttgtcaagaaaaactacgctaataataggtctaaacgtagtaaactcttactagaagaaatcccagaagaaatgatcgaacgccaactaaatgatacaagatacatatcaaaatacattagcggaatcttgtccaatatagtaaggaagaaagaaaatgacgaaggagtaaactctaaagacattatccctgggaatggcaaaataacgtcacaacttaaacaagactggggactaaatgacgtatggaatgacttaatcttaccacgattcgaaagaatgaacgagttaaccaaatcaagctacttcacagtctggaatgaaaaataccaaaaatttttgccaacagtcccggtagagttctctaaaggcttcagcaagaaacgaatagaccatagacaccacgcattagacgccctcgtaatagcttgtgccacaaaagaccacgtgaaccttctcaacaataaatcagctaaaagcgaaatgaaaagatatgacctcaaacgaaaacttatgaaatttgaaaagaaaacatatcaacactcgcagactggagaacgaatagtcaaagatgtgcctgtagagtttctaaaaccgtggaatgactttaccgtcgaagcaaaagaaaatctagagaaaataatagtatcattcaagcaaaacctaagagttatcaacaaagcaaccaaccattatgaaaaatggatagaaaaggacaatgtaaaagttaaaggactggtagaacaacaaggactaaattgggcaatcagaaaaccattgcataaagacaccgtatcaggaaaagtagacttacccggaataaaggtccccaagggaaaaatattaacggcaacgagaaaatcaattgacacttcttttgacctaaagacaatcaactccattactgacacaggagtacagaaaatattaaagaattacctagaatataagggcaattcatcagaagaagcctttagttcagagggaatagaagatatgaataacaatatagaaaaattcaacgaaggaaaactgcaccaaccaataacgaaagtaagaatatttgaactaggaagcaaatttccactaggacaaataggtaataagaaacacaaatacgtagaaacagcaaaaggtacaaatctattcttcgccatatatgaagatgataaagggaaaagaacatacgaaacgataccactgaatgaagtaatagagcgacaaaaacaaggcttagcccctgtaacgctgaaatccaaaaatgacttttacttatgcccaaacgacctagtctatgttgcagccgaaggtgaatcagtaaacaaaatcgactttaaatacgcttcccaagagttcatccacaacatatacaaggttgtatcattttccggatcgcaaatatttttcgtaaaacaaaacattgccgtttcgatagttaataaagctgaattttcaactttaaataaaatggaaagagcggtagatggaaaaatgataaaagactgctgtattaaactaaaaatagacagaataggaaacataaccaaaagctga

SEQ ID NO: 9111 - RNA, 4239 nt, synthetic construct
  misc_feature 1..4239: note = Cas9 variant
  source 1..4239: mol_type = other RNA
atgatgacgaagaacattttaggactagatcttggaacaaacagcataggatgggcattaataaaacaaaatgctgaagaacgcaagggaagcatactaggcatggggacgagagtactaccaatgtcacaagatgcactaggggacttcggaaaaggcaattcagtatcacaaacggcagcgagaacaggttatagaggtgtcaggaggctccgtgaacgattcctactacgtagagaacgtcttcaccgagtactaaacattcttggatttctacctgactactacgctgcccaaatagatttcgataaacgattcggcaaatttaaagcagaaaccgaacctaaactgccgtacaataatgagggttttatctttaaaaacagctttgaagaaatgctaagtgactttaagatatcccaaccagaattactctcagaaaacaagaaaataccatacgactggactatttactacttacgaaaaaaagcagtaagtcaaagaatagaaaaggaggagctagtatggatattactaaatttcaaccaaaaaagaggctattaccaattaaggggagaagacttcgatgaagagaaagacaaaacgtttgttactttgaacgtagacaaagtcatcgattcaggtgaaaaagtaaaaggaatagtattattcgacgtatattttactaatggatggaaatacgaaaaacagataacaaagccagaagactggctaggcagatcaaaagaattcataatcactgaaagtttattaaaaaacggggaagtgaagaggacatttaaagccgtagatagtgaaaaagattggattgcaataaaagccaaaacggaacaggaaatagagatagctcataaaacagtaggatcatacatatacgatgctatattacaaaatccaaaacagaaaatcaaaggaaaacttatacgtacaatcgagagaaaattctataaggaagaactccgcaaaatactagaaaaacagaaagaattccatcccgaactacagaatgaagacctatactccgattgcgtcagagaattatatcgaaataatgacgcacatcaactttcccttgcaaaaaaggattttattcatttattcgtggaagacattatattctaccagcgcccactgaaaagccaaaaatcatccgtcagcaattgcacactcgaatgccgaaaatataaagataaaaatggcgaagaaagaatacagtttcttaaagttataccaaaatccaacccatactatcaagaattccgaatctggcaatggatgtcgaatttaaaaatttacagaagagatgatgatgtaaatatcacctcagaatatctaaaaacgacagaagactatcaagacctattcgtgtttctaaatactagaaaagaagtagatcaaaaagcatgcttaaagcactttaaattaaacgaaaaaacccatagatggaattacgtcgaggataagagatatccttgcaatgaaaccggaacaatgatattagaaagattcaagaaagttggcgacagcgcagataacatcttcaccagagagatggaacaacagatgtggcacataatctattcggtcaacgacaagacagaatatgaaaaagctttaaaatcattcgctaaaaaaaatgacctagataatgtatcattctttgaagcgtttagaaaatttcccccttttgactcagaatacgggtctttttcagaaaaggcaattaaaaaactcctacctttaattagaacgggaaaatattggaactgggaagcagtagacgaaaaaacaaaaaaacgaatacaaaagatgataaccggggaatgggacgaagacataaaagataacatacgagaaaaaaccctatctttacagaaagaatcagattttcaaggactaccactctggctagcacagtatgcggtctatggaagacatagtgaagcatccgtagcaggaaaatggaattcggtaaatgacatggaagaatacctcaaagaattcaaacaacactcactccgaaatcctatagtagagcaagttattacagagacaataagagtagtcaaggacatatggataaaatacggaaacggagcagctgatttctttaatgaaatacacatagaactaggtagagaaatgaaattacccgcgaaagaacgaagcaaaatgacacaaaaaataagcgaaaacgagaacacaaatttaagaataaaggcattactagtagaaatgatgaacgacagtgaagtacacaatgtaaggccctattccccaatgcaacaagaaatattaaagatctacgaagatggtgcactaaattccgaaatatctgtcgacgacgacatattaaaaatcagcaaaacagcacaaccttcacccagcgaccttaaaaagtataaattatggctggaacaaaagtatcgcagcccatacacaggagacataattcctctaaataaactatttacaacagaatacgagattgagcacatcataccgcaatccagatactttgacgactcgttttcgaacaaagtcatatgcgaatcatccgtcaatcgactaaaagataattacataggtctagggtttataaagcaattccatggctataaaattagtgataaaacaaaagttttcgaagtagaagaatacgaagactttgtcaagaaaaactacgcaagcaattggagtaaaagaagcaaactactactcgaggaaataccagaagaaatgatagagagacaattaaacgatactagatatatatcaaagtacatcagcggaatactcagtaatatagtcaggaaaaaagaaaatgacgacggagtcaattcaaaagatataataccaggcaacggaaaaattacaagccagttaaaacaagactggggtttaaatgatgtatggaatgatctagtactaccaagatttgaaagaatgaacgaactaaccaaaagcaacgactttacagtatggaacgaaaagtaccaaaaatttttaccaacagtaccagtggaattctcaaaaggattttcaaaaaagagaatagaccataggcaccatgctctagacgcactcgtaattgcttgcgccactcgggaccatgtgaatttgttaaataatcaatccgcaaggtccgaaatgaaacgatatgatttgaaaaggaaattaatgaaattcgaaaaaaaagcctatcaacactcacaaaccggggaaagaatagtcaaagacgtaccagtcgaattcttaaaaccctgggacaatttcatcgtagaagcgaaagaaaatctagatagaataatcgtatcatttaagcaaaacctaagagtaattaacaaagcaacaaaccactatgagaaatggatagaaaagaataacgtcaaagtaaaagccctagtagaacaacaaggtctcaattgggccatacgtaaaccgttacacaaagatacagtctcaggcaaagtagacctacctggaacaaaagtacctaagggaaaaatacttacagctacgagaaaaagtattgacacaagcttcgatatgaaaaccataaacagtataacagataccgggattcaaaaaatactgaaaaactatctagaatacaaaggtagttacgaagatgctttcagcccggaaggtatagaggatatgaataaaaacatcgaaaaatttaatgatggcaaacaacatcaaccaatcataaaggttagaatatttgaactaggttctaaatttccactagggcaaataggcaacaaaaaacacaaatacgtagaaacagcgaaaggcacaaacctattcttcgctatatacgaagatgacaaaggaaaaagaacatacgagacaatccctctaaatgaagtaatagaaagacaaaaacaaggactcgccccagtaaccttcaaatctaaaaatgacttctatcttagcccaaacgacctcgtgtatgtagcagcagaaggagaatccgttgataaccttgactttcaatcagacagtcaagaatatataaacaacgtatacaaggtcgtgtcattcagtggctctcaaatcttcttcgtaaaacaaaacgtagcggtttcaatcgtaaataaagcggaatttagcacgctaaacaaaatggaaagagcaatcgacggaagaatgatcaaggaatgttgcgtaaaattgaaaatcgatcgaatcggaaatatgactaaaagttga

SEQ ID NO: 9112 - RNA, 4245 nt, synthetic construct
  misc_feature 1..4245: note = Cas9 variant
  source 1..4245: mol_type = other RNA
atgaagaaaatcttaggtttagaccttggcactaactcaatcggatgggcatttgtagaagaagcagaaaatgaatcagaaaaatcctccattataaaactaggggttagagtaaatccattaacagtggatgaacagcaaaacttcgagaaagggaaatctataacgacgaacgcagaccgaacgctcaaaagaagtatgagacgcaatttacaaagatacaaacaacgacgagagaatttaatcgacatactcatgaaaaatggattcacatctgatgatacaatcctatcggaaaacggtaaccgtacaacattcgaaacgtaccgcttaaggagcaaagcagttgcagaaaagatatctctacaagagtttgccagagtactgctaatgataaataagaaaagaggctacaaatcttcaagaaaagcaaaagggaccgaggatggagaattaatagatggaatggaagtggcaaagaaactatacaattataacctaacacccggacaactctgcctacaattattaaatgagggaaagaaacacttaccggatttttatagaagcgatctacaagcagagttcgacaggatattcgacatccaaatgactttttacactgaatatctaacattagaactgaaagaagaattacgaggcaagaaacgcgatgcagtttgggctatttgcgcaaaaatatttaaagaaaaaggattcgagctgatcggtacaaaaagacaaggttccacagcagaacaaaaacatgaaaactactcttggagagcaaaaggattatctgaaaaattagaacttgaacagttagtcgttgtattacaacaaataaacatacaactaaattcttcctccggatacctaggcgcaattagcgatcgaagcaaagaactatttttcaataaacagaccgtaggccaataccaaatggctgtcttagataaaaatcccaatgcaggattacgaaacatggttttctataggcaagactacttagacgagttcaatgcaatatgggaaaaacaagctctatttcatcctatcctaacagatacactcaaagacgaaataagagacgtaataattttctatcaaagacgcctaaaaagtcaaaaaggactaattagcttctgtgaactagagtcaagaaaaatagaggtagaaatagcaggacaaaataaaacgaaaatggtcggaagtagagtaataccaagatcttctccgctatttcaagagttcaaaatatggcaatcattaaataatatagaagtattcggcaaaggcaagaaatctaagaaacaaaaagaacaaacgctatttgaccaaaccgaagaccctctagaatttggaggtcgtcgcgaattatatgaagaagaaaaagaattactggccttagaactaagcataaagaaagaattaaagaaagcagatatactgaaacttctatttgataacccgaaagaattagaccttaacttcaatgcagtacaaggaaatttaactcaagcaacactatttaacgtatacaagaaaataatagaactatcaggacacgaaatagacgtcgaaaaagattcagcaagtaaaatattaaaatcaatagaagaaatcttcaaagccttaaactataacacagaaatcctacacttcgatagcgaaaaatcgcaggaccaacaggcaatgtatatgctatggcacctactttattcattcgaaggcgacaatagcaatacgggcaacgaaaatctcataaacaaaatttcaaaattatacgggtttgaaaaagaatacgctaaaatactagcaaacgtatcctttcaagacgattatggaagtctgtcagccaaagcaataagcaaaatcctcccatatcttaaagaaggccacaaaagcgacatagcatgcgatctagctggttacaaacattcagcgtcctcactcacgagggaagaattagaaaataaaacatataaagacagactagaaatattacctaaaaacacactaagaaacccagtagttgagaaaatactaaatcaaatgataaacgtaataaacttaattatagacagcagagaactaaagaaatccgcaaaagaacgtgaggaactcaccaaatccatatcagagaccacaaaacttcatcaacaatacaaagatatattagccaaagcaccattcaacctgactaacacatcacgaaatgacataataagatacaaactatacgaagaactaaaagataacggatataaaacactctattcaaataaatacatatcgccagccgctttattttccggtgatttcgatatcgaacatatcatacctcaaagtcgactatttgacgattcctttagcaacaaaacactagaactccgctccattaacatagaaaaagggaacaaaactgcctacgactttataaaaggaaaatacggagaaacaggagaagataattgcctagacaaatacttaaatagaatagaaactctatacaaaaacggaatactaaagaaatcaaaatacaataaattaaaaatgcaggataaagatattcctgatggctttatagaaagagatattagagacacacaatatattgccaaatacgctaaaactctacttggtgacctagtcaaattcgtcgtaagcacatcgggtagcgtaacagaaagactcagagaggactggcagctagttgatgtaatgaaagaattgaactgggaaaaatacatgcaactcggtttaacagaagagtttacaaatgaggaaggacatcgcattcgcaaaataaaagactggaccaaaaggaatgatcatcgacaccatgctatggatgcattaacagtagctttcactaaaaggcaatttatacaatatttaaacaacctaaacgcaagaaggatatcagacgaacaaggaatttccaatagtgagaaagacgaaagaaacaacgtatcaataaccactaatgatatgaaattgaacactcgcgatgtgttaggcattgaaaagaaagaactctatagagacaacagaggaaaactacgattcaaagcaccaatgccactactcgaatttagagaggaagcaaaaagacacctagaaaataccttaatatcaatcaaagccaaaaacaaagttacaaccataaacataaatacactaaagaaagcaggaggagtatacaagaaaacccaactaaccccaagaggacaactacataatgaaactatctacggaagtcaaaaacaatatattgtcaaagaagaaacgattaacgcaaaattcgatgtggagaaaatagcaaccgttaccaatccagtttacagggaagcactcctaaaaaggctcgaacaaaacaataacgatcccaagaaagcctttacaggaagcaacgcactcaccaagaaacccatgtggtttgacgaacaacaaactgaaaaagtcccagaaaaagttaaaactgttagtttcgaaactatatacacgatcagaaaagaaatcagccccgatctaaaaatagaaaaagtagtagatgagaaagtaagacaaatccttaacaacagactaaatgaatataatggaaacgcaaaacaggcgttctcaaaccttgacgaaaacccaatatggttaaataaagaaaaaggaataacaataaaaagagtaacaataactgggataaataacgcacaagcacttcatgaaaaactcgataaggacggaaaaccaattttagacggtgaaggtaagaaacaaccagtagactttgtaaacacaggaaacaatcatcatgtggcagtctattgcgatgcagacggaaaccttcaagaaaacgtaatttcgttttatgaagcagttacccgacgaaatctaggcctaccaataatcgacaaagattataagaaagacgatggttggcaatttttatttagtatgaagcagaatgaatacttcgtatttccaaacgaatcgacagggttcaatccaaatgaagtggatctgctcaaccctgataattattcattaatcagcccaaatctattcagagtacaaaagttcacaataaaagattatttctttcgccaccatttagaaacgaatgttgaatcaaactccaccctgaaaggcataacatggttaagatgcggactaaacaatatagataacataataaaagtcagaattaaccatatcggacaaataattcatgttggagaatattga

SEQ ID NO: 9113 - RNA, 4248 nt, synthetic construct
  misc_feature 1..4248: note = Cas9 variant
  source 1..4248: mol_type = other RNA
atggctaaattcaataaaccttactctataggtctagatataggtgtttcatcagtaggctatgccgttataactgaggactacagggtaccagcatttagattcaaagtattaggcaatactgagaaagagaaaatcaagaaaaatctgataggctcaaccactttcgtacccgcacaatccgcccaagtaaccagggtatttcgagtaaaccgaagaaggatagacagaagaaatcatagaattgcatacctaagagacatctttcaaaaagaaatagaaaaagtagacaaaaatttctatcgaagattagacgaatcctttcgagtactaggagacaaaagcgaagatttacaaataaaacaacctttcttcggagacaaagaactagaaactgcataccataagaaatacccaacaatatatcatcttagaaaacatctagcagatgcagacaaaaacagcccagttgcagacataagagaagtttacatggcgctttcccatattcttaaatatagagggcactttctcacactagacaaaattaatcctaacaatattaatatgcaaaactcctggattaatttcattgaatcatgccaagaagtgttcgacctagaagtatcagaagaatctaaaacaatcgccgcaattttcaaatcatcagaaaacagacaagaaaaagtcaaacaaatactaagttacttccaacaagagcttctaaagaaagacaaatcaatattcaaacaactacttcagctattattcggactcaaaacaaaattcaaagattgtttcgaactggaagaagaacctgacttaaatttctcgaaagagaactatgacgaaaacctagaaaacctactaggcacattagaagaagacttcagtgacgtttttgcaaaactaaaaatattaagagacacaatcctactcagtgatatgttaacctatacaggtgccactcacgcacgtttctccgcgactatggtagagagatacgaagaacatcgtaaagatttacaaagattcaaatcctttgtcaaacaaaacttatcagaacaagattatttagacatatttggccgaaaaacccccaatggatttgacgtagacaaagaaacaaaaggatacgtcggttatatatctaacaaaatggtattaacaaataaacagaaaacaatacaacaaaacttctatgactacatttctggaaaaatcactgggattgaaggcgccgaatactttctcaacaaaatctcagatggaacatttttaagaaagctacgaaccactgacaacggagctatacctaaccaaatacacgcctatgaattagaaaagataattgaaagacaagggcgagattacccattccttttagaaaacaaagacaaactattatccatactaacctttaaaattccctattacgttggtccattagctaaaggaaacaatagccgatttgcatggataaaacgagcaacatcccaagacattctagatgacaacgacgaagatacaagaaatggaaaaatcagaccatggaactaccacaaacttatcaacatggataagacacgagatgcttttataacaaacttaataggaaatgatatcattttactaaacgaaaaagtccttccaaaaagatcactcatctatgaagaagttatgttgcaaaacgaattaacaagggtgaaatacaaggacaaatatggaaaaacgcacttcttcgactctgaacttcgccaagaaataattaacaatttattcaaaacaaactcaaaaagagtgtcttccgccatgttactaaattacctagaaaactataccaacttgcaagccgtagaaatcgtatctgggatcgaaaaaggtaagtcattaaattcaacactaaaaacatacaatgatctgaaaacaatcttctcagaagaactcttagactccgaaatataccagaaagaactagaagaaatagtgaaggtcataacagtatttgatgacaagaaaagcattaaaaattatctaacgaaatattttggacgactcgagttcctaaacgaagaacgaataaaccaacttagcaaactaagatatacaggatggggacgttatagcgctaaactactactcgatataagagacgaagatactggattcaatctaatgcaattcttgagaaatgatgatgaaaatcgtaatctaagccaattaatatcagacagcaccctttcattcgattcagcaattaaatcaatccaaagcaaaagcacggtcgaagatgacgtttttgacgaaataaagaaattggctggatccccagcaataaaacgtgggattctcaattcgattaaaatagtcgacgaattagtacaaataataggatacccacctcaaaacattgtaatcgaaatggcacgagaaaatatgactacagaagaaggtcaaaagaaagcaaaaacaagaaaaactaaattagaatctgcacttaaaaatattgaaaattcagtattagagaacggaaaagtaccacactcagatgaacaattgcaaagtgagaaactatacttatattatttacaaaatggtaaagatatgtacagcttagacaaaactgggtcacccactcccctatatcgagatcgacttgaccaatacgaagttgaccatataatcccatatagcttcctcccaatcgattctatagacaacaaagtcttgacgcatagagaaaacaatcaaagaaaacttaacaacatacctgataaagaaacggttgcaaacatgaaaccgttttgggaaaaattatataacgcgaagctcatatcacaaaccaaataccagagactgacaacctcagaacgaaccccagatggagtattaactgaatcaatgaaagcaggatttatagaaagacaattggtggaaacaagacaaattataaaacatgtcgcacgaatactcgataacaggtttctagacacaaagattattacattaaaatcacaactgatcacaaactttaggaatacattccacatagctaaaatacgcgaactcaacgattaccaccatgcacatgacgcttatcttgcggtagtaatcggacaaaccctgttaaaagcctacccgaagttggcgccggaattaatatacggccaccacgcccactttaataggcacgaagaaaataaagcaactataaggaagcacctctatagtaatattatgcgattctttaacaatcccaatagcaaagtttctaaagacatctggaactgcaacagagatctaccaattattaaagacattatttacaattcgcaagttaactttgtaaaacgaacaatgatcaagaaaggcgcattttataaacaaaacataatacccaacgactcttcagttacagtggacaaacgctttcctattaaaaacaagaaatacctagacccaaaactatacgggggctactatgaaagaaacagcgcactatcagtctttataatcggacagagcttcaacaaaaataataaattaaaagttgtaaaagaattttatgatataaacatcattgattatcccctttttaacactgatccaatgtcattcttcaacgacgattcagaaaacggtttccttaccaaaaataaccttcaatctgtacaagcgttctataaaataccaaaatactctctaatacagaaaaacgacggaacacgaatgctattcgaaagcacaacaaactttcataaagcgacacaatttaaactcacagaagcacaaaacgaactcttctttcatatgaaaagactcttaacaaaaacagactttatggacctcaaatcagaagaatcaatcaaagaatcacaagatttcattatgaatcacaaaaatgagttcgacaatatagtaaacggcttatttggctacgcggaacgacaacttgggtccaaatcattatttactcaagcacacgaagcatacaaactaagaaaatatcctgtattttcattaaatgaagaaactataagatattactacgacaactttctacgattattttcactaacaaaatccggcacaagctcaggatatgtagttggattatttgaagctccaaaactaagaaacgtagtctatagagcaacaaaagacgaatcgaatgcgactttaatccatcaatcaatcacaggactatatgagacacgaatagacctatcaaaactcggggaagactga

SEQ ID NO: 9114 - RNA, 4248 nt, synthetic construct
  misc_feature 1..4248: note = Cas9 variant
  source 1..4248: mol_type = other RNA
atgaacttacgcaatgtagcaaaagaagggataaactataacataggattagatttaggaacaggttctgtaggatgggccgtaactgatgaacaaggagaacttttttctttcaaaggaaagacaacctggggtagcagaatattcccgaccgcagaaaccgcagcagatacaagactaaaaagaggacaaagaagaagatacgcgcgaagacgatggcgcttggatttgttacaatccttattcgaggaagaaattaaaaaagtagatccagagttctttacgcgacttaggcaatcccatttacttaaagaggataaaacatatgcagcgattttatcatcaaaaggagcaacacgaccattatttccagaaggagaagcagaagtggaatactataaaaaatacccaaccatatatcatttacgaaaagcgctcatggagtcaaacaatcaagaagatattcgtttgatatatcttgcatttcacaacatagtaaaagcccgcgggaacttcttacaccaagacacgccaggtttaacagcaagcaatgcaaacatgggggatgcagtggaaaaattgtgttcggccctagaagattggtgctcatcacaaaacatagagtgtgctataagaaaaaaccagaaatctatacaagaccttatggaaggaaaaaccatagaaccatcagaaagtaacgcattaaaagaaaccttcgacgcatcacgaagtagcaggaaggataaagcatctgtgctagcaggatggatagcaatccaaccaggtgaacaatttgaaccgaaacaggctaaagacgcttcaaaggaaatagcaaatgcagtctttgggctgagcgccaatatgaaaaaagtcttcgtggaattagaagaagatcaaaaaatttacttaaacaacgacgagcaagttgaagcattttatactgtctgcccagacgagggagtagctctttttgaggcactacaatccatgtactcggcgtatgtcttgatgggtatattaaaaggagctgatgggggaagcatctcgtcatgcaaagtagcagcatatgaacaatacaaagaagatttaaaacttttaaaaacacttgtaagagaatttgctcccaaaaagtacgacgagttcttcagaggagacatatttgatgcgaaaaaaggcttcagaactaggaactatgacccagcaacagccaaaggttatacaaaatataactctgttagaggagcttcttacgatgccttcaagaaagaagttgaaaaactctttgaaggaacagcggccgaagaagatgttaggtatactgatatgatgcaaagatttgatgagggcacgtttcttagaagattaaaaacatctgataacggaagtattccatatcaattgcaccttgaagaaatggtggctataattgaaaatcaaaaaacattttatccgtttttagaagaaaacaaagaaaaatttgaatcattagtaacatttcgaataccctactacgtaggaccattaacacaaaaaaacgctcgcccagataatcatggaaatgcacgatttgcctggtcccaaagaaaagaagggcaagaaaacgctcgtgtatatccttggaactgggaagaagttatagatagaaaacagagtgcagccaaattcatggaaagactaacaggcacatgcacatacatactcgaagaaccggtattgccaagatacagtctattatacgaggaatattgccttttaaatgagctcaacggagcaaggtggagagacatgggaggagattggcatcgttttgattatgagacacgaatggatattatcgaggatttattcaaaaaaaaaaaaggaacagtaaaatatgcaacagtggcggactggctcgtgcgagaaaaacaccgaagttgtgcagaagtaaaaggaggacaaggagaaaccggatttgaaagtaaattatcgagttatgtattttttaaaggagttttacacgtagacgaaattgatgaagcggatataccaatgatagaagagcttatttggtggaatacattatttgaagacaggagtatattaaaagaaagtatagaagacaaatacggtgacagactaaatgacgaacaaattaaagcgatatgcaaaaagagattcacaggatggggtaggctgtcaaaaaaacttttatgcggtattaaagcacaaacagacaatggaccatgtagcattatggatgtactacgagaaggaaatccaaataatgacgctagaagcgcaactatggtctttatggagattattagagatgataaatttggctttaccaaactcattgaggaagagaataagaaaagaatttcgagtgtagacgatttcgatgtaaacgatttacctggatctccagcagtgagacgaacggtaaaccaagctaaaagaatagtagatgagatagttggaatagcaggttgcgcaccacaaaatatatttatcgaagtaacacgagatgaagacgggagaaacaaaggacggagaacaaaaaggagatatgacgcaatacaagaagctgttaaagtattaaaaaaggaacaaaaagaatactttgatgctaacgtagcagacctcttaaaaaatacagcaccagccgcattagacgatgaaaggctggctctctattttatgcaaaatggcaagtgcatgtattgtggaaaagacctggacattaaccaattagacaaatatcaggtggatcacatactaccacaaagttatgttaaagatgactcttttgaaaacaaagcgttagtacactcagatgacaatcaaagaaaatccaacagcatgttattagacgacagtataatccgaaaaatgaagccatactgggaagcactcaggtcagcaggcctaataggagaaaaaaaattcaagaacctaacgcgggtacgtgtatcggataaagaactaggaggatttatagcacgtcaaatggtcgaaacttcacaaagtatgaaactaacatcgttattactagaacaagcatatccagaaacacaagtaagaccagttaaagcaggtttttcctcggacttaagaaggaggctaaagctggtaaaatgccgtgaaataaatgactaccatcatgcacacgacgcatatctagcatgtgaagtaggccaatttattgccctacgccataataaactatacgaaaatccaattggatatagtcatgcagtaaaggattttatagcaaaaagagcaaaatatgcgagtgaacatggcaaacctatggatacatacggaatgccagggtcaagttcattcgtaatatcttctttcatgacatctgggtttgatgaagaaactggagaaatctttaaagacgcatgggacgcttctctagcagcggtcaggatacaccaagcactaaataggaaagattgttatatatctagaatgccagaagaaacatcaggagcattctgggacgcaacaatctattcaccaaaacaaacaaaaaaaaagttatcactaccattaaaaaaagggctggacccgcaaaaatacggaagctatagtagagaacaatttgcatatttctttgtatatgaagcgaagaagattaaaaagaaggaagaaactaaagaatatgtgtttgcttcagtaccagtgcaagtagcagctttagtagctgcagacccgaatgcactaatcgaatttgcaaaagcagatgctgaggaaagaggattaaaatttgccaaaatagtacgagagaaggtgtacaagtatcagctgatagaagtaaacgatgagaggttcttcgtaacaggtctaagaacagtaagaaatggacttcaaattgcttttagcgaacaagatcgcaatattgtatccgggatcgttgaagggaactcatctaacaataacttacttgacatatacgataaaataacaaatagatatgcactatacgcaagtagatttggtaaattactcaacttgagtggctacagagaaaatttcatacaagcatcattggaagatcaggaaagagttgtcttagcattaatttccttgtttaatgctcgtacaaatatgatagatctttcagccataggatcaagcaaaactgtaggtaacatgagcatgacatttgcaaaagaaatggcgatggctgataacaggtttgcattcattgatcagagcgttacaggtatgctagaaagaaagacatacttatga

SEQ ID NO: 9115 - RNA, 4251 nt, synthetic construct
  misc_feature 1..4251: note = Cas9 variant
  source 1..4251: mol_type = other RNA
atgggaagtagaatcatccccatgtcccaagatatacttggggaatttggaaaaggtaactcagtatcccaaacaagtgaaagaacagcttatagatcgacaaggaggttaagagaaagattcttactaagaagagaaagactacacagagtactaaatatactcgacttcctacctacccattacgcaagtcaaatagatttcaagaaacggctaggtaaattcaaagaaaacaaagaaccgaaaatagcatacgataataaatcattcttatttttagatagcttcaacgaaatgctcaaagacttcgaacaagaacaacctaatatgctcataaacgaaaaaggagaaaagaaattaataccatatgattggacactatactatctacgtaaaaaggctttaagagagaaaatttcaaaagaagaactaagttggataatactcaacttcaaccagaaaagaggatattatcaactacgcggtgaagacgaagaagaaaatccaagtaaattagtcgaatttcattctcttacagtagtcgatgtagtgccagatgaaccaataaaaggaaaactcgaaacctggtacagcatcatattagacaacggttgggtataccgcagatcttcaaaaactgaactatatgactggaaagataaaataaaagaatttatagtcactacggacctaaactacgacggaacagtaaaaacagacaaagaaggtaacgtcaaaagatcattcagagcaccaagtgaaaccgactggacacttattaaaaagaaaactgaatatgaaatagaacaatcgagtaaaaccataggagaatacatatacaacactttactaaaataccctgaacagaaaatacggggaaaattaatcagaaccatagaaagaaaatactacaaagaagaattaaaacaaatattactaaaacaaaccgaatttcataacgaactaaaagatgactctttgtattacgactgcctaagagaactatacagaaataatgaatcacatcaactctttcttgagaagaaaaacttcgcacaattatttatagaagacatcatattctatcaacgtcctttaaggtcacagaaaagtttgatttctaattgcccacttgagttctataaattcaaagacagtgtaggaaacgaaaaagtacaacacttaaaagccataccaaaaagcaaccccttttaccaagaatttcgaatatggcaatggattagtaatctctcaatatatagtaaactagacgattctaactttaccagccactttttcgactccactgacgattgggaatcattatttgaaatgttaaatggaagaaaagaaattgagcaaaaacaactcctaaaattcctacttgaaaagaaaggattcaaaggtaaatcattatcatcggaaattgaaaaataccgatggaattacgtagaagataagaaatatccatgtaatgaaacgagatctctaattcaatcacgacttgacaaagttgcaaacttacccgaatcattccttactcggcacgtagaacaagaactctggcacctcatctacagtgtaactgacaaaattgagttcgagaaagccctagacacatttagcaagaaatacaaaatagacacaccaacttttgtagacgcatttaagaaatgtccacctttcaaaagcgagtacggatctttttcagaaaaagctatcaagaaattattaccattgatgagaactggaaaatattgggacctcgataacatagacaaagccacaaaacaacgaatagagaaaattatatcaggagaatatgataaagacattagagatagagtaagagaaaaagcaataaatctcctatctgaaacagactttaacagactacaattatggcttgctcaatacatagtatacgacaggcattcagaagccaccagtcttgataaatgggagacaatcgatgatatagtcacttacttacactcattcaaacaacactcattaagaaacccaattgtcgaacaagtaataacagagactatcagggtagtgaaagacatatggagcaattacggaaatgggtccaaagattactttaacgaaatccacgtagaattgggaagagaaatgaaacttccagctgaggaaagaaaacgtattcaagagaaaaactcacagaacgaggatacaaaccttagaataaaagcgctcctatccgagatgcagaatgatccaaatgtggaaaatgtccgaccatatagtcccgtccaacaggaaatactgaaaatatacgaggagggagtcctcaacagcaacatagagatagctgatgatatattaaaaatctccaaaaccgcccagccatcctcctccgatctaaaaagatacaaactgtggttagaacaaaaataccaatcaccatacacaggagaaatcatacccctaaataaattattcacgccagaatacgaaattgaacatataatcccccaatcacgatattttgacgattcatataataataaagtcatttgtgaatcagcagttaacaaattaaaagataacagcctcgggtacgaatttattaaaggttacaatggacaaatagtcgaatgtggatttggcaagaaagtaaaaatattttccatagatgaatacgaagatttcgttcagaaaaattatgccaataaccgcagcaaagcatcccgactcatgatggctgacatacccgaaaagatgatcgaaagacaactcaacgatacacgctacatatccaaatatatcagtaatattctctccaacatcgtccgttccgaatctaacgatgatggagtaaacagcaaaaacctgatctccgtcaatggaaagattacgacagtactaaagaaagactggggaatgaatgacatatggaatgacttgatcctaccacgtttcatccgaatgaatcagataacagatagcgacagttttacaacatggaacgaacgtttccaaaaatttataccaactgttcctatcgagctatccaaaaactttagtgcaaaacgtattgatcatcgccaccacgcaatggatgcattagtaatagcctgcgctacaagagaccacgtaaacctactgaataacttatacgcaaaatcatctgcccgttacgatctaaatcgaaaactacgcatttttgagaaaaccacgtataaagatataaaaacaggacaaattatagaaagggagataccaaaagcatttctgaaaccctggcaaaattttaccaccgatgcaaaagatgcgatcgaatcaattatagtatcatacaaacagtcactaagggtaataaacaaatcaacaaactactaccaaaagtgggtagaaaaagatggaatagtaaagaaagagaaaattaaacaagaaggcaaaaactgggcaataagaaaacccttacataaagacacagtgtccggattagtacaactaagctgggttaaagtcccaaaaggcaaggttatgaccgcaacaagaaagtccttagactcctccttcgaccttaagacgatagctaccataaccgacacaggcattcagaaaattctaataaaatatctagagtccaaagggaataacccagaatccgccttctccccagaaggcatagaagacttcaacaacaatatacatctatacaacgatggtaaaaagcatcgaccaataacaaaagtgagactatacgaaatcggatcaaaattcccactaggagaaaaaggcaacaaaaatgcaaaatacgtagaagcagcgaaaggtacaaacctattcttcgccgtatacgcaaacaacaaaggcgaaagatctttcgaaacaatacctctaaaccttgttatagacagattaaaactaggactctctgctgtaccagaaacaaacgaaaaaggtgataatcttctatttcacctatcgcctaacgatctagtatatgtgccatcagaagatgagatggaaaaccttaaactcataaatttagaacacatcagtaaagatcaactaaaccgcatatacaaaatggtcagtagtacctcaaatagatgcttctttataaaaagtgaaatagccctatcaatagtaaacaaaatcgaatactctccattaaataaaatggaaaaatcaatagaaggtatcatgataaaagacgtatgcttaaaactgcaggttaaccgcataggaaatctagaaaggtattttagctga

SEQ ID NO: 9116 - RNA, 4257 nt, synthetic construct
  misc_feature 1..4257: note = Cas9 variant
  source 1..4257: mol_type = other RNA
atgaaagtcaaaaacatattaggattagatataggagtaacaagtataggattcgcacacgtaacagaaaatgaaaaagacaataaaagtcacataaaacagttaggagtacgtataaatcccctgaccgtcgacgaacaaacgaacttcgaaaaagggagaccagcttccgtaaatgccgacagaacgctgaaacgaggagcaagaaaaatgttatcaagatataaagatagacgtaaaaacctaattgaaatattatccaaaacaggattcataaactccgaatcgatccttgccgaagacggcaaaaacacgacacactcaacttgggcattaagagctaaagcctccagagaaagaatagaaaaagatgaactcggacgcgtcttgttagccattaacaagaaacgcggctacaaatcatcacgaaaagccaaaaatgaagatgaaggacaagctattgatggaatggctatcgcgaaacgtttatacgaagaaaatttaaccccaggccaattagtatatcaactacttcgagaaggcaagaaatacataccagacttctatcgatccgatttacaagatgaactagacaaagtatggaactttcaaaaacaatttcaccaggaaatactaaccgataccttttacaaagacatacaaggaaaaggccaacgagcaacatcagcaagtttctatggtgtgtacgggttcaacacggcagaaaataaaggatcacgggaagagaaaagactacaagcatacgcatggagatctgatgccctaaccaaacagttaacacgtgaagaagtagccttcgtcataacggaaatcaacaacaaccttaacaattcaagcggatacttgggagcaatatccgacagatcaaaagaattattctttaataagaaaaccgtaggccaatatttatatgaacaactccaacaaaatccccatacaagacttaaaaaccaagtattctatcgacaggactacttagatgaatttgaaacgatatggacaatacaaagcagatattatccagaattaacagacgacttaaaaagagaaatcagagacgttgtcatattttaccaacgtaaattaaaaagtcaaaaaggcctagtatctttctgtgaactagaatcaaaagaaattatgatagagaaaaatggaaaagcggcagtaaagaaaataggaagtaaagtggctcctaaatcgagcccgctattccaagagttcaaaatttggcaggtactccacaatgtagacatcaaaaacaagaaagataaaacaaaacgacccctagatgactctgaaaaagaatacctatttaacgaacttaacattaaaggaaatctaaaagccgctaaagttattcaattattaacgctaaataaaaatgaaacagaactaaattatacacaactcgaaggaaaccgaactcaaaaagcactctacgaagcatatctaaaaatattagacaccgaagggtacgatgtaaataatttacttggcatcaaaagcaacaaagacgaagtgttcttagacgacttagacgtaaatgcattagaaattaaaaccatgatcaaacaaatttttaacgccttaaacatcaacacgggaatactagacttcgacgccgaactggacggaaaagcgtttgaacaacaagcaagctaccacctttggcatctattatattcttatgaagaagatggatcaaaaagtggaaatgaacacctatataaacttctagaaaacaaattcgggtttaaacccgaacatgcacgcatattggcgggaataactctcagcgatgactatggaaacttaagcgcaaaagcaatgagaaaaatatacccacaaataaaagaaaacaatttttccactgcatgcgagttagtaggatatcgtcatagcaaaaatagtctaacaaaggaagaaaatcaagaaagacctttaaagaataaattagaactcctcaagaaaaacagcctaagacaacctgtcgtagagaaaattttaaaccaaatgataaacctcgttaatgaactaatcgataaaaattcggaaaaagacgaacaaggaagcattatcgaatatttcaggttcgatgaaataagaatagaactagcaagagaattaaagaaaaacaccgatgaacgaagagacctagacgctgccattagagaaggaaacctaagaaacgagaaaatatacaaattactacaagcccaatttgggattaaaaacccgactagaaatgacataataagatatcgactatatgaagaacttaaaaacaacggttacaaagacctatatacaaactcatatataccacaagaaaaattgttcggaaaagaaatagatattgaccacataataccacaaagtaaactttttgacgacagctttagtaacaaaacattaacctacaacactactaacaaagataaaggaaaccaaaccggctttgactatatagagtctaaatatggaatagatggcatcgaggcttatacggcacgaatagaaaatctattcgaaagtggaaagaaaaataaagaagaaggagtttcgaaagcaaaatatcaaaaattactaaagaaagaatcagaaataggagatggattcatagaacgagatctgagagaaagtcaatatatagccaagaaagcgaaagaactattactgcaaattacgcgaagcgtagtcgccacaagcggatctataactgcaagattacgagaagattgggatctagtcaacgtcatgaaagaacttaatctaccgaaatatcgcgcactaggtttaactgaaatggaagaaaggaaatatggacaaaaagtagaagtaattaaagattggacaaaacgagatgaccatagacatcacgcaatggatgcactaacgattgcattcactaaacacaatcacatacaatacctcaaccacctgaatgctcgaaaagacgaacaacataaagaacataaaatcataaacgcaattgaaaacaaagaaactatattaataacagataaaagcggcaacaggaaacgagtatttaaagccccaatgcccaatttcaggcagactgccaaacaatatttagaggaggtactcatttctcacaaagccaaaaacaaggtggtaaccaaaaacaaaaataaaatccttggtaaagagaaaatacaagaaacattaacaccgcgaggacaattacatgaccaaaccatctatggattcaactggtggagtcgtattacactaagtaaaaaggtatcacgcaacgaaatagagaaaattatcgataataacacgaaattctttttacaagaatttattcaacttaaaggctcaatcgcgaaagcattcagcgatgcagaattaaataaactcatgtataaaggaaaaatactaaaagaaattgaagtagcaataccttgttatacacaacgaatagacatctcgaaagtattcacagatagtcagaaaagtaatagtgcaaaagaaaagaacatcaaaaacatactcgatctcaaagtacgaaacatcctacaaaataggctttccgagttcaaaggagattttaagaaagcattctccgacctagacaaaaacccaatctggttcaacaaagaaaagggaatcagcatcaagagagtaattatatcaggcgtcaaaaacgtagaacctttgcactataagaaagaccacctgggaaacgatatactagatggaaaagaaaatcgaatccctgttgactttatctccacaggaaataaccatcatgtcgcgatataccaagacgaaaaaggcaacctacaagaaaaagtcgtctctctcttcgacgcggtaaagctagtcaatgcagacgaaccagtaatcgacaagacctataatcaaggattaggatggcaattcttattcacaatgaaacagaatgagatgttcgtcttcccaaacgacaacactggattcgacccaaaagaaatagacctcctcgacccaagcaataagaaattaatttctcccaacttgttcagagtacagagcatatcaatcgtgcaatacggaaataatatagtacgagatttcaaatttaggaatcaccttgaaagcgttttaaacgatgacaaggttcttcacggcataacattccaacaaataaaatcattgggacctctcctaaatatagtaaaagtccgaataaaccacctaggagacatcgtctcagtaggagaatactga

SEQ ID NO: 9117 - RNA, 4260 nt, synthetic construct
  misc_feature 1..4260: note = Cas9 variant
  source 1..4260: mol_type = other RNA
atggcaaaaccacaaaactataccattggattagacataggaactaacagcgtcggatggactgtaacggatgaccaaaataacattctacgaataaaaagtaagaaagcgatcggtgcaagactctttgaagaaggaaaagtagcggcagaaagacgttcattcagaaccacacgaagacgattaagtagacgaaaatggcgaatcaaattactagaagaattattcgacgaagagatatctaaagtagacccaaacttctttgcacgttcacatgaatcatggataagtcctaaagataaaagggagaggtattcagcaattgtctttcccaccccggaagaggacaagaaatttcacaacgagtacccaactatttatcatctacgcgacagacttatgaaagatgaccaaaaacacgacataagagagatatacgtagcaattcaccacataatgaaatatcgaggtaactttctacatgatgagagtatcgagacttaccgaagcggtatgtcatcattgggaggaggcgatgagagaacaatactaaatacaaaaattttagatgatttaaatgatgctttcgccgacaatttagcgacccagggtatctccgtaaacagtgctagtgctgaccaaattaacgaaatagttacatcaggacacttaaatgtcgacagccaaaaagcaatagctaaattattactacccacaacattatcaagtgacgacaagaaacaggacaagaaaattaagaaattggccacagacgcagccaaaaacgtcgcaagtgcatggctaggatacaaagcaaacttcgcagctattctcaacattcaagaggttgataaagataagaagaaaatatattctttcgcactccaaggagcagacgaagaagataaagtcgaaactttagaatcagtattatcacaagaccaaatcgaaatagtggatagaataataagaataaggcacgcaatagttctaggagagatcataccggtaggaatgacattaagcgaggctatgatagaaaaatatgatcagcacgcaaaagatctaaagaacctaaaaaccgtaatcagaaacttaaaagatcgtaaaaacgcggtaaaactacaagcaatatatgatctctatgtgaacaacagacatgccgataccgcaaaagctatgaaactagctggcgttaagaaacgaaccgaactactcgaaccagaggaatttaataaaagcatagaaaaattattggacgacagtccagtatccgccgaaataaagaaacgcatcgcagaaaaagacttcctaccactacaaagaagtaattccaacggggttatacctaaccaattacatcaaatcgaactagatgagattatcaagaaacaatcaaaatactatccatttctcggtgaaactaatgaacacgcgagcgcagatgttgctagaaaagcgccaacaaaattggaccaactcctaacttttagagttccttattacgtaggacctctaattacaaaagaagaacaagaagaacaagatggtcattcatttgcctggatgatacgcaaaaatcccaaagatcacgagaaaataacaccgtggaactttgatgaaaaagtagacagaatggcaagtgcgacccagttcataaaacgaatgaccacaaaagacacttacttactaggagaagatgtactaccatcatccagtcttaaatatcaattattcacagtactaaacgaattaaataatcttcggattaatcataagaaattaacacgagaagaaaaagaacaagtcattgaagatctatttaagaaatacaaaacagtcaaagccgataaatttaaaaattattggcaaaaaggacacgctggactagacgtcaaaatccaaggtatggcagacccagaaaaatttaacagcacaatgtcgacatatatcgacctacagaaaatattcggggatcaactagacgatgcacaaaggcaaaacgacttcgagaaaatcatcgaatattctacaatattcgaagacaggaaaattttaggggaaaaattaagagcggactttgtatggcttagtgaagatcaaataaaaagattatgccgactccgattacagggttgggggcgtttaagtcttaaactgttgacacgcctcactgacgcagatggtcaaaacgtattagaaagactattaaacagtaatgacaatttcatgcaaatcgtaaaagacccagttatcaaagctaaaattgaacagaaaaatcaaaaattattaagagccgattggtcagagaatgcaacagaatccatactagatgaggcatatacaagtccacaaaataagaaagcaataagacaagtaatgagggttgtccatgatatcgtcaaagcctgcgacggaaacttaccagcaaaatttgctatcgagttcgcacggagccaagacgatgatcccaaacgaaccgtagcaagagccgatagattacagaaaatttatgcccaaatctcggatgaagtcgttagtcaaggagttaaagaccaattatccggaatgaaatcattaaaagatcgatattatctttattttatgcaaggtgggagagatgcatacactggaaaaccgctaaatattgacagattatcagattacgacatagaccatataatgcctcaaagtttcattaaagacgatagccttgacaatcgagttctagtaactagagcagtaaacaatcaaaaatcagataatgtgccggtactcttatacgggaatcacctagtagcggatttaggaattacaattagagaaatgtgggatagatggcagaaaagcggaatgataagtaaaagaaaattagcaaacctactcacagatccagccacactttctgaataccgtgccgaaggcttcataaaccgacaactcgttgaaacatcacaagtgataaaactaacagctacgatactacaatcagagttcccagacagtaaaataatagaagtgccagcaaaatataactcaatactaagaaaacaatttgatttatataaaagccgcgaagttaacgattaccatcacgcaatagatgcgtacttatctacaattgttggtaactatttatatcaagtatatcctaacttaagacgcctattcgtatatggagaatttaagaaattctcacacggagaggaagaaagcagtcaccaagccgtaaggcgagtaaaatcaatgaacttcttggacgatctattaagaggcaaacatggtgacgatatatactgtcgcgtaacaggtgaagttatattttcgcgaaaagacataatatcaaaactaaaacaggcttactccttcaagcaaatgcttgtgacacaagaagtcttcacaaagaaatcagctttattcgaccaaaccgtctacccctctccagcacgggactccaaaacaagaagcggactaataccacgtaaacaaggaatggacaccgaaatatacggagggtacagtggcaataaagatgcatacttcgtactagcacaagtcgttaaatccaaaggccacaccctacaagtagtgggtgttccaatcagagccctacgtgcattagccaactgttccaattattcagaacaacttctaaaaatcgtaaaggcacaagtactattcaataagaaaacaggaaaagcaaagaaaggtatatcagacgtaaggatcctgctcgacaaaattccatacaggcaaccagtactcgacggctccgccttttacatgctaggaagcagtacctacaaatataacttgaaacaaatatcactaagccaacaaagcatgaaatacatcttagactacatagacgacccaaacttcaacaaacacgagatgaccaaaattgaccaacaaaacgaaaaggaatgtctattaagtgtatacgacgaaatactcgataaaatggataaatacctttcattatacgacatcaatggatttagaaagaaattacacgtcggacgcgataaatttattaaattagaagtagaaaaacaagctgaagcaattaaaaatgtattaagaggatttcatgcaaatagtgacatgacaaaacttagcgaccttggactctccacaagtttaggatttatgcaagcaagtgacggcataaaactaagcgacaatgccgtatttatataccaatctccaacaggcctatttgaaagacgcgtaaaagtctcagatctcttaaagtga

SEQ ID NO: 9118 - RNA, 4260 nt, synthetic construct
  misc_feature 1..4260: note = Cas9 variant
  source 1..4260: mol_type = other RNA
atgatgatcaaaaacatattaggacttgacttaggaactaatagcataggatgggcattaatcaagcaaaacttcgaaaacaaatatggagaaattctaggaatgggatctagaattattcctatgtcacaggacgtactaggcgaatttggcaaaggaaatagcgtatctcaaacagcagcaagaacgggataccgaggagtaaggagattaagggaacgattcttacttcgaagggaacgactgcacagagtactcaacgtcttaaactttttacccgaacactacgcatcacaaatcgatttcgaaaaacggtttggaaaatttaaatatgagacagaaccgaaattagcctacaacaatgatggtttctttttcaaaaactcattcgatgagatgctcggcgacttcaaagaccaccaatttcatcttttagaaaatggaagaaaggtaccatatgactggactatatactatctgaggaaaaaggccttaagtcaaaagatagagaaagaagaattagcttggatactactcaactttaatcagaaaagaggatactaccaattaagaggagaagatttcgaagaagaaaaagatagagtatttgtacggctaaaggtagatagagtagtagacagtggcgaaaacataaaaggcaaaatactatacgatgtctattttgagaatggctggaagtacgaaaaacaaatagtcaagactgaagactggatcggacgaacaaaagagtttatcgtaaccgaatccattttaaagaatggagataccaaacgtacattcaaagcagtagatagcgaaaaagattggatagcaataaagaccaaaacagaacaggaaatcgacaaatcacacaaaacagtaggagcatacatatatgaagctctccttcaaaatccaaaacagaaaatcaaaggaaaattagttagaacaatcgaaagaaaattttacagagaagaactaaagaaaatcctagaacgacaaaaagagttccacccagaactccaaagcgatgatctatacaatgactgtatacgcgaattatacagaaacaacgaagcacatcaaataacattatcaaagaaagactttgtccatttattactaaatgacttaatcttctatcaaaggccgctgcgatctcagaaaagttcagtatccaattgtacattagaatttaggaaatacaaagacgaaaacggagtggaacatgcacaatatttaaaaacaataccaaaatcaaacccatactatcaagaatttagggtatggcaatggatgtttaacctaaatatctatagaaaagatgatgatacaaacgtaacgaaagagttcttatcatcaacagaagattatgaaacactgttcgagttcttgaacaacaggaaagaagttgatcaaaaagcccttctccgacatttcaaacttaacgaaaagactcataggtggaactatgtagaagacaagaaatatccctgtaatgaaacaaaaaccatgatctcaacaagactagaaaaagtagaaaattatccatcagactttttgacacgagaaatggaacaaaacatatggcacataatatacagcgttaatgataaaatagaatacgaaaaagccctcaaaagtttcgcccataaaaataacctcgatgaaaattccttcttcgaagcattcaagaaatttcccccatttaaatccgaatacggaagtttcagcgaaaaagcgattaagaaactattaccccttctacgcctaggaaaatactggaactgggaatccatagatagaaaatctcaaggaagaatcgaaaagattattaccggagagttcgacggtaacattaaagacaaagtacgagaaaaagcaatacacctaacagcggaaaacgacttccaaggactacaactatggctagcacaatacatagtctacggacggcactcagaagcatcaatgataggaaaatggaacagcgccgacgacctagaagagttcttgaaaggattcaaacaacactctctacgcaaccccatagtcgagcaagtcataactgaaacgttaagagtggtaaaagatatctggctaaaatacggaaatggtgcaaaagatttctttagcgaaatacacatagagttaggacgcgaaatgaaacaaaccaaagatgaacgggttgatgccactaaacgaattacagaaaacgaaaatacaaatcttagaatcaaagcacttttagcagaaatgatgaacgataatagcgtagagaatataagaccatatagcccaatgcaacaagaaatcttaaaaatatatgaagatggtatactaaaaagtgatatcgaaatcgacgacgatatactgaaaatctcaaaaactgcacaaccatcatcttctgacctaaaacgctataagctatggttagaacaacgatacaaaagtccgtacaccggacaaataattccactgaataaattatttacaagcgaatacgaaatagaacacataattccacaatcacgttacttcgatgacagcttcagtaacaaaataatatgcgaaagtgctgtcaacaagctaaaagataattacataggactcggttttatcaaacaattcggtgggatgatagtagaatgtggcttcgggaaatccgtcgaaatatttaaagctgaagaatacgaagactttgtaaagaaacattacgcaaataaccgctcaaaacgcaataaactactactagaagaaattccagagaaaatgattgaccgacaattgaatgataccagacatattagtaaatatattagtggcgttttgagcaacatagttagacaagaagatggaaccgacgaaggagtgaacagcaaaaacattgtacctggaaatggtaagatcaccacacaattaaaacaagactgggggttaaacgacgtatggaacgaattaatactaccacgtttcgaaagaatgaaccaacttacaaactcaacagacttcacaagctggaataaaaatcatcaaaaattcttgccgacagtgcccatcgaattttcaaaagggttcagtaaaaagaggatagatcatagacaccacgctatggacgcacttgtcatagcttgtgcaacaaaagatcatataaatttactaaacaaccaatccgcaaaaagtgatacaaaaagatacgacttaaaaagaaaactaatgaaattcgaaagagttgtatactcccacagtaaaacaggagagaaaattgaaaaagaagtacccaaacaattcttaaaaccgtgggacaacttcacagtagatgctaaaaacaaaatggagacaataatagtctctttcaaacaaaatttaagagtcataaataaagcaacaaaccactatgaaaaatggatcgaaaaagatggcataaagagaaaagaactcatcaaacaagaaggaacaaactgggcaatacgaaaaccaatgcacaaagaaacagtctccggtaaagtagacctacccggaataaaaatcccaaaggggaaaatattaaccgccactcgaaaaagcctagacacctccttcgaccttaaaaccatcaatagtataacagacactggaatacaaaagattctaaagaattatttagaatttaaaggatcgtcagaattggcattctcaccagagggaatcgaagacatgaataaaaatatcgaaaaatttaatgacgggaaaccacatcaatcaataaacaaagtcagaatatttgaactagggagtaaattctcagtaggacaaacaggaaataagaaagacaaatacgtagaggcagccaaaggaacaaacctatttttcgcagtgtacgaggacaaaaatggcaaacgaagttacgaaacaatccctttgaacgaggttattgaaagacaaaaacaaggacttgattcggtatcgtttaaaaataaagaggatttcctgctatgccctaacgatttagtatacgttccgagtgaagacgaattagagaacatctataacattgattttaaaaacttaacaacagagaaaacggggaatatctataaagttgttagctttagtggaaatcaaatattctttatcagacaagacatagcaataagtatagtaaataaagctgaattttcaacgctcaacaaaatggaaagagcgatagatggctcaatgataaaagaaaattgtattaaactaaaaattgaccgactaggaaacatagcaaaaatttga

SEQ ID NO: 9119 - RNA, 4263 nt, synthetic construct
  misc_feature 1..4263: note = Cas9 variant
  source 1..4263: mol_type = other RNA
atggcaaaacccaaggactatactataggattagatataggaactaattcagttggatgggtcgtaactgacgaccaaaacaacattctaagaataaaaggaaagaaagcaattggtgcgagattattcacggaaggaaaagtggctgcagaacgaagaagtttcaggaccactagacgtaggttatcaagaagaagatggagaataaaaatgttagaagaattattcgacgaagaaatcgctaaagtagatcccagtttcttcgcgagacttcatgagagctggatatcccccaaagacaaaagaaaacggtactctgcgatagtattcccgtcccctgaagaagacaagaaatttcacgaatcgtacccaaccatataccatctgagagacaaacttatgaaagacgatcaaaaacatgacatacgagaaatatacattgcagtacaccagatgattaaagctcgtggcaactttcttcacgatgagagcgttgagacataccgctcaggcatgagtagtttaggagggagatcagagagaacaatattgtcagtgcaaacgctcgaagaattaaatgatctatttgctgaaaacgaaggcaccgaagaagtcgaattaaacgtagcatccgccgagcagataaacgatattttgacaggaggacatttaaatgccgattcgcaaaaagaaatatccaatttattgctacccagttcattcccgtcttttgacgataaagcaaaagaaaaacaagtaaagaaactaataaataatgtggcaacaaatatcagcaaagcgtggctcggctataaagctgacttcagtaccatactaaatcttgcaaaagtagacaaagatcagaagaaaatattcgcattcgctctacaaggagaagatgaagaagacaaagttcaagaattagaatcactattagaacaatctcaaacagacatcgtagaccggttaattgaaataaggcatgcaatagttctgagtgaaatagttccagtaggaatgaccctaagcgaagcaatgatcgacaaatacgaccaacataaagaagacctaataacacttaaagcagtaataaggaacacaaaagataaaaagaaagcagcaaaacttcaagcaatttatgacttatatgtgaaaaacagacatgcagacttagcaaaagcgatgaaactgactggaatcaagaaacgctctgaactattagaccccgaagaactgaagaaaggcattagttctttactagatgattctcctgaagcggtagaaatcaaacaacgtttagaagagaaaacattcctcccactacaacgatcaaataacaacggagtaatacctaaccaattacatcaagtagaactagatgaaataataaagaaacaaagcaaatactacccttttcttgcagagaaaaacccagacgaatctgaagaagcacaaaagaaagcccccacaaaactagatgcactacttacctttagagtaccttattacgtcggaccaatgatcactaaagaagaacaagaagcacaaaatggccattcatttgcctggatggtacgaagggatccacaagaccacgaagcaatcacaccctggaatttcgagaagaaagtggacaaaatggcttcagctacacaattcataaaacgaatgactactaaagatacatatcttttaggagaagatgtactacccgcatcatcactcaaataccaactattcactgtgcttaacgaattaaataatttacgcgtaaacgggaagaaattaacaagcgacgaaaaagaacaagtcattgaaggactattcaagaaacagaaaacagtaaaagctgacaaattcgtaaaatactggcaagcaaaacatattggcgctgatattaaagttaaaggcctttcagacccatcaaaattcaactcaacaatgtcaacatatattgacttcaagaaaattttcggtgatcagttaaatgatgtaaacagacagaatgacttcgagaaaatcatagaatattccaccatattcgaagatagaaaaatattagaagataaactaagagcagatttcgcgtggctcagcgaagaacaaatcaaacaactttgcagacttagactacaaggatggggacgtttatcagacaaacttctaacaagacttactgatgccgacggccagaacgtattagagcgactatggaatagtaacgacaattttgtacaaattgtaagtgatccaaacataaaagcaaaaatcgaacaagagaatcaaaaactactaagggatagtcaaagcgacaacgcggttgaaagtatcttagacgatgcatacacatctccacaaaataagaaagccatcagacaggtaatgagggtagtacatgatatagtaaaagcatgtgacggaaacgtacccgcaaaatttgcgattgaatttgcaaggtcgcaagaagacgatccaaaacgaacgacagctcgagtaaaccaaatgcagaaaatttacgaccaaatctcagatgaggtcgtgtcacaaggagttaaagaacaactatcaggaatgaaatcgcttaaagaccggtattatctatatttcatgcaaggtggccgtgacgcatacacaggggctaaacttaacattgacaggttaagtgactatgacgtagaccatatcatgccacaaagttttgtcaaagacgattcactagacaatagagtcctagttgcacgtgcagtgaacaatcagaaaagcgacaaagtacccgcactactatttggcaataaagtagtcgccgatctcggtataaccgtcagagaaatgtgggacaaatggcaaaaattagggatgattagtaaaagaaaactatcaaatctactaactgatccggacgcactgactgaatacagagctcaaggatttattagaagacaattagttgaaacatcacaagtcattaaattaactgcaacgatactccaaagcgagtttccagattccaaaataatagaagtaccggcaaaatacaacagtatcgtaagaaaacaatttgatctatataaaagcagggaagttaacgacttccaccatgcaatagatgcatatttatctacaatagtcggaaactacctataccaagtctatccaaacttgcgtcgaatgtttgtgtatggagagttcaagaaattcagctcaaacgcggaagaatcagcccatgatgtcgctagacgagtaaaatctatgaatttcttagatgatcttctaagaggaacacacggagataacatatattgtcgctcaacaggagaaatagtattcaacagaaatgacataataagtaaactcaaacaggcttattcctttaaacaaatgctggtcacgcaagaagtattcacaagaaaatcagctttattcgatcaaacagtataccccagccctgagagagatagtaagaaacgcagtggattaataccgcgaaagaaaggaatggacccggaaatttatggaggatacgcccacaaccaagactcatacttcgtactagctaaaatagagaaagtaaaaggatacactctgcaaattgtaggagtaccaatccgatcacttgaaattataaacaaagcagaagatttctccacagctttgttggacattataaaatcaaaagtaatgtacaatgagaaaactggtcaacctaaaagaggtatcaaaaacgtagaaatacttgtaaataaattaccctatagacaaccaatattagaaaaagacgtatcatacatgttaggatcttccgcatataagtataacatgaaacaaattacactgagcaggcaatctatgaaatatattttagattacattgacgatcccaattttacaaagcacgaaatgacaatgatcgacgaacaaaatgaacgagaatgtctcctatcagtatacgacgaaatcttagaaaaagtagataaatacctaccgctattcgacggcaacaagtttagggaaaaattacacagcgcaaggaaggagttcgtaagtctatctgttgacgacgaagcctctgcaattgagaaaatattacgaggtcttcacgctaatagtgaaatgccatcactagaaaacctaaaaatcaaacctgctcttgggtttttccaaatgaaaaacggaattacactaagcaacgatgcagtactattatatcaaagtccaaccggcctgtttgaaagacgagtaaaagtatctgatctacttaaatga

SEQ ID NO: 9120 - RNA, 4263 nt, synthetic construct
  misc_feature 1..4263: note = Cas9 variant
  source 1..4263: mol_type = other RNA
atggccaaaccaaaagactacactataggactggatatcggtaccaattccgtaggatgggtagttacagatgaccaaaacaacatcttaagaatcaaaggtaagaaagccataggagcacggctgtttacagaaggcaaagtcgcagccaaaaggagaagttttcgtaccacacgtagacggctgtcaagaagaagatggagaatcaaactattagaggaactctttgacgaagaaattgcaaaagtagatccatcatttttcgcgagattgcacgagtcatggatcagcccaaaagacaaacgaaagagatattcagccatagtatttcctagccctgaggaagataagaaatttcatgaatcatatccaactatatatcacctaagggataaactaatgaaagacgatcaaaaacacgatatcagagaaatttatatagcagtacatcaaatgatcaaagctcggggcaacttcctacacgatgaaagcgtagagacatatcgttcagggatgtcttcgctcggaggtcgctcggagagaacaatattaagcgtacaaaccctagaagaactaaatgacctattcgcagaaaacgaaggaacagaggaagtagaactcaatgtcgcatctgccgaacaaataaatgatatattaacaggtggacaccttaatgcagactcacaaaaagaaatatcaaacttattgcttccaagtagctttccttcatttgacgacaaagcaaaagaaaaacaagtaaagaaattaattaataacgtagcgaccaatatatcaaaagcctggcttggctataaagctgacttcagtacaattttaaacctagctaaagtcgataaagatcaaaagaaaatctttgcatttgcactacagggcgaagatgaagaagacaaagtacaagaactagaatccctattagaacagtcacaaacagacatagttgaccgactcatagaaatacgacatgcaattgtacttagtgaaatcgtaccagtaggaatgacactatccgaagctatgatagacaaatatgatcaacacaaagaagacctaataacactgaaagcagttataaggaatacaaaagacaaaaagaaagcagctaaactacaagccatatatgacctatacgttaaaaatcgtcatgctgatctagctaaagcaatgaaactcacaggcatcaagaaaagatcagaactactagatcccgaagaactcaagaaaggaatatcatccctattggacgattctccagaagcagtcgaaataaaacagagaattgaggagaaaacctttctcccactacaacgttcaaataacaatggcgtaatacctaaccaattgcatcaagtggaactagatgaaattataaagaaacaaagtaaatactaccccttcctagccgagaaaaatccagacgaatcagaagaagcccaaaagaaagcaccaacaaaactagacgcactactaacattcagagtaccttactacgtgggtccaatgataacaaaagaagaacaagaagcacaaaatggacattcatttgcttggatggttagaagagatccacaagaccatgaagccataactccatggaattttgaaaagaaagtagataaaatggcatcggcaacgcagtttataaaacgtatgacaacgaaagacacttatcttcttggagaagatgtgctacccgcgagttctctaaaatatcagttatttacagttttaaacgaattaaacaatttgagagtaaatggtaagaaactaacaagcgacgaaaaagaacaagtcatagaaggactatttaagaaacagaaaacagtcaaagccgacaaatttgtaaaatattggcaagcaaaacatattggggcagacataaaagtaaaaggactttcagacccaagtaaattcaactcgactatgtcaacatacattgactttaagaaaatattcggagatcaactaaacgatgtaaatagacaaaatgacttcgaaaagataatagaatattcaacaatattcgaagatcgtaaaatactagaagacaaattacgcgtggattttgcatggctttctgaagaacaaataaaacaattatgcagactaaggctacaaggatgggggaggcttagcgacaaacttctaactagacttaccgacgcagacggccaaaacgttttagaaagactatggaactccaatgataatttcgttcaaatagtctccgaccccaatatcaaagcaaaaatcgaacaagaaaaccaaaaactcttaagagactctcaaagcgataacgcagtagaatcgatactagatgatgcatacacatcaccccaaaataagaaagccataagacaagttatgcgtgtagttcacgacatagttaaagcatgcgacgggaacgtccccgctaaattcgcaatagagttcgctaggagccaagaagacgatccaaaacgaacaactgccagagtaaaccaaatgcaaaagatatacgaccaaatatcagatgaagtagtatcacaaggcgtaaaagaacagctaagcggaatgaaaagtctcaaagaccggtactacctatattttatgcaagggggtcgagatgcatacactggagccaaactcaatattgatagattaagtgactatgacgtggatcacataatgccccaaagttttgtaaaagacgatagtttggataatagagttctagtagcacgagcagtcaataaccaaaaatcagataaagtacccgcactactatttggaaacaaagtggtagctgatctaggaataactgtaagagaaatgtgggataagtggcaaaaattaggaatgatctcaaaaagaaagctatcaaacctcctaacagatccagacgcattaacagaatatagagcacaaggtttcataagaagacagctagtagaaacttcacaagtaattaaacttacagccacaatattacaatctgagttccccgacagtaaaataatcgaagtaccggcgaaatacaatagtattgtaagaaagcaattcgatctgtataaatcacgtgaagtcaacgactttcaccacgcgattgacgcgtacctctcaacaatagtcggaaactacttataccaagtatacccaaatctccggagaatgtttgtgtatggtgaatttaaaaagttttcatcaaatgccgaagaatccgctcacgatgttgcacgacgagttaagagtatgaacttcctagacgatttactacgaggaacacatggcgataacatatattgtagaagcaccggtgaaattgtctttaacagaaacgacataatttcaaaattaaaacaagcctacagcttcaagcaaatgctagtgacacaagaagtattcacaaagaaatctgcattattcaatcaaacagtttacccttccccaaaaagggatgggtcaaaacgatcgggactgataccaagaaaacgcggcatggatccagaaatatatggaggatatgctcataaccaagactcccactttgtattggcaaaaatagaaaaagttaaaggatacaccttgcaaatagtaggtgtgcccatacgatcattagaaattataaataaggctgaagatttctcaaccgcactactagacatcattaagagcaaggtaatgtataatgagaaaacaggacagcctaaaagaggaattaaaaacgtagaaatattagtaaataaactaccctacagacaacccatattagaaaaagatgtaagctacatgctaggaagctctgcatataaatacaatataaaacagattacactatcgaggcaatccatgaaatacatattagactacatcgacgatccgaacttcactaaacatgaaatgacaatgatcgatgaacaaaatgaacgagaatgtctattatccgtttacgatgaaatactcgaaaaagtagataaatacctacccctatttgacggaaataagttccgcgaaaaactacatagtgctcgtaaagaatttgtatcgctaagtgtagatgacgaagccagtgcgatagagaaaatattaagaggattacatgccaactcggaaatgccatcgttggaaaatctaaaaataaaaccagcattgggtttcttccaaatgaaaaatggcattacattatctaatgacgctgtactactataccaaagcccaacaggactttttgaaagaagagtaaaagtatcagatttattaaaatga

SEQ ID NO: 9121 - RNA, 4263 nt, synthetic construct
  misc_feature 1..4263: note = Cas9 variant
  source 1..4263: mol_type = other RNA
atggccaaattcaataaaaattactcaatcggactagatattggcgtatcctccgttggatacgctgtagttaccgacgattatcgagtgccagcatttaaatttaaagtattgggaaacacagaaaaagagaaaatcaagaaaaacctaatcgggagcaccacctttgtaccagctcaatcagcccaaggtactcgagtctttagagttaacaggagaagaattgataggagaaatcaccgaatagcttacttacgagatattttccaaaaagaaatagaaaaagtagataaaaatttctacagacgcctcgacgaaagttttagagtgttaggggataaatcagaagaattacaaattaaacaaccattctttggagacaaagaactagaaaccgcttatcataagaaatacccaacaatataccatctccgtaaacacctagctgatgcagataagaactctcccgtagcagacatacgagaggtatacatggcaatatcacatatcttaaagtatcgtggacatttcctcacattagatagaataaacccaaataacatcaatatgcaaaacagttggattgattttatagaatcatgtcaagaggtattcgacttagaaataagcgacgaatccaaaactatcgtcgcaatatttaaatcttcagacaatagacaagaaaaagtaaagaaaatcctatcatatttccaacaagagctccttaagaaagacaaatcaatattcaaacaactgcttcaattactattcggactaaaaacaaaatttaaagactgtttcgaattggaggaagaaccagacttaaacttcagtaaagaaaattatgacgaaaatctagaaaacttcttgggatctctagaagaagattttagcgacgtcttcgcgaaattaaaagtattacgtgacactatactactttcgggcatgctaacatacacaggaacaacccgggccagattctcagcaaccatggtcgaaagatacgaagaacacagaaaagacctacaaaggttcaaaagtttcgtaaaacaaaatctctctgaacaagactatctcgacatctttggacgaaaaacccctaacggcttcgacgtagataaagaaacgaaaggctacgtaggatatatatcaaataaaatggtcttaaccaatccgcaaaagcaaaagacaatacaacaaaatttttatgactacatcagtggaaaaataacaggaatagaaggtgcagaatatttcttaaacaaaattagcgacggcacgttcctccgtaaactgcgaaccacagacaacggcgcagtcccaaaccaaatacacgcctacgaactagagaaaataattgatagacaaggcgaggactatccattcttactcgaaaataaagacaaactgctaagcatattaacgtttaaaataccatattacgtaggaccactctcaaaaggaaacaactcacgatttggttggataaaaagaaccatctcccaagatatacttgacgataatgatgaagacaccagaaatgggaaaatccgaccgtggaactaccaaaagttaataaatatggacgaaacaagagacgccttcatcaccaatctcattggaaacgatataatccttttaaacgaaaaagtactaccaaaaagatccctaatatacgaagaagtcatgctacaaaatgaactaaccagggtcaaatacaaagataaatatggtaaaacgcatttcttcgattccgaattaagacaagaaataataaacaatctcttcaaaaccaataataaaagggtttcttccgcaatgctacttgattatcttgaaaactatacaaacctccaagcagtagaaatagtatcaggaattgagaaaggaaaatctttgaactctacgctcaaaacatataatgacctaaaaacaatattttccgaagaattattagacagcgaaatttatcaaaaagaactagaagaaatagtaaaagttattaccgtttttgatgataagaaatcaatcaaaaactatttaataaaatatttcggccatttggagttcctcaatgaagaaagaataaaccaactctctaaactccgctacacaggttggggcagatatagcgcgaaactactcctggacatacgagacgaagataccggttttaacctgatgcaatttttacgcaatgatgatgaaaacagaaatctatcacaattaatctcggactccacactatcattcgattcagcaataaaatcgattcaatcaaaatccacagtagaagatgatgtattcgacgagataaagaaattagcaggttcccccgccataaaacgaggtattctcaattcaatcaaaatcgtagacgaacttgtccaaataataggatacccaccccaaaacatagtaatagaaatggccagagaaaacatgacaaccgaagaaggacaaaagaaagccaaaacccgcaaaacaaaattagaaagcgcacttaaaaacatagaaaactcagttttagaaaatgggaaagtgcctcactccgatgaacaattacaatccgaaaaattgtacctctattatcttcaaaacggaaaagacatgtattcactagacaaaaccggttctcccacacccttatatcgtgaccaacttgaccaatatgaagttgatcatataataccatattccttcttaccgatcgactcaatcgacaataaagtcttaacacatagagaaaataatcaaagaaaactcaacaacataccagataaagaaacagtagcaaacatgaaacctttttgggaaaaactctataatgcaaaactcatatcccaaacaaaataccaacgactaaccacaagcgaaagaacaccagacggagttctcacagaaagcatgaaagctggatttatagaacgacaattagttgaaacgagacaaataattaaacatgttgctcgaatactcgacaacagatttttggataccaaaataatagccttaaagagccaattaatcacaaactttagaaatacatttcatatcgcaaaaataagagaactaaatgactatcaccatgcccatgatgcttaccttgcagtcgtagttggacaaacactacttaaggcctatcccaaactggcaccagagttaatatatggacatcacgcacatttcaaccgacatgaggaaaacaaagcaaccatacgtaaacacttatattcaaatataatgagatttttcaacaacccagactcaaaggtaagcaaagatatttgggattgcaaccgggacctccctattatcaaagaagtcatatacaactcacaagtaaattttgtaaaacgaactatgataaagaaaggagcattctacaaccaaaaccctgtcggaaaattcaataaacaaattgcagcgaacaatagataccctttaaaaaccaaagtctcctctttagacacttcgatatacggtggatatggtcctatgaactctgctctctcaataataataatcgccgagagattcaatgagaagaaagggaaaatagaaaccgtaaaagaatttcacgacatattcatcatagattataagaaattcaacaataatccgtttcaattcctaaatgacacctcagaaaatggtttcttaaagaaaaacaatataaacagagtattagccttctacggagtcccaaaatattcattaatgcagaaaaacgatggaacacgtatgctgttcgaatcaaaatctaatctgcataaagccacacaatttaaattaacaaaaacgcaaaacgaactattcttccacatgcgacgcttactaacaaaatcaaatttgatggacctaaaatcagaatcagcaataaaagaatctcaaaacttcattttaaaacataaagaagagttcgataacataagtaatcaactatcggctttttcacagaaaatgctaggtgacacaacgtctctaagaaacttaatcaaaggatacaacgaaagaaaaatcaaagaaatagattcaagcgaagaagttataaaatacttttacgataattttataaaaatgtttagcttcgtcaaaagcggcgcgcccaaaggaataaatgactttttcaacaacaagtacaccgtcgctcgaatgagaccaaaaccagataagaaatttctcaatgccactctaattcaccaatcaattaccggtctatatgaaactagaattgatctaagcaaattaggcgaagattga

SEQ ID NO: 9122 - RNA, 4263 nt, synthetic construct
  misc_feature 1..4263: note = Cas9 variant
  source 1..4263: mol_type = other RNA
atggccaaatttaataagaactactcaataggactcgatattggagtcagtagcgtaggatacgcagtagttacagacgattatagagtcccagcgttcaaatttaaagttctaggaaacactgaaaaagaaaaaataaaaaaaaaccttataggatcaacgacttttgtaccggcacaatccgctcaaggaaccagagtctttcgagtgaacaggagaagaatagaccgccgaaaccatcgcattgcctacctccgtgacatttttcaaaaagaaatagaaaaagtggataaaaacttttatagacggctcgacgaatcattcagagtattaggagataaatccgaagaattacaaatcaaacagccattcttcggagacaaagaactagaaactgcctaccataaaaaataccctaccatatatcaccttcgaaaacacctcgcagatgcagacaaaaacagccccgtagcagacatacgtgaagtatacatggcaatctcacatatactaaaatacagaggacatttcctcacattagatcgaattaatccaaacaacataaacatgcaaaacagttggatagactttatcgaaagttgccaagaagtgtttgatttagaaatctcagatgaatcaaaaacaatagtagcgatatttaaatcctccgataacagacaagaaaaagtaaaaaaaatattatcatactttcaacaagaactactaaaaaaagacaaatcaatcttcaaacaattacttcaactcttatttggactaaagacaaaattcaaagactgttttgagctagaagaagaacccgaccttaacttttcgaaggaaaactacgacgaaaacctggaaaattttctaggatcgcttgaagaagatttctcggatgtatttgctaaattaaaagtactcagagatacaatattactctccggaatgcttacatacacaggaacaacccgagcaagattctcagctactatggtagagagatacgaagaacatagaaaagacttgcaacgatttaaatctttcgtcaaacaaaacctatctgaacaagactatctcgacatttttggtagaaaaacccccaacggatttgatgtagacaaagaaaccaaagggtacgtaggttacattagcaacaaaatggtcctcacgaatcctcaaaaacaaaaaactatacaacaaaacttttacgattacatatccggaaaaattacagggatagaaggagccgaatacttccttaataaaatttccgacggaacatttctaaggaaattgcggacaacagataacggggctgtaccaaaccagatacacgcgtatgaactcgaaaaaataatagatcgacaaggagaagactatccgttcctactagaaaacaaagataaactactctcaatactcacattcaaaatcccctattacgtagggcccctatcaaaaggtaacaactccagatttgggtggataaaacggacgatatcacaagatatactcgatgacaacgacgaggacacacgaaatggaaaaatcaggccatggaattaccaaaaattaatcaacatggacgagacacgcgacgcctttatcacaaacctcataggaaatgacataatattgctaaatgaaaaagtgctgcccaaaagatcgctaatatacgaagaagtcatgctccaaaatgaactaacacgagtcaaatacaaggacaaatatggaaaaacacacttttttgacagcgagctaagacaagaaataataaataacctatttaaaactaataataaacgagtatcttcagcaatgctactcgactacttggaaaactacactaacctacaagcagtcgaaatagtatcaggaattgaaaaaggaaaatcacttaatagcacccttaaaacatacaacgatttaaaaacaatattttcagaagaacttcttgactcagaaatataccaaaaagaattagaagaaatagttaaagtaatcacagtattcgatgataaaaaatccataaaaaattatctaatcaaatactttggccacttggagtttcttaatgaagagagaataaatcaattgtcaaaactacgatacacaggttggggccgttactccgccaaactactactcgatatccgagatgaagatacagggtttaatttgatgcaattcttaagaaatgacgacgaaaatcgcaatctttcacagctaatctcagatagcacgttatccttcgacagtgcaataaaaaccattcaatctaaaagtacggtagaagacgacgtcttcgatgagataaaaaaactcgctggaagcccggccattaaacgaggaatactaaattcaataaaaattgtagacgaattagttcaaataataggctacccgccacagaatattgtcattgaaatggcaagagaaaatatgactaccgaggaaggacaaaaaaaagcaaaaacaagaaaaacaaaacttgaatctgcactaaaaaacatagaaaatagcgtactcgaaaacggcaaagtcccacatagtgacgaacaactacaatccgaaaaactatatctatattatttacaaaacggtaaagacatgtatagcctagataaaactgggtccccaactccattatatagagatcaattagaccaatacgaagtagaccatattataccctactccttcctgccaatagactcaatcgacaataaagtgttaacacatagggagaataaccaacgaaaattaaacaatataccagataaagaaaccgtagcaaatatgaaaccattctgggaaaaactctacaacgcaaaacttataagtcaaactaaataccaaagactaaccacatcagaaagaacccccgacggcgtattaactgaaagtatgaaagccggctttatcgagaggcaactagtagaaacccgtcaaataatcaaacatgtcgcccgaatcctagataatagattcttagatactaaaataatcgcactgaaatcacaactaataaccaacttcaggaatactttccatatagcaaaaataagagaactaaatgattaccaccacgcccacgatgcctatttagccgtggtagtaggacaaacattactcaaagcatatccaaagttagcccccgaactcatttatggccaccatgcccacttcaatagacacgaagaaaataaagctacaatccgcaaacacctatatagcaacataatgagattcttcaataatccagactcaaaagtatcaaaagacatatgggattgtaatcgcgacctacccataataaaagaagtcatctataatagtcaagtaaatttcgtcaaaagaacaatgattaaaaagggtgccttctataaccaaaatcccgtaggaaaatttaacaagcaaatcgcagcaaacaacagatacccactaaaaacaaaagttagctcattagatacctcaatatatggaggttatggaccaatgaactcagcactatcaataattataatagcagaaagatttaatgaaaaaaaaggaaaaatcgaaaccgtcaaagaatttcatgatattttcatcatcgactacaaaaaatttaataacaacccatttcagttccttaatgatacatcagaaaatgggtttcttaaaaaaaataatataaacagagtcttagccttctacggagtccccaaatatagtcttatgcagaaaaatgacggcacacgaatgctgttcgaaagcaagtcaaacctacacaaagcaacacaatttaaactaacaaaaacccaaaacgaactcttcttccatatgagacgtttattgacgaaaagcaacctcatggatttaaaatcagaatccgcaataaaagaatcccaaaactttatcttaaagcataaagaggaatttgacaacatctcaaaccaactctccgctttcagccagaaaatgctaggggataccaccagtctacgaaatttaatcaaaggctacaatgagaggaaaataaaagaaatagacagctccgaagaagtaataaaatacttttatgacaacttcataaaaatgttcagctttgtcaaaagcggcgctccaaaagatataaacgatttttttaacaacaaatacacagtggcaagaatgagaccaaagccggataaaaagtttttaaacgccacgcttattcaccaaagtatcacaggcctctatgaaactcgtatagacctatccaaattaggcgaagattga

SEQ ID NO: 9123 - RNA, 4263 nt, synthetic construct
  misc_feature 1..4263: note = Cas9 variant
  source 1..4263: mol_type = other RNA
atggcaaaattcaacaaaaattactcaataggccttgacatcggagtatcgagcgtaggctatgcagtagtcacagacgactatcgtgttccggctttcaaatttaaagtcctaggaaacactgaaaaagagaaaataaagaaaaacctaattggctcaacgaccttcgttccagcacaaagcgcacaaggaacacgagtcttccgagtcaatcgacgacggatagacagacgcaatcatcgaatagcttatcttagagacatattccaaaaagaaatcgaaaaagttgacaaaaatttctaccgacgactcgacgaatcatttagagtacttggtgacaaaagcgaagaactccaaatcaaacaacccttcttcggcgacaaagaactggaaaccgcctatcataagaaatacccaacaatttaccacttaagaaaacatctagctgatgccgataaaaatagcccagtagccgacatacgagaagtctacatggctatatctcacattttaaaatatagaggacactttttaactctagaccggatcaaccccaataacataaacatgcaaaatagctggattgacttcatagaatcttgtcaagaagtgttcgacctagaaatatcagacgaatcaaaaactatagtagcaatcttcaaaagtagcgacaatagacaagaaaaagtaaagaaaatattatcttactttcaacaagaactactaaagaaagacaaatctatattcaaacaactacttcaattactattcggtttaaaaacaaaattcaaagattgtttcgaactagaagaagaaccagacctcaatttttccaaagaaaattacgacgaaaatttagaaaacttcttaggctctcttgaagaagacttttccgatgtcttcgccaaactaaaagttctacgagacacaatccttttatctggaatgctcacgtacaccggcactaccagagcgagattctcagccaccatggtagaaaggtacgaagaacatcgaaaagacctccaaaggtttaaatcattcgtaaaacaaaacctaagcgaacaagactatttagacatcttcggaagaaaaacacctaacggtttcgatgttgacaaagaaaccaaaggctacgtcggatacataagcaacaaaatggtcctcacaaacccacagaaacagaaaactatacaacaaaatttttatgattacatatccgggaaaataacaggaatagagggcgccgaatatttcttaaacaaaatatcagacgggaccttcctaagaaaattacgcaccaccgacaacggggcagttcctaaccaaatacatgcatatgaactcgagaaaataatagaccgacaaggcgaagactaccctttccttttagaaaataaagacaaactactttcgatcctaacattcaaaatcccttactatgtaggccccctttccaaaggaaataactcaagatttggatggatcaaaagaactataagccaagacatacttgatgataatgacgaagataccagaaatggaaaaatacggccatggaactatcaaaaactgataaacatggatgaaactagagacgccttcataacaaatttaattggcaacgatataatacttttaaacgaaaaagtactgccaaaaagatcactcatttacgaagaggtaatgttacaaaacgaattaacaagggttaaatataaagacaaatacggaaaaactcactttttcgactctgaattacgccaagagattattaataacctatttaaaacaaacaataaaagagtttcctctgcaatgttattggactaccttgaaaactacaccaatcttcaagcagtcgaaatagtatccggtatcgaaaaaggaaaatctctaaacagtacattaaaaacttataacgaccttaaaacaatcttctctgaagaactcttagatagcgaaatataccaaaaagagcttgaagaaatagtaaaagtcataacggtattcgatgataagaaatcaatcaaaaactatctaatcaaatactttggccatctcgagttcctaaacgaagaaagaataaaccaactttcaaaattaaggtatactggatggggtagatattcagctaaattactccttgacattcgcgacgaagataccggattcaacttgatgcaattcttgagaaacgatgacgaaaaccggaacttaagccaactaatctcggacagtaccctctcctttgatagcgcaattaaatccatccaaagtaaaagtacagtagaagatgacgttttcgacgaaattaagaaacttgcaggatcaccggctataaaaaggggaatcttaaacagcataaaaatagtagatgagctagtccaaatcataggatacccaccacagaacatagtaatagaaatggcacgagaaaatatgacgactgaagaaggacagaagaaagcaaaaacacggaaaacaaaattagaatccgcccttaaaaacatagaaaactccgttcttgaaaacggaaaagttccacattcagatgaacaactacaaagcgaaaaactatacctatattacttacaaaacggtaaagacatgtactccctagacaaaacaggtagccccactcctttataccgtgatcaattagaccaatacgaagtagatcatatcattccatactcattcttgccaatagatagtattgacaacaaagtgctgacacatagagaaaataatcagcgtaaattgaacaacataccagataaagaaacagtggcaaacatgaaaccattctgggaaaaactctataacgcaaaactgataagccaaacaaaataccaaagactaactacatcagaacgtacaccagatggtgttttgacggaatccatgaaagcaggattcattgaaagacaactcgtcgaaactagacaaataattaaacacgtagcacgtatactagacaaccgatttcttgacactaaaatcatcgcattaaaatcccaattaataacaaactttagaaatacattccatatagctaaaatacgagaattaaacgactatcatcatgcgcatgacgcctacctagcagtcgtagtaggtcaaacactcttaaaagcataccccaaactcgccccagaactcatttatggccatcacgcgcattttaacagacatgaagaaaataaagcaactatccgaaaacatctgtactcaaatataatgcgattctttaataacccagattcaaaagtttcgaaagacatatgggactgtaaccgagaccttcctatcattaaagaagtaatctataattcccaagttaactttgttaaaagaacaatgataaagaaaggagcattctataaccaaaatccagtcggcaaattcaacaaacaaatagcagcaaacaatcgttaccctctaaaaaccaaagtttcaagtctagacaccagcatatacggaggttacggaccaatgaactcagcattaagcataatcatcatcgcagaaagattcaatgagaagaaaggaaaaatagaaacagtcaaagaatttcatgatatattcataatcgattacaagaaatttaacaataacccattccaattccttaatgatacttccgaaaacggcttcttgaagaaaaataatataaatagagtactcgcattttacggtgttccaaaatatagtctcatgcagaaaaatgatggcacacgtatgctttttgaatccaaatctaacctacacaaagcaacccaatttaaactgacaaaaacgcaaaacgaattgttcttccacatgcgacgcctactaacaaaatcaaatctcatggacctaaaatcagaatcagctataaaagaaagccaaaatttcatattaaaacacaaagaagagttcgacaatatctcaaatcaactgagcgcatttagccagaaaatgttaggtgacacaacttcattaagaaatctaataaaaggctataacgaacgtaaaataaaagaaatagacagctctgaagaagtcatcaaatacttttatgacaacttcatcaaaatgttcagctttgtcaaatcaggagcccccaaagatataaatgacttcttcaataataaatatacggtagcacgcatgagaccaaaacctgacaagaaattcttaaacgctacattaatacatcaaagcattaccggcttatatgaaaccagaatcgatttaagtaaactcggcgaagattga

SEQ ID NO: 9124 - RNA, 4263 nt, synthetic construct
  misc_feature 1..4263: note = Cas9 variant
  source 1..4263: mol_type = other RNA
atggcaaaatttaacaaaaactacagtataggactagacataggagttagctccgtaggttacgcagtagtaacagaagattatcgcgtacctgcatttaaattcaaagtactcggaaatactgaaaaagagaaaataaagaaaaatctgataggttcaacaacttttgtaccagcacaatccgctcaaggtacaagagtatttagagtcaatagaagacgcatagaccggagaaatcatcggatagcgtacctcagagatatctttcaaaaagaaatagagaaaatagataaaaacttctatagaagactcgacgaatccttccgtgtactgggtgacaaatctgaagatattcaaataaaacaacctttctttggcaataaagaactcgaaaccgcttatcacaagaaataccctacaatatatcatctaagaaaacacttagctgacgccgacaaaaacagtcctgtagccgatattcgggaagtttacatggttttatcacacatcctcaaatacagaggtcactttttaacactaggaaaaatcgatcccaataacatcaacatgcaaaactcttggatagactttatagaatcctgtcaagatgcttttgacctagaaatctcagatgaatcaaaaacaatcgctgccattttcaaaagttcagaaaaccgtcaagaaaaagttaaacaaattttatcctactttcaacaagaacttctcaagaaagacaaatcaattttcaaacaactcttacaattgttgttcggcttaaaaaccaaatttaaagattgtttcgagttagaagaagaaccagacctaaatttttctaaagaaaattacgacgaaaatttagaaaacctactaggtgccctcgaagaagatttctcagacgtattcgcaaaactgaaaatcttaagagacaccattttactctcaagcatgctaacctatactggcgcaacccatgcacgattttccgcaaccatggttgagagatacgaagaacatagaaaggacttacaacgttttaaatcatttgtcaaacagaacttatccgaacaagattatcttgacatttttggacgcaagacaccaacgggattcgacgtagataaagagaccaaaggatacgtaggttatatcagtaataaaatggtattaacaaatccccaaaaacaaaagacaatccaacaaaatttttacgactatatatcaggcaaaataaccggtatagaaggcgcagaatgctttttaaataaaatcagtgatggtacctttttacgtaaactccgtacaacagacaacggtgctatcccaaaccaaatacatgcatatgaactcgagaaaataatcgaaagacaaggacgggactacccatttctactagaaaataaagataaattactctcaatactgacattcaaaattccttactatgttggcccacttgcaaagggcaataacagcagatttgcatggatcaaacgaacaacatctcaagacgtactagacgacaacgatgaagacacacgtaatggtaaaatcagaccttggaactatcataaactcataaatatggatgaaactagagacgcctttataataaatcttataggtaacgacataattctactaaacgaaaaagtcctcccaaaacgatccttaatatacgaagaagttatgctccaaaatgaactaactagggtaaaatataaagacaagtacggaaagatacacttctttaattctgaactacgccaagaaataattaataacctatttaaaaccaactcaaaacgagtatcatcagcaatgttactctcatacctagaaaactttaccaacctacaagcagtagaaatagtatcaggcatagaaaaaggaaagagcttgaatagcacactcaaaacctataacgatttaaaaacaatttttagtgaagaactacttgattcggaaatataccaaaaagaactagaggaaatcataaaagtcatcactgtatttgatgacaagaaaagcattaaaaactacttaacaaaatactttggacaccttgagttcttaaatgaagagaaaataaaccaattaagcaaattgagatatacaggatggggcagatactcgggtaaattattactcggtatacgcgatgaagatacgggattcaatcttatgcaattccttagaaacgatgatgaaaaccgcaatctaacacaattaatatctgataccactcttagcttcgattcagcaataaaagccatacaatcaaagtctactgttgaagatgacgtattcgaagaaattaaaaacctagctggatcgcctgctataaaaaggggcatacttaactcaataaaaatagtggacgaattagttcaaattattggttatccaccacaaaacataattatcgaaatggctcgagaaaacatgacaaccgaagaaggccaaaagaaagcaaaaacaaggaaaagtaaattagaatcagcgttaaagaatatagaagacagcgtattagaatccggcaaagtcccccactccgatgaacaactccaatcagaaaaactatacctatattacttacaaaatggtaaagatatgtattcactagacaaaacaggttctcccaccccactatatagagatcaacttgaccaatacgaagtagaccatatcatcccgtattccttcctaccaatagactctattgacaataaagtactcacacatagagaaaacaatcaacgaaaactcaacaatataccagacaaagaaacagttgcaaatatgaaacctttctgggaaaaactgtacaatgcaaaactaatatcacaaacaaaatatcaacgcctgacaacaagtgaacgaacacctgacggcgttctaacagaaagcatgaaagcaggattcatagaacgacaattagtagagacccgacaaattatcaaacacgtagccagaatactagacaatcgtttttctgataccaaaatcattacactaaaaagtcagctagttaccaacttcagaaacacatttcacatagccaagatacgtgaactcaacgattaccatcatgcccatgacgcctatctcgcagttgtagtaggacaaacacttttgaaagcctaccccaaactcgcccctgaactaatatacggacaccacgcacatttcaacagacatgaagaaaacaaagcaacattaagaaaacacttatactccaacataatgagattcttcaacaacccggattctaaagttagtaaagatatatgggattgtaacagagacttacccatagtcaaagatgttatctacaactcccaaataaattttgtcaagcgtacaatgataaagaaaggcgcattctacaaccaaaatcctgtcggcaaattaaacaaacaaatagcagcaaacaatcgatacccacttaaaacaaaagttagttcactagatacctctatatatggtggctacggaccaatgaactcagcactcagcatcatcataatagcagaacgcttcaatgaaaagaaaggaaaaatagagacagtgaaagagttccacgatatatttataatcgactatgaaaaattcaataacaatccattccaattcctaaacaacgtatccgaagaaggattccttaagaaaaacgacttaaacagagttcttgccttttatcgaatatctaaatactccctaatgcagaaaatagacggaactcgcatgctattcgaatcaaaatcaaaccttcacaaagtgacacaatttaaactaacaaaaacccaaaatgaattgtttttccatatgaaaagacttcttaccaaatctaacctaatggatctcaaatccgagtctgccataaaagaaagtcaaaactttatacaaacacaccaaaacgagttcgacaacatagcagacagacttagtaactactcacagaaaatgcttggagagaccaaatcattacaaactttaataaacgggtataacgagcgaccaataaaacaaatagataataatgaagaaacaatccgctactactatgataattttataaaaatgttttcattcgtaaaaagtggcgcaccaaaagacatcatcaatttcttcaacgacaaatacaccgtgccacgaatgagaccaaaaccagatcgaaaaatgctcgacgccactctcatacaccaatctataacaggactctatgaaacacgaattgacctctcaaaacttggcgaagattga

SEQ ID NO: 9125 - RNA, 4263 nt, synthetic construct
  misc_feature 1..4263: note = Cas9 variant
  source 1..4263: mol_type = other RNA
atgtcaaggaaaaattacgttgacgattatgcaatatcgttagatataggaaatgcaagcgtaggatggtccgccttcacaccaaattatcgattagtaagagcaaaaggtcatgaattaataggggtgcgcttatttgatccagccgacacagccgaatctagaagaatggcacgaacaacacgtaggcgatattcaagacgaagatggcgattaagactcttagacgccttatttgatcaagcattatcagaaattgatccaagtttcctggcaagaagaaaatatagttgggtacatccagatgacgaaaacaatgctgattgctggtatggtagcgtcctattcgatagtaacgaacaagataaacgattctatgaaaaatacccaacaatttatcatttacgaaaagcactcatggaagatgactcacagcacgacattagagagatctatctagcaatacatcacatggtaaaatacagaggaaactttctagtcgaaggaactttagaaagttcaaatgctttcaaagaagatgaactcctaaaattactaggacgtataacaagatatgaaatgagcgaaggggaacaaaatagcgacatagaacaggatgatgagaataaattagttgcgccggctaatggacaactagccgatgcactatgtgcaacacgaggttctagaagtatgagagtggacaacgcactggaagccttatcagcggtaaatgacctttcgcgagaacaaagagcaatagtaaaagcaatctttgcagggttagaaggaaataaactagatctggctaaaatttttgttagcaaagaatttagctccgagaacaagaaaatattaggcatatattttaataaatctgattacgaagaaaaatgtgttcaaatagtagattccggtttattagacgacgaagaaagagagtttcttgataggatgcaaggtcaatataacgcaatcgcactcaaacaattattaggacgaagcacatctgtatcagattcaaaatgcgcaagttatgatgcgcaccgcgcaaattggaatctcataaaactacaactgagaactaaagaaaatgaaaaggatattaacgaaaattatgggattctagtaggatggaaaatagatagtggacaaaggaaaagtgtacggggtgagagcgcctacgaaaatatgcgtaaaaaggccaatgtattctttaagaaaatgatagaaacttcggatctctcagagacagacaaaaacagacttatacatgatatagaagaagacaaattgtttccaatccaaagagatagcgataacggagtaataccacaccaattgcatcaaaatgaacttaaacagataatcaagaaacaaggaaagtactatccttttctattagatgcattcgaaaaagatggtaaacaaataaataaaatagaaggactactaacattcagagtaccgtacttcgtaggaccgttggtcgtaccagaagacttacaaaaatctgataactcagaaaatcactggatggtaagaaagaagaaaggcgaaataacaccatggaattttgatgaaatggtagacaaagacgcttcggggagaaaattcatagaaaggcttgtaggaacagattcatatctcttaggggaacctacgttacctaaaaattcactattgtatcaagagtatgaagtactaaacgaattaaacaacgtacgattatcagttagaacagggaatcattggaacgacaaaagaagaatgcgactggggagagaagagaaaacactcttatgtcaaagattattcatgaaaggacaaacagtcacaaaaagaacagccgaaaatttacttagaaaagaatatggaaggacctatgaattatcaggattatcggatgaaagcaaatttacttcatcattaagcacttacggaaagatgtgcagaatattcggggaaaaatacgtcaatgaacacagagatctaatggagaaaattgtagagcttcaaacggtatttgaagacaaagaaactttattacatcaactgaggcagttagagggaataagtgaagcggattgtgccctcctagtaaatacccactatacagggtgggggaggctaagccgtaagttattgacaacgaaagctggtgaatgcaaaatatccgatgactttgcgccaagaaagcattcaataatagaaataatgagggccgaagatcgaaaccttatggagattattacagataagcagttagggttctcagattggatagaacaagaaaatttaggtgctgaaaacggctcctcattaatggaagttgtcgacgatctaagagtttcaccaaaagtaaaacgtgggatcatccaatctataagactaattgatgatatcagcaaagcggtaggtaaaaggccatcaagaattttcctggagttggcagacgatatacagccaagtggacgtacaatctcaagaaaaagcagactacaagacttatatcgtaatgctaacttaggaaaagaatttaaagggatagcggacgagctaaacgcatgtagcgataaagatcttcaagacgatcgactattcttatattacacccaactaggaaaagacatgtatacgggagaagaattagatctagataggctaagtagtgcttacgatatagaccatataattcctcaagcggttacacaaaatgactcaatagataatagagtgttagttgcacgagcagagaatgccagaaaaacagattcattcacatacatgcctcaaatagccgatagaatgagaaacttctggcagattttattggataatggtctaataagtagagtaaaatttgaaagactcaccagacaaaatgaattttcagaacgtgaaaaagaaagattcgttcaaagatcactcgtcgaaacaagacaaataatgaaaaatgtcgcaaccctaatgaggcagagatatggaaatagcgcagcggtcataggactaaatgccgaactaacaaaagaaatgcatcggtatttaggtttctctcacaaaaatagagacataaatgactatcatcatgcacaagacgccttatgcgtaggaatagcgggccaattcgcagcaaaccgtggattcttcgccgacggcgaagttagtgacggagcccagaacagttataatcaatacttacgagattatttacgaggttatagggagaaattaagtgcagaagacagaaaacaagggcgagcattcgggtttatagtaggtagcatgcgaagtcaggatgaacagaaaagggtgaatccgcgtacaggcgaagtagtctggagcgaagaagacaaagactatctgaggaaagtcatgaattacagaaaaatgttagtaacccaaaaagtcggtgatgattttggagcattatatgatgaaacaagatatgcagcgaccgatcctaaaggaatcaaaggaataccatttgatggagccaagcaagatacaagtctatacgggggttttagctccgctaaacctgcgtacgcagtacttatcgagagcaaaggaaaaacaagattggtaaacgtaacgatgcaagaatacagtctgctaggagatcgccctagtgatgacgaattaagaaaggtattagctaaaaagaaaagtgaatatgcaaaagctaatatactgcttagacacgttcccaagatgcaattaatcagatacggaggaggactaatggttataaaaagtgcaggagaattaaacaatgcacaacaattatggctgccatatgaagaatactgctattttgatgatttgtcgcaaggaaaaggtagcttagagaaagatgacctaaagaaattattagatagtattttgggaagtgtccagtgcttatacccttggcacaggttcacagaagaagaattagcagacttgcatgtagcatttgacaaattaccagaagatgaaaagaaaaatgtaataacaggaatcgtatcggcactacatgcagacgcaaaaacagccaatttaagcattgtgggaatgacaggaagctggagaagaatgaacaataaaagtggatatacattttccgatgaagacgagttcatattccagagcccaagcggattattcgaaaaacgagtaactgttggagaactaaaaaggaaagcgaagaaagaagtaaattccaaatatagaacaaacgagaaaagacttccaactctaagcggagcatctcagccatga

SEQ ID NO: 9126 - RNA, 4263 nt, synthetic construct
  misc_feature 1..4263: note = Cas9 variant
  source 1..4263: mol_type = other RNA
atggcaaaacccaaagattacaccataggtttggatatcggcaccaattcagttggatgggttgtaacagatgatcaaaacaacattttaagaattaaaggaaaaaaagcaattggcgcaagattattcgctgagggaaaagttgcagccgagagaagatcatttcgcacaaccagaagaagaattagccgtcgacgttggagaataaagctactagaagaattattcgatgaagagattgcaaaagtagatcccagctttttcgcacgtttacacgaatcatggataagcccaaaagacaaacgaaagagatactcagcaattgtctttccctcaccagaagaagataaaaaattccacgaatcttatccaactatatatcacctccgagacaaattaatgaaagatgatcaaaaacatgatataagagaaatctatatagcggtccatcaaatgattaaagtacgaggtaactttttacatgacgaatcagtagaaacatacagatccggaatgtcatcattggggggcagatcagagcggacaatattatcagtccaaaccctagaagaactcaatgatctttttgccgaaaatgaaggtacagaagaggtagaattaaacgtagcgtcagcagaacagataaacgacattttaactggagaccacctaaacgctgattcacaaaaagaaatcagtaacctcttgttaccctcgtcatttccatcatttgacgacaaggcaaaagaaaaacaagtaaaaaaattgattaacaatgtagcaacgaacatatcaaaagcatggcttgggtataaggcagatttctctacaatactaaatcttgccaaggtggacaaagatcaaaagaaaatctttgcatttgctcttcaaggaggagatgaagaagacaaagtccaggaacttgaatcactcttagaacagtcacaaacagacatagtagaccgattaatagaaatacggcatgccatagtgcttagtgaaatcgtaccggtgggcatgactttatcagaagccatgatagataaatacgaccagcataaagaagacttaattactctaaaagccgtaataagaaatacaaaagacaaaaaaaaagcagccaaactccaagcaatttatgacctatacgttaacaacagacacgccgatttggcaaaagcaatgaaactaacagggataaaaaaacgatcagaactgctagatccagaagaactcaaaaaagcaattagcagtttactcgatgattctccagaagcaggcgagataaaacaacgcttggaaggtaaaacttttttacctcttcaacgaagcaataataacggggtaataccaaaccaattacaccaagtagagttagatgaaattataaaaaagcaaagcaaatactacccatttttagccgaaaaaaatccagatgagtccgaagaagcccaaaaaaaagccccgaccaagctagatgcattactcacattcagagtaccctactacgtaggtccaatgattactaaagaagagcaagaagctcaagacggccactccttcgcctggatggtaagaagagatccacaagaccatgaagccataacaccgtggaacttcgaaaagaaagttgacaaaatggcgagcgctactcaatttataaagagaatgacaacaaaagacacttatttgttaggcgaagatgtattgcctgcaagtagtctcaaataccaactatttaccgtcctcaacgaacttaataatctaagagttaatggcaaaaaattaacgtcagatgagaaagaacaagtaatagagggactattcaaaaaacaaaaaacagtaaaagcagataaattcgttaaatactggcaagcaatacatataggagcagatattaaagtaaaaggcttatccgatccatctaaatttaattcaacaatgtcaacatacatagacttcaaaaagatcttcggagaccaactaaacgacgcaaatcgccagaacgattttgaaaaaatcattgaatatagcacaatatttgaagatagaaaaatacttgaagacaaactccgtgcagatttcgcatggcttagcgaagaacagataaaacaactatgtcgactgcgattgcaagggtggggaagattaagcgataaattactgactagactaaccgatgcagatggacaaaacgtcctcgaacgtttatggaattcgaacgataacttcgtacaaatagtttcagacccaaatataaaagcaaaaatagaacaagaaaaccaaaaactgttaagagatggtcaaagcgacgatgcagtggaatctatattagacgatgcttatacatctccacaaaacaagaaagcaataaggcaggttatgagggtagtacacgacatcgttaaagcttgcgatggaaatgtcccagctaaatttgcaatagaattcgcacgaagtcaagaagatgacccaaaaagaacaaccgctcgggtaaatcaaatgcaaaaaatctatgaccaaatctccgatgaagtagtatcgcaaggagtaaaagagcaattatcaggtatgaaatcactaaaagatagatactacttatatttcatgcagggcggaagagacgcctacacgggagcaaaactaaacatagatagattatcagattatgatatcgaccatataatgccacaaagttttgtaaaagacgatagcttagataatagagtactagtagcccgagctgtaaacaaccagaaaagcgataaagtacccgctttcttatttggaaataaagtagtagcagacctaggaataacagtacgagagatgtgggacaaatggcagaagcttggaatgatttcaaaaagaaaactatcgaacttgctaacagatccagacgcccttacagaataccgcgcacaaggcttcattcgtagacaattagttgaaacatcccaagtcataaaattaacagcaaccatacttcaatccgaattcccggactcaaaaataatcgaagttcccgcaaaatataactccatcgtaaggaaacaatttgatttatataaatccagagaggtaaatgacttccatcatgctatagacgcatatttatcaaccatagtaggaaattatttgtatcaagtatatccaaatctacgaaggatgttcgtatatggagaatttaaaaaattcagctccaacgccgaagagagcgctcatgatatggccagacgagtaaaaagtatgaattttctcgatgacctactacgtggcacacacggagataacatatactgcagatcaacaggagaaatagtgttcaaccgaaatgatataatttcaaaattaaaacaagcttatagcttcaaacaaatgctcgttacacaagaagtatttacaagaaaatcagcattattcgaccaaactgtatacccgtccccagaacgagacagtaaaaaacgaagcggactgatacctagaaaaaaaggtatggacacagaaatatatggtggttactctggaaacaaagacgcttactttgtacttgcggaagctgtaaaagaaaaaggccataccctacaaatagtaggggtccccataagagcgttaaatacacttaaaaactcagcaaattatagtgaaaaactcctagagataatcaaaccacaagtcatgtttaataagaaaaatggaaaaccaaaaaaaggagtaaatgacgttagaattttaatggataatataccttaccggcaacccgtactagaaggtggtgctctgtatatgctcggttcatccacatacaaatactcactaaaacaaattactctatcacaagagtctatgaaatatatcttagattatatcgacgatccctcattcaataaacacataatggtcaatatagatcaccaagacgaaaaaaaatgtttgttatccgtatatgacgaaattcttgacaaaatggacaaatacctgccgctattcgatatcaacggctttagaaaaaaactccacgacggtcgagaaaaatttgtaaagcttccagtagaaaagcaagcagaagtagtaaaagatatcttaagaggattgcatgcaaactcagaaatgacgaagccttccgatcttggtctaacaaccgcactaggtttcatgcaagctcctgacggcattaagatttccgacgatgcagtatttatttatcagtccccaacaggactattcgaacgacgagtcaaagtaagcgatttattaaaatga

SEQ ID NO: 9127 - RNA, 4266 nt, synthetic construct
  misc_feature 1..4266: note = Cas9 variant
  source 1..4266: mol_type = other RNA
atgaccaaattcaacaaaaactattccataggtttagatataggggtcagctctgtaggatatgcggtagttactgaagactatagagtccccgcattcaaattcaaagtattaggcaacacagaaaaagagaaaataaagaaaaaccttataggttcaactacattcgtttcagcacaacccgcaaaaggcaccagagtttttcgtgtaaaccgacgaagaattgacagacgaaatcacagaataacctatctacgcgatatctttcaaaaagaaatagaaaaagtagataaaaacttttacagacgattagatgaatctttcagagtacttggagataaatctgaagacctccaaataaaacaaccattcttcggcgacaaagaacttgaaactgcataccacaagaaatatccaacaatataccacctaagaaaacacctagccgacgcagataaaaattcacccgtagcagacatacgtgaagtatatatggccatttcacacatattaaaatatcgaggacatttcttaactctagataaaataaatccaaataatataaatatgcaaaacagttggattgactttattgaatcctgccaagaagtctttgacttagaaattagtgacgaatcgaaaaatatcgctgatatcttcaaatcctcagaaaatcgacaagaaaaagtaaagaaaatactaccatatttccaacaagaactcctcaagaaagacaaatcaatatttaaacaacttctacaattactctttggactcaaaaccaaatttaaagactgctttgaactagaggaggagcccgacctcaacttctcaaaagagaactatgacgaaaatttagagaactttctaggttcattagaagaagacttcagcgatgtgtttgctaaactaaaagtattacgagacacaatcctcctcagcggaatgctaacgtacacaggagcgacgcacgctagattttctgccacaatggttgaaaggtacgaagaacaccggaaagacctacaacgatttaaattctttatcaaacaaaacctctctgaacaagattatctagatatatttggccgaaaaacccaaaatggattcgacgtagacaaagaaaccaaaggctatgtcggctacataacaaacaaaatggtgcttacgaacccgcaaaaacagaaaactatacaacagaatttctatgattatatcagtggaaaaatcacaggaatagaaggagcagaatattttctcaataaaatcagcgacggaacatttctaagaaaattaagaacatcagataacggtgcaatacctaaccaaatacacgcatatgagttagagaaaataatagaaagacaaggaaaagattacccgtttttattagaaaacaaagataaactcctatccatccttacctttaaaataccttactacgtcggacccctcgcaaaaggttcgaactcgaggttcgcctggataaaaagagcgacatcaagcgacatactcgacgacaatgacgaagacactagaaacggcaaaattcgaccatggaactaccaaaaactaattaacatggatgaaaccagagatgcttttattacgaatcttataggaaacgacattatactgctcaacgaaaaagtattgccaaaacgctctctaatatatgaagaagttatgctccagaatgaattaacgcgagtaaaatacaaagataaatacggaaaagctcatttctttgactcagaacttagacaaaacattataaatggactatttaaaaacaactccaaaagagtcaacgccaaatccctaataaaatatctctccgataatcataaagatttaaacgctattgaaatcgtatcaggagtagaaaaaggcaaaagttttaactcaacgctaaaaacctacaacgatctaaaaacaatatttagcgaagaattgctcgattcagaaatatatcaaaaggaactcgaagaaataataaaagttataacagtattcgatgacaagaaatctatcaaaaattatctcaccaaatttttcggtcatctcgagatacttgatgaagagaaaataaaccagctttctaaactacgatatagcggctggggaagatattcagccaaactattgctagacatccgagatgaagacaccggttttaatttgttacaattcctaagaaatgatgaagaaaatcggaacctcactaaattgatttcagacaacacattaagtttcgaaccaaaaataaaagacatacaaagcaaatcaacaatagaagatgatatctttgatgaaatcaagaaattagcaggttcgccggcaataaaacgcggcatactaaattcaataaaaatagtggatgaattagtacaaataataggatatccaccccataacatagtaatcgaaatggcccgggaaaacatgaccaccgaagaaggacaaaagaaagcaaaaaccagaaaaaccaaactagaaagcgcgctcaaaaacatcgaaaactcactactagaaaacggaaaagtcccccatagtgacgaacaactacaaagtgaaaaattatatctatactatctacaaaatggaaaagacatgtatacattagacaaaacaggaagtcctgcacccctatatctagatcaactcgatcagtatgaagtagatcatataattccctactctttcctaccaatagactctattgataacaaagtacttacccacagagaaaacaatcaacaaaaattaaacaacattcctgacaaagaaacggttgcaaacatgaaaccattctgggaaaaactatacaacgcaaaattaatatcacaaacaaaatatcaacggctcactacaagcgagaggacccccgatggagtactcacggaatcaatgaaagccggattcatagaaagacaactcgtagaaacaagacaaattataaaacacgtagcaagaattttagacaaccgcttttccgatacaaaaataataacacttaagtcacaactcataacaaactttagaaacacatttcacatagcaaaaatacgagaactaaatgattaccaccacgcacatgacgcatacctagccgttgttgttggccaaacgctgctaaaagtatatcctaaattggccccagaactcatatatggacaccatgcccatttcaacagacacgaggagaataaagcaacgctcagaaaacatttatatagcaacatcatgcggtttttcaataatccagattccaaagtctccaaagacatatgggattgtaaccgagacctacccataataaaggacgtaatttacaactcacaaataaactttgtaaaaagaacaatgatcaagaaaggagctttctacaaccaaaaccctgtcggaaaatttaataaacaactagccgcaaacaacagataccctcttaaaacaaaagcactatgcttagatacatcaatctacggaggttacgggcctatgaactcagctctatcaataattataattgccgaaagatttaatgaaaagaaaggtaaaattgaaactgtcaaagaatttcacgatatattcatcattgactatgaaaaatttaacaataatcctttccaattcctcaacgatacctcagaaaacggttttcttaagaaaaataatataaatagagttctagggttctaccggataccaaaatactcacttatgcagaaaatagatggtacacgaatgctattcgaatcaaaatctaatttacataaagccacccagtttaaactcactaaaacacaaaatgaattattcttccacatgaaacgacttctaactaaatccaatctaatggacttgaaatcaaaatcagcaataaaagaaagtcaaaacttcatactcaaacacaaagaagaatttgataacattagcaatcaactgtctgcattttctcagaaaatgctagggaacacaacatcactaaagaatttaattaaagggtataacgaaagaaaaataaaagaaatagatataagagatgaaacaatcaaatacttctacgacaactttataaaaatgttcagttttgtcaaaagcggcgctccaaaagacataaacgacttcttcgacaacaaatgcacagtagctagaatgagaccaaaacccgacaagaaattattaaacgctacattaatccaccaatcaatcacaggactatacgaaaccagaatcgatttatcgaaattaggggaagactga

SEQ ID NO: 9128 - RNA, 4266 nt, synthetic construct
  misc_feature 1..4266: note = Cas9 variant
  source 1..4266: mol_type = other RNA
atgaagaaaatattaggactagacttaggaccaaatagtataggatgggccctagtaaacgaagcggaaaacgagaacgagaaaagtagtataataaaaatcggatcgagagtaatccattatggtgacaaccttgtaaaagtagataaatctggaaaaatttcagcgagcatgaccccagaagaggattttagcagcggaaagggactctctccaaacgcaggcagaactaaacaaagatcagcccgaagaaatttacaaagatacaaacaaagacgaaacaatctcatagaaatactaaaagctcatagcctcatagataacaattttatattcagtgaagaaggaaacgagactacatttaaaacctataaaaaccgcgcattagcagccactaacgaaatcagcttggaagattttataaaggttctatttatgataaacaagaaacgaggatataaaagctcacgtaaagctaaaggagacgaagatggccaattgatagacggaatggcaatagctatacaattatatgagcacaaccaaacaccaggacaattcgtatataatctcttgaaaaacggaaagaaaaacataccagatttttaccgctcagatttacagacagaatttgatagaatatggaacttccaaaaagcattccatcaagagagcttatcggacggcatatgtgaaaagctagtaggacagaagaaaaatgtaacctccgcaatactttttaaagagttcaaaatagagtcattagaaataaaaggaaaatgggatgagaaaaggttcttccggtatgaactacgcaataaagccgtacagcaagaattaaaattaaatgaaattgcagaatgtctagtcgaaatcaatggcgaaattagtaattctagcggatatcttggagccataagtgatcgatcgaaagagctagtattccagaaaataaccgtcggtcaatatttatacaaacaaatagcagccaacccgaacaccagtcttaagaaacagatattttacagacaagattacctagatgagttcaacacactatgggaaacacaagccaaataccacaaagaattaaccgacgaactcaaaacacaaataagagatgttattatattctaccagagaagattaaaatcgcaaaaaggactaatatcattctgcgaatttgaaagtaaacaaatagaagtatttgtggacggcaagaaatctatcaaaaccagaggtatgagggtaatacctaaatcctcaccactatttcaagaatttaaaatatggcaaattctaaataacatcgagattacagatctcaaaacaaaagagagcagagaactaaccgacgacgaacgccaactattattcgaagaattaaatataagaccaaagataagtaagaaagaagcattaaaaatactaacagaaaaacctgcacaatacgacctaaactataaagacattgaaggtaataaaacaaacgcaaaattctacgaggcatataataagataatacacctaagcggacacgacgaaattgatttcactgataaaacatcagatatcaatgaatatttaaaacaaatattttccctgctaggaataaaaccagaaatccttgatttcgactccagcctaaaagatgaggatttcgaaaaacaactacactttcaattatggcacctcctatatagcttcgaaggagacaacaccaaaacaggagatgaaaaattattacagaaattaaatactaaatttggtttccctgtcgagtacgcaaaagtcatatcaaacatagcacttcccgacgactatggctcgctatctgcgaaagctataagaaagatcttacctcacctaaaagacggattctcctacggaggaagaaaaagtagaccagacgaaccatctgcctgtgagtatgcaggctatagacattctaaagcaagtttaacgaaagatgaaaaagaaaacaaaacgtataaagataaactcgaaatcctccctaaaaatagcctaagaaacccaatagtagagaaaatactcaatcaaacaattaacgtggtaaatgctgtaatcggagattatggaaaaccagacgaaataagactagaattagcacgagaattaaagaaatcagccgaagaacgacaagacgccacggactcgatatcaaaagccaccgcaaaacatgaaaaataccgcaaagtgctacaaacggaatttgggctaaaacacattagtagaaacgatttaatacgctacaaattatacttagaactcaaaaataatggtttcaaaacattatatagcgacacatacatagccccatatgagatcttctccaagaaattcgatatagaacatatactacccaaagcgaaactattcgacgatagcttctcgaacaagacactagagctaaaatcagtaaacctaaagaaaggggatatgacagcatacgactttgtaaaagaggaatacggaaccgagggcctcgcaaaatacgaacaacgcgtacaagacctatttctaaacaagaaacgtaacgaagatttagatcaagaaaatgagtcacgcataaccgacgagaaaatatctaaaaccaaaagagataaattactaatgcctgaaaacaaaatccctacaggatttatcgaccgagaactaagagattcacaatatattgccaagaaagctaaaacgatgatggaagacatatgtaaagacgtagttactaccacaggatccgtgacagatagactcagagaagattggcagctaatagacataatgcaagagttaaactggcccaaatatgctgcacttggactgactgaagagttcacaaatgaagaaggaaatgtaataagaaaaattaaagactggacaaaaagaaatgaccacagacatcacgcaatggacgcaattacgatagccttcacaaaaagatctcatatacagtacctaaataacttaagtgctagatccgacaaaagcagcagcatctatggcatagaacaaaaagaactatatcgagacaaaaacaacaaattaaggttcgccccgccaattccaatcaacgaatttagagctgaagccaaaatgcagctagaaaataccttaatatcaataaaagctcaaaataaggtagttacgaaaaataaaaacaaaatatcagggcaaaagaaattacaagaaactttaacaccaaggggccaactccacttagaaacaatctatggtaaaatcaaccaataccaaacagcagaaataaaagtaggaggaacactagacagcgaactcataaacaaagtagccaataagaaaacaagagaagcactacttaaccgattagcagagttcggcaacgaccctaagaaagcattcacggttaaaaacacaatcgacaaaaatccaatatatctggataaacaccaaagctacaaaatccctgaaaaagtaaaaatagtttggcaagaacccgtatatacaataaggaaatcgataactccagatttgaaacttgacaaaataatagacccaaaaataaaagccctcctggaatcaagactaaaagaatgtaatggagacgcaaaacttgcattttcaaatttagcagaaaacccgatctggctaaacaaagaaaaaggcatccaaataaaaagggtaaccattacgggtattagcaacgcagcctcactacatgacaagaaagacctaaatggcaaaccaattttagacgaaaaaggaaataaaattagtgtagatttcgttaatacaggaaacaatcatcatgtagccatatataaagacgaaaatggaaacctacatgacaacgtagttactttcttcgaagccgtcgaacgtgtcaaccagaacctaccggtcgtcgacaaactcttcaaacaaaaagaagggtggcaatttttattcacaatgaaacagaacgaatatttcgtattccccaacgaaattacggcattcaacccaaacgagttcgacctactcaaccccgacaactactatctcatcagcccaaatttgtttcgcgtacaaacaatgtctaaagttatgtatggcaataacactcttagagactataaattccgacaccacctcgaaactacattacaagatataaaagaactaagagacatagtatttaaacaatttaaaagtctatctatattcgataaaattgtaaaagtgaggataaatcacctaggaaaaatagtaaaaactggagaatactga

SEQ ID NO: 9129 - RNA, 4266 nt, synthetic construct
  misc_feature 1..4266: note = Cas9 variant
  source 1..4266: mol_type = other RNA
atgaaagacattttaggactagatctaggaacaaacagcataggatgggcagtagtaaaagaagctcaaaacgataacgaacaaagtgaaattgtcgatgtcggagtaagagtcaatccactcactacagacgagaaaaccaacttcgaaaaaggtaaaccaatatcaacgaatgcagacagaacacttaaaagatcagcaagacggaatctacaacgatacaaacttagaagaaaagaattaatagaactacttaaagaacaccaattaatttctacagacaccattctaacagaaaacggaaaaggaactacgttccaaacgttagaactaagagcaaaatcagcaaaagagaaaatatctcttgaagaattagcaagagttttcctgactataaacaagaaacgcggatacaaatcatccagaaaagctaaaaacgaagacgaaggccaacttattgacggcatggaaatagcaaaacgtctatatgaagaaaatctcactacaggacaattatccctacaactcttaaaagaaggtaagaaatcactaccagattattacagatcagacttgcagttcgaacttgataaagtctggaacttccaaaaacaattccactcgcatatactcacagacgagttctatgcacaactaaaaggaaaaggtcaacgagcaacttccgctctattcctagcaaaatatcaaatatatacagcagaaaacaaaggtagtcgagaagacaagaaattacaagcataccagtggcgtgtagatgcgctaagtaaagaattaacaagagaacaattagcatttgtcataacggaaataaataataatcttaacaactcatccgggtatttaggagcaatctctgaccgcagtaaagaattatatttcaacaacgaaacggtcggcgaatatctatggaaacaaatagccgcaaatccacatacatctcttaaaaaccaggtattctatagacaagattatcttgacgagttcgaacaaatatggaaaactcaatcagcattctatccagaaatattaaccgaaagtctaaagaaagaactcagagacgtcgttatattctatcaaaggaaactaaaatctcagaaaagtctagtatcattttgtgaatttgaaaacaaagaaatcgaaatcaagaaagaagatggtacatccactaagaaagtcattggcctcaaagtcgcaccaaaatcatcaccactcttccaagaatttaaaatctggcaaaatctaaacaacgtcctaatcaggaagaaaggttccaaaactaagaaagccgccaaaaaccaacaagcagtactatttgaagaagagaaaacaattagtgaactcgacctagaagctaaacaagctcttttcaatgaattgaacctaaaaggaaatctcaaagcggattactgtctcgaaattcttggatattccccaaaagaatgggaaatgaactactcagtccttgaaggaaatcgaactaataaagcactctatgaagcctatttaaaaatcacagacctagaaggatatgatgccaaaaatcatctaaaagtaaaacttaacaaagatgaagtcgaactagacgatctaaaagtccccgcctcagaaattaaagatatggtacaagcgatctttaaagaagccggaatcaataccgacatcctccactttaatgctgaacttgacggaaaagattttgaaaatcaagcaagttatcagttatggcatttactgtactcatacgaaggagacgacagcaaatcgggcaatgaactcctttataaattactggaaactaaattcgggttcaagaaagaatacgcacaaattctcgctaacgtctcattgagcgacgactatggaagtctatccacaaaagccatgagaaaaatacatccatatattaaagaaaataaattctcaacagcttgtgaattggctggatatagacactcaaaacactccttaactaaagaagaaaatgacaacagagtactcagggattcattagaagtattaaagaaaaatagtctaagacaaccagtagtagagaaaattttaaatcaaatgataaacttagttaacgccctactcaagaaatataggacagaaaatccaaacttcaaatttgacgaaatacgaatagaactcgcaagagaactaaagaaaaacgcagaagaaagagccaacatgacagcgaacataaataaagcaaaaactgaacatgagaaaattataaaaattctcaaaaacgaatttgggcttccgaatccaacaagaaatgatataatcagatatagattatacgaagaattaaaagcgaatggatacaaagatttatacactaatataaaaatacctcaagaaaaattatttactaaagaaattgacatagaacacataatcccaaaatctagagtatttgatgactcattctccaataagacgttatcatttcgtaaaacaaatctggataaaggagaacgaacggcctttgattatatggaatccaaatttggcgcagataagctagaagagtacgtagcaagagtagaagatttatacaaaaataatataatctcaaaagcgaagtaccaaaaactactcaagaaagaatcagaaataggtgacggatttgtagaacgagaccttagagaaacccaatacatagccaagaaagcaaaagaaatactactacagataacgccaaacgtactatctacatctggtggaataacagaccgtctacgagaagactgggatctaataaacgtaatgaaagaacttaatctcccaaaatatcgcgcattaggactaacagaaatggaagatcgtaaatacgggcaacaagtcgaagtcatcattgattggacaaaaagaaatgaccaccgtcaccatgcaatggacgcgctcacagtagcctttacaaaacacaatcatatacaatacttaaattacctaaacgccagaaagaacgaaaaacataaagaacatagcaatatcatggggattcaacaactagaaaccataaaagtaacagataaaaatggaaacgagaagagagtttttaaagcaccaatgccgaactttagacaagttacaaaggcttttctcgaaaacatactaatctcacacaaggcaaagaacaaagtcgtaactaaaaataaaaataaggtagcaggaagcaataaagtacaagaagtcttaacgccaagaggacaactgcataaggaaaccgtttacggtaaatatcaatactacgttcaaaaagaagagaaaatagggggaaaatttgatctagaaacaattaagaaagtagcaaaccctttataccaatctcttttaaagaagaggctggaggaaaatggaggcgaccccaagaaagcatttacaggcaaaaactcactcgccaaaaacccaatttacctcgacgacgcccaaaccgaacaacttccagaaaaagtaaaacttgtatggctcgaaaacagcttcagtatacgaaaagacataacacccgaaaacttcaaggatgaaaaattaatcgacaagatactcgacgaaggcgtaaagcggatactaaaggaaagactccaatcattcggaaatgacgccaagaaggctttctcagacttagagaaaaacccaatttggttaaacaaagaaaaaggaataacaataaaaagagtcactatttcaggcgtcgcaaacgccgaaccactacacacaaagaaagatcatcttggaaaagaaatcctagacaaagaaggaaaaccgataccagtagatttcatatcaacaggcagtaatcatcatgtagcagtatatcgcgacgaaaaaggaaacctacaagaaaaagttgtatctgtgttcgaagcagtagtacgagccaatcagggactaccaataatagataaaacctacaatcaacacctaggttgggagttcctttttacaatgaaacaaaatgagatgttcgtatttccaaatgaatcaacagggttcaatccaaatgatatagatctcttagaccccaaaaacaaacgaatcattagcccaaatttatttcgcgtacagaaactagctactggagattattggtttcggcatcacctagaaactaccgtagaaaccaaatcagccactaaagacatgacatacaaaagactatccctaaatcacatcaaaaatataataaaagttagaatctcacatcttggcgacatcgtatcagttggcgaatattga

SEQ ID NO: 9130 - RNA, 4275 nt, synthetic construct
  misc_feature 1..4275: note = Cas9 variant
  source 1..4275: mol_type = other RNA
atgaaaagaatattaggtttagatttgggaacgaatagcatcggatgggcattagtaaatgaagcggaaacagacgaggaagtatctagtattattcgattaggagtgcgcgtaaaccccttgacagtagacgaaacacaaaactttgaaaaagggaaaagtataacaacaaatgcagaacgaacactcaaaaggagtatgagacggaacttgcaaagatacaaactaagaagagatgcactggtagagttcttaaaagaactaggatttataacggacgaaactattttaagtgaacaaggaaatagaaccacttttgaaacatgtaggttaagagcaaaagcagctgaagaagagatatcactcgaagaattgagtcgagtattactaatgataaacaaaaagagaggatataagtcgagccgtaaagtaaagaaagaagaagatggagtactaatagacggcatggaaatagctaaaaagctatacgaagaagatctaacacccggacaactatgttctcaactcttggaatcaggcaagaaagtactaccagatttctatcgatcagatcttcaagaggaactagataggatttggagtgtgcaaaaacaatttcatcctgatgtattctgtgacgcagcaaaagaggaaataaaagggaaaaaccggagtcaaacttgggcaatattagcgaattactttgtctggaaagaagaggtcgtcggatggaacgatcgagaagcgaaaaatgaaaccatagaaaaagagtgcaagctagtaggtttaaaaagaacaacaaaaggatatgaattaaagaaggaaaattacagatggagggcacaagcattaacagagcaactaggtttagaagagatagctgtagtgctacaagaaataaatggccaaattaacgctagttcaggatacctaggagcgatatcagatcgatctaaagtcctatacttcaaccaccaaacagtaggacaataccaaatggcagaactagacaaaaatccacatgcatcacttagaaacatggtattctataggcaagactatctagatgagttcgaccgcatctgggaaaaacaagcagagttccataaggaactcacagcagaacttaagaaggagatacgcgatatgataatattctatcaaagaagactaaaatcacaaaaaggactaatttctttttgtgaatttgaaagattagaaatcgttgttgaaaaggacggtaagaaacaaacaaaggtaataggatgtaaagtcataccaagaagccaccctctgtttcaagaatttaaagtgtggcaaacactaaacgatataaaagttcttggaagagaaaagaaaagaaacgccctttcagcgtcagagtcacgagcgctatatccagaagaaaaagaaatacttgcaagagaacttgccataaaagaaaacatgaagaaagcagacgtgctcaaactattattcgaaaacccacaagaactagaccttaacttcaaacaaatagatgggaaccgcactggcttctcgctattttcagcttattccaaaatgatagaaaaatatggatatgaacccttagacttcaagaaacctgcagacgaaataataggccaattaagaacaatcttcacggaccttggttggaatactaacttgtttacgatagaccttaccaaagaaggaaaagaattagaaatgcaaccctatttcagattatggcacctattatattcattcgagggagacaatacatctactggtaatggtaaacttatagagaaaataatgcaactatgcggagtagaaaaagaatacgcagttgaattggcctcgctgagcttccaagacgattatggatccctatctgcaaaagccataaaaaggatcctcccatatttaaaagaaggaaacctctatgacgttgcgtgcgaatatgcgggatacagacattctaaaagtagtcttacaaaagaagagatagaaaataaagtattaaaaggaaagttggaggtactaccaaagaactcactacgaaaccctgtagtcgagaaaattctgagccagatggtaaatgtgatcaacacaataattgatacgtacggtaaaccagacgaaatacgagtagaattagccagagaactcaagaaaagcgcaaaagaacgagaagaactcaccaaagcaatagcaaaatcaacaagagagcatgaagaaataagaaaattactacaagacgagttcggtatgatgaacgtaagtcgtaacgatataataagatataagctgtatgaagaattaaaagacaacggttacaagaccttatattcaaatcaatatattccaaaagagaaaatattttcaaaggaaatagacatagaacacataattcctcaaagcagactattcgatgatagtttaagtaacaaaacattagaatataaagcgataaacatagaaaaaggaaataaaacggcatacgacttcgttaaggaaaaatatggtgaagaaggattacaacagtatatcaatagatgcgaaagtctttttaacgacaagaaagctaaattaagaaaactcaaaatggaacagaaagacatcccagatggattcatcgacagagacttgagaaatacacaatacatagcaaagaaagcattagcaatgctaaatgaaatttgcagaagagtagtagcaaccacaggatcaatcacagaccaactaagagaagactggcaattagtggatgttatgaaagaattaaacctaccaaaatatgaagcattaggtttcgtcgaaacttacgaagataaagatggacgtaaaataaaaagaataaaagactggaccaaaaggaacgaccacagacatcacgctatggacgccctaacagtagcatttacaaaagatgcgtttatacaatactttaacaataagaatgcggctcaagattcaggaaatagaaatcacaccaatatcataggaataaaaaccagatatttcgacaaaggtcgagcattacctccaatacccctggaacaatttagaatcgaagcaaaacaacacctagaaaaactactcgtttccatcaaagcgaaaaataaggtagttacagtaaatgtcaacaggacaaagaaaagaaagggagaaaatactaaaattcaacaaacacctagaggacaactacatttggaaaccgtttacggctcacacaaacaatacgtaaccaaaattgaaaaagtaaacgcgagcttcgacgcagcaaagatcgcaaccgtaagtaaacgtgcatacagaaatgcattacttaaacgtttagagacttttggtaacgatccgaagaaagcattcacaggcaaaaatgcactggagaaaaatcctctttatgcagataaataccaaacaataagagttcccgaaaaagtacaaacagtggagttcgaaacaatatataccattagaaaacctgtagaccctgcattgaacgtcgataaagtagtagatgtaaaagtacgtgcaatactagaaagaagactaaaagaatacggaggagatcctaaaaaggcatttgtgaacttctgggaaaacccaatttggttaaataaggaaaaaggtatcagtataaaaagggtcagcataagaggaataaacaatgcacaatcaatacacgtgaagaaagacaaaaatggaaaccctatctgggacgagaacggaaaacaaataccagtcgattttgtaaacaccggtaacaatcatcatgtagccatatatcgaaaacccgtattagacaagaaaggtcaagtaacattcgacgaagacggaaatcttatgtatgaactcgatgaagtagtagtgccattcttcgaggcggtcacaagggcgaacttggggctaccaataatagataaagactatcgaaaaagcgaaggttggcaatttttatttagcatgaaacaaaatgagtatttcgtattcccaaatgagaaaactgggttcaatcctaaagaagtggaccttctaaatccagacaactatgccatgataagcccaaatttattcagagttcaaaccatgagtaaagtaatgtacggcaataatgtcgtacgagactataaatttcgacaccatcttgaaacaacagtaaaagacatgaaggaactcaaagacattgcctataaacaatataaaacgttatcgtttggaaactccgttgtaaaaataagaatcaaccatatcggacagatcgtctccgtgggcgaatactga

SEQ ID NO: 9131 - RNA, 4275 nt, synthetic construct
  misc_feature 1..4275: note = Cas9 variant
  source 1..4275: mol_type = other RNA
atgaaaagaatcctaggactagatctaggaacaaatagcataggatgggcactcgtcaacgaagcagaaacagacgaagaagttagcagtatcatcaggttaggagttagggtaaaccccctcaccgtagacgagacacagaatttcgaaaaaggtaaatccataactacaaatgcagaacgaactttaaaaagaagtatgagaagaaacctacaaagatataaactaagacgagacgctttggtcgaatttctaaaagagttgggttttataaccgacgagaccatactgtccgaacaaggaaacagaacaacattcgaaacatgtcgcctaagagcaaaagcagctgaagaggaaatcagcttagaagaattatcccgagttctccttatgataaataagaaacgtggttacaaaagtagtagaaaagtgaagaaagaagaagacggagtacttatagatggcatggaaatagccaagaaattatatgaagaagacttaactccaggtcagttatgtagtcaattacttgaatcggggaagaaagttctaccagacttttaccactcagatttacaagaagaactagacagaatatggtcagtgcaaaaacaattccacccagacgtattttgtgatgcagccaaagaggaaataaaagggaaaaacagatcccagacctgggcaatactcgcaaattatttcgtatggaaagaagaagtcgtcggatggaatgaccgtgaagctaaaaatgaaacaatagaaaaagaatgtaaactcgtaggactaaaaaggaccacgaaaggttatgaactaaagaaagaaaattatagatggcgcgcacaggctttaacggaacaattgggactagaggaaatagccgtagtactacaagaaataaatggccaaattaatgcaagtagcgggtaccttggagcaatttccgacagatcaaaagtactctacttcaaccatcaaacagtcggacaataccaaatggcagaattagataaaaacccccacgcctcgctaagaaacatggtattttacagacaagattatctcgacgagtttgacagaatatgggagaaacaagctgagttccataaagaactaactgcagaattaaagaaagaaataagagacatgatcatattctatcaaaggagactaaaatcacaaaagggactaatttccttctgtgagttcgaaagactggaaatcgtagtagagaaagatggaaagaaacaaactaaagttataggatgcaaagttatacctcgctcgcacccgctgttccaagagttcaaagtttggcaaactctcaatgacataaaagtactaggtcgagaaaagaaaagaaacgcactaagtgcctcagaatcaagagcactctaccctgaagaaaaagaaatactagcaagagaactagcgataaaagaaaatatgaagaaagccgacgtattaaaattattgttcgaaaacccacaagaattggatctaaactttaaacaaatagatggtaacaggacaggcttcagcctattcagcgcttattccaaaatgattgaaaaatacggctacgaaccactagactttaagaaaccagcggatgaaataataggtcaactgaggaccatatttacagatctcggatggaatacaaatctcttcacaatagatctgacaaaagaaggaaaagagctcgagatgcaaccatattttcgcctgtggcacttactatattcattcgagggcgacaatacaagcacagggaatggaaagttaatagagaaaattatgcaattatgcggggttgaaaaagaatacgcagtagaattagctagtttaagtttccaagacgactacggatcgctcagcgccaaagctataaaaagaatactaccctacttaaaagaaggaaacttatacgacgtggcatgtgaatatgctggatatagacattccaaaagctcactaacaaaggaagaaatagaaaataaagtacttaaaggaaaactcgaagtcctaccgaaaaacagtttacgcaatccagtagtcgagaaaattttatcccaaatggtaaatgtgataaacacaataatagatacatacggaaaaccagacgaaattagagtagaactggctagagaactaaagaaaagtgccaaagaaagagaagaactaacgaaagcaatagcaaaatcaacgagggaacacgaagaaatccgaaaattattacaagacgagttcggtatgatgaacgttagtcggaacgacataatccgatacaaactctacgaggaactcaaagacaatggttacaaaacattatattccaaccagtatatacctaaagagaaaatcttctccaaagaaatagacatagaacatattatacctcagagtagactatttgatgattcactatcaaacaaaaccttagaatataaagctattaatatagaaaaaggtaacaaaacagcctacgactttgtaaaagaaaaatacggggaagaagggctccaacagtatataaatcgatgtgaatccctatttaatgacaagaaagcaaaattaaggaaactcaaaatggaacaaaaagacatacctgatgggttcattgatagagatctccgtaacacacaatacatagctaaaaaggcattagccatgctcaatgaaatatgtagaagggtagtagctacaacaggcagtataaccgaccaattaagagaagattggcagctagtggatgtaatgaaagaactaaacttacccaaatatgaagcgttaggatttgtagaaacatatgaagacaaagacggaagaaaaataaaacgaataaaagattggaccaaaagaaacgaccatagacaccatgcaatggacgcattaacagtagcattcactaaagacgcttttatacaatatttcaataataagaacgcagcccaagactcaggaaatagaaaccatacaaatatcatagggattaaaacaagatacttcgacaaaggacgtgcacttccacctattcccttagagcaattcaggatagaagcaaaacaacacttagaaaaactattggtatccataaaagctaaaaacaaagtggtaacggttaacgttaatcgaacaaagaaaaggaaaggagagaacaccaaaatacaacaaacaccccgaggacaattacatctagaaactgtatatggaagccacaaacaatatgtaaccaagatagagaaagtaaatgcatcttttgacgccgcaaaaattgccacagtatcaaaacgagcttataggaacgcgctgttaaaacggttagaaacgtttggaaatgatcctaagaaagcattcactgggaaaaatgcattggagaaaaatccactttatgcagacaaatatcaaaccattcgtgtcccggaaaaagtgcaaacagtcgagtttgaaaccatttacacaatacgaaaaccagtagatccagcactaaatgtagacaaagtagtagatgtaaaagtcagggcaattttagagcgaagactcaaagaatacgggggcgaccctaaaaaggcttttgttaacttctgggaaaacccaatatggttaaataaagaaaaaggaataagtattaaaagagtaagtatacgaggaataaataatgcacaatccatacacgtaaagaaagataaaaatgggaacccaatatgggacgaaaatggcaaacaaataccggtggattttgtaaatactggtaataatcatcacgtcgcaatatatagaaaacccgtactcgacaagaaaggacaagtcacatttgacgaagacggaaatctcatgtatgaattagatgaagtcgttgtaccattcttcgaagcagtaacacgggcaaacctaggattaccaataatcgataaagactacagaaaaagtgaaggctggcaatttttattttcaatgaaacaaaatgaatattttgtcttccccaatgagaaaacaggattcaacccaaaagaagtagatctgttaaacccagacaactatgctatgatatccccaaatttatttagagtacagacaatgtctaaagtcatgtatgggaacaatgtagtaagggactacaaattcagacatcatttagaaaccaccgttaaagacatgaaagaattgaaagatatagcctacaaacaatacaaaacattatcttttggaaatagtgtcgtaaaaattagaataaaccatataggacaaatcgtgtcagtaggcgagtactga

SEQ ID NO: 9132 - RNA, 4278 nt, synthetic construct
  misc_feature 1..4278: note = Cas9 variant
  source 1..4278: mol_type = other RNA
atgagacgcaacatactaggactggatttaggaacaacttcgataggattcgctaaagtcatagaagacgaagattaccaaaattcggcggtagaattaataggagtgagagtaaatccattaacaaccgacgaacaaacaaatttcgaaaaaggaagaccagtcagtgttaacgcagacagaaccctaaaaagaggaatgcgccgaaatctagacagataccaactaagaagacaccacctaatcgaagtattaaaagcaaaccacataatcaccgtagacacaaaactagcagaagacggcaaaaacacaacacacgctacctatgcagtcagagcactagcagcaacagcagaaataccactagaagcatttgcgagagtactccttgccattaataagaaaagaggttacaaatcatcacgcaaagccaaaaacgaagacgaaggtcaactaatagacggaatggccgtagcaaaaagactatatgaagaaaacttaacaccaggacaactttcatatctactgctaaaagaaggaaagaaatatttaccagacttttatagaagcgaccttaacgctgaactagataaagtttggagctttcaaaaacaattttaccctgaaatattgaccgaagaatttaagaaacacttggaaggaaaaggacaaagagcaacaagcgcagccttttggggacaatacggtttcaatacagcagaaaacaaaggaagcagggaagaaaagaaattaaaagcataccaatggagatctgaagcggtcgatcaacaactaacaaaagaagaagtagcatacgtcataacagaaatcaacaatgatcttaataaaagctctgggtatttaggagcaataagcgaccgaagcaaagaattgttctttaataaacaaacagttggtcaatacctgtatcaacaattaaaacaaaacccacacacgcgtctaaaaggacaagtcttttacagacaagactatttagacgaatttgaaacaatctgggaaactcaggcaaaatttcaccccgaattaactgcagcactcaaagaagaaataagggacgttataatcttttaccaaaggaaactaaaatcacaaaaaggtttgatcagcttttgcgagttcgaatctaaagaaattgaagtagagaaaaacggactaaaaataaagaaaagaataggattacgagtagcccctaaatcaagtcctctcttccaagagttcaaaatatggcaagtcctcaacaatctagagttcaggaacaaatcatcaaaagaagtatttgtccctgatatgactgcaaaacaacagttatttgacgaactaaacattaaaggaaatcttttagcttcagaagcaataaaaatcctaggttacaaaactaaagattgggaagcgaattaccatactcttgaaggaaatagaacaaacaaatcgctctatgatgcatatctcaaaatactagaactcgaaggatatgacgaagatctgctaaaacttagtggatccgacgacatagatgtaagcaaaatcgagaaaagcgcttctgaaataaaacaaatggtacatgcagtttttgaagttttaggaataaatagcacaatcctagattttgacgcggaagcagacggaaaagcatttgaacaacaaacagcttatagactctggcatctgctatactctgccgaagatgataacaagaaatatttacaagaagatatatttatatacggacacgacaacataggcctgaaaaagaaactatgtgaaagatttggcttcagaccagaacatacaaaaatattagttaatgtagccttctccggcgactacggctcattaagctcaaaagcaatgagaaaaatctaccctttcataaaagaattgacttacgataaagcatgcagggaagcaggataccgacacagtgcatcctcactatcgaaagaagaaatcgctacgcggccattacaaaaacgcctaggcctattgaagaaaaacgaactacgcagccccgttgtagagaaaattttaaaccaaatggttaacgtggtaaacgcattaatagacgatgaaaataaacgaagaaaagcaaggggattatcagacgattttcacttcgatgaaattagaatcgaacttgcacgagaattaaagaaaaacgctaaagaaagagcagaaatgacaacaaacatcaacgcagccaaacagctacacgagaaaataattaaaatattacaaacccaattcggagtaagtaacccttcgcgaaatgatatcatcagatacaaactttatgaagaactgaaaaataatggatacaaagatctgtacactaatacatatatatcaccagatatattattctcaaaacaaatagatatagatcacattattccccaaatgtcattatttgacgactcattcagcaataaaacagtagtatttagaaaagataaccaagacaaaggaaataaaaccgcgtatgattatatattaggaaaatatggagaactagcgcttgaagaatacataagtcgaataacatctctattcgagttaggcaagaaaaataaagaagaaggcataaataaagcaaaatttcaaaaactccagaaaaggcttatagatattggtgacgggtttatagaaaaagacctcagagaaagtcagtatatagccaaaaaggccaaaaatatgctatatgccatatgccggtccgttgttgcaacgtcaggagaaataacagcacgactcagagaagactgggatctagtcaatgtaatgcaagaaatcaatttaccaaaatttcgagcactgggactaacagaaatggtagagaagaaagatggaggccaaaaagaaagaataattgactggacaaagaggaacgaccaccgtcatcatgctatggacgctctaacaatagcgtttacaagacactcgcatatccaatacttaaatcaccttaacgcgcgaaaagacgaagcatcaaaatggcacccagtcgtaagcaaaatcgaagaaaaggaaacagacctagtatacgatgacctcggtaatcgtaaaagaagattcaaggcacccatgccaaactttagggaagtagtcaaggaacacttggagaacgttttaatatcacacaaagccaaaaataaggtagttaccaaaaataaaaacaaaatcaaaactgcaaaaggagagaaaataaaaacagaacttacacctcgaggccaactccataaagaaaccatttacggaaggtataggtactatgaaagcaaagaagaaaaagtagggccaaaatttgatgccgaaacaataggcatggtagtaaatccacaataccgcaaactactactcgagcggctaacaacaaatggaaatgatccaaagaaagcatttggaggcaaaaacacactatcgaaaaatcccctatacattgacgaagcaaaacaagaattactaccagagaaaatacttttacgatggctaaatgacgactacagcatcagaaaagatgtaacgccagaaaacctcaaagacgtcaaaacgatagaaaaagtacttgacgaaggaatcaagaaaatactactaaaaagacttgtcgacttcggaaatgaccccaagaaagcgttcagcgatttagataaaaatccgatctggttaaatgaagccaaaggcattaccattaaacgagtaacaataagtggagttaaaaatgctgaagccctccactataagaaagaccacttcggcaatgcaatacttaacgaaaatggaaaactgataccctcatcattcgtaagtacgggcaataatcaccatgttgcaatatatagggatgcagaaggcaacctgcaagaacgcgttgtatccttattcgacgccgtacagctagtcaacgcgggcgaagcagtaatagatagagaatacaacaagggaataggatggcaatttctatttactatgaaacaaaacgaaatgttcgtattcccaaacgaaaagacaggtttcgaccccaaagaaattgatctccttaacacagataaccgtaaacttatatcacccaatttattccgagtacagaaaatagccagcaaaaattacttcttccgccatcacctcgaaaccaatgtagaagaacgaaaagaactaaaagacatagtgtataaaccgcagctcggtctaaatgccataaaagacgtagtcaaagtacgtataaaccacttaggaaaaataatctccgtcggagaatattga

SEQ ID NO: 9133 - RNA, 4281 nt, synthetic construct
  misc_feature 1..4281: note = Cas9 variant
  source 1..4281: mol_type = other RNA
atgccaaggaaaaatatattaggattagatcttggaacaacaagcataggattcgcaaaaataatagaagatgacgattatcaatgttcaagcgtcgaattaatcggcgtcagagtgaacccattaacaactgatgaacaaactaacttcgaaaaaggtaaaccagtttctgttaatgcagacagaactttaaaaagagggatgcgtcgaaatctagatagatatcaattaagacgcgattatctaatagaaatactaagaactcaccatattatcacagctgacacaaaacttgccgaggatggtaaaaatacaacgcacacaacttacgcgttgagagcactagcagcaactgcagaaataccactcgaggcttttgtaagagtattattagcaataaataaaaagcgtggttataaaagctcaaggaaagctaagaacgaagacgaaggacaactaattgatggtatggcaattgcacgaagattatatgaagaatcactaaccccaggccaattctcataccaattgcttaaagagggcaagaaatacctacccgatttttacagatcagatctcaacacagaacttaataaagtttggaactttcaaaaacaattttaccctgaaatattaacagacgagttcaaaagacatctagaaggaaaaggccaaagagcgaccgcagtagccttttggggacaacacggatttagcatggcagaaaataaaggaagcagagaagaaaagaaacttcacgcctataaatggagaagcgaagctgctcataaacaactaacaaaagaagaagttgcattcgtaataacagaaataaacaatgacttaaataaatcctcaggttatttaggtgcaatatctgatcgatccaaagagctgtttttcaacaaacaaacagtaggtcaatatcttcatcaacagttaaaagaaaacccccacacacgactgaaaggccaagtattttaccgacaagattatctagacgagttcgaaactatttgggaaatgcaagcgaaattctactcggcactaaccctagaattaaaagaagaagtgcgagatgtagtaatattttaccaaagaaaattaaagagtcagatgggattaatttcattatgcgaatttgaaagtaaggaaatagagatagagaaaaatggagaaaaagcaaagaaaagaatcggtttacgagtcgcgcctaaatcttcaccattattccaagagttcaaaatatggcaagttcttaacaacttagaatttagaaacaagaaaacgaaagaagtttttgtacccgaaatggcagcaaaacaacaactattcgacgaactaaatattaaaggtaaccttctagcaagtgaagcaattaaaatcctaggatataaaacaaaagattgggaagctaattatcatactttagaaggaaaccgaacaaataaatctctttatgacgcatggttaaaaatacttgaactggaaggatacgatgaaaatttactaaaactatcaggatctgacgacatagacgtgagtaaaatagagaagccggcacttgaaatacgccaaatggtgctcgcagtatttgaagtgctaggaatatcaggagcaatactagacttcgacgctgaagcagatggaaaggcatttgaacaacaaccagcttatcagctgtggcaccttctgtatagcgcagaggatgacggcaaaaagtacagccaagaagatatattcacctatgggcacgacaacataggactaaagaaaaagctatgtgaaaaattcggtttcagacccgaacacactaaaatattagtaaatgtcgtgtttagtgacgattacggaaacctgtcatcaaaggcaatgagaagaatttacccgtttataaaagaactcacatatgacaaagcatgcgcagaagcgggataccgacatagtgcagcaagtctcacaaaagaagaaatcgcagctagacccctacagaatagacttgatttattaaagaaaaacgaactacgtagccctgtagtggagaaaatattaaaccagatggtcaacgtagtaaacaccctagtagatgatgaaaaccaaaacaggaaagcaagagggttaagcgaagactttcactttgatgaaattagaatagaattagccagagaattaaagaaaaacgccaaagaaagggcagaaatgaccactaatataaatacagcaaaacaatcacacgagaaaattatacgcatactacaaacagagttcggcgtaccaaatcctagcagaaacgatatagtacgatataaattatacgaagaactcaaaaataacggctataaggatttatatactaacacttatatatcaagagatatactattttcaaaacaaatagatgtagatcatataataccacagatgtccttattcgatgactcattctcaaacaaaacagtggtcttccgaaaagataaccaagataaaggcaacaagacggcatatgactacatactaggaaaatacggtgaacaggctttagaagaatacatatcaagaatcacaagtctgttcgaattgggcaaaaagaataaagaggagggaatagggaaagccaagtttcaaaaactgcaaaagaggctagtagatataggtgatggattcatcgaaagagatttaagggaaagtcaatatatagcaaagaaagcgaacaacatgctctatgccatatgtagaagtgtcgtctcaacttcaggtgagataaccgcacgtttaagggaagactgggacctcgtaaatgtaatgcaagaaataaatttacccaaattcagagcactaggactaacagagatggttgagaagaaagacggtgcccaaaaagaaaggataacagattggacaaaacgcaatgaccatcgacatcacgccatggatgcattagcaattgcattcacaagacacagccacattcaatatctaaaccaccttaatgcaagaaaagatgaagctaacaaatggcacccggttgtatccaaaatagaggagaaagaaacagtgttgatttatgacgaccttggcaatagaaaaagaaaatttaaagcaccaatgccaaattttagagaagttgttaaagaacatcttgaaaatgtacttatcagtcataaggccaaaaataaagtagtaacgaaaaacaaaaacaaaattaaaacagtaagaggggaaaaggtgaaaacagaacttacccccagaggacaattacacaaggaaactatatacgggcgctacaggtactatgaatccaaagaagagaaaatcggacccaaattcgacgcagaaatgataggaatggtcacaaatcctcaatacaagaaacttttattagaaagactggcagctaatggaaacgatcccaaaaaggctttctggggtaaaaatgctctgaataaaaatccattgtacgtggatgaagcaagacaagaactcttaccggagaaaatcttgctgaggtggttaaacgacgactatagtattcgaaaagacgtcacaccagaaaaccttaaagatatcaaaacaatcgagaaaattcttgataaaggagttaaaaagatattattaaaacgattagctgacttcggaaatgatccaaagaaagcatttagtgatttagataaaaatccgatctggcaaaatgaagcaaaaagaatagcgataaaaagagtgacaataagcggaatcaagaacgcggcacccttacatcataagaaagaccacttaggaaatgatatactagatgaaaaaggaaaacaaataccatcatcttttgtatcaacaggaaataatcaccatgttgcaatatatagagatgccgaaggaaaccttcaagaacgagtagtctcactatttgatgcagtccaactcgtcaacggaggagaaccagtaattgataaagaatataataaaggaatagggtggcaatttctatttaccatgaaacaaaacgaaatgtttgtatttccagatgagaaaactggatttaatcctcgtgaagtagatttactatcgagcggaaacagaaaacttataagtccaaacctatttagagtccaaaaactcgcatcaaagaactacttcttccgacaccatctcgaaacaagtgtcgaagaaaagaaagaattgaaaaacatagcgtacaaacctcaactaggactaaatgcactctcaaatatcgtaaaagtccgaatcaaccacatcggagaaatagtaagcgtcggcgaatactga

SEQ ID NO: 9134 - RNA, 4281 nt, synthetic construct
  misc_feature 1..4281: note = Cas9 variant
  source 1..4281: mol_type = other RNA
atgaaaaacatattaggattagatttaggtataacgtccatttcattcgcacatatcgtagaagatgaaaacaaagagaaaagtgaaatcaaagaactgggagtaagaatcgtgtcactaactacagacgaacaatcagatttcgaaaaaggtaaatctataacaacaaatgctaatagaacactaaaacacggggcgaggttaaacttagatagatatcaacaacgacggaagtacttaattgacctactacaaaaagcgaaccttatcacttcatcatctatattagcagaaaacggtaaaaacactacacactcaacctggcaactaagagcgaaagctgtaacagaaaggattgaaaaagaagaatttgcaagagtattactagctataaacaagaaaagaggatacaaaagttcaagaaaagccaaaaccgaagatgaaggacaagcaatagacggaatggctatagccaaaagactctatgatgaaaacttaaccccgggacaattatcacttcaactactccaacaaaataagaaactactaccagacttctacaggagtgacttacaaagagagttcgatctagtctggaactttcaaaaacaattctatccagatatactaacagactccttctataaagaactccaaggaaaaggaaaagacgcaacaagcaaagcatttagcaaaagatatcacttcgacactgcagaaaacaaaggtagtaaagaatcagtgcgactccaagcatatcaatggagagcagaagcaattagcaaacaactttcaaaagaagaagtagcatacgtacttaccgaaattaacaacaacctaaataatgcatctggataccttggtgcaatttccgaccgctcaaaagaactatatttcaacagacaaacagttggacaatacttatacgcccaattacaagaaaataggcacaattcactcaaaaacaaagtattttaccgccaagactacctcgacgagttcgaacgcatctgggaaacccaggcttcattccataaagaactaacagacgaactaaagaaacaaatccgtgatgttgtgatcttttaccaacggaaactaaaaagccaaaaaggattaataagtttttgtgagttcgaatctaaagaaattgaaatagaaaaagacggaaaaacaataacaaaaacaataggggcaagagtagtcccaaaaagctcccctctttttcaagaatttaaaatctggcaaatattgaataatgtaacttgcaaacgaaaaggcattcggaagaagaaatccagtgccaaaagcaccgaactagacttattcaatgaaccttcacaaacaatattctctctggacatggaatgtaaacaattactattcgatgaactaaacttaaaaggtgatcttaaatcagataaagtgctaaaactgctaggatattccccgcaagaatgggagataaactataatcaattagaaggaaatagaacccaaaaagcattatatgaagcatatctaaaaatcgtcgaaatggaggcccacgacgtaaaagacattctacaaataaaaagcgctaaagacgactggtcattagacgaatcaccattatcagcctcagaaataaaagaaaaagtcaaagatatatttcaagccctcggaatttgtacaaaaatattatattttgacccactattgccggtaaaagagttcgagaaacaagactcataccaactatggcatctactatactcatatgaatctgacgactcaacatccggaaatgaaacattatatagaatcctcgagaagaaatatgcattcaaaagagaacacgctcgaatcctagccaacgtagcattacaggatgattatggatcgttatcaacaaaagctatacgaaaaatatacccaaacataaaagaaaatcaatattcaaaggcttgtgaattagctggatacaaacattccaaattaagcctaactaccgaagaattagaagcacgagaactcaaaaatataataccgctactaaagaaaaatgcactaagaaatccggttgtagagaaaatacttaaccagatgataaatgtggtgaacgctctaatagagaaaaactcagaaagagacgccgaagggaaaatcacaaaatacttccacttcgacgaaataagaatcgaattggcgcgagaactaaagaaaaacgcacagaaaagatacgaaatgacacaaaacattaacaaagcaaaactcgaacaccagaaaatatcagaaattctgcagaagaaatttggaatcaaaaacccgacaaaatcagatataataagatacagactctatcaagaattagaacataatggatacaaagaactatatacaaatgctccaatcgcgagggatatgttatttagcaaaaatatagaaatcgaacacatagtccctaaagcaagagtctttgacgactcatttagcaacaaaactcttacatttcacagaataaactcaaataaaggagaatacacagcatttgattacatcacatcacttaacagcgaggaagaattaaaccagtatttgactagagtagagaacgcatataaaacaaaaagcatctcgctaacaaaatataaaaatttactaaagaaagcaagcgaaataggagacggattcataaacagagatctacgagatactcaatatatcgccaagaaagcaaaagaaatactatttcaggttaccaaaaacgtactctccacatcaggatctatcaccgatagattaagggaagactggggcctagttgacgtaatgaaggaactgaacatgccgaaataccaatcactaggtcttacagaagtagaagaacgcaaagaaggaaacaaggtgacagtaatcaaaaattggacaaaaagaaacgaccatcgacatcacgcaatggacgcacttacagtagcgttcaccaaaccctcatacattcaatacctaaatcacctaaatgcaagaaaagatgaaaacaataaaaactactcggtaatactagcgatagaagagaaagaaacgataaaagtacccactaataatggcaaaaataagcgagtattcattgaacctataccaaactttagacaggtggcaaagaaacacttagaagaaatatttatttcgcataaagccaaaaataaagttgtcaccaaaaatgtcaacaaacccgcagggaccgacaaacaacaaataaccctaacccctagaggacaattgcacaaagaaaccatatatgggaaataccaatattacgtaaacaaagaagaaaaagtaggagtcaagtttgatgaaagaacaataacaaaagtcagtaatcctttatatagggaagcgctattaaaaagactacaagccaacgataacgatcccaagaaagcatttaccggtaaaaatgcgctttcaaagaatccaatctacctagatgaaactaaaacaaaaactctgccggaaaaagtaaacttaacttatttagaagaagatttctccatacgcaaggatataagccctgacaactttaaagacctgaagtctatagaaaaagtaatagaccagggggtaaaaagaattttaataaaaagattacaagactacgacaatgaccctaagaaagcattcgtagaccttgagaaaaacccgatatggctaaacaaagagaaaggtattgcaataaaacgggtaaccataagtggtgtctcaaacgcccaacccttacatataggcaaagaccatctcggaaagacaaccctgaacaaagaaggaaatgaaataccagttgactacgtctcaacagggaataatcatcatgtagcaatataccgcgacaaagagggcaacctgcaagaacaaattgtttccttctttgaagcggtcgtccgcacacaacaagggctacccataatagacaaaacatacaaacaggaagagggatggcaattcctatttaccatgaaacaaaacgaaatgtttgtctttcctaacgcaacaacaggtttcaatcccgcggaaatagaccttttagatcccaaaaacaagaaactaatttcacccaacttattcagagtgcagaaaatcgccacgaaagattacttcttcagacatcatctagaaacaaacgtagagaccgacaacgtactcaaaaatacaacatggaaaagagagggcctgtccggattaaaagatattgtgaaggtaagaatcaaccatttaggcgatatagtcagcataggtgaatactga

SEQ ID NO: 9135 - RNA, 4281 nt, synthetic construct
  misc_feature 1..4281: note = Cas9 variant
  source 1..4281: mol_type = other RNA
atgaaacacattttaggactagatttaggaactaactccattggctgggcgttaataaaacaagactttgaaaacaaacaaggggaaatacttggcatgggatcccgcataataccgatgtcacaagatattctaggagacttcgggaaaggaaactcagtatctcagaccgctgaaagaacaaaatatcgctccgtaagaagattaagagaacgctttctattacgaagggaacgactacatagaatattaaatgtactgggcttcctaccagaacactacgcatcacaaatcgactttacaaaaagatttggcaaattcaaagaagaaacggaaccaaaattagtatatagcaatgaaggattcatcttcaagaaatcatttgaagaaatgctatccgatttcaaaactcatcaaccccaattattagaagataataagaaaataccatatgactggactatatattatctacggaagaaagcactatcacgaaaaatagaaaaagaggaattagcatggatcctcctaaactttaaccaaaaacgaggatactatcaactcagaggagaagaagaagaagagaatccaaataaactaatagaattttatagcctcaaaatcgtcgacgtccttgcagacgaaccccaaaaaggcaaaagcgatatatggtactcactaatcctagaaaatggatggatctatcgacgatcaagcaaaactccactctttgattggaaagagaaaaccagggatttcatcgtcacaatagacctaaacgacgatggaagtgtaaaaacggataaagaaggtaacgagaaaagatcgtttagagcgccgggcgaaaacgactggacattagtcaaaaagaaaaccgaacaagaaatagatagctccaggaaaactgtagggacatacatatacgaaacattgctgaaaaacccgaaacagaaaataaaaggaaaacttgttcgaactattgaacgaaaattctacaaaacagaactaaaacaaatcctagagaaacaaaaagaatttcatcccgaattacgacaagacgatctgtattcagattgcgtaagagaactatacaaaaacaacgaagcacatcaattaacattaagcaagaaagatttcgtacatctatttatggaagatataatcttttatcaaagaccgctaggaagtcaaaaatcttcaatatcaaactgcacactagaatttagaaaatataaagacgaaaatggcacggaacacacacaatatctaaaagcaatacccaaatccaacccttactaccaagagttcagaatctggcaatggatgtataacctgaacatatacaagaaagaagacgatacaaatgttacaaaagacttcctaaacacaaaagcagatttcgaatcattgtttgaatttttaaacaacagaaaagaagtcgatcaaaaagccttattaaaacatttcaaactaaacgacaaaacgcatagatggaactatgtcgaagataagaaatacccgtgtaacgaaaccaaaacaatgatactctcacgcctagataaagtcgaaaatatctccgatgatttcctaacaagagaaatggagcagaaaatatggcatattatctattctgtaaacgacaaggttgagtacgaaaaagccttaaaaagtttcgcaggtaaaaacaatctcgaagataattcattcttcgaggctttcaagaaatttccaccattcaaatcagaatatggtgcattctcggagaaagcaatcaagaaattattacctctaatgaggatgggtaagttctggaattataataacattagtgaacaatctaaatcacgtattcagaaaataataacgggagaatacgatgagaatataaaagacaaggtaagagaaaaagcaatccacttgaccactgaaaccgacttccaaggcttacaactatggctagtccaatatatagtatatggcaggcattcagaagctgccatgctaggcaaatggaatagcgcagatgacctagaggagtttttaaaagaatttaagcaacattcactaagaaatccgatcgtcgaacaagtaatcacagaaacgcttagagttgtcaaagatatatggcaaaaatacggcaatggtgcgaaagactttttccgagagattcatatcgaactaggacgagagatgaagttacccgctgaagaacgagaacgattaacacgtcaaatatcagaaaatgaaaacacaaactttcgcataaaagcactactcgcagaaatgatggacgacaactccgtagaaaatgttcgtccattttcaccgatgcaacaagagatacttaaaatatatgaagaaggtgtactaaacagcgacatagaaatagaagacgatattttaaaaatatcaaagaccgcccaacccagttcatctgatttaaaaagatacaaattatggttagaacagaaatataaatcaccatatacagggcaaatcattccattaaataaactatttaccccagaatacgaaattgaacatataatcccccaatcccgatatttcgacgacagctttactaataaaataatatgtgaatcagctgtgaataagctaaaagacaattacattggtctcgagttcataaagaaactcggcggatccatagtagaatgcggaaacggaaaatctgtagccatactcaaacacgacgcttatgaagacttcatcaagaaacactatgcaaataaccgatcaaaaagaaataaattactcttagaagacataccagagaaaatgattgaaaggcaaatgaacgacacaagatacataagcaaatacatttctggcgtcttatcaaatatcgtacgagttgaagacggtacagatgaaggtgtcaacagtaagaacatagtacctggtaacggaaaaatcaccacccaactaaaacaagattggggtttgaatgatgtatggaacgacctgattctcccaagatttgaacgaatgaaccacttaactaattcaacagactttacagcgtggaatgaaaatcaccaaaaattcttaccaacagtacctgtcgagttctcaaaaggattttcaaagaaacgcatcgatcaccgccaccatgcactagatgccttagtgatcgcatgcgcaacaaaagatcacgtaaatttattaaacaaccaatcagcaaaatcagacactaaaagatatgacctcaaaaagaaactaatgaagtttgaaaaagtggcctataaccacccccaaactggggaaaggattgaacgcgaagcgccaaaacaatttctgaaaccatgggaaacatttacaatcgacgccaaaaatcacctcgaaaccataattgtatcatttaaacaaaacctaagagtaatcaacaaagcaactaactactatgaaaaatacgttgaaaaagaaggaacaaaagtaaaagaaagagttgaacaaaaaggaacaaactgggctataagaaaaccaatgcacaaagaaaccgtatccggtaaaattgatttaccgcgaatcaaagtacccaaaggaaaaatattgacagctactcgcaagagcttagacacatcattcaatctcaaaactatcggttcaatcaccgatacaggaatacagaaaattctcaaaaactatctacaatataaagacaacaacccagaactagcctttagccccgaaggcatagaagacatgaacaagaatatcgaaaaattcaacaacggtaaagctcatcaaagcatttccaaagtacgcgtatttgaactaggatcaaagtttccactaggccaatccggaaataagaaagaaaaatatgtggaggcagcaaaaggaacgaacctattctttgcgatataccaggacaaaaacggaaagcgttcgtatgaaactatccctctaaatgaagtaattgaaaggcaaaaacaaggacttagtgtagtagacctaaagggagttgatgacttttatctaagcccaaatgacctcgtttatgttccatctgaagacgaactagaaaatataagcatgatagacttcaataaaatgtcctcagaacgaatctacaaagtagtatcttttacaggaaaccaaattttcttcgtcaggcaagacatagcaacatcagtcgtaaacaaagcagagttcagtacactgaataaaatggagagagcaatagatgggacaatgattaaagaaacatgcgtgaaactacagatagataggctaggaaacataagtaaaatttga

SEQ ID NO: 9136 - RNA, 4281 nt, synthetic construct
  misc_feature 1..4281: note = Cas9 variant
  source 1..4281: mol_type = other RNA
atgtacaacataggattagatatcggaacagggagtgttgggtggtgcttgacagacgaaaacggatatctattaaaagtaaatcgaaaagggaataacggaaacacctacagaaacagtgcatggggagtaaggcttttcgaaagcgccgatacagcggccgattgcaggataaaacgttcaacaagacgcaggtacaaaagaaggcgcacaagaattatagaactaaggaaaataatgagtgacatgataatgccaatagatcctaatttttacgcccgactagatgaagccttcctgtggaatgaagacaaaagcgacaaagctaaagccccatttctactattcaacgataatgggtacgacgacgttaaatattatactgattatccaactatataccacctaaggaaacatttattagaaaccaaagaaaaagcagatccaagatttatatatctagcgcttcaccacatgatgaaatatagaggacacttcttatttgaaggtcagagctttgaagcaattgataatatagaagacacctttatagaattagaacatctagtaaacgtctatgtaaaagaaaaagaagacacagacaacaatgctgaaaacaatgcgttataccaagaaatgaaaaactacctagcggacaataaagtcaaaaataaagataagaaagaatatataactgatacctttattaaagccgattacgacaacaaatacagtaaagaactagcagcagcagtcctaggatacgagttcaatgttggaataatagttaatgacaatagtctaacagatgaagatggaaaagccctaaaagcaaaattcgcagacgcaaaatacgaagaaaaagaagaaaaactaagtgacacactcggagaaagatattacataatagaaacgctcaagaaaatatacagttggaaagttctacacagcatcctcggagacaacaaatatctaagctatgcaatggttgataaatatgagaaacacagtgagcaattaaaagccctaaaatatctattccataaatatacatcacaagatgaatattcagaatttttccaccaagagaaaaacaaagaaggaaaatatattgtaaattatgccaactacatcaaaggcataaaacgtctctcgaatgaaactaataagaaatataatacaaaacaacaattataccaaagcataatgaaaatcttaggcgaaagagccgcagatgacgaagtatataagaaaatattagtcgaaatggaacaagaaacattccttgagaaaatcaataatgtagacaacagcgcgataccctaccaactaaatttaatggaaatggacaaaattttaacacaacaaggcgtatactataaagaactacgagataacaaagaactgttacttaaaatgttaacaagtaaaatcccgtactacgttggcccactcaataacaattcaaacggaaacagaaactttgcttggatgaccaagaaagacggcaaagaaaacgaaaaagtatacccatggaacgtaaaagatgtagtcgatatcgacgtaacagcagaagattttataacaaggatgacaaactattgcacctacctacccaacgaaaaagtcctaccaaaagagagcttactatatcaaagatacatgttactcgaagaactaagccaaataaggatagacggaaggaaactctcaaaagaagacagaaaagcaataataaacgacctgtttattggaaaaggaagagtgaaagttagcgacaaagacttcaaagaatacctaaacaaagtaaactatgttaaagtaaacggcaaaggttatgacgtcactggctatcaaagtgacgatggattcgcgtgcgcattatcatcttataacaaattcagacgtattctgggacacatagacgaacaaaatgagaaaatgatagaagacatcatatactggatcaccgtattcgaagacaaagacatcgtaaaacgaaaaataaacaaacaatatgcagacagattatcagccgaacagttaaagaagatccttaaattaaaattcaaaggatggggaagatatagctcaaaactactgaatggaataaaaggggacatggggaccacaataattgaaatgttagaggacgccgatgaaagattcgcatattgcgattattgtccgaatttcatgcaaataataaataaagatgagaaaataaaacaaataattgacgacaatagaccaagatacgacggtacaaaagatttactagatgtaatacaagatatgcatacaagtccagcaaataggagaggtatatggcaaacaatgaaagcaatcgaagaaatcattgaatatatgggagaaaaaccccaacaaatatatatagagttcgcacgagaggacgatccaaaagccaaaaacaaaagagcagactcaaggaaacgagccatcgataaggcactaaagaaactgaaagaagacgtcgttgacgagtacaatgaaaaagtgtacaaggaactcaagcaatacgaaaaacgtttagatgaagagaaagtttacttatacttcatgcaaaatggaaaagacctatattttcccgacaaagagcttaatctagacgaattagaaaaactcgaaatcgatcatatcatcccatactcattatccgacgacgatagcctagacaataaagcattagtactcaaaggaaacaatcaaaacaaaggaaataaaatagtaaaagaagcattcccacaactcttcagcaactcagggacagttaattactggaaaaacctaaagaaagcagggttaatatcagagaagaaatacaacaacttacagaaaaacaatgtagatgatatattaacaaagggctttatcaacagacaattagtagaaacacggcagatagttaagtctgtggcaaacctaatactagattactataacgaacagatcgacgttattgaagtaaaagcatcgttatcaacttcagtacgaaaaatgctaacatatgagaagaaagacaataatgggttttggatcgaaaacaaagacaactgcatgttctataaaaatcgcgatatgaatgattatcaccatgctcatgacgcatatctcgcaaacattataggtttatatatacagaaaaactatccacgactacaaaaggaactaaactatagccaataccgaagaatctggcgtaagtactatgaaaatactaaaaacaataatggagtaaattggttcgctaccttgggaaaattttcaagcaataacgaagaagcagattggtatgggcaagacataatagcatatatgagaaaaatattctgttatagagatgttttaatcagtaagaaggtagaggaaaatacaggtgctttttatagtgaaacgaaatacccaagagaagacaaggctggatcgaaattagtacccctaaaacaaggtaataatatgcgaggagccaacaacctgaaggaattggatgcacgaaaatatggaggatacaaaggaggagaaaaagcgtatttcgtcttagtaaaatactgcatagagaaagcattaaagaagaaagtcaagaaagaataccacatggagttcgttgaaatacccgtctacattgcgaggggtattaaaaataaagacataaatctctacgattacgtatgtgacatattaaatgaagcaaacaaaaatagtgttgcagatgtcgagatactccggaataaagtaccaaagtaccaaatgataattggtgagaatggtgaagaatattacctcgttagtgcaactgaagtaatcaactcaaaacaattcgtattaggaggagcgaaccaacaatacaaccgtctattaaactacataaaatacggcaaaaacgataaatggcagtatatacaaacagaactgttagatgaacaacttataggattatacaacttactcatcgcaaaaataaaagacgaatacaaaggcttctccaaggaggcagtacgaatacaagaaaacaactcattcgataaactagatgtaaaagacaagaaagagttcatagcagaaatgattaagttagtgcaaccagactcagattatccatacctaggaaaatacgcaacaggtctttctaacagaatgggccgaaaaacaggagaaaaagtaggcaagaaaataacgctagtagataaaagtgtcacgggtttatatgaaagaagaacaacattcgaactcgaagatgactccagcactaaaagctgctga

SEQ ID NO: 9137 - RNA, 4281 nt, synthetic construct
  misc_feature 1..4281: note = Cas9 variant
  source 1..4281: mol_type = other RNA
atgaaaaatatcctaggactggatctaggtacaacatcaattggcttcgcacacattgttgaagatgaaaataaagaaaaatctgagataaaagaacttggtgttcgaatagtctcattgaccaccgacgaacaaagcgacttcgaaaaaggaaaatcaattacaactaatgcaaataggacactgaaacacggagcacgcctaaacctcgatcgttaccaacaacgaagaaaatacttaatagatttgctacaaaaagcaaacctaatcacaccatcgtcaattcttgcagaaaacggcaaaaatacaacacattcaacgtggcaacttcgcgcaaaagccgtaaccgaacgcatagagaaagaggaatttgcacgaatactactggcaataaataagaaacgaggatataaatcaagtagaaaagcaaaaacagaggacgaaggacaagcaatagacggaatggcaatagcaaaaagactctacgatgaaaatctaaccccaggacaattatcactacaactgttacaacaaaacaaaaagctgcttcctgacttctacagaagcgacttacaaaaagagttcgacctcgtttggaacttccaaaaacaattttacccagacattctaactgacatattctacaaggaattgcaagggaaaggaaaagatgctacatcaaaggcattttccaagcgttaccattttgacaccactgaaaataaaggttcaaaagaatccgtaagattacaggcttaccagtggcgagctgaagcaatatccaaacaactatcaaaagaggaggtagcgtacgtactaacagaaataaataataatctcaacaatgcctcaggatacttaggtgccatttcggacagatccaaagaactatatttcaaccgtcagacagtgggtcaatatctatatgctaaattacaagaaaataggcacaactcccttaaaaacaaagtattttataggcaagactacttagacgagttcgaacgtatctgggaaacacaggcgagcttccataaagaactaacggacgaacttaagaaacaaataagagacgttgtaatattttaccaacgaaaacccaaaagtcaaaaaggattgataagtttctgcgaatttgaatctaaagaaatagaaattgaaaaagatggaaagactataaccaaaaatattggagcaagagtagtacccaaaagcagccccctatttcaggaatttaaaatatggcaaatactcaacaatgtcatttgcaaacgaaaaggcataagaaagaaaaagatcagtgcaaaaacaacccaacttgacttactaaacgaatctagccaaacaatattttccctagatatggaatgcaaacaactactttttgacgaactcaacctaaaaggggatttaaaatctgacaaggtgctaaaattattaggatactcaccccaagaatgggaaatcaactacaatcaattagaaggaaataggactcaaaaagccctatatgaggcatacttaaaaatagtcgaaatggaagctcacgatgtcaaagatatcctacagatcaaaagcgcaaaagatgattggagcttagacgaatctccattgtcagcatcggaaataagagaaaaagttaaagcgatctttcaaacactcggaatctgcactaaaatactatactttgatccacttctacccgtcaaagaatttgaagaacaagactcataccaactatggcaccttttatatagttacgaatcagacgattcgacatccggaaacgaaacattatatagaatcttagaaaagaaatacgcgtttaaacgagaacatgcacgtatactagccaacgtggcgctacaagacgactacggtagtttatcaaccaaagccataaggaaaatatatccaaacataaaagaaaaccaatacagtacagcttgtgagaaagcaggatataaacactcaaaactctcactaacgaccgaagaattggaagccagagaactcaaaaacataatccctctcctaaagaaaaacgctttaagaaatcccgtagtagagaaaatcctgaatcaaatgattaatgtagtaaacgcacttatagagaaaaattccgaaagagatgcagaaggaaaaataacaaaatactttcatttcgatgaaataaggattgaacttgcgagagaattgaaaaagaacgctcagaaaagatacgaaatgacccaaaatataaacaaagcaaaattagagcatcagaaaatctctgagatattacaaaaagagtttggcattaaaaatccaacaaaaagcgatatcatacgctaccgcctttatcaagagttagaacacaatggatacaaagaattatataccaacgctccgattgcaagagacatgcttttctccaaaaatatagaaatagaacacatagttcctaaagcacgagttttcgatgattcattctcaaataaaacactaacatttcacagaataaacagcgacaaaggagaatacacagcgttcgattatataacatctttaaactcagaggaagaactaaaccaatatctcacacgggtcgaaaatgcctacaaaactaaatccatctcaccgacaaaatataaaaacttattaaagaaagcatctgaaataggcgacgactttataaatagggatttaagagacactcaatacatagcaaagaaagcaaaagaaattctatttcaagtaaccaaaaacgtactctccacgtcaggctctataacagaccgtctcagagaagattggggacttgtagatgtcatgaaagaacttaatatgcctaaatatcaatccttaggtttaaccgaagtagaagaacgaaaagatggaaacaaagttaccgtcattaaaaactggactaaaagaaatgatcacaggcaccacgcaatggatgctctgactgtagccttcacaaaacccagttacatacaatatctcaatcacctaaatgcgcggaaagatgaaaacaacaaaaactactccgttatattagctatcgaagaaaaagaaaccataaaagtacctacaaataatggcaaaaataaaagagtattcatagaaccaattccaaatttcagacaagttgcaaagaaacaccttgaagaaatattcatcagtcataaagctaaaaataaagtcgtaaccaaaaatacaaacaaacctgcaggaacagataaacaacaaataacactaacaccccgcggacaactgcacaaagaaaccatctacggcaaataccaatactacataaataaagaagagaaaatcggtgtaaaattcgatgaaagaacaatagccaaagtaagtaaccctgtgtatagggaagcattattaaaaagactacaggcaaatgacaacgaccctaagaaagcctttgcaggcaaaaacgcactatctaaaaatccgatctatctagacgaaagcaaaaccaaaacgctacccgaaaaagtcaatcttacatacttagaagaggatttcagtataagaaaagacatatcaccagacaacttcaaagatttaaaatcaatagaaaaagtaatagatcaaggagtgaaaaggattttaataaaaaggttacaggcttacgacaacgacccaaagaaagcatttgtagacttagagaaaaaccctatctggttaaacaaagaaaaaggaattgcaattaaaagagttacaatatccggcgtaaataatgcacaaccactccacataggaaaagaccacctaggaaaaacaactctaaacaaagaaggcaaagaaattcctgttgactatgtatcaactggaaataaccaccatgtagcgatctaccgcgataaagaaggtaatcttcaagaacaaatagtctcatttttcgatgccgttgtacgggctcaacaaggtataccgatcatagacaaaacttataaacaagcagaaggctggcaatttttgttcaccatgaaacaaaatgaaatgttcgtctttcctaacgcaacaacaggattcaatcctgcggaaatagacctattagaccccaaaaataagaaattaattagtccaaatctgttcagggtacagaaaatagccactaaagactacttcttcaggcaccatctggagaccaacgtggaaacagacaatattctcaaaaacgtaacatggaaaagagagggattaagtggtcttaaagatatagtaaaagtaagaatcaaccacctcggagatattgtttccatcggggaatactga

SEQ ID NO: 9138 - RNA, 4281 nt, synthetic construct
  misc_feature 1..4281: note = Cas9 variant
  source 1..4281: mol_type = other RNA
atgaaaaacatactgggactagatctcggtacaacatctatcggattcacccatattgtagaagatgaaaataaagagaaatctgaaataaaggaactaggtgtaagaattgtcagcctcactacggacgaacaatccgattttgaaaaaggaaaatcaatttcaacaaacgcaaacagaacattaaaacacggagcacgattaaacctagacagataccaacaaagaagaaaattcctcattgacctactacagaaagcaaatttaataacgtcaagcagcatactcgcagagaacggtaaaaacacaacacattcaacttggcaattaagggcaaaagcagtcaccgaaagaatcgaaaaagaagaatttgctagggttttactagccatcaacaaaaagcgaggttacaaatcatcacgaaaagctaaaacagaggacgaaggacaagcaatagatggcatggcaatcgctaaaagactatacgatgaaaatttaacaccagggcaactaagtttgcaattactacaacaaaataaaaaattactcccagatttttacagaagtgatctacagaaagaattcgacttggtatggaactttcaaaaacaattctatcccgacatcttgacggactcattttacaaagaattacaaggaaaaggtaaagacgcaacctcgaaagcattcagtaaaagatatcacttcgacacagctgaaaataaaggttcaagagaatcagtaaggctccaagcatatcaatggagagccgaagctatcagtaaacagctctcaaaagaagaggtagcctacgtcctcacagaaataaacaacaatttaaataatgcgtcaggatatttaggagcgatatcagaccgtagtaaagaattatacttcaatagacaaacagtaggtcaatacctttacgcacaactccaagaaaacaaacacaattctctaaaaaacaaagtattctacagacaggattacctagatgaattcgaaagaatatgggaaacccaagcctcatttcataaggaactaacagaagaacttaaaaaacaaataagggacgtagtaattttttatcaacgtaaactaaaatcacaaaaaggactaatatcattctgtgaattcgagtccaaggaaatcgaaatcgaaaaagacggcaaaacaataaccaaatccataggagcgcgagtggtcccaaaaagtagccctctttttcaagagtttaaaatatggcaaatacttaataatgtaacctgcaaacgaaaaggaatcagaaaaaaaaaatcctcagcaaagagcacagaactagatctattcaatgaaccatcacaaaccatattttctcttgacatggaatgcaaacaactactgttcgaggaattaaatctaaaaggcgacctaaagagcgacaaagtacttaaactcctgggctattctccgcaagaatgggaaattaactataaccaactagaaggtaaccggacccaaaaagccctatacgaagcgtacctaaaaatagtcgaaatggaagcacatgacgttaaagatatattacaaataaaatcaacaaaagatgactgggcattagaagaatcacctttaagtgcatcagaaatacgtgagagagtaaaagcgatctttcaaacactaggaatctgcacaaaaattctatattttgatccgttactaccagtaaaagagtttgaagaacaggactcataccaactttggcatctactatactcttatgaatcagacgattccacatctggaaacgagaccttgtatcgcatactcgaaaaaaaatacgctttcaaacgagaacacgcgaccatcctagccaacgtgacgcttcaagacgattatggtagccttagtactaaagccatcagaaaaatttatccatatattaaagaaaatcaatattccacagcgtgtgaaaaagctggttataaacattctaaactatcgctaacaaccgaagagctggaagctagagagttaaaaaacatcatacctttactcaaaaaaaatgcactacgaaatccagtagtagaaaagattctaaaccaaatgataaacgtagtaaacgcactaatagaaaaaaacagcgaacgagatgctgaaggtaagataaccaaatactttcattttgacgaaataagaatagaactagcaagggaactaaaaaaaaatgcacaggaaagatacgaaatgacacagaacattaataaagctaagctagaacatcaaaaaataagcggtatattacaaaaagaatttggaataaaaaatccaacaaagtcagacatcacacgctacagactatatcaagaactcgctcataatgggtataacgatctatacacaaacacttatatccctaaagaattattattctccaaaaacattgacatagaacatattgtatcaaaggcaagagtctttgacgacagcttcagcaataaaacactagctttccgagaatttaacatcaaaaagggagaatctacagcattcgactatattaccagccttaacaatgaagaagaattaaaccaatatttgaacagagtagaaaacgcctacaaaaccaaaaatataagtccagcgaaatataagaacctactaaaaaaggcatccgaaataggagacggctttataaaccgtgacttgagagacactcaatacatagccaaaaaagcaaaagagatcctattccaagtcacaaaaaatgtactatcaacatccggaagcatcacagaccgcctgagagaagattggggtctggtcgatgtaatgaaagaacttaacatgccgaaataccaatcgctcggactaacagaagtcgaggaaagaaaagaaggaaacaaagtgactgttatcaaaaactggacaaaacgaaacgaccacaggcaccatgcaatggacgcacttacagtagcattcaccaaaccttcttatatacaatacctgaatcatctaaatgcgagaaaagacaaaaataacaagaattactcggtgatactagctatagaagaaaaagaaacaatcaaagttcctacaaataacggaaaaaacaaacgagtgttcatagaacctataccgaacttcagacaagtagcaaaaaaacatctagaagaaatattcatatcacataaagctaaaaacaaagtagtgacgaaaaacaccaataaaccagcaggtacagataagcaacaaattacactaactccgagaggtcaacttcataaagaaactgtatatggaaaataccaatattacgttaataaggaagaaaaaattggtgtaaagttcgacaaagaaaccatagcaaaagtaagcaacccagtatatagagaagctctactaaaacgccttcaagccaatgacaacgatccaaaaaaagcatttgccggcaaaaacgcactttcaaaaaaccctatttacctcgacgaagcaaaaacaaaaacattaactgaaaaagtcaacctaacttacctggaagaagattttagcattagaaaagacatatcacccgataactttaaagatttaaaatctatagaaaaggtaatcgatcaaggagttaaaagaattttaataaaacgtctacaagattatgacaacgatcccaaaaaggcttttgtagacctagaaaaaaacccaatttggttaaataaagaaaaaggaatagctattaaacgagtgacaatatcaggagtcaataacgcacaaccattacatatagggaaagaccacctcggaaaaacaaccttgaataaagagggaaaagaaatacctgtagattacgtatcaacgggtaataaccaccacgttgcaatatatagagataaagaaggtaatcttcaagagcaaatagtctcatttttcgaagcagtggtaggagcccaacaaggtctaccaatagtagacaaaacatacaaacaagcagaaggatggcaattcttgtttaccatgaaacaaaatgagatgttcgtatttcccaatgaagccactggttttaatcctgcggagattgacctattagacccaaaaaacaaaaaacaaataagtcctaacctattcagagtccagaagattgcaacaaaagattacttttttcgacaccacctcgaaacaaacgtagatacagacaacgtgttaaaaaacacaacatggaaaagagaaggtttatccgggctaaaggacatcgtaaaagtaagaataaatcatttaggcgatatcgtaagtatcggagaatattga

SEQ ID NO: 9139 - RNA, 4284 nt, synthetic construct
  misc_feature 1..4284: note = Cas9 variant
  source 1..4284: mol_type = other RNA
atgaagaaaatactaggcttagacctaggtaccagttctatcggttgggcattagtaaatgaagcggaaactagcgaagagaaatcttcaattatcaaattaggagtaagagtaaacccattgacagtagatgaactacaaaacttcgaaaaaggaaaatcaatcactacgaacgcagacagaacagcaggacgatcaatgcggcgaaatctacaacgatataaacttagaagagaaaacctaattgaagtacttaaagagtataattttataacggacgaaatgatcttaagcgaaaacggcaatcgaacaacatttgaaacataccgcttaagagcaaaagctgcggtagaggaaataagccttgaacaattcgctagagttttactaatgataaacaagaaaagaggctacaaatcctcaagaaaagctaaaggagcagaaaatggcaccttaatcgatggaatggaagtagcaaagaaaatgtacgatgaaggcatcacaccaggtgaactatgcctacagctactcaccgcaggcaaaagatatttcccagacttttatagatcagacttacaggcagaatttgatcgcatttggaatttccaaaaacaattttatccagacagcctaattgataaagtaaaagatgaagtgagaggcaaaaacaaatcgcaaacctgggcaatcttagcaaaatattttgtatggaaagaagtagaaaactcttggaatgaggaagaagcacaaacacgaagagtcgagaaagaatataggctagtagggataaaaagaggagtaaaaagagaagaactaaaactagaaaacttccaatggagagtaaaagctctaagtgaaagaatgaacccagaggaattagcaatagtactacaagaaatcaatgaacaaataagtaattcatcaggatatttaggagcgattagcgacagatcaaaagaattatactttaaccgtcaaacagttggccaataccagatggctgttcttgataacaacccaaatattggactccggaatatggtcttttataggcaagattatcttgacgaatttaataccatatgggaaaaacaagcagagttccacaaagaattaacagaagacctcaagaaagagatacgtgatatcgtaatcttctaccaacgaaggttgaaaagtcaaaaaggattaataaacatctgtgaatttgaaagacgacaaatcgaagtcgaaatagatggcaaaaagaaaataaaaacaataggatcccgagtaatccctcgaagctcaccactatttcaagaatttaaaatatggcaaacgttaaatgacatagaagtaagcgttctcggtgtcaaaaacaaaaggaagaaacaagacgacaatagtaccacactgctagattcagcagaaaacattgattcgctaaaactaaacgtatcaaggccacttgacgcagatgaaaaatcgctactggcaaaagaactctttatacgagataaactaaccaaatccgacgtattaaaattgcttttcaataatccacaaaatctaaatctcaatttcaaaaacatagacggtaacagaacaggttccgcactataccaagcattttcgaaaatcctcgaaatatcaggacatgaatcaattaatttcaagaaatcggcggatgaaatagttgaacaagtaaaaacaatattctcagcactcggatggaacacagaagtattatgctttgatagtgaaaaagaactagataaacaaccctacttcaaactatggcatctattatattcgttcgaaggagattccactccaacgggtgatggaaatttaatacagaaaatcgccgacttatgcgggttcgagaaagactatgcttcaatcttagcaaacataacgttccaggaggattatggatcactaagtactaaagcaataagaaaaatcctgccacatttaaaagacggaaaccaatatgacgtagcgtgcgaatacgctggctacaaacacagcaaatcaagcctcaagaaagaagaaatcaaaaacaaagtactaaaagacaaactagaactactacccaaaaactcactcagaaacccagtcgtagagaaaatcttaaaccaaatggtaaacgtcataaacgcaatcatcaccacatatggaaaaccagacgaaataagaatagaactagcaagagagctaaagaagaacgctaaggagagagaagaactcaccaaaagtattgttgacactacaaagacacacgaaggtatacgagcaatactacaaaatgattttggtatgagccatgttagcaggaatgcaatcataaggtataaactatatgaagaactaaaagacaatggatacaaaactctatatagtaatacctacataccgaaagaaaaactattctccaaagattttgatatagagcatattatcccacaggcaagactcttcgatgactcattttcaaacaaaacactagaagtgaaatcaataaatatagagaaaggatcgaagaccgcatatgactttgtggaagaaaaatatggagaacaaggcttacaagaatatctcaatagatgtgaagtgctattccgagacaagaaaacaaaactgcgaaagttaaagatgcaggagagtgaaattccagaaggcttcatagaccgagatctacgaaacacacagtatattgccaagaaagcgcttagcatgctgaacgaaatatgcagaagagtagtagcaacaactggagcaattacggatgaactacgcgaagactggcaactcgtagatgtcatgaaagaacttaactgggaaaaatataaggtcttaggtctagttgaatattttgaggataacgatggaaggctaatcgggcgtataaaagattggacaaaacgaaacgaccatagacatcatgccatggacgcattaacagttgcattcacaaaagatgtgtttatacaatacttcaataataaaaacgcaagtctcaaaccagatactaacgaagcagccataaggaacaagtacttccaaaatggtaaagccatcccaccaatgagcttagatgaatttagagccgaagccaagaaacacttaaatgacacacttatctcaataaaaactaaaaacaaagttgtcacaataaacctaaaccggaccaagaagaaaaatggaataaataaaaagcaacaacaaacaccaagaggacagttacacctagaaacagtatatggcagtcacaaacagtatgttgtaaaagaagaaaaagtcaatgcatcatttgacgcagcaaaaattgcaacagtaaataaaccagcatatagggatgcattattgagaagacttcaagaaaacggcaacgactccaagaaagcattcacaggaaagaacagcctcgataaacaaccagtatggctcgatgccaaacagaacgaatgcgtacccgaaaaagtcaaaactgtaatgctagagacagtgtacacagtaagaaaaccgatagatgagaagctcaacgtagataaagtggtcgatgccagaataagaaaacttcttcaagataggataaaagaatacggaaacgccaaaagcgcatttgcaaatttagatgagaacccaatctggctaaataaagaaaaaggcataacaataaagagggtatccgtatcaggaataagtaaagcacaatctttacatgaaaagaaagacaaagacggcaatttcatacttgacaaagatagcagaagaataccagtggacttcgtaaacactgggaacaatcaccacgtagcgatatatagaaaaccagtattagacaagaaaggacaagccgtgttcgatgaaaatggcgaactaaaatttgaattagaggaagtagtagtcagtttctttgatgcagttacacgagtaaacctctctcaacccattatagacaaagactacaaacggtcagaaggctggaaattcttattttcaatgaaacaaaacgaatatttcgtattccctaatgagaaaactggatttgatcccaaagaaatagatctcctgaaccccgagaactatgcgctcataagtccaaacttattcagagtacaaaagatagcctcaaaggactatgtatttagacaccaccttgaaacagtagtcgccgatcggaaagaactacaggaaatcacttggaaaagaatatcgtcgctatcaatcctaaacagaataataaaagtaagagtaaaccatataggtcaaatagtaatgataggagaatactga

SEQ ID NO: 9140 - RNA, 4284 nt, synthetic construct
  misc_feature 1..4284: note = Cas9 variant
  source 1..4284: mol_type = other RNA
atggctaagccaaaagattataccatcggattagacataggcacaaattcagttggatgggttgtaactgacgatcaaaacaatatattaagaataaaaggtaagaaagctattggcgctaggctatttgcagaaggaaaagtcgcagcagaaagaaggagtttcagaacaacaagaagacgtctcagtcgcaggcgctggagaattaaattactagaagaattatttgacaaagagatagctaaagtagacccttcatttttcgctagacttcatgaaagctggatcagtccaaaagataaaagaaaacgatatagtgctatagtcttcccaagccccgaagaagacaaaaaattccatgaaagctatccaacaatttatcatttgcgggacaaattaatgaaagacgaccaaaaacatgatatcagagaaatatacatagcagtccatcaaatgataaaagctcgtggaaactttctacacgatgaaagcgtcgaaacatatcggagtggcatgtcttcattaggaggtcgaagtgaacgtactatactatcagtccaaacattagaagagcttaatgatttatttgcagaaaatgaggggacagaagaagcaaaactaaacgtagcatcagcagagcagataaacgatatactgaccggtggacacttaaatgctgactcacagaaagaaatagggaatttacttttaccttcatcatttccgagcttcgatgacaaagcaaaagaaaaacaagtaaaaaagttaatcaaaaatgttgcgactaatatctccaaggcatggctagggtacaaagcagacttctctacaatattaaacctcgcaaacgtcgacaaagaccaaaagaaaatcttcgcattcgcactacagggaggagacgaagaagacaaagtacaagaactagaatccttattagaacaatcacaaacagacatagtagacaggctaatagaaattcgtcatgcaatcgtattatccgaaattgtaccagtaggaatgacactttcagaagcaatgatagacaaatacgatcaacacaaggaagaccttataactttaaaagcggttatcagaaatacaaaagacaaaaaaaaagcagctaaattacaagcaatatacgacttatatgtaaacaatcgacacgcagacttagcaaaagcaatgaaactgaccggcataaaaaaaaggtctgaactcttggaccccgaagagctaaaaaaagcaatctcaagtctactagacgactcaccagaagctgtcgaaataaaacaaatgttagaagaaaaaacttttttaccgcttcaacgttcaaataacaatggcgtaataccaaatcagttacatcaagtggaattagatgaaataataaaaaagcagagtaaatactacccattcctggcagaaaaaaacccagatgaatcagaggaggctcaaaaaaaagcccccacaaaattagatgcgttattaacattcagagtaccttactatgtaggtccaatgataacaaaagaagaacaagaagcgcaagacggccactcctttgcgtggatggtgcgtcgagatccacaagaccacgaagctattaccccatggaattttgaaaagaaggttgataaaatggcatcagctactcaattcattaaacgtatgactacaaaagacacctatctactaggagaagacgtcctaccagcaagctctttaaaatatcaactctttactgttttaaatgaactgaacaacctcagagtcaacggaaaaaaattaacctcagacgaaaaagaacaggttatagagggattatttaaaaaacagaaaacagtaaaggcagacaaattcgtaaaatactggcaagcgaaacatatcggagcagatataaaggttaaaggcctctcagatccaagtaaatttaactccacaatgtcgacatacatagatttcaaaaaaatatttggagatcaactaaacgacgtaaatcgacaaaatgactttgaaaaaataatagagtacagtacgatatttgaagataggaaaatactagaagataaattacgcgccgatttcgcatggctatcagaagagcaaatcaaacaactatgtaggcttagattacaaggatggggtaggttatccgacaaactactaactaggttgacagatgccgatggtcagaacgtcttggaaagattatggaatagcaacgacaattttgtacagattgtatcagacccaaacatcaaagctaaaatagaacaagaaaaccaaaaactactacgagatgggcaaagcgacgatgctgtagaatcaatactcgatgacgcatacacatcaccacaaaataaaaaagcaatacgtcaagtcatgcgtgtagtacacgatatagtgaaagcatgcgacggtaacgtgccggctaaatttgctattgagtttgcaagaagccaagaagatgatcccaaacgaaccacggcaagagttaaccaaatgcaaaaaatttatgaccaaatctcagatgaagtagtatcacagggtgtgaaggaacaactttctggtatgaaatctttgaaagacagatattacctctactttatgcaaggtgggcgagatgcatatacgggtgccaagctaaatattgacagattgtcggattacgacatagatcacatcatgccccaaagtttcgtcaaagacgatagcctagataatagggtgctagttgcaagagcagtcaataatcaaaaatcagataaagtcccagcattacttttcgggaataaagtggttgcagacttgggtataacagtaagagaaatgtgggacaagtggcaaaaattaggcatgatatccaaacggaagctatctaatttactaacagatccagatgctttaacagagtatagagcacagggattcatccggcgtcagttagttgaaacaagccaagtgataaaattaaccgccaccattctccaatccgaattcccagactctaaaataatagaagtaccggcaaaatacaactcaatcgttcgaaaacagttcgacctctataaaagtagagaagtcaatgattatcatcatgcaatagatgcataccttagtacaatagtaggcaactatctctaccaagtgtacccaaacctacgacgcatgttcgtgtatggcgaattcaaaaaattctccagtaacgctgaagaatcggcatatgacgtggtacgtcgggtaaaatctatgaatttcctcgacgatctattgagaggcactcatggagataatatttactgtagatcaaccggagaaatagtattcaacagaaacgatataataagtaaactgaaacaggcatactcattcaaacaaatgctagtgacccaagaagtcttcaccaaaaaaagcgctctatttgaccaaacagtatacccatcaccagaaagagattcaaaaaaaagatcaggactaattccacgtaaaaaaggaatggacacagaaatttacggggggtattctggaaacaaagatgcatatttcgtattagctgaggctgtaaaagaaaaaggtcatacattacaaattgtaggcgtaccaattcgagcattaaacacattaaaaaactcagccaattattcggaaaagctattagaaattattaaaccccaagtaatgtttaataaggacacaggtaaaccaatcaaaggaattaaagacgtaaaaattttaatggacaaaattccatgccgacagccagtactagaaggtgaatcatactacatgctagcttctagtaaatatagatattccctaaaacaaatcagcttatcacaaatgtcgatgaaatatatactcgattatattgacgatcccaactttaacaaacatgaaatgataaatatagaccaacaagatgagaaagaatgcttgttaagcgtgtacgatgaaatactagaaaaaatggacaaatatttacctctattcgacattaggtccttcaggaagaaattacatgacggtagggacgctttcatagcactacctgtcgcgtccgaagaaaaaaaaccaggtaaagtcgatgtgataagaaaagtcctaaaaggccttcatgctaacgcagacataactaatttggccgaacttggatttggcactgcagccctaggcgctctcgtaagtacaggaggaattaagatatcggacgacgcagtttttatttatcaatcaccaaccggactgttcgaaagacgtgtaaaagtatcggacttactaaaatga

SEQ ID NO: 9141 - RNA, 4287 nt, synthetic construct
  misc_feature 1..4287: note = Cas9 variant
  source 1..4287: mol_type = other RNA
atgaagaaaatcctaggtttagatttaggtaccacaagtatcggatcagcatacgtgttggaagcagaaaaatccgcagagcaaacaaaaatagtatatctcggtacccgaataatactctcctcagccgatgcagagaacttttctaaaggattaagttgctccccgactaccgatagaacgttcaagcgttctatgcgaagaagactccaacgttataaacaaaggcgatcatcgctaatacaacagtttaagaaaattggaataattaccaatactgaacaaataataagagaacctatatccgaaacacatgaactactcaggattcgttccaaagcagtaagcgaacgagtatctctcgaagagttcgccagaatactcctgacaataaacaaacgcagaggatacaaatcaaatagaaaaactagcaaatctaccgaagaagatggaaaattagtcgatgctatggctgtaacaaaagaactaataaagctcaagaaaacccccggccaatatatgttcgaacgattcaaaaggggtaaatatgcagaaatagacttctacccgtttgatcttattaacgaattaaaacaaatatgggaagtccaaggacaaaaatatcctgatgttttaactgaagacctcttatcatcacttcttaaacagaaaacaggaaaagcaaaagaactcatatatagcaaatcagatttaaacccagcagaagtaccaatcgattatcaaaaaggcaaaaagttaagaaaaacaattttaaacaaatactttgcgtatgaatctagaagcctcgcagccaccaacattataccagtcgaacaagttattacggcaatagtagccatatgcaaacaaataaataattcatcaggatatcttggcgcaataggagatagatcacgagttctttacgcgaacaaccaaactataggccagtacttatatgaaagaataaaagcaaacccacatgacagaatacgaggcgaagtattctacagacaagactatctagacgaatttgatagaatatgggaatgccaacaaaactattatccagcaatcttaaccaacgatagaaaacagtttatacgaaaccgaataatattctatcagaggccattaaaatccaagaaaagcgaacttgccttttgtgagttcgaatccagagaagtagaacacaatggcaagaaatatacagaaggactacatgtcgcgccaaaaagttcaccagtttttcaacacttccgcttatggcaaagattgggacaaatagaagtttctccactacggaaatggaacaaacaaagcaatgaactattcgaacaacaaaacgacactgaccaagaaagaatactaaacacggaagcaaaacaaaaactgttttcatatctaaatttgctagaccatctcaccgataatgaaattctgaatattctgggatactcccctgacaaatggaaaattaatttcagagaaataataggcaacagaacgaataactcaatgatgaaagcatttttcaacatgaaagagatgactgatggtgaacaaattaattgggagaaaaacctaaccaaaattaccaatggccaatcattaatatcacccgaacaaatcgtggacttgatccgacaattcttcgagagagaaggaattacaacaagtcttctatactttgaccctacgacagataacttcagagaacaatcgcattactcattatggcacctactatacagttacgaagatgacaacagccctacaggtacgacatcactatgtaaaacactcgccaaaagatacggtataccacatgaactatgcccgctactagcctcgttaacatttgagcctcaatatggatctttatcaacaaaagccatgagaaaaattctcccttttatgcaggaaaatggttacgacaaggcttgtgaactcgcaggttacagacattcagcttggaccaccaaagaagaaaacactgagagaactctaaagaactcattaccacttctgagaaaaggatctctaagaaacccagtcgtagagaaaatactaaaccagatgactcacgtaataaatacacacatatctgaatacggcaatcccgatgaaataagaatagaaatggcacgtgacatgcaagccaactctaaacaaagaaaagccatgacaaccgccatagcagaagcaacgaaacgaaacacccaattcatcgaagaaattcaaaaagaatttggattcaatccaagcaaaaacgaccttataaaatacaaattatggaaagaactcgcaccattaggatcaaagacactctattcaaatacttacatccctaaagaggaattatttactgcaaaattcgaaatagagcatattatacctcgagcattattctacgatgacagcttctcaaataaaaccctcgaactaaattctgtaaacaaacttaaaggaaacaaaacagcactagattacatggatacactaagtcaagaacaggcaaacgattacattattagagttgaagaactaaagaaaatcggagcaataacacaagcaaaatataagaaattactaataagggagaaagacttaggtgacgacttcacaaatagagatctcaccaacaccagatacatcatcaggcacgcagcagacatgctacttcaagtcactccttcaatcgtccacactaacggtagtataacggcgatactaagaagagactgggagctactcgacatattaaaagaactaaatcttcccacatacgaatccatagatcgaaaaatatccgacccgaaggaaaaactaactgaatctgtggaaagaaaagacggacaagccataaaaatgataaaagactggtccaaaagagacgaccatcgacaccatgcaatggacgctttgataactgcactcaccacccgcaaacacgtccaatatctaaacggtaaccgaggggcagaagaaacagacaaagttcaaaaacttcaacaactaaaagctctacgtaaacagctaatcggatccgacggccatttcataccaccaatgcatgacataagggtgcaagcaaaggaagctctgagccgtgtcatcataagcacgaaagccaagggaaaagtaacaaccccaaataccaatattatatgctcaagagacaagacgacagggcgaaaaatatacgtcaaacagacaaccctaacaccccgtggggcgttacacaaagaaatgcaatatggctgtaaccattactatctagaaaaacaaatcccaataggttctaaactaaccgaagaagaaatcagacttgtaagctcacccaaaattagatcaatgttatccgaaagactccaagcatataacaacgaccccaaatcagcgtttactggcagaaattcaatggataagaaaccactcgaagataaaaataagaaattagtatataccgacaagaaagtaaaacaaaccatactggcaaaccgtttcgtaaaacgcgatcgggtaaactcgaaacttgacctagacaaagtaatcgatacaggcatcaaacgcattctagagagacgtcttaaacaatacggaggaaaatacgaaaccgcctttagtgaccttgaaaataatcctatatggttaaacgaagaaaaaggaattgcaataaaatccgtgagaatcaggggcaaaaataacaccataacaataagacaaactaatacatgtaggataaaatatgtggcaaacgacaacaaccaccatttagcagtatatgccctacccgacggatccatagaggatgatatagtgtctttcttcgacgcagttgaacgatctagaaaaggactcccaataatcgataaacacaaaaatcaatcactaggctggaaatttttattttcagttaaacaaaacgagtactttcttttaccgcagcaaggcgagaaaatagacatagatacaggagagataagcatgcagacaacattttcacctaaagacttaagtccagaatatattatgaaccccgacaactatgccgaattagcgccacacatctttagagtacaaagcatatcaaaaacgccacaaggtaaccgagacgtaagaatatacctgtttaaacaacaatacatttccggatcccagaaagattccctgcacctaaaaggaataacgcatcggcaaatatcatcagccaaagacctagcaggattagtgaagatacgagttaatcatctaggacgcattgtagcagtcggagaaaaatga

SEQ ID NO: 9142 - RNA, 4287 nt, synthetic construct
  misc_feature 1..4287: note = Cas9 variant
  source 1..4287: mol_type = other RNA
atgaagaagatactaggtctcgacttaggcacagcttcaatcggatcagcctatgtgcttgaagcagaaaaatctgcagaccaaaccaaaatcgtctaccttggtaccagaataatactatcatcagcagacgcagagaacttctctaaaggcttatcatgctcgccaaccacagacaggactttcaaaagaagcatgagacgccgactacaacgatacaaacaaagaagatcttctcttattcaacaattcaagaaaataggaataatcactaatactgaacaaataataagggaaccaatatcagagacacacgaattactacgtataagaagcaaagcagtctcagagagggtaagtctagaggagttcgcaagaatcttactcacaataaataaaagaagaggttataaaagcaacagaaaaacctctaaatctaccgaagaagacggaaaattagtcgacgcaatggcagttacaaaagaattaataaaactcaagaaaacacccggacaatacatgtttgaaagattcaaacgaggtaaatacgctgaaatagatttttatccatttgatcttataaacgaactcaaacaaatatgggaagtacagggccaaaaatatcctgatgtcttaactgaagatctcttatcatcactattaaaacagaaaacagggaaagcaaaagaacttatctattctaaaagcgatttgaatcctgcagaagtaccgatagactatcaaaaaggcaagaaactgagaaaaacaatattaaataaatacttcgcatacgaatcacgatctctcgcagtaacaaatatcatacctgtagaacaagccataaccgcgatcgtagctatatgcaaacaaatcaataactcatcaggctatcttggagcaatcggagaccgttcacgtgtattatatgcaaataatcaaacaataggacagtatctatatgagagaattaaagctaacccccatgaccggataagaggagaggtattttatagacaggactacctcgatgaatttgatagaatctgggaatgtcagcaaaactattacccagccatcctcaccaatgatcgaaaacaatatataagaaacaggataatattttaccaaagacccttaaaatccaagaaatcagaacttgcattctgtgagttcgaaagtagagaagtggaacataacggaaagaaatatacagaaggactacacgtagcaccgaaatcgtcaccagtatttcaacatttccgactatggcaacgattaggacaaatcgaggtctccccacttagaaaatgggataaacaaagtaacgaactatttgaacaacaaaacaatgcagatagagaaggcatcctaaatacagaagcaaaacaaaaattattctcttacttgaacctcttagaccacttaaccgataacgaaatactaaatatccttggatatagcccagacaaatggaaaattaactttagagaaataatcggcaaccgaacaaacaatttaatgatgaaagccttctttagtatgaaagaaatgacagatggagaacagatagattgggagaaaaacctaacaaaaattactaacggccaatcactcatatcacctgaacaaattgtagacttaatcagacaattcttcgaaagagaaggcattactacttcactactctatttcgacccagcgaccgacaatttcagagaacaaagccattattcactctggcacctactctatagctacgaagacgacaattcacccaccggcaccacaagtctatgtaaaactcttgcaaaaagatatggcatcccacatgaattgtgcccactactagccagcctcactttcgaacgacagtatggatccctctccacaaaagccatgagaaaactactaccatttatgcaagagaaaagatatgacgaagcatgcgaattagctggctatagacacagcgcctggattacaaaggaagaaaacgcaaaaagaactctaaagaacaaattacccttacttaggaaaggatcacttcgaaacccagtcgtagagaaaatccttaaccaaatgacacacgtaatcaacactcacatcgctgaatacggaaacccggacgaaatacgaattgaaatggcacgagacatgcaggcaaatagcaaacaaagaaaagcgatgacggcagctataactgaagcaacaaaacgaaacacacaattcatcgaagaaatacaaaaagagttcggattcaatccatctaaaaatgacttaataaaatacaaactttggaaagaactagcacctttaggcaacaaaacactctattcaaacatatacatccccaaagaagaattatttaccgccaaattcgaaatagaacacattatacctagggcattattttacgacgactccttctcaaataaaactctcgaattaaacagcgtaaacaaactaaaaggaaataaaactgctttagattacttagatacactgggccaagaaaaagcaaacgactacatcctacgagtagaagaattaaagaaaatcggcgcaataactcaagcaaaatataagaaattactaatacgagaaaaagacttaggagatgacttcaccaaccgagacctcacaaacacgagatatataatcagacacgcagccgacatgctactacaagtaacaccctcaatagtgcatactaacggtagcattacagcgatactccgacgggattggggcctcttagatattttaaaagaattaaacctaccaacatatgaatccatagatagaaaaatctccgatccagaagaaaaactcacccaatcagtcgacagaaaagacggacaagcaataaagatgataaaggactggagtaaaagagatgatcacaggcatcacgccatggacgctttaataacagccctcacgaccagaaaacatgtacagtacctcaacggtaacagcggagccgaagaaaccgataaggcacagaaattggaacaacttaaggctttacgaaaacaactaataggctcagacggacacttcataccacccatgcatgacatacgagtccaagcgaaagaagctctaagtagggtcataatatcaacaaaagtcaaaggaaaagtaactactcccaatacaaacataatctgttcaagagacaaaacaacaggtagaaaaatatacgtacgccaaaccacccttacgccacgcggagcactccatctagatactaaatacggaattaaccgttattatcaagaaagagaggtgtcaatagggtcaaaattaactcaagaagagataaggctagtgtcatcaccccacatccaaagcatactacttgaaagactaagagccttcgataacaaccccaaaagcgccttcaccggacgaaattccgtcgataagaaacccttagaggataaaaataagaaattagtatacacagacaagaaagtcaaacaaacaattttagcgaatcgatttgtaaaaagagatcaagttaattcaaaactcaacctagataaagtcatagataccggaattaaaagaatcttggaaggccgcctacaacaatacggtggcaaatatgaaacagcattctctgatctcgaaaacaatccaatatggttaaatgaagaaaaaggcatagcaattaaatcagtgcgcatccgcggtaaaaacaacgccatcccaatacaccaaacagatacttgtccaatagactatgtcgccaacgataacaaccatcatctagcggtatacgtattaccagacggtacaatagaagacgatatagtaacattctttgacgcagtcgaacgtagtcgacaagggctacccattgtcgacaaaaacaaaaaccaatcattaggttggaaatttctctttagcataaaacaaaacgaatactttctcttacctcaacaggctgagaaaatagacatagacacaggtgaaattagcactcaaacaacattcagcccaaaagacctaagccctgaatatataatgaacccagataattatgcagaactagcatcacatatttttcgagttcaaagcatctcaaaaacgccccaagggaacagagatgtgagaatctacttattcaaacagcaatacatctcaggatcacaaaaggatagcttacaccttaaaggaattacatacagacaaatcagttctgcaaaagatttagcagagctagtcaaaatacgagtaaatcatttaggtcgtatcgtatccgttggagaaaagtga

SEQ ID NO: 9143 - RNA, 4287 nt, synthetic construct
  misc_feature 1..4287: note = Cas9 variant
  source 1..4287: mol_type = other RNA
atgaccaaaaaaatcctaggactagatctgggaaccacatcaattggatgggcgtatgtgatcgaaagtgataatcccgatgaatcagaaataaaacaaataggcgttagggtcaatcctcttacaacagacgaacaaacaaacttcgaaaaaggaaaaccattcagcataaacaaagaacgaaccctcaaacgaggagcacgtagaaatctcgatcgatacaaagataggcgaaacaatctaatagaagtgttaaaaaaagcgaacatattaagtcaagactcaatcttaaccgaggagggtcaacacacgactcaccaaacttggcaactcagagcaaaagccgccgttgacaaaatagaaaaagaagaattggcccgagtattactcgcgataaacaaaaaaagaggttataaatcatcccggaaggcgaaaaacgaagatgaaggtcaagcaatagatggaatggccgtagctaaaagattatacgacgaacaaattacatgcggacaactagtttaccaactactaagagaagggaaaaaatccatacctgatttttacagatccgacctacaagccgaatttgataaagtctggaacttccagaaacaattctatcccaaaatcttaaccgatgaattttataaagaacttaaggggaaaggtcaacgcgcaactagtgctctcttttacaaaacatataatttcaatactgcagaaaacaaaggaagccgcgaggaaaaaaaaattcaagcatataaatggagaagtgaagcaataagccagcaactggagaaagaggaagtagcgtttgtactcacagaaatcaacaataatcttaataactcctctggatacttaggcgcaataagtgacagaagcaaagaactatatttcaacaaacaaacagtcggtcaatatttataccaacaactacaagagaatagacatgcaagactaaaaaaccaagtattttacagacaagactacttagacgaattcgaagctatttggaaagaacaagcgaagcaccatactgagctaacagaagagctcaaagcagaaattcgagacatcataatcttctatcaacgaaaactcaaatcacaaaagggacttataagcttctgtgaatttgaaagtagagaaatccaaattgatggcaaaaaaaaaacaataggattaagagtagcgccgaaaagtagccctttattccaggaattcaagatatggcaaaacttaaataatgttctcgttagaaaaaaaggcagtagaaaaaggaacgtaaaacaagaaatacaaggatcactcttcgaagaggaaaaagaaatctttgtattcgatttagaaacaaaagaaaaattattcgaagaactcaaccttaaagggaacctgagtgcaaacaaagtaatagaactcctcggccataaacccacagaatgggaaataaactattcagcgttagaaggaaatcgtacaaatcaagccctatacaacgcatacctaaaaatactagatatagaaggatatgatgaagacttgctaaaattaagtgataaagatgatatcaacgtcgcagacctgaaaactccagcatcagaaataaaaaatatggtcagagatatattccaagtattaggcatcagtactgatattttagaatttgacgcagaattagacggaaaagacttcgaacaacaagcaagctaccaactatggcacttactatatagctatgaaggcgatgattcccaatcaggaaacgaaaaactgtatgagctgctcgagaagaaatttggattcaaaaaagaacattcacaagtactagcaaatgtaacattatccgatgactatggtaatctaagctcgaaagcaatgaggaaaatttaccccttcataaaggaaaacaactatagtactgcttgtgaattagcagggtacaggcactcaaaacactctctaacaaaagaggaaatagaaaacagaccactagatgataaattagaactgctaaaaaaaaattcattaagacaacctgtagtcgaaaaaatactgaatcaaatggtaaacgtagtaaattctctactagaaaaaaatcgaaaagaaaaccctgactttagattcgatgaaataagaatagaactagctcgcgaactcaagaaaaatgccaaagaacgagcagagatgacaacaaacattaactccgcaaaaactgaaaacgaaaagatttttaagttactgcaagcagaatttggactcaaaaaccccactcgaaatgacattatcaggtatagactatatgaagaactgaaaaataacggttataaagacctatacaccaacaaatatataccacgtgaaatacttttctcgaaacaagtcgacatagaacacatcattccccagagcaggttgtttgacgatagcttcagcaacaaaacaatagtataccgagaaacaaacctagataaggggaaccaaaccgcattcgattatatagatagtaaatatggaaatgaaaaggtcgaagaatatatactcagaatagaagctctccatgacgcatggaaaaagaataaagaagaaggtatatcaaaagcaaaatatcaaaagctgcttaaaaaagaaacagaaattggtgacggttttatagaaagagacctcagggaatctcaatacatagctaaaaaagccaaagaaatgttatttaaaataacgcgaagcgtagtaagtaccagcggttcaataacagataaactccgtgaagattggggcctcatcaacattatgaaagaactaaacctaccaaaatatagaagcctaggattaacggaaatgcaagaaagaaaatttggacaaaaagtagaggtcatcaacgattggaccaaaagaaatgatcaccggcaccatgccatggatgcactaactgtggcatttactaaacataatcacatacaatatttaaattacctaaatgcacgtaaaaacgagaatcataaattacataataatataatagcaatagagaatctagaaacggaaacgatgatcgacaacaacggatctaaaaggagggtcttcaaggcaccgatgcctaattttagacaagttgctaaagaacacctggaaaacgtattaatatcacacaaagccaaaaataaagtagtcacaaagaacaaaaataaaatcgcaggaaaagtggctgcacaagaaaccctcacaccacgaggacaacttcacaaagaaacagtatacggaaaataccagtattacgtcaacaaagaagaaaaaatcggaacaaaatttgacgaggaaacaataaataaagttagcaacccgcaatacagaaaactcctattagaaaggttatccgccaacggaaacgatccaaaaaaagcattcagtggcaaaaacgcgctatcaaagaaccccatatatctaaacgagactaaaacagagactgttccggaagttgtcaaactaacatggttagaagaagattactccatcagaaaagatataactccagacaattttaaagacgaaaaatccatcgacaaaatactggatgaaggcgttaaaagaatactcaaaaaaagactacgaaaaaacgataatgacccaaaaaaggcatttagcgacctcgacaaaaaccctatatggctaaacgaagaaaaaggtatatccataaaaagagttacaatatcaggtgtaaacaacgcagaacccctccattataaaaaagatcactttggcaacgacatcctggatgaaaaaggggacaaaataccagttgattttgtatcaactggaaataatcatcacgtagcggtgtatagggatgaaaaaggaaatctccaagagaatatagtatccttcttcgaagcagtaataagggtcaaccaaggcttaccgataattgacaaagcctacaaccaacaccttgggtggcaattcctattcacaatgaagcaaaacgaaatgtttgtgttcccaaacgaaaaatctggcttcaatccacaagagatagacctactagatccatccaacaaaaaaaaaatatcaccgaatttgttccgagtgcaaaagatgagtaaagtgatttatggtaacagtcctgtaagagaatacgtattcagacaccacttagaaaccaacgttgatgagaagaaagagctaaaagacataacattcaaaaacataaaaagcctgggatactttgaagacatagttaaagtacgaatcaaccacctaggagatatagtatcagtaggagaatattga

SEQ ID NO: 9144 - RNA, 4293 nt, synthetic construct
  misc_feature 1..4293: note = Cas9 variant
  source 1..4293: mol_type = other RNA
atgaaacacatactaggattagacttgggtacaaactcaataggatgggcagttgtaaaagaagcacaaaacgataacgaacaatcagaaatagtcgatgttggggtaagagtgaacccactcacaacagatgagaaaactaatttcgaaaaaggaaaaccgataagcacaaatgcggatagaacattaaaacgaagcgcacggagaaaccttcagagatacaaattaagacgaaaagaattaattgaactcttaaaagaacaccaacttattagcacagacacaatactcacagaaaatggaaaaggaaccacattccaaacactagaactaagagcaaaaagcgcaaaagagaaaatatcgctagaagaactcgcaagagtattcctcactatcaataagaaaagaggctataaatcttcacgaaaagctaaaaatgaagatgaaggacagctgatagatggaatggaaattgcaaaaagactatacgaagaaaatctaactacaggacaattatcattacagttgttaaaagaaggcaagaaatccttaccagactattacaggtcagatcttcaatttgaactagacaaagtctggaatttccaaaaacaatttcattcagacattttaacagatgaattttatgcacaacttaaaggaaaaggacaacgagcaacgagcgcacttttcctagcaaaatatcaaatatacactgctgaaaataaaggatcaagagaagacaagaaattacaagcatatcaatggagagtagacgcactaagcaaagaactaacaagggaacaactggcattcgtaataacagaaataaataacaacttaaacaactcaagtggctacctgggtgcaatatcagatagaagcaaagaattgtatttcaacaatgaaactgtaggagagtatctatggaaacagatagctgcaaatcctcatacaagtttgaaaaatcaagtattttatagacaagattatctagacgagttcgaacaaatatggaaaacacaatcggcattctaccccgaaattctcacagacgaactcaagaaagagctaagagacgttgtaatcttctaccagcggaaactaaaatcacaaaaatcattagtttccttttgtgaatttgaaaataaagagattgagatcaagaaagaagatggaacatccacaaagaaagtcataggattaaaagtcgcaccgaaaagctcaccactattccaagaatttaaaatttggcaaaacctaaataacgtattaattagaaagaaaggcagtaaaacgaagaaagttgccaaaaaccaacaggcggttcttttcgaagaggagaaaacgatatcggaactggaccttgaagcaaaacaagctctcttcaatgagctaaatctaaaagggaatctaaaagcagattactgtttagaaatactaggttattctccaaaagaatgggaaatgaactattcagtattagaaggtaacagaacaaacaaagcattatatgaagcatacctcaaaatcacagatctagaaggttatgacgccaaaaaccacctaaaagtcaaactaaataaagacgaggtcgaattagatgacctaaaagttcctgcatccgagataaaagatatggtgcaagctatattcaaagaagcgggaataaacacagacatattacatttcaatgcagaacttgacggaaaagacttcgaaaaccaagcatcatatcaactatggcacctcctgtactcatatgagggcgacgatagcaaatctggaaacgaattactatataaactccttgaaacaaaatttggtttcaagaaagaatatgcccaaatattagctaacgttagcttatccgacgattacggatctctaagcacaaaagcaatgcggaaaatccatccctacataaaagagaacaaattttcaactgcgtgcgaactagctggctatagacattcgaaacattcgttaaccaaagaagaaaacgataacagagtattgaaagattctctagaagtactcaagaaaaacagcctacgacaaccagtagtagagaaaatcctcaatcaaatgataaatctagttaatgcactactgaagaaatatcgaacagaaaacccaaatttcaaatttgatgaaataagaatagaactagcaagagaactcaagaaaaacgcagaagaacgagcaaacatgactgccaacataaataaagccaaaaccgaacatgagaaaatcataaaaatacttaaaaatgagttcggactaccaaatccgactagaaatgacattatcagatatagattatacgaagaactaaaagccaatggatataaagacctttataccaatatcaaaatcccacaagaaaaactatttactaaagaaattgatatcgaacacatcatacccaaatcaagggtattcgatgatagtttctcaaacaaaacattatcttttagaaaaacaaatttggataaaggcgaacgtactgcatttgactatatggagtcaaaatttggagcagataaattagaagaatatgtagcaagagtagaagacttatataaaaataatataatatctaaagcgaaataccaaaaattgctaaagaaagaatctgagataggagacggcttcgtagaaagggatctgcgagaaacacaatatatagctaagaaagcaaaagagattcttctacagataacaccgaacgtactatcaacctcaggtggcattacagaccgcttgagagaagattgggatctaataaacgtcatgaaggaattaaacctcccaaaatatagagcgctaggactaacccaaatggaagacagaaaatatggacaacaagtcgaagtaatcacagactggacaaaacgtaacgaccatagacatcatgctatggatgccttaactgttgcgttcaccaaacacaaccatatccaatacctaaactatctaaatgctaggaaaaacgaaaaacataaagaacacagtaatattatgggaatacaacaattagaaacaataaaagtcacagacaaaaacggaaacgagaaaagagtctttaaagcaccaatgccgaacttccgacaagtaacaaaagcatttcttgaaaacatcctaatcagtcataaagccaaaaataaagtagtcaccaaaaacaaaaacaaagtagccggaagtaacaaagtccaagaggtgctaacaccaagaggacaactccataaagaaaccgtatacggaaaatatcaatactacgtacaaaaagaagagaaaataggcgctaaattcgatttagaaaccataaagaaagtcgctaacccattgtaccaatcattattaaagaaaaggctagaagaaaatggaggtgaccccaaaaaggctttcacaggcaaaaatagcttagccaaaaacccgatttatttagatgatacacaaacagaacaattaccagaaaaagtaaagctagtgtggcttgaaaacagttttagtattagaaaagacataacaccggaaaattttaaagatgaaaaattaattgacaaaatcctcgacgagggtgtgaaaagaattttaaaagaaagattacaaagtttcggcaatgacgccaagaaagcattctctgatttagacaaaaacccgatctggttaaacaaagaaaaaggcattacaattaagagagttactataagtggagtagcaaacgcagaacccttacacaccaagaaagaccacctaggaaaagaaatactagataaagaagggaaaccaataccagtcgacttcataagcacaggatcaaatcaccatgtggcagtatacagagacgaaaagggcaatctgcaagaaaaagtagtgagcgtttttgaagcagtcgttagggcaaatcaaggattaccaataattgataaaacttataaccaacaccttggatgggaatttttatttacaatgaaacaaaacgagatgttcgtctttcccaacgaaagcacaggattcaacccaaatgacatcgacttactagaccccaaaaacaaaaggattatcagtccaaatttattcagggtccaaaagttcagtaaactgcaatacggaaattcatttgtaagagagtttgttttccgacatcacttagaaactacagtggaagatagaaaagaactacaaggaataacatacaaacaaatgaaaaatagtacatttttcaacgatattataaaagtacgcataaatcacctaggagatatagtgagtatcggcgaatattga

SEQ ID NO: 9145 - RNA, 4293 nt, synthetic construct
  misc_feature 1..4293: note = Cas9 variant
  source 1..4293: mol_type = other RNA
atgaaacatatactaggtttagatcttggtactaattcaataggatgggctgttgttaaagaagcacaaaacgataacgaacaatccgaaatcgtcgacgtcggagtaagagtaaatccacttaccacagatgaaaagaccaacttcgaaaaaggcaaaccaatttcaacaaacgcagatagaacactaaaacgatcagccaggcgtaatcttcaaaggtataaactaagacgaaaagaactaattgaactactcaaagaacaccaactcatatctacagacacaatactaacagaaaatggaaaaggcactacattccaaaccctagaactaagagctaaatcagcaaaagaaaaaatttcactagaagaactagcacgtgtcttccttacaattaacaaaaagaggggttataaatcatcaagaaaggccaaaaatgaagacgaaggccaattaattgatggtatggaaattgcgaaaagactttatgaagaaaacctaacaacaggacaattaagtttacaattactgaaagaagggaaaaaatcgctaccggactactacagaagtgatctccagttcgagctagataaagtttggaatttccagaaacaattccactctcacatactcacagacgaattttacgcccaactaaaaggcaaaggacaacgtgcaacctccgcactattcctagcaaaatatcagatttacacagcagagaataaagggagtagagaagataaaaaactccaagcataccaatggcgtgtagatgcattaagcaaagagttaacacgcgaacaacttgctttcgtgatcactgaaattaataacaatttaaacaattcgtcaggatatctaggagcaatatcagacagaagtaaagaattatactttaataacgaaacagtaggggaatatttatggaaacaaatagcagctaacccacacaccagcctaaaaaatcaagtgttctacagacaagattaccttgatgagttcgaacaaatatggaaaacacaatctgcattctacccagagatactaacagacgaattaaaaaaggaactaagagacgtagttatattttaccaacgcaagttaaaatcccaaaaatcgttggtaagtttctgcgaatttgaaaataaagaaatagaaatcaaaaaagaagacggcaccagcacgaaaaaagtaataggactaaaggtcgcaccaaagagtagtccactatttcaagaatttaaaatatggcaaaatcttaacaacgtactcatacgtaaaaaaggatctaaaaccaaaaaggttgataaaaatcaacaagctgtcttattcgaagaagaaaaaacaatattcgaattagacttagaagccaaacaagcactgtttaacgaacttaatctaaaaggaaaccttaaagcatattattgtcttgagatacttggatatagcccaaaggaatgggaaatgaattattcagttctcgaagggaacaggaccaataaagcattatatgaagcttacttaaaaataaccgatcttgagggatacgatgcaaaaaaccacttaaaagtcaaactaaacaaggatgaagtagaactcgatgatcttaaagtcccagcatctgaaataaaagatatggtacaagcaatctttaaagaagctggaatcaacactgatattctacactttaatgcagaattagacggaaaagattttgaaaaccaagcatcctaccaattatggcatttactttacagctacgaaggagacgactcaaaatcaggcaacgaattactctacaaactgcttgaaacgaaatttggattcaagaaagaatatgcacagattctagccaacgtgtcactgagcgacgattacggatccttatctactaaagccatgcgcaaaatacacccatatatcaaagaaaacaaattctccactgcatgtgaattagccggatacagacactccaagcactccctaacaaaggaagaaaacgataacagagttctaaaggattctctagaagtattgaaaaagaactcactacgacaaccagtagtcgagaaaatcttaaatcagatgataaacctagtaaacgccctactaaaaaagtacagaacagaaaacccaaattttaaatttgacgagattagaattgaacttgcacgcgaactcaaaaaaaacgcagaagagcgggcaaacatgaccgtaaacattaataaagcgaaaacagaacacgaaaaaatcataaaaattttaaaaaacgaattcggactaccaaaccctacacgtaatgatataataagatacagattatatgaagaattaaaagcaaacggctacaaagacctatatacaaatgaatatatagaaaagcaagacctattcaccaaaaacattgatatcgaacacatcattcccaaaagtcgagtattcgatgacagcttttcaaataaaaccctatctttcagaaaaactaatttagataagggagaacgcacagcattcgactacatagaatcaaaattcggtgcagataagctagaggaatacgtcgcaagagtagaagacttatacaaaaataacataattagcaaggctaaataccaaaaattgttaaagaaggaatcagaaataggcgacgggtttgttgagagagatctcagggaaactcaatacatagcgaaaaaagccaaggagattttgttacaaataaccccaaacgtactatcaaccagtggaggaatcacagaccgactacgagaggactgggatttaataaacgtgatgaaggagctaaacttacccaagtacagagctttaggtctaacacaaatggaagataggaaatacggacaacaagtggaagtaatcattgattggactaaacgaaatgaccacagacatcatgcaatggacgctctcacagtagcctttacaaagcataaccatatacaatacctgaattatctaaatgctagaaaaaacgaaaaacaccgtgaacattccaacataatgggaatccaacaattagaaaccatcaaagtgaccgacaaaaacggcaatgagaaaagagtattcaaagctcccatgccaaactttagacaagtaacgaaagcttttttagaaaatgtcctcataagtcataaagcaaaaaataaagtcgtaactaaaaataaaaacaaagtcgcaggatctaacaaagtacaagaagttttaacgccacgtggccaattacacaaagaaacagtatatggtaaataccaatactatgtacaaaaagaagaaaaaatcggagggaaatttgacctcgaaacaataaaaaaagtagcaaatccactctaccagagcctactaaagaaaagactagaggaaaatggaggcgacccaaaaaaagcttttacaggaaaaaacagtttagcgaaaaacccaatatatctggatgacgctcaaacagaacagctaccagaaaaagtcaaacttgtgtggttagaaaacagtttctccattagaaaagatatcaccccagaaaatttcaaagatgaaaaactcattgacaaaattctggacgaaggcgtaaaacgcattctaaaagaacgattacagtccttcggtaatgacgcaaaaaaagcgttctcggacttagataaaaaccccatatggttaaacaaagaaaaaggaatagcaattaaaagagttgcaatatcaggcgtagcaaatgcggaacctctacacactaaaaaagaccatttaggtaaagaaattttagataaagaaggaaaatcaatacctgttgatttcatttcaaccggcaataatcaccatgtggcagtttacagggatgaaaaaggaaatctacaagaaaaagtcgtctcagtatttgaagctgtagttcgtgcaaaccaaggtctcccaataatagataaaacatacaatcaacacctaggatgggaattcttatttactatgaaacaaaatgaaatgtttgtattctcaaatgaatctacaggatttaatccaaatgatatagatctactagaccctaaaaataaaaaaattatatcaccaaacttgttcagagttcaaaaattcagtaaactacaatacggaaacagcttcgtaagagaattcgtttttcgacaccatctagaaacaactgttgaagaccgaaaggaattacaaggcatcacatacaaacaaatgaaaaactctgcattctttaacgacataataaaagtacgaatcaatcatttaggcggaatcgtatcagtaggagaatactga

SEQ ID NO: 9146 - RNA, 4293 nt, synthetic construct
  misc_feature 1..4293: note = Cas9 variant
  source 1..4293: mol_type = other RNA
atgaaagacatactaggcctagacttaggaacaaacagcatcggttgggcagtagtaaaagaagcacaaaatgataacgaaacttccgaaatcgtagatcttggagtccgcgtaaaccccttaacaaccgacgaaaaaacaaattttgagaaaggcaagcccatatcaacaaatgctgatagaacattaaaaagatcagcacgtagaaacctgcaaaggtataaactgcgacgaaaagaactcatagaacttttaaaagaacatcaactaatatccacagatacaatcctaacagagaacggtaaaggaacatcatttcaaacactagaattaagagcgaaatctgcaaaagaaaaaataagcctagaagaattagcgagagtatttctgacaatcaataaaaaacgaggttacaaatcatcacgtaaagcaaaaaatgaagacgaaggacaattaattgatggaatggagatcgcaaaacgattatacgaagaaaacctgaccactgggcaattaagcctacaactattaaaggaaggcaaaaaatcactgcctgattattatagatcagaccttcaatttgaactagataaagtatggaacttccaaaagcaattccattcgcacatactgaccgatgaattttacgctcaattaaagggcaaaggccaaagagcgacgagtgcactattccttgcaaaataccagatctacactgcagaaaataaaggcagtagagaagacaaaaaacttcaggcatatcaatggagagtagatgcattatctaaagaactcaccagagaacaattggctttcgtgattaccgaaataaacaacaacctaaataatagttcagggtaccttggagctatatctgacagaagcaaagaattatacttcaacaatgaaaccgtaggggaatacctctggaaacaaatagcagcaaaccctcacacgtccctaaaaaaccaagttttctaccgacaagattatctagacgaattcgaacaaatatggaacacacaagcccaattctacccacagatactcacagatgaattaaaaaaggaattaagagatgtagtgatattttaccaacggaaattaaaatcacaaaaaagtttagttagtttctgcgaattcgaaaataaagaaatagaaatcaaaaaggaagacggtacaagcactaaaaaagtgataggacttaaagtagcccctaagtcctctcctctattccaagaattcaaaatatggcaaaacttgaataacgtattaatacgcaaaaaaggatcgaaaacaaaaaaggccgcaaaaaaccagcaagcagtcttgtttgaagaagaaaaaacaatatctgaattagacctcgaagcaaaacaagcattgtttaatgaacttaatctaaagggaaatctaaaagcagactactgcctcgaaatattaggctactcaccaaaagaatgggaaatgaattacagtgtgttagaaggaaacagaaccaataaagcactatacgaagcatacttgaaaattacagacctagaaggatatgacgcaaaaaatcacctaaaagtaaagttaaacaaagacgaagtcgaattagacgacctcaaagtcccagcttcagaaattaaagacatggtacaggctatcttcaaagaagcaggtatcaatacagacatcctccacttcaatgcagaacttgacggcaaagatttcgaaaatcaagcaagctaccaactatggcacctattgtattcatatgagggagacgatagcaaatccggaaacgaactcctatacaaactgctggaaaccaaattcggtttcaaaaaagaatatgctcaaatactagcaaacgtctctttgtccgacgactatggaagtctaagcacaaaagcaatgagaaaaatacacccatacataaaagaaaacaaattcagtacagcatgcgaattagccggatacagacatagtaagcatagcttgacaaaagaagaaaacgacaacagagtacttaaagattcattagaagtactaaaaaaaaactccttaagacagccagttgtagaaaaaatattgaatcaaatgataaacctcgtaaatgcactactgaaaaagtatagaacagaaaaccccaacttcaaatttgatgaaatcagaatagagctcgcacgagaattaaaaaaaaatgctgaagaaagagcaaatatgactgcaaacatcaacaaagcaaaaacagaacacgaaaaaataatcaaaatactgaaaaacgaatttggattgccgaatcccacaagaaacgacattattaggtatcgattatatgaagaacttaaagcaaacggatacaaggacctatacacaaacattaaaatcccacaagaaaaactatttacaaaagaaatagacatcgagcatataatcccaaaatccagagtgttcgatgacagtttctcaaacaaaacactgagcttcagaaaaacaaatctagataagggcgaacgaaccgcatttgactatatggaatcgaaattcggagcagacaaactagaagaatacgtagcgcgtgttgaagatctatacaagaataacataataagtaaagcgaaataccaaaaactattaaagaaagaaagtgaaataggagatggattcgtcgagagagatttaagagagactcaatatatagcgaaaaaggcaaaggaaatcctcttacaaatcactccaaatgtactaagcactagtggcggaataaccgatcggttacgtgaagactgggacttaataaatgttatgaaagaattaaacctacccaagtaccgagcactaggtttaaccgaaatggaagatcgaaagtatggtcagcaagtagaggtgattattgactggaccaagaggaatgatcaccgtcaccatgcaatggatgcgttaactgtagcgtttacaaaacataatcacatccagtacttaaattacctaaacgctagaaaaaacgaaaaacataaagaacattccaacatcatgggtatccaacagctggaaacaattaaagtgacggacaaaaatggcaatgaaaagcgagtatttaaagccccaatgccaaatttcagacaagtaacaaaagcattcctggaaaacatcctcatatctcataaagccaaaaataaagttgtaaccaagaataagaacaaagtagcaggatccaacaaagtgcaagaagtactaacaccacgaggacaattacacaaagaaacagtatacggaaagtaccaatactacgttcaaaaagaagaaaaaataggtggaaaatttgacctagaaaccataaagaaagtagccaacccattataccaaagcctcttaaaaaaaagattagaagaaaacgggggggatccaaaaaaggcctttacaggaaaatacagcctagccaaaaatcccatatacctggacgatgcccaaacagagcagttacccgaaaaagttaaattagtatggttagaaaattccttttccattagaaaagacattacgccggaaaatttcaaagacgaaaaattaatagataaaatattagatgaaggcgttaaaaggatcttaaaggaaagactgcagtcattcggcaacgacgcaaaaaaggctttcagcgacttagacaaaaacccaatttggcttaacaaagaaaagggaatcactataaaacgagtaacaatctccggcgtagcaaatgccgaaccactacatactaaaaaagaccacctaggaaaggaaatattagataaagagggaaaaccaattccagtcgatttcatatcgacagggagtaatcatcatgtagccgtatacagagatgagaaaggaaatctacaagaaaaagtggtctcagtatttgaagcagtagtcagggccaatcaaggcctacccataatcgacaaaacatacaatcaacacctaggatgggaatttctattcaccatgaaacaaaatgagatgttcgtatttcccaatgaatctacaggattcaatccaaacgacatagatttactagaccccaaaaacaaaagaatcatctccccaaacctattccgcgtccaaacaatctcagtggttaaatacggaaatgctatagtacgggactttaaattcagacatcacctcgaaactacagtagaagataaaaaggaacttcaaggtaaaacatatcaacaaattaaaagtctaagcccccttaacgatataatcaaagtcagaataaatcatttaggagacatcgtttcagttggtgaatattga

SEQ ID NO: 9147 - RNA, 4293 nt, synthetic construct
  misc_feature 1..4293: note = Cas9 variant
  source 1..4293: mol_type = other RNA
atgaaacatatattaggtttagacctaggtactaattcaataggctgggcatacgtgaaagaagcagaaaacgatacggaaacttcagaaatagtagacctaggagttagagtaaatccactaacaacagacgagaaaacaaacttcgaaaaaggaaaaccaatatcaacgaacgcagacagaactttaaaaagatcggcacgacgtaacctacaacgatataaactaagacgaaaagaacttattgaattattaaaagaacaccaactgatctcagaaaatacaatcctcactgaaaacggaaaaggcactacattccaaacactagaactaagagcaaaatcagcaaaagagaaaatttctctcggtgaattagccagagttttcttaaccataaataagaaacgtggctacaaaagttctcgaaaagccaaaaatgaagacgaaggccaactaatagacggaatggaaatcgcaaaacgactctatgaagaaaacttaacaaccggccaattatccttacaattattgaaagaagggaagaaatcattaccagactactacagaagcgacctacaattcgaactagataaagtatggaattttcagaaacaattccatagtgatatcctcacagacgaattttatgcccaactgaaaggaaaaggccaaagagccacctcggcactctttctagcaaaataccaaatatataccgcagaaaacaaaggatcaagagaagataagaaactacaggcctaccaatggcgagttgatgcattatcaaaagaacttaccagagaacaattagcatttgtaataaccgaaatcaataacaatctaaacaactcatcaggctaccttggggcaatatctgacaggagcaaagaactgtatttcaacaacgaaaccgtaggagaatacttatggaaacaaatagcagccaacccacataccagcctaaagaatcaagtattttatcgccaagactatttagatgagttcgaacaaatatggaatactcaagcacaattctatccccaaatacttacagatgaactaaagaaagaattaagagacgtagtcatattttaccaaagaaaattaaaaagtcaaaaatcattagttagcttctgtgaatttgaaaataaagaaatagaaatcaagaaagaagatggaactagcactaagaaagttataggtttaaaagttgcaccgaaatctagtccactatttcaagaatttaaaatctggcagaatctaaacaacgtactcataaggaagaaaggctcaaaaacgaagaaagcggctaaaaaccaacaagcagtactattcgaagaagagaaaacgatatcagaactagatctagaagcaaaacaagcactatttaatgaactaaacctaaaaggcaatttaaaagcagactattgcctcgaaatactaggctacagtccgaaagaatgggaaatgaattattccgtcctagaaggtaatagaactaacaaagcattatacgaagcctacctaaaaatcacagacctcgaaggttatgatgccaaaaaccatttaaaagtaaaattaaataaagacgaagtagaactagacgatttaaaagttcccgcatcagaaataaaagaaatggttcaagcaatttttaaagaagctggaataaacacagacatccttcacttcaatgcagaactagacggtaaagatttcgagaaccaggcttcataccaactgtggcacctcctatattcctacgaaggagatgactcgaaatcaggtaacgaattattatataaattactagagacaaaattcggtttcaagaaagaatatgcacaaatacttgcaaacgttagcctgtcagacgattacggtaacctgagcaccaaagctatgaggaaaatttatccatacataaaagagaataaattttctacagcttgcgagctagccggctatcgacactccaaacattcactaacaaaagaagaaaacgataacagagtactcaaagactccctagaagttctcaagaaaaactcactaagacaaccagtagtagagaaaatactaaaccaaatgataaacttggtaaacgcacttttgaagaaatacagaacagaaaatcctaacttcaaatttgatgaaatcagaatagaactggcccgcgaactaaagaaaaacgcagaagaaagagcaaacatgactgctaatataaacaaagcgaaaacggaacatgagaaaatcataaaaatactcaaaaacgaatttgggctaccaaacccaacccgaaacgatattattcgatatcggctatacgaagaattaaaagcaaacggatataaagacctctatacaaatataaaaattccgcaggaaaaactctttaccaaagaaattgatatagagcacatcataccaaaatccagagtcttcgacgacagtttcagtaacaaaacattatctttccgaaaaacaaacctcgataaaggcgaaagaacagcattcgactacatggaaagtaaatttggagctgacaaactagaagagtatgtagctagagtagaagacttatacaaaaacaacatcatatcaaaagctaaatatcagaaactactgaagaaagaatccgaaatcggtgacggattcgtagaacgtgatctaagggaaacacagtatatagcgaagaaagcaaaggaaatattgttacaaataacaagaaatgtactttccaccagcgggggtataaccgatcgattaagggaggactgggacctcgtcaacgtaatgaaagaactaaatctaccgaaatacagagcactaggactaacagaaatggaagaccgtaagtatggtcagcaagtggaagtaatcatcgactggacaaaaagaaatgatcatagacatcacgcgatggacgcactcacagtagcatttacaaaacacaaccatattcaataccttaactatttaaacgcacgtaaaaatgaaaaacaccgcgagcattctaacataatgggaatccaacaattagaaacaatcaaggtaactgataaaaatggaaacgagaaaagagttttcaaagcaccaatgccaaacttcagacaagtcacaaaagcattcctagaaaacgtattaatatcccataaagccaaaaacaaagtcgtaaccaagaataaaaataaagtcgcagggtcaaataaagtacaagaagtgctcacaccgagggggcaattacacaaagaaaccgtttacggaaaataccagtactatgtccaaaaggaagagaaaattggagggaaattcgacttagaaactattaaaaaggtcgccaacccattataccaatctttactaaagaaacgactagaagaaaacggaggagatccaaagaaagcattcacaggcaaaaattcgttagctaaaaatcccatctacttagacgacgcacaaactgaacaattacccgaaaaagtaaaactcgtttggttagagaactctttttcaattagaaaagacattacaccagaaaattttaaagatgaaaaactaatcgataaaatattagatgaaggagtaaaacgtatactaaaagagagattacagtcatttggaaacgatgccaagaaagccttctcagacctggataaaaaccccatctggctcaataaagaaaaaggaattacgataaagagagtaactatctcaggagtggcaaatgccgaacctttacacacgaaaaaggatcacctagggaaagaaattctagataaagaaggaaagcccattccagtcgactttataagcacaggtagcaaccaccacgtcgcagtgtatagggacgaaaaaggaaatctccaagaaaaggtcgtttcagtctttgaggcggtagtacgtgcaaaccagggcctaccaatcattgacaaaacttacaatgaacatttaggttgggagttcttatttacgatgaaacagaacgaaatgttcgtattccccaatgaatctacaggattcaacccaaacgatatcgacctgttagaccccaaaaataaacgaataataagcccaaacctatttagagtacaaactattagcgtagtaaaatacgggaacgccatcgtacgagattttaagttcagacatcatcttgaaactactgttgaagataagaaagaactacagggcaaaacatatcaacaaataaagagcttaagtccgctaaatgacatcataaaagtcagaataaatcatttaggggatatagtaagtgtcggggaatactga

SEQ ID NO: 9148 - RNA, 4293 nt, synthetic construct
  misc_feature 1..4293: note = Cas9 variant
  source 1..4293: mol_type = other RNA
atggcacaaaaatatatactcggattagacttaggaaccaactccattggatgggccgtagtaaaagaagcagaaaacgacaatgaacagtcagaaatagtcgacgtaggagttagagttaatccactgacaacggacgagaaaaccaacttcgaaaaaggcaaaccaatatcgaccaacgcagacagaactttaaaacggggagcacgaaggaacctacaaagatacaaactaagacgaaaagaactaattaaaatattaaaagaacatcaactaataagtgacgatactatactagctgagaacggaaaaggaacaacatatcaaaccctaaaattaagagccaaatcaagtaaagagaaaatcagtctagaagaactcgccagggtttttctaaccataaacaagaaaagaggatacaaatcatcgcgtaaaaccaaaaacgaagatgaaggacaattaatagacggaatggaaattgcaaaacgcctatacgaagagaacttaacaacaggacaactaagtttacaactcctcaaagaaggaaagaaatctctacctgactactaccgatcagacctcgaactcgaattagataaagtctggaactttcaaaaacaatttcactcagacatacttacagacgagttctatacgcaactaaaaggtaaaggacaacgcgccacgtcggcgctatttcttgaaaagtaccaaatatatacagtagagaacaaaggaaatagagaagagaaaaaccttcaagcataccaatggagagtggatgccctaagcaaagaactaacaagagaggaactagcatttgtaattacggaaatcaataataacttaaataattctagtggatacctaggagcaatatcagatagatcaaaggaattgtattttaacaacgaaacagtaggagaatacttatggaaacaaatcgccgctaatccacacaccagtctgaaaaatcaagtattctacagacaagactacttagacgagttcgaaaggatatggaacacacaggctcagttttacccacagattttaaccgaaagtttaaagaaagaattaagagatgtagtaattttctaccaaagaaaattaaaatcacaaaaatctctagtgagtttttgcgagttcgaaaacaaagaaatagaaatcaaaaacgaagatgggacaacaacaaagaaagtaataggactaaaagtggcacccaaatcaagtcccctcttccaagaatttaaaatttggcaaaacttaaataatgtattaatcagaaagaaaggaagcaaaaccgaaaaagtcgccaaaaatcagcaagtagtgttgttcgaagaagagaaaacaataagtgaattagacctggaagcaaaacaagctctctttaacgaactcaacctaaaaggaaacttaaaagcagattactgcctcgaaatattgggatatagttcaaaagagtgggaaatgaactatagtgtactggaaggaaacagaacaaataaagcactatacgaagcctatctcaaaataacagatctagaaggatatgatgccaaaaattacctcaaagtaaaaagtaataaagatgaagtggaactagacgatctaaaagtccccgcctcggaaataaaagaaatggtccaagcaatatttaaagaagcaggaataaatacagacatactccatttcgatgcagaacttgacggaaaagattttgaaaaccagggtagttacaaactatggcacctgttatactcttatgaaggagatgatagcaaaagcggaaacgaacttttatataaactcttagaaacaaaattcggattgaagaaagaatatgcccaaatcctcgccaatatctccctctcagacgactacggcaacctatcaaccaaagcaatgagaaaaatccacccctacattaaagaaaacaaattttcaactgcatgcgaactagcgggatatcgacacagcaaacattctctaacaaaagaagaaaacgaaaaacgagttcttaaagacggcttagaagtactaaagaaaaacagtttaaggcaacccgtcgttgagaaaatactcaatcaaatgattaatctagtaaacgcgttattgaagaaatacagaaccgaaaacccaaattttaaatttgatgaaatccgaattgaactagccagagaactgaagaaaaacgcagaagaacgtgctaacatgacggcaaatataaacaaagcgaaaaccgaacacgagaaaatagataaaatattaaaatcagaatttggattaccaaaccccacacgcaatgacatcatccgctacaggttatacgaagaattaaaagcaaacggatataaagatctttatacaaatagatacatatcttctgaaaaattattctcgaaagaaatagatatcgaacatatcattcccaaatcaagagttttcgatgactctttttctaataaaacaatcgtataccgtacggataacctcgataaaggcgaacaaactgcttatgactacattgaatcgaaattcggagccgaaaaacttaaagaatacatgactcgagtaaaagacctatatcaaaagaaaatcatcagtaaagcgaaatatcaaaaactattaaagaaagaatctgaaatcggcgacggatttgtagaaagagatctacgtgaaacacaatatatcgcgaagaaagcaaaagaaattttactacaaataacacacaacgtcctctctacatcaggcggaattacagacaggctcagaaaagattgggggcttgtcaacgtgatgaaagaattgaacctcccaaaatacagagcattaggcttaactaaaatggaagaccgaaaatatggacaacaggtagaagttattacagattggaccaaaagaaacgaccttcgacaccacgcaatggacgcgctaaccgtagcgttcaccaaacataaccatatccaatatcttaactatctcaatgcaagaaagaatgaaaaacacaaagaacacaacaacataatggcaatccagcaactagaaaccataaaagtaacggacgaaaatggtaacgagaaacgaatcttcaaagccccaatgcccaactttagacaagtagcaaaaacatttttagaaaatgtattaatatctcacaaagccaaaaacaaagtcgttactaaaaataaaaacaaaatctcagggagtaataaagtgcaggaagtacttacaccaagaggacagttacacaaagaaacagtctatggtaaatatcaatattacgtacagaaagaagagaaaataggagcaaaatttgatagtgaaaccattgaaaaggttgcaaatcccttatatcaatcactactcaagaaacgattggaagaaaacggtggcgacccaaagaaagcgtttaccggtaaaaactcacttgccaaaaacccaatatacctcgatgatacacaaactgaacaactacccgaaaaagttaaattggtatggttagaaaattctttctcaataagaaaagacataacacccgaaaacttcaaagatgaaaaattaatagacaaaattttagacgaaggcgtcaaaagaatactgaaagaaagactgcagtcgtttggaaatgatgcaaagaaagcattcagcgatctagagaaaaatcccatatggctaaataaagaaaaaggcatagcaattaaacgagtgacaatatctggagtagctaacgcagaaccactccacacaaagaaagatcatctagggaaagaaatattagataaagaaggcaaacctattccggtcgattttatatcaactggaaacaaccatcacgtagcagtctacagagatgaaaaaggaaaccttcaggaaaaagtcctatccgtatttgaagcagtggtgcgagcaaatcaaggtctacctataatagagaaaacttataatcaacacttgggatgggaatttctattcagcatgaagcagaatgaaatgtttgtattccctaacgaatcaacaggatttaaccctaatgacatagacttattagatcccaaaaataaaaggataatatcacctaacctatttaaagtacagaaactagcaaccaaaaactatatgtttacccaccacttagaaacaaaatcaatcgatggggatatgctaaagaacaagaaagaattatcaggaatactctacaattttatccaaacaccacaaaaactgtatggaataataaaagtccgaataaaccacctcggagacattgtctccgtaggtgaatattga

SEQ ID NO: 9149 - RNA, 4296 nt, synthetic construct
  misc_feature 1..4296: note = Cas9 variant
  source 1..4296: mol_type = other RNA
atgaaacgcatacttggcctagacctaggcagcagcagcataggttgggcgctagtaaatgaagctgaaagtaaaaacgaaagatcatcaatcgtaaaactaggggtacgggtaaatccactaacagtagatgaatctattaactttgaaaaaggaaaatccatcacgactaatgcggatagaacgttaaaaagatctatgcgaaggaatctacataggtacaaattaagaagagaagcattgatagaagttctaaaggaatgtaaattcataacagaggatacaatactcagtgaaaacggaaacaggacgacttttgaaacgtatagattaagagtaaaagccttaaccgaagaaatatctctcgaggaatttgcacgagtacttataatgataaacaagaaacgtggttataaatcatcacgtaaagcgggcggagcagaagaagatacactaatagacggaatggatattgcacgaaaattatacgatgcaaatttaacgccaggcgaattgtgcctgcaattgctatcagccggtaagaaagttttacccgatttttacagatcagacctccagaacgaattagaccgaatttgggaaaaacaaaaagaatactatcctggtatattaacggcagcactaaaagaagaattaagagggaagaaaagagatgctgtgtgggcaatatgcgcaaatgcatttgtatggaaagaaacatatacagaatggaacaacgaagaaagtaaaaacgagcaaatcgaaaaagaacacaaattagaaggcatatatagcaaacgaaaaagagatgaagctaagaaagaaaacctccaatggcgagtaagcggtttaaaagaaaaactatcactagaacagctagtaataatcctacaagaaattaatacacaaataaacaactcatcaggatacctgggcacaataagcgatcgctctaaagaattatatttcaataaacaaacagtaggccaatacttgatggatatattggacaacaacccgaacgcaagcctaaggaacatagttttctacagacaagattatcttgatgagtttaatgtactctgggaaaaacaagcggagtttcataaagagctaacaggagaattgaagaaagaaatccgagatataataatattctatcaaagaagattaaaaagtcaaaaaggccttatatctttctgtgagttcgaatcaagacaaatagaagtaaaaatagacggaaaaagaaaaataaggacggtaggcaatcgcgtcataccaaggagcagtcctctattccaagagttcaaaatatggcaaatactcaacaatatcgaagtaacagcagtaggtaataaaaataaacaaagaatgcaaaacggaagcaatgaaccagatgacacagaacaactagaactcaatggaagacgatatctctatcaagaggagaaagaactacttgcaaaagaactatttgtaagagataaaatgacaaaactagacgtgctaagactactcttcgataatccagaagaattagacctaaatttcaaaacaatagatggcaataaaacaggctacctcttctttcaggcttacagcaaaatgatagaaatgtcgggccatgaacccgtagatttcaagaaacccatagagaaaatagtagaacaagtgaaatcagtatttgtattactaaactggaatacagatatactatcctttgatagtaacaaagaactcgacaaacaatcatactataaactatggcatcttttatattccttcgaaggtgacaacacacctacaggtaatggatgcctagtacagaaaataatggactcttatgggttaggaaaagaatttgccaaaattctagctaatattacattccaagaagactatggtagcttaagtgcaaaagccattcacaaaatcttgccacatttaaaagaaggcaatcaatacgacgtagcatgtgaatacgccggttataggcacagcaaatcttccttaacaaaggaggaaatagcaaataaggtcctcaaagacaaacttgaagtacttccaaggaacagtctaagaaatcctgtcgttgagaaaatactaaatcaaatggttaatgtaataaatgctataatagaagcatacggcagaccagacgaaataagagtagaactagcaagggaacttaagaaaaacgcgaaggaacgagaaaagctgacaaagagtatagccgaaactaccaaaacccacgaagctcacaagaaattactccaagaagaatttggattaaagaacgtaggccgtagcgatattctaagatacaaattgtacaaagaattggaaagcagaggttataaaacgctatatagtaatacatatataccgagagaaaaattattctcgaaagagtttgatatagaacatataatcccacaagcgcgattatttgacgatagtttctcaaataaaacactggaagcaagaaatgttaacatagagaaaggcaatagaacagcatatgacttcgtgaaagaaaaatttggtgaaagcggaacagataatagcttagactgctatctgaataacatagaagtattattcgtatctggaaaaataagcaaaaccaaatacacaaaactcaaaatgactgaacaagacatacccggagggttcatagaaagagaccttagaaacacccaatacattgcaaagaaagcactgtctatgttaaatgaaataagtcgttgtgtagtagctacttctggaagtataactgataaattacgtgaagattggcaattagtagacgtaatgaaagaactgaattgggaaaaatataaagcgctgggtttggtagaatactttgaagacaaagatggaaaacaaataggaagaataaaagactggagcaaaaggaatgatcatcgtcaccacgccatggatgcattaacagtcgctttcacaaaagaagtattcattcaatactttaataataagaacgctagcctgaacccaaacacgaatgaatatgccattaaaaacaaatactttcaaaacgggagagcgattgctccaatacccctaaatgagttcagagcagaagcaaagaaacacttggaaaacacattgatttcaatcaaagctaaaaacaaagtgattacgaataatatcaacaaaaccaagaaaagaggaggagtcaacaccaagaaacaacaaacaccacggggccaacttcacttagaaacaatctacggatgttgccgacaatacctcacaaaagaagaaaaagttaacgcctccttcgacgtgtcaaaaatagcaacggtcagcagttcagtataccgagatgcactcctaaaacgcctacaagaacatcacaacgaccctaagaaagcctttgcaggacgaaatagtttagacaagaaaccagtatggcttgataaagaacaaattagaaaagtaccagaaaaagtaaaaacagtaacattcgaaactatatataccatacggaaagaaataagtccagatttaagagttgataaaataatagattccggggtaagaaaaatgttaacaggtaggctaaaagaatatggcaacgacgccaaaaaggctttttcgaacctagacgaaaaacccatatggttgaataaagaaaaaggcataccaataaaaagagttacaattagcggaatatcgaatgcacaatcccttcatgtcaagaaagacaaagacggaaaaccagtcctagacggaaacggaagaaacatacctgtagacttcgtgaacacaggaaataaccaccatgttgcagtatacagacgacctgtaatcgataaaaacggacaaatggtaatagatgaaaatggtaacttaaaatatgaattagaggaagttgtcgtaacattctttgacgcagtaacaagagtcaatttaggtcaaccgataatcgataaagactacaaagcctcagaaggttggcaatttctatttagtatgaaacagaatgaatatttcgtctttcccaataagaaaactggcttcaatcctaaagaaatcgacctactagatgcagacaattacggactaattagcccgaatctcttccgagttcaaaaatttactcataaaaactacgtatttaggcaccacctagagacaactattaaagatacctcatccattttacggggaataacatggatagactttagaagcagcaaaggattagacagcatagtaaaagtacgagtgaaccacatagggcagatagtatctgtgggagagtattga

SEQ ID NO: 9150 - RNA, 4299 nt, synthetic construct
  misc_feature 1..4299: note = Cas9 variant
  source 1..4299: mol_type = other RNA
atgaagaaaattttgggactcgatttaggatccaacagtatcggatgggcacttgttaacgaagccgaaaacagagatgaagcatcgagcataataaaattaggagtacgtgtaaacccattaacagtagacgagatgcaaaatttcgaaaaagggaaatccataactacaaatgccgatagaacattaaaacgtagcatgaggagaaacctacaacgatacaaattaagacgagacgctctaattaaactgcttaagaaagtaggatttatagcagatggtactattttaagtgaacaaggaaatagatctacttttgaaacgtatcgtctcagagctaaagccccagacgaggagatatcccttcaagaattagcacgagtactattaatgataaacaagaaaagaggttacaaaagctcgagaaaaataaaagaaaaagaagcaggaacgttaatagatggtatgaaagtcgcaaagaaattatacgacgaagatttaacaccgggacaattatgcttacaactccttgaatcaggaaagaaaagcctgccagacttttatagctcagatttacaagaagagtttgatcgaatttggaattttcagaaacaatttaacccaaaagccttttgcgatacagctaaagaagagatcaaaggtaaaaacaaatcacaaacatgggctatactcgcaaaatacttcatttggacagacgaaatggttgtttggaacgaaaaagaaagtaaaaccgaaagagtcgaaaaagaatgtaaattagttggattaaaacgcacagttaagaaagaagaacaaagaaaagaaaactatagatggagagtacaagccctaaccgaacaactagatttaggaaaagtagcagttgtacttcaggaaataaacggccaaatatccacatcaagcggctatttaggtgcaataagcgacagatctaaagtattatattttaacaggcaaacagtaggtcaataccaaatggcagaactcgagaaaaatccaaatacgagtctaagaaatatggtattttaccgacaagactatttagatgaatttgacaagatctgggaaaaacaggcagagttccataaggaattaactgtcgaactcaaaaaggaaataagggatataataatattttaccaacgacgattaaaaagtcaaaaaggcttaattggattctgtgagttcgaaaatagagaaatcatggtggagaaaaatggaaaaatgcaagcaaaagtagtgggctgtaaagtaataccaaggtcacaccctctattccaagaatttaagatatggcagactctcaataatgtagaagtatttgcaggcgaaaagaaatgtaaaagaaaaagaactgatgcatttcctggcttgtttgacggcacagaagataccttaatggtagaagggtggcgatacttatatcaagaagagaaagaaatcctcgcaaaagagttaagcgtaaagaaatcattaaagaaagaatacatactcaaactattatttgacaatccccaagacttagatatgaatttcgaacaaattgaaggcaacgacacagggaatgtactcttcagcgcatatagcaaaatgattgaaaaatacgggtatgaaccactagatttcgggaaatctacagacgaaattatagaacgactacaagtaatctttaccgatctgggctggaataccgacctattatttgtagatctcaataaagaagggaaagatttggaaaaacaaccatattttaaattatggcatcttctatactcattcgaaggcgataatacaccaaccggcaacggcaaactggttgagaaactcatggaactatgtcatgttggaaaagagtgtgcacttgagctagtaaacatttcatttcaaaacgactatgggtcacttagcgcaaaagcaataaagaaaatattaccctatttaaaagaagggaatcggtacgatgtggcatgcggatatgccggatatcgtcacagcaaatcctcactaacaaaagaagaaatcgaaaacaaagtattgaaagacaaactcgacatactccctaaaaatagtctcagaaatccagtgatcgagaaaatactaaaccaaatggtgaacgtaataaacgctataattgatacatacggaaaacctgacgaaataagagttgaattagcaagagaactaaagaaaagtgcaaaagaaagagatgaattaactaaagctatagcaaaatcaacaagagaacatgaagaaatacgtaaagttctacaagaagagttcggtatgataaacgtctcaagaaacgatatcatacgatacaaactgtatgaagaactaaaagataacggatacaaaactctctattctaaccaatacatcccgaaggaaaaagtattttcaaaagaaattgatatagaacacataataccacaagctagattgtttgatgattcattatctaataagacactggaatataaggcaataaacatagaaaaagggaataaaactgcctatgacttcgtaaaagaaaaatacggggaaaaaggattacaacagtatctaaaccgatgtgaatcgttattcaaaggacaccggacaaaacttcgaaaattaaaaatggggcaagaaaacattcccgagggattcatcgatcgggatttacgcaacacgcaatacatcgcaaagaaagcgttagctatgctaaacgagatatgtagacgtgtcgtcgcaactactgggagtataactgacagattaagagaagactggcaattagttgatgtactcaaagagctcaacttacccaaatacgaaacactaggattagtagaggtctatgaagataaagatggcaggaaaataaaaagaataaaggattggactaagagaaacgatcaccgacatcatgcaatggacgcactgacagtcgcatttaccaaagatgtttttatacaatactttaacaataaaaacgctgcttggcaagcagattgtaaagaacatagtgacattataggtataaagactagatattttgaaaatggtagagcactacccccaatgcctctagttagatttagagccgaagcaaagtctcatttagaaacactattagtatccataaaggctaaaaacaaagtagtaactaataatgtaaattgcaccaaaagaaaaggtggtgaaaacaagaaactgcaacaaacaccacgcgggcagctacacctcgaaacaatatacggatcccatagacaatacgtaatgaaagaagaaaaagttaatgcatcattcgattcatcaaaaatcgcaacggtatgtaaacaggcatacagaaacgcattattagaaagattagcggcattcgggaacgatccgaaaaaggctttcacgggtaaaaacagcctagagaaaaatccagtttatttggacagagagcaaacagcgagagtccctgaacgagtaagaacggtagaactcgaaacggtttataccattcgaaaaccagtagaccctaacctatcagtagacaaggttgttgacgcaaaagtccggagtatcttagaacaaagattaagagaatatgatggagaagcaaaaagagcctttgtcaatctggacgaaaacccaatatggttaaatgaagagaaaggaattgctataaagagggtaacaataaggggaataaacaaagttcaatcattacacggtaagaaagacaaaaacggcaacttaatactagacgaaacaggtaaaaagatacccgtagacttcgtaaatacaggaaacaatcaccatgtagcaatatatagaaagccagttcttgataaaacaggacaagaaatgctagataacgaaggaaatccagtatatgaattagatgaagtagtagtaagtttctttgaagccgtaactagagtcaatttaggcctcccagttatagacaaaaattacaacaagtcagaaggatggcaatttatgtttaccatgaaacaaaatgaatactttgtatttccaaacgaaaagacaggattcgacccaaaagaggtagatctcttaaacccagaaaactatgccgtaataagccccaatttgttcagagtacaaaagataacagaaaaggactacatgttcagacaccacttagagacaaaagtagtagacgacaagtttttaaaagagattacatggaagagaatattaactccaaataaactcgaaggcatagtaaaagttcgggttaaccacattggccaaattgtgagcgtcggggaatattga

SEQ ID NO: 9151 - RNA, 4299 nt, synthetic construct
  misc_feature 1..4299: note = Cas9 variant
  source 1..4299: mol_type = other RNA
atgaagaaaatacttggcttggacctagggagtaacagtatagggtgggctctagtaaatgaagcagaaaattcagatgaagtgagttcaatcataaaacttggagtccgagtcaaccccctaacagtagacgaaatgcaaaactttgaaaaaggaaaatctataacaacaaacgcagatagaacattaaaacgatcgatgcgtagaaatctgcaaagatacaaactaagacgagacgccctgattaaattactcaagaaagtgggattcataaccgatggaacaattctatccgaacaaggaaacaggacaacctttgaaacataccgattaagagccaaagcaccagacgaagaaataagcctccaggagcttgctagagtgttacttatgataaataagaaacgaggctataaatcgtcaagaaaaattaaagaaaaagaagccggcacgttaattgatggaatggaagtcgcaaagaaactctacgatgaagacctaacacccggacaattatgtttacaactactagaaagtgggaagaaaagtctgccagatttctacagtagcgacctccaggaagaatttgaccggatatggaactttcaaaaacaatttaatccaaaagcattttgcgatacagcaaaagaagaaataaaagggaaaaacaaaagtcaaacgtgggcaatattagcgaaatactttatatggacagatgaaatggtagtttggaatgaaaaagagagcaaaacagaacgagtagaaaaagaatgtaaattagttggactaaaaagaaccgtaaagaaagaagaacaaaggaaagaaaattactgctggcgagtacaggcacttacagagcaactagatttagaaaaggttgcggttgtcttacaagaaattaacggacaaatatcaacgtctagtggatacttaggagcaataagcgaccgcagcaaagtcctatactttaatcgacaaactgtcggacaatatcaaatggccgaattagagaaaaacccgaacacaagcctaagaaacatggtattctatagacaagactatctagatgaatttgataaaatctgggaaaaacaagcagaatttcataaggaactaacagttgaattaaagaaggaaataagagatattattattttctaccaacgaagactaaaatcacaaaaaggtctaatcgggttctgtgaatttgaaaatagagaaataatggttgagaaaaatggaaaaatgcaggcaaaagtagtgggttgcaaagttatcccaagaagtcatccactctttcaagaatttaaaatatggcagacgttaaacaacgttgaagtatttgcaggcgagaagaaatgtaaacgtaaaagaacagacgcattcccaggcttatttgacggaacagaagatacattaatggtagaaggatggagatatttatatcaggaagaaaaagaaatactagcaaaagaattaagtgtcaagaaaagtctcaagaaagaatatatactgaaattactattcgataatccacaggaccttgatatgaactttgaacaaatcgaaggtaacgatacgggaaatgtattattcagcgcctacagtaaaatgatagaaaaatacggctacgagccactagacttcggtaaaccaactgacaaaatcatagaacagctacaagttatattcgcagatttaggatggaatacagaccttttattcgtagacttgaacaaagaaggaaaagatctagaaaaacaaccatactttaaattatggcatttattatacagcttcgaaggagataatacgcccacaggaaatggaaaattagtagaaaaattaatggagctgtgtcatgttggcaaagaatgcgctttagagttagttaatatatcatttcaaaacgactatggatccttgtcagcaaaagcaataaagaaaatactcccgtatttaaaagagggaaatagatacgatgtagcgtgcggatatgcaggatatcgacactcaaaaagctctctgactaaagaagaaatcgaaaataaagtcctgaaagataaattagatattctgcccaaaaatagtctacgaaacccagtagtagagaaaatattaaaccaaatggtaaatgtaataaatgcgatcatagacacttacggaaaaccagatgaaatacgcgttgaactagcgagagaattaaagaaatctgccaaagaacgagaagaattaacaaaagcgatagcgaaatccacgagagagcatgaagagatacgcaaagttttacaagaggaatttggaatgataaatgtttcaagaaacgacatcatacgatataaattatatgaggaactaaaagacaacgggtacaaaacactttatagcaaccaatacatcccgaaagaaaaagttttcagcaaagaaatagacatagaacatataataccgcaagcgcgactttttgacgactcattgagtaacaaaacactcgaatacaaagcaattaatatagagaaaggaaataaaacagcttatgactttgttaaagaaaaatatggagaaaaaggcttacaacaatatttgaacagatgcgaatcattatttaaaggacaaagaacgaaactgaggaaactaaaaatgggccaagaaaacataccagaaggcttcatagatcgcgacttaagaaatacgcaatatatagctaaaaaggcattagcaatgctgaatgaaatttgtagaagagtggtagcaaccacaggctcaataacagatcgactcagagaagactggcaattagtggatgtattaaaagagcttaatttacctaaatatgaaacattaggattagtggaagtatacgaagacaaagatggtaggaaaataaaaagaattaaagactggacaaagagaaacgatcatagacaccatgcaatggatgcattgacggtagcattcacaaaagacgtcttcatacaatattttaataacaaaaatgcagcatggcaagcagactgtaaggaacacagtgatataatcgggataaaaacacgatatttcgaaaacggacggagtctacctccgatgcccttggtaaggtttcgggcagaagctaaatctcatttagaaacactattagtaagcatcaaggcgaaaaacaaggtagttaccaataatgtcaactgcacaaaaagaaaaggtggagaaaacaagaaattgcagcaaagtcctagaggacaactccaccttgaaacaatttacggcagtcatagacaatacgtaacaaaagaagaaaaagttaatgcgagctttgatagctcaaaaatagcaaccgtatgcaaacaggcatacagaaatgcactactggagagactagcagcattcggaaacgatcctaaaaaggcattcaccggcaaaaactctctagaaaagaacccagtatatttaaacagggagcaaaccgcaagagtaccagagagagttagaaccgtagaattagaaacggtttatacaataagaaaacccgtagaccctaacttaagcgtagataaggtagtagacgcaaaagtccgcagtatactagaacaaagactaagagaatatgacggagaagcaaaaagagcattcgtcaacctcgacgagaatccgatatggttaaacgaggagaaaggaatagccataaaaagggtaacaataagggggatcaataaagtccaatcattacacggtaagaaagataaaaacggaaatttgattctagatgaaaccgggaaaaagataccagttgacttcgtaaataccggaaacaaccatcatgtagcgatctacagaaaacccgtactcaacaaaacagggcaagagatgttggataatgaaggaaatccagtatacgaactcgatgaagtagttgtttctttctttgaggctgtcacaagagtcaatctaggactacccgtaatagacaaaaattataataaaagcgaaggttggcaatttatgtttacaatgaaacaaaacgaatatttcgttttcccaaacgagaaaacccggttcgatcccaaagaagttgaccttttaaatcccgaaaattatgccgtgataagcccaaacttattcagagtacagaaaatcactgaaaaggactacatgttcagacaccacttagaaacaaaagtggtagacgataagtttctaaaagaaataacatggaagcgaatactgactccaaacaaattagaaggtatagtcaaagtgagagtaaatcatatcggacaaatagtaagcgtaggggaatattga

SEQ ID NO: 9152 - RNA, 4299 nt, synthetic construct
  misc_feature 1..4299: note = Cas9 variant
  source 1..4299: mol_type = other RNA
atgaaaaatatactaggattagatttaggaacgacatctattggattcgcgcatatagtcgaagacgaaaacaaagaaaaatcagaaatcaaagaactcggagtccgaatagttagtttgacaacggatgaacaaagtgactttgaaaaaggtaaaagtataacaacgaacgcaaatcgaacgttaaaacatggagcaagactaaacctcgaccgatatcaacaaagaagaaaatacctaatagacctactgcataaagcaaacctcataacgccaagttcaatattagctgaaaatggcaaaaacacgacacacagtacatggcaactccgagcaaaagcagtcacagaacggattgaaaaagaagagttcgcacgtatactactcgcaataaacaagaaaagaggatataaatcatcgagaaaagctaaaacggaagacgaaggacaagctatagatggaatggcaatagcaaaaagactatacgatgaaaatcttacgccaggtcaattgtccttgcaacttctacaacaaaacaagaaactattaccagacttttaccgatccgatctccaaaaagagttcgacctcgtctggaattttcaaaaacaattctacccagacatactaactgatattttctataaagaacttcaaggaaaaggtaaagacgctacgtcaaaagcattctcgaaaagatatcacttcgacacagccgaaaacaaaggttcaaaagaaagtgttagattgcaagcgtaccaatggcgtgccgaagcagtctcaaaacagctatcaaaagaagaagtagcttacgtgcttacggaaataaacaacaacctaaacaatgcttcaggatacctaggtgcaatttctgatagaagcaaagaactctactttaatagacagaccgtaggacaatacctatatgcacaattacaggaaaatcgtcataatagtctcaaaaataaagtattttaccgtcaagactacctagacgaatttgaaagaatctgggaaacacaagcactattccataaagaactaaccgacgaactaaagaaacaaatccgtgatgtagtgatattctaccaaagaaaacctaaatcacaaaaaggtctaatatcgttctgtgagttcgaatcaaaagaaatcgaaatagaaaaagacggcaaaacaattactaaaaatatcggagcaagagtcgttcccaaaagcagcccattattccaagagttcaaaatctggcaaatactaaacaacgtaatctgtaaacgaaaaggaataaggaagaagaaaatatccgccaaaactacccaactagacttattaaatgaatccagtcaaaccatattcagtctagatatggaatgcaaacaactactattcgacgaactaaatctcaaaggagacttaaaaagcgacaaagtattaaaactactaggatactcaccacaagaatgggaaatcaattataaccagttagaaggaaacagaacacaaaaagctctatatgaagcatacttaaaaatagtagaaatggaagcacacgatgtaaaagacatacttcaaataaaaagcacaaaagatgactggtcattagacgaaagcccactaagtgcatcagaaatacgagaatcggtaaaagcgatatttcaagcgttaggcatttgtaccaaaatcctatactttgaccccttattaccggtgaaagatttcgaggaacaagattcctaccaactatggcacctcctctatagttacgaatccgacgatagtacatcaggaaatgaaacactctacagaatactagaaaagaaatatgcatttaaaagagagcacgcaagaatcttagcaaatgtggccctacaagatgactacggaagcctatctacaaaagctatacgaaaaatttaccccaacattaaagagaatcaatattcaacggcatgcgaaatggcgggatataaacactcgaaattatcactaacaaccgaagaattagaagctcgggagcttaaaaatatcatcccattactcaagaaaaatgccctacgcaatccagtcgtcgagaaaatactaaaccaaatgataaatgtcgtaaatgcgttaattgagaaaaattcagaaagggatgctgaaggtaaaataacaaaatactttcacttcgatgaaatacgaatagaactagccagagaactcaagaaaaacgcgcaaaaacgatacgaaatgacacaaaacataaacaaagcaaaatccgagcatcagaaaataagcgaaattttacaaaaagagtttggaatcaaaaatcctaccaaatcagacattatacgatatagactctacaaagaactagagcataacggatataaagaactatacacaaatacctacattgcacccgacgtacttttctcaaagaacattgatatagaacacatagtacccaaagcacgcgtctttgatgattcctttagcaacaaaacgctcgctttcaaagatttcaatatcaagaaaggagaatcaacagcttttgattatataacatcgcttaaaaacgaagaaaaattaaaccagtacctagctagagttgaaaacgcctataaaaccaaaaacataagccctgctaaatacaaaaacttactaaagaaagccagcgaaataggagacggtttcataaacagagacctaagagatactcaatatatagccaagaaagcaaaggaaatactattccaagtcaccaaaaatgtactatcaacaagcggttccataaccgatagactacgcgaggactggagcctcgtagacgtaatgaaagagttaaacatgccaaaataccaatccctgggtcttacagaagttgaagaaagaaaagatggaaacaaagtaaccgtaataaaagactggactaagcgaaatgaccatcgacaccacgccatggacgcactcactgtagcctttacgaaacccagctatatccaatatcttaatcaccttaatgcaagaaaagatgaaaataataagaattacagcgtaatactagctattgagaaaaaggagacaataaaggtacctacaaacaacggcaaaaataaacgagttttcatcgaaccaataccaaactttagacaagtagccaagaaacacctagaagaaatcttcataagccataaagccaaaaataaagtagtaaccaaaaacacaaataaaccagcaggaacaaacaaacaacaaataacactaacaccgagaggacaacttcacaaagagacaatatacggaaaataccaatactatgtcaataaagaagaaaaagtgggtgtcaagtttgacaaagaaacaatagcaaaagtgtctaatcctctataccgagaagcattactgaaaagacttcaagccaatgataacgatccaaagaaggcattcacaggcaaaaacgcacttagtaaaaacccaatctacttagatgaagcaaaaacgaaaacgttacccgaaaaagttaacctaacttacctcgaagaagatttttccgttaggaagaaaatagtccccaaaaatcctacaagcaaagaatttgtacctaaccttaaaagcattgaaaaagtagttgacgaaggtgtacgaaatatactaatcgaacgattgagagtctataataatgaccccgagaaagcatttgtagacttggaaaagaaccccatctggctaaataaagagaaaggtatagcaataaaacgcgtcactatatcaggagtaaacaacgcacaaccactccacataggaaaagaccatctaggtaaaacaacactaaacaaagagggaaaagaaataccagtagactatgtttcaacaggaaataaccatcacgtggcgatatatagagacaaggaaggaaatctacaagaacaaattgtctcattctttgaagcagtggtaagaactcaacaaggtttacccatcattgataaaacttataaacaggaagaaggatggcaatttctatttactatgaaacagaatgaaatgttcgtattcccaaatgaagccaccggtttcaaccccgcggaaatcgatttactcgaccccaaaaacaagaaacaaatctcaccaaatttattccgtgttcagaaaatagcaacaaaagactatttctttcgacatcatcttgaaaccaatgtcgaaacagataacgtccttaaaaacacaacatggaagcgcgaaggactatctggtctaaaagatatcgttaaagtaagaataaatcatctaggggatatagtatctataggtgaatactga

SEQ ID NO: 9153 - RNA, 4302 nt, synthetic construct
  misc_feature 1..4302: note = Cas9 variant
  source 1..4302: mol_type = other RNA
atgaaaaaaatcttaggacttgacttaggaactacatcaataggatacgcccaagtaaacgaaagtgaggatttcaaagattcctcaatagaacgaataggagttcgagtcaatcctctctcagtagatgaacaaacaaatttcgagaaaggcaaaccaatttcgattaacgcagacaggacactgaaaagcggggccaggcgcacgctcgaccgttatcaagatagaagaagcaatctaattgatgcactcgttaagtctgtaataatcactgaagatacagtgttagccgaagatggcaaaaatactactcactccacttttgcattacgagcgaagtccgctagcgagaaagtggaaaaagctgaatttgcaagaatccttttagcaattaacaaaaagcgcggctataaaagcagtaggaaaactaacaataatgatgacgaaggacaagcaatagacggaatggcaatagcaaagaagctttatgacgaaaacttaaccccaggacaattagcataccaactattaaaagagggaaaaaaatatttgccggatttctacagatcagacctacaagcagaatttgacaaaatctggacgttccaaaagcaattttatcccgagattctaaccgacgaacttcaaaaagaattagcgggaaaagggcaacgagccacaagtgcaatattctggaaaaaatacgactttaacacagcagagaacaaaggaaccagagaagaaaaaaaattaaaagcatacgaatggcgatccactagcgtagacaaaaaattacaaaaagaagaagttgcttatgtaataacagaaattaataataacctaacaaatagttcgggctacctcggagcaatctcagacagatcaaaagaattatacttcaataaacaaacagtagggcaatacttatttaagcaaatacaaaaaaatccacacacaaaacttaagaatcaagtcttctatagacaagactatttcgatgaatttgaaatcatatgggaaacacaagcaaaattccatccagaattaacagaagaactaaaaaataagataagagatataataatattctaccaacgaaaattaaaaagtcagaaaggacttatttccttttgcgaatttgaaagaaaagaagttgaaatagaaaaaggaggaagacgtatgaaaaaaactatcggattaaaagtcgccccaaaatcgtccccactgtttcaagaattcaagatttggcaagtactgaataatgtactaataagaaaaaaaggatctaaaaaaagacgagtcaaggagccagatcaactaaacctagtggagcaggaacaagaagtaatgttcttcgacatgcaaacaaaacaaaccctattcgacgaattaaacgtcaagggtaatctaaaagcaaaacgaataatagaactcataggacaagatgcaaacgactgggaaataaattattcagaaatagaagggaaccgaacgaataaagccttgtatgacgcctatctaaaaattctagacttagagggatacgacacaaaagcccttctagatgtaaaaacgtctaaggacgaggtagaattagacgatattaatatatcaggccctgaagtaaaagatttagttaaaagaatattcgaaagtttagaaatcgatacccaaatattagagttcgatgcagaactcgatggagaagttttcgaaaaacaaagcagctatctactctggcacctgctatacagctatgaaggagatgactctccatcaggaaacgaaaagctatataaattgctaaaacaaaagttcggtttcaagaaagaacacgcacaaatactagcgagtatcaccctatctgacgactatggaagtctttcagcaaaagctatgcgtaagatatacccatacattagagaacaaacttttgataaagctgcatcactagccggctatagacactctgcgtcatccttgacaaaagaagaaatcgcaaatcgcccactaaaagataaactagaactgataaaaaaaaattcattaagaaaccctgtagtagaaaagatactaaatcaagtcgtaaacatagtgaacagtctaatagaagcgaactccgaaaaagattcagacggcaacataataagctattttaaattcgatgaaatcagaattgagcttgcacgagatctaaaaaaaaatgcaaaagaacgagcagaaatgacattaaacataaacgccgccaaaatagtacatgaaaagattttcaaactgttacaagcagaattcggcgtcaaaaatcccacacgtaacgatataatacggtacaaactttatgaagaattaaaaaataacggatacaaagatttatataccaatatatacataccccgcgaaatactattcagtaaacaaatagatatagaacatattattcctcaaagcaaaatgttcgacgacagtttttcaaacaaaacaattgtatttaggaaagacaacttagataagggcaacagtacagcttttgactacatagattccaggttcggaaaggataaactaacggatttcgaacaaagaatcgagttcttatttgaacaaggaaaaaaaaacaaagaggagggaataagcaaagcaaaataccaaaaattacttaaacgtgaagctgacatcggtgacggcttcatagaacgcgacctaagagacacacaatatatagccaaaaaagcgcgcaacctactatatgaaatatgtaggatagtaactccaacgactggcagcattactgataggctaagagaagactgggacctagtaaacattatgcaagaactcaacttagataaattcaaaaaacttggcctcaccgaaatggtagaaaaaaaagacggatcatttaaagaacgtatcgtagactggtctaagcgaaatgatcatagacaccacgccatggatgcactaacaatagctttcacaaaacacagccacattcaatatctaaactatttaaacgcaagaaaaaacgagaatcacaaacaacatcacaacataatcggaatagaacgcaaagaaacagagttcgtcatagatgacctcggaaacaaaaaacgtaaatttcacttgccacttcccaattttagagaagaagccaaaaaacacctagaaaacgtcttagtaagctttaaggcaaagaataaagtggtaacaaaaaataaaaataagaccgcttcatcaaaaggagaaaaaataaaagtagaactaactccacgcggccaactacataaagagacagtatacggtaagtacaaattctatgttagcaaagaagaaagaataggcggaaaattcgatcaacgtacgattgaacgcgtagccaattccactcataagcgattattattacagagattacttgagaatgacaacgacgcaaaaaaagcctttacaggcaaaaacgcactcgcaaagaaccccatttatttagacgacactaaaacgctaactttaccagaaatagttaaattaacatggctggaagaagattattccataagaaaagacataacacccgaaaacttcaaagacatcaaagtaatagacaaaatactagatgaaggagtaaagagaatactcaaagaaaggttagcaaaacataacaataacccaaaagaagcttttagcgacctagagaaaaacccgatctggctaaatgaaaaaaagtcaatatcaatcaaaaaagtaaaaataagcggtattaataatgctgaagccctacactataaaaaaaaccacctgggaatagagattttagacgatgaaaaaaaaagaataccagtcgatttcgtctccacagggaataaccaccatgttgcaatatatagagatgaaaaaggaaacttacaagaagacgttgtctcgttttttgaagcagttgcgagagtaaaccaaaacttgccaatcatagacaaaacgttaaaagcctatctaggatggacattcctattcacaatgaaacaaaatgaatatttcatctttccaaacaaacaaactggattcaaccccaccgaaattgacctacttgacagtatgaataacaaactgatatcccctaacttattccgggtccaaaaattcactgtcaaagattattttttccgtcaccacctagaaaccaacgtggaagacgatagcaaacttaaaaacacaacatggaaaagagaaggactcggcggaataggaaacatagtaaaagtgagaattaaccatatagggcaaattgttaaaataggtgaatattga

SEQ ID NO: 9154 - RNA, 4305 nt, synthetic construct
  misc_feature 1..4305: note = Cas9 variant
  source 1..4305: mol_type = other RNA
atgaaaaatatccttgggttagacctaggtactaacagtataggatgggcatatgtaaaacaagcacaaaatgattcggaaaaatcagaaatagctgagcttggagtgagggtaaaccctctcaccgtagacgagaaaaccaatttcgaaaaaggtaaaccaatttcaacaaatgcagacagaacgctaaaacgcggagcaaggaggaatttacaacgatacaaattaaggagacaagaattgatagagctcttaaaagattatcaagtaataagtgacaagacaatacttgcagaagatgggaaggaaacaacgttcgagacattaagactacgtgtaaagagtgcaaaggaacaagtaagcctagaagaactagcaagaatacttttaatgataaacaagaaacgaggatataaatcaagtagaaaagctaaaaacgaagatgaaggacaattaatcgatggaatggaaatagcaagacgactatacgacgaaaatctaactacaggccaattaagtctacaactacttaaagaagggaagaaatctctccctgactactaccgtagtgacctacagcacgaattagacaaagtctggaattttcaaaaacaatttcatccagacattctcacagatgagttctacacttcaattcagggtaaaggacaaaaagcaacccgggaatcgttttcgtccaaatatggtatagatactgcagaaaataaaggatccagagaagaaaagaaattacaggcttatcaatggagagctgatgcgacacataaagaactaacaaaagaagaattagcctttgtaattacagaaataaacaataacattaacaacagcagcggttatttaggtgccatatcagaccgcagtaaagagcttatctttgcaaatgaaacagtcggagaatacctatggaaacaaatacaaaacgatccacacacatcgttgaaaaatcaggtattttacagacaagattattttgatgaatttgaacggatatgggaaacacaatcaggattttatccacaaatattaacagaatccttaaagaacgaactacgagacatcttaatattttaccaacgaaaactaaaatctcaaaaagcgttagtatccatctgtgagttcgaaagcaaagaaataccattaaaagataaacaagggaatccaataagtaaaaacggcatcccagtaactaaacttgtaggaccgaaagttgctccgaaaagttcacctctattccaagaatttaaaatatggcaaaatttaaacaacgttctagttagaccaaaaggatcacgaaaaagaaaagtaacaacaaaccaacaatccacactcttagaaggacaagaaccggtatttgagctgaacttagaacaaaaagaattattatttgaagaattaaatcttaaaggaaatttaaaaacagactactgcctagaactaattggctatagcgcaaaagaatgggaaatgaattacccaacgctagaaggaaataaaacaaataaagcactatacgaggcttatttaaaaatcatcgattcagaaggctatgacgctaaaaagctcttaaaagtcaaaaccgataaggacgacatcaatcttgatgatataaaagtaagcgcaagcgaaataaagacgatgatatccgatatattcaatgagttaggaataaatacaaaaatactagatttcgacgcggaactcgaaaggaaacaatttgaagctcaggcttcttaccggttgtggcacctcttatactcttacgaaggagacgattcaaaaagcggtaacgaactactatatcgcttactcgaggataaattcgggtttaaacgagagcattcaaaaacacttgcaaatgtaagccttctaagcgactatggtaacctatcaaccaaagccatccgaacgatatatccttacatcaaagaaaacaaatttagcacagcatgtgaattagcaggttacagacattcaaaattgagtatatccaaagaagaaaacgaaaacagaactttaaaagacacactagacgtactaaagaaaaactccttaagacaaccagtcgtagagaaaatactaaatcaaatgattaacctaataaatgaacttatagaaaaacatagcgaaaaagacgaaaaaggaaatatcgtaaaatacttcaaattcgatgaaatacacatcgaactagcacgtgaactgaagaaaaatgcagaagaaagaagagaactcgactcaaaagtcagagaaggaaaagacagaaatgagaaaataattacaatactgaaatcagagttcggcctcccttaccctaccaaaaatgacatcacacggtaccgattatacgaagaactaaaagacaatggttacaaagacctttatacaaatacctacatccccagagaaaaacttttctctaaagaaatagacatagaacatataattccaaaatcacgactattcaacgactccttcagtaataaaacaatctgttacagacaagacaacctaaataaaggcgaacgaacagcatatgattacatcgaaggattaggaaaaacccaactagacgaatacctaaatcgcgtagaaaatctatacactaataaatttataactaaagctaaataccgaaacctactgaaaaaggaaagcgaaataggggatggctttatagaaagagatctcagagaaactcaatacattgcaaagaaagcaaaagaaatgttactccaaataacaagacatgtcgtatctacaaccggatcaatcaccgaccgcttacgcgacgattgggaattagttaatgtaatgagagaactaaacctacctaaatacaaagtactcggtttgactgaaatacaagaaaggaaaaatgggcaaacagtagaagtaataacggattggacaaaaagaaacgaccatagacaccacgcaatggatgcactaaccgtagcgttcacaaaacacagccatatacaatatctgaactttttaaacgcacgaaaagacgaaaaacataaggaatactccaacatcatgggcatacaacaattagaaactgagaaaacaactgataaagatggaaaagaccgacgagtctttaagactccaatacctaacttccgccaggtagcaaaagaacatttagaaagcatacttatcagccacaaaaccaaaaataaagtagtaacaagagcaacaaacaaaattgcaggatcaaagaaacaacaagaaacactgagcccacgtggacagctacacaaagaaacagtctatggcaaatatcgacgatatgtacaaaaagaagagaaaataggatctaaattcgacctacagacaatcgaaagagtcgcaaaccctctctacaaacggttactaactaaaagactagaagaaaatggaggtgacccaaagaaagcgttcactggcaaaaatgcgctggccaaaagtccaatatacttagacgaaacacaaacccaacaattgccagaaaaagttaagctagtatggctagaaaccgacttcagcatcagaaaagatataaccccagataattttaaagatgaaaaatctattgataaagtactcgatgaaggaatcaaaagaattttaaaagaccgattaaaatcattcgatggagatgccaaaagagcgtttaccgacctcgaacaaaacccaatctggctaaataaagaaaaaggaatagccataaaacgtgtcaccatatcgggagttagtaacgccgaaccactacacacaaagaaagaccacttgggaaatgaaatcttcgatgatacagggaaaccaataccagttgactacgtctctactggcaacaatcaccacatagccatctaccgcgatgaaaacggaaatcttcaagaaaaagccgtatcatttttcgaagccgtaactcgggccaaccaaggcctaccaactgttgataaaacgtacaaccaacatctaggatggcaatttctattcacaatgaaacaaaacgaaatgtttgtctttccaaataaagaaacaggatttgacccccaggaaatcgatctcttagatccgaaaaataagaaactcatatcaccaaacctgttccgcgtacagaaaatttcaaccaaaaactacttcttccgacatcatctagaaacttccgtagaaacacataacgccctaaacggcgtaacgtataaatcacaactcggtttaaatggaataacagatattataaaagtcaggatcaatcatctaggcgatatagtgcatataggcgaatactga

SEQ ID NO: 9155 - RNA, 4308 nt, synthetic construct
  misc_feature 1..4308: note = Cas9 variant
  source 1..4308: mol_type = other RNA
atgttaggatgcgaaagaaaaaggaaaagacgagaaaaagaaaaaatggcaaaaccaaaagactatacaattggactagatattggaactaattctgtaggatgggtagttaccgatgaccaaaacaacatattaagaataaaaggaaaaaaagcaatcggcgctcgactatttaccgaaggcaaagtcgcagctgaacggcgatcctttagaacaactagaagaagactcagtagacgaagatggagaataaaaatgctcgaagaactctttgacgaggagatagcaaaagtagaccccagctttttcgcaagactccacgaatcatggattagtccaaaagataaaaggaaacgctactcagcaatagttttcccctcaccagaagaggataaaaaattccatgaatcctatcccacaatataccacctaagagataaactaatgaaagacgaccaaaaacacgacattcgagaaatatacatagcagtacaccaaatgataaaagctcggggaaacttccttcatgacgaaagtgtagaaacttacagatccggaatgagcagtctaggaggtagaagtgagcgaaatatactatctgtgcagacattggaagaactaaacgacctcttcgccgaaaacgaaggaacagaagaagtagaactaaatgtggcctccgcggaacaaatcaacgacatattaaccggaggtcacttaaacgcagactcacaaaaagaaatttctaatctattattacccagcagcttcccatcttttgatgacaaggcaaaagaaaaacaagtcaaaaaattgataaataatgttgccacaaatatctccaaagcatggttaggctataaagctgatttttccacgattttaaacctagcaaaagttgataaggatcagaaaaaaatatttgcctttgcactacaaggaggtgatgaagaggacaaagtccaagaattagaatcattattagagcaatcacaaacagacatagtagatcgcttaatagaaataagacatgccatagtcctctcagagattgtcccagtcggaatgaccttatcagaagccatgatagacaaatacgatcaacacaaagaagacctgattacactaaaagctgtcatacgaaatacaaaagacaaaaaaaaagccgccaaattacaagcgatctacgacctatacgttaaaaatcgacacgctgatttagcaaaagctatgaagctaacaggcatcaaaaaaagatcagaactactagaccccgaagaactgaaaaaaggcatctcgtctctattggatgactcaccagaagcggtcgaaattaaacaaagattagaagaaaagactttcctaccactacaaagaagcaataacaacggagtgattccaaatcaattacaccaagtcgaattggatgaaataatcaaaaagcaaagcaaatactatccattcttggctgaaaaaaatcccgatgagtcagaagaagcacaaaaaaaagccccaactaaacttgatgctctgttaacttttagagtgccatactacgtaggcccaatgatcacgaaagaagaacaagaagcacaaaatggacactcatttgcgtggatggtaagaagagacccccaagaccacgaagccataaccccttggaactttgaaaaaaaagtagacaaaatggccagtgctacacagttcataaaacgtatgacaacaaaggacacatatttactaggcgaagacgtacttcctgcaagttcattaaaatatcaattattcactgtactaaatgaactaaataatctaagagtcaacggtaagaaactcacaagtgacgaaaaggaacaagtcattgaaggattgtttaaaaaacaaaaaacagtaaaagcagacaaattcgtaaaatattggcaagcaaagcacattggagcagatataaaagtaaaaggactatctgacccaagtaaatttaactctaccatgtcaacgtatatagacttcaaaaagatcttcggcgaccaattaaacgatgttaatcgacaaaacgacttcgagaaaataatagaatattcaacaatattcgaagacagaaaaatactagaagacaaactaagggtcgactttgcatggctaagcgaagaacaaattaaacaattatgcagacttagattgcaaggatgggggcgactgtcggacaagttattaaccagactaacagacgctgacggccaaaacgttttagaaaggctatggaactccaacgacaattttgtacagatagttagcgatcccaacataaaagccaaaatcgaacaagagaaccaaaaattgcttcgagactctcaaagcgataacgcagtggaaagcattctggacgacgcctatacaagtccacaaaacaaaaaagctatcagacaagtaatgcgagtagttcacgatatcgttaaagcatgcgatggaaacgtgccagcaaaatttgccatcgaatttgcgcgtagtcaagaagatgacccaaaaagaactacagcaagagttaatcaaatgcaaaaaatctatgaccagataagtgatgaggtggtctcacaaggagtcaaagaacaactatcgggcatgaaatcactaaaagacagatattacctatactttatgcaaggaggaagggacgcatacacaggagcgaaattaaacatagataggctaagcgattacgatgtcgaccacataatgccccaatcattcgtaaaagacgatagtttagacaacagagtgctagtcgcaagagctgtaaacaaccaaaaatccgataaagtaccagctctattattcggaaataaagtcgtggccgatctcgggataacagtaagagaaatgtgggacaaatggcaaaagttaggtatgatatcaaaaagaaaactcagtaatcttttaaccgattcagatgcactcactgaatacagagcacaaggttttatcagaagacaattggtagaaacatcccaagtaataaaattaaccgcaaccatactacaaagcgagttcccagattcaaaaatcattgaagtaccagccaaatataattcaatagttagaaaacaatttgacctttataaatcacgagaagttaacgactttcaccacgcaattgacgcctacttatcaaccatagttggaaactacctctaccaggtatatccaaatctgagaaggatgttcgtgtatggagaatttaaaaaatttagtagcaatgcagaggaatcagctcacgacgtagcccgacgtgttaaatctatgaatttcctagatgatttattaagaggaacacacggagataacatttattgccgttccacaggtgaaatcgtgttcaacagaaatgacattataagtaaattgaaacaggcgtacagtttcaaacaaatgcttgtaactcaagaagtttttacaaagaaatccgccctatttaatcaaactgtttatccatcacccaaaagagacggttcaaaacggagcggactcatcccacgtaaaagaggaatggacccagaaatatacggagggtacgcccataatcaagattcctactttgtcctagcaaaaatcgaaaaagtcaaaggttacacgctgcaaatagtaggggtcccaatacgaagcctcgaaattataaataaagctgaagacttttcaactgcattactcgatattataaaatcaaaagtcatgtataatgaaaagactggacaaccaaaacgtgggatcaagaatgtagagatattagttaataaacttccatatcgacaacctatattagaaaaagacgtaagttatatgttaggttctagtgcatacaagtacaatattaaacaaattactctttcaagacaatccatgaaatacatactagactacatcgacgacccgaactttacgaaacacgagatgacaatgatagacgagcagaacgaaagagaatgtcttcttagcgtctacgatgagatactagaaaaagtagacaaatatctacctctgtttgatggaaataaatttcgcgaaaaactccactccgcacggaaagaatttgtatcattaagcgttgatgatgaagcatctgcaatagaaaagatactcagaggcctacatgcaaatagcgaaatgccctcgctagaaaaccttaaaataaaaccagcactaggattcttccaaatgaaaaacggtataacactctctaatgatgcagtcctgctttatcaatctcccacaggtttgtttgaacgaagagtaaaagtcagcgatctactaaaatga

SEQ ID NO: 9156 - RNA, 4308 nt, synthetic construct
  misc_feature 1..4308: note = Cas9 variant
  source 1..4308: mol_type = other RNA
atgaaaaacatacttggattagacttaggaacaacatcaattggtttcgcccatatcgtagaggatgaaaataaagaaaaatctgaaataaaagaactcggtgtaagaatcgtgcctttaacaaccgatgaacaatctgattttgaaaaaggaaaatccataaccaccaatgcgaaccgcactttaaaacacggagcaagactcaatctagacagataccaacaaagaagaaaatatttaatcgacctattacaaaaagcaaacctaataaccagctcaagtatactagcagaaaacggcaaaaacacgacacattcaacatggcaactacgagcaaaagccgtaacagaaagaatcgaaaaagaagagttcgcgagagtattactagccataaacaagaaacgaggatataaaagcagcagaaaagcaaaaacagaagatgaaggtcaagccatcgacggaatggcaatagcaaaacgattatatgatgagaatctaacaacaggtcaactttcattgcagctcctacagcaaaataagaaattgctaccagacttttacagatcggacctacaaaaagagttcgacctcgtatggaacttccaaaaacaattttatccagacatcctaacagacagtttctacaaagaactccaagggaaaggtaaagatgcaacatcaaaagcattttctaaacgttatcattttgatacggcagaaaataaaggttcaaaagaatcagtaagactacaggcttatcaatggcgtgtcgaagcgatctccaaacaactaagcaaggaagaagtagcgtatgtcctaacagaaataaacaacaacttaaataacgcctccggctacttaggtgcaatctcagacaggagcaaggaactctatttcaaccgccaaaccgtaggtcaatacttgtatgcacaattacaagagaacagacacaactcacttaaaaacaaagtattctacagacaagactatctagacgagttcgaaagaatatgggaaacacaggcttcctttcacaaagaactaaccgaagaactcaagaaacaaattcgagacgtagtcatcttttatcaacgtaaaccaaaatcacaaaaaggcttaatatcattttgtgagttcgaatccaaagaaatcgaaatagaaaaagacggtaaaactataacaaaaaccatcggagctagagttgtccctaaatcaagcccattatttcaagagttcaaaatatggcaaatactaaacaacgttatatgcaaacgaaaaggcataagaaagaaaaaggtatctgcaaaaactacgcaattagacctattaaatgaaagttcacaaactattttctcactagatatggaatgcaaacaattactatttgaagaattaaatctcaaaggagacttgaaatccgataaagtattgaaactactaggttacagtccccaagaatgggaaataaactacaaccaactcgaaggcaacagaacgcaaaaagccttgtacgaggcatatttaaagattgtcgaaatggaagcacatgatgtaaaagacatacttcaaatcaaatcagctaaagatgactggtcactagacgaatcgcccttatctgcgtctgaaatcagggaaagcgtaaaagcaatattccaagcactaggaatatgcacgaaaatactttacttcgatcctctcctcccagtaaaagagttcgaaaaacaagattcatatcaactatggcatcttttatatagctacgaatcagatgacagtacaagtggcaacgaaacattataccgcatactagaaaagaaatatgcttttaaacgagaacatgtgcgcattttagcaaacgtagcactacaagacgattacggatcactatccacaaaagccattcgaaaaatatatccaaacataaaagaaaatcaatattccatagcatgtgagatggctggctacaaacattcaaaactgtcattgactacagaagaattagaagccagggaactgaaaaacataatacccctacttaagaaaaacgcgttaagaaacccagtagtagagaagatattaaatcaaatgataaacgtagttaatgctctaatagagaaaaatagcgaacgagacgcagaaggaaaaatcacaaaatacttccacttcgacgaaatcaggattgaactagcacgagaactcaagaaaaacgcacagaaaagatacgaaatgacacaaaatataaacaaagctaaattagaacatcagaaaatatcagaaatactacaaaagcaatttggaattaaaaacccaacaaaaagtgacataatacgatacagactatatcaagagcttgaacacaacggatataaggaattatatactaatgcatacatagccccagatgtcctattctctaaaaacatagatatagaacatatagtgcctaaagcccgagtgttcgacgactctttctcaaataaaacattggcattcagagagttcaacataaagaaaggcgaatccactgcatttgattacatcacaagtctcaatagtgaggaagaattaaaccaatatctaacccgcgtcgaaaacgcctacaaaacaaaatcaattagtccgacaaaatataaaaatctgctcaagaaagcatcagaaataggagacgatttcataaacagagatcttagagacacgcaatacatagcaaagaaagcgaaagaaatactatttcaagttaccaaaaatgttctcagcacatcaggtagtataacagaccgcttacgagaagattggggtttagtcgatgtaatgaaagaactaaatatgcctaaataccagtcactaggtcttacagaagtcgaagaacgaaaagatggaaacaaagtaacagttatcaaaaattggacaaaacgaaatgaccataggcatcacgctatggatgctcttactgtagcatttacaaaaccaagttacatacagtacctaaaccacttgaacgcacgaaaagatgagaataacaaaaactactccgttatactagcaatagaagagaaagaaaccattaaagtcagaactaacaacggtaaaaacaaacgggtatttattgaaccaatacctaacttccgacaagtagcgaagaaacatctggaagaaatcttcataagtcacaaaaccaaaaacaaagtcgtaactaaaaatgttaacaaaccagccggaacagataaacaacaaataacattaacaccaagaggacaactacataaagaaaccatatatggaaaataccaatattacgttaataaagaagagaaaatcggagtaaaatttgacaaagaaacgatagcaaaagttagcaatccactatatcgcgaagctctcctcaaacgcttacaggcgaatgataatgaccccaagaaagcattcacaggcaaaaatgccctaagcaaaaagccgatatacctagacgaatcaaagacgaaaacactaccagagaaagtaaatttaacgtacttagaagaagattttagcatcagaaaagacattagtccagacaactttaaagaccttaaatctatagaaaaagtaattgaccaaggagtaaaaagaatacttatcaaaagacttcaagcatatgacaacgaccccaaaaaggcattcgtagacctagagaaaaatccaatatggctgaacaaagaaaaaggaatagctattaaaagggtaaccatcagcggagtaaacaacgcgcaaccattgcacatcggaaaagaccatctaggcaaaacaactctaaacaaggagggaaaagaaataccagtagactacgtctccaccggcaacaatcaccatgttgccatttaccgcgataaagaaggaaaccttcaagaacaaatagttagtttctttgatgcagtagtacgtgcccagcaaggattacctataattgacaaaacctataaacaagcagaaggctggcaatttatgtttacaatgaaacaaaatgaaatgttcgtattccctaacgaaactactggatttaaccccgcggaaatagatttactcgacccgaagaacaagaaattaatcagccccaacctcttcagggttcaaacgatatcagttgtcaaatacgggaatagtgtcgttagagactttaaattcagacatcatttagaaacaaccttacaagatgacaaaatacttcaaggcatcacatttcaacaaattaaaagtctcgaacctctgagaaacatcgtaaaagtcagaataaaccatcttggtgacatcgtatcaataggtgaatattga

SEQ ID NO: 9157 - RNA, 4308 nt, synthetic construct
  misc_feature 1..4308: note = Cas9 variant
  source 1..4308: mol_type = other RNA
atgaaaaatatcctaggccttgatcttggaacgacaagtataggatttgcacatattgtagaggatgaaaacaaagagaaatccgagatcaaagaactaggtgtacggatagtatctttggccaccgatgaacaatcagacttcgaaaaagggaaaagcatatcaaccaacgctaatagaactctaaaacatggcgcaaggctaaatttagaccgatatcaacaaagaagaaaattcttaatagacctcctacaaaaagcaaaccttatcacttcagcatccatacttgccgaaaacggtaaaaatacaacacacagcacatggcaattgcgagcaaaagcagtaacagaaagaattgaaaaagaagaattcgcaagagtactcttagctattaacaaaaaacgagggtataaaaacagcaggaaaactaaaacggaagatgaaggacaagcaatagatggaatggctatagcaaaatgtctttacgatgaaaatttaaccccggggcaactatcgcttcaactcttacaacaaaataaaaaactactacctgacttctacagaagcgacttacaaaaggagttcgatctcgtctggaatctacaaaaacaattctacccagatattcttacggactccttttacaaggaactacagggtaaaggcaaagatgcaacgtccaaagctttcagtaaacgataccacttcgatacagcagaaaacaaaggctcaaaagaaagtgtaagactacaggcataccaatggcgagcagaagcaatctcaaaacaactctcaaaagaagaagtagcctacgtattaaccgagataaacaacaaccttaacaattcatctggctatttaggcgcgatatcagacagaagtaaagaattatacttcaatcgacaaacagtaggacaatacctatacgctcaattacaagaaaatagacataattcgttaaaaaacaaagtcttttatagacaagactatcttgacgaattcgaaagaatatgggaaactcaagcatcatttcacaaggaactaacagatgagcttaagaaacaaatccgggatgtagtcatattctaccaaagaaagctaaagtcccaaaaaggattagtaagcttttgcgagttcgagagcaaagaaatagaaattgagaaagatggtaaagcaatcacaaaatccatcggtgcaagagttgtccctaaatcctcaccattatttcaagaatttaaaatatggcaaattcttaataatgtaacatgtaagagaaaaggaataagaaaaaaaaaatcatcggccaagtctaccgaacttgatctgtttaacgaaccatcccaatccatattctcactagacatggaatgcaaacaattacttttcgacgaattaaatctaaaaggcgatctaaaatccgataaagtgttgaaactattaggttattcaccacaagaatgggaaattaattacaatcaacttgaagggaataggactcaaaagtctttatacgaagcatatttaaaaataattgaaatagagggatatgaagtaaaagatatcctacagataaaatcaacaaaggatgattggtcactagacgaatcaccgttaagcgcaagtgagatcagagaaagagtaaaagttatctttcaaacattaggtatatgtactaaaatcttatattttgacccattacttccagtaaaagaatttgagcaacaatacagttatcaactatggcacttgctttactcttacgaatccgacgacagcacatccggaaacgaaacactctatcgaatactagaaaaaaaatacgcttttaaacgagaacacgcgactatactcgcaaacgtagcgcttcaagatgactatggttcactatctacaaaagctatacgcaaaatatacccttacataaaagaaaaccaatattcaacagcttgtgaactggcaggttataaacattctaaactaagtctcacaacggaagaactagaagcccgcgaactaaaaaatataatcccattactcaaaaaaaatgcattgcgaaaccccgtcgtagaaaaaatactaaaccaaatgatcaacgttgtaaatgccttaatagaaaaaaatagcgagagagacgcggaaggcaaaattaccaaatacttccatttcgacgaaataaggatcgaactagcccgcgaattaaagaaaaatgctcaagagcgatatgaaatgacccaaaacataaacaaagccaaattagaacatcaaaaaatatcagaaaaacttcaaaaacaatttggaataaaaaatcctacaaaaagcgacattatacgatacagactataccaagagctagaacataacggatataaagaactatataccaacacgtacatagctcctgatgtcctcttttcaaaaaacattgacatcgagcatatagtaccaaaagcccgggtcttcgacgactctttctcaaacaaaaccttagcattcaaagaatttaatatcaagaagggagaaagtactgccttcgattatatcaccagtttaaactgtgaaggcgaactaaaccaatacctgacccgcgttgaaaacgcatataaaaccaaatcaattagcttaacaaaatataaaaatctactaaagaaagcttcagaaataggagatggtttcattaacagagatctaagagacacacaatacatagcaaaaaaagcaaaagaaatattgttccaggtcacaaagaacgtactctcaacatcaggatcaataacagatagactccgtgaagactggggattagtcgacgtaatgaaagaactcaatatgcctaaataccaaagtctaggtctaacagaagtagaagaaagaaaggacggtaataaagtaacagtaataaaagattggacaaaaagaaacgaccaccgacaccatgccatggacgcactgacagtggcattcaccaaaccaagctacatacaatatctcaaccatttaaacgctagaaaagatgaaaacaataaaaattacagtgtaatactagcgatagagaaaaaggagaccattaaagttcccataaataatggaaaaaacaaacgcgtattcatagaacctatactaaacttccggcaggtggcaaaaaaacacttagaggaaatatttataagccataaagcgaaaaacaaggttgtgaccaagaacataaataaacctgctgggactgataaacaacaaataactctgaccccaagaggacaattacacaaagaaacaatttatggtaaataccaatattacgtcaataaagaagaaaaagtaggcgtaaaattcgacgaaaggacaataacaaaagtctctaaccctctctaccgagaagcactgctaaaacgcctacaagcaaacgacaatgacccaaaaaaagcattcgcaggaaaaaacgcactaagcaaaaatcccatatatctagacgaagcaaaaactaaaactttacccgaaaaagtgaacctaacatacctagaagaagacttcagtatcagaaaagatatctctccggataacttcaaagatttaaaatcaattgaaaaagtcatcgatcaaggtgtgaaacgtattttaataaaaaggctccaagcctatgataacgacccgaaaaaagccttcgtagatttagaaaaaaatccaatatggctaaataaagagaagggaattgccataaagagagtcacaataagcggagtctcgaatgcccaaccactacacatcggaaaagatcatctaggtaaaacgacactaaataaagaggggaaagaagtaccagtcgactatgtaagcacaggaaataatcatcacgtggcaatatatcgagataaagagggaaacctccaagaacaaattgtaagtttcttcgaagcagtagtgcgagcacaacagggattacctataatagataaaaactacaaacaagctgaaggttggcaattcatgtttacaatgaagcagaacgaaatgttcgttttccctaatgaagccacaggatttaatccagcagaaattgacttactagaccccaaaaataaaaaattaatctcccccaacttgtttagagtacagaccatctcaattgtgaaatacggcaattcagtagtgagagacttcaaatttagacaccatctagaaaccaccctacaagacgacaaaatactacaaggtatcacttttcaacagataaaatcacttgagccactcagaaacatagtaaaagtgagaatcaaccatttaggtgacattgtgaacattggtgaatactga

SEQ ID NO: 9158 - RNA, 4311 nt, synthetic construct
  misc_feature 1..4311: note = Cas9 variant
  source 1..4311: mol_type = other RNA
atgaaaagaatattaggcttagatttaggaactaactccataggatgggccctagttaatgaagcagaaaacaaagatgaacgcagttcaatagtgaaacttggagttcgagtaaacccccttacagtggacgaactcactaactttgaaaaaggaaaatcaataaccacgaacgcagatagaaccttaaaacgaggcatgcgtagaaaccttcaacgttataaactaagaagagaaacattaactgaggtattaaaagaacacaaattaattacagaggacacaatattaagcgaaaatggaaaccgcacaacatttgaaacttacaggctcagagcaaaagcagtaacagaggaaatctcactcgaagagttcgcacgcgttctattaatgattaacaagaaacgaggatataaaagcagcagaaaagcaaaaggtgtggaagaagggacacttattgatggcatggacatagctagagaactatacaacaacaacctaaccccaggagaattatgcttacaattactcgatgcaggaaagaaattcttaccggacttctatagatccgatctgcagaatgaactagatagaatatgggaaaaacaaaaagaatactatccagaaatactgacggacgtcttaaaagaagaattacgagggaagaaaagagatgcagtctgggctatatgtgcaaaatactttgtctggaaagaaaattatacagaatggaacaaagaaaaaggaaaaacagaacagcaagaacgcgaacataaattagaaggtatatactcaaaacgaaaaagagacgaagcaaaacgagagaatcttcaatggcgagtcaatggactaaaagaaaaactatctcttgaacagctagtaatagtatttcaagaaatgaatactcagatcaacaatagttctgggtacttaggagctataagcgatcggagcaaagaattatactttaacaaacaaacagtgggtcaataccaaatggaaatgctagataaaaacccaaacgctagcttaagaaacatggtcttttatcgacaagactatttagacgaatttaatatgctgtgggaaaaacaagctgtttaccataaagaactaacagaagaattaaagaaagaaataagggatataataattttctatcaaagaagacttaaatcgcaaaaagggcttataggtttctgtgagttcgaatccagacaaatagaagtagatatagatggtaaaaagaaaataaaaacggtaggaaatcgagtaataagccgaagcagtcctctatttcaagaatttaaaatatggcaaatattaaacaacatcgaagtcacagtagtaggaaagaaacgaaaacgacgaaaactaaaagaaaactactcagcgttgttcgaggaacttaatgatgccgaacaactagaattaaacggatcacgacgtctctgtcaagaggaaaaagaactacttgctcaggaactgtttgtaagggataaaatgacaaaaagtgaagtattaaaactcctatttgataacccacaagaattggatcttaatttcaaaaccatcgacggcaacaagactggatacgcattattccaagcctacagtaagatgatagaaatgagtggacatgaaccagtagacttcaagaaacccgtagagaaagttgtagaatacatcaaagcagtattcgatctcttaaattggaacacagacattttaggtttcaattcaaatgaagaattagataaccaaagctactataaactgtggcatttactatattcgtttgaaggcgataatacgccaacaggaaatggaagactaatacagaaaatgactgagctctatggattcgaaaaagaatatgcgaccattctagcaaatgtgagctttcaagacgactacggtagcttatcggcaaaagcaatacacaaaatacttccacatttgaaagaaggaaacagatacgacgtagcatgtgtatatgccggataccgtcactcagaaagttcattaacacgagaggaaatagcaaataaggtacttaaagatagacttatgttactccctaaaaactcactacacaacccagtagtagagaaaatactaaaccaaatggtaaacgtcatcaacgtaattatagatatatatggaaaaccagacgaaataagagtagaactggcacgcgagttaaagaaaaatgctaaagaaagagaagaattaacaaaatcgatcgcacaaacaacaaaagcccacgaagaatacaaaaccctactacagactgagttcggattaacaaatgtgtcacgaacagatatattaagatataaactctataaagaattggagtcatgcggatataaaaccctctattcaaatacttatatatcgcgggaaaagttattctcaaaagaatttgatattgaacatattatcccacaagcgagattatttgatgatagttttagcaataaaacattggaagctagaagcgttaacatcgaaaaaggaaacaacactgcatacgatttcgtaaaagagaaattcggagaatccggcgcagataatagtttagaacaatatctaaataacatagaagatcttttcaaatccggaaagatatctaaaacaaagtacaataaactcaaaatggcagagcaagacatcccagatggatttattgaaagagatttaagaaatacgcaatatatcgccaagaaagccctcagtatgctaaacgaaataagccatagagtagtagccacatcaggatcagtcaccgacaaattacgggaagactggcaactcatcgatgtaatgaaagaactcaactgggagaaatataaagcattagggctagttgaatatttcgaagaccgagacggaagacaaataggaagaataaaagattggacaaaaagaaatgaccataggcatcacgctatggacgcattaaccgtagctttcacaaaagacgtattcatacaatactttaacaataagaacgcaagcctagatccaaacgctaacgagcatgcaattaaaaataaatactttcaaaatggacgcgcaatagcgccaatgccgctccgagagtttagagctgaagctaagaaacatttagaaaatactttaatcagtataaaagccaaaaataaggtgataacaggaaatatcaacaaaacacgaaagaaaggaggggtaaataaaaatatgcaacagactccgagaggacaattacatctggaaacaatatacggatccggaaaacaatacctaacaaaagaggaaaaagtcaatgctagctttgatatgagaaaaattggaactgttagcaaatcagcatatagagacgcattactaaaacgactgtatgaaaatgacaatgatcctaaaaaggcatttgcaggcaaaaactccctagacaaacaaccaatatggctagacaaagaacaaatgagaaaagtgccagagaaagtaaagatcgtcaccttagaagctatttatacaatacgaaaagaaatcagcccagacctaaaagtggacaaagtaatagacgtgggtgttcgcaagatactaattgatagattgaatgaatatggaaatgatgcaaagaaggcattttccaatttggatgaaaacccaatttggttaaataaagagaagggaatctcgataaagagagttacaattagtggtatatcgaatgcacagagcttacacgtaaagaaagataaagatggaaaacccattttagatgaaaacggccgtaatatacctgtagatttcgtcaacacaggaaacaatcatcacgtcgcagtctattatcggccagtaatagacaaacgtggacaactggtggttgatgaagccggaaacccaaaatacgaactagaagaggtggtagtatccttctttgaagcagtgacaagagctaacctaggtcaaccaataatagacaaagattataaaactacagaaggttggcaatttttattctccatgaaacagaacgaatactttgtattccccaatgagaaaaccggtttcaaccctaaagaaattgacctattggacgttgaaaactatggactaatatcgccaaatttatttagggtacaaaaattctcattgaaaaattatgtattcagacaccacctagaaactacaataaaagatacatcaagtatactaagaggtataacctggatcgattttcgaagctcaaaaggactagacacaattgtcaaagttagggttaaccatattggacaaatagtaagcgtgggagagtactga

SEQ ID NO: 9159 - RNA, 4311 nt, synthetic construct
  misc_feature 1..4311: note = Cas9 variant
  source 1..4311: mol_type = other RNA
atgaagagaatactaggcctagatttaggtacaaacagcatcggttgggcattagttaacgaagctgaaaacaaagacgaaagatcgagcatagtaaaactaggcgtacgggtcaatccactcactgtcgatgaattaacaaactttgaaaaaggaaaatccattaccaccaatgcagatagaacattaaagcgaggaatgagaagaaacctacaaagatacaaactgcgacgagaaactctaacagaagtattgaaagaacacaaactaataacagaagacactatactaagcgaaaatggaaaccgaactacgttcgagacataccgactacgagcgaaagcagtaacagaggaaattagcttagaagaatttgcacgagtacttctcatgatcaataagaaacgtggttataaatcatcaagaaaagcaaaaggcgtcgaagagggtacactaattgacggaatggacatagctagagaactatacaataacaacctaacaccaggggaattatgcttacaactattagacgcaggcaagaagtttctccctgacttctaccgaagtgatctgcagaatgaactggacagaatatgggaaaagcaaaaagaatattacccagaaattctcactgatgtgttgaaagaagaactccgaggcaagaaaagagacgctgtatgggctatatgtgccaagtatttcgtatggaaagaaaattatacagaatggaataaagagaaaggaaaaaccgaacaacaagaaagagaacacaaacttgagggaatctactctaaaagaaaacgagatgaagcaaagagagaaaatttacaatggagagtaaacggactaaaagaaaaactaagcctagaacagctagttatagtatttcaagaaatgaatacacaaatcaacaattcaagtggatatctaggagcaatctccgacaggtcaaaagaactatacttcaacaaacaaacggttggtcaataccaaatggaaatgctcgataaaaaccccaatgcaagtctgagaaacatggtcttctacagacaagattatttggacgagttcaacatgctttgggaaaaacaagcagtataccataaagaattaaccgaggaactcaaaaaggaaatcagggatattataatcttttaccaaaggcgattaaaaagccaaaaaggattaattggattctgcgagttcgaaagcagacaaatagaagtcgatatagatggaaagaagaaaattaaaaccgtaggcaatcgcgtcatcagccgttcttccccattattccaagaatttaaaatatggcaaatacttaacaacatcgaagtaacggtagtcggaaagaaaagaaaaagacgaaaacttaaagaaaattacagcgccttattcgaagaactaaacgatgcggaacaacttgaattgaacggcagcaggcgattgtgccaagaagaaaaagaactcctcgcacaggaacttttcataagagataaaatgacaaaaagcgaagtactaaaattactctttgacaacccacaagaacttgacttaaacttcaaaacaatagacggaaataagaccggttacgcattattccaagcatatagcaaaatgatagaaatgtcaggccacgaaccagttgattttaaaaagcctgtggaaaaggtagttgaatacataaaggcagtatttgacttattaaactggaacacagacatactaggattcaatagtaacgaagaactcgacaaccaaccatattacaagttgtggcacctattatactcatttgaaggcgacaacacaccaacaggaaacggccgactaatccaaaagatgacagagttatacggatttgaaaaagaatatgcaaccattctagctaacgtaagtttccaagatgactacggatcgttgtccgcaaaagctatacataaaatattaccacacttaaaagaaggtaacagatatgacgtagcatgtgtatatgcaggatatcgtcactcagagtctagcctcacccgagaagaaatagccaataaagtacttaaagatcgccttatgctactccccaaaaactcattacataatccagtcgtggagaaaatattaaaccaaatggtaaatgtaataaatgtaataatagatatatacggaaaaccagacgaaatcagggtagaattagcaagagaactaaagaaaaatgcaaaagaaagagaagaattaacaaaaagcatagcacaaacaactaaagcacacgaagaatataaaacactgcttcagacagagttcggtctaacaaacgttagccgcacggacatattacggtacaaattatataaagaactagaatcttgtgggtacaaaactctatatagtaatacatacatatcacgtgaaaagctattctcaaaagagttcgatattgaacacatcatccctcaggctaggctattcgatgatagcttcagcaataaaacattagaagcaagatcagttaacatagaaaaagggaataagaccgcgtacgactttgtgaaagaaaagttcggggaaagcggggcagataattcactagaacactaccttaataacatcgaagatttatttaaaagcggcaaaatatcaaaaacaaagtataacaaattaaaaatggcagaacaagacataccagatgggttcatagaacgtgacttgagaaatacgcaatatattgccaaaaaggccctatcgatgttaaacgaaatcagtcatagagtagtcgcgacaagcggatcggtaacagacaaactcagagaagactggcagctaatcgacgtcatgaaagaactaaattgggaaaagtacaaagcattaggcctagtagaatacttcgaagatagagacggtcgtcaaattggtcgtataaaggactggacaaagcgaaacgaccatagacatcacgcaatggatgccttaacggtagcttttacgaaggacgtattcattcaatatttcaataataagaacgccagtctagaccctaacgcaaatgaacacgctattaaaaataaatattttcaaaatggaagggcaatagccccaatgccattaagagagttcagagcggaagctaagaaacatttggaaaacaccctaatatcaatcaaagctaaaaacaaagtaattacaggaaatataaacaaaacaaggaagaagggaggagttaataaaaatatgcaacaaacaccccgtggccaattacatcttgaaaccatatatggttcagggaagcaatatctaaccaaagaagaaaaagttaacgcatcattcgacatgagaaaaatcgggacggtatcaaaatcagcatatcgcgacgcactattaaaacgactttacgaaaacgataatgatccaaagaaagcattcgcgggcaaaaattcgcttgataaacaacctatctggttagataaagaacaaatgagaaaggttccagaaaaagtcaaaatagtgacattagaagccatatacactataaggaaagaaataagtccagatctaaaagttgacaaagtgatcgatgtaggagtacgaaaaatattaatagacaggttaaacgaatatggaaatgatgccaagaaagcattcagtaatctagataaaaacccaatttggctaaacaaagaaaaaggaataagcataaaaagagtaacaatatcgggaatatcaaatgcgcaaagcctacatgttaagaaagataaagatggaaaaccgattttagacgaaaatggtagaaacatacctgtagatttcgttaatacggggaataatcatcacgttgctgtatactaccggcctgtgatcgacaaaagaggtcagctagtagtcgacgaagcagggaatccgaaatacgaactagaagaagtggtagtatcgttctttgaggcagtaacaagagctaacttaggtctaccaataatagacaaagactataaaacaacagaaggttggcaatttctattttcaatgaaacaaaatgagtattttgttttccccaatgagaaaacaggcttcaatcccaaagaaatagatttgttagacgtcgaaaattacggtctaatatcaccaaacctatttagagttcaaaaattcagccttaaaaattatgtattcagacaccacttagaaacaacaataaaagatacatctagcatactaagaggtatcacttggatcgatttcaggagcagcaaaggtttagatacgatagtcaaggtaagggttaatcatataggacaaattgtatcagtaggagaatactga

SEQ ID NO: 9160 - RNA, 4311 nt, synthetic construct
  misc_feature 1..4311: note = Cas9 variant
  source 1..4311: mol_type = other RNA
atgaaaagaatactaggactagacttaggcaccaactctatcgggtgggctctcgtcaatgaagccgaaaacaaagacgaacggagtagtatcgtaaaactaggagtacgagtcaacccacttactgtggatgaattaacaaattttgaaaagggaaaatcaataacaacaaatgcagacagaacattaaaaagagggatgaggaggaacctacaaagatacaagctaagaagagaaaccctcactgaagtactaaaagagcataaattaatcacagaagatactattttgagtgagaacggaaaccgaaccacatttgagacatatcgactacgagcaaaagcagtaacagaagaaatcagcctagaagagttcgcaagagtactcctaatgattaacaagaaaagaggatataaaagtagtagaaaagcaaaaggagtagaagaaggtacattaatagacggaatggatattgcgagagaactatacaacaacaacctaacacccggtgaactttgtcttcaactattggacgcaggaaagaaatttctcccagacttttacagaagcgacctacaaaacgaattagatcgcatatgggagaaacaaaaagaatactacccggaaatactcacagatgttttgaaagaggaattaagaggaaagaaaagagatgccgtgtgggcaatatgcgcaaaatacttcgtatggaaagagaattatactgaatggaacaaagaaaaaggaaaaactgagcaacaagaacgagagcacaaactggaaggcatctacagcaaacgaaaaagggatgaagctaaaagggagaatctacaatggagggttaatggattgaaagaaaaactgagcttagaacaacttgtaatagtattccaagaaatgaacacacaaatcaataactcgtctggatacttaggagcaatatcggatagaagtaaagagctgtactttaataaacaaacagtggggcaatatcaaatggaaatgcttgataaaaatcctaatgcttcattacggaatatggtattttatagacaagattacctagatgagttcaatatgctatgggaaaaacaagcagtataccacaaagaacttacggaagaattaaagaaagaaattagagatattattatattctatcagagacgtctaaaaagtcagaaaggcctgataggcttctgcgagtttgaaagtcgacaaatagaagtagacatcgatggtaaaaagaaaatcaaaaccgtaggaaacagagtcatctctcgctcctcaccattattccaagagtttaaaatttggcaaatactcaacaatatagaagtgacagttgttggcaagaaaagaaaacgccgtaaattaaaagaaaattactcggctctattcgaagaactaaacgacgcagaacaattagaactaaacggatcccgaagactatgccaagaagaaaaagaattactagcgcaagaactcttcataagagacaaaatgacaaaatccgaagtactaaaactattattcgataacccccaagaactcgacctgaatttcaaaactatcgacggaaacaaaacaggatacgcattatttcaagcatatagtaaaatgatagaaatgtcaggacatgaaccagtcgattttaagaaaccagtagaaaaagttgttgaatatataaaagccgtatttgacttattaaattggaataccgacatcctgggatttaattcaaatgaggagttagataaccaatcatattataaattgtggcacctattatatagcttcgaaggtgataacacaccgactggcaatggtaggttaatacagaaaatgacagaactatacggatttgaaaaagaatacgcgacaatattagcaaacgtaagttttcaagatgattatggttcacttagtgctaaagcaattcacaaaatattaccacacttaaaagaaggaaatcgatatgatgtagcctgcgtatacgcagggtatcgacacagtgaaagctcattaacgcgcgaagaaatagcaaacaaagttttgaaagatagactaatgctcttaccgaaaaactctttacataatccagttgtagagaaaatacttaaccaaatggtaaatgtcataaatgtaatcatcgacatatacggtaaaccagacgaaatacgagtagaactagccagagaactcaagaaaaacgcaaaagaaagagaagaattgaccaaaagtatagcacaaacgactaaagcgcatgaagaatacaaaacgctactgcaaacagagttcggtcttacaaacgtatcacgtacagatatactaagatataaactatacaaagaacttgaaagctgcggatataaaactctatattcaaacacatacataagccgagagaaacttttcagtaaagagttcgatatcgaacatatcataccacaagcacgactatttgatgactccttttcgaacaaaacattagaagcccgctcagtcaatatagaaaaagggaacaagactgcatatgacttcgtaaaggaaaaattcggtgagtctggggccgataattcactcgaacactacctcaacaacatagaggatctcttcaaatcaggaaaaatctcgaagaccaaatataacaaactcaaaatggcagagcaagacattccagatggattcatagaaagggacctgaggaacacccaatacatagccaaaaaggcactaagcatgcttaatgaaataagccatcgagttgtagcaacaagtggatcagttacagacaagctaagagaagattggcagctaattgacgtaatgaaagaattgaactgggaaaaatacaaagcattaggtttagtcgaatattttgaggatagagatggtagacaaataggaagaatcaaagactggactaagcgaaacgatcacagacatcatgctatggatgcattaaccgtagcatttacaaaagacgtcttcattcaatatttcaataacaagaacgcatcactagatcctaacgcaaatgaacacgcgattaagaataaatatttccaaaacggacgtgcaatagctccaatgccgttaagagaatttagagcagaagcaaagaaacacctcgagaacacgttgattagcataaaagccaaaaacaaagtcataacagggaacataaataaaactaggaagaaaggaggcgttaacaaaaacatgcagcaaacaccacgaggccaattgcaccttgaaaccatttacggctcaggaaaacagtatttaaccaaagaagaaaaagtaaatgcaagttttgacatgaggaagataggtaccgtaagcaagctagcgtatcgtgatgcgttattaaagcgattatatgaaaatgacaacgatccaaagaaagcctttgcaggtaaaaattcactagacaaacaacctatttggctggataaagaacaaatgcgaaaagtaccagaaaaagtaaaaattgtaaccttagaggcaatatacacaataagaaaagaaatctcgccagaccttaaagtcgataaagtaatagatgtcggagtaaggaaaatactaattgacaggctaaatgaatatggaaacgatgcgaagaaagcattctcaaacttagacgaaaatccaatctggctaaacaaagagaaaggaataagtatcaaacgagtaactatcagcggaatatcaaacgcgcaatcattacatgtcaagaaagacaaagacggaaaacctatcctagacgaaaacggaaggaacattccagttgattttgtcaatacaggcaacaatcatcacgtagcagtctattacagaccagtaatagataaacgaggccagcttgtagtagacgaagcaggcaacccgaaatacgaattagaagaagtagtagtcagtttcttcgaagccgtaactcgtgcaaacttgggacaacccataatagacaaagactataaaacaaccgaaggctggcaatttctatttagtatgaaacagaatgaatactttgtctttccaaatgagaaaacaggattcaatcctaaagaaatagatctattagacgtagaaaattatggactgatttcacctaacttatttcgagtacagaaattttcactcaaaaattacgtatttcgccaccacctagaaacaacaataaaagacacatcgagcatactaagagggataacgtggatagattttagaagctccaaaggtttagacactatcgtaaaagttcgtgtgaatcatataggacaaatagtttcagtgggtgaatactga

SEQ ID NO: 9161 - RNA, 4311 nt, synthetic construct
  misc_feature 1..4311: note = Cas9 variant
  source 1..4311: mol_type = other RNA
atgaagaggatcttaggattagatctaggaacaaacagcataggttgggcattagttaatgaagccgaaaacaaagacgaacgaagctcaatagtaaaactgggagtacgcgtcaatccattaacagttgacgaattaactaattttgagaaaggaaaaagtattactaccaacgctgatagaacattaaaaagaggaatgcgacgaaatctacaacgatataagttacgacgagaaaccctcacagaagtactcaaagaacacaaattaatcacagaagatacgatactttcggaaaacggaaaccgaaccacatttgaaacctatcgattaagagcaaaggcggtcacggaagaaatctccttagaagagttcgcaagagtactacttatgataaataaaaagagaggatacaaaagttcaagaaaagctaaaggtgtcgaagagggaactctaatagatggaatggacatcgcaagggaattgtataacaataacttaacccccggtgaattatgtctacagttactcgatgccggaaagaaatttctacctgacttttacagaagtgacctacaaaatgaattagaccggatatgggaaaaacaaaaagaatattacccagaaattttaacagatgtacttaaagaagaattaagagggaagaaacgtgatgcagtgtgggccatatgtgccaaatatttcgtttggaaagaaacatacacagagtggaataaagagaagggtaaaacagagcagcaggaaagagaacacaagctcgaaggaatttattctaaaagaaaaagagacgaggccaaaagagaaaacctacaatggagagtcaacgggctaaaggaaaaattatctctcgaacaattagtcatagtcttccaagaaatgaatacacaaatcaataacagcagtgggtacttaggcgctattagcgacagaagcaaagaattatattttaataagcaaactgtgggccaatatcaaatggagatgttagacaaaaatcctaacgcatcgctaagaaatatggtattctatagacaagattacctcgacgagtttaatatgctatgggaaaaacaagcagtatatcataaagaattaacagaagaactaaagaaagaaattagagacattataatcttctaccaacgacgcctaaaatctcaaaaaggcttaataggattctgtgagttcgaatcaaggcaaatagaagtagatatcgatggaaagaagaaaataaaaacagtaggaaaccgagtaatatctagatcaagtcctctatttcaagaatttaaaatatggcaaatattaaacaacatagaagtaacggtggtaggtaagaaacgaaaacgtaggaaactaaaagagaattacagcgctatttttgaagaattaaatgatgccgaacaactcgaattaaatggatcaagacgactatgtcaagaagaaaaagaactcttggcacaagaactatttgtccgcgacaaaatgacaaaatccgaagtattaaaactcctattcgacaatccgcaagaactagacttaaattttaaaacaatcgatggaaacaaaacaggttatgcactctttcaagcatacagcaaaatgatagaaatgtctgggcatgaacccgtagatttcaagaaacccgtcgaaaaagtggtagaatacataaaagctgtatttgacttattaaattggaacacggacatcttgggttttaactcaaatgaagaacttgataaccaatcgtactacaaactctggcatttactctatagttttgaaggagataatactcccacaggaaacggtcgcttaatacagaaaatgaccgaactatacggcttcgaaaaagaatatgctacaatattagcaaatgttagctttcaagacgactacgggagtctaagtgctaaagcgatacacaaaatactaccacacctaaaagaaggaaacagatatgacgtagcatgtgtttacgcaggttaccgtcacagtgaaagtagtttaaccagagaagaaatagcaaataaagtgctaaaagaccgactcatgctactacccaaaaactcactacacaatcccgtagttgagaaaatcctaaaccaaatggtaaacgttatcaacgtcatcatagatatatatggaaaaccggatgaaatacgtgtagaactagcgagagaactaaagaaaaatgcaaaagaacgagaagaactaacaaaatccatagcacaaaccacgaaagctaacgaagaatataaaacattattacaaacagaatttggtttaacaaacgtaagtagaacagacattttgagatataaactgtataaagaactcgaatcatgcgggtacaaaactctctattcgaatacatatatttcgcgagaaaaattattctctaaagagttcgacatagagcacataatcccacaagcaagactctttgatgactccttttctaacaaaacattagaagcaagaagtgtaaacattgaaaaaggaaataaaacagcatacgatttcgtaaaagaaaaattcggagaatcaggggcagacaattcattagaacactatttaaataacatagaagacctattcaaaagtggcaaaatatctaaaacaaaatacaacaaattaaaaatggcaaagcaagatatacctgacggatttatcgagcgagacctcagaaacacacaatatatagcaaagaaagcattaagcatgttgaacgagatcagtcatagggtcgtagcaactagcggtagtgtaactgacaaactccgagaagactggcaactgattgacgtaatgaaagaactgaattgggaaaaatacaaggctttaggcctagtcgagtactttgaagacagagatggaagacaaatcggaagaataaaagactggacaaaaagaaacgatcacagacaccacgctatggatgcattaacagtggcattcaccaaagacgtgtttatacagtactttaacaacaaaaatgccagtcttgatcccaacgctaatgaacacgcaattaaaaacaagtattttcaaaatggtagagctatagcacccatgcctctcagagagttcagggcggaagcaaagaaacacttagaaaacacattaatatcaataaaagccaaaaataaagtgataacaggcaatattaataaaaccagaaagaaaggtggtgtcaataaaaatatgcaacaaacacctagaggacaactacacttagaaacaatctacggaagtggcaaacaatacctgacgaaagaggaacgggttaacgcatcttttgacatgagaaaaatagaaaccgttagcaaaagtgcttaccgggatgcgttattaaaacgactatatgaaaatgacaatgatccgaagaaagcctttgcaggtaaaaactcattagataaacaaccaatatggctcgataaagaacaaaaacgaaaagtaccagaaaaagtgaagatagtcacattagaagctatctacacaatacgcaaagaaatatcaccagatctcaaagtagacaaagtcatagacgtaggagtaagaaaaatattaatagatagacttaatgagtacggcaatgacgctaagaaagcattttctaatctcgacgaaaacccaatttggctaaacaaagaaaaagggatttcaataaaaagagtaactatatccggtatatcaaatgcacaatcgttacacgtgaagaaagataaagatggcaaacctatcctagacgaaaatggccgaaacataccagtagacttcgtaaatacagggaacaatcatcacgtcgctgtatattacagaccggtgatagataaaaggggacaattagtcgtagatgaagccggaaacccgaaatacgagcttgaagaagtagtagtatcatttttcgaagcagtaactagggcaaacttagggcaaccgattatcgataaagactacaaaaccaccgaaggttggcaattcctatttagtatgaaacaaaacgaatattttgtatttccaaatgagaaaactggattcaacccaaaagaaatcgacctcttagatgtagaaaattacggattgatatctccaaatctatttagagtacaaaagttctcacttaaaaattatgttttccggcaccatctagaaacaacaatcaaagatacctcatcaatactgagaggaatcacttggatagattttcgttcaagcaaaggattagacacaatagttaaagttcgagttaatcacatcgggcaaatagtaagtgtaggagaatactga

SEQ ID NO: 9162 - RNA, 4311 nt, synthetic construct
  misc_feature 1..4311: note = Cas9 variant
  source 1..4311: mol_type = other RNA
atgaaaaggatacttggattagaccttggaactaattcaatcggttgggccctggtaaatgaagcagaaaacaaagacgagcggagtagtatcgtgaaactgggggtcagagtgaacccccttaccgtcgacgaattgacaaactttgaaaaaggaaaaagtatcacaacaaatgctgacagaacactgaaaagaggaatgagaagaaacctacaacgatacaaattaagaagagaaacattaaccgaagtactaaaagaacacaaactaatcacagaagatactattctatcagaaaacggaaatagaactacttttgaaacataccgactacgggcaaaagcagtaacagaagaaataagtctggaagaatttgcaagagtcctactaatgatcaataagaaaagagggtataaatctagcagaaaagcaaaaggcgtggaagaaggcacccttatagacggcatggacatagcaagagagctatataacaataatttgacacctggggaactatgtctccaactattagatgctgggaagaaatttctaccagacttctaccgctcagacctccaaaatgaactcgatagaatatgggaaaaacaaaaagaatattacccagaaatactaaccgatgtacttaaagaagaattacgaggtaagaaacgagatgcagtctgggcaatttgtgcaaaatatttcgtttggaaagagacatatacggaatggaataaagaaaaaggaaaaacagaacaacaagaaaaagaacacaaactagaaggcatttatagcaaaagaaaacgcgatgaagcgaaaagagaaaatcttcaatggagagtaaacggactaaaagaaaaattatcacttgaacagctagtaatagtattccaagagatgaacacacaaataaacaattcatcaggatacctaggagcaattagcgataggagcaaagaattatatttcaacaaacaaaccgtaggacaataccaaatggaaatgttagataaaaatccaaacgcatcgcttagaaacatggtattctatagacaagattatctcgacgagtttaacatgctatgggagaaacaagcagtttatcacaaagaactaacagaggaactaaagaaagaaataagagacataatcatcttctaccaacgcaggctcaaatcgcaaaaaggtctaattggtttttgcgaatttgagtctcgacaaatagaagttgatatagatggtaaaaagaaaatcaaaacagtcggaaacagagtaatatcaagaagctcacctctttttcaagaatttaaaatctggcaaatacttaataatattgaagttacagtagtcggaaagaaacgaaaaaggagaaaattaaaagaaaattattcagctttattcgaagagttaaatgacgcggagcaattagaactgaacggatctcgaagactttgccaagaagaaaaagaactcttagcacaagaattatttatacgagacaaaatgaccaaaagcgaagttctcaaacttctgttcgacaatccccaagaactcgatcttaactttaaaacaatagatgggaacaaaacaggttacgcactgttccaggcttactcaaaaatgatcgaaatgtcaggacatgaaccagttgactttaagaaacctgtcgaaaaagtagtagagtacataaaagcagtttttgacctactgaactggaacaccgacatactaggattcaacagtaacgaggaactagataatcaatcgtactacaaactatggcacctattatactcctttgaaggcgacaatacgccaactggaaatggaagactgatccagaaaatgactgaactatacggatttgaaaaagaatacgctacgattctagcaaacgtatcattccaagatgactatggaagtctaagtgctaaagctatccacaaaatactgccgcatctaaaagaaggaaatagatatgatgtagcgtgtgtatacgctggataccgacatagcgaatcctctctcacaagagaagagattgccaacaaagtactaaaagaccgactaatgctcctacccaaaaacagtttgcataatccagtcgttgagaaaattttaaaccaaatggtaaacgtaatcaacgtcatcatagacatctatgggaaaccagacgaaataagagtagaattagcaagggaacttaagaaaaatgcaaaagaaagagaagaattaactaaatcaatagcgcaaacaactaaagcgcacgaagaatataaaacgctactacaaacagagttcggactaacaaacgtttcgcgtacagatatactccgatataaactttacaaagaactcgaaagttgcggatacaaaacactatacagtaatacatatataagtagagaaaagctattttcaaaagaatttgatatagaacatataatcccccaagctcgactattcgatgatagtttcagtaacaagactctagaagccaggtcagttaacattgaaaaaggcaataagacagcatacgacttcgtaaaagaaaaatttggagagtcgggtgctgataacagtctagaacactatttaaacaacatcgaagatctattcaaatcaggaaagatcagcaaaactaaatacaacaagttaaaaatggccgaacaggacatacctgatggattcatagagagagaccttcgaaacacacagtatattgcaaagaaagcactgtctatgttaaacgaaatatcccatagagtagtggcaacgagtggatcagtaaccgataaactacgagaagactggcagttgatagacgtaatgaaagaacttaattgggaaaaatacaaagcactcggcctcgttgagtatttcgaagatagagacgggcgtcaaataggtcgtataaaagactggacaaaaagaaacgaccacagacatcacgccatggatgcattaacggtcgctttcactaaagatgtatttattcaatacttcaacaataaaaacgcatcattagaccccaacgcaaacgaacacgcaatcaaaaacaaatatttccaaaatggtagagcaatagcgccgatgccattaagagagttccgggcagaagcgaagaaacatcttgaaaatacgctcatctcgattaaagccaaaaataaagttattacaggaaacattaacaaaaccagaaagaaaggaggagtaaacaaaaatatgcaacaaacaccgagaggacaattgcatttagaaaccatttatggttccggaaaacaatacctcacaaaagaagaaaaagtcaatgctagttttgacatgagaaaaataggcacagtatctaaactcgcataccgagatgcattactcaaaagattatatgaaaacgataatgaccctaaaaaggcttttgctggtaaaaattccctcgacaaacaaccaatatggttagacaaagaacagatgagaaaagtgccagaaaaagttaaaatagttacccttgaagcaatatacaccattcggaaagagataagcccagacttaaaagttgacaaagtgatcgatgtgggagttagaaaaatattaattgacagactaaacgaatatgggaatgatgcaaagaaagcattctcaaacttagatgaaaaccctatatggcttaacaaagaaaaaggaatctctattaaaagagtaacaatctcaggaatatcaaacgctcaatcgctgcacgttaagaaagataaagatggaaaaccaatacttgacgagaacggacggaacattccggttgattttgtaaatacgggaaacaaccatcatgtagccgtatactacagaccagtgatagataaacggggacaattagtagtagacgaagcaggtaaccccaaatatgaactagaagaagtagtagtatcattcttcgaagctgtaacacgagctaatctaggtcaaccgatcatagataaagactataaaacaacggaaggatggcaatttctattctctatgaaacaaaatgaatacttcgtattccctaatgagaaaaccggatttaacccaaaagaaatagatctacttgatgtcgaaaattacggattaatcagcccgaacctattcagagtccaaaaattcagtcttaaaaattacgtttttaggcaccacttagaaactaccataaaagacacatcatctatattaaggggtataacctggatagacttccgaagcagcaaaggactggacacaattgttaaagtaagagtgaatcacataggtcaaattgtaagtgtaggggagtattga

SEQ ID NO: 9163 - RNA, 4311 nt, synthetic construct
  misc_feature 1..4311: note = Cas9 variant
  source 1..4311: mol_type = other RNA
atgaaaaggattctgggactggatctgggaaccaattccattggctgggcactggtaaatgaagcagaaaataaggacgaaagatcctcaatcgtaaaactcggtgtaagagtaaatccactaacagtagacgaactaactaattttgaaaagggtaaaagcataacaacaaatgccgatagaacgctgaaaaggggtatgagacgaaatttacaacgatacaagctaaggagagaaactctcacagaagttttaaaagaacataaactcataacagaagacaccattttaagtgaaaacggtaatcgtacaacatttgaaacgtaccgattaagagctaaagcggtaacagaagaaatttcgctagaagaatttgccagagtactgctaatgataaataagaaacgaggttataaatccagccggaaagcaaaaggtgtggaagaaggaacactaatagacgggatggatattgcccgagaactatataacaacaacctaacacctggagaattatgtctacagctcttagacgcgggaaagaaattccttcccgatttctatcgatcagatcttcaaaacgagctagatagaatatgggaaaaacaaaaagaatactacccagaaatacttacagacgtcctgaaagaagaattgcgaggtaagaaacgagacgcagtatgggctatatgcgctaaatacttcgtatggaaagaaaattacacagaatggaataaagaaaaaggaaaaacagaacagcaggaaagagaacacaaactagagggtatttacagtaaacgcaaaagagatgaagcaaaaagagaaaacttacagtggcgcgtcaacggacttaaagaaaagctatcactagaacagcttgtaatagtatttcaggaaatgaatacacaaataaataactccagtgggtatttaggcgcgatctcggacagatcaaaagaattatatttcaacaaacagacagtaggacaatatcaaatggaaatgttagataaaaaccctaatgcgagtttaagaaatatggtattttaccgacaagactacctagacgagttcaacatgctttgggaaaaacaagccgtttatcataaggaacttacagaagaactaaagaaagaaatacgagatattattattttctatcaacgaagactaaaaagtcaaaaaggcctaataggtttttgtgagttcgaaagtagacaaatcgaagtcgatatagatggtaaaaagaaaataaaaactgttggaaatcgtgtcataagtagaagtagtcccttattccaagagttcaaaatatggcaaattttaaataatatagaagtgacagttgtaggaaagaaaagaaaaaggagaaaacttaaagaaaattatagcgccctatttgaagaactcaacgacgccgaacagctggaactaaatggctcgagacgactgtgccaagaagaaaaagaactactggcgcaagaactattcataagggacaaaatgacaaaaagcgaggtcctaaaactactattcgataatccacaggaattagacctcaatttcaaaacgatagacggcaataaaacaggatacgctttattccaagcatatagtaaaatgatagaaatgagcggccacgaaccggtagacttcaagaaacctgtagaaaaagttgtcgaatacataaaagcagtattcgacctactaaattggaatacagacatactaggattcaactcaaacgaagaactagacaaccaaccctactataaactttggcatcttttatactcattcgagggagataacacaccgacaggcaatggcagattaatacagaaaatgacggaactatacggtttcgaaaaagaatatgcaacaatattagcaaatgttagtttccaagacgattatgggtcattatcagccaaagcaatacacaaaatcttaccacacttaaaagaaggaaatcgatacgatgtagcttgcgtttatgcaggatatagacacagtgaaagcagcctaacaagagaagaaatcgcaaataaagttttaaaagacagattaatgctactaccgaaaaactctcttcataatccagttgttgagaaaatactgaaccaaatggtaaacgtcataaacgtgataatagacatttacggcaaaccagatgaaattcgagtcgaattagctagagaattgaagaaaaacgcaaaagaacgtgaagaattaactaaatcaatagctcagacaacaaaagcacatgaagaatacaaaactctgttacaaacagaatttggtctcacaaacgtatcaaggactgacatactaaggtataaattatacaaagaactagaatcttgcggatataaaacactttatagtaacacatatatttcacgcgaaaaattattctcgaaagaatttgatatcgaacacataatacctcaagcaagacttttcgatgacagtttttccaataaaacattggaggctagatcagttaacatagaaaaagggaacaaaacggcatacgacttcgttaaagaaaaatttggggaaagcggtgcagataacagtttagaacattatctaaataacatagaagacctcttcaaatccggaaaaatttctaaaacgaaatacaacaaattgaaaatggcagaacaagacataccagatggattcatagaaagagatttacgaaatactcaatacattgccaagaaagcacttagtatgcttaatgagatatctcacagagtagtagctacaagtggatcagttactgataaactccgagaagattggcaactaatagatgttatgaaagaactcaactgggaaaaatacaaagcactcggattagttgagtactttgaagacagggacgggcgacagataggaaggataaaagactggacaaaacggaatgaccatagacatcacgcaatggacgcattgacggtagcttttaccaaagacgtatttatacaatatttcaataacaaaaacgcgtctctggacccaaacgctaacgaacatgcaattaaaaataaatacttccaaaatggtcgagctatagcacctatgccattaagagaatttagagcagaagcgaaaaagcacctagaaaacactctaataagtataaaagctaaaaacaaagtcataacaggaaacataaataaaacaagaaagaaaggcggggttaataagaatatgcaacagacaccccgtggtcaacttcatttagaaactatatacggcagtggaaaacagtatttaactaaagaagaaaaagtaaatgcgtcatttgacatgcgaaagataggtaccgtgagtaaaagcgcctacagagatgcactgctgaagagactatacgaaaacgataacgacccgaaaaaggcttttgctggtaaaaatagtctagataaacaacccatatggctagataaagaacaaatgagaaaagtgcccgaaaaagtcaaaatagtaaccctggaagcaatctacacaataagaaaagaaatatcgagtgacctaaaagtagacaaagtaatagacgtgggagtaagaaaaattcttatagaccgattgaatgaatatggaaatgacgcaaagaaagcattttcaaatctagataaaaatccaatatggttaaacaaagaaaaaggaattagtataaaacgagtgaccatatcaggaatatctaacgctcaatccctccacgtaaagaaagataaagatggaaaaccaatactggatgaaaacggtcgtaatatcccagtagattttgtgaacactggtaataatcaccatgtggccgtatattatagaccagttatcgacaaacgaggacaacttgtagtcgatgaagctggcaatccaaaatatgagttggaggaagtagtagtcagcttctttgaagcggtaaccagagcaaatcttggactgccaataatagataaagattataaaacaactgaaggatggcaatttttatttagcatgaaacaaaacgaatactttgttttccctaatgagaaaaccggttttaatccaaaagaaatagatctattggatgtggaaaactacggattaataagcccaaatttatttagagttcaaaaattttcacttaaaaattatgtattcagacaccacctcgaaaccacaatcaaagacacaagttcaatactaaggggcataacatggatcgactttagatcgtcaaaaggtctagatacaatagtcaaggtgagagtaaaccacataggacaaatcgtaagcgtcggagaatattga

SEQ ID NO: 9164 - RNA, 4311 nt, synthetic construct
  misc_feature 1..4311: note = Cas9 variant
  source 1..4311: mol_type = other RNA
atgaaacgaatattaggcttagacttgggtacgaactccataggttgggcattagttaatgaggcagagaacaaggacgagcgatcatctatcgttaaactcggtgtaagggtaaaccccctaactgtagacgagttaacgaactttgaaaaaggaaagagcattacaacaaatgccgatagaacactaaaaaggggaatgcgacggaacttacaaagatacaaattacgccgcgagacattaacagaggtactaaaagaacacaaactgattacggaagatacgatcctttcagaaaatggtaacagaactacattcgagacctatagactgagagcaaaagcagttactgaggaaatatcgttggaagaatttgcccgcgttttattgatgataaacaagaaacgaggctataaatctagtcgtaaagcaaaaggcgtagaagaagggaccttaatagacggaatggatatagcaagagaactatacaacaataacctaacgccaggagaattatgcttacaactactagacgccggcaagaaatttctccccgacttttatagatcagatttgcaaaacgaattagatagaatatgggaaaaacaaaaagaatactaccctgagatactgacagacgtcctaaaagaagaattgagaggaaagaaaagagacgccgtatgggcaatctgtgcaaaatactttgtatggaaagaaaattatacagagtggaataaagaaaaaggaaaaacagaacaacaagaacgagaacacaaattagaaggaatatatagtaaaagaaaacgcgacgaagcaaaaagagaaaacctacaatggagagtgaacggtctcaaagaaaaactaagtctagaacaattagtaatagtgtttcaagaaatgaatacgcaaataaacaattctagtgggtatttgggagcaataagtgacagatctaaagagttatatttcaataaacaaactgtcggacaatgccaaatggaaatgttagacaagaatccaaatgcgagtttacggaatatggtattctacagacaagattacttagacgagttcaatatgctatgggaaaaacaagccgtttatcataaagaactaaccgaagaattaaagaaagaaattagagacataataatattctaccagagaagattaaaaagtcaaaagggattaataggtttttgcgaatttgaatctagacaaattgaagttgatatagacggaaagaagaaaataaaaacagtaggaaatagggtcatctcaagaagtagtccattatttcaagagttcaaaatatggcaaattttaaataacatagaagttacagtcgttggcaagaaaaggaaaagaagaaaattaaaagaaaattacagcgcactttttgaagaattaaatgatgcagaacaactagaactaaacggctctagacgattatgtcaagaagaaaaagaattattagcacaagagttattcataagggataaaatgacaaaaagcgaagtcctaaaactactttttgataacccacaagagcttgatctgaattttaaaacaatcgatggaaacaaaactggatacgcattattccaagcatattcaaaaatgatagaaatgtcaggacatgaacctgtcgactttaagaaaccagtggagaaagtggtagaatatataaaagctgtatttgacctgctaaactggaataccgatatactaggattcaacagtaacgaagaacttgacaatcaaccctattataaactctggcatctactttattctttcgaaggcgacaacactccaacaggaaatggtcgattaatccagaaaatgacagaactatacggattcgagaaagaatatgctaccatactcgccaacgtcagtttccaagacgattacggatcgctgagtgcaaaagcaatacataaaatactaccccacctaaaagagggaaacaggtacgatgtggcatgcgtctatgcgggctatagacattcggaaagctcattaacgagagaagagatagccaacaaagtcctcaaagatagacttatgctcctgcccaaaaattcactacacaacccagtagtggagaaaatattaaatcaaatggtaaacgtaataaacgtcataatcgatatatacggaaaacccgatgaaatcagagtagaactcgcaagggaattaaagaaaaatgccaaagaaagggaagaactaactaaaagcattgcacaaacaacaaaagcacacgaggaatacaaaaccttactacaaacagagttcggacttactaatgtatcaagaacagatatactgcgttataaactatacaaagaactagaaagctgcggatataaaaccttatattctaatacttatatttcaagggaaaaattatttagtaaagagttcgacatagaacacataataccgcaagcaagactattcgatgactctttctcaaataaaacactggaagcaaggtctgtaaatatagaaaagggaaacaaaacggcctatgatttcgtgaaagagaagtttggagagagtggtgcggataattccctagaacactaccttaacaacatagaggatctatttaagtcaggaaaaatttcaaagacaaaatataataaactaaaaatggcagaacaagatatacctgatggatttattgaaagagacctaaggaatacacaatatatagccaaaaaggcattaagtatgctaaatgagatatcacaccgcgtagttgccacgtcagggtccgtaacagataaactaagagaagattggcagcttatagatgtaatgaaagaattaaattgggagaagtacaaggcactgggcttagtagaatatttcgaagaccgcgacggccgacagattggccgaataaaagactggacaaaaagaaacgatcacagacaccacgctatggatgcactaacagtagcctttacaaaagatgtgttcatacaatatttcaataataaaaacgcttcattagaccctaacgcaaacgaacacgcaatcaaaaacaaatacttccagaatggaagggcgatagcaccaatgccactaagagagttcagagcagaagcaaagaaacacttggaaaataccttaataagtataaaagctaaaaataaggtcataacaggaaatataaacaaaacacgaaagaaaggcggagtaaataaaaatatgcaacaaactcccagaggacaattacatcttgaaactatatacggaagtggtaaacaatatttgaccaaagaagaaaaagtaaacgcatcattcgatatgagaaaaataggaacagtatcaaaatctgcatatagagacgcactcctaaaaagactctacgaaaatgacaatgaccccaagaaagcatttgccggtaaaaattcattagataaacaaccaatttggcttgacaaagaacaaatgcgaaaggtaccagaaaaagtaaagatagtaactctagaagcaatatatactatcagaaaagaaatatcacccgatcttaaagtagataaggtaattgacgtaggagtaagaaaaatactgatagacagattaaacgaatacggaaacgacgcaaagaaagcattttccaatctcgacaaaaaccctatttggttgaacaaagaaaaaggcatatctataaagcgtgttacaataagtggcatatcaaatgcacaaagcctgcacgtaaagaaagataaagacggtaaaccaatattagacgaaaacggtagaaatataccagtagacttcgttaataccgggaacaatcaccacgtagctgtgtattaccggccagttattgataaaagaggacagctagtagtcgatgaagccggaaatccaaaatatgaactagaagaagtagtcgttagctttttcgaagctgtaacaagagcgaacctaggattaccaataatagacaaagactacaaaactaccgaaggttggcaattcctattttctatgaaacaaaatgaatattttgtattcccaaacgagaaaacaggcttcaaccctaaagaaatcgatttattagatgtagaaaattatggcttaatctctcccaatctatttagggttcaaaaattttctctaaagaattacgtctttcggcatcatttagaaacaaccataaaagacacgtcttctatattaagaggaataacctggatagacttcagatcgtcgaaaggcttagatacgattgtaaaagtaagagtaaatcatattggacaaatagtctccgtaggagaatattga

SEQ ID NO: 9165 - RNA, 4311 nt, synthetic construct
  misc_feature 1..4311: note = Cas9 variant
  source 1..4311: mol_type = other RNA
atgaaaagaattttgggactggacctcggaacaaactctataggatgggcgctagtgaatgaagcagaaaataaggacgaaaggagctcaattgtaaaactgggtgtgagggtgaatcctctaactgtagacgaattaacaaatttcgaaaaaggtaagtcaatcactacaaatgcagatagaacactgaaaagaggaatgagacgaaacctacagagatacaaattgaggagagaaacactgaccgaagtactcaaggaacacaaactaattactgaagacacaattttgagtgaaaacggaaatagaacgacattcgaaacttataggcttagggcgaaggcggtaacagaagaaatttctctcgaggaatttgcaagggtactcttaatgataaataagaaacgagggtacaaatcttcccgtaaagctaagggagttgaggagggaacactcattgacggtatggacatagcccgtgaactatataataataacttaacaccgggagaattatgtctacaattattagacgcaggcaagaaattcttaccagacttctatagatccgacctacaaaacgaattagatagaatttgggaaaaacaaaaggaatactaccctgaaatattaacggacgtgttaaaagaagaactaagaggaaagaaaagagacgcggtttgggcaatatgcgctaaatattttgtatggaaagaaacatacacggaatggaataaagagaaaggaaaaaccgaacaacaagaaagagaacacaaactagaaggaatatattcaaaacggaaaagagatgaagctaaaagggaaaatttgcaatggagagtaaacggcctcaaagaaaaacttagtctggagcaattagtaattgtattccaagaaatgaatacgcaaataaataacagttcgggatatttaggagccatatcagatagaagtaaagaactgtacttcaataaacaaactgtcggccagtatcagatggagatgttagataaaaacccaaatgcatcactacgaaatatggtattttatagacaggactatctggatgagttcaatatgctatgggaaaaacaagctgtataccacaaagaactaacagaggaactcaaaaaggaaatcagagacattataatattctatcaaagacgattaaaaagtcaaaaaggcctaataggcttctgcgaatttgaaagcagacaaatagaagtagacatagatggtaaaaagaaaataaaaacagtgggaaatagagtaatctccagaagcagtcccctatttcaagagttcaaaatctggcaaattttgaacaacatagaagtaacagtagtcggaaagaaaagaaaacgaagaaaactaaaagaaaactacagcgcaatatttgaagaattaaacgatgccgaacaacttgaactcaatggaagcagaagactctgccaagaagaaaaagaattactagcgcaagaactcttcgtaagagacaaaatgaccaaatcagaagtccttaaactattattcgacaatcctcaagaattagatctaaattttaaaacgatagacggaaacaaaacaggatatgccttatttcaagcatacagcaaaatgatagaaatgtcaggacatgaacccgtagactttaaaaagccagtagaaaaagtcgttgaatatatcaaagcggtgttcgacttactgaattggaacacagacatactaggattcaatagtaatgaagaactagataatcagtcttattacaagctgtggcacctactgtactcattcgaaggagacaacacaccaacgggaaatggccgattaattcaaaagatgacagaactatatggtttcgagaaagagtacgctacaatactagcaaacgtcagttttcaagacgattacggctctctatcagccaaagccatacacaaaattctgccgcatctaaaagaagggaatagatacgacgttgcgtgtgtatacgcaggatatagacacagtgaaagtagcttaaccagggaagaaatagcaaataaagttcttaaagaccgcctaatgcttttaccgaaaaattcactacataatccagtcgtcgagaaaatcctaaatcaaatggtcaacgttataaatgtaataatcgatatctatggaaagccagatgaaattagagtagaacttgcacgagaactcaagaaaaacgcaaaagaacgcgaagaattaacaaaaagtatagcacaaactacaaaagctaatgaagagtataaaactttattacaaacagagttcggtctaactaacgtatcgagaacagacattttgaggtacaaactatacaaagaactagaatcctgtggatacaaaacactatactcgaacacctatatatcaagggaaaaattattttcaaaagagttcgatattgaacatattataccacaagcgagactatttgatgattcattttcaaataaaaccctcgaagcccgaagtgtaaatatagaaaaaggcaacaaaacagcctacgactttgttaaagaaaaattcggagaatcaggagcagataattcactagaacattatctaaacaacatagaagatctcttcaaaagcggaaaaatatcaaaaaccaagtataacaaactaaagatggcggaacaagacataccagacgggtttatagaaagggatctaaggaacacacaatatattgccaagaaagcattgtcaatgttaaatgaaataagccatagagttgtcgcaacatctggatcggtaacagataaattgcgagaagactggcaattgatcgacgttatgaaagagctaaattgggaaaaatataaggcactaggcctagtagaatactttgaagacagagacggacgacaaataggacgtataaaagactggactaaacgaaatgatcacagacatcatgcgatggacgcactcacagttgccttcacaaaagacgtattcatccagtacttcaacaacaaaaacgcatccttagatccaaatgcaaatgaacacgctatcaaaaacaaatactttcagaatggtagagcaatagcacctatgccactaagagagttcagggcagaagctaaaaagcacctagaaaataccctaatctcaatcaaagcaaagaacaaagtaataacaggtaacattaataagacacgtaagaaaggaggtgtaaataaaaatatgcaacaaacaccacgcgggcagttacatctagagacaatatacggctctggtaaacaatatttaacaaaagaagaaaaagtcaatgctagcttcgacatgaggaaaattgaaacggtcagcaaatcagcttacagagacgctctattaaaaagactatacgaaaatgacaatgatccaaagaaagcattcgccggtaaaaacagtttagataaacaacctatatggctagacaaagaacagatgagaaaagttcctgaaaaagtcaaaatagtcacgctagaagcaatatacacaattagaaaagaaataagcccggacttaaaagttgataaagtgatagacgtaggagtaagaaagatattaatagacagattaaatgaatacggaaacgatgccaaaaaggcattcagcaacttagacaaaaatccaatatggttaaataaggaaaaagggataagcattaaaagagtcacgataagcggtatatcaaatgcacagagcttacatgtcaagaaagacaaagacggaaagcccattctagatgaaaacggacgaaatataccagtcgattttgtcaacacaggaaacaatcaccatgtagcagtctattacaggccagtaatagacaaacgtggacaattagtcgtagatgaagccggaaatcctaaatatgaattagaagaagttgtagttagcttctttgaagcagtcacacgagccaatctaggactaccaataattgacaaagactacaagaccacagaaggatggcaatttctgtttagcatgaaacaaaacgaatatttcgtattccctaacgagaaaattggattcaatccaaaagaaatagatttgttagacgtagaaaattacgggttaatatcaccaaacttattcagagtacaaaaattttcattaaagaactatgtttttagacatcatctggaaactacgataaaagacacgagtagcatattaagaggaataacttggatagatttcaggtcgagtaaaggactagacacaatagttaaagtcagagtaaatcacattggacaaatagtaagcgttggcgaatattga

SEQ ID NO: 9166 - RNA, 4311 nt, synthetic construct
  misc_feature 1..4311: note = Cas9 variant
  source 1..4311: mol_type = other RNA
atgaaaagaatcttgggattagatttaggcactaacagcatcggatgggccctcgtcgatgaagcagaaaacaaagatgaaagaagtagtatcgtaaaactaggggtcagggtcaacccactcacagttgatgaattaaccaactttgaaaagggaaaaagcataacaaccaatgccgatagaacacttaaaagaggtatgcggagaaacttacaaaggtataaactacgtagagaaacactcatggaagtattaaaagaacacaaacttataaccgaggatacaatattaagtgaaaacggaaacagaacaacgtttgaaacttatcggctaagagcaaaagcagcaacagagaagataagtctagaagaatttgccagggtactacttatgatcaataaaaagagaggatacaaatcatgccgaaaagcaaagggtgcagaagaagggaccctaatagatggaatggatatagcaagagaactgtataacaataacttaacgcccggagaattatgtctacaactactggacgccgggaagaaatacctaccagatttctacagaagtgacttacaaaacgaactggacagaatatgggaaaaacaaaaagaatactaccctgaaatacttactgaggtactcaaggaagaactaaggggcaagaaacgagatgcagtgtgggcaatatgcgcaaaaagttttgtatgggaagaatattacactgaatggaacaaagaaaaagggaaaactgaacaacaagaaagagagcacaaacttgaaggaatatactcaaagagaaaaagagacgaagctaaaagagaaaatcttcaatggcgagttaacggcttaaaagaaaaactatcactagaacaacttgtaatagtgttacaagaaatgaatatacaaatcaataacagcagcggataccttggcgctataagcgacagaagcaaagaattatacttcaataaacaaacagtaggtcaatatcaaatggaaatgcttgacaaaaacccaaatgcatccctgagaaatatggtattctacaggcaagactacctagacgaatttaataccttatgggagaagcaagccgagtaccataaagaattaacaggggaactaaagaaagaaataagggatatagtaatcttctaccaaagaagattaaaaagccaaaaaggattagtaggtttttgcgagttcgaaagtcgccaaatcgaagtagaaatagatggcaaaaagaaaattaaaactgtcggcaaccgagtcataccacgctcatctcctctatttcaagagttcaaaatatggcaaatattaaataacatagaagtcacagtagtaggtaagaaaggaaaacgaagaaaacaaaaagataactcaccaactttgttcgatggcttagatgacacagaacagttagaactcaacggaagccgatatctctatcaagaagagaaagaattactagcacaagagttattcgtccgcgacaaaatgaccaaatcagatgtgttaaaattgctattcgacaaccctcaagaactagatctaaattttaaaacaatcgatggaaacaagactggatacacattgtttcaagcctactctaaaatgatagaaatgtcagggcatgaaccagtagattttaagaaaacagtagagaaagtagtcgaacatgtgaaagcagtttttgatctactaaactggaacacggatatattaggttttaattcgaacgaagaactagataatcaatcttactataagctatggcacttgctttattcattcgaaggcgacaatacacctacaggaaatgcacgattggtacagaaaataacagaactatatggcttcgaaaaggaatatgccattattctcgcgaacgtgacctttcaagacgactacggatcgctatctgctaaagctatccacaaaattctcccacacttaaaagaaggcaacagatacgacgtagcctgtgcatacgcgggttataaacactcagaatcatcattaacaaaagaagaaatagcaaacaaagcattaaaggataggttaacattactccccaaaaataacctaagaaacccagtagtggagaaaatcttaaaccaaatggtaaacgtgataaacgcaatcatagatacatatggaaaaccagacgaaataagagtagaacttgcgagagaacttaagaaaaacgctaaagaacgcgaagaactaacaaaattcatagcggaaacaacgagaaaacatgaagagtttaaaatattattacaaagtgaatttggtcttacaaacgtaagtagaaccgatatactacgttacaaattatacaaagaattagaatcgtgtggatataaaaccctatattcaaatacatatatcccacgagaaaagctatttagtaaagaatttgacattgaacatattatacctcaagcaagattatttgatgactccttcagcaacaaaactctagaagcaagatcaataaatttggaaaaaggaaataaaactgcatatgacttcgtaaaagaaaaattcggagaatcaggagcagataactcgctagatcactatttaaacaacattgaagatctatttaaaagtggtaaaatatccaagaccaaatataataaattaaagatggcagagcaagacattccagatggatttatcaaccgcgacctaagaaacactcaatatatagcgaagaaagcgctaagcatgttaaatgaaatatctagaagggtagtggcaacatctggcaccattacagataaactcagacaagactggcaacttgttgatgtaatgaaagaacttaactgggaaaaatacaaagcattaggcctagtagaatacttcgaagataaagacggacgtcaaattggaaggataaaagactggacaaaacgaaacgatcatcgacatcacgctatggatgctttaacggtggcctttacaaaagatatctttatccaatacttcaataacaaaaacgcttccctaaattcaaacacaaacgaatacgcgattaaaaacaaatacttccaaaatggcagagcaatagcaccaataccactaagagagttcagggttgaagcaaagaaacacctagaaaatacactcattagcataaaagcaaagaacaaggtagtaactggtaacataaacaaaactaaaaagcgaggtggggtaaacaaatatctacaacaaacgccgagaggccaattacatttagaaacgatatatggatctggcaaacaatacctaacgaaagaagaaaaagtcaacgcatcttttgatatgaagaaaatagccacagtaagtaaatctgcttatagagacgtactattaaaacgactccatgaaaacgacaacgacccaaagaaagcgtttaccggtaaaaatagtctagataaacaacctatctggctggataaagaacaaacacgcaaagtcccagaaaaagttaaaacagtaacattagaaaccatttacacagtccgcaaagaaataagcccagaccttaaagtagataaagttatagatgcaggggtaagaaaaatactaacaggacggttaaacgaatacggaaatgacgcgaagaaagcctttagcaacctagacgagaaccccatatggctaaacaaagaaaaaggtatcagcataaaaagagttaccatatcaggaatatctaatgcccaaagcctacatgtcaagaaagacaaagacggcaaacccatactggacgaagatagcagaaatataccagtggacttcgtcaacacagggaacaaccaccatgtagctgtctacagaagacctgtaatagacaaacggggtcagctagttattgacgaagctggcaaccctaaatatgaacttgaagaagtagttgttagcttcttcgaagccgtaaccagagcaaacctaggtcaaccaattatcgacaaagactacaaaacgtcagagggttggcaatttcttttcagtatgaaacaaaatgaatactttgtattcccaaatgagaaaacgggctttaaccccaaagaaatagatctattagacgcagaaaattatggcgtaatatcaccaaatttatttagggtacaaaaattcgcacataaaaactacgtttttcgtcatcacttagaaaccacgattaaagatacaagcagcatactaaaaggcatcacttggatagattttcgaagctcaaaaggcttagatgcaatagtaaaagttagagtaaatcacataggccaaatagtgagtgtaggcgaatactga

SEQ ID NO: 9167 - RNA, 4311 nt, synthetic construct
  misc_feature 1..4311: note = Cas9 variant
  source 1..4311: mol_type = other RNA
atgaaatatattaaatacattctaggtcttgacataggcagcaactcgattggatgggcactaattcaacttgatttactacagaaaacaaaacgcataatcgccgccggatccagaataattccaatggaccaaaaagttctatccgatttcgggaaaggtataacaatatcacccacagctcaaagaacaagctatagaaatgcaagacactgtagggaacgtcatttactaaggagagaacgactacatagagtattacatattctaggtttcctccccacacattacgacaaacaaatagatttcagcaaaaggtatggcaaattcgttgacaatacagaacctaaaatcgcatacaatgaaggaaaatttctattcatggattcctttcaagaaatgctttcagatttcaaaagtcaccaaccagacttattttacaccaagaaaaacggcgaagaatccaaaataccctacgactggacaatatactatctaaggaagaaagccctaagccagaaaataagcaaagaagaactcgcatggatcatcctaaactttaatcagaaaaggggatactaccaactacgggaagaagaaggaaataaagaaaacgactttgaaataatttcgagtaaaattatatccgttattaagaaagacaaagacaagaaatacaacaaatattggtacgacatcatactagaaaacggacttgtataccaagcagccttctataatgatttcgtatacaactggatcaaccaagatcgtgaatttataatagaacgaacaagtctcaaaaacggtgctgaaaaagtcaaattgagctacttaccaacttttgacgaaatagataaaatggataagaaagaacaagataaatattataagaaaataaaaatcaaaacagaaaactccatcggaaacaaaacagtcggatgttatatctatgaccatatattacaaaacccaaacgagaaaataaaaggaaaattagttagaacaatcgaacgaaaatactacaaagaagaattaaaagcaatactagaaaaacaaatagcattacaacccgaattattcacagatcaactactagcagattgtattagagaattatattccaaaaacgaagcacaacaacgtaatctagccgcccgcgatttcgttcatctattagtggaagacattattttctaccaacgaccgcttcgtcgtcaaaaatcaaccttagcaaactgctcactcgaatccagatcttacatcgacaaagattcccatactcgaaaagaagcaccactaaaagtctgtcctaaatcaaatccctactatcaagaatttcgagtcctgcaatggttacaaaatttaaaaatatacgaaatagacagcgatcaagaagtaacacatcaattcataaaaacattggaagataaacaacaactctttgagttccttatggcccaaaaagaaattgattgtgaagaattattaaaatacttccttaatcaaacgtaccccaatgcgaaagaaaaagcactaaaaagcgaactcaagaaatggaaagatacctatagatggaactatgtatatgatataggagaaaaatcaagtaagaaataccccatgaatgaaacacgatatgaattgaaaagacacctagagaaagtagctaatctaccagatgatttcttgagctcagaagtagaatacctgttgtggcacttaatatatagcgtaaaagataaagtagcatatgaaaaaggcctcaagaaatttgcacagaaacatcacttagacaaagactccttcgtagagtcatttaagaaatttaacccatacccctcagagtatggatcatttagcgaaaaagctataagaaagttgctaccactcatgagattcggagcacactgggattttaaccacatcgacaaaaacacacaaaagagaatagaagatctcataactggtgttgaaaatgaagaaatacgaacaattttaagagaaaaagcagaaaaatatcaattagaaaaagaaacagacttccaagacttaccactttggttagctcaatacatagtatacaaccgacacgctgaggcttcttcactagagaaatggacatccgttaacgatctagaaacttatctaaatgagttcaaacaacatagtctcagaaatccaatagtcgagcaagtagtaatggaaacattacgagtagttcgcgacatatggcaacaatatggccaaggccaagcatcattctttaatgaaatacatatagagcttggaagagaactaaagaaaacagcaaaagaaagagaaaaattatctaaacaaaaccagaaaaatgaagatataaacctgagcataaaagaaaaactcaaagaattagaaaagtataatacaagagcctactcaataacgcatcaagaaaagtacaaactatggctagagcaaaaacacataagtccgtacacaggccaaatcattagccccgagaatctcttcactgataactatgaaatagaacacatcataccacaatctcgatttttcgatgactcattatcaaataaggtagtgtgtgaatctatagtaaacaaagcaccatacaaagacagacaattaggactagagtttatcaaaaaccaaggtgggagaatagttaaggaattaagtaaagagaacaaaactattaaaatcttcaccgaagaacaatatcgtacttttatcaaagaacactactcaaataacccagagaaaaccaagaaattactgttagaagaaataccggagaaaatggtagcccgccaaatgaacgacacctgttatatctcaaaattcataagtgaaatattaagtaaaatagtaagatctgacgaacaggatgaaggagtccacagcaaaaacgttatactctgtacaggaaaaataacctcaatcctacgacaagactggggtctgaacgatatatgggacaatttgatattaccacggttcgagcgcatgaataaccttctacaaaaagaaaaattcactatatacagcatagaaaaacagaagaaaattccagtagtaccaatcaacgaccaattcaaatcttttcagaagaaaagaattgatcaccgacaccatgccatggacgcaattataatagcatgcacgacacgtgaacatataaattacataaacaaccaacacgcactcgagaaggaaaaagataagaaagaaaaacaagaggaaagagacaaactaagggagaaattatgcataaagaaatataataaccgatcagaaggcaattattcatggatattcaaaaagccgtgggacacctttacccaagaagtaagagtcgcacttgaggatatagtcgtatcattcaaacaaaacctccgcgtaattaacaaagcaaccaattactatgaaagatgggtcgaagaaaacggaaaatacatcaagaaaatggtaaaacaagaagggacaaattgggccattcgaaaaccgctacacgaagaaacaataagtggaaaaatatacctggatagagagaaaataaccaaaaacgacatactgactgcgactcgaaaaacagtagactcaagtttcgatgacaaacgaatcaagaaaatcacagatacaggcatacagaaaatactcctcaattacttaaaatataaaggaagcccagaaatagcattcagcccagaaggcctcgaagaactaaacaaaaacctatcaatatacaatgacggaaaaccgcacaaaccaatatacaaggtacgaatatatgagaaaggatcagggcgctttgcattaggagaaaaagggcgaaaatacaaaaagtacgtacaaggcgcatccaacctatactttggtatttaccaaggagcaaaacggagttttgccacaataccgctcaacgaagtaatcgaacgacaaaaacaaggtctcccatcagtaccagagtacaatgaaaaaggcgatttactattgttctccttatccccaaacgacctggtttatgtacctatagaaggcgaaataatagaaaatatagacttcaggaaccttagtaaagaacaaaaagaacgaatatataacgtaaacgactttagcagtacatgctattttacgccaaacagaatcgcaaaagccatatttcctaaggaagttgatttacagaggaaaggagataaattaagcgggtcttacgacacaaaaacggcaagccttgaagggatacaaataaaagaagtttgtattaagttaaaagtagaccgcttaggcaacataagtaaagcatga

SEQ ID NO: 9168 - RNA, 4314 nt, synthetic construct
  misc_feature 1..4314: note = Cas9 variant
  source 1..4314: mol_type = other RNA
atgaaatacataaaatacatacttggtctcgacatcggcagcaattctattggctgggccttaatccagcttgatctgctacaaaaaaccaaacgaatcatagcgacaggaagcagaataatacccatggaccaaaaagtcctatcagatttcggcaaaggcataacaatatcacctaccgcacaacgaacgtcttatcgtaatgcgagacattgccgagaaagacacctgctccgaagagaaaggctacatagagtcctacatatccttggtttcttaccaacacattacgacaagcaaatagacttctccaagcgctatggtaaattcgttgataataccgaaccgaaaatagcttataacgaaagaaaattcctattcatggacagctttcaagaaatgctagcggatttcaaaatccaccaaccagacctattctacacaaaaaagaatggtgaggaatcaaaaataccatacgactggaccatctactatctaagaaaaaaagcactgtcacggaaaatcagtaaagaagaactagcgtggatcattttaaactttaaccaaaaaagaggttactaccagctaagagaagaagaagaggaaaataaagaaaatgatttcgaaatcatcagttcgaaaattataagtgtgataaaaaaagataaagataaaaaatacaataaatattggtatgacataattctggaaaatggattagtataccaagctgccttctataatgacttcgtatataattggataaaccaggatcgcgaattcataatcgaaaggatatcattaaaaaatggtaccgaaaaagtaaagttatcatacctccccacattcgacgaaattgataaaatggacaaaaaagagcaagataagtactacaaaaaaataaaaataaaaaccgaaaacagcataggaaacaagacagtgggatgctacatttatgaccatatactccaaaatccaaatgaaaaaatcaaaggtaaactagtacgcacaatcgaacgcaaatattacaaagaagaactgaaagcaatattagaaaaacaggtggcactacaacccgaattatttacagatcaattatttgcagactgcatacgagaactttacagtaaaaatgaagcacaacagagaaatctagcagctagagacttcgtacatctattcgtagaagatatcatattttatcaacgatcattacgacggcaaaaaagtaccctagcaaactgctctcttgaatctagaagttatatagacaaagactcgcatacaagaaaagaagcaccattaaaagtttgcccaaaatcaaatccatactatcaagaattccgcgtacttcaatggttacaaaacctaaaaatatatgagatagacacagatcaagaagttacacatgagtttataaaaactctagaggacaaacaacaatttttcgacttcctaatgaatcaaaaagaaatagactgtgaagaattactaaaatatttcttaaatcaaacatacccaaatgcacgcgagaaagccctaaaaagtgaattaaaaaaatggaaagacacatatagatggaactacgtttacgacataggggaaaaatcctcaaaaaaatacccaatgaatgaaacccgatatgagttaaagagacacctagagaaagtcgccaacctaccagacgatttcttatcttcagaagttgaatatttactctggcacttaatatattcagtcaaagacaaagtagcttatgaaaaaggcctgaaaactttcgctcaaaaacatcatctcgataaagattcattcgtagaatcatttaaaaaatttaagccctatccttcagaatacggatcattttcggaaaaagccatcagaaagctactccccctcatgagattcggatcctattgggactttaaccacatagacaaaaacacacaaaaaaggatagaagatctcataaccggcgtagaaaacgaggaaataagaacaattttaagagaaaaagctgagaaatatcaactagaaaaagaaaccgacttccaagatttaccgctatggcttgcacaatatatagtatataacagacacgcagaagcctctagcttagaaaaatggacgtccgtaaacgaccttgaaacatatcttaatgaatttaaacaatactcactaaggaatccaatagtagagcaagtcgtaatggaaaccttacgagtagtccgagatatatggcagcaatacggacaaggacaagcaagcttttttgacgaaatacatattgaactaggacgcgaacttaaaaaaactgcaaaagagagggaaaaactctccaaacaaaatcaaaaaaatgaagacattaacttatccataaaagaaaaactgaaagagctcgaaaaatacaacactcgagcttacagtatcacacaccaagaaaaatataaactatggctggaacagaagcatatcagcccgtacacagggcaaataataagtcctgaaaacttgtttacggataactatgaaatagaacatataattccacaatccagattcttcgatgacagcctatcaaataaagtagtttgcgaatccatagtaaacaaggcaccatacaaggatagacaattaggcctcgagttcataaaaaatcagggaggaagaattgttaaagagttaagcacagaaaacaaaacaattaaaatattcactgaagaacaatataggacttttatcaaagaacactatagtaataacccagaaaaaactaaaaaattattgttagaagaaatacccgaaaaaatggtagccagacagatgaatgatacatgttatatctccaaattcattagcgaaatactctcaaaaatagttcgaagcgacgaacaagatgaaggcgtccactcaaaaaacgttatcctatgtacaggaaagataacaagcgcattaaaacaagactggggagtcaatgatgtttggaatgacctaatactgccaagatttgaacgcatgaacgacctaacacaatcaacactatttacaacatacaacgaaaaataccagaaatacctaccaactgtacccatggaatactcaaatggtttccaaaaaaaacgcatagatcatagacatcatgcgatggacgcaataatcatagcatgcgccacacgagaacacattaactatataaacaatcaacacgcattagaaaagggtaaagataaaaaagaaaaacagaaggaacacgacaaactccgtgagaaattatgtatcaaaaaagataataagggctcagaggaaaactattcatggatttttaaaaaaccttgggatacattcactcaagaagtccaagccgcactagaaggcatcgttgtaagtttcaaacaaaatttaagagtaattaataaagcgacaaactattacgaaaggtgggtcgaagaaaacggtaaatatataaagaaaatggttaaacaagaagggactaactgggctataagaaaacctctacacgaagaaactatatcaggaaaaatatacctagaccgtgaagaaatcactaaaaatgatatcctaaccgccacaaggaaaaccgtagattcaagtttcgatgaaaaaagaataaaaaaaatcacagatacaggaatacagaaaatactactaaattaccttaaatacaaaggttcaccagaaatagcattctcaccagaaggtctagaagagcttaataaaaaccttagcatatataatgacggtaaacctcataaaccaatatataaagtccgaatttatgaaaaaggaagtggaaggttcgctctcggagagaaagggcgcaaatacaaaaaatatgtgcaaggcgcaccaaatctatactttggtatttaccaaggcgcaaataaaagaagcttcgcaacaataccactaaacgaagtaattgaaagacagaaacaaggtcgacccagtatccccgaatacaacgaaaaaggcgatccacttctcttcagcctttcacctaatgacctagtatacgtacccgtggagggagagataatagaagacattgactttcaaaatctaagtaaagaacaaaaagaaagaatatacaatgtgaatgacttcagcagtacgtgctacttcacacccaatagaatcgcaaaagctatctttccgaaagaagtagacttacaacgcaaaggcgacaaattaccaggtagttacgacacaaagacagcatcactagaaggtatccaaatcaaagaggtatgcattaaacttaaaatcgaccggttaggaaacataagtaaggcttga

SEQ ID NO: 9169 - RNA, 4317 nt, synthetic construct
  misc_feature 1..4317: note = Cas9 variant
  source 1..4317: mol_type = other RNA
atgaaaactatactcggattagatctaggaactaactcaataggctgggcactaataaaacaaaacttcgaaaacaaatacggagaaatactcggcatgggatctcgtataataccaatgagccaagacatattgggagaatttggcaaaggcaattcagtctctcaaactgcagcccgtaccgactaccgagcaacacgacgactccgcgaaaggtttttattgagacgagaacgactccaccgagtgctcaacgtcttaaactttttgccagaacactatgcatcacaaatagatttcgacaaacgatttggaaaattcaaagtagaaacagagccgaaactagcatggaaaaatatagatggaaaattctcgttcttatttcaaacaagttttaatgaaatgctagaagacttcaaagcgcacggacaagatttgaaagtaccatatgattggacgatctattatttacggaagaaagcactgagtcagaaaatagaaaaagaagaactcgtttggatcctattaaacttcaaccaaaaacgaggatactatcaactaaggggagaagaagaagaagaaaacccaaataaactaattgagttctattctttaaaaataatagatgtactggccgacgaaccacaaaaaggaaaatcagacatttggtatagtctagtcctagagaatggatggatatatagaagaagttcaaaaacatccctattagattggaaagacaaaattagagattttattgtgactacggatctcaacgacgacggatcagttaaaaccgacaaagaaggaaacgagaaaaggagctttcgagcaccaggggaaaatgattggactctagtcaaaacaaaaacagaacaagaaatagaccgaagtcggaaaacagtaggaaactatatatatgaaacattattgcaaaacccgaaacagaaaataaaggggaagctagtaagaacaatcgaaagaaaattttacaaagaagaattaaagaggatattagaaaagcaaaaagaatttcaccgagaactcgaatctaatgacctttacaacgattgtataagagaactatacagaaataatgaagcccatcaactaacacttagcaaaaaggactttgtacatttattcatggaagacataatattttatcaaagaccactcaaatcacaaaagagctcaatatcaaactgcaccttagaatttcgtaaatataaagacgaaaatggaatagaacacacacaatttctaaaagcgattccaaaaagtaatccgtattaccaagaatttcgaatatggcaatggatattcaacctaaatatatataagaaagataacgacgacaatgtaacaaaagaatttttgaatactacacgcgactttgagaatttatttgagttcttaaataaccgaaaggaaatcgaacaaaagcccctactaaagttcttattagaacagaaagaatttaaagggaaattattaaacgcagaaacagaaaaatttagatggaattacgttgaagacaagaaatacccctgtaacgaaactagaactatgatctcggaacgattaaagaaagtggaaaatataagcgatgacttcttaacgagggaaatggaacagaaaatctggcacataatatacagcgtaaatgacaaaaccgaatatgaaaaagcactcaaatcatttgcggaaaagaacaaccttgacgaaaatagtctctttgaagccttcaagaaactaccacctttcaaatcagaatacggatcatttagcgaaaaagcaataaagaaactcttaccattaatgagactaggtaaatattggtcatacgcaaaaatagacttatactctaaaaatcggatacagaaaataataacgggggaatttgatgaaaacatcaaagatagagtgagagaaaaagcaataaggctcacagctgaaaatgatttccaaggcttacaattatggctagcccaatatatagtatacggccgacactcagaagcaagcatgattggtaaatggaactctgccgatgatttggaagagttcctaaaagaatttaaacaacactcattaagaaatccaatagtagaacaagtaattactgaaaccctcagaattgtaaaagatatatggctcaaatacggaaatggagcaaaagacttctttaatgaaatacacatagaattaggacgcgaaatgaaacaaacaaaagacgaacgagccaatgctaccaaaactattacagaaaatgaaaataccaacctaaggatcaaagcactacttgcagaaatgatgaacgatcacagtgttgaaaacgttcgcccttactcccccatgcaacaggaaatcctaaaaatatatgaagacggtatattaaagagcgacatagaaatcgacgacgatatattaaaaatctcaaaaacagcacaaccatcatcttcggaccttaaaaggtacaaactgtggttagaacaaaaatacaaaagcccatatacgggccaaattattccgttaaacaaactatttacacctgaatacgaaatcgaacacatcattccacaatcaagatattttgacgacagtttttcaaataaaattatatgcgaatctgcagtaaataaattaaaagacaactacattggattaggattcatcaaacaatttggaggaacaataatcgaatgcggcttcggtaaaagagtaaaggtattcgaagtcggagaatatgaggaatttgttaagaaacactacgctaataatcgcggaaaaagaaacaaattgctcctagaagaaatacctgagaaaatgatcgaacgacaaatgaatgatactcgacacatatcaaagtatatcagcgggatattgtcccacatcgtaagagtagaagacgggacggacgaaggagtaaactccaaaaacgtaataccaggaaacggcaaaataaccacgcaattacgacaggactggggactaaatgatgtatggaacgaattaatactccccagattcgaacgcatgaaccaactcacaaatagtactgattttacatcatggaacgaaaaccatcaaaaatacttaccaacagtccctgtcgagttcagtaaaggattctccaagaaacgcatagatcatagacatcacgctttagatgcacttgtaattgcctgtgcaacaaaagatcacgtaaacctgctaaacaaccaatcagcaaaatcagccacaaaacgctatgatctaaagaagaaattgatgaaatttgaaaagaccgtctataaagaccctcaaacagagaaaagaatagaaagagaagtaccaaaacactttctaaaaccctgggaaacatttacagtcgatgccaaaaatcgacttgaaactataatagtcagttttaaacaaaatctgcgcgtaatcaacaaagcaacgaactattacgaaaaatacgtagaaaaagacggagtgatgatgaaagaaagagtcgaacaaacaggaacaaactgggcaattagaaaaccaatgcacaaagaaacagtctccggtaaaatcgacttaccctgggtaaaagtaccaaaaggaaaaatattaaccgcgaccaggaaatctttagatacctcgttcgatttaaaagcaatagcatctatcacagacactggtatccagaaaatactcaaaaattacctagaatttaaggaatcaccagaacttgcgtttagtccagaaggaatcgaagatatgaataagaatatagaaaaatataatggaggacgcccacatcaaccaatatctaaagttcgggtgtttgagttgggttcaaaattccaagttgggcaaactggaaataagaaagataaatacgttgaagcagcaaaaggaacaaatttatttttcgcaatatacgaagacaagaaaggaaaacgatcgtatgaaacaataccacttaacgaagtgatagaacgacagaaacaaggactcagcgtagtagacttgaaaaacgtaaacgactttttcttatgccccaatgacttagtttacataccatcgggagacgaatttgaaaacagaggatcaatagaaatagagaatatcaccaaagagaaaagtgaacgattttataaagtagtgagctttagtggctctcaaattttctttgtaagacatgatatagccgtaagcatagtaaataaaggtgagttcagcacactcaataaaatggaaagagcaattgatggctccatggtcaaagaaatatgcataaaactaaaaatagacagattaggggatgtcttaaaagcctga

SEQ ID NO: 9170 - RNA, 4317 nt, synthetic construct
  misc_feature 1..4317: note = Cas9 variant
  source 1..4317: mol_type = other RNA
atggtcaagaaagggtacacaatagggctcgacattggaacaacatcagttggatgggcagtgaccgacgatgacttcgagctagttaacaaaaagatgtcaataaaggataaatctggtagtaccattaaacgagtaaggaaaaacctctggggagtcagattatttgacgaagcaaaaacagcggaaaatacaagaagaacaagaggagtacgtagacgcattagaagacgtaaagaacgactaaactatctccaaggcatattctcaagtgaaatggctaagatggatgaaaatttctttatgcgattagaagaatcgtttttcaagttaagcgataaatcagaacaaaataaatttccctacgccttatttaaaaatgaaatagaagaaaaagcgtattatagacagttcccaacaatataccacctaagaaaacatctcatggaacacgaagaatcagacctacgaaaaatatacttaggattacaccatattttaaaatacagaggccatttcgtacaagaaggccaaaagatggatgtagcgaacatagacatacaaggaaatttgaaagaattatttaatgcattaaatgaaaatttttccaacaaagaggacgactttgaacaagagagaatgaaagacggagtcaaacgagcaaaagtactcttcgacacggaaaaattggctgctgtggaagaaatattaaaggagaaaatatcaaaatcatggaaggtaaacaaaatatcaaaagggatacttgcagaaaagaaggatctaccaatttttaaagcaatagtcggcaacaaaattgacttagctggaatattcgattgtccagattacgcagaaaaagtaaatgaatcgataaaggaattgaaagacaaagtctattttaacaaagaagattttgaggaaacattcgaaaaactgtcccaactacttaaagaagaggagctagaaatattaattctagcaagaaagtgctatgaggcagtgctattagcagatataatgcaaggtgaacagagcttatcagacgcaatggtagcaaaatacaacgaccataagaaagacctagtgatattcaagaaatttgtaatcgactacttctcagaagatgtgtactttgacctgttcaaaaacacacagctcgccgggaactatcacagctacgtaaaaggagaaagaaaaggtaacaaattcaatcacgcatctcttgacgatttctataaatttgtaaagaaagaattagataagaaagcagaggaactatcagaacatccggtttataaacaaatattacagaaaatagaattggaaacattcctaccaaaacaaagaatgttcaaaaatggtgcaataccttatcaagtgcatttacatgaacttcgagccataataaagaaacaagagaaaagatttccattccttgctgagaaaataatcattaaagacaaccagaaagatatatccgaatacaagatcgaaacactaatgaaattccgtataccatattacgtagggccactaatagaagcacgtgaaggagaattgggaaagaaacgcacaaattacagcagattcgcctggatgcaaaaatcacccgaaagccagaacattggaataactccctggaacttccactccgttgtagataaagacgcatcagccagtgaatttattgaaagaatgacaggtttttgttcctactttccagaagaaccagttttacctaaaaactcattaatataccaacaattcacggtgtttcaagaattaagtatagtaggatattacgacgaacagaacagaaaacactatctcgatggggaaacaagaagaagaatattcgaagaccttttcaagaaaaatcgaactgtatcagcaggactactgagaaaatggttggtatgcaaccaaaggaccagccaagaagaaaaagaaattaggttattcggattagacctgaagaaaaacgggctgggctctggaaatttcaatacaaaatatacaacatacctagacttaaaagatgctggaataacagaaaaacaattaaaacaacacaaagacttctttgagaaaatagtaaaataccaaaccatctttgaagacaagaaaatcctaaaaagaagaataatccttttgaacgaagaacaaccactactatcagaagaacaaatcaaaaacttagcaaagaaacactacacagggtggggaaacctaagtcttaaactaatagatggcatacaggataaaggaaaaacgatcttagattacctggaaacccaagattataatcaaaacttgatgcaactaatgaatgatgaaaataaaagttttgaaatgcaaatagaacaagcaagagcaggaaaagtccaatttggaaaaatagattacagcttcgtcgagcaattagctggctcaccagcaatcaaaagaggtatatggcaatcacttcaaatagtagaggaattagtcgcgtttttaggcaaagaaaacataaagaaaatcgtaatagaaatggctagagaaaatcaatcatctaaaagaacgaaaagtagacaaaaacaaatagaagcgctgtatcaaaaagtcactggagacctcaaaaatgaacaagagaaaatagatgtaatgcaaaattttgacaatgaaagagtcttcttgtactacctacaaaacggcaagtgtatgcacagcggggaaaaactagaactctcgcagcttagcgaatacgaaattgatcacataattccacaaacatacatcaaagatgactcattcgataacaaggtacttgtcacacgaaatgcgaatcaacaaaagggaggggacgtcccaagttacgatgtaatcgataaaatgaaatcatactgggaaaagttgaaagaaaacaacctaataagcgaaaagaaatttgcaaatttaacaaaagggaaatttgacgaccaacagctgtcagggtttatcaatcgacagctagtggagacaagacaaataactaagaacgtagcgattatactagataaaatatacaacgatgaagctaaaaacgaaaaagaagtagcaataatcacgctaaaaagtgctctaacaagccaatatagacaaggcataatatacgtaccaaacgacgactttgacgagctcaaattagtaagtaaaactaacagcaggctaaaagaagttaaactacacgacggcttctataaagttagagaaataaacgattatcatcacgcacacgacgcctatctaaataatgtagttgcaacatatttatacgaagccatgcctgaccttagaccattattcgtgtacggagaacattccagagaaatacacaaacgatttttaggaaaatacgcaacaacaagaaaaggccaattcaaacaactgctagtagacatgcaagacgaatattggatgaggaaagataaagaaggaaactttatagatggagaaatactatggcgaagagacgaggtactacaaatagtgaagaaagtattagattatagaaatatacaaatcaccaagaaattagaaatgatggtaacaggaggcgaagaaaaatctttttatcaagattcacgatgtagaaaagataagacagcaataccatacaaaacaaactgggatccatcaaaatatggagggttcaaatcaccacgaactgcgtatgcaatcccagtaatcaagaaaaataaaccaaaacttgagccagtacttttagtaaatagaagcaaagttgaaacagatggacagttcgattgcgaaaaatttaaagaactcaaccccacattaaagattctaggacaaccaatatggaaatatcaaagttttgaaatgttcgacggtactaaacggtatatagcgtcagcatccgaaatacataagggaaaccaaataaaatttagccaagaacacatgaaatttatttcctgttgtcagaaatacgacgaagtcaaaaataaactagcgttcgattttgtaaacgaatcaaaacacttatttcaggaaatactaacagcaattaaagacaatattcatagataccgcttaatagctgaaggaattgaagtacatcgcaaattcagcaacatgttagaaaatatagaaaaactatctacacaagagttagtagacaacttactagacgctataaatataacgtctgtaggtaccacaaataatgcattcggcagagttagatacaagggttcctacctaaacgaaatatggtccgcaacactgattcaccaaagcgttaccggcctatatgaaacacgtgaaaaattaatatga
